United States Patent 7,250,496 (BIOINFORMATICALLY DETECTABLE GROUP OF NOVEL REGULATORY GENES AND USES THEREOF) - sequence listing, part 2

SEQ ID NO: 15883 - RNA, 79 nt, Human
agagcugcucugcaagcuagaacgugggacgcacacauccugggugcugucuugugaagccuugcugcaggcaagcccu

SEQ ID NO: 15884 - RNA, 73 nt, Human
gaaacuggugauuguuggugauggagccuguggaaagacaugcuugcucauagucuucagcaaggaccaguuc

SEQ ID NO: 15885 - RNA, 120 nt, Human
guggauggaaagcagguagaguuggcuuugugggacacagcugggcaggaagauuaugaucgccugaggccccucuccuacccagauaccgauguuauacugauguguuuuuccaucgac

SEQ ID NO: 15886 - RNA, 69 nt, Human; identical to SEQ ID NO: 15454

SEQ ID NO: 15887 - RNA, 63 nt, Human; identical to SEQ ID NO: 92

SEQ ID NO: 15888 - RNA, 65 nt, Human
uauauuacuuggcacaauuuauuucuacacauaaaguuuuuaaaaugaauuuuaccguaacuaua

SEQ ID NO: 15889 - RNA, 66 nt, Human
cccgcuguggucugcacagugcacauaccucacgaucacgggaaacacacaugcagagaaggcggg

SEQ ID NO: 15890 - RNA, 100 nt, Human
acuuuuuuuuuuuuuuugaaggcaguuuuauaacuuuauuugaucugacgaucagcgauuaguucucauccacauugacugucuguagauuuuugaaagu

SEQ ID NO: 15891 - RNA, 61 nt, Human
guaacagguacauagguaaccaaaguauauagcuuauuuggugaaucuucauccucauuac

SEQ ID NO: 15892 - RNA, 74 nt, Human
ucauugguuucagaguucgcagguccccagcuuugcccagaugcugaaaaagaaccugccaguucaaccagcga

SEQ ID NO: 15893 - RNA, 70 nt, Human
gacacagucuauugacccaaaacuucaggaauaccucuguaguuuuaagagguuagaagacuuccguguu

SEQ ID NO: 15894 - RNA, 82 nt, Human
gugaugaauuuggaagaaaaagacauuccucuacuucuggugaggagaguaaucgucauagacuuccaccuaauuccucuac

SEQ ID NO: 15895 - RNA, 93 nt, Human
guucuuuguccuugaagucaacauucacaucaauuauuuauucggggaaaaucuucugguguuuaauugugauauaagaaagaagacaagaac

SEQ ID NO: 15896 - RNA, 61 nt, Human; identical to SEQ ID NO: 347

SEQ ID NO: 15897 - RNA, 74 nt, Human; identical to SEQ ID NO: 3804

SEQ ID NO: 15898 - RNA, 61 nt, Human; identical to SEQ ID NO: 347

SEQ ID NO: 15899 - RNA, 74 nt, Human; identical to SEQ ID NO: 3804

SEQ ID NO: 15900 - RNA, 80 nt, Human
cuauucuuaaguccuacacuguuuuagagcaucaagucacugcaguuauucaguucugagacacugucgauuuauuuuag

SEQ ID NO: 15901 - RNA, 64 nt, Human
gagacuuguuuuuuaccauaauuauuuugccaucaagacagugguuacaaaaaaaaaaguacuc

SEQ ID NO: 15902 - RNA, 61 nt, Human; identical to SEQ ID NO: 347

SEQ ID NO: 15903 - RNA, 61 nt, Human; identical to SEQ ID NO: 9580

SEQ ID NO: 15904 - RNA, 82 nt, Human; identical to SEQ ID NO: 12483

SEQ ID NO: 15905 - RNA, 74 nt, Human
ggcggaggcacucagagaagguaaagcuuuccuagcccaagcaaggaugcucugcccagcuggccaccaccgcu

SEQ ID NO: 15906 - RNA, 75 nt, Human
gggcgcuccaggaccggccccagcgggcaaaccccccgcauucacccccgcacccggggcuccacccaagcgccc

SEQ ID NO: 15907 - RNA, 63 nt, Human
gaucacucaugauguuucuuccaagaacugcaaagccaucuuggaagagcagcccaggugguc

SEQ ID NO: 15908 - RNA, 62 nt, Human
ggccagguucucgcucugucgugucuguucaaaccggcacggucugauccggaaauauggcc

SEQ ID NO: 15909 - RNA, 84 nt, Human
cggcguucuuuuccucugccgugagugcgcuucgacgcucacacgguggcggacacacggagagaggcaaauaaaagaagaccg

SEQ ID NO: 15910 - RNA, 80 nt, Human
ucuuuuugggggaaaaccccgauaggguugugcacugguaaagaacaccugaaucuuaucucgguucucccuccaaagga

SEQ ID NO: 15911 - RNA, 63 nt, Human
ccaaggagcuagaggacuuugagaugaagaaagcugcugcucgagcugucacuggcguccugg

SEQ ID NO: 15912 - RNA, 95 nt, Human; identical to SEQ ID NO: 10902

SEQ ID NO: 15913 - RNA, 66 nt, Human
ugguggagcuaagagagugaccuccauugcagaccaggcugaauguggacuuugccuuguucccca

SEQ ID NO: 15914 - RNA, 83 nt, Human
gagggggccgguuaucccccaagguuugccgcgaccgggggggccccccuccgggcaccgccuugggcgcgugccgaccccuu

SEQ ID NO: 15915 - RNA, 70 nt, Human
gcugagaagcagugacccgcagaugccggcugaauggacugcuccggucuuggagucacugcuacucagc

SEQ ID NO: 15916 - RNA, 66 nt, Human
aggaucauucuuccucggcggauaacaagagcgcaguggcucuucccuggggauagagugcacccu

SEQ ID NO: 15917 - RNA, 65 nt, Human
cugggggaacacaggggguccacauaauaagaagacacuuaaguuccucccccuuauaaucccag

SEQ ID NO: 15918 - RNA, 90 nt, Human
ggauucugcauacgccaucucugagagccauggagggagccacaccccuggugacuucauggugcuggaugggagacgcuagcggcaucc

SEQ ID NO: 15919 - RNA, 63 nt, Human
ucucuuacauucuuuuuucuuuuucccgggguuuauauacuuuaggaaaaagagauuaagaga

SEQ ID NO: 15920 - RNA, 87 nt, Human
gcgcggucugcgcguucccauuuuccacaggaggcgccgauuuuuuuucgaaccaccucccgcaagaaaaugguguugucgccgugc

SEQ ID NO: 15921 - RNA, 108 nt, Human
cgguucucuggaggcugagugccguugcggugcccuaggaggccgagcucuguugcuucgaacuccaguggucagaccugcucauaucucagcauuucuucaggaccg

SEQ ID NO: 15922 - RNA, 61 nt, Human
acauucgcuccacagaacuggcaagcaggucaucgaguaugccggcaguggagaugaacgu

SEQ ID NO: 15923 - RNA, 68 nt, Human
gagggacgagagccccuagcaggaaaacauugauuugcuguacacucaauagggcaucucaugccuuc

SEQ ID NO: 15924 - RNA, 76 nt, Human
gggcuggauuguggcgggccagggccgccugcgugaucgggacucuggauuccugguguggacgacuuccaugccc

SEQ ID NO: 15925 - RNA, 71 nt, Human
aggcuugggccugagcagcugggagggcuccuucuccccggcccccucuuucugcaucgggacuggggcuu

SEQ ID NO: 15926 - RNA, 69 nt, Human
aucaaugagauccgucagaugucuggggcgcagaucaaaauugcgaacccaguggaaggaucuacugau

SEQ ID NO: 15927 - RNA, 85 nt, Human; identical to SEQ ID NO: 2337

SEQ ID NO: 15928 - RNA, 66 nt, Human
uuuaucaucacucgugauuuuuaauuaaagcguuaaauuccuucucuguucaggggugauggugag

SEQ ID NO: 15929 - RNA, 66 nt, Human; identical to SEQ ID NO: 2802

SEQ ID NO: 15930 - RNA, 65 nt, Human
ggcugauuuagaaacgcguccucagcggaaagcugacucguagaagggcgccuuccacuacagcc

SEQ ID NO: 15931 - RNA, 68 nt, Human
gaaagccucugagaacuugaagcauauuguuaaccaugaugaugucucgaggaaucugaagaacuuuc

SEQ ID NO: 15932 - RNA, 64 nt, Human
ugggcucagauaaucaguccaaaccccugauaccucuucaaaaagaaacugauucagagaccca

SEQ ID NO: 15933 - RNA, 73 nt, Human
ugcauuucuuuuuagcuguuaauuguacuaugccaucaucaccauuaguaaauguagcuggccaggacaugua

SEQ ID NO: 15934 - RNA, 74 nt, Human
gauaaaguugaaggcuacaagaagaccaaggaagcuguuugcuccuuaagaaacuuaaagccuggaaugauauc

SEQ ID NO: 15935 - RNA, 83 nt, Human
gugcuuuccggaaguuagaugaauuguacggcacuuggcguaaagccgcuucccucaagaguaacuacaaucuucccaugcac

SEQ ID NO: 15936 - RNA, 70 nt, Human
ggcuucauacgcuauguccugcccguuagagcagccagcggguacagaauggauuuuggaagagggaguc

SEQ ID NO: 15937 - RNA, 76 nt, Human
ggcagccuggaggcugaagagugggugagcgggcggaugccgaccgaucuucauucacugcggaaggccaagugcc

SEQ ID NO: 15938 - RNA, 77 nt, Human
gugcaggcugcgacaacgugguacucaucuggaaugugggcacagcggaggagcuguaccgccuggacagccugcac

SEQ ID NO: 15939 - RNA, 63 nt, Human
cuggaggagggacgggucugcagguuccaaugggugacagccugacaucugucccuucaacgg

SEQ ID NO: 15940 - RNA, 90 nt, Human
ggacuuggauauggggugcugggaucgauuccuagcuuuaccacuaacuagcuguguggccuugaguaaaucccguuaccucucugagcc

SEQ ID NO: 15941 - RNA, 67 nt, Human
aggacgcggccgcaagcuuauucccuuuagugaggguuaauuuuagcuuggcacuggccgucguuuu

SEQ ID NO: 15942 - RNA, 63 nt, Human; identical to SEQ ID NO: 10365

SEQ ID NO: 15943 - RNA, 63 nt, Human
auggugacaacaugcuggagccaagugcuaacaugccuugguucagggauggaaagucaccgu

SEQ ID NO: 15944 - RNA, 79 nt, Human; identical to SEQ ID NO: 1810

SEQ ID NO: 15945 - RNA, 67 nt, Human
gagagcauuagacccaagaccauuguggagaagauugacuugacaguguguccagcauaaugcucuc

SEQ ID NO: 15946 - RNA, 65 nt, Human
ggaugaaaacauggaccucuuggaagguauaacuggcuuugaagacucuguccgaaaguuuaucu

SEQ ID NO: 15947 - RNA, 61 nt, Human
agcgcuccacccaaauacauuaacaccuccucagagguuuauuucucccagggacagugcu

SEQ ID NO: 15948 - RNA, 60 nt, Human
gauccucaagaugggcgaauccaacucggggcugagauguugaugcgcccacuugggcuc

SEQ ID NO: 15949 - RNA, 69 nt, Human
uuauuuuuuucuuuaagcucuuucacacuuuuucuucacacaacagaucuauugaggggcaaaaaauag

SEQ ID NO: 15950 - RNA, 79 nt, Human
cguauaucuguucucgguacuauagggcaccagaguugaucuuuggagccacugauuauaccucuaguauagauguaug

SEQ ID NO: 15951 - RNA, 98 nt, Human
ucaggauccaacaagagguucugcgguuuaauaucccgauggcagauuccaaaggaauggauauaggcuaaacuucggaaccucuuguuggauccuga

SEQ ID NO: 15952 - RNA, 84 nt, Human; identical to SEQ ID NO: 286

SEQ ID NO: 15953 - RNA, 89 nt, Human; identical to SEQ ID NO: 288

SEQ ID NO: 15954 - RNA, 91 nt, Human
uuuuuucuauuuaacuuuuuuaaugggucucaaaauucugugacaaauuuuuggucaaguuguuuccauuaaaaaguacugauuuuaaaaa

SEQ ID NO: 15955 - RNA, 74 nt, Human; identical to SEQ ID NO: 365

SEQ ID NO: 15956 - RNA, 77 nt, Human; identical to SEQ ID NO: 3082

SEQ ID NO: 15957 - RNA, 76 nt, Human
auuggcaaauagcgugggauagauuugucucuuaaugggugugaccaauccuguuuuuccuaugcucugggugaau

SEQ ID NO: 15958 - RNA, 80 nt, Human; identical to SEQ ID NO: 14260

SEQ ID NO: 15959 - RNA, 70 nt, Human
cucuugagucuuggccaugagaucuguguucagagagagcuguuucguaaagggccaguggacuagagag

SEQ ID NO: 15960 - RNA, 70 nt, Human
uuuagcugguuccagguagaagaggcuauuguuuuagauagagauuagcuugugggaagauaaagcugga

SEQ ID NO: 15961 - RNA, 110 nt, Human
caguaucaugauguauaugagggcuaacccauugugguuuacuuaaaaauuaguuuaaguggaguuagaaguggguuauuuuccucuggugaaaauuauggacauagcug

SEQ ID NO: 15962 - RNA, 71 nt, Human
guguguagggauaaggcgugaccacagcuccuugggccuucgagaguagugauuacuaccuuccugcgugc

SEQ ID NO: 15963 - RNA, 70 nt, Human
cuucacagucggcucucagcagcugcugcugguuucucggcuccagcaccacgaguaccgcacucugagg

SEQ ID NO: 15964 - RNA, 89 nt, Human
gaaguaaagcauuguuuuggagcugguucacagaaaaaaggcaaaacugguuauccugacuucaagcuccaacauaaacugcucgcuuu

SEQ ID NO: 15965 - RNA, 89 nt, Human
cuucagcuugaugcauggucacuucuuuacuauuuaaaauacuacacauuguacaaaauaucgaagacacuaccauaugcuaaaggaag

SEQ ID NO: 15966 - RNA, 99 nt, Human
uagcugggauauaggauuuuuguuguuuuuguuuuuguuuguuuugcuauuuagcaauaacauggucaaaaaggcaaucagaaauuuuaaauacaguua

SEQ ID NO: 15967 - RNA, 70 nt, Human
gcugagccuuaaugggggcagaaaggggucauaaagaacccucuucagcuccacauucacggggcucugc

SEQ ID NO: 15968 - RNA, 62 nt, Human
gugaguguucuaaugauuccuaaacuacagucccuuaggaacugcguggcuaucacacugac

SEQ ID NO: 15969 - RNA, 66 nt, Human
acaaauaaguuaauuaagggccuguuacuaaaccaagauacaacaggagccuaauguuuaguuugu

SEQ ID NO: 15970 - RNA, 85 nt, Human
ucaagauggaggagacucugcugcauacacuuggaggucuagauuuccauagagggcacguagcauauugaggaccuuuucuuga

SEQ ID NO: 15971 - RNA, 89 nt, Human
aguagugggagcacuguguuuagaguuaagagugaacacuguuugauuuuacuuggaauuuccucuguuauauagccuuucccaaugcu

SEQ ID NO: 15972 - RNA, 81 nt, Human; identical to SEQ ID NO: 14670

SEQ ID NO: 15973 - RNA, 81 nt, Human
gggaauaccuuggcaagcagcuccaguccgagcagccccagaccgcugccgcccgaagcuaagccugccucuggccuuccc

SEQ ID NO: 15974 - RNA, 78 nt, Human
aaaguuaugauuaauaauauauauaaaaugucugacaguguguuuaacauauuguagauauuuuuaaaucuuuacuuu

SEQ ID NO: 15975 - RNA, 129 nt, Human
gcggaugaggggguuacaucuagauaaacuuacuuugaauugaaaauacuuuaagucaaaaaugcacuuucaacuuaacauuauuuuuaacuuaugaugggcguguugggauguagccccaucauaagu

SEQ ID NO: 15976 - RNA, 73 nt, Human
uccuucggucuuuuuuuauuugcuuaaaucaaguugcuuauaaagauuuguugaaaaagaggcagacagagga

SEQ ID NO: 15977 - RNA, 66 nt, Human
cgaaaaauaaccaucgggcggggcucucgucguacccgcggcgaaccauccgcccaccuugguucg

SEQ ID NO: 15978 - RNA, 86 nt, Human
uauauguugaaugucuaaaaugguaaaaugugccacugugucaaguuacaguggcuuauguucuuucaucaaguaauucacauaug

SEQ ID NO: 15979 - RNA, 93 nt, Human
cugaagacuacuauagcugaagcaucauucacuggacgugacuucucucaaauagugauccccuuaaaugcuuuggucuuaucugucguguag

SEQ ID NO: 15980 - RNA, 87 nt, Human
ggaaggagccagaauggaggcccaggcugggagguguccgugcuggagccaguuuugagccaagccucaggaagcuggcugccuucu

SEQ ID NO: 15981 - RNA, 70 nt, Human
uuaauauuucaucuuauuuaauggugcaugacuucagugaaacuacccuuugcaaugcaauaaauuuuaa

SEQ ID NO: 15982 - RNA, 74 nt, Human
uucuuaacgauauaagcaacggcuuugagagagaaaacuacuuucaaacaaagcacaguaacaguugaaaagag

SEQ ID NO: 15983 - RNA, 82 nt, Human; identical to SEQ ID NO: 3034

SEQ ID NO: 15984 - RNA, 68 nt, Human; identical to SEQ ID NO: 13466

SEQ ID NO: 15985 - RNA, 65 nt, Human
ugccucucagaacaucaccuaccacugcaagaacagcauugcauacauggaugaggagacuggca

SEQ ID NO: 15986 - RNA, 64 nt, Human
cacuaacaacuucuggccgggccacggggcucaugccuuguaauucucagccagagggcgggug

SEQ ID NO: 15987 - RNA, 77 nt, Human
gguuucagcauguccuucucugaaugaugaauacuuuuacuacuugugacaacauuaacgguccucaugcugauacc

SEQ ID NO: 15988 - RNA, 102 nt, Human
acauugagagggucaaauaguaaauauuguaggcuauguuggcuaccuguagucuccaucacauauucuuugucuuuauuauuuaugauccuuuuaaaaugu

SEQ ID NO: 15989 - RNA, 90 nt, Human
cauuccuaauugugggcacauguuguggaguugagcugaauucugugaauggaaacguggcucauuugcaucaugcaguaagugggagug

SEQ ID NO: 15990 - RNA, 84 nt, Human
ugucuuuugccgaaaugcuaaugauuucugugaaaacucacuaggguacaggagacaaucauuuauguuuaagaaaagaaggca

SEQ ID NO: 15991 - RNA, 85 nt, Human; identical to SEQ ID NO: 1585

SEQ ID NO: 15992 - RNA, 91 nt, Human
ggaggaagaggacucaaaagucuggccuuucacugagcccccacagcaguggggggagaagcaaggguugggcccaguguccccuuucccc

SEQ ID NO: 15993 - RNA, 64 nt, Human
gucugcagaaacagugcaaggaagggcagcgacuuccugguugagcuucugcuaaaacauggac

SEQ ID NO: 15994 - RNA, 64 nt, Human
ugcuucagugcugcuccugagagaguagcagguuaccacucuggcaggccccagcccugcagca

SEQ ID NO: 15995 - RNA, 75 nt, Human
agaccuuccucuggaaccucaguuaaauucacuuaaucuaagugggucuaggugcugggggcccuuaucuugucu

SEQ ID NO: 15996 - RNA, 73 nt, Human
ccuguuaagaaugccuucguuauuucgucaugcuuuaaggcccaggaaaaaccuaggcaaaacucuugguggg

SEQ ID NO: 15997 - RNA, 67 nt, Human
gguuuggagagucccuucagaucuccaauaaacuuguuuguggaggccuggggaguuucuucagacc

SEQ ID NO: 15998 - RNA, 90 nt, Human
agcuuugccucuccauggaauaagugaagacuuuccaaaaacuccaguuugcagugcuuacuuuuuccguugaccuccgagugcucagcu

SEQ ID NO: 15999 - RNA, 121 nt, Human
cagggucagaucuuuuguuucuacuuuucauaagugcaucugcuugucugacaaucaauuauaauuuauaguuaggaaaauaaggucacauaucuugaaucacuugaaagccauuacccug

SEQ ID NO: 16000 - RNA, 72 nt, Human
cuggccucaagugguccucccaucuuggcuucccaaagugcugggauuacagaugugagccaccauggccgg

SEQ ID NO: 16001 - RNA, 64 nt, Human
uggaacauucucucuuaauuaacucuuuuauugaaguauaauguacuuagaggaaaaaugucca

SEQ ID NO: 16002 - RNA, 73 nt, Human
cucuaccauuacauuauaucguauauaguugaugguaaaauaauuauauaugggccugcauacaguggaagag

SEQ ID NO: 16003 - RNA, 60 nt, Human
guauauuccaacgcaucccugcugauccagaaugucacccggaaggaugcaggaaccuac

SEQ ID NO: 16004 - RNA, 64 nt, Human
cucaacucgcagaaacaguggaagcagucgaaggacuucaacccacugacacuguacuucagag

SEQ ID NO: 16005 - RNA, 94 nt, Human
gcacccaguggagccuggaucggagccguaccccccggggacuagaugaugaacuggacaccggggaugccaaaguucuuccaggucauugagc

SEQ ID NO: 16006 - RNA, 106 nt, Human
gggcacugcggggugcuugcugucucgcuugagggccucacgaugcguccaucacugcugaugacccguuaccuggaguccuggggcgcagccaagccuuuugccc

SEQ ID NO: 16007 - RNA, 83 nt, Human
gcuuuucuuucauaucugaaaccuagcugcuuacuuggcuuuucaauuucaguaguuaggauucugauuuugucuacucuagc

SEQ ID NO: 16008 - RNA, 89 nt, Human
ugucuuuuuaggucugucaugaugucuagucuuguugcuaugauucauaggugcauaaaggcuuuaauuuguuuaguuuuuaaaagaca

SEQ ID NO: 16009 - RNA, 62 nt, Human
uggcaggagaaguugcccaacuggcagaucacaaagauggcgagcgcaaguuucaccuguug

SEQ ID NO: 16010 - RNA, 60 nt, Human
acagugagucauucgggcaguuagguggaaaaacacacuccuuugccacgugcuugcugu

SEQ ID NO: 16011 - RNA, 70 nt, Human
gcuggggugcuaggacuuggugcauguguucuuucuaguccuuacgauguucccaccuggaugccccagc

SEQ ID NO: 16012 - RNA, 128 nt, Human
uaaauucaggguaaugguuacaguuaggagaggaaagggaauacaaucagauuaugguaguaaacagggauuuuaaccauauugauuauguuuuauuucugaaacuggguaauggauacucugguuua

SEQ ID NO: 16013 - RNA, 63 nt, Human
gcggggcucccgggcgcgcgugcccggggucugcugugcagcgcgcggccgggcagcucccgc

SEQ ID NO: 16014 - RNA, 76 nt, Human
agaagaggaaaguugcuagcauuuauugaguuucuacuacauauugggcacugugcuaagugauuuaccuuucucu

SEQ ID NO: 16015 - RNA, 60 nt, Human
uaguaugagauuaagcuagagcaggucugauuccaaacugcuuauuucuucucuuugcug

SEQ ID NO: 16016 - RNA, 75 nt, Human
ugcaagagggucagguauaugugugucuaauacaguggucuguacuuccauccacauauauguggcuuuguugua

SEQ ID NO: 16017 - RNA, 66 nt, Human
ugauuucuaggacucaagcagcaagccaggauucuagguguggcugcugugucaucuuugaaguca

SEQ ID NO: 16018 - RNA, 64 nt, Human
uuaaacaccuucaucauggaacucucagagugggguccguuuggguuccuggugguggguuuga

SEQ ID NO: 16019 - RNA, 77 nt, Human
uuaugaugaaguaucgggagacggguuuucaagaagaaaguccgguauucaggauaucucuaaaguuaucauuauaa

SEQ ID NO: 16020 - RNA, 86 nt, Human
ccgcucaacucuucaucuucucgccccacuccaaacgagagagcgacggaccggagaggcgagacagcggcgagagaagggagcgg

SEQ ID NO: 16021 - RNA, 64 nt, Human
gaaacacgcugagcucauggagaugcagcuucuucuguagcuccuaaagcccagcugagguauc

SEQ ID NO: 16022 - RNA, 86 nt, Human
ggcccacgugccggucaugcccauuccgcggugggugcgcuccuuccacggcccgcacaccaccugcugcaugcggcuguugggcc

SEQ ID NO: 16023 - RNA, 74 nt, Human
gcaguggagggggcaggaccuccugcuggugcagcaccagcugcugugagcagguccaccggccccuacacugc

SEQ ID NO: 16024 - RNA, 66 nt, Human
uaguacagcaaaugaauggauauuucugcuaauuuccacuuaauuucuucauaauauggcugucug

SEQ ID NO: 16025 - RNA, 75 nt, Human
gggaauccaugaccacaguaaggaccaaauugccgaucuccugcaacaaaaacuaaacugucaaggcaguuuccc

SEQ ID NO: 16026 - RNA, 86 nt, Human
ugagucagcugcuuccacauaaaagucauauauacgcaagguagaaauauguugagacaauauaugauuaugguggcagcugauca

SEQ ID NO: 16027 - RNA, 65 nt, Human
cuucagcucaucagaggggcaagauucuuuuuuaauacagucucucccugucaucugggcuggag

SEQ ID NO: 16028 - RNA, 85 nt, Human
ggcauguggcugggcagguggauuacaaggcuggucuugaguccugaccucaagugauccaccugccucugccucccaaagugcu

SEQ ID NO: 16029 - RNA, 64 nt, Human
ugauguccauuuuauguuagcuguauucuucaaauuuaugaaggcccuagaaagguggucauua

SEQ ID NO: 16030 - RNA, 67 nt, Human
guacacuucacucagaggcaggugcaucuuuaaauaauuucuuauaagccucuaaagugaucagugc

SEQ ID NO: 16031 - RNA, 70 nt, Human
guuagggauaagugcuuauuuuuaagagcuguggagcucuuaaauaucaaccauggcacuuucuccugac

SEQ ID NO: 16032 - RNA, 93 nt, Human
cuucugggcgccauagagagcguggcgguaucccggagccugccguccggcccuaccgggaccgaugcccucuaguggccuaguguccagaag

SEQ ID NO: 16033 - RNA, 82 nt, Human
gcugcugcugaagcuacaccucuggccgcaguugcgcuggcuuccggcggacuuggccuuugcggugcgagcucugugcugc

SEQ ID NO: 16034 - RNA, 71 nt, Human
gucucagcuagaacgagcggcccuagguuuucggaagggaggaucaggguauguuugcgagcggcuggaac

SEQ ID NO: 16035 - RNA, 65 nt, Human
accagggauaccaucugguccagugguuuuuaaacaaagcugcuuagcaccuggaauucccuggu

SEQ ID NO: 16036 - RNA, 87 nt, Human
gagagauuaagagcuguucucuggaguuccaaucccaccuuuaccguuuaauagcugugugacuuuagguaaguuacuuaaccucuc

SEQ ID NO: 16037 - RNA, 105 nt, Human
gcaggccccgcuggugcacugaagagccacccuguggcaucgauaaacaccgguguuuaucgaugccaccccuggccuucuuuugcccgaccagggguggcuggc

SEQ ID NO: 16038 - RNA, 70 nt, Human
gugggaacggguggcccggcugugugacuuuaaccccaagucuagcaagcaggccaaagaugucucccgc

SEQ ID NO: 16039 - RNA, 93 nt, Human
gacuuuguuggaaggggaggcggggagagagugcuggaggcucuggggcgauggcuuccgcaccucuuccaaccacccucuuucccuggaguc

SEQ ID NO: 16040 - RNA, 96 nt, Human
ucccguuucccugcuuuggccaauggaggagcuacgaauggcacgaccugcucgagcuuggcagucuccaguugggcugugcauggaagcuuggga

SEQ ID NO: 16041 - RNA, 70 nt, Human
cuuauuuccugcucuguggugucaagauauuguugaaaaugucaaaaagaccugcagauaccccuaugag

SEQ ID NO: 16042 - RNA, 76 nt, Human
uggcauggugaaagggugcaaugggcuuauuuaaggacuagagcagugugcagccauaacacaagaaaucauguca

SEQ ID NO: 16043 - RNA, 73 nt, Human
ccagcaugauccugaaaucugcauccgccgugguuuguauucauugugcauaucagggauacccucaagcugg

SEQ ID NO: 16044 - RNA, 77 nt, Human
cugggacucagagccccgcuucuucccacuccacuuguugucccaugaaggaagaagugggguuccuccugacccag

SEQ ID NO: 16045 - RNA, 67 nt, Human
gccucuuacgguuugguaugggacaugcacacacacucacaugcucucacucaccacacuggagggc

SEQ ID NO: 16046 - RNA, 64 nt, Human
cucuuucauccuguagucagggagauaggccacaaaggugcugccaaggaccaggaugauggag

SEQ ID NO: 16047 - RNA, 131 nt, Human
ucagccccuuugaucaggugcucugagaagaggucagaauggcaggcaggggguggggaaggcggugcuucuugagccccacuuagcaacuggucacucauccucuggcagcuggaucuugcuggggucga

SEQ ID NO: 16048 - RNA, 61 nt, Human
uccaugaugggaaggccauuggcucucgguauuucacaagccucucagcuucgcgucggga

SEQ ID NO: 16049 - RNA, 64 nt, Human
cguccuuuucccuuccuucgucccuuccuuccuuccuuucgccgggcgcgauggagccggggcg

SEQ ID NO: 16050 - RNA, 95 nt, Human
gugggagcuccaggggaggggaacagcacaggaagccucuaucagugccagucgggcacaggacacugccugccagucacccugagagguuccac

SEQ ID NO: 16051 - RNA, 88 nt, Human
ucgagugcuggaaggaugaaggauuccugcaucacugugauggccauggcgcugcugucuggguucuuuuucuucgcgccggccucga

SEQ ID NO: 16052 - RNA, 73 nt, Human
agguauuuuugcaaucuaaaauagugaugcuaauacugcuucaguaagcuagauuuacuaauuuaagaauccu

SEQ ID NO: 16053 - RNA, 60 nt, Human
augggaauggccuacaauuacaauaaacaauuaauucaguuauuuuaggggccuuaccau

SEQ ID NO: 16054 - RNA, 70 nt, Human
gugugcuaaaacagaaauagagguagaaucccauuuuucuuaaguaccacucuacaagccaguuccacac

SEQ ID NO: 16055 - RNA, 61 nt, Human; identical to SEQ ID NO: 8378

SEQ ID NO: 16056 - RNA, 91 nt, Human
uugcuuccucuugagugcaacggaaagggcuaucagauaucugcacguuugugagauuuauagcuccuccauuacacuucuucauaagcaa

SEQ ID NO: 16057 - RNA, 64 nt, Human; identical to SEQ ID NO: 14289

SEQ ID NO: 16058 - RNA, 80 nt, Human
aagggguuuucgcaaaaucacucgggggaagggaaagguugcuuuguuaaucaugcccuauggugggugauuaacugcuu

SEQ ID NO: 16059 - RNA, 62 nt, Human; identical to SEQ ID NO: 241

SEQ ID NO: 16060 - RNA, 66 nt, Human
ggugaaaugaggguagcaguagugacgcccaucuccacuggcagugcugauccucagaaacucauc

SEQ ID NO: 16061 - RNA, 68 nt, Human
gcuccuggcuccuagggcagcgccuagagcacagugugauugcaucaggcgcccuuugaggccagggc

SEQ ID NO: 16062 - RNA, 72 nt, Human
cacuguugcccaagcuggaguagagugacaccaucuuggcucacugcaaccuccgccuccuggguucaagug

SEQ ID NO: 16063 - RNA, 79 nt, Human
gccucagccuucagaguagcugagaccacagauguguaccacuaugcucagcuacuuuuuuuuagaaggggggugaggc

SEQ ID NO: 16064 - RNA, 84 nt, Human
gaagacuuugugauucaggcaaaggcugacuguuacuucaccaacgggacagaaaaggugcaguuuguggucugauuccucuuu

SEQ ID NO: 16065 - RNA, 65 nt, Human
gagcucauucugaagaggcugacgauuuuacuaucucauuuuuuuccuuucuccagaauggguuc

SEQ ID NO: 16066 - RNA, 65 nt, Human
acggcgagagcgagaacagacguaagggcgacaacuagaaauccgcccugcgcuggcucugccgu

SEQ ID NO: 16067 - RNA, 89 nt, Human; identical to SEQ ID NO: 6449

SEQ ID NO: 16068 - RNA, 60 nt, Human
gagauggagcgagucagaaccagcauggaguguuacugcugauuucugucccugcaucuc

SEQ ID NO: 16069 - RNA, 69 nt, Human
uugaagaacaccaacauuuagaagcauuuaaaaagacagagcaagaagaaauguaggaugugguaucag

SEQ ID NO: 16070 - RNA, 106 nt, Human
ccccgucuugcuaagcaguuuaguuagacugcaggccagucucuguggugugacaccccccaguggcaaggagcugccaaaacugagcuucugggcaagacguggg

SEQ ID NO: 16071 - RNA, 60 nt, Human
ggcuuucuguucauccguacuuucaaagauuuagugaucaaguacuaugugucaggaacc

SEQ ID NO: 16072 - RNA, 73 nt, Human
ucaaaaggcagcaucugauugugauuugguccagaaauuccuggccagaauauuuccaguguggugcauguga

SEQ ID NO: 16073 - RNA, 73 nt, Human; identical to SEQ ID NO: 7292

SEQ ID NO: 16074 - RNA, 110 nt, Human
gcuguaucaccuuggaucagucagguaaccucccgcgaaucugguugcuuccggggcaggggauccgcgggcugcagguuugagccugguugccggcaggguggagcagc

SEQ ID NO: 16075 - RNA, 61 nt, Human
ggugacaaacaugcuggagaccaagugcuacaugcuugguucaagggauggacaagucacc

SEQ ID NO: 16076 - RNA, 69 nt, Human
cccucaccuuauugggcaaaacugcaucaaucuccuuuugcaguuucugcuggacaucagggugagugg

SEQ ID NO: 16077 - RNA, 64 nt, Human
cuccuggggaguggugaggaggcauuuuugcuaaggcuucaccucuucccuucaucuccagggg

SEQ ID NO: 16078 - RNA, 75 nt, Human
gaagcuuuggggaauuaaguucuuuucaaaucuuggaagucaauauucacuugaaggaauucuauccggggcuuu

SEQ ID NO: 16079 - RNA, 106 nt, Human
gcaaaggaaguggcuuaaugauccugaagggauuucuucugaugguagcuuuuuguauuaucacguaagauucuauuuucaguuguguguaagccaguuuuuuagu

SEQ ID NO: 16080 - RNA, 60 nt, Human
gcugacauuaacuacaauuaugggaaaugcaaaaguuguuuggauaugguaguguguggu

SEQ ID NO: 16081 - RNA, 60 nt, Human
uuugauacuguaucuguuuuccuucaaaguauagagcuuuuggggaaggaaaguauugaa

SEQ ID NO: 16082 - RNA, 77 nt, Human
ccugcgcaaccucuaccgccucuccaaggcccucuucccgccggagccccuggugcugcgagagaugugcaagcagg

SEQ ID NO: 16083 - RNA, 73 nt, Human
gacaaccugccacucuaugagcuuaagaacaccaucacagugucccccuucucgggcgagagugacaucuguc

SEQ ID NO: 16084 - RNA, 61 nt, Human
uccugaaccggcccaaccccuugcuggcguugccccccgcccgcccccacggcccagagga

SEQ ID NO: 16085 - RNA, 81 nt, Human
cuuuugaccuuuucuuccuggacuauugaaaucaagcuuauggauuaagugauauuucuauagcgauugaaagggcaauag

SEQ ID NO: 16086 - RNA, 61 nt, Human
ggauguguuuaaaaucugucauuugcuuauuugccuguuagacaugacugaugacauaucu

SEQ ID NO: 16087 - RNA, 92 nt, Human
gagcuuuucacaagaucgagagccauauauaaucucccagauauguauuuuugagagagagagaauauaugccacgucuugucuuguggcuc

SEQ ID NO: 16088 - RNA, 80 nt, Human
acaggcugcuauaaaugcgcuugaugggcucggcuucuuccuugucaaggaugccuuucuccacauaagcaucagcuugu

SEQ ID NO: 16089 - RNA, 81 nt, Human
uauugaugaagucucucaucuuuagaaaggucauaaucuucuuuauuucccuuuuugucauguuucuucaaccauucaaua

SEQ ID NO: 16090 - RNA, 83 nt, Human
agcaguggcugcuacagcugguacggacugauaggcaauucagaccaacagaagauaaccauaagcugcauggagccaugacu

SEQ ID NO: 16091 - RNA, 77 nt, Human
agaauuaaaauuauauguagaaggaaacaccaagaaaagaauuuccagggaaaauccucuuugcagguauuaauucu

SEQ ID NO: 16092 - RNA, 69 nt, Human
gaggaauuuuuuugcuuguuugucuuuuaagaaaggaaagaaaggaugaaaaaaauaaacagaaaacuc

SEQ ID NO: 16093 - RNA, 86 nt, Human
gcucaggcacaauugucaccaaggaguuaaaagcuucuucuucaauagaggaauguucuggggguccuggagacuuaccauugagc

SEQ ID NO: 16094 - RNA, 87 nt, Human
agaacuucagccguggcucucuagucuucgugucaauauccuuuauuguuuugaugauuauuuucuucagccauggcucauauuucu

SEQ ID NO: 16095 - RNA, 82 nt, Human; identical to SEQ ID NO: 968

SEQ ID NO: 16096 - RNA, 60 nt, Human; identical to SEQ ID NO: 969

SEQ ID NO: 16097 - RNA, 61 nt, Human
gcucgccgcgcuagcccugcugaccugcagccuguggccggcacgggcagacaacgcgagc

SEQ ID NO: 16098 - RNA, 76 nt, Human
gcggccagcacauggcgguguugcaguggagcgugcugggccgcgagcugcagcugcacgaacaucauguggucgc

SEQ ID NO: 16099 - RNA, 62 nt, Human
gcggcgcccccagcccagcccggcccaguccccccgcgcugugaccuggggccucucgccgc

SEQ ID NO: 16100 - RNA, 99 nt, Human; identical to SEQ ID NO: 1699

SEQ ID NO: 16101 - RNA, 67 nt, Human
cuaaugaauucucuuaaaaacauacuguauucuguugcuguguguuucauuuuaaauugagcauuag

SEQ ID NO: 16102 - RNA, 88 nt, Human
gugccaggaaaggcgggauuacuucuuuuuucuuuuuucaccgguggauuggggagaggguccggggucccgaaacccuuucugggau

SEQ ID NO: 16103 - RNA, 60 nt, Human; identical to SEQ ID NO: 1701

SEQ ID NO: 16104 - RNA, 67 nt, Human
cguccacuuucaucucuuugcucgggagguucaacugcuggaccccaaagagacugcaucauggacg

SEQ ID NO: 16105 - RNA, 70 nt, Human
uguuccacgugcuggcacacaucuacugggcccacuucaaggagacgcuggcccuggagcugcacggaca

SEQ ID NO: 16106 - RNA, 65 nt, Human; identical to SEQ ID NO: 6179

SEQ ID NO: 16107 - RNA, 89 nt, Human
uuucucaguucauaggcuaucccaucacccuuuauuuggagaaggaacgagagaaggaaauuagugaugaugaggcagaggaagagaaa

SEQ ID NO: 16108 - RNA, 72 nt, Human
cgaacggcgaaccacagacuaggcuauuuacggaaagaaggaaagaagccgauuaugugguuuagccaguug

SEQ ID NO: 16109 - RNA, 75 nt, Human
gaccccgucaaggcguauaagcuacgugacacauuauauugcaagcgcaaaguauccuacgccucgaugagaguc

SEQ ID NO: 16110 - RNA, 78 nt, Human; identical to SEQ ID NO: 5647

SEQ ID NO: 16111 - RNA, 61 nt, Human
ggagugagggcaggcgagccccaccccggccccggcccuccuggacucgccugcucgcuuc

SEQ ID NO: 16112 - RNA, 60 nt, Human
uccugccccggaagacugugucugcagcgucccacugcucaggccacugaauggguagga

SEQ ID NO: 16113 - RNA, 75 nt, Human
cgaugggcccaaggagguugucgcugcaggcuuuugaaccugugccuugcugugcucaccugggggggggucacg

SEQ ID NO: 16114 - RNA, 61 nt, Human
cuuccacaccugcucuaguccuguggguccccacguuccugcuggacgcagcugagggaag

SEQ ID NO: 16115 - RNA, 111 nt, Human
gacgcuggcccucacgagugacuacaucacgccugcuggccucaggcaccuaccugguccacagccuacauccuggugguggcgggcacugucgucauggugacuggcguc

SEQ ID NO: 16116 - RNA, 85 nt, Human
gccgggcuuggaagccuuugaccuggauccugcacaguuggggagucaauguccagcccuacuccggguccccagccaaccuggc

SEQ ID NO: 16117 - RNA, 67 nt, Human; identical to SEQ ID NO: 4894

SEQ ID NO: 16118 - RNA, 131 nt, Human
cccccccccuuaacccccccccuuugggggggcggggggggguuaccccccuggggggggggggaccccgcccccccaccugggggaaccccccuuuuuccuuaaaccaauacgggggggggggggggggg

SEQ ID NO: 16119 - RNA, 60 nt, Human
ccuuuuuuccccccgggggcggggguuuugggggggccccccccaggggggggggggggg

SEQ ID NO: 16120 - RNA, 62 nt, Human
gcgcaucauucccacccuuucucaaugauuccuucacuugacucccuguggaaugaaaccgc

SEQ ID NO: 16121 - RNA, 64 nt, Human
acuuuuuuaaugggucucaaaauucugugacaaauuuuuggucaaguugauuccauuaaaaagu

SEQ ID NO: 16122 - RNA, 89 nt, Human; identical to SEQ ID NO: 288

SEQ ID NO: 16123 - RNA, 68 nt, Human
gggagaaaugaggaggcuuuaaaaauagacaccacuguuuuuggccuuuguuuaaaauagugauuccc

SEQ ID NO: 16124 - RNA, 67 nt, Human
ugccaucagggaagcuuaacuacaacaauucucuuucagugucgucaauuuuccaugaguucaggca

SEQ ID NO: 16125 - RNA, 80 nt, Human
agucccaggacgguggaaacuagcuaguagauugcagccauguuguggaagcugcugcugagaucccaguccugcaggcu

SEQ ID NO: 16126 - RNA, 110 nt, Human
cccugugccugucucuccaggguucuaccacuuggggggauugggccgguccguggugcauuggauggugucccaaccgggugguggaccuugucaucgacgucacaggg

SEQ ID NO: 16127 - RNA, 63 nt, Human
ccucucuggcuucuuucuccuuagcucagcagguccacuugggguucugggcucccagagagg

SEQ ID NO: 16128 - RNA, 64 nt, Human; identical to SEQ ID NO: 3251

SEQ ID NO: 16129 - RNA, 77 nt, Human
ggagccucagucccucauccgugaaauggggauacaaagauguaccucgcccacacuggccagcagaccaaggcucc

SEQ ID NO: 16130 - RNA, 66 nt, Human
uccagcugcauaguaauccaguguauauauguaccauaggccauucaaucacucucuaugcuugga

SEQ ID NO: 16131 - RNA, 64 nt, Human
aacauccaauucaacugugggaaaggagcuccuucaacugaugccccaguacuuuguggguguu

SEQ ID NO: 16132 - RNA, 78 nt, Human
guggcccagaguccgagucgugcaggugcugugggcccugcuggcagugcuccuggcgucguggaggcugugggcgau

SEQ ID NO: 16133 - RNA, 61 nt, Human
agccucaggucuauuuuuauaacuuguggucguacacaauaacaaaaaaaaaaagggggcu

SEQ ID NO: 16134 - RNA, 78 nt, Human
gcaauucaacuuugaguuaucuuuuaaauaugucuuguauaguucauauucauggcugaaacuugaccacacuauugc

SEQ ID NO: 16135 - RNA, 79 nt, Human
auggguuccucacccccucccuccagaacagcuugagacagucuccaagcugagcuggaugggcuaccuuagaacccgu

SEQ ID NO: 16136 - RNA, 118 nt, Human
ggggaaagccgcugggagguaauggaguaaaggauaaaaguauuaucuuuagaacagacagacgaggguuuggauucuacuagauggugacuguaugaccuuaaaguaguuauucucu

SEQ ID NO: 16137 - RNA, 72 nt, Human
gcaguggagggggcaggaccuccugcuggugcagcaccagugcuggagcagguccaccggccccuacauugc

SEQ ID NO: 16138 - RNA, 64 nt, Human; identical to SEQ ID NO: 1642

SEQ ID NO: 16139 - RNA, 69 nt, Human; identical to SEQ ID NO: 6356

SEQ ID NO: 16140 - RNA, 71 nt, Human
gagcaggaggauucagauucgaaacaucccuccucacgugcagugggaggugucggauggacuuuuggcuc

SEQ ID NO: 16141 - RNA, 70 nt, Human
ucccggaugaagaggugagcuccccuucgcccccucagcgagcccagcguggggaccacucuucccggga

SEQ ID NO: 16142 - RNA, 82 nt, Human; identical to SEQ ID NO: 4052

SEQ ID NO: 16143 - RNA, 64 nt, Human; identical to SEQ ID NO: 4053

SEQ ID NO: 16144 - RNA, 72 nt, Human
gcauaagagaacaguacaauuugcaguuaggaucaucuuucuagauuucuguaucuuucaaaauuucugugc

SEQ ID NO: 16145 - RNA, 80 nt, Human
uuaggcauugaacacauucuuaaaaacacuggucuguaagaaacugguguuuugaaaaauuaaagugugucguagucuag

SEQ ID NO: 16146 - RNA, 76 nt, Human
uuuauuuuggccacauagaucaaaguuaguuucagucuuuucaagcucuaaaauuuugguucugugguuauuuaaa

SEQ ID NO: 16147 - RNA, 60 nt, Human
uagauagguaaggcugggugcaguggcucacacauguuaucccagcacuuucagaagcua

SEQ ID NO: 16148 - RNA, 97 nt, Human
caucuauuuaagcugaagacaacaucaugggaguuagggagauuucggagugcgauugagcuggacacccccucuaugacugcagagcaaguagcug

SEQ ID NO: 16149 - RNA, 82 nt, Human
ccgagaacugagccuggaugauccugagguggagcaggugaguggccgggguuugccugaugaucaugcugggcccauucgg

SEQ ID NO: 16150 - RNA, 64 nt, Human
cugcagacugaagggagcaacggcaagaaagaagugcugagcgguuuccaaguggugcuggaag

SEQ ID NO: 16151 - RNA, 73 nt, Human
ccacauugacugucuguagauuuuggaaagugguaacagguacauagguaaccagaguauauagcuuaugugg

SEQ ID NO: 16152 - RNA, 64 nt, Human
guuuucuggacagccgcacacggauucgguauggcacauuccuuauugcguuggcccagacagc

SEQ ID NO: 16153 - RNA, 72 nt, Human
ucacccuggugugaaugcgcacaucuggaguuccagcuccuucauggcaaaguuccgaaucgcuuggaguga

SEQ ID NO: 16154 - RNA, 69 nt, Human
gcccccaaaccauguucagccacacgccuaccaguucaccuaccguguuacugaauguggcaucagggc

SEQ ID NO: 16155 - RNA, 70 nt, Human
guccccauggcucaccaagcccugcuccaugagaguagccagcaagagcagggccacagcccagaaggau

SEQ ID NO: 16156 - RNA, 65 nt, Human; identical to SEQ ID NO: 4180

SEQ ID NO: 16157 - RNA, 69 nt, Human
ucugggucucuaaaagccacccucaguuuauaccaacugaucaggaaauagguggugacagggccuuga

SEQ ID NO: 16158 - RNA, 67 nt, Human
ucuuugcagggcacagaugaccaaagucccuuccugcuuccuguuaccugucuugcuccuggggaga

SEQ ID NO: 16159 - RNA, 71 nt, Human
uugucuuuuguauaaaugacaaaguguugaaaauguaucuccugaauaaauguuucaaaugcagaaaccag

SEQ ID NO: 16160 - RNA, 78 nt, Human; identical to SEQ ID NO: 8845

SEQ ID NO: 16161 - RNA, 64 nt, Human; identical to SEQ ID NO: 4082

SEQ ID NO: 16162 - RNA, 83 nt, Human
ggcaggcagcuggugccggggcggucaccuccugcucagagaugucaaaucccagccucugaagcugccccaccagcucugcc

SEQ ID NO: 16163 - RNA, 63 nt, Human
cucgguguccucccugguggcuaacagggaaucuuacccaccacaggccuccaagcaccagag

SEQ ID NO: 16164 - RNA, 77 nt, Human
gccuuuugccugggaauugccucagcuacucuaacauuugaucacaguuuagaggcacaguggaccaaguggaaggc

SEQ ID NO: 16165 - RNA, 93 nt, Human
ggcuuuuagugcuacuggugcucuugaaggacagauguuccggaaaacugggaggcuuaucucacugagugagcagaaucugguagcacugcu

SEQ ID NO: 16166 - RNA, 93 nt, Human
gggaagggaaacacagcuucacaauggccaugaacgccuuuggagacaugaccagugaagaauucaggcaggugaugaauggcuuucaaaacc

SEQ ID NO: 16167 - RNA, 79 nt, Human
augggucgugacacugggccugagcuuugucuacaugauucgaguuuaccugcugcaggguugguacauugugaccuau

SEQ ID NO: 16168 - RNA, 64 nt, Human
cugaggcuggcugcgugcucagaggguuugcugaaggccucacagccgcuuagcacaguuacag

SEQ ID NO: 16169 - RNA, 63 nt, Human
gguguacagauuuuucacaagacuuggacagauuuaucaguccuggcuagacaaguccacacc

SEQ ID NO: 16170 - RNA, 63 nt, Human
gcagcagcaccgucucccuggcagcgggcuucuuugugcgaagcccggagaaugugaggcugc

SEQ ID NO: 16171 - RNA, 81 nt, Human
guuuggggacuggcucgggaaugggcucaggcagcuccacgggguuugccuggcagguucaggcucaggacagcccugagc

SEQ ID NO: 16172 - RNA, 60 nt, Human
gaggauccuccggaagccuuaacccuccuuccccaaacagggcucuaaaucaugguccuc

SEQ ID NO: 16173 - RNA, 86 nt, Human
auaaguugaauauuauucuuuaaugugacuagcaaaaaaauucuuuuuuuaacuacaucguauaugccuagaauaaugaaacuugu

SEQ ID NO: 16174 - RNA, 66 nt, Human
aucaucauuuaguuuucuaacccuucuuugauucuuaaaguuucaaaauggagacucauggaugau

SEQ ID NO: 16175 - RNA, 67 nt, Human
guuuauuuaaccauuauccguaagcauuuaucagaauauauguuuagagggaaauauaaauuuaaac

SEQ ID NO: 16176 - RNA, 121 nt, Human; identical to SEQ ID NO: 14784

SEQ ID NO: 16177 - RNA, 60 nt, Human; identical to SEQ ID NO: 1551

SEQ ID NO: 16178 - RNA, 62 nt, Human
agauuccaggccccacccuagacuuccugaaucagaaacuugguugugggguguggggaucu

SEQ ID NO: 16179 - RNA, 64 nt, Human
gaguacgugcuaagugccuuguguacuuugugagcucugugccaggugcuuuguggauguucuc

SEQ ID NO: 16180 - RNA, 103 nt, Human
uuaaucccuccagugacagcgguggggcagcuguuuuguuucuauuucacagaugagaaaggcggagaggcuccaaaagggcuaaugauuggauggagauugg

SEQ ID NO: 16181 - RNA, 72 nt, Human
ccgggagcggccgguggcugagcagucccagaaagcgccugggacuuuagaccaguuaacccggcgcccugg

SEQ ID NO: 16182 - RNA, 131 nt, Human
augcucccuauaaucagacauuaacuggauauaaugacuacaucaagaugagcauuaauccuaagaaacuuguaauggguguuccuugguaugguuaugauuauaccugccugaaucugucugaggaucau

SEQ ID NO: 16183 - RNA, 78 nt, Human
gcuuacggggcauuuggcauuguuggaaaugcaaaacugucuugacuacucugggagaugcugguagccaaaacaagc

SEQ ID NO: 16184 - RNA, 66 nt, Human
uuuuguaucagaggauuuaguucuugcauuuauaauuguuggauauacugaguaucggauauaaag

SEQ ID NO: 16185 - RNA, 63 nt, Human
ggcuuuaaaguugaacauuaccacuuuaggugaucacuuagugucaguguaguuguaaaugcu

SEQ ID NO: 16186 - RNA, 73 nt, Human
guguuguacucauuaauguuauuaugagguuaauguuauuauuaggcuuuuaacaauaugacuguguacacau

SEQ ID NO: 16187 - RNA, 83 nt, Human
uuucuuuuugcuuuuuguuuuguuuuuucauauuuguagggguugugaagucccuagaaaacagagaauccaguuguaagaaa

SEQ ID NO: 16188 - RNA, 80 nt, Human
gccuaacucagcuucuaguccuuggaaauuaagcagcucauugaaaauucaagaguuccagccagaagcuacagcuaggc

SEQ ID NO: 16189 - RNA, 69 nt, Human
ggaauucaucauaugaaggaaugaagauguucaaaagaaaaccuucaaccucaugccagaagauguucc

SEQ ID NO: 16190 - RNA, 86 nt, Human
uuucccucuguagugguugguguggcauuuauaauauaacuccuuuauguacacuguaaaccauuccuucucagggcagauggaag

SEQ ID NO: 16191 - RNA, 74 nt, Human
cuguuguuguuuauagcauuuagaaaaaaauuaaagacuauuguuuaaagcaguuuuagguguacagcaaguag

SEQ ID NO: 16192 - RNA, 112 nt, Human
uccuaauguaucaaaaauagauaguuggugacugcccugugugcagagcccagcccuggauuugugccgcaguuguugguaauacacacuuccugucuguucuggugcugga

SEQ ID NO: 16193 - RNA, 85 nt, Human
gaagccacuggaagguuucuccagaccaugugacuguugcuugugcuucauagucgugaaacuggugucuccuuuaguggcauuc

SEQ ID NO: 16194 - RNA, 71 nt, Human
gcgccgggcggccauggacuuguacagcaccccggccgcugcgcuggacagguucguggccagaaggcugc

SEQ ID NO: 16195 - RNA, 68 nt, Human
gguuuucuagauacaggaacaugucaucugcagagacaguuugacgucaucucuuugucuugaauacu

SEQ ID NO: 16196 - RNA, 67 nt, Human
ucugugaccagugggacgcccucggcucucugacacauagucgcagggaagcccuggagaaaacaga

SEQ ID NO: 16197 - RNA, 85 nt, Human
gguguauugcuuugcccucuuuuucacugagaaccauucagaaaggauauggucuguaucaaaguuggccaacaugcaacuugcc

SEQ ID NO: 16198 - RNA, 70 nt, Human
aauuuuauacuuuuaauuuuuuuuguauuugaaauuuuucauaauacauagaugauauaaaaaugagauu

SEQ ID NO: 16199 - RNA, 70 nt, Human
gaggaggaaggagugauuaucugugucauuauuuuuugauagauugaguaagaagcuauauggacuccuc

SEQ ID NO: 16200 - RNA, 66 nt, Human
ggaugagaaggaacuaauauaugagucuaucuaggaagaaagaaucauugagauaggaggaaaucc

SEQ ID NO: 16201 - RNA, 72 nt, Human
ggcuggagugggacgaucacagcucccugcagugucgacauccccaggcucaagcauccucccaucucagcc

SEQ ID NO: 16202 - RNA, 72 nt, Human
uagagacaggguuuugccauguugcucaggcuagucuugaaugcccgggcucaagugauccaccccccucug

SEQ ID NO: 16203 - RNA, 64 nt, Human
acugcuuaguggcuaugucugugcucacuccuuuagaguuuuauauuuaacuuccauuaguagu

SEQ ID NO: 16204 - RNA, 62 nt, Human; identical to SEQ ID NO: 5011

SEQ ID NO: 16205 - RNA, 76 nt, Human; identical to SEQ ID NO: 4288

SEQ ID NO: 16206 - RNA, 67 nt, Human
cucacugcuauauucaaaauuuauugagcugcaacugugugcucagcaaugagaauauagcagugag

SEQ ID NO: 16207 - RNA, 69 nt, Human
cuuuccaccuagcugauccuaaauguuccuuccucagggaggucuuuucugauuucuuggugggucaag

SEQ ID NO: 16208 - RNA, 75 nt, Human
uuagcaccaugcauuuuccagaguuuuuauuacaauuguaaaauuauggcuguaauaggcuggcugcgcugcuag

SEQ ID NO: 16209 - RNA, 67 nt, Human
gaagaauguggaucaguuuugauggaacuuggaguacguuuucaucgacuuaucuaugagcaucuuc

SEQ ID NO: 16210 - RNA, 74 nt, Human
caggguguuuaucgaugccacaucccccucaaagggagugcgauggggauguggcuugcuucuuccgggcucug

SEQ ID NO: 16211 - RNA, 63 nt, Human
uggguaugauggauguggcgaaaugaacauauuauggauuuuguugugucaucuauuaaccua

SEQ ID NO: 16212 - RNA, 63 nt, Human; identical to SEQ ID NO: 1503

SEQ ID NO: 16213 - RNA, 61 nt, Human
guggagcccagacgcucucggcucacuggguccccggccccccgagcugaggaggcuucgc

SEQ ID NO: 16214 - RNA, 68 nt, Human
gaaggcgggccaagucagcuggcacagaggccaggagguugcugugcaggacaaggagccgcaaggac

SEQ ID NO: 16215 - RNA, 63 nt, Human
ugucacugugaggaaggugagggcggggagggcccccagagccucaggcagcucagagaggca

SEQ ID NO: 16216 - RNA, 83 nt, Human
cuguacgcucccacgguggcacaugaacgacuucuuccacuccuuccugauuguguuccgcgugcuguguggagaguggauag

SEQ ID NO: 16217 - RNA, 64 nt, Human
gaccaugugggacuguauggaggucgcuggucaagcuaugugccuuauuguuuacaugaugguc

SEQ ID NO: 16218 - RNA, 72 nt, Human
gugaucuauuauuuuuauaauuuuauaauuaauuauaucuacaauuauuaauugcaaaagaauagugaucau

SEQ ID NO: 16219 - RNA, 61 nt, Human
caugaagggguaauauaugggguauaacagaaccguauguacgcugccugugaccuuugug

SEQ ID NO: 16220 - RNA, 76 nt, Human
gauaggcgagucuaagagcuacugucagaccuucaguauacaguaacccuguucccaagauuguacuaggccuauc

SEQ ID NO: 16221 - RNA, 72 nt, Human
guuaacacaagauuuuuuuuuuuaagauacacuaaaaugaaaaucucuaagagaaaaugucuucuuuaggac

SEQ ID NO: 16222 - RNA, 66 nt, Human
uccucagcuggagcaacagcaggggggggggcaggacccccugcuggggcaacaccagcuggugga

SEQ ID NO: 16223 - RNA, 74 nt, Human
gaaacccuauaaauguccuaucugugagaaaaguuucauucagagaucaaacuuuaauagacaucagaggguuc

SEQ ID NO: 16224 - RNA, 64 nt, Human
gaacucacaccggagagacauacuuucagugcaccaucugcaaaaaagccuuucugcggaguuc

SEQ ID NO: 16225 - RNA, 72 nt, Human
gacaagagaaugacaaggagaaccuaaauuuggagaaucacagggaccaggagcuccugcaugcuuccuguc

SEQ ID NO: 16226 - RNA, 76 nt, Human
ggaggcauuucccaucccaaaucugaccugacuaauucaauagaauuuggggaagagcuggcaggaauauaccuuc

SEQ ID NO: 16227 - RNA, 84 nt, Human
guuugccacauguagccagggguccuuguggaucacuaucuggagucagagguaaucaggcccaggcugcguugaaggcugaac

SEQ ID NO: 16228 - RNA, 68 nt, Human
cacugcgccaagugcuuccgcuacaagcagucgcucaaguaccaccugcggacccacacgggcgagug

SEQ ID NO: 16229 - RNA, 99 nt, Human
gcgcgcgccccgccgccgccgcccggccaggugcgcgggccgugcccccccucggacaccgccaggcccgagcccagcgggcgggggcggggcgcgcgc

SEQ ID NO: 16230 - RNA, 61 nt, Human
uuucugaguuaacaaaauauuuuuaauaaaaucuuuuuguuuguuuguuuuguuuuggaaa

SEQ ID NO: 16231 - RNA, 71 nt, Human
acacaaauguucccaguuuuucaucugcacugccaagcacugaguugguuggauuggcaagcauguugugu

SEQ ID NO: 16232 - RNA, 72 nt, Human
agaaucauuccuuacuguugcucauggagagcacccgcuccacccccauuugcucgcaguauccuagaaucu

SEQ ID NO: 16233 - RNA, 131 nt, Human
agcgcuuugagguccaggauacuggcaaugaccagcauagaagaucaccaguugcugacguguggacaacucgagauuaguuugacuugguguuuuaucuugacccaccagaaucauuccuuacuguugcu

SEQ ID NO: 16234 - RNA, 89 nt, Human
accccuccucaaauuauaagguaaaugacacaaaguugaacauagggucaguguugggcaaaaagcauuuaaaauauagauaacggggu

SEQ ID NO: 16235 - RNA, 70 nt, Human
ugcaugauuuugaaaacuauauguguaauugugacaaaacuaaacuguagagaaaagacaaaaucaagca

SEQ ID NO: 16236 - RNA, 89 nt, Human
ugcuuccucuugagugcaacggaaagggcuaucagauaucugcacguuugucgaauuuauagcuccuccauuacacuucuucauaagca

SEQ ID NO: 16237 - RNA, 64 nt, Human; identical to SEQ ID NO: 8380

SEQ ID NO: 16238 - RNA, 89 nt, Human; identical to SEQ ID NO: 288

SEQ ID NO: 16239 - RNA, 61 nt, Human; identical to SEQ ID NO: 776

SEQ ID NO: 16240 - RNA, 75 nt, Human
ccccgauuuguaggcagcagagaaagagaucuuaguaauaguuguggccaaggauucuuugcuugucuccugggg

SEQ ID NO: 16241 - RNA, 65 nt, Human
cugccgccucuccgagcucuugugacgcggaccucagugccaggauggcucggggcgagcggcgg

SEQ ID NO: 16242 - RNA, 74 nt, Human
cuuggagcuggagaaguugacuuguagagcccuccaggucagggccucaggaacacccuuuuucucaagccaag

SEQ ID NO: 16243 - RNA, 95 nt, Human
ugugggcgcagcagggcaccgacccggggacuccuaagcucaggcacacgugugagcagggggacgguguggguccuauggcugggaguuccacg

SEQ ID NO: 16244 - RNA, 116 nt, Human
gcccuuggccauggcagcuugguugggacagccgggccaagggaaaaaaaggugcaaaaguccaaaugcuggcacuucagguguggccggcacccagccaggcgcagugggugggc

SEQ ID NO: 16245 - RNA, 65 nt, Human
acaauacugucuuugugguucuggcuguuuagcacuaaacacccaguuauaaaagguaggcuugu

SEQ ID NO: 16246 - RNA, 63 nt, Human
caggugcaggguggacucuuucuggauguuguagucagacagggugcguccaucuuccagcug

SEQ ID NO: 16247 - RNA, 75 nt, Human
ccagucagggucuucacgaagaucugcaucccaccucuaagacggaggaccaggugcaggguggacucuuucugg

SEQ ID NO: 16248 - RNA, 81 nt, Human
accugcgcccuccugccuccugugaccucgagaucucucuucggggggucaagcugagucugagcggaggagggcccgagu

SEQ ID NO: 16249 - RNA, 61 nt, Human
gaugaagaacaucuccuucugcggcugccauccccgcaacagcugcuauuucggcuucauc

SEQ ID NO: 16250 - RNA, 68 nt, Human
guggcgcagagugugggccgcgccuuccuggaguacuaccaagagcaccuggcguacgccugccccac

SEQ ID NO: 16251 - RNA, 92 nt, Human
ggacucauagugguagauagcuuauuggucaggguagauagagauauguuuucuguguaacugucuaguuuuuguccuaccauucggagacu

SEQ ID NO: 16252 - RNA, 77 nt, Human
cuacauggaggugggauauuaaaaaacacaaguaaccguaaaauuauguguuauggaauauaguuauaagcaugugg

SEQ ID NO: 16253 - RNA, 63 nt, Human
gccgcuccucgcgcuucuuccgggccagcucagccuugaccuguccugggugcugggacgugc

SEQ ID NO: 16254 - RNA, 62 nt, Human
ggguagcgaaggggucgcccuugucgcuggacucugggccaccccaguuauacucgcuggcc

SEQ ID NO: 16255 - RNA, 88 nt, Human
cuguauguauaaagucaugcucgauuucaggagagcagcugaucacaauuugcuucaugaaucaagguguggaaaugguuauauaugg

SEQ ID NO: 16256 - RNA, 79 nt, Human
uggcucugcugggcgugaggccgucggucacagcgaaggagcuugccuggcccugggaggcccaaggauagcagggcca

SEQ ID NO: 16257 - RNA, 61 nt, Human
uuugaaauucauaguuuacagaauuuuaaugagagaaauuauugagcuaaugaauggcaga

SEQ ID NO: 16258 - RNA, 74 nt, Human
cugguaguugguaaaggagcuggccuugaacucagggauaucuugaaagccacuguugcuucuauggacucuag

SEQ ID NO: 16259 - RNA, 111 nt, Human
gggaggccgcagguccucgcuggucccggagacuaugcuggucaggccagggcuggguccggggccaggcuggcagcugucuggggcuggggaggagcccugccgcauccc

SEQ ID NO: 16260 - RNA, 89 nt, Human
guucccacacuggcgguguggcugccugcucagggccuggcuccuccgacauggaggaggaaggggcggcagcuggcacagccggggac

SEQ ID NO: 16261 - RNA, 63 nt, Human
ucugcgcaguccgcgcaaacaugcaggugcuugaagagcgagcggugcgugcggaagcgcagg

SEQ ID NO: 16262 - RNA, 81 nt, Human
ugagaaaugccaggcaaucaaugaggaugcucaguuuagcaucuccuauuugaguagauuuacaguuguguggaauucuua

SEQ ID NO: 16263 - RNA, 79 nt, Human
guguguuucccgccauguauuuauucuucaugcuugguuuucuagcauuuucaaguuugcaguaaaagguucaauacac

SEQ ID NO: 16264 - RNA, 60 nt, Human
ccucuccuccucuucccuccccaucuaaagggguuuggggagagacacaggcaggcgagg

SEQ ID NO: 16265 - RNA, 65 nt, Human
ggcuggucccagucuguugggguggugcucaggguaaagggcuaugggcaacaggggaccagacc

SEQ ID NO: 16266 - RNA, 70 nt, Human
gcggggggggccgcggcgcgggcccagggcggcaggacucgggccggagcguggccggacccccacccgc

SEQ ID NO: 16267 - RNA, 102 nt, Human
ggcugacugggcccgaaaguggagggggaccguggagaagggcccccaguaugacacacuggagaaggccuggcaugccuuuuucacggcggcugagcggcu

SEQ ID NO: 16268 - RNA, 84 nt, Human
uuugcccuucucagucuguuccacuucuaggaggcagccaccaggcucagcauccggcaagaaaacagaaaauauggggacaga

SEQ ID NO: 16269 - RNA, 67 nt, Human
aaaaacucaagagcaaaaaaaagguaugcuauaauuuuuaggucuucaauuuuuguauagaguuuuu

SEQ ID NO: 16270 - RNA, 77 nt, Human
cuuuucucaccgaagugaucuggaaugugcuaccguauaugcaaggaagacagguuacaagaucaaggugaaggcag

SEQ ID NO: 16271 - RNA, 68 nt, Human
gcagcugcguaaaacauacaggccggagcuuaucaaagaugggaaguuuggggccuacaugcaggugc

SEQ ID NO: 16272 - RNA, 62 nt, Human; identical to SEQ ID NO: 15871

SEQ ID NO: 16273 - RNA, 77 nt, Human
gcccaaagacaaauauugggcaggaaaucaguucucacugagcccgguuuccauguaaaaucucuguuguggugggc

SEQ ID NO: 16274 - RNA, 62 nt, Human
gggacagguggauuuauuuuuuuaaguuacaauaaaaugcucucaaguccuuugaauguucc

SEQ ID NO: 16275 - RNA, 63 nt, Human
cucuuguauaaaaaagcaccaguguccuggacuggacacccacugcuauaaaagaugcagggg

SEQ ID NO: 16276 - RNA, 88 nt, Human
guggaaacuguguggauggaauaguauuauguacaaggcagggguugaagugauagguacaaguucuuucauauuuacacuauuucac

SEQ ID NO: 16277 - RNA, 80 nt, Human; identical to SEQ ID NO: 9102

SEQ ID NO: 16278 - RNA, 130 nt, Human; identical to SEQ ID NO: 3361

SEQ ID NO: 16279 - RNA, 67 nt, Human
caucagcuggcaauuguaaauagguuuccaggaucaaaacuaaccuuucagcguauucucagcuaug

SEQ ID NO: 16280 - RNA, 61 nt, Human
ccauauggaugaaggacuuggguaggaaagauguuccuguugaaguuacccaaccaaaugg

SEQ ID NO: 16281 - RNA, 70 nt, Human
caauuuucugaugcuuauauuauguuaaugggaguuuucuauacuuccaggagccaaucauuagaauuug

SEQ ID NO: 16282 - RNA, 80 nt, Human
ccuucacugaacaacugugugaacuuggugaagucacuguaucucucuucaccuuaacucccucaccaguacaguggagg

SEQ ID NO: 16283 - RNA, 63 nt, Human
gcuggggaugagaaagagcccuguggcuacguggugucaggaagugggauugucagccucagc

SEQ ID NO: 16284 - RNA, 63 nt, Human; identical to SEQ ID NO: 16283

SEQ ID NO: 16285 - RNA, 92 nt, Human
ucagcuccuucacugaacaacugugugaacuuggugaagucacuguaucucucuucaccuuaacucccucaccaguacaguggagguguugg

SEQ ID NO: 16286 - RNA, 62 nt, Human
acaauucaagaaucguuauucaucacauaaugggaaaguggugaguuggugagugcugaugu

SEQ ID NO: 16287 - RNA, 61 nt, Human
ggcagcggaugaauauugggaagcucuagauuagcugaaucuggaggaaaagucaguugcc

SEQ ID NO: 16288 - RNA, 86 nt, Human
gagucuugcucugucgcccaggcugaauugcaguggggccaucucagcucacugcaaccuucaccuuccggguucaagcaguucuc

SEQ ID NO: 16289 - RNA, 81 nt, Human
gccucauccucccaaguagcugggauuacaggcuuuugccauuaugccugguaauuuugguauuuuuaguagagauggggu

SEQ ID NO: 16290 - RNA, 81 nt, Human
cggauggguuaccggacuuccaggcauugcaaaaugccuuugauaucggucgcagccuggacauugucuauuaccuguuug

SEQ ID NO: 16291 - RNA, 66 nt, Human
gguggggcgcccgaaaaaaccagcugcugcgaagaaaaccacgcgcaaauccucaacugcccugcc

SEQ ID NO: 16292 - RNA, 92 nt, Human
cagaaaugaacaaaacuaaugcuagcagguuaaaaucaaucaaaauguuuaaaaauugauucuguccucagcauguuauuuccucagcucug

SEQ ID NO: 16293 - RNA, 72 nt, Human
cgggucacagcgccgccgccgcccaugcugcugccccuagccugccugcacggccgcgucgcucagugccug

SEQ ID NO: 16294 - RNA, 60 nt, Human
cuccuugcuuuugcuugcagagccgcucccgaggccccggcgcggcgcgagggcgcggag

SEQ ID NO: 16295 - RNA, 64 nt, Human
cccaucucugugacuuccuggagacucauuucuagaugggaagggaaguuaucaagacgauggg

SEQ ID NO: 16296 - RNA, 69 nt, Human
ggcugggaaggcgaguauucucuuccgaagagguccacucucaaggcaggaauaaagagcuuuugagcc

SEQ ID NO: 16297 - RNA, 79 nt, Human
gcuuuucuaguuugcaacuucuaaucugcugugagucaggaaaacauauggcagaguuaaauugugcuuuugguuaggu

SEQ ID NO: 16298 - RNA, 66 nt, Human
gcccguggaucauuaaguauccucuaccugcaaauggggaggcuauuucuuaaacuguccauuggu

SEQ ID NO: 16299 - RNA, 75 nt, Human
ccauaguucucccgcgucugguuggccccguguguuccuuuuccuauaccuccccaggcagccuggggaacgugg

SEQ ID NO: 16300 - RNA, 74 nt, Human
ggauuggaacuguguuugggagccucaucauugguuaugccaggaacccuucucugaagcaacagcucuucucc

SEQ ID NO: 16301 - RNA, 76 nt, Human
agugaaccagaaugcaguuuuccuugagauaccuguuuuaaaagguuuuucagacaauuuugcagaaaggugcauu

SEQ ID NO: 16302 - RNA, 90 nt, Human
cauuucagccagaggacuuuggaacugugaauauacuuccugaaggggagggagaagggaggaaguuccauuguguuaaaggcuguaaug

SEQ ID NO: 16303 - RNA, 99 nt, Human
gaggcaggagaaucgcuugaauccgggagguggagguugcagugagcugagaugguuccauugcacuccagccuggguaacagagugagacuccgucuc

SEQ ID NO: 16304 - RNA, 64 nt, Human
uuugggggucacgacuugacguaaacaggauuuggaacaguuaugcgacgauugugcuuugagg

SEQ ID NO: 16305 - RNA, 72 nt, Human; identical to SEQ ID NO: 3662

SEQ ID NO: 16306 - RNA, 102 nt, Human; identical to SEQ ID NO: 2172

SEQ ID NO: 16307 - RNA, 77 nt, Human; identical to SEQ ID NO: 3082

SEQ ID NO: 16308 - RNA, 60 nt, Human; identical to SEQ ID NO: 14851

SEQ ID NO: 16309 - RNA, 126 nt, Human
ugcguuguuacaggaagucccuugccauccuaaaagccaccccuuuucucucuaaggagaauggcccaguccucucccaaguccacacaggggaggugauagcauugcuuucguguaaauuaugua

SEQ ID NO: 16310 - RNA, 117 nt, Human
cgcguacaggaucugguuaccugugcaguugugaauacccagagguugggcagaucagugucucuaguccuaccucuggguauucacaacuguacaggaucugguuaccugcucgug

SEQ ID NO: 16311 - RNA, 73 nt, Human
uagggugugguccccuggcacguggccaccaucaugucuaggccuaugcuaggaggcaaauggccaggcucug

SEQ ID NO: 16312 - RNA, 72 nt, Human
gguauuguguauucuguaauuaugaaaaagguuguuucuauuuuuacaauauuaucagcaauaaucauugcc

SEQ ID NO: 16313 - RNA, 93 nt, Human
gugguguuauuuaauguuuugcaucuguaucuucuaaauucagagaucuggaggauugauaagauucagauucaauuuugaguguaagccuac

SEQ ID NO: 16314 - RNA, 60 nt, Human
ugcaaaaacuaaaucaggugucccguaaauaugccagcggucuggguuugguugauugca

SEQ ID NO: 16315 - RNA, 62 nt, Human
uuaaugacacuugaaaauguuauuaaauucaaauuuuagcauccauaauaaaguuucauuga

SEQ ID NO: 16316 - RNA, 80 nt, Human; identical to SEQ ID NO: 10199

SEQ ID NO: 16317 - RNA, 72 nt, Human
cugccucugaaauagcugcugcuucgagauccucccuuuuuaaagcacuuucuaaagcccucaggauggcgg

SEQ ID NO: 16318 - RNA, 70 nt, Human
cugacuucaaaaaauuaauguguauccagggacauuuuaaaaaccuguacacaguguuuauugugguuag

SEQ ID NO: 16319 - RNA, 89 nt, Human
ccuuucgggugauugcauaguguccuuugagcucgugcagggcccacaugauguccugacuacugagcacuuugaagucggccaugagg

SEQ ID NO: 16320 - RNA, 64 nt, Human
uacucugccccggacugagcuuagcaucuuugugguucaccuuggcuugaguagggggcaggua

SEQ ID NO: 16321 - RNA, 63 nt, Human
ucauuggcagcuuuccaaggaaaaccgcuuuuuuuuuucuuggguuuuugggcagccuuguga

SEQ ID NO: 16322 - RNA, 99 nt, Human
ggaaauuaggagaaggaauuucagguggguuuaagucagagcuaguuccccaacagaaagaucauuugaaaccaguuuuuaucccuucucuuuccuucc

SEQ ID NO: 16323 - RNA, 72 nt, Human
uuucccuaaaucaaaucaauauuaauugugccuuauuucacuuaacauagacuugaauuauuuuuagggaaa

SEQ ID NO: 16324 - RNA, 103 nt, Human
uaucgcagugugggaacaagacuuuucauugccuuuugcucaguaagauugucuacacaaacugccacgggaggaaugacaagcaguugacccacuggugaua

SEQ ID NO: 16325 - RNA, 63 nt, Human
ugccauaugcacucuccuuuuuacaaggcaaucacagauugcaaauuccauagggcuguggca

SEQ ID NO: 16326 - RNA, 75 nt, Human
gcuuaauugcugauacauaugaaugaaaccuuggcugguauuaccuggcauucacugugcuaucggcaaugaugc

SEQ ID NO: 16327 - RNA, 62 nt, Human; identical to SEQ ID NO: 4147

SEQ ID NO: 16328 - RNA, 73 nt, Human
aaugaaauguauggucuuuugugauuggcaucuuucccuuagcauguuuucaguuucauccauguauuucauu

SEQ ID NO: 16329 - RNA, 63 nt, Human
uuuuguauuuuuaaaauguauuuuguaaacaguguuaugaaauauaauucacauaccacaaaa

SEQ ID NO: 16330 - RNA, 75 nt, Human
caaaccagcaacaugaaauggacaaaccaaucugcuuaagaucugucauaguuuagaucaugguuaucugauuug

SEQ ID NO: 16331 - RNA, 60 nt, Human
cauccucgugggaaauuuccagguuuugugaagaccuguagaaccucuuuuuguggggug

SEQ ID NO: 16332 - RNA, 60 nt, Human
ggacaaagaacggaggacaggcgagaccaucccccguugucuucgcgugugucugagucc

SEQ ID NO: 16333 - RNA, 63 nt, Human; identical to SEQ ID NO: 11061

SEQ ID NO: 16334 - RNA, 63 nt, Human; identical to SEQ ID NO: 14043

SEQ ID NO: 16335 - RNA, 107 nt, Human
aagccuuguuuuuucccagagcaaccauguuuuagcauaaugggaugaccuggugucccauuauaaauaaagggugguauggcuagaaggguaugagcaguaggcuu

SEQ ID NO: 16336 - RNA, 69 nt, Human
agauuuuaguuaacaauaaugagccugggagcaguaguacuaaggcgucuuuuguaggcuuaagaauuu

SEQ ID NO: 16337 - RNA, 67 nt, Human; identical to SEQ ID NO: 2928

SEQ ID NO: 16338 - RNA, 76 nt, Human
acucaggugaguuuuagcuuuauuggggagggggugaucuaaaacacucuuuacgccggcuucuauugacuugggu

SEQ ID NO: 16339 - RNA, 97 nt, Human
ccucuagagggauaugaagcaccgccaggguccuuugaguuuuaagcuguggcucguaguguucuggcgggcaguuauguugauuuaacuguugagg

SEQ ID NO: 16340 - RNA, 82 nt, Human; identical to SEQ ID NO: 4821

SEQ ID NO: 16341 - RNA, 66 nt, Human; identical to SEQ ID NO: 4823

SEQ ID NO: 16342 - RNA, 92 nt, Human
cuucccgaaccguuucguaccucagcaucccugagagaucuagcacauuccauucuguaacagggacgccacagguuuuuaguggagggagg

SEQ ID NO: 16343 - RNA, 76 nt, Human
ggugccgaggucagagaugguggcccuagagucauaggcuugagcagggagccacgauaauucuccagacaguacc

SEQ ID NO: 16344 - RNA, 104 nt, Human
ucauaguggcaaugaaugacgagcauugagccaucaugaggugccaggcacugcuucggaaaccaaaggaccaugcugaagagcucugucguucuccacucuga

SEQ ID NO: 16345 - RNA, 64 nt, Human; identical to SEQ ID NO: 287

SEQ ID NO: 16346 - RNA, 89 nt, Human; identical to SEQ ID NO: 288

SEQ ID NO: 16347 - RNA, 61 nt, Human
caauuuuuauaaucuauuuguggauuuuguuaaaagauuucacaugaagauuuauuaguug

SEQ ID NO: 16348 - RNA, 68 nt, Human
uaaaauuuuuauauguuuaguuaaaagauuugacaugaaaauuuauuagauaccauuuaaaaauuuua

SEQ ID NO: 16349 - RNA, 88 nt, Human
ugaguguguuucuggacacaaacuucugcaguagaaugaccuaacaugucgguuucauugcagucauuauaggauugaaauacguuca

SEQ ID NO: 16350 - RNA, 68 nt, Human
guucacguacagcagaacauguaguuaugcuugcucuuugcaucuacuugacauucuuugaagugaac

SEQ ID NO: 16351 - RNA, 87 nt, Human
ugaccuagauuuaguuuaaauaccaguuuccuuaccaggaaggaaagaaaacugguaaggaaacuguuguuguuaaaaucuagguua

SEQ ID NO: 16352 - RNA, 86 nt, Human
acaauauaauauauucuaaacacaaugaaauagggaauauaauguaugaacuuuuugcauuggcuugaagcaauauaauauauugu

SEQ ID NO: 16353 - RNA, 82 nt, Human
gucacaagaauuuggauggugcaguuaauguugaaguuacagcauuucagauuuuauugucagauauuuagauguuuguuac

SEQ ID NO: 16354 - RNA, 66 nt, Human
gaugggaggaaaguagagguuucgaagggaaaaaaguucguccuuuaacauccaccccccaccauc

SEQ ID NO: 16355 - RNA, 65 nt, Human; identical to SEQ ID NO: 6774

SEQ ID NO: 16356 - RNA, 76 nt, Human; identical to SEQ ID NO: 758

SEQ ID NO: 16357 - RNA, 71 nt, Human; identical to SEQ ID NO: 1764

SEQ ID NO: 16358 - RNA, 61 nt, Human
ggaucucugaagacauccuuauugacgacaguuuuguccaaggggauauccacagaguacc

SEQ ID NO: 16359 - RNA, 114 nt, Human
uugaucucuuggcgaucuucuucuugcccauggcagcugucacuuugcggggguagcggucaauuccagccaccagagcauggcuguaggggcgaucugaggugccaucaucaa

SEQ ID NO: 16360 - RNA, 77 nt, Human
gagucacaggucguguuacagaucagggggacagacaagcacagaacccccaucucccaucacccagccuccgaguc

SEQ ID NO: 16361 - RNA, 65 nt, Human
gugaagcuguugauuauguuuguaguuguugcauuacaguuacacaagaguuaaccagaaugcau

SEQ ID NO: 16362 - RNA, 80 nt, Human
cugggggaaugcgguggcuuccaggguaaccgucugacccugaacuucagcacguuaagcggccgggggucaucuaacag

SEQ ID NO: 16363 - RNA, 74 nt, Human
ggcgacaggugcagaacaaaaacagcaggacaaacccacgaguuugaauguuggaaagacacugacaaaucgcc

SEQ ID NO: 16364 - RNA, 89 nt, Human
gguaguagccauggcggccaugaguuuguugcggcggguuucgguuacugcgguggcagcucugucuggccggccccuuggcacucgcc

SEQ ID NO: 16365 - RNA, 64 nt, Human
ccauccuuuaauagaucucauaagcagaauucagaucaugaaugacugaccagaauaugggugg

SEQ ID NO: 16366 - RNA, 60 nt, Human
ccguugaaacagggaggcaagcacaagacugggccaaaucuccauggucucuuugggcgg

SEQ ID NO: 16367 - RNA, 79 nt, Human
ggaaugguggagugcaauuuuaaacguuuaauggagauggguuuauaauuaaauuauauaauggguaugugacuauuuu

SEQ ID NO: 16368 - RNA, 82 nt, Human
caggcuacuucuauagacaucacuuaaccuaaaauucuaaagaguuaauaugcaugagggauaguaauauaggaagcaccug

SEQ ID NO: 16369 - RNA, 84 nt, Human
ccaaugccaucuuucgcuucuaacugccaguuggcacauucagcuucaaugccuugggaagggaggagcagaggaaagcagggg

SEQ ID NO: 16370 - RNA, 74 nt, Human; identical to SEQ ID NO: 6796

SEQ ID NO: 16371 - RNA, 70 nt, Human; identical to SEQ ID NO: 9240

SEQ ID NO: 16372 - RNA, 91 nt, Human; identical to SEQ ID NO: 10617

SEQ ID NO: 16373 - RNA, 74 nt, Human
gaauugugaacuuguugaagcauagaauugggcauccaguacuuuugucauaaucacugcaucuucuucaauuc

SEQ ID NO: 16374 - RNA, 64 nt, Human
uagcuggcugggcucuuaucuggaaguuccaaggacuaauccacuuucaugcucauucugguug

SEQ ID NO: 16375 - RNA, 68 nt, Human; identical to SEQ ID NO: 1444

SEQ ID NO: 16376 - RNA, 78 nt, Human; identical to SEQ ID NO: 1445

SEQ ID NO: 16377 - RNA, 62 nt, Human
cagaggcugaaguauacaaacugaaagcugaacuaagaaaugacucuuuacuucaaacucug

SEQ ID NO: 16378 - RNA, 61 nt, Human
ugguucuuuagcauguucucaguucaagaauuacgauccugaaagaaggccuaaagaauua

SEQ ID NO: 16379 - RNA, 91 nt, Human
gguuccuuuggucgcucgcuccucuccuacuuggauaacugugguaauucuagagcuaagacaagguagagccgagagacaagguagagcc

SEQ ID NO: 16380 - RNA, 70 nt, Human
accacauuguugcuuggagacaugucauuuucgcgucugucugacauuugcgucugagaaacaaugcggu

SEQ ID NO: 16381 - RNA, 65 nt, Human
ccuuagauguucugacagcacugcaccuuuggcuugguuucagugguugguggaacaugaauagg

SEQ ID NO: 16382 - RNA, 86 nt, Human
auucauggcuagcaccuggaaaugcaguaucucguguauauagcaaaaagauccuggguaguucggaugauacuggaauccugaau

SEQ ID NO: 16383 - RNA, 85 nt, Human
gcaccugaauaaaugaagcgaaggaugucugauaaacaagaacagaagagggcgucuuuaacaaugacucguaaugguggguugc

SEQ ID NO: 16384 - RNA, 86 nt, Human
cuuuuucagucaugcaggagucagucgaaguguggccauaauaacugcuuuucucaugaagacugaccaacuucccuuugaaaaag

SEQ ID NO: 16385 - RNA, 65 nt, Human
gaccggugcguggccuucaucggucaggcccgcgcugagggccgugcgguguuggugcacugguc

SEQ ID NO: 16386 - RNA, 62 nt, Human; identical to SEQ ID NO: 1426

SEQ ID NO: 16387 - RNA, 80 nt, Human
uugcagaauuuaccucaagaacucuuugcuguugacccaacuaccguuucacaaggauugaaagaugagguucucuacaa

SEQ ID NO: 16388 - RNA, 87 nt, Human
uuuuaguugcagccacuaacauguuaaucaaaagaagcaaauacauguuuuucccuugagaaaacauggauagugguguaacgggaa

SEQ ID NO: 16389 - RNA, 90 nt, Human
guguuuacuauauucagaguugugcaacuaucauuuuucucacccccaaaagaaacccuaugcccguuaguauucacucuguuuucucac

SEQ ID NO: 16390 - RNA, 75 nt, Human
ugggcaaggccaugcuccucuggaggcuuccaugaugcaucccauauucaguguuucccgaguaagccccaccca

SEQ ID NO: 16391 - RNA, 89 nt, Human
ccagaagucuauaacauuccaauucacacuucauaccuauuguuaaugguagguacaggagaggaaugaugauuuacccggacuauugg

SEQ ID NO: 16392 - RNA, 65 nt, Human
gggcugggcucaggaaaaaccagccacugcuuuacaggacaggggguugaagcugagccccgccu

SEQ ID NO: 16393 - RNA, 79 nt, Human
ugucugucucagcucaaccacagucugacaccagagcccacuuccauccucucuggugugaggcacagcgagggcagca

SEQ ID NO: 16394 - RNA, 72 nt, Human
caguugauuauggcaagaaguccaagcuggaguucuccauuuaacccagcaccccagguuuguccacagcug

SEQ ID NO: 16395 - RNA, 80 nt, Human; identical to SEQ ID NO: 788

SEQ ID NO: 16396 - RNA, 79 nt, Human; identical to SEQ ID NO: 3903

SEQ ID NO: 16397 - RNA, 83 nt, Human
gggguugccgcucugggaacccgaccguuuggagccagggucugucccccggaggucccggaaagggcggggcggccaacccc

SEQ ID NO: 16398 - RNA, 98 nt, Human
gggacguccgcgacuaccuggaagagaggcuggaagcugaauucggucagaagagaauccaucugaauagccaguuuccaggcacccagcggcuuccc

SEQ ID NO: 16399 - RNA, 60 nt, Human
ccagggguuuccuccuuucguuuggguuaucaaagcguuagguuauaggaauucucuugg

SEQ ID NO: 16400 - RNA, 100 nt, Human
guggcagggucauaggauaauaguggagagaaggucagcagauaaacacgugaacaaaggucucugguuuuccuaggcagaggucccuguggccuuccgc

SEQ ID NO: 16401 - RNA, 68 nt, Human
gaugcuuuuguaugcuucuaucauuuggggagauuauuuccuuacuuucuagaauaacaagauguucc

SEQ ID NO: 16402 - RNA, 97 nt, Human
gguuuacuguguaccuauccugccuuaauucuagaaucagcucuuucuccaacaagcuuugguucuucuuaguggcgcaugauauguauuagagacc

SEQ ID NO: 16403 - RNA, 72 nt, Human
ucgccuucccaaagugcugggauuacagaugugagccaccacaccuggcugucuuuuccauuauggguguga

SEQ ID NO: 16404 - RNA, 73 nt, Human
gagagugacacacagugcuggcccggagacauuuccacaaaguggucaacucugccugcauccuaaaacuuuu

SEQ ID NO: 16405 - RNA, 89 nt, Human
uccuuacagucguuuuuuuacagagaaaaggggcauuguuuuuucacugcuuucucaacaguuccugugaauaaaugaaacauuucgga

SEQ ID NO: 16406 - RNA, 93 nt, Human
ugucaccauccuucaagcugagacuccuggugagccuuugccaccaugaaaaccacauagcugaccagggcugugcuugagguacagaggaca

SEQ ID NO: 16407 - RNA, 80 nt, Human
gacaaacuucgucacagacgcgcggguacacacgcaccggacccuccgggagaguguaccugccgaucauagacgacguc

SEQ ID NO: 16408 - RNA, 76 nt, Human; identical to SEQ ID NO: 13770

SEQ ID NO: 16409 - RNA, 85 nt, Human
cacagaaucagaccaugacuaccuucaccuggaacaucaaccacgcccggcugauggugguggaggaaccgauguguuuacugug

SEQ ID NO: 16410 - RNA, 72 nt, Human; identical to SEQ ID NO: 5736

SEQ ID NO: 16411 - RNA, 73 nt, Human
cucugacaacaguggcuggacugaaauccgccgggaagccugggucuccucuagcuuauuggugucuccagag

SEQ ID NO: 16412 - RNA, 83 nt, Human
uucuggcagcgguacccgaaucccuauagcaaacaugucuugacggaagacauaguacaccgggaggugaccccugaccagaa

SEQ ID NO: 16413 - RNA, 79 nt, Human; identical to SEQ ID NO: 1810

SEQ ID NO: 16414 - RNA, 65 nt, Human
gcagacucaugcagcccuauggccgcucagaccaaggcgcagagcaacuaucagggcagcucugc

SEQ ID NO: 16415 - RNA, 67 nt, Human
ggcccagcaguauugcucacgggggcuccagccgccggcguaggcccucaugagcuacgccuggguc

SEQ ID NO: 16416 - RNA, 84 nt, Human
ugacuuggaaggugcccugugcuaugucgugccugcagggacacgucggaucccgugggccucacaugccaggucaccagguca

SEQ ID NO: 16417 - RNA, 71 nt, Human; identical to SEQ ID NO: 1145

SEQ ID NO: 16418 - RNA, 67 nt, Human; identical to SEQ ID NO: 1146

SEQ ID NO: 16419 - RNA, 80 nt, Human; identical to SEQ ID NO: 100

SEQ ID NO: 16420 - RNA, 77 nt, Human
cugggguguuuauggcaagucacuuugacagacauuaauguggcagauguugucugacuuacuguuucaacaaccag

SEQ ID NO: 16421 - RNA, 65 nt, Human; identical to SEQ ID NO: 247

SEQ ID NO: 16422 - RNA, 80 nt, Human; identical to SEQ ID NO: 100

SEQ ID NO: 16423 - RNA, 89 nt, Human
uuguucaccuggcaagcacuguggcuggcucuccaggauguuuucccauugugggguugggcacggcccggugggaccagaguggacga

SEQ ID NO: 16424 - RNA, 60 nt, Human
gcauacacugacacgggaaagagggcgaagacaccaagcaaacugcccgaaacagaaagc

SEQ ID NO: 16425 - RNA, 66 nt, Human
ggcauccggcggaacuggaucgaggcucugagaaagaccguacguccaacuucagccccagauguc

SEQ ID NO: 16426 - RNA, 64 nt, Human
guggcagcagccugagaaagugcccugacgggagaacuuagcggugcccucaugccugcucaac

SEQ ID NO: 16427 - RNA, 65 nt, Human
ugagcuggauggugagaucgaccugcguuccugcacggaugucacugaguacgcggugcagcgca

SEQ ID NO: 16428 - RNA, 110 nt, Human; identical to SEQ ID NO: 5411

SEQ ID NO: 16429 - RNA, 81 nt, Human
cagggcgcauagugauaccuuugauaaagggcagaugaauaaaacaugcagcuacacgacggaagaacaauuguaauccug

SEQ ID NO: 16430 - RNA, 107 nt, Human
cccggaguauggccgcaagaagcgccuccugacugggccucaugucccuccagagccugaaugaugugagcuugagcacaggcgcaucaauugcugccaacccaggg

SEQ ID NO: 16431 - RNA, 63 nt, Human
ccuaccccagcggccagaucggcuucaugcugugcagcaagaacccgagcacgaacuuccagg

SEQ ID NO: 16432 - RNA, 60 nt, Human
ccuugaaaggcaauuguuggcuguuuucauaagcaggaaaaauaaacagaaguauaaagg

SEQ ID NO: 16433 - RNA, 65 nt, Human
gguuccgguucuguggugaucuggacugucccgacuggguccuggcagaaaucagcacgcuggcc

SEQ ID NO: 16434 - RNA, 83 nt, Human; identical to SEQ ID NO: 741

SEQ ID NO: 16435 - RNA, 61 nt, Human; identical to SEQ ID NO: 742

SEQ ID NO: 16436 - RNA, 78 nt, Human; identical to SEQ ID NO: 743

SEQ ID NO: 16437 - RNA, 85 nt, Human
aggcgccauuccuuccacauucggcuauggggaggaaagccaguaggacccauuugucgacaugguggaagggguuucacugucu

SEQ ID NO: 16438 - RNA, 75 nt, Human
ggccaaggucaggcuggaggagguggacuuuggccccuagggagcccccaccugaccucuacuugcaccuuggcu

SEQ ID NO: 16439 - RNA, 78 nt, Human
ugacauuuggauaaacaagaggcgccauuccuuccacauucggcuauggggaggaaagccaguaggacccauuugucg

SEQ ID NO: 16440 - RNA, 103 nt, Human; identical to SEQ ID NO: 13269

SEQ ID NO: 16441 - RNA, 101 nt, Human
ggaaggaaaaaaaguaaauaugcaggcuuuuaggacugaguagccuugaaaauaaaccucauuucuaaaaaggaccuuuuguuuauacuuuuuuuuuuuuu

SEQ ID NO: 16442 - RNA, 65 nt, Human
gcuggagguacugucagagguugaaugccaucugcgagugucuuucuuugaugucaccuaccggc

SEQ ID NO: 16443 - RNA, 64 nt, Human
cugguuucagaucucagaccuuauuuuuauauccuacaaaaauuucaauaaccuuugaaaucag

SEQ ID NO: 16444 - RNA, 89 nt, Human
ggaaaaaaacuuuaauuggcgccaaaaaacagaaugaaaugggcuuggccuuauauuguguuuuuugcguuggucugggguuuucuucu

SEQ ID NO: 16445 - RNA, 90 nt, Human; identical to SEQ ID NO: 5362

SEQ ID NO: 16446 - RNA, 72 nt, Human
ucuuuuucggcgcuugcacucaggcauuuaacaacacuggacacggugcaaggugacagcagucgguuggga

SEQ ID NO: 16447 - RNA, 81 nt, Human
cagggcuggagagagggagacgcagagccggacgugacgggcugugcuugucaaaacugugcagucuccuucguggcucug

SEQ ID NO: 16448 - RNA, 62 nt, Human
ggcccaaccacaaaggcagagaaguuagccccagaaagcugacagcugaaggcggggaggcu

SEQ ID NO: 16449 - RNA, 66 nt, Human
ggcuccacccagcaaggccucuggcaggggcuauguuuaaggcuggggucaggcagaggugggacc

SEQ ID NO: 16450 - RNA, 73 nt, Human
aaccauagcaggugucagcccugguccagucagccuugcccagugggcagggaagggcuagggcugugugguu

SEQ ID NO: 16451 - RNA, 64 nt, Human
gugagucagugggcggcaagguggaaaacuguaggguggccaguuagccguaaaaaaagaucac

SEQ ID NO: 16452 - RNA, 91 nt, Human
ccaaggcgccuuuguuggggguccgggaauccgcggugugccaggucggaaaaggcguccgcuuuccuggagaggaggcuaaggugccggg

SEQ ID NO: 16453 - RNA, 80 nt, Human
aguuuaggaaacaauguuucugggagagugcuuaauuccugugaaguuuaugauccugccucagaaacauggacugagcu

SEQ ID NO: 16454 - RNA, 97 nt, Human
uguccaaugauugaagccaggaagaaucaugggcugguauuuguaaaagacaagauauuugcuguggguggucagaaugguuuagguggucuggaca

SEQ ID NO: 16455 - RNA, 60 nt, Human
cugcgccggcugcccguugcuagcuauggcaaaugguggcggcggcggcggcggcagcag

SEQ ID NO: 16456 - RNA, 90 nt, Human
ggcggcggcggcggaggcagcagucuuagaaugaguagcaauauccacgcgaaccaucucagccuagacgcguccuccuccuccuccucc

SEQ ID NO: 16457 - RNA, 99 nt, Human
ucuucgggggccucuucaucaucuugcucuggcggacgcucaaguaccuguggaccgugugcugccacugcgggggcaagacgaaggaggcccagaaga

SEQ ID NO: 16458 - RNA, 79 nt, Human
cacacaauuaaguugcugcaaauucaaaagcuuagagagaauaagcuucuugguggugaaacuacaacucucacgugug

SEQ ID NO: 16459 - RNA, 76 nt, Human
ccgugguuccucaccugcauuaaccagccccaguuccgggcugucuugggggaagugcaacuguggagaaagaugg

SEQ ID NO: 16460 - RNA, 60 nt, Human
auuaggcccuaauugccugacuuaaauuaauauugguuaaggcccacuuaggguccuggu

SEQ ID NO: 16461 - RNA, 62 nt, Human
guauuaaaccuauucuuuauaaacucauauuacuguucuaaauugaagaaauuauuuauuac

SEQ ID NO: 16462 - RNA, 87 nt, Human
uuuuuuuuuugcauuucucauuuuuauuugacagaaaaaguugcucuugcuguacagauuuuaaaaaaccaaaaugccuuuaagaaa

SEQ ID NO: 16463 - RNA, 106 nt, Human; identical to SEQ ID NO: 6411

SEQ ID NO: 16464 - RNA, 80 nt, Human; identical to SEQ ID NO: 367

SEQ ID NO: 16465 - RNA, 65 nt, Human
ggcccccucaaaaguggucucaacgggggguucgccggccccgggagaaacacgccagggggacc

SEQ ID NO: 16466 - RNA, 62 nt, Human
ucucuggggucaagagagagccugggccuaggagaucuagggucuaaaaaagcucaaaggga

SEQ ID NO: 16467 - RNA, 70 nt, Human
ggauuugcucauugcuguaccacaucugcucuagggaaucuggauuauguuauacaaggcaagcauuuuu

SEQ ID NO: 16468 - RNA, 77 nt, Human
gguuguuaacaucugacacagugagugagaaaaaauccagcacagucacugggcagguuuaagaagaaguggcagcc

SEQ ID NO: 16469 - RNA, 71 nt, Human
guuuagaaguuucuggccccacaguucuagaggcugacugacuggggcagguuguagagaaacuucuggac

SEQ ID NO: 16470 - RNA, 81 nt, Human
cuaugacugcucugccauguugcuuugccgaccucgccccugggaaggggaccgggcaaggccacuuccagaggguugugg

SEQ ID NO: 16471 - RNA, 97 nt, Human
agagcugauaauagauguuuaguuuuaaaaaggauuaugugcgggagacucucuguuagaggagccuuuuucaucugacauuuguuauuucuguucu

SEQ ID NO: 16472 - RNA, 71 nt, Human
ugccauuuugacuuaugacugcaggaccaaguguauuucuguccuguauucuaccgaguccgaggguggua

SEQ ID NO: 16473 - RNA, 75 nt, Human
uccaguccauggcaggcggguacaaggggagguaagaugggagcuccacuccuuggaccaccagcugguucugga

SEQ ID NO: 16474 - RNA, 60 nt, Human
uggaauuuucugagagaucuuuauucuuuauucaggaugugggaucgaucagcacugcca

SEQ ID NO: 16475 - RNA, 105 nt, Human
acuugugcugauauuuuaaggaugugcucaagaguaugaagcagggugcuuuugucccuuucucuccucccuaguaauucccuccucccuaucccauagccaagu

SEQ ID NO: 16476 - RNA, 67 nt, Human
cccuuugcuucguugguaugguaggugcccuuguggcggaacauguaccggaucaggaagaccaggg

SEQ ID NO: 16477 - RNA, 64 nt, Human
gccaccccucaaaugagccauuccuuuuugcuuucaucaauggucucugugaaguuggggucgu

SEQ ID NO: 16478 - RNA, 76 nt, Human; identical to SEQ ID NO: 128

SEQ ID NO: 16479 - RNA, 85 nt, Human
gaugaauccuucaaauaggagccgauggaucugugguccuuugggacucaucaaagccuugguuuagcauuuugucaguuuuauc

SEQ ID NO: 16480 - RNA, 63 nt, Human
ucgcugcccucucugccagcaggacugggugguccaaagaaucggcaaaugagagugguuaga

SEQ ID NO: 16481 - RNA, 75 nt, Human; identical to SEQ ID NO: 1049

SEQ ID NO: 16482 - RNA, 70 nt, Human
gggagaagggcuugaugcuuggggugggaggagagaccccuccccugggauccugcagcucuagucuccc

SEQ ID NO: 16483 - RNA, 74 nt, Human
ccucugccuugcccccagacccaccagccaggagccagagggagggaggcugaggggcggggacgaggaagagg

SEQ ID NO: 16484 - RNA, 78 nt, Human
cuuccagguccucaguacacaaccaccacgagggaaacccagaccuagguuuccggcgccgacucugaggcccgggag

SEQ ID NO: 16485 - RNA, 70 nt, Human; identical to SEQ ID NO: 2845

SEQ ID NO: 16486 - RNA, 75 nt, Human
gaggcccucaagagcaguagaaucaguauauccugaaggcagugcuggaggcagucucaugcacuaggggguuuc

SEQ ID NO: 16487 - RNA, 60 nt, Human
uuccaaccacguugcccaguguaaauccaagcaggaacuggagcaugaugucggugggga

SEQ ID NO: 16488 - RNA, 62 nt, Human
gucuacaagcauuuugaaauauucugugccuucgcagaauuucgugugugaucacugaggac

SEQ ID NO: 16489 - RNA, 87 nt, Human
ugcucuacaaaguugagggucagagggggaacaauuauauagaaauuucggagauguguauucuuuggccuucgaaauucuggagca

SEQ ID NO: 16490 - RNA, 125 nt, Human
uggaagugagcgguugacccuccuggcuccccugaauucuguauucaaagauggaaccccuccaauugaugcccauacaaggaauuugcuucggaaccacauaauuaaagaccagcuggccucua

SEQ ID NO: 16491 - RNA, 68 nt, Human; identical to SEQ ID NO: 14562

SEQ ID NO: 16492 - RNA, 79 nt, Human
uugaugagcuacucaucccagacucagccaagacacuauuugaauuggcugcagagucugauguguccacagccauuga

SEQ ID NO: 16493 - RNA, 64 nt, Human
aaauaucaaagacuaauacuggaauauguauucuacacauauaucauuuauuucuuugaucuuu

SEQ ID NO: 16494 - RNA, 70 nt, Human
uuuguugauagagugguuuccuccuuuguaauuccccugcccagggccagcccauagcuuuauuuucaga

SEQ ID NO: 16495 - RNA, 61 nt, Human
ggcuagcacaguuccagaucacuguaauuucuuuacaauuuucuauacuguuuaaaagguc

SEQ ID NO: 16496 - RNA, 75 nt, Human
uucuacaauaaucauuuaucauuuauguaaucaaaaaguuauuuuuauuauuuuaguuuacaugccuuuguggaa

SEQ ID NO: 16497 - RNA, 78 nt, Human
caguuggucuuggcacucagccagcuucgccuccgugaucuucaggaugucagggagcugcugcaggucagccagcug

SEQ ID NO: 16498 - RNA, 81 nt, Human
cuggaacugccuucgugccgccucaaucucuuuguucaucucaucuuuaaggaucuuguucucuuugugacagcguucuag

SEQ ID NO: 16499 - RNA, 96 nt, Human
uaggagaagggggugccaaugccuggugaggcgcuggaccgcagccacaggcagauggugaaggcguacagcucaggcagcgucuucuugaucuug

SEQ ID NO: 16500 - RNA, 68 nt, Human; identical to SEQ ID NO: 10162

SEQ ID NO: 16501 - RNA, 60 nt, Human
auuugaaccaacaguucuuagaccggucuuccaacccugguuaagaauuggguugcaagu

SEQ ID NO: 16502 - RNA, 66 nt, Human
ccuuuuuaaugggucccaaaaucugugacaaauuuugguccaguugguucccuuuaaaaguucugg

SEQ ID NO: 16503 - RNA, 63 nt, Human
aguauugagggggcaucagaauuggguguacagcugagcauucucuccugacucuucuaugcu

SEQ ID NO: 16504 - RNA, 89 nt, Human
gggcugcgggcgaccuuuaccauaggacgaaguaaccuugcauucggaugcaagguguacuguacguacacaggugcuggucgaugucc

SEQ ID NO: 16505 - RNA, 89 nt, Human
guuuuauuuuuguaaagguauguaaguuauuaaaugguuaaucauggccuuuuaaaaauaaaauaaagugauaccuuuacaaugaagac

SEQ ID NO: 16506 - RNA, 85 nt, Human
uuuaaaaaaauaccacugugagaauaaagcgcuaguaagauacaucacuuacugauuuuaaaaauacagaaagauuuugaguaaa

SEQ ID NO: 16507 - RNA, 69 nt, Human
ccuucgcuagucuccguauggcccgugccaacgcccggcucuucggcauacggggcaaaagagccaagg

SEQ ID NO: 16508 - RNA, 74 nt, Human
uuggccaguuggcguaauaccgaagaggccugaaccgaucgccuuuuccaacaguugcgcaaccugauagccaa

SEQ ID NO: 16509 - RNA, 65 nt, Human
uacauuuauugaaauggcuguacauguaagcagguaacuacacagcagacguggcaauaugugug

SEQ ID NO: 16510 - RNA, 61 nt, Human
gcuucugccgaggugucccugaugccaagauucgcauuuuugaccuggggcggaaaaaggc

SEQ ID NO: 16511 - RNA, 62 nt, Human; identical to SEQ ID NO: 5274

SEQ ID NO: 16512 - RNA, 77 nt, Human; identical to SEQ ID NO: 14184

SEQ ID NO: 16513 - RNA, 74 nt, Human
aucacuugaacccgggagguggagguugcagugagcugagaucaugccacugcacuccagccugggcaagagau

SEQ ID NO: 16514 - RNA, 67 nt, Human
ggcacaguggcucacgccuguaaucacagcacuuuggaaggcagaggugagugaauuacuugaggcc

SEQ ID NO: 16515 - RNA, 69 nt, Human
gccauuagacuuauaggugaugcaagcaucuaagagagggguuaaucacacuauagaggcauaaguggu

SEQ ID NO: 16516 - RNA, 66 nt, Human; identical to SEQ ID NO: 4461

SEQ ID NO: 16517 - RNA, 61 nt, Human
ggugacaacaugcugggagccaagugcuaacaugccuuggguucaagcgauggaagucacc

SEQ ID NO: 16518 - RNA, 70 nt, Human
ccaacacgcuggugagaggccugauuagguuuuggggaagaucugagagcucuggccucuucgugagugg

SEQ ID NO: 16519 - RNA, 69 nt, Human
gccuggagaaggccuccccugaccugcucucucaguauccuggagagcuggccagaggccaucacaggc

SEQ ID NO: 16520 - RNA, 88 nt, Human
ggaggauugcucgaaccugggaggcggagguugcagugagccuagaucacgccauugcacuccagccugggugacagagugagacucc

SEQ ID NO: 16521 - RNA, 73 nt, Human
guggcggcuccagacccggguagugccuuuguccccugaauacucacucccccgguccagagggccuucccac

SEQ ID NO: 16522 - RNA, 120 nt, Human
guguguguggucuuucacucucagauagugaauguacgucaccacaacaaggaaaaagcgcugaggaagaaugugcaucccacaggucagagagucaagcaggaaguaccaguagagcac

SEQ ID NO: 16523 - RNA, 90 nt, Human
uccaaauauagcaaauuuggaacaacuaggcauuacugugaaagaacuuccuaguuuuucauuugucugccaccacauugcuacauugga

SEQ ID NO: 16524 - RNA, 79 nt, Human
uuuaugauuuguuucaguuuuauuuuccugucucaguuucaguaaaagauucagagaacugauugacacacaucauaag

SEQ ID NO: 16525 - RNA, 62 nt, Human
uuuuucuuuuucacggaacaaggugacacuaucuuuguucaaaccaaagugaaaaggaagag

SEQ ID NO: 16526 - RNA, 66 nt, Human; identical to SEQ ID NO: 10783

SEQ ID NO: 16527 - RNA, 88 nt, Human
caccaccguuacuacgaucaauguuugcgcauguucgagaugagucucaccaacaguguguaagucauuaacaguccuaacuguggug

SEQ ID NO: 16528 - RNA, 65 nt, Human
uguguauguguguguauguguguguuuuguaaaaucuguaaauagcacaugaccaaaugaacaua

SEQ ID NO: 16529 - RNA, 67 nt, Human
cauuagauucaguccauagauucugugacaaaauuaacuacagucagucugugcaaugaaauugaug

SEQ ID NO: 16530 - RNA, 64 nt, Human
aaaguaaugaauugggauguacaagguuauucuuaacgcuuauuugaaaccacuuuauuuuuuu

SEQ ID NO: 16531 - RNA, 66 nt, Human
gcgcugccacaccccgcuaauuuuuguauuuuuaguagagacgggguuacaccaugugggucaggc

SEQ ID NO: 16532 - RNA, 72 nt, Human
gcucuguuacccaggcuggaaugcaguggcacaaucucggcucacugcaaccuccaccucccggguucaagc

SEQ ID NO: 16533 - RNA, 62 nt, Human
aguuggagcguucagaaguugauagcaagaugaaagaaaguuggaauuucuggagacuaauu

SEQ ID NO: 16534 - RNA, 88 nt, Human
ggagaaucacuugaaccagggagguggagguugcagugagcugagauugcaccauugcacuccagccugggugaaaaagcgagacucc

SEQ ID NO: 16535 - RNA, 93 nt, Human
ugguagaaauaugggaugccaagguggguggaucacuuaagaucaggaguuugagaccagccucaccaacauggagaaaucucaucucuacua

SEQ ID NO: 16536 - RNA, 61 nt, Human; identical to SEQ ID NO: 15377

SEQ ID NO: 16537 - RNA, 70 nt, Human; identical to SEQ ID NO: 1644

SEQ ID NO: 16538 - RNA, 68 nt, Human
uuuuaagaaauuaauuuauuugaguucaaauauuuuugaaauauaaaaauugguuguauuuuuuaaag

SEQ ID NO: 16539 - RNA, 98 nt, Human
acagccuggcuccuaacaggagggaagaugaagcagacugccgggagaucucugccagcaaacucuucucuucccacucauguuaggcccaguguugu

SEQ ID NO: 16540 - RNA, 66 nt, Human
aggugggcagaucacuugaggucaggaguucgagaccagccuggucaacauggugaaaccccgucu

SEQ ID NO: 16541 - RNA, 60 nt, Human
ggcccacgcguacacuccucugguucaaugcugccccagccugagcguacaguguggucc

SEQ ID NO: 16542 - RNA, 62 nt, Human
gcacuggggggcccagccuaccugccagacaguucccaggagugaggcuggucuuuccuggc

SEQ ID NO: 16543 - RNA, 69 nt, Human
gcgcacaguggcaguaccgggcaccgcacugacacaaguguaggggggaugggggaagccacagacagc

SEQ ID NO: 16544 - RNA, 61 nt, Human
gaugcaucugggaagggcauggagcacugcacccauauccccauacuucgcccuaagcauc

SEQ ID NO: 16545 - RNA, 64 nt, Human
gcugggauuacagacaugagccaccgcgcccggccugauugugguucuuaagacccuccccagc

SEQ ID NO: 16546 - RNA, 67 nt, Human
ucaugaagcuuccaugaaaagccaagaggacuggguccagagagcuucuggguagcugaacacguga

SEQ ID NO: 16547 - RNA, 90 nt, Human
uaagcagcaucauggagguuugaagaugccgcauuuggauuggaugaauuccaaauucugcuugcuugcuuuuuaauauugauaugcuua

SEQ ID NO: 16548 - RNA, 96 nt, Human
cugauuuaaaaauauggucuuuguuuuauaugauuaaaugguuuguuuucauagaugauauguuacucauuguaaagaccacauauuuuuauucag

SEQ ID NO: 16549 - RNA, 63 nt, Human
gcgguuuuaugucuuuagaaauguuuugccuuucuaagccuugugcuaaaggcguauaacggu

SEQ ID NO: 16550 - RNA, 80 nt, Human
cuucauccacuacucagucauccaaacuagugccauuacaaaugcggcacagucgaugaucugucaauguagagaugcag

SEQ ID NO: 16551 - RNA, 64 nt, Human
gggugugugcuuuggugguguugagaugcucagucauccaaaaccuauacuaaaguauaguccu

SEQ ID NO: 16552 - RNA, 87 nt, Human; identical to SEQ ID NO: 76

SEQ ID NO: 16553 - RNA, 78 nt, Human; identical to SEQ ID NO: 99

SEQ ID NO: 16554 - RNA, 80 nt, Human; identical to SEQ ID NO: 100

SEQ ID NO: 16555 - RNA, 78 nt, Human
ugugcccacaguguugagaacuauguggcagauaucgagguggauggaaagcagguagaguuggcuuugugggacaca

SEQ ID NO: 16556 - RNA, 75 nt, Human; identical to SEQ ID NO: 9063

SEQ ID NO: 16557 - RNA, 80 nt, Human; identical to SEQ ID NO: 9064

SEQ ID NO: 16558 - RNA, 82 nt, Human
gggcaacugugugagccugcuguccccaagccccgagggugacccgcgcuucagcuuccuccuccacuucuacacaguaccc

SEQ ID NO: 16559 - RNA, 60 nt, Human
uggacagccucucuuuccagcugggccucuaccucagcccacacuuccuccaggccucca

SEQ ID NO: 16560 - RNA, 91 nt, Human; identical to SEQ ID NO: 9253

SEQ ID NO: 16561 - RNA, 84 nt, Human
cugcauagacagguauucuuccaugcaggaaucuggaccaagaaaguggccccuauucagagaaggaaaaagccugcuucacag

SEQ ID NO: 16562 - RNA, 66 nt, Human
ggucuggggcaagaucacucgaucuccaggaugaggucgucaccuuccagugucauguccuugguc

SEQ ID NO: 16563 - RNA, 92 nt, Human
gacuugucguggccccggucugacuugucguggccccugucuaguuucucauggcugcgguccgacuugucauggccccuguccgacuuguc

SEQ ID NO: 16564 - RNA, 96 nt, Human
ggcuccgguccaacuuuucuucagcaucugcauuacugcuucugagcuucuuggccgauuugguaaccacggaguuggggucauguggggagagcc

SEQ ID NO: 16565 - RNA, 88 nt, Human
ugggagccauugccucucgcuuugucugcuucgggccacacgucucccguugaagcagaaaucaggucccuuucaguucuggcuccca

SEQ ID NO: 16566 - RNA, 94 nt, Human
auagccaguaccacacuaucuugguuacuguaguuuuacagcaaguuuugaaacugaaaacuaugaguccuccaauuuuguuaguuuuggcuau

SEQ ID NO: 16567 - RNA, 98 nt, Human
guccagauaauuccaggccaggcacgguggcucacgucuguaaucauagcacuuugggacuacaggcauaagccaucaugccuggcuuauuucuagac

SEQ ID NO: 16568 - RNA, 82 nt, Human
guuuuauuuaaacuuuuuuguaauucaaguaaaaaaaaagcuguuuuuuaacuacuguuacauaaaaaguggaaagugaggc

SEQ ID NO: 16569 - RNA, 74 nt, Human
aggccaggcacgguggcucacgucuguaaucauagcacuuugggacuacaggcauaagccaucaugccuggcuu

SEQ ID NO: 16570 - RNA, 82 nt, Human; identical to SEQ ID NO: 16568

SEQ ID NO: 16571 - RNA, 87 nt, Human
ggacacagccuccuuugcugcuagugucgauaucuucuuuaucaacaaguuuacgaucacugucaguuucccuggaguacuuaaucc

SEQ ID NO: 16572 - RNA, 85 nt, Human
uguccuugauuauuuguuaaaaucugcuagaaaaguaacaggaauguuaucaagccuuucuagacauuuugaacacaaucugaca

SEQ ID NO: 16573 - RNA, 66 nt, Human
ucggcucggggcaaacucgcucuuggacuugguugucuuuggucaggcaugugcccugagcaucga

SEQ ID NO: 16574 - RNA, 103 nt, Human; identical to SEQ ID NO: 294

SEQ ID NO: 16575 - RNA, 61 nt, Human
gcuuuaaauuuuuguacuuugcugaaaauucuuuuucccagggucuauaaaacauuaauuc

SEQ ID NO: 16576 - RNA, 94 nt, Human
ggguucuuuugucuuuaaaucaauaaguaaucuaggacuagcauuauguuugcuagaccuggcauuugcucgggacauaagguucaaaguuucc

SEQ ID NO: 16577 - RNA, 84 nt, Human
guuuuucgauguuuagauauuuuucuucggggaagcacaaguuucuuuucauggucccugaucaauuuuaaacaguuggaacac

SEQ ID NO: 16578 - RNA, 96 nt, Human
uuuauaauucaaauuacguuggcuugcucaauuaucaauucuguuacuuaaaacaaaacugacauucugagcuauuccacaguaaagaauuacaaa

SEQ ID NO: 16579 - RNA, 82 nt, Human
gcccuugugccaguugcucuugcagguguaggaggugcgacaaucuucccaccauugcucacaguccucuuugcacaggggc

SEQ ID NO: 16580 - RNA, 96 nt, Human
ggaaaggccaggcugcccagggcccagccccacucauggcugcagcauagaaccucgccaccuccucauugggguugcccugggcugggucgaacc

SEQ ID NO: 16581 - RNA, 76 nt, Human
ggagugcaguggcguggucucggcucgcugcaaccucugccucccagguucuagcgggucucaugccucggccucc

SEQ ID NO: 16582 - RNA, 63 nt, Human
ucuguguuugaagugucuauugggcuagcaugguuagaaauagaacauuaccaucauugcaga

SEQ ID NO: 16583 - RNA, 65 nt, Human
uguggcuauuuaaauucaaguuaguuaaaauuaaauacauuuuaaaauugagucccuuagucaua

SEQ ID NO: 16584 - RNA, 61 nt, Human
acguggccuggggggagcugugacuaccuggugguggacacugcccccgugggaccuccgu

SEQ ID NO: 16585 - RNA, 68 nt, Human
cggggacagcggucacugcugggccuuccacguccacccccacgaaggauaacagcaaaaugucccug

SEQ ID NO: 16586 - RNA, 69 nt, Human
cugagugcccggggccagguaucugcaaggaugagaaacgcacacguaaacugacgcccguccgcucgg

SEQ ID NO: 16587 - RNA, 62 nt, Human; identical to SEQ ID NO: 6784

SEQ ID NO: 16588 - RNA, 92 nt, Human; identical to SEQ ID NO: 6785

SEQ ID NO: 16589 - RNA, 69 nt, Human
aucucccaaacucauuucuucaucuacagucaccucccuguaucccugaacaccuggguauugggagau

SEQ ID NO: 16590 - RNA, 81 nt, Human
gaggaccaagacugacacagacucucuucuguuucccuuaucuccuuuccaaaguaagucugugaaucuacccugguccuu

SEQ ID NO: 16591 - RNA, 63 nt, Human
gggcccacaguagguacuccuccaggggcagcucuucuugguccauauccugcccaucugcuc

SEQ ID NO: 16592 - RNA, 113 nt, Human
aggugugucucaggaaggugguucugugcaugccugggugugguuaaggcguggccagaaggcuucccuggugcucucaguccaggcaaagcccagagcaucugagcacgucu

SEQ ID NO: 16593 - RNA, 60 nt, Human
guuugaacguggugaaacaggguguaguucuuuuccacauucugugucaucuagucgugc

SEQ ID NO: 16594 - RNA, 87 nt, Human
acgggggaacaacacaggagagaaauaguauauacagccacgacugcuguugccgcugacuauaaaacaaaccuguguugucucugu

SEQ ID NO: 16595 - RNA, 68 nt, Human
agcugccuugaggcuccuggacugcguccuuaccaacauucgguccaauggaaggccuuuuggcugcu

SEQ ID NO: 16596 - RNA, 61 nt, Human
ccaauugggggcuuggacuguaccguugccacugggcaugugguuuuaagcccgggagugg

SEQ ID NO: 16597 - RNA, 78 nt, Human; identical to SEQ ID NO: 13410

SEQ ID NO: 16598 - RNA, 76 nt, Human
cauccgcagccaggccucccugacaacccagcaggccaucggccugaagcauuacagugacuuccuggaacguaug

SEQ ID NO: 16599 - RNA, 65 nt, Human
cucauuaugcuuuuccuguagaacaaaacaaguaguuggguuuaucugcaauuaggguuuuugag

SEQ ID NO: 16600 - RNA, 87 nt, Human
gugaggguggcuggacaaguuggguagaccugcaaaagggccagcggcucucugcauggcucuggccauccggcacuuucccuugac

SEQ ID NO: 16601 - RNA, 97 nt, Human
gagcccggcacgccacaggacccguggcacauucccggugugccugagccgugcacgccacaggacccguggcacauucccggugugccuugagcuc

SEQ ID NO: 16602 - RNA, 76 nt, Human
ucaccagcuuccuggagcugcacugccuugagagccccacagagcugucucagagcagcgacagugaggccgguga

SEQ ID NO: 16603 - RNA, 67 nt, Human
uggccuguuugauuccugucagagguuugcugacccaagacaguaucgaaaaugcauauuaagguca

SEQ ID NO: 16604 - RNA, 73 nt, Human
gggcccauucuugcuucucaggcaccuuccguuuauuaauugccauugcuccugacaucacuaagaugggucc

SEQ ID NO: 16605 - RNA, 63 nt, Human
cauucuuaauucgagccacagucugggucacaagguggggagggcaggaaagaaucgggggug

SEQ ID NO: 16606 - RNA, 71 nt, Human
ggaggaaugcgggccuggccuggcauguggggcgacucuggucugggcgggcaggcgggcagcauuccucc

SEQ ID NO: 16607 - RNA, 73 nt, Human
uauuggauugccacacuggucugauugccugcaaguuuggugaggcugaggcaaagaaugguggcgucuggua

SEQ ID NO: 16608 - RNA, 79 nt, Human
gaugaucuucuacugaaaugccuaaagaagucacaggcuggcuucuguuuuauucagggauuuuuuuaaaaagucaauc

SEQ ID NO: 16609 - RNA, 76 nt, Human
uacaaagguaauauuguauuaaaaucauguuuaagauagcugcuuuuauguguauuuuauauugcaugcuuuugua

SEQ ID NO: 16610 - RNA, 94 nt, Human
gccuucucagaguacggcucaggcuugggggccggcugcuuggggguccgguugagguggaccccaagccugagccguccuucucagaguacgc

SEQ ID NO: 16611 - RNA, 67 nt, Human
ggagggcuggggcggugcaggcucugggacccaggggccaggguggcucuucucuccccagcccucc

SEQ ID NO: 16612 - RNA, 70 nt, Human
cacaaagaauagcaagaaugaaaauuacucagauacaccucugaauuugucuccugcuaaauauuuugug

SEQ ID NO: 16613 - RNA, 90 nt, Human
gcaguuguugauuaaauguauuagcaaauuuugaaugaaaugcaaauuucauuagaaauuuagccauuagauaaagucagaaaguacugu

SEQ ID NO: 16614 - RNA, 66 nt, Human
gcucaaaaaauuuagccgcugcguuaagccaugaugguaacggaggcaguggaaccaaucgugagc

SEQ ID NO: 16615 - RNA, 67 nt, Human
gucauucaagaguugcuuguggacuacuaugugaaagauacaagacacaaauguaacuucugaggac

SEQ ID NO: 16616 - RNA, 67 nt, Human
acucacgaagauaguauuggaaccucccaacauaaaaguugguaggacuccgagaugaccaaggagu

SEQ ID NO: 16617 - RNA, 62 nt, Human
ggacccccucggucuaccauguuggcaugucaacaguuucagccaaugugcccgugaagucc

SEQ ID NO: 16618 - RNA, 60 nt, Human
gggauucugugacaggcagcugaaccuacggcugcugaagaaacacaauuacaauauccu

SEQ ID NO: 16619 - RNA, 85 nt, Human
gaccuguucuguuuuaucuucugucagcuccucuggugcuaugccugugguacugauugagcuaaagaagaaaagagaggagguu

SEQ ID NO: 16620 - RNA, 61 nt, Human; identical to SEQ ID NO: 544

SEQ ID NO: 16621 - RNA, 64 nt, Human
gucuucucuaagaaauuuuagaauggacauugaacaaaguuuauacaaauuugagggagaagau

SEQ ID NO: 16622 - RNA, 72 nt, Human
gcccagcccucaccccuaagggggggccgaacgugcacacguguggccccagcggugaggacaaaacggggc

SEQ ID NO: 16623 - RNA, 62 nt, Human
auggugacaacaugcuggagccaagugcuaaauggcuugguucacggauggcaagucaccgu

SEQ ID NO: 16624 - RNA, 71 nt, Human
guggcacacaagugugagacaggcggguugucucaaaagcccggcuauugcguugcaccacuuugcgccac

SEQ ID NO: 16625 - RNA, 83 nt, Human
agucuuacuauguugcccaggcugguccugaacucuuggccucgagagauccugcugccucaaccucccaaguagcuaagauu

SEQ ID NO: 16626 - RNA, 74 nt, Human
cacucuguaacccaggcuagagugcaguggugcaaucauagcuuacuaaagccucaaacuccuggguucaagug

SEQ ID NO: 16627 - RNA, 65 nt, Human
gccacgcgcaggucggggcgguacuuguucuugcggaucaugugucugaugcugcugagcguggc

SEQ ID NO: 16628 - RNA, 100 nt, Human
ccgugcaccucaucgacaagcuuccacugcccgucaccaucaagagccaccucaaguccuucucgauggccaacggcaugaacgcggucaugaugcacgg

SEQ ID NO: 16629 - RNA, 85 nt, Human
cucuugguguaugacaucaccaaccgcugguccuuugacggcaucgaccgcuggaucaaggagaucgaugagcaugcacccggag

SEQ ID NO: 16630 - RNA, 68 nt, Human; identical to SEQ ID NO: 6117

SEQ ID NO: 16631 - RNA, 77 nt, Human
uaugguguagcauauuuacauagcauuuuauaugguaauggguauuauaagaaaucuagagaugauuuaacauuaua

SEQ ID NO: 16632 - RNA, 69 nt, Human
guguuucucccucaaucaaaaguucaaaucagcuuuauguuaagcagcugggaggagaggggggaagac

SEQ ID NO: 16633 - RNA, 91 nt, Human
gugaagacacgggagaaaauccaccauaauaaaacugacauucaauuuucaacuuuaguuauuuaacacagauuuucuuuauucucuuuau

SEQ ID NO: 16634 - RNA, 79 nt, Human
ugagacgggguuuggcucugucgcgcagagaucgugccacugcaauccagccugggcgacagagcgagacucugucuca

SEQ ID NO: 16635 - RNA, 78 nt, Human
gaugcacuuguccguucccauagccugcugcuaugauccccugccacagcugcacagaggggcacggaacuccaaauc

SEQ ID NO: 16636 - RNA, 80 nt, Human
gcagacacacagaagccgaguauugccgucaccaugucagcacacaauccuguccugggcagcucgguggcaaugucugu

SEQ ID NO: 16637 - RNA, 63 nt, Human
caagagcugcccaagcggcugguaucugcuacaucaccagcacauuugccagcuguagccuug

SEQ ID NO: 16638 - RNA, 77 nt, Human
guuucagagcauaacucgauugcccaucauccugaaagggauuuugacaaaagaggaugcagaguuagcugugaagc

SEQ ID NO: 16639 - RNA, 125 nt, Human
ucuaugugcauccagaccugcagcugaacaaacaguugauccagaggguagaaucccuagguuucaaagcuuugguaauaacuuuggauacaccuguauguggcaacaggcgacaugacauucga

SEQ ID NO: 16640 - RNA, 67 nt, Human
cccaauacaucauagagggcagucagcucaauuagggcuaaauggcaaacuuucuucauguccuggg

SEQ ID NO: 16641 - RNA, 69 nt, Human
gcugucaauggaacgcaaaaaagaccagaaucuuuuguuuugauuuucacagcuuuuuguuguuucagc

SEQ ID NO: 16642 - RNA, 71 nt, Human
guugcugcuucuugguuggaagauucuggacagccugaaaggcuuugagauacuccacacugagcaguggc

SEQ ID NO: 16643 - RNA, 80 nt, Human
cccugacagaaugguggugcgggauuguuaaagguuuuuaacccuuccaauuaugaccgguuauaccaccucccgaaggg

SEQ ID NO: 16644 - RNA, 67 nt, Human
cggcccguaggcgucuggcagcccggcgccaucuucaucgagcgccauggccgcagccugcgggccg

SEQ ID NO: 16645 - RNA, 61 nt, Human
ggacuuagauaucgcauacaaaauuuggaaaaauguggugagcugugaaggcuaugagucc

SEQ ID NO: 16646 - RNA, 74 nt, Human
ucuuauaccccaaaagucauacagugucagaacaaaggcugggauggguaugauguaacagugggaauguaaga

SEQ ID NO: 16647 - RNA, 68 nt, Human
ggguggugcagcuggcgaccugggcgggagcugauguucuaguuugaggacugugcagcuggagaccc

SEQ ID NO: 16648 - RNA, 66 nt, Human
aggucagugcauggaaaguuacuaacaggaaacaucaaguuagggggacucgugcuaaacugacuu

SEQ ID NO: 16649 - RNA, 78 nt, Human
uguaagucaugacuguuaucacaggggagagagauuaggcucaacucugaauacagugaagacaauuggggauuuaua

SEQ ID NO: 16650 - RNA, 89 nt, Human
acuguuuaaaguuaacacuuguuuaaauuuuuuuacacuauagcauuuaugcaaugguuuacagaauucauggaguuauuuuuaucagu

SEQ ID NO: 16651 - RNA, 60 nt, Human
ggcgggcacggggcguaggagcuggcuggcggccggcucugcauguucuuguugccuguc

SEQ ID NO: 16652 - RNA, 71 nt, Human
uuacaugagaauguuauuugaauggaauuuucuuaacccagaagguaguauuuauaaucauuuacuuguag

SEQ ID NO: 16653 - RNA, 96 nt, Human
gaacacuguuugaguacguacuguaugcagaccaguugcugugagauaaucuauacuacuguuccugucucaguaaaauuagaugggcaaguguuc

SEQ ID NO: 16654 - RNA, 107 nt, Human
uaaauaagucauauagguaauuauuguccaacacauguuuaaguaaaguauaugauaauuggauccauguguaugugggaaaagcuguaccuguuuuuguuuauuug

SEQ ID NO: 16655 - RNA, 69 nt, Human
gcaucuucaucuuggucaccacgccagagaggauccgcccucgaauggacacauuaccagugaaggggc

SEQ ID NO: 16656 - RNA, 76 nt, Human; identical to SEQ ID NO: 758

SEQ ID NO: 16657 - RNA, 94 nt, Human; identical to SEQ ID NO: 6788

SEQ ID NO: 16658 - RNA, 66 nt, Human; identical to SEQ ID NO: 1983

SEQ ID NO: 16659 - RNA, 69 nt, Human
gagaaagguacacaguugcccgguugggaaugugcuuggcgcugacccugcgggcaucugacuggucuu

SEQ ID NO: 16660 - RNA, 81 nt, Human
ucagcauuccuuacuaugugauaaaauacauauagaauauaagauauacuauauacauuuuguccauaaacguuaugcuga

SEQ ID NO: 16661 - RNA, 70 nt, Human; identical to SEQ ID NO: 1713

SEQ ID NO: 16662 - RNA, 81 nt, Human; identical to SEQ ID NO: 1712

SEQ ID NO: 16663 - RNA, 67 nt, Human
ggaagcgagcgagcgcuucgcugccggcuacauccagugcaugcacgaggugcacacguucgugucc

SEQ ID NO: 16664 - RNA, 76 nt, Human
ggagugucuuggaggccuuggugaccaaugccagcagaguccugcggggugugggcccggccucccuggauucucu

SEQ ID NO: 16665 - RNA, 70 nt, Human
ggcugaacugagucaggcuccugcugaggggcccgauuggugcccgcagccugggcagcugaccacagcc

SEQ ID NO: 16666 - RNA, 86 nt, Human
gucguguccuacccaugcgcgucccggcggagcgggcaugcgccaccgcggcgccuggcgggacgugugggccgugaggauaggac

SEQ ID NO: 16667 - RNA, 71 nt, Human
gcgcagcacgcuuuccgcaccuucgacaagaacggcgacggcaccaucgacuuccgggaguucaucugcgc

SEQ ID NO: 16668 - RNA, 60 nt, Human
ggacaagaucuucaagaagauggaccaggauaaggacgaccagauuacauggaggaguuc

SEQ ID NO: 16669 - RNA, 78 nt, Human
uuugagauguacgaccuggacggcgacgggcgcaucacgcgccuggagaugcuggagaucaucgaggcaaucuacaag

SEQ ID NO: 16670 - RNA, 75 nt, Human; identical to SEQ ID NO: 74

SEQ ID NO: 16671 - RNA, 87 nt, Human; identical to SEQ ID NO: 76

SEQ ID NO: 16672 - RNA, 71 nt, Human; identical to SEQ ID NO: 77

SEQ ID NO: 16673 - RNA, 61 nt, Human
cugaagcugaagggccccugguuuggacaugccucuuucccgggcucucuucuggcuccag

SEQ ID NO: 16674 - RNA, 69 nt, Human
gagcaaaucaacaugaggcaugaucugaguuauucugaagaauuagagaggcugaaugguaccuugcuu

SEQ ID NO: 16675 - RNA, 60 nt, Human
agcagccucuugucacagcuugacuccuagguagugugccuagugaccaagagggcugcu

SEQ ID NO: 16676 - RNA, 101 nt, Human
ugaggcaggagaauugcuugaacccgggaggcggaggcugcagugagccaagaucgcuccacuguacuccagccugggcgacagagcaagacuccgucuca

SEQ ID NO: 16677 - RNA, 74 nt, Human
cuggauucagccugggccugggcagugggcaggggcugugcgccacccccgguaacaggcccaggcgguuccag

SEQ ID NO: 16678 - RNA, 66 nt, Human
gcaggugaagccgcugccugcgccccuggauggacagcggaagaagcgaggcggcgcagguaccgc

SEQ ID NO: 16679 - RNA, 83 nt, Human
gccuagccuggccucuucuacgugguagagugcuuagagaucacgccagcaccuccauccacucuaagugggcgggcuguggc

SEQ ID NO: 16680 - RNA, 66 nt, Human
gcugacaggagcuuugguagucacacaugccugacggggugcacaggaccacagucucugaaaggc

SEQ ID NO: 16681 - RNA, 66 nt, Human
aacuggaucacacugcauaugucccacaaaagaaagcacaauguacaaaaugugcauguuucaguu

SEQ ID NO: 16682 - RNA, 66 nt, Human
uuuuugucacuguaacuauuuuuauuacauuacaauaauuaggaguaguacaguucaugacaaaaa

SEQ ID NO: 16683 - RNA, 68 nt, Human
gggggagucagguugucagcucagcaagugugcagaaaacacuuggaagagggucggcuuuauccucc

SEQ ID NO: 16684 - RNA, 82 nt, Human
uuguccgcucccagauguguaguacugauuaugaccagauucuaccugauuguuauucuugggcugaagaggggggggagaa

SEQ ID NO: 16685 - RNA, 70 nt, Human
accugcgacugagcgaugccgucggggaccagguacuggccgugguuuaacggguccugcgguggugggu

SEQ ID NO: 16686 - RNA, 68 nt, Human
gcaucuuacuuuauuuuaaaauuaucugccucccuguagguaucauuuuuugaaggggguuaaccugc

SEQ ID NO: 16687 - RNA, 87 nt, Human; identical to SEQ ID NO: 76

SEQ ID NO: 16688 - RNA, 65 nt, Human
uacucaggggcuuauuaugcaccgugguaauacucagaccaguuacuccacagaaguuccgagua

SEQ ID NO: 16689 - RNA, 67 nt, Human
aggacugguucgcuugguuuauagcagugacagccguucaugcacagcugcuucccaacccaguccu

SEQ ID NO: 16690 - RNA, 79 nt, Human
ugucugauaaccacacuaauucaucugcuuccagguuacagcuccgucuagcagcaagguugaaaagguuaaaaaggca

SEQ ID NO: 16691 - RNA, 63 nt, Human
aguuucccaauauguagaagaagccauuaagauggcuuacugugacaagcaaauguggaaacu

SEQ ID NO: 16692 - RNA, 76 nt, Human
ggaagcaaagaugacuuccucauauaugauagauguggccgucugguauaucaucuggguugccuuuuugccuucc

SEQ ID NO: 16693 - RNA, 64 nt, Human; identical to SEQ ID NO: 1777

SEQ ID NO: 16694 - RNA, 64 nt, Human
uucuuauauggucgguaaucaucaaggaaucucuucucgauuuaaaauacacacaucuuaagaa

SEQ ID NO: 16695 - RNA, 62 nt, Human
cgggaaauuguccauuugaccuuagccggauggcagcaaagagaaggugggcaaguucugug

SEQ ID NO: 16696 - RNA, 67 nt, Human
guaucugggagucaggaugguccagcuaugugaugcuuaggaucaugguuaacguuucccacgguau

SEQ ID NO: 16697 - RNA, 75 nt, Human
guccugugaguuuacuggggauauucuccguaacaccggugucugaggauaugcuuggucggguauucaauggau

SEQ ID NO: 16698 - RNA, 67 nt, Human
auuuuuccuuugauuuucucuucucagucauaaguggaaauggaagggauucauucaaagguaaaau

SEQ ID NO: 16699 - RNA, 65 nt, Human
gaucuaucacugggacagaaggaagaugaaaacauuuacuucagacuguuuacuacuguucgauu

SEQ ID NO: 16700 - RNA, 105 nt, Human
gcaaagucuucccagaggugaaguauucaggcugaucuggaacucuggcuggauaauggagaagagcaaucugggcacuguuaccacugggcagaaugacauggc

SEQ ID NO: 16701 - RNA, 86 nt, Human; identical to SEQ ID NO: 9719

SEQ ID NO: 16702 - RNA, 75 nt, Human
uacgggcuggcgcgaccuuucaggccugugcugccccgccugcggcugcgagggguugagaacgccuagcccgug

SEQ ID NO: 16703 - RNA, 81 nt, Human
ccgugcuccugugauuaaugcugugagcaacaggcaugguggccagugccugugcucgaaccgugacaaucacacauacgg

SEQ ID NO: 16704 - RNA, 88 nt, Human
gguggcccaagcguugccugcagguugauggcaggggcacgucaaggcguaacccuggaucugcgcauugcuggaccuaugggccacu

SEQ ID NO: 16705 - RNA, 84 nt, Human
cccgaucugccuccagucucggacuugguuguugcgcgcuccggcuccggcugagcugggagaguuggaggagguguuuucggg

SEQ ID NO: 16706 - RNA, 60 nt, Human
cuuggugacaaauauguuguguaaaguucaggggagaguccgccacauguuguucccagg

SEQ ID NO: 16707 - RNA, 75 nt, Human
agugugauaucaagaaagggcuucaccaggaugaucaaugcaaauggauauggagcuuucuuggaaugaaacauu

SEQ ID NO: 16708 - RNA, 74 nt, Human
cagaagucucccugcugaaucgaaaggaagugcuacaauauucuuucaaauucaucgcaguugagagaaaacug

SEQ ID NO: 16709 - RNA, 62 nt, Human
cuucucuuaaucugccuuuggucuguugauuuucagugaacaaucagagaguaaaggggaag

SEQ ID NO: 16710 - RNA, 118 nt, Human
auuuaacugggauucacugucagcacaacauaaaugaaugcgaaguugagccuugcaaaaaugguggaacuauguacagaucuuguugcuaacuauuccugugagugcccaggcgaau

SEQ ID NO: 16711 - RNA, 62 nt, Human
gagcucuuuuuggacuccaaaaaugguaucccuacuaugcacgucuuaauaagaaggggcuu

SEQ ID NO: 16712 - RNA, 61 nt, Human
agugcaaacacaucuucuguuuaacccauugguauacacagaauauuccugugcccacacu

SEQ ID NO: 16713 - RNA, 80 nt, Human
augucaaucuauaauuuuaaccauuuauccaagauucuacuaaguguaaaauuauuuaauaauggcuauuaaauugauau

SEQ ID NO: 16714 - RNA, 60 nt, Human
ucgaacaacugaaagaacaagcagcaacuggaaaacagcuagaaaaaaaucaguuggaga

SEQ ID NO: 16715 - RNA, 98 nt, Human
gaggcagagaauugcuugaacccaggaggcagaguuugcagugagccaagaucacaccacugcacuccagcuuggacgacagagcgagacucugucuc

SEQ ID NO: 16716 - RNA, 64 nt, Human
accacgcagaagaggugcagugugauggcaggagcuuccaccgcugcugcuuucucugcauggu

SEQ ID NO: 16717 - RNA, 74 nt, Human
gccacagcccuuaggggaguccagggccagcuggucgaaagugaggaucuugcccccugcccugaggaugcggc

SEQ ID NO: 16718 - RNA, 64 nt, Human; identical to SEQ ID NO: 1375

SEQ ID NO: 16719 - RNA, 61 nt, Human; identical to SEQ ID NO: 2204

SEQ ID NO: 16720 - RNA, 80 nt, Human; identical to SEQ ID NO: 12407

SEQ ID NO: 16721 - RNA, 85 nt, Human
aagcagcuucaauucugccgggacuucucccgccuuuuuuuuccugcggcgggagaaguagaugaagccagugauuaggguguuu

SEQ ID NO: 16722 - RNA, 67 nt, Human
ccgagauggaggccaaugucgugggcugcuacuggcccaacccccuggcccagggcuucaucaccgg

SEQ ID NO: 16723 - RNA, 92 nt, Human
ugggaaggcuuucgcagacaugaugggcaagguggacgucugaaaguggugcaaccuguccgaguucaucguguacuaugagaguuucacca

SEQ ID NO: 16724 - RNA, 91 nt, Human
cucuagcgugauagucucuucuggguggcugcauccucaggcaggcuccccuccuagucccacauccaggaugacaccuuaacaguuaggg

SEQ ID NO: 16725 - RNA, 66 nt, Human
cuccagaguagcguaggacuucaggcaugcaccaccaugccuggguaacuugcguauuuucgguag

SEQ ID NO: 16726 - RNA, 65 nt, Human
gaacgaccgugcucguuaucuuuauccguucguguucaugagaguaaggucucugcacaucguuc

SEQ ID NO: 16727 - RNA, 60 nt, Human
auuuuaaaauuagcucaucaauuucugcaaaaaaauaaagaagccagcugauauuuugau

SEQ ID NO: 16728 - RNA, 114 nt, Human
uaacuauuuaaguuuuccaaauuuaugaacacaggaugucuucccauuuauuuaagucgucucuaauuucuuucaaugauauuuuguaguuuucaauguagaauucuucuguug

SEQ ID NO: 16729 - RNA, 106 nt, Human; identical to SEQ ID NO: 14525

SEQ ID NO: 16730 - RNA, 106 nt, Human
gcauauauuucagcuuaugcugaagaauuagcuguauguagcgcguugaaucauaucuugcagggccauauacggguacaucuucagcauaagcugaaauauaugc

SEQ ID NO: 16731 - RNA, 63 nt, Human
ggcucgaucacagcucaccaccgccucaaccuccugggcucaagugaucuuccugucucagcc

SEQ ID NO: 16732 - RNA, 73 nt, Human
aguuuauccacguuacaaaagcauauuugucucuccucugaguaagaaugcuguguuccuucgcuggacaacu

SEQ ID NO: 16733 - RNA, 64 nt, Human
ugucaccauccagcaugaguuucugaauaauuucucucacuuuauauccuguuggcuggcgaca

SEQ ID NO: 16734 - RNA, 90 nt, Human
aaacuuaacaaugaaggcagaagaagaacauaguagaaacaauuacuacaaacauuuuagcuuccaauuucauauaauguuauacaguuu

SEQ ID NO: 16735 - RNA, 62 nt, Human
uuuuuuugguauuuagaaauuuuuuuaauugaaauuuugaaaauuuuuugacucuaaaaagg

SEQ ID NO: 16736 - RNA, 94 nt, Human
ccuuuaagauauccaucuuuuucuuuuuaacccuaaucuuucacuugaaagauuuuauuguauaaaaaguuucacaggucaauaaacuuagagg

SEQ ID NO: 16737 - RNA, 101 nt, Human
cacgaggucauuuaaaaguucauuuugagggaauaacauguaauauaauuugaaauaaagguauaguaaccuuaaaaagaacauuauaacugauuguugug

SEQ ID NO: 16738 - RNA, 64 nt, Human
ggugaauuuguuaaaaugaguaacuuugauaaaguuuuucaugcacaggcaaaauguauucacu

SEQ ID NO: 16739 - RNA, 60 nt, Human
uaaacaugauguugagauuauuauauacuguauuuucuucuaaauuaacccuaauguuua

SEQ ID NO: 16740 - RNA, 113 nt, Human
gucaauuuuuauucuuuucauaaaaccucuuuguaaacauguaccuuuucuucccaucaaaaaugcauuaacaagaucaugcuuauaguuagucagcacaagaaaaaaacgac

SEQ ID NO: 16741 - RNA, 61 nt, Human
uauauguacaagcaagaagucaauuuuuauucuuuucauaaaaccucuuuguaaacaugua

SEQ ID NO: 16742 - RNA, 77 nt, Human
uuuggggauuuuuuuuuaaccuuuauucauucagaaugcaauucugggccacucuacaaccaagagaaaacccuaaa

SEQ ID NO: 16743 - RNA, 69 nt, Human; identical to SEQ ID NO: 10301

SEQ ID NO: 16744 - RNA, 70 nt, Human
auaaauaaugaccuaauuucauuuaaaaaaugguuucagcaaauaugaaaauagaaaguccguuauuugu

SEQ ID NO: 16745 - RNA, 85 nt, Human
cccucuccccagcucuccucccccuggccccgucgccccgcccucgccgggcugggcugcggggucaggggccgagcggagaggg

SEQ ID NO: 16746 - RNA, 71 nt, Human
gcccucgaggcccccgcagucccaucauucaguuccguagggucaccggcgcggcaguggccucgcagggc

SEQ ID NO: 16747 - RNA, 60 nt, Human
guauaaaugugugugugauauauaugugugguguguauguguaguguguauagugugugc

SEQ ID NO: 16748 - RNA, 64 nt, Human
auucuuaaucuuagugaaauucugaaauacuugauaauucuuuaaaagcugucugguuaagaau

SEQ ID NO: 16749 - RNA, 87 nt, Human
ggaaaugguuauugaaucagauagaccaguucuguugagggucuuaaagagucucaauuuucucaucuauaaaaccaauaccuuucc

SEQ ID NO: 16750 - RNA, 70 nt, Human; identical to SEQ ID NO: 3865

SEQ ID NO: 16751 - RNA, 62 nt, Human
gguguuaacuaaugcacucaauagugaucacaaagaauacaggaagugccaaguucaaugcc

SEQ ID NO: 16752 - RNA, 61 nt, Human
accguaaccuuuguacuuguuuuccuccuggggaaagugucagaacagugcaaggacuggu

SEQ ID NO: 16753 - RNA, 65 nt, Human
aguguaaaagcuagagauuuauuguuauuuuaugauuaauaaauugucaaauuaguuaugacacu

SEQ ID NO: 16754 - RNA, 68 nt, Human
gaggcauaaagcagaaagagcaaagacacaugaauacccuucuuaacaaucucuucuacuuaugccuc

SEQ ID NO: 16755 - RNA, 66 nt, Human
gagacgggguuucaccauguuagcaaugauggucucuaucuccugaccuugugauccaccugccuc

SEQ ID NO: 16756 - RNA, 128 nt, Human
gccuccuguaacagucgccuuuuguguucugcuggcauuuguuugaacacaguccacagguucagugguugcaucucuaaucagcugccaguccccaucccagacauucuuugcaucuaagcugaggu

SEQ ID NO: 16757 - RNA, 92 nt, Human; identical to SEQ ID NO: 3187

SEQ ID NO: 16758 - RNA, 60 nt, Human; identical to SEQ ID NO: 3188

SEQ ID NO: 16759 - RNA, 75 nt, Human
acucaccauuuuacuacuucuaucuuuuugacuuuccaagaauguccuagaguuggagugguacaguaugugggu

SEQ ID NO: 16760 - RNA, 60 nt, Human
cuaaaguccauaguuuacauuagaguucauucuuugaguuucacggauuauggguuuugg

SEQ ID NO: 16761 - RNA, 65 nt, Human
agcgccggcuaugccccuguauuggauugccacacgggucacauugcaugcaaguuugcugagcu

SEQ ID NO: 16762 - RNA, 65 nt, Human
uucuugaagucugggugaugcugccauugugauaugguuccuggcaagcccaugugugucgagag

SEQ ID NO: 16763 - RNA, 63 nt, Human
guaaaucgcgaugugugcagcccguugcucauucugugucuugcaccguugccagccauuugc

SEQ ID NO: 16764 - RNA, 86 nt, Human; identical to SEQ ID NO: 7823

SEQ ID NO: 16765 - RNA, 69 nt, Human
gcgucgggaucucggccccgggaggcguuccgucgggcgcagccgcgaagaugccguuggaacugacgc

SEQ ID NO: 16766 - RNA, 79 nt, Human
ucaguugcuaugaagccagcuaccagccccucgaccucgacagaugcgacagggacuugucgcugaucaaugugauuga

SEQ ID NO: 16767 - RNA, 71 nt, Human
cgcuguaaagaaguucuugaguggcguguaaaauacagcaaauacaaaccauuaucaaaaccuaaaaagug

SEQ ID NO: 16768 - RNA, 91 nt, Human
gacagugaaggauucuuaucacauaaugugcaggccaugugccugugaacuugaaguuugcgcaaaauguggaaagaaagaagacauuguu

SEQ ID NO: 16769 - RNA, 65 nt, Human
ggugaauaauuuuucaauugggaaucuuuucauaauucaaaauaguuccugaaaauuaaugcauc

SEQ ID NO: 16770 - RNA, 66 nt, Human
ucaaugucuucuacuuaagcugggugcauuuaaaaugcaacacaauucuuugaaaggagacuauga

SEQ ID NO: 16771 - RNA, 70 nt, Human
ggcucucggccuuggcaacggccgucgucaugguuacuggccccuaggcgccgauggccgaggccgcgcc

SEQ ID NO: 16772 - RNA, 76 nt, Human; identical to SEQ ID NO: 8409

SEQ ID NO: 16773 - RNA, 94 nt, Human
cauaaaaaucccuguguccuaaagucauggcgugcucuauuucauggucauuuguagagcacagcagcacugugccugucagggaaaaggugug

SEQ ID NO: 16774 - RNA, 88 nt, Human; identical to SEQ ID NO: 8410

SEQ ID NO: 16775 - RNA, 96 nt, Human
ggacaaagggucaauccacaaauuugucccuuaccugauugcuggcauccaacacucaugccaggacauugugugccaagagcuugacccaagucc

SEQ ID NO: 16776 - RNA, 75 nt, Human
ucauugcugauggaggaauccaaaaugugggucauauugcgaaagccuuggcccuuggggccuccacagucauga

SEQ ID NO: 16777 - RNA, 79 nt, Human; identical to SEQ ID NO: 1810

SEQ ID NO: 16778 - RNA, 61 nt, Human
acuccaccugaagauuaucggcuauaagagaauaagaauugccgacacauaacagugaagu

SEQ ID NO: 16779 - RNA, 68 nt, Human
cccuugacuuaacuuuuuaaccaaguuguuuauuccaaagaguguggaauuuugguuggggugggggg

SEQ ID NO: 16780 - RNA, 64 nt, Human
ucuugauguucagacauuuauguguugaaaauuuuuuaaauauuuaaauguacuuauauuaaga

SEQ ID NO: 16781 - RNA, 65 nt, Human
cgggagagacucuuuggaguucagagagauaggugagacucuaacugccaaagaguaucauuucg

SEQ ID NO: 16782 - RNA, 66 nt, Human
ccaauuacuucauacccuuuuuggagacugauuaugcacagcugcaacaucuuaugaaaccuaugg

SEQ ID NO: 16783 - RNA, 113 nt, Human
uuggucauuaucuugagcagugaccauuacuagaucauguuaaauuagcgaaugcuguuacugaauacgcuaacccauguguugcugaugagucaacugacaauugugaccaa

SEQ ID NO: 16784 - RNA, 84 nt, Human
gauucccccaggugggcgaagcggugggaagaaaccuucgguugguggaggcgguuccagucuguugaaaccccuuggggaauu

SEQ ID NO: 16785 - RNA, 91 nt, Human
gcacucuguguccagacuuuaacuaaaggcggauuucccgagacuacgggugugcuguuagaaggguucugggucugugcacuaaagaggu

SEQ ID NO: 16786 - RNA, 110 nt, Human
gcacugaagauggcggcugcuguaggacgguugcuccgagcgucgguugcccgacaugugagugccauuccuuggggcauuucugccacugcagcccucaggccugcugc

SEQ ID NO: 16787 - RNA, 68 nt, Human
guggauucccacuuuagccaucugugccuggauaaauacaccaagaaagaauggugguugugggccac

SEQ ID NO: 16788 - RNA, 65 nt, Human
ccaggaaccauucaaguaaauggccauggaggacagccaucaaaacuugugaagaggggaccugg

SEQ ID NO: 16789 - RNA, 79 nt, Human; identical to SEQ ID NO: 1810

SEQ ID NO: 16790 - RNA, 60 nt, Human
cagccuugugugaaaaugccuucuuccucuuuaagaaaaaggacaauuuuuaagcugcug

SEQ ID NO: 16791 - RNA, 92 nt, Human
gcagguauguuacgaaguuuagggggaauuugcuaagccgggagcauauggcuuggcgugcaagugcuggaugaaacuuauaacaugccugc

SEQ ID NO: 16792 - RNA, 71 nt, Human
ggaauggugacaacaugcuuggagccaagugcuaacaugccuugguuccagggauggcaagucaccguaac

SEQ ID NO: 16793 - RNA, 79 nt, Human; identical to SEQ ID NO: 1810

SEQ ID NO: 16794 - RNA, 75 nt, Human
gcauccaggacugcgggacaagauucuuggugccaccauugagaacuccaggauuguccugcagaucgacaaugc

SEQ ID NO: 16795 - RNA, 67 nt, Human
ggaggacaaugacacauuuucucugguggucuuguaauuggggaugauguaaacaugagucuaaucu

SEQ ID NO: 16796 - RNA, 74 nt, Human
uacgggaaauacauaaaucauacuauaugacgauagcccagaagauugcauggaggaucuuuguguuuccugua

SEQ ID NO: 16797 - RNA, 79 nt, Human
uggaguuauuguugaccaggcaucaagaaaggagggauaugcaucagaaaucauuuugccugaaauaagcacaacucca

SEQ ID NO: 16798 - RNA, 61 nt, Human
ggcugggccugagacaugggcuggccuccagguggagggguccagcaggcagguacaagcc

SEQ ID NO: 16799 - RNA, 66 nt, Human
gaggcagguggaucaccaagucaggaguucaagaccagccuggcaaagauggugaaacccugucuc

SEQ ID NO: 16800 - RNA, 61 nt, Human
gcacuucccacacuaaaauaacccaguuuuucucaaucuuuugguauuuuuggagaggugu

SEQ ID NO: 16801 - RNA, 85 nt, Human
auguggaauuuucagaaaaagauugucugcucugguuaaacuuccuucuggagaggauuacaauuugaaacuggaacuucuucau

SEQ ID NO: 16802 - RNA, 69 nt, Human
ggggaccaaagaacucugaacgguuuuuugucaaucgaaugugcacaauaaaagguucggaucgucccc

SEQ ID NO: 16803 - RNA, 80 nt, Human
guuuacaagacaugauuuugcuggcuuuacaaaaggacauucuauuuauuuuuccaguaauucuucauugucccauaagc

SEQ ID NO: 16804 - RNA, 82 nt, Human; identical to SEQ ID NO: 1523

SEQ ID NO: 16805 - RNA, 73 nt, Human
auucuauaaugaagauguuucaugaacuggggcauguauuugucaagaaacuucuuaucuucaugaacugaau

SEQ ID NO: 16806 - RNA, 76 nt, Human; identical to SEQ ID NO: 10891

SEQ ID NO: 16807 - RNA, 87 nt, Human
aggauccgcguauaggcugaagaaaaagacguucaguuaacagugcgcgcuguagaacuuuaacacaagucuucagguggaauuccu

SEQ ID NO: 16808 - RNA, 61 nt, Human; identical to SEQ ID NO: 7082

SEQ ID NO: 16809 - RNA, 67 nt, Human
uaccguuuacaguuuagugagguggucugcauucucgcaaacgacuuacaaaguacaagaaauggug

SEQ ID NO: 16810 - RNA, 76 nt, Human
cauuuuuaguuuuguuaaaaaaaaauucugacaaaucagaaauggggguucaggagugguggugaugcaaaagaug

SEQ ID NO: 16811 - RNA, 82 nt, Human
ccguguccuguucaacugagaagaaaacguagcauggucagaauaaggcaugaaaaggggaaagugaggcaggaacacacgg

SEQ ID NO: 16812 - RNA, 77 nt, Human
gacuauucaggcgcaguacaaguuggggcacugcauccuuuguggauggauuuccguugcuguguuccucacaaguc

SEQ ID NO: 16813 - RNA, 75 nt, Human
uuuuuuuuuuugaaguuuuugcuauaaaacauuuaauguuaaccuacaauacaauguaaacuuuuaugaaaaaaa

SEQ ID NO: 16814 - RNA, 62 nt, Human
cgacuaugacuaccugcggaagcucuucaccgaccucuucgaccgcaguggcuucguguucg

SEQ ID NO: 16815 - RNA, 69 nt, Human
ggagaaagagaaaaucgcugcagcgacacaagugacccugggcgcgugcagcccccugaaucuuucucc

SEQ ID NO: 16816 - RNA, 66 nt, Human
gcagguauuuucauagacaaauuaaagauuaaauaagauaucauggcauaagugaaaauauuuagc

SEQ ID NO: 16817 - RNA, 61 nt, Human
uagguggcugaauucaaaauuaauuuuuuaaauuaaugaguuuucaacuagaaguccccua

SEQ ID NO: 16818 - RNA, 62 nt, Human
acuggcaucucauuuacaaaguauuuuugugaaauacucuccauuggcuuugcuugcucagu

SEQ ID NO: 16819 - RNA, 67 nt, Human
cagcacacuaccagaagacagcagaaaugaaaagcauuuacuuguggcuggauuauuuguaaugcug

SEQ ID NO: 16820 - RNA, 72 nt, Human
cgggggggcgccggugcugaaacaggguccccgcgccggggcgggggaaacccaaagcggggcgcccccccg

SEQ ID NO: 16821 - RNA, 88 nt, Human
guuuuggccaggggcgguccccagaaggaugccagggagacucacucaauccuuggucagcccugcggauccugcgccgagccaaugc

SEQ ID NO: 16822 - RNA, 62 nt, Human
uuucuguuaauaacacaaaauauuuuuuuaagaaaaaaagaaaaaaaagguagggaaagaag

SEQ ID NO: 16823 - RNA, 62 nt, Human
gcugguaacugauaagggggcaccgcugaggggcgggcccccucaaggcgggaguugccggc

SEQ ID NO: 16824 - RNA, 92 nt, Human
gugcuucaacugguaucuaugaggcccuagagcuccgggacaaugauaagacucgcuauauggggaagggugucucaaaggcuguugagcac

SEQ ID NO: 16825 - RNA, 75 nt, Human
gacccacuguccauuuggguuggccugaugcaggagucaauuaccugcagugguugguccaaacaggcucugguc

SEQ ID NO: 16826 - RNA, 64 nt, Human
gcaggguggucagggugggagacacaagauguuuuuauagucuagagccuuuaaaaaacccagc

SEQ ID NO: 16827 - RNA, 68 nt, Human
cccggggacugagaguuaaggagaguuggaggcuuuacugggccacaggguuccuacucgccccuggg

SEQ ID NO: 16828 - RNA, 78 nt, Human
uuucggauacuuacauaguuuugcgggaagccagaucgaagauguaucccagcaagcacacuaggcagguggcugaga

SEQ ID NO: 16829 - RNA, 60 nt, Human
uauagauacacaaggaauaauuucugauccaggaucguccuuccaaaugguguauuuaua

SEQ ID NO: 16830 - RNA, 93 nt, Human
uggagcugacugaagcaucuuauuuuauaguauaucaacuuugguguuuaaauugacccugcaagguagcugaagaacuuuuagacaguucca

SEQ ID NO: 16831 - RNA, 84 nt, Human; identical to SEQ ID NO: 4235

SEQ ID NO: 16832 - RNA, 67 nt, Human; identical to SEQ ID NO: 3353

SEQ ID NO: 16833 - RNA, 65 nt, Human
ugcucagacugggugugcuggggcucaugguggacugaucaugcugcccugggacccagcuggua

SEQ ID NO: 16834 - RNA, 69 nt, Human
acagauuccgcgacaaaauucacuccagucacucugggcacagaggcugauaguugcaggucuaucugu

SEQ ID NO: 16835 - RNA, 62 nt, Human
gcgggcuccacgaugaucgccaacagcaugcccauugcgaccauggccgccuuccaguccgu

SEQ ID NO: 16836 - RNA, 73 nt, Human
gcacugcgagaccugcauaucuggcuucuacggugaucccaccaauggagggaaaugucagccaugcaagugc

SEQ ID NO: 16837 - RNA, 61 nt, Human
gcaugugucuagaggacagcagaucaacuggucuuucauucacuguccagcuugccaaugc

SEQ ID NO: 16838 - RNA, 75 nt, Human
ggcacgcgucucugugcaacaccaacacgggcaagugcuucugcaccaccaagggcgucaagggggacgagugcc

SEQ ID NO: 16839 - RNA, 84 nt, Human
acuucuucucuuauguuagcuucauuauuagauuguuucauuuuugaaaauuccugaugugagaccugaauauuuuuaagaagu

SEQ ID NO: 16840 - RNA, 64 nt, Human
agggcugucaaaaacuugcuugucaugucaaaauucacagauuucaagucauucuccagacccu

SEQ ID NO: 16841 - RNA, 68 nt, Human
cuguuucuucauagauucuuggacuuuaguuguaagaccuacauagacucgaucuaguucaguaacag

SEQ ID NO: 16842 - RNA, 97 nt, Human
gggagccgguugaggaaaggcagacauccgacuucuugcccugguauaacuggcacgacaaggguaaggaucugcaucugaucuuccacggguuucc

SEQ ID NO: 16843 - RNA, 87 nt, Human
ggugccgcuggucugaaucagaguaaaaggcaggcagccggaguucccacucgccuuccaugagcucuccgcagcucagcgagcauc

SEQ ID NO: 16844 - RNA, 61 nt, Human
aucaugagauagacacuguuuaaggccgcauagguguuagucccaguuccauuuucaugau

SEQ ID NO: 16845 - RNA, 90 nt, Human
ccauauuggacuuuccaucugucagaaggaugauggcaugucggauuuccugccaggccaucguuuccaugccgagguagucgcauuugg

SEQ ID NO: 16846 - RNA, 83 nt, Human
ggacagacaugaugacuuugagcucugaggcaaaggugauaauggcaacgcucacauugaucucaaagcugaagauccugucc

SEQ ID NO: 16847 - RNA, 70 nt, Human
guccauuugggguauuccaucuuccuggucacaaugaugacuugaggcuggauaccauccucgucuggac

SEQ ID NO: 16848 - RNA, 85 nt, Human
aguacaggugcagcugagggaccaggcuggugggaagcucugcuccaugucuucucccagacacccauauucaguggcucuuacu

SEQ ID NO: 16849 - RNA, 123 nt, Human
cauacuuauauacuuuuugaaauauuuauuauuagcuaauaauuuauuuuuauuguaucgguagcucuaaauuguucuaaagcaaauuauaaaauaguuuuaaaaauagcuuauauuuguaug

SEQ ID NO: 16850 - RNA, 103 nt, Human
cuuuaaggaggcgaggaagugccggcaagucugaucuuuaaaauggugacuaaauaguaguguggcuauagaauuuauugucuaaacccgagcaacuuugagg

SEQ ID NO: 16851 - RNA, 80 nt, Human
cuuucuguccacucugaggugcugcuccagauguggggcccucccagagggccucggagacaccauaggggaacagggag

SEQ ID NO: 16852 - RNA, 90 nt, Human
ggcuccauucugaccucccugaagcgcuggguuagacgggcaccaucagcccaccucacaggcucggcgucgggugagcucguggacgcu

SEQ ID NO: 16853 - RNA, 64 nt, Human
gguggguggauggagagaggccccagccuaaggacccaggcuccugccuucccaccacccgucc

SEQ ID NO: 16854 - RNA, 66 nt, Human
cuucccagcaggaguccucaggaacaguggguguucagcagaaaaacacaggcucuucuggugagg

SEQ ID NO: 16855 - RNA, 67 nt, Human
gccucuuacccacugggauaggaaccaaaauguguucacugucccuguuuagccaaggguagguggc

SEQ ID NO: 16856 - RNA, 101 nt, Human
uggcccucccugccugcuuauguauggacagaguauguugucucagcuuccuccgagagagacuggugguuuagcuucugucuacacaggcagaagggcua

SEQ ID NO: 16857 - RNA, 80 nt, Human
cagcuuucaguuaaaaaagaagaagaagaaauggcaaagagaaaguuuuuucaaauuucuuucuuuuuuaauuuagauug

SEQ ID NO: 16858 - RNA, 74 nt, Human; identical to SEQ ID NO: 365

SEQ ID NO: 16859 - RNA, 102 nt, Human; identical to SEQ ID NO: 2172

SEQ ID NO: 16860 - RNA, 68 nt, Human; identical to SEQ ID NO: 6413

SEQ ID NO: 16861 - RNA, 98 nt, Human
aguguugcauuacuuugaggcagaucguugucuauuucuucugaaaagucagucugaguugcagaaguaauagugugccuuggaguagcagcagcauu

SEQ ID NO: 16862 - RNA, 62 nt, Human
uuuguaguauuaacuugaacuugguugauuucuuuuauaacuuguucauaagauggugggag

SEQ ID NO: 16863 - RNA, 66 nt, Human
cuaauaauucacauuaaggcuucuggaguauaagugguucacagaaguaugaaaaggggauguuag

SEQ ID NO: 16864 - RNA, 68 nt, Human; identical to SEQ ID NO: 3808

SEQ ID NO: 16865 - RNA, 67 nt, Human; identical to SEQ ID NO: 3809

SEQ ID NO: 16866 - RNA, 70 nt, Human
uguuugucagugauuuagaugauuuaaaaaugcaugugugauuugaauuuuauaauuguuuugacaagca

SEQ ID NO: 16867 - RNA, 64 nt, Human
ggagaaacccagggcuaaagucacguguuuuccuccuuuaagacuuagcucaacacuucacucc

SEQ ID NO: 16868 - RNA, 73 nt, Human
cagggaggcugcauggggccagcgcuagguggcugacucagcagcagccauggggcuggaagaagcuucccug

SEQ ID NO: 16869 - RNA, 91 nt, Human
ccaguggccagggcuuuguugcguuggggcucuccugcagugcagacuuacaggaagggccuuggcggccagcacgcgagcccguaguugg

SEQ ID NO: 16870 - RNA, 81 nt, Human; identical to SEQ ID NO: 12385

SEQ ID NO: 16871 - RNA, 87 nt, Human
cauuuucuuucacagcuugacaauguuuacauguacaaaaacccagcaagaagcaucaugucauguagauuucaguaagggagaaug

SEQ ID NO: 16872 - RNA, 118 nt, Human; identical to SEQ ID NO: 12386

SEQ ID NO: 16873 - RNA, 69 nt, Human
guagacaaguccuccagcacagccuauauggagcucacuaggcugacaucugaggacucugcugucuau

SEQ ID NO: 16874 - RNA, 62 nt, Human
aggaagucagguugggugaccccaguaacugcucucagaggcugggugaugaccggcuuccu

SEQ ID NO: 16875 - RNA, 87 nt, Human; identical to SEQ ID NO: 76

SEQ ID NO: 16876 - RNA, 60 nt, Human
cuggucuccugugaagaacauguggaucucuucccgaaggaaaaggucccaggagaccag

SEQ ID NO: 16877 - RNA, 61 nt, Human
uuggcccugugucuuugucauggcacaaaggugugcacugcgugacaaugacccaagccag

SEQ ID NO: 16878 - RNA, 60 nt, Human
acaccgugggcuuguuaacuugcuuugaguuggaagcgguuugaauuacgccuguaaugu

SEQ ID NO: 16879 - RNA, 60 nt, Human; identical to SEQ ID NO: 10992

SEQ ID NO: 16880 - RNA, 62 nt, Human
ccucaggaggggagggcugguaggagggggggagaggucucuguccuacugcucuccagagg

SEQ ID NO: 16881 - RNA, 64 nt, Human
ugauguguuugauuuccuucuauaugauucaagauguguuucugauucugugaagaacauauca

SEQ ID NO: 16882 - RNA, 76 nt, Human
gauuuuauuaaaauuaaguugaacaucaauagcacauuaauauaaugguaaaauuuaacuuaucugguauaaaauc

SEQ ID NO: 16883 - RNA, 105 nt, Human
uuaagaauacagauuuuuaccuacauuaaaggcuaaacuuuuuuuuguuuuaaagauuuaagcaaguuuuaaaauguuaauuguaaaggaaauucuguguguuaa

SEQ ID NO: 16884 - RNA, 91 nt, Human
gggaggaucaccugagcccuggaaguggagguugcagugaaccauaauugcgcaaccacacuccagccugggcuacagagcgaaaccuucc

SEQ ID NO: 16885 - RNA, 112 nt, Human
uacuaaaaauacaaaaauuagcuggacguaguggcaugugugcucgugugugugcugugugugcgugugugcugugcguuugugugugcugugcguuugugugugugcugug

SEQ ID NO: 16886 - RNA, 66 nt, Human
gagcuggccacaaguaaaccugccaaugacaaacucaggacuuaacagaaagacuuaguucaguuc

SEQ ID NO: 16887 - RNA, 61 nt, Human
gcuuugugcucaggcaucacauagcaggcagccugcagccuuucuugccugagagaagagu

SEQ ID NO: 16888 - RNA, 82 nt, Human
guggcuaggaaagaacagcauaacuucagaguaaggguauagacuugggaugugaggcaguuaugcugaaagguucugucac

SEQ ID NO: 16889 - RNA, 67 nt, Human
acgucgcccuggacuucgagcaggagauggccaccgccggauccuccucuucucugggagaagacgu

SEQ ID NO: 16890 - RNA, 68 nt, Human
gggcucaaguaauccuuuugccucagccucccaaagugcugggauugcaggcaugagcuacggugccc

SEQ ID NO: 16891 - RNA, 75 nt, Human; identical to SEQ ID NO: 447

SEQ ID NO: 16892 - RNA, 106 nt, Human
gcaggguguacaccugugguucucggggcugccuuuggcuuuggagaugguuuucucgaugggggcugggagggcuuuguuggagacuugcacuuguacuccuugc

SEQ ID NO: 16893 - RNA, 130 nt, Human
ucuuguccacggugagcuugcuguagaggaagaaggagccgucggaguccagcacgggaggcguggucuuguaguuguucuccggcugcccauugcucucccacuccacggcgaugucgcugggauagaa

SEQ ID NO: 16894 - RNA, 77 nt, Human
cguucauuuuaugcuucaugguugaaauuuuucugucagugaguggaaaauaaccaugagauacauagacuguagcg

SEQ ID NO: 16895 - RNA, 69 nt, Human
ucauuucaucuuugugcuuugguuaacaagcaggcucaagagacugcuuuguguaauuaaaugaauuga

SEQ ID NO: 16896 - RNA, 66 nt, Human
uucugguggugauguggcuaugauugacaaauauucuguaaaauuucugccugucugccucuagaa

SEQ ID NO: 16897 - RNA, 76 nt, Human
cugauuccuuauuuauggaaucaucucuggguauaugauuuccaaaaccuagagauauuccuaugguauaauucag

SEQ ID NO: 16898 - RNA, 68 nt, Human
acuuucugggaagaauucaacaaccauuuaguagacacugacuauguugauguucuugucccaaaagu

SEQ ID NO: 16899 - RNA, 81 nt, Human
agguagccuacuggugauuucauauugccucugguggcagagagucaguuacuuccaagaggccuuuacuuugggcugcuu

SEQ ID NO: 16900 - RNA, 75 nt, Human
uggagaguuuaaauaauuugcugaaugucucauggccaaaauccuauugaaguauuugcugggaucuucucucca

SEQ ID NO: 16901 - RNA, 66 nt, Human
uguaugucuuuaaacaauaagcaauuucuucucaaauacugugcacuuuccccaaacagauauaca

SEQ ID NO: 16902 - RNA, 99 nt, Human; identical to SEQ ID NO: 11253

SEQ ID NO: 16903 - RNA, 78 nt, Human; identical to SEQ ID NO: 5302

SEQ ID NO: 16904 - RNA, 62 nt, Human; identical to SEQ ID NO: 484

SEQ ID NO: 16905 - RNA, 70 nt, Human; identical to SEQ ID NO: 5304

SEQ ID NO: 16906 - RNA, 63 nt, Human
augagggcagcaccugccucugaaugggaaaucaugcaacuacucagaauguguccuccucau

SEQ ID NO: 16907 - RNA, 63 nt, Human
uggaugagcguggcuugucccaauaaaacuuuauuuucagaaacaagccacugggcugguuca

SEQ ID NO: 16908 - RNA, 76 nt, Human; identical to SEQ ID NO: 758

SEQ ID NO: 16909 - RNA, 71 nt, Human; identical to SEQ ID NO: 1764

SEQ ID NO: 16910 - RNA, 67 nt, Human
cagcugggcccgggggaccacuaccaccaaaaugcggggaccgguaguggccccaaaugucuggcug

SEQ ID NO: 16911 - RNA, 62 nt, Human
guugguccuucuggcaacacuugaggggagauacuaucacccuuaucuuuguagggaccagc

SEQ ID NO: 16912 - RNA, 85 nt, Human
gucacagacuguugaaacaugaccagaagcguguagcuccauccaucgugcuagagcucgcuugggucccuuugacaucuuuggc

SEQ ID NO: 16913 - RNA, 63 nt, Human
ucucguucauccauucaugcgcgucacuaauuagaugacgaggcauuuggcuaccuuaagaga

SEQ ID NO: 16914 - RNA, 71 nt, Human
cacuaaaaacaguuaauucaagagcauuguucuggcauccaaauccaaaagccuuguuacuguuucuaaug

SEQ ID NO: 16915 - RNA, 71 nt, Human
uacuuccagccuucccuuaucugauagaccaucuuugggaaacaaccagguggauguuaaugggagaagua

SEQ ID NO: 16916 - RNA, 72 nt, Human
gagagcacggucugaaucugcacagagcaagaugcugaguggagucgggggcuuugugcugggccugcucuu

SEQ ID NO: 16917 - RNA, 70 nt, Human
uccuggucuguucugugagugguuucuauccaggcagcauugaagucaggugguuccggaauggccagga

SEQ ID NO: 16918 - RNA, 76 nt, Human
agggcuuggaucaugcauuacaguguguugauuacaucaaggcugauggacaaaauauaggaugcagauuuucccu

SEQ ID NO: 16919 - RNA, 69 nt, Human
uugaucuuaacaagggcauugaagcgaagauacacacgcuuuuaccauggcaaugcacaaauggaucag

SEQ ID NO: 16920 - RNA, 73 nt, Human
gugaaaugggacuauuuguuugucuuuaaauacagucucuauaggaaagacaaaauaaauacuuaaaucucac

SEQ ID NO: 16921 - RNA, 98 nt, Human
uacuugauucaugaugaggagauggccacugaaauuggacagugacagucuuuucugcccauuguucaauuauauucgucucuuuacauuagaaagua

SEQ ID NO: 16922 - RNA, 88 nt, Human
cagcagagcauccggaacgucacagaggacgugcagaacagcuguuuggccuacgucacucaugaggacaucugcagaugcuuugcug

SEQ ID NO: 16923 - RNA, 67 nt, Human
ccaaagugcugggauuacaggugugagccaccgugcaugaccaaaaguccuucuaauagcaaagugg

SEQ ID NO: 16924 - RNA, 68 nt, Human
ccucacugccucuaccugaaaaacugagauauuuagccacuuggucucauuuggaggauacaguaggg

SEQ ID NO: 16925 - RNA, 81 nt, Human
guuuuauccuagauccugagaggcccucaaagugggagagucagcugccaaggauuaaagggcaagcaggaaugggagaac

SEQ ID NO: 16926 - RNA, 61 nt, Human
accuuguggggcucuugggaugggcgggcacccaagcccuggcuuguccuucccagaaggu

SEQ ID NO: 16927 - RNA, 73 nt, Human
ccagcaucaucgcagagauccugagugucuaccagaagugcaaggacaagcaggcugcugcuaagugagcugg

SEQ ID NO: 16928 - RNA, 66 nt, Human
ugcugcuaagucagguugccuuuacuuugaaaaagguaaaaaggacaaaacauaucuacuuaggca

SEQ ID NO: 16929 - RNA, 90 nt, Human
ccccgagugagcaauuucugucccuuuuaagggcucacaacucuaagggggugugcgugagagggucgugaucgauugagcaagcagggg

SEQ ID NO: 16930 - RNA, 68 nt, Human
cuccccaaucaccgcugcuugccagggugccucuucacaguucccauguggcagcaguaguggcagag

SEQ ID NO: 16931 - RNA, 93 nt, Human
cuggacggcgucgaaaugaccccggccaccgugcuggcgacccugaaccguaucgguggcgaacacgguaucggucgucuggacaucgucgag

SEQ ID NO: 16932 - RNA, 87 nt, Human
ccuguuaguauuguuaaaaagcaagagugacuuuaguauucaugaacaguaaaucagaggucagacuugacaagagcgagugacagg

SEQ ID NO: 16933 - RNA, 69 nt, Human
auuucacucuuuugccuuccagucacuuaacuacaacuaagagaaagacacagguagaugauagggaau

SEQ ID NO: 16934 - RNA, 80 nt, Human
gacaaucucauaacaggaagauuugaacauagcagcugcuuaccauuucaugcuaauuaaaugugauuuccaucauuguc

SEQ ID NO: 16935 - RNA, 62 nt, Human
uagggguuugcaaacaauacguagccaauuuccuuaaaagggaaauucuugugugucuccua

SEQ ID NO: 16936 - RNA, 64 nt, Human; identical to SEQ ID NO: 1650

SEQ ID NO: 16937 - RNA, 62 nt, Human; identical to SEQ ID NO: 1651

SEQ ID NO: 16938 - RNA, 116 nt, Human; identical to SEQ ID NO: 1652

SEQ ID NO: 16939 - RNA, 67 nt, Human; identical to SEQ ID NO: 1460

SEQ ID NO: 16940 - RNA, 60 nt, Human; identical to SEQ ID NO: 1551

SEQ ID NO: 16941 - RNA, 60 nt, Human; identical to SEQ ID NO: 1551

SEQ ID NO: 16942 - RNA, 72 nt, Human
gaggcggagcuugcagugagccgagaucccgcacugcacuccagccugggcgacagagcgagacuccgucuc

SEQ ID NO: 16943 - RNA, 67 nt, Human
gcauguucaaaugguuuccacugauucgauuuuucauucauuuaaugcaaacccauucuggauaugu

SEQ ID NO: 16944 - RNA, 94 nt, Human
acuggcgcugcaaggcugugggcaaggucaucccuugagcugaacgggaagcucacuggcauggccuuccgugucccacugccaacgugucagu

SEQ ID NO: 16945 - RNA, 65 nt, Human
gccgcaucuucuugugcgucgccagccgagccacaucgcugagacaccauggggaaggugaaggu

SEQ ID NO: 16946 - RNA, 80 nt, Human
ccaguguguugaacaaauucaagaguugguucuacgcuucugugagaagaacugugaaaagagcaugguugaacagcugg

SEQ ID NO: 16947 - RNA, 101 nt, Human
cgauuaugacacugacaaugaaaauacuaacauaccagucauuuaccauaagugaauauugaauuugaagcguuauucccuaucagauaaugauuaugacg

SEQ ID NO: 16948 - RNA, 61 nt, Human
ugucccuccacagaucgcucugaccauguaacagcagcuucagaaagaacuggcgggggca

SEQ ID NO: 16949 - RNA, 65 nt, Human
caagaagguuaucuccucagccaacagagcugugguuggugugguggcuggagguggccgaauug

SEQ ID NO: 16950 - RNA, 82 nt, Human
cucuauuguacuuuuaaaaauccuauuuuugcaguuggcuuccuaucagugaauuaguuagguaguuuugguacauuuggag

SEQ ID NO: 16951 - RNA, 61 nt, Human
ugauuaaccuuuagcaauaaacgaaaguuuaacuaagcuauacuaaccccaggguugguca

SEQ ID NO: 16952 - RNA, 64 nt, Human
cucuuugugcccucauuugguauuuggugcugaaacuaagcauggugcuaccauucaagaagag

SEQ ID NO: 16953 - RNA, 70 nt, Human
caagccgcgcacgguggcucacgccuguaaucccaaagugcuaggauuauagccaccgcaccucgucuug

SEQ ID NO: 16954 - RNA, 72 nt, Human
ccaaauaaauuaaaaauguuuuaaagcccugaguucauagacugguuuuaggagauuuuuaugacacacggg

SEQ ID NO: 16955 - RNA, 83 nt, Human
gcccccucucggcuucccccucucccccucccccugcgggauguucagggugggggagaauugaggagcucggagaggcaggu

SEQ ID NO: 16956 - RNA, 64 nt, Human
gcucugcuuauauagaccucccaccgagugguagcguaaggagggcgaugagagauaucagagc

SEQ ID NO: 16957 - RNA, 66 nt, Human
cacagcagaccaaucauguucccugaaauuuaacaaucaaucauacuuaauaaaggccuguuagug

SEQ ID NO: 16958 - RNA, 78 nt, Human
gcaccaguaagaaagacugucgcuagcauuuuuauuucaucaucaacaacaaacaugcaguuucuuucucugaugugc

SEQ ID NO: 16959 - RNA, 61 nt, Human
uaucuuuaaauacugcaaagcauugugagcugcaucacuuugugcauugccacaggagaua

SEQ ID NO: 16960 - RNA, 84 nt, Human
cuuuuauuuauuuuccuaguauuuuuuuccucagauggaaaaauaauuucaucaagaaaacaagugcuucugccaaagugaaag

SEQ ID NO: 16961 - RNA, 94 nt, Human
aaguuuuaaauucugauuuuucacuacuacuaaagauagauacaccagauucucauuuauuaaauucaugaccaaauccagaauuuguaggcuu

SEQ ID NO: 16962 - RNA, 89 nt, Human
guucuucuauuauucccauuuuauggauaaagaaacaaagacacauagagguuaaaaguuucugcccauggaauauagccaggaagaac

SEQ ID NO: 16963 - RNA, 78 nt, Human
uuauugaagacuuuaacaguagauaaaggaauagaguuuuucuaaucaucuaaaggcuguuaauaguguugacaauaa

SEQ ID NO: 16964 - RNA, 63 nt, Human
ggacauuggaaaugaaauuaauaucuucuacuugauuagaaaaaguggaucuuuuccaaugcc

SEQ ID NO: 16965 - RNA, 66 nt, Human
aggccuggcacagccuuggcuuccacgccugagcguggagcgcacgaguuaguuguaguccggcuu

SEQ ID NO: 16966 - RNA, 65 nt, Human
cuuccuguugguuugagccccuuuuuguuuugcccucuggguguuuucuuuggucccgcaggagg

SEQ ID NO: 16967 - RNA, 91 nt, Human
gguucauucucuggaucagagucaguggugucagaauaucuauaaugaucagguucauugucacuaacaucugguguacagaaguugaacu

SEQ ID NO: 16968 - RNA, 62 nt, Human
uauaagguuuauuuucacuguguuuuaucccucuugauaaaaaaaaaauucagacuuuugua

SEQ ID NO: 16969 - RNA, 60 nt, Human
acugugauacaagcacuggguucuuugagaugagagcuguuuuuagugucuguucggagu

SEQ ID NO: 16970 - RNA, 63 nt, Human
gagaucacuggcuggcuggaaggcuucauucauuaaacguuguuccccagcaucuaauuucuc

SEQ ID NO: 16971 - RNA, 85 nt, Human
uucugguguuuccuagagagccaauggacuguauauaaaugcugcguuuguuuggagagggugucuuucuguaaggaucacugaa

SEQ ID NO: 16972 - RNA, 60 nt, Human
cacuuguuuauggccuaaaauuuguauaaggacacacuuauacagauuucauaaacaaug

SEQ ID NO: 16973 - RNA, 75 nt, Human
gaggcugggaagugcaagaccaagauaugaacagauucauuaucugguacagauacccugcauauuuuuggccuc

SEQ ID NO: 16974 - RNA, 72 nt, Human
uaugaagaaagaaauguuuuugaaaguuuacgugugugcauuuaucaucauaaauacauuuaauucauugua

SEQ ID NO: 16975 - RNA, 81 nt, Human
gacuggaaggugcccugugcuaugucgugccugcagggacacgucggaucccgugggccucacaugccaggucaccagguc

SEQ ID NO: 16976 - RNA, 64 nt, Human
gcagacucaugcagcccuauggccgcucagaccaaggcgcagagaacuaucagggcagcucugc

SEQ ID NO: 16977 - RNA, 65 nt, Human
ggcccagcaguauugcucacgggggcuccagcgccggcguggcccucaugagcuacgccuggguc

SEQ ID NO: 16978 - RNA, 70 nt, Human
gaucuccuacuuuucaccucagaaagcuacaaauguaaaaggaaaauuaaauuuguuuugagaggagauc

SEQ ID NO: 16979 - RNA, 60 nt, Human
cuuaauugaauacuuagaaaaaaauggccaguggcgauugaaagguauauuaaaauuaag

SEQ ID NO: 16980 - RNA, 62 nt, Human; identical to SEQ ID NO: 7075

SEQ ID NO: 16981 - RNA, 65 nt, Human
cuuuguaugcccagggaaggaggcgcuaugaucggaagcagaguggcuauggugggcagacaaag

SEQ ID NO: 16982 - RNA, 68 nt, Human
ggccaggugucgggcgcuguuucucguuuucaucauauagacaaaacagcccugcugcaaagaugguc

SEQ ID NO: 16983 - RNA, 84 nt, Human
uuuuuuuaacaugugucaaaagauuuuauuaaacuaauucaauuuguuagggaaaugguaagauguuacaacugguuaagagga

SEQ ID NO: 16984 - RNA, 87 nt, Human
cuaggaaggugauccgggaggcuggagagcuugucaaggucacagacccacgguuuuccgcccccuaggguccaagcucuuuccugg

SEQ ID NO: 16985 - RNA, 60 nt, Human
gguggcagcaggggaacgucuucucaugcuccgugaugcaugaggcucugcacaaccacu

SEQ ID NO: 16986 - RNA, 68 nt, Human
uuugccagacugauuuccgaauucuacuggaugcauucaaaguuaccagaagacgaaggacuggggag

SEQ ID NO: 16987 - RNA, 67 nt, Human; identical to SEQ ID NO: 1379

SEQ ID NO: 16988 - RNA, 63 nt, Human; identical to SEQ ID NO: 1366

SEQ ID NO: 16989 - RNA, 86 nt, Human; identical to SEQ ID NO: 1381

SEQ ID NO: 16990 - RNA, 62 nt, Human
ugccagggugaaagggauagacaacuggauuagagcccaagugccacuccaguugcuuggca

SEQ ID NO: 16991 - RNA, 96 nt, Human
gggaaaggccaucacccuccguggacggggucucggccaccacauccaccuucugaagguggcccagacaccuccacgcugcugacugcacuuccc

SEQ ID NO: 16992 - RNA, 60 nt, Human
ggguggucggauggcagcgugacgccaguaucauuuccagcauuuccaucuuuaccacuc

SEQ ID NO: 16993 - RNA, 71 nt, Human
uaucucaacgagaagggacaccucacgucgcugacagcucggcacguggcuggucccaggccccagagaua

SEQ ID NO: 16994 - RNA, 66 nt, Human; identical to SEQ ID NO: 2392

SEQ ID NO: 16995 - RNA, 88 nt, Human; identical to SEQ ID NO: 2393

SEQ ID NO: 16996 - RNA, 89 nt, Human
gccacgguucauuucacccuugacaggcucauugaggauggcauaagcgugugucauucuggaugucuugcaccgggcauagccguggu

SEQ ID NO: 16997 - RNA, 92 nt, Human
ggguucucgacggcagcagagcggggcuucuuggcagcgggcucgaagucggccuccucggcccaggacuccuucaccucguugaugagcuc

SEQ ID NO: 16998 - RNA, 74 nt, Human
guagccuggaagaggggcuccugcagguaaucguacacuucauuuuugccuagccgaucaucuuccugagcugc

SEQ ID NO: 16999 - RNA, 63 nt, Human
gucaagucuuaaagcauguuggauuucagaaacaugaguuuauucauaucuucuggacugagc

SEQ ID NO: 17000 - RNA, 75 nt, Human
aaaggccacuucuaugacuuauuuuucuguuugguugggcugccauggaaaccggaagcauguauucaagccuuu

SEQ ID NO: 17001 - RNA, 77 nt, Human
cuagagacagacauagucaaaaugaaaacauaaauuccaauuuugugucaauuauuuucaaacuauguucccucugg

SEQ ID NO: 17002 - RNA, 71 nt, Human
guuuucauaaguaggacagcaccagucauuauuuuuucacugacugcuccugguccuauuguuuaggaagc

SEQ ID NO: 17003 - RNA, 72 nt, Human; identical to SEQ ID NO: 4935

SEQ ID NO: 17004 - RNA, 104 nt, Human; identical to SEQ ID NO: 4774

SEQ ID NO: 17005 - RNA, 82 nt, Human; identical to SEQ ID NO: 182

SEQ ID NO: 17006 - RNA, 68 nt, Human
ggacucucaggaaucuuucagauugcugcaacuaagcaggaagggauggaaggucuccuugggacucu

SEQ ID NO: 17007 - RNA, 74 nt, Human
ggugcuaucugucugcucuaguaauaagccggcuauuguagaagcugguggaaugcaagcuuuaggacuucacc

SEQ ID NO: 17008 - RNA, 94 nt, Human
gugcagcuggaauucuuucuaaccucacuugcaauaauuauuagaaccagaugauggucuggcaagugggugguauagaggcucuugugcguac

SEQ ID NO: 17009 - RNA, 93 nt, Human
gccgacgccggcccgcucugcgccgccugccguauggcugcgggccccgagccgcccgagugggaaccgcgcuggaggaaggcgcugcgcggc

SEQ ID NO: 17010 - RNA, 65 nt, Human
ggagaacaaggggucuguggaaaucaugagaaaggacuugaaugacacccgggaccugcauggcc

SEQ ID NO: 17011 - RNA, 72 nt, Human; identical to SEQ ID NO: 3662

SEQ ID NO: 17012 - RNA, 63 nt, Human; identical to SEQ ID NO: 12838

SEQ ID NO: 17013 - RNA, 85 nt, Human; identical to SEQ ID NO: 10310

SEQ ID NO: 17014 - RNA, 68 nt, Human
gacuacugaaaggaaaagcuggugcuggggagcccuccacaccacugacugaugaauuucagcacguc

SEQ ID NO: 17015 - RNA, 66 nt, Human
gggguauccuguaauaaggcagggcagggcucgaacaccagugcucgcugccacuagggaggccuc

SEQ ID NO: 17016 - RNA, 74 nt, Human; identical to SEQ ID NO: 1525

SEQ ID NO: 17017 - RNA, 66 nt, Human; identical to SEQ ID NO: 1526

SEQ ID NO: 17018 - RNA, 64 nt, Human; identical to SEQ ID NO: 1527

SEQ ID NO: 17019 - RNA, 68 nt, Human
ucaucucgggugggaugugcgagguuucugugcccuuaucgucugguucuugguaugucccaggauga

SEQ ID NO: 17020 - RNA, 75 nt, Human
cccaagaccccugugccauuggggugcuccacucucucaaacaggaugagcaucucacagugcggggucugcggg

SEQ ID NO: 17021 - RNA, 62 nt, Human
cugccacagccuugaccggccggaagggaaugcccuucacccgguuagauggggcucugcag

SEQ ID NO: 17022 - RNA, 83 nt, Human
gguuuucaaaauaccuuuuaaaaaguauucuagcccaagauuuuucuguaaacuagauuauguuguaaacuuuuuucuaaauc

SEQ ID NO: 17023 - RNA, 66 nt, Human
uuuuuuuuuuccaaagauuuauugaagcagaaccaaguugguuggauacuugcuggaaaaaaaaaa

SEQ ID NO: 17024 - RNA, 62 nt, Human; identical to SEQ ID NO: 6172

SEQ ID NO: 17025 - RNA, 80 nt, Human; identical to SEQ ID NO: 9351

SEQ ID NO: 17026 - RNA, 72 nt, Human; identical to SEQ ID NO: 3662

SEQ ID NO: 17027 - RNA, 74 nt, Human; identical to SEQ ID NO: 365

SEQ ID NO: 17028 - RNA, 102 nt, Human; identical to SEQ ID NO: 2172

SEQ ID NO: 17029 - RNA, 78 nt, Human
agguguuuauuuuguucuauuuaagaauuuguuuuauuaaauuaauauaaaaaucuuuguaaaucucuauauacaucu

SEQ ID NO: 17030 - RNA, 77 nt, Human; identical to SEQ ID NO: 6000

SEQ ID NO: 17031 - RNA, 67 nt, Human
gggcauugcagcugaugcacugauagacggcacgugcuguggaucaggguauauagacagaaugguc

SEQ ID NO: 17032 - RNA, 62 nt, Human
gggcucgggcucugggcucaccaccucaucgaucagagggaggcccaguccugcccgggccc

SEQ ID NO: 17033 - RNA, 85 nt, Human; identical to SEQ ID NO: 11784

SEQ ID NO: 17034 - RNA, 103 nt, Human
uuuuuuuuuuuuuuuccugcauuucucauuuuuauuugacagaaaaaguugcuuuugcuguacagauuuuaaaaaaccaaaaugccuuuaaaaaacaugaaaa

SEQ ID NO: 17035 - RNA, 66 nt, Human
gacuaugauguggaauggggcuaugcuuuugaugugcaucucaaugcuuuuuauccacuccugguc

SEQ ID NO: 17036 - RNA, 120 nt, Human; identical to SEQ ID NO: 1182

SEQ ID NO: 17037 - RNA, 78 nt, Human
uucaguucucgaggagaaaagauccuuauggcagaugcugauggagccacaaaguuuccagauguugagaacuuagaa

SEQ ID NO: 17038 - RNA, 80 nt, Human
aaaaauauaugcuauuguuuagacuuuccauccuuuuuuuuuuuuauuuugaggaaaagucaaauucauuguuuauuuuu

SEQ ID NO: 17039 - RNA, 67 nt, Human
gauacugggaagagcauuagccaagaacuugucucuuugaucuguuucguuaagcugaaccaguguc

SEQ ID NO: 17040 - RNA, 96 nt, Human
ccaagagaggcucuucugggggccaggcugggacugggccccggaaaccaaaacuccgugccuuacccagccggggcccuccuggagccuucuugg

SEQ ID NO: 17041 - RNA, 66 nt, Human
gccaagggccagucggggggugcugcgcucugccaguguccaccacgagucugccugcccuugagc

SEQ ID NO: 17042 - RNA, 93 nt, Human; identical to SEQ ID NO: 634

SEQ ID NO: 17043 - RNA, 77 nt, Human
gcaguuccagggauauggccagcaaccaacuucccaggcaccagcuccugccuuuucuggucagccucaacaacugc

SEQ ID NO: 17044 - RNA, 66 nt, Human
uacaccaauuaauguagcugcuagcuauuggccucccaaaagacuccaguacuauuuuaauuugua

SEQ ID NO: 17045 - RNA, 70 nt, Human
uccuuaugcgcguaaccguccucccuuuggucagggcuauacccaaccuggaccugguuaucgauaagga

SEQ ID NO: 17046 - RNA, 118 nt, Human; identical to SEQ ID NO: 3011

SEQ ID NO: 17047 - RNA, 80 nt, Human; identical to SEQ ID NO: 3013

SEQ ID NO: 17048 - RNA, 80 nt, Human; identical to SEQ ID NO: 83

SEQ ID NO: 17049 - RNA, 77 nt, Human
ccgcguaucauacaccuuccuaggggcgugagucaagggcucaggauugcccauguggaucacugugugcugcucgg

SEQ ID NO: 17050 - RNA, 75 nt, Human
ggcgcugucuaccuccucugguccagggguacugguggcauuagaacuagaccagucagagaagucagacguguu

SEQ ID NO: 17051 - RNA, 62 nt, Human; identical to SEQ ID NO: 17032

SEQ ID NO: 17052 - RNA, 62 nt, Human
agccugagacuaguucggacuccccuucggcaaggucgaaggggguucggcuggucucugcu

SEQ ID NO: 17053 - RNA, 66 nt, Human
ucuugggcaacggucaugaugggaggaguaaucagaggugcucuuguguugugaucaggcuggaga

SEQ ID NO: 17054 - RNA, 63 nt, Human; identical to SEQ ID NO: 1098

SEQ ID NO: 17055 - RNA, 68 nt, Human
ggaaaaagguuucuucucggaaggcuuuuuuaaaggggcggguuuuugggaagcgggggccuuuuucc

SEQ ID NO: 17056 - RNA, 130 nt, Human
uuuuuuuuuuuuuuuuuuuuuuuuuuuuuuuuuuuuuuuuuuuuuuuuuuuuuuuuggccggaaaaaaaaggcuuuaaaaaaaaaaaagcggccaaaaaaaaauggaccuuaaggaaaaaaaaaaaaaaa

SEQ ID NO: 17057 - RNA, 67 nt, Human; identical to SEQ ID NO: 3685

SEQ ID NO: 17058 - RNA, 73 nt, Human; identical to SEQ ID NO: 2833

SEQ ID NO: 17059 - RNA, 67 nt, Human
ccucuuuccuuucuucagacaaacaccaaauaaaaugcaggugaaagagaugaaccacgacuagagg

SEQ ID NO: 17060 - RNA, 61 nt, Human
uuagaaauuuaugcugacucgaucuaaaaaaaauuauguugguuaauguuaaucuaucuaa

SEQ ID NO: 17061 - RNA, 98 nt, Human
uuucaugaugugcuacaugauagauuuguaaacaccugucucaauaaacuuauaguuguguuggaauagguauuauucucaguugcaucuucaugaaa

SEQ ID NO: 17062 - RNA, 60 nt, Human
ccuugcugagguuugccagccgggacaccaguuaacugcucguucagcugcucagcaagg

SEQ ID NO: 17063 - RNA, 80 nt, Human
gcagugcuugucuaacagcuucugggugcagauuuucuucggcauccuuuugcacucagcuuauuacagguagguagugc

SEQ ID NO: 17064 - RNA, 89 nt, Human
uuuuauaugaccugcagguaaaaagcacauuuaauuauaaacaauauauucaaaaugggcaaauuuuauuuucaaaugcagguguagag

SEQ ID NO: 17065 - RNA, 72 nt, Human
guaaagccgucggacauccuuggagagaggauagauuccuuaauucuuuugccaaguaugccucggcuuggc

SEQ ID NO: 17066 - RNA, 63 nt, Human
ccugucuuggggcucuccuaccgauuggcugugggcgacaauccgaucgugccccaagacagg

SEQ ID NO: 17067 - RNA, 93 nt, Human
cgucuuccagccgggggacacuauccucgaagacaccucguguuucacccguguuuuugcggcgagaaggcugucccccgugcggggggggcg

SEQ ID NO: 17068 - RNA, 72 nt, Human
ccaaagggucggcagguggagccucggggggggggcccccgguggggcuccacccgucacauggcccgaggg

SEQ ID NO: 17069 - RNA, 84 nt, Human
cgucaugucuaagucagagucuccuaaagagcccgaacagcugaggaagcucuucauggaggguugagcuugaaacaacugaug

SEQ ID NO: 17070 - RNA, 63 nt, Human
ggucgaaguggucuggaacuugcggggcguggagggguccggcgggaaugaccacuuccggcc

SEQ ID NO: 17071 - RNA, 73 nt, Human
uugaagaggguuuaauaugggaguuauuuuacauagguugugggcauguguagcugcccauuaugcccuucaa

SEQ ID NO: 17072 - RNA, 78 nt, Human
gguaaaguggggaaggccacaucugagcggggucgcgcucggugauuguuccuggccaguguggagucucuaaacacc

SEQ ID NO: 17073 - RNA, 60 nt, Human; identical to SEQ ID NO: 1551

SEQ ID NO: 17074 - RNA, 73 nt, Human
cugugggcgagugaaaggguuccaaccggaaggggaacuggacgcaagggacaacacgcacucgggaacacag

SEQ ID NO: 17075 - RNA, 79 nt, Human
gccugggccugagcagcaucguuggcgucugguaccugcugaggaagcacuggauugccaacaaccuuuuuggccuggc

SEQ ID NO: 17076 - RNA, 67 nt, Human
guuuuuuccagccagcuuuccaaaucgacaguaccagcugcucuucacacaggguucuggggaaaac

SEQ ID NO: 17077 - RNA, 61 nt, Human
ggggcuuggggcuggggccugcagcagaagugugcccagcgucucucagcucccgcacccc

SEQ ID NO: 17078 - RNA, 109 nt, Human
ugucuucucagguagcagggcgcguuuccacuuaaggugugucugucacgcaccucauucuccccagacagucuuugaguaacaucuguucccaucuuccuuggaagca

SEQ ID NO: 17079 - RNA, 61 nt, Human; identical to SEQ ID NO: 6766

SEQ ID NO: 17080 - RNA, 76 nt, Human; identical to SEQ ID NO: 758

SEQ ID NO: 17081 - RNA, 86 nt, Human
cacaggagggauccuuggguuaaggauuguauuuaaaaacccccaaacggcguuuuaacaaugguaaccccccuagggcuccugug

SEQ ID NO: 17082 - RNA, 79 nt, Human; identical to SEQ ID NO: 7764

SEQ ID NO: 17083 - RNA, 117 nt, Human
cugggugcgguggugugcaccuguaaucccagcuacuugggaggcugaggcagaagaaucgcuugaacccaggagguggagguugcagugagccaagaucacaccacugcacuccag

SEQ ID NO: 17084 - RNA, 93 nt, Human
cuucaccacuucaccacugugcauccugggaaguggccuccuccuuuaaauagggauggaggucuccagggugugcucuggaagauugugagg

SEQ ID NO: 17085 - RNA, 65 nt, Human
ggucccacugaagcaccucuauuuaaaucccccuguuccgaauaagggagcuguguaaauggacc

SEQ ID NO: 17086 - RNA, 61 nt, Human
uucuuuggcauuuauucacuagaucucuaaacaggagaucacuguuucguaugcucuagag

SEQ ID NO: 17087 - RNA, 86 nt, Human
auugcaggauggagcacugagaaagcaagauguuggcuaccagaaauggaguuucaaaaauuuucuuaaaagcucuauuggacaau

SEQ ID NO: 17088 - RNA, 63 nt, Human
ucaguaaaacauuuucaaaagucaucaauauuuuggaucugagcauuuaaauguuuuauauga

SEQ ID NO: 17089 - RNA, 79 nt, Human
ugaggggugaauucaugauccucgcuuacugacuuccugcgcucggggagucaggugcggggagcgguuaagcccuuca

SEQ ID NO: 17090 - RNA, 66 nt, Human
guugcuguagccaaauucguugucauaccaggaaaugagcuugacaaaguggucguugagggcaau

SEQ ID NO: 17091 - RNA, 60 nt, Human
gaugggauggaaaugaaauggccaaaagagcaaaggcuuauuucaaaaccuuugucccuc

SEQ ID NO: 17092 - RNA, 62 nt, Human
gucccccccccucgccacggcaaacauagcaaaaaaaugucccucuuggcccccggggggac

SEQ ID NO: 17093 - RNA, 61 nt, Human
uccuccgcgggcaugaccaguccgccuacgacggcaaggauuacaucgcccugaacgagga

SEQ ID NO: 17094 - RNA, 69 nt, Human
cugcgugcgcagguucgucgucugugccaggagaaucaguggcuacgggaugaacuggccaacacgcag

SEQ ID NO: 17095 - RNA, 72 nt, Human
gcguucgcgcccggcggcgcuccaggugcugacagcgcgagagagcgcggcccucaggagcaaggcgaaugu

SEQ ID NO: 17096 - RNA, 60 nt, Human
uccaguacgccucgcaggggcgcuacgagguagcugugccccucugcaagcaggccugga

SEQ ID NO: 17097 - RNA, 65 nt, Human
gaaggccggcggguugcggccacccacggauuaagguccacgggggcuucuuugcguuggucuuu

SEQ ID NO: 17098 - RNA, 70 nt, Human
ggcuagcgucccugucggagcgggccucgcguuguggacgaggcgcagagaccgcgucagggacgcagcc

SEQ ID NO: 17099 - RNA, 67 nt, Human
uccagaggggaagacgaaggcaugguucagggcaccgugaagucccauucuguuuuguucccuugga

SEQ ID NO: 17100 - RNA, 72 nt, Human
uuacagggcugcuugaacccucauaggccuaggcuuuggucuaaaaggaacauuuaaaaaguugcccuguaa

SEQ ID NO: 17101 - RNA, 83 nt, Human
ggucuaguugucuuagaguugggcugaacagaagcacucuuccaagggcgcugcagcaauuuucagugagacagcagaagacu

SEQ ID NO: 17102 - RNA, 65 nt, Human
ucgcuccucagcggauugcuggauaaggucaguuuucucagacucccgccacugaugaggagaga

SEQ ID NO: 17103 - RNA, 71 nt, Human
uucaaaaccagaagcagucgagacauaggacaaccuagcaguuggccuuauaaguggcucuuuguuuugaa

SEQ ID NO: 17104 - RNA, 85 nt, Human
uucgcuggcucgcaaaucacauuucaucaagcucagaugacuuauuuggcaugugggcucgugcaggaugucaugcagaagugaa

SEQ ID NO: 17105 - RNA, 71 nt, Human
gacgaauccuuaguacuguggaaaagagcagacagaaauauaaaccagcuucucucacaguggaauucguc

SEQ ID NO: 17106 - RNA, 78 nt, Human
ccggaaccugcucaucuggaucaagaagaauuugcuaaaagagcggccagaguuguucauccaggagacagcgugcgg

SEQ ID NO: 17107 - RNA, 72 nt, Human; identical to SEQ ID NO: 5861

SEQ ID NO: 17108 - RNA, 76 nt, Human
gcguguuggcuuggcuguugacauggaugaaauugaaaaguaccaagaaguggaagaagaccaagacccaucaugc

SEQ ID NO: 17109 - RNA, 97 nt, Human
acaguauugcuagggggcagaaaauuccuaucuucucugccgcgugggcuaccacacaaugagauugcaggucagaucugucgccaggcuugguugu

SEQ ID NO: 17110 - RNA, 72 nt, Human
cggggccgcacccgagcuacgccgugccgcaccgguugggccggucggugggagcucugggagcaggcgcug

SEQ ID NO: 17111 - RNA, 74 nt, Human; identical to SEQ ID NO: 12863

SEQ ID NO: 17112 - RNA, 70 nt, Human
cgccgacgcccccgaggaggaggaccacguccuggugcugaggaaaagcaacuucgcggaggcgcuggcg

SEQ ID NO: 17113 - RNA, 88 nt, Human
gcggggaggauuuauaaaggcgaggccgggaccggcgcgcgcucucgucgcccccgcugucccggcggcgccaaccgaagcgccccgc

SEQ ID NO: 17114 - RNA, 66 nt, Human
uggggguuguccucuuuaagaacaguugaugaacgccggaacaacuuugaaaggggagggucccca

SEQ ID NO: 17115 - RNA, 82 nt, Human
caucucgagacagcgguucagaaagucccggaagauagcugacagcuucucuggguucugaaguucuggggucccauuggug

SEQ ID NO: 17116 - RNA, 82 nt, Human
guggagugaggcuggagaggggcuuggcaaucuucaggaauugaugcuguagcagcucuuuagcugaaccucucuucuccac

SEQ ID NO: 17117 - RNA, 64 nt, Human
gcgcgcggugguggugggcuuugacccgcacuucagcuacaugaagcucaccaaggcccugcgc

SEQ ID NO: 17118 - RNA, 62 nt, Human
aggggcauauuuuauauuagugaagagguauuacugacacaauuucuucuauauaugaaccu

SEQ ID NO: 17119 - RNA, 60 nt, Human
gcaggaucuccaacuauaaugcuucuguccuuaaaagcagguggaguugguugaaucugu

SEQ ID NO: 17120 - RNA, 93 nt, Human
uuuaguaaggucaguuugauuggauacuuaaguuuuagaaaugagaaaaauacagaguuuuagaaaugagaucuagagaacacgucuucuaaa

SEQ ID NO: 17121 - RNA, 67 nt, Human
cauugucgucauuggacacguagauucgggcaaguccaccacuacguggccaucugaucuauaaaug

SEQ ID NO: 17122 - RNA, 67 nt, Human
ggugacaaaccauugcugugagccaagcugcuaacaugccuugguuccaacgcgauggcaagucacc

SEQ ID NO: 17123 - RNA, 100 nt, Human
gacgagagcccugaaggcagcgcugccgacgaccucuacagcaugcucgaggaggagaggcagcagaggcaugagcagcgacccgcggcggggcggcguc

SEQ ID NO: 17124 - RNA, 60 nt, Human
ggggcggcauccccagccugguucgggccgugacggcggcggcaugcagggacgcgcccc

SEQ ID NO: 17125 - RNA, 76 nt, Human
cccaggcgucgaagcaaugcuccggucuuagccucccaaguagcggcgaguacaggcacagugccacgacgccggg

SEQ ID NO: 17126 - RNA, 64 nt, Human; identical to SEQ ID NO: 15556

SEQ ID NO: 17127 - RNA, 86 nt, Human
agacuugauguuuuugaaaguugucaccaguuuauugucaccuuccaacugaaccacugucuugacuuucuccccugucauugucu

SEQ ID NO: 17128 - RNA, 64 nt, Human
guauauauauauauauauauauauguaugcgugaguguguguguauauauauauauauauguau

SEQ ID NO: 17129 - RNA, 91 nt, Human
ucacuacagucucagucaacagugugaauguaucauguuuuacuuuaaaugugugugugauacuucuucauuauguccugcgcugcaguga

SEQ ID NO: 17130 - RNA, 70 nt, Human
cauccagccaaagaggucgaagcggcucuggacacuuugggggggucgcgcagggggcucgguggggaug

SEQ ID NO: 17131 - RNA, 80 nt, Human
ucaugucuaagucagagucuccuaaagagcccgaacagcugaggaagcucuucauggaggguugagcuugaaacaacuga

SEQ ID NO: 17132 - RNA, 63 nt, Human
cucuaucugccgagcuucuucaccuacgccaaguacaucgugcaaguggaugguaagauaggg

SEQ ID NO: 17133 - RNA, 90 nt, Human
uccuacgagaugaugaugcagugugugucccgcauguuggcccacccccugcaugucaucucaaugcgcugcaugguccaguuuguggga

SEQ ID NO: 17134 - RNA, 86 nt, Human
ggcacgacggugggaccuuccacugcagacacaaagcacaccaccaccugaggucgaggguuaugauuugaauccuaccaagugcc

SEQ ID NO: 17135 - RNA, 114 nt, Human
cgcgaucgggaauuggcagugagcguguuccagaguucagucugcgccucagguaacacgggccugacgccggcgcgucucucgggaauaaccuggcuguuggugagaucugcg

SEQ ID NO: 17136 - RNA, 79 nt, Human
cuggaugcuuuggagccaagcuuucgucccaugcaagggaaacaaccacuucugggauguccgcugcaaucugcuccgg

SEQ ID NO: 17137 - RNA, 77 nt, Human
gcagaaugcccagagucuucccugguagaugcagguuccauagcgacguucuccugcaaugcacgcugguauucugc

SEQ ID NO: 17138 - RNA, 92 nt, Human
gagggugucuauggagaggcggcggcgcggcugcugaggcggaggcugaggcaguggcgauggcgcccuuuccugaagaaguggacgucuuc

SEQ ID NO: 17139 - RNA, 61 nt, Human
uauuccgcuggaugacaagucagauaacgaagcagaagugucagaacauuccacagguaua

SEQ ID NO: 17140 - RNA, 74 nt, Human
ccuacagcacaaucccccgcucagcuggcugguagggcccuucgccuugcccgcuggcgggcaguagcuguagg

SEQ ID NO: 17141 - RNA, 94 nt, Human
gcgcccgggcgcuacuggaagaggucaaggcgcugcucggcccugcgccugaggacgaggaugagcggccugaggccgaggacagcccgggugc

SEQ ID NO: 17142 - RNA, 75 nt, Human
ggcaguagaggccgcuauggcgaacguuccgugggcagaggucugcgagaaauuccaggcggcgcucgcucuguc

SEQ ID NO: 17143 - RNA, 64 nt, Human
caagucugagcucuggaagccagaagccuuuagccaggaauuuggagaccaggauguagacuug

SEQ ID NO: 17144 - RNA, 72 nt, Human
guugggauucccaucggggagggugcucaugaugaagagguacucaagacaauugacgagggagaugccgau

SEQ ID NO: 17145 - RNA, 63 nt, Human
uaacagcagaagauagaagaguugguacaacaaaucuucacuuagaugugucugaugcuguua

SEQ ID NO: 17146 - RNA, 62 nt, Human
uggcaggcucaaucuggccucuaggcuaccuagcuacuuuguaaggccugaucugggcccca

SEQ ID NO: 17147 - RNA, 65 nt, Human
gaagaugauguuuuuauuccucuguauccaaagagugcuguagaaaacaaaacaucaccucauuc

SEQ ID NO: 17148 - RNA, 70 nt, Human
guuaccuuauuauagcacuucucaaugccacaccugggccagaugugguuaaaaagugcaaccagguagc

SEQ ID NO: 17149 - RNA, 61 nt, Human
guuccaagaaagacaguucuggucaggccuaaagcucuuccgcaauauucuucuuuggaau

SEQ ID NO: 17150 - RNA, 83 nt, Human
aggcaugaaguuugaucgaggcuauauuucuccauacuuuauuaauacaucaaaaggucagaaaugugaauuccaggaugccu

SEQ ID NO: 17151 - RNA, 87 nt, Human; identical to SEQ ID NO: 76

SEQ ID NO: 17152 - RNA, 97 nt, Human
ggcuguggauagcuuggugccaauuggucguggucagcgugaacugauuauuggugacccgacagacugggaaaaccucaauugcuaugacacaauc

SEQ ID NO: 17153 - RNA, 75 nt, Human; identical to SEQ ID NO: 74

SEQ ID NO: 17154 - RNA, 87 nt, Human; identical to SEQ ID NO: 76

SEQ ID NO: 17155 - RNA, 87 nt, Human; identical to SEQ ID NO: 76

SEQ ID NO: 17156 - RNA, 87 nt, Human; identical to SEQ ID NO: 76

SEQ ID NO: 17157 - RNA, 87 nt, Human; identical to SEQ ID NO: 76

SEQ ID NO: 17158 - RNA, 75 nt, Human; identical to SEQ ID NO: 74

SEQ ID NO: 17159 - RNA, 87 nt, Human; identical to SEQ ID NO: 76

SEQ ID NO: 17160 - RNA, 71 nt, Human; identical to SEQ ID NO: 77

SEQ ID NO: 17161 - RNA, 75 nt, Human; identical to SEQ ID NO: 74

SEQ ID NO: 17162 - RNA, 87 nt, Human; identical to SEQ ID NO: 76

SEQ ID NO: 17163 - RNA, 71 nt, Human; identical to SEQ ID NO: 77

SEQ ID NO: 17164 - RNA, 75 nt, Human
gcagcuggaucgggccucagagcaggcggcaggcguugcccacgcugucagcugaggugucaaggucauggcugu

SEQ ID NO: 17165 - RNA, 75 nt, Human; identical to SEQ ID NO: 74

SEQ ID NO: 17166 - RNA, 87 nt, Human; identical to SEQ ID NO: 76

SEQ ID NO: 17167 - RNA, 71 nt, Human; identical to SEQ ID NO: 77

SEQ ID NO: 17168 - RNA, 75 nt, Human
gagauguccucuauucuugaagagcguauccuuggagcugauaccucuguugaucuugaagaaacugggcguguc

SEQ ID NO: 17169 - RNA, 71 nt, Human; identical to SEQ ID NO: 77

SEQ ID NO: 17170 - RNA, 75 nt, Human; identical to SEQ ID NO: 74

SEQ ID NO: 17171 - RNA, 71 nt, Human; identical to SEQ ID NO: 77

SEQ ID NO: 17172 - RNA, 75 nt, Human; identical to SEQ ID NO: 74

SEQ ID NO: 17173 - RNA, 87 nt, Human; identical to SEQ ID NO: 76

SEQ ID NO: 17174 - RNA, 71 nt, Human; identical to SEQ ID NO: 77

SEQ ID NO: 17175 - RNA, 75 nt, Human; identical to SEQ ID NO: 74

SEQ ID NO: 17176 - RNA, 61 nt, Human
gcuauugacacaaucauuaaccagaaacguuucaaugauggaucugaugaaaagaaaaagc

SEQ ID NO: 17177 - RNA, 87 nt, Human; identical to SEQ ID NO: 76

SEQ ID NO: 17178 - RNA, 71 nt, Human; identical to SEQ ID NO: 77

SEQ ID NO: 17179 - RNA, 63 nt, Human; identical to SEQ ID NO: 3963

SEQ ID NO: 17180 - RNA, 75 nt, Human; identical to SEQ ID NO: 74

SEQ ID NO: 17181 - RNA, 71 nt, Human; identical to SEQ ID NO: 77

SEQ ID NO: 17182 - RNA, 75 nt, Human; identical to SEQ ID NO: 74

SEQ ID NO: 17183 - RNA, 87 nt, Human; identical to SEQ ID NO: 76

SEQ ID NO: 17184 - RNA, 78 nt, Human; identical to SEQ ID NO: 99

SEQ ID NO: 17185 - RNA, 66 nt, Human
gaagguuaagcuggcuguccugaaauauuauaaggugggaugagaauggcaaaauuagucgccuuc

SEQ ID NO: 17186 - RNA, 80 nt, Human; identical to SEQ ID NO: 100

SEQ ID NO: 17187 - RNA, 65 nt, Human; identical to SEQ ID NO: 1518

SEQ ID NO: 17188 - RNA, 75 nt, Human; identical to SEQ ID NO: 74

SEQ ID NO: 17189 - RNA, 92 nt, Human
gcugcaaggaacuuccaugccucuaacacucaucuucaaaagacugggacugcugagauguccucuauucuugaagagcguauucuuggagc

SEQ ID NO: 17190 - RNA, 87 nt, Human; identical to SEQ ID NO: 76

SEQ ID NO: 17191 - RNA, 71 nt, Human; identical to SEQ ID NO: 77

SEQ ID NO: 17192 - RNA, 87 nt, Human; identical to SEQ ID NO: 76

SEQ ID NO: 17193 - RNA, 75 nt, Human; identical to SEQ ID NO: 74

SEQ ID NO: 17194 - RNA, 87 nt, Human; identical to SEQ ID NO: 76

SEQ ID NO: 17195 - RNA, 71 nt, Human; identical to SEQ ID NO: 77

SEQ ID NO: 17196 - RNA, 65 nt, Human; identical to SEQ ID NO: 1518

SEQ ID NO: 17197 - RNA, 75 nt, Human; identical to SEQ ID NO: 74

SEQ ID NO: 17198 - RNA, 87 nt, Human; identical to SEQ ID NO: 76

SEQ ID NO: 17199 - RNA, 71 nt, Human; identical to SEQ ID NO: 77

SEQ ID NO: 17200 - RNA, 78 nt, Human; identical to SEQ ID NO: 10175

SEQ ID NO: 17201 - RNA, 63 nt, Human
gagcuguaucugcagguucguaagcauagagacgauuugaauaucuuccagugauaucggcuc

SEQ ID NO: 17202 - RNA, 61 nt, Human
auuacauaugucauugguucccuuuuaauuugaauggguggggauaaaauaaagauguaau

SEQ ID NO: 17203 - RNA, 61 nt, Human
gauguuuuaaacauagaacauugguuggaauaauaacacauuaauaacaauuuaaaauguc

SEQ ID NO: 17204 - RNA, 68 nt, Human
uguauauauuauguacacauagaauguuacauauuauauauaugguuuuagguguauauauauguaua

SEQ ID NO: 17205 - RNA, 77 nt, Human
auaucaaaaggaaguuauaaggccauugagagaaaaucucagaagaagucaacaggcccaagauaccucagugauau

SEQ ID NO: 17206 - RNA, 66 nt, Human
gaugcagaaagaacuugaggugacuaaugacauaauagcaaaacuucaagccaaaguucaugaauc

SEQ ID NO: 17207 - RNA, 65 nt, Human
uaaagaaaaguuacaaccaagaacugggagauuuuccaaagcucuaaagugacugaacagcuuua

SEQ ID NO: 17208 - RNA, 65 nt, Human; identical to SEQ ID NO: 1518

SEQ ID NO: 17209 - RNA, 80 nt, Human
cugcccuggcccaccuccgugcugcgguccuguaugugauggauuugucugagcagugugggcaugggcugagggagcag

SEQ ID NO: 17210 - RNA, 70 nt, Human
cuguugccuaguuuuguacauggaucucauuuuacaagagaaucucucugcaaaaaaaaaaaaaaaacag

SEQ ID NO: 17211 - RNA, 72 nt, Human
gguuauaguacuaccaauguuggugacuugguaagauuauauccaggugauugguguguguguauuauggcu

SEQ ID NO: 17212 - RNA, 76 nt, Human
ccgggguuccaccccuuucuccggcccucagccucccccguacuguggcacugccggccccuggcccuagucccgg

SEQ ID NO: 17213 - RNA, 87 nt, Human
cgggcuugaccggcgucggcccgccgccuccgcugccgcuucgccccaauccggucccucuggcccggccugacccggucuggcuug

SEQ ID NO: 17214 - RNA, 71 nt, Human
cgcuuccuaucucagcgcccugccgccgccgccgcggcccagcgagcggcccugaugcaggccaucaagug

SEQ ID NO: 17215 - RNA, 75 nt, Human; identical to SEQ ID NO: 12725

SEQ ID NO: 17216 - RNA, 60 nt, Human
gcuuaugggauacagcuggacaagaagauuaugacagauuacgcccccuauccuaucagc

SEQ ID NO: 17217 - RNA, 90 nt, Human
ggaggccggaugugaguggagcggccauuuccuguuucucugcaguuuuccucagcuuugggugguggccgcugccgggcaucggcuucc

SEQ ID NO: 17218 - RNA, 76 nt, Human
ccauugauuagguguauuagauacuaauuuggccuauuuuaagaaccaaaaacuaacuucuagacaaacuucaagg

SEQ ID NO: 17219 - RNA, 77 nt, Human
aagcugaaggugcuggaggugccaagugaagugugugcauuuuugauaacuguguacuucuggugacuguacaguuu

SEQ ID NO: 17220 - RNA, 67 nt, Human
acuggcccauggguugcauugagaaccaacguugugcuugacuuguagucccuuuacugcggucagu

SEQ ID NO: 17221 - RNA, 61 nt, Human
gggcuaaaugaucuacagccuuggccuaaucaaauggcuauagcauguggaucucgagcuc

SEQ ID NO: 17222 - RNA, 61 nt, Human
ucuucacgccaucgcacuggacagaggcgucugaaacccugcccuggccaguggcgugaga

SEQ ID NO: 17223 - RNA, 84 nt, Human; identical to SEQ ID NO: 384

SEQ ID NO: 17224 - RNA, 89 nt, Human; identical to SEQ ID NO: 385

SEQ ID NO: 17225 - RNA, 75 nt, Human; identical to SEQ ID NO: 74

SEQ ID NO: 17226 - RNA, 87 nt, Human; identical to SEQ ID NO: 76

SEQ ID NO: 17227 - RNA, 71 nt, Human; identical to SEQ ID NO: 77

SEQ ID NO: 17228 - RNA, 65 nt, Human; identical to SEQ ID NO: 1518

SEQ ID NO: 17229 - RNA, 75 nt, Human; identical to SEQ ID NO: 74

SEQ ID NO: 17230 - RNA, 87 nt, Human; identical to SEQ ID NO: 76

SEQ ID NO: 17231 - RNA, 78 nt, Human
accuucggguccacugguuugaugacacccaccgcaacugucuguggcauaucacgaacagcaaagcgacccaaaggu

SEQ ID NO: 17232 - RNA, 65 nt, Human; identical to SEQ ID NO: 1518

SEQ ID NO: 17233 - RNA, 87 nt, Human; identical to SEQ ID NO: 76

SEQ ID NO: 17234 - RNA, 65 nt, Human; identical to SEQ ID NO: 1518

SEQ ID NO: 17235 - RNA, 75 nt, Human; identical to SEQ ID NO: 74

SEQ ID NO: 17236 - RNA, 87 nt, Human; identical to SEQ ID NO: 76

SEQ ID NO: 17237 - RNA, 71 nt, Human; identical to SEQ ID NO: 77

SEQ ID NO: 17238 - RNA, 75 nt, Human; identical to SEQ ID NO: 74

SEQ ID NO: 17239 - RNA, 75 nt, Human; identical to SEQ ID NO: 74

SEQ ID NO: 17240 - RNA, 87 nt, Human; identical to SEQ ID NO: 76

SEQ ID NO: 17241 - RNA, 71 nt, Human; identical to SEQ ID NO: 77

SEQ ID NO: 17242 - RNA, 61 nt, Human; identical to SEQ ID NO: 1238

SEQ ID NO: 17243 - RNA, 75 nt, Human; identical to SEQ ID NO: 74

SEQ ID NO: 17244 - RNA, 87 nt, Human; identical to SEQ ID NO: 76

SEQ ID NO: 17245 - RNA, 71 nt, Human; identical to SEQ ID NO: 77

SEQ ID NO: 17246 - RNA, 65 nt, Human; identical to SEQ ID NO: 1518

SEQ ID NO: 17247 - RNA, 75 nt, Human; identical to SEQ ID NO: 74

SEQ ID NO: 17248 - RNA, 87 nt, Human; identical to SEQ ID NO: 76

SEQ ID NO: 17249 - RNA, 65 nt, Human; identical to SEQ ID NO: 1518

SEQ ID NO: 17250 - RNA, 75 nt, Human; identical to SEQ ID NO: 74

SEQ ID NO: 17251 - RNA, 87 nt, Human; identical to SEQ ID NO: 76

SEQ ID NO: 17252 - RNA, 75 nt, Human; identical to SEQ ID NO: 74

SEQ ID NO: 17253 - RNA, 87 nt, Human; identical to SEQ ID NO: 76

SEQ ID NO: 17254 - RNA, 71 nt, Human; identical to SEQ ID NO: 77

SEQ ID NO: 17255 - RNA, 62 nt, Human
ggaacuuguaacuuuaugcaagagucuguucuugacuuugacaaaccuucaagugcaauucc

SEQ ID NO: 17256 - RNA, 64 nt, Human
auucuauuagagugguauuuuuauccaauuucacagauuaaaauauaaggcacuucaauaaaau

SEQ ID NO: 17257 - RNA, 68 nt, Human
cauuuugcuuauucauggcaucuuucaaauuuuauuuuaguuuccuuuauuugccaagaauacauaug

SEQ ID NO: 17258 - RNA, 81 nt, Human
uaaggagagaaggaaaggguaggaaaccagggccuuggguuuaguaacaggcauuggaugucuauuaaccaacuauucuua

SEQ ID NO: 17259 - RNA, 68 nt, Human
cucaguaaaacggcauuuuguuagcuuucuccuuacuccaccaggggaauaacagugaauuuagugag

SEQ ID NO: 17260 - RNA, 130 nt, Human
gaagagaagaaaugggagcaggcagcccucgucagcagaccgggagccgcgugggcgcggagccauuugcauuccggucugcguggggcucggggaugcuggugacaggcccgguucccgguggcucgcc

SEQ ID NO: 17261 - RNA, 60 nt, Human; identical to SEQ ID NO: 10165

SEQ ID NO: 17262 - RNA, 95 nt, Human
gccuggcuccagcagccugggcauggcggcgacucccccaaaaacaccccagcugggugggugccugggggccuaggugaggcugguguuggagc

SEQ ID NO: 17263 - RNA, 79 nt, Human
aacucuaaaggaucagcugauuuauaaucuucuaaaggaagaacagaccccccagaauaagauuacaguuguugggguu

SEQ ID NO: 17264 - RNA, 71 nt, Human
agacaaauugaagggagagaugauggaccuccaacauggcagccuuuuccuuagaacaccaaagauugucu

SEQ ID NO: 17265 - RNA, 60 nt, Human
gauuggacauuugaacagacagugggaaacugcaauuacaugccugucuacuguucuauc

SEQ ID NO: 17266 - RNA, 75 nt, Human
ggugcgggagcgacggggcccagggauuguguuuaaaguagugcuucuaccaacaugucccgugguuccagcgcc

SEQ ID NO: 17267 - RNA, 79 nt, Human
cccgcguaucauacaccuuccuaggggcgugagucaagggcucaggauugcccauguggaucacugugugcugcucggg

SEQ ID NO: 17268 - RNA, 62 nt, Human
gggcucgggcucugggcucaccaccucaucgaucagagggaggcccaguucuguccgggccc

SEQ ID NO: 17269 - RNA, 65 nt, Human
gcauccuugguuggaagggccaagcacacaccuaacaggcagcugggccucucgacuuggggugc

SEQ ID NO: 17270 - RNA, 74 nt, Human; identical to SEQ ID NO: 15934

SEQ ID NO: 17271 - RNA, 61 nt, Human
gcggacauuaaacaccaugacgguuuacguccacgggggccucaccaaacaauugucccgc

SEQ ID NO: 17272 - RNA, 82 nt, Human
ggcaccagcaagagcccagggcucaggucgaugcgggguaacuccgggcauggaccugauaagccucggcucugcgcaagcc

SEQ ID NO: 17273 - RNA, 62 nt, Human
ggccuauugaagacaccugcucaguaugacgcuucugagcuaaaagcuuccaugaaggggcu

SEQ ID NO: 17274 - RNA, 84 nt, Human
ugguaucgacugccuugcuacaccucaggcccggggcugccuugccacccguggccacuucggccaagugcccuuuugaugcca

SEQ ID NO: 17275 - RNA, 64 nt, Human
cccuccagaaccugugcgagaaagaccugaaggagauccagcaccaccugaagaaacuggaggg

SEQ ID NO: 17276 - RNA, 108 nt, Human
cauaacuguaaauuguugguagguagaaguuaauauuugugguucauguauauuuugaccagaguauauuuaaguauauaauuucagcuuccuugauuuagaaauaug

SEQ ID NO: 17277 - RNA, 61 nt, Human; identical to SEQ ID NO: 3214

SEQ ID NO: 17278 - RNA, 65 nt, Human; identical to SEQ ID NO: 5312

SEQ ID NO: 17279 - RNA, 85 nt, Human; identical to SEQ ID NO: 3621

SEQ ID NO: 17280 - RNA, 62 nt, Human
gguuuaccauaugugaaauuuguuuuugacuuacaaaaaugcccaugucacauggguucacc

SEQ ID NO: 17281 - RNA, 97 nt, Human
uaacaaaaaccacuuuuauuuuuaaaucaauuuacuaucaaauacacaacagaacucgguguggaggcaguguuugauuucaacugguuaucuguua

SEQ ID NO: 17282 - RNA, 96 nt, Human
uccucacuguagcaucuugucaguggcacuacuuuuaaaaaaaugauucccuuuagaaaagcuaguauauuuguauucagagauuacaagugaggg

SEQ ID NO: 17283 - RNA, 81 nt, Human
ucgguguggaggcaguguuugauuucaacugguuaucuguuaaaaggcuugugucccagugcaacacuaccuuugugcaga

SEQ ID NO: 17284 - RNA, 78 nt, Human; identical to SEQ ID NO: 99

SEQ ID NO: 17285 - RNA, 65 nt, Human; identical to SEQ ID NO: 247

SEQ ID NO: 17286 - RNA, 80 nt, Human; identical to SEQ ID NO: 100

SEQ ID NO: 17287 - RNA, 63 nt, Human
caggggaggggaagaagguggacauugcggguaucuaccccccugugaccacccccuucacug

SEQ ID NO: 17288 - RNA, 72 nt, Human
cuggguccccaagucuggucuucugugaggcaggggcuaagcaggagcuuguccaggaaugugggggucugg

SEQ ID NO: 17289 - RNA, 75 nt, Human
cuguggggggcgucugcgcccuggccaauguccugggggcucagguaugccagcuggagcgacugugcugcacgg

SEQ ID NO: 17290 - RNA, 89 nt, Human
gaccucauuguuccacaaauugugccucuauuuuuaccauuuuggguaaacgucaggauagagauaccacauguggcaagccaaagguc

SEQ ID NO: 17291 - RNA, 63 nt, Human; identical to SEQ ID NO: 2971

SEQ ID NO: 17292 - RNA, 61 nt, Human; identical to SEQ ID NO: 1092

SEQ ID NO: 17293 - RNA, 72 nt, Human
uuagaaacuauugacuguccauagugguuauugauauuccucucaacccuuuuaagucugauccccuucuaa

SEQ ID NO: 17294 - RNA, 82 nt, Human; identical to SEQ ID NO: 1770

SEQ ID NO: 17295 - RNA, 65 nt, Human
ucuccuugcagcucaaucaaggcaaucugcauaguaagaagagugugggauuuggaggcaagaga

SEQ ID NO: 17296 - RNA, 69 nt, Human
uuuuucagaagguuuuaaaagacugaugaauacugauggaaaauuacacuuaaaaccacuuaugaaaaa

SEQ ID NO: 17297 - RNA, 128 nt, Human
guugacacucaucucuuuugucuuaugcuuagccauauuuaaaucuuaaauuuaauagagucuagugaaaaaaugagugggaagaaugaauauaaaaguaauaauauaaggaaaaagggaaaguaaac

SEQ ID NO: 17298 - RNA, 63 nt, Human; identical to SEQ ID NO: 981

SEQ ID NO: 17299 - RNA, 65 nt, Human; identical to SEQ ID NO: 1253

SEQ ID NO: 17300 - RNA, 60 nt, Human
gagaaggccagguuuucuaccuaugggguuuuucuacccggagauacuaaugggcuucuu

SEQ ID NO: 17301 - RNA, 78 nt, Human
gcugcuaaucauagugguauuugguugggaaugacuuguggagcagguaguaccuuuacggcuguggcuuuuggcagc

SEQ ID NO: 17302 - RNA, 66 nt, Human
uagccucacagaugacuuaaaaaucugguauuuucuacaucagaguucauagcggggauggggcua

SEQ ID NO: 17303 - RNA, 60 nt, Human; identical to SEQ ID NO: 7955

SEQ ID NO: 17304 - RNA, 70 nt, Human
acccucuuuauucacaaguguaccucugcuaaccauaauuacaucacuaagccuguuaguuugagagggu

SEQ ID NO: 17305 - RNA, 64 nt, Human
gugcccaaucaauucuugguuuauucuuuuccaaaaaguaaaauaaccaaagucuuaaaaguac

SEQ ID NO: 17306 - RNA, 73 nt, Human
guaacacaacuuuuauaauuaaccacugaaguugucuuuaaggacaaaacuuaaauuuuaaaauggguguuac

SEQ ID NO: 17307 - RNA, 66 nt, Human
guugccuugcuccaagucugggcaucgugacauugccgugaugcccagaagaaaguuaauggcaau

SEQ ID NO: 17308 - RNA, 62 nt, Human
gaaaaaguuuggcaaaggcacagguuuuggcaguagaucuuguuuuucuugccauccacuuc

SEQ ID NO: 17309 - RNA, 111 nt, Human
ggauauggagaaugauaccagguaucaagcucauagcggccaaaagcaauuguuuuaaucauguugcuucccucugugauuuggacuugcagccuuaacuucuccaaaucc

SEQ ID NO: 17310 - RNA, 62 nt, Human
ugaucuccugugggucuggugcuauauucuagagaaguuugcaccuggacaauaggaauucg

SEQ ID NO: 17311 - RNA, 62 nt, Human; identical to SEQ ID NO: 6172

SEQ ID NO: 17312 - RNA, 82 nt, Human
gcugcugcugcuccccagcccaccagugccuggccagccugcccccuucccuggacagggcuguggagauggcuccggcggc

SEQ ID NO: 17313 - RNA, 80 nt, Human; identical to SEQ ID NO: 9351

SEQ ID NO: 17314 - RNA, 84 nt, Human; identical to SEQ ID NO: 2448

SEQ ID NO: 17315 - RNA, 98 nt, Human
ugucggcuuugcuggcccagcaagccugauaagcaugaagcucuuaucuuugguggcuguggucggguguuugcuggugcccccagcugaagccaaca

SEQ ID NO: 17316 - RNA, 78 nt, Human; identical to SEQ ID NO: 99

SEQ ID NO: 17317 - RNA, 80 nt, Human; identical to SEQ ID NO: 100

SEQ ID NO: 17318 - RNA, 108 nt, Human
ggcagcugcugcguggaugugcugggugcugagcaagcuggagcucaggcucucauacauuuuggcccugccugcuuaagcccuccagcccgcccacugcccguugcc

SEQ ID NO: 17319 - RNA, 93 nt, Human
ggcuuuggcuacucuccugcgcccacgguaccuggaccugcuagucuccagcccagcuuuuccccaaccaguggguucccugaguccagagcc

SEQ ID NO: 17320 - RNA, 76 nt, Human
gugcuucgucaacguucuguggccuuggagcucugugucaaggccuuugaggcccagaacccagaccccaaagcgc

SEQ ID NO: 17321 - RNA, 101 nt, Human; identical to SEQ ID NO: 411

SEQ ID NO: 17322 - RNA, 101 nt, Human
cagguccuuccuuuagagucugguuguugcaccaucugcuugguuggcuggcagcugagagcccugcugugggagagcgaagggggucaaaggaagacuug

SEQ ID NO: 17323 - RNA, 69 nt, Human
ugggaaccacgucaccacgguacaacaagcagcaagcaauguauuuaccauggcgaggggcacauuuca

SEQ ID NO: 17324 - RNA, 69 nt, Human
aaggcuugaucuuagaaguucaaaauuguuccauaugguaaagacacauucacugccuggucaggccuu

SEQ ID NO: 17325 - RNA, 69 nt, Human
guauuuccagcuguuuuucaauaagcaccauccacacgagucaguauuauuuucaaaaggcuucuauac

SEQ ID NO: 17326 - RNA, 130 nt, Human
uuuccuuuccugcauuucugaauuugucauguugcuuaucuugcucagaauuuccuucauucucaaaaguaugggugugguacagauuuucgggcagcagcauguaacacuuuauagguagguuuuccaa

SEQ ID NO: 17327 - RNA, 84 nt, Human
aaaugauguuguggaugcaacagaacuccuacaauguaaaauaaucguucacauuugagggguucuuauccacuuugcuuauuu

SEQ ID NO: 17328 - RNA, 78 nt, Human
ccaccagucuguccccaucucugaaauccuuccuucucuuucccccuaagucuuuugagugucaucauguacuggugg

SEQ ID NO: 17329 - RNA, 75 nt, Human
gccagcucagccuuggcuuuuaacucaauauuccaguccauaggggugguuaaaaguugcugcaaggcugcaggc

SEQ ID NO: 17330 - RNA, 62 nt, Human
cuugauggauaaaagucuucauguuggcacucaaugugccuuaacaagaagaugcccacaag

SEQ ID NO: 17331 - RNA, 75 nt, Human; identical to SEQ ID NO: 74

SEQ ID NO: 17332 - RNA, 71 nt, Human; identical to SEQ ID NO: 77

SEQ ID NO: 17333 - RNA, 66 nt, Human
gcugacgugggugugaucgcuagcagcuucgagaucgggaaccuggcgcucauccucuucgugagc

SEQ ID NO: 17334 - RNA, 82 nt, Human
gggacacgcuacgcccggccaccucccgguggcacgaauccccccuugcgccuacccuuggaggccggcgcgcccccccccc

SEQ ID NO: 17335 - RNA, 68 nt, Human
guguccugcuuuuccaacaucaagaucuuccugguguccgagugcgcccugaugcuggcgcagggcac

SEQ ID NO: 17336 - RNA, 99 nt, Human
gggccgucuccucaaacagcccgaagaucaggaucuuguucuucaugcccugcuggaaggacgaguuccuccgggucuugcagaugaucggaucggccc

SEQ ID NO: 17337 - RNA, 74 nt, Human
uggacgacaacgaugcucacaaagaaggccguguggcaggugaacuccaccaccuuccucugcucguaugucca

SEQ ID NO: 17338 - RNA, 81 nt, Human
aacccgguggaaaaaaggggcuccccggaggacaaccccccccuggggggguuuacuaaaucccggggccccggccggguu

SEQ ID NO: 17339 - RNA, 79 nt, Human
cgggggggguccccccaaaagggguucucucuuuccaagcgccgcgcuggggaaaagggggccccgggucccccccccg

SEQ ID NO: 17340 - RNA, 65 nt, Human
gggaacaaaaaaaggggggggcccacccccccccccaaaaagggccccccccuucaaaaaacccc

SEQ ID NO: 17341 - RNA, 63 nt, Human
gggugagccccaggauucccccuaaccccgggggcccccgaaggggguucucaagguucaccc

SEQ ID NO: 17342 - RNA, 75 nt, Human; identical to SEQ ID NO: 74

SEQ ID NO: 17343 - RNA, 87 nt, Human; identical to SEQ ID NO: 76

SEQ ID NO: 17344 - RNA, 71 nt, Human; identical to SEQ ID NO: 77

SEQ ID NO: 17345 - RNA, 78 nt, Human; identical to SEQ ID NO: 99

SEQ ID NO: 17346 - RNA, 80 nt, Human; identical to SEQ ID NO: 100

SEQ ID NO: 17347 - RNA, 75 nt, Human
cuacggggaugaucgucgugguggcagaggaggcuaugaucgaggcggcuaccggggccgcggcggggaccgugg

SEQ ID NO: 17348 - RNA, 72 nt, Human
cgcugugcgugagcugcgacggcaagguggagcacuaccgcaucauguaccaugccagcaagcucagcaucg

SEQ ID NO: 17349 - RNA, 78 nt, Human
gaggagguguacuuugagaaccucuuguugcugguggagcacuacaccucagacguuuauuuuuucuguacgcgccuc

SEQ ID NO: 17350 - RNA, 61 nt, Human; identical to SEQ ID NO: 823

SEQ ID NO: 17351 - RNA, 83 nt, Human; identical to SEQ ID NO: 11462

SEQ ID NO: 17352 - RNA, 72 nt, Human
gggauggaaagucacccguaaagauggcaaugccagugggaacacgcugccugaagcucuggacugcauccu

SEQ ID NO: 17353 - RNA, 79 nt, Human; identical to SEQ ID NO: 1810

SEQ ID NO: 17354 - RNA, 81 nt, Human
cauggcaaccgccaaggccguugcugcuggcaauuccugucgccaggaagaugucauugccacagccucugagccgccgug

SEQ ID NO: 17355 - RNA, 76 nt, Human
ucaacgcagugaaagauguagccaaagcccugugagaccucaucagugcaacgaaggcugcagcuggcaaaguugg

SEQ ID NO: 17356 - RNA, 73 nt, Human
agaagaaggauagguagcccuuagugccccagcuuucagcuuguuucugugggcagcuacugucuuauuuucu

SEQ ID NO: 17357 - RNA, 101 nt, Human
ugaggcaggagaaucacuugaaccccaggaggcggagguugcagugagcugagaucacgccacugcacuccagccuggcgacugagugagacuccgucuca

SEQ ID NO: 17358 - RNA, 65 nt, Human
gaguacccaagcaaugccguggaggaggucacucagaacaacuuccggcuccucugcaagggcuc

SEQ ID NO: 17359 - RNA, 63 nt, Human
gggagugucucacucaucauucugcucaccgauggcgaccccacuguggaggagacuaacccc

SEQ ID NO: 17360 - RNA, 61 nt, Human
ugguucugcuuuuauacccucuggugucucaccagaaauguucuugcuagcagaaauacua

SEQ ID NO: 17361 - RNA, 73 nt, Human
uuucugugacagucacugcccucaggcuuggccuguccugauaggcugggugguagugcaucuuccauagggg

SEQ ID NO: 17362 - RNA, 106 nt, Human
uuguuucggacuauagagugcugauggcagagauuggugaggauuuggauaaaucugauguguccucauuaauuuuccucaugaaggauuacaugggccgaggcag

SEQ ID NO: 17363 - RNA, 88 nt, Human
gaagaugauacuguugugguagcacuggacuuacaaggugugguauucccuuacuuuccacgacuggggcgcuacaaucucaauuuuc

SEQ ID NO: 17364 - RNA, 97 nt, Human
ggagucaggaacuacggauuuugggauaaagauaaaagcagauaugauguuuucuguuuuacauccaauuucaauggccguuuuuacuaucugaucc

SEQ ID NO: 17365 - RNA, 62 nt, Human
cuggagcagugggugaccgaggaggccgccugccuuugugccgccuucgccaaccacuccgg

SEQ ID NO: 17366 - RNA, 70 nt, Human
ccacuuguaaaugacuauaaacuauuaugugauugcuuuuuuuuuuuagaaugucuuguuuaaauagugg

SEQ ID NO: 17367 - RNA, 82 nt, Human
uauggaaggguguaaagauucuuuugaaagguuuauucacauuguagaacagcaaaugacauuuuuacaguauuuuuuugua

SEQ ID NO: 17368 - RNA, 66 nt, Human
ugguauauguguauuagugaaacauuguaaaggugaacuucuaccucuguaucuaaauguauacca

SEQ ID NO: 17369 - RNA, 75 nt, Human
uuccucaggaaguugcuguguuucauuucuuuggauggacucuuaucuagaauacauagcagcucugcaaaggaa

SEQ ID NO: 17370 - RNA, 76 nt, Human
gccagaaacucauaauccagaggaacuguguccagcaagcgggcguaguugccauugaucugggcgaugaucuggu

SEQ ID NO: 17371 - RNA, 72 nt, Human
ugcagggcuuaauaaaguaguuguugcccagaaucuuggaagguggcuuaucacuguagccagcccuuugcg

SEQ ID NO: 17372 - RNA, 74 nt, Human
gcuuaauauaguggugagaaguguaugguguuuaacggaggggggggaguguuaaggguuauuguggguugagu

SEQ ID NO: 17373 - RNA, 67 nt, Human
guguggcaaguaagguuuauauuugugaguuguguuggcgggcagauguuuuuuuucuuggauauau

SEQ ID NO: 17374 - RNA, 87 nt, Human
uagaugggggaaauguuuguuuuggguuuuggagggggguguuuuuuuuuuuuuguuuggagauguauauuauauuuuuaauaucua

SEQ ID NO: 17375 - RNA, 62 nt, Human
uuuacaggguugaagaguuugggaggggguuuuacguuguuagaggauggaaauuuuguggg

SEQ ID NO: 17376 - RNA, 81 nt, Human
agcacguuggcaguguuuuuuuuggcuuuucguguuguuggggcggcggcgauguuggugggggugcgcuggggguguguu

SEQ ID NO: 17377 - RNA, 65 nt, Human
ccggagguugagugcaguggguuugguugguugggucugccugggguuguguguauuguuuccgg

SEQ ID NO: 17378 - RNA, 101 nt, Human
cguggagguguagagggaucgcggucuggucgugugauuuugggaguuguuuggggugcggguucugugucgggugggagcguuuguuguggaccuccgcg

SEQ ID NO: 17379 - RNA, 87 nt, Human; identical to SEQ ID NO: 76

SEQ ID NO: 17380 - RNA, 71 nt, Human; identical to SEQ ID NO: 77

SEQ ID NO: 17381 - RNA, 90 nt, Human
cauaggaagccauaguucuuuguuaccacagggaauuacguccaagugaauuuccugauucucaggugacuaaaaagcuagcacucuaug

SEQ ID NO: 17382 - RNA, 105 nt, Human
gccccccuuuuauaugagaugaauaaccaauaauaauuuuuuuuaauaagaccccaaugaacuuguauuaaaaggauuuuguucccagaauauaaaaaccaggac

SEQ ID NO: 17383 - RNA, 74 nt, Human
uugcauuuccagaauucugaguuaaagaaacaaaguguuugcuuuguaacaggccaaaauucuauuuccugcaa

SEQ ID NO: 17384 - RNA, 95 nt, Human
guuugagguguuugugguauaauuuuuuugcguuuaguaugguguguaguuauauauauugaguuuaaggguuguguguauagaguauuuuggau

SEQ ID NO: 17385 - RNA, 75 nt, Human
uaauuuauguuuauuauuuauacguuauauucgguuuauuuauuguguugguguguaaaauguagguguuuauug

SEQ ID NO: 17386 - RNA, 110 nt, Human
acuuggagcaaaagauugaggugcauuucaugccuccuuuugagagucuugcucugucgcccaggcuguagugcaguggcgcaaucuuggcugcaccucagccuccaagu

SEQ ID NO: 17387 - RNA, 65 nt, Human
cuauguaaauucuagagaguagcagaccucucaucugaagucuuagugaaucucuuuugacauag

SEQ ID NO: 17388 - RNA, 65 nt, Human
guaucuuucuucuuuccccuuucuuuuucuaaacaagagaagaaaagcguaauagaggggagaac

SEQ ID NO: 17389 - RNA, 72 nt, Human
gacacaaagaugaaaagcuuggccacaaaggagcugacggugccguggcgagagagauccaucuugacgguc

SEQ ID NO: 17390 - RNA, 60 nt, Human
ggugagggccaccaccccacugugggggcucaccuuccggguggugaaaaagcccuccuc

SEQ ID NO: 17391 - RNA, 95 nt, Human
cucaggaggacuuguuugcacacagagcaauguuaggcacugcuguuuugggaauuuggcuuucauuaauguucuaaggcagauaucuacuuggg

SEQ ID NO: 17392 - RNA, 131 nt, Human; identical to SEQ ID NO: 6294

SEQ ID NO: 17393 - RNA, 61 nt, Human; identical to SEQ ID NO: 776

SEQ ID NO: 17394 - RNA, 77 nt, Human
cccaaugcuggucucaguaaaacacugagguggaagcuuacacaucucccucagccucugguuuuucagcacuuggg

SEQ ID NO: 17395 - RNA, 92 nt, Human
cgcuacuggcaagucugucuggggcucccucgcuguccagaacagcccuaaggguugccaccgggacaagaggacccagauugucuacagug

SEQ ID NO: 17396 - RNA, 67 nt, Human
ucaggccguugcugagcucaacgggacccagguggagucuguacagcucaaagucaacauagcccga

SEQ ID NO: 17397 - RNA, 88 nt, Human
uccaugugacugucggcgggcuuugucucuggauucgauggcucugcgggcacagccaucaucacagaagagcaugcagccaugugga

SEQ ID NO: 17398 - RNA, 70 nt, Human
ccauuuaaugaccagcagucacugagcgcugugaaaauucacucagugauaccccguguggucuugaagg

SEQ ID NO: 17399 - RNA, 62 nt, Human
gugauucucucagcccugagguauacagaaucauuugccucagacugcuguuggauuuuaac

SEQ ID NO: 17400 - RNA, 86 nt, Human
guggcacagcuggagaguggggagcugggacuugagcccagguaguguguccccagcaccuucaacuaaacuccauucugugcugc

SEQ ID NO: 17401 - RNA, 72 nt, Human
uuuuuuucagugaacauguuuuuauugaacaccaacuuaauuucaggaacauuucagguacauugucagaaa

SEQ ID NO: 17402 - RNA, 61 nt, Human; identical to SEQ ID NO: 776

SEQ ID NO: 17403 - RNA, 87 nt, Human
agacaucacgguggaggacaugaacgagcuagagcgacaguuucuugaauugcugcaguucagacaucaauguuccuuccagugucu

SEQ ID NO: 17404 - RNA, 63 nt, Human
uagguugagaaaagacagacuugggguagagcuaggccgagucgcccucccuuucucuuuuua

SEQ ID NO: 17405 - RNA, 60 nt, Human; identical to SEQ ID NO: 3438

SEQ ID NO: 17406 - RNA, 76 nt, Human
guauacagguccuucagggaggcaagagaccuuucgacuggucugcaggugccuccaaaugcugguccuguggaac

SEQ ID NO: 17407 - RNA, 67 nt, Human
ccagcaacgacauguaccacagccgcgcgcugcagguggugcgcgcccgcaagcagaucguagcugg

SEQ ID NO: 17408 - RNA, 75 nt, Human; identical to SEQ ID NO: 197

SEQ ID NO: 17409 - RNA, 67 nt, Human
agccccaccucggcccgauaagcugacacuaagaacuugagggagagcgaacggcucgagugggucu

SEQ ID NO: 17410 - RNA, 110 nt, Human
gagcggggccgggcgggagggugggcaggccgcggcggccugggcucgcgggagcucacuuuguuccugccccgccggcggggcgagccgguucucuccccgucucucuc

SEQ ID NO: 17411 - RNA, 86 nt, Human
gccauccugucggugaacggcaccgaccugcgccaggccacccacgaccaggccgugcaggcgcugaagcgcgcgggcaaggaggu

SEQ ID NO: 17412 - RNA, 108 nt, Human
aaauggaagaagauacaguauuguuuagaucagaaucauuaaaaaauauuuuuguuuaguaaguuugaagauuucuggcuuuuaggccuuuucuauuuuguuccauuu

SEQ ID NO: 17413 - RNA, 66 nt, Human; identical to SEQ ID NO: 1526

SEQ ID NO: 17414 - RNA, 104 nt, Human
agauguuaagguaugcuucaaaaauuuuguaaauguuuauuuuaaacuuaucuguuuguaaauuguaacugauuaagaauugugauaguucagcuugaaugucu

SEQ ID NO: 17415 - RNA, 61 nt, Human
cuccuguggugaauggauaaguaaaggcagaaaagauuuuuugucauaccuccaugugggg

SEQ ID NO: 17416 - RNA, 84 nt, Human; identical to SEQ ID NO: 286

SEQ ID NO: 17417 - RNA, 89 nt, Human; identical to SEQ ID NO: 288

SEQ ID NO: 17418 - RNA, 94 nt, Human; identical to SEQ ID NO: 5398

SEQ ID NO: 17419 - RNA, 102 nt, Human; identical to SEQ ID NO: 2701

SEQ ID NO: 17420 - RNA, 87 nt, Human
cguuacgggugcuggcggcugcagccggaguucaaaccuaagcagcuggaaggaaccauggccaacugugagcguaccuucauugcg

SEQ ID NO: 17421 - RNA, 92 nt, Human
ucuugugggagagauuaucaagcguuuugagcagaaaggauuccgccuuguuggucugaaauucaugcaagcuuccgaagaucuucucaagg

SEQ ID NO: 17422 - RNA, 98 nt, Human
caugguggcgcaugucuguagucccagcuacucaggagacuaaggugaaaagaucaucugagccugggaaguuguggcugcagugaguugugaucaug

SEQ ID NO: 17423 - RNA, 78 nt, Human
gagguuaagugacuugcucaaugccacacugaaaauuuagcacaaagccaggucuggagcagagguggcuugaaccuc

SEQ ID NO: 17424 - RNA, 81 nt, Human
uucauccauuucuguauuuguauccauuucuguauccccagugcuucauacaguaggauuuaauauaugcagggugaugag

SEQ ID NO: 17425 - RNA, 71 nt, Human
gaggacgugggggcugcugcccaacacggaggcugggcuggccugguccgugggcucagguucucauccuc

SEQ ID NO: 17426 - RNA, 99 nt, Human
ggugaguccuucaacuacaucugcaagguuuuauuucuuaggaaaauauuuaaagcaaauauuucaaaaaugacuaaaucugagugguagggagucacu

SEQ ID NO: 17427 - RNA, 102 nt, Human
gugcaucugccuccugugcgucucugugcacacgcuuguaucuggaugcagaguccugugcccaguguacaugcacagaugugcgcaucuggguagaugugc

SEQ ID NO: 17428 - RNA, 63 nt, Human
caguguggagcaggggcugggucugaggccccuccugaggcuucauccuugcucugcagccug

SEQ ID NO: 17429 - RNA, 87 nt, Human
ccccacagcugggccuccuuccucuuuuccaagccccuuccagaagaguggccacugggcaggcaccggaaauggccaucugcgggg

SEQ ID NO: 17430 - RNA, 65 nt, Human
ggaacagcgguggaggccgagcaguccccaccuccuuggguggcucaguccucagccucuggucc

SEQ ID NO: 17431 - RNA, 63 nt, Human; identical to SEQ ID NO: 11804

SEQ ID NO: 17432 - RNA, 86 nt, Human
gccauuggccaggccaccagggguccccaugauaaugcacagcuaguugcuugagcaugguuauggugauucgugcccccaacagc

SEQ ID NO: 17433 - RNA, 105 nt, Human
guguauguuuuuuugugucuuggggaagcuuugaaauacuugcugauuuauggagagugaaaagugaaccagacuuucucagaacauuuagaaaaacucagacac

SEQ ID NO: 17434 - RNA, 60 nt, Human
gcaucuauucauacauuaaauuauguuuccuguucauaauaucaaacaucucacaggugc

SEQ ID NO: 17435 - RNA, 66 nt, Human
uaauggucuuaugccaauccaugcagaaaaauaagacacaaugcaggagucagaugaggaccauua

SEQ ID NO: 17436 - RNA, 62 nt, Human
augcaguauuugguuuccuguuccuguguuaauuugcuuaggauaauggccuccagcugcau

SEQ ID NO: 17437 - RNA, 80 nt, Human
cgugagccaauucucccuaauaaacucccuuauauauguagucauauauccuacuaguucuguuccucuggagaaucaug

SEQ ID NO: 17438 - RNA, 82 nt, Human
uaauacaaaauccuugucaguuuugcuagauguuuaucaauuuuauacauucuuuuagaagacuuuauuuuauuuuguuuua

SEQ ID NO: 17439 - RNA, 93 nt, Human
agacugaggaccaagacugacacagacucucuucuguuucccuuaucuccuuuccaaaguaagucugugaaucuacccugguccuuuccuucu

SEQ ID NO: 17440 - RNA, 69 nt, Human; identical to SEQ ID NO: 16589

SEQ ID NO: 17441 - RNA, 63 nt, Human; identical to SEQ ID NO: 16591

SEQ ID NO: 17442 - RNA, 70 nt, Human
caucaugcaguuucuucauuagguaguccagcuggauuuucuuacaugacagcagaaacagucaaagaug

SEQ ID NO: 17443 - RNA, 62 nt, Human
ggcucauucgauaucuccucacucaccugucuggugccucggugauggcuguugugugagcc

SEQ ID NO: 17444 - RNA, 63 nt, Human
uaguuauguguugugugauaaaccauauaaaauuuagugucuuaaaaucacaacacuuuauug

SEQ ID NO: 17445 - RNA, 101 nt, Human
ugcuauagaauguuagaugacauauuauugacugagggauuucuggauaagagauuacuaacucauguuuucugaaucucgugauuuaaaauuuuguagua

SEQ ID NO: 17446 - RNA, 66 nt, Human
caacuccgccucuggccuggccucuucaacugugcugugggagaggaguugcugaagacugaguug

SEQ ID NO: 17447 - RNA, 63 nt, Human
gcaccgcagcacccuugggagcucccagugccucugggugacuugggggugccagcauugugc

SEQ ID NO: 17448 - RNA, 72 nt, Human
ugaugaaaugcacuuucccgugcagcaguguucuuuugccugucaacugcugggugguuuuugcauucauca

SEQ ID NO: 17449 - RNA, 85 nt, Human
ugcaaagcgcucaaauguggaagccagucauuggcauuuuuauuuuuuauugauugauugauuuuuucaccaguggcuuuuugua

SEQ ID NO: 17450 - RNA, 77 nt, Human
gccugugaaccaaagcuucgugcacauguguuccccuaaagguuggggagccucgcugugucuugcuguucccaggc

SEQ ID NO: 17451 - RNA, 67 nt, Human
gucuugccuccugucugcagcugugaauagucauuugacugugacuguugcccuuagccagccagau

SEQ ID NO: 17452 - RNA, 60 nt, Human
cggcauuuugccuuccuguuuuugcucacccagaaacgcuggugaaaguaaaagaugcug

SEQ ID NO: 17453 - RNA, 85 nt, Human
ucggggaaaugugcgcggaaccccuauuuguuuauuuuucuaaauacauucaaauauguauccgcucaugagacaauaacccuga

SEQ ID NO: 17454 - RNA, 64 nt, Human
gaggcugggcugagcaggagcgcaaugaauugucagacagcuggaguucagugagccagacuuc

SEQ ID NO: 17455 - RNA, 68 nt, Human; identical to SEQ ID NO: 4221

SEQ ID NO: 17456 - RNA, 96 nt, Human
cacguguacauauguauagguacgagcgcugcggccuccccgugcgcccucccgcgaccgggggcccgguuuguauguacauagaauguauaggug

SEQ ID NO: 17457 - RNA, 69 nt, Human
gcuuugcacuucggaaccuguugcguuuugacccacggagguggaggaguaacuuuuugacauguuggc

SEQ ID NO: 17458 - RNA, 62 nt, Human
acuggaaggauggauauagaccaccugcuggucgaucaguguccgguaacccuccuugcggu

SEQ ID NO: 17459 - RNA, 88 nt, Human
uuccccccuuccugugugcuggggaguuagcugugagcuggcuggggugggguccguggcuggguccguggcugggucugauggggaa

SEQ ID NO: 17460 - RNA, 71 nt, Human
auccccguucccgauuccuguaguagcggcuguauugcagccgccugccgaacugacccgggucuguggau

SEQ ID NO: 17461 - RNA, 65 nt, Human
gcgcaguuucaucuagcgacuggucacccuugcaauuauggauauuuacucgcgucccacugcgc

SEQ ID NO: 17462 - RNA, 74 nt, Human
ggucccucuggcgccguucgguuucucuuauugccuucacugaggaugagucccuuuguggcucuauguggacc

SEQ ID NO: 17463 - RNA, 69 nt, Human
aggaggaguuuuuuuuuuuucuuuuuauuuuuuuuuuuuuuuuaaaaaaaaaaaaaaaaaaucccuccu

SEQ ID NO: 17464 - RNA, 81 nt, Human
cagaccccagacacccauuguccauagccuucucagggcagagugggcugguuguguugacaauaaaacaguguugguuug

SEQ ID NO: 17465 - RNA, 85 nt, Human
augauccaucuguguaguuucugaacagucagcgauuccagguuuuaaauaguuguaaauuuucaguuucuacacacuuuaucau

SEQ ID NO: 17466 - RNA, 76 nt, Human
gaucgcguggccgccaaaagaugaggaccccgccaacugaucauggcagcaaaucauaggcaagcggccgcggauc

SEQ ID NO: 17467 - RNA, 60 nt, Human
ggauugugggggcaaugaaugaagcgaacagauuuucguucauuuugguucucaggguuu

SEQ ID NO: 17468 - RNA, 61 nt, Human; identical to SEQ ID NO: 823

SEQ ID NO: 17469 - RNA, 65 nt, Human
gaagucagcacuuacauuacgaaaauggguacaaccccgacacaguagcaauuggugccaauuuc

SEQ ID NO: 17470 - RNA, 61 nt, Human
ggugacaacaugcuggagccaagugcuaacaugccugugguucaagggauggaaagucacc

SEQ ID NO: 17471 - RNA, 89 nt, Human
cagagcugcaaggccuucgcuggcucuccugaguacgugaaccuccccaucaauggcaacgggaaacagugaggguuggggugacucug

SEQ ID NO: 17472 - RNA, 62 nt, Human
ggcaagaccuucguugugggagaccagaucuccuucgcugacuacaaccugcuggacuugcu

SEQ ID NO: 17473 - RNA, 64 nt, Human
gguguacaggguaaaugacggcguggaguagcugcgcugcaaauacgucgcccucgucuacacc

SEQ ID NO: 17474 - RNA, 67 nt, Human
gcauauucauggcuuagauuuuaaaucacauuuacagaugagggaaaacuucuaggccuaaacaggu

SEQ ID NO: 17475 - RNA, 73 nt, Human
guuaguucaguacuuauuagcugcaggagcuaacguucaugcaagaacagcaacaggggauacagcgacuaac

SEQ ID NO: 17476 - RNA, 83 nt, Human
acuggaacaacguuugacgguguuggggggugcuguacauuggcugauaacacuuagcaaacacugaucuuacugugugaagu

SEQ ID NO: 17477 - RNA, 61 nt, Human
uaguguugaagguugugcguccacaccuacuuaguggcucaguggaaagcacgucgcauua

SEQ ID NO: 17478 - RNA, 60 nt, Human
ucucacaguuccucuggagaaaaaaaagagaaagagguccagggcaggaggaucaugaga

SEQ ID NO: 17479 - RNA, 83 nt, Human
ucucuugcaacgugugagcugccucuugccaagagugaguggcaaaagaaacuaaccccggagcaguucuacgucacaagaga

SEQ ID NO: 17480 - RNA, 60 nt, Human
agcacagaacugcuuuuuauuuggggucugugaguuucuuagguauuagcaaucugugcu

SEQ ID NO: 17481 - RNA, 72 nt, Human
gcuuauuuucuaacuuaaaauucaccuggaacuuuaaaugggaaaggauucuuuuaauuguggauuauaggc

SEQ ID NO: 17482 - RNA, 66 nt, Human
cagcuguuuucacucauuagcuccugagguaaacaaauggaaaaaaugagcgaacuggaacaguug

SEQ ID NO: 17483 - RNA, 82 nt, Human
gccucuuccaaauuaugggauauccgagauggcauguguuagacagucuuccaggggacaugucccagauaucaaggguggc

SEQ ID NO: 17484 - RNA, 61 nt, Human
aucggucaaacgggucauacgcaaguguugacacauauuguguacacucccuaggacugau

SEQ ID NO: 17485 - RNA, 82 nt, Human
gguugcacaacgagcacagcccggacuaugaguuggagaucuaaauucugaucugagucuggaacugacaaguugugugacc

SEQ ID NO: 17486 - RNA, 60 nt, Human
cccugggguuuccaccuccugccuccggccuccagagggugugaggccccaaccccaggg

SEQ ID NO: 17487 - RNA, 70 nt, Human
guaccgagaccucuuccagcaggggaccugagggcuguccucgcugcugagaagagccauaacucgugac

SEQ ID NO: 17488 - RNA, 74 nt, Human
ccaucaggagagggggggucagaaggggacaggguguuacugguguuuuaauuugcuccgccucuugcugaugg

SEQ ID NO: 17489 - RNA, 60 nt, Human
cugcaucaucagugucaugucuguagcugggagcuggagacccaagaaauccuggugcag

SEQ ID NO: 17490 - RNA, 84 nt, Human
gaaaaaugaguaaaauaauuaaugaaacauauuuagagcacuuaauggucucuguuuucaauauaauucuugauuucauuuuuc

SEQ ID NO: 17491 - RNA, 80 nt, Human
gcuugccauccugcaguaguauaaaucaugaauaaaaaauaauuuugcuguuguaguauacauuggagaaacuggcaggu

SEQ ID NO: 17492 - RNA, 94 nt, Human
ccucccgugcugcccgggggcaggcaggugggcaaggagggggcaggaagccccccaggccucaccuucugaguccccaaucagggcagggagg

SEQ ID NO: 17493 - RNA, 68 nt, Human
cuuaggagaacacagcugauuuuaacauguucugaggagcacaauuuuucuugcugguacucaugaag

SEQ ID NO: 17494 - RNA, 60 nt, Human
gggccgggggugaaugcggccgaggcccuuucaaggcuuugaaugauaccacuaaggccc

SEQ ID NO: 17495 - RNA, 81 nt, Human
gacaagaggguggucuaccugggggccaugcuucuauuggaugagagggacgaugcccaccuggugauuaccaacaguguu

SEQ ID NO: 17496 - RNA, 77 nt, Human
ccuccggccucgguagaaccgccagcccgcguccgaaggcggaggcgaggggaacuggccgcgugaggggccugagg

SEQ ID NO: 17497 - RNA, 63 nt, Human
cuuccaugcauauugacgagggaucuagucuaaguaagaaugucuuuugccugcgcguggagg

SEQ ID NO: 17498 - RNA, 68 nt, Human
uaucaaguacuuaguuuggccaaauuuagaguauaguuuaaaggggaaaaaaaguuuguauuuugaug

SEQ ID NO: 17499 - RNA, 82 nt, Human; identical to SEQ ID NO: 6291

SEQ ID NO: 17500 - RNA, 80 nt, Human; identical to SEQ ID NO: 887

SEQ ID NO: 17501 - RNA, 83 nt, Human
ccugacgcaguuguuccugcagacccagcaccagcgggaugaguccaggagugggucacguaccucugggaucagcugucagg

SEQ ID NO: 17502 - RNA, 64 nt, Human
ggucucauugacaggauaguggccagggaugcuugugcagaacauaaucauguugacgagugcc

SEQ ID NO: 17503 - RNA, 61 nt, Human
auauuuucauguauuucucacaggaauuugauacuucccacugugaauacugguuaaguau

SEQ ID NO: 17504 - RNA, 70 nt, Human
cacuguucacugccgacaucccucccccagcagaaugggaggcaggggacaagggaggcaguggcuagug

SEQ ID NO: 17505 - RNA, 96 nt, Human
gacccgggguggggugcacucgccauuuccucacgugcaggacagcucuugauuuggguggaaaacagggugcuaaagccaaccagccuuuggguc

SEQ ID NO: 17506 - RNA, 72 nt, Human
gcaguagccagccauacuauguguauucccaguaucauguacgcacuaaaaaaaaugugugcuugcugcugc

SEQ ID NO: 17507 - RNA, 80 nt, Human
ugagagauuagaaaauguuuggaauuuauaaaauuaauguuuuucuuuguaaccauuuauauauauuuuuuaacauuuua

SEQ ID NO: 17508 - RNA, 72 nt, Human
ggacgaauccuuaguacuguggaaaagagcagacagaaauauaaccagcuucucucacaguggaauucgucc

SEQ ID NO: 17509 - RNA, 64 nt, Human
guugcuuauugcaucucuuuggagccauuguagccggugggcagaggaaugcuuugcaagcaau

SEQ ID NO: 17510 - RNA, 65 nt, Human
ucuccagccacuauggaaguucuuaugcgaguauuggcagauugugauuccugggaggauggaga

SEQ ID NO: 17511 - RNA, 61 nt, Human
gcugaaacaggagcugucccugcugccccuaacggagccugcuaucaccgccaauuuuagc

SEQ ID NO: 17512 - RNA, 64 nt, Human
ucuuugcccccuuuggcaguggcugcccagucaaugggcagagccagcugaggggggcuuugga

SEQ ID NO: 17513 - RNA, 64 nt, Human
agcaugagccacugcaccgggcugacaugucaaaauaaagguuaagugcuauggucugaauguu

SEQ ID NO: 17514 - RNA, 60 nt, Human
gugggcaaggucaucccugagcugaacggaaagcucaccuggauggcuuucgugucccau

SEQ ID NO: 17515 - RNA, 64 nt, Human
guggacucgcugauguuuggaaagauuggacuugcuacagaaggucuuuccacagugaugacac

SEQ ID NO: 17516 - RNA, 65 nt, Human; identical to SEQ ID NO: 1518

SEQ ID NO: 17517 - RNA, 75 nt, Human; identical to SEQ ID NO: 74

SEQ ID NO: 17518 - RNA, 70 nt, Human
guaggcgaguuggucugaaagcccccgguaucauuccucgaauuucagugcgcggaaccaacuugcagac

SEQ ID NO: 17519 - RNA, 88 nt, Human
guccuugaacuuggaaccugacaauguugguguugucgugucuggaaaugauaaacuaauuaacggaaggagauauagugaagaggac

SEQ ID NO: 17520 - RNA, 71 nt, Human; identical to SEQ ID NO: 77

SEQ ID NO: 17521 - RNA, 67 nt, Human
ccgcagccgggcugaggcugagagcauguaccagaucaaguaugaggagcugcagagccuggcuggg

SEQ ID NO: 17522 - RNA, 76 nt, Human
gaucucggacacaucuguggugcuguccauggacaacagccgcucccuggacauggacagcaucauugcugagguc

SEQ ID NO: 17523 - RNA, 60 nt, Human
ccacuguauuuacuccuuuggaauauggugcuuguggccuuucugaggagaaagcugugg

SEQ ID NO: 17524 - RNA, 80 nt, Human
cgggcuuucccaagaauccucccaagguugcuuccccaagcuucggcugggguuggccuuuggauccccgggaagguccg

SEQ ID NO: 17525 - RNA, 61 nt, Human
gcgguccaacccagaucaaccaaguggugagucauccaaaccagccucucaccaucaccgc

SEQ ID NO: 17526 - RNA, 61 nt, Human
ggccuccuguucugcugauggcaccguccgcaucugggaccccagcagcagcagcccggcc

SEQ ID NO: 17527 - RNA, 67 nt, Human
gugcuggcgcugaugcccuggcaaggucuucguaugaugcccaccuggcccugcccuggcgccacgc

SEQ ID NO: 17528 - RNA, 61 nt, Human
acaugccuugguucacggauggcaagucccccguaggauggcaugcccguggacacgcugu

SEQ ID NO: 17529 - RNA, 79 nt, Human; identical to SEQ ID NO: 1810

SEQ ID NO: 17530 - RNA, 131 nt, Human
cuuagaugguuucuucauuagaccauuuuacaagaugauguugggaaagcagauaacccugaaugacauggaaucuguggauagugaauauuacaacucuuugaaauggauccuggagaaugacccuacug

SEQ ID NO: 17531 - RNA, 74 nt, Human
gaggccacucccuuuaaaaaugcucaaaguguuggagcuacugugugacaacagcugacauuuaggagggcuuu

SEQ ID NO: 17532 - RNA, 63 nt, Human
agggauguauugugauuaucugaaauauugagauuuuugguagaccuggacaauacuaacccu

SEQ ID NO: 17533 - RNA, 73 nt, Human
gccuucacuaccgccuggagaagcacgagcgagcccgaugucgccguugaccuggacagcacuuguggagagc

SEQ ID NO: 17534 - RNA, 61 nt, Human
gucuccagugauccacagacugcgauucagaaccgacguacagcuagguaucucuggagac

SEQ ID NO: 17535 - RNA, 84 nt, Human
cugaacuugggccagccacucaucugacuuguccuucguucccuaaccugucaaguaaaacggaagagggauggaccgaaccag

SEQ ID NO: 17536 - RNA, 61 nt, Human
uagagcccccuuccuugcccuguauuuuuguuuuagagguugaguuuuggacuaggcuuug

SEQ ID NO: 17537 - RNA, 122 nt, Human
cgugcucucggccgaccuggugcacuaccugcgccucagccgcgacuaccugcgcgccuggcacagcgaggacgugucucugggcgccuggcuggcgccgguggacguccagcgggagcacg

SEQ ID NO: 17538 - RNA, 88 nt, Human
gcgacgcuggcgcgcgagggccgccugugcaagcgcgaggugcagcugcgccuguccuacguguacgacugguccgcgccgcccucgc

SEQ ID NO: 17539 - RNA, 63 nt, Human
gcggcugcagcaaccaguaccuggugacgcacaagcagagccuggaggacaugcuggagaagc

SEQ ID NO: 17540 - RNA, 86 nt, Human; identical to SEQ ID NO: 7823

SEQ ID NO: 17541 - RNA, 61 nt, Human
cuuggaacgaacuaauccugaaagaagaacuacuugugaagggcaaacaguuuaguucaag

SEQ ID NO: 17542 - RNA, 64 nt, Human
acccccuuucugcugcccucaccugugcaaaacuuaccacagccuuugaggaaguauggggggu

SEQ ID NO: 17543 - RNA, 67 nt, Human
gguaauuaagaauccaguaucagaucacuuuccaguuggauguaugaaaguuggcacuucuuuuucc

SEQ ID NO: 17544 - RNA, 94 nt, Human
acuaggguggcggggggacgaacuucucuuccucacaugagguuacuguuucuuuccucuguggggcauuggauccucccacaguugcccuggu

SEQ ID NO: 17545 - RNA, 67 nt, Human
gcgcuuuauguuuucuuccguuugauaauuaguugguuaaaagcugagggaaccggaaggaaagugc

SEQ ID NO: 17546 - RNA, 68 nt, Human
guuguuuuuauaaugggcguuuucacaugcacauauguguaugcauguauacgcccauacagacaugc

SEQ ID NO: 17547 - RNA, 80 nt, Human
cuggcccuccacuucccccacaaccauggcgcacgaauccgagaggagcucucgucucggggugcccugcggggagccgg

SEQ ID NO: 17548 - RNA, 70 nt, Human
gcgaggaggaucacccccaagucugugccaagugcugcgcacaauucacugacccaacugaauuccucgc

SEQ ID NO: 17549 - RNA, 82 nt, Human
gacgcugcuggccuuugccggguacucagggcuacuggcugggguggaagugagugcugggucaccccccauccgcaacguc

SEQ ID NO: 17550 - RNA, 65 nt, Human
gcgcgagccgccuggcaacucugcgacuacuaccugcccuacgcgcugggccgggggcuacgugc

SEQ ID NO: 17551 - RNA, 72 nt, Human
uacgaaaaccucacggccaaggugcuggccaugcuggccuggcuggacgagcacguggccuucgaguucgug

SEQ ID NO: 17552 - RNA, 110 nt, Human
cuucugccagccccuggccuuuacuuucuuccuugccuaugcagggcaaacaaaaugugaaauucugcccucagcugagcugaguaagggcuccuggggguuggcuggag

SEQ ID NO: 17553 - RNA, 68 nt, Human
aagcacaucaugggccagaauguugcagauuacaugcgcuacuuaauggaacgaagaugaagaugcuu

SEQ ID NO: 17554 - RNA, 62 nt, Human; identical to SEQ ID NO: 2350

SEQ ID NO: 17555 - RNA, 82 nt, Human
gcugaagccauuggugucugcuccgcugaucguccugaugcccgaggaccuguggaccguggaaaaugacaugauggucagc

SEQ ID NO: 17556 - RNA, 71 nt, Human; identical to SEQ ID NO: 4943

SEQ ID NO: 17557 - RNA, 63 nt, Human
cucuuuaggucccaaucacaugucuacaguugcuguccauucuuucauugagaucuaaggcag

SEQ ID NO: 17558 - RNA, 66 nt, Human
gggaagaaggaaugcugcacacagaugccgagaauuaaucggaacagacaggcauugcuggauccc

SEQ ID NO: 17559 - RNA, 82 nt, Human
ccucccauaguucucccgcgucugguuggcccguguguuccuuuuccuauaccuccccaggcagccuggggaacgugguugg

SEQ ID NO: 17560 - RNA, 71 nt, Human
ggaggccauggggcucuuuugucugaugguagccuuucucauccucuuugccaugugaaggagccgucucc

SEQ ID NO: 17561 - RNA, 84 nt, Human
ggcugggauuggaacuguguugggagccucaucauugguuaugccaggaacccuucucugaagcaacagcucuucuccuacgcc

SEQ ID NO: 17562 - RNA, 84 nt, Human
ugucuccacucccuccuuggucaagagcaccucacagcugcugagccguccgcuaucugcagggugcugaaacgaccggagaua

SEQ ID NO: 17563 - RNA, 70 nt, Human
augugguccaaccugggcauggccuagcuaucucccugucugugguuggggcagccuggggcaucuauau

SEQ ID NO: 17564 - RNA, 63 nt, Human
ccgugggagucugcuacaccauuuugauugggcuuccgcuugauguggcaugguuccugacgg

SEQ ID NO: 17565 - RNA, 66 nt, Human
gccagccagcccagcagcgcuccgugcuccaucggagagcggugugcggagaaggcaugagcuggc

SEQ ID NO: 17566 - RNA, 64 nt, Human
ucccugcugauuccgccuaagcccguaccccuuggcugagguuucgcuggauaguagguaggga

SEQ ID NO: 17567 - RNA, 64 nt, Human
agccacucagaaggcugaggcaggaggaucgcuugagaccaagaguuugagccugcggugagcu

SEQ ID NO: 17568 - RNA, 67 nt, Human
ggcaacaaaacaagacucugucucuacaaaaaguuuaagaaaugagccagacauggugguguaugcc

SEQ ID NO: 17569 - RNA, 62 nt, Human
uucuggucucagggugaugcauugcgccaugugggauauuuggcacggacugaggccaagaa

SEQ ID NO: 17570 - RNA, 90 nt, Human
auguccucgguugcaaaugugccuagauggucguaccgguaauccaaguacacugguggggcaggagccggccaagacgaaugaggacau

SEQ ID NO: 17571 - RNA, 78 nt, Human
cucugggaagcuuagaagauacuucagcacugggaggauucuuuuacaggaacuguguguugauuucugguuccagag

SEQ ID NO: 17572 - RNA, 69 nt, Human
ccuuccacucagcucaacuuuauggcuuccugagcaaggagguaaagaacauggaagagaaguggaugg

SEQ ID NO: 17573 - RNA, 69 nt, Human
agaacuuuuauaaaagcaucuuuuggaacuucaacguugccaauuuuccucagcuuuuuuuucccuucu

SEQ ID NO: 17574 - RNA, 73 nt, Human
gcaguugcagccaagggcaugugguguggcacccuagcuauuaaacaguggcuuuggcucuuuaacaauuugc

SEQ ID NO: 17575 - RNA, 63 nt, Human
gggugauguacuccacagugaccggguccuccacagucagccgguggcucuggcacuccaccc

SEQ ID NO: 17576 - RNA, 80 nt, Human
uggcaccccggccuauggcauuggccuuccaggcaugguaugugcccgaggggucagucugauagagccuaggagugcca

SEQ ID NO: 17577 - RNA, 76 nt, Human; identical to SEQ ID NO: 3277

SEQ ID NO: 17578 - RNA, 78 nt, Human
ggucuuguggaaaggaggagcgaccgccugagcgugcagcaggacguccuccugaccugaaguacaagucacaagacc

SEQ ID NO: 17579 - RNA, 79 nt, Human; identical to SEQ ID NO: 995

SEQ ID NO: 17580 - RNA, 61 nt, Human; identical to SEQ ID NO: 996

SEQ ID NO: 17581 - RNA, 75 nt, Human
ugcugagcucggcuuauauuucggaccacaugaaggugcacagccaggguccucaccaugucugugagcucugca

SEQ ID NO: 17582 - RNA, 90 nt, Human; identical to SEQ ID NO: 1285

SEQ ID NO: 17583 - RNA, 81 nt, Human
acaauauaguuucuccugaacaccugcuuuccuucugggagucuggaauuuugguaugugccaggcagagacuaccuuugu

SEQ ID NO: 17584 - RNA, 60 nt, Human
uugauuggcaucugggaacuuggaguucagggggcuuccaccauucccagaacugaucaa

SEQ ID NO: 17585 - RNA, 66 nt, Human
gauggugugaaauguccacuucuuaauuuuaagaugaacuuagucuaaagaagauacaggcccauc

SEQ ID NO: 17586 - RNA, 71 nt, Human
gcuugauuugcuuggugaccgaauuacuaggugacuaguuuacuaacuaggucauucacggcaagucaagu

SEQ ID NO: 17587 - RNA, 78 nt, Human; identical to SEQ ID NO: 99

SEQ ID NO: 17588 - RNA, 65 nt, Human; identical to SEQ ID NO: 247

SEQ ID NO: 17589 - RNA, 76 nt, Human
acuucguugugguugacacggugcauaugggauucgaguccuuggccucaauccgcgggguaccaccacaaggagu

SEQ ID NO: 17590 - RNA, 65 nt, Human
gccugugaugcucacgacuggcguaugguugucacgcagggcaagccagagagagcagagaaggc

SEQ ID NO: 17591 - RNA, 82 nt, Human
gcgucaccagcagcgaggugcccgccgucuccguugaaguaguugccacgaccaguuggcagguuccgaugcuugguggcgc

SEQ ID NO: 17592 - RNA, 85 nt, Human
gcaagaaacgugugcuaaagacugagguuccuuggaaacaugcugaaaauucuguucucaagggugucagaaccauacguacugc

SEQ ID NO: 17593 - RNA, 61 nt, Human
caggcccugccacggccaacucaggucagccagccugaggcuguggccuccaaagggucug

SEQ ID NO: 17594 - RNA, 99 nt, Human
ccacguuagcugccuuccuugagcuccccaggagucgguuuccacaucuguagagguggagggcugguguggaggugcucaugggggugcggugcuugg

SEQ ID NO: 17595 - RNA, 61 nt, Human
ccccccaggucgcaggugucugaggccagccaaccugcagagcacucgcggcguggguggg

SEQ ID NO: 17596 - RNA, 63 nt, Human
gcagcaaggagaggaugcagaacagcuucuugcagaagcaccugcuccggcauccagcgcugc

SEQ ID NO: 17597 - RNA, 78 nt, Human
ggagacugccuggcuguguccucucagccaggugccguguuggccuuggcuaggacccagagccacacugcagccucc

SEQ ID NO: 17598 - RNA, 79 nt, Human
uggcugcccagugugucacaaagguggcgcugaauguuuccugugccaaucuuuggauaaagauauagggucaaaguca

SEQ ID NO: 17599 - RNA, 67 nt, Human
acguaaggggcugggcugggcagcaccaggggcuugaggcucuggugaugcuccuccagcuccucgu

SEQ ID NO: 17600 - RNA, 73 nt, Human
caggcccuaggagggcgagggcuuaguagguaucuucagggucagagccugaguccucgccuuguugguucug

SEQ ID NO: 17601 - RNA, 64 nt, Human
gacuuugcuuccgguacaaacaggccaccugagcacuggugguggccugcuccggcugcuuguc

SEQ ID NO: 17602 - RNA, 60 nt, Human
gauggcgguggccaccuccuuggagcacuuaacacccagaccgacguggccauuguaguc

SEQ ID NO: 17603 - RNA, 82 nt, Human
auauauucauuugcacuuacgugaaacacaaacuuugcucuacaaaauuucguguuucuuagugauuuuaaaaugcauguau

SEQ ID NO: 17604 - RNA, 60 nt, Human; identical to SEQ ID NO: 2287

SEQ ID NO: 17605 - RNA, 67 nt, Human; identical to SEQ ID NO: 2288

SEQ ID NO: 17606 - RNA, 66 nt, Human; identical to SEQ ID NO: 13041

SEQ ID NO: 17607 - RNA, 67 nt, Human; identical to SEQ ID NO: 11915

SEQ ID NO: 17608 - RNA, 68 nt, Human
ucaggaagacuucccaaaauaagacucaguaugaauuugcuaaguaacugaucuaugaaguuagcuga

SEQ ID NO: 17609 - RNA, 93 nt, Human
cuuauuuuuucacaagccugguuauuugaggaugugcuuguaacguaugcuuucucuucuauuucucauagccaaugcuuguaccuuaauagg

SEQ ID NO: 17610 - RNA, 94 nt, Human
gaggaaggacuggagagccacuugaggucauauguuaagguauguaaaacacacuguucugaucacuuacaucuguggcucuccaguuuuccuu

SEQ ID NO: 17611 - RNA, 88 nt, Human
gcgcagcaucugcuucuugcuguugucggagguguccggcacguugagaaccgcucccgagaacuugcucuugaaguagaucaagcgu

SEQ ID NO: 17612 - RNA, 76 nt, Human
cuccaacgaugccuuuguucugaaaacccccucagccgccuaccuguggguggguacaggagccagcgaggcagag

SEQ ID NO: 17613 - RNA, 67 nt, Human
guggaggcgcugugucuccuacgcaacuucugagggcuggagggugccaagggcagcugcugaccgc

SEQ ID NO: 17614 - RNA, 86 nt, Human
cccaguuuucaagaaucaacacauaugacaagguagcuuagcuacacacaugagaagccugagaaagugguuguuuugaacuaggg

SEQ ID NO: 17615 - RNA, 63 nt, Human
ucaccuguaccuugcuuggguaauacaaagaauagugcuuauuuauacaaauuuacuugguga

SEQ ID NO: 17616 - RNA, 76 nt, Human
cggaaaguuuauauagagaauucuggcuuuaacagugaacuggaauaaugagagcuucacugguaaaaugcuucug

SEQ ID NO: 17617 - RNA, 71 nt, Human
ccaucuauagacuuauuuugcucaaugguuucugaaugccaaacugcucacaaaaauaagucuucugaagg

SEQ ID NO: 17618 - RNA, 61 nt, Human
gaauaauagcuuuuaaauuguuuaaaaauaagcuuauuaaacaagaauauaaauuuuaauc

SEQ ID NO: 17619 - RNA, 75 nt, Human
cucugaucaauccuucuuuuucucuuuugcccacaauuuaaggcaaguaggaugugcagaaggaaaugggaaggg

SEQ ID NO: 17620 - RNA, 91 nt, Human
uucagcuuucaguuaaaaaagaaggaaggaaggaaaugggcaaagaggaaagguuuuuucaaauuucuuucuuuuuuaauuuaggauugag

SEQ ID NO: 17621 - RNA, 80 nt, Human; identical to SEQ ID NO: 367

SEQ ID NO: 17622 - RNA, 67 nt, Human
gaguguccguugaaagcaauaaggaauuccagaacagaacuguacuucuugucccucucucacacuu

SEQ ID NO: 17623 - RNA, 98 nt, Human; identical to SEQ ID NO: 6908

SEQ ID NO: 17624 - RNA, 78 nt, Human; identical to SEQ ID NO: 6909

SEQ ID NO: 17625 - RNA, 81 nt, Human; identical to SEQ ID NO: 3878

SEQ ID NO: 17626 - RNA, 68 nt, Human
cagcauuggaucaacuauuucuucagaucguucugauucagagcgagaggagauugaaguggauguug

SEQ ID NO: 17627 - RNA, 62 nt, Human
cccgacugcagcauucaaagcccccacggagguugagccgggcacagaaacacagcagcggg

SEQ ID NO: 17628 - RNA, 60 nt, Human
gcucaucugcgccuuuguuuagaacgcuuaaaaguucugauuccacuaggaccagacugc

SEQ ID NO: 17629 - RNA, 84 nt, Human; identical to SEQ ID NO: 286

SEQ ID NO: 17630 - RNA, 80 nt, Human
ggguuccacacuguugggagucgcugcaagaaucggacaggcgcugagcaccuguggcugacccgacaucucagggaccc

SEQ ID NO: 17631 - RNA, 98 nt, Human
ucagguggcggugcagaaggucaacgccgcaggcacagaucccagcucuccuguuggcuuugugcuugggguagaucuucuucacauauucccccugg

SEQ ID NO: 17632 - RNA, 71 nt, Human; identical to SEQ ID NO: 77

SEQ ID NO: 17633 - RNA, 62 nt, Human
uagcacccccacuggcgccugggacagcugguauuaagccucggagccggugggccauguug

SEQ ID NO: 17634 - RNA, 67 nt, Human
ggacaccgacaccaaaaacccguuuuuuuccccaaagaaaggcguguuugguuuaagaacgguguuu

SEQ ID NO: 17635 - RNA, 100 nt, Human
uucuuucccccccuuuuuuuuuguggggcgcgggcguugggaaccgacaccgccgggggggcccgggguccgggcggcacguucuuccggggggguggaa

SEQ ID NO: 17636 - RNA, 75 nt, Human
cucaugguugaauaugacauuuuucugcuuuucccucuaagaaguuuuugagaauguuaauguugaaguaugcag

SEQ ID NO: 17637 - RNA, 70 nt, Human
uuguaauuauaaugguaucaaauaagaugcaaaagaaguugaugcuuauuggugcuuaagagaauuacaa

SEQ ID NO: 17638 - RNA, 124 nt, Human
cugagacccugggagagaaguuugaagcacaacucccuuaaggucuccaaaccagacggugacgccugcgggaccaucuggggcaccugcuuccacccgucucucugcccacucgggucugcag

SEQ ID NO: 17639 - RNA, 66 nt, Human
uacaggagcuuuugugugccugguagaaacuauuucuguuccagucacauugccaucacucuugua

SEQ ID NO: 17640 - RNA, 79 nt, Human; identical to SEQ ID NO: 728

SEQ ID NO: 17641 - RNA, 72 nt, Human
cggggucggcacacaggcuuugagacaaccaggaugcggagacaaucacaaagaguguguaggccagccccg

SEQ ID NO: 17642 - RNA, 65 nt, Human
ggcgcgggcucggcgggcugcgugcuggcugggaggcucacggaggaccccgccgagcgcgugcu

SEQ ID NO: 17643 - RNA, 75 nt, Human; identical to SEQ ID NO: 74

SEQ ID NO: 17644 - RNA, 71 nt, Human; identical to SEQ ID NO: 77

SEQ ID NO: 17645 - RNA, 69 nt, Human
ccuuaguuggaggccacagucaucuuuaacaucuaguauguugacagguucuaugguuuccaacagagg

SEQ ID NO: 17646 - RNA, 69 nt, Human
uaucaaauaaagauaucuagcuugacacaaaaguugguagcugcaagguuaagcuguauuaguuugaug

SEQ ID NO: 17647 - RNA, 85 nt, Human
uugagguguuuggaugaaaaaaaauacaagagcuuugccuucaugucuacagaucucuuaauauauuguuggucuugcaccuuaa

SEQ ID NO: 17648 - RNA, 70 nt, Human
uuuuguccuuaaauauuggcuguaacaaaugcugauuuagcaaaaaguaagcuucuauuagacagcaaga

SEQ ID NO: 17649 - RNA, 72 nt, Human; identical to SEQ ID NO: 2728

SEQ ID NO: 17650 - RNA, 83 nt, Human; identical to SEQ ID NO: 2729

SEQ ID NO: 17651 - RNA, 130 nt, Human; identical to SEQ ID NO: 2385

SEQ ID NO: 17652 - RNA, 65 nt, Human; identical to SEQ ID NO: 2386

SEQ ID NO: 17653 - RNA, 66 nt, Human
cuuaaucuuguggauuuuguagaugguuucaaaugacugaacugcauucagauuuacgagugaaag

SEQ ID NO: 17654 - RNA, 66 nt, Human
uaggaaauuuugacaguauuuuuguacaaaacauuuuuuugaaaaaauacuuguuaauuuauucua

SEQ ID NO: 17655 - RNA, 81 nt, Human
ugcauuaguugguugcaugaacuucgaagggcagauauuacugcacaaacugccaucucgcuucauuuuuuuaacuaugca

SEQ ID NO: 17656 - RNA, 78 nt, Human
aguugugugcguucaacacgauaauaccuguugccacuggaggaacagauggguacgucgugucuggaagugccagcu

SEQ ID NO: 17657 - RNA, 74 nt, Human
gcccggcgcggcauguccugggugccgcggugcgggcagugaacgcgcgccggggggaugggccggcgccgggc

SEQ ID NO: 17658 - RNA, 70 nt, Human; identical to SEQ ID NO: 455

SEQ ID NO: 17659 - RNA, 72 nt, Human; identical to SEQ ID NO: 1920

SEQ ID NO: 17660 - RNA, 112 nt, Human; identical to SEQ ID NO: 2686

SEQ ID NO: 17661 - RNA, 85 nt, Human
acuuccagcucagcggugcuuuaggagauuuugauucgcuuuccaaggacaaugucuucgagaauaaccguuuggccuuugaagu

SEQ ID NO: 17662 - RNA, 92 nt, Human
cauggccaagcggcugagccaaauugggguggaaaacacagaggagaaccgccggcuguaccgccagguccuguucagugcugaugaccgug

SEQ ID NO: 17663 - RNA, 67 nt, Human
cugaaauguuucucaguuuuagcuuuugaaaacccccagguaucgaugacccugguaaauguuuugg

SEQ ID NO: 17664 - RNA, 62 nt, Human
acuguuggauguuacaccagccuuuccaggguuaaccacugugguggugugcugcuuauagu

SEQ ID NO: 17665 - RNA, 79 nt, Human
caguuugcaauuacuuucucgauuggugucaguaguuuuacugauuaggacuuuuauugugaauuacaguugaaagcug

SEQ ID NO: 17666 - RNA, 91 nt, Human
ucugucagccuuacuauauacugagcuacuccuuucccaccucccccugaacacugugacaagaggaagcuagguugaaaucacugauaga

SEQ ID NO: 17667 - RNA, 72 nt, Human
auccgcaucggccucccugcccacaaagcgccacaacggugaccagccggagcagccggagcugaagcggau

SEQ ID NO: 17668 - RNA, 65 nt, Human
ggcacucacguggcaucaguccccacugcgguccacggccaggugaacaaugccgcggcgagucc

SEQ ID NO: 17669 - RNA, 76 nt, Human
gggggugcaaggcccugugguuggacuucaccucuuagcacugaaaacccaaaacccaacuggccuuaacaccucu

SEQ ID NO: 17670 - RNA, 62 nt, Human; identical to SEQ ID NO: 9237

SEQ ID NO: 17671 - RNA, 87 nt, Human
gagagguaugaacgaguugucagguuccuaugggcuuaagcuaggacaaucaggcccuaaacuccaaauuuggauaaaauaucucuu

SEQ ID NO: 17672 - RNA, 72 nt, Human
gcauucuucuuggccaccugcauagucugacacauacguauguacaguuagacuugcaggcugcaggagugc

SEQ ID NO: 17673 - RNA, 75 nt, Human
uuuguuuugcuuuuguuuuuuuccucauguaacauuggugaaggauccaggaauaugacacaaagguggaauaaa

SEQ ID NO: 17674 - RNA, 67 nt, Human; identical to SEQ ID NO: 3685

SEQ ID NO: 17675 - RNA, 89 nt, Human
gcucguguggggucuccgguccagggcgcggcaugggcguccuggccgcagcggcgcgcugccugguccggggugcggaccgaaugagc

SEQ ID NO: 17676 - RNA, 74 nt, Human
ucgucucugaaagccacucggaauuucuccaucucagauuggagcaagaacuuugagguuguuuuccaggauga

SEQ ID NO: 17677 - RNA, 67 nt, Human; identical to SEQ ID NO: 1862

SEQ ID NO: 17678 - RNA, 112 nt, Human
gugaggcaguucaccagccggcucaggucuucucuguucaagguuccgucaucaucaaagucaaagaugcggaaggcauaaugggacuugaugucuggcguggcugugucac

SEQ ID NO: 17679 - RNA, 62 nt, Human
cguggagcccggcgccccaggccuggggaacugccuccggcaaaggcgcgguuuucaccacg

SEQ ID NO: 17680 - RNA, 96 nt, Human
ggccgugucucaaguaaccaccaaguacgugcuguggguggacgacgacuucgucuucacggcgcggacgcggcuggagaggcuuguggacgugcu

SEQ ID NO: 17681 - RNA, 63 nt, Human
gucggcuucccaggcugcguggucaccgacggcgugguuaacuucuuccuggcgcggacugac

SEQ ID NO: 17682 - RNA, 64 nt, Human
auauggucaugugaaucaaauuugauguauaaaguacucacacaaguugucucaaagaugauau

SEQ ID NO: 17683 - RNA, 68 nt, Human
cugugaacagagaggccaugggaagauucgaaauuauucacgaaaaauccuaagauuucaguucagag

SEQ ID NO: 17684 - RNA, 60 nt, Human
acagugauucggcacauaaaacaggugcugaacuguagcaguuguuuuacuccauccugu

SEQ ID NO: 17685 - RNA, 75 nt, Human
gguuagagaaacucaucagaagaaaguuucaaucacuucacuguuauuuucugcaauucuuauucucuuauagcc

SEQ ID NO: 17686 - RNA, 66 nt, Human
gugauuuuauuauuaucaacuauaacauucaaaucagauuacauaaaaaugguucuauaaaauuau

SEQ ID NO: 17687 - RNA, 75 nt, Human
gcuauagaacaaauguuucgucuuaaaauauauuuaggaaauguaaaauuaaagauuaaaaauuuuauucuaugc

SEQ ID NO: 17688 - RNA, 131 nt, Human
uaaaauuauaaacacaauuccuagcucacaggccauaaaaagcaggcagcagcauggauuugauccacaggccauaguuggcugucucuuaaacaggcuuuuauacguuaugcaaaguguuucaaauucca

SEQ ID NO: 17689 - RNA, 76 nt, Human
uccagagacuuuggagacuuuucguuuuuuagauuucucauuuuaaaacacacauaauacaaguuuucuuucugga

SEQ ID NO: 17690 - RNA, 62 nt, Human
cagugauguuuauaauguucugccagcagcuccugcaggcucuggcugaaggucugcagcug

SEQ ID NO: 17691 - RNA, 65 nt, Human
gcuggagugugaucuagcucacuguagccucaacguccauggcucaggugauucucacacucagc

SEQ ID NO: 17692 - RNA, 101 nt, Human
ccaccaguccaggggugggaauacagggggugggaggugugcauaagagguuauaggcacaggccagcccgguacagaacccuaggcguccugacaggugg

SEQ ID NO: 17693 - RNA, 67 nt, Human
ccagcuaagauaugcuuucuggccgcgaccacaugaagccgcgggcuguuguaaauuucuuuguugg

SEQ ID NO: 17694 - RNA, 80 nt, Human
gcaagaaggaaggagggagggcagagcguugucugagcaacaaaggccgccugcugccuucucugucugucuccuggugc

SEQ ID NO: 17695 - RNA, 95 nt, Human
ggucauuguguccugccaaggcacagccguagaucuggaaagagcagaaugcuuuccuuuucagauguggcuggucauggaaggggcaguugucc

SEQ ID NO: 17696 - RNA, 65 nt, Human
cauugacaauccagugggcacaggcuucaguuuuacugaugauacccacggauaugcagucaaug

SEQ ID NO: 17697 - RNA, 92 nt, Human
gcacgggauuuauacagugcacuaauucaguuuuuccagauauuuccugaauauaaaaauaaugacuuugaugucacuggggagucuuaugc

SEQ ID NO: 17698 - RNA, 61 nt, Human
ggcuguuucgcucccuauacagaaguguuuccaugccaccuaagggagacucaggacagcc

SEQ ID NO: 17699 - RNA, 72 nt, Human
uuguggaacaugggccuuauguugucacaaguaacaugaccuugcgugacagagacuuccccuggaccacaa

SEQ ID NO: 17700 - RNA, 78 nt, Human; identical to SEQ ID NO: 99

SEQ ID NO: 17701 - RNA, 80 nt, Human; identical to SEQ ID NO: 100

SEQ ID NO: 17702 - RNA, 71 nt, Human
gccccacuuuuaaaaaccuggcuccuuacucuggcugggucccggggaagagauauuuuuaaaacaagggc

SEQ ID NO: 17703 - RNA, 72 nt, Human
gcugcggcugagaaguaccgccugcggaguaacugcaaagaugcuguccgugcgcguugcugcggccguggu

SEQ ID NO: 17704 - RNA, 71 nt, Human; identical to SEQ ID NO: 77

SEQ ID NO: 17705 - RNA, 90 nt, Human
aagguuuuuggagcugcacugaagcaucuuauuuuauaguauaucaaccuuuuguuuuuaaauugaccugccaagguagcugaagaccuu

SEQ ID NO: 17706 - RNA, 80 nt, Human
guuuauuggagcuagcaauaauugguuucuggcaaguuuggccagacugacuucaaaaaauuaauguguauccaggggac

SEQ ID NO: 17707 - RNA, 75 nt, Human
gauacuggaaacuuugguuuugggauccaggaacacaucgaucuggguaucaaauaugacccaagcauugguauc

SEQ ID NO: 17708 - RNA, 76 nt, Human
ucuccucccccuuggggaaaugugccucauuuguggcaaauguagggggugcaggucugaacaaggguggacaaga

SEQ ID NO: 17709 - RNA, 69 nt, Human
ccgcagucccucuauuacucacugguugagagcaagagcggugccauucaguuuguggacggauugcgg

SEQ ID NO: 17710 - RNA, 70 nt, Human
gaauucuacaagagccucacuaaugacugggaagaccacuuggcagucaagcacuuuucuguagaagguc

SEQ ID NO: 17711 - RNA, 72 nt, Human
agaaacaugcuugccuuauguaucagaggacaugcucagcagauccaagagauauauuuggcaacuuuuucu

SEQ ID NO: 17712 - RNA, 77 nt, Human; identical to SEQ ID NO: 1216

SEQ ID NO: 17713 - RNA, 68 nt, Human; identical to SEQ ID NO: 813

SEQ ID NO: 17714 - RNA, 75 nt, Human; identical to SEQ ID NO: 815

SEQ ID NO: 17715 - RNA, 73 nt, Human
caaaggcaggcuucuccgguggcauggugguagacuacccuaacagugccaaagcaaagaaauucuaccucug

SEQ ID NO: 17716 - RNA, 72 nt, Human
cuuuuuucuguucucguccggggaucccgagcuguccugcagcuguacccugagaacucagagcaguuggag

SEQ ID NO: 17717 - RNA, 76 nt, Human
ggagucuuguguuucaccaaaugagagguucccauuaaggauguucgaggcggggaaugguggagggcaagacucc

SEQ ID NO: 17718 - RNA, 100 nt, Human
uggagcuucuuuaucugccagagaauaagcccuguuaccugcuggauauuggcuguggcacugggcugaguggaaguuaucugucagaugaagggcacua

SEQ ID NO: 17719 - RNA, 60 nt, Human
aggcccacauggucacucacagcagccgcaaggaccacgagugcaagcucuguggggccu

SEQ ID NO: 17720 - RNA, 71 nt, Human
gaggggcacaccgggcgaggccguucgccugcgcgcaguguggcaaggccuuccccaaggucuaccugcuc

SEQ ID NO: 17721 - RNA, 66 nt, Human
guguggaaagagcuuccgggagucgggugcacugacccggcaccucaagucucucacccccugcac

SEQ ID NO: 17722 - RNA, 81 nt, Human
gaucgccauguucauggugaacaccauucaacaaucuauccaucuccggaggaaccuugaagcuguucagaauaugguauc

SEQ ID NO: 17723 - RNA, 79 nt, Human
gugacacacaccgaugaccgcccggacgaacccuacuucccaggcauccaacguggucgcgaccucgugugcgugucau

SEQ ID NO: 17724 - RNA, 67 nt, Human
uguccgaaugugcucuuacacccaugucucagcauugcuuggcacugaacacaccuccacacggaca

SEQ ID NO: 17725 - RNA, 96 nt, Human
cuaccuuguuuuugguuggcuuuuguuguuguuccugcuacuuucaccuuuaagcagagcagucaggagacaagcauaaaccagagcacuggguag

SEQ ID NO: 17726 - RNA, 66 nt, Human
gcuacagagcugucugaugcaauacuugaaggauaccccaagagcaagaagcaguucuuuguaagu

SEQ ID NO: 17727 - RNA, 88 nt, Human
gaggccccugggcugguggacguaccuggugggcacccugagccucagggcccugugcccugguggcagcccccagcaccaggaccuc

SEQ ID NO: 17728 - RNA, 75 nt, Human
gggcagcuggugguacaugaacucuuuuccaguguccuucaggagaucugugaugaggugaaccugccgcugcuc

SEQ ID NO: 17729 - RNA, 61 nt, Human
uugugagaugcuguuaugcugagaaaccugacuuuguuaguguuggcaaaaagucuuacag

SEQ ID NO: 17730 - RNA, 77 nt, Human
ccgcugguaccggggcauccggggacugcgugcggcagacgguucgcaaccauggcaguccugggccuguaccgcgg

SEQ ID NO: 17731 - RNA, 77 nt, Human
gcacaugcgggaugcccaggguacggcuggacgagcacgcguguggccugcugugcggccugggcgcuggcgugugc

SEQ ID NO: 17732 - RNA, 75 nt, Human
aagcuuuauucccauuggguccaaggcugguaaggauaguuaaaaaagcugccuaugggcuggagggagaggcuu

SEQ ID NO: 17733 - RNA, 64 nt, Human
gcugggcucaaaaggcucugggucgugcuugaaagugagccuuucgaagagauacucgcccagc

SEQ ID NO: 17734 - RNA, 83 nt, Human
guggcucacgccuuccagagccacaucaucggggcgaaauaaaagcccagagagagguagguguaggaggccgugcaggucac

SEQ ID NO: 17735 - RNA, 85 nt, Human
cagguccugccuguuccccauggugcuucucacccugaaacccucagagcuacagccagggauagagcagaugagcagugagcug

SEQ ID NO: 17736 - RNA, 69 nt, Human
uuuccucaagagugcauuccagaaggggaccugcuauucuucgaggggaccugcuauucuucgagggga

SEQ ID NO: 17737 - RNA, 64 nt, Human
gagaggagcaggugcagugauucauacccacucuaaagcuggcugugauggccacccuucucuu

SEQ ID NO: 17738 - RNA, 77 nt, Human
ucauugaaaaggacaucaguggaccuucgucaucgaaugaagcuaaaaaaaaggccaguguacuccucuuuacauga

SEQ ID NO: 17739 - RNA, 66 nt, Human
ggauuggaaaggggacagagagguggacaagcaaguccagccuucuccaggugcucaucuccaucc

SEQ ID NO: 17740 - RNA, 105 nt, Human; identical to SEQ ID NO: 979

SEQ ID NO: 17741 - RNA, 73 nt, Human; identical to SEQ ID NO: 4762

SEQ ID NO: 17742 - RNA, 65 nt, Human
gugaugcucgagcaauuggcucugcuucagagggugcccagagcuccuugcaagaaguuuaccac

SEQ ID NO: 17743 - RNA, 68 nt, Human
caugucagaagcucaaagcgacucauaaugcaugugaauuugcuuuggagagacuuaucuucugagug

SEQ ID NO: 17744 - RNA, 114 nt, Human
ccauuuuauaaaauguuauacucauauuugucugaauuuuuccaguauuccuacaugaaauuguauguauuaaaaacucaauauuaguggcaaauauuaauacuauuaaaaugg

SEQ ID NO: 17745 - RNA, 68 nt, Human
gauauucgcucuggagaaguuacauguaaauagaauucuauaaauuguuuuccaguugaccgaguauc

SEQ ID NO: 17746 - RNA, 70 nt, Human
gguuagagacuucaaggagagucaccuugcucauuuaauugcgaauccaucucaucugauugaaauaacc

SEQ ID NO: 17747 - RNA, 74 nt, Human
uuuuaaaaaauguuuugggcugggauuacagguguuugccaccgcgcccagcccaaauuauuacauucguaaga

SEQ ID NO: 17748 - RNA, 75 nt, Human
ccccaaugugcucaaguucauuggugugcuguacaaggauaagaagcugaaccuccugacagaguacauugaggg

SEQ ID NO: 17749 - RNA, 78 nt, Human
uggugguggcagacuuugggcugucacggcucauaauggaagagaggaaaagggcccccauggagaaggccaccccca

SEQ ID NO: 17750 - RNA, 68 nt, Human
gcucgaguaucaggaagaaaugaaagccaacuacagggaaauggcgaaggagcuuucugaaaucaugc

SEQ ID NO: 17751 - RNA, 81 nt, Human
gggcucgggggcgcucagcggcgagugggcaagauuggggccuuuccuguccucgaagcugcacaaagguggccccagccc

SEQ ID NO: 17752 - RNA, 94 nt, Human
gcagagcuuguguaggaagaaugaaaucugcaauuugacuuuuaggagugucguuuuccgggucaggcagauugguauucagcgcuggcucugc

SEQ ID NO: 17753 - RNA, 63 nt, Human
ugugugaauuuaggcaaguuuauaccuuuuaauguuucaguuucgcugucuuuuccucacaca

SEQ ID NO: 17754 - RNA, 74 nt, Human
agaaacuuauuaggcaagaacagguaauguaguuauccaugacuacuuuuaaccaugcagacuaauaauauucu

SEQ ID NO: 17755 - RNA, 95 nt, Human
acagacuuccggggaauuuugauguuuucccguguuguagagcuuccaggguuuaauaaaacugguuaaaaauugagucuuucccugaaguaagu

SEQ ID NO: 17756 - RNA, 70 nt, Human
guaacuuugcucuuuuaauaauuauguucagccuaugaugaaguauuugauuauuagacagcaaugucac

SEQ ID NO: 17757 - RNA, 62 nt, Human
cgccacccaggaguccacauuccaggagcugugcgaggggcugcuggaggagucggauggug

SEQ ID NO: 17758 - RNA, 83 nt, Human
gccgcguugcgggccgcccggcuucggcaccaggagcuuguccggcugcucgggaucaaggcccagguggcccuguagcuggc

SEQ ID NO: 17759 - RNA, 74 nt, Human
gggagccaggccagggcgaggggccggaggcuggggaugccgaggucugucccacgcccgcccgccuggccacc

SEQ ID NO: 17760 - RNA, 65 nt, Human
cccauuuggcuuauaaagacucgguuacagcuugaugcaaggaaccgcggggaaaggcgaauggg

SEQ ID NO: 17761 - RNA, 74 nt, Human
cugcaaggaaaaguugaaugauguauuugauccugauucuacccaaguacauaugauuucagcugcaauggcag

SEQ ID NO: 17762 - RNA, 78 nt, Human
gacagauggacuaaaaggauuuuauaggggcaugucugcuucauaugcugguauaucagagacuguuauccauuuguu

SEQ ID NO: 17763 - RNA, 72 nt, Human
ugcaaaauauuucauaaguauggaugugcaauauuacuggccauagugcaaaaggugaaagguuuuacugca

SEQ ID NO: 17764 - RNA, 60 nt, Human
ccgaagcuuccggacgacgaggaaccgcccaacauggccucggagagugggaagcuuugg

SEQ ID NO: 17765 - RNA, 61 nt, Human
ggggagaauagaaagaaaacaauugacaaaauccucaaauguaaacucaauuugccucccu

SEQ ID NO: 17766 - RNA, 62 nt, Human
guggauugguggaguuugggagcauuaauguaugacaugcugacuggagcacccccauucac

SEQ ID NO: 17767 - RNA, 63 nt, Human
gauaccagccucccacuguggugccugguggagaacuggccaagguacaaggaaggcuguguu

SEQ ID NO: 17768 - RNA, 85 nt, Human
gaugucaaugcugccauugccaccaucaaaacaagcgcagcauccaguuuguggauuggugccccacuggcuucaagguggcauc

SEQ ID NO: 17769 - RNA, 60 nt, Human
aucauaugaguucagguguggaguuuuucacugguggcaucaugucugugcucaauagau

SEQ ID NO: 17770 - RNA, 61 nt, Human; identical to SEQ ID NO: 1363

SEQ ID NO: 17771 - RNA, 63 nt, Human; identical to SEQ ID NO: 8453

SEQ ID NO: 17772 - RNA, 63 nt, Human; identical to SEQ ID NO: 1364

SEQ ID NO: 17773 - RNA, 64 nt, Human
ggauacaaguggggccaugccucccuggcccugacuccaggcugggguauccugaacuguaucc

SEQ ID NO: 17774 - RNA, 64 nt, Human; identical to SEQ ID NO: 287

SEQ ID NO: 17775 - RNA, 67 nt, Human
uccaaagcacuuuuguugagugacaacccgauuagcaaggcccuguuacugaacagagggcagugga

SEQ ID NO: 17776 - RNA, 61 nt, Human
gcucuuagugggaguauaguauugaguccucuagagaggauuaugauacgacucugagagc

SEQ ID NO: 17777 - RNA, 94 nt, Human
gggaguauagggcugugacuaguauguugaguccuguaaguaggagagugauauuugaucaggaaacgugguuacuagcccagagaguucuccc

SEQ ID NO: 17778 - RNA, 63 nt, Human
aaccuggcagccggacugggcgcccagaaaggucaguggugcugccccauucggcgaaagguu

SEQ ID NO: 17779 - RNA, 66 nt, Human
ugggcggcagguaacgagucauugccucucacgccaccuggaaggcuggacuacuuccuccuccca

SEQ ID NO: 17780 - RNA, 90 nt, Human
aggaccagugcaauuuagaggugcauguuuauaaucaagaagaagacucuuuuuuauguacaccaugauauacucuugucugcauauccu

SEQ ID NO: 17781 - RNA, 64 nt, Human
gauugacacacagggggauggaguugguccuuguccauucucucacccuugcugugcauguauc

SEQ ID NO: 17782 - RNA, 69 nt, Human
ggggacuuaguuagguagauuaauaucuggagcuccucgagggaccaaaucuccaacuuuuuuuucccc

SEQ ID NO: 17783 - RNA, 63 nt, Human
aggucaaauuguguccuccaucacugcuucccugagauuugauggagcccugaauguugaccu

SEQ ID NO: 17784 - RNA, 74 nt, Human
gccgagaguguguggcaggccccaacaucgccgccaucgucgggggcaccguggcaggcaucgugcugaucggc

SEQ ID NO: 17785 - RNA, 65 nt, Human
ggcgcuuggagaaggagaagcucaagucccaguggaacaaugauaauccccuuuucaagagcgcc

SEQ ID NO: 17786 - RNA, 86 nt, Human
ggugaagacaaggccgucaggagccaccaugucugccccaucacgcggcgagacaugguugccaucagcucuugauggaugucacc

SEQ ID NO: 17787 - RNA, 90 nt, Human
ucaacagggauuuggugccaacuggagucuuggugaccaauggggauuaugaucaagaacaguuugcugaugaccaaauaccacuguugg

SEQ ID NO: 17788 - RNA, 69 nt, Human
acuaugcaccaggugccauguuucauuuauguuaucucauuuaauauucacaacaagccuugcaguagu

SEQ ID NO: 17789 - RNA, 108 nt, Human
uuacaaugcuugguuuccccauugauuuuucaucaaucggacuaacaguagcaaaucauugagagucagaguugggguaaagauuccagggaaagcgaacauuuguaa

SEQ ID NO: 17790 - RNA, 66 nt, Human
ucccuagaugauucugaagguaagccauguuugggaacccagaacucaaccuuucacaucuuugga

SEQ ID NO: 17791 - RNA, 84 nt, Human
aucauucauacuuguccauuuuuuucuauuaguuuuauuuugguguaaaaaguucuuuauuaguaaaaauguuagaguaaugau

SEQ ID NO: 17792 - RNA, 66 nt, Human
uucuugggcuaacaguagagcugaacuuuuccauaucauguuuagagaccacugguagccuaagaa

SEQ ID NO: 17793 - RNA, 81 nt, Human
agauuccuccuuauaauucuguaaguguuggcuuuuaacuuggaauaauggccauauccuaccaaauuuuaaaagguuucu

SEQ ID NO: 17794 - RNA, 72 nt, Human
ugaaaguuuaguuuuauuauggacacuuuaugcaaacauuucaauacuuuuggcuacuucuauaaucuuuua

SEQ ID NO: 17795 - RNA, 76 nt, Human
uugaugaugucucucacucuguuccuuuaauuacaaagucucugaagacucugaacuugacugaggauaauguuaa

SEQ ID NO: 17796 - RNA, 131 nt, Human
gaaguuugaggcuguagugagcuaugauugcaccagugcacuccagcuuggaugacagaauggaguuucacucuugucucccaggcuggaguacaauggcaugaucucagcuuacugcaaccuccgucucc

SEQ ID NO: 17797 - RNA, 76 nt, Human
cauguuauagauuauuuggaaagacuguauuucccauugucacaaagcaaguuuauuucaaaugcuuuaucacaug

SEQ ID NO: 17798 - RNA, 63 nt, Human
cagcuccagcacacacacucuucccugggcagcaggaaaaggagguaacaaggacuugggcug

SEQ ID NO: 17799 - RNA, 131 nt, Human
gcugucuagcgaaaacuagucacuaaguccuggccugagagauacccacauuuccuuuagaacaaacagaacuaauaccuguguacauuucugagagccugaugugugaguccuuaaaauguagaccuugc

SEQ ID NO: 17800 - RNA, 75 nt, Human
aucuauuguccaguagucacaugggcucaaucuaauugcaaagagaagccccaaaauauaagaggacauguggau

SEQ ID NO: 17801 - RNA, 86 nt, Human
gacggugaggauggucccaagaggcgcagcuagggucacuggccccgguccuggugccucuugccuuugccuuucuucuucuuguc

SEQ ID NO: 17802 - RNA, 99 nt, Human
gcagcggcgccacgcggguccacugguugcacugcgggcuguaggccuccacgcccagcacgucgaagcgcuccauggacucgauguugucaucgcugc

SEQ ID NO: 17803 - RNA, 81 nt, Human
ggccucgcggucguacaccugcacggucuuggagaaggcaguguucucccagcuguagccgcccaggauguagaugcggcc

SEQ ID NO: 17804 - RNA, 81 nt, Human
aagucuugcuguaguguggaugaaguuuuguuguaguguggauagcaaugacagucuuucucuaauguuuccagaagauuu

SEQ ID NO: 17805 - RNA, 74 nt, Human
ggguuccaaugggugcacaguuccaaaaauguggagggacccuucucaguuuugaggccaugaauccaaagccc

SEQ ID NO: 17806 - RNA, 64 nt, Human
ugcuggcaugcuagguuucuggguucucucucccugagcgguccuggugacccugcuugaagca

SEQ ID NO: 17807 - RNA, 79 nt, Human; identical to SEQ ID NO: 6024

SEQ ID NO: 17808 - RNA, 79 nt, Human; identical to SEQ ID NO: 6025

SEQ ID NO: 17809 - RNA, 78 nt, Human; identical to SEQ ID NO: 5647

SEQ ID NO: 17810 - RNA, 86 nt, Human
ggcccgcgacugcugggcaccuucauccagcccugggguucucgugccuacgugaccuggaugacgggcggcaucuuuguggcgcc

SEQ ID NO: 17811 - RNA, 77 nt, Human
cugggguguuuauggcaagucacuuugacagacauuauuguggcaauguugucugacuuacuguuucaacaaaccag

SEQ ID NO: 17812 - RNA, 65 nt, Human; identical to SEQ ID NO: 247

SEQ ID NO: 17813 - RNA, 80 nt, Human; identical to SEQ ID NO: 100

SEQ ID NO: 17814 - RNA, 99 nt, Human
caggccaggcaggggccacgugugggccagucagccacuacaagauuuuugcuaagcuuugggcuguuggcagcaucuuggaccucaugccugggccug

SEQ ID NO: 17815 - RNA, 97 nt, Human
auugaaaaagaaaaagaagaaaacgaaaagaagaaacaaaagaaagcaucaugaugaauaaaaugucuuugcuuguaauuuuuaaauucauaucaau

SEQ ID NO: 17816 - RNA, 75 nt, Human; identical to SEQ ID NO: 9063

SEQ ID NO: 17817 - RNA, 80 nt, Human; identical to SEQ ID NO: 2983

SEQ ID NO: 17818 - RNA, 61 nt, Human
ccaugagcacggugaagcagacccaagacauuccauauacuggucccuuuaauugcucugg

SEQ ID NO: 17819 - RNA, 77 nt, Human; identical to SEQ ID NO: 17811

SEQ ID NO: 17820 - RNA, 66 nt, Human
gaagguuaagcuggcuguccugaaauauuauacagguggaugagaauggcaaaauuagucgccuuc

SEQ ID NO: 17821 - RNA, 80 nt, Human; identical to SEQ ID NO: 100

SEQ ID NO: 17822 - RNA, 66 nt, Human
cccgccaccacgcccagguaauuuggugucaguagagacgggguuuccccaugugggccuggcggg

SEQ ID NO: 17823 - RNA, 87 nt, Human
cgggugacaggacuuuucgaacaaggucucaccaugcugcccaagcuggucugaaaacucuuguccucaggcaguccucccaccucg

SEQ ID NO: 17824 - RNA, 89 nt, Human
ggaguuucacuguuguugcccagguuggagugcaggggcacaaucucagcucauugcaaccucugccuccgggguucaagugauucucc

SEQ ID NO: 17825 - RNA, 103 nt, Human
uugagacagggucucgcucuguugcccaggcuggagugcaggggcaugaucccagcucacugcaaccuccaccucuuggauucaagugauucucccgucucag

SEQ ID NO: 17826 - RNA, 72 nt, Human
agugcugagcuuuuaacaggaaauguggcccuagguauuagucuuaguuuaaaauguugguguuuagagacu

SEQ ID NO: 17827 - RNA, 63 nt, Human
uagcaaguugaaggacagguaguugagaugaaacacuucaaaacccugguuauagauguacug

SEQ ID NO: 17828 - RNA, 70 nt, Human
uauucacaaaguuaucugauagggccuuggaggagaagguccaguuuuaaaaaaugacaguuuguguuua

SEQ ID NO: 17829 - RNA, 67 nt, Human
ggucccggucucgguccaggaguccucccccaguguccaagagggaauccaaauccaggucgcgauc

SEQ ID NO: 17830 - RNA, 72 nt, Human
uaauuuagugaggugaacgacuucagauuucauuacuggauuggauauuugagguaaaauuucauuugguua

SEQ ID NO: 17831 - RNA, 75 nt, Human; identical to SEQ ID NO: 74

SEQ ID NO: 17832 - RNA, 87 nt, Human; identical to SEQ ID NO: 76

SEQ ID NO: 17833 - RNA, 71 nt, Human; identical to SEQ ID NO: 77

SEQ ID NO: 17834 - RNA, 65 nt, Human; identical to SEQ ID NO: 247

SEQ ID NO: 17835 - RNA, 80 nt, Human; identical to SEQ ID NO: 100

SEQ ID NO: 17836 - RNA, 67 nt, Human
gggguggguaugcgccaacccuauuucaggcagcgcucaaaguagguggagccgauguagccacccc

SEQ ID NO: 17837 - RNA, 70 nt, Human
acugaaaaauuugguaaauagguuggauucuuguuagaggguuuuuguucuggaagccauauuugauagu

SEQ ID NO: 17838 - RNA, 60 nt, Human
cagaauccaguggaacccaaaguccuaagcgccauucugggucuuacgcugugacaucug

SEQ ID NO: 17839 - RNA, 122 nt, Human
cuggcauuaaggcuguggauagcuuggugccaauuggucguggccagcgugaacugauuauugggugaccgaccagacuggcgaaaaccuuccauugcuauugaccacaaucauuaacccag

SEQ ID NO: 17840 - RNA, 75 nt, Human; identical to SEQ ID NO: 74

SEQ ID NO: 17841 - RNA, 87 nt, Human; identical to SEQ ID NO: 76

SEQ ID NO: 17842 - RNA, 71 nt, Human; identical to SEQ ID NO: 77

SEQ ID NO: 17843 - RNA, 65 nt, Human
ggugaaggugcugaggaaagcucccaggaugagccugggagugcuucagguaucagcuuccagcc

SEQ ID NO: 17844 - RNA, 76 nt, Human; identical to SEQ ID NO: 758

SEQ ID NO: 17845 - RNA, 99 nt, Human
gguugacuaaggucggcuuuguuccuggaaaugcaguugaaaguuccccauuaugauuuuaacucuucucagaagcaaagcacgcuuugauaaauagcc

SEQ ID NO: 17846 - RNA, 74 nt, Human
ucauggagauacaauaacaccacuuaucagugaaucucaauucaagauguuauggaggaauagauuugcuuuga

SEQ ID NO: 17847 - RNA, 88 nt, Human
uuuuuuaauaauucaaauaucuggccacauuccagagauucucagaaaaaucuuaaaugaagccaugguauguguuguuuuugaaaaa

SEQ ID NO: 17848 - RNA, 87 nt, Human
ccgcuacaggcaccagugccgcugcgcgggagcuagggcugucgaggccaacccuuccgcgcccgugacgcggggccugagagacgg

SEQ ID NO: 17849 - RNA, 73 nt, Human
gauggcggcugcaggguugcugccgccccaucugcuauugcccggcgaggucgccgcugccucagcugccauc

SEQ ID NO: 17850 - RNA, 83 nt, Human
gauuucgcguugggauuuaccuguuuagagaguaagaccaagaaugugcucuggagauuuaaauuuucccagcuuaagggauc

SEQ ID NO: 17851 - RNA, 70 nt, Human; identical to SEQ ID NO: 13852

SEQ ID NO: 17852 - RNA, 74 nt, Human
cgggaagguucuggaggcaaacgaagccugcgggaucugcaggcgcucagugccuuggggaagaaggaauccug

SEQ ID NO: 17853 - RNA, 62 nt, Human
ugcaguggccgguacagcugggaggagcgccccuuccggcuacacauuaccauuccggugca

SEQ ID NO: 17854 - RNA, 90 nt, Human
aggacugcagccuaaauuccaaauaccagagacugaaauuuucagccuugcuaagggaacaucucgauguuugaaccuuuguugugucuu

SEQ ID NO: 17855 - RNA, 67 nt, Human
aguuugucgugguuauaaaacaauuagcagaauagccuacauuuguauuuauuuucuauuccauacu

SEQ ID NO: 17856 - RNA, 130 nt, Human
gcuagcaccucccccaggagaccguugcagucggccagcccccuucuccacgguaaccaugugcgaccgaaaggccgugaucaaaaaugcggacaugucggaagagaugcaacaggacucgguggagugc

SEQ ID NO: 17857 - RNA, 74 nt, Human
gacguucucuugccaguuucuccagcaggaccccuucuuguuuugaaaauggucggcugcuuugguaggacguc

SEQ ID NO: 17858 - RNA, 76 nt, Human; identical to SEQ ID NO: 758

SEQ ID NO: 17859 - RNA, 71 nt, Human; identical to SEQ ID NO: 1764

SEQ ID NO: 17860 - RNA, 73 nt, Human; identical to SEQ ID NO: 8238

SEQ ID NO: 17861 - RNA, 64 nt, Human; identical to SEQ ID NO: 8239

SEQ ID NO: 17862 - RNA, 130 nt, Human
uaacaggacccauuccaaggaguguguguggguuuucccccuccccuguguccucugucaccuuggugaugaggccagagugaugugaagacugggagggaacccuaggucagaccuugguuuccuguug

SEQ ID NO: 17863 - RNA, 73 nt, Human; identical to SEQ ID NO: 721

SEQ ID NO: 17864 - RNA, 82 nt, Human; identical to SEQ ID NO: 119

SEQ ID NO: 17865 - RNA, 63 nt, Human; identical to SEQ ID NO: 722

SEQ ID NO: 17866 - RNA, 60 nt, Human; identical to SEQ ID NO: 723

SEQ ID NO: 17867 - RNA, 112 nt, Human
ccacgggccugguguucaucaucgugguagucaacaucuucaucacggcuucgggguccagaagcccuugauggacauggcaccccagcaguuagggacaccaggacccugg

SEQ ID NO: 17868 - RNA, 131 nt, Human
gauaaacucuuuagguauuagagccucuuagaugagguaucguuuacugcaaagaaaaaaaauuguuauaauuuugccauaaguuaugccuauuuagauggcuguauaacugguacuuugaagagaugaac

SEQ ID NO: 17869 - RNA, 88 nt, Human
ggaugccuuuuauuucuuuauuuugucugaucacucuggcuuggaugucccauacuguguugaauaagaguggugaaagugggcaucc

SEQ ID NO: 17870 - RNA, 69 nt, Human
ggcacaugcgaaaaugccccguuaauuuuuuuauauuuuuaguagagacgggguuucaccgugugagcc

SEQ ID NO: 17871 - RNA, 103 nt, Human
uugagauggaguauugcucuguggcccaggcuggagugcaguggcacaaucucggcuuacugcaagcuccgccuccuggguucacgccauucuccuaccucag

SEQ ID NO: 17872 - RNA, 78 nt, Human
acuuguugaaauagugauuugcaauagacuaagaaacauucccuguagucaacauucaaaauccuacuaucaucaggu

SEQ ID NO: 17873 - RNA, 98 nt, Human
augauuucauuaugaaaugguaaaaaguauaugugcaauacuucugagcuacaaagaacacuuguauuuucuccuuugcauuuauaacugaaguucau

SEQ ID NO: 17874 - RNA, 76 nt, Human
gugcucccguagagcccguugagguuggcguaguggcaguuccuguaccaccaggccccucgguaggagacagcgc

SEQ ID NO: 17875 - RNA, 103 nt, Human; identical to SEQ ID NO: 12300

SEQ ID NO: 17876 - RNA, 61 nt, Human
cugucuccggccgcccuggugcugccuguguccaugaccggugcuggggggucgggggcag

SEQ ID NO: 17877 - RNA, 74 nt, Human; identical to SEQ ID NO: 12302

SEQ ID NO: 17878 - RNA, 66 nt, Human; identical to SEQ ID NO: 2392

SEQ ID NO: 17879 - RNA, 88 nt, Human; identical to SEQ ID NO: 2393

SEQ ID NO: 17880 - RNA, 84 nt, Human; identical to SEQ ID NO: 384

SEQ ID NO: 17881 - RNA, 102 nt, Human; identical to SEQ ID NO: 2701

SEQ ID NO: 17882 - RNA, 60 nt, Human; identical to SEQ ID NO: 5595

SEQ ID NO: 17883 - RNA, 65 nt, Human; identical to SEQ ID NO: 247

SEQ ID NO: 17884 - RNA, 80 nt, Human; identical to SEQ ID NO: 100

SEQ ID NO: 17885 - RNA, 61 nt, Human
gggccuccaauccuaguaaacaggggcgcgaaugcccuuuuuccuccuaggguaggggacc

SEQ ID NO: 17886 - RNA, 64 nt, Human
uccuagacaacaacugauuuaauauccuugauaccaagcuaugauagaggaccagcgucuagga

SEQ ID NO: 17887 - RNA, 66 nt, Human
ucuaguagcgaagaucaacccaugcgcacaaaguaaaucgcguagacaaagacuuucgagauugga

SEQ ID NO: 17888 - RNA, 80 nt, Human; identical to SEQ ID NO: 174

SEQ ID NO: 17889 - RNA, 65 nt, Human; identical to SEQ ID NO: 3507

SEQ ID NO: 17890 - RNA, 77 nt, Human
uggggcuugcacugccuucucaggccagcuauacccuagcugagcaaagaacugaagaagcaaguguccacucccca

SEQ ID NO: 17891 - RNA, 70 nt, Human
uuuugaacuaauagaaauuuaauguuguuuuaagauaauacuuaaauauuaagaaagcuaaaauuuaaaa

SEQ ID NO: 17892 - RNA, 99 nt, Human
gcugcuggccccaaggagccacggggugaggcuggucaaaccaagggggcuuguuuggugggaucuggucguguggcccggggccccggggcgggcagc

SEQ ID NO: 17893 - RNA, 64 nt, Human
ggggcgggaagggcccccggaagugugggggcgcugcaugcgaaggguggcucgcgcuggcccc

SEQ ID NO: 17894 - RNA, 64 nt, Human
cguugucucguaucuuuucagucuaaagauccaaccgcauugugacuuguuaagauagacaacg

SEQ ID NO: 17895 - RNA, 70 nt, Human
ucacaccgacgggguaaugaauauguuagaacuacaagccucauauucagguauccaaagucaggaauga

SEQ ID NO: 17896 - RNA, 87 nt, Human
cccuucgucgggcuaccuugugggagggcgccccccccucuucuggggggcgggggacgcccucucgugcggccccccucccucggg

SEQ ID NO: 17897 - RNA, 69 nt, Human
auguauguuaccaaaauaaauauaucuaacaccaggacuagaaugguaguaauuuugggcauaaugcau

SEQ ID NO: 17898 - RNA, 82 nt, Human
cccuaauaccugucauccuccauagaacgguguggguuuuuacacacaacgacacgcgguaucuggcaauacaggcgauggg

SEQ ID NO: 17899 - RNA, 63 nt, Human
agguucugaggcaaguauuuauuccaagcaaacacgugggcguggacagcuaucucagagccu

SEQ ID NO: 17900 - RNA, 97 nt, Human
cuccauagccaucaucugcuacagggccaaagccaccuccagcgcccaggugauuggggugcugcucugggucgaacaugcggaucugggauugggg

SEQ ID NO: 17901 - RNA, 62 nt, Human
gucuuccagcuucagcccuucucuugccaccucuguggucugagcugggggagggggagggc

SEQ ID NO: 17902 - RNA, 65 nt, Human; identical to SEQ ID NO: 3875

SEQ ID NO: 17903 - RNA, 66 nt, Human; identical to SEQ ID NO: 3876

SEQ ID NO: 17904 - RNA, 115 nt, Human
gacccacagccuaagcugagugugaccccagaagccacgaugugcucuguauccagaacacacuuggcagauggaggaagcaucugaguuugagaccauggcuguuacagggauc

SEQ ID NO: 17905 - RNA, 64 nt, Human
ucucgguuccucccauacaugauauaauacagaaugaaauagaugaauaagaggaaaaccaaga

SEQ ID NO: 17906 - RNA, 70 nt, Human
cuucaauccucugucucucgaggaacuaggcuccaacacggggauccagguuuucaaucagauugugaag

SEQ ID NO: 17907 - RNA, 66 nt, Human
uccccgcgccgcgagaccaggcucccgcuccgguugcggcgaccgccuccgcggcgccccugggga

SEQ ID NO: 17908 - RNA, 106 nt, Human; identical to SEQ ID NO: 6411

SEQ ID NO: 17909 - RNA, 61 nt, Human
acaucauuagagcccuguagaaugacagcuuuuuucagguugccagucucuucauccaugu

SEQ ID NO: 17910 - RNA, 77 nt, Human; identical to SEQ ID NO: 8698

SEQ ID NO: 17911 - RNA, 80 nt, Human; identical to SEQ ID NO: 367

SEQ ID NO: 17912 - RNA, 86 nt, Human
cucgaagugauccugaggccgaagauugggcugccugguguugcagagacagaagccgggagcggcugaucaggaacacgugcgag

SEQ ID NO: 17913 - RNA, 86 nt, Human
ggcuccacagugugcacagaugaacgaaguuauggcagaguuagcuaacagaacucccucaaguuucauuugugaaguuggaagcu

SEQ ID NO: 17914 - RNA, 79 nt, Human
gguguuccugaaguaucugaaaaauaugaaauuagcucuguucccacuuuucuguuuuucaagaauucucagaaacauc

SEQ ID NO: 17915 - RNA, 61 nt, Human
cugcagacggugagcagugagaagguccgcuccacuaaucucaacugcucagugauugcgg

SEQ ID NO: 17916 - RNA, 105 nt, Human
gcgccaaagagaccaacaagaugauuuuagcguggacuaggacacuuaaccuaagaagaguuucacuuaaucauucaaaucacuaucugaagggucacggagcgc

SEQ ID NO: 17917 - RNA, 62 nt, Human
gugaggcaugacggcuccgagcccugcguggacgugcuguucggagacgggcaucgccugau

SEQ ID NO: 17918 - RNA, 80 nt, Human
auugcaggugauggcucaguguuccgagacuugguuauuaaguacggugcaguugacccacuguuggcucuccuugcagu

SEQ ID NO: 17919 - RNA, 107 nt, Human
ccgggucugacaggagcagccugugggcaccgcggcgguaguuggaggcgggagaggguccguagccgcgccgcccugccccgccaugggccuccugucggacccgg

SEQ ID NO: 17920 - RNA, 62 nt, Human
gggggaauagugggggggcccauggcaacgcacuuggggguauacaccccgcuuucaccccc

SEQ ID NO: 17921 - RNA, 84 nt, Human
cugucuacugguccaaauagaccaugucaguucacccccugguuugugucuauggguggcugugguauaugggaaaaguagcgg

SEQ ID NO: 17922 - RNA, 82 nt, Human
gaacagaaucuuguggaagaagaaugaaguugcugauuaugaagcuacaacauuuuccaucuucuauaacaacacucuguuc

SEQ ID NO: 17923 - RNA, 69 nt, Human
gugugaugacccuaguaagcacauauugguagccuuugcauacaagaaugugaaauuguucucaagcac

SEQ ID NO: 17924 - RNA, 70 nt, Human
uggucguggucauuguugcuuccuucuucauauugaagaacuucaacccacagugaacuacauaugucca

SEQ ID NO: 17925 - RNA, 60 nt, Human
ggugacaacaugcuggagccaagugcuaacaugccuggguucaagggauggaaagucacc

SEQ ID NO: 17926 - RNA, 74 nt, Human
uccucaacccguuugguggucacuuugguccgucaaguuccacggaguaauugugaaaggccagaauuugagga

SEQ ID NO: 17927 - RNA, 93 nt, Human
gcaggacaucaucuaugaaaauuaucugugaguacgaaaacgagcaucgugguuuaagguguuccagaugacuucaaagguaugaaugccugc

SEQ ID NO: 17928 - RNA, 64 nt, Human
gcaucgugcuggcuucuuaauaggugaugguugccgguguagggaccaggcacggcacgauagc

SEQ ID NO: 17929 - RNA, 60 nt, Human
auaugucaggguacuguauagguucuggaaggaaguuauaauauaguagacuguucaugu

SEQ ID NO: 17930 - RNA, 102 nt, Human
cuuaugagcaaaaguugguauuuaagagucauuugagggaauagcuguauauauugaauuaagguuguaccuuaaagacauuauacugauguuguggagggg

SEQ ID NO: 17931 - RNA, 63 nt, Human
ccuguuuucccggggugagccaguaucuccccagacacuggcaggcacgccgggcagaguagg

SEQ ID NO: 17932 - RNA, 81 nt, Human
cugcaguugugcgaggacgaaguuccuccagaagaaggccuuccuuaccugguccucacaucuccuuagcgugacucguag

SEQ ID NO: 17933 - RNA, 62 nt, Human
gcuccccugggcuccuucccauggcugccuccacgcagcaggcagaggagggggcggggggc

SEQ ID NO: 17934 - RNA, 75 nt, Human; identical to SEQ ID NO: 74

SEQ ID NO: 17935 - RNA, 86 nt, Human; identical to SEQ ID NO: 1403

SEQ ID NO: 17936 - RNA, 61 nt, Human
cagaguucagugcccugcuucagggcagagaccaaguuguggagucaggaacugaaagcug

SEQ ID NO: 17937 - RNA, 69 nt, Human; identical to SEQ ID NO: 10828

SEQ ID NO: 17938 - RNA, 78 nt, Human; identical to SEQ ID NO: 6377

SEQ ID NO: 17939 - RNA, 103 nt, Human
gggguggaaggauacggugaccuggugaccugucuugugaggcccacgguauccgacguguccugcaagcacaaauuacucagggcacccuucaagucagccc

SEQ ID NO: 17940 - RNA, 82 nt, Human
cccacugccggcagugcugguucuccaacagaguggugucuagauuuaucagaguaacgagaagacaaacuccggcacuggg

SEQ ID NO: 17941 - RNA, 94 nt, Human
aacagagauuuaccgcauuguuucucagaagcaaaugucagacagacgcgaaaaugacaugucuccaagcaacaaugugguuccuauucauguu

SEQ ID NO: 17942 - RNA, 78 nt, Human; identical to SEQ ID NO: 99

SEQ ID NO: 17943 - RNA, 65 nt, Human; identical to SEQ ID NO: 247

SEQ ID NO: 17944 - RNA, 80 nt, Human
ucuuguguugagacuucgugguggugcuaagaaaaggaagaagaagucucacaccacucccaagaagaauaagcacaaga

SEQ ID NO: 17945 - RNA, 61 nt, Human
gauauuccaaaagaacaagaaauuaaugcagugucuaauuuuuuuucuuuuguaauuuauc

SEQ ID NO: 17946 - RNA, 68 nt, Human
gaggcagguggaucaccugaggucaggaguucaggagcagccuggccaacauggugaaaccccgucuc

SEQ ID NO: 17947 - RNA, 67 nt, Human
ggccagcuggucgaaagugaggaucuugcccccugcccugaagaugcggcugccgacccugcugguc

SEQ ID NO: 17948 - RNA, 90 nt, Human
ggcuaaauuuauuuucuugugucugccuagcaagauaauuucucuauucuuugacaguauugucucaggcaccugaaucagaccuaagcc

SEQ ID NO: 17949 - RNA, 66 nt, Human
ggaagacauggcuguugugaggaucaaauggaaggauccaugagugcuuagaacaguccugggucc

SEQ ID NO: 17950 - RNA, 65 nt, Human; identical to SEQ ID NO: 1518

SEQ ID NO: 17951 - RNA, 75 nt, Human; identical to SEQ ID NO: 74

SEQ ID NO: 17952 - RNA, 87 nt, Human; identical to SEQ ID NO: 76

SEQ ID NO: 17953 - RNA, 71 nt, Human; identical to SEQ ID NO: 77

SEQ ID NO: 17954 - RNA, 88 nt, Human
ggccacagugugggcucagggaacauucuggcagccgugggguucuguucagugggccugguggagacccucuagccgaccuguggcc

SEQ ID NO: 17955 - RNA, 81 nt, Human
gacacgauuauuuuuccuucagcacuuugauguucuaacuccaugguuuucuagcauugauuguagaggguggaucugguc

SEQ ID NO: 17956 - RNA, 81 nt, Human
uguaaaucaucucguguuccugaaacuguccucacugcacucuccuucuugauugauaguuuacuuauacguugaauuaca

SEQ ID NO: 17957 - RNA, 65 nt, Human; identical to SEQ ID NO: 1518

SEQ ID NO: 17958 - RNA, 96 nt, Human; identical to SEQ ID NO: 2594

SEQ ID NO: 17959 - RNA, 87 nt, Human; identical to SEQ ID NO: 76

SEQ ID NO: 17960 - RNA, 72 nt, Human
gcauagcuuucaagaaauugucacaaaagguuuuauucucuuugcuugugacuauuuuucauugaagcaugc

SEQ ID NO: 17961 - RNA, 65 nt, Human; identical to SEQ ID NO: 1518

SEQ ID NO: 17962 - RNA, 75 nt, Human; identical to SEQ ID NO: 74

SEQ ID NO: 17963 - RNA, 87 nt, Human; identical to SEQ ID NO: 76

SEQ ID NO: 17964 - RNA, 65 nt, Human; identical to SEQ ID NO: 1518

SEQ ID NO: 17965 - RNA, 75 nt, Human; identical to SEQ ID NO: 74

SEQ ID NO: 17966 - RNA, 87 nt, Human; identical to SEQ ID NO: 76

SEQ ID NO: 17967 - RNA, 71 nt, Human; identical to SEQ ID NO: 77

SEQ ID NO: 17968 - RNA, 65 nt, Human; identical to SEQ ID NO: 1518

SEQ ID NO: 17969 - RNA, 75 nt, Human; identical to SEQ ID NO: 74

SEQ ID NO: 17970 - RNA, 87 nt, Human; identical to SEQ ID NO: 76

SEQ ID NO: 17971 - RNA, 71 nt, Human; identical to SEQ ID NO: 77

SEQ ID NO: 17972 - RNA, 82 nt, Human; identical to SEQ ID NO: 119

SEQ ID NO: 17973 - RNA, 62 nt, Human
caugugaugauaauggucuucucgccaucccaagauggguuggcagccaugaucuuugcaug

SEQ ID NO: 17974 - RNA, 109 nt, Human
cugugcaccucgugguaaaacucuuugggguucgccagcuguagcucauauuucauguuggggucaugccgaacacccaugaaguuguaguuccacgaggacugggcag

SEQ ID NO: 17975 - RNA, 62 nt, Human
cuguguucuggcggccccauucguagccacugggggucagcuuguaggccgucaguguacag

SEQ ID NO: 17976 - RNA, 65 nt, Human; identical to SEQ ID NO: 1518

SEQ ID NO: 17977 - RNA, 75 nt, Human; identical to SEQ ID NO: 74

SEQ ID NO: 17978 - RNA, 87 nt, Human; identical to SEQ ID NO: 76

SEQ ID NO: 17979 - RNA, 71 nt, Human; identical to SEQ ID NO: 77

SEQ ID NO: 17980 - RNA, 75 nt, Human; identical to SEQ ID NO: 74

SEQ ID NO: 17981 - RNA, 71 nt, Human; identical to SEQ ID NO: 77

SEQ ID NO: 17982 - RNA, 68 nt, Human
caggggauggcccugguuggccuggaagggugaaccugccagauuuaucaguagaggcugauccucug

SEQ ID NO: 17983 - RNA, 60 nt, Human
cuccgacuccaacucccccugcuguaagaggaggaagcggggacacaguggggacaggag

SEQ ID NO: 17984 - RNA, 74 nt, Human
gaagcccgaggcugcuccuguggaaguggcucugggcaccagccuguggggcuaaagacuugacagcuagcuuc

SEQ ID NO: 17985 - RNA, 67 nt, Human
ucucgcagguggcaugacagaggcucugaggccugauggcuggacccugcucacugcuguuguggga

SEQ ID NO: 17986 - RNA, 80 nt, Human
ugaccucuauuuucuuauauugcucuuugguuucauaauuuuuuacagggaaaaaaaaagggggggaaaaucaggggcca

SEQ ID NO: 17987 - RNA, 75 nt, Human; identical to SEQ ID NO: 74

SEQ ID NO: 17988 - RNA, 87 nt, Human; identical to SEQ ID NO: 76

SEQ ID NO: 17989 - RNA, 79 nt, Human
ucagugcgggaaccaaugcagacuggcauuaaggcuguggauagcuuggugccaauuggucguggucaacgugaacuga

SEQ ID NO: 17990 - RNA, 81 nt, Human; identical to SEQ ID NO: 4694

SEQ ID NO: 17991 - RNA, 89 nt, Human; identical to SEQ ID NO: 504

SEQ ID NO: 17992 - RNA, 65 nt, Human; identical to SEQ ID NO: 1518

SEQ ID NO: 17993 - RNA, 75 nt, Human; identical to SEQ ID NO: 74

SEQ ID NO: 17994 - RNA, 87 nt, Human; identical to SEQ ID NO: 76

SEQ ID NO: 17995 - RNA, 75 nt, Human; identical to SEQ ID NO: 74

SEQ ID NO: 17996 - RNA, 87 nt, Human; identical to SEQ ID NO: 76

SEQ ID NO: 17997 - RNA, 71 nt, Human; identical to SEQ ID NO: 77

SEQ ID NO: 17998 - RNA, 66 nt, Human
gaaagauugugcagaugacugaagcagaaguucgaggcuuauguaucaagucucgggagaucuuuc

SEQ ID NO: 17999 - RNA, 76 nt, Human
gaggaaagcagucuuuggaaaccauuuguuugcuauuggcuuauaaaaucaaauauccagagaacuucuuucucuu

SEQ ID NO: 18000 - RNA, 108 nt, Human; identical to SEQ ID NO: 13761

SEQ ID NO: 18001 - RNA, 75 nt, Human; identical to SEQ ID NO: 74

SEQ ID NO: 18002 - RNA, 87 nt, Human; identical to SEQ ID NO: 76

SEQ ID NO: 18003 - RNA, 71 nt, Human; identical to SEQ ID NO: 77

SEQ ID NO: 18004 - RNA, 87 nt, Human; identical to SEQ ID NO: 76

SEQ ID NO: 18005 - RNA, 72 nt, Human
ggcagcaaaauuucggguugggaacuugaagaagcaaugcgcuaauuauuauuccaagucccaguuguugcc

SEQ ID NO: 18006 - RNA, 65 nt, Human; identical to SEQ ID NO: 1518

SEQ ID NO: 18007 - RNA, 87 nt, Human; identical to SEQ ID NO: 76

SEQ ID NO: 18008 - RNA, 61 nt, Human
gguuccuugugaggcuccgagcagggcugggaagacccccccaucggggcugagcagagcu

SEQ ID NO: 18009 - RNA, 124 nt, Human
ucccuagccugcagcgcgccgcgcccccggccccgcgccugcacgacgccgccgccuccugguucggggcugucgugacccugggugccgcggcggggggagugcugggcggcuggcuggugga

SEQ ID NO: 18010 - RNA, 86 nt, Human; identical to SEQ ID NO: 8024

SEQ ID NO: 18011 - RNA, 65 nt, Human; identical to SEQ ID NO: 1518

SEQ ID NO: 18012 - RNA, 71 nt, Human; identical to SEQ ID NO: 77

SEQ ID NO: 18013 - RNA, 75 nt, Human; identical to SEQ ID NO: 74

SEQ ID NO: 18014 - RNA, 71 nt, Human; identical to SEQ ID NO: 77

SEQ ID NO: 18015 - RNA, 65 nt, Human; identical to SEQ ID NO: 1518

SEQ ID NO: 18016 - RNA, 75 nt, Human; identical to SEQ ID NO: 74

SEQ ID NO: 18017 - RNA, 87 nt, Human; identical to SEQ ID NO: 76

SEQ ID NO: 18018 - RNA, 71 nt, Human; identical to SEQ ID NO: 77

SEQ ID NO: 18019 - RNA, 88 nt, Human
cacagacauuuucggggcaguuuucuuugggaaggucuuugauaaauuuuguaaucaccucucggaagaaagccccaaaugacaugug

SEQ ID NO: 18020 - RNA, 73 nt, Human
ggagugcaguggcacaaucucagcucacuacaaccuccgccucccagguucaagcgauucugccuuagccucc

SEQ ID NO: 18021 - RNA, 87 nt, Human
uagcuggaauuacaggugccugccaccaugucuggcuaauuuuuguguuuuuaguagagaugggguuucaccauguuggccaggcug

SEQ ID NO: 18022 - RNA, 71 nt, Human; identical to SEQ ID NO: 77

SEQ ID NO: 18023 - RNA, 76 nt, Human; identical to SEQ ID NO: 758

SEQ ID NO: 18024 - RNA, 71 nt, Human; identical to SEQ ID NO: 1764

SEQ ID NO: 18025 - RNA, 71 nt, Human
uuuuuuuuuuuuuuuuuuaaaggggucucauuuauugucacuguuccaaauguacaaaaaaaauuagaaaa

SEQ ID NO: 18026 - RNA, 65 nt, Human; identical to SEQ ID NO: 1518

SEQ ID NO: 18027 - RNA, 75 nt, Human; identical to SEQ ID NO: 74

SEQ ID NO: 18028 - RNA, 87 nt, Human; identical to SEQ ID NO: 76

SEQ ID NO: 18029 - RNA, 71 nt, Human; identical to SEQ ID NO: 77

SEQ ID NO: 18030 - RNA, 116 nt, Human
auagauugagguugguuuaaaauuauuccuguaaaccaacaauaaagcaaagaagagguucauuuuuguaaauaacacugguuucaaauagugauguuagacuuaaccuaauuuau

SEQ ID NO: 18031 - RNA, 69 nt, Human
gaauguugcugucaaagggcugcccccuaccuuauaaggguugcugggcauuugaaggcaggaagauuu

SEQ ID NO: 18032 - RNA, 78 nt, Human
ucccucucccaccugucugcauagaaaggcagaauuagacauagcaugcuuuggaaaagcaaauaggaauuguuggga

SEQ ID NO: 18033 - RNA, 77 nt, Human
ugaacugaaugagagagaaaaagagguccagaguaguuuguggagcgauguuuccaucucuaaugccacucagcuca

SEQ ID NO: 18034 - RNA, 104 nt, Human
uuauggucccacaaccacggccgucuuguuuucccggccaggaagcuucaucuuccggaucauccuggaaagggacagaggcggccgguuggugcgacucauaa

SEQ ID NO: 18035 - RNA, 67 nt, Human
cauguuguucgcaaugugugagaacgugaugaaagacgauauccccguuuacacacaaauucaacug

SEQ ID NO: 18036 - RNA, 72 nt, Human; identical to SEQ ID NO: 1696

SEQ ID NO: 18037 - RNA, 63 nt, Human
ccauugccauuucuacauguuauucgcuuguuacccucaaguugauacaaggucuggcauugg

SEQ ID NO: 18038 - RNA, 87 nt, Human
acugaggccgugguuccaguggcugcucggugguggggcuggagcuuggcagcauccugcagcccucuggacucccggcucucgagu

SEQ ID NO: 18039 - RNA, 98 nt, Human
uggugagggcguguggcugaagcucuguuccugcuuggggguuggccacacagcaucccaacuccagguccagagccgagccugacagcccuccucca

SEQ ID NO: 18040 - RNA, 110 nt, Human
uguuauuauuuauuucuuuuaauacaaagcuuuggcauuagcaguuuuaugagaaaauaaaaugugcgaaaaauaaaugcuuguguggcaugauugguaaaugaugcaca

SEQ ID NO: 18041 - RNA, 87 nt, Human; identical to SEQ ID NO: 76

SEQ ID NO: 18042 - RNA, 65 nt, Human; identical to SEQ ID NO: 1518

SEQ ID NO: 18043 - RNA, 75 nt, Human; identical to SEQ ID NO: 74

SEQ ID NO: 18044 - RNA, 87 nt, Human; identical to SEQ ID NO: 76

SEQ ID NO: 18045 - RNA, 75 nt, Human; identical to SEQ ID NO: 74

SEQ ID NO: 18046 - RNA, 87 nt, Human; identical to SEQ ID NO: 76

SEQ ID NO: 18047 - RNA, 71 nt, Human; identical to SEQ ID NO: 77

SEQ ID NO: 18048 - RNA, 109 nt, Human
gcacgccuuacgugucucgguccugaccgauggcaggaggagacgcgccgcugaaucggcgcguuuucgggcugcacaaaccacgggacggagccucgagcaggcgugc

SEQ ID NO: 18049 - RNA, 95 nt, Human; identical to SEQ ID NO: 806

SEQ ID NO: 18050 - RNA, 94 nt, Human; identical to SEQ ID NO: 807

SEQ ID NO: 18051 - RNA, 76 nt, Human
agacucuguuaugauuuuauuucuucaauuguuccaaucacaguuucuaauacagaaauaaaacuauucagcgucu

SEQ ID NO: 18052 - RNA, 82 nt, Human
gacagccaguaucauccugagcacugagguaugcuuuccauggccgagacccagcccuacucauugcgauggucuggauguu

SEQ ID NO: 18053 - RNA, 75 nt, Human
gccaaggcaacacuugcugaugagcaacuuuaaggcuaagccaaguuuucucaaaauaaucagcaguaagcuggc

SEQ ID NO: 18054 - RNA, 76 nt, Human
cacuggguucugcuacuccccagaccucagggacaacugccggggguucaggguugguagcagggaguacccagug

SEQ ID NO: 18055 - RNA, 91 nt, Human
cuuaaggagagagauuguguucuuccucucucaggggugauaacucaggaagccucuggguugggaagaccaucaguucuuuugucuuagg

SEQ ID NO: 18056 - RNA, 61 nt, Human
auagagggcuuucuaugugccaggugcugguccaagccccuuuucaacauaagcucucugu

SEQ ID NO: 18057 - RNA, 67 nt, Human
gcagccaccuacacagagugauagagauugaaaaagaaucaccuuucaccaugggcagcgaggcugc

SEQ ID NO: 18058 - RNA, 84 nt, Human
guugauuuguuuccaugaaccugaguugcuuugauuuaaaaaaaauuaaugcaacaaaaauacagcaucaguauacaaauccac

SEQ ID NO: 18059 - RNA, 93 nt, Human
gguugggggugcccggcuggcagcuccgagggacccagagucugagccugcucugaggcacccggggcaguuggcugggccagcccaccaacc

SEQ ID NO: 18060 - RNA, 84 nt, Human; identical to SEQ ID NO: 384

SEQ ID NO: 18061 - RNA, 89 nt, Human; identical to SEQ ID NO: 385

SEQ ID NO: 18062 - RNA, 66 nt, Human; identical to SEQ ID NO: 8995

SEQ ID NO: 18063 - RNA, 79 nt, Human
ggauaguuggaacuaauguacagaacuaaauuuuuuaaacuuuauuugcuguuaaaauucugugaaguuucaguuaucu

SEQ ID NO: 18064 - RNA, 81 nt, Human
gucauaauuuguuaaaaugacuucauuuaacauucacugauguagauuaauaauguaaguucugauuuaaagaaugguggc

SEQ ID NO: 18065 - RNA, 61 nt, Human
auguauauaauaucuccgguuuauaaaaccuauuuauaacacuuuuuacauauauguacau

SEQ ID NO: 18066 - RNA, 85 nt, Human
ggccaucuacacggugaggcacccggaguggcaucucaacucggauuacuccuacgguuucgccuacauccuggccuggguggcc

SEQ ID NO: 18067 - RNA, 74 nt, Human
uaugaaaggugugaacuugcaauguccuccugucuuaaacccaaguugacagugcccucucaaaacuuuucaua

SEQ ID NO: 18068 - RNA, 100 nt, Human
aaccugagaacauccauuucaauguccccaaacacuauuuauccccugaaaaagcagcuuaaaauaugggugcacauuuugcagcuuauguucuuugguu

SEQ ID NO: 18069 - RNA, 64 nt, Human
cggagcaccugucuucauugccucucccuucugcagccugaaaggagggauguucaggacucug

SEQ ID NO: 18070 - RNA, 76 nt, Human
gggcuaggcugggccuagcuguagagacacaccuaaguuccguucucuguuuggaggcugcacccagccugagucc

SEQ ID NO: 18071 - RNA, 76 nt, Human; identical to SEQ ID NO: 4396

SEQ ID NO: 18072 - RNA, 79 nt, Human
cauuuuucacucuuuaaaaucacauucaaaaaucggcaaagaaacgccccggggaaugaguagacgggaggggagggug

SEQ ID NO: 18073 - RNA, 90 nt, Human
cccaugaagcuguuacagauuguguaucuuggacugaauucuauaaguauauaugguacagacuaaaacaaauguggcuagcuagguggg

SEQ ID NO: 18074 - RNA, 78 nt, Human
uauuuagguaaagcucuaagacucaugagccaacuuuucauguaacuggcuuuccuaggcuggggcuugaacuaagua

SEQ ID NO: 18075 - RNA, 68 nt, Human; identical to SEQ ID NO: 5576

SEQ ID NO: 18076 - RNA, 62 nt, Human
ccuuuuaaguuuggauugggugagcuuucuucuaaaaggagcuucugaaguaauugcaaagg

SEQ ID NO: 18077 - RNA, 68 nt, Human
gguaauugaaaguuuguugaugaauauuuguguaaaacgcauucaagucuauaaccuuuccaauuacc

SEQ ID NO: 18078 - RNA, 72 nt, Human
uguugcugagugagucuuucuagccaggacaagcugauuggaauuuuugaaugguagagaagaaacagcaca

SEQ ID NO: 18079 - RNA, 68 nt, Human
gcagcacaaaggcggcgcggugcacaucggaguuguaguacuucagcugcaucugcgccaccugcugc

SEQ ID NO: 18080 - RNA, 66 nt, Human; identical to SEQ ID NO: 4249

SEQ ID NO: 18081 - RNA, 82 nt, Human; identical to SEQ ID NO: 1766

SEQ ID NO: 18082 - RNA, 92 nt, Human
aaaugcaguguagggagaggagauggcaggacacagcaaacaggacacauuugccugcuucucucuugccuaauucuuccugaccuguauuu

SEQ ID NO: 18083 - RNA, 73 nt, Human
auuaauccuuuuaaaacauuuuuguuaaaguuaguguaucaguaagaaacagaccuaguuuaaaaggaauaau

SEQ ID NO: 18084 - RNA, 86 nt, Human
uuuuuuuuuuuuuuuuuuuuuuuuuguggaaacccaggagcuuuuuuuuuuuaaaaaccauuuggaaaaaaggggaggaggacgaa

SEQ ID NO: 18085 - RNA, 81 nt, Human
aauuuuuuuauucuacauaaaagcugucaaaguuuugacacaucaaaaaugcaaaauaauggaauauacuuuaaaaaaauu

SEQ ID NO: 18086 - RNA, 65 nt, Human
aggcucaguuccuggaagagagacagagggucgcuacucuucuuggccugcucaggagggggccu

SEQ ID NO: 18087 - RNA, 61 nt, Human
gcuauuggccgacuccgcgaucugcuuguuaggcauaagggguggaaacuggccaagaugc

SEQ ID NO: 18088 - RNA, 62 nt, Human
ggcuuuggaggggcccgcagagcgcuggcauaggacauggcgggcuugccccccgcagagcu

SEQ ID NO: 18089 - RNA, 62 nt, Human
gggugauguacuucacagugaccggguccuccacagguagcucgggcuauggcacuucaccc

SEQ ID NO: 18090 - RNA, 80 nt, Human; identical to SEQ ID NO: 17576

SEQ ID NO: 18091 - RNA, 68 nt, Human
aaugugccuaguagaaaauuuuaaauuaccuauguggcucacauuauacuucuacuggacaguacauu

SEQ ID NO: 18092 - RNA, 72 nt, Human
cgcccuggggucauugucagguaaagaugguaaagccuguugcuagucaaguauugagggacucagguggug

SEQ ID NO: 18093 - RNA, 68 nt, Human; identical to SEQ ID NO: 18091

SEQ ID NO: 18094 - RNA, 72 nt, Human; identical to SEQ ID NO: 18092

SEQ ID NO: 18095 - RNA, 62 nt, Human
aaccaccagaucacgguccugcacgucuaccaccaugccucgaugcugaacaucuggugguu

SEQ ID NO: 18096 - RNA, 63 nt, Human
gugaugaacuggguccccugcggccacucuuauuuuggugccacacuuaauagcuucauccac

SEQ ID NO: 18097 - RNA, 74 nt, Human
ccgggaggccccgaggaggcggcuccucuucaagagugggagggggcaggccuggaguguugggggcagccugg

SEQ ID NO: 18098 - RNA, 65 nt, Human
cuggcagcagccccagccugaccgcccggaguguacuuuccuugacaggcaaggcuguuggccag

SEQ ID NO: 18099 - RNA, 128 nt, Human; identical to SEQ ID NO: 844

SEQ ID NO: 18100 - RNA, 79 nt, Human
cgacuugucuccucuauauaaaugcguagggguuuuaguuaaauguccuuugaaguauacuugaggagggugacgggcg

SEQ ID NO: 18101 - RNA, 85 nt, Human; identical to SEQ ID NO: 6904

SEQ ID NO: 18102 - RNA, 72 nt, Human; identical to SEQ ID NO: 8132

SEQ ID NO: 18103 - RNA, 73 nt, Human
cguuuuggaagcaaguggguucagugaaguguguugccacgaauagcacccgcugcuuuuggcuuuauuaacg

SEQ ID NO: 18104 - RNA, 64 nt, Human; identical to SEQ ID NO: 3890

SEQ ID NO: 18105 - RNA, 82 nt, Human
uggaguggggcggcgguugccgguggccucagacaugcagaaggggacggggcgccggccgggccacgaggccccccaccca

SEQ ID NO: 18106 - RNA, 94 nt, Human
gggugcauggccggaugucucugggacugaacgggggagggagugugaucugcugcuccuccaaauucccacaaggacuuuccuaucaucacuu

SEQ ID NO: 18107 - RNA, 78 nt, Human; identical to SEQ ID NO: 99

SEQ ID NO: 18108 - RNA, 65 nt, Human; identical to SEQ ID NO: 247

SEQ ID NO: 18109 - RNA, 80 nt, Human; identical to SEQ ID NO: 100

SEQ ID NO: 18110 - RNA, 79 nt, Human
ucugccuccagugucaaucccaaaccccgaacaaccaucuuuguuuagugggcaagugagggaccacauugauuucaga

SEQ ID NO: 18111 - RNA, 66 nt, Human; identical to SEQ ID NO: 1526

SEQ ID NO: 18112 - RNA, 122 nt, Human
auguguaccauggcugaaaaaaagagucacaaguggcugagacacugcuccauacaggacucauguguggucauugcccacccaaucuuaugacuccaucaucuugggaccuggaacaacau

SEQ ID NO: 18113 - RNA, 65 nt, Human
guauuaauuugauucuuaugucuuuuguaagugagaacaauagacuuucaggauacaaaacaugc

SEQ ID NO: 18114 - RNA, 65 nt, Human
gugccaauguccuaccagcuaccccagaccuacuacaggauuuuuacguggcgauuuccaagcac

SEQ ID NO: 18115 - RNA, 73 nt, Human
uccaguuuuuggacagaaugcgggcugccggcaaguuggaccagccugaucguuucucuuucaaagaccagga

SEQ ID NO: 18116 - RNA, 71 nt, Human
cagauguuuugaagaucgugacgucuuguaacuagcagugugugcacagaauccuacucaaggaacgucug

SEQ ID NO: 18117 - RNA, 71 nt, Human
gaacgguugugaccacaccgacacguauuuuacagauaaaucauucuugcggcggcgggucgaacacguuu

SEQ ID NO: 18118 - RNA, 82 nt, Human
cauggcccacucacccaaacuuacccuacacacacuaggauaucuucuaggugaaagcaguaaauggaggagguugggcaug

SEQ ID NO: 18119 - RNA, 65 nt, Human
gaaggcagugcccccagugcuagugaugcccagaaggacaaggaagcauccccacuacugcccuc

SEQ ID NO: 18120 - RNA, 60 nt, Human
gcaacagagucauuauuuggagaauaacagugaaaacagccaagcagauaaacucugugc

SEQ ID NO: 18121 - RNA, 78 nt, Human
cccccagaggaaucugguaaagaagacaaacagggccaggcgcgguggcucacuucuuuaaucccagcacuuuggggg

SEQ ID NO: 18122 - RNA, 75 nt, Human
ucaggaguucaccauuagacucucacauuuacauauauuccggaagaugugagagucuaauggugagcucuauga

SEQ ID NO: 18123 - RNA, 66 nt, Human
cagaauggccgugucggacacugauuuggaucacauucuuccaucuucuguucuuccuccauucug

SEQ ID NO: 18124 - RNA, 63 nt, Human
ugcaguuguaauuuagauucgagaagugguuuauccuuugacuggaaaagaaaaguagcugca

SEQ ID NO: 18125 - RNA, 64 nt, Human
agaugaaauuaagccacucacuuuaaaauuuuuauaagaauuugaacguggcuuuguuuccucu

SEQ ID NO: 18126 - RNA, 61 nt, Human
ucuaauuccauacaauuucugcaauuuuaaaagauacccccaaauugauuguuaggauaga

SEQ ID NO: 18127 - RNA, 97 nt, Human
ggaagcugggaggacgcagauccuucggaccggggggcgacccuuuuuaggcugugacucggggguggccccaggcccgggauagcccccagauucc

SEQ ID NO: 18128 - RNA, 98 nt, Human
gcuucaacuuugacuuucugccagaggagagugagcacaauaucuggggcaccuaagauguagcauguuuccgaaagugggagguuuaggacugaggc

SEQ ID NO: 18129 - RNA, 77 nt, Human
uguuacaggaggcagaaagaaaugauuuagguagacgggguaaagccaguccccagcagaaaauuugccuuuuaaca

SEQ ID NO: 18130 - RNA, 78 nt, Human; identical to SEQ ID NO: 5110

SEQ ID NO: 18131 - RNA, 84 nt, Human; identical to SEQ ID NO: 5111

SEQ ID NO: 18132 - RNA, 69 nt, Human
uccuucuucaccgacgauguacagcaagacaccucagcugggaguggaaccuugucgauuaaggaagga

SEQ ID NO: 18133 - RNA, 60 nt, Human; identical to SEQ ID NO: 5112

SEQ ID NO: 18134 - RNA, 84 nt, Human
gggggaggaccacguugguuuggcuugccgagcaugucacgggugggagaagcucacagcccgguaggccgcaaguccuuuucu

SEQ ID NO: 18135 - RNA, 60 nt, Human; identical to SEQ ID NO: 10992

SEQ ID NO: 18136 - RNA, 64 nt, Human
guucaacuuugagaguuucccggaguccccuggggagaacggggcaacuuugcaaacccuaagc

SEQ ID NO: 18137 - RNA, 70 nt, Human
ggagucuccucucuaccgccacugucacaccguagcccacauggauagcacaguugucagacaagauucc

SEQ ID NO: 18138 - RNA, 73 nt, Human
gggaagguggggaggguccgaggggaaggggacccagcuucccugugcccgcucaccccacuccaccaguccc

SEQ ID NO: 18139 - RNA, 67 nt, Human
uuuguuaauguuucaaacauacuuucuugguuuucuaauggaguauauaguuuagucauuucacaga

SEQ ID NO: 18140 - RNA, 61 nt, Human
ggaguggccuauuaagagucucaaagucuaccugggagugaagaagaaacucaggccaccc

SEQ ID NO: 18141 - RNA, 81 nt, Human; identical to SEQ ID NO: 7833

SEQ ID NO: 18142 - RNA, 70 nt, Human; identical to SEQ ID NO: 7835

SEQ ID NO: 18143 - RNA, 88 nt, Human
cugagcagauuccucauggucaugggggccacguuguuauguaccuugcaucacgugggugguuuccauauagaccgaggcgguucag

SEQ ID NO: 18144 - RNA, 63 nt, Human
aaguggucucugcuggggaaggguuuacuuuucuuuuuuucuuuaauaacaaggagauuacuu

SEQ ID NO: 18145 - RNA, 69 nt, Human
gccaaaaucagcauguucuccuaugccucagccaguucuaauguaauaggagaugcaguuuauuuaagc

SEQ ID NO: 18146 - RNA, 130 nt, Human
ucacgucugcaaucccaguacuuucggaggcugaagcggugguucacuugaugccaggcugcucuugaauuccugaccucaggugauccucccgccucggccucccaaggugcugggauuaaaggcauga

SEQ ID NO: 18147 - RNA, 71 nt, Human
uucaguuugauacaugcuauugauugcuuaaaauuuccuacuaaaaaauuaauauucucaacuaaauugaa

SEQ ID NO: 18148 - RNA, 73 nt, Human
acuaagacuggcugugguuaaaugaauauguucaguucugaacuuuuaauaguaacuccaauucaguaauggu

SEQ ID NO: 18149 - RNA, 63 nt, Human
cuuggauuuuucacucggggaaugcuccggcuuaacagcagauccggguggucgcuggccaag

SEQ ID NO: 18150 - RNA, 65 nt, Human
gcacuucgggacgggggggaaacaccacaaaacgggccugcggaauuccucacuugucugugugu

SEQ ID NO: 18151 - RNA, 63 nt, Human
uacaggcacauaccaccacgcccagcaaauuugugugugugugugugugugugugugugugug

SEQ ID NO: 18152 - RNA, 68 nt, Human
ccuccuuugcuccucaaaaauauucaagggacagucucucuuucauauauuuuggcugcagauacagg

SEQ ID NO: 18153 - RNA, 70 nt, Human
ccccuuuuccagggggaaaaccugggggcccacuugcuuuaauaaaucccccaccccccgggaaaagggg

SEQ ID NO: 18154 - RNA, 63 nt, Human
gggccaaaauuguuuccuggggaaaauuguuaccccuucaaaauuccccacaacauacaaccc

SEQ ID NO: 18155 - RNA, 103 nt, Human
aaggggagguuuuugcaaauucccaaggaaaugucaaaaagggaaaauggccagcauuauccauuugcuuuuuuggguuuacugggggaauaacacuuuccuu

SEQ ID NO: 18156 - RNA, 61 nt, Human
uuugggggguuuggccaaacuuuuuauuuaauauucuggaguugguuaacacacacuuaaa

SEQ ID NO: 18157 - RNA, 64 nt, Human
gaguguuuugguguucccugccccuguguuuuggggagcuugggggcggggauguugaacacuu

SEQ ID NO: 18158 - RNA, 80 nt, Human
gcgcgcucucccugcucaucccgaggagagagacugauggcgggacagggcuucuuggggugggugggaaaggggugcgc

SEQ ID NO: 18159 - RNA, 88 nt, Human
guuuuuguuuuuuuggucauaaauccagaugagaugaaguaucgugucuacuauuuccuuucagagccgugaucuuccuaacgagagc

SEQ ID NO: 18160 - RNA, 61 nt, Human
ucuuccaucggccucggucuuuuagauucccugccuucgagccgaaccgagauuuggaagg

SEQ ID NO: 18161 - RNA, 95 nt, Human
ccccaaagcugaaagagcuuucaugaaaaugccuggagccauucaguauagaacuaagugcucuuccccaugguagcuaucucaacuuugaaggg

SEQ ID NO: 18162 - RNA, 64 nt, Human
ugggaaaauaaggcacuguccaaguaacacacagugacaguggcaaagucgugcuugcuuccca

SEQ ID NO: 18163 - RNA, 75 nt, Human
gauaaaguugaaggcuacaagaagaccaaggaagcuguuuugcuccuuaagaaacuuaaagccuggaaugauauc

SEQ ID NO: 18164 - RNA, 63 nt, Human
gaucuuagcagaaucuugaaaagcccagagaucaaagagcccuucgagcacacgcagaagauc

SEQ ID NO: 18165 - RNA, 67 nt, Human
ugugucguggaggcgaauguuugcaccaaccaaaaccuggcgccguuggcaucguagagugaacaca

SEQ ID NO: 18166 - RNA, 66 nt, Human; identical to SEQ ID NO: 4461

SEQ ID NO: 18167 - RNA, 61 nt, Human
ggugacaacaugcuggagccaagugcuaacuauggccugguucaagggauggaaagucacc

SEQ ID NO: 18168 - RNA, 66 nt, Human; identical to SEQ ID NO: 3532

SEQ ID NO: 18169 - RNA, 61 nt, Human
gugacaacaugcuggagaccaagugcuaacaugccuugguuccacgggaugggaaagucac

SEQ ID NO: 18170 - RNA, 68 nt, Human
cagaagagcuaaaacgguuugaugauccagguuugaugcucauggguuucaagccguugguacugcug

SEQ ID NO: 18171 - RNA, 65 nt, Human
gcagggggacggccccaaguguccuguccacaaaaggcgcggugacaaagggacuccuaacccgc

SEQ ID NO: 18172 - RNA, 61 nt, Human
gcgggcgaauaaccccgucuuuuuccauuauaacucuuccggcaaaggcgcguuugcccgc

SEQ ID NO: 18173 - RNA, 83 nt, Human
gucucuguuccgcaggaugggguuuguuaaaguuguuaagaauaaggccuacuuuaagagauaccaagugaaauuuagaagac

SEQ ID NO: 18174 - RNA, 62 nt, Human; identical to SEQ ID NO: 2350

SEQ ID NO: 18175 - RNA, 81 nt, Human
gcccaggcuggaguguaguggcaugaucucggcucacugcaagcucugccucccggguucacgcccuucuccugccucagc

SEQ ID NO: 18176 - RNA, 77 nt, Human
uuucaccacguuugccaucauggucuugaucuccugaccucaugauccacccgucuuggccguccaaagugcuggga

SEQ ID NO: 18177 - RNA, 94 nt, Human; identical to SEQ ID NO: 807

SEQ ID NO: 18178 - RNA, 77 nt, Human; identical to SEQ ID NO: 796

SEQ ID NO: 18179 - RNA, 84 nt, Human
ccggaagcugcccuuccagagguuggugagggagaucgcgcaggauuucaaaaccgaccugagguuucagagcgcagccaucgg

SEQ ID NO: 18180 - RNA, 66 nt, Human; identical to SEQ ID NO: 3532

SEQ ID NO: 18181 - RNA, 67 nt, Human; identical to SEQ ID NO: 351

SEQ ID NO: 18182 - RNA, 66 nt, Human
ccccgggauuuuggccugccccuucgucggagacccggccgggggggcgcagcucuuuccuagggg

SEQ ID NO: 18183 - RNA, 83 nt, Human
gggcauccuggcugcagaugaguccacugggagcauugccaagcggcugcaguccauuggcaccgagaacaccgaggagaacc

SEQ ID NO: 18184 - RNA, 81 nt, Human
cgauugggacugacgcucauggacaggguucccauggauaaauuugucgaaggcaccagguccaaugcaguggucaagucg

SEQ ID NO: 18185 - RNA, 75 nt, Human
caccgcguaggaugcugauauugccugccgaugcugccagcggaaaugaugauggugucaguaucaaaaccggug

SEQ ID NO: 18186 - RNA, 130 nt, Human
auauaggaagguauacugguuucuggugugauucuuuagcuacauuuauuccuugucuuaugucauuucacuggaucauguaacuguccuggcuuucagaaauuauauuagaugcccagccuuucucauu

SEQ ID NO: 18187 - RNA, 66 nt, Human
gagaugggguuucgccguguuagccaggacggccucgaucuccugacgucgugauccgcccgucuc

SEQ ID NO: 18188 - RNA, 81 nt, Human
cuggagguggaagccaacaaugccuuugaccaguaucgagaccuguauuuugaagguggcgucucaucugucuaccucugg

SEQ ID NO: 18189 - RNA, 72 nt, Human
uuucggaaucaggcgggucccuggugauucgcuggguuuucccacuucccacggggaccucaccuuugggaa

SEQ ID NO: 18190 - RNA, 61 nt, Human
ggcaucuucuggcuugacuggauggaaggagacuuaggaaccuaccaguuggcaugauguc

SEQ ID NO: 18191 - RNA, 62 nt, Human
gugggguagcagauggaguaauggucacgagguccagacccacucccaaagcucagacuugc

SEQ ID NO: 18192 - RNA, 60 nt, Human
ucggggaaacggcgggguacugcacagcccuggcugcuacagaaccaccaaaacccgcga

SEQ ID NO: 18193 - RNA, 100 nt, Human
ggccugugccgcgaccggccccccugggcggggcucggggcugccgcgucccgcgacgcgggaccucgccccccgcucguggccggccccggcgcgggcc

SEQ ID NO: 18194 - RNA, 95 nt, Human
augaaguuaugugugcacaauucaaguggacuguaaacuguugguauauucagugaugcaguucugaacuuguauauggcaugauguauuuuuau

SEQ ID NO: 18195 - RNA, 62 nt, Human
cagaguguaaauggugaucuucuaaaucuguguccacaaauuccaaaacccauaacacucug

SEQ ID NO: 18196 - RNA, 70 nt, Human
caguauuuguccuaccggguuuuuguuguuuucuguucuguauaauaguaucuaauguuggcaaaaauug

SEQ ID NO: 18197 - RNA, 97 nt, Human
cgauggcugguggcuggggccagccccgggacucccgggugcaggaggacccuguggucccggguccuggcgcuggcaucccugggcaaaagcggcg

SEQ ID NO: 18198 - RNA, 76 nt, Human
guaggcccuguuggcuuuggcccuggugaucggagucaccuggacagcccagaggcucgagaagccauguuccugc

SEQ ID NO: 18199 - RNA, 69 nt, Human
guguggggcguggaccagggcggcgggcagcggguuuuccuccugguccuccaaaaugcgcuucagaac

SEQ ID NO: 18200 - RNA, 73 nt, Human
cccucccaacccccuugaucccuuucucugaucaggggaaaggagcugagugagggagguagaguuggaaggg

SEQ ID NO: 18201 - RNA, 88 nt, Human
agaucagagaauaggucuauauuucauuaagauaaauguuucaaaugaaacauuugguaauugagaauacuacuuuaauaucugagcu

SEQ ID NO: 18202 - RNA, 69 nt, Human
ccuggaggaucagcgcuaacucauguacaaugugcucauuauuggacaauauucugcuaucuacacagg

SEQ ID NO: 18203 - RNA, 84 nt, Human; identical to SEQ ID NO: 286

SEQ ID NO: 18204 - RNA, 65 nt, Human
cccggagcccagucacagcggugccugccuagcacaaguguaggacagcuuuauugaucucuggg

SEQ ID NO: 18205 - RNA, 71 nt, Human
cuuuccacacaggcuaccagauauuuuauuuacauuuaaaaauagguuuucuucuucaacguaguggaaag

SEQ ID NO: 18206 - RNA, 93 nt, Human
uuuuuuuaguuaaaacuguuuaauaggaacaaucuuuuucaagcaugaaagagcuuuguuuuggaggauuauagcaacauacaacugagagag

SEQ ID NO: 18207 - RNA, 65 nt, Human
guaauuuucucaucaacagaaucuggcucucuauuuucuguaaguccuucaugagagucuguugc

SEQ ID NO: 18208 - RNA, 131 nt, Human
uauucuugcuuuaucuggaacaguuuacuccguuauugaauaucuauuaguguuuaauauagaagagcuuaauaaaccgcuaauccgaaaauaaugguauucccuugcuuuucagaccuuuuugcugaaua

SEQ ID NO: 18209 - RNA, 65 nt, Human
ccccacccaccagccgccaagcgucacaccaaacccaggaccuucagacaggaugaauggugggg

SEQ ID NO: 18210 - RNA, 64 nt, Human
uucccaggcggcaggucugggucugagcacaugcuguuugggggaucaccuggacgccugggga

SEQ ID NO: 18211 - RNA, 88 nt, Human
cugggcccgggagacaacuuggcgucaccccucagcggucgccacucucuucucuguuguuggguccgcaucguauucccggaaucag

SEQ ID NO: 18212 - RNA, 84 nt, Human
gugaacuuuuagcuccugcagcuccuuuugacaagaaauguggucgugaaaauuggacuguugcuuuugcuccagaugguucau

SEQ ID NO: 18213 - RNA, 74 nt, Human
gaggaggcuauggcuaguuagaauauaugcaugguaacugaauuaccuguaucuguuuuuaaugggguccucuc

SEQ ID NO: 18214 - RNA, 73 nt, Human
uguucucuaggccuuuguagaaaacauggacguuguuccuuggcgcacauauuaugcgaaucuauagagaaua

SEQ ID NO: 18215 - RNA, 63 nt, Human
cugagcaagaaggagcugaaagagcugcugcagacggagcucucuggcuuccuggaugcccag

SEQ ID NO: 18216 - RNA, 86 nt, Human
cccugguguggggagccgaggcggugcaggcccuccgggagcgccuggguguggggggccgcacgguaggcgcccugccccgcggg

SEQ ID NO: 18217 - RNA, 71 nt, Human
ccgguucaggcaggcccuggacuggcgugucccggucuaagaguggcccagccggcgccugccugagcugg

SEQ ID NO: 18218 - RNA, 63 nt, Human
gcugcugaugcccgaagaggcgcggcucuuggccgagaucggcgccgugacucuggucagcgc

SEQ ID NO: 18219 - RNA, 67 nt, Human
cuguuuccucucgaauuccauccuguuggagaaacagggaguccaggagcccguugggaggagacag

SEQ ID NO: 18220 - RNA, 85 nt, Human
guggacccaaguuaggugugacacguucacauaacugugcagcacaugccgggagugaucagucagacauuuuaauuugaaccac

SEQ ID NO: 18221 - RNA, 63 nt, Human
ccgcggaagccggcuggagcacuuugggacugccccaguacggauaauaguuggccuccgugg

SEQ ID NO: 18222 - RNA, 61 nt, Human
agagcgaaggauuugagagcacucuccagaacaaggaaagauuuuuauugcaaggcgcucu

SEQ ID NO: 18223 - RNA, 114 nt, Human
cuuaugcuuuggcaaauuuccuaccguuguuuggaccugguggaucauguuccugucuacauuuucaguucccuauuuucuguuucaacauugggccacuggcuauagcaagag

SEQ ID NO: 18224 - RNA, 71 nt, Human
uugccgggccgcuacccggggucuggggaacacaccggcguucuaaaacaccgcgggcgauggcgcggcga

SEQ ID NO: 18225 - RNA, 65 nt, Human
agcuauucaguugguaagcuuccaggaaaaaggacaggcagaaagaguuugagaccugaauagcu

SEQ ID NO: 18226 - RNA, 65 nt, Human
ccagauuucagucuuuuccuguuuuuguuaacuuuggguuaaaaaaaaaaaaaaagucucguugg

SEQ ID NO: 18227 - RNA, 64 nt, Human
gguugaacaaugcucucacauuacaggaauuuagggccuagaauguguaaggcucuugccagcc

SEQ ID NO: 18228 - RNA, 71 nt, Human
ggauguuuggaagauaagcuuaaaggagaaaugauggaucugcagcaugggagcuuauuucuucagacacc

SEQ ID NO: 18229 - RNA, 61 nt, Human
gcagguuuaggacagccauuggcuaacugggucgaucuacugggcugauucugggacccgu

SEQ ID NO: 18230 - RNA, 101 nt, Human
gagaguauaaagccaacagauccagguuuugaaauauuuaaguaaaaugacagcaugacacuaauaaacaaaaauauaaucuaaauuguuuuuuuauuuuu

SEQ ID NO: 18231 - RNA, 80 nt, Human
gcgagugccagcaugccuggcuaauuuuuuguauuuuuaguagagacuggguuucaccauguuggccaggcuggucucgu

SEQ ID NO: 18232 - RNA, 112 nt, Human
cuggagaacuuaaaaaaauaaagacugcugccugggccucacccuagaccaauuagaucagaauuuccaggaguugaggucugaacaucauuaauuuuuuaaagcuccccag

SEQ ID NO: 18233 - RNA, 63 nt, Human
ucaggcaguagcaucaacaucacccugaagcuuguuaaucagauucucacaugcuaucacuga

SEQ ID NO: 18234 - RNA, 77 nt, Human
acagauuaaaggauagggugcaccauuuuuguaacuuuuaaggcguugcaaaagggcauuuucugucaaauauuugu

SEQ ID NO: 18235 - RNA, 62 nt, Human
ucuugccuuucccuugauaaugcaguaagggacccccauuuuacgacacagggcaggcaaga

SEQ ID NO: 18236 - RNA, 87 nt, Human
ggagucucacucuguugcccaggcuggaauggaguggcgcgaucucagcucacugcacuccagccugggggaacagagugagacuuc

SEQ ID NO: 18237 - RNA, 68 nt, Human
ucuuuaggaaagaaaaugaaauaaagacauuuucuuuuuuuucuuuacuuuuuuuuuuuuuuaugaga

SEQ ID NO: 18238 - RNA, 70 nt, Human
uggugguaacgaaauuugguaaugcucuucgaaccugaggguuauggggcugacuuuagugggaccauca

SEQ ID NO: 18239 - RNA, 66 nt, Human
cagaagagcuugcuagagugucaaaacuucuccccagggagauaauguugacccuugcucucucug

SEQ ID NO: 18240 - RNA, 71 nt, Human
ugaaaauucuuuauuuaaaauaccaaguuauuaaaauggguaaaaugacauaguaaaauaaaauuuuuuca

SEQ ID NO: 18241 - RNA, 62 nt, Human
ugauggguaggcacaugaugccagccaagccguccuucuguauuaccuguguuugccgauca

SEQ ID NO: 18242 - RNA, 68 nt, Human
gacgagcugagguuggacuuguugaaauaauccugauacauuccuacaauggccacugcucagcuuuc

SEQ ID NO: 18243 - RNA, 64 nt, Human
cauguugacuuuccauaaauugagcgucagguuacuggauauggguaugggaaaaauuggcaug

SEQ ID NO: 18244 - RNA, 88 nt, Human
ggcggcgaaaggaccggcuuaaugccagaccgggaguuggagguguccgaucucgaguggggauccagcaaggccuucucagccaguc

SEQ ID NO: 18245 - RNA, 62 nt, Human
ggagacaaagugggagcagugaagucacgcugcugaacaugcucaauaucucccgcuucucc

SEQ ID NO: 18246 - RNA, 94 nt, Human
uaaugucagcuccuuuuccuacguaugaaaaccaauugaguguuaccaauauaauggaauuuucuuucauauguaggaaaaggagcugacauua

SEQ ID NO: 18247 - RNA, 87 nt, Human
uuuacuaacacuauauguguuauguuuuucauaaaaauauaucaauugauaugaacuuaggacauugacuuauacgaguguaguaga

SEQ ID NO: 18248 - RNA, 78 nt, Human
ccguaugaaugcagcgaaugugggaaagccuuuagguuugaagucuccauucguuguacaccagagaacucauacagg

SEQ ID NO: 18249 - RNA, 94 nt, Human
gaaagccuuugguaggaaggaacagcucacugcacaucugagagcucaugcaggagagaagcccuauggaugcagugaaugugggaaggcuuuc

SEQ ID NO: 18250 - RNA, 81 nt, Human; identical to SEQ ID NO: 13161

SEQ ID NO: 18251 - RNA, 63 nt, Human
cuacucuuauuccuacucauuuagcaguaguucuauugggcacuaguagucaguagggagugg

SEQ ID NO: 18252 - RNA, 91 nt, Human
cuagaacaaaauaugacuuuuuuacaccaucuugcuguugauucauuggcuuuugaagagaagcauagaagagacuuuuuauuuauucuag

SEQ ID NO: 18253 - RNA, 62 nt, Human
cuuuguguacuggaaugauguugaauucagagaggugacagaacuuauuaaaguggauaaag

SEQ ID NO: 18254 - RNA, 61 nt, Human
uccugccgggcucguggcggcuucuguccgcuccgcggugggaagcgccuuccccacagga

SEQ ID NO: 18255 - RNA, 74 nt, Human
guuauuuugacuugccucuucaucuggcaaaaucucugaaccacugcucuggagaugacagcaggcaaaaucac

SEQ ID NO: 18256 - RNA, 68 nt, Human
uaggauugaacuuacccgcacuuuguuccaaauaauucaauuucuucgggggaagcuucugcaucuua

SEQ ID NO: 18257 - RNA, 69 nt, Human
gucucuucagagcugcuugugcccaguggugcuucaacugguaucuaugaggcccuagagcuccgggac

SEQ ID NO: 18258 - RNA, 71 nt, Human
gugaguuuuguuuccaccuggacugucaccugccggcccugcaggauguaccaggggaggaguggagcugc

SEQ ID NO: 18259 - RNA, 62 nt, Human
guaccugagcccugaccucuggagggacuguuuuucccauguuccuaucaggaguucaugac

SEQ ID NO: 18260 - RNA, 61 nt, Human
gccugaugacaugcucacgugacaugguuaugcccuguuuggcuuuauaugugauaaaggc

SEQ ID NO: 18261 - RNA, 66 nt, Human
uucauauucacuguuucauaaauauuacaguaaaugagcuuuuuauauugcaaacagugguuggaa

SEQ ID NO: 18262 - RNA, 63 nt, Human
uuuuuuuucucugacaucacagacuuguuuauucucaaacaugggccuguuagaaaaaaaaaa

SEQ ID NO: 18263 - RNA, 67 nt, Human
gaagaaaccacaaaauucaggaagguucuuaugaaccauucauucauugaagaguuguuuuuuuuuc

SEQ ID NO: 18264 - RNA, 80 nt, Human
cccaaaacaaguucuuccagacuaaagaaauuaagguaacaucaauaccuaggucugagauauacccauccuuguuuggg

SEQ ID NO: 18265 - RNA, 65 nt, Human
cuggcacuucagaaccucuuccucuacacuuuuggugugcuucugaaucuaggucugcaugcugg

SEQ ID NO: 18266 - RNA, 82 nt, Human
ucuacagaggcccuggcacauuuuuccuuuccaccccugaguccaccaaagcaaaauguccccuccagggccccucuguggg

SEQ ID NO: 18267 - RNA, 76 nt, Human
aguagaggugggguuucaucauaguggucagguugggcuugaacuccugaccucaggugaucugccugccucggcu

SEQ ID NO: 18268 - RNA, 96 nt, Human
ggagucucgcuguguugcccagccuggagggaagugguguaguggugugaucucagcucacugcaacuucugccuccuggguucaagugauucucc

SEQ ID NO: 18269 - RNA, 85 nt, Human
uagcugggacuacaggcgcaugugccaccccuggcuaaguuuuuauauuuuaguagagaugggguuucaccuuguuacccagcug

SEQ ID NO: 18270 - RNA, 69 nt, Human
gguuuccccauacugucucuuguuuuuggaggugacauuuccauccagaaggauaacgaucaggaaacu

SEQ ID NO: 18271 - RNA, 77 nt, Human
uugagggcugggaagaggcuaggcgacgugguuucagauacgaaaaggacuaugcugggaauauuuucugucuucaa

SEQ ID NO: 18272 - RNA, 70 nt, Human
cuuaucuuaacaucuacucugugccaagcacucugcuauaauaugggaccauaaagaugaguaagacaag

SEQ ID NO: 18273 - RNA, 71 nt, Human
uuuccugaucagcuuuuaauaucugucaaauaaaaauugaaauugaagaugguauauaagauuucaggaaa

SEQ ID NO: 18274 - RNA, 61 nt, Human
uagaggccagccuuugucuuguucagaugacuguugcacaggaaagacugcuggcugacua

SEQ ID NO: 18275 - RNA, 60 nt, Human
cgugcguggaaguggcucgcagauacuggagaacgggaagggagacgcuugcagcgcgcg

SEQ ID NO: 18276 - RNA, 65 nt, Human; identical to SEQ ID NO: 1518

SEQ ID NO: 18277 - RNA, 75 nt, Human; identical to SEQ ID NO: 74

SEQ ID NO: 18278 - RNA, 87 nt, Human; identical to SEQ ID NO: 76

SEQ ID NO: 18279 - RNA, 71 nt, Human; identical to SEQ ID NO: 77

SEQ ID NO: 18280 - RNA, 60 nt, Human
ucuggagaaaagucagaaugaacaagaagcuauucgcaauaaccugacgacacucuuaga

SEQ ID NO: 18281 - RNA, 63 nt, Human
aguugaaaaguuccggcagagaauucuggcucccuguaagcuagagacuguuggauggcagcu

SEQ ID NO: 18282 - RNA, 72 nt, Human
caacucggagugaacaaugaagauucaaagagccuggagaaaguucuuguggaauucagucacaaggaguug

SEQ ID NO: 18283 - RNA, 84 nt, Human
cacugaguguagacaaguccuccagcacagccuauauggagcucacuaggcugacaucugaggacucugcugucuauuucugug

SEQ ID NO: 18284 - RNA, 74 nt, Human; identical to SEQ ID NO: 14314

SEQ ID NO: 18285 - RNA, 90 nt, Human
ggaaccuuugccucugccaccugcacagucugccaaagaccuucccagggggaggacauucgggcugacgugauuggcagacaggguucc

SEQ ID NO: 18286 - RNA, 92 nt, Human
ccggccgcccagggucgccgccgccccucgcaccgcuaggucugcgcaccaucucgcccccgccguggggaggcgugcggcucagcggucgg

SEQ ID NO: 18287 - RNA, 67 nt, Human
gcccgcccgccgccccgcagcgccagggacggcccgccuggcaagaagcugcgcugaaggcccgggc

SEQ ID NO: 18288 - RNA, 62 nt, Human
ccccgggggggacgcccggagaaacgugguucuacacgggacgaccgggcgcccacuugggg

SEQ ID NO: 18289 - RNA, 130 nt, Human
ggggaaccgcgguggcuuccgcggagguuucggcaguggcauucggggccggggucgcggccguggacggggccggggccgaggccgcggagcucgcggaggcaaggccgaggauaaggaguggaugccc

SEQ ID NO: 18290 - RNA, 75 nt, Human
agcggagggacugauaucucuggcuaaauauuuguccuuuuauuaugguuucuaaaucaguuauuuucuucagcu

SEQ ID NO: 18291 - RNA, 63 nt, Human
cccuauuuuuguccaauaaggcgaaccuuuaacagagucccuuaauuggguggcuaaaacggg

SEQ ID NO: 18292 - RNA, 64 nt, Human
uggaauaauuaaaaauucuggugcaguggugguauaccaaucuuuagaauucuuaaguauucua

SEQ ID NO: 18293 - RNA, 62 nt, Human
aaauuauauuugugugaaaaugugacaaacacacuuaucugucucuucuacaaaugugguuu

SEQ ID NO: 18294 - RNA, 60 nt, Human
ucaaagccagcugaaggaaagaggaagugcuagagagagcacccuucagugugcuucuga

SEQ ID NO: 18295 - RNA, 78 nt, Human; identical to SEQ ID NO: 9151

SEQ ID NO: 18296 - RNA, 60 nt, Human
uuaaguuuucaugauucaauacucuuaagauacuuuguuuuaaaauuacugaaagccuga

SEQ ID NO: 18297 - RNA, 76 nt, Human
uucacuucugcugaacucuguguuacugcugccuagaaaaggguguaugugguuaggaguaauaggugagggugaa

SEQ ID NO: 18298 - RNA, 61 nt, Human
gagaagugagcugguucaaaguucacagaguuaggacuguguccuggcuggcucauuuuuc

SEQ ID NO: 18299 - RNA, 69 nt, Human
gagugaacgcuaaaacggaggagaguaaacccuacaggaaacgugggaauacucuagaauucuucauuc

SEQ ID NO: 18300 - RNA, 117 nt, Human
ucuuggaguugugaagguccgccuuaucuauaaaucugcuugggcgacagccgguccaacuacuaaacgggauugcccacggcaauaaaaugaguaauggcggcccacaccccaggg

SEQ ID NO: 18301 - RNA, 81 nt, Human
aggaacagacuucauucuuuuucuuaacaaaaaaggcaucuucagugugugauuucaaaagaaagaagauucuggguuccu

SEQ ID NO: 18302 - RNA, 93 nt, Human
uugauacaaagcuuaaaauucugcauauggucauagaaaaugcauauugguuuguguuuuuaucacuugcuuccaacuuaggcuuuggcucag

SEQ ID NO: 18303 - RNA, 62 nt, Human; identical to SEQ ID NO: 10015

SEQ ID NO: 18304 - RNA, 73 nt, Human
gcagugauguugggcaacucugcgccggggccugcgacccgcgaggcgggcucggcgcugcuagcauugcagc

SEQ ID NO: 18305 - RNA, 77 nt, Human
gccugccugcgccuuucgcaaccuccucggcccugcguggucucgagcugggugagcgagcgggcgggcugguaggc

SEQ ID NO: 18306 - RNA, 65 nt, Human
gcucagaagaagccagcugaaucucaaaaaauagagcgugaagaugcccuggcuuuuaauucagc

SEQ ID NO: 18307 - RNA, 87 nt, Human; identical to SEQ ID NO: 76

SEQ ID NO: 18308 - RNA, 60 nt, Human; identical to SEQ ID NO: 2705

SEQ ID NO: 18309 - RNA, 72 nt, Human; identical to SEQ ID NO: 1989

SEQ ID NO: 18310 - RNA, 66 nt, Human
agaggccagagaggcgguggcguccgagaagugcggugcguguguauacucucucucugugccucu

SEQ ID NO: 18311 - RNA, 83 nt, Human
auaucucucacacauucucccccuugggcgcuguaaugcugggaaguggugugguguguacacaaagugugugugugagaugu

SEQ ID NO: 18312 - RNA, 72 nt, Human
ggaguuuuuuuaaaaaaaagaaauuacucguggugacaccaucagcggugauuuccaucuaaagaauucucc

SEQ ID NO: 18313 - RNA, 65 nt, Human
auggugacaacaugcuggagccaagugcuaacaugccuugguuccacgggauggaaagucaccgu

SEQ ID NO: 18314 - RNA, 70 nt, Human; identical to SEQ ID NO: 16318

SEQ ID NO: 18315 - RNA, 109 nt, Human
gguagcugaagaccuuuuagacaguuccaucuuuuuuuuuaaauuuuuucugccuauuuaaagacaaauuaugggacguuuguagaaccugaguauuuuucuuuuuacc

SEQ ID NO: 18316 - RNA, 123 nt, Human; identical to SEQ ID NO: 5157

SEQ ID NO: 18317 - RNA, 67 nt, Human
gaaagcuucgucugccaaacagagacucaagugugccagucuucaaaaauuuggagaaagagcuuuc

SEQ ID NO: 18318 - RNA, 62 nt, Human
gggacuuccuccacccucaccaggacauucuuuccaucucuugucuccugugugcaaguccc

SEQ ID NO: 18319 - RNA, 78 nt, Human
gcgggauuacugucuucuaccuggccuguggggaacuacgggcucauggaauacgagagggccuuaaaguacguccgc

SEQ ID NO: 18320 - RNA, 81 nt, Human
ugggcuuggccaucgugguaggcaugcccuuggguguggcgggacuggccggauucaucggauuugcuguguccaagucca

SEQ ID NO: 18321 - RNA, 61 nt, Human
auugcuaugguuugucauugcaugcuuugucuugugugugacugagugaaaauauggugau

SEQ ID NO: 18322 - RNA, 60 nt, Human
ggcucaugaggaugcggagugugagaagcucauggagcucuacgagcgucuggaggagcu

SEQ ID NO: 18323 - RNA, 79 nt, Human
ucccuuucugcccacgacucgaagauaggcagccaaaaagaaggaggcugccaaagcucgacagcggcccagaaaagga

SEQ ID NO: 18324 - RNA, 123 nt, Human
ggugcuggucuguguucugguugcgcuggccauugucuaucucauugccuuggcugucugucagugccgccgaaagaacuacgggcagcuggacaucuuuccagcccgggauaccuaccaucc

SEQ ID NO: 18325 - RNA, 77 nt, Human
auuauguauuuauuauuggcgauuauaaaguuuguuuucacagggcguaguaguuagcaacaaugaaaaugaauaau

SEQ ID NO: 18326 - RNA, 64 nt, Human
cguaaaucuauggguagaaugcaaagggaacucgauacuuugcagcaaacuuaugaauuaaacg

SEQ ID NO: 18327 - RNA, 65 nt, Human
gccaccauaaguuucagguacagccaaugcaaagccuuggaaauccaccugacagcuccgguugu

SEQ ID NO: 18328 - RNA, 66 nt, Human
gcccuguggggaggcucuccagagcauugcuucagauugaggugacccugggcgguaccauggggc

SEQ ID NO: 18329 - RNA, 83 nt, Human
ggccgcugggagccuugagagccaugugcaaagaggacagauccuguuccugucaccauugcucucgauucacucagcuggcu

SEQ ID NO: 18330 - RNA, 78 nt, Human
uucaccugaucuccagaaggccucgaaauccaccuaucgacuaauaccggauuuaagcaaggcaaaggagauagugag

SEQ ID NO: 18331 - RNA, 60 nt, Human
gagagacaccauccuggcgaggaguuucaauaaauggcuccucuccugaguuagucucuu

SEQ ID NO: 18332 - RNA, 103 nt, Human
gccugggcugugguaaguaauggagcugugaguuccuggauggugacacgguccaggaucuugaaacucguguccaguuucaggggcuggcugcagcgcuggc

SEQ ID NO: 18333 - RNA, 93 nt, Human
ggcuaggcuggucuugaacuccugaccucgugauccacccgccuuggccucccaaagugcugggauuacaggcaugagccaccgcaccuggcc

SEQ ID NO: 18334 - RNA, 64 nt, Human
uuacuacucauauugauuaaaacaguuaacacacuuuuuucuuuuuaaaaugugagaucaguga

SEQ ID NO: 18335 - RNA, 102 nt, Human
uugagauggagucucgcucuguugcccaggcuggagugcaguggugcgaucucagcucacugcauccucugccucccggguucaagcaauucucugccucag

SEQ ID NO: 18336 - RNA, 71 nt, Human; identical to SEQ ID NO: 6999

SEQ ID NO: 18337 - RNA, 61 nt, Human
cucaugggccacauuggccuccaagaguaaaacccuuggacacagccagaaagcccaagag

SEQ ID NO: 18338 - RNA, 63 nt, Human
cuggcauggccuuccguguccccacugccaacgugucagugguggaccugaccugccgucuag

SEQ ID NO: 18339 - RNA, 81 nt, Human
gcgacugcagcucugggacacagcuggucaggagagguuccgcagccugauccccagcuacauccgggacuccacgguggc

SEQ ID NO: 18340 - RNA, 81 nt, Human
gcgcgccaaagaacugagcgucauguucauugagaccagugcgaagacuggcuacaacgugaagcagcuuuuucgacgugu

SEQ ID NO: 18341 - RNA, 77 nt, Human
guguaaaauuauugcuuaugucauuucuuaagcaguuaugcucuuaaugcuuaaaagaaggcuagcauuguuugcac

SEQ ID NO: 18342 - RNA, 72 nt, Human
cccuuuggcccggcugcgcccacaggcccccggacgccgagccaugcccgcacagaagagccagccgagggg

SEQ ID NO: 18343 - RNA, 63 nt, Human
uugggcuuuuacuggugcccggucuugagccagacaagguaagggcaaguuggggagguccag

SEQ ID NO: 18344 - RNA, 66 nt, Human; identical to SEQ ID NO: 3532

SEQ ID NO: 18345 - RNA, 69 nt, Human
cacgagagcgcagcauccgaccagguugucacugagaagauguuuauuuuggucaguuggguuuuuaug

SEQ ID NO: 18346 - RNA, 76 nt, Human
cgcagcgcgggcacacggagcugcugacgguggagcaggcccuggccgacuucgcagagcugcuccgcgcgcuacg

SEQ ID NO: 18347 - RNA, 80 nt, Human; identical to SEQ ID NO: 7871

SEQ ID NO: 18348 - RNA, 69 nt, Human
guuuuaaaagagacaggaccugaugaugaguggauagccaaagaggcaaaggucaacuccaauuaaaac

SEQ ID NO: 18349 - RNA, 102 nt, Human
acagagcacaauagggagaagggguacugguucugaacagaauggguucccuucauagagccgauguuucagaaaauacugcuuuuuguucuuaaacucugu

SEQ ID NO: 18350 - RNA, 86 nt, Human
agcaugaucaagaagccccgcccacucgggcugaaggcagugauuuuggccaaugcaguccuggauggagccgacugcaucaugcu

SEQ ID NO: 18351 - RNA, 72 nt, Human
gcagagaaggucuuccuugcucagaagaugaugauuggacggugcaaccgagcugggaagccugucaucugu

SEQ ID NO: 18352 - RNA, 99 nt, Human
guugauaugguguuugcgucauucauccgcaaggcaucugauguccaugaaguuaggaagguccugggagagaagggaaagaacaucaagauuaucagc

SEQ ID NO: 18353 - RNA, 72 nt, Human; identical to SEQ ID NO: 12171

SEQ ID NO: 18354 - RNA, 68 nt, Human; identical to SEQ ID NO: 7705

SEQ ID NO: 18355 - RNA, 63 nt, Human
ggccgaucgagaucuuccagucgagcugaugaacuguauccaaugauuggaaacucccuggcc

SEQ ID NO: 18356 - RNA, 75 nt, Human
uggcaaauuguaagcguuaaauauuuguuaaaaaucgcguuaaauuuuuguuaaaucagcuuauuuuuuaaccca

SEQ ID NO: 18357 - RNA, 61 nt, Human
uguuuuugcuaaguaguauugcuguacaugugacacuuuuaaauucaauuuagcauuaaua

SEQ ID NO: 18358 - RNA, 93 nt, Human
ggguugugucuccaguccucucuggaggguauguucugggcggaggggccaucugcauggaacuucucaccaaacagggcuggagcagugccu

SEQ ID NO: 18359 - RNA, 78 nt, Human
ccaaccacauggcacaucgggcuauuugaacacggugacugucucucccagauggaucccucugugcuucuuggacgg

SEQ ID NO: 18360 - RNA, 64 nt, Human
gcggcggcaggagagguuguggugcuaguuucucuaagccauccagugccauccucgucgcugc

SEQ ID NO: 18361 - RNA, 64 nt, Human
guggcugggacaagcuggucaagguuauggaacccuggcuaacugcaagcugaagaccaaccac

SEQ ID NO: 18362 - RNA, 71 nt, Human; identical to SEQ ID NO: 6999

SEQ ID NO: 18363 - RNA, 60 nt, Human; identical to SEQ ID NO: 894

SEQ ID NO: 18364 - RNA, 65 nt, Human; identical to SEQ ID NO: 6010

SEQ ID NO: 18365 - RNA, 65 nt, Human; identical to SEQ ID NO: 6010

SEQ ID NO: 18366 - RNA, 85 nt, Human; identical to SEQ ID NO: 10310

SEQ ID NO: 18367 - RNA, 61 nt, Human
gcccuuguggugcggcccccaguguccgcugcuggggccgcuaggugaccgagaucggggc

SEQ ID NO: 18368 - RNA, 84 nt, Human
gggguaccaacgaguccuggccuugucuguggaggcggauuacaccuucccauugcugaaaaggucgaggccucuuggugaucc

SEQ ID NO: 18369 - RNA, 64 nt, Human; identical to SEQ ID NO: 11768

SEQ ID NO: 18370 - RNA, 73 nt, Human
gucacgaaagagugucggauucggaucgcugguggauugccagacgagguuuagggucgcggcuacaagugac

SEQ ID NO: 18371 - RNA, 73 nt, Human; identical to SEQ ID NO: 10930

SEQ ID NO: 18372 - RNA, 78 nt, Human
gucaaugcugacuuggggagcuggugugaacauguccguuuccggugcuuucaugccgguugcccaugacagcggaac

SEQ ID NO: 18373 - RNA, 69 nt, Human
cuccagcagugugacgggguaccgggugcucugagaccauuuccggguucccguugccuuugcugaggg

SEQ ID NO: 18374 - RNA, 74 nt, Human
cucuuucaguggaaaaccgauggggaaccuggcccccaaggcuggucccccaggaacgggcagcccuucaagag

SEQ ID NO: 18375 - RNA, 71 nt, Human; identical to SEQ ID NO: 17560

SEQ ID NO: 18376 - RNA, 85 nt, Human; identical to SEQ ID NO: 14413

SEQ ID NO: 18377 - RNA, 108 nt, Human
ggucaagagcaccucacagcugcugagccguccgcuaucugcaguggugcugaaacgaccggagauacugacagaugagagccucagcagcuuggcagucucaugucc

SEQ ID NO: 18378 - RNA, 75 nt, Human; identical to SEQ ID NO: 74

SEQ ID NO: 18379 - RNA, 86 nt, Human; identical to SEQ ID NO: 1403

SEQ ID NO: 18380 - RNA, 71 nt, Human; identical to SEQ ID NO: 77

SEQ ID NO: 18381 - RNA, 62 nt, Human
gucaguuguggaagaggucaucacuccccggaaggaccuggccucuuuaauccucaauugau

SEQ ID NO: 18382 - RNA, 87 nt, Human
ugagguuucccuccaggagucaauccgauacgccccuggggaugcagggagaaguggcugaaugacuugcugugccuggaugccuca

SEQ ID NO: 18383 - RNA, 64 nt, Human
ccuggaggcucucguggcccaccuuuaaaaaguaaaggugccccaagaaacgagaggcucuugg

SEQ ID NO: 18384 - RNA, 74 nt, Human
ugucuccauugagauuaauguggccccugcuuaguucuuacuaaucagaacacuuaauuuacaaucaaaugaca

SEQ ID NO: 18385 - RNA, 131 nt, Human; identical to SEQ ID NO: 1788

SEQ ID NO: 18386 - RNA, 61 nt, Human
gagcgcgacccccggugcggcgcggcuaccccggcggaggcggcgggcgcggggcgcgcuc

SEQ ID NO: 18387 - RNA, 60 nt, Human
gccaggccccugcgcgccaagcccugguuggcagccggggaggacgucaggaggcccugc

SEQ ID NO: 18388 - RNA, 65 nt, Human; identical to SEQ ID NO: 11397

SEQ ID NO: 18389 - RNA, 62 nt, Human
gaugcauuuguuggagguuuucugucucaacuggucucugcaagccucugacugaauguauc

SEQ ID NO: 18390 - RNA, 99 nt, Human
ugcccuaauugcuuccugagaauucccauauuaauaaagaagaaaauuaucugccauuuuuuccuacuauaauaacgcugaaucuuaauuuagagggua

SEQ ID NO: 18391 - RNA, 64 nt, Human
uuuccauugcuugaauguaagagucagaugauguuuuaauugaaauaaaauucuaggcuggaaa

SEQ ID NO: 18392 - RNA, 80 nt, Human
ccguuggacccagagagccugaguuggagaugaacuuuggccaacuuuccucaucaccauacuuaaaauccuguccaagg

SEQ ID NO: 18393 - RNA, 62 nt, Human
aucccgcgacugagucaguaccugguuaguacacuacacaggagcagacuggggcgugugau

SEQ ID NO: 18394 - RNA, 61 nt, Human
gcaugggaaucuuuauagugauccucugggaguucuaucuaccccuauuuauauucccugu

SEQ ID NO: 18395 - RNA, 62 nt, Human
guguuuuugccguuacucccuuaggaggaaagaaagacgcucccccaggaacagcacuacac

SEQ ID NO: 18396 - RNA, 69 nt, Human; identical to SEQ ID NO: 3815

SEQ ID NO: 18397 - RNA, 78 nt, Human
ugagagaaagauuuauaaaggcaucauucaaaaggauuuuuacauuugggugugccuuacucgauuacaaaaauuuca

SEQ ID NO: 18398 - RNA, 90 nt, Human
caaccccgagccuggcguccggccuguggcgcacccugcaagugggcuggaacaugcagcugcugcccgcgggcuuggcguccuuuguug

SEQ ID NO: 18399 - RNA, 61 nt, Human
gcggaggcuggacuggagugacagccuggcccaacuggcucaagccagggcagcccucugu

SEQ ID NO: 18400 - RNA, 91 nt, Human
uacagccacgcggcaggagagugugcucgcaacgccaccugcacccacuacacgcagcucgugugggccaccucaagccagcugggcugug

SEQ ID NO: 18401 - RNA, 66 nt, Human
uacuagauuauaaacuccaugagggcagagaccaucucugccuuuuuuaccacuauuagcucagua

SEQ ID NO: 18402 - RNA, 87 nt, Human
gagggaaauaccuuggcaugcagcuccaguccgagcagccccaaaccgcugccgcccgaagcuaagccugccucuggccuuccccuc

SEQ ID NO: 18403 - RNA, 131 nt, Human
uuuccaaacaacaacaacaaaauaacauguuugccuguuaaguuguauaaaaguaggugauucuguauuuaaagaaaauauuacuguuacauauacugcuugcaauuucuguauuuauuguucucuggaaa

SEQ ID NO: 18404 - RNA, 66 nt, Human
ucaguugagaugaaaaacagguauucaguauuauucuaaacucuugcuguuauucauaccaauuga

SEQ ID NO: 18405 - RNA, 85 nt, Human
uggaucaugggugguggugaacagcagaaagggauuauggaugaaucugcauuguucuagcugcuccccaugccacccgucuccg

SEQ ID NO: 18406 - RNA, 61 nt, Human
cugcuggaggacuggacugcuacuacuacuccuggcuguggcagugagagaauccuggcag

SEQ ID NO: 18407 - RNA, 65 nt, Human
guguagcagcauugguuuuccaaaaaaugugagacuuuuucuuggacgaauucagguagcuacac

SEQ ID NO: 18408 - RNA, 77 nt, Human
cuuccagaguuccacuuggcucucccaaauagguaccucaaaaacuguuagcaagcgccauuuggaugucuugacag

SEQ ID NO: 18409 - RNA, 69 nt, Human
ggaaagagguugugagcugauuggauuaaagaccuggcacuucaguaacucagcacgcuuccacuucac

SEQ ID NO: 18410 - RNA, 72 nt, Human
aaguuggcgugcagcugggagagcuagacuaaguuggucaugaugcagaagcuacucaggugcagucggcuu

SEQ ID NO: 18411 - RNA, 67 nt, Human
uccaugacaaccuuaggucucuugacaggaaucugcccuaaacagccaggacuugggucaacaugga

SEQ ID NO: 18412 - RNA, 75 nt, Human
gcuucuccucggccaauucgcggaagaaguggcucacgccuuccagaaccacaucaucgcggucgaaauagaagc

SEQ ID NO: 18413 - RNA, 68 nt, Human
acaaagaucugacaugucacccagggacccauuucacccacugcucuguuuggccgccagucuuuugu

SEQ ID NO: 18414 - RNA, 61 nt, Human
ugguuuguugcccuugccaauaacaaaaauguuggaaagucgaguggcaaagcuguugcca

SEQ ID NO: 18415 - RNA, 65 nt, Human
cucauucagagcucuuuuggcugcgagaaacagacacccaaucaaaucagcuucagcaaaaugag

SEQ ID NO: 18416 - RNA, 70 nt, Human
ggccacuuucaagaacagagugucaucuuuaauguaggcguucuuggcauucuccaaaacagaaugagcc

SEQ ID NO: 18417 - RNA, 60 nt, Human
ugcaauguucaucuccccaucaggucuuuuaaagcugcugauggggagaugaacauugca

SEQ ID NO: 18418 - RNA, 62 nt, Human
accuuggucaacaucuuccccgcuaugcuggaauuacuucgguguucugcgguggccauggu

SEQ ID NO: 18419 - RNA, 65 nt, Human
gaggagagugaagaggaggcgcugccuucuaggugcugugacuucuccuuuucgugauucuucuc

SEQ ID NO: 18420 - RNA, 65 nt, Human
ggagcuucuuacugccuuuuccuguccccuagucaacggcauccaucuuccugguaggaggcuuc

SEQ ID NO: 18421 - RNA, 97 nt, Human
ccacggcggcggccugggagcagagguggagcgaccccauuacgcuaaagaugaaaggcugggguuggcuggcccugcuucugggggcccugcuggg

SEQ ID NO: 18422 - RNA, 89 nt, Human
aacccagucucuuacauuucaucuguuaaauagugacgguguauuagucuguucuugcacuacuacaaaugauuaguuuagacuggguu

SEQ ID NO: 18423 - RNA, 80 nt, Human
uguggcuggaggaauaguaagagaaguggggggaggugccacacacuuuaacaaccaggucucuuuauaacuccaucaca

SEQ ID NO: 18424 - RNA, 63 nt, Human
gcagggcaaguuccaaggcagaccgcagcacacacaggucuaccagaaagaacagugcccugc

SEQ ID NO: 18425 - RNA, 63 nt, Human
gccaccaggucaugaaggaggcguuugggcccgaagauggguuacagaggcucaccugguggu

SEQ ID NO: 18426 - RNA, 60 nt, Human
auuuguugcccaggcuggggugcacgacucacuguagccucaaacucccugggcucaagu

SEQ ID NO: 18427 - RNA, 65 nt, Human
uaagaucccuacccucauccugacccacgaggaaagaaggaaaggaagaguuuguggggauuuug

SEQ ID NO: 18428 - RNA, 61 nt, Human
ucuuccugcacagaggagccuggcccaaaaaagauaccccaggcuucuccgugcaggaaga

SEQ ID NO: 18429 - RNA, 85 nt, Human
guucagacugccacaauacaagucaggagagggcguuuucuuugugcugccaauucugaucauuuaaauuuugguuuguuugggu

SEQ ID NO: 18430 - RNA, 78 nt, Human; identical to SEQ ID NO: 5302

SEQ ID NO: 18431 - RNA, 62 nt, Human; identical to SEQ ID NO: 484

SEQ ID NO: 18432 - RNA, 70 nt, Human; identical to SEQ ID NO: 5304

SEQ ID NO: 18433 - RNA, 61 nt, Human; identical to SEQ ID NO: 4783

SEQ ID NO: 18434 - RNA, 84 nt, Human; identical to SEQ ID NO: 4784

SEQ ID NO: 18435 - RNA, 70 nt, Human
uagcaggugguggggcuaugaucuaaacacaggcauucuggguccagguccaugcucugaaccucugcug

SEQ ID NO: 18436 - RNA, 88 nt, Human
ugucugcaagauuccgauuaaugcuauuuuuaugguuccaaauuuaagauagacaauagcugaucauaauagggaacacuuacagaca

SEQ ID NO: 18437 - RNA, 64 nt, Human
auaauugacauuauggcaguauaguucacucuuuauucucugcuuuaugccauuaugaaauuau

SEQ ID NO: 18438 - RNA, 80 nt, Human
ggccucugcaacuuacuagcuguguguccuugggaaagaacuucaaggacuucuuugcagguaucugauuaguggagguc

SEQ ID NO: 18439 - RNA, 83 nt, Human
uagaaggaaauauauaaaaauguuuacaaauauuuuaaaaaguaaaaaaugaauaaaaguaaaaauuugagugguucucucug

SEQ ID NO: 18440 - RNA, 70 nt, Human
accuguuuuuacuuccucacccugaauucguuuuguaaauguagaguuuggauguguaacugaggcaggu

SEQ ID NO: 18441 - RNA, 110 nt, Human
cguaggccgauuuccggguguuguagguuucucuuuuucaggcuuauacucaugaaucuugucugaagcuuuugagggcagacugccaaguccuggagaaauaguagaug

SEQ ID NO: 18442 - RNA, 77 nt, Human; identical to SEQ ID NO: 14076

SEQ ID NO: 18443 - RNA, 62 nt, Human
uugggguaaugaaguauuucaguuuugugaauagaugaccuguuuuuacuuccucacccuga

SEQ ID NO: 18444 - RNA, 74 nt, Human
aguucuucagcagacucaacuaucauggacauucaggucccgacacgagccccagaugcagucuacacagaacu

SEQ ID NO: 18445 - RNA, 86 nt, Human
ccgucagcccuuggcagggggucuuggaagccagagguuuuugcucagggcagggaaagggcugcaggauccccgggggcugccgg

SEQ ID NO: 18446 - RNA, 81 nt, Human
gcccaccucuccaacccaaacuggcugugaugaaaaccaaaaacccagaccagaccagcaacugggaaggaacggaugggc

SEQ ID NO: 18447 - RNA, 73 nt, Human
ggaccugcaggggaaggaagcagggugacgguuugguauccccaccuaagacccuccccuuuccccugaggcc

SEQ ID NO: 18448 - RNA, 67 nt, Human
gggagguguuucucugcuucaggagugcccgccggcccuugcagcugcuggaagacccauuuaucuc

SEQ ID NO: 18449 - RNA, 79 nt, Human
augacaugucuccacgaggguacagcugugcucuuacuuuuaagcacggaaaucgaccugcccgugaauaggcacucau

SEQ ID NO: 18450 - RNA, 61 nt, Human
agaagagucuaagauggugacugaugucucuuccuccuucccaaauaucugagacucuucu

SEQ ID NO: 18451 - RNA, 88 nt, Human
gaagacuauuuguuuucauuuucuuugccuccucucuggcuauguguccccggaaggcagcuuggauuuugacagcagcaaccucuuc

SEQ ID NO: 18452 - RNA, 72 nt, Human
aagugguaaguugguacgcugucuaauucuuuccuucaaaucuugaauaccuccugugccaauggaucucuu

SEQ ID NO: 18453 - RNA, 65 nt, Human
gaugguuuuucgaaucauaauagcgcuguaggaucauagcacuucugcuuuucaaauauccaguc

SEQ ID NO: 18454 - RNA, 62 nt, Human; identical to SEQ ID NO: 17330

SEQ ID NO: 18455 - RNA, 96 nt, Human
gcuccaggaaucccuucgaggccccagucccuccccacuuaggaccccaaguccaccagacuggaggugagggggccgagcagagagucuuggagc

SEQ ID NO: 18456 - RNA, 72 nt, Human
uuuuuuuuuuuuuuuuucccugaucucugcauugggaaggaaaaugcaaaaguggaaagaguuggagagaag

SEQ ID NO: 18457 - RNA, 74 nt, Human
ccaaagugcugggauuacaaguguaagacacuacauccaaccuacacuuuuaaaaauuaucccacaguucuugg

SEQ ID NO: 18458 - RNA, 64 nt, Human
cuggguuugucauguugcccaggcuggacucaaacuccuggccucaagcaaucgccugccucag

SEQ ID NO: 18459 - RNA, 67 nt, Human
uguuuuuaaaaauuuuccauuccuuuuugaaaucuuucaauuucaauuugggaaguuucuauugaca

SEQ ID NO: 18460 - RNA, 65 nt, Human
guuugcuauagcuuacugcuuaacuaauuuuaaauaaggaaauaaguauguuagaugcaguagac

SEQ ID NO: 18461 - RNA, 82 nt, Human
uuagaguaauucuauuguuaacauuuuaguguauuguuuuuugaagagaguguauaguagugguuaagagaugagacuuugg

SEQ ID NO: 18462 - RNA, 104 nt, Human
aaaaauccagcugagugauaaaggcugaguguugaggaaauuucugcaguuuuaagcagucguauuugcgauugaagcugaguacauuuugcugguguauuuuu

SEQ ID NO: 18463 - RNA, 77 nt, Human
cagacuucacagagaaugcaggugucuugacuucaggucugucuguucuguuggcaaguaaaugcaguacuguucug

SEQ ID NO: 18464 - RNA, 74 nt, Human; identical to SEQ ID NO: 13531

SEQ ID NO: 18465 - RNA, 97 nt, Human; identical to SEQ ID NO: 13532

SEQ ID NO: 18466 - RNA, 101 nt, Human; identical to SEQ ID NO: 6996

SEQ ID NO: 18467 - RNA, 62 nt, Human
aguucuuugauuugcucuuugaggaccuccacuucuucuuugaccgcauacaucaaauggcu

SEQ ID NO: 18468 - RNA, 63 nt, Human
cagccaguucugcgggggcauaggcagcuaugcgguugguccugagcccugcgaugcuggcug

SEQ ID NO: 18469 - RNA, 74 nt, Human
uccgaugcuacuauuuuauugcaggagguggggguguaugcaccgcacaccggggcuaugagaagcaagaagga

SEQ ID NO: 18470 - RNA, 64 nt, Human; identical to SEQ ID NO: 12453

SEQ ID NO: 18471 - RNA, 82 nt, Human; identical to SEQ ID NO: 5099

SEQ ID NO: 18472 - RNA, 99 nt, Human
gggcuaggcaucucaucuugcuggggcuguuggguccccuggaccucaaaucccaauaccaggaggacaagaaacagagcugggaggagucgugugccc

SEQ ID NO: 18473 - RNA, 64 nt, Human
gucugaaccugggggaucaggggaguaggggacucuccccuuguccacugauggggggucuggc

SEQ ID NO: 18474 - RNA, 72 nt, Human
ugccuguguaagugcucauggcugcugugcuuuugcuguacaagucccugaguuucucaucuacagcgggca

SEQ ID NO: 18475 - RNA, 65 nt, Human
gccuggcguguuaaguuguguccucaccugucauuggcgaagggcagggcgaucucaaacuuggc

SEQ ID NO: 18476 - RNA, 62 nt, Human
ggccagccgugcucacuguccugcugacccaggcccggcaggcaggucaucgggugcuggcc

SEQ ID NO: 18477 - RNA, 82 nt, Human
uccuuccauguuuuccuacaccuuuucaauaaguggauuucuuuuaacucccugaacagagaagcccguggcacaggaggga

SEQ ID NO: 18478 - RNA, 88 nt, Human
cggacuuuugggccggggccgggcggcgggggaggcucucuaaggccuccgccucugccucucccgcccccuuacccgccccggagcg

SEQ ID NO: 18479 - RNA, 60 nt, Human; identical to SEQ ID NO: 7400

SEQ ID NO: 18480 - RNA, 64 nt, Human; identical to SEQ ID NO: 8200

SEQ ID NO: 18481 - RNA, 66 nt, Human; identical to SEQ ID NO: 2189

SEQ ID NO: 18482 - RNA, 69 nt, Human
aaaaaggaaaguguauuuugggaauaaagucaggugggaaaauuccauuuuuuuaaauucccccuuuuu

SEQ ID NO: 18483 - RNA, 92 nt, Human
guucaugcagcuguggcagaguuacaguucugugguuucauguuaguuaccuuauaguuacuguguaauuagugccacuuaauguauguuac

SEQ ID NO: 18484 - RNA, 60 nt, Human
ggguggaucaccugaggucaggaguucaagaccagccuggccaacauggugaaacucccc

SEQ ID NO: 18485 - RNA, 81 nt, Human
uccauggauuuaaauaaauaaaauuuaauucugccuuuuauaacaugcaggguuguuuuaugguuguugagauuuguguga

SEQ ID NO: 18486 - RNA, 80 nt, Human
uguguuuagguaccaacaauuguuaaugacgcucaguucauauuuucagaauaucacauugauaaugguacuauaauaua

SEQ ID NO: 18487 - RNA, 79 nt, Human
caggaucgagggcgugcugugcggggccgugaagcagcugaaggucacccgcgccaagccugacagcacccucuaccug

SEQ ID NO: 18488 - RNA, 71 nt, Human
cggucucaccaaacgccccaaacucuccuccacacccccucugagugcccuggggcgccuggcugaggcug

SEQ ID NO: 18489 - RNA, 61 nt, Human
cugcucgaccuuccacuaguacauacuugcucauuguaaaaccuguaugaaaguguagcag

SEQ ID NO: 18490 - RNA, 105 nt, Human
gccacccuauuugcaguuuuucuaaguaacuugguagguugaaagauccaaggucaaaagaacuuauccaguguagcaaauaacaguaaaauaagauaaaguggc

SEQ ID NO: 18491 - RNA, 62 nt, Human
gugggugcaucacaugaggucaggaguucgagaucagccuggccaacauggugaaaucccau

SEQ ID NO: 18492 - RNA, 62 nt, Human
aaauugcauucuuuucaaauuuauaagucuaagaaaacaaaaccaaauaaaagaagccauuu

SEQ ID NO: 18493 - RNA, 113 nt, Human
agaaauguugaugggaacugagcauugcuugcuuucaucagguguucuuguugccaaagacaugaacgauacugaggaaaacgacaagagugagcauucccgccaguaaaucu

SEQ ID NO: 18494 - RNA, 71 nt, Human
auugauuugcaaaaggcauauuuacucuuugugagaaaucacuuuuuaaauugcauucuuuucaaauuuau

SEQ ID NO: 18495 - RNA, 73 nt, Human
gguaauacucucgaccccauucuucuaacacagaaaacuuucucagguaaacugugggguuaugagaaucccc

SEQ ID NO: 18496 - RNA, 79 nt, Human
ggagaaaggcugagcuuggagaaaaggugcuugaggaccccacugccuaaggaccugcucuaggaaacauucccacucc

SEQ ID NO: 18497 - RNA, 79 nt, Human; identical to SEQ ID NO: 4118

SEQ ID NO: 18498 - RNA, 63 nt, Human
gagggggccuucaagcuguacugugagcagacgcauugguauuaucauucagcagucucccuc

SEQ ID NO: 18499 - RNA, 62 nt, Human
caggcuggagcgcaguggcgaucauggcccacugcggccucgaccuccugggcuccagcgug

SEQ ID NO: 18500 - RNA, 70 nt, Human
gcacgagcucuuccuucccacagcgucuaaucuuuuuuuauguuuuuguggcaaggucucgcuuagucgc

SEQ ID NO: 18501 - RNA, 78 nt, Human; identical to SEQ ID NO: 99

SEQ ID NO: 18502 - RNA, 65 nt, Human; identical to SEQ ID NO: 247

SEQ ID NO: 18503 - RNA, 80 nt, Human; identical to SEQ ID NO: 100

SEQ ID NO: 18504 - RNA, 122 nt, Human
aucugcagacagacacuggcaacauugcggacacccuccaggaagcgagaaugcagaguuuccucugugauaucaagcacuucaggguuguagaugcugccauugucgaacaccugcuggau

SEQ ID NO: 18505 - RNA, 67 nt, Human
gcuucaaccuuagcuggggcugcagcagcacagggagcagcugugguggcagcagcacaggggcagc

SEQ ID NO: 18506 - RNA, 62 nt, Human
caacauccuguucugcggcuuccuuggcucuuuuugcccguaugccgaagagccgggcguug

SEQ ID NO: 18507 - RNA, 66 nt, Human
cuuggguggcaucuccuauaucuaauuccaucauuucuagauacuuagggugagugcccauccagg

SEQ ID NO: 18508 - RNA, 78 nt, Human
uguuauggcugagggaagcagugauggggguaggcaccacagucuguaaccccuccccuucuaucuuaguacccaaca

SEQ ID NO: 18509 - RNA, 73 nt, Human
ccaggcggccuccccugccgcauaaagugcuugaacagagccgccgugccucagaggacugggccuguccugg

SEQ ID NO: 18510 - RNA, 71 nt, Human
guaguauuuggauaguuagauguuuuacuuagauuuuuguuucauuagcaacuaaugguugaggugucuau

SEQ ID NO: 18511 - RNA, 72 nt, Human
gucuggggcccugcgccugaugagcugccaugaaaguggccgccucucacacuggcaggcgguggcucagau

SEQ ID NO: 18512 - RNA, 76 nt, Human
ugcugagguucuggaguggcacaggaacaggaggagcaaaugacacugggucuuugugcugaggcaggacacagcg

SEQ ID NO: 18513 - RNA, 130 nt, Human
agcaugcucaguuaaauuugaauuucagacaaauaaugaaugcuuuuacuguaaauauaugccaaauauugcaugaaacauucuuaacgugacaauuguuucucugaaauucaaacuuaacugggcaucu

SEQ ID NO: 18514 - RNA, 84 nt, Human; identical to SEQ ID NO: 7538

SEQ ID NO: 18515 - RNA, 65 nt, Human; identical to SEQ ID NO: 8124

SEQ ID NO: 18516 - RNA, 88 nt, Human
ggaguuucgcuuuuguugcccaggcuggaaugcaguggcgcaaucucggcuacuguaaccuccaccucccagguucuagcgauucucc

SEQ ID NO: 18517 - RNA, 73 nt, Human
cuguauguaguuuaaucccugauaucuaccucacccccacgaugugacauccuauucagcauuauaccugcag

SEQ ID NO: 18518 - RNA, 96 nt, Human
ucauuaaaucuuucuuccugaauuuucuuaucuuaauaguaccucuggauacgguucaguccccauuaaggccagaauuucaaauuaaguaaauga

SEQ ID NO: 18519 - RNA, 76 nt, Human
gcggagccgguagcccgcagaagcccggucagcgcacgugcccgcgagaccugcaaacuugugccaccggcucugc

SEQ ID NO: 18520 - RNA, 71 nt, Human
ggcagaaggcuuuuacaccacaagugcagugaaagaacugcacggugaguuuaaaacaaccgcuuguggcc

SEQ ID NO: 18521 - RNA, 102 nt, Human
gugucugggaggaguccccuacgccucccugguggccaccauccucugcuucuccgggguggccuuauucugcggcugugggcauguggcucucgcaggcac

SEQ ID NO: 18522 - RNA, 67 nt, Human
cacgggcugggcucuaggcggucuuggggccaugaucgggcccgggggcuggcuggacccccccgug

SEQ ID NO: 18523 - RNA, 64 nt, Human
ccaggagcagaucgguggagaugcugcugccagaugcuagcuugcuccgccuaucccugcccgg

SEQ ID NO: 18524 - RNA, 61 nt, Human
aaguuuauccuuuauguguguuaaaauugcaauucuauaucagaaaugaaggaaacaacuu

SEQ ID NO: 18525 - RNA, 68 nt, Human
gaucacaagggcaacccaccaaacuagcguacuaccaguauggccugggcaaucuuggcccugugauc

SEQ ID NO: 18526 - RNA, 81 nt, Human
gccaggaccaagagacaggcagcucaccaggguggacaaaucgccagagauguggugcauuguccuguuuucacuuuuggc

SEQ ID NO: 18527 - RNA, 65 nt, Human
accuacuucccgcacuucgaccugagccacggcucugcccagguuaagggccacggcaagaaggu

SEQ ID NO: 18528 - RNA, 72 nt, Human; identical to SEQ ID NO: 3359

SEQ ID NO: 18529 - RNA, 67 nt, Human; identical to SEQ ID NO: 12406

SEQ ID NO: 18530 - RNA, 80 nt, Human
guaucuacagccacuguaagcauccaguaggcaggaagauggcuuugggcagcggcuggaugaaagcagauuugagauac

SEQ ID NO: 18531 - RNA, 67 nt, Human; identical to SEQ ID NO: 12406

SEQ ID NO: 18532 - RNA, 67 nt, Human; identical to SEQ ID NO: 12406

SEQ ID NO: 18533 - RNA, 80 nt, Human; identical to SEQ ID NO: 12407

SEQ ID NO: 18534 - RNA, 64 nt, Human
gacagcacuaauuuaaugccgauauacucuagaugaaguuuuacauuguugagcuauugcuguu

SEQ ID NO: 18535 - RNA, 62 nt, Human
aggcauuucaucuggguauuuucaggcuccaguccaggccuggccuuccacaucuggugcuu

SEQ ID NO: 18536 - RNA, 89 nt, Human
guggccagcggagggcaggagagguaaccagcggccuucaguuccacuguccucaccuugguccggcuccugcacuuuccacuguccgc

SEQ ID NO: 18537 - RNA, 68 nt, Human
auugguggccuagaaucugaucuguccuguuuaugcacaccggagggauaggaucuguaccguccagu

SEQ ID NO: 18538 - RNA, 73 nt, Human
ugcugaaugggcuguuuucuaaccaugccuccuugccucuggagacucuuguugguuggagcaguaguuggca

SEQ ID NO: 18539 - RNA, 68 nt, Human
ucgaagguaucucaacggaaccaggggucaaccccuaagacaauucagguccauuguugugccuuuga

SEQ ID NO: 18540 - RNA, 70 nt, Human
uuggccccgcgggaaaggagacagacgcgggccauuggucagugucaccgcccaaaaaccuaggggcugg

SEQ ID NO: 18541 - RNA, 62 nt, Human
gcucuaguggugggucugagguuugcucuaguggugggucugagguuuucucuacugagggc

SEQ ID NO: 18542 - RNA, 130 nt, Human
guucuguucuuuuucuguuuuccugaugaggcuucuguacuucucccuuuaaggaggcaacugaauagcaugaaaauaagggguauggguggugguaguugcugaggggaaugacaauggauuugguaac

SEQ ID NO: 18543 - RNA, 64 nt, Human
guccuucaugggccugcuggccauguacaccuacuuccaggccaagauaagggcccugaagggc

SEQ ID NO: 18544 - RNA, 61 nt, Human
caaugcuccagaaggauugccccagcugauggaaguagugcgauccaacuaugaagcaaug

SEQ ID NO: 18545 - RNA, 66 nt, Human
gaggccucgugccaagccaccucuugguccuaaaagcucugcaggauggccgggcauaugggucuc

SEQ ID NO: 18546 - RNA, 63 nt, Human
guggaggcuguggagcugcuaauucgcaaucauuugguuaauaugcagcaguaugaucuucac

SEQ ID NO: 18547 - RNA, 75 nt, Human; identical to SEQ ID NO: 74

SEQ ID NO: 18548 - RNA, 67 nt, Human
gcggcugcaggaguaccgccugcggaguaacugcaaagaugcuguccgugcgcguugcugcggccgu

SEQ ID NO: 18549 - RNA, 87 nt, Human; identical to SEQ ID NO: 76

SEQ ID NO: 18550 - RNA, 71 nt, Human; identical to SEQ ID NO: 77

SEQ ID NO: 18551 - RNA, 60 nt, Human
gcuugaacccaggagugaggcugcaguaagcuauaaucugccaugcacuccagccugagc

SEQ ID NO: 18552 - RNA, 86 nt, Human
ugaucugucuuuauaaaggagauggaagugaauucaagauauugagauguuagauuugacuggguuguccuuuggcuagaagauca

SEQ ID NO: 18553 - RNA, 76 nt, Human
caggacagaaaucauuaucuuagccaccagaacacagaauguucuuggugagaagggccggaugauucuggaacug

SEQ ID NO: 18554 - RNA, 65 nt, Human
gcuguaguucagaugagguuuggcuuuccagagggcaguguagagcuuuaugcugaaaagguggc

SEQ ID NO: 18555 - RNA, 69 nt, Human
ccuuuuauaugaugaucuggagaauucugcucuuugauaacaacucaggauuuuuuugaucacguuugg

SEQ ID NO: 18556 - RNA, 69 nt, Human
guuauucuaagggccaaauuuuguaaaauuuccauuaggaaugucagcuucaaauacccuuuggauagc

SEQ ID NO: 18557 - RNA, 90 nt, Human
ugaguaaauuuguaugcaguauaaagcccaaguagaggguguauuuuuaaugacuacuuugcuuacauuuuagauugugcaaaugucuca

SEQ ID NO: 18558 - RNA, 61 nt, Human; identical to SEQ ID NO: 13200

SEQ ID NO: 18559 - RNA, 74 nt, Human
uaacugggggcuauuuuaucagcuugccuauuaaaggacuaugguaaguauagaaucuuaaugguugccaguua

SEQ ID NO: 18560 - RNA, 69 nt, Human
acuuaaggguaguuuaucuagauacaggacuuucuucccugauaaguaguaucauuggagcccuuaggu

SEQ ID NO: 18561 - RNA, 79 nt, Human
caauugguaacuugaguugugucuuggucaugggagaguauugcauucuugguugaauacauaguuaagauguuaauug

SEQ ID NO: 18562 - RNA, 75 nt, Human
uuuuuuuuuuuuuggagacggagucucacuccagccugggcaacagagcaagacucugucucaaaaaaaaauaaa

SEQ ID NO: 18563 - RNA, 67 nt, Human
gccuugucaccuccaguugggugccucuggguucccacuggcucugcccaggugggggugggugggc

SEQ ID NO: 18564 - RNA, 64 nt, Human; identical to SEQ ID NO: 6321

SEQ ID NO: 18565 - RNA, 60 nt, Human
ugggagugcuacuaaagauauaugagacuucaacaucuugaccacaucacuuuuucucca

SEQ ID NO: 18566 - RNA, 84 nt, Human
auuagguguuuauuuuguucuauuuaagaauuuguuuuauuaaauuaauauaaaaaucuuuguaaaucucuauauacaucuggu

SEQ ID NO: 18567 - RNA, 77 nt, Human; identical to SEQ ID NO: 6000

SEQ ID NO: 18568 - RNA, 61 nt, Human; identical to SEQ ID NO: 2204

SEQ ID NO: 18569 - RNA, 67 nt, Human
ucacgccuggagcgccuucugcaaggcccuggccuaagacaggcuggcacagccccaggcuugguga

SEQ ID NO: 18570 - RNA, 98 nt, Human
aggugguuacccuaacagcuaaugauaagacaaguguuuccuucuccucccucccgggacaaggugucauauacaaugucauuguuugggacccguuu

SEQ ID NO: 18571 - RNA, 62 nt, Human
uacaucugcugccuacauuccugcucacacauacgcuugcagcuuugaggcaggagagggua

SEQ ID NO: 18572 - RNA, 73 nt, Human
ugcaguaugaugucuaucaguauuuucugccugagaaugaccucacugaggagauguugcugaagcaucugca

SEQ ID NO: 18573 - RNA, 69 nt, Human
caugugauuucagguuuuucguacugagaacauugagauuucaguuggaagacacccugaaaucuuaug

SEQ ID NO: 18574 - RNA, 82 nt, Human
ugcagauucccaaggaaaugucagaaaggcaaaauggccagcauuauccauuugcuuuuuuggguuuacugggugaauagca

SEQ ID NO: 18575 - RNA, 70 nt, Human
aagaaauaaugcagcuacaggagcaaauuaaauuacuauaaaacauuccuucaucuguaaaacauuucuu

SEQ ID NO: 18576 - RNA, 74 nt, Human
aaugcagccauggcgucuaguucuggagaucucauaaggguggguccaaagacgauuccaagguucucugcauu

SEQ ID NO: 18577 - RNA, 81 nt, Human
aggauuuaauaauuacucuuuuacuuuuauuacaauaaauaauuaucaauaauagaauuaaacaauuuucaauuaaaaccu

SEQ ID NO: 18578 - RNA, 63 nt, Human
aggcauagagaauggcgugcacuuucugcagcuagagcugauucaaugggcgcuugagugccu

SEQ ID NO: 18579 - RNA, 76 nt, Human
gcccggcgcggcauguccugggugccgcggugcgggcagugaacgcgcgccggggcgggaugggccggcgccgggc

SEQ ID NO: 18580 - RNA, 85 nt, Human
ggcugcugccuuaugggucagugguaugggugugaggacaucugauggaguucucuuccaaccacugccuacaauugguggugcc

SEQ ID NO: 18581 - RNA, 71 nt, Human
ggguccuuuuaagcaucuuuuacagucagcacgauguuaagcucucuccauagggggugcuguuggggccc

SEQ ID NO: 18582 - RNA, 79 nt, Human
caggugguggcguguucuuccaucaggagucauguaauguuuggugaucucucgugauguuagcagcuguugcuguuug

SEQ ID NO: 18583 - RNA, 65 nt, Human
gagauggguuucaccauguuggucaggcuggucucgaacuccugaccucaugauccgcccaccuc

SEQ ID NO: 18584 - RNA, 77 nt, Human
gcuucccugggagaaaguccuucccuccccauggcccagcccuggggaaagaaagcagagacuaacucagggacugc

SEQ ID NO: 18585 - RNA, 68 nt, Human
ggccggcugagggcgaaaucaagacuggagccaagugcgcugagcucucacaugagguccuuugcucc

SEQ ID NO: 18586 - RNA, 74 nt, Human
cggcgcuuccgcaaguuccugguguuuguggcaaacuucgaugaagaaugaccccaagaccuuugagggcguug

SEQ ID NO: 18587 - RNA, 82 nt, Human; identical to SEQ ID NO: 119

SEQ ID NO: 18588 - RNA, 63 nt, Human; identical to SEQ ID NO: 722

SEQ ID NO: 18589 - RNA, 60 nt, Human; identical to SEQ ID NO: 723

SEQ ID NO: 18590 - RNA, 81 nt, Human
gugguggacagaucgagcauucaagucccuccgauucaauacuugcacaacgaacuggaagugcgucacaggguucgccac

SEQ ID NO: 18591 - RNA, 68 nt, Human
gucccaaaagccacccaaaaauuguagagaagcuuuuacugcugauggugaucaaguuuuugcaggac

SEQ ID NO: 18592 - RNA, 63 nt, Human
agcauggaccagaucccagacugcaucacccaugucgccaucuccgagagccuagucccugcu

SEQ ID NO: 18593 - RNA, 65 nt, Human
gccaugccugguaccauggccgcaucccccgagaggucucggagaccuugguacaacgcaacggc

SEQ ID NO: 18594 - RNA, 62 nt, Human
cuggucauuauaucuaucagcauauguucaucagccauauaccaauagauccaaucgaucag

SEQ ID NO: 18595 - RNA, 101 nt, Human
agagagaacuccgcaaggggggugggguguccauaagaacacuccauaggagugcucuagaggcccccccucucuauaaaagauuuguggaggugucaucu

SEQ ID NO: 18596 - RNA, 66 nt, Human
uucuucccuguuagggagagcugagggcagcugccacugagucuccugucccugagaaggggagga

SEQ ID NO: 18597 - RNA, 60 nt, Human
ucauguuacauacgucuuacagugcacguuaccccaaucugugaaaauaaaccaacauga

SEQ ID NO: 18598 - RNA, 73 nt, Human
cuguggcacaugccuauacugagacgggagggucacuugacuccaggaguucaaggcuaugaucaugccacag

SEQ ID NO: 18599 - RNA, 79 nt, Human
gaaucagaaaguucuaauuagaaaaucaaauauauugcauauuguuaaaacauuuugguacugaucaacuuccugcuuu

SEQ ID NO: 18600 - RNA, 79 nt, Human; identical to SEQ ID NO: 18599

SEQ ID NO: 18601 - RNA, 72 nt, Human; identical to SEQ ID NO: 18511

SEQ ID NO: 18602 - RNA, 76 nt, Human; identical to SEQ ID NO: 18512

SEQ ID NO: 18603 - RNA, 73 nt, Human
gcaguggagggggcaggaccuccugcuggugcagcaccagcucguggagcagguccaccggccccuacauugc

SEQ ID NO: 18604 - RNA, 62 nt, Human
gguaucacagcaucacuuaguagacagaaaucuuaucuuccccuuaaaguaguugucaugcc

SEQ ID NO: 18605 - RNA, 60 nt, Human; identical to SEQ ID NO: 18597

SEQ ID NO: 18606 - RNA, 62 nt, Human
ugcggaagccggacgggcagggauggggccccaacuucgcccugcccauuuugacuucagca

SEQ ID NO: 18607 - RNA, 60 nt, Human
uuuaacguguguuuuugccaaaaaaaggcgccaguauaucgagggcgaacacacguuaaa

SEQ ID NO: 18608 - RNA, 126 nt, Human
caguaauaaauauaaugcagucuucuuaagagucaguuuggaguugaaaaggcaguguacccuugauggaaacagucaaacuggugguaccaucuucuucagaacugcaucuaaaaggcugugcug

SEQ ID NO: 18609 - RNA, 64 nt, Human
gugacaaauugcacuaacauacuuuuccagcguaacucuaguucaaagucugugagcuugucac

SEQ ID NO: 18610 - RNA, 87 nt, Human
ggucaugccugaaucuguaccuucuacagagauccugaagcagauugaacaaagaaagagcagggcugucgugcagauggcgugacc

SEQ ID NO: 18611 - RNA, 66 nt, Human
cugauuucucuguggaacguguucggucccgagugaggacugugugucuuuuuacccugaaguuag

SEQ ID NO: 18612 - RNA, 100 nt, Human
cagugccaauuccuggucggaauggugacaacaugcuggagacaagugcuaacaugacuugguucaagcgauggcaagucacccguaaggauggcaacug

SEQ ID NO: 18613 - RNA, 79 nt, Human; identical to SEQ ID NO: 1810

SEQ ID NO: 18614 - RNA, 71 nt, Human
gguacuucuacucacagcggcgauuccgaggccaacuccagcaauggcuuugcaaaucugcggaaagugcu

SEQ ID NO: 18615 - RNA, 67 nt, Human
ugaacgacuauaggguaugacccccaucauuuacaccaguaggucucgggacauccuuugguguuca

SEQ ID NO: 18616 - RNA, 73 nt, Human
ccggccccaggcauguaccacggacccccuccccucagagcuggggccucccgucagcucugccugggccugg

SEQ ID NO: 18617 - RNA, 68 nt, Human
gccccccagagcuaauuacauccacacccauccccugaagugguggacauaagggagcccuggggagc

SEQ ID NO: 18618 - RNA, 69 nt, Human
uucuagucccagagccaguguuuauuagcaagauggaacccaaaggcggcuguggccugggcagcagaa

SEQ ID NO: 18619 - RNA, 94 nt, Human
gcugcagcaugggaggguaaauauuuuauugccaaucaaaaaauaugcauaagguuuuacuggauuuaagaaauuucccuucacuauuuacagc

SEQ ID NO: 18620 - RNA, 65 nt, Human
uaaggggcaaacugcaaauuucugcagcaugauuacuguaugaaugaaugacaucauguuccuua

SEQ ID NO: 18621 - RNA, 70 nt, Human
aucugaucucucggucccuuccuuaaccccauaaaaagaaggggauauuuggggaccgacgggaacaggu

SEQ ID NO: 18622 - RNA, 76 nt, Human
cuuaacccagaagugcgcuuuguggucauucuaccugauuacuuguggggggccuaaaagugggcuuuucugauag

SEQ ID NO: 18623 - RNA, 79 nt, Human
gaagagagccugcugaugugguaauuugcuggguuaaaaacuuuaaaaguguagcagaagcauagcaagugcucuuuuc

SEQ ID NO: 18624 - RNA, 65 nt, Human
ugcauugcuucagaugguggugucugaacacaaagcacuuuucagaaacgucuaaauacaaugca

SEQ ID NO: 18625 - RNA, 77 nt, Human
ccuaucaguagauccuuccacuggguucgcaauuuugaucugcgccccagacaucugacggaucucauugauuuugg

SEQ ID NO: 18626 - RNA, 83 nt, Human
ggaucaugggugguggugaacagcagaaagggauuauggaugaaucugcauuguucuagcugcuccccaugccacccgucucc

SEQ ID NO: 18627 - RNA, 67 nt, Human
uguguagaaacugaaaauuuacaaacuauuuaaaaccuggaaucgcugacuguucagaaacuacaca

SEQ ID NO: 18628 - RNA, 97 nt, Human
gaguccacuggugcccaguaacacccuccgugggaccaccaugggaagcaugugccgcggaguccaccacaggggguccugggucccgggagggcuc

SEQ ID NO: 18629 - RNA, 61 nt, Human
gccagugucuuugggggcuguggcaagggccccuugccugggguucccuuacucaucuggu

SEQ ID NO: 18630 - RNA, 67 nt, Human
gcugaauuacauuuacuguacaaagaacgguucggagagaaccaggaauggcggagugucuaacagc

SEQ ID NO: 18631 - RNA, 77 nt, Human; identical to SEQ ID NO: 9858

SEQ ID NO: 18632 - RNA, 64 nt, Human
guccuugcagucggggugauaugacacaucuguugucuaauguaccuacugugugcucacggac

SEQ ID NO: 18633 - RNA, 83 nt, Human
guguauuuacaaccuggagauagcugacagcccauacuucaccuugaaguuugacuugucuguucccucaaaugugucgacac

SEQ ID NO: 18634 - RNA, 66 nt, Human
ggcgagaagguguuccguguuaacguugaagaugaaaaucacauuaacauaauccgcgaguuggcc

SEQ ID NO: 18635 - RNA, 73 nt, Human
acagucacccugguuaauaacaaguuuuacugaucaguugcugguugguugguugguuggcaugugggugugu

SEQ ID NO: 18636 - RNA, 75 nt, Human
guuuauccugaugucgcuuguaaugcaguagaggcuauucgcuucggcuuuccuuuccucgacuuuuugguaaac

SEQ ID NO: 18637 - RNA, 75 nt, Human
ugaaaauggagggcacucuaucagucuauaacuaucaacguagugcaacaggguguuuugauaccuuuguuuuca

SEQ ID NO: 18638 - RNA, 63 nt, Human; identical to SEQ ID NO: 1503

SEQ ID NO: 18639 - RNA, 60 nt, Human
guugcaauguagaauauaaaaccauaucgaauaauuucucguagccuguuacauuguuac

SEQ ID NO: 18640 - RNA, 63 nt, Human
gccaagaucuugaugaaaaaauagugaugagaaacauugaccggacaaucaugaaggcucugc

SEQ ID NO: 18641 - RNA, 67 nt, Human
ggccaacaugacauaaccccaucucugcuacaaguauaaaaauuagcuggguguaguggugugugcc

SEQ ID NO: 18642 - RNA, 100 nt, Human
ugagacaggagaauugcuuuaacccgggaggcggagguugcagugagccgagauggcaccacugugcucuaccugggugacagagcaagacucugucuca

SEQ ID NO: 18643 - RNA, 71 nt, Human
cggcaaggggggcggcaaaauucgcaaggugcgcgacagcacuggagcacgugucaucuucccugcggcug

SEQ ID NO: 18644 - RNA, 64 nt, Human; identical to SEQ ID NO: 3783

SEQ ID NO: 18645 - RNA, 84 nt, Human
gaccccaagcaccaccgccacuucgucauccgcagaggccaggucuugcgggagauugcugaagaguauggcggggugaugguc

SEQ ID NO: 18646 - RNA, 83 nt, Human; identical to SEQ ID NO: 13454

SEQ ID NO: 18647 - RNA, 64 nt, Human
gggcguuggcagagguggcggcggcggcaugggugccccgacguugcccccugccuggcagccc

SEQ ID NO: 18648 - RNA, 62 nt, Human
uuaggaaaggagaucaacauuuucaaauuagauguuucaacugugcucuuguuuugucuuga

SEQ ID NO: 18649 - RNA, 64 nt, Human
auggugacaacaugcuggagccaagugcuaacaugccuugguucaagggauggaaagucaccgu

SEQ ID NO: 18650 - RNA, 61 nt, Human; identical to SEQ ID NO: 823

SEQ ID NO: 18651 - RNA, 64 nt, Human
acgcgaggaacaacacuucaggguaaggugauaaccaccgauauggccgggaagugcucgacgu

SEQ ID NO: 18652 - RNA, 69 nt, Human
gcccuuggccugcucuccaggagguuuacccauggggguugggccguccggggcgaguggcacgggggu

SEQ ID NO: 18653 - RNA, 66 nt, Human
ugggaaaggaaaagacucauaucaacaugucuggcauuggacacguagauucgggcaaguccacca

SEQ ID NO: 18654 - RNA, 74 nt, Human
auagccaguuuucccagcaccauuuauugaagagauaguuuuuccccaauguacauucuuggcagcuguguuau

SEQ ID NO: 18655 - RNA, 62 nt, Human
gcuguuuugguuacuauagcucuguaguuuaauuugaagucagguaaugugauuccuccagu

SEQ ID NO: 18656 - RNA, 100 nt, Human
uucauaguuugaggucuuagguuuaagucuucaauccauuugcauuugauauuuguauaugugagagauaggaaucuaguuuuauucuucugccuaugga

SEQ ID NO: 18657 - RNA, 93 nt, Human
gucauuguacuaguuagaagcuuauuaucuuaauucaguagguuuauguagaccuuaacaaaaggaaauaaauaucuuguaaugaguauugac

SEQ ID NO: 18658 - RNA, 61 nt, Human
gugauugguuuaauuuguguaugaaucaugucuugauuuuaaauguugucuuaccaauuau

SEQ ID NO: 18659 - RNA, 94 nt, Human; identical to SEQ ID NO: 600

SEQ ID NO: 18660 - RNA, 82 nt, Human
agaggaauuuggaguaguuucaaauacaagauugauugcugcugcuacuucuguauuaaaaacuagauuuucauaugccuuu

SEQ ID NO: 18661 - RNA, 75 nt, Human
aggaugaaucauauauuagaaugugaauucuaucuguuagaacuaauggauuguugcuugauaguguaucauccu

SEQ ID NO: 18662 - RNA, 64 nt, Human
cuguguuguacagcagaaagaugccaggcaaugguuugcugagcuuucuguggauauggaaaag

SEQ ID NO: 18663 - RNA, 70 nt, Human
cuuuuggcagagcucccacuauuugcaauggauuuuggauaaacaagaucuguuggaggagcgccaaaag

SEQ ID NO: 18664 - RNA, 95 nt, Human
gucauuuaucucugauggcacuuugagggaaaagaauguccacauacaguuuuugaaagaucuucucuccaaaccaguuaguuagagccagugac

SEQ ID NO: 18665 - RNA, 66 nt, Human
guguucuggggcggaaucugugcugucuagguuugugcuucuagccaugcccauucccgcccccac

SEQ ID NO: 18666 - RNA, 127 nt, Human
ugaggacccaggcccauccagggauuucaucucuaagccuggcagugcuggggggaaauguguuucuguguauauagcuccucuuguccacucugcuuucggaagugcuguggucugggggucuuca

SEQ ID NO: 18667 - RNA, 67 nt, Human
guucuuuucccuugcugcaaccuacagaggugccauugugggaaugauaguagcugaaauuaagaac

SEQ ID NO: 18668 - RNA, 70 nt, Human
gccaugccaccgccucgccaaccugcauacucccaugcaucgaguagccuggcuguaggugacacauggc

SEQ ID NO: 18669 - RNA, 72 nt, Human
gucuuuggguaauuugaccccacgugcucucuggcccucaagcauguaaccucggggucugaggcccaggac

SEQ ID NO: 18670 - RNA, 77 nt, Human
gugguggaugggccaucagaauauacacuugcuagauaauuuggcuaucugagugaaaugaguuauggaucuacuac

SEQ ID NO: 18671 - RNA, 63 nt, Human
gguccggggcuacgacuucaaccgcggugugaauuaccgcgcacugcuggaggccuucggacc

SEQ ID NO: 18672 - RNA, 64 nt, Human
uguguguguauauauguauguguguauguguguguauauauagauguauauauauacacacaca

SEQ ID NO: 18673 - RNA, 100 nt, Human
uaagaucuuuauuauuaaguaacucacugggguugucaaaguauguuauaaaauuacacagauaauuagagauauauguuacauagaaaugcugauuuua

SEQ ID NO: 18674 - RNA, 82 nt, Human
ugcaguacucuaauuuagccaaguaauugcugcuguaaaauccaaaucuacagagcgcacaauuuuuuaaauggagugugca

SEQ ID NO: 18675 - RNA, 76 nt, Human
aaaaucccacauuuuuggauuauguccggccacguuccuggacuugucguuacguguuuuagaagcuugggacuuu

SEQ ID NO: 18676 - RNA, 77 nt, Human
gcugauguggacuucucuuuucuugggcaauggagucuuacucugcuuuuauucucaagaaugguaugcacgucagc

SEQ ID NO: 18677 - RNA, 62 nt, Human
cauugccauuaauuuacuauaggucacuuaauuugaauugguauuaauuuaguaacgcaaug

SEQ ID NO: 18678 - RNA, 63 nt, Human
ucaaagagcaacgcagggaaauacuaagaugaagccuuaauacccaacagaguugugcuauga

SEQ ID NO: 18679 - RNA, 86 nt, Human
uuuuucuuguuaucuauuucagccugaaaaugaaaucccaagacuuuaaacauuuaugagcaugaggaggaagcaucacagaagaa

SEQ ID NO: 18680 - RNA, 63 nt, Human; identical to SEQ ID NO: 5205

SEQ ID NO: 18681 - RNA, 64 nt, Human
cuuuuauauuucuuuucaagauuggaucagagcucaucuccauccagucuuguuucuaugaagg

SEQ ID NO: 18682 - RNA, 75 nt, Human; identical to SEQ ID NO: 74

SEQ ID NO: 18683 - RNA, 71 nt, Human; identical to SEQ ID NO: 77

SEQ ID NO: 18684 - RNA, 80 nt, Human; identical to SEQ ID NO: 174

SEQ ID NO: 18685 - RNA, 64 nt, Human; identical to SEQ ID NO: 175

SEQ ID NO: 18686 - RNA, 66 nt, Human; identical to SEQ ID NO: 5320

SEQ ID NO: 18687 - RNA, 71 nt, Human
acagaugucugcugccaaaaaguuguucugauagaaaauccaaaaucaucgaccccaaaagccaagucugu

SEQ ID NO: 18688 - RNA, 69 nt, Human
ugucuuaaccaauuugggggcaggguggggucucaagccuuuggccccugugacuccaaguauaaggca

SEQ ID NO: 18689 - RNA, 83 nt, Human
uugaaaauggaauggaaucuccaggagugaggguuuccauggaagccagcacuauccuuggggacaccacugaccauuaacaa

SEQ ID NO: 18690 - RNA, 64 nt, Human; identical to SEQ ID NO: 1324

SEQ ID NO: 18691 - RNA, 68 nt, Human
aauucagaguuaauuacaaauucaguugaaacaaaauuucaguuuggauuaaauuuacacugugaauu

SEQ ID NO: 18692 - RNA, 80 nt, Human; identical to SEQ ID NO: 353

SEQ ID NO: 18693 - RNA, 62 nt, Human; identical to SEQ ID NO: 6733

SEQ ID NO: 18694 - RNA, 61 nt, Human
ccagacaaccaccccaccaaguucaaggugacaaauguggaugaugaggggguggagcugg

SEQ ID NO: 18695 - RNA, 65 nt, Human
cggucagcuccccgauggccugggugagggcaggcuggcugcucugacaccauggggagcugcug

SEQ ID NO: 18696 - RNA, 61 nt, Human
gcaagaaagagaugcaacccacacacccaauccgccuggggcuugcucuuaacuuuucugu

SEQ ID NO: 18697 - RNA, 81 nt, Human
uuccucccuaaucuucgggguuccuuccaguagcaauuucagccuuaguuucuuuagaaggaccggcgauuaauggaggga

SEQ ID NO: 18698 - RNA, 63 nt, Human
ccauguguucacauguucucaucauuuagcuccuauuuguaagugagaacaugcgguauuugg

SEQ ID NO: 18699 - RNA, 60 nt, Human
uguguuauuuugcuaaggauaauggcuuccagcuccauccaugucccugcaaaggacacg

SEQ ID NO: 18700 - RNA, 61 nt, Human
ucuuucauauugugaaacaucagaggguacaaccuuuguucuucaguuuagguauuaaaga

SEQ ID NO: 18701 - RNA, 80 nt, Human
uuuuaaguucuuuagaaugugacgcuuuuaauauagccucugguuuuagauggagaaacacuaugcuauugucauuaaaa

SEQ ID NO: 18702 - RNA, 78 nt, Human
uuuugagagucugacaugcauaucauaauuuuaugucagguauuauagauauuuugaaauggugacugacucuuuuga

SEQ ID NO: 18703 - RNA, 85 nt, Human
cuucccaggcccguggcaacccagcaguccuucccucagcugccuaggaggaagggacccagcugggucugggccacaagggagg

SEQ ID NO: 18704 - RNA, 79 nt, Human
ucuuguguugagacuucgugguggugcuaagaaaaggaagaagaagucuuacaccaucccaagaagaauaagcacaaga

SEQ ID NO: 18705 - RNA, 85 nt, Human
cgagccugacuugauggucuguccaauggccaugauguacucgucaaggucauuggacagcugaaccuugaccagucgggucuug

SEQ ID NO: 18706 - RNA, 60 nt, Human
gggagggucacuugagcccaggaauugugagaucaacugggcauauagggagauccuguc

SEQ ID NO: 18707 - RNA, 61 nt, Human
uggguucgguggucaugcuguaaucccaucacuuugggaggcagaaggugauacugauuca

SEQ ID NO: 18708 - RNA, 76 nt, Human
uuuaaaaaaagaagcuauguuuacacuacacuauagucuauuuaaagugugaaauggguuaugucuuaauuuuaaa

SEQ ID NO: 18709 - RNA, 61 nt, Human
ggaaaggugguuuuuauucacagaaaguuacaacuaauccaaaccuuaggaucaucagucu

SEQ ID NO: 18710 - RNA, 67 nt, Human
ugugcaacuuaugaaucuuugauaauauuuccuaugcggauugcucaacagguuuauauaaagcaca

SEQ ID NO: 18711 - RNA, 65 nt, Human
ucccgcgaaaaaagaccuugugguccucaguuggcucggccaggaaauacaagggguccaagggg

SEQ ID NO: 18712 - RNA, 73 nt, Human
gagcuacgcugggcuuugagguagagguuggggguuuaugaacccaaaucugguuaagaucuugguguggcuc

SEQ ID NO: 18713 - RNA, 73 nt, Human
ggauagguggcugagacccacugcccugagcuacuacuaguguggcugugccugugggucucuagaaccaucu

SEQ ID NO: 18714 - RNA, 62 nt, Human
uguuuagugucuauuuauucuuggguggccaguuuugaaaccuaaaaauggacaauaaagca

SEQ ID NO: 18715 - RNA, 60 nt, Human
cauauaucugggagcacuucgauaaggaccggcugguccaggugguaacucagaguaaug

SEQ ID NO: 18716 - RNA, 65 nt, Human
gcccagguggugcagugggugagcuuugcugauuccgauauagugcccccagccaguaccugggu

SEQ ID NO: 18717 - RNA, 64 nt, Human; identical to SEQ ID NO: 13710

SEQ ID NO: 18718 - RNA, 81 nt, Human
cgugcucuaugcccggacagugguggcgccgaugggcuaucuucccagaacggcacgcuguaugugacggcacggaggacg

SEQ ID NO: 18719 - RNA, 80 nt, Human
gggugaagauggcggcagccgaggccgcgaacugcaucauggagguguccuguggccaggcggaaagcagugagaagccc

SEQ ID NO: 18720 - RNA, 83 nt, Human
ggcagaaaaucgauucagaugaagcacgaggauucgagggaaucuuuguacugucaacuuuuugguacuucgaguuuucugcc

SEQ ID NO: 18721 - RNA, 72 nt, Human
cucuaugccaugguggugguucucucgaggggcucaagauccugagggaggggcaccccaaggcagcaugag

SEQ ID NO: 18722 - RNA, 68 nt, Human
cugggggggggggggccagcacccugguugaaacggcaggcggcauuggguccagcaaggaccucuag

SEQ ID NO: 18723 - RNA, 72 nt, Human
uggaggccaagcugauaaaacacaagaaggggauugucaaugaacaguuucugcugcagcggugggcagacg

SEQ ID NO: 18724 - RNA, 62 nt, Human
uuucagagauuauguguguacauauaaacaaauguuucuuauuuauuuauuuauuuuugaga

SEQ ID NO: 18725 - RNA, 64 nt, Human
auuguguaaaaaaggggcgcgccgggaaaggaaaccgggaauaugagcgcgacgaaaacauagu

SEQ ID NO: 18726 - RNA, 73 nt, Human
ccgccgcgaguuuuuguuuugucccaaaauccccgcgcggggaauagggcagugggcagaaaagacugggcgg

SEQ ID NO: 18727 - RNA, 64 nt, Human
uacuuuuuuuuuuuuuuuuuuucaauagaucuuuuauuuguuuaauaacuuaugaaaaggagug

SEQ ID NO: 18728 - RNA, 86 nt, Human
uggguuuuguguuugaucuggaaaaacacuuguacaaugaaaauucaucaauguaggugucauucugaauuaaaugucuguauuca

SEQ ID NO: 18729 - RNA, 69 nt, Human
gaacugcucugcagaaaggucgcugcucaaguggcugcacucacaggcuagccuuucugcacugcuguc

SEQ ID NO: 18730 - RNA, 64 nt, Human
auccaagagugugauggauucuauuaagaaaauugauuuccuccguuaauaaggauccuuggau

SEQ ID NO: 18731 - RNA, 62 nt, Human
gaggcgagcaaaagauuguaaugacugaagcuguuuaauugugauuuguggacguuuuccuu

SEQ ID NO: 18732 - RNA, 60 nt, Human
ggugaaggcagacagcgaguggcgacgaugaucaaaggcuucuccugagacugcgucacu

SEQ ID NO: 18733 - RNA, 70 nt, Human
ucccccgaccuaugggcauaccuuuaagaauuagaaaagucuuuuccgugguagaucaaacgcgagggga

SEQ ID NO: 18734 - RNA, 65 nt, Human
ucggaagcauuucggggcguuggaggccgcucuuggccaaaauaaaugacccugaagcuuuucgg

SEQ ID NO: 18735 - RNA, 64 nt, Human; identical to SEQ ID NO: 3889

SEQ ID NO: 18736 - RNA, 64 nt, Human; identical to SEQ ID NO: 3890

SEQ ID NO: 18737 - RNA, 80 nt, Human
gggucaagcugaaaaggcaagguuucuucaacuggcuugagagcuaugagguaggcuguuuccuucuuucgcuuuguccc

SEQ ID NO: 18738 - RNA, 64 nt, Human
gccccccaacauaaccaauuuaggaaaggcaauucuuuaaagggguuaaaaccuuuuggggggc

SEQ ID NO: 18739 - RNA, 69 nt, Human
cugccucccagucuccucuuccaacucuguccuguuugaugauggccucagggagacaagggauggcag

SEQ ID NO: 18740 - RNA, 62 nt, Human
gagcccucugagaggcccagguccuagagcagcuucugccugggcugaggucuugggggcuu

SEQ ID NO: 18741 - RNA, 75 nt, Human
agggggaagaauggagauggcagggcucuggaauuagaggaggucauucauuucacaaacauuugcagacccccu

SEQ ID NO: 18742 - RNA, 63 nt, Human
gcugcgugagugcuuagagcuuuucgguggaagaugccggacaguaacuucgcagagcgcagc

SEQ ID NO: 18743 - RNA, 131 nt, Human; identical to SEQ ID NO: 6294

SEQ ID NO: 18744 - RNA, 80 nt, Human
gaaugugucccagagauucugguauguuguaucuuuguucucguugguuucaaagaacaucuuuauuucugccuucauuu

SEQ ID NO: 18745 - RNA, 79 nt, Human
gugauguuagggugucaauuuuagaucuuuccugcuuucucuugugggcauuuagugcuauaaauuucccucuacacac

SEQ ID NO: 18746 - RNA, 61 nt, Human
gguuggggucauggcgccccgaagccuccuccugcugcucucaggggcccuggcccugacc

SEQ ID NO: 18747 - RNA, 64 nt, Human
caggcagaaagguugggcaugggcuugguaucccgaagcucugucucccacuccgugcugucug

SEQ ID NO: 18748 - RNA, 90 nt, Human
uccuaaucaguuugcguuuaauguuuuugauugaguccauacaucacacuguagauaggcaaaaccaagaacugaugcaggcucaaagga

SEQ ID NO: 18749 - RNA, 75 nt, Human
ugcagacaaaccaguguuaagaaaguauucaccaucauuuaaacaaauaaccacuuaaauagaacagugucugca

SEQ ID NO: 18750 - RNA, 120 nt, Human
uugaaccugaccaugguuuuuaauuagauacugcuagggcauuuuaaugugcaaaaaaauuaacauaguucuuuucaaaagaaacuguccucaguguucuagagaccuagaggguuucaa

SEQ ID NO: 18751 - RNA, 89 nt, Human; identical to SEQ ID NO: 288

SEQ ID NO: 18752 - RNA, 61 nt, Human; identical to SEQ ID NO: 776

SEQ ID NO: 18753 - RNA, 118 nt, Human; identical to SEQ ID NO: 3011

SEQ ID NO: 18754 - RNA, 61 nt, Human
ggcuucaugauauacaccaauuccaaaauaaaacaaucaaaugguccagguguagaaugcc

SEQ ID NO: 18755 - RNA, 69 nt, Human
ucuugcccaggcuggagugcaguggugcgaucuuggcucacugcaaccucugccuccuggguucaagca

SEQ ID NO: 18756 - RNA, 73 nt, Human; identical to SEQ ID NO: 11655

SEQ ID NO: 18757 - RNA, 90 nt, Human; identical to SEQ ID NO: 15

SEQ ID NO: 18758 - RNA, 77 nt, Human; identical to SEQ ID NO: 16

SEQ ID NO: 18759 - RNA, 60 nt, Human
uuuacuacuuuaauuugugcuuuuuuugaaaaaaaguuuucaaguaagagcaauaguaaa

SEQ ID NO: 18760 - RNA, 89 nt, Human
agagguggaacuuugaagaauucacuggucguuuuguaucacagguacaacuagagcguacacuuaacuuuucaacuguucuaucaucu

SEQ ID NO: 18761 - RNA, 73 nt, Human
cagauggcuaaugagcaggcguuucuucauuuuucuuugcaaguuuguucuauaugcucguauggccugaaug

SEQ ID NO: 18762 - RNA, 71 nt, Human
gcuuccucaguucuuuccauccuccuucuaaaggcaaaacacagaacaaccaccaaaagaaaaagggaagc

SEQ ID NO: 18763 - RNA, 87 nt, Human
uccugccucaccacugugcagguggguggcguggagaccgaagucgggcuggcaggcagggcuuacagcacagagggagggcaugga

SEQ ID NO: 18764 - RNA, 79 nt, Human; identical to SEQ ID NO: 5273

SEQ ID NO: 18765 - RNA, 71 nt, Human
gaggagcccaguggcgccuuuucagugguucuugggaugcuccgcagccaauuaagccgacugaguuccuu

SEQ ID NO: 18766 - RNA, 62 nt, Human; identical to SEQ ID NO: 5274

SEQ ID NO: 18767 - RNA, 63 nt, Human
caaugcaaacaucuauaaaaugccucugcauaauugucagaagcuauaguccagaaaucauug

SEQ ID NO: 18768 - RNA, 63 nt, Human
cugcacauaucaucgcggaauucauucggcuuccagcaagcugacacuccaugauacaagcgg

SEQ ID NO: 18769 - RNA, 88 nt, Human
gaggauuuuauuucaagauaaaacauaacuucuacccauacuauugauuccaaagguuagaaaaaguguuuuuccucaucuuauccuu

SEQ ID NO: 18770 - RNA, 66 nt, Human
aggcggguggaucaccggaggucaggaguucaagaccagccuggcaaauauugugaaaccccgucu

SEQ ID NO: 18771 - RNA, 63 nt, Human
cagugugauggugcaugccuguggucccagcuacucuggaggcugaggcaggagaaucaccug

SEQ ID NO: 18772 - RNA, 69 nt, Human
ggugcucguguauugguggugcuccguguauugguggagcacacuuguaaucccaguacuuugggagcc

SEQ ID NO: 18773 - RNA, 74 nt, Human; identical to SEQ ID NO: 3801

SEQ ID NO: 18774 - RNA, 74 nt, Human
gcugcaucaaagguagacuuucgcacagguugugagguuggagucacaguguuauuuguuguaccugauguagu

SEQ ID NO: 18775 - RNA, 83 nt, Human
ugggucuguuuacagagugugguaauuucguucuuuagauuugcagaauuuauaaagaaagaaaauuacagccugcacaccca

SEQ ID NO: 18776 - RNA, 131 nt, Human
auucuaagaguaaacccacccaauauggcaaacaaucaaaauuuuuaaaauuuaacuuagaaagucugagaucauuauuuucaaaacauugauuuguacauuguuucauacacaaauaauugacugacuau

SEQ ID NO: 18777 - RNA, 62 nt, Human
cuuugggagguaauuaggugaugaggguagagcccucaugaauggaauuugugcccuuaaag

SEQ ID NO: 18778 - RNA, 69 nt, Human
aucaacaacauaacuauauguuaauauuuugaacuaacauuucaaauguagacugaccacauguuugau

SEQ ID NO: 18779 - RNA, 68 nt, Human
cugaauccacuggucuugguugcccccacauggaacaucaauauugguaaccacacgaucccuuucag

SEQ ID NO: 18780 - RNA, 69 nt, Human
cuuaaagaaucaauguucccuuuugugaagauggcuuuuguugucauuagauucuacugauuuuuuagg

SEQ ID NO: 18781 - RNA, 92 nt, Human; identical to SEQ ID NO: 9220

SEQ ID NO: 18782 - RNA, 84 nt, Human
uacuuagacgacugaacuggccucuguguucuaaugguugagccucagaguacauauuuggggugcgguuugguuugcuuugua

SEQ ID NO: 18783 - RNA, 67 nt, Human
agcucccaguaucgaggggcaaacuuaacauuagcuuaaugcgacuuauuugcccagauuggguccu

SEQ ID NO: 18784 - RNA, 104 nt, Human
auggcaccccacgggguuuccacacguuggugcguaugagcaucuuugacucuuagucgcucggcaccgcauaacaccccugugggcacgucugauugugccgu

SEQ ID NO: 18785 - RNA, 66 nt, Human
gcuaugccagcccggagaugugcuucguguuuagcgacagguauaaauuccggacauggcggcagc

SEQ ID NO: 18786 - RNA, 71 nt, Human
ggucgcagguugggauggcggcuggaggcgaucaugguucgcccgacagcuaccgcucaccucuugccucc

SEQ ID NO: 18787 - RNA, 81 nt, Human; identical to SEQ ID NO: 2259

SEQ ID NO: 18788 - RNA, 73 nt, Human
gaugggaggccuggggcccugcccgcuggacagcacuaucucuaccagcggugguuccggccuucugauaauc

SEQ ID NO: 18789 - RNA, 65 nt, Human
uggccugcugacacuucccugcaacccauccaccccugguuucuccuccugggagucaaagucca

SEQ ID NO: 18790 - RNA, 61 nt, Human
ccuguuuuuccuugccacauuggacuuccagaagccauuuggauuggguuuagaagauggg

SEQ ID NO: 18791 - RNA, 68 nt, Human
ucaaucaaauuugggauucucaacauuuucugugucaauaaaagguguggaauuaguagauucgauga

SEQ ID NO: 18792 - RNA, 70 nt, Human; identical to SEQ ID NO: 2062

SEQ ID NO: 18793 - RNA, 60 nt, Human; identical to SEQ ID NO: 3438

SEQ ID NO: 18794 - RNA, 76 nt, Human; identical to SEQ ID NO: 17406

SEQ ID NO: 18795 - RNA, 130 nt, Human
gguguggcagcuaacgccuguaauuccagcacuuugggaggccaagguggguggaucacuucaggucaggaauucgagaccagccuuggccuaccaaagugcugggauuacgggcgugagccaccgcacc

SEQ ID NO: 18796 - RNA, 92 nt, Human
ugccuugagacagggucucacuuuguugcccaggcuggaaugcagucgcacacucauagcccccugcagccuugaccucccuggcucaagca

SEQ ID NO: 18797 - RNA, 78 nt, Human; identical to SEQ ID NO: 99

SEQ ID NO: 18798 - RNA, 80 nt, Human
ucuuguguugagacuucgugguggugcuaagaaaaggaagaagaagucuuacaccacucccaagaagaauaagcgcaaga

SEQ ID NO: 18799 - RNA, 68 nt, Human
cggcguggcgggcgaucccacacgcgccacgggaaacguuacgcgcgagggagagaagcgccccggcg

SEQ ID NO: 18800 - RNA, 65 nt, Human
gaagguuaggcuggcuguccugaaauauuauaagguggaugagaauggcaaaauuagucgccuuc

SEQ ID NO: 18801 - RNA, 80 nt, Human; identical to SEQ ID NO: 100

SEQ ID NO: 18802 - RNA, 76 nt, Human; identical to SEQ ID NO: 758

SEQ ID NO: 18803 - RNA, 67 nt, Human
gaacuuuuagaauaugaaaauaagagcccugaggauccacaggucuuggauaacuuucuacaaguuc

SEQ ID NO: 18804 - RNA, 80 nt, Human; identical to SEQ ID NO: 13061

SEQ ID NO: 18805 - RNA, 60 nt, Human
uugccuccuauaaguggaaugucucccggcccucauugcuggcugacuccaaggauguga

SEQ ID NO: 18806 - RNA, 77 nt, Human
gggauaaauggacuuuggcacauaucuaacucuaguaacaauauuuuacauauguacacuuauuccauauauauucc

SEQ ID NO: 18807 - RNA, 89 nt, Human; identical to SEQ ID NO: 8424

SEQ ID NO: 18808 - RNA, 69 nt, Human
ccgaccccagccgcggugagucuguggcgcgcuccguuguggcccuucuuguugccggcacuucuucgg

SEQ ID NO: 18809 - RNA, 65 nt, Human
ccaaacugaauaaauagcaucccucuccccacgagagcuaggggagacucaugugcugaguuugg

SEQ ID NO: 18810 - RNA, 62 nt, Human
ccugccacacuccccucccagccuggucccaggacagguggucggugagggucuggagcggg

SEQ ID NO: 18811 - RNA, 109 nt, Human
ccaccgaggcgcgcguggggccacugccguggcggcggcugcccuccucacacucggcuccgcgccgccuccggccaccgugcgcucccgcguggggcgccucggaugg

SEQ ID NO: 18812 - RNA, 129 nt, Human
agcaugcucaguuaaauuugaauuucagacaaacaaugaaugcuuuuacuguaaauauaugccaaauauugcaugaaacauucuuaacgugaaauuguuucucugaaauucaaacuuaacugggcaucu

SEQ ID NO: 18813 - RNA, 84 nt, Human; identical to SEQ ID NO: 7538

SEQ ID NO: 18814 - RNA, 78 nt, Human
agaaaguuuuucaauccuucauggaaauaacaucacguuucuucuacagacaugaaacauggagagagaaacauuucu

SEQ ID NO: 18815 - RNA, 110 nt, Human
ggucaucuugugucuguucauggaguacuuggagaaaaaccgcuucacuuugucagcgaccuggugggcgugcaacacacgagcuucauguuaccaaaacuggagagacc

SEQ ID NO: 18816 - RNA, 104 nt, Human
aauuaacuaagucacaggaaggucucacuuaagcagauuaugaucaauccaaaauuucuucuauguacgucagcuuuagugagauuuacuccauuaguauaauu

SEQ ID NO: 18817 - RNA, 61 nt, Human; identical to SEQ ID NO: 544

SEQ ID NO: 18818 - RNA, 92 nt, Human; identical to SEQ ID NO: 9620

SEQ ID NO: 18819 - RNA, 77 nt, Human
gggaggggggccucacuauguugcccaggcuggucgcaaacacccagccucaagcaauccuccugccucagccuccc

SEQ ID NO: 18820 - RNA, 84 nt, Human
uguuuaaaaaacggaaacugaagagcucuguguaaauucacuuuuaagacacggugaaguucaaauguauaugaagaagaaaca

SEQ ID NO: 18821 - RNA, 64 nt, Human; identical to SEQ ID NO: 1375

SEQ ID NO: 18822 - RNA, 61 nt, Human; identical to SEQ ID NO: 2204

SEQ ID NO: 18823 - RNA, 80 nt, Human
gugcugcugcugcucggccuguuucggccgccccccgcgcucugcgcgcggccgguaaaggagccccgcggccuaagcgc

SEQ ID NO: 18824 - RNA, 61 nt, Human; identical to SEQ ID NO: 8603

SEQ ID NO: 18825 - RNA, 62 nt, Human; identical to SEQ ID NO: 7075

SEQ ID NO: 18826 - RNA, 80 nt, Human; identical to SEQ ID NO: 7076

SEQ ID NO: 18827 - RNA, 96 nt, Human
gggcugcuuguggcuuccauuuucaauugccaggaaagagguagaaauaucuugucauggacagucguucuauggugggcauuugagcuuuggccc

SEQ ID NO: 18828 - RNA, 79 nt, Human
auuccccugauucucucuacaaaaugcuaacauuuaaauaugucauuuguaaauuguuaaccagaaggaacaugggaau

SEQ ID NO: 18829 - RNA, 81 nt, Human; identical to SEQ ID NO: 13271

SEQ ID NO: 18830 - RNA, 76 nt, Human; identical to SEQ ID NO: 758

SEQ ID NO: 18831 - RNA, 63 nt, Human; identical to SEQ ID NO: 9379

SEQ ID NO: 18832 - RNA, 70 nt, Human; identical to SEQ ID NO: 4167

SEQ ID NO: 18833 - RNA, 61 nt, Human; identical to SEQ ID NO: 18754

SEQ ID NO: 18834 - RNA, 80 nt, Human; identical to SEQ ID NO: 174

SEQ ID NO: 18835 - RNA, 64 nt, Human
gcuaagauaguucagauugaucuuaggucaauggguagaccuauguaguucaugaagucuuggc

SEQ ID NO: 18836 - RNA, 66 nt, Human; identical to SEQ ID NO: 5320

SEQ ID NO: 18837 - RNA, 90 nt, Human; identical to SEQ ID NO: 5340

SEQ ID NO: 18838 - RNA, 67 nt, Human; identical to SEQ ID NO: 14482

SEQ ID NO: 18839 - RNA, 60 nt, Human
aacauguauauuuaggugccaaauaugauuguuaaccauauguaacuuauuaaauauguu

SEQ ID NO: 18840 - RNA, 80 nt, Human
acaaagacaugaaagcuaaaaaagaaaacaccucaagagcuuuugguuuuacuuuuuugguuuuuguuuuuuguuuuugu

SEQ ID NO: 18841 - RNA, 80 nt, Human
aguuucuuccuccugggggggucguggucucgcuggcuuuaggagugaagcugcagaccuucgccaagaggauuacaacu

SEQ ID NO: 18842 - RNA, 102 nt, Human
ggaauugguggguucuuggucucacugacuucaagaaugaagcuguggacccucacgaugagugugacaguucuuaaagauagugugcccagaguuccuucc

SEQ ID NO: 18843 - RNA, 92 nt, Human
aggagauauaaagcuggcuugcccugcgcuguuugcaaucacccacuccugguggcugcaggugcuggggagagagcuaggggagguuuccu

SEQ ID NO: 18844 - RNA, 66 nt, Human
ucugaaggaggcuuggcggugguugggcugguggcugagccugacugccucaucuucuccgccaga

SEQ ID NO: 18845 - RNA, 84 nt, Human
uacacacaaguuagauggaauuuuuagagugaaagaauuaaguaggauuuaauugggugcuuuguaaauagucaacugugugua

SEQ ID NO: 18846 - RNA, 75 nt, Human
cccuugcauuugucuucuaagguaggagggcagacaccauugccuuuggucuacaacugaggaaacaauauaggg

SEQ ID NO: 18847 - RNA, 75 nt, Human
guccucacccuggcccagcgacucauaaagucaugcaaccaugagcaucacugccuccugggccaaagugagcac

SEQ ID NO: 18848 - RNA, 74 nt, Human
uggcuguaaaugcguggauuuauaccugaguucucucaucuguuucacugauccaugugucuguuuuuaugcca

SEQ ID NO: 18849 - RNA, 60 nt, Human
cccaugugccaugcauggugcugggcaccaaagugcuuuccaucccuugccugcuauggg

SEQ ID NO: 18850 - RNA, 63 nt, Human; identical to SEQ ID NO: 11804

SEQ ID NO: 18851 - RNA, 109 nt, Human
gauacuuuuaagaaguuuaggaguugugaaugugguaaaacugaaccuuuccagugauuuaguggaaaggucuuaucaaucuuaauuuuuucuuuuucaugaaaguuuc

SEQ ID NO: 18852 - RNA, 90 nt, Human
ucauauucuggacucaaaucauggaaagaaggcauuacuguacacugcgguaaaucaguuggcuaugggaagcaguucagcagaagauga

SEQ ID NO: 18853 - RNA, 84 nt, Human
auagaaaaacacacuaauuaugugcgggguauauggcaugugcucuggccuuaauccaugaacaucauuauaucauuuuuuuau

SEQ ID NO: 18854 - RNA, 80 nt, Human
ggaacucugcuuugccucacaucauaucauuauggcucagaaugaacugcugagcuuuacuaugagugaaagaagcagcc

SEQ ID NO: 18855 - RNA, 76 nt, Human
cgugacuugggcagugguaggcggguuccagaaguuuaaaagugaugcugugagcaggacccccuuccaggugaug

SEQ ID NO: 18856 - RNA, 70 nt, Human
gauucuggggcaaauuguggacaaguagaagaacguccuuccccuuggaaacuuugguuggcucggcuuc

SEQ ID NO: 18857 - RNA, 100 nt, Human; identical to SEQ ID NO: 1173

SEQ ID NO: 18858 - RNA, 70 nt, Human; identical to SEQ ID NO: 1335

SEQ ID NO: 18859 - RNA, 91 nt, Human
gggguccaggcucugguuggggcuguggacugaggucugaucuccaggcugguauguggacugugggcaguuuggacugggccuggguccc

SEQ ID NO: 18860 - RNA, 130 nt, Human
uggucuuggggucuagggugggaguuggguucugguuuagauccagacaagguucuagacauugggcuggggcuuaaguguuaagguuuggaguggauucuuagcugcuucugggcucuggaggggauca

SEQ ID NO: 18861 - RNA, 68 nt, Human
acuuucauguguagaugaaguaagagguacggagauccucuucacuugcuauucuagacagagaaggu

SEQ ID NO: 18862 - RNA, 76 nt, Human
agaauugcaguggagcaaauuggucauuuuuuaaaaaaauauauuuuaaccuacagucaccaguuuucauuguucu

SEQ ID NO: 18863 - RNA, 65 nt, Human
uaccucacugaaguacucgcauguuguuugguacccacugagcaacuguuucaguuccuaaggua

SEQ ID NO: 18864 - RNA, 75 nt, Human
gucaauguaggugcccucaauagccuccuugggugucuugaagcccagaccgauguucuuguaguaccgcgggac

SEQ ID NO: 18865 - RNA, 71 nt, Human; identical to SEQ ID NO: 1764

SEQ ID NO: 18866 - RNA, 61 nt, Human; identical to SEQ ID NO: 12046

SEQ ID NO: 18867 - RNA, 60 nt, Human
agucucgaacuccugagcucaagcaguccgcccaccuugaccucccaaagugcugggauu

SEQ ID NO: 18868 - RNA, 68 nt, Human
ggguucaagugauccucccaccuuagccucccaaguagcugggaccauuggugcaugccacuaugccu

SEQ ID NO: 18869 - RNA, 69 nt, Human
gguaugagcugccaugcccagcuucauucuuuuuaaagacugaauaauauuccauuguaugcguaugcc

SEQ ID NO: 18870 - RNA, 62 nt, Human
auggugacaacaugcuggagcccagugcuacaugccuugguucacgggauggaagucaccgu

SEQ ID NO: 18871 - RNA, 91 nt, Human
aggaaaagaaagaaagaaaauaaauucuuaauguguguguguguuguguguguguguguuuguaauuauuucuauuuuucacucuuuuccu

SEQ ID NO: 18872 - RNA, 81 nt, Human
cuaugaggaaguaauagucucuuuuccaaauacuguuaguccaaaggcuuguuuguagaaucagacuguucuuuguuuugg

SEQ ID NO: 18873 - RNA, 75 nt, Human
gaggcggagguuugcagugagccgagagcgugccauugcauuccagccugggcaacaagagcaaaacuccgucuc

SEQ ID NO: 18874 - RNA, 85 nt, Human
ccgauucacugcuagucccagaagguguccagccgagacucuuucgggaggaggcucuucgugcugguacugguguugugaucgg

SEQ ID NO: 18875 - RNA, 103 nt, Human
gugucgauccccucuucucaucacugcugcuccaacuggauugaugacuccgggaauggucagagccuugguuggagccuaagagaauggaggagggcggcgc

SEQ ID NO: 18876 - RNA, 82 nt, Human
uacauuauuuacaccaaaagcacagggcucgugugggugaacagucugcagucaaagccgaugcuggguguccuguagugua

SEQ ID NO: 18877 - RNA, 64 nt, Human
agcucaucaaugcugccaagggcuccucgaacuccuaugccauucagcaacgcaaggacgagcu

SEQ ID NO: 18878 - RNA, 66 nt, Human
cugugcacaggcgcucgugaggcugccuuccggcaacauuacgaccauugcugagugccuggccag

SEQ ID NO: 18879 - RNA, 93 nt, Human
cugagaguuggggccacaccaccagugaggggugcaguagucacucacagacucagacaagcaacccacuggcuugccugucccaauucccag

SEQ ID NO: 18880 - RNA, 60 nt, Human
gcuggggcaccaugcagagucagagaagggauuacacucugcaaauuuugugcucacagc

SEQ ID NO: 18881 - RNA, 62 nt, Human
guugcggcccccaaucccagacagucagcucucaagcuugcccaccuggguuuggcugcagc

SEQ ID NO: 18882 - RNA, 60 nt, Human
gaauagaucuguuucuuucuguccacaaugauuugugucauagacauaauugaucaauuu

SEQ ID NO: 18883 - RNA, 60 nt, Human
cugcuguguccucguaggcccugcacaggcaaguggggcgcguggacaucgucacagcag

SEQ ID NO: 18884 - RNA, 71 nt, Human
gcagcacaaaggcggcgcggugcacgucggaguuguaguacuucagcugcaucugcgccaccugcugcugu

SEQ ID NO: 18885 - RNA, 66 nt, Human; identical to SEQ ID NO: 4249

SEQ ID NO: 18886 - RNA, 64 nt, Human
gauuuuuauuauuuaaaaaaauggaaaaacaaaaaugcauuuuucauucaauaaauguuccauc

SEQ ID NO: 18887 - RNA, 74 nt, Human
uaacugcagcaauuuccuugaacugucuguagaaauucuggaaugcagauauuuauucaaugguacugcaguua

SEQ ID NO: 18888 - RNA, 61 nt, Human
aguacggcagccuugagaucaaaugccccggccugggcuccaauccacagcaugcaaaacu

SEQ ID NO: 18889 - RNA, 74 nt, Human
gccacugcggcagcugcgauguguaguaggugaugaugaugucagcaccugcucugcggaaggcagucaguggu

SEQ ID NO: 18890 - RNA, 68 nt, Human
ggcauucccggcuucaccaauagcaugucaaguuccuucccuuacaucccguucacagcucgagugcc

SEQ ID NO: 18891 - RNA, 69 nt, Human
ugguuuucacuugucugaggccccgggaacguuuuaaaguucuaguucuugggccuggcacugucucca

SEQ ID NO: 18892 - RNA, 64 nt, Human
cugagaaagugucuuaaucaaaauuucuacaaaucuuugauaucgccuuauuuauuuucugcag

SEQ ID NO: 18893 - RNA, 65 nt, Human
guuuuuauuuuguuaauuuuuuauugaguguccaaauuaaugucaauauaacagaauucaaaggc

SEQ ID NO: 18894 - RNA, 91 nt, Human
ggauccggcugccagccugaggccaagcacggcuggagacccacgaccuggccugccguugcccugagcugcagccucggccccaggaucc

SEQ ID NO: 18895 - RNA, 84 nt, Human; identical to SEQ ID NO: 286

SEQ ID NO: 18896 - RNA, 64 nt, Human; identical to SEQ ID NO: 14346

SEQ ID NO: 18897 - RNA, 89 nt, Human; identical to SEQ ID NO: 288

SEQ ID NO: 18898 - RNA, 89 nt, Human; identical to SEQ ID NO: 288

SEQ ID NO: 18899 - RNA, 72 nt, Human
ucauauagcuguggggggcuuuaauauucuggacauuuauucacugauguuagaaucaucacacauaucuga

SEQ ID NO: 18900 - RNA, 67 nt, Human
ugaggacuuuaaagugguauugaguaauacuuaccugaaaguugccaaaugcuuuugugaggccuca

SEQ ID NO: 18901 - RNA, 64 nt, Human
ccaucauggcucagauuggcuccuauguuccugcagaagaagcgacaauugggauuguggaugg

SEQ ID NO: 18902 - RNA, 86 nt, Human
uaucuuggaugaacuaggaagagggacgagcacucaugauggaauugccauugccuaugcuacacuugaguauuucauccgagaug

SEQ ID NO: 18903 - RNA, 82 nt, Human
ggguuugggucaaccuuggguuucuucacuggagcagcaacugacuugccguuucaugaagugucccuucuugcccuugccc

SEQ ID NO: 18904 - RNA, 65 nt, Human; identical to SEQ ID NO: 247

SEQ ID NO: 18905 - RNA, 66 nt, Human
guauguuuuauaaggugggugagggagguuguuuugcccugaaaacaucuacaaaugcuagcauau

SEQ ID NO: 18906 - RNA, 60 nt, Human
uguucuugugaugaucagauugucaguucaguuuacuguauuccacacaacauacgagca

SEQ ID NO: 18907 - RNA, 63 nt, Human
ugcauuacaaaccugcagcuugccaacaacaacaaaaaagguaaagguuucacagucagugca

SEQ ID NO: 18908 - RNA, 70 nt, Human; identical to SEQ ID NO: 16155

SEQ ID NO: 18909 - RNA, 82 nt, Human
ucugauuggcugcagggaugaaaguuuuuaaguucauaggacugaugauccuccucaccucugcguuuucagccgguucagg

SEQ ID NO: 18910 - RNA, 63 nt, Human; identical to SEQ ID NO: 527

SEQ ID NO: 18911 - RNA, 78 nt, Human
gcccgccgcucuuccuggcgugucaucuccagcauugagcagaaaacagagaggaaugagaagaagcagcagaugggc

SEQ ID NO: 18912 - RNA, 69 nt, Human; identical to SEQ ID NO: 528

SEQ ID NO: 18913 - RNA, 90 nt, Human; identical to SEQ ID NO: 5735

SEQ ID NO: 18914 - RNA, 78 nt, Human
cugggguguuuauggcaagucacuuugacagacauuauuguggcuaauguugucugacuuacuguuucaacaaaccag

SEQ ID NO: 18915 - RNA, 65 nt, Human; identical to SEQ ID NO: 247

SEQ ID NO: 18916 - RNA, 80 nt, Human
ucugguguggagacuucgugguggugcuaagaaaaggaagaagaagucuuacaccacucccaagaagaauaagcacaaga

SEQ ID NO: 18917 - RNA, 62 nt, Human
aacuguuguggccuuuuuugauccauaagaguugguacuguuuaaggccaaaaguaacaguu

SEQ ID NO: 18918 - RNA, 79 nt, Human
agaggaaaaagcaagugcuccagaaaaaccuguaaagaaacaaaagacaggugagacuucgagagcccugucaucuucu

SEQ ID NO: 18919 - RNA, 61 nt, Human; identical to SEQ ID NO: 4152

SEQ ID NO: 18920 - RNA, 79 nt, Human; identical to SEQ ID NO: 4153

SEQ ID NO: 18921 - RNA, 67 nt, Human
gauaucaauguaaaggaugaucaaacacuggaauauauuuuccuaggacuuccuuuauucugguuuc

SEQ ID NO: 18922 - RNA, 77 nt, Human
gguacaucugcauaaacaauauggcacaucuacuuauuaaccaaguuuccugugcuuucacauuguuuuuugcuacc

SEQ ID NO: 18923 - RNA, 72 nt, Human
uuuguuuguuuuguuuuguuuuguuuucucaaaaauguugaauuuggaaagagaacuauccagaaagauaga

SEQ ID NO: 18924 - RNA, 84 nt, Human
uuuggcacgaaccaugccacuguuuccaugggcccgaguuacuuuuccccagaugacucugguuuuguuugguuugccgccaga

SEQ ID NO: 18925 - RNA, 107 nt, Human
gccuaugaucucuaagcuuggguuccguguugccaaagcgccuucugguggacucagcccaggaggagcccaugugccccacgcuggccuggcuuguggucaugggc

SEQ ID NO: 18926 - RNA, 85 nt, Human
uguugaaaacaaauacuguuucauuuguugaaaacaaauacugugucauuuguuuucagacagcaaacagaaugauucuuugaca

SEQ ID NO: 18927 - RNA, 93 nt, Human
guggcugcguggacaaguggcgucgcgguagccccuuacccggcaaaggcccgguuggggcucuguugcgggcgcacgacgcacggcggcgac

SEQ ID NO: 18928 - RNA, 69 nt, Human
cggcguugcugcccccgagacccgggugccugccccggcggugcgggucgcgggccuccgcucucgccg

SEQ ID NO: 18929 - RNA, 60 nt, Human
gccccucuccgggcacugugcgggagccacuuccccaaacaguccccguucugcaagggc

SEQ ID NO: 18930 - RNA, 76 nt, Human
ggauagcagaagguugauguuuuuagugggacccaaggccuugaauuucccaguaauaaaauuagguuuccuuucc

SEQ ID NO: 18931 - RNA, 60 nt, Human
ucgcuggauuaauguuugacaggaaaaaacacgaaauggaugaacagcugaucgagucga

SEQ ID NO: 18932 - RNA, 77 nt, Human; identical to SEQ ID NO: 17811

SEQ ID NO: 18933 - RNA, 65 nt, Human; identical to SEQ ID NO: 247

SEQ ID NO: 18934 - RNA, 80 nt, Human; identical to SEQ ID NO: 100

SEQ ID NO: 18935 - RNA, 60 nt, Human
cuggcaugaggacugggucguguucuaugcccggcaaauucuuguuucuucacaugccgg

SEQ ID NO: 18936 - RNA, 65 nt, Human
aacaaaguuuaagcuaguguuaauaaauuaaaaaaaauugcuugucugucuacuucagcuuuguu

SEQ ID NO: 18937 - RNA, 68 nt, Human
ggccgcucuagaggauccaagcuuacguacgcgugcaugcgacgucauagcucuucuauagugucacc

SEQ ID NO: 18938 - RNA, 68 nt, Human
gaaggcgggccgaaggcuuauucccuuuaguggagguuaauuuuuacuuugguaccuggcccgccuuu

SEQ ID NO: 18939 - RNA, 105 nt, Human
gcggaguggaaguggccguggggcggguaugggacuagcuggcgugugcgcccugagacgcucagcgggcuauauacucgucgguggggccggcggucagucugc

SEQ ID NO: 18940 - RNA, 124 nt, Human
cggcuagguacgcaggcugguggcgcggaggcugcggcugcgaaguacgccugcggaguaacugcaaagaugcuguccgugcgcguugcugcggccgugguccgcgcccuuccucggcgggccg

SEQ ID NO: 18941 - RNA, 75 nt, Human; identical to SEQ ID NO: 74

SEQ ID NO: 18942 - RNA, 87 nt, Human; identical to SEQ ID NO: 76

SEQ ID NO: 18943 - RNA, 63 nt, Human; identical to SEQ ID NO: 527

SEQ ID NO: 18944 - RNA, 76 nt, Human
augcuacacaacagaaaguaagguguucuacuugaaaaugaaaggagauuauuuagguaucuuucugaaguggcau

SEQ ID NO: 18945 - RNA, 127 nt, Human
caggcuuaccaggaagcauuugaaauuaguaagaaagaaaugcagccuacacacccaauucgucuuggucuggcacuuaauuucucagucuuuuacuaugagauucuaaaucuccugaaaaggccug

SEQ ID NO: 18946 - RNA, 69 nt, Human; identical to SEQ ID NO: 528

SEQ ID NO: 18947 - RNA, 68 nt, Human
aggaaaggaggaagaaauguuuucuuaggggaauucgcuagguuuuaacgauuguuucuccugcuccu

SEQ ID NO: 18948 - RNA, 79 nt, Human; identical to SEQ ID NO: 995

SEQ ID NO: 18949 - RNA, 61 nt, Human; identical to SEQ ID NO: 996

SEQ ID NO: 18950 - RNA, 74 nt, Human
ugcugagcucggcuuauauuucggaccacaugaaggugcacagccagguccucaccaugucugugagcucugca

SEQ ID NO: 18951 - RNA, 68 nt, Human
gccuggcgauugagagugacggcaagaaggggagcaaaguuuucauguauuacuucgauaacccgggu

SEQ ID NO: 18952 - RNA, 80 nt, Human
ugcaacggagagacuguggucuacugggaagugaaguacccuuuucccauguccaacagagacuaugucuaccuucggca

SEQ ID NO: 18953 - RNA, 80 nt, Human
agcgaggugcgcaggaacuuugaugcacuggugauggaccugacuacguacuaucccgcaagagcgagcaugccucagcu

SEQ ID NO: 18954 - RNA, 68 nt, Human
ggcucgucuccuugaaaucaacgcgcguaccaagauguuucgugaguaacuagagagcagacgcagcc

SEQ ID NO: 18955 - RNA, 83 nt, Human
cuacuaaugaggcuaguuauuagauauacuguauuuuaacacuaaagaauagagcuuuaucuucguauuuaucuuauuuauag

SEQ ID NO: 18956 - RNA, 71 nt, Human
cucuuaucaaugaagaacuuuguauccaacaauaauaaacuggcaaauugcaaaguuacguuuuguaggag

SEQ ID NO: 18957 - RNA, 81 nt, Human
guaaguccugcucauguauguuccuuuauuugaagcaaaccuacagguguuucuuaauaugacagaaucaugaagacuugc

SEQ ID NO: 18958 - RNA, 79 nt, Human
guguuugaaagcucuguuuauaaauagugauugauacauuuaucauguauuuggugcugaagauaaacacuuuuuacau

SEQ ID NO: 18959 - RNA, 66 nt, Human
gcuguacauuguugcuugagagucuguacauuuaguccagauuuguauuugcacugucaguauggc

SEQ ID NO: 18960 - RNA, 88 nt, Human
gucaguguuccagguguaucuuagcuaaaacuagagaaugcccuaacuuagaugguuuuugaagccuauacaauugguauuguuugac

SEQ ID NO: 18961 - RNA, 70 nt, Human
uggaacaaauuggcugacaccuuacugguaaccugcuauucuucugguguuauccuucaggauuguucca

SEQ ID NO: 18962 - RNA, 91 nt, Human
uuuuuugauucagcuuauacccgggcugaaaaccucaauuuauguucaugacagugggguuuucagcccggguauaagcugaaucaaaaaa

SEQ ID NO: 18963 - RNA, 86 nt, Human
caggaaacagauugagagcuguauaucuggcgcuaaaaaccaguaauguuuuuguagaaaguuggcauugagaaucugugggccug

SEQ ID NO: 18964 - RNA, 70 nt, Human
gugauucaucaacuuaaugccccuuuguggcagauucgugguacagagaaaagcagcgugagggaguuac

SEQ ID NO: 18965 - RNA, 106 nt, Human
gccucaccccugcggagagcaccguggcggggcgacagcgcaugcaggaacgggggucuccucuccugcccguccuggccggggugccucuggggacgggcgacgc

SEQ ID NO: 18966 - RNA, 87 nt, Human
gcgguccgagguggaagaaguggauuuugccggcugguuguguaaaacccugcggcugaaccagcccggcacacccacgcgcaccgc

SEQ ID NO: 18967 - RNA, 100 nt, Human
ggccaucuuugaacuccuggacuauauugugaacgagccaccuccuaagcugcccaacgguguguucacccccgacuuccaggaguugucaauaaaugcc

SEQ ID NO: 18968 - RNA, 60 nt, Human
gugugacaguggccgggcucccugcguccugcuggugaccugcccaccgucccuguccau

SEQ ID NO: 18969 - RNA, 79 nt, Human; identical to SEQ ID NO: 16297

SEQ ID NO: 18970 - RNA, 80 nt, Human
ccagaacgauggugugcccucgguuggguccgggcucgaguccuucaugcuguccgggguugggaccgccgcguucucgg

SEQ ID NO: 18971 - RNA, 77 nt, Human
ccuguccuucggucccccaggccugccggucagaagccuggggcugguaggcccuuggugguccucauguggauggg

SEQ ID NO: 18972 - RNA, 71 nt, Human
gccuccuccuuccugccugugaugcuccgucucaaacagccgaaaccugucuugcaauggggggagggggc

SEQ ID NO: 18973 - RNA, 61 nt, Human
caaggaaucugugucuuugaugaccaccucaaaagggucgcagacuucacaguguaacuug

SEQ ID NO: 18974 - RNA, 81 nt, Human
gaccuugaugaccagcgucacgacagagcgcugugggccaaucccgccauggaccucucccucgaugcugaccagcacguc

SEQ ID NO: 18975 - RNA, 77 nt, Human
ggcagggccccuuugagguaccaguugacaccugucgucacgacugcaccugaagcccagccaaugagcggcccgcc

SEQ ID NO: 18976 - RNA, 67 nt, Human; identical to SEQ ID NO: 3353

SEQ ID NO: 18977 - RNA, 67 nt, Human; identical to SEQ ID NO: 1379

SEQ ID NO: 18978 - RNA, 63 nt, Human; identical to SEQ ID NO: 1366

SEQ ID NO: 18979 - RNA, 86 nt, Human; identical to SEQ ID NO: 1381

SEQ ID NO: 18980 - RNA, 72 nt, Human
gagcgcaggaagucacuaccauuuauauucuaaaacagaacuaucuauguucauaggacuucugauguguuc

SEQ ID NO: 18981 - RNA, 66 nt, Human
aguauggaugugucuugaauguguugaggcccuuggaagggacucuuucugcaagauaccuguacu

SEQ ID NO: 18982 - RNA, 89 nt, Human; identical to SEQ ID NO: 14153

SEQ ID NO: 18983 - RNA, 85 nt, Human
gaauguaaaaggaauauuacaguguuaacugccauauauguaauauacacaaacucaauuagcauuguaauggccaaaugcauuc

SEQ ID NO: 18984 - RNA, 99 nt, Human; identical to SEQ ID NO: 16322

SEQ ID NO: 18985 - RNA, 66 nt, Human; identical to SEQ ID NO: 12118

SEQ ID NO: 18986 - RNA, 62 nt, Human; identical to SEQ ID NO: 12047

SEQ ID NO: 18987 - RNA, 73 nt, Human; identical to SEQ ID NO: 12049

SEQ ID NO: 18988 - RNA, 63 nt, Human; identical to SEQ ID NO: 9730

SEQ ID NO: 18989 - RNA, 62 nt, Human
gccagaggagccugcuguuuuucagaacugaacuggaagggcagaaucaggcuaucucuggc

SEQ ID NO: 18990 - RNA, 65 nt, Human; identical to SEQ ID NO: 5414

SEQ ID NO: 18991 - RNA, 85 nt, Human; identical to SEQ ID NO: 2879

SEQ ID NO: 18992 - RNA, 66 nt, Human; identical to SEQ ID NO: 1526

SEQ ID NO: 18993 - RNA, 100 nt, Human
ugugauuccucagccagagcaaccucucuaugccaaguacaggcacugcucagggagaaggagagugcugaacggcaagggugcagguggagggauggca

SEQ ID NO: 18994 - RNA, 70 nt, Human; identical to SEQ ID NO: 6934

SEQ ID NO: 18995 - RNA, 73 nt, Human
uguaggccggagguucaugguugguauugcuaggguggcgcuuccaauuaggugcaugaguagguggccugca

SEQ ID NO: 18996 - RNA, 68 nt, Human
gccuggccaacauggugaaacccugucucuacuaaaaauacaaaaaguagccagccgugaugacaggc

SEQ ID NO: 18997 - RNA, 72 nt, Human
gucucaaaaggggaaaaaaaaaauugcugaugugacccaugaagggaacucauuuuccucguaauuugggac

SEQ ID NO: 18998 - RNA, 62 nt, Human
uccugguaguggccagggccugcguuccucagaccaaaaggcgcaaacuggcauugcuguga

SEQ ID NO: 18999 - RNA, 102 nt, Human
ugagacgaagucuugcucuucuugcccaggcuggagugcaauggugacaucucagcucaccacacucuccaccugccagguucaagcgauucuccugucuca

SEQ ID NO: 19000 - RNA, 91 nt, Human
uuaaauuuuuaauagcuaauauaauaacagccaauguuuguugaaugccaaaacuauucuguuuauuacauuaauuaucuaguucauuuaa

SEQ ID NO: 19001 - RNA, 77 nt, Human
uuccaucuuuuuauaccaauuugacaugcuaccuucaucaccuucccauguauaauuaauuggguauaauucuggaa

SEQ ID NO: 19002 - RNA, 63 nt, Human
caaugacuugggccaauuacacgacugcaaagcuagagcugccaacagggcuccagggaguug

SEQ ID NO: 19003 - RNA, 69 nt, Human
ccaccggggaucuagccuguggcaccccggagaugacacgaggcucacaugacucuagacacuuggugg

SEQ ID NO: 19004 - RNA, 70 nt, Human
gcagggaccccugaaguguuggucgggggccucgagcugccugagcugacacgaggggaggggucugugu

SEQ ID NO: 19005 - RNA, 90 nt, Human
gccugggccgggagugggccacguggggacuacuguguggagcugaccgcacuccccagcaugcuggcauccagcuccccaagggccagc

SEQ ID NO: 19006 - RNA, 67 nt, Human
gcgcugggucaaucagucaacacacgccucucacuuaugacgaguacgucugaugcugccacagugc

SEQ ID NO: 19007 - RNA, 66 nt, Human
ggugucauuuuaagagagguaauccagcaucauguaccaaggccuaccaauguuuaaaaugacauu

SEQ ID NO: 19008 - RNA, 64 nt, Human
ugguccuuuguaaccucauaaaguguccgaugagcagcaggggcuggaggauaauuuagggcca

SEQ ID NO: 19009 - RNA, 66 nt, Human
gguuugacugucagaaauuauuggucugcguucacacuugauuugcucaacuuuccacagacagcc

SEQ ID NO: 19010 - RNA, 62 nt, Human
gucccaucagcuuggaugacaaaugauauggucacccuaaauuggucuuccaggugcuugac

SEQ ID NO: 19011 - RNA, 69 nt, Human
auuggaugaauuuuguaacaaacaucuuuagauaacuuacauucuaaugguuuuuacagauuauugaau

SEQ ID NO: 19012 - RNA, 68 nt, Human
ggauacccucuauaaagcauuuguguucuuuuacaaaucguaagaagacgcuuauuuguauugguacc

SEQ ID NO: 19013 - RNA, 94 nt, Human
ugaagauuuuuaagacaauuauugaguaaaauacaaagaauaagaugaccuggcauuccauuuuuuuuuacuuuauauaugugucuaauuuuca

SEQ ID NO: 19014 - RNA, 64 nt, Human; identical to SEQ ID NO: 17566

SEQ ID NO: 19015 - RNA, 75 nt, Human; identical to SEQ ID NO: 74

SEQ ID NO: 19016 - RNA, 71 nt, Human
ggccaagcgaaccccgucggcccugcggacaacuccgcgcgcagccggagcacauggggggcgucaaggcc

SEQ ID NO: 19017 - RNA, 85 nt, Human
guccuugaacuuggaaccugacaauguuggugugucguguuggaaaugauaaacuaauuaaggaaggagauauagugaagaggac

SEQ ID NO: 19018 - RNA, 71 nt, Human; identical to SEQ ID NO: 77

SEQ ID NO: 19019 - RNA, 87 nt, Human; identical to SEQ ID NO: 76

SEQ ID NO: 19020 - RNA, 108 nt, Human; identical to SEQ ID NO: 710

SEQ ID NO: 19021 - RNA, 75 nt, Human; identical to SEQ ID NO: 74

SEQ ID NO: 19022 - RNA, 71 nt, Human; identical to SEQ ID NO: 77

SEQ ID NO: 19023 - RNA, 73 nt, Human
gccgcaccaggucuuguagcagcgccuccucgagaagccaacagagcaguaagcgcagcagccggaguguggc

SEQ ID NO: 19024 - RNA, 67 nt, Human; identical to SEQ ID NO: 6270

SEQ ID NO: 19025 - RNA, 84 nt, Human
aggaggaucuguuugggaaacauagauugucuuccccucaaaugaggggaaaaaaaaagacccuuuguucaaauggauucuguu

SEQ ID NO: 19026 - RNA, 68 nt, Human
caguauguuuaugucauucuaaaugcagcaauucaugauagcaguccaauugaucauaagcagguuug

SEQ ID NO: 19027 - RNA, 61 nt, Human
ucaucuauaaguagcaucugggaagaggagaucgaggccacaguuugcuauuuuaguauga

SEQ ID NO: 19028 - RNA, 93 nt, Human
acacaaaacuaugagagugacaaaauggugacagguagcugggaccuaggcuaucuuaccaugaagguuguuuugcuuauuguauauuugugu

SEQ ID NO: 19029 - RNA, 61 nt, Human
uggucucgccucucuccucuccuccccccaggaggaacuugaaaggaggguaaaaagacua

SEQ ID NO: 19030 - RNA, 88 nt, Human
aagaagacauguuuuagacaaauacucacguguaugggcaaaaaacucgaggacuguauuugugacuaauuguauaacagguuauuuu

SEQ ID NO: 19031 - RNA, 69 nt, Human
cuuuaucuuuuuuuauaccauuuuauccuuuucucuuuaacagaaaguaaauauguauaaaauuugaag

SEQ ID NO: 19032 - RNA, 82 nt, Human
uggauaaauuuccuguuguguggguggcauuuuucuuaacgagauuugcuucugucuuagccucacacagggaaaauaucca

SEQ ID NO: 19033 - RNA, 76 nt, Human
ccggguguuggcagggcuguacaugggccgcucagacacccagcugguggugcggcaggcgucccugcaugucugg

SEQ ID NO: 19034 - RNA, 103 nt, Human
gcgugagauccuaccccucucuuugggcuccugcuggguuuccuggccagcacgugugcagauaagagaacgauugcagcgagaacauugggagaucuugugc

SEQ ID NO: 19035 - RNA, 88 nt, Human
ucagguucagcucuguucagcuccuuggggaucuccuguuucacaucucaggagucacugggaagaugaccacagaaacugccucuga

SEQ ID NO: 19036 - RNA, 79 nt, Human
ggauuaacacggcagaggaacaaaggugugcucugagcuucuucauauuucaccuucacccucaccuguguucucuucc

SEQ ID NO: 19037 - RNA, 72 nt, Human
ugcuuuaaaugcucccugccugguguggggauggggucccccucuuugugagggcuggagcauggcacggca

SEQ ID NO: 19038 - RNA, 66 nt, Human
acaggugugugccaccacgcccggcuaauuuuuuguauuuuuaguagacgugggguuucaccaugu

SEQ ID NO: 19039 - RNA, 67 nt, Human
ugaucuccugaccuugugauccgcccgacuuggccucccaacgugcugggauuacaggcaugaguca

SEQ ID NO: 19040 - RNA, 103 nt, Human
uugagacagagucuugcucugucacccaggcuggagugcaguggcacgaucucagcucacugcaaccuccgucucccggguucaagcaauucuccugccucag

SEQ ID NO: 19041 - RNA, 84 nt, Human
gucgacuuuuuuuuuuuuuuuuuucuggcccaaauugaguuuaauaaagagcuugagugaugcucagauuagggagggagugac

SEQ ID NO: 19042 - RNA, 84 nt, Human
aucaguuucuuuugaaggugaguaaaauuaaacucugugcuuccaugacagggguuuuuuauaccccuuuaaaaaauacuuggu

SEQ ID NO: 19043 - RNA, 63 nt, Human
aaauaaaugauaugaaucauuuaacuauacaaauguauaguuaaugcuaacauguauuuauuu

SEQ ID NO: 19044 - RNA, 73 nt, Human; identical to SEQ ID NO: 15657

SEQ ID NO: 19045 - RNA, 79 nt, Human; identical to SEQ ID NO: 18561

SEQ ID NO: 19046 - RNA, 65 nt, Human
cuuucagaaauagccauaauuuuguauuacauacaaguaagccauuuuaaggaguuucaugaaag

SEQ ID NO: 19047 - RNA, 61 nt, Human
uacagcuuagaaaaugcagguuacccccccuccccgccagccugcuuuguuacauccugua

SEQ ID NO: 19048 - RNA, 83 nt, Human; identical to SEQ ID NO: 15057

SEQ ID NO: 19049 - RNA, 78 nt, Human
ucggcaggucugcagugggaaccuguggagacaaaagugacuucuucuuggaugccacuccccuguguugacuuucga

SEQ ID NO: 19050 - RNA, 79 nt, Human
ugcaucuuucauaguucuguuaacuauuuuguacaucgcuucuuuuucaaaacuaguucuuaggaacagacucgaugca

SEQ ID NO: 19051 - RNA, 61 nt, Human
gagaaagaaaguaguuuuaagguccagcuucuuagucuacuugaagcaaauuuuuuuucuu

SEQ ID NO: 19052 - RNA, 65 nt, Human
ggagauugaugucaggucagaauauuggaguuauacaucuauuucugaguugaauacucagcucc

SEQ ID NO: 19053 - RNA, 90 nt, Human
uauacucuuauaugggcuaaaaagaccccaugaauaaauagcagguucaguaguugaggaguggaguuuaguagguucguauucaguaua

SEQ ID NO: 19054 - RNA, 67 nt, Human; identical to SEQ ID NO: 1736

SEQ ID NO: 19055 - RNA, 92 nt, Human; identical to SEQ ID NO: 1737

SEQ ID NO: 19056 - RNA, 77 nt, Human; identical to SEQ ID NO: 1738

SEQ ID NO: 19057 - RNA, 88 nt, Human
gguggugguagcauuugggucugagaucggcccagcucugacugaaggggcuuggcuuccacucagcaucagcguggcagucaccacc

SEQ ID NO: 19058 - RNA, 61 nt, Human
uaaaagauuucaccagaaaaccuucauauaaaaauucaggcccuuuuuggacaauuuuuua

SEQ ID NO: 19059 - RNA, 64 nt, Human
ccucccauccucgugcacacggaugcugacaggccuuggggaaagcagcgcguggauguggagg

SEQ ID NO: 19060 - RNA, 61 nt, Human; identical to SEQ ID NO: 544

SEQ ID NO: 19061 - RNA, 82 nt, Human
cuacuaguaaguagauuucucaaauaaaacauaauaauagcuaaauauagcuaauauuuacugaccauuuacuaugcagcag

SEQ ID NO: 19062 - RNA, 76 nt, Human
gccauguugguuucaaauuuagauaaaaugagaaaugaggucauuuuaauuuuugucuaccgaauaugacaguggc

SEQ ID NO: 19063 - RNA, 82 nt, Human
acugcgugcuauccuucaacaaguguacguggcuggauaaugucguccagaucccacauguguggacgaucgccauagcagu

SEQ ID NO: 19064 - RNA, 65 nt, Human
guucugcaaacaauguccaagguauuuucaaccaccaggaacuuggauacagugugcuuuagaau

SEQ ID NO: 19065 - RNA, 71 nt, Human
uaaauauuucuaauucuuuuuuuguuuucaguucccuacugugaaaauuuaaguagauucuuaaauguuug

SEQ ID NO: 19066 - RNA, 64 nt, Human; identical to SEQ ID NO: 3818

SEQ ID NO: 19067 - RNA, 67 nt, Human
caccaagaucugcaccugcggcggcuccacccgggcccgcgcccuaggcuucacggcagaucaggug

SEQ ID NO: 19068 - RNA, 86 nt, Human
cgcuccaguugguuggguauaccgaugacuuugggccgugaguguguuucggguuucaaggucgcugggcccgagguggaccugcg

SEQ ID NO: 19069 - RNA, 61 nt, Human
gcacagcccccucaugcugguccuugagcauuucaugggcggagggacuggcgggguuggc

SEQ ID NO: 19070 - RNA, 111 nt, Human
gguugugggcagagcuccuggcccggaugcugucuccuguucuaucgagagacuuggaagaucagcacugagauuauuaugagcagaauggucaggaggaugcccagagcc

SEQ ID NO: 19071 - RNA, 80 nt, Human; identical to SEQ ID NO: 100

SEQ ID NO: 19072 - RNA, 90 nt, Human
agccccuguguccagcugccuccagaagguucccagcaccgggguccacacagccguguugcugccacuuccaggugcuggcuugggguu

SEQ ID NO: 19073 - RNA, 91 nt, Human
gcgcagaggcuuucauuagaacacuuggaacguuauucagaugaaaugucaaaaugagcagcgucccucuccacacuggcagccccugugu

SEQ ID NO: 19074 - RNA, 63 nt, Human
ccagacaaccuuagccaaaccauuuacccaaauaaaguauaggcgauagaaauugagaccugg

SEQ ID NO: 19075 - RNA, 93 nt, Human
auuuuacuuucuucauaguucgacaccuuaaauguauauuacuaauaguagcuuugcauuuuuggcugauuuaaaaauugauauaaaugaaau

SEQ ID NO: 19076 - RNA, 69 nt, Human
ggcaugagccugccagauugccaauuccauccuccaccuucagaggaugccgccauccagaauuuugcc

SEQ ID NO: 19077 - RNA, 60 nt, Human
uguuauucuuaaagauguuugaaaugaauauaccuuucuaaauaucuuuuuaaaauaaua

SEQ ID NO: 19078 - RNA, 92 nt, Human
aaguuacucuagcuuuuuaaaaggcuguuuacaauucuguguaaaaauagagcaguaucuacucaaguuuguguaaauguuagggauaauuu

SEQ ID NO: 19079 - RNA, 71 nt, Human
gcccagagucagcaugugcggcgggccaggaccacaaggcuccuaaucccagauguaccgcgacccuaggc

SEQ ID NO: 19080 - RNA, 64 nt, Human
gugaaccucgccuggagcaucucucccuaccuagccgugcagcugcugccagguuuaagaacac

SEQ ID NO: 19081 - RNA, 74 nt, Human
ucguucgguggaccgggagccguuagugaugugcugaagcaaucaaguccuggucaccuggacacaucgagcga

SEQ ID NO: 19082 - RNA, 89 nt, Human
gagguuggaaagggaaugaauugcaacguuguauccgaaagaggaaaaugguuggaaguagaauguucgcugaugaccugcacaaccuu

SEQ ID NO: 19083 - RNA, 63 nt, Human
cuugcguuacccacuuaaaucgcuggagacaauccccuuuugcaaguggcguauaacgauaag

SEQ ID NO: 19084 - RNA, 75 nt, Human
gauuggugaaaguuuuuaguaccaagaaaacagggaugaggcucuuggauuaaaagguaacuucauucacugauu

SEQ ID NO: 19085 - RNA, 125 nt, Human
gggugugggggaugcuaaccacagggccugagaagucuugcuuuaugggcucaagaaugccaugcgcuggcaguacaugugcacaaagcagaaucucagagggucuccugcagcccucugcuccu

SEQ ID NO: 19086 - RNA, 63 nt, Human; identical to SEQ ID NO: 19074

SEQ ID NO: 19087 - RNA, 75 nt, Human
ucuuuucgaaguauggcaaaaugugggcugcucuguucauaagggcuugccuucguucaguauguuaaugagaga

SEQ ID NO: 19088 - RNA, 62 nt, Human
cagaacauauaccauauagugaaaggcaacuuuuuaaauaacuucaugacuaauaugaacug

SEQ ID NO: 19089 - RNA, 60 nt, Human
gccuccuucucaaaacucaaauacucuuuauucaucuaagggucugggagagucgggggu

SEQ ID NO: 19090 - RNA, 66 nt, Human
gcggugaagaccuggcgacgcaucggaaaguacgaggagaaccgacgcacagcuaggaaugaccgc

SEQ ID NO: 19091 - RNA, 60 nt, Human
gcucauugcucaaagguauuuauuacaguaucaggagccaauaccuugugagcaguuggu

SEQ ID NO: 19092 - RNA, 79 nt, Human
cauuguaacaaugccucuuuucucacauaaaguuauugauucgaagcaguaaauuuucuuuuuaaaaagaggcucaaug

SEQ ID NO: 19093 - RNA, 87 nt, Human
uggacagauuuaucaguccuggcuagacaaguccacacccuacacggcugugcgaugggucgugacacugggccugagcuuugucua

SEQ ID NO: 19094 - RNA, 70 nt, Human
gcugucggggauucugcugggcaauggcacccugcccgccaccauccucaccagucucuucaccgacagc

SEQ ID NO: 19095 - RNA, 69 nt, Human
guauuuggagaaggcauuugaagaugaaaugaaaaagcuucuccucuuccuuaaagccuuuuccgaaac

SEQ ID NO: 19096 - RNA, 73 nt, Human
cagguguguauuuacuuuagaaaaaaugaaaaagacaagauuuaugagaaauauuugaaggcaguacacucug

SEQ ID NO: 19097 - RNA, 67 nt, Human
guuguuuggaugauuaagagauugccauuuuuaucuuggaagaacuagugguaaaacauccaagagc

SEQ ID NO: 19098 - RNA, 71 nt, Human
gaaguugaggaugacgaugaugaugagccaaucuuuguuggcgagauaucaaguucaaaaccagcaauuuc

SEQ ID NO: 19099 - RNA, 76 nt, Human
uccauuggauguuguuuaucaauaucaacaguacccaguuacaauucuggacugucauaaguagucauccaguaga

SEQ ID NO: 19100 - RNA, 99 nt, Human
agcaauucacuagacaaucuucacaugaaugucgguagccagggucucucccgagggauggcuuuagucuugaugaaugugaaccaugucggaauuguu

SEQ ID NO: 19101 - RNA, 71 nt, Human
ggcacuagcuuagcaaagaaggucacagugauguggagucgccgcacccaucuuugaagauagccaguguc

SEQ ID NO: 19102 - RNA, 82 nt, Human
cccacagacgaauaccuggagggcaugaugagcgaggccccggggcccaucaacuucaccauguuccucaccauguuugggg

SEQ ID NO: 19103 - RNA, 78 nt, Human; identical to SEQ ID NO: 17106

SEQ ID NO: 19104 - RNA, 72 nt, Human; identical to SEQ ID NO: 5861

SEQ ID NO: 19105 - RNA, 62 nt, Human
ccgcaccgaucgccuuucccaacagugcgcagccugaauggcgaauggcaaauuguaagcgg

SEQ ID NO: 19106 - RNA, 62 nt, Human
uauuuauuucaaggagacagaucaaauuaaaaacuucaagaauguuuucugccugguaaaua

SEQ ID NO: 19107 - RNA, 84 nt, Human
auuaaucucuuuauccaugcugaacgacugugacuauucaguaacgaaguaauaguaauuaauuaguaugguauaaucuuuaau

SEQ ID NO: 19108 - RNA, 63 nt, Human; identical to SEQ ID NO: 6872

SEQ ID NO: 19109 - RNA, 81 nt, Human
gguuuuccacuuagcauucaaaauguugcauagagaguaguuuucaauuucuuauguacucuucgaaguaaguugaaaauc

SEQ ID NO: 19110 - RNA, 73 nt, Human
uccuguuaaaucuguugcacucuccugggcugucuuuuucuccagcagaccccugcaugcaguuguguaagga

SEQ ID NO: 19111 - RNA, 64 nt, Human
gguggguggaucaccugaggucaggaguucgagaccagccuggccaacacggugaaaccccauc

SEQ ID NO: 19112 - RNA, 107 nt, Human
ugaggugggagaauugcuugaacccaggaggcggaggcagaggcugcagugacccaagauugugccacugcacuccacccugggcaacagagcaagaccccaucuca

SEQ ID NO: 19113 - RNA, 119 nt, Human
agguggcuccagugggcauuuucuucauauuaaaauuuuuuacaugaagcaauagaaguacaaaauacuuauuuuguucaaaauuuuaauguguuccaugaaacuguuggcagucgcuu

SEQ ID NO: 19114 - RNA, 93 nt, Human
agagggcaaaugucaacugcuggagagagugcauggacagaagugcaagcaaaauaaaguccagcucuuccagguugaccacuuugugccccu

SEQ ID NO: 19115 - RNA, 62 nt, Human
uugagucucagaaacaagcucuuuaauaaggaaaauccagaagcuauaaaacuggggggcaa

SEQ ID NO: 19116 - RNA, 77 nt, Human
uuugugcauaucaaaccuuguuccagaauggaguggcgaaaacaaucgggcugaagcagcgguaccagaugcagaaa

SEQ ID NO: 19117 - RNA, 80 nt, Human; identical to SEQ ID NO: 174

SEQ ID NO: 19118 - RNA, 64 nt, Human; identical to SEQ ID NO: 175

SEQ ID NO: 19119 - RNA, 66 nt, Human; identical to SEQ ID NO: 5320

SEQ ID NO: 19120 - RNA, 69 nt, Human; identical to SEQ ID NO: 3814

SEQ ID NO: 19121 - RNA, 69 nt, Human; identical to SEQ ID NO: 3815

SEQ ID NO: 19122 - RNA, 65 nt, Human
cagguguuccgggccccuucaccuggggcucaagugagagcagguguucugggccccuucaccug

SEQ ID NO: 19123 - RNA, 75 nt, Human
ggggcucaagugagagcaaguggucccgggccccuucaccaggggcucaggugagagcagguguucccgggcccc

SEQ ID NO: 19124 - RNA, 81 nt, Human
accagcugcaugacgguguccuguccucggcagcgcuacccugccaacugcacggugcgggaccacguccacugcuugggu

SEQ ID NO: 19125 - RNA, 64 nt, Human; identical to SEQ ID NO: 175

SEQ ID NO: 19126 - RNA, 61 nt, Human; identical to SEQ ID NO: 148

SEQ ID NO: 19127 - RNA, 80 nt, Human
ugucaccagagauggaucacacuugauggggaugguuagacaacugucucauucaauaaacugucaguuucuggagggca

SEQ ID NO: 19128 - RNA, 82 nt, Human; identical to SEQ ID NO: 13628

SEQ ID NO: 19129 - RNA, 89 nt, Human
cggaaccgcugucuuucacgccugucucacuccacacgggggccccgaccccagggucccgaaagucccaggcuguuggacguggucug

SEQ ID NO: 19130 - RNA, 88 nt, Human
gaucacuuccagguccucaguacacaaccaccacgagggaaacccagaccuagguuuccggcgccgacucugaggcccgggaguuuuc

SEQ ID NO: 19131 - RNA, 100 nt, Human; identical to SEQ ID NO: 18068

SEQ ID NO: 19132 - RNA, 74 nt, Human
cuguguccagcccuugcagagagcuuuguccucugacaucagcuaccacacaggcucauucucaacuggcacag

SEQ ID NO: 19133 - RNA, 76 nt, Human
gcugcuuccggagcaccugucuucauugccucucccuucugcagccugaaaggagggauguucaggacucugcagc

SEQ ID NO: 19134 - RNA, 125 nt, Human
ggcucugaaggguguuuguucugggcugggcuaggcugggccuagcuguagagacacaccuaaguuccguucucuguuuggaggcugcacccagccugaguccccaccaguccccuccaagagcc

SEQ ID NO: 19135 - RNA, 100 nt, Human; identical to SEQ ID NO: 1173

SEQ ID NO: 19136 - RNA, 70 nt, Human; identical to SEQ ID NO: 1335

SEQ ID NO: 19137 - RNA, 78 nt, Human
ggagagcauuuguauguuauggugaaugccaaauuugaaguggaggcaauguucacugcaaugugcgaaugccaggcc

SEQ ID NO: 19138 - RNA, 65 nt, Human
ggauucucacuggaauaccccaccauuaguuuacaugcauuauccagggaccgaagugacugucu

SEQ ID NO: 19139 - RNA, 67 nt, Human
gcuauuccaagaacaugaauggaggaauguugggccgaauuacagcgugguugugcaugggaguggu

SEQ ID NO: 19140 - RNA, 74 nt, Human
uuuggugccuggaauugguaugugguugggcaacgcccaaugccauucgugcuaacuggauuuuggguaucgag

SEQ ID NO: 19141 - RNA, 72 nt, Human; identical to SEQ ID NO: 3662

SEQ ID NO: 19142 - RNA, 74 nt, Human; identical to SEQ ID NO: 365

SEQ ID NO: 19143 - RNA, 96 nt, Human
acggaaaggaagggcucagauuaggggguguagcacauuuaucaggagguaagaucuccauagucuccuaccccuccuggccuggccuuuuacugu

SEQ ID NO: 19144 - RNA, 63 nt, Human
uucuguagcaaugaaaauuuuuaauuugaauaaaaaucacguaagcaugagguuguuggggaa

SEQ ID NO: 19145 - RNA, 69 nt, Human
cucacucagaccuucaugagcuggaaucucaucacuggaauguuccagcgacuggacaagcugaggaag

SEQ ID NO: 19146 - RNA, 81 nt, Human
guagauaaaaggugaaccaugugacaugggcauuuuuguaagucaaaaacaaauuucacauaugguaaaccuaauauucac

SEQ ID NO: 19147 - RNA, 131 nt, Human
agccaaucugcagacagacacuggcaacauugcggacacccuccaggaagcgagaaugcagaguuuccucugugauaucaagcacuucaggguuguagaugcugccauugucguacaccugcuggaugacu

SEQ ID NO: 19148 - RNA, 66 nt, Human
ccuuggcuucaaccuuagcuggggcugcagcagcacagagagcagcugugguggcagcagccaagg

SEQ ID NO: 19149 - RNA, 62 nt, Human
ggagaaggggggagauguugagcauguucagcagcguggcuucgcuggcucccacuuugucu

SEQ ID NO: 19150 - RNA, 71 nt, Human
ucucaaggccugacagacagaagggcuuggagauuuuuuuucuuuacaauucagucuucagcaacuugaga

SEQ ID NO: 19151 - RNA, 72 nt, Human; identical to SEQ ID NO: 7726

SEQ ID NO: 19152 - RNA, 77 nt, Human
ucuucggacaaaggcagcaguaagcuaaaaacaaaaucaacuggcugaauuuuccuucuuuaccucuugucugagga

SEQ ID NO: 19153 - RNA, 80 nt, Human; identical to SEQ ID NO: 11254

SEQ ID NO: 19154 - RNA, 91 nt, Human
uugauuuucauuaauccagagcugcagcaccagagauaauuucaaucaacucuuuugugaugacagcuuggcggguacgguugaaugucaa

SEQ ID NO: 19155 - RNA, 100 nt, Human
ucaacuggcuuuggcaugauuuaugauaucccugggauuaugcgugagaagagagaauugaacccggaagcauagacugugcuagacauggccuguauga

SEQ ID NO: 19156 - RNA, 79 nt, Human
ucugaagauagaucgccaucaugaacgacaccguaacuauccggacuagaaaguacaugaccaagcgacuaucuucaga

SEQ ID NO: 19157 - RNA, 95 nt, Human
aggaaaugcggagccgcgugguucugggggaguugggguucgcaauguccauacuacugacuuucccgguaacuauuccgguuaugaugaugccu

SEQ ID NO: 19158 - RNA, 73 nt, Human
agcgugugcagcgcuaccuggaggagaagggcaccuaccgaggagugucugccgaucuaccugcugcgcaucu

SEQ ID NO: 19159 - RNA, 65 nt, Human
augugggggaagugccuggacugcaucaaugagcugauggauauccuguuugcaaaucccaacau

SEQ ID NO: 19160 - RNA, 62 nt, Human
guuuugauuacgaggcccaucagcgacaggugacccgcugagggcuuccucaaagucugagc

SEQ ID NO: 19161 - RNA, 75 nt, Human; identical to SEQ ID NO: 15515

SEQ ID NO: 19162 - RNA, 69 nt, Human
caugaugcgaacaguacagauugcggcagugagcaaaacugauagcaaaaguaauauaaaaguaccaug

SEQ ID NO: 19163 - RNA, 69 nt, Human
caugcgcacaucaugguugacuucgugcuuagauaguuggcauggagagcgaugcuagugaugcacaug

SEQ ID NO: 19164 - RNA, 116 nt, Human
gcaaagucucucuguaccacccugugccaggucgcugcgcuacauguccugaacgggcaaaacacggcgaauguaccgcacguaccuggacacggugaaauugcugaugagguugc

SEQ ID NO: 19165 - RNA, 104 nt, Human
uagguacuagauuugcguccugauggacaucgagcaggucucuggacucacaaucgagggaucugccaccgagaucugucgcgugcgcaagucuugaacaucua

SEQ ID NO: 19166 - RNA, 71 nt, Human
acgucaggugagggcucggcccggcgguccccguuggucccugcagcccgggccgggccugacccuggugu

SEQ ID NO: 19167 - RNA, 78 nt, Human
cugggcccggaggucaccacgcaguuacggcgugccaauaccggacggugcacacugaguggacccagagggaccugg

SEQ ID NO: 19168 - RNA, 71 nt, Human
guccuucuuucagaccaaagcuuggacgucagugccagcgaugaugagauagccaggcugaagaagcagac

SEQ ID NO: 19169 - RNA, 78 nt, Human; identical to SEQ ID NO: 99

SEQ ID NO: 19170 - RNA, 80 nt, Human; identical to SEQ ID NO: 100

SEQ ID NO: 19171 - RNA, 92 nt, Human
gagacacagucuugcucuguugcccaggcuggaaugcaguggcgccaucucagcucacugcaaccugggcaacaagagcaaaacuccgucuc

SEQ ID NO: 19172 - RNA, 62 nt, Human
auccagcaauuuuccugcuggguauuuacccaaaagaaaggaaaucacuauauugaagggau

SEQ ID NO: 19173 - RNA, 70 nt, Human
ucaucucaccccaguuaaaauggcuuguacccaaaagacaggcaguuaacaaaugcuggcaaagagaugg

SEQ ID NO: 19174 - RNA, 76 nt, Human
aagaugcuacccagcaucuuuaaaccagcuuggugcggauagucugacuaguuuaaggagacuggcgaagcgucuu

SEQ ID NO: 19175 - RNA, 115 nt, Human
ugguucauagaagcagccaccagcagaugacaaagaagcuucaguucuccuuaaagaaguuagggguaggacaaguaucucgugguauugaagaggugaauauguuuacaaacca

SEQ ID NO: 19176 - RNA, 76 nt, Human
caggcaaggaagaugcugccaauaacuaugcccgagggcacuacaccauuggcaaggagaucauugaccuugugug

SEQ ID NO: 19177 - RNA, 80 nt, Human; identical to SEQ ID NO: 788

SEQ ID NO: 19178 - RNA, 68 nt, Human
aagggaaucacgaacacagagacgucaucguaggacaccugcccuuccucugugagacugucuuccuu

SEQ ID NO: 19179 - RNA, 78 nt, Human
cacacccaggcacuagagcaguucugggauacagugucugaauccucaguggucacugcucucuuggcccugacugug

SEQ ID NO: 19180 - RNA, 81 nt, Human
ggggauggugcauagcuaaauugacaggagcagauggugcaugagcgauuaugugcgcuggaacguggaagugacgucucc

SEQ ID NO: 19181 - RNA, 70 nt, Human
uggcgugaaccugggagcuugcagugagccgagaucgcgccacugcauuccagccugggcagcagagcca

SEQ ID NO: 19182 - RNA, 62 nt, Human
ggaugcccaggacagccagcccugagcucucagcagcuucacucaagcuguccuaggaaucc

SEQ ID NO: 19183 - RNA, 74 nt, Human
guccuaugucacguggggcuuauaggacggacggggcuugaucuggauguucugugccccuugcggucugggau

SEQ ID NO: 19184 - RNA, 62 nt, Human
ugaagggaggcacugaggucuucugaucuggggagaacagacugggacucaucuuccuuuca

SEQ ID NO: 19185 - RNA, 88 nt, Human
guuuaccaccaagucagaugugugguccuuuggcgugcuccucugggagcugaugacaagaggagccccaccuuauccugauguaaac

SEQ ID NO: 19186 - RNA, 120 nt, Human
uaucagcaaucuucucuacuuucauuggggagcacuauguccaugugaacgcuacuuaugugaacguaaaaugugucgcuccauauccuucucuguugucaucagaagauaacgcugaug

SEQ ID NO: 19187 - RNA, 64 nt, Human
aaaaagggugauauucaaggugaaaaguaauaagagaagcgcauaaugaauaaugaccuuauuu

SEQ ID NO: 19188 - RNA, 60 nt, Human
uccagaaccgugagaaguaaauuucuguuuauuuaaacagucaaguaaaaucaagcuggg

SEQ ID NO: 19189 - RNA, 78 nt, Human; identical to SEQ ID NO: 12410

SEQ ID NO: 19190 - RNA, 81 nt, Human; identical to SEQ ID NO: 18064

SEQ ID NO: 19191 - RNA, 67 nt, Human
gacgaaccuuggccgcaguccuugcgaacuguucgcaaaacagugcgggcugcggugggucagcguc

SEQ ID NO: 19192 - RNA, 61 nt, Human
gcaaugccguagcuauggaauagaagcauuuguugaacucuuuuugugagccaggcccugu

SEQ ID NO: 19193 - RNA, 94 nt, Human
uggagggucucuaguuaauuggcauuccggugcuuaaggccacuuuuggguagagguuuggcaaggauggaguguccagaccuaugauccucua

SEQ ID NO: 19194 - RNA, 66 nt, Human
cucccugauauaagcugcuuuaacccugaugagcugauaaguggcagggcagugaaagaaggggag

SEQ ID NO: 19195 - RNA, 74 nt, Human
cugcauuuuaagauuuucugaccuggauuuaaaagauaugagucuuauuaaucccagcagcagucuuaaagcag

SEQ ID NO: 19196 - RNA, 73 nt, Human
guuuugaauguaaagaaaaauuguggaaaugcugucagcagcuauucacagaccaaaccagacauccauagac

SEQ ID NO: 19197 - RNA, 62 nt, Human
ugcugaugaaauuuaucaccagacagcuucuauuuaaaagcaacuggcugugacauugagca

SEQ ID NO: 19198 - RNA, 105 nt, Human
gcucugucacccaggcugagugcaggggcaugaucauggcucacugaacuccaccucaugggucagcgaucuccugacucaagcucaaguacuggauuacagggc

SEQ ID NO: 19199 - RNA, 67 nt, Human
gccugucaguggcccucccuggugcacuguccccgaaaccccugcuugggaagggaagcugucgggu

SEQ ID NO: 19200 - RNA, 75 nt, Human
gggacgguugggggcugggagcccugggcguguaguguaacuggaaucuuuugccucucccagccaccuccuccc

SEQ ID NO: 19201 - RNA, 60 nt, Human
ccugggugacucugauggcaagcaugagacugugaaccaggaagagaagaguggcccagg

SEQ ID NO: 19202 - RNA, 63 nt, Human
ggccggcccgggaaauaucuucuuaggguaagggaaauaugcccuaugagagggggggcggcc

SEQ ID NO: 19203 - RNA, 86 nt, Human
ccugucccucaccugcggugguuuaugguggguccuucagugguuacuacuggagcuggauccgccagcccccaggaaggggcugg

SEQ ID NO: 19204 - RNA, 81 nt, Human
uggacgucucaggauucccucuuuuggaacucugguuuaugggcggaagacuccgagggcaggaauguggagagacguuua

SEQ ID NO: 19205 - RNA, 67 nt, Human
guggcccagacccagcugggucccuuccuccuaggcagcugagggaaggacugcugggauuggccac

SEQ ID NO: 19206 - RNA, 60 nt, Human
ugccgacucuaucgaucccuuaccuucaaugagaccuaccaggacaucagugaguuggua

SEQ ID NO: 19207 - RNA, 74 nt, Human
gcgucggacaccugggguggcacacacacgcaaaaugucacgccguguaagacacacccgagggaucaugucgc

SEQ ID NO: 19208 - RNA, 83 nt, Human
ucgcuauggaaugggaacgucuguugagagagcggcagccagcacugauuacuacaagagaggcgauuucauuccugggcuga

SEQ ID NO: 19209 - RNA, 82 nt, Human
aacccgacacaguagcauuugugccaauuucugguuggaauggugacaacaugcuggagccaagugcuaacaugucuggguu

SEQ ID NO: 19210 - RNA, 73 nt, Human
caggaugcuacacaaugggguugggaaaggcccuggggccgaggagaaggguuccaaaccggugugguaccug

SEQ ID NO: 19211 - RNA, 66 nt, Human; identical to SEQ ID NO: 3532

SEQ ID NO: 19212 - RNA, 62 nt, Human
ggugacaacaugcugagagccaagugcuaacauggccuggcuccagggauggcaaagucacc

SEQ ID NO: 19213 - RNA, 69 nt, Human
agaccaugacuaccuucaccuggaacaucaaccacgcccggcugauggugguggaggaacgauguguuu

SEQ ID NO: 19214 - RNA, 72 nt, Human; identical to SEQ ID NO: 5736

SEQ ID NO: 19215 - RNA, 77 nt, Human
cggcccggcccucgcgugccucccaggcuccgcaccccugaugcugcgcgggugcugagcccgcuucggccgggacg

SEQ ID NO: 19216 - RNA, 79 nt, Human; identical to SEQ ID NO: 1810

SEQ ID NO: 19217 - RNA, 98 nt, Human
gccuguccucugggagugaccuuuauuaguccaccccuuggagcuagacauccuguacuuagucacggggaugguggaagagggagaagaggaagggu

SEQ ID NO: 19218 - RNA, 61 nt, Human
ugguaugacacucgccccaaaggaaaacaacuuuucuuacacgaaggacgcgucacugcca

SEQ ID NO: 19219 - RNA, 62 nt, Human; identical to SEQ ID NO: 3062

SEQ ID NO: 19220 - RNA, 83 nt, Human
ggaaugaggucugaacuccacugaauuaaaccacuggcauuugggggcuguguauuauagcagugcaaagaguuccuuuaucc

SEQ ID NO: 19221 - RNA, 94 nt, Human
auuugacacacuuggaggcauggucuaguaauaauaauguaauauguaccuugcugguuaauauaacuaagauuuugccuuuauuggguuaggu

SEQ ID NO: 19222 - RNA, 75 nt, Human
gcgugaccuggcagcuguagcuucugugggacuuccacugcucaggcgucaggcucauauagcugcuggccgcgu

SEQ ID NO: 19223 - RNA, 71 nt, Human; identical to SEQ ID NO: 1050

SEQ ID NO: 19224 - RNA, 65 nt, Human
uuguuuggaggguguuguggucuccaaucccggcuugacggggcugcuaucugccuuccaggcaa

SEQ ID NO: 19225 - RNA, 62 nt, Human
gaccagauguuggcugcuguacuuacucccugagguagggaauguguggugaucgagugguc

SEQ ID NO: 19226 - RNA, 68 nt, Human
uguguggugaucgaguggucuguguuccuauugcugguggggugauagggugggcuaaaaaccaugca

SEQ ID NO: 19227 - RNA, 70 nt, Human
ucccaaccuccccuuccuguggcugccccagagccugugagggaugcugcaguacaggggagcauaggga

SEQ ID NO: 19228 - RNA, 92 nt, Human; identical to SEQ ID NO: 16824

SEQ ID NO: 19229 - RNA, 66 nt, Human
uucauaaauuaaaugucuacaugugccagaauggaaaggaaacaaggggagacaacuuuuauagaa

SEQ ID NO: 19230 - RNA, 61 nt, Human
uaagguuaugucuguguaugucauucacacuuaggcaagcauacacaggcacauggcuuua

SEQ ID NO: 19231 - RNA, 80 nt, Human
aggguacagugugguagucuugaccuaggaauacacccaugaaaacaccuccacaauuaaaauagcacaucuguggcccu

SEQ ID NO: 19232 - RNA, 94 nt, Human
uuucgaguuuuuauagguuggugcaaaagugauugugguuugcauugagaauaauggagaagacgaauauuuggacaacuguauauaaauggaa

SEQ ID NO: 19233 - RNA, 63 nt, Human
cucagugaguucagaauauccuacaccuaaccccccucuuagaugguagcuaugcucagugag

SEQ ID NO: 19234 - RNA, 90 nt, Human
aggaguuggggguauagaaugagguugacccuuuucguguuaaccuguaauuaacucugggagucaaugucuaugguacacuugacuguu

SEQ ID NO: 19235 - RNA, 61 nt, Human
gaacaacucuaguggaaccccacaaauuucauuaaguuacgguuucauuuuauuucuguuc

SEQ ID NO: 19236 - RNA, 87 nt, Human
agaggcuguguggccaaccaggacccaaggugcccuucccagauuccuugggaaggacacagcaguauuggaccgguucuagccucu

SEQ ID NO: 19237 - RNA, 78 nt, Human
gggaacuucuggauacaaguggggccaugcucccuggcccugacuccaggcugggguauccugaacuguauccaaccc

SEQ ID NO: 19238 - RNA, 62 nt, Human
gccaugucuaucggauuagcacucggugccaaauacucaacugaugcuccugguaugauggc

SEQ ID NO: 19239 - RNA, 69 nt, Human
ugccucuggauauuuaaggacagugucaggaccgacucggccaacgcacucuaaauccccagauaggua

SEQ ID NO: 19240 - RNA, 70 nt, Human
uggguccuaaaccagugaaccuuuggcaucguaucuuccaugaauuacugagcuccaaaauugggaucca

SEQ ID NO: 19241 - RNA, 72 nt, Human
ugacuccugcugccaucucaaggacauuuuccuaaggacaguccugguguccugauggagugaaagggauca

SEQ ID NO: 19242 - RNA, 100 nt, Human
uggcucagaucugcugagguucuggaguggcacaggaacaggaggagcaaaugacacugggucuuugugcugaggcaggacacagcggcuuuccgaaaca

SEQ ID NO: 19243 - RNA, 66 nt, Human
ggguucuucaaagguucuuuuauuguggaacuuucuuaaguaggaggaaaggauuguuaagggccc

SEQ ID NO: 19244 - RNA, 73 nt, Human
cgcugcucacauccugcacggagacugacccgcccugcguccuagggcaggcuccaggcagggucugcaugug

SEQ ID NO: 19245 - RNA, 110 nt, Human
cucuuugagaugacugguauugaauggagcagucuuugaaaggcaccaacccuuccuaacugaugguggucucuugaaagaggcucuuccaaauuugucuucugaaagug

SEQ ID NO: 19246 - RNA, 60 nt, Human
agccucccuaguaguugggauuacaggcaugcgcuaccaagcccagcuaauuuuuguguu

SEQ ID NO: 19247 - RNA, 80 nt, Human; identical to SEQ ID NO: 10264

SEQ ID NO: 19248 - RNA, 63 nt, Human
ggaaaccccacguguccuuuccuaaccaggaagcccguccucuaaggagggggcauggguccc

SEQ ID NO: 19249 - RNA, 104 nt, Human
ucccuguccagccuaagcgugcuucuguguccagcuuuaaggccucugcgugaggaaggccacagacucccagcugucagcacgcuggcaugaugagacuugga

SEQ ID NO: 19250 - RNA, 70 nt, Human
acaggaaggacgggcguggucugcaggaggaucuccaggccccugcagcccucccuacaguccucucugu

SEQ ID NO: 19251 - RNA, 79 nt, Human; identical to SEQ ID NO: 10416

SEQ ID NO: 19252 - RNA, 64 nt, Human
cucuuuggaaaauauuccugauuccagcccagggcccaggguggggcagcaggagcuaacggag

SEQ ID NO: 19253 - RNA, 127 nt, Human
ggugguuuguuucaccuaucaacccgucaucuagguuuuaagccccgcaugcauuagguauuuguccuaaugugcugcuucccuuuucccccaagacccugacaggccccugggugugauguucccc

SEQ ID NO: 19254 - RNA, 68 nt, Human
guuccuguguuaguuugcugaggaugaugguuuccagcuucauccaugucccugcaaaggacaggaac

SEQ ID NO: 19255 - RNA, 78 nt, Human
cugggauauggaucgcuggcuaaguuaaugucauguaacucuguacugaugccaaaguuagccacaucuuacuuccag

SEQ ID NO: 19256 - RNA, 69 nt, Human
uuucuguuuucaaaaauuauuaaaucuaaaaauuacuucugauuuuaaaaggauucucugaaacagaag

SEQ ID NO: 19257 - RNA, 78 nt, Human
gagacuaugacgaaucacuuuacagcauccaaggucaucaacagagaauucuaaaugucgguagcguucaucaguuuc

SEQ ID NO: 19258 - RNA, 66 nt, Human; identical to SEQ ID NO: 16024

SEQ ID NO: 19259 - RNA, 82 nt, Human
cccuuggaucaugacaaauaagucucacacagugccguaauacuuguggauucuuuuguaaucuuuguaaucuuaauaaggg

SEQ ID NO: 19260 - RNA, 75 nt, Human
caggaggcagaaaguuccagaaaccaaggagccaaccuguggauuaaaggguauugugacucacauguccuccug

SEQ ID NO: 19261 - RNA, 63 nt, Human
uggguugaagaaucuguuuuguucuuuugguaguuuuauuaaaacaugaccuauucuuacuca

SEQ ID NO: 19262 - RNA, 89 nt, Human; identical to SEQ ID NO: 14669

SEQ ID NO: 19263 - RNA, 69 nt, Human
uguuaaguuguauaaaaguaggugauucuguauuuaaagaaaauauuacuguuacauauacugcuugca

SEQ ID NO: 19264 - RNA, 87 nt, Human
gagaaguuaagccucgaaugaaugagcuggaagcuuuuaauauguugaaaguuguacugguucccuguauagagacuuugauuccuc

SEQ ID NO: 19265 - RNA, 73 nt, Human
gguggcccccugcgcaaagaccuaggcccuggugucgggcuggcaggccugguaggcggaggcgggcaccacc

SEQ ID NO: 19266 - RNA, 76 nt, Human
auuggaagcugugcaguauaaaauucaaguuguugcuggagcaaauuacuacauuaagguacgagcaggugauaau

SEQ ID NO: 19267 - RNA, 117 nt, Human
uauaugcacuugaaaguauucaaaagucuucccggacaaaaugaggacuugguacuuacuggauaccagguugacaaaaacaaggaugacgagcugacgggcuuuuagcagcaugua

SEQ ID NO: 19268 - RNA, 82 nt, Human; identical to SEQ ID NO: 8738

SEQ ID NO: 19269 - RNA, 74 nt, Human
gucuuuuguaaaucaaguaagaauccauuaaagaaauuaauuuuaaaugugcauuaccugguuacauaaaggac

SEQ ID NO: 19270 - RNA, 104 nt, Human
ugcgguggggaugggggaguugggggcccucacuugguccuucucuguuguuuuuuuccaggacaaagccaaaggccccuuguuagcuggccaucccugcccca

SEQ ID NO: 19271 - RNA, 60 nt, Human
aggagucaagaaacuuuucuuuugagcuauugacagcuuuuaacaaguuauuauacuccu

SEQ ID NO: 19272 - RNA, 69 nt, Human
cgaaauacuggauuaugauaaggguuuaaggauaugguaaaaaaaaaucccaggaccacccauguuucg

SEQ ID NO: 19273 - RNA, 90 nt, Human
augguuuaacuuuguuguuuaacuauccucagcauccuuuccaucaagaauggaggugcuuugauuaaugguuaaaacuuguuuuacuau

SEQ ID NO: 19274 - RNA, 85 nt, Human
ccaggugaauggcugguuagaaaguucuuuggcuccuuaccagacucuugggccagugggcauucugugccuguggugaccgugg

SEQ ID NO: 19275 - RNA, 112 nt, Human
caggcgcgcggggccgucggggcugagcggcggugugucgggcggcggcggggggcggcccccgggaccucgcaugcacgaagccgccgggcccggggcgcccucgcgcuug

SEQ ID NO: 19276 - RNA, 70 nt, Human
ccgggcccgggcgcgccgaaaccagggccaccgaaaggcggcgggaaggaggcgcgcggaccgggcgcgg

SEQ ID NO: 19277 - RNA, 89 nt, Human
gucgcagcagcucagacaccaggccacccgcgggggcgcuguauggcgugggcgcgccggguucgguguaauagaacgcaggcggcggc

SEQ ID NO: 19278 - RNA, 64 nt, Human
aaagacucguuuugucuucucuuccccugaaguaauuuaaacucccaaagcagcacgaguuuuu

SEQ ID NO: 19279 - RNA, 86 nt, Human
uuaacauuuugagauauuuuauuucugugauaaggaaaucucacauaaaagucuuuaucauuucauuaauucacaaaaaguguuaa

SEQ ID NO: 19280 - RNA, 72 nt, Human
auugaaauacuauuauuacuauauauuaaauuggaacaaauuugagaugcaguaauauaugggcuuuuuaau

SEQ ID NO: 19281 - RNA, 64 nt, Human
uaucuccuguucucccccccgugucgcaauucgcguguuacauaggucggcuugagcacugaua

SEQ ID NO: 19282 - RNA, 105 nt, Human
cauugucuccuucucagaagacuccguuucuggggaaacaucacuuuuucaauaacaggaagugucuccgcagcuuuuacuauuuuugacuggauaacuucaaug

SEQ ID NO: 19283 - RNA, 69 nt, Human
gugaaccuuuucaaauaaccccucccuucuguuuuuauuuuggaaggucuaaaguuugugaggguucau

SEQ ID NO: 19284 - RNA, 63 nt, Human
cuagagcgguccuuggggagacgcgggucccaguccugcggcuccuacuggggagugcgcugg

SEQ ID NO: 19285 - RNA, 60 nt, Human
gcuggagauaaggagugggcccuggaagaugcucauucaggcccugcucaagauuccagu

SEQ ID NO: 19286 - RNA, 131 nt, Human
ugcacaccaggaacccaagucuuucaacggauccuugaagaauguggcuguagaugaacugagcaggcagggcugcaccgucacagugucugauuuguaugcccaugaacuuggagccgagggccaaggca

SEQ ID NO: 19287 - RNA, 69 nt, Human; identical to SEQ ID NO: 3815

SEQ ID NO: 19288 - RNA, 61 nt, Human
uccaugucuccaagugcucugcuauaccugccaccagcagcugccaccuccagacuuugga

SEQ ID NO: 19289 - RNA, 61 nt, Human
uaggaggugaugaggcugccacaucuaagagaagccucacagagguagcaucaagccccua

SEQ ID NO: 19290 - RNA, 69 nt, Human
ucccuuucuuugugaagguuacauuccauuggggggaaguaauaaaacauaaacuguguuagauaggga

SEQ ID NO: 19291 - RNA, 75 nt, Human
uuuacugagcgucuacuuugggcccgacacuuuucuagguacaggagauauggcagggaacaaaugccaagugaa

SEQ ID NO: 19292 - RNA, 69 nt, Human
uuuuuuuuuuuuuuuuugaaaagggauaaucuuuuauuucauuccacugggcaaaaaacaaaacaaaaa

SEQ ID NO: 19293 - RNA, 95 nt, Human
gcagacugccccagugucuccaucgaggcugggggacagcugcugcccccacuggagacagcggacuguccuucaguagaagacagguggucugc

SEQ ID NO: 19294 - RNA, 66 nt, Human
gucuggguguagugucauuuuaaguauuuuggggugggaugagggagagagagcagcuccacagac

SEQ ID NO: 19295 - RNA, 87 nt, Human
guggcuuuuccagaaccagcauguucccuuuccucaguaaacgaggaauccauaaaacaaguuuuuguugguuacuaccagagucau

SEQ ID NO: 19296 - RNA, 80 nt, Human
caggugcugcugagcgagcccgaggaggcggcggcucuguaucggggccuuagccgccagcccgcgcugagcgccgccug

SEQ ID NO: 19297 - RNA, 125 nt, Human
ggcacuuuuguauacauuacuuauuucauuugagaaaaaaauauuuaccauaggaauuucaccaugaauguucuaucauauguuuaaccuugauuuggaaucugauauauguuuuuuagaaggcc

SEQ ID NO: 19298 - RNA, 74 nt, Human
ucauucacuuuuauuauaggauccccacaaauucaguagaaaaggggugggauacagaaaaaaaaagugagaga

SEQ ID NO: 19299 - RNA, 79 nt, Human
agugggagcaggagcuuggaggugagcacaggaagccccacuugaggcuuuuacgcagccucuagucucuguuucuucu

SEQ ID NO: 19300 - RNA, 81 nt, Human; identical to SEQ ID NO: 1413

SEQ ID NO: 19301 - RNA, 65 nt, Human; identical to SEQ ID NO: 1415

SEQ ID NO: 19302 - RNA, 77 nt, Human
agccguacauucccacgcaguuucaucucagggaggccaguuggcggccgguccuggauuuguuuuaagguacggcu

SEQ ID NO: 19303 - RNA, 62 nt, Human
ggaggggucccugcagaagcguggcauuguggaacaaugcuguaccagcaucugcucccucu

SEQ ID NO: 19304 - RNA, 66 nt, Human
cagaaaaugggcgggguggugugggugaugggacucauuguagaaaggaagccuugcucauuucug

SEQ ID NO: 19305 - RNA, 68 nt, Human
gaaccagucagguuuacuuacgcuggauguuugagugugaagaaauaccggcccaaguacugcgguuc

SEQ ID NO: 19306 - RNA, 83 nt, Human
cugcuuuugcacagaucugggaguaucggauguagcugaguccagccugucuccaguaggccaccaugcuguagcgaaagcgg

SEQ ID NO: 19307 - RNA, 61 nt, Human
gcucgucgggccgaaucgccaagacgccggcaaugucggcucgugccgauucggcacgagc

SEQ ID NO: 19308 - RNA, 90 nt, Human
guuuuacagaggugacaggauuuugggguguuguuuuuuucuguucuucuuccuugacugaggcaauacauuuuguguuacuuguauaau

SEQ ID NO: 19309 - RNA, 71 nt, Human
gacagggucuggguccagcgguaauugggcaugucugcccguugccuagguugggcucaguuuuccuuguc

SEQ ID NO: 19310 - RNA, 91 nt, Human
ggaaaaaacaggggcuaguugaauuuagccuuggaaaaauccaucuccggauguugauccaugaacuucuucagaaucuccuguuucuucu

SEQ ID NO: 19311 - RNA, 66 nt, Human
guccucaaugagccacgagcucuccuccaccuucacuucauuguagagcuccccaucaaugaucgc

SEQ ID NO: 19312 - RNA, 72 nt, Human
ggaacagggagggccugugucuggccaggcugagguuccagaucuguugccaucauggccccuucaggugcc

SEQ ID NO: 19313 - RNA, 89 nt, Human
gcucugguugcuucgaauacuuuggcuugaucuuucugaacucaucacaucucgaggaucaauucauauguugucaaaggcuuaagggc

SEQ ID NO: 19314 - RNA, 71 nt, Human
gcuguaaaacacucuacacaauuucacaagacgcauugcaggggaaaaagugacugagauggaucaacagu

SEQ ID NO: 19315 - RNA, 65 nt, Human
gggccuggggaauuggcacaccagcugguacuccucuaccagcugcccauaccaaccccagggcc

SEQ ID NO: 19316 - RNA, 95 nt, Human
gaagcaaaguguuucaacaacugagagguaagaaaaucuuguuauuugcauguauuuuuauauaaucaaucagguugcagauucuaaaauugcuc

SEQ ID NO: 19317 - RNA, 125 nt, Human
gcagcgauccaucagcaacaccaaacuugaaauugauuuauguggaaaaacuuggcuugucugccaucuaacaagcccuguugaguaaaauaagcaagcuuaaauuugauuaguugugugucugc

SEQ ID NO: 19318 - RNA, 67 nt, Human
gggagugguaggcugccuuuucuccugguauuuguacacaaaagcuggggagagcuuuuccacugcc

SEQ ID NO: 19319 - RNA, 78 nt, Human
uuugauuaguugugugucugccugaaaccauuuaguagagcacuuuaauucugcaugguuuuuacaaaacucauuaaa

SEQ ID NO: 19320 - RNA, 76 nt, Human
gaggguacuguagaaucuuuauuaucucaacaaucuaaaaaaugauguuuauuuccuuaguuagauagugccacuu

SEQ ID NO: 19321 - RNA, 64 nt, Human
ucugucucaacuggucucugcaagccucugacugaauguauccgugcuggcccuaugagacgga

SEQ ID NO: 19322 - RNA, 66 nt, Human
uucccccgaacuugaucaauguauacaaugcuuacacauucauauaugugcaagauucaacaggaa

SEQ ID NO: 19323 - RNA, 64 nt, Human; identical to SEQ ID NO: 8532

SEQ ID NO: 19324 - RNA, 64 nt, Human
ucguuuuggaucacuuuggacccagcggugauggugaacuugaagugcuucccauucugaacga

SEQ ID NO: 19325 - RNA, 73 nt, Human
ucuuccggcagaccgauugccuucaugaaggcuucaaaguuuuccuggcucugcaguugguacuugccggaga

SEQ ID NO: 19326 - RNA, 74 nt, Human; identical to SEQ ID NO: 1641

SEQ ID NO: 19327 - RNA, 67 nt, Human
ggggggcaccaaugacaagggaauugggauggggaugacagucccuauuuccuuugcuguguucccc

SEQ ID NO: 19328 - RNA, 67 nt, Human
ggccgauccugguuuauuugguuuucuucucagccaagggaggggacccgcagggcaggcgccggcc

SEQ ID NO: 19329 - RNA, 79 nt, Human; identical to SEQ ID NO: 2369

SEQ ID NO: 19330 - RNA, 106 nt, Human
gauuuguagauguugacccagaguccucuguccccuccugaagaggauuuucuuacugguuucuacugaaggggagguaggggaggcuugaccaacggaacaaguu

SEQ ID NO: 19331 - RNA, 65 nt, Human
ggguaagcuagguggcucagggaguggcagaagggccauuuuucccucugccaaaaagacuuccu

SEQ ID NO: 19332 - RNA, 87 nt, Human; identical to SEQ ID NO: 17671

SEQ ID NO: 19333 - RNA, 73 nt, Human
ggaaggagggcggugucggcaggagccagggguguccucuggcuucccaaagcuagggccguucccuccuucc

SEQ ID NO: 19334 - RNA, 74 nt, Human
ggucccuucuaugugaaaagagaaggugggcugaagccucuaagaucuucuccaguuuucacauaguauggacu

SEQ ID NO: 19335 - RNA, 74 nt, Human
gccucuggcuuuaccauugaaauuuaagaacuagaacgauuucuuaaaguaagugugggucaagguccuaaggc

SEQ ID NO: 19336 - RNA, 81 nt, Human
uguaaaguucagacauaaaaaggggcaguaaagaaucuguaacugcagaaagugcugccugagcacuguaaauacuuuuca

SEQ ID NO: 19337 - RNA, 87 nt, Human
ugccuuuggcuggcuccuugguguggggcaggguaggguuuggcaacagccugggcuucaugcccccucugguggaccucaaaggca

SEQ ID NO: 19338 - RNA, 71 nt, Human; identical to SEQ ID NO: 1764

SEQ ID NO: 19339 - RNA, 93 nt, Human
gcuagagcugccaacagggcuccagggagcuuggcuucuguagaaguucuaaggaagcgguacgaacuccacggcgggugggcgcuaacuagc

SEQ ID NO: 19340 - RNA, 64 nt, Human
ggaccccugcaaguguuggucgggggccucgaccugccugagcugacacgaggggagggggucu

SEQ ID NO: 19341 - RNA, 60 nt, Human
ggcucacaugauucuagacacuugguggaaagugaggggagaaaaacaaucacuugggcc

SEQ ID NO: 19342 - RNA, 103 nt, Human
ccacaauggaagucauuaccucugcagucaauuaagugugcugaguuccuuuccuuaugggggcccagugugcaauggcugcaaacagcagcuuccuuggugg

SEQ ID NO: 19343 - RNA, 118 nt, Human
cccugauaauaggccuuucaaauguauguucaugucucugaccuugcauuaccccaauguaggcuucaaacaggcaugcgaggugccuuuggaaaaccccaaggcacuguggucaggg

SEQ ID NO: 19344 - RNA, 72 nt, Human
cuuggauccucuagagcggccggcuacuacuacuaaauucgcggccgcgucgacgaaacauuuaggaccaag

SEQ ID NO: 19345 - RNA, 61 nt, Human
aguuuaguggcaaguucuuuagccuuugccuuuucgagcuuggcgauacgagccacaaacu

SEQ ID NO: 19346 - RNA, 130 nt, Human; identical to SEQ ID NO: 18146

SEQ ID NO: 19347 - RNA, 74 nt, Human
uguuguguuuaaaaaauaagaaaccucuuuaagcaauagauuugcuguggguuuucuuuuuuaaaaacauaaua

SEQ ID NO: 19348 - RNA, 70 nt, Human; identical to SEQ ID NO: 9460

SEQ ID NO: 19349 - RNA, 65 nt, Human
ggaagccaugaagcagucuucuugccgugaaugggguaaauauggacugcgcauucauggguucc

SEQ ID NO: 19350 - RNA, 76 nt, Human
ucucuacuguaauuaauugggucuauuauuaacucucuguuccaucauagaauguggccaggccuuacaauggaga

SEQ ID NO: 19351 - RNA, 65 nt, Human
cucaaggugccucguuuuuguccuagaaauggaguuucuauaucaaucugcuucauaaccuuggg

SEQ ID NO: 19352 - RNA, 65 nt, Human
gggcucacuguauuuuauaugguugugugggaaaaugcauuacuaguuuauuauggcuugggucc

SEQ ID NO: 19353 - RNA, 91 nt, Human
uguugcccaggcuggucuugaacucuauaguguuugaucauagaaguggagauacuaaccaaaaaucuuuucaaauuaagccuaauaaaca

SEQ ID NO: 19354 - RNA, 71 nt, Human
gguaacaugcaaauaaugugauaaaguuaaagaggacuugucaauagcaaacauuauaaauguaugcuacu

SEQ ID NO: 19355 - RNA, 79 nt, Human
uuugguaguaauuucauuuuacagugguugaauuuacccacccaaggcuuaaugaccacaaaauguuucugcaacuaaa

SEQ ID NO: 19356 - RNA, 66 nt, Human
gccucuguccuuuaucagucgucuuagcagaucugucuuauuuuucagcugauaaacguagagagc

SEQ ID NO: 19357 - RNA, 78 nt, Human
ggagugacuggcaggaucagauuugggcauuugugaaguucucuagcucagguuccauucaaugcaagucacaauucc

SEQ ID NO: 19358 - RNA, 65 nt, Human
ccugcccugaggaugcggcugcgggcccggcuggucacgcgcagugcacauaccuucaguuuggg

SEQ ID NO: 19359 - RNA, 99 nt, Human
ccauugcccacguccucccagcccugcacaaggaccggccccguuuugacuuugccaauuuggcgguggcugccacgcaagaggauccgccuaagaugg

SEQ ID NO: 19360 - RNA, 60 nt, Human
gugcacgagaucacccgcuccaccaucacggagauggcggcggcgcagggccucguggac

SEQ ID NO: 19361 - RNA, 82 nt, Human; identical to SEQ ID NO: 8738

SEQ ID NO: 19362 - RNA, 69 nt, Human
ucuucacagagugccuuuaugaccaguuuggagaauuacgaugguaaggggaagaggcagauaugaaga

SEQ ID NO: 19363 - RNA, 60 nt, Human
ccagccucuccuccagccugagaagcaugccgucgcuggacgggguggacgggaagcugg

SEQ ID NO: 19364 - RNA, 61 nt, Human
uugaucucaucgguaagcgggugccggaucaccacugacauccucuugcggacggaaucga

SEQ ID NO: 19365 - RNA, 72 nt, Human
caguaucugaacacagucauuccuuacgagaagaaagccucuccucccucaguggaagaccugcagaugcug

SEQ ID NO: 19366 - RNA, 70 nt, Human
cucugacacugagguaauugaggagauugaggaaaugaugcagaacuccccagacccugaggaagaagag

SEQ ID NO: 19367 - RNA, 69 nt, Human
gccggaccccagagccugaggugggcagugugccaggucccuugcggccuccucaagcccuguccaggc

SEQ ID NO: 19368 - RNA, 71 nt, Human
gcucagaacuuguucacgaacgugacagagcuuacguuaagcagaggucaccgggcaacuaaguuccaugc

SEQ ID NO: 19369 - RNA, 99 nt, Human
gagacggggaauccucagggccuauuaccaggagaggaaucgagccaugguccuccuuacuccucuucagcuggugaauccuccggaucuccuuuccuc

SEQ ID NO: 19370 - RNA, 64 nt, Human
ggaggccggagcggagccgcgucugacugaggcgggcagcaagcggccccucgcuccucccucc

SEQ ID NO: 19371 - RNA, 62 nt, Human; identical to SEQ ID NO: 5971

SEQ ID NO: 19372 - RNA, 90 nt, Human
cacaaguggcuccauuacgacagggauuagagugacauucaucaaaaucaaguucacacuggucuccgcuguauccuggcaccacaggug

SEQ ID NO: 19373 - RNA, 71 nt, Human
uugugccagccauagucacaugucucgguaucuugcucacaaagugcaccaacauaacuuggaaggcagag

SEQ ID NO: 19374 - RNA, 90 nt, Human
ccagaauguuuugagcuacuucgggauacuugguaaagggggcuauggaaagguucuccaaguacgagaaguaacaggagcaaauacugg

SEQ ID NO: 19375 - RNA, 83 nt, Human
gcggaggcucguaacugucgguucuuuccccuucggucuuaggaugaggugggcgcaccgggcauagugguuggaguuucugu

SEQ ID NO: 19376 - RNA, 87 nt, Human
gguuuagguuaugcugauguugagaaccguguaccauguaaaccagagacaguuaugcgaauugcuagcaucagcaaaagucucacc

SEQ ID NO: 19377 - RNA, 66 nt, Human
uugugggaagcagggaaacuggaucuugauauuccaguacaacauuauguucccgaauucccagaa

SEQ ID NO: 19378 - RNA, 73 nt, Human; identical to SEQ ID NO: 7892

SEQ ID NO: 19379 - RNA, 100 nt, Human
gcagucuccucccuuguggcccagacccagcugggucccuuccuccuaggcagcugagggaaggacugcuggguuggccacgggccugggaaggggaagc

SEQ ID NO: 19380 - RNA, 81 nt, Human
ccauguguucgaguguaauuuagagagcagcguggagaguaucaucucaccgaaggugaaaauggcauuacggacaucagg

SEQ ID NO: 19381 - RNA, 65 nt, Human
gccgcggcguaacggcagccaucuuguuuguuugagugaaucggaaaggaggcgccggcuguggc

SEQ ID NO: 19382 - RNA, 63 nt, Human
ggaaagccaaauaccuucuugcagacuguaaugaagcauucauuaagauaaagauggcuuuuc

SEQ ID NO: 19383 - RNA, 109 nt, Human; identical to SEQ ID NO: 831

SEQ ID NO: 19384 - RNA, 75 nt, Human; identical to SEQ ID NO: 74

SEQ ID NO: 19385 - RNA, 100 nt, Human
ggccaaaagagauccacuguugccccaguugguggaaaagacuuuacagaugcaacaugccaugaaguaccacccuuuggggguggucggcuuacgggcc

SEQ ID NO: 19386 - RNA, 87 nt, Human; identical to SEQ ID NO: 76

SEQ ID NO: 19387 - RNA, 71 nt, Human; identical to SEQ ID NO: 77

SEQ ID NO: 19388 - RNA, 80 nt, Human
gcccuggccucacccccuuaccaauggagggcagggggaaagaccaccuggccauuaaggggaaagggggccuccagggc

SEQ ID NO: 19389 - RNA, 130 nt, Human
ucaagaaguucaccuucggcuuagacugggugcccaagaaacuggauguguccaucgagaugccagaggagcucgacaucucccaguugaggggcacagggcugcagcccggagaggaggagcugccaga

SEQ ID NO: 19390 - RNA, 71 nt, Human; identical to SEQ ID NO: 6999

SEQ ID NO: 19391 - RNA, 60 nt, Human; identical to SEQ ID NO: 894

SEQ ID NO: 19392 - RNA, 62 nt, Human
gggggggggaccccccgggcgccccuggguuuaccaucccugggaggcgggggccccccucc

SEQ ID NO: 19393 - RNA, 62 nt, Human
acugcuggggagucccugccacacucagucccccaccacacugaaucuccccuccucacagu

SEQ ID NO: 19394 - RNA, 87 nt, Human; identical to SEQ ID NO: 76

SEQ ID NO: 19395 - RNA, 73 nt, Human; identical to SEQ ID NO: 75

SEQ ID NO: 19396 - RNA, 71 nt, Human; identical to SEQ ID NO: 77

SEQ ID NO: 19397 - RNA, 89 nt, Human
ucucuaacaaggugcagagcuuagcugauuggugaacagugauugguuuccgcuuuguucacaguggcuaaguucugcaccugaagaga

SEQ ID NO: 19398 - RNA, 88 nt, Human
cccccguuugagggaguccaacuugccggguuguuaaaagaaccuccaggccuuuaagcauucggcuggguuggcccuuaaagggggg

SEQ ID NO: 19399 - RNA, 60 nt, Human
cgcccgacuggccccaucagcccaacaagaccuucgcuuucaucuccaaccagccgggcg

SEQ ID NO: 19400 - RNA, 65 nt, Human
gccgcccgccauccucuggcucucaccccgaaagcaccuggucucagccaagagcaaugggcggc

SEQ ID NO: 19401 - RNA, 70 nt, Human
guaccugugcaucgcggccaacgcgggcggcaacgacuccaugcccgcccaccugcaugugcgcagcuac

SEQ ID NO: 19402 - RNA, 62 nt, Human; identical to SEQ ID NO: 2890

SEQ ID NO: 19403 - RNA, 74 nt, Human; identical to SEQ ID NO: 9607

SEQ ID NO: 19404 - RNA, 72 nt, Human
ccccuggauuuggaaaaaaaaaagcaggguccccccccgggggaauuguuguaaauaaaaacccgccggggg

SEQ ID NO: 19405 - RNA, 100 nt, Human
agguguucucagcauucaucacaguguugcaaaugaaggagaugaaaguaagugacaucccccaguacucccagcuggugcugaaugucugugagacccu

SEQ ID NO: 19406 - RNA, 74 nt, Human
aguauucuuucuagagaguuagguucuguggaugaaauccuuggacccuugacggagauccuggagggagugcu

SEQ ID NO: 19407 - RNA, 86 nt, Human
ggagcugugugagguagacgaggauggugacuccuggcugcagguaacccgcaggcuccccauccuacacaccuccucaccacucu

SEQ ID NO: 19408 - RNA, 84 nt, Human
aguccaccgacucacugcccgcgcacgcgaccgagucuucgcuauugcugaccuacgucugugcugcgguguguccagggggcu

SEQ ID NO: 19409 - RNA, 105 nt, Human
agcaucugcaguacaucgugaccugguauggacucucugcagcuacauccuaccugugguuuaagaaauuccuacgugggacaccuggugugugacagaucagcu

SEQ ID NO: 19410 - RNA, 63 nt, Human
cacugcaccgaccugggagucaccauccugguaaauagaggguucguucccaggaagaaagug

SEQ ID NO: 19411 - RNA, 65 nt, Human
ggcauuaucgagaccuggaagcuauggccagaaucacaggcgcagagcccaucuucauugaugcc

SEQ ID NO: 19412 - RNA, 62 nt, Human
auccacacugcccaaauuuccacgcaccucaaggcgcccagagaucacgcacgcgguacgau

SEQ ID NO: 19413 - RNA, 67 nt, Human
cggggggagccgagauuagagcaucagccugagagaagcggugcuucugguucuccgcuccgccucg

SEQ ID NO: 19414 - RNA, 61 nt, Human
ugccauucgguguucccaacaguuaaucuccuggaagagguugacaggggaggccuuggca

SEQ ID NO: 19415 - RNA, 86 nt, Human
gcggcagccgccggggcgcaaugcgagcggcuggcguaggcuugguggacugucacugccaccucuccgccccggacuuugaccgc

SEQ ID NO: 19416 - RNA, 64 nt, Human
gggcccggcccucccuggaucuccucccuccucccagggguucagauguggugggguagggccc

SEQ ID NO: 19417 - RNA, 115 nt, Human
uagggacccugcagcucuggaguggguggagggagggagcuacgggcaggaggaagaauuuuguagagcugccagcgcucucccagguucacccacccaggcuucaccagcccug

SEQ ID NO: 19418 - RNA, 74 nt, Human
cgccucagccgccucgcacauuuagucuugccgggaguggugugauucccgaccaagauggcggccguggggcg

SEQ ID NO: 19419 - RNA, 94 nt, Human
ggacugcuuggauucuuuacagaaaugggcagugucguuagagaaccuguugaccaacugaaaauuccuccugaagaaaugaaacaaauggacc

SEQ ID NO: 19420 - RNA, 74 nt, Human
ccaccgcugguguaguauucguggaccauguacugaaucauauacacgcacgaugguacaauccgagugguugg

SEQ ID NO: 19421 - RNA, 78 nt, Human
caaggggggugcaugcuucaaaggaaugcugggggugaaaauccuaaacauggguagaauggcagcaugcaggacuug

SEQ ID NO: 19422 - RNA, 72 nt, Human
gcggggguuaggcgcugagacggauuuggcggugagaucgcuguggccaggcugcagcugaaugggccucgu

SEQ ID NO: 19423 - RNA, 86 nt, Human
cgucaugucuaagucagagucuccuaaagagcccgaacagcugaggaagcucuucauuggaggguugagcuuugaaacaacugaug

SEQ ID NO: 19424 - RNA, 65 nt, Human
ucccuucugcuuagagaaagaaauggccuuuagcugguuucauguuuguguuuugacuggaggga

SEQ ID NO: 19425 - RNA, 79 nt, Human; identical to SEQ ID NO: 1810

SEQ ID NO: 19426 - RNA, 79 nt, Human; identical to SEQ ID NO: 1810

SEQ ID NO: 19427 - RNA, 64 nt, Human
guucuuauacaauaauuugggcguacaucaugcagcccuucuugaugauuugcucccagagaac

SEQ ID NO: 19428 - RNA, 66 nt, Human; identical to SEQ ID NO: 5267

SEQ ID NO: 19429 - RNA, 74 nt, Human
cugggugcugcaugggucccuccagcugccaccaccugcaccaggcagucccgaggggucacaggcuagcccag

SEQ ID NO: 19430 - RNA, 115 nt, Human
gcuuugggcccucggcgacuuucccaggcagugcaggcuagcccaguccaggagugugcagccuggcuugggucgagcucugucacaucuggauaagcaacugggggcugagagu

SEQ ID NO: 19431 - RNA, 89 nt, Human
ugaggucacggccgucuuugcugcugaugcuauggcccgccuguccgggacggugggcguggcggcagugacagcaggcccuggccuca

SEQ ID NO: 19432 - RNA, 86 nt, Human
gacucaaugugcaacugacaucugcuagugaugaucugguaauauacaaccuguccaguagccaaacaguugguuuuuauugaguu

SEQ ID NO: 19433 - RNA, 69 nt, Human
gggggguaaacaaauuucuuuccuggucaauagaaaaaaaaaaaggaaacggguuuuugggugcuuccc

SEQ ID NO: 19434 - RNA, 79 nt, Human
ugccccuuccaugaccagccacaucugaaaaggaaagcauucugcucuuuccagaucuacgcugugccuuggcagggca

SEQ ID NO: 19435 - RNA, 60 nt, Human
aaaaauaaaaauaaaaaguugaauugcagaaaagcuaagagguuuuuaguuuuuguuuuu

SEQ ID NO: 19436 - RNA, 75 nt, Human
gccaugagcacaggcggguccacacacaggcggcgaaccuccacucgcuggcagacggcucgcuuuucguauggc

SEQ ID NO: 19437 - RNA, 103 nt, Human
cugagauucuauggucuauuccuauucuagauuggucucucagauuccaaauuccacuucugaggcucuaagcccagccuaggaucugacacuggagucucag

SEQ ID NO: 19438 - RNA, 90 nt, Human
cagggauuuuuaaguccguuuagagagcaaaccauauugugccucuucaucuugacccaggcucuuauagauagguccuaaacauugcug

SEQ ID NO: 19439 - RNA, 86 nt, Human
uaccuuuuuccugucagaaagguuuuccucugugcuacccuuaacuuagggaugaacagacuauaacuaggaaaggaggaaaggua

SEQ ID NO: 19440 - RNA, 75 nt, Human
uucaguuaaaaaaaagaaaaaagaaaaugggcaagagaaagguuuuucaaauuucuuuuuuuuuauuuaauugag

SEQ ID NO: 19441 - RNA, 62 nt, Human
gaggacaacaagugaccagggcugcccuccacccucacccuccacccuuugcugcugaccuc

SEQ ID NO: 19442 - RNA, 94 nt, Human
guaggcuugaugacagagccuggacaagaacagcgaccaggagaucgaccucaaggaguacucgguguuccugaccaugcugugcauggccuac

SEQ ID NO: 19443 - RNA, 71 nt, Human; identical to SEQ ID NO: 8959

SEQ ID NO: 19444 - RNA, 90 nt, Human; identical to SEQ ID NO: 1501

SEQ ID NO: 19445 - RNA, 82 nt, Human
uuguggagagcgagggaaggaguuaaugaaacuguauugcacaaugcucugaucaauccuucuuuuucucuuuugcccacaa

SEQ ID NO: 19446 - RNA, 80 nt, Human; identical to SEQ ID NO: 367

SEQ ID NO: 19447 - RNA, 88 nt, Human
gcuggguacagcccugccagcccaucccugagcagggcacccccagauggggcagagcaggguauggcugggcagggcaaggcugggc

SEQ ID NO: 19448 - RNA, 63 nt, Human
aagucuagaagaugaaauugugggaagacuucuaaaaauuuuguuuguuaucuuuguugacuu

SEQ ID NO: 19449 - RNA, 62 nt, Human
uucuggauaugacugguaaaaacuggauauuaauuucuacuacuacucccaaaagucuagaa

SEQ ID NO: 19450 - RNA, 73 nt, Human
auugugcgaaacgcuucgccagacaugcagggccuaccuuguuaguacgggucuagaagccaguugcaucaau

SEQ ID NO: 19451 - RNA, 75 nt, Human
gauguggguuugugcauccuggacugaagagugaguugcauccuucgacucagauagauucauagaauucacguc

SEQ ID NO: 19452 - RNA, 87 nt, Human
agggcugcuaaggaagcaaaaaaggcuaagcaagcaucuaaaaagacugcaauggcugcugcuaaggcaccuacaaaggcagcaccu

SEQ ID NO: 19453 - RNA, 65 nt, Human
gacacguaggcgcuacgcaggaccgacgggaagguuuuccaguuucuuaaugcgaaaugcgaguc

SEQ ID NO: 19454 - RNA, 68 nt, Human
cuuucggaugugaaucauaaaucuaccacuguggcuagaacagccuauauguacauggauucugaaag

SEQ ID NO: 19455 - RNA, 70 nt, Human
ggaaaaggaugacaaugugcuuuuauuuuuuuucuuguuaaaaaaaaacaacauugguaaaucguuuucc

SEQ ID NO: 19456 - RNA, 65 nt, Human
cucucccuugcaauuguucgccccucugggccaaaccaaagggacgcugcucuguacagguagag

SEQ ID NO: 19457 - RNA, 116 nt, Human
gccauaaguggaauucuucauugagucguugacuucucgacggaaugcugacagguucugggugaaccugucucuguuuuucguaagaagauuucgcucgaugccuuccaucaggu

SEQ ID NO: 19458 - RNA, 68 nt, Human
cagggccucucugcagcugccucaucuccauuucuuucuuucuggcuuggggcugcacuuuggcucug

SEQ ID NO: 19459 - RNA, 76 nt, Human
gagagcaggagcaaagccuuucugaaggguugccuggcacuguggguuucaggcagggccucucugcagcugccuc

SEQ ID NO: 19460 - RNA, 66 nt, Human
guugguuccgcaggacccacggucacaguuacugucucugucauacccaggugcuguggcacuaac

SEQ ID NO: 19461 - RNA, 63 nt, Human
aucaagucagagagacaaaauauuuuucagaggguaacuucagaacaaucucucuuccuuggu

SEQ ID NO: 19462 - RNA, 60 nt, Human
gcagucaacacugagacagguucccccagagaaaaaccuucugcuucagugggccccugc

SEQ ID NO: 19463 - RNA, 74 nt, Human
gcucaccaacuauaaguaggaauacuggcugaucuugguaggacucagcggguauccaguguaaauuguugagc

SEQ ID NO: 19464 - RNA, 67 nt, Human
auuugguauucaguuggauuuggauauauuaggauuaccucucagucacagauucacuaguucagau

SEQ ID NO: 19465 - RNA, 105 nt, Human
gucgaguuauaccauuuuuccagaugcguauuaauacugcuuaagaaguuauauaggaauuucugcgacaagucauaacauuuacggggaugguaagaacucugc

SEQ ID NO: 19466 - RNA, 61 nt, Human
ucucagaaaacaguuaagaagucaaggcauuugaucuuuccccuuuaauuugaauuugaga

SEQ ID NO: 19467 - RNA, 72 nt, Human
gcuuaucucuuuugguuccuuguuggaaaguugauuuugaaggcauccagcuugggaacccgggacaauagc

SEQ ID NO: 19468 - RNA, 79 nt, Human
gacuuuauggucccucagaaucacagucacuggaugugucaacgcaggugacacagauacacucaggacucaaaaaauc

SEQ ID NO: 19469 - RNA, 75 nt, Human; identical to SEQ ID NO: 1049

SEQ ID NO: 19470 - RNA, 71 nt, Human; identical to SEQ ID NO: 1050

SEQ ID NO: 19471 - RNA, 95 nt, Human
agaauauucuacaccuuggaaaagaaaaucagcaguaacauucucacugaauauuguaaauuacauuuuucuucauaaaagguacauacuauucu

SEQ ID NO: 19472 - RNA, 62 nt, Human
auaaaagguacauacuauucugcacuuuuccaccaaaagcagugguguguuaugcuuguuau

SEQ ID NO: 19473 - RNA, 83 nt, Human
gaggccagcgccccguggccaggcagcagcgugugcaugucgccggcugugccacgcguggcugcggaagcguggauggccuc

SEQ ID NO: 19474 - RNA, 65 nt, Human
gcaccgggugcuccugcucgaggccacugugacguucaugcaggcccugugggagcccacggugu

SEQ ID NO: 19475 - RNA, 70 nt, Human
cugagccuguggagagauucuggucacuuggagcagcuacacugcacgugccucuuuacucagcgcucag

SEQ ID NO: 19476 - RNA, 84 nt, Human
uagccacucugcucuacgugguccaugcgguguucucuuuaaucagauggaagucuucauaaagccgcaguagaacuugagcug

SEQ ID NO: 19477 - RNA, 65 nt, Human
gcggggggagcagcagccaaguccgcgggaaaccgagcugcucgggccugcccugcaccccccgc

SEQ ID NO: 19478 - RNA, 65 nt, Human
uuuuuuuuuuugagggucgcaauuuuauuaagaaaacaaaaauucaaccuauacaaaaaggaaaa

SEQ ID NO: 19479 - RNA, 78 nt, Human
uccgcccgcggcugccggugcgagcggggcccggcuccccuccucccccgcccgccgccgccgcugugauugggugga

SEQ ID NO: 19480 - RNA, 60 nt, Human
ggguggaucacaaggucaggaguucaagaccagccuggccaacauagugaaaccccaccu

SEQ ID NO: 19481 - RNA, 76 nt, Human
ucgcuugaacccaggaggcagagguuguaguaagccgagaucacgccacugcacuccagccugggcaacagaguga

SEQ ID NO: 19482 - RNA, 66 nt, Human
guuugaucacugaauuuggcaguuauuauuaccuagguacccccgcuguuacacagguguuuagau

SEQ ID NO: 19483 - RNA, 67 nt, Human; identical to SEQ ID NO: 10237

SEQ ID NO: 19484 - RNA, 88 nt, Human
ggcacccucggugcugccuccucugaggcuggcaguuccuuccuggauaugcaaggucaagagcggagggggaagcagagagagugcc

SEQ ID NO: 19485 - RNA, 87 nt, Human
gcggaguccaucccggauggccugcagggugugucgcuucucgcugagccaguggccgcccuccaggcauccuggugggaccuccgc

SEQ ID NO: 19486 - RNA, 70 nt, Human
uggugcuuggggcagggucugaugggggcuacaggcaggugcuccccgguccccaccccuacagcugccg

SEQ ID NO: 19487 - RNA, 90 nt, Human
auguauaaauguaaggaguauauauuuugaauacuaugaucaccccagaaugaucauucaauaagaauguaucuaauaucauuuguacau

SEQ ID NO: 19488 - RNA, 91 nt, Human
gagggaaaguaggucagauuuuccuaucacaucuuuuuacuuuuaaaguaaaaauggauacacaugaaauccgacucuucuuaaauuccuc

SEQ ID NO: 19489 - RNA, 64 nt, Human
gguugcuucaaaaaagagugaauggcauuuucugcuuauuaugucaaaagcugaagcucuuacc

SEQ ID NO: 19490 - RNA, 70 nt, Human
guauauaaaacauacccacaugagauucuuacuuuaaaaugcagauuuuaagggguaugauguugaauac

SEQ ID NO: 19491 - RNA, 65 nt, Human
guguguagugguugugcagagccucaugcaucacggagcaugagaagacauuccccuccugccac

SEQ ID NO: 19492 - RNA, 66 nt, Human
accaaugccagaacuuguaucaacuugaggguaacaagcgaauaacauguagaaauggacaauggu

SEQ ID NO: 19493 - RNA, 72 nt, Human; identical to SEQ ID NO: 225

SEQ ID NO: 19494 - RNA, 62 nt, Human; identical to SEQ ID NO: 2027

SEQ ID NO: 19495 - RNA, 118 nt, Human
agcaauuaugucuuuauugguuauauaaauuuacagucuuugagaagcuguguaaauauugccaguuaauauaguuucacuuuuuauuugcauaacaauaauaacaauauuaaaagcu

SEQ ID NO: 19496 - RNA, 85 nt, Human
gacuacauguucauuuuaaagguuaaauuaugaucaguacaaacauacguaacucaucuaauuucauuuuaaaugauauuugguu

SEQ ID NO: 19497 - RNA, 87 nt, Human
uuggaccuaaguguaacuccuucaugcacuaaacuggacagagccaugcugucuagucuugaaguccucauuuacacagagguucag

SEQ ID NO: 19498 - RNA, 86 nt, Human
gagaauugcuugaacccgggagguggaguuugcagugagccaagauugcgccacugcacuccagccugggcgacagagcgagacuc

SEQ ID NO: 19499 - RNA, 61 nt, Human
gugguguggcacugggagcugcuccuaaggaagcagggagcaaaucccaccuuuaccccac

SEQ ID NO: 19500 - RNA, 64 nt, Human
aggcagggcauagcgacagugugggaccugcccccagcuucugccacgcuuuaugcccuugccu

SEQ ID NO: 19501 - RNA, 62 nt, Human
gacagugguggggaggaggacgagaaggagucauugucggcguccucguccucauccgcguc

SEQ ID NO: 19502 - RNA, 62 nt, Human; identical to SEQ ID NO: 2890

SEQ ID NO: 19503 - RNA, 62 nt, Human
gguggcaauucggacgaggaggcguuggagucacuuccgcgucaccagcuccugugccugcc

SEQ ID NO: 19504 - RNA, 92 nt, Human
ggcacucgacacaacauuugcgcucaacugucuuguccaccauugguguugcugggcuugugaucuacguugcagguguaggucugggugcc

SEQ ID NO: 19505 - RNA, 60 nt, Human
uggucagagcgccugaguuccacgacaccgucaccgguucggggaaguaguccuugacca

SEQ ID NO: 19506 - RNA, 69 nt, Human
aacgggagaugcaguuuauuuacaccagcagccaugggggcagagggaauacacagcguuuacaaaguu

SEQ ID NO: 19507 - RNA, 60 nt, Human; identical to SEQ ID NO: 2924

SEQ ID NO: 19508 - RNA, 61 nt, Human; identical to SEQ ID NO: 2925

SEQ ID NO: 19509 - RNA, 67 nt, Human
gugugggcacaagaggcagcacucaggacaaucuccagcauggccuggucuccucuccuccucacuc

SEQ ID NO: 19510 - RNA, 69 nt, Human
uccuguacugggaccaacuacaacaucgggacaccuucugauguauauugguaccagcagauuccagga

SEQ ID NO: 19511 - RNA, 63 nt, Human; identical to SEQ ID NO: 6735

SEQ ID NO: 19512 - RNA, 114 nt, Human
cacggcugggcuggucaccaucacgucgggcauccaggacaucggcaccuaccacaccaucuucuugcucaccauccuggcagcccuggcccugcuggugcuuauccugcugug

SEQ ID NO: 19513 - RNA, 63 nt, Human
ccuggggcccacaaggggggggguccaagagcuaaagacccccccaacuauacaggcuuuggg

SEQ ID NO: 19514 - RNA, 68 nt, Human
cuggaacccgccccgucgggggaccccgaggcuccgccuccaggcccccuccacucggccuucuccag

SEQ ID NO: 19515 - RNA, 79 nt, Human
gcccggccgccgagccuuucgggugccccccgggggccagacccccggggcuucaagggcgccucccucggccgagggc

SEQ ID NO: 19516 - RNA, 66 nt, Human
aggcuggacccaucccuguggcuccaaucggaacacucaaaccccagccucagccagucccagccu

SEQ ID NO: 19517 - RNA, 82 nt, Human
agugaauaagaauggauuauuuauguuacagaaaacagcaugggguuucuguaaagagaaaaauuauccugguauauuuacu

SEQ ID NO: 19518 - RNA, 106 nt, Human
gguuaugaggcauuuuuugaaauucauauauccuuacuauaauagugaaucaucaaguguugaauguaagugcaguagaaauuaugaaaucucuugccacagaacc

SEQ ID NO: 19519 - RNA, 117 nt, Human
cgggcuuguaggugucggcuugcuggcccagcaaggccugauaagcaugaagcucuuaucuugguggcuguggucggguguugcuggugcccccagcugaagccaacaagaguucug

SEQ ID NO: 19520 - RNA, 73 nt, Human
accucuagcucgccguuggccgccuccaggacgcgcaccuuguccagguaggaggccaggcggucguugaggu

SEQ ID NO: 19521 - RNA, 91 nt, Human
gcggucaggacgccgccguagccgccggcguagccccccgaggaggacgaggacacaaagcgggcggaggacacggauacgccgcggccgc

SEQ ID NO: 19522 - RNA, 72 nt, Human
gacuccugccccagccccauccucagcuuccaccuaagaaguagugcaggaaaguggugauaagcagauguc

SEQ ID NO: 19523 - RNA, 106 nt, Human
aguugaggguauuaagcgcauacugugugacuccaccgggaaaggacucugggacaccgcaccggguuuccgcgggacuucacaccaugugccuuuugccuuugcu

SEQ ID NO: 19524 - RNA, 62 nt, Human
gcucuguaugcuuucacuguaaugaaucuuacucauggguaagauucauucauaugcugagu

SEQ ID NO: 19525 - RNA, 61 nt, Human; identical to SEQ ID NO: 347

SEQ ID NO: 19526 - RNA, 74 nt, Human; identical to SEQ ID NO: 365

SEQ ID NO: 19527 - RNA, 102 nt, Human; identical to SEQ ID NO: 2172

SEQ ID NO: 19528 - RNA, 77 nt, Human; identical to SEQ ID NO: 3082

SEQ ID NO: 19529 - RNA, 80 nt, Human; identical to SEQ ID NO: 367

SEQ ID NO: 19530 - RNA, 97 nt, Human
aggcaggagaaugguguuaacccaggaggcggagcuugcagugagccgagaucgcgccacugcacuccagccugggagacacagccagacuccgucu

SEQ ID NO: 19531 - RNA, 66 nt, Human
gagacggguggaucacaaggucaggagaucgagacgauccuggcuaacacggugaaacuccgucuc

SEQ ID NO: 19532 - RNA, 79 nt, Human
gucgcugccgcaugugugacaagcugcuuaaugccaaccagccaugagcuuccagauuuaucagacauauugcaccgac

SEQ ID NO: 19533 - RNA, 72 nt, Human; identical to SEQ ID NO: 3662

SEQ ID NO: 19534 - RNA, 102 nt, Human; identical to SEQ ID NO: 2172

SEQ ID NO: 19535 - RNA, 90 nt, Human; identical to SEQ ID NO: 1501

SEQ ID NO: 19536 - RNA, 77 nt, Human; identical to SEQ ID NO: 2332

SEQ ID NO: 19537 - RNA, 84 nt, Human; identical to SEQ ID NO: 286

SEQ ID NO: 19538 - RNA, 89 nt, Human; identical to SEQ ID NO: 288

SEQ ID NO: 19539 - RNA, 91 nt, Human; identical to SEQ ID NO: 15954

SEQ ID NO: 19540 - RNA, 89 nt, Human; identical to SEQ ID NO: 8537

SEQ ID NO: 19541 - RNA, 126 nt, Human
cacauucccauucacuugauuuucuacauguaauuaccuucuuuuguuuaucauuagauuugauggggccaaaguugagauagaauagagggugaugacgguaagagcaagugucccaugaaugug

SEQ ID NO: 19542 - RNA, 96 nt, Human
ccucauaacuggaguagaguuccugguugcuuuucauaagagggagaguuacuuucuuuguaucucugcaagcagagauuucucuuugguuugagg

SEQ ID NO: 19543 - RNA, 64 nt, Human; identical to SEQ ID NO: 287

SEQ ID NO: 19544 - RNA, 79 nt, Human
cucugcaugacuugggcacugacaugguuccugccaucucccuggcuuaugagcaggcugagagugacaucaugaagag

SEQ ID NO: 19545 - RNA, 67 nt, Human
cagaaugucagagcugagucugguguuacugacuaaggaacaaccugacucaggcucuagauggcug

SEQ ID NO: 19546 - RNA, 72 nt, Human
ggcgucugguacucagaugucacgaagcacgccauuggacuaagauggugguuucgcauagugccaagcacc

SEQ ID NO: 19547 - RNA, 78 nt, Human
gugauucagcucugccaggccauuguuucacuuaccugccuccugaaacucugcaagacuugguagaaaaugaaucau

SEQ ID NO: 19548 - RNA, 65 nt, Human
uugacuuguuguuucuucaaaacuuugacugugaccuugaaacugugguucugaaaacaagugaa

SEQ ID NO: 19549 - RNA, 72 nt, Human
gauggaauaguucagaaggaaugguaccaguuccuccuuguaccucugguagaauucggcugugaauccauc

SEQ ID NO: 19550 - RNA, 117 nt, Human
gugucuuuauaguagaaugauuuauauuccuuuggguauauauccaggaaugguauugcugagucaaaugguauuucugguucuagauccuuggggaaucaccauacugucuuccac

SEQ ID NO: 19551 - RNA, 74 nt, Human
agauaggauaguacagaaggaaugguaccaguuccuccuugcaccucugguagaauucggcugugaauccaucu

SEQ ID NO: 19552 - RNA, 68 nt, Human
agucuuugcuacugugaauagugccgcaauaaacauacgugugcaugugucuuuauaguagaaugauu

SEQ ID NO: 19553 - RNA, 66 nt, Human
ccuuuggguauauauccaggaaugguauugcugagucaaaugguauuucugguucuagauccuugg

SEQ ID NO: 19554 - RNA, 70 nt, Human
aagucuuugcuauugugaauagugccgcaauaaacauacgugugcaugugucuuuauaguagaaugauuu

SEQ ID NO: 19555 - RNA, 66 nt, Human; identical to SEQ ID NO: 19553

SEQ ID NO: 19556 - RNA, 67 nt, Human
aaccccagugacagugcagaaaaagaaggguuucauauguggagugugaugcaugucaaugggaguu

SEQ ID NO: 19557 - RNA, 83 nt, Human
ggagagaggguguagagucaugccaguucuuaggugcuccugacaaggagaucugcagcacucugcucacauuccuguuuucc

SEQ ID NO: 19558 - RNA, 81 nt, Human
gcuggaaugccgacauguggccuuuccuuguagaugcuugauuuucucacaacuuggaggcauccucguggcauggcuggc

SEQ ID NO: 19559 - RNA, 70 nt, Human
ggggaggaggugggucgcagaaugggcugacucggagcgaguuuuuaauuuuggcuuuaccugcuucucc

SEQ ID NO: 19560 - RNA, 75 nt, Human
agguaccucaccuaaguggaaucauacaguauuugucuuuuugugacuagcuuauuucacuuagcauuauguccu

SEQ ID NO: 19561 - RNA, 64 nt, Human
uauuuaauggucagcuuuucauguuuaucugccuccuccuccugcagguacugucuaucuagua

SEQ ID NO: 19562 - RNA, 118 nt, Human
uacaaaaacagacaguccacgguggcugcaggcacaugcaggcgggacugggucagacacuccagggcugcacauguuccagcuggccugaguccgacacgucauagcuggcuuugua

SEQ ID NO: 19563 - RNA, 67 nt, Human
uuggccaggauuuucaugaggggccguagcuugagccaccacuguucuuugggaauccugugcucaa

SEQ ID NO: 19564 - RNA, 79 nt, Human
gcaggccggccagcuggcccggcgccucugggaggccucccguaucccccugcucuaggccaagguggccgcagucugc

SEQ ID NO: 19565 - RNA, 64 nt, Human
uacugagcaaggccccagauccuucucucuggaggaagagggaagcccagggguccuguuugua

SEQ ID NO: 19566 - RNA, 67 nt, Human; identical to SEQ ID NO: 12728

SEQ ID NO: 19567 - RNA, 60 nt, Human; identical to SEQ ID NO: 11068

SEQ ID NO: 19568 - RNA, 90 nt, Human; identical to SEQ ID NO: 11069

SEQ ID NO: 19569 - RNA, 68 nt, Human
aggcaaagaaagacuuaagggagcagagggcugucuguugcuaccauuuuuuucaaauucuacugccu

SEQ ID NO: 19570 - RNA, 86 nt, Human
ucuucacccuaaaauauuuugcuauauaucucauaagagcaaagauacugucuuauguagguacaaugcauuuaucaaauugagga

SEQ ID NO: 19571 - RNA, 90 nt, Human
uuuuuccugcuucaggguccaauucaagauuacucuugacauuuauugucaugauauugucuguuuggguaauccuuuauuuugggaaga

SEQ ID NO: 19572 - RNA, 66 nt, Human
aacuggucuuuaaugggggucaccagggauuuguucucuugcuuuaauaccugcuucuggccaguu

SEQ ID NO: 19573 - RNA, 70 nt, Human
uggccuguauguugucugccguagagguauuuguaugucucagaacgguuauacucaaaaacauggguca

SEQ ID NO: 19574 - RNA, 79 nt, Human; identical to SEQ ID NO: 728

SEQ ID NO: 19575 - RNA, 73 nt, Human; identical to SEQ ID NO: 729

SEQ ID NO: 19576 - RNA, 62 nt, Human; identical to SEQ ID NO: 8445

SEQ ID NO: 19577 - RNA, 68 nt, Human
cuggauuugauuucuuuuuaugaaaguuucauaugaauguaacuugauuuuuuacuauuauaaucuag

SEQ ID NO: 19578 - RNA, 60 nt, Human
gggaugugcuguuguugaauucaagauggaagagagcaugaaaaaagcugcggaaguccu

SEQ ID NO: 19579 - RNA, 92 nt, Human
uaauuuaaauuaguggcauauaaagucaucaucuugcuugaacaaacaucuuauuacauugagcaugucuuuuaucccaugaaaugaaauua

SEQ ID NO: 19580 - RNA, 80 nt, Human
gauauauaaaucggggaaaauagaucauuuauugaagacauacuguacagaugaaaaugaucuguugacuccuuuguauc

SEQ ID NO: 19581 - RNA, 69 nt, Human
gcgauagguaaauaacucaauggacaacaauugauaaauuucaacuaugucaagguccuugccaaccgc

SEQ ID NO: 19582 - RNA, 61 nt, Human; identical to SEQ ID NO: 6766

SEQ ID NO: 19583 - RNA, 77 nt, Human
gcccacugugacgaugucaccgaucuggacgucccugaagcagggggacagguguacagacauguuucuuguggcgc

SEQ ID NO: 19584 - RNA, 68 nt, Human
uuuguaaaaaaaaauuccccuuuuuuacucuuaaccuugagagugaagaagagguuuucuuugacaaa

SEQ ID NO: 19585 - RNA, 77 nt, Human; identical to SEQ ID NO: 3082

SEQ ID NO: 19586 - RNA, 68 nt, Human
caugcgcugaaugaugucacggcagucguugaacacacggcggauguucucaguguccacagcgcaug

SEQ ID NO: 19587 - RNA, 63 nt, Human
ccacugcagugcugauccucagaaacucaucucgaaugaguacuuggccccggucacgcgugg

SEQ ID NO: 19588 - RNA, 108 nt, Human
ggaacuuuuguggccuuuuuuccuuuuucuguaggccgccuuaagcuuucuaaauuuggaacaucuaagcaagcugaagggaaaaaggggguuucgcaaaaucacucc

SEQ ID NO: 19589 - RNA, 78 nt, Human
gaaaagcgagcggccggcuagcacgaggugggccugaggauuuagugcccacucgcuagaugguuuucguugcagugc

SEQ ID NO: 19590 - RNA, 70 nt, Human
gcgagucgcgcgagaggguggccgacagcggaggcaaacguugugcgcgcgcacaugagcgcgugcucgu

SEQ ID NO: 19591 - RNA, 73 nt, Human
guucuguuacacaauguuugcacaggcacagugguuucgccacgaaccgguguacacuugucaggggcagagc

SEQ ID NO: 19592 - RNA, 73 nt, Human; identical to SEQ ID NO: 1278

SEQ ID NO: 19593 - RNA, 90 nt, Human; identical to SEQ ID NO: 1280

SEQ ID NO: 19594 - RNA, 70 nt, Human; identical to SEQ ID NO: 1282

SEQ ID NO: 19595 - RNA, 80 nt, Human; identical to SEQ ID NO: 174

SEQ ID NO: 19596 - RNA, 64 nt, Human; identical to SEQ ID NO: 175

SEQ ID NO: 19597 - RNA, 87 nt, Human
ggugaggacauugcgggaggccggcugggagccuuuugugcggccccaggacgcgcaaauucugaccaguccuccaugucucucacc

SEQ ID NO: 19598 - RNA, 67 nt, Human
gugaauguuuaaauaauauuggugacuccucuccucugauuagagccacuguugguauuuugaucac

SEQ ID NO: 19599 - RNA, 91 nt, Human
uggugaagauucugcugagauuuuagacagugauguuuuagaucguccucucaacaucaugauucccaaaauuuuuacaguucuucaagca

SEQ ID NO: 19600 - RNA, 102 nt, Human
caaacugaucaccuggggaugagagcaauggguaacugaagcuuugggcucgggggacaggucagugcccacguuguuguauucccauuuugucucaguuug

SEQ ID NO: 19601 - RNA, 70 nt, Human; identical to SEQ ID NO: 8430

SEQ ID NO: 19602 - RNA, 74 nt, Human
gggcguucuguggcuuucauuaauauaguucuuaguuuuccacuggucuguaucccauucugccuuggacgccu

SEQ ID NO: 19603 - RNA, 97 nt, Human
ggcggggggucuugggggccucucagcucccgcccaugccucccugaugggugggcccaggcggcucucucugaggagaccucacccacuccucgcu

SEQ ID NO: 19604 - RNA, 76 nt, Human
guuugaccacuguaagugccugcacucuguauucuauuaauaaacuaaaauaaagggaagacgcugcuggugaaac

SEQ ID NO: 19605 - RNA, 61 nt, Human; identical to SEQ ID NO: 347

SEQ ID NO: 19606 - RNA, 83 nt, Human
uuuuuuucccccaaaaauuuugggggccccccgcacccacagggggggggcucacccaacacaaauuuugugggggggggaaa

SEQ ID NO: 19607 - RNA, 62 nt, Human
gguggugauaugaucaagguucacacaguuaacaaacuguagugaggauucaacucaucacc

SEQ ID NO: 19608 - RNA, 91 nt, Human
auugggggccauggguagggguuuggggggcggccggugggggaauccccugccuuggccuugccuccccuuccugccacgugccccuagu

SEQ ID NO: 19609 - RNA, 108 nt, Human
gcaccagugaggaagaagacugcguggauucauggggagccucacagcagccacgcagcaggcucuggguggggcugccguuaaggcacguucuuuccuuacuggugc

SEQ ID NO: 19610 - RNA, 62 nt, Human
ucaugguuuaaaugaggaacaaucaguaaaucagauucuguccucuucucugcauaccguga

SEQ ID NO: 19611 - RNA, 69 nt, Human
gggagcagaacagagauugaagacgggugggcacaggaguaagcgccaccaucgaucccggcugcugcc

SEQ ID NO: 19612 - RNA, 68 nt, Human
uggaaaugugauuuucuuaauagcugaguucaugguugcuugaagucaggccuggcuauucauuucca

SEQ ID NO: 19613 - RNA, 61 nt, Human
acuauuuccaagagcaacagcaaaucgaaaaaucuucaugcaaugguuguucuagaaaagu

SEQ ID NO: 19614 - RNA, 128 nt, Human
ccaccagaguaguaauuuuccaaucuauccuuuaaaaguucaaguguauuauugcauuuuuuaaguuguaaaagaaugauguacacauauccuuaaacauaguauauaaaagcaacuacucaaugggg

SEQ ID NO: 19615 - RNA, 88 nt, Human
gagauuacuuacguaaagaaaauuauuugucuuuugauuaauagugcaauuuaaaacuggaagucguuuucuuuaaaaaugcauucuc

SEQ ID NO: 19616 - RNA, 60 nt, Human
guucuguuucugguguuguuuugucaauuaugcugaugccacgggaccauggaacagugc

SEQ ID NO: 19617 - RNA, 69 nt, Human
uagaaaagucuauuacauugguuuaugcuuuaaauauaguuaccaccagaguaguaauuuuccaaucua

SEQ ID NO: 19618 - RNA, 69 nt, Human
caguugaauuauacuauuggcgagguuccaauaucauuuguggaucguguuuauggugaauccaaguug

SEQ ID NO: 19619 - RNA, 77 nt, Human
caugaaagaagccugguuacugauuuguauaaaauguacucuuaaaguauaaaguauaagguaagguaaauuucaug

SEQ ID NO: 19620 - RNA, 73 nt, Human
gugggagcggccgcguuuuuuuuuuuuuuuuuugcaguugcaagauuuaauagagugaaaacagagcucccau

SEQ ID NO: 19621 - RNA, 69 nt, Human; identical to SEQ ID NO: 11308

SEQ ID NO: 19622 - RNA, 87 nt, Human; identical to SEQ ID NO: 11310

SEQ ID NO: 19623 - RNA, 98 nt, Human
ccuagagucuggccucugauucacaaucuucccagccuacgguguuagaggugggguggucaagaagugaagacagaugguccuugacuuacaauagg

SEQ ID NO: 19624 - RNA, 72 nt, Human
ugaggguuuucccgcuugcagauggcuccgauggugaagccagggagggaagcacagugggcagguccuuca

SEQ ID NO: 19625 - RNA, 65 nt, Human
auucgccgagggucagguucagcguaccgcaccguacauugagcgccaugcuuagcucgucgaau

SEQ ID NO: 19626 - RNA, 87 nt, Human
gcuguuucauccucaugcucugaguagggcuguguugcaaaauccucauccacaaacauauccucgauagaaguaagggucagacgc

SEQ ID NO: 19627 - RNA, 83 nt, Human
ggccaugcuuaauacaguuuuauaacaaaauauuucaccuuuucugggcgaauuuguaguaaaaaauguuuaaccaaguagcc

SEQ ID NO: 19628 - RNA, 81 nt, Human
ucucuuuugugagcagugagugccuauuugauuaccuaccugguaaacacacaugccuuaaucugacugcacaugaggagg

SEQ ID NO: 19629 - RNA, 95 nt, Human
ggacgauucugcagaggcauuaagauaacgcuguccagauacauacucucccgugugcaucugggauccuggguccugaggccuuucaggagucc

SEQ ID NO: 19630 - RNA, 60 nt, Human
gcaguugucuauaaucuauccugccaucaggcuaaguauauuuugugauuuagaaacugc

SEQ ID NO: 19631 - RNA, 94 nt, Human
uagcuuaaauaauuaaaauaauggaauuuagugacuuguuaguuuaccuuaaaauuaaaauggaacuuuauuuuguuuaucaguauuuaggcua

SEQ ID NO: 19632 - RNA, 95 nt, Human
gguaaauuuccccaacaguguguaguuagaauuccuucagggugaugccagguucuauuuggaauuuauauacaaccugcuuggguggagaagcc

SEQ ID NO: 19633 - RNA, 82 nt, Human
agcugaggcugccucagagucuucagaggaaggccuuggccuccaaccccacaacucuaagguucugagaaggcagaaugcu

SEQ ID NO: 19634 - RNA, 72 nt, Human
ggaaguguugcugcuggggaugaaagcagcugcuccucugcacgccugcugguuuccuccuuccacgcuucc

SEQ ID NO: 19635 - RNA, 81 nt, Human
gggugaucuaccaaaacaguuugaguuuuaaauuauccagugcagugguuccuagacucacuuugugcauggaggcagccc

SEQ ID NO: 19636 - RNA, 61 nt, Human
ucacuuuggacaccugauucuauaggccaugugcaggcuguguaucugguguguccccuga

SEQ ID NO: 19637 - RNA, 61 nt, Human
gaauagucaagguuuaauuuugcuuuaaucuaauaaagccgaagugggacuuuuauuuuuc

SEQ ID NO: 19638 - RNA, 87 nt, Human
guggggugaagggucauuaagggcacgcaguagccauaaugccacacccuuugugccagccacugcgcuucuggaaaccuaccccac

SEQ ID NO: 19639 - RNA, 64 nt, Human
agaaauucccuggaccagaugcugaaagagaaaagagggguugguaguuggcuauggauuuucu

SEQ ID NO: 19640 - RNA, 73 nt, Human
ggaagaucacucugcucugauuauggaaaagucuucaagggcugcuucaaacucaaacacagagagaaacucu

SEQ ID NO: 19641 - RNA, 90 nt, Human
ggauucagcuuucaguuaaaaaagaagaagaagaaauggcaaagagaaaguuuuuucaaacuucuuucuuuuuuaauuuagauugaguuc

SEQ ID NO: 19642 - RNA, 85 nt, Human
acguaaaugccgcuucgccuucgcgcgcgaauugcaagcucugcauuaaugaaucggccaacgcgcggggagaggcgguuugcgu

SEQ ID NO: 19643 - RNA, 75 nt, Human
ccgcuuccucgcucacugacucgcugcgcucggucguucggcugcggcgagcgguaucagcucacucaaaggcgg

SEQ ID NO: 19644 - RNA, 73 nt, Human
ggguaucuggucucaauaguuuaaguaacauuacaauauaacgcuguuuugacuaauuuuagauugggugucc

SEQ ID NO: 19645 - RNA, 63 nt, Human
gguucuucucuuucuuuaaauguguugccaucaaguagcagcgucaguaggaguuauaauacc

SEQ ID NO: 19646 - RNA, 91 nt, Human
guacgcugugacacaggagagcaagaucacguauuuggaaagagugaugacccaagacugauuaugaaucuccaaguaacacaucaaguac

SEQ ID NO: 19647 - RNA, 94 nt, Human
uguugugaaagugacuauaacccaaacuuuuuuuuuuuuguuaaagaggauugggaagugguauggauuuuuggguuaucuucacuuuacggca

SEQ ID NO: 19648 - RNA, 64 nt, Human
ccuuuauuaguccaccccuuggagcuagacauccuguacuuagucacggggaugguggaagagg

SEQ ID NO: 19649 - RNA, 99 nt, Human; identical to SEQ ID NO: 1699

SEQ ID NO: 19650 - RNA, 62 nt, Human; identical to SEQ ID NO: 3062

SEQ ID NO: 19651 - RNA, 68 nt, Human; identical to SEQ ID NO: 13466

SEQ ID NO: 19652 - RNA, 65 nt, Human
gcauacauggaugaggagacuggcaaccugaaaaaggcugucauucuacagggcucuaaugaugu

SEQ ID NO: 19653 - RNA, 87 nt, Human
gacacacuuggcuuggggcagguguugagguuugauuuuuuuuuuuuuucacccuacaaacaggcccccuacacagcuggauguguu

SEQ ID NO: 19654 - RNA, 62 nt, Human
ugaaggaauaauggaaaauaauggcaauuuauuaaauuguagaaaaugugcuagcugcuuca

SEQ ID NO: 19655 - RNA, 69 nt, Human
gcuguuucucuugucuuuuuacuuagcaaaggaaaacuuuagugaaugcuacuugacaagaagaaaagu

SEQ ID NO: 19656 - RNA, 91 nt, Human
uuuuaauuugcuuauuuaauauauuuguuggccagagaucuauuuuuauaucaaugugccuugcauguauauuaaaaaaaaaaaauuggga

SEQ ID NO: 19657 - RNA, 67 nt, Human
ugagucaaagaaguaagauggugaaaauuaaauuaaguaauauuucauaaucuuaggaauucucuca

SEQ ID NO: 19658 - RNA, 82 nt, Human; identical to SEQ ID NO: 1997

SEQ ID NO: 19659 - RNA, 70 nt, Human
gccugggacgugcccauuuuuacuguaaauuaugauuccguaacugacuuguaguaagcagguuucuggc

SEQ ID NO: 19660 - RNA, 61 nt, Human
gcccuuccaguucacugacaaacauggggcaagugugcccagcugggcuggaaaaccgggc

SEQ ID NO: 19661 - RNA, 62 nt, Human
acugaaaucuuuccagaaaauccaaguccggcguaguacgcgaauuggagaaaaaguucagu

SEQ ID NO: 19662 - RNA, 97 nt, Human
guucaguucgagcgccaagaucgugaagcccaauggcgagaagccggacgaguucgaguccggcaucucccaggcucuucuggagcuggagaugaac

SEQ ID NO: 19663 - RNA, 62 nt, Human; identical to SEQ ID NO: 11219

SEQ ID NO: 19664 - RNA, 69 nt, Human; identical to SEQ ID NO: 12131

SEQ ID NO: 19665 - RNA, 61 nt, Human
cagcguaaggcgggugcgucuucuguacuccucgugucguccagagccucgucguccacug

SEQ ID NO: 19666 - RNA, 83 nt, Human
gugccaccaugaacccaggugaaauaacacaagcauguggcucaucacaaagccuguuugguggucucuucacauggacgcgc

SEQ ID NO: 19667 - RNA, 80 nt, Human
aaguuuaagaagcagccucuugucacagguugacuccuagguagugugccuagugaccaagagggcugcuaagaaagcuu

SEQ ID NO: 19668 - RNA, 62 nt, Human
acagaaaaugauguuacaaacaccagaaaagccacucucuauucuggauguaauaucucugu

SEQ ID NO: 19669 - RNA, 104 nt, Human
gcaccgaggggccaguaccuucuggauaccuccacaugguccgagugcacugaaccaaaccacauguggcaaugggaugauucucugguacuauccuuuggucc

SEQ ID NO: 19670 - RNA, 65 nt, Human
ugguaacuuguucggagaucucgcacgcuuuuaaacgugacaagggcucacgagucgaaauauca

SEQ ID NO: 19671 - RNA, 68 nt, Human
cacuauauugcguaauuccuuucaaauaccguacuuagggaaaacagagcuccagcgugaugacagug

SEQ ID NO: 19672 - RNA, 65 nt, Human
caugcaagcauauuuuucagcaaguacagaaucugugcaacucugcagaaauggcuaagugcaug

SEQ ID NO: 19673 - RNA, 64 nt, Human
ucaugguggaggaggguaaauaugucacucacacugaguagaccaaauuucuucauauccagga

SEQ ID NO: 19674 - RNA, 83 nt, Human
uccaacuuuguggaaugguaaggauuuuuaggguuguuuggccagaacaagagaaauaacugcagaaaacacauaugguugga

SEQ ID NO: 19675 - RNA, 65 nt, Human
gauauaaguucuguucaaggcaagaaguuuccaaucucaaauauuucaugccaacaacuuauguu

SEQ ID NO: 19676 - RNA, 69 nt, Human
uacuaauuuuacauaaacuguuuauguccaaaaauaugcauauaaaacacuuauacagauaaauuagug

SEQ ID NO: 19677 - RNA, 70 nt, Human
guucaacaucauuagagcccuguagaaugacagccuuuuucagguugccagucugcucauccauguaugc

SEQ ID NO: 19678 - RNA, 77 nt, Human; identical to SEQ ID NO: 3082

SEQ ID NO: 19679 - RNA, 80 nt, Human; identical to SEQ ID NO: 367

SEQ ID NO: 19680 - RNA, 105 nt, Human
uucaccaccauggagaaggccuggggcucauuugcaggggggagccaaaagggucaucaucucugcccccucugcugaugcccccauguucgucaugggugugaa

SEQ ID NO: 19681 - RNA, 131 nt, Human; identical to SEQ ID NO: 6294

SEQ ID NO: 19682 - RNA, 61 nt, Human; identical to SEQ ID NO: 776

SEQ ID NO: 19683 - RNA, 96 nt, Human
caugccaagcacgguucagcucccugcggccaagucgaaauguggucuucagcaucaucgagcauuucuggagggagcugcugcugucucagccug

SEQ ID NO: 19684 - RNA, 76 nt, Human
ccccucuccagcauagugagaucaagaaggaggcuucacauuuuaucuucagcuccaucaccauccuggagaaggg

SEQ ID NO: 19685 - RNA, 104 nt, Human
gcuagucauuaacccccaccagcagcacauggaugcauucuauugggugauugacugggaagggaugaucucugucucuagccuggugggacuucuugaaaagc

SEQ ID NO: 19686 - RNA, 96 nt, Human
cgaugcugagaucagaauguggccuggacaacuucggggacuuugacugggucaucgagaaccauggaguugaacagccgccuggaggagcaguug

SEQ ID NO: 19687 - RNA, 108 nt, Human
agcccccgcgccgggggcucaggcucaacugaggguuuugucauuuucaagucugaaaguggcuguucuccugccuuuguuguuucuucuuuuccuggcgucuggguu

SEQ ID NO: 19688 - RNA, 70 nt, Human
ugacauccacaaauuguacauuauuuacaccaaaagcacagggcucgugugggugaacagucugcaguca

SEQ ID NO: 19689 - RNA, 71 nt, Human
ccaaagcugcaaaccauuuagggagucaucaauuacauauuuuguacacuuucaaaaagcuuacagcuggg

SEQ ID NO: 19690 - RNA, 71 nt, Human
gagcuguaaauugcuuaaaucgcuuaaacuggagauuucagugagauuuuuagcaguagauuacuaagcuc

SEQ ID NO: 19691 - RNA, 62 nt, Human; identical to SEQ ID NO: 12047

SEQ ID NO: 19692 - RNA, 64 nt, Human
gaugguguaaaugguaaacgugauaucaugagacauuuccugauucucacaccaacacauuauu

SEQ ID NO: 19693 - RNA, 73 nt, Human
uaguaucauggacuaaacuaggucaaagugaaguauaugcaaaaugaccauuuuguuuuuuuccauuuuauua

SEQ ID NO: 19694 - RNA, 63 nt, Human; identical to SEQ ID NO: 9730

SEQ ID NO: 19695 - RNA, 73 nt, Human
ucaaggaagggcaggcguauggcuaauugguuuugaauuacaugauuggcuugcccaauacauuuggccuuga

SEQ ID NO: 19696 - RNA, 74 nt, Human
guagagaugggaucucacuuuguuguccaaucuguucucaaacucuuggcuucaagugagccuccugccucugc

SEQ ID NO: 19697 - RNA, 67 nt, Human
cgucccaaaggccggcaagaugguguccuggaugaucugucgccugguggugcugguguuugggaug

SEQ ID NO: 19698 - RNA, 98 nt, Human
gaacuccgcccuguagccggugcugguggcccggcgcgcuggaaccgcggcgacccgcuccagcgcgggaccagcagcaagggccgagcgccagguuc

SEQ ID NO: 19699 - RNA, 79 nt, Human
gcagagaucguuacagacauuuuuaucuccugguucccuuucuacuaugagaucaagauggccuucgugcuguggcugc

SEQ ID NO: 19700 - RNA, 74 nt, Human
gcugugaagaccaagaacauucgugaauaugugcgguggaugauguacuggauuguuuuugcacucuucauggc

SEQ ID NO: 19701 - RNA, 94 nt, Human
guuuauuaucuaucuucacaguuuauauuuacugaauuauauauuuuauuucuuaaaauucacauuuaauacaaacuuucuuagauauuuaaac

SEQ ID NO: 19702 - RNA, 103 nt, Human
uaguauaguaguaaggagaaucuuaaaucuuagauucuuggggguaugacuagagcaauuccuaaauccagaugaugauuuuaccauugcuauguauaagcug

SEQ ID NO: 19703 - RNA, 75 nt, Human
aguguuuucauccuucuucauggccuccuucccacaaauaucaggaaaaugggaacugaugaggagaguaacauu

SEQ ID NO: 19704 - RNA, 74 nt, Human
caauuacaguccuacaaguaccuggguugccucccuccugaccuggagaacaguccccugguacacugucauug

SEQ ID NO: 19705 - RNA, 93 nt, Human
gagaggggaauaggagaagaaauaugggguaaaauaauagacccgauguacuuagguaccaccaugguuuucuuuuucuauaguuuucuuuuc

SEQ ID NO: 19706 - RNA, 73 nt, Human
uucuuuuuaggguguuaaucuuuaugugaaaaaucuugaugaugguauugaugaugaacgucuccggaaagag

SEQ ID NO: 19707 - RNA, 98 nt, Human
gccagggccaucagguuccguuuggggcccgucagcagguuggccauuccauaggugacgacuuugcccauggguuucaggagguuguagcccuuggc

SEQ ID NO: 19708 - RNA, 69 nt, Human
gguggaagccacacacagcccgguuggccugcagcagcugcagagcugucacgcugaacugauuccacc

SEQ ID NO: 19709 - RNA, 74 nt, Human
ccucacggccuggcugggugcugagcaggaggucagccuugcuggcaggcuggcgcuggcaggcaggucggagg

SEQ ID NO: 19710 - RNA, 131 nt, Human
cuucaccaugcaggggugacuuuuauuugaaggcagaaaacacccuauuuggggguucacucauaaucugcaacaguuuguuuguuuguuuuuaaaaaagagaaaaaucagaagccaaagggccugggaag

SEQ ID NO: 19711 - RNA, 66 nt, Human
gucacuuccgcccgggccuggccgagguucgggcuccguuggccgagggggccguacggagguggc

SEQ ID NO: 19712 - RNA, 72 nt, Human
agcagguuuaaaaggugcucauuuagagauucuaaccaauuacguggugaauuauaaaauuucuuuccugcu

SEQ ID NO: 19713 - RNA, 76 nt, Human
agugcguaacuggcaugaggacuauuggucuuugagaaauucuggccaacaguuaucaaaugguauuguacacacu

SEQ ID NO: 19714 - RNA, 62 nt, Human; identical to SEQ ID NO: 7958

SEQ ID NO: 19715 - RNA, 81 nt, Human
ucaccucaacuggauucggaaugugcugauuuccauuggacucaaguugaucucacuuauauucugagugccgggagguga

SEQ ID NO: 19716 - RNA, 60 nt, Human
agcugucagggccucacuguggaaggaagguccacagaaaacauccugggguccugagcu

SEQ ID NO: 19717 - RNA, 94 nt, Human
ugugaugggaggaguccucuguaucucagucugauccuggucucccucucggccauggucucacacuagugcugcugggaaaccaucccucaca

SEQ ID NO: 19718 - RNA, 71 nt, Human
ugcucuggcggucgccaaucuggucggcauggcggugaucacgaucuugccgacguuggggguguuaagca

SEQ ID NO: 19719 - RNA, 74 nt, Human
agugcccaggaugauauuuuuacacaagcuguaaauauggcaggauugccagcagugaguaucccuguugcacu

SEQ ID NO: 19720 - RNA, 80 nt, Human
cuuuuaacucuggaguagaugucuugcuaacccccaccaccuugagugaggcaguaccauacuuggaguucaucaaagag

SEQ ID NO: 19721 - RNA, 86 nt, Human; identical to SEQ ID NO: 15806

SEQ ID NO: 19722 - RNA, 64 nt, Human
aggccugggcccgcuuccugcaagaaaacaagcagcuucugcacgacgcacuggcccaggaccu

SEQ ID NO: 19723 - RNA, 64 nt, Human
cuggaugaaggacgagcgugugcccaagaaacuggccacgcagcuggacuccgccuucauccgg

SEQ ID NO: 19724 - RNA, 80 nt, Human; identical to SEQ ID NO: 16857

SEQ ID NO: 19725 - RNA, 123 nt, Human; identical to SEQ ID NO: 6745

SEQ ID NO: 19726 - RNA, 61 nt, Human
aauaaauauauagagagacauaauuuuaguggcaaaaugaagacuagacucuauuauuauu

SEQ ID NO: 19727 - RNA, 73 nt, Human
uuuugagacagagucucacucuguugcccagacuggacggcaguggcaacaagagcgaaacuccaucucaaaa

SEQ ID NO: 19728 - RNA, 89 nt, Human
gagccaaauaugagugaccauggccuguaacacagcccucaggagauccugagaacuaugcccaagguggucggggugcagcuugguuu

SEQ ID NO: 19729 - RNA, 74 nt, Human
gggcuccagguuacagguagauuuaaaauugacugguugacaauugguuaaguuuaucuaaagaucugggacuc

SEQ ID NO: 19730 - RNA, 62 nt, Human
agcuucuccaugcagaaggcugaggugugcuccuguuccaggccuguguuguguggagggcu

SEQ ID NO: 19731 - RNA, 91 nt, Human
cacuuggcuccugagggaucuuuacugaacgcagcaccuugacuaccuggcgcucucucuugaguggggcugucccuccugagcuaaagug

SEQ ID NO: 19732 - RNA, 66 nt, Human
ugaugaggacugggacagguacgugcacccugugcuucaccuaacugccugugccgaucucucuca

SEQ ID NO: 19733 - RNA, 69 nt, Human
ccccguggaauuuuaugaggaguuaugccuaacaacuguugggcaaccucagggggauauuuauggugg

SEQ ID NO: 19734 - RNA, 63 nt, Human
ggugaggcaaaucccuggaaggcuugaacccugcaguucagucucccgggguaaucacucccc

SEQ ID NO: 19735 - RNA, 103 nt, Human
caccacccaugauccaucuguguaguuucugaacagucagcgauuccagguuuuaaauaguuuguaaauuuucaguuucuacacacuuuaucauccacucgug

SEQ ID NO: 19736 - RNA, 122 nt, Human
gguuuuuuuuuuuuggcucaugaauuuuucuguuugacauggaaaugacagaguggaauauuaauacauuuuaguuuaguucugucaugccaggaauuuuuucauacaauuaaaacauggcc

SEQ ID NO: 19737 - RNA, 61 nt, Human
uaaagcguuuuaauuccuuucucuguucagcuguugaugcugagauccauauuuaguuuua

SEQ ID NO: 19738 - RNA, 62 nt, Human
guuuucauccucuaguacugaagugcccucaaggugguaggcacuguauagcaggagaaaac

SEQ ID NO: 19739 - RNA, 84 nt, Human
aucguucagcagugguuagaauacagggugacucaaguagaugggcacuccaguaaaaaugacauccucacacuguugaaggau

SEQ ID NO: 19740 - RNA, 64 nt, Human
uuuugucacauucagcauuauccaggccucaggcaacaucugucuaguguugucuugaucaaga

SEQ ID NO: 19741 - RNA, 86 nt, Human
gaccagcgacauuuuugggucuccggucacugccacuucacgcuuggcacacccaaacaaacccaagucaagguccucggcugguu

SEQ ID NO: 19742 - RNA, 60 nt, Human
guccagaagaagcuacuccuuccagcaggccuaauaggauggcaucuaauauuuuuggac

SEQ ID NO: 19743 - RNA, 83 nt, Human; identical to SEQ ID NO: 5689

SEQ ID NO: 19744 - RNA, 61 nt, Human
augaagaaccacagaauggcugcagauguuccuugucuuuuccaugacugacauuuuucau

SEQ ID NO: 19745 - RNA, 64 nt, Human
ccccaggaggcggcgggggcgcaggggcgcgcgggggcgcccgugccggagccgcccaaggagg

SEQ ID NO: 19746 - RNA, 78 nt, Human
ggagcaguacgggaccaacccauuugacucggcagacagugcuuaguccuauggagaacguccaugauaaacgugccc

SEQ ID NO: 19747 - RNA, 61 nt, Human
ggcgacacccggaaguuagacuugcgacuagggaggcaggauagacauccggggaggcgcc

SEQ ID NO: 19748 - RNA, 92 nt, Human
ucuccgugugcaguaccuccgccagauccacgccaaccacgagacacugcugcgggaggugcagacccugcgcgaccggcucugcacggagg

SEQ ID NO: 19749 - RNA, 64 nt, Human
gcguucgcaaagucuguagucaucacaggcuucccuauugagcucguggacaggcuuagagcgu

SEQ ID NO: 19750 - RNA, 98 nt, Human; identical to SEQ ID NO: 5140

SEQ ID NO: 19751 - RNA, 96 nt, Human
gacuccucgguggacagcaauaauggguugauauacucaaagucuucgaacucugacuggucgauccucuuuauggcauccucaucgucugggguc

SEQ ID NO: 19752 - RNA, 60 nt, Human
gagccaucuucucaucuugguaucaggaaagcaucuuuaucaaagaaguuuguauggcuu

SEQ ID NO: 19753 - RNA, 78 nt, Human
gaggcagaaacuguggaagguaaauauauguuaagaaacuaauaguuucuuguuuguagauuccucuggugcugucuc

SEQ ID NO: 19754 - RNA, 76 nt, Human
gugugguuaugucucuguauaggcaagugucugugucuauagauacuuuugcuuuuuauagugauuaaagcuccac

SEQ ID NO: 19755 - RNA, 74 nt, Human
acuauacauagucauauacguaacaucuauaaccauacauagucacauauguaauaucuauaacuauacauagu

SEQ ID NO: 19756 - RNA, 78 nt, Human
cuauacauagucauauauguaauauauaacuauaugaccauacauagucauauauguaacauauaugacuauacauag

SEQ ID NO: 19757 - RNA, 69 nt, Human
gugguuugcugccuacauucaugauggaagaaaugcuaauuuucaguuugaguuuagugaaaaaauuac

SEQ ID NO: 19758 - RNA, 82 nt, Human
aguagccguaauggguccugcaggagccacccagcugguccagcgggaugggcuccuccucgggagccugugugagguugcu

SEQ ID NO: 19759 - RNA, 81 nt, Human
ccaggcauccugccccccagguaagcccaggcguccucucaggagaugcugguccuugcaugugggcagcagggcuccugg

SEQ ID NO: 19760 - RNA, 68 nt, Human
uuuugcugauaaggagaaaguuuuaguggucuugauacaaaucggccacaauauuccuuuaagccaaa

SEQ ID NO: 19761 - RNA, 68 nt, Human
ggaagugggauugugggaggguacagcugaacauugacuguacuucuauauccaugaucucacuggcc

SEQ ID NO: 19762 - RNA, 102 nt, Human
uuuuuuuuuuuuuggauguaugcuucuuugcauuuauuuuaaaaaugugacauauauugucauggaaugugcaaaagaaaucaauuuuuaaaaaugaaaaaa

SEQ ID NO: 19763 - RNA, 61 nt, Human
gacugaagauacucaggguaaaaagaaauggaaaaaaacauguugucucccaucuuuuguc

SEQ ID NO: 19764 - RNA, 90 nt, Human
gccagagcagacuacuaaagcuuuaccugugagguuuuuguuuacagauuacaauagacuguccaguguagguggagaaacuucucuggc

SEQ ID NO: 19765 - RNA, 69 nt, Human
uucuggcucucuuauauauuucuuuauugucauuuacuuugguggacgaagagaaggagagaguuggaa

SEQ ID NO: 19766 - RNA, 104 nt, Human
ccugccccccugccugccaucugagagcccugcagugugccugcgcccugccuacagccggcgcgcucagccgggcaacuucaaugcagcgggggguccucggg

SEQ ID NO: 19767 - RNA, 72 nt, Human
cgcauagccgccucuucgaccaggccuucgggcugccccugcugccggaggaguggucgcaugugguuagcg

SEQ ID NO: 19768 - RNA, 73 nt, Human
gccccggagacagaagcaugaacgugucaaaagaaccaagugaaugcgcgugcguggaagaauacaccggggc

SEQ ID NO: 19769 - RNA, 124 nt, Human
agaagggugugcuguuuggaguuccuggggccuucaccccuggauguuccaagacacaccugccaggguuuguggagcaggcugaggcucugaaggccaagggaguccaggugguggccugucu

SEQ ID NO: 19770 - RNA, 75 nt, Human
ggugguacaggauggcauagugaaggcccugaauguggaaccagauggcacaggccucaccugcagccuggcacc

SEQ ID NO: 19771 - RNA, 81 nt, Human
ccccaguugucagaggagccagagcagugccaguucuccuaaggagcugguggugcuccucauggaaccuugccguugggg

SEQ ID NO: 19772 - RNA, 63 nt, Human; identical to SEQ ID NO: 18424

SEQ ID NO: 19773 - RNA, 63 nt, Human; identical to SEQ ID NO: 18425

SEQ ID NO: 19774 - RNA, 60 nt, Human
agagggaaguugcaacuuagcauaguauuaucugucuuuaaguccucaucuucuuccucu

SEQ ID NO: 19775 - RNA, 97 nt, Human
ccuuucauaauauggggaaaauguagaugcuugaauguuuagcauuagauagauaguuuugaaacauucauuguuugcauuugacuugcuugaaagg

SEQ ID NO: 19776 - RNA, 60 nt, Human
ggguuaguauagagauguggauguagucucaaaauauacaaauauaauucuuuacagucc

SEQ ID NO: 19777 - RNA, 80 nt, Human
gccgcugggagccuugagagccaugugcaagaggacagauccuguuccugucaccauugcucucgauucacucagcuggc

SEQ ID NO: 19778 - RNA, 68 nt, Human
gcucagcgucaccuggguggauggagccgugcgugccaggcgccgucccaagccuggagacucugagc

SEQ ID NO: 19779 - RNA, 124 nt, Human
gguucgccgugggccuggggacccgcgguccagggcgccaugcgggcaucgcugcugcugucggugcugcuggcccgcaagggcccguggcugugggcaucucccuguggcuucacccugagcc

SEQ ID NO: 19780 - RNA, 75 nt, Human; identical to SEQ ID NO: 74

SEQ ID NO: 19781 - RNA, 97 nt, Human
ugcaaagaugcuguccgugcgcguugcugcggccgugguccgcgcccuuccucggcgggccggacuggucuccagaaaugcuuggguucaucuuuca

SEQ ID NO: 19782 - RNA, 71 nt, Human; identical to SEQ ID NO: 77

SEQ ID NO: 19783 - RNA, 80 nt, Human
cgucgucggcgcugggcaggcacacggcggacacugucugggagaagcggacagguguggccagcuccagcagggggaug

SEQ ID NO: 19784 - RNA, 69 nt, Human
gaacuugggguucuugaaaacauuggagaucuucaagaccugaauguucuccucgucaaagcccugguc

SEQ ID NO: 19785 - RNA, 63 nt, Human
ggggcagggcugccugcugcagcuugccaggggucuuguuggcguuguacuuggucuugcccc

SEQ ID NO: 19786 - RNA, 79 nt, Human
ggguaugagcuuggcgacacgggcguacacagcgggcguggugguaaagcaggugcggcugccccaggacacaaugccc

SEQ ID NO: 19787 - RNA, 94 nt, Human; identical to SEQ ID NO: 4048

SEQ ID NO: 19788 - RNA, 80 nt, Human
agucuaauauagagauuacuggcuuuaacagugaacuggaauaaugagggcuucacugguaaaaugcuucugaauugacu

SEQ ID NO: 19789 - RNA, 88 nt, Human
gaggugccucaguggaggcgcugugucuccuacgcaacuucugagggcuggagggugccaagggcagcugcugaccgccuggugcuuc

SEQ ID NO: 19790 - RNA, 65 nt, Human
accaaugccagaacuguaucaacuugaggguaacaagcgaauaacauguagaaauggacaauggu

SEQ ID NO: 19791 - RNA, 72 nt, Human; identical to SEQ ID NO: 225

SEQ ID NO: 19792 - RNA, 62 nt, Human; identical to SEQ ID NO: 2027

SEQ ID NO: 19793 - RNA, 67 nt, Human
aaacacuauuuuauuuaaauaaggggaagcuuucuaaaaguauacuucuccuaauaaaaauagguuu

SEQ ID NO: 19794 - RNA, 65 nt, Human
aauccugaucugguccauuaaagagugugcgcggacaaaguuucugaaaggauuagagaaggauu

SEQ ID NO: 19795 - RNA, 67 nt, Human
ugccgggagcugggcaugaaagcccuggacaugaauucauguccagagcuuucaugccuuaaaggua

SEQ ID NO: 19796 - RNA, 66 nt, Human
gagacgggguuucaccauguugguuaggcuggucucgaacuccugaccucaugauccacccaccuc

SEQ ID NO: 19797 - RNA, 60 nt, Human
gcuagagugcagauggcaugaucucagacucacugcaaccucugccuccugcguucaagc

SEQ ID NO: 19798 - RNA, 62 nt, Human
gugcugggauuacaggugugagccaucuuuguuuuuagauucacauucauauacucccgcau

SEQ ID NO: 19799 - RNA, 64 nt, Human
agcagcaucuccuggaugcggaccugcuggaugaagagccaggaggugaccaggccaggcugcu

SEQ ID NO: 19800 - RNA, 94 nt, Human
cugcccauugaagcgguagugauaggcauagaaggcgaagugguagagauagaagaaccgcagccaaugccgcuugcuggugcugguguggcag

SEQ ID NO: 19801 - RNA, 67 nt, Human
guaccgcagcagcgggcaggacgcgcuggagaagauccgggcaggggccucccuggugcagcuguac

SEQ ID NO: 19802 - RNA, 68 nt, Human
ccuucguuuucaggccuugucaagaagacaaauuuuuaaaucauuuuccugaccccugagaaagcagg

SEQ ID NO: 19803 - RNA, 63 nt, Human
cugggauguggcugucauuucacaagagcauccgaguuuggggagauaugcagcuguaccaag

SEQ ID NO: 19804 - RNA, 76 nt, Human
gggaucaaaugguggcuguguaaaucucuggagucauuuuauuccaucagacucuucacaacuauuccuaucuccc

SEQ ID NO: 19805 - RNA, 66 nt, Human
ugagaaggucauuacuuagaaguaagaauguagaaaaugcuuacuuuuuguaauuguaacuucuua

SEQ ID NO: 19806 - RNA, 73 nt, Human
gucgugugcgucccucggugccacaugcacgcaacgugugugugugggagaucacugcggcggagcaagcgac

SEQ ID NO: 19807 - RNA, 80 nt, Human
gccccgggggcagucgcgccugugaacgguggggcaggagacccuguaggaggaccccgggccgcaggccccugaggagc

SEQ ID NO: 19808 - RNA, 68 nt, Human
ggaauauaagcuggugguggugggcgccggcggugugggcaagagugcgcugaccauccagcugaucc

SEQ ID NO: 19809 - RNA, 70 nt, Human
gugccuguuggacauccuggauaccgccggccaggaggaguacagcgccaugcgggaccaguacaugcgc

SEQ ID NO: 19810 - RNA, 67 nt, Human
uccaccaguacagggagcagaucaaacgggugaaggacucggaugacgugcccauggugcugguggg

SEQ ID NO: 19811 - RNA, 77 nt, Human
gaaugcuaauacaccaaccaagugggguggauaguaaguaugucugcaauauuaacaguuggguggagacuguauuc

SEQ ID NO: 19812 - RNA, 60 nt, Human
uucucuacgcacguuucuagaucuguauucuauguggugcgagcaugugcguucagagaa

SEQ ID NO: 19813 - RNA, 89 nt, Human
ggaguuuuguucuuguugcccaggcuggagugcaauggcacaauccuggcucacugcaaccuccgccuccuggguucaagcaauucucc

SEQ ID NO: 19814 - RNA, 79 nt, Human; identical to SEQ ID NO: 6024

SEQ ID NO: 19815 - RNA, 79 nt, Human; identical to SEQ ID NO: 6025

SEQ ID NO: 19816 - RNA, 63 nt, Human; identical to SEQ ID NO: 11285

SEQ ID NO: 19817 - RNA, 68 nt, Human; identical to SEQ ID NO: 11792

SEQ ID NO: 19818 - RNA, 67 nt, Human
gguuacagucucuagcuucgccauguacauggcccuuccguguacauggaugggcggggagguaacu

SEQ ID NO: 19819 - RNA, 94 nt, Human
aucgcacgagaaugauucagcaaucacggagugggggcaaugcgcgucgagaaauauuugugugcgccgcucagugagaacaauucuuagcgau

SEQ ID NO: 19820 - RNA, 84 nt, Human
cgagcucgcccagcauaucagguuggugcgccgaaauuguuuguugagauauuggucgauagcaaauauguagugggcgguuug

SEQ ID NO: 19821 - RNA, 76 nt, Human
acuguguuucuuuccuuuuguggaaaauggucauucugaaucuucaggacaaacacaucugggaaggugauacugu

SEQ ID NO: 19822 - RNA, 95 nt, Human
agauucaaagcaacaccaccaccacugaaguauuuuuaguuauauaagauuggaacuaccaagcauguggcuccuggucaguguaauucuaaucu

SEQ ID NO: 19823 - RNA, 61 nt, Human
ggauacagacuucaaaacaaugaggaacaacauuuucauguguuagaacgggggcuggucc

SEQ ID NO: 19824 - RNA, 70 nt, Human; identical to SEQ ID NO: 314

SEQ ID NO: 19825 - RNA, 78 nt, Human
ggcaacuucaggaugacaaaaacaaagucucuucugcugggaaaucccaguacagaucguuucucaucucuaagugcc

SEQ ID NO: 19826 - RNA, 61 nt, Human
gucaugucaccuuucacccagcaauauucagucuaaaagcagcaaggccguggugcauggc

SEQ ID NO: 19827 - RNA, 70 nt, Human; identical to SEQ ID NO: 6895

SEQ ID NO: 19828 - RNA, 64 nt, Human
augcuggacacugccuuaggaaaaccacgagagguguuucgacuuccuacagauuugacagcau

SEQ ID NO: 19829 - RNA, 79 nt, Human
ccgucuuugugcaucuauccauuucucaucuucuaccuggguuaccuugucagauggaacuggaagauguaugucaugg

SEQ ID NO: 19830 - RNA, 85 nt, Human
ugaagaacuuggggauccuuuuauuauaauucacaguaucucacugccuaaaugcugaagaaauuuauaguacccuacuucuucg

SEQ ID NO: 19831 - RNA, 67 nt, Human
caguccaaaccggaagggcagaauuuauuuuugggaaacugaaggaagucccgaccuuccuggauug

SEQ ID NO: 19832 - RNA, 60 nt, Human
gcacacucauggacuuuagguuuagaaaccuccucagccuucauuuguucguggaugugu

SEQ ID NO: 19833 - RNA, 78 nt, Human
gcccggaaaccacacuacgacaucuggggcaauacagucaauguagccagcaggauggaguccacgggggucaugggc

SEQ ID NO: 19834 - RNA, 61 nt, Human
ggggaagggggagcugcugaccuucuucuugaaggggcgggauaagcuagccaccuucccc

SEQ ID NO: 19835 - RNA, 74 nt, Human
cgaugauagagucgccagcagcacgugguucucguaaggaugaaugcuuguagugcugucuaaacguaacaucg

SEQ ID NO: 19836 - RNA, 83 nt, Human
cuggaagaaggaagcugugauagguuaugugaaagagaugucuccucaucucuaauggcuuaccgagacagcucucgauucag

SEQ ID NO: 19837 - RNA, 100 nt, Human
gcucuucaccaucccgcacacucaggaggccuuccgcacccgggaagaguaugaagcccgcuuggaaagguacagugagcgcauuuggacgugcaagagu

SEQ ID NO: 19838 - RNA, 77 nt, Human
ggcucagauucauagccccugaauagucccucauagucccugaguucauaaguagugguuauaguacaaucuaagcu

SEQ ID NO: 19839 - RNA, 88 nt, Human
uccaaaggcuccaacagggcccuccagacucaauggcaggguggugucugcacaagcuggaaguguccuugugaugagcccaucagga

SEQ ID NO: 19840 - RNA, 79 nt, Human; identical to SEQ ID NO: 6903

SEQ ID NO: 19841 - RNA, 85 nt, Human; identical to SEQ ID NO: 6904

SEQ ID NO: 19842 - RNA, 78 nt, Human
cuuccauugccacguagacauugcccagagugaagugguucacagcaaaguguggugcgaucucuacugccauggugg

SEQ ID NO: 19843 - RNA, 83 nt, Human
agagacuauuaaaugugacaugaauuauggaguagaaaaaucugcuugauuuauuaauuuuaugauauaugugaucaguaucu

SEQ ID NO: 19844 - RNA, 76 nt, Human
agucuguuguuagucuuaaaaaugaggaggaaaaugaaaauuccauuucucaguacaaagaauccgugaagagacu

SEQ ID NO: 19845 - RNA, 77 nt, Human
gcuuacauggaagaguauauaugggaaaauagcucaucagaaagaaauauccuggaaacgcuucuccagaugaaagc

SEQ ID NO: 19846 - RNA, 71 nt, Human
agcagcagcccucucucuggaaccgugggauuuggaccauucuccacccugaagugcagaggguugcuguu

SEQ ID NO: 19847 - RNA, 96 nt, Human
ccucccauguacacaggacacgaguacacagucaggucggcuggggcuggcaagucacuuggugcccggggccugugugcugaugcugacgggagg

SEQ ID NO: 19848 - RNA, 80 nt, Human
ucugagucacuagaugaggaggaggaagaugaugaugauuuaugccuuuucuuuucuucuuucuuaacuuuagauuuggg

SEQ ID NO: 19849 - RNA, 70 nt, Human
gggccccaagcucgcuaguccucggaucccagaaacauaacuccgggggugcagaccugcuuggaggccc

SEQ ID NO: 19850 - RNA, 89 nt, Human
agggacauugccuuauuucugcuagaucaaaguagaaguccaguuccucuacuuggcaucuguugauaucuggaaagggugguguuccu

SEQ ID NO: 19851 - RNA, 60 nt, Human
ccuaccgcugccucaaugggcucugcuugagcaagggcaacccugagugugacgggaagg

SEQ ID NO: 19852 - RNA, 61 nt, Human; identical to SEQ ID NO: 1238

SEQ ID NO: 19853 - RNA, 83 nt, Human; identical to SEQ ID NO: 3404

SEQ ID NO: 19854 - RNA, 68 nt, Human
aaaacuguguccaaaaggauuguuucgaaauaugcaugcaaauaguucuguuaauaacccacuguuuu

SEQ ID NO: 19855 - RNA, 60 nt, Human
ccaaacugucucugccucuucccggagaauccagcugggcuagaggcugagcaccuuugg

SEQ ID NO: 19856 - RNA, 85 nt, Human
cuuuuggaaggugacuuuaucaccuuaaugcauauuccccucuccauagaggagaggaaaagguguaggccugccuuaccgagag

SEQ ID NO: 19857 - RNA, 64 nt, Human
ugucuuuaaaaagcaugucgugauguacacauuucgucauuaccuaucauguuguuuuguagca

SEQ ID NO: 19858 - RNA, 76 nt, Human
ucacugugucgcccagguuggagugcaguggcgcgaucuccaccuacugcaaccucugccucccggguucaaguga

SEQ ID NO: 19859 - RNA, 88 nt, Human
ucgcccgucccuuaccuacauuguuccaacaugccagaggcuguuaaccuuggagaccugcugcggauauggguacggcccggcgcga

SEQ ID NO: 19860 - RNA, 77 nt, Human
cggccgucaaccuccucaaguauacuucaaaggacauuuaacuaaaagcccuacgcauuauauagaggagacagucg

SEQ ID NO: 19861 - RNA, 77 nt, Human
gcugagcgacuucgaggggaagaagcccggguaacucagcugauccguggcuuugguaguuccuggaaaucaucagu

SEQ ID NO: 19862 - RNA, 64 nt, Human
gggugugcugauggagcgggcugcagaugacagcaaagagguugagagcuuccagcagcugcuc

SEQ ID NO: 19863 - RNA, 65 nt, Human
uuuacauuagcagggcugggcaagauucuuacauaauucaagaccuaaaaccagccugcaguaga

SEQ ID NO: 19864 - RNA, 91 nt, Human
aggcucggcacagagaaggagguagcuccaccugccuucccugcaggccggcgggguggggguauggcucugcuccuuccuguccuggccu

SEQ ID NO: 19865 - RNA, 85 nt, Human; identical to SEQ ID NO: 10310

SEQ ID NO: 19866 - RNA, 64 nt, Human
aaggaugacaaauuguuuacauauauacuauagaaauacacacugaacuggcaauaacaucuuu

SEQ ID NO: 19867 - RNA, 71 nt, Human
guguauauguguguguguguguguguguagcuugaagugguccauauguacacacacauauacauauauau

SEQ ID NO: 19868 - RNA, 60 nt, Human
uagagagagagagagagagaacgcgagcagacuagguccuuucuugaaagacucucucug

SEQ ID NO: 19869 - RNA, 61 nt, Human
guguuggaaagguuuccuugagcuauuguuuuuacuugauuauaggcagccuugauaacau

SEQ ID NO: 19870 - RNA, 61 nt, Human
uccacuugcugccauugacuucuggccagaaacaaacuucuuugccgcuuggcagcuugga

SEQ ID NO: 19871 - RNA, 80 nt, Human; identical to SEQ ID NO: 4151

SEQ ID NO: 19872 - RNA, 64 nt, Human; identical to SEQ ID NO: 287

SEQ ID NO: 19873 - RNA, 62 nt, Human
ccagacuacuuccuauaaauuucuccugggaaaccugccuuuguauguggaaguauaccugg

SEQ ID NO: 19874 - RNA, 125 nt, Human
ggagggauacaauuggugucaugaucggaaugugguuaccauuuucagugcacccaauuacuguuaucguugugggaaccaggcugcuaucauggaauuagaugacacuuuaaaauauuccuucc

SEQ ID NO: 19875 - RNA, 93 nt, Human
uacuaaugaugagcauuuagcacaauuugagacugaaauuuaguacacuauguucuaggucagucuaacaguuugccugcuguauuuauagua

SEQ ID NO: 19876 - RNA, 68 nt, Human; identical to SEQ ID NO: 223

SEQ ID NO: 19877 - RNA, 67 nt, Human; identical to SEQ ID NO: 4195

SEQ ID NO: 19878 - RNA, 68 nt, Human
gguugccucuuugaucaaacggguaucagaaauccaaaauuccaaaauccacagauccaaagagcucc

SEQ ID NO: 19879 - RNA, 68 nt, Human
gucaagccauccccaagcucauugggcaggaaaaccugaccuguguuggugggagaugacuuacagac

SEQ ID NO: 19880 - RNA, 75 nt, Human
gaaagcuaguaacagguacauagguaaccaaaguauauagcuuauuuggugaaucuucguccucauuacguuuuc

SEQ ID NO: 19881 - RNA, 71 nt, Human
gcccgaggugcacgcuucuugaagcccacuccauggaugcgcuugugaauguugaugguguauucucgggu

SEQ ID NO: 19882 - RNA, 66 nt, Human
cagucgcuccagggccgcagcaguucacucccacacauagaacccaggucacugcuggggcgauug

SEQ ID NO: 19883 - RNA, 76 nt, Human
ugguguggaggccuauguucugccccauacaccccacaggcccugcuuaugggaaggaacacaggccuccagccca

SEQ ID NO: 19884 - RNA, 75 nt, Human
cugggacuacaggugcaugccacccauuuaaaauuuuuuuuuucuuagagaugggagucuugcuauguuucccgg

SEQ ID NO: 19885 - RNA, 90 nt, Human
gggagucuuccucugucgcccaggcuggagugcgguggcaugaucguggcucacugcaaccucagacuucugggcucaggugauucuccc

SEQ ID NO: 19886 - RNA, 65 nt, Human
uggccuuaauuuccugauccuccuuccuuggucuccugaguaacugggauuacggaugugagcca

SEQ ID NO: 19887 - RNA, 81 nt, Human
cugugggcucuggcauauauuagcugugugacugugggugagucacuucacuucauggaggcucaguuuccucgucuguag

SEQ ID NO: 19888 - RNA, 68 nt, Human
ggaauccagggagaacuggagccuguuuuaugcuggcauggaacuuggccucaguacgucuggguucu

SEQ ID NO: 19889 - RNA, 89 nt, Human
ucuuaugguuuauuccucagguaucauucugaucauuguuguuacaggagagaugagaggaaguuagaggggcuagaagaaccaggaga

SEQ ID NO: 19890 - RNA, 87 nt, Human; identical to SEQ ID NO: 841

SEQ ID NO: 19891 - RNA, 66 nt, Human
gggugguggacgagagcuuuguugacacgucccccacagggcccagcucagcagaugccaccacuu

SEQ ID NO: 19892 - RNA, 65 nt, Human
ucauuccuaugcucaaugucaagguuuaaauuaaccaauuuuccuugcagugucaugggaaguga

SEQ ID NO: 19893 - RNA, 88 nt, Human
ucuguuuuguuuuuugguaucacuuauguagugugaacuucaguagcaaacccacaauaccagcuugauauucaaaugaucaaagaga

SEQ ID NO: 19894 - RNA, 78 nt, Human
gcgccuggccuucucguccuuuucaaguggccacaccuuccaagaaggucgccugagacccuccugaggggcaggugc

SEQ ID NO: 19895 - RNA, 86 nt, Human
cuccacuaaggggcccuuggaaaccggacaauguugaaggcugaagcuuccauggggauccgcaguccagagccccuugggagggg

SEQ ID NO: 19896 - RNA, 110 nt, Human
gaggcagcggcaguggaguucgcugcgcgcuguugggggccaccugucuuuucgcuugugucccucuuucuagugucgcgcucgagucccgacgggccgcuccaagccuc

SEQ ID NO: 19897 - RNA, 65 nt, Human
ccucguuugcccucaacggggggagcuuuggcggccgguucccuuuaaggggggggaaaugcagg

SEQ ID NO: 19898 - RNA, 83 nt, Human
ggcgcacccgguggccgcccggaccugcuuauugcugucaagucgguggcagaggacuucgagcggcgccaaggccgugcgcc

SEQ ID NO: 19899 - RNA, 73 nt, Human
gcgcuuuguggcuccuccuggccaggucauacuucgaaguuguccccucgccaaagggacgggucaguagcgu

SEQ ID NO: 19900 - RNA, 78 nt, Human
gggcuuguugcugcucggagccgguggaccuggcugaggcacggcuggcgccgccuguaccugaaaugcagcgaggcu

SEQ ID NO: 19901 - RNA, 70 nt, Human
guuaaaucagaagccauuugugcugagcuuugucuagaaauaaagcauaguguaguggagaugaucaagc

SEQ ID NO: 19902 - RNA, 68 nt, Human
ccuugggaaaaaugagaacauauaacugggcgucccuccaccaucucaugucucuucauauuccaggg

SEQ ID NO: 19903 - RNA, 64 nt, Human
ugugcacguuacacucauccacauugguacaacuaauuuuuaagcguaaauucccccguccaca

SEQ ID NO: 19904 - RNA, 76 nt, Human
cagugaaggaagaaccuguagaagaugaccucguuccggagcuggguaucucaaaucugcuuucauccagccacug

SEQ ID NO: 19905 - RNA, 75 nt, Human
uccccagcugauuagugucuaaggaaugauccaauacuguugcccuuuuccuugacuauuacacugccuggagga

SEQ ID NO: 19906 - RNA, 63 nt, Human
uucagugacauguccucucugcuugguguaaaccauucuugggaggacacuuuugccaaugaa

SEQ ID NO: 19907 - RNA, 66 nt, Human
ucugccauuuauuggagauaggcauauaaaacacugaguuuuauugagcacauaguauguggcagg

SEQ ID NO: 19908 - RNA, 92 nt, Human
aguacaucauaaucggcgacacagguguugguaaaucaugcuuauugcuacaguuuacagacaagagguuucagccagugcaugaccuuacu

SEQ ID NO: 19909 - RNA, 81 nt, Human
cgcggaggcggggcggaggcgccgcggcggcuguuauuguucggcugggcucggucgggcgcugucucccucggcucugcg

SEQ ID NO: 19910 - RNA, 107 nt, Human
cuuccucacagccccucacucccggcggcugacagcagcagcggcggcggcgggcggcgccuggcguuucgaggcugagcggcaccgggguuggggcgcggaggagg

SEQ ID NO: 19911 - RNA, 63 nt, Human
cugguggacgcuugggaacgguuaacucauaaggggucuacgcuuccccaaugggguccccag

SEQ ID NO: 19912 - RNA, 65 nt, Human
ggugcaguaccgcggcgaggugcaggccaugcucggccagagcaccgaggagcugcgggugcgcc

SEQ ID NO: 19913 - RNA, 81 nt, Human
cacacuggugcugacugcauuugguauugcauuccugcugaggaggagaacaagcuggaagaugugguccacaccccugug

SEQ ID NO: 19914 - RNA, 85 nt, Human
gaggcuggcuguacaaacggagcgcugcugaucgacgaacagagauccuguacaacacucaaggggucguuguaaagccagacuc

SEQ ID NO: 19915 - RNA, 61 nt, Human
gcggcugcuccggcuucuggccccuggcgggcuucuuguccgcgcgccgggagccggccgc

SEQ ID NO: 19916 - RNA, 74 nt, Human
gaggucccuuccucagcuguuuugagaagccuucggguugaauguggguccagacggagaggagacgagagcuc

SEQ ID NO: 19917 - RNA, 93 nt, Human
ggcuccuccuguccggggcggagcccugcgucgcgggccuggggaggccccgccagcacccuugacgucugggucccgagcagugcggcagcc

SEQ ID NO: 19918 - RNA, 101 nt, Human
uuugaacuuguccccugaauagcuacagguuuuggaagcugaaucaauguuaucagaugaguuagaauccaaaccagagcuccugguacaguuuguucaga

SEQ ID NO: 19919 - RNA, 63 nt, Human
cucaacgcaaggcuucacagcuuuccaaggacagggaccggcucuggaguggccgugcgugag

SEQ ID NO: 19920 - RNA, 62 nt, Human
uugucucaaaguuaugccuaccuggcucguaggaugccaacguuaggagugaaaauagucaa

SEQ ID NO: 19921 - RNA, 68 nt, Human; identical to SEQ ID NO: 574

SEQ ID NO: 19922 - RNA, 79 nt, Human
uuuuuuuuuuuuacauugugaucuuaauuauacuuuuauuaaaauauagcauacuuaugcacagagugaauagaaaaaa

SEQ ID NO: 19923 - RNA, 93 nt, Human
gagacggccaugcuggucugcaagucagaguccgugccagcugucacugacugggccugguacaagaucacugacucugaggacaaggcccuc

SEQ ID NO: 19924 - RNA, 70 nt, Human
aucugggccaggcugggccaggccugcagggucacgacuggagggugugggcccggccaggcuggcagau

SEQ ID NO: 19925 - RNA, 79 nt, Human
gcagauggggcacucgcugcccucagcgcagagcucacacagcgcagcguguuggcacggcagcacugcccgcuucugu

SEQ ID NO: 19926 - RNA, 89 nt, Human
agcuuccugcaggcccagcugugccaggacgugcugagcagcuuccaggagcuguguggggcccuggggcuggaacccgguggggggcu

SEQ ID NO: 19927 - RNA, 97 nt, Human
gccagccugucuaccagcagggccgggccugcaccagcaccaagugccugguggugggugcuggaccuugcgggcugcgggucgcuguggagcuggc

SEQ ID NO: 19928 - RNA, 60 nt, Human
ccuccucuucugguaccaccgaggccuccuccuagccgccggggccuccaggagcggugg

SEQ ID NO: 19929 - RNA, 89 nt, Human
cgcgacuccgugagcgccuccgccggucccgggacgcgggagcgucgccguucucgcuccuugucucgcucccggcuccgcucucugcg

SEQ ID NO: 19930 - RNA, 73 nt, Human
cucccgcucacggucccggucccggucccugugcggaagcggggaggggccgggccucucaucguagcgggag

SEQ ID NO: 19931 - RNA, 62 nt, Human
aguaguuccugggugcuuugauguuaagucauacauaauucgagaaauaccaggaaucuucu

SEQ ID NO: 19932 - RNA, 63 nt, Human
cgggucgggguuuaacgcguuucugggccgccguaagcccggccuaggggcagcuuugacucg

SEQ ID NO: 19933 - RNA, 107 nt, Human
uuggagaguuauguagccauuuuuacccugagucucuugauuccagcccgugugauuugcuggcagucauagaguucuauccgcucaaggcuaugacagcucuucaa

SEQ ID NO: 19934 - RNA, 75 nt, Human
uguggcucgccagcccugcaguauuugaugugcaguauugcaccacaagcucugcggaccuuggccauugccgca

SEQ ID NO: 19935 - RNA, 73 nt, Human
uuguucccaucaguuuagcccagagauagacaguagaaugcaaauaccucccuccccuaaacugacuggacgg

SEQ ID NO: 19936 - RNA, 60 nt, Human
gucuuuuuuuuucuucuuuuuuuccuuuaauaauaaaaaagaaaaccaaaaaaaaaggac

SEQ ID NO: 19937 - RNA, 68 nt, Human
ggggaccucgggagccucacuggucccagcagacaccucaggaaccguggggacaaccgggauucccc

SEQ ID NO: 19938 - RNA, 64 nt, Human
uuggagcaguuucugaccauccugccuggggagauccagaugugggugcggaaacaguguccag

SEQ ID NO: 19939 - RNA, 87 nt, Human
guggcacccugugggagccccaaauggcgcuauugacuucccuggagucauaggagaaccguuauacaggucaccaagggucuucac

SEQ ID NO: 19940 - RNA, 61 nt, Human
cagcuaugauauuaacgccugggcagcguucgcaauagcagccaggcuguaauguacgcug

SEQ ID NO: 19941 - RNA, 62 nt, Human
gcugcccagcuggaguacaaguaugcgaucaagcucacuggaaacucaccuccugggucagu

SEQ ID NO: 19942 - RNA, 79 nt, Human
ggaggagacaagcaagcugucauguuauaagcagcccuuugagggguccaugugaugucaaggaaugaagucucuagcc

SEQ ID NO: 19943 - RNA, 84 nt, Human; identical to SEQ ID NO: 286

SEQ ID NO: 19944 - RNA, 84 nt, Human; identical to SEQ ID NO: 286

SEQ ID NO: 19945 - RNA, 89 nt, Human; identical to SEQ ID NO: 288

SEQ ID NO: 19946 - RNA, 61 nt, Human; identical to SEQ ID NO: 776

SEQ ID NO: 19947 - RNA, 77 nt, Human
guuucuguuauugcauguuuauuucuucugggcauauccuuaaccuuggccaaauaaacuucaaaacugauugagac

SEQ ID NO: 19948 - RNA, 62 nt, Human; identical to SEQ ID NO: 9865

SEQ ID NO: 19949 - RNA, 78 nt, Human; identical to SEQ ID NO: 5302

SEQ ID NO: 19950 - RNA, 74 nt, Human
agaaccagcugauggccccagugccugaaagugcccuugggcaccuccucagcuggugccaggaucuggucucu

SEQ ID NO: 19951 - RNA, 62 nt, Human; identical to SEQ ID NO: 3237

SEQ ID NO: 19952 - RNA, 64 nt, Human
ggucucauccgaacccugcggauguauuuuucacccaagaaauuucggauuucaacaagagacc

SEQ ID NO: 19953 - RNA, 90 nt, Human
ucagccugcugaacaguuccuuuuucaaaaacauagauaccauccaaaaauuuccugauauccuuguuuuuaacuguuggggcuugcuga

SEQ ID NO: 19954 - RNA, 83 nt, Human
cccgugggcggcacggggggggcgccggauucacccgugggcggcacgggggggggcccggcgucacccuugggcggcacggg

SEQ ID NO: 19955 - RNA, 77 nt, Human
ggggcagccucagagucacccguggggggcacagggggggccccggagucacccgugggcggcacgggggcggucuc

SEQ ID NO: 19956 - RNA, 61 nt, Human
ccagacccauucagccccuuccgcugucuggggugggguuaaggggcacaaugggaaaugg

SEQ ID NO: 19957 - RNA, 65 nt, Human
cugcacaaacauauugauacaaaaacaacacuguuaagaguguuugcaccgucuauguggguaag

SEQ ID NO: 19958 - RNA, 81 nt, Human
agcugccgcgccgccuguccgacucgcccguguucgacgcgccccccagccccccggacucgcugucggaccgcgacagcu

SEQ ID NO: 19959 - RNA, 71 nt, Human
cugagcuccggcagccucagcggcucugagucucccagccucaacccuggccgccgccugccaaucuucag

SEQ ID NO: 19960 - RNA, 68 nt, Human
gaggcuuggucuguaagcgccgcuugauuccuuuguaggggguacaagugguuugggauucagggcuu

SEQ ID NO: 19961 - RNA, 75 nt, Human
gcgguuuaauaaaguugacgggauugcguuucauucucauuuccuuauacaauaccuguuauggccgcugaccgc

SEQ ID NO: 19962 - RNA, 92 nt, Human
ccaucucucagauuacuucauugcucaccggccggcucugaaagaaaaguaucccaaaucggcgcaccuugggcgaauuguuugacaaaugg

SEQ ID NO: 19963 - RNA, 86 nt, Human
aaugcuaauaugauggucuuaggacaugaaccaagacaaacaacuucgaaucugggucacuuaaacaagccaucuauccaggcauu

SEQ ID NO: 19964 - RNA, 66 nt, Human
gagacgggguuucaccguguuagccaggauggucucaaucuccugacuucaugauccgcccgucuc

SEQ ID NO: 19965 - RNA, 70 nt, Human
ggccuugaacgucaucuuuacugugcauuuccuuugaaaauaaagcagcugaagauuucaacacauggcc

SEQ ID NO: 19966 - RNA, 82 nt, Human
guuucuuguaaaggcgucugacaguccugagaauuauugaugguaaggaauaaaaaauguacagaugacuucaugaagauac

SEQ ID NO: 19967 - RNA, 69 nt, Human
uacauuuauugaauauacucuguaaagaaggugcaauccugagcauaauaaaguguagaaaugaaugua

SEQ ID NO: 19968 - RNA, 88 nt, Human
agguugucauacgcauauuugaccuucucucgaaacaggcgcuuggcgucguucagggugugggcgaucagggcgcacuuggcagccu

SEQ ID NO: 19969 - RNA, 86 nt, Human
gggccuugaggaugauguuccgggugugcauccccuggaaguagucgaucugcuccugcgucauccggaagcggaccuucuugccc

SEQ ID NO: 19970 - RNA, 86 nt, Human
agcgggaucgcuucgggugcucgacuccuguugcgcaugcucagcgcgcugcccggcuggggacccgcgcaccugcagcgcccgcu

SEQ ID NO: 19971 - RNA, 85 nt, Human
cucccggucaucaucuucaccacguucuggggccucgucggcaucgccgggcccugguucgugccgaagggacccaaccgcggag

SEQ ID NO: 19972 - RNA, 95 nt, Human
gggauguccugcuccaauacccgcacugcucuggaguauugcccucuuucccaaggagaugcugcugguggagcugguaugggugcggucuuccc

SEQ ID NO: 19973 - RNA, 73 nt, Human
gaaauuuuaguucauauguacacuagccagugguuguggacaaccauuuacuugguguaaagaacuuaauuuc

SEQ ID NO: 19974 - RNA, 66 nt, Human
aagcguuuuaauuccuuucucuguucagcuguuuuugcugagauccauauuuaguuuuauaagcuu

SEQ ID NO: 19975 - RNA, 103 nt, Human; identical to SEQ ID NO: 19735

SEQ ID NO: 19976 - RNA, 75 nt, Human
uggcauggggaccagcuagaacaaugcagauucauccauaaucccuuucugcuguucaccaccacccaugaucca

SEQ ID NO: 19977 - RNA, 63 nt, Human; identical to SEQ ID NO: 981

SEQ ID NO: 19978 - RNA, 88 nt, Human
aguauuuaagauggauauuugguggcucuauuuguucugauaucuuuuggucuaaauuaugagguaccaagauuguuucuuuguuucu

SEQ ID NO: 19979 - RNA, 64 nt, Human
uaaguagaugggagaauauguuuaaaauauuaggaauccuagaccauauuuucaagucaucuua

SEQ ID NO: 19980 - RNA, 63 nt, Human
gccgcauuugcgaggcucuaaaacauggggggugcuccagaaagguuccucgcgcaaaaaggc

SEQ ID NO: 19981 - RNA, 65 nt, Human
ggugagcccugccgcugucccauggcccagggagccacuggugcggacgccggcagauguuuacc

SEQ ID NO: 19982 - RNA, 63 nt, Human; identical to SEQ ID NO: 4175

SEQ ID NO: 19983 - RNA, 131 nt, Human
gaauuugggucccuuugugguacgugcuuuccuucguaguucaacaagugaagguuuauuacugaagauugauccauuguugccuaaagaaguaaaaaaugaagaaagugaaaaagaagaugccuaaaugu

SEQ ID NO: 19984 - RNA, 86 nt, Human
gcugaauuugggucccuuugugguacgugcuuuccuucguaguucaacaagugaagguuuauuacugaagauugauccauuguugc

SEQ ID NO: 19985 - RNA, 97 nt, Human
agacugagaaaaagagcguugaauauaagagaaaauacuuccucuguucucagaucguauuuguuuuaaggccacaccuuuuugaaguuuucaguuu

SEQ ID NO: 19986 - RNA, 75 nt, Human
gccgucuccccugcucccggugcucugcgagaucuccccugaccagaucuccacagcccggacccgggggcuggc

SEQ ID NO: 19987 - RNA, 85 nt, Human
cccagggacuagucuaccaagguuauuuggcagcuaauucuagauuuggaucauugcccagaguugcacuugcuggucucuuggg

SEQ ID NO: 19988 - RNA, 68 nt, Human
gaaguuuuuuaaaccucugaauuuguacacauuuaaaauuucaaguguacuuuaaaauaaaauacuuc

SEQ ID NO: 19989 - RNA, 67 nt, Human
accagguggccuuaguucuccagcaucacaucccuguauaagcuccucugagcagggucgacauggu

SEQ ID NO: 19990 - RNA, 81 nt, Human
aguuuugucaguauuugcauggcuuguacggggcagagaacuucuggagguccuuacuuagccauucuugcugacaucacu

SEQ ID NO: 19991 - RNA, 131 nt, Human
uagucauguacagaacaugaucaaggguguuacacugggcuuccguuacaagaugaggucuguguaugcucacuuccccaucaacguuguuauccaguguaacacccuugaucaugcucuguacaugacua

SEQ ID NO: 19992 - RNA, 65 nt, Human; identical to SEQ ID NO: 476

SEQ ID NO: 19993 - RNA, 62 nt, Human; identical to SEQ ID NO: 9237

SEQ ID NO: 19994 - RNA, 76 nt, Human
uuuguguuguuuuguuuuuauuuuuaaaugaaguuuccaucugugcacguuaagaaaauaaacaaaacaacaggaa

SEQ ID NO: 19995 - RNA, 70 nt, Human
caggcuccaccgguaguuucccgucuuugcaguuucauguuacuauacauuccugccgauccgaguccug

SEQ ID NO: 19996 - RNA, 63 nt, Human
gcuaaggaauggcgcaucuauaaauuuucacacaaucgugguuuuugugccaugcccuguggu

SEQ ID NO: 19997 - RNA, 86 nt, Human
caggggauguucauuuuuuuauuccuguguguuuuaucuagaaagauucaagaagaauauuacagauuguucaaaaauguccccug

SEQ ID NO: 19998 - RNA, 78 nt, Human
gagaacauaaggucuugugcaagaggaggccucgcucuucuguuccuucucggcaccaccuggaucuuugggguucuc

SEQ ID NO: 19999 - RNA, 60 nt, Human
ggcgggggauauagggucgaagccgcacucguaagggguggauuuuucuauguagccguu

SEQ ID NO: 20000 - RNA, 70 nt, Human; identical to SEQ ID NO: 3607

SEQ ID NO: 20001 - RNA, 63 nt, Human; identical to SEQ ID NO: 981

SEQ ID NO: 20002 - RNA, 86 nt, Human
aaaucugauauuuaaaacauuuaugugguaaaauaaucucauuugauuauggauaucauaaauagaauauaaaagauauuacauuu

SEQ ID NO: 20003 - RNA, 78 nt, Human; identical to SEQ ID NO: 11810

SEQ ID NO: 20004 - RNA, 79 nt, Human; identical to SEQ ID NO: 10269

SEQ ID NO: 20005 - RNA, 61 nt, Human
gucccugcagggccgcccgcggcggggcaguguccacucacucgugcucggccccagggac

SEQ ID NO: 20006 - RNA, 110 nt, Human
aggccugcaucaccggccgugauuucuccgcuugcagcuucacuccggagcccgcgaaccggcuaccgccccgcugcagcacgaugaugucgcggucugugaguuugucu

SEQ ID NO: 20007 - RNA, 67 nt, Human
guggugcaaucguagcucaccucucaugccagccuucuguguagcugguguuauaggugugcaccac

SEQ ID NO: 20008 - RNA, 87 nt, Human
ucauaacauucccuaccaguuagauguaccaaaauuuaaugauauauucauaauuuuaugguuugcauuuaaauuuuuaucuuauga

SEQ ID NO: 20009 - RNA, 80 nt, Human
aagcgacuucaaaaauaugggaacacaguuaguuauuuuuacacaguucuuuuuguuuuugugugugugugcugucgcuu

SEQ ID NO: 20010 - RNA, 61 nt, Human; identical to SEQ ID NO: 3291

SEQ ID NO: 20011 - RNA, 80 nt, Human
gcaccucuuggacugaaucguuugucuagacuacauguauuacaaagucucuuuggcaagauugcagcaagaucaugugc

SEQ ID NO: 20012 - RNA, 75 nt, Human
uuuacauuguuuaccaagcuguagugcuuuaagaacacuacuuaaaaagcaaaauaaacuugguuuacauuuaaa

SEQ ID NO: 20013 - RNA, 61 nt, Human
caggcccugccacggucaacucaggucagccagccugaggcuguggccuccaaagggucug

SEQ ID NO: 20014 - RNA, 61 nt, Human
ccccccaggucgcaggugucugaggccagucaaccugcagagcacucgcggcguggguggg

SEQ ID NO: 20015 - RNA, 88 nt, Human
gacccacuuccugcuccagcaccagccccuccagcugaccacccuguuggaccaguacaucagagagcaacgcgagaaggauucuguc

SEQ ID NO: 20016 - RNA, 80 nt, Human
gcaggcagggcuuuaucaacuacuccaagcuccccagccugccccuggugcagggggagcuuguaggaggccucaccugc

SEQ ID NO: 20017 - RNA, 63 nt, Human
gcgagaaggauucugucaugucggccaaugggaagucagauccugacacuguuucggacucgu

SEQ ID NO: 20018 - RNA, 66 nt, Human
gguggugcgcccaucgcugacuggagaggaccugggaucccaccucggccggcgagcgcgcccgcc

SEQ ID NO: 20019 - RNA, 68 nt, Human
aggcaaagaaagccuuaagggagcagagggcuugucuguugcuaccauuucuucaaauucuacugccu

SEQ ID NO: 20020 - RNA, 76 nt, Human
gcacggaacugaccgggauccugaggcugguaacugacccugaaccuaaaacccaggauugauggucuuucucugc

SEQ ID NO: 20021 - RNA, 79 nt, Human
uaagauauuuauuacaugcauaaucuuacuuccuuuucaaaauaaccuuggaagguagguaaagcagguaucgguuuua

SEQ ID NO: 20022 - RNA, 67 nt, Human
ucaccaacuccuuccuuagggacaaaagguagggcuuuauguacaagccuuagggaagaaaugguga

SEQ ID NO: 20023 - RNA, 76 nt, Human
guggcaaguucuuuagccuuugccuuuucgagcuuggcgauacgagccacagacuuaggacccaggacauugccac

SEQ ID NO: 20024 - RNA, 75 nt, Human
gagacugcgggcccagcguuccauguccuuggcaaucuguugagcugucuuggucuugugcuucuccuucuucuc

SEQ ID NO: 20025 - RNA, 69 nt, Human; identical to SEQ ID NO: 5630

SEQ ID NO: 20026 - RNA, 77 nt, Human
gacuucuccuguccauccccuuggcccccucuccucuaguccaugagauuacagcuuugcacacugacaggaggguc

SEQ ID NO: 20027 - RNA, 96 nt, Human
cagacugggccaauguccacaaagaauuccuggucagcaccaccgaugucaaaaggugcaauaucaaggaagggcaaggcgugauggcuuaauuug

SEQ ID NO: 20028 - RNA, 93 nt, Human
auaaacugcuguccagauuguuaauuucauuuauauuuauuuuaauuaauuugucaugaauauggacaaaaccuuuucugggguguggggugu

SEQ ID NO: 20029 - RNA, 63 nt, Human
uugagaaaaagguaauaaugauuuugucagaauucuuugaauuuauauuuacuagcuacuuaa

SEQ ID NO: 20030 - RNA, 85 nt, Human
caugucuugcaugcguguuuucauugguuuucucccuuacugcuucauuuaggaggguguugauuagaggaagcaacaggacaug

SEQ ID NO: 20031 - RNA, 83 nt, Human
cugccaaauauccauuagacauugagugagaaacaggucacaagauugccacucccuuaagcaggaucuagguauuuagguag

SEQ ID NO: 20032 - RNA, 80 nt, Human
gaguuagcaucaugaauuugcuuuucuccucuaaaaugcaaagguuagauucaaauuaucaugauugucagcugucacuc

SEQ ID NO: 20033 - RNA, 97 nt, Human
gcugccuuccuugagcuccccaggagucgguuuccacaucugugagguggagggcugguguggaggugcucauggggugcggugcuugggagacagc

SEQ ID NO: 20034 - RNA, 67 nt, Human
gcuucaaccugaguucugcguuauaaagccuggagaaagcuaagcuuagaacauaacuugcugaagu

SEQ ID NO: 20035 - RNA, 66 nt, Human
ugcuauuguauuauccauuaguucuguaauauuuaauuuuagauucuuuuauuuuuuuaauuggca

SEQ ID NO: 20036 - RNA, 76 nt, Human
uuaucuuuuuguagcaggaauuuaugugccagaggugagagucuuucugguacugauuuuuugagaccaaggauaa

SEQ ID NO: 20037 - RNA, 70 nt, Human
uuauguauauguacugucuaaaacaauacuuuuuuaaaaaaaaggaacaguugggagaaaauaaauauaa

SEQ ID NO: 20038 - RNA, 64 nt, Human
gguccuggauguggugcggaaggagugugaaaacugcgacugccugcagggcuuccagcugacc

SEQ ID NO: 20039 - RNA, 82 nt, Human
ucgcuguggggcggcacgugcuccggcaugggcacguugcucaucagcaaggugcgugaggaguaugccgaccgcaucauga

SEQ ID NO: 20040 - RNA, 71 nt, Human
ccaccucuuuucccccaagcccaacaauccuuugagguacucaugauugagcgcguggugggggggggugg

SEQ ID NO: 20041 - RNA, 92 nt, Human
uuauuuccuggcaacugcucucuguaccgacaaaaucuaucccaaggcauugaccuugugauuagauuuacacagagcuuuugcuuuuauaa

SEQ ID NO: 20042 - RNA, 69 nt, Human
cgcacgcgcuauguggagcauguguguaugagccacacauacacgcagaaaaaguauguagcgacgucg

SEQ ID NO: 20043 - RNA, 65 nt, Human
uagaguguguguauguguguauguuuaaauaauacauuugacuagggcgcaguugcucauaccug

SEQ ID NO: 20044 - RNA, 70 nt, Human
gucgcugggauagaagccuuugaccaagcaggucaggcugaccugguucuuggucagcucaucccgggau

SEQ ID NO: 20045 - RNA, 74 nt, Human; identical to SEQ ID NO: 9061

SEQ ID NO: 20046 - RNA, 66 nt, Human; identical to SEQ ID NO: 2802

SEQ ID NO: 20047 - RNA, 65 nt, Human
gcuccuccagucaccccacagaugccauuucaccaagaaaaugggguggugggaagcuugggagc

SEQ ID NO: 20048 - RNA, 130 nt, Human
ccagugccccuggggcagcugguaguguccagaagaauggacaccugcuccagauuuagaugcccaucugggcuuuuguuugauuugcggcguuccugucuucuguaaagcuagugaguugucccaagag

SEQ ID NO: 20049 - RNA, 76 nt, Human
gaggaguaugggguagagcaauggucugggccaaggaauggugagcuuagggucuuccucugacuccuuacuccuc

SEQ ID NO: 20050 - RNA, 64 nt, Human; identical to SEQ ID NO: 3174

SEQ ID NO: 20051 - RNA, 70 nt, Human; identical to SEQ ID NO: 3175

SEQ ID NO: 20052 - RNA, 99 nt, Human
ugaguuuuuaaacaugcuuuuagacaaaggugcugugaagaccaaaaauugcuuuuuugaaaucauaaagccuuuugacaaguacauaaugagacuuca

SEQ ID NO: 20053 - RNA, 94 nt, Human
uugaacuugaaacagaaaccugugcuaaaaugcuugccucauucaaauguuccuuaaaaccagagcacagagauuuuugcuuuuuuacuaucaa

SEQ ID NO: 20054 - RNA, 72 nt, Human
gagcaucucaagggggccuuauucaauucuagguaacuagccaggugugaaagaaagggcccagggugucuc

SEQ ID NO: 20055 - RNA, 65 nt, Human
gcagaggaagauuggagaccaggaacaugauuuuaaauuaugugccuuuacugcagcuuucuugc

SEQ ID NO: 20056 - RNA, 70 nt, Human
ggagggacagauaacauuguuuuauggggacucagaaagauucauuauuuuauaugucauaugucccuuu

SEQ ID NO: 20057 - RNA, 86 nt, Human
ggagucucacugucacccaggcuggaguguagugcugcgauccugacucgcugcaaccuccaccucuggaguucaggugauucucc

SEQ ID NO: 20058 - RNA, 82 nt, Human
ugcagguuuguuacauagguaaaugugugcuaugguggugugcugcaccuaucaacccaugaccaagguauuaagcucagca

SEQ ID NO: 20059 - RNA, 70 nt, Human
gcaggagagcauacuuggcaaggaugagaauaccugugugauaaacacagcaucugcacauauuuccugc

SEQ ID NO: 20060 - RNA, 75 nt, Human
cuucaguuguccuugugauugggaaauuuguccgugaauucuucagugggauuucucacuccaucauguuugaag

SEQ ID NO: 20061 - RNA, 106 nt, Human
guggaucgaauuuugaaguugugcacagauauuuuuuuaguucgagagacaggagaacuggagcuagaagaagaucucuaugccaaauuaauauuccuauauccgc

SEQ ID NO: 20062 - RNA, 65 nt, Human; identical to SEQ ID NO: 7359

SEQ ID NO: 20063 - RNA, 92 nt, Human
ggacaccaucuuuauaaaaguaaaacuucuagauccugaaauguacuacaguagagucuauaguuuacacuuuuaaucacagauuggaauuc

SEQ ID NO: 20064 - RNA, 64 nt, Human; identical to SEQ ID NO: 7360

SEQ ID NO: 20065 - RNA, 112 nt, Human
gcuaccugccaaaaauucaugcugagccugaacuuccaagugacagcagaacugaaaaugguaugucugcacaaaugccaaggcuaagugagugacacaggcauguuacagc

SEQ ID NO: 20066 - RNA, 99 nt, Human
gguacaagauuuuuaaaauuuuucuuuuaauaaaaaagcuuuacacaaacaagccauuagcuuauuucaagaaagaaaaucgaaaauuagucuaaggcc

SEQ ID NO: 20067 - RNA, 68 nt, Human
ggaggagucggacgaggauaugggauuuggucucuuugacuaaucaccagaaagcaaccaacuuagcc

SEQ ID NO: 20068 - RNA, 69 nt, Human
uggcugcugcccuguggugcugcacacagcugcuccugcugcugcgcaccccagcuaagguugaagcca

SEQ ID NO: 20069 - RNA, 60 nt, Human
gacauucugccagguuuucuugggcaaugacaccaagaaguugacagccaggugaauguu

SEQ ID NO: 20070 - RNA, 81 nt, Human
ggaaucugcuugaucagagacucugaggccaaaaacucaucauaacuugcuggccagcgucuuugaccaguuuaggauucu

SEQ ID NO: 20071 - RNA, 96 nt, Human
aaguccaacaucccgggccguucuguauuuaugucgccacaguugcuuguuuguaguggcauagaugacagcaucucucauccgauggcuggucuu

SEQ ID NO: 20072 - RNA, 68 nt, Human
aguuuaggauaaacacauggcacaguaaccaaauccagucucucauaucccguauuuuuucuuuagcu

SEQ ID NO: 20073 - RNA, 73 nt, Human; identical to SEQ ID NO: 4293

SEQ ID NO: 20074 - RNA, 64 nt, Human; identical to SEQ ID NO: 1642

SEQ ID NO: 20075 - RNA, 93 nt, Human
gccauaugagccacuucucagccaccaugucuuuaaauucaucgacauugaacuuggugaagccccauuucuuugagaaguggaucgucuggc

SEQ ID NO: 20076 - RNA, 70 nt, Human
guucaucucagccacagacaccauccggaagaugaagaacgauuuccggaagauggaggaugagauggac

SEQ ID NO: 20077 - RNA, 72 nt, Human; identical to SEQ ID NO: 6340

SEQ ID NO: 20078 - RNA, 63 nt, Human; identical to SEQ ID NO: 123

SEQ ID NO: 20079 - RNA, 64 nt, Human
ccccacgcucaguccuggucaaaggcugccagaccuuucugagugcccccaggaggggcugggg

SEQ ID NO: 20080 - RNA, 91 nt, Human; identical to SEQ ID NO: 124

SEQ ID NO: 20081 - RNA, 63 nt, Human
guagugcuugucacauaguaagccuuuguuguuguuagcgcuuacuguguaacaaaucacugc

SEQ ID NO: 20082 - RNA, 131 nt, Human
uugccuaagcuggaguacauuggugugaucuuggcucacugcaaccuccaccucccaggggaaucgcuugaaccccggaggcggagguuguggugaacugaaaucgccccauugcacuccagccugggcaa

SEQ ID NO: 20083 - RNA, 67 nt, Human
uccaggacagcauuggaaaagacauagaaaaaggcuuugccaaucuauuuuauucccucuccaugga

SEQ ID NO: 20084 - RNA, 81 nt, Human
gagguuggcccccugaggugugagugaaaugagcuuugcuuuauuuuccaaguuucucucucaccuucaggggcauucuuc

SEQ ID NO: 20085 - RNA, 71 nt, Human
guggccgagguaauugcauugccuguggaacaggggaacuuuccguaccugcagugggugcgccaggucac

SEQ ID NO: 20086 - RNA, 61 nt, Human; identical to SEQ ID NO: 2940

SEQ ID NO: 20087 - RNA, 86 nt, Human
ugguucauggggaaaaacauuaaaauuaaaaaguccaaucaauuauagagguggcuuuaacacuuaaaguuuucucccucaaacca

SEQ ID NO: 20088 - RNA, 122 nt, Human
aauauguucauugcuuguauuuuuaaaacaacagaauuuccaguaugaaacaggcugaaagagcaggaagaaauguucuuuguauaauaaugggaaguuuggaauauaaaaguuuauauauu

SEQ ID NO: 20089 - RNA, 77 nt, Human
gcaucccuaauguucuuccucuagucaguuugcuuugcugaaagcucccuggaauuaguucaagucuaccgggaagc

SEQ ID NO: 20090 - RNA, 82 nt, Human
guuuccauuguguuuugccgaucuucuggcuaaucgugguauccuccauguuauuaguaauucuguauuccauuuuguuaac

SEQ ID NO: 20091 - RNA, 72 nt, Human
uguguuugcuguuuuccaucauguguuauccuaagaguugggguuuuuuuaaaaucuguuucaccaggcgca

SEQ ID NO: 20092 - RNA, 60 nt, Human
gacuaagaacaagacuggaaauaguuuagaaaagaaaugaaaaccggucguggagauguc

SEQ ID NO: 20093 - RNA, 71 nt, Human
gaaaggucauguucccuguccggguggacgcuaggauaaaaaggggucugucggaaugggguuaaccuuuc

SEQ ID NO: 20094 - RNA, 88 nt, Human
augaugcgcgucuucuuguugucccgagccgcguugcccggcgacuccgggaucucggcggucagauaauacgaagccgcagcacugu

SEQ ID NO: 20095 - RNA, 95 nt, Human
uguuaaugccagacugccgaccaugggcgaugagugacuuugaccagcagcuuguucaguuccucgucguugcguauggccagcuggaggugacg

SEQ ID NO: 20096 - RNA, 75 nt, Human
gacaacauaaugagacccccaucucuacagaaaaauuaaaaaauuagccaggcgggguguugcauguuuguaguc

SEQ ID NO: 20097 - RNA, 60 nt, Human; identical to SEQ ID NO: 11695

SEQ ID NO: 20098 - RNA, 86 nt, Human
gcugacacgauggagaagguaugugcaggggacuccuggagggggacgagguuuucagcacagccuucauguuccccgugcucagc

SEQ ID NO: 20099 - RNA, 63 nt, Human; identical to SEQ ID NO: 11697

SEQ ID NO: 20100 - RNA, 94 nt, Human; identical to SEQ ID NO: 15195

SEQ ID NO: 20101 - RNA, 63 nt, Human; identical to SEQ ID NO: 527

SEQ ID NO: 20102 - RNA, 73 nt, Human
uaguaagaacagaaaugcagccuacacacccaauucgucuuggucuggcacuaaauuucucagucuuuuacua

SEQ ID NO: 20103 - RNA, 79 nt, Human
ccgcuggucguggcgaaagagccggcggagccggagacccgcucccggagacgccgacucgcgauccccgcgcgggcgg

SEQ ID NO: 20104 - RNA, 88 nt, Human
cacauaaaucagguuuauuuguuuuucagagaguuuguugcuaaacauuuaccagcacacccuaaagagaggagaaaaaaaauaugug

SEQ ID NO: 20105 - RNA, 66 nt, Human
uaaaguagaaaguuggagucaaacacuggaugcagaaauuuuggauuuuucaucacuuucucuuua

SEQ ID NO: 20106 - RNA, 94 nt, Human
aaguauaguauaguaaauacauaaaccaguaacauagucauuuauugucauuauuaaauauuauguacaggacauaauugcuguacuuuuacuu

SEQ ID NO: 20107 - RNA, 81 nt, Human
cuggcagugcaauagauuuguuuacaccaguaucaccacaaacacgugagugauguauugcaauacauauggcaucacuag

SEQ ID NO: 20108 - RNA, 79 nt, Human
cuuccuccucucugaccgguuggccagggacuaugcagccaucgucuucuuugcuaacaaccgcuuugagacagggaag

SEQ ID NO: 20109 - RNA, 72 nt, Human
gcaucacccucaagagcugccggagacaguuugacaacuuuaaacgggucuucaaggugguagaggaaaugc

SEQ ID NO: 20110 - RNA, 68 nt, Human
gcccucccggcaggcacuacucaucgagagguacuaugccuuugaugaggccuuuguucgggaggugc

SEQ ID NO: 20111 - RNA, 95 nt, Human
gucgccaugaccagugagcuggacaucuucguggggaacacgacccuuaucgacgaggacguguaucgccucuggcucgaugguuacucggugac

SEQ ID NO: 20112 - RNA, 82 nt, Human
uacacucugaucgagauccuauuccagauguuccugcaguauacuuuguaaugccaacugaagaaaauauugacagaaugug

SEQ ID NO: 20113 - RNA, 67 nt, Human
uuauuaagcuccuguuaaauaugcacauacagacacacguugaaauuccauuucaggggcuuuauag

SEQ ID NO: 20114 - RNA, 75 nt, Human
ccucuggccccgucccucuuuucuccggcagggacgcaggaugccuuggugcacucuagagacggggaccggagg

SEQ ID NO: 20115 - RNA, 63 nt, Human
gcccagagcugugguauaaauuuuuuuaauaggcugaaauagaaauaugaauagcauuugggu

SEQ ID NO: 20116 - RNA, 66 nt, Human
ggggccccaacgcgggcuuagccucccgccuuggcucgggcaggcgcccgucgacccuucggcccc

SEQ ID NO: 20117 - RNA, 71 nt, Human
uucacaagacagugaugaugaaaaaaugccagaucuggaguaaggaauaugucaucaccuggauuugagaa

SEQ ID NO: 20118 - RNA, 60 nt, Human
gccagggcaggguguggggacugccacacagcccacguacaucucuccuccuugcuuggc

SEQ ID NO: 20119 - RNA, 78 nt, Human
gugacauccugcacagagucaauuaugaauguguuguuuuaaaccauuauaugaguaccauucugcaaaggauuccau

SEQ ID NO: 20120 - RNA, 75 nt, Human
cauuguccccacugcauugccaucuugaagauuugucacacucugacaggagaaggcuuguuuggcaugacaaug

SEQ ID NO: 20121 - RNA, 60 nt, Human
cgggagccgcauggagccccgggcggcggacggcugcucccugggcgacguggguuucug

SEQ ID NO: 20122 - RNA, 66 nt, Human; identical to SEQ ID NO: 5852

SEQ ID NO: 20123 - RNA, 62 nt, Human; identical to SEQ ID NO: 5854

SEQ ID NO: 20124 - RNA, 62 nt, Human
uucuucauccagaugcugacuuuggguaugauuauccauccguuuugcauuggaaauuagag

SEQ ID NO: 20125 - RNA, 70 nt, Human
acggaggggaggagacucaguuccucuucaucccuuuacuuccugauaaacuugucucacuuuacucugu

SEQ ID NO: 20126 - RNA, 67 nt, Human
ggccugccaucacugugcacccacacaccaccagcuguaacccaggcacaggaccucaaggugggcc

SEQ ID NO: 20127 - RNA, 77 nt, Human
ucugaauuauccuggcugucuuuaguugcuaucgguccuggucuuggcuacuaacaucauccagccagguguucaga

SEQ ID NO: 20128 - RNA, 74 nt, Human
accuacuuugagauggcaagaacugcuggagacacacuggauguuuuuaccaugauugacaucuuuaaguaugu

SEQ ID NO: 20129 - RNA, 78 nt, Human
gcagcgucuggucacucgcucuccucuggggacugcagagaagcaggaccucgggccaugggguguuuugaaugcugu

SEQ ID NO: 20130 - RNA, 84 nt, Human
cucccggucaucaucuucaccacguucuggggccucgucgcaucgccgggcccugguucgugccgaagggacccaaccgcggag

SEQ ID NO: 20131 - RNA, 62 nt, Human
gacauguuuauuaauuaaacuaucacuuaaauaaaaaaaagugcauagaaaauaaacauguu

SEQ ID NO: 20132 - RNA, 60 nt, Human
uuuuccuuuuuuuuuuuucucuuuuucucuaaccagaagcuuggaagaacacaaggaaaa

SEQ ID NO: 20133 - RNA, 75 nt, Human; identical to SEQ ID NO: 74

SEQ ID NO: 20134 - RNA, 67 nt, Human; identical to SEQ ID NO: 836

SEQ ID NO: 20135 - RNA, 87 nt, Human; identical to SEQ ID NO: 76

SEQ ID NO: 20136 - RNA, 71 nt, Human; identical to SEQ ID NO: 77

SEQ ID NO: 20137 - RNA, 87 nt, Human
gcgcgucugugauucuuccuucuugacuuuuugcugccuucucuccccgcagcggacuuuaggggauuacaggaugauaggcugcgu

SEQ ID NO: 20138 - RNA, 76 nt, Human
uccgcagugugagaaguagauaggguuacugguuacgucaguaaaaccgaggcucaguuuaaucuugagaugcggg

SEQ ID NO: 20139 - RNA, 73 nt, Human; identical to SEQ ID NO: 18603

SEQ ID NO: 20140 - RNA, 64 nt, Human; identical to SEQ ID NO: 1642

SEQ ID NO: 20141 - RNA, 70 nt, Human; identical to SEQ ID NO: 3190

SEQ ID NO: 20142 - RNA, 62 nt, Human
gccaucacugccacccagaagacuguuggauggccccuccgggaaaacuguggcgugauggc

SEQ ID NO: 20143 - RNA, 65 nt, Human
gccgcaucuucuuuugcgucgccagccgagccacaucgcucagacaccauggggaaggugaaggu

SEQ ID NO: 20144 - RNA, 72 nt, Human; identical to SEQ ID NO: 3442

SEQ ID NO: 20145 - RNA, 62 nt, Human
ccuuccuguccgcccucuuccccucuaaugcucacgcucccaacacaaggugggcagggagg

SEQ ID NO: 20146 - RNA, 89 nt, Human
ggcugggccaagccagggauggggccacagccagaaccccgagcccuacuuccagguucugguuagcucagccccagcccagcccagcu

SEQ ID NO: 20147 - RNA, 90 nt, Human; identical to SEQ ID NO: 2702

SEQ ID NO: 20148 - RNA, 119 nt, Human
gagaaggagaucggcuugugguuucacccugaggaacugguagauuacacgagcugugcucagaacuggaucuaugaaugacaggagggcagaaccacauugcuuuucacauccauuuc

SEQ ID NO: 20149 - RNA, 73 nt, Human; identical to SEQ ID NO: 721

SEQ ID NO: 20150 - RNA, 82 nt, Human
ggggaccggucucaccgaaugcauccugucgggcaucaugucugugaacgggaagaaggugcugcacauugaccggaacccc

SEQ ID NO: 20151 - RNA, 63 nt, Human; identical to SEQ ID NO: 722

SEQ ID NO: 20152 - RNA, 60 nt, Human; identical to SEQ ID NO: 723

SEQ ID NO: 20153 - RNA, 82 nt, Human
cuggagcagcugcguaaaacauuacaggccggagcuuaucaaagauggcaaguuuggggccuacaugcaggugcacauucag

SEQ ID NO: 20154 - RNA, 65 nt, Human
uucagaaugaugggccugugaccauagagcuggaaucgccagcucccggcacugcuaccucugaa

SEQ ID NO: 20155 - RNA, 68 nt, Human
gaucaacaggcuuauuagaagaaugaacuaaggugucuaccaugauuauuuuucuaagcugguugguu

SEQ ID NO: 20156 - RNA, 94 nt, Human
gccccucucagcagacgcuucaugauaggaaggacugaaaagucuuguggacaccuggucuuucccugauguucucguggcugcuguugggggc

SEQ ID NO: 20157 - RNA, 61 nt, Human
gcgggagagucuguguguaugugucuuccccggaauccacaacacagcacccuccuccugu

SEQ ID NO: 20158 - RNA, 68 nt, Human
ccggggcucugcgggcgccgggcagagaccugcggccaggucgugucccgugugcccgagagcgccgg

SEQ ID NO: 20159 - RNA, 79 nt, Human; identical to SEQ ID NO: 6595

SEQ ID NO: 20160 - RNA, 86 nt, Human; identical to SEQ ID NO: 7823

SEQ ID NO: 20161 - RNA, 73 nt, Human; identical to SEQ ID NO: 7824

SEQ ID NO: 20162 - RNA, 84 nt, Human
ggccgcccggaacaccuucaccuucugcugcacgaaaugcuucuucuuggucuuggaggcgaagccgaaaccugggccggggcc

SEQ ID NO: 20163 - RNA, 98 nt, Human
aggagaagaccuucaagcuuuacauuuggacuuggacgcaagaacuucaggaggauggagucacuugugguauugauguggacuuugagguuuggccu

SEQ ID NO: 20164 - RNA, 68 nt, Human; identical to SEQ ID NO: 10839

SEQ ID NO: 20165 - RNA, 70 nt, Human
ccuccugacacccuucucccacucuccuaggcauucuggaccucuggguugggaucagggguaggaaugg

SEQ ID NO: 20166 - RNA, 130 nt, Human
ggagguccccuucuauuggggcuugugauuccuuuugacggggcuugagguccucagggguuuucuucccauuaccgggcuggcccccuguuuuccgauuuguuugucccugggcgggaguauggccucc

SEQ ID NO: 20167 - RNA, 93 nt, Human
uccauaaauccuugaugauugacaacacccauuuuuccuuuugccgaccccaagaguuuugggaguuguaguuaaucaucaagagaauuuggg

SEQ ID NO: 20168 - RNA, 65 nt, Human
gaggaagacggugcccgauccauccacagaaaaaccuucuaaugucgggacaucaucuucaccuc

SEQ ID NO: 20169 - RNA, 77 nt, Human
uauuccacguggauugggggcuccaucuuugccucccuggacaccuuuaagaagaugugggucuccaaaaaggaaua

SEQ ID NO: 20170 - RNA, 65 nt, Human
gguugcaggaacccaaggcgugaacgauggugacaugcggcuggccgaugggggcgccaccaacc

SEQ ID NO: 20171 - RNA, 64 nt, Human
ugagauccaggucaguugugauuaauuuuucucuguauuaugcaauguauuuuccugcuuuuca

SEQ ID NO: 20172 - RNA, 99 nt, Human
gagaaugaugguucucugcuuuauaucuccaacuggaauaaugcauuauuuaaccauuuucuccauuguuggauccuagaguuguuuccaguuuuucuc

SEQ ID NO: 20173 - RNA, 67 nt, Human
guuuuauuccaucccuguaucaaccuauuuaacacuucagcaggaccuggugcauguggauugauac

SEQ ID NO: 20174 - RNA, 77 nt, Human; identical to SEQ ID NO: 15248

SEQ ID NO: 20175 - RNA, 96 nt, Human
gacaauggcagcaucuacaacccugaagugcuugauaucacagaggaaacucugcauucucgcuuccuggaggguguccgcaauguugccaguguc

SEQ ID NO: 20176 - RNA, 63 nt, Human
gaguccuggccuugucuguggagacggauuacaccuucccacuugcugaaaaggucaaggcuu

SEQ ID NO: 20177 - RNA, 87 nt, Human
gauccauuuucacuuauuggagagagcacgauuuauuguggugacaauucaguguggagucgugcugcuccagaguguaaagugguc

SEQ ID NO: 20178 - RNA, 81 nt, Human
uuacuacaaagcaacaguuauguuugaaugcgauaaggguuuuuaccucgauggcagcgacacaauugucugugacaguaa

SEQ ID NO: 20179 - RNA, 63 nt, Human
guuccuucauucugaccuucaaauguguagagagcuuugcacgucccuauggcagggaggggc

SEQ ID NO: 20180 - RNA, 67 nt, Human
acacugcgcugauggcacgguucucagucgcgcgagacacggaggagacagaggcgauggugcgugu

SEQ ID NO: 20181 - RNA, 74 nt, Human
cgcucuguuacccaggcuggagugcaguggcaagaucuuggcucaccgcaaccuccaccuccagguuucaagcg

SEQ ID NO: 20182 - RNA, 68 nt, Human
gacucguauccacaacuguaguaucauacagaacauguuuuguuuuguuuuguuucugagauggaguc

SEQ ID NO: 20183 - RNA, 63 nt, Human
gucaccucaagucuauaguuuacauuagaguucacucuugguguacauucuguagguuuugac

SEQ ID NO: 20184 - RNA, 77 nt, Human
ugccccguuacucuuagugugauagacuaccacgcugguuuauguucagcguuccccuauauuguuguuucggggca

SEQ ID NO: 20185 - RNA, 61 nt, Human
cuuguuguggaggcugcugcgggcgcaaagggcacuuuucugugauagugucgacggugag

SEQ ID NO: 20186 - RNA, 73 nt, Human
gguguuccugcagcguccacacagaggcagcagcucuaaugaaugauuagcuuguggaguuguggcaaauacc

SEQ ID NO: 20187 - RNA, 99 nt, Human; identical to SEQ ID NO: 18352

SEQ ID NO: 20188 - RNA, 62 nt, Human
ucguggugaucuaggcauugagauuccugcagagaaggucuuccuugcucagaagaugauga

SEQ ID NO: 20189 - RNA, 100 nt, Human
uugcaauuauuugaggaacuccgccgccuggcgcccauuacacagcgaccccacagaagccaccgcgugggugccguggaggccucuucaagugcugcag

SEQ ID NO: 20190 - RNA, 87 nt, Human
gguaggcgcaguaccguguaucguagguagcaguaggaacgggggccgccgcggccugcagccgcucauggcggugaggugugugcc

SEQ ID NO: 20191 - RNA, 68 nt, Human
ccgcgugcaguaccaguucgagauggagagcuucgacuccauccccggccuggugcgcugcuacgugg

SEQ ID NO: 20192 - RNA, 65 nt, Human
gcccagggaaggccaaccgaauugcucacggcagcagaauggagggccagucccggaaucugggc

SEQ ID NO: 20193 - RNA, 72 nt, Human; identical to SEQ ID NO: 2728

SEQ ID NO: 20194 - RNA, 118 nt, Human; identical to SEQ ID NO: 3011

SEQ ID NO: 20195 - RNA, 123 nt, Human
ggugccccucacccugccuauccgcauagcacgccccgccagaacuaccacaggcaauacaagcacuggugccccugaccggcagcugcgcgcacggcaggccugccuaucccucacagcacc

SEQ ID NO: 20196 - RNA, 65 nt, Human
ucaugcugcagcauauuguacuggccugcugcuggcccgcaggcuucucaauagguucggcaugg

SEQ ID NO: 20197 - RNA, 78 nt, Human
guguggagacugagagguuaacugucuugcccagcgcaagucaacagcaaaacggaacuaaaauuucaggcucgacac

SEQ ID NO: 20198 - RNA, 70 nt, Human
ccaccggguaucuagccuguggccaccccggagaugacacgaggcucacaugacucuagacacuuggugg

SEQ ID NO: 20199 - RNA, 67 nt, Human
gcuccagcagcgagggguucgcguuacuuaggaacagcagcucuuuuugcccuucuucuguaggagc

SEQ ID NO: 20200 - RNA, 88 nt, Human; identical to SEQ ID NO: 8544

SEQ ID NO: 20201 - RNA, 76 nt, Human
aaauagugauuccaaagacaagguuucccuggaacccaccagauguacaagaaacaaaucuuuagguuugccauuu

SEQ ID NO: 20202 - RNA, 74 nt, Human
aggaaacagaaaguuugagccuauaagccucuuuaucccaaucaaauggcuaacguccacucuuucuggcuucu

SEQ ID NO: 20203 - RNA, 68 nt, Human
guggauuugacccuccuguugguuaguuagcuucagaauggucuauaaccagacaaagucaaauucac

SEQ ID NO: 20204 - RNA, 66 nt, Human; identical to SEQ ID NO: 4822

SEQ ID NO: 20205 - RNA, 67 nt, Human
auaaugaauuauaaaacuuugauaguuacauuguacuaucauuuaugaggcauuuauuuuucauuau

SEQ ID NO: 20206 - RNA, 73 nt, Human
uacaccugaaagaaacuucauacuuguguguucuguuccccaucucagagcaagauuaugaagagaaggucua

SEQ ID NO: 20207 - RNA, 66 nt, Human; identical to SEQ ID NO: 4823

SEQ ID NO: 20208 - RNA, 71 nt, Human; identical to SEQ ID NO: 2059

SEQ ID NO: 20209 - RNA, 85 nt, Human
caacauuagacauuucuuucaguacugguuuugucccuaucugccaggggcaaagaaagaugaaaagauaauuuauccuauguug

SEQ ID NO: 20210 - RNA, 63 nt, Human
ggcauuagcuagauaagguauaauaaaacuuccuuaccuacaaauuugaaacauguugauguc

SEQ ID NO: 20211 - RNA, 90 nt, Human
gugaguugagcgcugcugcuccgcgguggagucaccgcaccgcucccgggaucaugguguucuacuucaccagcagcagcguuaauucau

SEQ ID NO: 20212 - RNA, 89 nt, Human; identical to SEQ ID NO: 6085

SEQ ID NO: 20213 - RNA, 111 nt, Human
gcugaagcaucagaagaaacagaugaaaaugauuugauccuggaaguaacugcaggaguuggaggucaggaggcaauguuguuuacaucagagauauugauauguaucagc

SEQ ID NO: 20214 - RNA, 74 nt, Human; identical to SEQ ID NO: 521

SEQ ID NO: 20215 - RNA, 61 nt, Human
guugcuugacgggcacccacggccagcccacaaggcuauccuggccgcccgcuccagcuac

SEQ ID NO: 20216 - RNA, 84 nt, Human
aaaauauuuuuuaaauuuuuaaaauuugauuuuaaauuucaaauaaauuuaaauaaauuuuaaauaaauuuuaaauaaaauuuu

SEQ ID NO: 20217 - RNA, 74 nt, Human
ccuuaguuucuuagcccaugaaacgagaucauugccugacaccagggacuaccucaagggcuuuugacuugagg

SEQ ID NO: 20218 - RNA, 68 nt, Human
gcuaagaauucagaugucaggaagucugugaaucuugauggauuuucugagaaaccugacucaauggc

SEQ ID NO: 20219 - RNA, 94 nt, Human
uaagagggaaguaagacuuuuaagaaaagaaaaaguuaugccucauuccucauguggcuuccaauaaguaucuuaggaacuuauuuccuuuuua

SEQ ID NO: 20220 - RNA, 83 nt, Human
ggggggaaggguggucaccgcucagacguccagauagggaagcacgcuucccuaacgccgugccaggguggcgaucucccccc

SEQ ID NO: 20221 - RNA, 67 nt, Human
aagcaaaaaggaauguuuuacaacaaagcuuauuaaaacaucugguuccuggaauauuucuugguuu

SEQ ID NO: 20222 - RNA, 84 nt, Human; identical to SEQ ID NO: 286

SEQ ID NO: 20223 - RNA, 89 nt, Human; identical to SEQ ID NO: 288

SEQ ID NO: 20224 - RNA, 77 nt, Human
acggccgaggggguagcuuuaacugugacgggugucgcccaggugaagaucaugacggagaaggaacuccuggccgu

SEQ ID NO: 20225 - RNA, 85 nt, Human
cgagggcccuccgugccgccggcgccaugggcaauugccacacgguggggcccaacgaggcgcuggugguuucagggggcuguug

SEQ ID NO: 20226 - RNA, 116 nt, Human
uuccgggaagcugaguugaaaaagggaauagugagauguagaaauuucaaggggacacccaagauaugugagauuuaaaggagacauuaaagcuggaaagaagacuucauaaggaa

SEQ ID NO: 20227 - RNA, 73 nt, Human
cugugcccugacccuacaagaugccaagagaagaugcucacuucaucuaugguuaccccaagaaggggcacgg

SEQ ID NO: 20228 - RNA, 67 nt, Human
gccuccuccugaauccucucucaguccuccaacacuaccaagaagaaaagcaauuauucaggauggc

SEQ ID NO: 20229 - RNA, 84 nt, Human; identical to SEQ ID NO: 286

SEQ ID NO: 20230 - RNA, 89 nt, Human; identical to SEQ ID NO: 288

SEQ ID NO: 20231 - RNA, 61 nt, Human; identical to SEQ ID NO: 776

SEQ ID NO: 20232 - RNA, 66 nt, Human; identical to SEQ ID NO: 1888

SEQ ID NO: 20233 - RNA, 69 nt, Human; identical to SEQ ID NO: 10828

SEQ ID NO: 20234 - RNA, 65 nt, Human; identical to SEQ ID NO: 1245

SEQ ID NO: 20235 - RNA, 76 nt, Human; identical to SEQ ID NO: 5199

SEQ ID NO: 20236 - RNA, 84 nt, Human; identical to SEQ ID NO: 1246

SEQ ID NO: 20237 - RNA, 84 nt, Human
cguugauuuugggccuauugaagacaccugcucaguaugacgcuucugagcuaaaagcuuccaugaaggggcugggaaccgacg

SEQ ID NO: 20238 - RNA, 62 nt, Human
gaaucucuacguugcuuaacccuuuuggcguguaccagaggcaagguaaugucgggggaauc

SEQ ID NO: 20239 - RNA, 69 nt, Human
gggucugucacuugauuaugaacugguugaccaagauggucggaucucaugacgcugagugacaggaac

SEQ ID NO: 20240 - RNA, 70 nt, Human
agcuagaagaccuguugcggaagguucgcgccaaggagaccaggaagcgagcacucagcagguuaaagcu

SEQ ID NO: 20241 - RNA, 68 nt, Human; identical to SEQ ID NO: 18170

SEQ ID NO: 20242 - RNA, 74 nt, Human
gugaucucugugggcauuuauaaucugguccagaaggcucucaagccuccuccaauaaagcucuaucgggaaac

SEQ ID NO: 20243 - RNA, 77 nt, Human
gcaccagcucuugggccucaaccuccucuuccugcugucccagaaccggguggcugaguuccacacggaguuggagc

SEQ ID NO: 20244 - RNA, 65 nt, Human
ggcgaguggaaccguaaaagccccaaucuuagcaagugcggggaagagcugggucgacucaagcu

SEQ ID NO: 20245 - RNA, 71 nt, Human
aggacuagagcucaugcugaucaugucggucagggguuugacuggcagaguacggcugcuguuggaguuuu

SEQ ID NO: 20246 - RNA, 74 nt, Human
guuuugaaagcuguacaauuuggugaauggagugaccaaccucgcauaaccaaagaugugauuuguuuucaugc

SEQ ID NO: 20247 - RNA, 63 nt, Human
gggaggccaacuugaaaaaggccccaccaaaaagguagcgcuggccaccaaagagggccuucc

SEQ ID NO: 20248 - RNA, 61 nt, Human
gugggaaccccuuugccugaacgccuuacuaauggcaaguuuaaccccccgggguucccac

SEQ ID NO: 20249 - RNA, 71 nt, Human
ggacuugucuugguuccagaaccugacgacccggcgacggcgacgucucuuuugacuaaaagacagugucc

SEQ ID NO: 20250 - RNA, 71 nt, Human
ggucagcaguccuagcccccaacagccccagagcagggguucuccaaagggggaacuuggagggcugaacc

SEQ ID NO: 20251 - RNA, 73 nt, Human
gcgggccgcugccaugacgaccgccaucuuggagcgccugagcacccugucggucagcgggcagcagcugcgc

SEQ ID NO: 20252 - RNA, 75 nt, Human
accgggggcccccuuauuguuuggggcaaagggccagggccccggaaacgcuccccauauaaaauggcccccggu

SEQ ID NO: 20253 - RNA, 65 nt, Human
gaacaggacccgucgucaugggccgugugauccguggacagaggaagggcgccgggucuguguuc

SEQ ID NO: 20254 - RNA, 79 nt, Human
cugcucuucuucagccauggccagcaaaacagugcagcagacuuguccaugcugguccuggagucccuggagaaggcgg

SEQ ID NO: 20255 - RNA, 60 nt, Human
uggagguggcugacgagcugcuggaaaaucuggcuaaaguguucagccugauggacccca

SEQ ID NO: 20256 - RNA, 97 nt, Human
ggguguguuagccccgccucuucuccuugugggaugcguccggcauauucuugcugggcuucuucccagagguuggagccgcgugcuuuuuuuaccc

SEQ ID NO: 20257 - RNA, 73 nt, Human
gaauuucaacugggugaaucuguaaaauauuuccuggauaacuuggauaaacuuggagaaccagauuauauuc

SEQ ID NO: 20258 - RNA, 98 nt, Human
gguagccggaggggcccgccgaggcggcggcggcggcggcaagauggcggacuuccugccgucgcgguccgugcuguccgugugcuuccccggcugcc

SEQ ID NO: 20259 - RNA, 77 nt, Human
gcagcccgaacaagaucacucaaggugaaggauaaucuacuaauaccagcacuuugaaugaaaauuuguuucucugc

SEQ ID NO: 20260 - RNA, 72 nt, Human
ggcuggcccccaaaguuuccgguucucccccaagugggaaaauaggggggccgaaaccaacagggguuugcc

SEQ ID NO: 20261 - RNA, 70 nt, Human
gagaccgagccauguggcuagaaauccuccucacuucagugcugggcuuugccaucuacugguucaucuc

SEQ ID NO: 20262 - RNA, 70 nt, Human
uuucugggcccugaauucuauuuuaguaaaauaaaauuuuacuaaccagauaggggaugggguuggggaa

SEQ ID NO: 20263 - RNA, 72 nt, Human
gcccuugauguccugcaaaugaaggaggaggauguccuuaaguuccuugcagcaggaacccacuuagguggc

SEQ ID NO: 20264 - RNA, 62 nt, Human
uccccgcuccugaguucacugcuacucaacccugagguugcagacuugggccugaaagggga

SEQ ID NO: 20265 - RNA, 63 nt, Human
ccaccaccaugccugacccauuuggcagcagccucgugugugguggucugguguggacggugg

SEQ ID NO: 20266 - RNA, 67 nt, Human
agggaaagaauugaucgccguuucugguaaaaagcugggaagaugggccuuaaauucuugaaaaccu

SEQ ID NO: 20267 - RNA, 60 nt, Human; identical to SEQ ID NO: 1551

SEQ ID NO: 20268 - RNA, 65 nt, Human
ggcuacguaucccggaggguugcuccuuuugccccguuucggguucuugacccuccaugcuggcc

SEQ ID NO: 20269 - RNA, 64 nt, Human; identical to SEQ ID NO: 3783

SEQ ID NO: 20270 - RNA, 61 nt, Human
gugucacuguagaccccaaauaccaucccaagauuaucgggagaaagggggcaguaauuac

SEQ ID NO: 20271 - RNA, 68 nt, Human
gaagacucucugccuccgccaaaauuuaauuaaaugcauugagaaucuggaggagcuacagagucuuc

SEQ ID NO: 20272 - RNA, 80 nt, Human
gccagggggaaccacgcuugcuugagggcucuggaacugcauccuaccaccaacucggcccaacuggacaagccccuggc

SEQ ID NO: 20273 - RNA, 78 nt, Human; identical to SEQ ID NO: 13410

SEQ ID NO: 20274 - RNA, 79 nt, Human; identical to SEQ ID NO: 1810

SEQ ID NO: 20275 - RNA, 67 nt, Human
cugggcggcggcacgggcucaggcaugggcacgcugcucaucagcaagauccgugaggaguucccgg

SEQ ID NO: 20276 - RNA, 65 nt, Human
gccacacugucggugcaccagcugguggagaauacagacgagaccuacugcaucgacaacgaggc

SEQ ID NO: 20277 - RNA, 88 nt, Human
gccugggcuucgcgggccgcucacccacccgcgggcagcccagcaguaaccgggggcccugaaccguggcccgaacuucaccccaggc

SEQ ID NO: 20278 - RNA, 71 nt, Human
gaagauccucuguagaagaacucggugccccugcgaacucggcaguuaacugcguuccucuggaggacuuu

SEQ ID NO: 20279 - RNA, 67 nt, Human; identical to SEQ ID NO: 3685

SEQ ID NO: 20280 - RNA, 73 nt, Human; identical to SEQ ID NO: 2833

SEQ ID NO: 20281 - RNA, 85 nt, Human
ccaaugcuacacaaccagaaaguaaggcguucuacuugaaaaugaaaggagauuauuuuagguaucuuucugaaguggcaucugg

SEQ ID NO: 20282 - RNA, 90 nt, Human
gggggacugaauggcgcauuccgggcgggagggcaaaacaaccccacugguuuuccccgcccccccuggaaucugccccccguguccccc

SEQ ID NO: 20283 - RNA, 79 nt, Human
ccagccagacaccuccaagcguucaaagugaaggccgugcagagcuggucacugaaaugagccugauaggauaggcugg

SEQ ID NO: 20284 - RNA, 72 nt, Human
gccaucaccccgucugucucccgcaccagcuucaccuccgugucccgguccggggguggcgguggugguggc

SEQ ID NO: 20285 - RNA, 65 nt, Human
ccuuguacacucgcugcgaacacccucguggucuuacgcaucugggugucgcggcgcccacaagg

SEQ ID NO: 20286 - RNA, 63 nt, Human
guggcggggccccggcggccuggggggucuccugggcccccccccacccauggagcccaccgc

SEQ ID NO: 20287 - RNA, 63 nt, Human
cuucuggccuuaugucucaggaaugcaguuuauuuugauuggcaucuucuaccaggccugaag

SEQ ID NO: 20288 - RNA, 63 nt, Human
ucagcccuuacaaucucacaugccuaccucuucugugguaguuccugagccuugaggaguuga

SEQ ID NO: 20289 - RNA, 104 nt, Human
ugcacgcguacguaagcuuggauccucuagagcggucgccuacuacuacuaaauucgcggccgcgucgacaucuggauggcaucuacuucguaugacuauugca

SEQ ID NO: 20290 - RNA, 76 nt, Human; identical to SEQ ID NO: 14654

SEQ ID NO: 20291 - RNA, 73 nt, Human
gagcucagugccuuaccuuugcagggccaggguccccguucuggccaguguuggcuagggacacuugcaguuc

SEQ ID NO: 20292 - RNA, 80 nt, Human
agagguggucugcugaccugugguaucucagaggggacguuccuccuccucccugugcacaggugggcugaccuccugcu

SEQ ID NO: 20293 - RNA, 130 nt, Human
cauuuucuuuucuaauggcauugaaacuuuaaaaaaaauggauucaacuguuuuugcagaauguagaaaguauucuguguccuugguuaaagaaauccacuugugaagugugccuggaaaaugaaaguug

SEQ ID NO: 20294 - RNA, 66 nt, Human
gaggcagguggaucacgaggucaagagaucaagaccauccugaccaacguggugaaacccugucuc

SEQ ID NO: 20295 - RNA, 62 nt, Human
uguuuaucuuuucuuuauucuacuaguugaaacucaauuuuuuaauaugaaacaaauagaca

SEQ ID NO: 20296 - RNA, 67 nt, Human
cuccccaguccucuccuggcaccagcaccuuagaaguuguuggcagaaggcacuuaaacugugggag

SEQ ID NO: 20297 - RNA, 60 nt, Human
gccuccucucccuucugugggucgcucccagagccauggcccaugggaaggacagagugu

SEQ ID NO: 20298 - RNA, 67 nt, Human
uguguccuuggggccuggggggauguugcuccucagcucccucccucagcccugccccucugagaca

SEQ ID NO: 20299 - RNA, 62 nt, Human
gggggugguaaggaggaggcggguuuggacagaaggacaagauacuuccuucuaaagcuuuc

SEQ ID NO: 20300 - RNA, 86 nt, Human
agcuccgcgccgccggcaaugagaguuuccugcaacggccaguacgccgaggccuccgcgcucuacggccgcgcgcugcgggugcu

SEQ ID NO: 20301 - RNA, 76 nt, Human
cacgggggaggaaggaaggagcucccaacucgccuggccuggccacgggauggcccccaaauucccagacucugug

SEQ ID NO: 20302 - RNA, 60 nt, Human
guguucucuacuccaaccgagcagcaugucacuugaaggcauggaaacugcagagacugc

SEQ ID NO: 20303 - RNA, 86 nt, Human
gauggcaagccuagcccccaucccugcccaagaccauccucugcaggacaggccugaugggcgagugguggggcagggcaugccuc

SEQ ID NO: 20304 - RNA, 102 nt, Human; identical to SEQ ID NO: 2172

SEQ ID NO: 20305 - RNA, 80 nt, Human; identical to SEQ ID NO: 367

SEQ ID NO: 20306 - RNA, 78 nt, Human
gagaaugcaaaauucacuuacauuuuaaagacagaacacacuucaugucagugguaggcugauucugauuuugcucuc

SEQ ID NO: 20307 - RNA, 85 nt, Human
gauuuugcucucagaaccccuucccccuucaucaugccccucugcuuuaggguuacgcuaguggaaaaauuugagcagcaaacuc

SEQ ID NO: 20308 - RNA, 111 nt, Human; identical to SEQ ID NO: 1275

SEQ ID NO: 20309 - RNA, 60 nt, Human; identical to SEQ ID NO: 1276

SEQ ID NO: 20310 - RNA, 74 nt, Human; identical to SEQ ID NO: 16717

SEQ ID NO: 20311 - RNA, 105 nt, Human; identical to SEQ ID NO: 11263

SEQ ID NO: 20312 - RNA, 62 nt, Human
agguuuuaggguuaauauacuguuucauauacuguacaaaguuucaucauugcccccaaccu

SEQ ID NO: 20313 - RNA, 74 nt, Human
ggaauuucagagugagagcauauacaauucaaaacacuugcuuugucccuuuucucagagcucugauauuuucc

SEQ ID NO: 20314 - RNA, 78 nt, Human
aggugcaguaaagguccauuguguggcuugagaccuaugaucugaggcuugugcauaauaagauggcagcuguuaccu

SEQ ID NO: 20315 - RNA, 75 nt, Human
ccucaacugcuguucuagacugugggggugcauuccugucucagcaccaaggaucccaacaggcaggcagggagg

SEQ ID NO: 20316 - RNA, 61 nt, Human; identical to SEQ ID NO: 9168

SEQ ID NO: 20317 - RNA, 86 nt, Human; identical to SEQ ID NO: 9092

SEQ ID NO: 20318 - RNA, 65 nt, Human; identical to SEQ ID NO: 247

SEQ ID NO: 20319 - RNA, 65 nt, Human
uagagaauauuugauuuuuguugucaguguauuaaagaaauuuucacauugauaaauguucucua

SEQ ID NO: 20320 - RNA, 75 nt, Human
cuaaucaguuucagcuuugcaggagguuuccugcauaaauugggaaguaacacuggaaaguaggaauuugguuag

SEQ ID NO: 20321 - RNA, 99 nt, Human
ugggaagacuguauauuuauaauuugcauacuacuugcaauuuuuuguuuuucaucacuuguaauaauggaauggaaauguaagcuauaaagacucuca

SEQ ID NO: 20322 - RNA, 70 nt, Human
uucuuaauuuugaugguuggcuauuugacuucucuaaaaaugagaaagagcuauuuuaaaauauaaagaa

SEQ ID NO: 20323 - RNA, 75 nt, Human
acuauucaggcgcaguacaaguuggggcacugcauccuuuguggauggauuuccguugcuguguuccucacaagu

SEQ ID NO: 20324 - RNA, 60 nt, Human
auguaaacuuuuaugaaaaaaauuuaaaguacacuagauuucuucaguaaauuaucacau

SEQ ID NO: 20325 - RNA, 63 nt, Human; identical to SEQ ID NO: 19734

SEQ ID NO: 20326 - RNA, 61 nt, Human
uggggcacugaggcccgggauguaggcacuggacagcagcaacccaggcaucugugcccca

SEQ ID NO: 20327 - RNA, 69 nt, Human
gucucucgaggucaccaugaucccauccaucccuggaccuaggacccucaggcuggccgacgaugaggc

SEQ ID NO: 20328 - RNA, 67 nt, Human
guggucacgcccacaaucuucagcguggccucucccaggucacuguaggagaugcuguagugaccau

SEQ ID NO: 20329 - RNA, 65 nt, Human; identical to SEQ ID NO: 11430

SEQ ID NO: 20330 - RNA, 71 nt, Human
acucauugaaaauggaggcuaugcagaccagaccuaugauggaugggugacacagccccagguuagcgggu

SEQ ID NO: 20331 - RNA, 62 nt, Human
caucuuggucccucucuaggcugugauggaaucugaaaugaaguuugacaaggaccaugaug

SEQ ID NO: 20332 - RNA, 76 nt, Human; identical to SEQ ID NO: 10105

SEQ ID NO: 20333 - RNA, 82 nt, Human
aacagccgaaaccugucuugcaauggggggagggggcguuucgcuuuccuucuucuuggcuuucucucgucuuguggcuguu

SEQ ID NO: 20334 - RNA, 60 nt, Human
gaguuuuuccaugucgagauuuccccuccuuuuccugcggggauucuggacagguugcuc

SEQ ID NO: 20335 - RNA, 106 nt, Human
gugccaggaggugguggacacguacggcaagcuccauccuguccauccugcuggaggaggucagcccugagcuguugugcagcauguugcacuucugcucuggcac

SEQ ID NO: 20336 - RNA, 63 nt, Human
gucugggugcaguuuauucugauuuacucugaggugagcugaaaucaggaccgcagcucgggc

SEQ ID NO: 20337 - RNA, 60 nt, Human; identical to SEQ ID NO: 7400

SEQ ID NO: 20338 - RNA, 66 nt, Human; identical to SEQ ID NO: 2189

SEQ ID NO: 20339 - RNA, 91 nt, Human
augccuggcugggaagucuggggaagggauacagagcuuggugggccuaacaccauucauaucccuuacccucugucucuccucccuguau

SEQ ID NO: 20340 - RNA, 100 nt, Human
gguuagguaacccuugugacccuguaugaagguccacuuccuuccuuuccuccgggagggaauggucuucguggcuuggaauuauaagucaaccugcacc

SEQ ID NO: 20341 - RNA, 69 nt, Human
gcugggcugggcgaguaucucuucgaaagggucacucucaagcacgacuaagagccuucugagcccagc

SEQ ID NO: 20342 - RNA, 98 nt, Human
gugggguaaaacccagacgccaugaaagcggccauggccuuggagaaaaagcuuaaccaggcccuuuuggauuuucaugcccuggguucuugccgcac

SEQ ID NO: 20343 - RNA, 63 nt, Human
ucagaagauugaauugaaaccuuaaaaacuaucauaauaguaggaaugcauguuaagauuuga

SEQ ID NO: 20344 - RNA, 66 nt, Human
ggucuccaugaugauacggggucucuauagucaaagaagaggacuuggcuccccugagugggaacc

SEQ ID NO: 20345 - RNA, 85 nt, Human
guggcagaagaucccagcugaccacggccccuuucucuggggucagagggagaagacaggcgcagucagcaggggcagcuguugc

SEQ ID NO: 20346 - RNA, 116 nt, Human
guggccuuuuuuccuuuuucuguaggccgccuuaagcuuucuaaauuuggaacaucuaagcaagcugaagggaaaaggggguuucgcaaaaucacucgggggaagggaaagguugc

SEQ ID NO: 20347 - RNA, 69 nt, Human
uacugacgaaggugcaugcgcugaaugaugucacggcagucguugaacacacggcggauguucucagug

SEQ ID NO: 20348 - RNA, 75 nt, Human; identical to SEQ ID NO: 1470

SEQ ID NO: 20349 - RNA, 83 nt, Human; identical to SEQ ID NO: 1471

SEQ ID NO: 20350 - RNA, 63 nt, Human
gccaggcaaguggcagagcgaaccugggucuucacacacuuuccucuucuugacuguacuggc

SEQ ID NO: 20351 - RNA, 96 nt, Human
ggaggcccagguccucacccuggcccagcgacucauaaagucaugcaaccaugagcaucacugccuccugggccaaagugagcacaaagguccucu

SEQ ID NO: 20352 - RNA, 63 nt, Human
gcgccggagggcuggcacugcugggggacccauuacacccuccgcagccgcuggcccaggugc

SEQ ID NO: 20353 - RNA, 69 nt, Human
gggcgcccgcacuccucagcucuuggguggucgaugggacugggcgccguggagcaggggguggcgcuc

SEQ ID NO: 20354 - RNA, 81 nt, Human
acaugugaccucgggacgcccaggugugucugcaugugugagcauguacaugagugggugugucuaggugcgugcgcgugu

SEQ ID NO: 20355 - RNA, 69 nt, Human
acaugugcauuggugauuuugaucauccauucuuaauauuugauuucugugucaccuacugucauuugu

SEQ ID NO: 20356 - RNA, 129 nt, Human
gcuggcuuuugucuuuuuaaaaauuucuugaauuugugguuguguccaauuugcaaacauuuccaaaaauguuugcuuugcuuacauaccacaugauuuuaauguuuuuuguauaccauaauaucuagc

SEQ ID NO: 20357 - RNA, 60 nt, Human
uuugauccuguaaucacugaaggguacauacuccauguggacuucccuuaaacaggcaaa

SEQ ID NO: 20358 - RNA, 73 nt, Human
aggcuggagugcaauggcaugaucuuggcucacugcaaccucugccucccagguucaagcaauucuccugccu

SEQ ID NO: 20359 - RNA, 74 nt, Human
gagaaguaccacauaaauauggauucaaagaaacagaaaaaaucuagaaucuugcuauucaaaguguagcucuc

SEQ ID NO: 20360 - RNA, 94 nt, Human
uaucaccugggaguuugugagaaaugcagaaaccugugccccaccuuagacccacagaaucauaaucagcauuuuagcaagaccacaggugaua

SEQ ID NO: 20361 - RNA, 62 nt, Human
gacaaaauauuuggccuaaauuuucaccugcucuauagggauauuuuuacugguguuuuguu

SEQ ID NO: 20362 - RNA, 74 nt, Human
ucaguuuccguagucuauucuuucccucauuuuuuucauuucucugauauuuuuaguuucugcuaucuaacuga

SEQ ID NO: 20363 - RNA, 82 nt, Human
gcguggugggaggcuggggcuggugccugcggacagcuccagauggaaucccaggccacggugcuucuaguauccccccagc

SEQ ID NO: 20364 - RNA, 67 nt, Human; identical to SEQ ID NO: 1347

SEQ ID NO: 20365 - RNA, 66 nt, Human; identical to SEQ ID NO: 3934

SEQ ID NO: 20366 - RNA, 69 nt, Human; identical to SEQ ID NO: 1348

SEQ ID NO: 20367 - RNA, 68 nt, Human; identical to SEQ ID NO: 16754

SEQ ID NO: 20368 - RNA, 65 nt, Human
gcgacccccuccgagaucugcuuauguucccaauggaagauauaucuaucucggugauaggucgu

SEQ ID NO: 20369 - RNA, 67 nt, Human
gccaucugccacuuugugagcucaucaucagucccaaguggaacuagacucacagaccuuagauggc

SEQ ID NO: 20370 - RNA, 82 nt, Human; identical to SEQ ID NO: 11444

SEQ ID NO: 20371 - RNA, 87 nt, Human
gccucaaagcugcauguugagugccgucugcuuucggucccgucauuaucucuguauagacccaguuggcaaucaugcauuuggggc

SEQ ID NO: 20372 - RNA, 77 nt, Human
ucugcaagugugaaaggaaggcacuaaggaaagaccaccugguccugggccugccucuuccccuagcacccaguaga

SEQ ID NO: 20373 - RNA, 91 nt, Human
uguguauauguguauauauauguauguaacacauauacauauauauacacauauauguguguauauauacauauauauacauguacacaca

SEQ ID NO: 20374 - RNA, 96 nt, Human
cccuuccgacugccaccuggaaggggcuggcuguucugcucccucucccaccuggcacuggggugggcagcuggccaggaggcaguguggaggugg

SEQ ID NO: 20375 - RNA, 66 nt, Human
cuggggucaaagugcacagcgggcuggcccagccccaggcagccuuuuccucuuuccaggccccag

SEQ ID NO: 20376 - RNA, 77 nt, Human
cauugcuuccuccgugugauuuccgaagcaaagcaaugggacccuacgcuucagagucuuauugggguggggcagug

SEQ ID NO: 20377 - RNA, 65 nt, Human
cuuuuauuuaguuggauauguuucuuuacagaaugcagaaaacacaucuuaaaaucauauagaag

SEQ ID NO: 20378 - RNA, 86 nt, Human
uccaguugcuauggcaacaggccauucugggccagccacgucucugcauggcagugcccaaugguggaguugcuaugggcaacgga

SEQ ID NO: 20379 - RNA, 68 nt, Human
cuucgcagggaacaauccuuauugcacaggucaggaccugggugggugaggcauuccccaaggcgggg

SEQ ID NO: 20380 - RNA, 66 nt, Human
gagcgagaccuuaaucaauuugaaaauauucacuguauguauuuuggaggauuggguucucagcuu

SEQ ID NO: 20381 - RNA, 71 nt, Human
ggcugaggugggaggauggcuugaacauggggcagugagccuugauugcaccauacucuccagccugggcc

SEQ ID NO: 20382 - RNA, 101 nt, Human
cugagacacaguuucacucugucaccaggcaggagugcaguggcaaaucucggcucgcugcaaccucugcaucccggguucaagugacucuggugccucag

SEQ ID NO: 20383 - RNA, 93 nt, Human
gaguagcugggacuacaggugugcacccccacgccggcuaauuuuuuuuguuguuaguagagacgggguuucaccauguuggucaggcugcuc

SEQ ID NO: 20384 - RNA, 66 nt, Human
ggugcacuccucaaucucuccaaaaacggagaaccucuguuucagcucugaucgagucaugcggcc

SEQ ID NO: 20385 - RNA, 83 nt, Human
gucaagagaaucaaauuugcucuuuacaggugcugggucaaagucuucccgguuggagucaagaucagaauagcuccucuugc

SEQ ID NO: 20386 - RNA, 123 nt, Human
gagcuguuuacaucaugagagaugugucuuuauaaauggauuaaucccauuauugcagaaaugguuuuguuaucaugggagggggucauuauaaaaagacaauuuugccaggugcaguggcuc

SEQ ID NO: 20387 - RNA, 74 nt, Human
ugaaugugucuuccaaaguucauguguuggaaacuugauccccaaugcagaaauguuggaagguggcaccuuua

SEQ ID NO: 20388 - RNA, 78 nt, Human
uacauguagauaugaucagauuuaccauuuuuagggggaagagggaaaaaaagguguuuuuaucaucaacuacaugug

SEQ ID NO: 20389 - RNA, 66 nt, Human
ucccguauuuauaugcaaagcccgugugacuggaagugcacguggcacgcauuuuaauaaacugga

SEQ ID NO: 20390 - RNA, 66 nt, Human
gcuguuggauggaauguucuguaacugccuguuagguccauuugcucuacagugccauuuaacugu

SEQ ID NO: 20391 - RNA, 60 nt, Human
guaucauauaugaucuaucuuagauguuccaugugcuguugagaagaauauguauucugc

SEQ ID NO: 20392 - RNA, 82 nt, Human
ccguaagcaugugacuggccauuugugccgaguucuuauuuuuacggagggcuuguggccuuagacgccaguuugcuuaugg

SEQ ID NO: 20393 - RNA, 73 nt, Human; identical to SEQ ID NO: 16328

SEQ ID NO: 20394 - RNA, 73 nt, Human
ugucuaauuuuagaacauuuucauugccucagucucuuacuuucugucucuaaagauuugucuauuuugaaca

SEQ ID NO: 20395 - RNA, 63 nt, Human; identical to SEQ ID NO: 16329

SEQ ID NO: 20396 - RNA, 64 nt, Human; identical to SEQ ID NO: 1375

SEQ ID NO: 20397 - RNA, 61 nt, Human; identical to SEQ ID NO: 2204

SEQ ID NO: 20398 - RNA, 73 nt, Human
ugggggcuguggcagggccgccugccugggguucccuuacucaucugguaguucaugcaggccacggcccuca

SEQ ID NO: 20399 - RNA, 66 nt, Human
gccaacugaaaaagcugaauuuggaacauaaagucaauaaauccauaaccagcaauacuauggggc

SEQ ID NO: 20400 - RNA, 63 nt, Human
ggcgcugugucuccuacgcaacuucugagggcuggagggugccaagggacgcugcugaccgcc

SEQ ID NO: 20401 - RNA, 68 nt, Human
auuuaagaaaacugauucaguuguguuggaaaaaauaaagaaaucugauauuaaacguuuucuaagau

SEQ ID NO: 20402 - RNA, 79 nt, Human
ggaauaaaccugagaaaggauaguggcucuagagaaacaguaauagcaccuuucuagcaccuuugauuuuucucagucc

SEQ ID NO: 20403 - RNA, 64 nt, Human
ccacgccuggagcgccuucugcaaggcccuggccuaagacaggcuggcacagccccaugcuugg

SEQ ID NO: 20404 - RNA, 61 nt, Human; identical to SEQ ID NO: 2204

SEQ ID NO: 20405 - RNA, 131 nt, Human
cccaccuccgcauggcaggucagagggcaccugggcucugagaaaccguggcaagcugguccuagaggaggaggaccccuggagcacaagguucagcaagggugaccccgggacuugcuggucagacuggg

SEQ ID NO: 20406 - RNA, 95 nt, Human
cugcagcaggccuugcaaagggggcauucuggaugguggugcaagaacagaugagcgaguccagcucuccucaugcucccaagggccuccuggag

SEQ ID NO: 20407 - RNA, 71 nt, Human
uuuggcauuuggaugaaaugauucucacagcaucuuaagaaaaguuagugucaacccaaccaaaaacuaaa

SEQ ID NO: 20408 - RNA, 76 nt, Human; identical to SEQ ID NO: 18346

SEQ ID NO: 20409 - RNA, 80 nt, Human; identical to SEQ ID NO: 7871

SEQ ID NO: 20410 - RNA, 75 nt, Human
guccggggcgaggggcccaucuucuucuacacugggaacgagggcgacgugugggccuucgccaacaacucgggc

SEQ ID NO: 20411 - RNA, 75 nt, Human
cgccggcgccgcgggaggugguggaggccuagccggagccgagaggucucuuguucccgucccacggucccggcg

SEQ ID NO: 20412 - RNA, 77 nt, Human; identical to SEQ ID NO: 2642

SEQ ID NO: 20413 - RNA, 83 nt, Human; identical to SEQ ID NO: 7610

SEQ ID NO: 20414 - RNA, 81 nt, Human
ggacauucagcugguggccgcgcucucugucacccugggccucuuugcaguggagcuggcgguuuccucucaggagucucc

SEQ ID NO: 20415 - RNA, 78 nt, Human
ggcuuuauucgucaccgucuugggcugaaaaagaaacccuucugauuaccuucaugacgggaaccuaaggacgaagcc

SEQ ID NO: 20416 - RNA, 72 nt, Human
gucugagucugggauuaucgcauguauuuagugcuugguaguacaauaugguugguaguaacagaccacaac

SEQ ID NO: 20417 - RNA, 66 nt, Human
ggcuguuugaggaaucuugagccaaguccuagucauuauuuuugccauccucgaacuugaacaguc

SEQ ID NO: 20418 - RNA, 67 nt, Human
accuuucuuuuguuuauuuauauucuuuaguuuugugcacacuuugaggaauugauuuaggacaggu

SEQ ID NO: 20419 - RNA, 68 nt, Human
ggacauuugguggcugaggagagcgcgucacugcuauugaauagcuccauuuaacaccagccaugucu

SEQ ID NO: 20420 - RNA, 72 nt, Human
gagaugaaauguuuuacuucugacugugggacuaauguguuccuacagguugcaacauaaaacggauuucuc

SEQ ID NO: 20421 - RNA, 62 nt, Human
gcaagucuucuuagagcuggggccaagugacuucuccuugacuccucugagcaaagcccagc

SEQ ID NO: 20422 - RNA, 83 nt, Human
gcacagcacaggaaccugggcaggcaguccacccucagggccugccugugaccacugcuaaccugugcggaacaaacaugugc

SEQ ID NO: 20423 - RNA, 73 nt, Human
ggggaacugacuuauagaaaaugcucagcacguggccuagcacaaggcauucuuuaaaucugagucucucccc

SEQ ID NO: 20424 - RNA, 61 nt, Human
accgugggugguucaaugacaugaaaaucaccguaucauuggagauugugccacccaaggu

SEQ ID NO: 20425 - RNA, 66 nt, Human
guagugaacuugcuuuaccccgaaacccaccaauccacaguagggucaaccgauuaaguccacugc

SEQ ID NO: 20426 - RNA, 77 nt, Human
uagaagccauauaauauuuucauuagcacaaggauuuucaaaaccucguagaacacuuaaaaauuauucggcuuuua

SEQ ID NO: 20427 - RNA, 73 nt, Human
aaguauucaacuuaauuuuuacagaaaauucuuucuuuucacacccguauuuucuguguguaugugaauacuu

SEQ ID NO: 20428 - RNA, 64 nt, Human; identical to SEQ ID NO: 2723

SEQ ID NO: 20429 - RNA, 71 nt, Human
gggaugaguacuuaaauaaaucuaugaagcaaucuaagcucagaaauuuucuugauuuguauauuuucccc

SEQ ID NO: 20430 - RNA, 73 nt, Human
gauuuuucuccaggcuguagaaccugccagacuguaguacaguggcaggcaacuuacaucccuuggaaaaguu

SEQ ID NO: 20431 - RNA, 73 nt, Human
guaauuuuauuucaaugucugauuuacacaguacaaaaguguacuaauaaccgucagaaauuuuuaaagcuac

SEQ ID NO: 20432 - RNA, 80 nt, Human
acagaguuccaaaaucuccuuuaucacucgacauacagaacccucuugucuugaguuugggaguuaauuuugcucuuugu

SEQ ID NO: 20433 - RNA, 64 nt, Human
ggacucuuugauugagccguauaaaccaaauuuauuguuuggcuuccacuugguuaaaguguuc

SEQ ID NO: 20434 - RNA, 99 nt, Human
ugggaauuaacaaucaaauauuuggaaauuuuuaaauugagaaaguuaacuguaucauuuuaaacucaaaauuuaaaaaaauauuugauuugaccccua

SEQ ID NO: 20435 - RNA, 86 nt, Human
auagcgccaguuccccagcaaacccccuccagagcugcccccggaugcacagacaaggagggggcuugggagugacuugaagcugu

SEQ ID NO: 20436 - RNA, 62 nt, Human; identical to SEQ ID NO: 4083

SEQ ID NO: 20437 - RNA, 63 nt, Human; identical to SEQ ID NO: 4084

SEQ ID NO: 20438 - RNA, 82 nt, Human
gugcggguuuguuacauagguaaacgugucccauggugguuugcugcaccuaucaaccuaucaccuagguauuaagccccac

SEQ ID NO: 20439 - RNA, 101 nt, Human
ggaauuuccucuguuauauagcuuuucccaaugcuaauuuccaaacaacaacaacaaaauaacuuguuugccuauuaaguuguauaaaaguaggagauucu

SEQ ID NO: 20440 - RNA, 80 nt, Human
gggaaaccuuggcaagcaguuccaguccgagcagccccagaccgcugccgcccgaagcuaagccugccucuggccuuccc

SEQ ID NO: 20441 - RNA, 90 nt, Human
ccaggccgggccaccgccggcccccugggcuguccgcgggagccgacugccugaacagcuuuaccgccggggugccuggcuucgugcugg

SEQ ID NO: 20442 - RNA, 62 nt, Human
auuuuauugcuuugaaugcucaaacuaugggaaaucuuugguaaaaauaaagacaauaaaau

SEQ ID NO: 20443 - RNA, 65 nt, Human
ggggacucaaaaagggaagcagagugggcuguugaugucuggaaagcucccucaccagagugccc

SEQ ID NO: 20444 - RNA, 97 nt, Human
gugggucacacagcaucaugggggaugagcuggggcuggagucggcuguaucugacaccagacccuucauucaagcucccuugaugacaacgcccac

SEQ ID NO: 20445 - RNA, 76 nt, Human
cggccgcucaaaucugccgguagcccagcccgccccgcgugcgggggcuguggcgguuacacggccgggcgcgccg

SEQ ID NO: 20446 - RNA, 119 nt, Human; identical to SEQ ID NO: 10250

SEQ ID NO: 20447 - RNA, 67 nt, Human; identical to SEQ ID NO: 11915

SEQ ID NO: 20448 - RNA, 68 nt, Human; identical to SEQ ID NO: 17608

SEQ ID NO: 20449 - RNA, 73 nt, Human; identical to SEQ ID NO: 7929

SEQ ID NO: 20450 - RNA, 83 nt, Human; identical to SEQ ID NO: 1471

SEQ ID NO: 20451 - RNA, 73 nt, Human; identical to SEQ ID NO: 12049

SEQ ID NO: 20452 - RNA, 69 nt, Human; identical to SEQ ID NO: 12131

SEQ ID NO: 20453 - RNA, 87 nt, Human
auaacauugauuauugauuagauacauaucauuauaguuuaggguaugggauauaguguccaauguagcauuauuaguucaauuuau

SEQ ID NO: 20454 - RNA, 71 nt, Human
aucaacauauccugauucgaaugcgaagauuucuaacucuagacacuugcaguaacauuugggaaguugau

SEQ ID NO: 20455 - RNA, 77 nt, Human
uuggcauggacuaguucaaguaucagugccuccaucaauguuuuuacaagucacuaaauacugaaaguccuugacaa

SEQ ID NO: 20456 - RNA, 68 nt, Human; identical to SEQ ID NO: 3678

SEQ ID NO: 20457 - RNA, 78 nt, Human; identical to SEQ ID NO: 99

SEQ ID NO: 20458 - RNA, 65 nt, Human; identical to SEQ ID NO: 247

SEQ ID NO: 20459 - RNA, 80 nt, Human; identical to SEQ ID NO: 100

SEQ ID NO: 20460 - RNA, 117 nt, Human
uucaauuuguuaacagagcaaauuuaagacuuucaaucaaauauguaacaugcugaaaugaagaaauauuacauauuugauugaaagucuucaauuuguuaacagagcaaauuugaa

SEQ ID NO: 20461 - RNA, 68 nt, Human; identical to SEQ ID NO: 7022

SEQ ID NO: 20462 - RNA, 75 nt, Human; identical to SEQ ID NO: 7023

SEQ ID NO: 20463 - RNA, 89 nt, Human
gagacagggucucacucuguugcccaggcuggaggcgugaccuuggcucacugcacucuagccuaggugacagagcaagacucugucuc

SEQ ID NO: 20464 - RNA, 70 nt, Human
ggcucucgggagaccagaggcauggccuuccuggaucacacaaauugccugaauugcucucccuugggcc

SEQ ID NO: 20465 - RNA, 71 nt, Human
gcgguucugcgcgccgccgaucuugccgaugcugugcaggcugcagagcgcgcacggcucgcuggagccgc

SEQ ID NO: 20466 - RNA, 81 nt, Human
acuuguaucugcuguguagcaucugaucugaauggcaggcuuauaucaagcuuucuuccauauggugcaccggguaugagu

SEQ ID NO: 20467 - RNA, 89 nt, Human
agauucuauauccuaaaacauuuaaaccucacuaggccugcaauuuuggagaggguuagcuaaauauguuggguaucacuucagagucu

SEQ ID NO: 20468 - RNA, 92 nt, Human
cacucggaacaccaccaggcugugugccagaaucuugaauguucaugugcaucaugaccacggguuccacacucuggugggaaauccggaug

SEQ ID NO: 20469 - RNA, 74 nt, Human
gugaauggaggugcucgugauguaaaacuucucauggggggaaccagggcauuacuuuuaaccaaaacauucac

SEQ ID NO: 20470 - RNA, 65 nt, Human
ugauuaaaugguugguuuucauagaugauauguuacucaugguaaagaccacauauuuuuauuca

SEQ ID NO: 20471 - RNA, 76 nt, Human
cuucgugcuggccacccuacagcagauugagccugucaacggacaggugacgguccuggucaugugccacacgagg

SEQ ID NO: 20472 - RNA, 64 nt, Human
gggcuggugugcaggaaguucagccggaauccaggaggguucugggaccacgacagaccagccc

SEQ ID NO: 20473 - RNA, 70 nt, Human
uuggcgcucgugcggaauaggagcuucagccuaaagaaugugaagcacucugugcuggaacgaguguuga

SEQ ID NO: 20474 - RNA, 70 nt, Human
cagcauggugcagccgcagacguccaaagcugaaagcccagccuuggcagcgucuccgaaugcccagaug

SEQ ID NO: 20475 - RNA, 99 nt, Human
agugcaggaugugcggguuuguuacauagguaaacgugucccauggugguuugcugcaccuaucaaccuaucaccuagguauuaagccccacaugcauu

SEQ ID NO: 20476 - RNA, 69 nt, Human
acagaaguaccgagaaugccguucgggggccuuuauggcgacguaagaacgggcuuggacuuggucugu

SEQ ID NO: 20477 - RNA, 107 nt, Human
accucucccagugcaugguugacaaucacugguuuccaucaucaaaucuuaaaaucaaagcauuuuggaagcugagaauguauuggcaauucaucucacucaggggu

SEQ ID NO: 20478 - RNA, 70 nt, Human
cagcacauguggccaaacauggguguacuaaaaucucuugugaaaauaccuauaaugacucacauguaug

SEQ ID NO: 20479 - RNA, 79 nt, Human
uggccaacagguaaagaagucagcuaguauuugcagccacguugaauaucaaauacuauuugguguccuuuguuggcca

SEQ ID NO: 20480 - RNA, 89 nt, Human
aguacccuacaugcagaaaaacccagaguuagauucauugcugaaaacaagagccuggaguagggcucuuuuuuuguuaaaggggagcu

SEQ ID NO: 20481 - RNA, 88 nt, Human
guuguugcuguuuguuauccugagguaugacuuaaaugaagauuuacggagaugagacgaugaugcaggaaaauaggaggacaucagc

SEQ ID NO: 20482 - RNA, 60 nt, Human
cuguugcccaggcucacugcaaccucugccucccaaguucaagugauuccugugccucag

SEQ ID NO: 20483 - RNA, 105 nt, Human
cuguggggggcacaggggcagccucagagucacccguggggggcacagggggggccccggagucacccgugggcggcacgggggcggucucggagucacccgugg

SEQ ID NO: 20484 - RNA, 97 nt, Human
gggguaugaggcuuuauucaggaagagcucaagaugggaggggagccccuggggucccacucuuguggccucuugauaccaaggcucaugggacgcu

SEQ ID NO: 20485 - RNA, 77 nt, Human
gauuuaguacaguuaugcucagaugaacacuggacccauguggcagggucaagcaacuagaacaugauucagaaauc

SEQ ID NO: 20486 - RNA, 65 nt, Human
ugauucagaaaucagugaauuuuucacuuggacaggaccaagaggcauuucacugccaugaaaca

SEQ ID NO: 20487 - RNA, 74 nt, Human
ccuuauuaaagcaucugcaacagccaggaaucauugagcuaugaguaaaacgcugccuuaggugauuugucagg

SEQ ID NO: 20488 - RNA, 68 nt, Human
guagagggcaaugugguugucauggagacagcugucuucaacacaaaccauccugugcaucuaucuac

SEQ ID NO: 20489 - RNA, 62 nt, Human
cuuuugugaguguauauaaugguuuuguuaggauggcaaaaccagguauccaaaggcgaaag

SEQ ID NO: 20490 - RNA, 75 nt, Human
uccuugugagaauuccgacugcacaacccugcacuucagcuguguguaaugaaaaggguugggaugaaucaggga

SEQ ID NO: 20491 - RNA, 67 nt, Human; identical to SEQ ID NO: 1379

SEQ ID NO: 20492 - RNA, 63 nt, Human; identical to SEQ ID NO: 1366

SEQ ID NO: 20493 - RNA, 86 nt, Human; identical to SEQ ID NO: 1381

SEQ ID NO: 20494 - RNA, 64 nt, Human
gcgcuggcuggggucgggcuccaugcucuggaugggacugggccgucgacacgccagccggugc

SEQ ID NO: 20495 - RNA, 69 nt, Human
gucaaggauuuggguuggggcacccaggaagccugaggguuagcuggguggaccuccuggcuccucggc

SEQ ID NO: 20496 - RNA, 62 nt, Human
auguuuuauuucacuggaaaauucuguaaagaacuaaaucugguucccuuggaaaaaaacau

SEQ ID NO: 20497 - RNA, 127 nt, Human
ccucugacucuaaggcccugugggaugaaaagcagguauccaaaagaacucugcuuggcccuuugauacggccuugaggucagcccuggugccugcuuucuggcccacagaccgcugaaauccuagg

SEQ ID NO: 20498 - RNA, 61 nt, Human
acuccucgcugcgguugugggaccuguggaaguauucgcagacacucuccauggcgggggu

SEQ ID NO: 20499 - RNA, 63 nt, Human
agacgaaccggaugucaacgggauccccuaaggcuuggaacccuuuauacaucuggggcaucu

SEQ ID NO: 20500 - RNA, 86 nt, Human
auugaugaagaucaggggugcugaagccugguuccuggggucgcuucugaucuaggcgguucuugccucuggugacuggcguuaau

SEQ ID NO: 20501 - RNA, 78 nt, Human
gcaggagugggaggagggaggacaaguggaagucuaggcuggcugagcuguucugucucgaaaaguuccuaaaacugu

SEQ ID NO: 20502 - RNA, 68 nt, Human; identical to SEQ ID NO: 9690

SEQ ID NO: 20503 - RNA, 67 nt, Human; identical to SEQ ID NO: 3685

SEQ ID NO: 20504 - RNA, 73 nt, Human; identical to SEQ ID NO: 2833

SEQ ID NO: 20505 - RNA, 111 nt, Human
ccuggcaacacugagcacugaaaucuccuuucuuugccugacugcauuuauaugaaagguccagaacaggcaaauuuguagagacagaaaguagauuaguggcugccuagg

SEQ ID NO: 20506 - RNA, 71 nt, Human
cacaacuucggggcagccgggcacaagcccaggcucaggacgcagagcugguccggcugcgcgaggcugug

SEQ ID NO: 20507 - RNA, 67 nt, Human
uggccuggguaaggugccuggcaggaagcaagacaaggccucuggcagagagcaccuuagcaggcca

SEQ ID NO: 20508 - RNA, 73 nt, Human
cgggcacuggaacuuggugcgggaaaagaaacgacagaacaagucguugugccggccuuaguuccaaauuccg

SEQ ID NO: 20509 - RNA, 60 nt, Human
gcguuuugcaaauuggcgcacucugaaaccuugcggggagccccaauuacgcgaucuugc

SEQ ID NO: 20510 - RNA, 76 nt, Human; identical to SEQ ID NO: 4813

SEQ ID NO: 20511 - RNA, 110 nt, Human; identical to SEQ ID NO: 4814

SEQ ID NO: 20512 - RNA, 86 nt, Human
acugugaucgucgugacugugguccuauugaggccagugucugaguuaugggcuuggcacguauaggauccacuauuauucacagu

SEQ ID NO: 20513 - RNA, 88 nt, Human
gcugcagccugggacugaccgggaggcucugauuauuuacccaccacagguagguuguguucugaaucucagguucacagguuaaggc

SEQ ID NO: 20514 - RNA, 60 nt, Human
gauuaguaaaagugcuuuccauguuacuuuauucagagcuaauaagugcuuuccuuaguu

SEQ ID NO: 20515 - RNA, 65 nt, Human
guguugcagcuuuauaguuuuuaaaauauuuuagauaauucuuaaacuaugaaccuucuuaacau

SEQ ID NO: 20516 - RNA, 62 nt, Human
uuguuccguuagucgcuaacuuaguaagugcuuuucuuauagaaccccuucugacugagcaa

SEQ ID NO: 20517 - RNA, 71 nt, Human
aaucaccauguagugugucuucuugaguaggccaauguugcguauagagagaaaaugacuaucaggagauu

SEQ ID NO: 20518 - RNA, 68 nt, Human
ugauauauuguuaagaguaguacauauuuaagaagacgaaaauauguuuuugauccccaauuauauca

SEQ ID NO: 20519 - RNA, 70 nt, Human
uguacaggaugauuuucauauuuugaagggauucaucacuucacaaagcaucuccauucuaucuuguuca

SEQ ID NO: 20520 - RNA, 117 nt, Human
uuagucagugagcuagacccagugccggaguuggucuucucgugacucugauaaaucuagacaccacucuguuggagaaccagcacugccggcagcugggguuagugcacugacuga

SEQ ID NO: 20521 - RNA, 94 nt, Human; identical to SEQ ID NO: 5398

SEQ ID NO: 20522 - RNA, 89 nt, Human
gucaaauccacacauguauauucucucuaugcccaggcccaucugggggagggcagcccagagacacgugugcaccugugugggcugac

SEQ ID NO: 20523 - RNA, 67 nt, Human
uggugugggagaugcgugugagcgagacacccucagcuccaaggguggcacgcugcuccguggacca

SEQ ID NO: 20524 - RNA, 92 nt, Human
gcucaucuugguaugcgggccccugcucgggucaauucgggggacccuuucugccagucccuuacccggcugcgcaggucugauaugauggc

SEQ ID NO: 20525 - RNA, 74 nt, Human; identical to SEQ ID NO: 4179

SEQ ID NO: 20526 - RNA, 102 nt, Human; identical to SEQ ID NO: 2774

SEQ ID NO: 20527 - RNA, 78 nt, Human
cugggguguuuauggcaagucacuuugacagacauuaucguggcaaaugcugucugacuuacugguucaacaaaccag

SEQ ID NO: 20528 - RNA, 65 nt, Human; identical to SEQ ID NO: 247

SEQ ID NO: 20529 - RNA, 80 nt, Human; identical to SEQ ID NO: 100

SEQ ID NO: 20530 - RNA, 68 nt, Human
gguguuuacagugcugcaaauuacaccaaugggagcuuuggaaguaauuuugugucugcugguauacc

SEQ ID NO: 20531 - RNA, 78 nt, Human; identical to SEQ ID NO: 99

SEQ ID NO: 20532 - RNA, 80 nt, Human; identical to SEQ ID NO: 100

SEQ ID NO: 20533 - RNA, 67 nt, Human
ggugcagugguucacgccuguaaucccagcacuuugggaggccaaggcggguggaucaccugaggcc

SEQ ID NO: 20534 - RNA, 86 nt, Human; identical to SEQ ID NO: 1381

SEQ ID NO: 20535 - RNA, 78 nt, Human; identical to SEQ ID NO: 4389

SEQ ID NO: 20536 - RNA, 75 nt, Human
gauaucgaagagcuggagaccaaggccgugggaaugucuaacgauggccgcuuucucaaguuugacaucgaaauc

SEQ ID NO: 20537 - RNA, 62 nt, Human
cucagcucugucccugcccagcugguggguggcguaggccaggaugguguggcagagcuggg

SEQ ID NO: 20538 - RNA, 75 nt, Human
gcaugccgacuacagcugguaccaggcgggcagugcccgcucagggccuguuacagucuaccccuacaugcaugc

SEQ ID NO: 20539 - RNA, 90 nt, Human
guaucuugugcugaccuccuaucucauccggugacuuagaaugccuaacucuuugggaaugcagccuaguaggucucagccuuauuuuac

SEQ ID NO: 20540 - RNA, 84 nt, Human
ugcaucaaggauagugaugaaggugugagacuuucgacaauaaacuuguuuaaaaguuucuguaccaauaucuuucccugagua

SEQ ID NO: 20541 - RNA, 73 nt, Human
cagcuucuccuuccgggacagcuccaccuguuccucguccaugguggugucgaugggccggaaguaggacaug

SEQ ID NO: 20542 - RNA, 60 nt, Human
gauauucuuccagagugaugcggccgucgcuguccgagucguacauguggaacagaaauc

SEQ ID NO: 20543 - RNA, 66 nt, Human
gucggcgauggagcgagcggacuccuucucgaugugaggguuucccgacagcagcuccucgaccac

SEQ ID NO: 20544 - RNA, 78 nt, Human; identical to SEQ ID NO: 99

SEQ ID NO: 20545 - RNA, 65 nt, Human; identical to SEQ ID NO: 247

SEQ ID NO: 20546 - RNA, 80 nt, Human; identical to SEQ ID NO: 100

SEQ ID NO: 20547 - RNA, 67 nt, Human; identical to SEQ ID NO: 1379

SEQ ID NO: 20548 - RNA, 63 nt, Human; identical to SEQ ID NO: 1366

SEQ ID NO: 20549 - RNA, 63 nt, Human
uucuuauauugguguuaaucaucaaggaaucucuucucgauuaaaauacacacaucuuaagaa

SEQ ID NO: 20550 - RNA, 63 nt, Human
gaaguccuugggaugggcgucugcucuggacaccccaaagagcuccugcccucucagcccuuu

SEQ ID NO: 20551 - RNA, 80 nt, Human
gccucagauuucugcucaugaucuacauagauuuggaaacuguuuuccucuguuuuggucucuugggcaacauuuuuggc

SEQ ID NO: 20552 - RNA, 93 nt, Human
uacaacaccucacacuggucagcugguuucuacuugguguuugguuuuucccagccccauuuuaucuucagcggccgcgguguuuguuuugug

SEQ ID NO: 20553 - RNA, 74 nt, Human
ugucccauagagcuuuugcauccucuggauguauugcgaaagaaauguccagacuuugagggcuacaggguaca

SEQ ID NO: 20554 - RNA, 81 nt, Human
ugucuauggaaaugugaauaaaggcaauccaugaauaggucaacuucuuccuggguaaccuccccagguguuuuguggaca

SEQ ID NO: 20555 - RNA, 61 nt, Human; identical to SEQ ID NO: 16752

SEQ ID NO: 20556 - RNA, 96 nt, Human
gccuaggauucuggagccacguacacuguuaaauauuccaagaaaaguccacuguuccuauaaugugucauuguauguggcuccagaauacuaggu

SEQ ID NO: 20557 - RNA, 62 nt, Human
auauggugugagaaauggcuguaggaaacaacacucaacgaaguuauuccaucaucccgugu

SEQ ID NO: 20558 - RNA, 86 nt, Human
cacuggcagcaguucuacuuccugagcaagcggcgccgcaaccuucugcguaacccguguggggaagaggacuuggaaggcuggug

SEQ ID NO: 20559 - RNA, 78 nt, Human
agucaaagauuccacugauugacauuugauaaauaaacaucaggauuauguuuauuguuuguuuucagucuuugcacu

SEQ ID NO: 20560 - RNA, 82 nt, Human
uuuuuaaaucuugaaaaggguuucuguacuuaccugguuugccaaguaugccaguguaaugaaacugcccuuauuuuaaaag

SEQ ID NO: 20561 - RNA, 102 nt, Human
cacuacguugaccugaaggaccauccauucuuugccggccuggugaaauacaugcacucagggccgguaguugccauggucugggaggggcugaauguggug

SEQ ID NO: 20562 - RNA, 87 nt, Human; identical to SEQ ID NO: 4680

SEQ ID NO: 20563 - RNA, 90 nt, Human; identical to SEQ ID NO: 2702

SEQ ID NO: 20564 - RNA, 73 nt, Human; identical to SEQ ID NO: 5663

SEQ ID NO: 20565 - RNA, 87 nt, Human; identical to SEQ ID NO: 76

SEQ ID NO: 20566 - RNA, 71 nt, Human
ugcccgcguacaugggcugaggaauguucaagcagaagaaaugguagaguauucuucaggcuuaaagggua

SEQ ID NO: 20567 - RNA, 62 nt, Human; identical to SEQ ID NO: 5011

SEQ ID NO: 20568 - RNA, 66 nt, Human
ggcgagagagcggcagggugaggcccggccguccguggcauggccaggccucagcgcgaccucgcc

SEQ ID NO: 20569 - RNA, 72 nt, Human; identical to SEQ ID NO: 4935

SEQ ID NO: 20570 - RNA, 78 nt, Human
aaaaccaaaaaacauauauauaauggcuucucugucaccgcuggugacaauaggucuuaaugcaaguuuucauguuuu

SEQ ID NO: 20571 - RNA, 84 nt, Human; identical to SEQ ID NO: 286

SEQ ID NO: 20572 - RNA, 89 nt, Human
ggccaauugaaacaaacaguucugagaccguucuuccaccacugauuaagagugggguggcagguauuagggauaauauucauuuggcc

SEQ ID NO: 20573 - RNA, 80 nt, Human
acauaccaacuuccaaucugccuaaaugugacagccucugcccaagacuggcucacugaggcgucuuggcuacuggaugu

SEQ ID NO: 20574 - RNA, 111 nt, Human; identical to SEQ ID NO: 1275

SEQ ID NO: 20575 - RNA, 94 nt, Human
ucagcaggauuuacacgguggggcgcagcuucgagggccgggagcuccuggucaucgagcuguccgacaacccuggcguccaugagccugguga

SEQ ID NO: 20576 - RNA, 80 nt, Human
uugggaauaugcaugggaaugaggcuguuggacgagaacugcucauuuucuuggcccaguaccuaugcaacgaauaccag

SEQ ID NO: 20577 - RNA, 64 nt, Human
aaagagauuuaagugauuacaguguagaaauaucuuucuguaugugauacagugguuucucuuu

SEQ ID NO: 20578 - RNA, 73 nt, Human
gggauucuccaccaggacaccgccagcguccccaccguccucagcuuggcaaacguuucccgaagaggauucc

SEQ ID NO: 20579 - RNA, 85 nt, Human
gggcacacacguucagccacccaccuucaagcacaaagagaaagcugaauuugcaggaugggagggcucagggugugcguucccc

SEQ ID NO: 20580 - RNA, 79 nt, Human
uaggcgccgggugccgaugacugggccuucuugcucucggucggcuucuuggucucggcgugccccauucccggcccug

SEQ ID NO: 20581 - RNA, 70 nt, Human
ucugugccagguauauuuguauauguaaccaaaucugguuuuugcaucccacgagugaccccgcugcgga

SEQ ID NO: 20582 - RNA, 69 nt, Human
uucccgucugucccccuaccccaagucccccagucccucaaaggaggcagggaguggggacugcaggaa

SEQ ID NO: 20583 - RNA, 94 nt, Human
ucuaucuacaaacugucauucuaugaacauaucaguugggggagauaaaguaacagauggugaugagaauucauggauagaauaacuggaugga

SEQ ID NO: 20584 - RNA, 83 nt, Human
gacaauuaaggacgugggaugaggcuccgagacaggacgcgguucugccuggggauccugaagauaaaaagcuuugaaaaguc

SEQ ID NO: 20585 - RNA, 86 nt, Human
gguggcauugcuggauggccgggacugcacaguggagaugcccauccugaaggacguggccacuguggcugucugcgacgcgcauc

SEQ ID NO: 20586 - RNA, 63 nt, Human
uucauggucguggaagcugagcccauauuaagagaugucaggcguccgaccuccgaucaugaa

SEQ ID NO: 20587 - RNA, 91 nt, Human
caaacacuauuuauccccugaaaaagcagcuuaaaauaugggugcacauuuugcagcuuauguucuuugguuaggcucugaaggguguuug

SEQ ID NO: 20588 - RNA, 64 nt, Human; identical to SEQ ID NO: 18069

SEQ ID NO: 20589 - RNA, 91 nt, Human
cugggcugggcuaggcugggccuagcuuguagagacacaccuaaguuccguucucuguuuggaggcugcacccagccugaguccccaccag

SEQ ID NO: 20590 - RNA, 64 nt, Human; identical to SEQ ID NO: 3818

SEQ ID NO: 20591 - RNA, 60 nt, Human; identical to SEQ ID NO: 10418

SEQ ID NO: 20592 - RNA, 86 nt, Human; identical to SEQ ID NO: 3434

SEQ ID NO: 20593 - RNA, 62 nt, Human; identical to SEQ ID NO: 3436

SEQ ID NO: 20594 - RNA, 91 nt, Human; identical to SEQ ID NO: 1284

SEQ ID NO: 20595 - RNA, 87 nt, Human
cauauaaaaguauuacacaauucuguucagcacaugauucuugauaauaaaugacuauguuauaggguuauguauacuuuuagauug

SEQ ID NO: 20596 - RNA, 74 nt, Human
gggguauaaucaugugucacauagcauuguuuuggucaacaguggaccacauguaugaggacacauauaauccc

SEQ ID NO: 20597 - RNA, 61 nt, Human; identical to SEQ ID NO: 2204

SEQ ID NO: 20598 - RNA, 75 nt, Human; identical to SEQ ID NO: 17800

SEQ ID NO: 20599 - RNA, 69 nt, Human
uuauaaaaggguauuuauuucuuauucaugucaaguccaauaagaauucuacugcccuacuuuuuguaa

SEQ ID NO: 20600 - RNA, 66 nt, Human
accccaugccucacuugugagauuagaguaccauguuuucuuucuuuccacauguggaaguggggu

SEQ ID NO: 20601 - RNA, 61 nt, Human
gacuagaacuaauaucauuuggguuuacaaaaaccaucucaaguccaaacauguucuuguc

SEQ ID NO: 20602 - RNA, 20 nt, Human
cagcaccagaauuucgucgu

SEQ ID NO: 20603 - RNA, 24 nt, Human
ggaaaacaaguacaaagguuacgg

SEQ ID NO: 20604 - RNA, 24 nt, Human
ucgccgccaccgccgccgccgccg

SEQ ID NO: 20605 - RNA, 24 nt, Human
cuuacagucgcgggccaggaugag

SEQ ID NO: 20606 - RNA, 24 nt, Human
auugauggucagccaggugccuuc

SEQ ID NO: 20607 - RNA, 24 nt, Human
ugagaaugaccccaagaccuuuga

SEQ ID NO: 20608 - RNA, 24 nt, Human
caaguacaagaaaaccuccacuga

SEQ ID NO: 20609 - RNA, 24 nt, Human
ugagaaccguuugugauaauagaa

SEQ ID NO: 20610 - RNA, 21 nt, Human
ugggaagugccuggcggggcc

SEQ ID NO: 20611 - RNA, 24 nt, Human
uugcauguggauccugagaacuuc

SEQ ID NO: 20612 - RNA, 24 nt, Human
ugggaugaucucaaggggcaccuu

SEQ ID NO: 20613 - RNA, 24 nt, Human
gaggagaaacccugggaaggcucc

SEQ ID NO: 20614 - RNA, 24 nt, Human
uaggccuaacaugagaucagguaa

SEQ ID NO: 20615 - RNA, 24 nt, Human
aaguaugcacaguccgugucaggg

SEQ ID NO: 20616 - RNA, 24 nt, Human
caaaugacuuaguaaucuaauaug

SEQ ID NO: 20617 - RNA, 24 nt, Human
uuccaguaagaaguucaagaguac

SEQ ID NO: 20618 - RNA, 24 nt, Human
augcuuuuugaaagaccuguucuc

SEQ ID NO: 20619 - RNA, 24 nt, Human
ucauggaggggauacaagacggaa

SEQ ID NO: 20620 - RNA, 24 nt, Human
ucccugcaagucuguuuuauguua

SEQ ID NO: 20621 - RNA, 24 nt, Human
ucacugagcgaguacagccccugg

SEQ ID NO: 20622 - RNA, 24 nt, Human
acuaguagacugaugagcuggauu

SEQ ID NO: 20623 - RNA, 24 nt, Human
uaaaguacaaaaacgccaccuuuu

SEQ ID NO: 20624 - RNA, 24 nt, Human
ucaguaguuguuccuuaguaagcu

SEQ ID NO: 20625 - RNA, 24 nt, Human
ugaggcagggcgaccucaaguuac

SEQ ID NO: 20626 - RNA, 24 nt, Human
caccaccagagaugaccggaaaua

SEQ ID NO: 20627 - RNA, 23 nt, Human
uauaacagggaacaagaagagaa

SEQ ID NO: 20628 - RNA, 24 nt, Human
uuaugcggacacacacucacacga

SEQ ID NO: 20629 - RNA, 24 nt, Human
uauugaguggccaugugauuggga

SEQ ID NO: 20630 - RNA, 24 nt, Human
cggaagcucacacggacagucaca

SEQ ID NO: 20631 - RNA, 20 nt, Human
uuggcaaaaucuacugaagc

SEQ ID NO: 20632 - RNA, 24 nt, Human
uauuugucuuuuugaaauagaguu

SEQ ID NO: 20633 - RNA, 22 nt, Human
uagcugcgaagcugaaagcaga

SEQ ID NO: 20634 - RNA, 17 nt, Human
uacaaugucugcaagag

SEQ ID NO: 20635 - RNA, 24 nt, Human
ucuguaguacgauuuaaauguuuu

SEQ ID NO: 20636 - RNA, 24 nt, Human
ugucaaaauuauaugccauauaca

SEQ ID NO: 20637 - RNA, 24 nt, Human
agagguugcagugagccaagauug

SEQ ID NO: 20638 - RNA, 23 nt, Human
uugaaaaugucaaaauuauaugc

SEQ ID NO: 20639 - RNA, 24 nt, Human
uaaggcaggcagaucaccugaggu

SEQ ID NO: 20640 - RNA, 24 nt, Human
ugugcugguccgacaccugggcua

SEQ ID NO: 20641 - RNA, 24 nt, Human
uugguucuuauugacugaauuuac

SEQ ID NO: 20642 - RNA, 24 nt, Human
ugagagcaccaggagcagguagaa

SEQ ID NO: 20643 - RNA, 24 nt, Human
ugagagcaagaaggcuggaaaugc

SEQ ID NO: 20644 - RNA, 24 nt, Human
ugccuuaaaaaaugaagagggagu

SEQ ID NO: 20645 - RNA, 24 nt, Human
cucacuuuccacccucucuccacc

SEQ ID NO: 20646 - RNA, 24 nt, Human
ucuguccugcguccucuguccccg

SEQ ID NO: 20647 - RNA, 24 nt, Human
aagcagaguugacccagccaagaa

SEQ ID NO: 20648 - RNA, 24 nt, Human
ugagccugggaggguggcagggag

SEQ ID NO: 20649 - RNA, 24 nt, Human
ucacuguaauuauuauuauuuucu

SEQ ID NO: 20650 - RNA, 24 nt, Human
caaaggcccuggcaaacgucaaca

SEQ ID NO: 20651 - RNA, 20 nt, Human
ugaggugacagucacggagg

SEQ ID NO: 20652 - RNA, 24 nt, Human
aggcaggauagugacaguggcucg

SEQ ID NO: 20653 - RNA, 24 nt, Human
uaaucauauaugugacuaacauuu

SEQ ID NO: 20654 - RNA, 24 nt, Human
uugcuggguugauucuaguugugu

SEQ ID NO: 20655 - RNA, 24 nt, Human
aggcagguggaucacgaggucagg

SEQ ID NO: 20656 - RNA, 20 nt, Human
ucaaucucaccuucugauau

SEQ ID NO: 20657 - RNA, 24 nt, Human
ugaggacaaguggagccacaaggg

SEQ ID NO: 20658 - RNA, 24 nt, Human
uucacagaugaggacacugaggcc

SEQ ID NO: 20659 - RNA, 24 nt, Human
cacugagcauuguagcgcgccuuc

SEQ ID NO: 20660 - RNA, 24 nt, Human
uguguacauggcagaguuugugug

SEQ ID NO: 20661 - RNA, 24 nt, Human
cacucuguuauuuagacucaucuu

SEQ ID NO: 20662 - RNA, 24 nt, Human
gcuacugucucacugaaacauuua

SEQ ID NO: 20663 - RNA, 24 nt, Human
ucugcauccacauugucauguccu

SEQ ID NO: 20664 - RNA, 24 nt, Human
aagcaucgcgguguguuucagagc

SEQ ID NO: 20665 - RNA, 24 nt, Human
cacagcgcaggcgcucauccuccc

SEQ ID NO: 20666 - RNA, 22 nt, Human
ucagcugccgcuccagauccag

SEQ ID NO: 20667 - RNA, 24 nt, Human
auugcagcagcagcagcuucuugg

SEQ ID NO: 20668 - RNA, 23 nt, Human
uggcuggggaauuguccacgagg

SEQ ID NO: 20669 - RNA, 24 nt, Human
aagcagugacuccugagagacauu

SEQ ID NO: 20670 - RNA, 22 nt, Human
acuuaucugucuugucagcugg

SEQ ID NO: 20671 - RNA, 24 nt, Human
uggcugacuucgagugggugaugu

SEQ ID NO: 20672 - RNA, 24 nt, Human
accgcucauaaccucaagggggug

SEQ ID NO: 20673 - RNA, 24 nt, Human
ugagaaggcugguacccagugcuu

SEQ ID NO: 20674 - RNA, 21 nt, Human
ucccuguuguccauuguguau

SEQ ID NO: 20675 - RNA, 24 nt, Human
uugaucuugaagaaacugggcgug

SEQ ID NO: 20676 - RNA, 24 nt, Human
uccgugcgcguugcugcggccgug

SEQ ID NO: 20677 - RNA, 24 nt, Human
aggaaggagauauagugaagagga

SEQ ID NO: 20678 - RNA, 24 nt, Human
guagaguuuucuucaggcuuaaag

SEQ ID NO: 20679 - RNA, 24 nt, Human
ugaaagggcacgaauaugggggua

SEQ ID NO: 20680 - RNA, 24 nt, Human
ucaaacagacggacucugcaaggc

SEQ ID NO: 20681 - RNA, 24 nt, Human
cguucagaaugcguuugcugucau

SEQ ID NO: 20682 - RNA, 24 nt, Human
ugagagcacgaguuaguuguaguc

SEQ ID NO: 20683 - RNA, 22 nt, Human
cuccaguacuucuguuugugcc

SEQ ID NO: 20684 - RNA, 24 nt, Human
uauaacauguaugcuuuucagaau

SEQ ID NO: 20685 - RNA, 24 nt, Human
aggcugcagaggacugguccgucu

SEQ ID NO: 20686 - RNA, 24 nt, Human
uuuccacagaagcaccaccuauca

SEQ ID NO: 20687 - RNA, 24 nt, Human
agaaagcugauggugugcccgucu

SEQ ID NO: 20688 - RNA, 24 nt, Human
ugcaugggagaaaugauuucugaa

SEQ ID NO: 20689 - RNA, 24 nt, Human
aguccauuuguaacgcauacuaag

SEQ ID NO: 20690 - RNA, 17 nt, Human
uggcagaccuaagugug

SEQ ID NO: 20691 - RNA, 24 nt, Human
uguguauccacaaccuaguuauuu

SEQ ID NO: 20692 - RNA, 24 nt, Human
aagcaaaucuuagcuauauuuuaa

SEQ ID NO: 20693 - RNA, 22 nt, Human
uggaauuuucugggccgaauac

SEQ ID NO: 20694 - RNA, 24 nt, Human
guggagcgcugguggaagguaccg

SEQ ID NO: 20695 - RNA, 24 nt, Human
uaagcugguggaggacacgaagca

SEQ ID NO: 20696 - RNA, 24 nt, Human
acccagugaggcacgacgugguuu

SEQ ID NO: 20697 - RNA, 24 nt, Human
ugagagcaagaaggcuggaaaugc

SEQ ID NO: 20698 - RNA, 24 nt, Human
acugagcaccuccucuugcaguua

SEQ ID NO: 20699 - RNA, 24 nt, Human
uugcaccucguggcugcuuuguuc

SEQ ID NO: 20700 - RNA, 24 nt, Human
uauggcaagucacuuugacagaca

SEQ ID NO: 20701 - RNA, 24 nt, Human
uacaccacucccaagaagaauaag

SEQ ID NO: 20702 - RNA, 24 nt, Human
ucaaucauuuguacagugacuuau

SEQ ID NO: 20703 - RNA, 23 nt, Human
ugucacagccacagauguugucc

SEQ ID NO: 20704 - RNA, 24 nt, Human
ggggggcccaggccgagcuccuug

SEQ ID NO: 20705 - RNA, 24 nt, Human
ggcccaguguuggagagcugaagg

SEQ ID NO: 20706 - RNA, 24 nt, Human
uaggagcacccuggucagggcuaa

SEQ ID NO: 20707 - RNA, 24 nt, Human
uauggcaagucacuuugacagaca

SEQ ID NO: 20708 - RNA, 24 nt, Human
uacaccacucccaagaagaauaag

SEQ ID NO: 20709 - RNA, 24 nt, Human
ucccaagucucugggugguuggaa

SEQ ID NO: 20710 - RNA, 24 nt, Human
ugguauguguuucuccuggacaag

SEQ ID NO: 20711 - RNA, 24 nt, Human
cugguuccugcccuuuugauguuc

SEQ ID NO: 20712 - RNA, 24 nt, Human
uccccuugcuggaugcccuacgcc

SEQ ID NO: 20713 - RNA, 24 nt, Human
uaacauucauggaugcaaaccacu

SEQ ID NO: 20714 - RNA, 24 nt, Human
cggcaugggguccgggggccuggc

SEQ ID NO: 20715 - RNA, 24 nt, Human
gcucauuugcaggggggagccaaa

SEQ ID NO: 20716 - RNA, 24 nt, Human
uccgagcggucaggcuggggcugc

SEQ ID NO: 20717 - RNA, 24 nt, Human
uggcuccagaggccaccaagaacu

SEQ ID NO: 20718 - RNA, 24 nt, Human
uuuguggaguuuuccauagccucu

SEQ ID NO: 20719 - RNA, 23 nt, Human
ucccgagucagagcggcagagau

SEQ ID NO: 20720 - RNA, 24 nt, Human
ugugaacgggaagaaggugcugca

SEQ ID NO: 20721 - RNA, 18 nt, Human
ugguacccugguuggccu

SEQ ID NO: 20722 - RNA, 24 nt, Human
uuaaugauaggcucuuggggcauc

SEQ ID NO: 20723 - RNA, 24 nt, Human
ccacagggcugcacuagcacagcc

SEQ ID NO: 20724 - RNA, 20 nt, Human
uguccagaauuuccagaagu

SEQ ID NO: 20725 - RNA, 24 nt, Human
uguggcccuucucuuuaaguccga

SEQ ID NO: 20726 - RNA, 24 nt, Human
uaagggaaauauuggugcuuucuc

SEQ ID NO: 20727 - RNA, 24 nt, Human
acucuugucagacuuaacuaagca

SEQ ID NO: 20728 - RNA, 24 nt, Human
cgacaugugagugccauuccuugg

SEQ ID NO: 20729 - RNA, 24 nt, Human
uguguuguggucuggggagaaugu

SEQ ID NO: 20730 - RNA, 24 nt, Human
uucaaauaggagccgauggaucug

SEQ ID NO: 20731 - RNA, 24 nt, Human
ugugauguauugugggacaaaaua

SEQ ID NO: 20732 - RNA, 24 nt, Human
uaauguggggacaaaaaauauacc

SEQ ID NO: 20733 - RNA, 24 nt, Human
uagaaagaaaggagauuauuaccc

SEQ ID NO: 20734 - RNA, 22 nt, Human
uaugauguuucuuugcaaugga

SEQ ID NO: 20735 - RNA, 24 nt, Human
uuuaaauugcugaugcaggaauua

SEQ ID NO: 20736 - RNA, 24 nt, Human
uggggcugcgcggggccgggcgag

SEQ ID NO: 20737 - RNA, 24 nt, Human
ccgcugcuggggcugcugcucggc

SEQ ID NO: 20738 - RNA, 24 nt, Human
agcuggugccccuggcccgggccu

SEQ ID NO: 20739 - RNA, 24 nt, Human
ccuggcuuccucaccaacucugug

SEQ ID NO: 20740 - RNA, 24 nt, Human
ucgagcgggcccugcuggcugcgg

SEQ ID NO: 20741 - RNA, 24 nt, Human
ucacugagcuagugacuauuggga

SEQ ID NO: 20742 - RNA, 24 nt, Human
ugaaaaguucuaggguccgcaaca

SEQ ID NO: 20743 - RNA, 24 nt, Human
ucccccuuauaaaguuugccaaaa

SEQ ID NO: 20744 - RNA, 24 nt, Human
gacaccuaaggugaguucugggcg

SEQ ID NO: 20745 - RNA, 24 nt, Human
uggaugcucuucggccugcacggg

SEQ ID NO: 20746 - RNA, 24 nt, Human
cgauccggguaggagacaaagggc

SEQ ID NO: 20747 - RNA, 24 nt, Human
gaaggugcugggcgugguggcuca

SEQ ID NO: 20748 - RNA, 24 nt, Human
uggaucacuugcggucaggaguuc

SEQ ID NO: 20749 - RNA, 19 nt, Human
ugucacagaacuacagucu

SEQ ID NO: 20750 - RNA, 24 nt, Human
ucacugcaaccucugccucauggg

SEQ ID NO: 20751 - RNA, 24 nt, Human
ucagagcaacggcccaagucuggg

SEQ ID NO: 20752 - RNA, 24 nt, Human
uggcggcagaggaggggaugaguc

SEQ ID NO: 20753 - RNA, 24 nt, Human
uacaggcugcuauccacaccacca

SEQ ID NO: 20754 - RNA, 24 nt, Human
ugaggaacucuucaaugccaaucu

SEQ ID NO: 20755 - RNA, 24 nt, Human
aggcguuguaggcugacuccaggu

SEQ ID NO: 20756 - RNA, 24 nt, Human
uaugauaaaugauuauaacgugug

SEQ ID NO: 20757 - RNA, 24 nt, Human
guagucccggauccuuaguuggcu

SEQ ID NO: 20758 - RNA, 24 nt, Human
ucaugggcugaugguuaucguggc

SEQ ID NO: 20759 - RNA, 24 nt, Human
uuggagugggguuuagccaacucc

SEQ ID NO: 20760 - RNA, 24 nt, Human
uucaaaaauuauugauaaauuuau

SEQ ID NO: 20761 - RNA, 24 nt, Human
uuggacuucgggcccggagccucc

SEQ ID NO: 20762 - RNA, 22 nt, Human
uucaagcuggcccauggccggu

SEQ ID NO: 20763 - RNA, 23 nt, Human
ucacaggggaagcugugguacgu

SEQ ID NO: 20764 - RNA, 24 nt, Human
ugacaccaccccacuccucuuccu

SEQ ID NO: 20765 - RNA, 24 nt, Human
uuccuccaaacuccuaugcaggca

SEQ ID NO: 20766 - RNA, 24 nt, Human
uggggcugaucaagggcagagagc

SEQ ID NO: 20767 - RNA, 24 nt, Human
agaggaagagaggacagagaggcc

SEQ ID NO: 20768 - RNA, 24 nt, Human
ugcacuauucaguuaucuauugag

SEQ ID NO: 20769 - RNA, 24 nt, Human
uugcuugguguaacuaaucacugu

SEQ ID NO: 20770 - RNA, 24 nt, Human
guccuuccuucuccacauaaggcc

SEQ ID NO: 20771 - RNA, 24 nt, Human
uaccgcgucuccaagggucacagu

SEQ ID NO: 20772 - RNA, 24 nt, Human
ccgagcccugcauguggagcccuc

SEQ ID NO: 20773 - RNA, 24 nt, Human
gagccucagcuucuccuggauuug

SEQ ID NO: 20774 - RNA, 24 nt, Human
uaaauugugugaaauagucucccg

SEQ ID NO: 20775 - RNA, 24 nt, Human
uccacuggcgaaagaugccuuucu

SEQ ID NO: 20776 - RNA, 24 nt, Human
uaguucagauugaucuuaggucaa

SEQ ID NO: 20777 - RNA, 24 nt, Human
cggauagagugguggcucccagaa

SEQ ID NO: 20778 - RNA, 24 nt, Human
uuacugcauuuugaaaauguauuc

SEQ ID NO: 20779 - RNA, 24 nt, Human
augguaauggagguaaaguguguc

SEQ ID NO: 20780 - RNA, 24 nt, Human
cagugcuaguguaaacaguaugaa

SEQ ID NO: 20781 - RNA, 24 nt, Human
ugucaaggucuaguaggggaucca

SEQ ID NO: 20782 - RNA, 24 nt, Human
ucccggagcgguggggcggggccu

SEQ ID NO: 20783 - RNA, 24 nt, Human
ucaguucuucccaggugaacagca

SEQ ID NO: 20784 - RNA, 24 nt, Human
uaugagaucuagauacugauacuc

SEQ ID NO: 20785 - RNA, 19 nt, Human
uauuuuguuguuuuguacc

SEQ ID NO: 20786 - RNA, 22 nt, Human
uguggcuggucauggaaggggc

SEQ ID NO: 20787 - RNA, 24 nt, Human
uauuuuauugcaggaggugggggu

SEQ ID NO: 20788 - RNA, 24 nt, Human
uuugccccgggccaccucacucuc

SEQ ID NO: 20789 - RNA, 24 nt, Human
agccagggggaugcggcggccaua

SEQ ID NO: 20790 - RNA, 24 nt, Human
uuuaugagccccaaauuuaggauu

SEQ ID NO: 20791 - RNA, 24 nt, Human
uaguuuucaugaaucguggaauga

SEQ ID NO: 20792 - RNA, 24 nt, Human
uuuaacauaucauuuuuccauuua

SEQ ID NO: 20793 - RNA, 24 nt, Human
uaucaaggaagggcaggcgugaug

SEQ ID NO: 20794 - RNA, 24 nt, Human
uucaaauuucuuucuuuuuuaauu

SEQ ID NO: 20795 - RNA, 24 nt, Human
uaacagguguaagaguguugaaaa

SEQ ID NO: 20796 - RNA, 24 nt, Human
ucccaaccccuguauucccacccc

SEQ ID NO: 20797 - RNA, 24 nt, Human
cagccgcgcgcugcagguggugcg

SEQ ID NO: 20798 - RNA, 24 nt, Human
uuggacaacugccccuuccaugac

SEQ ID NO: 20799 - RNA, 24 nt, Human
agcguauugccuauccauugugau

SEQ ID NO: 20800 - RNA, 24 nt, Human
gaccaguauucaacuuguggggca

SEQ ID NO: 20801 - RNA, 24 nt, Human
uguagaacucagccuucuuggaaa

SEQ ID NO: 20802 - RNA, 24 nt, Human
cuuugauucagcaagccacaacag

SEQ ID NO: 20803 - RNA, 24 nt, Human
uugcugguggcggccuuggcggug

SEQ ID NO: 20804 - RNA, 19 nt, Human
cuccuggauggacaucaua

SEQ ID NO: 20805 - RNA, 20 nt, Human
guggauccggaucuucaugg

SEQ ID NO: 20806 - RNA, 24 nt, Human
guuaacuucuugagcuauuucgug

SEQ ID NO: 20807 - RNA, 24 nt, Human
uauggcaaggaccugauggagaag

SEQ ID NO: 20808 - RNA, 24 nt, Human
aaggagcuuugguucggagacagg

SEQ ID NO: 20809 - RNA, 24 nt, Human
uguccagaccauugucuuccaacc

SEQ ID NO: 20810 - RNA, 24 nt, Human
uauggcaaggaccugauggagaag

SEQ ID NO: 20811 - RNA, 24 nt, Human
aaggagcuuugguucggagacagg

SEQ ID NO: 20812 - RNA, 24 nt, Human
uguccagaccauugucuuccaacc

SEQ ID NO: 20813 - RNA, 24 nt, Human
uauggcaaggaccugauggagaag

SEQ ID NO: 20814 - RNA, 24 nt, Human
aaggagcuuugguucggagacagg

SEQ ID NO: 20815 - RNA, 24 nt, Human
ggacccggcucuccuggcccugug

SEQ ID NO: 20816 - RNA, 24 nt, Human
ucuuucuuuuuuaaaagaagaugg

SEQ ID NO: 20817 - RNA, 24 nt, Human
uuuuuuuuuuccccccccccaccc

SEQ ID NO: 20818 - RNA, 24 nt, Human
gaguuuguuuuuuuuuuuuucccc

SEQ ID NO: 20819 - RNA, 24 nt, Human
ggccgugguccgcgcccuuccucg

SEQ ID NO: 20820 - RNA, 24 nt, Human
uugaucuugaagaaacugggcgug

SEQ ID NO: 20821 - RNA, 24 nt, Human
aggaaggagauauagugaagagga

SEQ ID NO: 20822 - RNA, 24 nt, Human
guagaguuuucuucaggcuuaaag

SEQ ID NO: 20823 - RNA, 24 nt, Human
uuaaauacgcugaguacuaaaaag

SEQ ID NO: 20824 - RNA, 24 nt, Human
uaucagaguauauacacaugaggu

SEQ ID NO: 20825 - RNA, 24 nt, Human
uaggcaccauauuugcugaacuag

SEQ ID NO: 20826 - RNA, 19 nt, Human
uaacauagcauuaaggugg

SEQ ID NO: 20827 - RNA, 24 nt, Human
uuugagaacaggugaaucagcuga

SEQ ID NO: 20828 - RNA, 20 nt, Human
uugaaugcacaaauucuguc

SEQ ID NO: 20829 - RNA, 24 nt, Human
ucauucauugcuacauaauuuggu

SEQ ID NO: 20830 - RNA, 24 nt, Human
ugagcaggccgugucccugaguca

SEQ ID NO: 20831 - RNA, 24 nt, Human
uaccaccagcaccagcacagcugc

SEQ ID NO: 20832 - RNA, 24 nt, Human
uguggccaguaccaagagucggug

SEQ ID NO: 20833 - RNA, 24 nt, Human
cucccuaggcgucccaucucgcuu

SEQ ID NO: 20834 - RNA, 24 nt, Human
uauuguggcuggagacaugagcaa

SEQ ID NO: 20835 - RNA, 24 nt, Human
cagcugcuuccuuguagccaagaa

SEQ ID NO: 20836 - RNA, 20 nt, Human
uggugugaggaugaggagga

SEQ ID NO: 20837 - RNA, 24 nt, Human
ugguauuuuugaagcugcuaucau

SEQ ID NO: 20838 - RNA, 24 nt, Human
auggaucugaacugaaguccugua

SEQ ID NO: 20839 - RNA, 24 nt, Human
uuagauacugucgguaagacucua

SEQ ID NO: 20840 - RNA, 24 nt, Human
uauacaguaaauucucgucucugu

SEQ ID NO: 20841 - RNA, 18 nt, Human
uggugggugauuaacugc

SEQ ID NO: 20842 - RNA, 24 nt, Human
ugucacggcagucguugaacacac

SEQ ID NO: 20843 - RNA, 24 nt, Human
uccuuuuucuguaggccgccuuaa

SEQ ID NO: 20844 - RNA, 24 nt, Human
uggcuagaaacuugucagcaugaa

SEQ ID NO: 20845 - RNA, 24 nt, Human
uuccuuagaggggagucuucaccc

SEQ ID NO: 20846 - RNA, 24 nt, Human
gcccguuuagauaccauggcagag

SEQ ID NO: 20847 - RNA, 24 nt, Human
uauggcaagucacuuugacagaca

SEQ ID NO: 20848 - RNA, 24 nt, Human
ugagaauggcaaaauuagucgccu

SEQ ID NO: 20849 - RNA, 24 nt, Human
uacaccacucccaagaagaauaag

SEQ ID NO: 20850 - RNA, 24 nt, Human
uucaacuaccuagaaauaguuacc

SEQ ID NO: 20851 - RNA, 24 nt, Human
uuuauagugacugaguaugaugcu

SEQ ID NO: 20852 - RNA, 20 nt, Human
ugccccaggcccggaucagc

SEQ ID NO: 20853 - RNA, 24 nt, Human
uuuagggggaaaaaaacggggaaa

SEQ ID NO: 20854 - RNA, 24 nt, Human
uauugaagaacccuucuugggggg

SEQ ID NO: 20855 - RNA, 24 nt, Human
aucccauuaaacaauauguccaca

SEQ ID NO: 20856 - RNA, 24 nt, Human
aacauccuuacgccuauuuaaugu

SEQ ID NO: 20857 - RNA, 24 nt, Human
uuagagaaaggcugauuccaaucu

SEQ ID NO: 20858 - RNA, 24 nt, Human
ugagaaaguccccgggaggugcuc

SEQ ID NO: 20859 - RNA, 24 nt, Human
uagcuuguuuuauuagcauuccgg

SEQ ID NO: 20860 - RNA, 24 nt, Human
ugagguggaacaacuuguugcgga

SEQ ID NO: 20861 - RNA, 24 nt, Human
aaccguguuuuucauucucccuaa

SEQ ID NO: 20862 - RNA, 24 nt, Human
auccuggacccagugcacagcguu

SEQ ID NO: 20863 - RNA, 24 nt, Human
cauuaguaaucagauuccaguuug

SEQ ID NO: 20864 - RNA, 24 nt, Human
acgaugcuuugugugucauccgga

SEQ ID NO: 20865 - RNA, 24 nt, Human
uggcacugaagaacaccugugagu

SEQ ID NO: 20866 - RNA, 24 nt, Human
aggugguggagaccuugcugaagc

SEQ ID NO: 20867 - RNA, 24 nt, Human
ugcgggaaacgaugggcacaacag

SEQ ID NO: 20868 - RNA, 24 nt, Human
gaagagggggucugauaagccauc

SEQ ID NO: 20869 - RNA, 24 nt, Human
ugagauccaucugacugcugccau

SEQ ID NO: 20870 - RNA, 24 nt, Human
aggaaauuacaguuagaggucaca

SEQ ID NO: 20871 - RNA, 24 nt, Human
uaccuucaccuggaacaucaacca

SEQ ID NO: 20872 - RNA, 24 nt, Human
cacucgguguacguccuggaggac

SEQ ID NO: 20873 - RNA, 24 nt, Human
caccgggaggugaccccugaccag

SEQ ID NO: 20874 - RNA, 24 nt, Human
ugaagaacaucaccuaagagauua

SEQ ID NO: 20875 - RNA, 24 nt, Human
ucgaaagugguucuuggaaaacuu

SEQ ID NO: 20876 - RNA, 24 nt, Human
agacuggaucugggcuagagagag

SEQ ID NO: 20877 - RNA, 24 nt, Human
aggaaauuacaguuagaggucaca

SEQ ID NO: 20878 - RNA, 23 nt, Human
ucaagagcacccugauuuggcua

SEQ ID NO: 20879 - RNA, 24 nt, Human
cgaggaagaggaggagcaguuggu

SEQ ID NO: 20880 - RNA, 24 nt, Human
uauuugaagaaaauguugaacaug

SEQ ID NO: 20881 - RNA, 24 nt, Human
auugcaaaauuacaacugagacag

SEQ ID NO: 20882 - RNA, 24 nt, Human
uuuauuggaaaauacccaaauaau

SEQ ID NO: 20883 - RNA, 24 nt, Human
uuaauuguuuaccuagauuauuua

SEQ ID NO: 20884 - RNA, 24 nt, Human
uaacauacaaagcuauaauuaaga

SEQ ID NO: 20885 - RNA, 24 nt, Human
uacagaagaaaucaauacaauaga

SEQ ID NO: 20886 - RNA, 24 nt, Human
ugauaugcuuuuacuucaacuuag

SEQ ID NO: 20887 - RNA, 24 nt, Human
ugcauuguuaucauuaaccagucu

SEQ ID NO: 20888 - RNA, 24 nt, Human
uaaugggucucaaaauucugugac

SEQ ID NO: 20889 - RNA, 24 nt, Human
uauuagggauaauauucauuuagc

SEQ ID NO: 20890 - RNA, 24 nt, Human
gcgcauagguuauuucaaaccagg

SEQ ID NO: 20891 - RNA, 24 nt, Human
caugagacucuucauuuuguccac

SEQ ID NO: 20892 - RNA, 20 nt, Human
uggcugaaggucugcagcug

SEQ ID NO: 20893 - RNA, 24 nt, Human
gaggauccauuuuaugguugaugc

SEQ ID NO: 20894 - RNA, 24 nt, Human
ggcccgggcggccggggcuucugg

SEQ ID NO: 20895 - RNA, 24 nt, Human
uauuagggauaauauucauuuagc

SEQ ID NO: 20896 - RNA, 24 nt, Human
uaaaguagcuucaaaaagacuucu

SEQ ID NO: 20897 - RNA, 24 nt, Human
cuuggcccaccucuaugacccagc

SEQ ID NO: 20898 - RNA, 24 nt, Human
ugaguguagccuuuguaucaugug

SEQ ID NO: 20899 - RNA, 24 nt, Human
ucagccaagaaugcgacagccguc

SEQ ID NO: 20900 - RNA, 24 nt, Human
cuuugugacagaccgggacaaagu

SEQ ID NO: 20901 - RNA, 24 nt, Human
cucgagcaacgguuaccaucaaug

SEQ ID NO: 20902 - RNA, 21 nt, Human
uacaguuucagauaaggacac

SEQ ID NO: 20903 - RNA, 24 nt, Human
agagguccuuagauagagaggaga

SEQ ID NO: 20904 - RNA, 18 nt, Human
uuugucuccaccaccucc

SEQ ID NO: 20905 - RNA, 24 nt, Human
aaccugaggcagaaaguggauaau

SEQ ID NO: 20906 - RNA, 24 nt, Human
ugaggaccuggguaguaguuaguu

SEQ ID NO: 20907 - RNA, 24 nt, Human
ugagcaucaggauuuuauggauga

SEQ ID NO: 20908 - RNA, 24 nt, Human
aaccacaucgccgccuuguccucc

SEQ ID NO: 20909 - RNA, 24 nt, Human
augcauucugggcacuggugcaag

SEQ ID NO: 20910 - RNA, 24 nt, Human
uauggcaagucacuuugacagaca

SEQ ID NO: 20911 - RNA, 24 nt, Human
uacaccacucccaagaagaauaag

SEQ ID NO: 20912 - RNA, 24 nt, Human
ucucugguguuggaugcuuugugu

SEQ ID NO: 20913 - RNA, 24 nt, Human
uggaaaucuccuuacugauccgua

SEQ ID NO: 20914 - RNA, 24 nt, Human
ugaaguuguaaugccaauaaccug

SEQ ID NO: 20915 - RNA, 24 nt, Human
uuguaagaguggaauuaacugccc

SEQ ID NO: 20916 - RNA, 24 nt, Human
aaugucaccuucaccagcaauauu

SEQ ID NO: 20917 - RNA, 24 nt, Human
ugaaaaguuggaagauuuugcauc

SEQ ID NO: 20918 - RNA, 24 nt, Human
ggacugggccgucgcacacgccag

SEQ ID NO: 20919 - RNA, 24 nt, Human
uucgauuacaauggcguaggauag

SEQ ID NO: 20920 - RNA, 24 nt, Human
ugggaucagauaugacauugcacu

SEQ ID NO: 20921 - RNA, 24 nt, Human
gaggaaacagccccacugcauuug

SEQ ID NO: 20922 - RNA, 24 nt, Human
uaauguguuuguguuggcuuugca

SEQ ID NO: 20923 - RNA, 24 nt, Human
cgggauuauuguguguaggcugua

SEQ ID NO: 20924 - RNA, 18 nt, Human
uugguccggagaggcugc

SEQ ID NO: 20925 - RNA, 24 nt, Human
ccuuaccuagacgccggaggggac

SEQ ID NO: 20926 - RNA, 21 nt, Human
agagagaggcauuuagcugau

SEQ ID NO: 20927 - RNA, 24 nt, Human
auuauauuuauucaggaggaccau

SEQ ID NO: 20928 - RNA, 24 nt, Human
uagcguggccacugcguugauguu

SEQ ID NO: 20929 - RNA, 24 nt, Human
acagugguuugauuaauuggauug

SEQ ID NO: 20930 - RNA, 24 nt, Human
uuuuuuuuuuuuuuuuuuguuuuu

SEQ ID NO: 20931 - RNA, 24 nt, Human
accacuuuacaaauuguucuuguc

SEQ ID NO: 20932 - RNA, 24 nt, Human
acuuuggugccguuacuugugaaa

SEQ ID NO: 20933 - RNA, 24 nt, Human
ugaauuaaacaaucguguggagaa

SEQ ID NO: 20934 - RNA, 20 nt, Human
uauuacagauuauuuuuccc

SEQ ID NO: 20935 - RNA, 24 nt, Human
ugccucagugacagcagcauauuu

SEQ ID NO: 20936 - RNA, 21 nt, Human
ggugaucgaggagccuggccu

SEQ ID NO: 20937 - RNA, 24 nt, Human
cagcccacuccccaaacuggcuac

SEQ ID NO: 20938 - RNA, 24 nt, Human
ugggagcucugcaaaaucaguagc

SEQ ID NO: 20939 - RNA, 20 nt, Human
uggcagaggaggaggaguca

SEQ ID NO: 20940 - RNA, 24 nt, Human
uggcaauaaauacuaugggauugu

SEQ ID NO: 20941 - RNA, 21 nt, Human
ugucuccaacuagaaaugauc

SEQ ID NO: 20942 - RNA, 24 nt, Human
ugaaaaaauaagcaauuaucauaa

SEQ ID NO: 20943 - RNA, 24 nt, Human
uuauaaggcuuagacagaauuauu

SEQ ID NO: 20944 - RNA, 24 nt, Human
gaucacagggucuaaggguggcca

SEQ ID NO: 20945 - RNA, 24 nt, Human
ugggauuagaagcagaaggcugac

SEQ ID NO: 20946 - RNA, 24 nt, Human
uacaaugaauauuaauacauauug

SEQ ID NO: 20947 - RNA, 24 nt, Human
uguacaaaaccuaauuuguuguca

SEQ ID NO: 20948 - RNA, 24 nt, Human
uggaagaugcucaacaccuccucc

SEQ ID NO: 20949 - RNA, 24 nt, Human
ucccuguagaagucuccaggaaga

SEQ ID NO: 20950 - RNA, 20 nt, Human
uacaggguuuugguauguuu

SEQ ID NO: 20951 - RNA, 24 nt, Human
uuaaaaaaaaaaaaaagugggaau

SEQ ID NO: 20952 - RNA, 24 nt, Human
aacgcuuuuauacuguauuuugua

SEQ ID NO: 20953 - RNA, 24 nt, Human
uuaccacuuucaauagucauuaau

SEQ ID NO: 20954 - RNA, 21 nt, Human
ucugacaguucugcgacaagc

SEQ ID NO: 20955 - RNA, 24 nt, Human
uggcgcaguccugugggcggcgug

SEQ ID NO: 20956 - RNA, 24 nt, Human
ugaaauucauuuagugaaguagug

SEQ ID NO: 20957 - RNA, 21 nt, Human
cacuguauagcaggagaaaac

SEQ ID NO: 20958 - RNA, 24 nt, Human
aagaguucacaccugaugaaugua

SEQ ID NO: 20959 - RNA, 24 nt, Human
agagaucauaaauuuaugugugau

SEQ ID NO: 20960 - RNA, 24 nt, Human
uuucaguucuguaccuaggccucc

SEQ ID NO: 20961 - RNA, 24 nt, Human
ucaaugcccuccuuuauccucauc

SEQ ID NO: 20962 - RNA, 24 nt, Human
uucauucacuuaaaauacugauua

SEQ ID NO: 20963 - RNA, 24 nt, Human
acuggcuucugcucuugcucuuuc

SEQ ID NO: 20964 - RNA, 24 nt, Human
cucauggaaaauggggagaaaacu

SEQ ID NO: 20965 - RNA, 24 nt, Human
aaccaguuucacuuguaccaagac

SEQ ID NO: 20966 - RNA, 24 nt, Human
ugugcagaagaaauggaaggauuc

SEQ ID NO: 20967 - RNA, 24 nt, Human
aagaagaaaaaagaaauggcacaa

SEQ ID NO: 20968 - RNA, 24 nt, Human
ucaauuuuuauuuugguuuucuua

SEQ ID NO: 20969 - RNA, 24 nt, Human
ugggugugugugugugugugcgug

SEQ ID NO: 20970 - RNA, 24 nt, Human
uagguucuaggggugcaagccucu

SEQ ID NO: 20971 - RNA, 24 nt, Human
acaguacagugugagcccccggga

SEQ ID NO: 20972 - RNA, 24 nt, Human
cugcaagaccucauucaauugaug

SEQ ID NO: 20973 - RNA, 24 nt, Human
agggcacgaugggagcgggagaca

SEQ ID NO: 20974 - RNA, 24 nt, Human
caucccaaugccagaccuuccucc

SEQ ID NO: 20975 - RNA, 24 nt, Human
cuagagaagucagaagaaucagaa

SEQ ID NO: 20976 - RNA, 22 nt, Human
uuuguaaacaugaaguuacuau

SEQ ID NO: 20977 - RNA, 24 nt, Human
uauuuuacuaugauaguugagaaa

SEQ ID NO: 20978 - RNA, 24 nt, Human
aaggaggucauaauggggaaacac

SEQ ID NO: 20979 - RNA, 24 nt, Human
ucuaucacuuucauguaacaaugg

SEQ ID NO: 20980 - RNA, 24 nt, Human
cacaguguuccuaggcuggagugc

SEQ ID NO: 20981 - RNA, 24 nt, Human
cuuagcccucucaguagcugggac

SEQ ID NO: 20982 - RNA, 22 nt, Human
ucuugcuauguugccgggcugg

SEQ ID NO: 20983 - RNA, 24 nt, Human
uuggccucuggacacucaucggcc

SEQ ID NO: 20984 - RNA, 24 nt, Human
ugaaugacuauuuuauucguauuu

SEQ ID NO: 20985 - RNA, 24 nt, Human
ugaggaccagugcacugaguacau

SEQ ID NO: 20986 - RNA, 24 nt, Human
aggcagcggcuguggcagcccggc

SEQ ID NO: 20987 - RNA, 20 nt, Human
ucugaccucccaggaagugu

SEQ ID NO: 20988 - RNA, 24 nt, Human
uauaauaauuaacaacagcaaaga

SEQ ID NO: 20989 - RNA, 24 nt, Human
ugagguguccugugcccugacccu

SEQ ID NO: 20990 - RNA, 24 nt, Human
uugaucaucgggacagcaaagugu

SEQ ID NO: 20991 - RNA, 23 nt, Human
uuagaauacuggugcuuuuggau

SEQ ID NO: 20992 - RNA, 24 nt, Human
uggcucuguaacucuucaaaggcc

SEQ ID NO: 20993 - RNA, 24 nt, Human
uauuuuggcaaguaauaugacuau

SEQ ID NO: 20994 - RNA, 23 nt, Human
auugaugguaguucaguuggggu

SEQ ID NO: 20995 - RNA, 24 nt, Human
uacccauccucugauuuauacaua

SEQ ID NO: 20996 - RNA, 24 nt, Human
caggcauuaucauucuucaccuac

SEQ ID NO: 20997 - RNA, 24 nt, Human
uauacugcauuuuuugagccuauc

SEQ ID NO: 20998 - RNA, 24 nt, Human
ugggaucgaagugacaaagugugu

SEQ ID NO: 20999 - RNA, 24 nt, Human
uacuggagaggaaaugacugcuga

SEQ ID NO: 21000 - RNA, 24 nt, Human
aaaacguagagcgguuccagacuc

SEQ ID NO: 21001 - RNA, 24 nt, Human
ugagggaaaauucaguuguugugc

SEQ ID NO: 21002 - RNA, 24 nt, Human
agcaggacuucucggcgagggagu

SEQ ID NO: 21003 - RNA, 24 nt, Human
uauguauuauaauuucuaaaaugc

SEQ ID NO: 21004 - RNA, 20 nt, Human
uguccagaauuuccagaagu

SEQ ID NO: 21005 - RNA, 24 nt, Human
ugagugcccccagggaggggcugg

SEQ ID NO: 21006 - RNA, 24 nt, Human
uguggcccuucucuuuaaguccga

SEQ ID NO: 21007 - RNA, 23 nt, Human
uccgugcgcguugcugcggccgu

SEQ ID NO: 21008 - RNA, 24 nt, Human
aggaaggagauauagugaagagga

SEQ ID NO: 21009 - RNA, 24 nt, Human
ugauagugucgagcaggaugucaa

SEQ ID NO: 21010 - RNA, 24 nt, Human
aacacuuuguuguagcugcccucc

SEQ ID NO: 21011 - RNA, 24 nt, Human
uugaagaagaggauccggguggcc

SEQ ID NO: 21012 - RNA, 24 nt, Human
ccaaagcucagacuugccaggcuc

SEQ ID NO: 21013 - RNA, 22 nt, Human
uuccucugauuuuggcaugugg

SEQ ID NO: 21014 - RNA, 24 nt, Human
gggcacgcgcgcaggagcucaugu

SEQ ID NO: 21015 - RNA, 24 nt, Human
ucgcaggcggaggggcagccucua

SEQ ID NO: 21016 - RNA, 24 nt, Human
auggagcggaaggcagauuagaca

SEQ ID NO: 21017 - RNA, 24 nt, Human
ugagauuguguggucccggcagcg

SEQ ID NO: 21018 - RNA, 24 nt, Human
gggacaguggacagggacucagaa

SEQ ID NO: 21019 - RNA, 24 nt, Human
gaggaucccgguaagagcgucugu

SEQ ID NO: 21020 - RNA, 24 nt, Human
gaccuuccccuaccuuuuguggaa

SEQ ID NO: 21021 - RNA, 24 nt, Human
aggggauccucaguauagccggug

SEQ ID NO: 21022 - RNA, 24 nt, Human
uacuguaauccccgcugcugcucc

SEQ ID NO: 21023 - RNA, 24 nt, Human
ggugaauucauguguaguacaagc

SEQ ID NO: 21024 - RNA, 24 nt, Human
ugucucgaucccacuuaacuaucu

SEQ ID NO: 21025 - RNA, 24 nt, Human
uuuguagucauuuuaaguagcaug

SEQ ID NO: 21026 - RNA, 24 nt, Human
uucaaguuaaucuagaaauuuauu

SEQ ID NO: 21027 - RNA, 24 nt, Human
ugguugacaaaaaauguaucuuua

SEQ ID NO: 21028 - RNA, 24 nt, Human
uggcauaggcguugaugugaccgu

SEQ ID NO: 21029 - RNA, 24 nt, Human
cagugggugacagagugagacccu

SEQ ID NO: 21030 - RNA, 24 nt, Human
agcccgucgcgagggggaagacag

SEQ ID NO: 21031 - RNA, 24 nt, Human
uagcaggaacacuacacuacgugc

SEQ ID NO: 21032 - RNA, 24 nt, Human
ucagauccagcuuguggaugcucu

SEQ ID NO: 21033 - RNA, 24 nt, Human
uggcgaucuuuuuuuuuuuuuuuu

SEQ ID NO: 21034 - RNA, 24 nt, Human
auggaucugggauuucaauccagc

SEQ ID NO: 21035 - RNA, 24 nt, Human
uauguuguguauaaauguacacuu

SEQ ID NO: 21036 - RNA, 24 nt, Human
uauguuguguauaaauguacacuu

SEQ ID NO: 21037 - RNA, 20 nt, Human
caugagguucagguaggugc

SEQ ID NO: 21038 - RNA, 24 nt, Human
accugguuccccaucacucugugc

SEQ ID NO: 21039 - RNA, 21 nt, Human
ccugaaguuauuaauucuacu

SEQ ID NO: 21040 - RNA, 24 nt, Human
auaauacauuauucauuaucuuuc

SEQ ID NO: 21041 - RNA, 19 nt, Human
guggaucuuuuccaaugcc

SEQ ID NO: 21042 - RNA, 23 nt, Human
uaacuuguaaagcuucccacaau

SEQ ID NO: 21043 - RNA, 24 nt, Human
cuagcauaauaguauuuauuaaag

SEQ ID NO: 21044 - RNA, 24 nt, Human
uaaauuuucaguuucuacacacuu

SEQ ID NO: 21045 - RNA, 24 nt, Human
aucccuuucugcuguucaccacca

SEQ ID NO: 21046 - RNA, 24 nt, Human
uguaauaguuuaugcuguauaguu

SEQ ID NO: 21047 - RNA, 24 nt, Human
ugaccuggcuaaaaacaaaauucc

SEQ ID NO: 21048 - RNA, 24 nt, Human
acggagcaugagaagacguucccc

SEQ ID NO: 21049 - RNA, 24 nt, Human
cggcugcccauugcucucccacuc

SEQ ID NO: 21050 - RNA, 24 nt, Human
ugaagaguggaaguguucaagaac

SEQ ID NO: 21051 - RNA, 24 nt, Human
gggaagcagaacaucuaagaaaga

SEQ ID NO: 21052 - RNA, 24 nt, Human
ugggccagcugcuucgacugcugc

SEQ ID NO: 21053 - RNA, 24 nt, Human
agaguauaaacguaaaaaggaaca

SEQ ID NO: 21054 - RNA, 24 nt, Human
aguggacaauaagacuauacugag

SEQ ID NO: 21055 - RNA, 24 nt, Human
ucccauacuuagaauguuucuagu

SEQ ID NO: 21056 - RNA, 19 nt, Human
uacauuugaggcuuguuuu

SEQ ID NO: 21057 - RNA, 24 nt, Human
uaagaaaaacaaucauauauaugc

SEQ ID NO: 21058 - RNA, 24 nt, Human
uuagcagggcgugguggugggcac

SEQ ID NO: 21059 - RNA, 24 nt, Human
ccacugcacuccagcuugggagac

SEQ ID NO: 21060 - RNA, 24 nt, Human
uccagcuugagugacagagugaga

SEQ ID NO: 21061 - RNA, 24 nt, Human
ugauguuuucuucucucuucauuu

SEQ ID NO: 21062 - RNA, 24 nt, Human
gagcuuguacgaucucuuuguuag

SEQ ID NO: 21063 - RNA, 24 nt, Human
aacccaguuccuuuuauccucaga

SEQ ID NO: 21064 - RNA, 24 nt, Human
accccgucucuacuaaaacuacaa

SEQ ID NO: 21065 - RNA, 24 nt, Human
ccacugcacuccagccugggugac

SEQ ID NO: 21066 - RNA, 24 nt, Human
ucacaagguccggagauugagacc

SEQ ID NO: 21067 - RNA, 24 nt, Human
caggcacccugggcccccuggagg

SEQ ID NO: 21068 - RNA, 17 nt, Human
ucacugggccuccaugc

SEQ ID NO: 21069 - RNA, 24 nt, Human
aguuuuuuuaaaguuuucuuuuuu

SEQ ID NO: 21070 - RNA, 24 nt, Human
uuccugucuuuuuacauuaauaca

SEQ ID NO: 21071 - RNA, 24 nt, Human
uccguugacagugagcgguugcaa

SEQ ID NO: 21072 - RNA, 24 nt, Human
uugcaaauccgcuugacagugagc

SEQ ID NO: 21073 - RNA, 24 nt, Human
uugacagugagcgguugcaaaucc

SEQ ID NO: 21074 - RNA, 20 nt, Human
caguccuuucccuguugagu

SEQ ID NO: 21075 - RNA, 24 nt, Human
uaauauagauuacugccucuaacu

SEQ ID NO: 21076 - RNA, 24 nt, Human
uaaauacaaauccuaaauacaugg

SEQ ID NO: 21077 - RNA, 24 nt, Human
ccccugagggagaggaaaggugaa

SEQ ID NO: 21078 - RNA, 24 nt, Human
ugcaaagacucccccugacccacc

SEQ ID NO: 21079 - RNA, 24 nt, Human
uugcaucgcuuaaguacguugcau

SEQ ID NO: 21080 - RNA, 24 nt, Human
ccgccgcgcccagcccccacaaaa

SEQ ID NO: 21081 - RNA, 24 nt, Human
ugggcaaaagagaaaaagaaggau

SEQ ID NO: 21082 - RNA, 24 nt, Human
caaucauugaauacaaaacaaaua

SEQ ID NO: 21083 - RNA, 24 nt, Human
uaaaaugccagaauauaaaaugag

SEQ ID NO: 21084 - RNA, 21 nt, Human
uugcucccucacuuuguuucc

SEQ ID NO: 21085 - RNA, 24 nt, Human
uaucaagucagcacacaccuuuuc

SEQ ID NO: 21086 - RNA, 21 nt, Human
ugauggaaguaaucugcuuaa

SEQ ID NO: 21087 - RNA, 24 nt, Human
guuuuaguugguguagcaguggga

SEQ ID NO: 21088 - RNA, 24 nt, Human
ugccuuauaaucuuuggcuccagu

SEQ ID NO: 21089 - RNA, 24 nt, Human
ucuaagccucaagucauguuccua

SEQ ID NO: 21090 - RNA, 24 nt, Human
cauaguauauuuuccuuccuuaau

SEQ ID NO: 21091 - RNA, 24 nt, Human
ugacagaugugaugagaagaagaa

SEQ ID NO: 21092 - RNA, 24 nt, Human
gcuaaaguugaacaaucccgguac

SEQ ID NO: 21093 - RNA, 24 nt, Human
aguuguuacugguuugucaagcau

SEQ ID NO: 21094 - RNA, 24 nt, Human
aaacuccaaugguucagugacugu

SEQ ID NO: 21095 - RNA, 19 nt, Human
cacuuugccacugcucuuc

SEQ ID NO: 21096 - RNA, 24 nt, Human
cagcugccucccgagccuccaaga

SEQ ID NO: 21097 - RNA, 24 nt, Human
cagcagcacgcagugagagccucg

SEQ ID NO: 21098 - RNA, 24 nt, Human
uguggcagugagagaauccuggca

SEQ ID NO: 21099 - RNA, 24 nt, Human
ucaaaaaaguuaccucaucaggua

SEQ ID NO: 21100 - RNA, 24 nt, Human
gaccucaacgccccugaccucuau

SEQ ID NO: 21101 - RNA, 24 nt, Human
uacuacguggcgcuggccuggacc

SEQ ID NO: 21102 - RNA, 24 nt, Human
uuaguggaguugaagaucagccag

SEQ ID NO: 21103 - RNA, 24 nt, Human
uugaucuugaagaaacugggcgug

SEQ ID NO: 21104 - RNA, 24 nt, Human
guagaguuuucuucaggcuuaaag

SEQ ID NO: 21105 - RNA, 24 nt, Human
aggaaggagauauagugaagagga

SEQ ID NO: 21106 - RNA, 24 nt, Human
uccgugcgcguugcugcggcgugg

SEQ ID NO: 21107 - RNA, 24 nt, Human
uugaucuugaagaaacugggcgug

SEQ ID NO: 21108 - RNA, 24 nt, Human
aggaaggagauauagugaagagga

SEQ ID NO: 21109 - RNA, 24 nt, Human
guagaguuuucuucaggcuuaaag

SEQ ID NO: 21110 - RNA, 18 nt, Human
aggugcuucuaagcccag

SEQ ID NO: 21111 - RNA, 24 nt, Human
aagcaggaaucugagauuuccaag

SEQ ID NO: 21112 - RNA, 24 nt, Human
acuugcuggcuaguaugcagcugc

SEQ ID NO: 21113 - RNA, 24 nt, Human
cgagcagaggagcggaaggcgagc

SEQ ID NO: 21114 - RNA, 24 nt, Human
uggcaccggcccugccugcgcugc

SEQ ID NO: 21115 - RNA, 24 nt, Human
ucacgcugggagaaugagagggac

SEQ ID NO: 21116 - RNA, 24 nt, Human
acuaacgcgugcuuaagccucuga

SEQ ID NO: 21117 - RNA, 24 nt, Human
aaaggaacuguuaaacugaaaaag

SEQ ID NO: 21118 - RNA, 23 nt, Human
uucauauucaccagguccguauu

SEQ ID NO: 21119 - RNA, 24 nt, Human
acaaaucuucacuaugcauauuac

SEQ ID NO: 21120 - RNA, 24 nt, Human
uacccauugcucucccacuccacg

SEQ ID NO: 21121 - RNA, 24 nt, Human
agaaagcagcuuuuuugaauucua

SEQ ID NO: 21122 - RNA, 24 nt, Human
uggcaggaaugggaggcauccaga

SEQ ID NO: 21123 - RNA, 24 nt, Human
ugagacagagcuggcaugcgccag

SEQ ID NO: 21124 - RNA, 24 nt, Human
cgccaggguccagacacggagaac

SEQ ID NO: 21125 - RNA, 24 nt, Human
ccagggggggcaguggggugggcc

SEQ ID NO: 21126 - RNA, 24 nt, Human
ccagggcgcgucgcguggccguuc

SEQ ID NO: 21127 - RNA, 24 nt, Human
aaggagccacggggugaggcuggu

SEQ ID NO: 21128 - RNA, 24 nt, Human
uguucuggagcuguuggacaaaua

SEQ ID NO: 21129 - RNA, 24 nt, Human
aggcagucacagaacaggggcaug

SEQ ID NO: 21130 - RNA, 24 nt, Human
uaccucagccgugccgcucccugu

SEQ ID NO: 21131 - RNA, 24 nt, Human
ucccuagaccuaagagugccuugg

SEQ ID NO: 21132 - RNA, 24 nt, Human
uugcucccuacgucacacuccgga

SEQ ID NO: 21133 - RNA, 24 nt, Human
uguuguguaucuuuuuuguucuuu

SEQ ID NO: 21134 - RNA, 24 nt, Human
ucuaaugcaguuuguucuguaacu

SEQ ID NO: 21135 - RNA, 24 nt, Human
agauggggagcugauuuucauagu

SEQ ID NO: 21136 - RNA, 19 nt, Human
uggcacaaccacaggcacu

SEQ ID NO: 21137 - RNA, 24 nt, Human
uggcaugacuauagcucacuguaa

SEQ ID NO: 21138 - RNA, 24 nt, Human
uaauggguuaauggguggggggca

SEQ ID NO: 21139 - RNA, 24 nt, Human
uaauaaauaugauauuuaaacgau

SEQ ID NO: 21140 - RNA, 24 nt, Human
auuaugcuaauguuaaaaauaaag

SEQ ID NO: 21141 - RNA, 24 nt, Human
ugauagauacugaguuuuugcuca

SEQ ID NO: 21142 - RNA, 21 nt, Human
uaacauaguggucauuugucc

SEQ ID NO: 21143 - RNA, 24 nt, Human
cuggugcuaguguuucuaucagau

SEQ ID NO: 21144 - RNA, 24 nt, Human
cagcguccagaugaagcucggaca

SEQ ID NO: 21145 - RNA, 24 nt, Human
ucacaaccacggcccuggaggagc

SEQ ID NO: 21146 - RNA, 24 nt, Human
ugccgcagcuguucacuugggcag

SEQ ID NO: 21147 - RNA, 24 nt, Human
ucuuuuguucauuuugagucccca

SEQ ID NO: 21148 - RNA, 21 nt, Human
uugacauugaggaugaagaaa

SEQ ID NO: 21149 - RNA, 24 nt, Human
aggcuguagcaaaguuugcaccau

SEQ ID NO: 21150 - RNA, 24 nt, Human
uagggcaacuucaguucggguuaa

SEQ ID NO: 21151 - RNA, 24 nt, Human
uauuagggauaauauucauuuagc

SEQ ID NO: 21152 - RNA, 24 nt, Human
uuuuaugucuggcuuauuucacuu

SEQ ID NO: 21153 - RNA, 19 nt, Human
ugauuuguaauuauuuucu

SEQ ID NO: 21154 - RNA, 24 nt, Human
ugccuaggcugguaggcuggucuc

SEQ ID NO: 21155 - RNA, 21 nt, Human
uggcaucaaguauuagggcac

SEQ ID NO: 21156 - RNA, 24 nt, Human
cugccaggcugaagccuguuccug

SEQ ID NO: 21157 - RNA, 24 nt, Human
uuuguagugaaguauaguagcaau

SEQ ID NO: 21158 - RNA, 24 nt, Human
uuaguauuaacaaauggcaaugag

SEQ ID NO: 21159 - RNA, 20 nt, Human
uucagagugguagaucuuua

SEQ ID NO: 21160 - RNA, 24 nt, Human
ucaccaggucaccgucuccuucca

SEQ ID NO: 21161 - RNA, 23 nt, Human
agaggcuaucagggcggcucugc

SEQ ID NO: 21162 - RNA, 24 nt, Human
uauugcucacgggggcuccagccg

SEQ ID NO: 21163 - RNA, 24 nt, Human
uccucggucuccgcccugcccccg

SEQ ID NO: 21164 - RNA, 24 nt, Human
uuagagcauacuuuguaggacucu

SEQ ID NO: 21165 - RNA, 24 nt, Human
ucccuguaagaauuuaccuuccaa

SEQ ID NO: 21166 - RNA, 24 nt, Human
uagcacaugacuuaaaaggugcug

SEQ ID NO: 21167 - RNA, 24 nt, Human
ugucaaagugacuugccauaaaca

SEQ ID NO: 21168 - RNA, 24 nt, Human
uuagcaccaccacgaagucucgac

SEQ ID NO: 21169 - RNA, 24 nt, Human
aggaagcuccccaagccucacugu

SEQ ID NO: 21170 - RNA, 24 nt, Human
ugcauuguuaucauuaaccagucu

SEQ ID NO: 21171 - RNA, 24 nt, Human
uuagcacgaaccauauauccauug

SEQ ID NO: 21172 - RNA, 24 nt, Human
ucaguugcugcucaaggcacagcu

SEQ ID NO: 21173 - RNA, 24 nt, Human
guugcuguucucuacaaagaugac

SEQ ID NO: 21174 - RNA, 24 nt, Human
uaaaugauaaauuaggauauguuu

SEQ ID NO: 21175 - RNA, 24 nt, Human
aagcgcugggauuguucugaucuc

SEQ ID NO: 21176 - RNA, 24 nt, Human
agugacaacagggagugacauuug

SEQ ID NO: 21177 - RNA, 24 nt, Human
ccugucuuggucuaaacauguuga

SEQ ID NO: 21178 - RNA, 24 nt, Human
acugucaccauagaaucuagugca

SEQ ID NO: 21179 - RNA, 24 nt, Human
uuaacauuugcaguccuuguguca

SEQ ID NO: 21180 - RNA, 24 nt, Human
gacucuguuuccccauuucuugcu

SEQ ID NO: 21181 - RNA, 24 nt, Human
uuuguuuucuguauguuguugggg

SEQ ID NO: 21182 - RNA, 24 nt, Human
aagaacuaauaacaucuugaguua

SEQ ID NO: 21183 - RNA, 24 nt, Human
cauugcguuacagcuacccacagu

SEQ ID NO: 21184 - RNA, 24 nt, Human
cguaaauauauauagugcuaaguc

SEQ ID NO: 21185 - RNA, 24 nt, Human
ugacaaagcacagaaaaaccagau

SEQ ID NO: 21186 - RNA, 24 nt, Human
uuuaaguagaacaaacuaaauaca

SEQ ID NO: 21187 - RNA, 24 nt, Human
aggcagcucccuucccccaggaag

SEQ ID NO: 21188 - RNA, 24 nt, Human
uacaucaaaaucaagucccuggcu

SEQ ID NO: 21189 - RNA, 24 nt, Human
ugcaaggcggaaaggcuggggcag

SEQ ID NO: 21190 - RNA, 24 nt, Human
gaccgguccgaccuggcguccucc

SEQ ID NO: 21191 - RNA, 24 nt, Human
agcuagccagaaugaacaacacaa

SEQ ID NO: 21192 - RNA, 21 nt, Human
uauuacuguaguccaugugca

SEQ ID NO: 21193 - RNA, 24 nt, Human
agagcacuguccagagcuuccucc

SEQ ID NO: 21194 - RNA, 22 nt, Human
uuggucuuaagcaguguuagaa

SEQ ID NO: 21195 - RNA, 24 nt, Human
agagcacuguccagagcuuccucc

SEQ ID NO: 21196 - RNA, 22 nt, Human
uuggucuuaagcaguguuagaa

SEQ ID NO: 21197 - RNA, 21 nt, Human
cucgugcuucgccguggcccc

SEQ ID NO: 21198 - RNA, 24 nt, Human
cacgguagucuucacuuugaaaca

SEQ ID NO: 21199 - RNA, 24 nt, Human
uucugagugaguuucuuaauccug

SEQ ID NO: 21200 - RNA, 24 nt, Human
uugcugaagaaugcuuuauuucca

SEQ ID NO: 21201 - RNA, 24 nt, Human
uacgguauauuucaagagauucua

SEQ ID NO: 21202 - RNA, 24 nt, Human
uaccggacgggcugggucuauggu

SEQ ID NO: 21203 - RNA, 24 nt, Human
acugaauuuuaaguauuagauuuu

SEQ ID NO: 21204 - RNA, 24 nt, Human
uauuuuaugaaagccuguuuuuuu

SEQ ID NO: 21205 - RNA, 24 nt, Human
uauguaccucucuaaacuaaguuc

SEQ ID NO: 21206 - RNA, 24 nt, Human
agccgguaaugcccucauggaugg

SEQ ID NO: 21207 - RNA, 24 nt, Human
uguggcuuaccaggugaauauugg

SEQ ID NO: 21208 - RNA, 24 nt, Human
uauuagccaucauugaggcacucu

SEQ ID NO: 21209 - RNA, 24 nt, Human
ugagggacaucuaaucuugguucg

SEQ ID NO: 21210 - RNA, 24 nt, Human
cauuaacuuuaaacauggucugcg

SEQ ID NO: 21211 - RNA, 24 nt, Human
ugccuguacaucaacaucuucuca

SEQ ID NO: 21212 - RNA, 24 nt, Human
aaggagcagcucgaggccaggagg

SEQ ID NO: 21213 - RNA, 24 nt, Human
cacggcaggucugaugccccgguu

SEQ ID NO: 21214 - RNA, 24 nt, Human
ugagugcacuugggagaccuggug

SEQ ID NO: 21215 - RNA, 24 nt, Human
aggaagacaggguucuggugccag

SEQ ID NO: 21216 - RNA, 24 nt, Human
ucaaagguagaggggugauucugu

SEQ ID NO: 21217 - RNA, 24 nt, Human
uacacugggacgucagcaaacacc

SEQ ID NO: 21218 - RNA, 24 nt, Human
uugguggugguggugguuuuuuuu

SEQ ID NO: 21219 - RNA, 24 nt, Human
uccaggaggaaugugaugauugcc

SEQ ID NO: 21220 - RNA, 24 nt, Human
aacccauuuuugucuucauaagca

SEQ ID NO: 21221 - RNA, 24 nt, Human
uuaaaguuauaugaagucccugag

SEQ ID NO: 21222 - RNA, 24 nt, Human
ugugucacccuaaagaagcauaua

SEQ ID NO: 21223 - RNA, 24 nt, Human
ugcugcugguaccaaaugugauuu

SEQ ID NO: 21224 - RNA, 24 nt, Human
acgacauuguuccacaaaguccuu

SEQ ID NO: 21225 - RNA, 24 nt, Human
accuugucgcguacuuuuuccaca

SEQ ID NO: 21226 - RNA, 24 nt, Human
uuaaagcuauucaggauuuaguag

SEQ ID NO: 21227 - RNA, 19 nt, Human
uaacucuuucagaaauuca

SEQ ID NO: 21228 - RNA, 24 nt, Human
ucacaggagauacguguuuuauuu

SEQ ID NO: 21229 - RNA, 24 nt, Human
ucuuauugaauuuuuucaucugcu

SEQ ID NO: 21230 - RNA, 19 nt, Human
uuucauggucauauaaugg

SEQ ID NO: 21231 - RNA, 21 nt, Human
uaugucaauucagaaauagag

SEQ ID NO: 21232 - RNA, 24 nt, Human
uacagcacaauauuucaauggaau

SEQ ID NO: 21233 - RNA, 24 nt, Human
gguaaagaaaaaugacauaguaaa

SEQ ID NO: 21234 - RNA, 24 nt, Human
uacccguucucccuuuggucaggg

SEQ ID NO: 21235 - RNA, 24 nt, Human
cagcagccucaacaguaugguauu

SEQ ID NO: 21236 - RNA, 24 nt, Human
ucuuugaaugacuauuccaaguaa

SEQ ID NO: 21237 - RNA, 24 nt, Human
gccaaauuuccacuuucagcaguu

SEQ ID NO: 21238 - RNA, 24 nt, Human
uacaugauuuuuaucuaacaacgu

SEQ ID NO: 21239 - RNA, 24 nt, Human
ccuaacaucaagaaugugagagaa

SEQ ID NO: 21240 - RNA, 24 nt, Human
uuaaagggaaucauuaacagccug

SEQ ID NO: 21241 - RNA, 24 nt, Human
ugaagcagaagcagauucggcgcg

SEQ ID NO: 21242 - RNA, 24 nt, Human
acggaccugggugcagccgcacgu

SEQ ID NO: 21243 - RNA, 24 nt, Human
ucgcgcugccgccgccacugcugc

SEQ ID NO: 21244 - RNA, 24 nt, Human
uaaauugugugaaauagucucccg

SEQ ID NO: 21245 - RNA, 24 nt, Human
gagccucagcuucuccuggauuug

SEQ ID NO: 21246 - RNA, 24 nt, Human
ugaagagauaggcuucauagauua

SEQ ID NO: 21247 - RNA, 24 nt, Human
uguggagugggccagcugaguacc

SEQ ID NO: 21248 - RNA, 24 nt, Human
auagaacaaauauuuacagauaca

SEQ ID NO: 21249 - RNA, 24 nt, Human
uagggucucuagaaggcagguagu

SEQ ID NO: 21250 - RNA, 24 nt, Human
uaauagccaaaagucagaauuuaa

SEQ ID NO: 21251 - RNA, 24 nt, Human
uuccuccuuggucacugccuucuc

SEQ ID NO: 21252 - RNA, 24 nt, Human
ugaauaggcacagagggcaccugu

SEQ ID NO: 21253 - RNA, 24 nt, Human
agggggugggagguguacauaaga

SEQ ID NO: 21254 - RNA, 24 nt, Human
gaagguaggagggagggcagagcg

SEQ ID NO: 21255 - RNA, 24 nt, Human
uggcuggucauggaaggggcaguu

SEQ ID NO: 21256 - RNA, 24 nt, Human
ccaaaaguacuugccgcucuaccc

SEQ ID NO: 21257 - RNA, 24 nt, Human
uuccgguaucguaaaacaucuccu

SEQ ID NO: 21258 - RNA, 24 nt, Human
uaacugagucaucuuuuuuccauu

SEQ ID NO: 21259 - RNA, 20 nt, Human
agagccaaugagggacagga

SEQ ID NO: 21260 - RNA, 24 nt, Human
caccagcguccggaucggggcguc

SEQ ID NO: 21261 - RNA, 24 nt, Human
ugggucuuugugcugaggcaggac

SEQ ID NO: 21262 - RNA, 24 nt, Human
ucucacacuggcaggcgguggcuc

SEQ ID NO: 21263 - RNA, 24 nt, Human
acagcgcuguccaccugcagcugc

SEQ ID NO: 21264 - RNA, 19 nt, Human
cacagcauuaacggcgccc

SEQ ID NO: 21265 - RNA, 24 nt, Human
caggagcguccaggcacugcagcu

SEQ ID NO: 21266 - RNA, 24 nt, Human
cuuggagcuguccauugcagacca

SEQ ID NO: 21267 - RNA, 17 nt, Human
gccccgggaagggcuuc

SEQ ID NO: 21268 - RNA, 24 nt, Human
uaggugugugccacgaugcuggcu

SEQ ID NO: 21269 - RNA, 24 nt, Human
uauccaagauaagaaucugaauuu

SEQ ID NO: 21270 - RNA, 24 nt, Human
aacaggucugugaugcccuuaguu

SEQ ID NO: 21271 - RNA, 24 nt, Human
uuccauggggagauauggccaguu

SEQ ID NO: 21272 - RNA, 24 nt, Human
aggcaauuugauguggacauucuu

SEQ ID NO: 21273 - RNA, 24 nt, Human
uucgaugagaaucugaauuaucca

SEQ ID NO: 21274 - RNA, 24 nt, Human
agugacacgugaaugauaauguga

SEQ ID NO: 21275 - RNA, 24 nt, Human
ugaugaagguuucccauaugguuu

SEQ ID NO: 21276 - RNA, 24 nt, Human
gugaacucagauacuuguuuccac

SEQ ID NO: 21277 - RNA, 24 nt, Human
acgaagcaggagguaagcccaacg

SEQ ID NO: 21278 - RNA, 24 nt, Human
caggggaggccggccacaaaugca

SEQ ID NO: 21279 - RNA, 24 nt, Human
uuuacaauucaguaugauuagacg

SEQ ID NO: 21280 - RNA, 24 nt, Human
ugauuuugggucccuuugugguac

SEQ ID NO: 21281 - RNA, 24 nt, Human
ccuccagcucggacaacuaggcgu

SEQ ID NO: 21282 - RNA, 24 nt, Human
augcagccuaaaaggugguugaaa

SEQ ID NO: 21283 - RNA, 24 nt, Human
ugggagcuggaagagguaggggga

SEQ ID NO: 21284 - RNA, 24 nt, Human
ugggugcagauggcugggccaagg

SEQ ID NO: 21285 - RNA, 24 nt, Human
uaugaggcugaugaauuugagaug

SEQ ID NO: 21286 - RNA, 24 nt, Human
ugcuuguaaucuuggaccagaacg

SEQ ID NO: 21287 - RNA, 24 nt, Human
uauagcaguguggauuuuggauac

SEQ ID NO: 21288 - RNA, 24 nt, Human
ugccguaacgggagcuggucucgg

SEQ ID NO: 21289 - RNA, 24 nt, Human
uuuaaaaaaugaacauauuaagag

SEQ ID NO: 21290 - RNA, 24 nt, Human
uauuaaauaaaauuucagggagcc

SEQ ID NO: 21291 - RNA, 24 nt, Human
auggccuuauuugaggcaguguau

SEQ ID NO: 21292 - RNA, 24 nt, Human
aagcagguuuucucuagucugcuu

SEQ ID NO: 21293 - RNA, 24 nt, Human
ugcgcggggagagcgaggcggggc

SEQ ID NO: 21294 - RNA, 24 nt, Human
cgaaugcaccaugaguuagaguga

SEQ ID NO: 21295 - RNA, 24 nt, Human
cuuuguguacagagguccgggucu

SEQ ID NO: 21296 - RNA, 24 nt, Human
uucauuaggaaugucuucuuguca

SEQ ID NO: 21297 - RNA, 24 nt, Human
ucccaucgagcugguugucuucuu

SEQ ID NO: 21298 - RNA, 24 nt, Human
cagcggcagagagccauccucuau

SEQ ID NO: 21299 - RNA, 24 nt, Human
acaaagcaagagaagaagcagaga

SEQ ID NO: 21300 - RNA, 24 nt, Human
cucccgggccuacagcggcugcgg

SEQ ID NO: 21301 - RNA, 24 nt, Human
agcgauguuuccccucgaaaggcc

SEQ ID NO: 21302 - RNA, 24 nt, Human
uagaaaguccaccugcccucguuc

SEQ ID NO: 21303 - RNA, 24 nt, Human
uucaucaugaucauaggcaguuga

SEQ ID NO: 21304 - RNA, 24 nt, Human
ugcguuuauaaaacuaguuuuuaa

SEQ ID NO: 21305 - RNA, 18 nt, Human
ugaguggacauuauuggc

SEQ ID NO: 21306 - RNA, 24 nt, Human
acugccuugugaugccucccuaga

SEQ ID NO: 21307 - RNA, 24 nt, Human
ugaggucauagccagaaggaguuu

SEQ ID NO: 21308 - RNA, 24 nt, Human
uugaucuugaagaaacugggcgug

SEQ ID NO: 21309 - RNA, 24 nt, Human
guagaguuuucuucaggcuuaaag

SEQ ID NO: 21310 - RNA, 24 nt, Human
guagaguuuucuucaggcuuaaag

SEQ ID NO: 21311 - RNA, 24 nt, Human
gcgcguugcugcggccgugguccg

SEQ ID NO: 21312 - RNA, 24 nt, Human
uugaucuugaagaaacugggcgug

SEQ ID NO: 21313 - RNA, 24 nt, Human
aggaaggagauauagugaagagga

SEQ ID NO: 21314 - RNA, 24 nt, Human
uacuccagguggguguuagcacug

SEQ ID NO: 21315 - RNA, 24 nt, Human
uguggauagcuucugaucccuggg

SEQ ID NO: 21316 - RNA, 24 nt, Human
ugagcaaaccaaggggguuuauag

SEQ ID NO: 21317 - RNA, 24 nt, Human
aacagcuucaaacagugguuggca

SEQ ID NO: 21318 - RNA, 24 nt, Human
uuauucggguggaccgacagaccu

SEQ ID NO: 21319 - RNA, 24 nt, Human
ucuccagaaaugcuuuggguucau

SEQ ID NO: 21320 - RNA, 24 nt, Human
uugaucuugaagaaacugggcgug

SEQ ID NO: 21321 - RNA, 24 nt, Human
guagaguuuucuucaggcuuaaag

SEQ ID NO: 21322 - RNA, 24 nt, Human
ugagaaugaccccaagaccuuuga

SEQ ID NO: 21323 - RNA, 24 nt, Human
cuuccaaucugaugggcauguuug

SEQ ID NO: 21324 - RNA, 22 nt, Human
guggagggcagcuuugucuaca

SEQ ID NO: 21325 - RNA, 22 nt, Human
ccgcagaggcccgaggcaccgg

SEQ ID NO: 21326 - RNA, 24 nt, Human
cagcuccucggguggggccugcgg

SEQ ID NO: 21327 - RNA, 24 nt, Human
ugcgugaaguacugagcaggguga

SEQ ID NO: 21328 - RNA, 24 nt, Human
caugcaacucugccuccgggguuc

SEQ ID NO: 21329 - RNA, 24 nt, Human
gggcacugaagaugaugcgaccca

SEQ ID NO: 21330 - RNA, 24 nt, Human
uacagugcuuguaaaagguuugaa

SEQ ID NO: 21331 - RNA, 24 nt, Human
uucccugacuuggugaaacaugcu

SEQ ID NO: 21332 - RNA, 24 nt, Human
agcagaaguguggccacgggaggg

SEQ ID NO: 21333 - RNA, 24 nt, Human
aaccaggugcucuccaauaaagac

SEQ ID NO: 21334 - RNA, 24 nt, Human
cuggagccgugcgccuccacugca

SEQ ID NO: 21335 - RNA, 24 nt, Human
agagaggugucugugaaguuuuug

SEQ ID NO: 21336 - RNA, 24 nt, Human
ucaaugcagucaccgugguauggg

SEQ ID NO: 21337 - RNA, 24 nt, Human
auguccuugaucauuuuauguucu

SEQ ID NO: 21338 - RNA, 20 nt, Human
uuccugguuagacucuguuc

SEQ ID NO: 21339 - RNA, 24 nt, Human
uuuguuggguuuucugaaacuuaa

SEQ ID NO: 21340 - RNA, 24 nt, Human
caggauccuucagcacugaggugu

SEQ ID NO: 21341 - RNA, 24 nt, Human
uccacagugucagcuauggccaug

SEQ ID NO: 21342 - RNA, 24 nt, Human
acugcucugagauuugagggaaac

SEQ ID NO: 21343 - RNA, 24 nt, Human
ccuggacgagccccagggacaguc

SEQ ID NO: 21344 - RNA, 21 nt, Human
cugcagcagcucuucuccucc

SEQ ID NO: 21345 - RNA, 24 nt, Human
gauuguguuugucacucuagaaga

SEQ ID NO: 21346 - RNA, 24 nt, Human
uaccagaagaccaaugccgugucu

SEQ ID NO: 21347 - RNA, 24 nt, Human
cacgggccgaggaggauguggagc

SEQ ID NO: 21348 - RNA, 24 nt, Human
acaggcgagggcgugaacgaugug

SEQ ID NO: 21349 - RNA, 24 nt, Human
auggaucccucugugcuucuggac

SEQ ID NO: 21350 - RNA, 24 nt, Human
acccuuacacgcuagaugguuggg

SEQ ID NO: 21351 - RNA, 24 nt, Human
caggacaccugguccccagcuccc

SEQ ID NO: 21352 - RNA, 23 nt, Human
uccagguuucuggucagccuggg

SEQ ID NO: 21353 - RNA, 24 nt, Human
uggcaauuucuuagagaucaagaa

SEQ ID NO: 21354 - RNA, 24 nt, Human
uuucauguuuaacauugcagaugg

SEQ ID NO: 21355 - RNA, 24 nt, Human
ugagggcagagagaggggagcccc

SEQ ID NO: 21356 - RNA, 24 nt, Human
acugugcugggaacauguaccacu

SEQ ID NO: 21357 - RNA, 24 nt, Human
uagcauacuuuuguuagcaaccgg

SEQ ID NO: 21358 - RNA, 24 nt, Human
ucccaagccagaaagaaguuaacu

SEQ ID NO: 21359 - RNA, 24 nt, Human
ggacagguguacagacauguucuu

SEQ ID NO: 21360 - RNA, 24 nt, Human
ucgaauggacacauuaccagugaa

SEQ ID NO: 21361 - RNA, 24 nt, Human
uucauuguccagaguccggcuguu

SEQ ID NO: 21362 - RNA, 21 nt, Human
uuccuuggagcucuccauugg

SEQ ID NO: 21363 - RNA, 24 nt, Human
ugcauuguuaucauuaacccaguc

SEQ ID NO: 21364 - RNA, 24 nt, Human
auggaguuccaggggcccaugccc

SEQ ID NO: 21365 - RNA, 24 nt, Human
ugugaacccugucucucugcagcu

SEQ ID NO: 21366 - RNA, 24 nt, Human
ugagaccauucuuccucuuguguu

SEQ ID NO: 21367 - RNA, 24 nt, Human
ucgaggacagcgccgccuaggacc

SEQ ID NO: 21368 - RNA, 24 nt, Human
uaccugaaauauggaguaaccaag

SEQ ID NO: 21369 - RNA, 24 nt, Human
uauggcaagucacuuugacagaca

SEQ ID NO: 21370 - RNA, 24 nt, Human
ugagaauggcaaaauuagucgccu

SEQ ID NO: 21371 - RNA, 24 nt, Human
uacaccacucccaagaagaauaag

SEQ ID NO: 21372 - RNA, 24 nt, Human
aucauccaugagaucucccacagu

SEQ ID NO: 21373 - RNA, 24 nt, Human
accauguacgcccagaggaggauc

SEQ ID NO: 21374 - RNA, 24 nt, Human
uccaaauuacuuucaggauguuuu

SEQ ID NO: 21375 - RNA, 24 nt, Human
ugcauuguuaucauuaaccagucu

SEQ ID NO: 21376 - RNA, 24 nt, Human
uauuagggauaauauucauuuagc

SEQ ID NO: 21377 - RNA, 24 nt, Human
uaaugggucucaaaauucugugac

SEQ ID NO: 21378 - RNA, 24 nt, Human
cagcggaugguguaucggacauag

SEQ ID NO: 21379 - RNA, 24 nt, Human
aggcaguggcaagagggguucagg

SEQ ID NO: 21380 - RNA, 24 nt, Human
uagugcaacaguuuggcuuugcgg

SEQ ID NO: 21381 - RNA, 24 nt, Human
uggcuucacucucacaaacuccuu

SEQ ID NO: 21382 - RNA, 24 nt, Human
ucaguccaguuauauccgcaguau

SEQ ID NO: 21383 - RNA, 24 nt, Human
cagcggauggggcacgacagcuag

SEQ ID NO: 21384 - RNA, 24 nt, Human
uucaccuugaucacggggcccuug

SEQ ID NO: 21385 - RNA, 19 nt, Human
uagcagcaugauuuauaau

SEQ ID NO: 21386 - RNA, 21 nt, Human
ggacaugaacucaucauuuuu

SEQ ID NO: 21387 - RNA, 24 nt, Human
aggcagucacagaacaggggcaug

SEQ ID NO: 21388 - RNA, 24 nt, Human
uaaugggucucaaaauucugugac

SEQ ID NO: 21389 - RNA, 24 nt, Human
uguguuuguagacuuggaacccac

SEQ ID NO: 21390 - RNA, 24 nt, Human
ugcauuguuaucauuaaccagucu

SEQ ID NO: 21391 - RNA, 24 nt, Human
uaaugggucucaaaauucugugac

SEQ ID NO: 21392 - RNA, 24 nt, Human
uauuagggauaauauucauuuagc

SEQ ID NO: 21393 - RNA, 24 nt, Human
uuuagagggagggcgccgugcaaa

SEQ ID NO: 21394 - RNA, 24 nt, Human
uuggccauuacaaagacacaggaa

SEQ ID NO: 21395 - RNA, 24 nt, Human
uggaagcagcggaggaaggagacg

SEQ ID NO: 21396 - RNA, 23 nt, Human
ugcaaaaaguccaggccugggca

SEQ ID NO: 21397 - RNA, 24 nt, Human
ucaguuggaagacacccugaaauc

SEQ ID NO: 21398 - RNA, 24 nt, Human
accaagcuuuguccccucucgcug

SEQ ID NO: 21399 - RNA, 24 nt, Human
uuaguguacagguacaugggcugu

SEQ ID NO: 21400 - RNA, 24 nt, Human
uugaagccagauauugaccucucu

SEQ ID NO: 21401 - RNA, 24 nt, Human
uaggauuuuuggaaugguauauga

SEQ ID NO: 21402 - RNA, 24 nt, Human
caguaggucccaacagcgggcuua

SEQ ID NO: 21403 - RNA, 24 nt, Human
uucaaacauauucugaacauugau

SEQ ID NO: 21404 - RNA, 24 nt, Human
ucccaagccagaaagaaguuaacu

SEQ ID NO: 21405 - RNA, 24 nt, Human
uggcaugacccuggagaguagcug

SEQ ID NO: 21406 - RNA, 24 nt, Human
uaacuugaugaaagaagauugucu

SEQ ID NO: 21407 - RNA, 24 nt, Human
uggaagaucuuagaauugccugcc

SEQ ID NO: 21408 - RNA, 22 nt, Human
uacugggugaauagcacuuucc

SEQ ID NO: 21409 - RNA, 24 nt, Human
ucagcucaccauuuauaccagucc

SEQ ID NO: 21410 - RNA, 24 nt, Human
ugccguggugaaauguuuagauca

SEQ ID NO: 21411 - RNA, 24 nt, Human
cacaccgaccggcccgagguaucg

SEQ ID NO: 21412 - RNA, 24 nt, Human
uuuuguuuacugagaguaagauca

SEQ ID NO: 21413 - RNA, 21 nt, Human
cacuuuguucuuuuucugaag

SEQ ID NO: 21414 - RNA, 24 nt, Human
ccuuacucccucuuuaagauugcg

SEQ ID NO: 21415 - RNA, 24 nt, Human
aguuuggauucugaaaacuaacug

SEQ ID NO: 21416 - RNA, 24 nt, Human
uuagagcuggcagcagcaucucag

SEQ ID NO: 21417 - RNA, 21 nt, Human
ugaaaugcaauaauauguauc

SEQ ID NO: 21418 - RNA, 24 nt, Human
ucacaccagagggaugggguagga

SEQ ID NO: 21419 - RNA, 24 nt, Human
uggaaaguagcccuucuggacaga

SEQ ID NO: 21420 - RNA, 24 nt, Human
ugagauuuuacaagcuuguaaaag

SEQ ID NO: 21421 - RNA, 24 nt, Human
cagcacuucaauugaauauaaucc

SEQ ID NO: 21422 - RNA, 24 nt, Human
auagcagucauaaaucucagggca

SEQ ID NO: 21423 - RNA, 24 nt, Human
uaagguuaaggcuguaccauguac

SEQ ID NO: 21424 - RNA, 21 nt, Human
aaguaugccugggucuuggau

SEQ ID NO: 21425 - RNA, 24 nt, Human
uccccaggccacucgcagucuugc

SEQ ID NO: 21426 - RNA, 24 nt, Human
cagcagccacagcagccgcuucug

SEQ ID NO: 21427 - RNA, 24 nt, Human
uuacugcagcuccagcagcugcuc

SEQ ID NO: 21428 - RNA, 22 nt, Human
uucccuuccucauccugcagcc

SEQ ID NO: 21429 - RNA, 24 nt, Human
uugaucuugaagaaacugggcgug

SEQ ID NO: 21430 - RNA, 24 nt, Human
aggaaggagauauagugaagagga

SEQ ID NO: 21431 - RNA, 24 nt, Human
guagaguuuucuucaggcuuaaag

SEQ ID NO: 21432 - RNA, 24 nt, Human
ucuccagaaaugcuuuggguucau

SEQ ID NO: 21433 - RNA, 24 nt, Human
uugaucuugaagaaacugggcgug

SEQ ID NO: 21434 - RNA, 24 nt, Human
ccccgguaucauuccucgaauuuc

SEQ ID NO: 21435 - RNA, 24 nt, Human
aggaaggagauauagugaagagga

SEQ ID NO: 21436 - RNA, 24 nt, Human
guagaguuuucuucaggcuuaaag

SEQ ID NO: 21437 - RNA, 23 nt, Human
uccgugcgcguugcugcggccgu

SEQ ID NO: 21438 - RNA, 24 nt, Human
aggaaggagauauagugaagagga

SEQ ID NO: 21439 - RNA, 24 nt, Human
uuuguugggauggaagcaugaagg

SEQ ID NO: 21440 - RNA, 24 nt, Human
ucgccgucaccgccgcggcuccgg

SEQ ID NO: 21441 - RNA, 24 nt, Human
ggagugcacgucucucuaggcuuc

SEQ ID NO: 21442 - RNA, 24 nt, Human
uacauggacaccggcgaggagauc

SEQ ID NO: 21443 - RNA, 24 nt, Human
ucgcuggcagcagccccagccuga

SEQ ID NO: 21444 - RNA, 24 nt, Human
uggcaaucuccucaugagaaaacu

SEQ ID NO: 21445 - RNA, 24 nt, Human
ccugcagggcucggccguaggaga

SEQ ID NO: 21446 - RNA, 24 nt, Human
uguuguguuuuuuguuuuuuuccc

SEQ ID NO: 21447 - RNA, 21 nt, Human
uggcagauggaucucuccggc

SEQ ID NO: 21448 - RNA, 24 nt, Human
gggcgcgggccccaccagggcgau

SEQ ID NO: 21449 - RNA, 24 nt, Human
ucacaaagguaacaaaaaacguac

SEQ ID NO: 21450 - RNA, 24 nt, Human
uguaagaaauaagaaucaucaccu

SEQ ID NO: 21451 - RNA, 20 nt, Human
ugugaugauucgguucuugg

SEQ ID NO: 21452 - RNA, 24 nt, Human
cagcaggcgggggcagccuggcag

SEQ ID NO: 21453 - RNA, 24 nt, Human
uuccgcuugggguugcgggccucc

SEQ ID NO: 21454 - RNA, 24 nt, Human
agccggcgucgcugucucgcuugc

SEQ ID NO: 21455 - RNA, 24 nt, Human
uccaccuccuugcgguggcgggag

SEQ ID NO: 21456 - RNA, 24 nt, Human
cuugcugugcggagggccugcuau

SEQ ID NO: 21457 - RNA, 24 nt, Human
auaugcuuugccuaggacagguuu

SEQ ID NO: 21458 - RNA, 24 nt, Human
uggaaagggugguagcccuggaaa

SEQ ID NO: 21459 - RNA, 24 nt, Human
ucccucagcagcguggugaccgug

SEQ ID NO: 21460 - RNA, 24 nt, Human
ucauaaggaauuaacucaugagau

SEQ ID NO: 21461 - RNA, 24 nt, Human
uaccuaaugggcugaggaagggag

SEQ ID NO: 21462 - RNA, 24 nt, Human
gaaaucaccuagggcagccaagcu

SEQ ID NO: 21463 - RNA, 24 nt, Human
uggcuuuggaucugaacuaauggg

SEQ ID NO: 21464 - RNA, 24 nt, Human
uguuauuguccccugccucgccug

SEQ ID NO: 21465 - RNA, 24 nt, Human
cgccugugcccgcggugugccgca

SEQ ID NO: 21466 - RNA, 24 nt, Human
uaaaauaccucuaauaaacacugu

SEQ ID NO: 21467 - RNA, 24 nt, Human
agggauuaaauauagauguaauuu

SEQ ID NO: 21468 - RNA, 24 nt, Human
ugucacagucaaagugccucagaa

SEQ ID NO: 21469 - RNA, 24 nt, Human
uggaaaguucagcaagaucagcaa

SEQ ID NO: 21470 - RNA, 24 nt, Human
ugccugaaaaaauauccuuugugc

SEQ ID NO: 21471 - RNA, 24 nt, Human
uacgugaaacagaagaggcuaagc

SEQ ID NO: 21472 - RNA, 24 nt, Human
ugaaaaguagaauuuccauugaga

SEQ ID NO: 21473 - RNA, 24 nt, Human
uaagguuuuuuuuuuuucuuuaaa

SEQ ID NO: 21474 - RNA, 24 nt, Human
uucaugggcaaaaggaggaaggga

SEQ ID NO: 21475 - RNA, 24 nt, Human
gucacuuucuccgcuuguagauuu

SEQ ID NO: 21476 - RNA, 24 nt, Human
uauggcaaggaccugauggagaag

SEQ ID NO: 21477 - RNA, 23 nt, Human
uaucuuaccaugaagguuguuuu

SEQ ID NO: 21478 - RNA, 24 nt, Human
ggaggaacuugaaaggaggguaaa

SEQ ID NO: 21479 - RNA, 24 nt, Human
cuugcgcuuaguguccuacauggg

SEQ ID NO: 21480 - RNA, 24 nt, Human
ccuugcucuguugcucaggcugaa

SEQ ID NO: 21481 - RNA, 24 nt, Human
uuugaagaaccuaagaaagauuaa

SEQ ID NO: 21482 - RNA, 24 nt, Human
gaccuagaaacaaaugcacuaaga

SEQ ID NO: 21483 - RNA, 22 nt, Human
cauugcaacauguuucauugau

SEQ ID NO: 21484 - RNA, 24 nt, Human
cuagcaccgguaugugcgacccua

SEQ ID NO: 21485 - RNA, 24 nt, Human
uaguugaugccaaccuugaagcca

SEQ ID NO: 21486 - RNA, 24 nt, Human
guccauggcgagcccaggccucag

SEQ ID NO: 21487 - RNA, 24 nt, Human
gggcaucguggcugaggugcuggu

SEQ ID NO: 21488 - RNA, 24 nt, Human
ucagagcuacacauugagaaccug

SEQ ID NO: 21489 - RNA, 24 nt, Human
acccuugaaccauccaugauugca

SEQ ID NO: 21490 - RNA, 24 nt, Human
uuaggcuacgaaacaucacuauug

SEQ ID NO: 21491 - RNA, 24 nt, Human
uauguugccaucaaugaccccuuc

SEQ ID NO: 21492 - RNA, 24 nt, Human
uggauggcccuccgggaaacugug

SEQ ID NO: 21493 - RNA, 24 nt, Human
ucacuggauggcuuccguguccca

SEQ ID NO: 21494 - RNA, 24 nt, Human
uacacugagcaccacgggguuccu

SEQ ID NO: 21495 - RNA, 21 nt, Human
cugcccccucugcugaugccc

SEQ ID NO: 21496 - RNA, 24 nt, Human
uuccugguugagaaaccacuuggg

SEQ ID NO: 21497 - RNA, 24 nt, Human
uggaagaagagggaagucaucaag

SEQ ID NO: 21498 - RNA, 20 nt, Human
ucugucgggcagguggccgu

SEQ ID NO: 21499 - RNA, 24 nt, Human
aggcacgccgagcagggggcggcg

SEQ ID NO: 21500 - RNA, 23 nt, Human
uggugggguccgaagugggagac

SEQ ID NO: 21501 - RNA, 24 nt, Human
caggaucugguacuguucuggagu

SEQ ID NO: 21502 - RNA, 24 nt, Human
cugaaucugaaagaacucccccau

SEQ ID NO: 21503 - RNA, 18 nt, Human
ugagaucaggaaagcggu

SEQ ID NO: 21504 - RNA, 22 nt, Human
ccccugagcccaccuacugcuc

SEQ ID NO: 21505 - RNA, 24 nt, Human
ucccucuggacauacugcugccug

SEQ ID NO: 21506 - RNA, 24 nt, Human
uaugggggcccuaguuaugccucc

SEQ ID NO: 21507 - RNA, 24 nt, Human
ucaaccuucuuaaaauuuuuaaga

SEQ ID NO: 21508 - RNA, 24 nt, Human
aacuaggucauucaccgcaagguc

SEQ ID NO: 21509 - RNA, 24 nt, Human
uccaaagcaucguaaucaggagcc

SEQ ID NO: 21510 - RNA, 24 nt, Human
uggcuguggacaccuuccacaccg

SEQ ID NO: 21511 - RNA, 24 nt, Human
cacagcucggcccccucccgcagc

SEQ ID NO: 21512 - RNA, 24 nt, Human
guugcuagaguaaucucacacaca

SEQ ID NO: 21513 - RNA, 24 nt, Human
uacaucacugcuagaauauuuagc

SEQ ID NO: 21514 - RNA, 24 nt, Human
ucgccaggagccggaccacagacg

SEQ ID NO: 21515 - RNA, 24 nt, Human
uaauguacgggcgccagguccgac

SEQ ID NO: 21516 - RNA, 24 nt, Human
uagggugcuuaaagcuaacuaguc

SEQ ID NO: 21517 - RNA, 24 nt, Human
gauuugagaaaguaggagagacag

SEQ ID NO: 21518 - RNA, 24 nt, Human
gaagugcaaaauggaauaaacuga

SEQ ID NO: 21519 - RNA, 24 nt, Human
uaguauuucauaccgccugaaaug

SEQ ID NO: 21520 - RNA, 24 nt, Human
ugacaaggguaguaaggaggucau

SEQ ID NO: 21521 - RNA, 24 nt, Human
ucucgcuuuucuucuggcauaguu

SEQ ID NO: 21522 - RNA, 24 nt, Human
ugugcaugcccacagcccgaggcc

SEQ ID NO: 21523 - RNA, 24 nt, Human
agggagagggggaaagguccaaag

SEQ ID NO: 21524 - RNA, 24 nt, Human
ugucauugcaauaggauguuacaa

SEQ ID NO: 21525 - RNA, 24 nt, Human
ugcguuaacacgacuuauuuucuu

SEQ ID NO: 21526 - RNA, 24 nt, Human
aaagugcugggaccacaggcagga

SEQ ID NO: 21527 - RNA, 24 nt, Human
ugcagagguuccuccuuguccuug

SEQ ID NO: 21528 - RNA, 24 nt, Human
uuugcaguuguugaaauugucccc

SEQ ID NO: 21529 - RNA, 22 nt, Human
ugggauguggccauucuugugg

SEQ ID NO: 21530 - RNA, 24 nt, Human
uacagcacaauauuucaauggaau

SEQ ID NO: 21531 - RNA, 24 nt, Human
gguaaagaaaaaugacauaguaaa

SEQ ID NO: 21532 - RNA, 21 nt, Human
ucaaucucaccuucugauaua

SEQ ID NO: 21533 - RNA, 24 nt, Human
auggauuguagaguaagguuuugu

SEQ ID NO: 21534 - RNA, 24 nt, Human
agggcgcuguggacgcggugagga

SEQ ID NO: 21535 - RNA, 24 nt, Human
ucggggcggugaggacgcuguggg

SEQ ID NO: 21536 - RNA, 24 nt, Human
aguuaguuuuuuuuuauuauuauu

SEQ ID NO: 21537 - RNA, 24 nt, Human
gggcagagcugagaagccaagggg

SEQ ID NO: 21538 - RNA, 24 nt, Human
uuagugcaugaaaggcuaaugcuc

SEQ ID NO: 21539 - RNA, 24 nt, Human
ccucccagcauucggguagugguc

SEQ ID NO: 21540 - RNA, 24 nt, Human
caccacuaauaucugagauguuau

SEQ ID NO: 21541 - RNA, 18 nt, Human
uguauuaguuuuuauuug

SEQ ID NO: 21542 - RNA, 21 nt, Human
uauugugguaacggacaggaa

SEQ ID NO: 21543 - RNA, 24 nt, Human
ugagccgaggggccagccccacuc

SEQ ID NO: 21544 - RNA, 24 nt, Human
ucuguugugauuauuugaauagcu

SEQ ID NO: 21545 - RNA, 24 nt, Human
uggaauggaggugacagaaagaaa

SEQ ID NO: 21546 - RNA, 24 nt, Human
uguucuggagcuguuggacaaaua

SEQ ID NO: 21547 - RNA, 24 nt, Human
cuaccgccaccgccgccgccgauu

SEQ ID NO: 21548 - RNA, 24 nt, Human
aggcagucacagaacaggggcaug

SEQ ID NO: 21549 - RNA, 24 nt, Human
aaccagaaaguaagguguucuacu

SEQ ID NO: 21550 - RNA, 24 nt, Human
gacacugggguugggaaaucaagc

SEQ ID NO: 21551 - RNA, 24 nt, Human
augcugcugagccccggcacugcc

SEQ ID NO: 21552 - RNA, 24 nt, Human
ugggugcgguaucaucuaagagaa

SEQ ID NO: 21553 - RNA, 24 nt, Human
uguaagaucucuucgagagagcug

SEQ ID NO: 21554 - RNA, 24 nt, Human
uaacuaguggggcuuaaugaaggu

SEQ ID NO: 21555 - RNA, 24 nt, Human
uagguaacuagguaacuuauugug

SEQ ID NO: 21556 - RNA, 24 nt, Human
gguaagaauuagauuccuuauaaa

SEQ ID NO: 21557 - RNA, 24 nt, Human
ugagcuggaggagaagcaacuuug

SEQ ID NO: 21558 - RNA, 24 nt, Human
gggcaagaguuucgccggcgcauc

SEQ ID NO: 21559 - RNA, 24 nt, Human
ugacugcgagucgucugggggagg

SEQ ID NO: 21560 - RNA, 19 nt, Human
uagcagguuggcuuccuuc

SEQ ID NO: 21561 - RNA, 24 nt, Human
ugaggauaaaagcuggugggagcc

SEQ ID NO: 21562 - RNA, 24 nt, Human
ugaaaauucggaugucgcugaucc

SEQ ID NO: 21563 - RNA, 24 nt, Human
aaaguccauugaucaucacaaaaa

SEQ ID NO: 21564 - RNA, 23 nt, Human
uuucucccuccuaauaugcaagg

SEQ ID NO: 21565 - RNA, 24 nt, Human
cugcugcacgugaagcggggcggc

SEQ ID NO: 21566 - RNA, 24 nt, Human
ucccggacugugagcggcuguuag

SEQ ID NO: 21567 - RNA, 24 nt, Human
uccaaagaggagccaguuaccaug

SEQ ID NO: 21568 - RNA, 24 nt, Human
ugugaugauuauuucuucagccau

SEQ ID NO: 21569 - RNA, 24 nt, Human
acgggccgcuuuccacaaugcagu

SEQ ID NO: 21570 - RNA, 24 nt, Human
aggccgagguccgcggccaggugc

SEQ ID NO: 21571 - RNA, 24 nt, Human
uggccggcacgggcagacaacgcg

SEQ ID NO: 21572 - RNA, 24 nt, Human
ucuacaauaauaaauccaaagagg

SEQ ID NO: 21573 - RNA, 24 nt, Human
aggccgagguccgcggccaggugc

SEQ ID NO: 21574 - RNA, 24 nt, Human
uuugcacaagcuugucagugacau

SEQ ID NO: 21575 - RNA, 24 nt, Human
accaugcguacgaguugaaaggau

SEQ ID NO: 21576 - RNA, 24 nt, Human
uaccgugcuugugacagguuugga

SEQ ID NO: 21577 - RNA, 24 nt, Human
gcgcguugcugcggccgugguccg

SEQ ID NO: 21578 - RNA, 21 nt, Human
ugagaaggagaugcugcucuu

SEQ ID NO: 21579 - RNA, 24 nt, Human
agagauuggugaggauuuggauaa

SEQ ID NO: 21580 - RNA, 24 nt, Human
acugguucaccuacaaugagacaa

SEQ ID NO: 21581 - RNA, 23 nt, Human
cucugcuucagagggugcccaga

SEQ ID NO: 21582 - RNA, 24 nt, Human
uaauauguuaaaaacauuuugcuu

SEQ ID NO: 21583 - RNA, 24 nt, Human
uacacaguauuuaagauggauauu

SEQ ID NO: 21584 - RNA, 24 nt, Human
uccaccagaugcagauuuguguuu

SEQ ID NO: 21585 - RNA, 23 nt, Human
uacacggauagaacgagauccgg

SEQ ID NO: 21586 - RNA, 24 nt, Human
ucgcuccuaacgcucccuggcccg

SEQ ID NO: 21587 - RNA, 24 nt, Human
aggcauuuagucaagcagaaagca

SEQ ID NO: 21588 - RNA, 24 nt, Human
ccccgggagcugcgcuaggcgaac

SEQ ID NO: 21589 - RNA, 24 nt, Human
aaggacaucacagguaaacugaag

SEQ ID NO: 21590 - RNA, 24 nt, Human
aagagcacuugaucguacuggcuc

SEQ ID NO: 21591 - RNA, 24 nt, Human
gaguuugcuuacacuuacgcugcc

SEQ ID NO: 21592 - RNA, 21 nt, Human
uaucauauggguuuucauuuu

SEQ ID NO: 21593 - RNA, 24 nt, Human
uuccuacuuugcugagagucucca

SEQ ID NO: 21594 - RNA, 24 nt, Human
ggugcaguggaaauccuugccuug

SEQ ID NO: 21595 - RNA, 24 nt, Human
aggaggaagaaauguuuucuuagg

SEQ ID NO: 21596 - RNA, 24 nt, Human
caagcuccucuccccccucuuuuc

SEQ ID NO: 21597 - RNA, 24 nt, Human
agccacuucccucccaacccuggu

SEQ ID NO: 21598 - RNA, 24 nt, Human
uaguucagauugaucuuaggucaa

SEQ ID NO: 21599 - RNA, 17 nt, Human
ucaagggucguguguuu

SEQ ID NO: 21600 - RNA, 22 nt, Human
uuccauggucaaaaaauggcag

SEQ ID NO: 21601 - RNA, 24 nt, Human
uauuguacacggucaucuguugaa

SEQ ID NO: 21602 - RNA, 24 nt, Human
uuaacuuauaagcccccacuucac

SEQ ID NO: 21603 - RNA, 23 nt, Human
uaccaagggccugguugggccac

SEQ ID NO: 21604 - RNA, 24 nt, Human
ucuccaauuccuucaugucgucgu

SEQ ID NO: 21605 - RNA, 17 nt, Human
ugucugggcccagccag

SEQ ID NO: 21606 - RNA, 24 nt, Human
uguauagcaauaugcuuggagagg

SEQ ID NO: 21607 - RNA, 24 nt, Human
ugagucacaaacugcgucuuggag

SEQ ID NO: 21608 - RNA, 24 nt, Human
uuggcccacaucuguuuaaucuuc

SEQ ID NO: 21609 - RNA, 24 nt, Human
uuuguacaaaaauacugucaaaau

SEQ ID NO: 21610 - RNA, 24 nt, Human
acaguaacuaaaggcagaucuucu

SEQ ID NO: 21611 - RNA, 24 nt, Human
uguugguuuuggccuugcaagagc

SEQ ID NO: 21612 - RNA, 22 nt, Human
caccggaggagaggucucuagu

SEQ ID NO: 21613 - RNA, 24 nt, Human
uguugugccagaagcuggcggagc

SEQ ID NO: 21614 - RNA, 24 nt, Human
cuugcagcccacagggcuggagaa

SEQ ID NO: 21615 - RNA, 24 nt, Human
cggaagcggaauuuccucagcuuu

SEQ ID NO: 21616 - RNA, 24 nt, Human
uaccuggugucugauggagaggcg

SEQ ID NO: 21617 - RNA, 24 nt, Human
ucggcagaugucguugccaaucaa

SEQ ID NO: 21618 - RNA, 24 nt, Human
uaugguauugggagaaguagaucg

SEQ ID NO: 21619 - RNA, 24 nt, Human
uaagaacuguuuuuaauuuucagc

SEQ ID NO: 21620 - RNA, 24 nt, Human
ugacaagaagauauuugcauuuau

SEQ ID NO: 21621 - RNA, 24 nt, Human
uucaagcauguuaggaaauccucu

SEQ ID NO: 21622 - RNA, 24 nt, Human
uuuuaggccuucauauaucuucua

SEQ ID NO: 21623 - RNA, 24 nt, Human
uccugcugucuugguuuugucuug

SEQ ID NO: 21624 - RNA, 24 nt, Human
cuccuguaccuggguacagggucu

SEQ ID NO: 21625 - RNA, 24 nt, Human
uugaucuugaagaaacugggcgug

SEQ ID NO: 21626 - RNA, 24 nt, Human
aggaaggagauauagugaagagga

SEQ ID NO: 21627 - RNA, 24 nt, Human
aggcagagguugcagugagccaag

SEQ ID NO: 21628 - RNA, 24 nt, Human
aauggcucacaccuguaaucccag

SEQ ID NO: 21629 - RNA, 24 nt, Human
ugagauguccucuauucuugaaga

SEQ ID NO: 21630 - RNA, 24 nt, Human
gcgcguugcugcggccgugguccg

SEQ ID NO: 21631 - RNA, 24 nt, Human
uuccaguuggugaggagcuguggg

SEQ ID NO: 21632 - RNA, 24 nt, Human
aggaaggagauauagugaagagga

SEQ ID NO: 21633 - RNA, 24 nt, Human
aacauuuuuuuguuguuguuuuga

SEQ ID NO: 21634 - RNA, 24 nt, Human
ucacugcaaccuccaccuccuggg

SEQ ID NO: 21635 - RNA, 22 nt, Human
auuuauuugcccacuugaucuu

SEQ ID NO: 21636 - RNA, 24 nt, Human
cagcauccacuguucugcccagua

SEQ ID NO: 21637 - RNA, 24 nt, Human
ucucuuagauuuuuugcuguaauu

SEQ ID NO: 21638 - RNA, 24 nt, Human
uagccuuaucaugaacuugagguu

SEQ ID NO: 21639 - RNA, 24 nt, Human
cccaugcuugagcuuccaugggga

SEQ ID NO: 21640 - RNA, 24 nt, Human
uggccggaccccaccugguucuuu

SEQ ID NO: 21641 - RNA, 24 nt, Human
ucauauuguagagcggguguggga

SEQ ID NO: 21642 - RNA, 18 nt, Human
ugacaggcggagcagcau

SEQ ID NO: 21643 - RNA, 24 nt, Human
uggcagccagaucuucaucgagca

SEQ ID NO: 21644 - RNA, 23 nt, Human
ccugcagcagcucauggcccagc

SEQ ID NO: 21645 - RNA, 24 nt, Human
cagcacacggagccgauggaggua

SEQ ID NO: 21646 - RNA, 24 nt, Human
cacagacuauauucgcuucacuga

SEQ ID NO: 21647 - RNA, 24 nt, Human
ggaaugauccacgaacugcucuug

SEQ ID NO: 21648 - RNA, 24 nt, Human
cccgacccagggccggugcgcgug

SEQ ID NO: 21649 - RNA, 24 nt, Human
aggaaggagauauagugaagagga

SEQ ID NO: 21650 - RNA, 24 nt, Human
ucaggcucagauagcugcuggccg

SEQ ID NO: 21651 - RNA, 24 nt, Human
ugggauccugcagcucuagucucc

SEQ ID NO: 21652 - RNA, 24 nt, Human
ucaggcuccugcaaccccaggcau

SEQ ID NO: 21653 - RNA, 24 nt, Human
ucucaaugccguguguucucuuug

SEQ ID NO: 21654 - RNA, 20 nt, Human
uaucuggacuggaaaugauu

SEQ ID NO: 21655 - RNA, 23 nt, Human
ugaagugaugguucgaaugucac

SEQ ID NO: 21656 - RNA, 24 nt, Human
aagggacccagcugggucugggcc

SEQ ID NO: 21657 - RNA, 24 nt, Human
gggcaggcgagccccaccccggcc

SEQ ID NO: 21658 - RNA, 24 nt, Human
aggccauucacaacuucguggagg

SEQ ID NO: 21659 - RNA, 24 nt, Human
aggcggagcugcugaaccugagga

SEQ ID NO: 21660 - RNA, 24 nt, Human
ugcaagccuuggcaagccagcacc

SEQ ID NO: 21661 - RNA, 24 nt, Human
ugggaggccauggccuucgccagc

SEQ ID NO: 21662 - RNA, 24 nt, Human
uggggucaugccgaacacccauga

SEQ ID NO: 21663 - RNA, 24 nt, Human
uugggaaggauguagguguagaca

SEQ ID NO: 21664 - RNA, 24 nt, Human
uccgcagaguaaaccucccccucc

SEQ ID NO: 21665 - RNA, 24 nt, Human
uauagggaguaauuagggaccuaa

SEQ ID NO: 21666 - RNA, 24 nt, Human
guggucccuccauguugucacagc

SEQ ID NO: 21667 - RNA, 24 nt, Human
agacgagauguacuuggaccagaa

SEQ ID NO: 21668 - RNA, 24 nt, Human
ugcuguaggucuuagagccugguu

SEQ ID NO: 21669 - RNA, 24 nt, Human
aaguggcuauuuuagagaaaaaga

SEQ ID NO: 21670 - RNA, 23 nt, Human
uggagaauuugcugaacaucuuu

SEQ ID NO: 21671 - RNA, 24 nt, Human
uaugugauguggucaguaaaauuu

SEQ ID NO: 21672 - RNA, 24 nt, Human
aauuaugguauuaacuugcuacag

SEQ ID NO: 21673 - RNA, 24 nt, Human
agugaagauugaaugucuagauau

SEQ ID NO: 21674 - RNA, 19 nt, Human
uauccugugaaaguuuguu

SEQ ID NO: 21675 - RNA, 24 nt, Human
uaguuuguuuucugguuuaaaaaa

SEQ ID NO: 21676 - RNA, 24 nt, Human
ugggauauugauuucuuguuuuuu

SEQ ID NO: 21677 - RNA, 24 nt, Human
ugagagacugcuccccauugcaga

SEQ ID NO: 21678 - RNA, 24 nt, Human
uaugugaugaaaaaguauagcuuu

SEQ ID NO: 21679 - RNA, 24 nt, Human
uauggugcagcuuuuuuuuaauua

SEQ ID NO: 21680 - RNA, 24 nt, Human
uuugccaaacauuugucgugguua

SEQ ID NO: 21681 - RNA, 24 nt, Human
uaggugaagggauuccagguuagu

SEQ ID NO: 21682 - RNA, 24 nt, Human
acagcacagucugcgucuguggug

SEQ ID NO: 21683 - RNA, 24 nt, Human
uacaagguggggcugcgggacguu

SEQ ID NO: 21684 - RNA, 24 nt, Human
gguuuuguguuuuguuugguuuca

SEQ ID NO: 21685 - RNA, 24 nt, Human
ugcugguaaccuggcguccggugg

SEQ ID NO: 21686 - RNA, 24 nt, Human
ugggaggccauggccuucgccagc

SEQ ID NO: 21687 - RNA, 24 nt, Human
uugccgagaacuccacaaaugcuc

SEQ ID NO: 21688 - RNA, 24 nt, Human
ucucaaaacccuccucaucaucua

SEQ ID NO: 21689 - RNA, 24 nt, Human
caucggaacuggcaccacuauugu

SEQ ID NO: 21690 - RNA, 24 nt, Human
ggaugagacguuugcuguccugag

SEQ ID NO: 21691 - RNA, 24 nt, Human
aagcaguucauggacaucuucucg

SEQ ID NO: 21692 - RNA, 24 nt, Human
ugguauuuucuuuuggcaagaugc

SEQ ID NO: 21693 - RNA, 24 nt, Human
uguggaauauguagauucacuuuu

SEQ ID NO: 21694 - RNA, 24 nt, Human
uaccuggauuuuuauuucaauuua

SEQ ID NO: 21695 - RNA, 24 nt, Human
uguauggauauguguaaauguuau

SEQ ID NO: 21696 - RNA, 24 nt, Human
uauuuuuuccauuuuuuuucucuc

SEQ ID NO: 21697 - RNA, 22 nt, Human
ugccuaauugaaucgaaacuuc

SEQ ID NO: 21698 - RNA, 24 nt, Human
ucucauaucacgaacagcaaagcg

SEQ ID NO: 21699 - RNA, 24 nt, Human
gagugcgucauauguuguuccuag

SEQ ID NO: 21700 - RNA, 18 nt, Human
uaacauguuuaaguagau

SEQ ID NO: 21701 - RNA, 24 nt, Human
agccugaggcuggggaugguggcu

SEQ ID NO: 21702 - RNA, 24 nt, Human
ugcauuguuaucauuaaccagucu

SEQ ID NO: 21703 - RNA, 24 nt, Human
uauuagggauaauauucauuuagc

SEQ ID NO: 21704 - RNA, 24 nt, Human
ccaguacagaucguuucucaucuc

SEQ ID NO: 21705 - RNA, 23 nt, Human
ugaacugacaguuguugcugcug

SEQ ID NO: 21706 - RNA, 24 nt, Human
uauaugauuucaggaguucuuggg

SEQ ID NO: 21707 - RNA, 24 nt, Human
uacugcugggggggcaugggccgu

SEQ ID NO: 21708 - RNA, 24 nt, Human
uugcuccaaauggcugcgcucucu

SEQ ID NO: 21709 - RNA, 24 nt, Human
gcgccccccgccuuccucucacuc

SEQ ID NO: 21710 - RNA, 24 nt, Human
cagcagccaggagauguccucuga

SEQ ID NO: 21711 - RNA, 24 nt, Human
cggggcugcaggcggcgcagagca

SEQ ID NO: 21712 - RNA, 24 nt, Human
uucaaauuucuuucuuuuuuaauu

SEQ ID NO: 21713 - RNA, 24 nt, Human
uaccggcuggccacuucuuccaag

SEQ ID NO: 21714 - RNA, 24 nt, Human
ugucauuggucgaagaguugaagu

SEQ ID NO: 21715 - RNA, 22 nt, Human
uguguuagaagauggaccagag

SEQ ID NO: 21716 - RNA, 24 nt, Human
aggcagaaguugcagugagccaag

SEQ ID NO: 21717 - RNA, 24 nt, Human
uauuugacugcuaaauucuccaca

SEQ ID NO: 21718 - RNA, 24 nt, Human
agacauagaugugaaaauuuuagg

SEQ ID NO: 21719 - RNA, 21 nt, Human
ugaaaucauacagcugugcaa

SEQ ID NO: 21720 - RNA, 24 nt, Human
aggaggaagaaauguuuucuuagg

SEQ ID NO: 21721 - RNA, 24 nt, Human
caagcuccucuccccccucuuuuc

SEQ ID NO: 21722 - RNA, 24 nt, Human
agccacuucccucccaacccuggu

SEQ ID NO: 21723 - RNA, 24 nt, Human
ugcccguacccccucuccucucug

SEQ ID NO: 21724 - RNA, 24 nt, Human
uccagggggagggaggaaaggaag

SEQ ID NO: 21725 - RNA, 22 nt, Human
ugcugagugaugcugugagggu

SEQ ID NO: 21726 - RNA, 24 nt, Human
uaccacaccaaugccuucaugguc

SEQ ID NO: 21727 - RNA, 24 nt, Human
uugaucuugaagaaacugggcgug

SEQ ID NO: 21728 - RNA, 24 nt, Human
gcgcguugcugcggccgugguccg

SEQ ID NO: 21729 - RNA, 24 nt, Human
aggaaggagauauagugaagagga

SEQ ID NO: 21730 - RNA, 24 nt, Human
guagaguuuucuucaggcuuaaag

SEQ ID NO: 21731 - RNA, 23 nt, Human
ugaaaugccuuugugacauuuuu

SEQ ID NO: 21732 - RNA, 24 nt, Human
ugagguggguggaucaccugaggu

SEQ ID NO: 21733 - RNA, 24 nt, Human
uaaguuaaaaaagacacauggucc

SEQ ID NO: 21734 - RNA, 24 nt, Human
aagaagccaagcccacagagacua

SEQ ID NO: 21735 - RNA, 24 nt, Human
uauguuguuuaguguuauauucca

SEQ ID NO: 21736 - RNA, 24 nt, Human
uuaaauguuauucgguuaaacagg

SEQ ID NO: 21737 - RNA, 24 nt, Human
ugcaaauauauaaauuugaguaug

SEQ ID NO: 21738 - RNA, 24 nt, Human
ugaguuacuacuaugguauuguua

SEQ ID NO: 21739 - RNA, 22 nt, Human
ucugcugugcuggcuucccaug

SEQ ID NO: 21740 - RNA, 24 nt, Human
ugcauuguuaucauuaaccagucu

SEQ ID NO: 21741 - RNA, 24 nt, Human
uaaugggucucaaaauucugugac

SEQ ID NO: 21742 - RNA, 24 nt, Human
uauuagggauaauauucauuuagc

SEQ ID NO: 21743 - RNA, 24 nt, Human
cuuugauucagcaagccacaacag

SEQ ID NO: 21744 - RNA, 24 nt, Human
agaguugaugacccgggagagguu

SEQ ID NO: 21745 - RNA, 24 nt, Human
aaguccgccucuuguucucacacu

SEQ ID NO: 21746 - RNA, 24 nt, Human
uggccugaugauccacagcggaga

SEQ ID NO: 21747 - RNA, 24 nt, Human
ugugugccauugcccaggcagagu

SEQ ID NO: 21748 - RNA, 24 nt, Human
ugugugcacgugcuuuauucacaa

SEQ ID NO: 21749 - RNA, 24 nt, Human
aggcaaaaccauuuauauuuugaa

SEQ ID NO: 21750 - RNA, 24 nt, Human
uuagauguucggggcugcacgcgc

SEQ ID NO: 21751 - RNA, 22 nt, Human
uaaaccguugaaacccauucgu

SEQ ID NO: 21752 - RNA, 24 nt, Human
ucuccagaaaugcuuggguucauc

SEQ ID NO: 21753 - RNA, 24 nt, Human
cgugcaaagaagaagcuggccuga

SEQ ID NO: 21754 - RNA, 24 nt, Human
uugaucuugaagaaacugggcgug

SEQ ID NO: 21755 - RNA, 24 nt, Human
guagaguuuucuucaggcuuaaag

SEQ ID NO: 21756 - RNA, 24 nt, Human
uuaaugccaggaacagauuuugca

SEQ ID NO: 21757 - RNA, 24 nt, Human
uuacaccccacccgacguggccau

SEQ ID NO: 21758 - RNA, 19 nt, Human
uccaugggggauuggauuc

SEQ ID NO: 21759 - RNA, 24 nt, Human
uggacugaucuugugcccaauuaa

SEQ ID NO: 21760 - RNA, 24 nt, Human
auuccaguaagcucuuuauugaac

SEQ ID NO: 21761 - RNA, 22 nt, Human
uggcgccauucuucagggcagc

SEQ ID NO: 21762 - RNA, 24 nt, Human
accaucuuguauucaagugcugac

SEQ ID NO: 21763 - RNA, 24 nt, Human
gcacguggggccagguguccuguc

SEQ ID NO: 21764 - RNA, 24 nt, Human
acccucacauccgcgugggccccu

SEQ ID NO: 21765 - RNA, 24 nt, Human
uccccgugggucaagcauuugucu

SEQ ID NO: 21766 - RNA, 24 nt, Human
ugcccgggucugugccagcucuga

SEQ ID NO: 21767 - RNA, 24 nt, Human
cucccaugcuggacuccgacggcu

SEQ ID NO: 21768 - RNA, 24 nt, Human
ugaccaagaaccaggucagccuga

SEQ ID NO: 21769 - RNA, 24 nt, Human
aggaagguuuagcagugcuucaau

SEQ ID NO: 21770 - RNA, 24 nt, Human
ugaccaaagaguggccugucuguu

SEQ ID NO: 21771 - RNA, 24 nt, Human
uagguggguggauauauucaugua

SEQ ID NO: 21772 - RNA, 24 nt, Human
agguuuggggaauuuagaauuauc

SEQ ID NO: 21773 - RNA, 24 nt, Human
uaacagaagggguuuuguaagcug

SEQ ID NO: 21774 - RNA, 24 nt, Human
auuucauucacuggggaggaacaa

SEQ ID NO: 21775 - RNA, 22 nt, Human
uaaggcgaggcggaauuaaacc

SEQ ID NO: 21776 - RNA, 24 nt, Human
ugcaagaaaaaagaaauacaaauu

SEQ ID NO: 21777 - RNA, 24 nt, Human
aggcacaucauggcuugguaucuc

SEQ ID NO: 21778 - RNA, 24 nt, Human
uguuauggaguuuucaacaugggg

SEQ ID NO: 21779 - RNA, 24 nt, Human
auggcccacgugacacuuguucau

SEQ ID NO: 21780 - RNA, 24 nt, Human
uugaucuugaagaaacugggcgug

SEQ ID NO: 21781 - RNA, 24 nt, Human
aggaaggagauauagugaagagga

SEQ ID NO: 21782 - RNA, 24 nt, Human
guagaguuuucuucaggcuuaaag

SEQ ID NO: 21783 - RNA, 24 nt, Human
uguucaguugcugcucacaauagu

SEQ ID NO: 21784 - RNA, 24 nt, Human
aagcguuggcaugaaaaagugaaa

SEQ ID NO: 21785 - RNA, 24 nt, Human
ugccugauaacagggugcaguguu

SEQ ID NO: 21786 - RNA, 20 nt, Human
ucacagauuuguauucucca

SEQ ID NO: 21787 - RNA, 24 nt, Human
aagaagaucuagaacgacuucucu

SEQ ID NO: 21788 - RNA, 24 nt, Human
ugaccgugaucuuguucgucuuuu

SEQ ID NO: 21789 - RNA, 24 nt, Human
ucuguggauugugaaguuuaucua

SEQ ID NO: 21790 - RNA, 24 nt, Human
uauuuuguauuuuuaguagagaca

SEQ ID NO: 21791 - RNA, 24 nt, Human
aagcacaacaacguaaagaaucuu

SEQ ID NO: 21792 - RNA, 24 nt, Human
uuguucagacggugucucuccugu

SEQ ID NO: 21793 - RNA, 22 nt, Human
uaggucuuugucagacauucug

SEQ ID NO: 21794 - RNA, 24 nt, Human
uaugaugauuuuuuucucaauuuu

SEQ ID NO: 21795 - RNA, 24 nt, Human
ccugcagacuugcucugcuccauc

SEQ ID NO: 21796 - RNA, 22 nt, Human
gacacaauucuguauaaucugu

SEQ ID NO: 21797 - RNA, 24 nt, Human
uuuaugguuuaaaaucaauuggug

SEQ ID NO: 21798 - RNA, 21 nt, Human
uacgauguuuccucuauggug

SEQ ID NO: 21799 - RNA, 24 nt, Human
aggcagcaguugcggccgcuuuua

SEQ ID NO: 21800 - RNA, 24 nt, Human
augcugccgggcacuuggcgggcc

SEQ ID NO: 21801 - RNA, 24 nt, Human
gggaagaagauuccggaaugcaga

SEQ ID NO: 21802 - RNA, 24 nt, Human
ucuacauuagcagugcugugcaag

SEQ ID NO: 21803 - RNA, 24 nt, Human
ggccgugguccgcgcccuuccucg

SEQ ID NO: 21804 - RNA, 24 nt, Human
aggaaggagauauagugaagagga

SEQ ID NO: 21805 - RNA, 24 nt, Human
uaccagaaagccauguucauauuu

SEQ ID NO: 21806 - RNA, 24 nt, Human
ugaaauggauaagaugcaugcagg

SEQ ID NO: 21807 - RNA, 24 nt, Human
acuggauucggaaugugcugauuu

SEQ ID NO: 21808 - RNA, 24 nt, Human
uuuaaaaguuucuguaccaauauc

SEQ ID NO: 21809 - RNA, 24 nt, Human
cggcccgggacugguggaucuccc

SEQ ID NO: 21810 - RNA, 24 nt, Human
gcagcugggugcucgccagggccc

SEQ ID NO: 21811 - RNA, 24 nt, Human
agugaaggacggaagcuggagaag

SEQ ID NO: 21812 - RNA, 24 nt, Human
gucaucuuuaaggacaauuuuucu

SEQ ID NO: 21813 - RNA, 24 nt, Human
caccagggaggacagcugcuggca

SEQ ID NO: 21814 - RNA, 24 nt, Human
augcacuguaccuuguacagucau

SEQ ID NO: 21815 - RNA, 24 nt, Human
ugaguacaagauaagcauuuuaug

SEQ ID NO: 21816 - RNA, 24 nt, Human
aaagugcaguaugaugggacacuu

SEQ ID NO: 21817 - RNA, 24 nt, Human
aguuuggauucugaaaacuaacug

SEQ ID NO: 21818 - RNA, 24 nt, Human
uuagagcuggcagcagcaucucag

SEQ ID NO: 21819 - RNA, 24 nt, Human
gggaauugagcuugcgccccaggu

SEQ ID NO: 21820 - RNA, 24 nt, Human
ugccucaacuuguuacagcagagu

SEQ ID NO: 21821 - RNA, 24 nt, Human
uggcagagaugcauuccagagaug

SEQ ID NO: 21822 - RNA, 24 nt, Human
uaccagacauccaaugacagccuc

SEQ ID NO: 21823 - RNA, 24 nt, Human
ugugcagaagaaauggaaggauuc

SEQ ID NO: 21824 - RNA, 24 nt, Human
ucaaaagccugauccugccaaaac

SEQ ID NO: 21825 - RNA, 24 nt, Human
ugacuuccauauggacuuugacuc

SEQ ID NO: 21826 - RNA, 24 nt, Human
uauggcaagucacuuugacagaca

SEQ ID NO: 21827 - RNA, 24 nt, Human
uacaccacucccaagaagaauaag

SEQ ID NO: 21828 - RNA, 24 nt, Human
uauggcaagucacuuugacagaca

SEQ ID NO: 21829 - RNA, 24 nt, Human
uacaccacucccaagaagaauaag

SEQ ID NO: 21830 - RNA, 24 nt, Human
uaauguucaacuuuucacaaaaga

SEQ ID NO: 21831 - RNA, 24 nt, Human
ucauacgguggaacggccauaugu

SEQ ID NO: 21832 - RNA, 24 nt, Human
uaauucacgguguaaagcaagcuu

SEQ ID NO: 21833 - RNA, 24 nt, Human
ugggaggcagagacggacguaucg

SEQ ID NO: 21834 - RNA, 24 nt, Human
ugauauggauaagggagaccagcu

SEQ ID NO: 21835 - RNA, 24 nt, Human
uacagcauuaucuauagauuugua

SEQ ID NO: 21836 - RNA, 24 nt, Human
ugggaggcugaggcuggaggauca

SEQ ID NO: 21837 - RNA, 24 nt, Human
uccauuaauuauuugggguugcaa

SEQ ID NO: 21838 - RNA, 24 nt, Human
uacccagugguacaguucauauag

SEQ ID NO: 21839 - RNA, 24 nt, Human
aagcagaaagggaagagaagcgag

SEQ ID NO: 21840 - RNA, 24 nt, Human
uucccaugccaccaggcuccugca

SEQ ID NO: 21841 - RNA, 24 nt, Human
uugcagccgcugcagcugcugcca

SEQ ID NO: 21842 - RNA, 24 nt, Human
ugcccugguggcagcccccagcac

SEQ ID NO: 21843 - RNA, 24 nt, Human
ugagaaagaugaguuaauccuuuu

SEQ ID NO: 21844 - RNA, 24 nt, Human
ucggaugguggccuggaagagaca

SEQ ID NO: 21845 - RNA, 24 nt, Human
agagcaguucuaccacuacaagga

SEQ ID NO: 21846 - RNA, 24 nt, Human
uucuucacgggcagcaagcuggug

SEQ ID NO: 21847 - RNA, 24 nt, Human
cagcgcgcaccccggcggggcuuu

SEQ ID NO: 21848 - RNA, 24 nt, Human
uucuuggugagaagggccggcgga

SEQ ID NO: 21849 - RNA, 24 nt, Human
caaugcaguccuggauggagccga

SEQ ID NO: 21850 - RNA, 24 nt, Human
uaugguguuugcgucauucauccg

SEQ ID NO: 21851 - RNA, 24 nt, Human
uaagaagccacuauaucaauggug

SEQ ID NO: 21852 - RNA, 20 nt, Human
uaagacgggggucucugagc

SEQ ID NO: 21853 - RNA, 24 nt, Human
cuagaccauauuuucaagucaucu

SEQ ID NO: 21854 - RNA, 24 nt, Human
uauaacauguaugcuuuucagaau

SEQ ID NO: 21855 - RNA, 24 nt, Human
uugaucuugaagaaacugggcgug

SEQ ID NO: 21856 - RNA, 24 nt, Human
aggaaggagauauagugaagagga

SEQ ID NO: 21857 - RNA, 24 nt, Human
guagaguuuucuucaggcuuaaag

SEQ ID NO: 21858 - RNA, 24 nt, Human
aaaugccuggcugagauucagggg

SEQ ID NO: 21859 - RNA, 24 nt, Human
caggucccucccucauuccaagga

SEQ ID NO: 21860 - RNA, 24 nt, Human
agggcgcgcuuaccccggggucua

SEQ ID NO: 21861 - RNA, 24 nt, Human
agaggcaggcgccagggggaaccc

SEQ ID NO: 21862 - RNA, 20 nt, Human
cugcgcccccuccugccagg

SEQ ID NO: 21863 - RNA, 24 nt, Human
uauggcaagucacuuugacagaca

SEQ ID NO: 21864 - RNA, 24 nt, Human
ugagaauggcaaaauuagucgccu

SEQ ID NO: 21865 - RNA, 24 nt, Human
uacaccacucccaagaagaauaag

SEQ ID NO: 21866 - RNA, 24 nt, Human
uauggaguuaaggaaggucacgug

SEQ ID NO: 21867 - RNA, 24 nt, Human
ucuggcaugaauucugccagucug

SEQ ID NO: 21868 - RNA, 24 nt, Human
uacauuguccugacacuggaaaag

SEQ ID NO: 21869 - RNA, 24 nt, Human
uugaucuugaagaaacugggcgug

SEQ ID NO: 21870 - RNA, 24 nt, Human
guagaguuuucuucaggcuuaaag

SEQ ID NO: 21871 - RNA, 24 nt, Human
ucagauaucugguuguuaugugau

SEQ ID NO: 21872 - RNA, 24 nt, Human
auccaguugaugggcugccagauc

SEQ ID NO: 21873 - RNA, 24 nt, Human
ugaguaacaaaaaaaugaaauaag

SEQ ID NO: 21874 - RNA, 24 nt, Human
acuuuaguggacuucugugagauu

SEQ ID NO: 21875 - RNA, 24 nt, Human
uguaaacccugcugaaucuguaac

SEQ ID NO: 21876 - RNA, 24 nt, Human
acuggcugccugcggguggcuccu

SEQ ID NO: 21877 - RNA, 20 nt, Human
cuuggcccaguaccuaugca

SEQ ID NO: 21878 - RNA, 24 nt, Human
uguggauauaguuuucccuguugg

SEQ ID NO: 21879 - RNA, 24 nt, Human
uuggaacuaugaaaagcucuucuc

SEQ ID NO: 21880 - RNA, 24 nt, Human
cucacaguaaccuccaccucccgg

SEQ ID NO: 21881 - RNA, 24 nt, Human
uaguuugauuguagaaaucacauc

SEQ ID NO: 21882 - RNA, 24 nt, Human
agauuagguuagaauaacacugcu

SEQ ID NO: 21883 - RNA, 24 nt, Human
uuuuacagccacuccagauuugua

SEQ ID NO: 21884 - RNA, 24 nt, Human
uuuacauuuacaaauuauaucaua

SEQ ID NO: 21885 - RNA, 24 nt, Human
uugaagcuugaaaauuuuauuuaa

SEQ ID NO: 21886 - RNA, 20 nt, Human
uggccggaagcugggcgggu

SEQ ID NO: 21887 - RNA, 24 nt, Human
uccguaucugcccuguggaauuca

SEQ ID NO: 21888 - RNA, 24 nt, Human
cuugccuaaacuccuccgcccugc

SEQ ID NO: 21889 - RNA, 24 nt, Human
aguugcugaggaacaaugcaccac

SEQ ID NO: 21890 - RNA, 24 nt, Human
uggcugggguuaccguggccugga

SEQ ID NO: 21891 - RNA, 21 nt, Human
uugguagagaccucaucuuug

SEQ ID NO: 21892 - RNA, 24 nt, Human
aacgguuuucuugcuucgagcuca

SEQ ID NO: 21893 - RNA, 24 nt, Human
gaucaucugaggucaggaguucga

SEQ ID NO: 21894 - RNA, 24 nt, Human
aggcgaagguugcagugagccgag

SEQ ID NO: 21895 - RNA, 24 nt, Human
uggcguaauagcgaagaggccccg

SEQ ID NO: 21896 - RNA, 24 nt, Human
ccccggggggggggggggggucua

SEQ ID NO: 21897 - RNA, 24 nt, Human
uugaucuugaagaaacugggcgug

SEQ ID NO: 21898 - RNA, 24 nt, Human
guagaguuuucuucaggcuuaaag

SEQ ID NO: 21899 - RNA, 24 nt, Human
acugccucagccucccgaguagcu

SEQ ID NO: 21900 - RNA, 24 nt, Human
ucccagagauuuugguacguugug

SEQ ID NO: 21901 - RNA, 24 nt, Human
uauugcucaucuguguuugaaaca

SEQ ID NO: 21902 - RNA, 24 nt, Human
uaccgcuaagaagcuaugucaauu

SEQ ID NO: 21903 - RNA, 24 nt, Human
uguucaguugcugcucacaauagu

SEQ ID NO: 21904 - RNA, 24 nt, Human
ugccugauaacagggugcaguguu

SEQ ID NO: 21905 - RNA, 24 nt, Human
ccucagggcuccucauccaggagu

SEQ ID NO: 21906 - RNA, 24 nt, Human
ucggaacgccauucuauccccaaa

SEQ ID NO: 21907 - RNA, 24 nt, Human
gggccgugacaugggggcccgggg

SEQ ID NO: 21908 - RNA, 24 nt, Human
uaaaauauucucuucuccuaucuu

SEQ ID NO: 21909 - RNA, 24 nt, Human
uaauggguuuggccaaauaucauc

SEQ ID NO: 21910 - RNA, 24 nt, Human
uccagguuuauguuuaaaugacag

SEQ ID NO: 21911 - RNA, 24 nt, Human
ucaagacauuaacaugaguagaag

SEQ ID NO: 21912 - RNA, 24 nt, Human
aagcaugccauuucuguuuucuug

SEQ ID NO: 21913 - RNA, 24 nt, Human
ccccgggaagucagaaaucgauca

SEQ ID NO: 21914 - RNA, 24 nt, Human
acccugugguaccgcgccccagag

SEQ ID NO: 21915 - RNA, 24 nt, Human
ugguguguaucggcccagggugac

SEQ ID NO: 21916 - RNA, 24 nt, Human
ggagcaacggcaacaacggcggua

SEQ ID NO: 21917 - RNA, 24 nt, Human
uuggaacgcacagaggaacgagcu

SEQ ID NO: 21918 - RNA, 24 nt, Human
gggaaugugagcacaaugcauaau

SEQ ID NO: 21919 - RNA, 24 nt, Human
uguuaugugucgugcugcgguuca

SEQ ID NO: 21920 - RNA, 24 nt, Human
uaauuuguccaagaaaaaaaaccg

SEQ ID NO: 21921 - RNA, 24 nt, Human
cauccuguuaacuacuacguugac

SEQ ID NO: 21922 - RNA, 24 nt, Human
augcugcccugugacccaacuggu

SEQ ID NO: 21923 - RNA, 23 nt, Human
uccaugggcaacuucuuggccca

SEQ ID NO: 21924 - RNA, 24 nt, Human
auuucauucacuggggaggaacaa

SEQ ID NO: 21925 - RNA, 20 nt, Human
uaaggcgaggcggaauuaaa

SEQ ID NO: 21926 - RNA, 24 nt, Human
uugaucuugaagaaacugggcgug

SEQ ID NO: 21927 - RNA, 20 nt, Human
uccgugcgcguugcugcggc

SEQ ID NO: 21928 - RNA, 24 nt, Human
aggaaggagauauagugaagagga

SEQ ID NO: 21929 - RNA, 24 nt, Human
guagaguuuucuucaggcuuaaag

SEQ ID NO: 21930 - RNA, 24 nt, Human
ugcauuguuaucauuaaccagucu

SEQ ID NO: 21931 - RNA, 24 nt, Human
uaaugggucucaaaauucugugac

SEQ ID NO: 21932 - RNA, 24 nt, Human
uauuagggauaauauucauuuagc

SEQ ID NO: 21933 - RNA, 24 nt, Human
ucucgcgcucggccgccgcccgcu

SEQ ID NO: 21934 - RNA, 24 nt, Human
uagggcacauggauuauaaguauc

SEQ ID NO: 21935 - RNA, 24 nt, Human
auuucauucacuggggaggaacaa

SEQ ID NO: 21936 - RNA, 23 nt, Human
uaaggcgaggcggaauuaaaccc

SEQ ID NO: 21937 - RNA, 24 nt, Human
uagcagaaaaguauuccaauccuc

SEQ ID NO: 21938 - RNA, 24 nt, Human
guuucauucucugauacacacaag

SEQ ID NO: 21939 - RNA, 24 nt, Human
ugaauuaaaauuuguggcuccugg

SEQ ID NO: 21940 - RNA, 24 nt, Human
ugucacaggccgugaggugccugg

SEQ ID NO: 21941 - RNA, 18 nt, Human
cacuugauuuugaaccuu

SEQ ID NO: 21942 - RNA, 24 nt, Human
uguagagaaaagaauuuuuuuucc

SEQ ID NO: 21943 - RNA, 24 nt, Human
ccuagcccugaagccccaggaacc

SEQ ID NO: 21944 - RNA, 24 nt, Human
uuuuuuuuuuaaagcaaguaacuu

SEQ ID NO: 21945 - RNA, 24 nt, Human
auguggcuaaauggggaugaggag

SEQ ID NO: 21946 - RNA, 24 nt, Human
uugcuucggggaaacagccaggaa

SEQ ID NO: 21947 - RNA, 23 nt, Human
uuagacuauagacauaacuacaa

SEQ ID NO: 21948 - RNA, 24 nt, Human
gggaaggaaaggggccugagcugg

SEQ ID NO: 21949 - RNA, 24 nt, Human
ccggagcacauuccugagcgcuga

SEQ ID NO: 21950 - RNA, 24 nt, Human
uauggcaagucacuuugacagaca

SEQ ID NO: 21951 - RNA, 24 nt, Human
uacaccacucccaagaagaauaag

SEQ ID NO: 21952 - RNA, 24 nt, Human
uccuuggacaacaccaaaaacaca

SEQ ID NO: 21953 - RNA, 24 nt, Human
ucacugcaaccuccgccucccggg

SEQ ID NO: 21954 - RNA, 24 nt, Human
cacucugucgcccaggcuagagcg

SEQ ID NO: 21955 - RNA, 22 nt, Human
caucaccggcugagggacuccu

SEQ ID NO: 21956 - RNA, 24 nt, Human
aagaaggcauuuucacacaaggcu

SEQ ID NO: 21957 - RNA, 24 nt, Human
caugaggccgcgccuguguccagc

SEQ ID NO: 21958 - RNA, 24 nt, Human
uagaugaucuuacuuucuugaaag

SEQ ID NO: 21959 - RNA, 24 nt, Human
ccucacagacggccaggagccagg

SEQ ID NO: 21960 - RNA, 24 nt, Human
aagcugccucugcccacuggauuc

SEQ ID NO: 21961 - RNA, 24 nt, Human
acgcagggcgcagaggcggggacg

SEQ ID NO: 21962 - RNA, 24 nt, Human
ucuaaugccacucagcucaggagc

SEQ ID NO: 21963 - RNA, 24 nt, Human
ugggaaaagucuuucacccuggua

SEQ ID NO: 21964 - RNA, 24 nt, Human
ucgaccacagaugcucugaacguu

SEQ ID NO: 21965 - RNA, 24 nt, Human
uguuauggggauaagcuggugagg

SEQ ID NO: 21966 - RNA, 24 nt, Human
aagcagcugcccagcccgcccuuc

SEQ ID NO: 21967 - RNA, 24 nt, Human
cagccuggacuuaccaccacuaaa

SEQ ID NO: 21968 - RNA, 24 nt, Human
caaaaguaauaauggcugaacuua

SEQ ID NO: 21969 - RNA, 24 nt, Human
uagagugcuuuuguagugagcuaa

SEQ ID NO: 21970 - RNA, 24 nt, Human
ugaaauaacaaguuuagugcuuua

SEQ ID NO: 21971 - RNA, 24 nt, Human
uuggcccaagaagggcuggggugc

SEQ ID NO: 21972 - RNA, 24 nt, Human
cguuguuuucaaacuucgagcggc

SEQ ID NO: 21973 - RNA, 24 nt, Human
uagcauguggguuguacagaguau

SEQ ID NO: 21974 - RNA, 24 nt, Human
ugagauccuugguaccccuaaaaa

SEQ ID NO: 21975 - RNA, 24 nt, Human
uauuucaugcgcacagagggaagc

SEQ ID NO: 21976 - RNA, 24 nt, Human
agacaggcuggcacagccccaggc

SEQ ID NO: 21977 - RNA, 24 nt, Human
uggcuuaggcagaauucuccucug

SEQ ID NO: 21978 - RNA, 24 nt, Human
acgcggauucucuugcccacaauu

SEQ ID NO: 21979 - RNA, 24 nt, Human
cuuggauuuucuggaaagauuuca

SEQ ID NO: 21980 - RNA, 22 nt, Human
cgccgggacagcagacugccgg

SEQ ID NO: 21981 - RNA, 24 nt, Human
cagccuggacuuaccaccacuaaa

SEQ ID NO: 21982 - RNA, 24 nt, Human
ggcccggagcggagcgcgcccugc

SEQ ID NO: 21983 - RNA, 24 nt, Human
ucagugauaucccuauacacugcc

SEQ ID NO: 21984 - RNA, 24 nt, Human
acuggaaugcaggcaguggaagcc

SEQ ID NO: 21985 - RNA, 24 nt, Human
ggggauggggagggcggggggcag

SEQ ID NO: 21986 - RNA, 22 nt, Human
ucacggaggccaccaugcccca

SEQ ID NO: 21987 - RNA, 20 nt, Human
caucaggguacauagcgggg

SEQ ID NO: 21988 - RNA, 24 nt, Human
acccuagagaauacuagggcuucu

SEQ ID NO: 21989 - RNA, 24 nt, Human
ucaaaauuacauaguucauuucua

SEQ ID NO: 21990 - RNA, 17 nt, Human
uuaaaggcagauuucau

SEQ ID NO: 21991 - RNA, 24 nt, Human
uacauuuaugaggcaagucagcug

SEQ ID NO: 21992 - RNA, 24 nt, Human
auggauuuauuauuugaaacuaac

SEQ ID NO: 21993 - RNA, 24 nt, Human
ugucauugcaauaggauguuacaa

SEQ ID NO: 21994 - RNA, 24 nt, Human
ugcguuaacacgacuuauuuucuu

SEQ ID NO: 21995 - RNA, 24 nt, Human
ucaaagugccagggcuggagaagu

SEQ ID NO: 21996 - RNA, 24 nt, Human
ucucuggguggccaugcuugguuu

SEQ ID NO: 21997 - RNA, 24 nt, Human
uaaauucagccaguauuuauuuaa

SEQ ID NO: 21998 - RNA, 24 nt, Human
acuaaguaauaucaggaaagaaga

SEQ ID NO: 21999 - RNA, 24 nt, Human
uacaccacucccaagaagaauaag

SEQ ID NO: 22000 - RNA, 24 nt, Human
ggaguccagcuucguacuacaaau

SEQ ID NO: 22001 - RNA, 24 nt, Human
ugauaugcuuuuacuucaacuuag

SEQ ID NO: 22002 - RNA, 24 nt, Human
caugucagccaggcgaacuccuga

SEQ ID NO: 22003 - RNA, 24 nt, Human
ucucgcucuguugcccaggcugga

SEQ ID NO: 22004 - RNA, 24 nt, Human
aggaaggagauauagugaagagga

SEQ ID NO: 22005 - RNA, 24 nt, Human
guagaguuuucuucaggcuuaaag

SEQ ID NO: 22006 - RNA, 24 nt, Human
ugaagucaccaugggguugguagg

SEQ ID NO: 22007 - RNA, 24 nt, Human
aggaaggagauauagugaagagga

SEQ ID NO: 22008 - RNA, 24 nt, Human
guagaguuuucuucaggcuuaaag

SEQ ID NO: 22009 - RNA, 24 nt, Human
gcuaaagcccggagcaggcucugc

SEQ ID NO: 22010 - RNA, 24 nt, Human
ccaaaacggaaaggcccuccccuu

SEQ ID NO: 22011 - RNA, 24 nt, Human
agggauggacccacuuucuccacc

SEQ ID NO: 22012 - RNA, 24 nt, Human
uccauacuacugacuuucccggua

SEQ ID NO: 22013 - RNA, 24 nt, Human
uuccuuguaguucguggucugaga

SEQ ID NO: 22014 - RNA, 24 nt, Human
caguaugguagugggcuacccccu

SEQ ID NO: 22015 - RNA, 24 nt, Human
uccaaguuccuacggugcccagca

SEQ ID NO: 22016 - RNA, 24 nt, Human
guggagggcccuauggacacccca

SEQ ID NO: 22017 - RNA, 24 nt, Human
ugagugggucguagcggaaucggg

SEQ ID NO: 22018 - RNA, 24 nt, Human
ucagaaggggguccggugggucuc

SEQ ID NO: 22019 - RNA, 24 nt, Human
ugacaaaauauuguugguguaaga

SEQ ID NO: 22020 - RNA, 24 nt, Human
ucaccuagagagcauguacuggca

SEQ ID NO: 22021 - RNA, 24 nt, Human
ugaggacuucugagcagagaggug

SEQ ID NO: 22022 - RNA, 22 nt, Human
ugauauggacuuggggaccagc

SEQ ID NO: 22023 - RNA, 24 nt, Human
ugagaauggcaaaauuagucgccu

SEQ ID NO: 22024 - RNA, 24 nt, Human
uuuggauuuuuaaccuccuucccc

SEQ ID NO: 22025 - RNA, 24 nt, Human
uacaccacucccaagaagaauaag

SEQ ID NO: 22026 - RNA, 24 nt, Human
ucaggcccgcgcugagggccgugc

SEQ ID NO: 22027 - RNA, 24 nt, Human
uaccucuagugcaauuuauaagca

SEQ ID NO: 22028 - RNA, 24 nt, Human
uaacauacacauagugaagaaugc

SEQ ID NO: 22029 - RNA, 24 nt, Human
ugcagaaaaacauaucugguaaaa

SEQ ID NO: 22030 - RNA, 24 nt, Human
ccagagugcugggauuacaggcau

SEQ ID NO: 22031 - RNA, 24 nt, Human
uaugucacccaggcuggagugcaa

SEQ ID NO: 22032 - RNA, 24 nt, Human
aacaccuaaauguuuuuauuuuug

SEQ ID NO: 22033 - RNA, 24 nt, Human
uacuuggucaacucaggcaaagcg

SEQ ID NO: 22034 - RNA, 24 nt, Human
caccgagcugaccgggcagggggc

SEQ ID NO: 22035 - RNA, 24 nt, Human
auaccauuccacguuaucaacaag

SEQ ID NO: 22036 - RNA, 24 nt, Human
uugaagaacaagauguucucauau

SEQ ID NO: 22037 - RNA, 24 nt, Human
aagcagcgggagggaacgcgguaa

SEQ ID NO: 22038 - RNA, 24 nt, Human
ugacggugugccaagguccuguuu

SEQ ID NO: 22039 - RNA, 24 nt, Human
gaaaggcuucuugaaagagaauuu

SEQ ID NO: 22040 - RNA, 24 nt, Human
cugaggcugcacuagccucugccc

SEQ ID NO: 22041 - RNA, 24 nt, Human
uuuugcagcuuagagaucacccac

SEQ ID NO: 22042 - RNA, 24 nt, Human
uggcgugcucugggugggugugcg

SEQ ID NO: 22043 - RNA, 23 nt, Human
agauccuaguauagaggaggagg

SEQ ID NO: 22044 - RNA, 24 nt, Human
ucucaugcugaacaguucuccauc

SEQ ID NO: 22045 - RNA, 24 nt, Human
ucuacaauaaccucaacccccuua

SEQ ID NO: 22046 - RNA, 24 nt, Human
aggcagaguggagagaaacaacuc

SEQ ID NO: 22047 - RNA, 24 nt, Human
cgucuauaucaccuugaagaagua

SEQ ID NO: 22048 - RNA, 17 nt, Human
uaacauggauggguuga

SEQ ID NO: 22049 - RNA, 24 nt, Human
caccaaaggcuucaacccacagcc

SEQ ID NO: 22050 - RNA, 24 nt, Human
agccgcaaguuccugcugcuuggu

SEQ ID NO: 22051 - RNA, 24 nt, Human
accccgucggccggcgcauucccc

SEQ ID NO: 22052 - RNA, 19 nt, Human
cagcuccugggcugugcuc

SEQ ID NO: 22053 - RNA, 24 nt, Human
uugaagacucucccucguauguaa

SEQ ID NO: 22054 - RNA, 24 nt, Human
gcagcaacaaaggcggccccgaag

SEQ ID NO: 22055 - RNA, 24 nt, Human
caccugaaaaccuuauuaaaaaac

SEQ ID NO: 22056 - RNA, 24 nt, Human
uuaaagcagacagaacuuuuugca

SEQ ID NO: 22057 - RNA, 24 nt, Human
uggccgugaucgccuccauuguga

SEQ ID NO: 22058 - RNA, 24 nt, Human
ugaguggucuucaggguccccagu

SEQ ID NO: 22059 - RNA, 24 nt, Human
gaccagcacccacacucaggcucu

SEQ ID NO: 22060 - RNA, 20 nt, Human
uguccagaauuuccagaagu

SEQ ID NO: 22061 - RNA, 24 nt, Human
uggaugcagugucucgggacuucg

SEQ ID NO: 22062 - RNA, 24 nt, Human
uguggcccuucucuuuaaguccga

SEQ ID NO: 22063 - RNA, 24 nt, Human
uacguugaggcuuuauagagacgc

SEQ ID NO: 22064 - RNA, 24 nt, Human
uaacauaagcagugagaaugagac

SEQ ID NO: 22065 - RNA, 24 nt, Human
uuccuuuccaugcagcacacaaua

SEQ ID NO: 22066 - RNA, 24 nt, Human
ccuacagacugacuaaguaggggg

SEQ ID NO: 22067 - RNA, 24 nt, Human
caugucaauguagguuaggccagc

SEQ ID NO: 22068 - RNA, 24 nt, Human
uaaaguaauucauuaugacuuuug

SEQ ID NO: 22069 - RNA, 22 nt, Human
ugggguguguuccgggcccggc

SEQ ID NO: 22070 - RNA, 24 nt, Human
uuccgguugaaaucgauggaacug

SEQ ID NO: 22071 - RNA, 24 nt, Human
agggguccggugcugucgcgggaa

SEQ ID NO: 22072 - RNA, 24 nt, Human
uuaguauuauuuauuugacaacuc

SEQ ID NO: 22073 - RNA, 24 nt, Human
aaaaagaaauccagagcuaucaag

SEQ ID NO: 22074 - RNA, 24 nt, Human
uggcuaaaauuuucuggacuucau

SEQ ID NO: 22075 - RNA, 24 nt, Human
gcgaaugucaauuuauugagcauu

SEQ ID NO: 22076 - RNA, 24 nt, Human
caccuggccuaauccacaaacugu

SEQ ID NO: 22077 - RNA, 24 nt, Human
acuacaauaaagauuacauacacc

SEQ ID NO: 22078 - RNA, 24 nt, Human
uauguugcccaggcaagucucaaa

SEQ ID NO: 22079 - RNA, 24 nt, Human
uaccauuugccucucgggcucaag

SEQ ID NO: 22080 - RNA, 24 nt, Human
ugauauuaacuuugaccaccuggc

SEQ ID NO: 22081 - RNA, 24 nt, Human
uaaguccagcccacacucaaggaa

SEQ ID NO: 22082 - RNA, 24 nt, Human
uaucucagcaggcccaauauaauu

SEQ ID NO: 22083 - RNA, 24 nt, Human
cacuggccgcugcacacucgccgc

SEQ ID NO: 22084 - RNA, 24 nt, Human
cuggaccgccgcuucugccccuaa

SEQ ID NO: 22085 - RNA, 23 nt, Human
aacuucuuuuagccccagaccuu

SEQ ID NO: 22086 - RNA, 24 nt, Human
uacuccagcccgggugacagagug

SEQ ID NO: 22087 - RNA, 24 nt, Human
ugggauggugcaugucaugugcuc

SEQ ID NO: 22088 - RNA, 24 nt, Human
ucaccaggguucugccucuggccc

SEQ ID NO: 22089 - RNA, 24 nt, Human
ggcccagaggcucaagaggcacca

SEQ ID NO: 22090 - RNA, 19 nt, Human
uaggauggggguggaggca

SEQ ID NO: 22091 - RNA, 24 nt, Human
aagcgccccagauguggggaacag

SEQ ID NO: 22092 - RNA, 17 nt, Human
ugcaaaagucaaaauau

SEQ ID NO: 22093 - RNA, 24 nt, Human
gucaagcuuugggaggcugaggcu

SEQ ID NO: 22094 - RNA, 17 nt, Human
uccaugaggucaauucc

SEQ ID NO: 22095 - RNA, 24 nt, Human
ugucaugcagaggcuccaggggca

SEQ ID NO: 22096 - RNA, 17 nt, Human
uccaugaggucaauucc

SEQ ID NO: 22097 - RNA, 24 nt, Human
ugucaugcagaggcuccaggggca

SEQ ID NO: 22098 - RNA, 24 nt, Human
ucaggacaguaaggacaaggaaag

SEQ ID NO: 22099 - RNA, 24 nt, Human
gcgcugcgguaguuggggucuccc

SEQ ID NO: 22100 - RNA, 24 nt, Human
ucugaucaauccuucuuuuucucu

SEQ ID NO: 22101 - RNA, 24 nt, Human
uaacagguguaagaguguugaaaa

SEQ ID NO: 22102 - RNA, 24 nt, Human
ucaguuaaaaaagaagaagaagaa

SEQ ID NO: 22103 - RNA, 24 nt, Human
ugugcuguugcucuccgggacuug

SEQ ID NO: 22104 - RNA, 24 nt, Human
ucacugagcuaaugaucuaauccu

SEQ ID NO: 22105 - RNA, 24 nt, Human
ugcccgagggggcuuuggcccugu

SEQ ID NO: 22106 - RNA, 18 nt, Human
ucugcaguugugucccuc

SEQ ID NO: 22107 - RNA, 24 nt, Human
uguacacaaccguguccgaauggu

SEQ ID NO: 22108 - RNA, 24 nt, Human
uaaacgaagagaaccaugagcaau

SEQ ID NO: 22109 - RNA, 24 nt, Human
ugggcucuacaagccuuugugaug

SEQ ID NO: 22110 - RNA, 24 nt, Human
uacccuucaugcaugaaagacaaa

SEQ ID NO: 22111 - RNA, 24 nt, Human
gcagaucgccaaacugaggcagca

SEQ ID NO: 22112 - RNA, 24 nt, Human
ucaguuccuaugccacugucaaau

SEQ ID NO: 22113 - RNA, 18 nt, Human
ugcccuguauaaugggau

SEQ ID NO: 22114 - RNA, 24 nt, Human
caacccaauuuauauguaguagcu

SEQ ID NO: 22115 - RNA, 24 nt, Human
ugagugcaauauaauagucaugaa

SEQ ID NO: 22116 - RNA, 24 nt, Human
uccaaagaggagccaguuaccaug

SEQ ID NO: 22117 - RNA, 24 nt, Human
acgggccgcuuuccacaaugcagu

SEQ ID NO: 22118 - RNA, 24 nt, Human
uggccggcacgggcagacaacgcg

SEQ ID NO: 22119 - RNA, 22 nt, Human
uccgugcgcguugcugcggccg

SEQ ID NO: 22120 - RNA, 24 nt, Human
uugaucuugaagaaacugggcgug

SEQ ID NO: 22121 - RNA, 24 nt, Human
aggaaggagauauagugaagagga

SEQ ID NO: 22122 - RNA, 24 nt, Human
guagaguuuucuucaggcuuaaag

SEQ ID NO: 22123 - RNA, 24 nt, Human
guagugcaggcuggcucuuggaaa

SEQ ID NO: 22124 - RNA, 24 nt, Human
ugagaaaaaaaaaccaccagaagu

SEQ ID NO: 22125 - RNA, 24 nt, Human
ugucaagaaacuucuuaucuucau

SEQ ID NO: 22126 - RNA, 24 nt, Human
gaugcaaaauguuugcaguuugac

SEQ ID NO: 22127 - RNA, 24 nt, Human
aaauggaaucuagaagcuaaauuu

SEQ ID NO: 22128 - RNA, 22 nt, Human
uuuacagaaaauucuagaacaa

SEQ ID NO: 22129 - RNA, 24 nt, Human
ccacugcucuccagccuggguggc

SEQ ID NO: 22130 - RNA, 24 nt, Human
uaucuucaccaccaccgccuucag

SEQ ID NO: 22131 - RNA, 24 nt, Human
uacagagacacuuucuugcuuucu

SEQ ID NO: 22132 - RNA, 24 nt, Human
uauuucuggaauuuucuguuuaau

SEQ ID NO: 22133 - RNA, 24 nt, Human
ccuaaaacaguucuguauauucuu

SEQ ID NO: 22134 - RNA, 24 nt, Human
cggaaguagaauuuagaggaagaa

SEQ ID NO: 22135 - RNA, 24 nt, Human
guggacccgggggccacuggccca

SEQ ID NO: 22136 - RNA, 24 nt, Human
uaaacuguauccuuuaguuuuauc

SEQ ID NO: 22137 - RNA, 24 nt, Human
ucccuggggcuggccagggcagcc

SEQ ID NO: 22138 - RNA, 24 nt, Human
uguucaguugcugcucacaauagu

SEQ ID NO: 22139 - RNA, 24 nt, Human
cuugaaggcuaugugggauuugcc

SEQ ID NO: 22140 - RNA, 20 nt, Human
ucacagauuuguauucucca

SEQ ID NO: 22141 - RNA, 24 nt, Human
ccuugggugucauggaucccagac

SEQ ID NO: 22142 - RNA, 24 nt, Human
uugaucuugaagaaacugggcgug

SEQ ID NO: 22143 - RNA, 24 nt, Human
guagaguuuucuucaggcuuaaag

SEQ ID NO: 22144 - RNA, 24 nt, Human
uacgguucuccaugcccccuccag

SEQ ID NO: 22145 - RNA, 24 nt, Human
gaaagcacaaacauggauccagaa

SEQ ID NO: 22146 - RNA, 24 nt, Human
cguuuugaaauucaucccaacugu

SEQ ID NO: 22147 - RNA, 24 nt, Human
aacaccucuggcuuuucugauguu

SEQ ID NO: 22148 - RNA, 24 nt, Human
ugaguaaaucagauguugaauucu

SEQ ID NO: 22149 - RNA, 24 nt, Human
cgauauggugauuguugguuaaga

SEQ ID NO: 22150 - RNA, 24 nt, Human
ugauguauuugcaaacauuaaugu

SEQ ID NO: 22151 - RNA, 24 nt, Human
ugagaggaagccuucuguacuuga

SEQ ID NO: 22152 - RNA, 21 nt, Human
uucaagggauggaaagucacc

SEQ ID NO: 22153 - RNA, 24 nt, Human
ugaaacuaagagauaucgauugac

SEQ ID NO: 22154 - RNA, 24 nt, Human
uacacuggcagagcucacagauga

SEQ ID NO: 22155 - RNA, 24 nt, Human
uagaagcagacggugugcagaaag

SEQ ID NO: 22156 - RNA, 24 nt, Human
uauaagccguuaccgcagacccga

SEQ ID NO: 22157 - RNA, 24 nt, Human
ucgacaauaaugguuaugcuugag

SEQ ID NO: 22158 - RNA, 24 nt, Human
agcccauuuugaggccagaggugc

SEQ ID NO: 22159 - RNA, 24 nt, Human
cggcugcggagccggcgguccuug

SEQ ID NO: 22160 - RNA, 22 nt, Human
cgccgggacagcagacugccgg

SEQ ID NO: 22161 - RNA, 24 nt, Human
aaguaguuauacucaggaagaacu

SEQ ID NO: 22162 - RNA, 24 nt, Human
uauggcaaggaccugauggagaag

SEQ ID NO: 22163 - RNA, 24 nt, Human
aaggagcuuugguucggagacagg

SEQ ID NO: 22164 - RNA, 24 nt, Human
cggggccccuggccacggcguacc

SEQ ID NO: 22165 - RNA, 24 nt, Human
ugucaagaguuuuucuaauauggg

SEQ ID NO: 22166 - RNA, 24 nt, Human
uaccccgucaagacucccagcuua

SEQ ID NO: 22167 - RNA, 24 nt, Human
ucccaggggguacaugaguuucug

SEQ ID NO: 22168 - RNA, 24 nt, Human
uaccugagucucugagcuuuucag

SEQ ID NO: 22169 - RNA, 24 nt, Human
uacucuggaguugaggugcgaguu

SEQ ID NO: 22170 - RNA, 24 nt, Human
aaguuugucgcugauggcaucuuc

SEQ ID NO: 22171 - RNA, 24 nt, Human
uggccugaugauccacagcggaga

SEQ ID NO: 22172 - RNA, 24 nt, Human
ugugugccauugcccaggcagagu

SEQ ID NO: 22173 - RNA, 24 nt, Human
uuuugaugacgauucuuaacaaua

SEQ ID NO: 22174 - RNA, 24 nt, Human
cugggcuugaaggucuucuuccug

SEQ ID NO: 22175 - RNA, 24 nt, Human
uagaucggggauccaauggugagu

SEQ ID NO: 22176 - RNA, 24 nt, Human
uuuuauaguugaggauuguauuga

SEQ ID NO: 22177 - RNA, 24 nt, Human
gugguuccagcucaacuuuuaaua

SEQ ID NO: 22178 - RNA, 23 nt, Human
uguauagaaguugcuuuccugau

SEQ ID NO: 22179 - RNA, 24 nt, Human
uauaugaugaaaagaauugagaag

SEQ ID NO: 22180 - RNA, 24 nt, Human
aaguagucguucuuauaucuaagc

SEQ ID NO: 22181 - RNA, 24 nt, Human
uucaugugcauaaguugacucauu

SEQ ID NO: 22182 - RNA, 24 nt, Human
acuuguauuuccugauuaaaacaa

SEQ ID NO: 22183 - RNA, 24 nt, Human
uuagagacugguacuuguauuucc

SEQ ID NO: 22184 - RNA, 24 nt, Human
ugggaauuaucaccugcucguucc

SEQ ID NO: 22185 - RNA, 24 nt, Human
agagguggugagguugaucggggg

SEQ ID NO: 22186 - RNA, 24 nt, Human
uuaggccaacauguauuaagcuga

SEQ ID NO: 22187 - RNA, 24 nt, Human
ccaccgaaauguugucaacgucca

SEQ ID NO: 22188 - RNA, 19 nt, Human
uuucaugccguccugaagc

SEQ ID NO: 22189 - RNA, 24 nt, Human
uacucugugccaagcacucugcua

SEQ ID NO: 22190 - RNA, 24 nt, Human
uaaaaucaagucauuguauauauu

SEQ ID NO: 22191 - RNA, 24 nt, Human
gaagaugguauauaagauuucagg

SEQ ID NO: 22192 - RNA, 24 nt, Human
ugaugcagacccuggaagggacac

SEQ ID NO: 22193 - RNA, 24 nt, Human
uaccggcaggcgcaguuugacauc

SEQ ID NO: 22194 - RNA, 24 nt, Human
cacaagccugguuauuugaggaug

SEQ ID NO: 22195 - RNA, 24 nt, Human
acacuguucugaucacuuacaucu

SEQ ID NO: 22196 - RNA, 24 nt, Human
uagcaucaucauuguucuacuacu

SEQ ID NO: 22197 - RNA, 19 nt, Human
ugugaaaaaauaaguccuu

SEQ ID NO: 22198 - RNA, 24 nt, Human
aaagaaacauaauugaaggaaugg

SEQ ID NO: 22199 - RNA, 24 nt, Human
uaccuuaacauaugaccucgagug

SEQ ID NO: 22200 - RNA, 24 nt, Human
acccagacugugucuaagggccaa

SEQ ID NO: 22201 - RNA, 24 nt, Human
uaugguaauuacacgaaggcuuuu

SEQ ID NO: 22202 - RNA, 24 nt, Human
aaaguaaccaagaaaauuaaaaua

SEQ ID NO: 22203 - RNA, 24 nt, Human
uugaugguagccaugaaaauuuuc

SEQ ID NO: 22204 - RNA, 24 nt, Human
uauaaaacaguccaaacaagaaaa

SEQ ID NO: 22205 - RNA, 24 nt, Human
acacuguucugaucacuuacaucu

SEQ ID NO: 22206 - RNA, 24 nt, Human
ugugauaauaaugaaauguuucca

SEQ ID NO: 22207 - RNA, 24 nt, Human
ugugauaauaaugaaauguuucca

SEQ ID NO: 22208 - RNA, 24 nt, Human
uauaagaaggucuucguauacuaa

SEQ ID NO: 22209 - RNA, 24 nt, Human
guuccugacuucaguauaguaugu

SEQ ID NO: 22210 - RNA, 24 nt, Human
ugaaaaguacacaaacaagguaua

SEQ ID NO: 22211 - RNA, 24 nt, Human
aagccuccagacaaaguuaacucc

SEQ ID NO: 22212 - RNA, 19 nt, Human
ugugaaaaaauaaguccuu

SEQ ID NO: 22213 - RNA, 24 nt, Human
acacuguucugaucacuuacaucu

SEQ ID NO: 22214 - RNA, 24 nt, Human
uagcaucaucauuguucuacuacu

SEQ ID NO: 22215 - RNA, 24 nt, Human
ugggaucucuccagauauggucgc

SEQ ID NO: 22216 - RNA, 24 nt, Human
uccgccaguucugcucgggcucug

SEQ ID NO: 22217 - RNA, 24 nt, Human
cgaguaccuugaggauguucugga

SEQ ID NO: 22218 - RNA, 24 nt, Human
uugaucuugaagaaacugggcgug

SEQ ID NO: 22219 - RNA, 24 nt, Human
aggaaggagauauagugaagagga

SEQ ID NO: 22220 - RNA, 24 nt, Human
guagaguuuucuucaggcuuaaag

SEQ ID NO: 22221 - RNA, 24 nt, Human
cuggaggugggcuuuggcauggcc

SEQ ID NO: 22222 - RNA, 24 nt, Human
ugucaugguguagaacuugaacac

SEQ ID NO: 22223 - RNA, 24 nt, Human
gggcaagaguuuaucucuggagag

SEQ ID NO: 22224 - RNA, 24 nt, Human
acugugugcuaaauauuaggcuac

SEQ ID NO: 22225 - RNA, 24 nt, Human
uuuuucaccuugacuggccaucua

SEQ ID NO: 22226 - RNA, 23 nt, Human
ugagagccaccgaguauuugcca

SEQ ID NO: 22227 - RNA, 24 nt, Human
uggaagacucauuauucagagcug

SEQ ID NO: 22228 - RNA, 24 nt, Human
uggcagugaggaaaauauggaaag

SEQ ID NO: 22229 - RNA, 24 nt, Human
ugauaugggauaggagguuucuca

SEQ ID NO: 22230 - RNA, 24 nt, Human
ugucagacauuaauauucacauac

SEQ ID NO: 22231 - RNA, 24 nt, Human
uugaucuugaagaaacugggcgug

SEQ ID NO: 22232 - RNA, 24 nt, Human
ucgcugagccucucuaccccaggu

SEQ ID NO: 22233 - RNA, 24 nt, Human
caggagccugggcgggcuucgcuu

SEQ ID NO: 22234 - RNA, 24 nt, Human
cagcccaugacagcuucccuuccu

SEQ ID NO: 22235 - RNA, 24 nt, Human
acaaauuaagauauucuaaaguau

SEQ ID NO: 22236 - RNA, 24 nt, Human
uccaaguaauuuugcaaaaaaaaa

SEQ ID NO: 22237 - RNA, 24 nt, Human
uauuccuuaaaaguuucaagagcu

SEQ ID NO: 22238 - RNA, 24 nt, Human
ucuccagaaaugcuuuggguucau

SEQ ID NO: 22239 - RNA, 24 nt, Human
aggaaggagauauagugaagagga

SEQ ID NO: 22240 - RNA, 24 nt, Human
guagaguuuucuucaggcuuaaag

SEQ ID NO: 22241 - RNA, 22 nt, Human
uacaaaaaaacccgggccuuuu

SEQ ID NO: 22242 - RNA, 24 nt, Human
gagcagcagcaguggagggggcag

SEQ ID NO: 22243 - RNA, 24 nt, Human
gugcagaaugagggccgaguagau

SEQ ID NO: 22244 - RNA, 24 nt, Human
uguggaaucggccgaggggagguc

SEQ ID NO: 22245 - RNA, 24 nt, Human
ugugcuuauuaaaaauggucaucu

SEQ ID NO: 22246 - RNA, 24 nt, Human
uuguauuuuuuaaagcuauaauuc

SEQ ID NO: 22247 - RNA, 24 nt, Human
ccugcaugaauuggcuccugauuu

SEQ ID NO: 22248 - RNA, 24 nt, Human
ggggaacaugaagaugaagggccu

SEQ ID NO: 22249 - RNA, 24 nt, Human
ugacaaaaccugcaaucacgcacu

SEQ ID NO: 22250 - RNA, 24 nt, Human
ugaagagcuauggccacaccuuug

SEQ ID NO: 22251 - RNA, 24 nt, Human
ucaguuauaauguucuuuuuaagg

SEQ ID NO: 22252 - RNA, 24 nt, Human
ugacuacauacauagauggguagc

SEQ ID NO: 22253 - RNA, 24 nt, Human
aauggcaccuucaaaaggggcgau

SEQ ID NO: 22254 - RNA, 24 nt, Human
uugaucuugaagaaacugggcgug

SEQ ID NO: 22255 - RNA, 24 nt, Human
ggccgugguccgcgcccuuccucg

SEQ ID NO: 22256 - RNA, 24 nt, Human
uagcuuggugccaaucggucgugg

SEQ ID NO: 22257 - RNA, 24 nt, Human
guagaguuuucuucaggcuuaaag

SEQ ID NO: 22258 - RNA, 24 nt, Human
ucggguguuaaaaaacuagagcuu

SEQ ID NO: 22259 - RNA, 24 nt, Human
uugguuggauacuugcuggaaaaa

SEQ ID NO: 22260 - RNA, 24 nt, Human
uugaucuugaagaaacugggcgug

SEQ ID NO: 22261 - RNA, 24 nt, Human
gguuuuguuggcuugggcaacagg

SEQ ID NO: 22262 - RNA, 24 nt, Human
aggugguucauagaacagccacag

SEQ ID NO: 22263 - RNA, 24 nt, Human
aaccagcuuggugcggcauagucu

SEQ ID NO: 22264 - RNA, 24 nt, Human
ggccgugguccgcgcccuuccucg

SEQ ID NO: 22265 - RNA, 24 nt, Human
ugagauguccucuauucuugaaga

SEQ ID NO: 22266 - RNA, 24 nt, Human
ugugugcagauggggcuggauuug

SEQ ID NO: 22267 - RNA, 24 nt, Human
ucacuguugcuacuuuuccucuca

SEQ ID NO: 22268 - RNA, 24 nt, Human
uacguugcuuugauaucaccauuu

SEQ ID NO: 22269 - RNA, 24 nt, Human
uuuuucuuuuuuguacaaaaauac

SEQ ID NO: 22270 - RNA, 24 nt, Human
uugaaaguagggccuacauggguc

SEQ ID NO: 22271 - RNA, 24 nt, Human
aaguacccagcacaauacuuguau

SEQ ID NO: 22272 - RNA, 23 nt, Human
ucacuuggggcuguauaaaaaaa

SEQ ID NO: 22273 - RNA, 24 nt, Human
ugguguguagggucauuauucaug

SEQ ID NO: 22274 - RNA, 24 nt, Human
acccagacugugucuaagggccaa

SEQ ID NO: 22275 - RNA, 24 nt, Human
uaugguaauuacacgaaggcuuuu

SEQ ID NO: 22276 - RNA, 24 nt, Human
ucacuacagaggucauuggguugu

SEQ ID NO: 22277 - RNA, 24 nt, Human
uagcacagugcugacgacucaggu

SEQ ID NO: 22278 - RNA, 24 nt, Human
cacaagccugguuauuugaggaug

SEQ ID NO: 22279 - RNA, 24 nt, Human
uguuucuuuuaauggguuuccaaa

SEQ ID NO: 22280 - RNA, 24 nt, Human
ugaggucauguguuaagguaugua

SEQ ID NO: 22281 - RNA, 24 nt, Human
ugugauaauaaugaaauguuucca

SEQ ID NO: 22282 - RNA, 24 nt, Human
uacagguuagggcaauuuggacuu

SEQ ID NO: 22283 - RNA, 24 nt, Human
auuugagauuuaaaaaugaaauua

SEQ ID NO: 22284 - RNA, 24 nt, Human
ugugcagcuugaucggcggcgccg

SEQ ID NO: 22285 - RNA, 24 nt, Human
ucucauggcucuggggcugggucc

SEQ ID NO: 22286 - RNA, 18 nt, Human
uugguuccgacuggaguc

SEQ ID NO: 22287 - RNA, 24 nt, Human
ugaaccaggaaaacugaagcaccu

SEQ ID NO: 22288 - RNA, 24 nt, Human
uauuauggcugcuguuguccaaca

SEQ ID NO: 22289 - RNA, 24 nt, Human
uacuccacagacagagcugagggu

SEQ ID NO: 22290 - RNA, 24 nt, Human
uaaaugauaccugggguuucuucc

SEQ ID NO: 22291 - RNA, 18 nt, Human
uagcucggcgccuggguu

SEQ ID NO: 22292 - RNA, 24 nt, Human
cacuccgcaggaaaguugagagca

SEQ ID NO: 22293 - RNA, 24 nt, Human
aagugucuuuuugggucgacaucc

SEQ ID NO: 22294 - RNA, 24 nt, Human
gaccuugugauccaccugccucag

SEQ ID NO: 22295 - RNA, 24 nt, Human
ugggaaaauguucauuuaauaaac

SEQ ID NO: 22296 - RNA, 24 nt, Human
uuugcauugaggugguuccggcca

SEQ ID NO: 22297 - RNA, 24 nt, Human
uauuacacacggauguaagcauuu

SEQ ID NO: 22298 - RNA, 24 nt, Human
uugaucuugaagaaacugggcgug

SEQ ID NO: 22299 - RNA, 24 nt, Human
aggaaggagauauagugaagagga

SEQ ID NO: 22300 - RNA, 24 nt, Human
ugagcaguguaugucaggacuugu

SEQ ID NO: 22301 - RNA, 24 nt, Human
uagcuuugggauuuugaauuggua

SEQ ID NO: 22302 - RNA, 24 nt, Human
uagagcuagugaauuagccuauuu

SEQ ID NO: 22303 - RNA, 24 nt, Human
uaaggaaaucuugagugaaaaucc

SEQ ID NO: 22304 - RNA, 24 nt, Human
uuccugagggagugaagucucugg

SEQ ID NO: 22305 - RNA, 24 nt, Human
caugucauguguaugcagcucuuc

SEQ ID NO: 22306 - RNA, 24 nt, Human
agauaggaagauaggagggccuug

SEQ ID NO: 22307 - RNA, 24 nt, Human
ucccgcgcgcgcgcuccguggccg

SEQ ID NO: 22308 - RNA, 24 nt, Human
uaauucaggguguauauuuuuaau

SEQ ID NO: 22309 - RNA, 24 nt, Human
uucauuuuuuauuugugacuguag

SEQ ID NO: 22310 - RNA, 23 nt, Human
ugaguggacccagagggaccugg

SEQ ID NO: 22311 - RNA, 24 nt, Human
uguaaccauguuuucauaggauuu

SEQ ID NO: 22312 - RNA, 24 nt, Human
uucaucauuuccucaagagaaaca

SEQ ID NO: 22313 - RNA, 24 nt, Human
uuagaaguaaauagcagauucaac

SEQ ID NO: 22314 - RNA, 24 nt, Human
uucaucauuuccucaagagaaaca

SEQ ID NO: 22315 - RNA, 24 nt, Human
uguaaccauguuuucauaggauuu

SEQ ID NO: 22316 - RNA, 24 nt, Human
uuagaaguaaauagcagauucaac

SEQ ID NO: 22317 - RNA, 24 nt, Human
augggccacagagauuccacuuuc

SEQ ID NO: 22318 - RNA, 19 nt, Human
aucagguuuuugucugcau

SEQ ID NO: 22319 - RNA, 24 nt, Human
uucgucccgaaguuggugucccgu

SEQ ID NO: 22320 - RNA, 24 nt, Human
agaguuguucauccaggaagacag

SEQ ID NO: 22321 - RNA, 24 nt, Human
agcuacugggugagcuggacuacc

SEQ ID NO: 22322 - RNA, 24 nt, Human
aagccgcgcuguuccugcugcugg

SEQ ID NO: 22323 - RNA, 24 nt, Human
accaggugcugcucguggccugcu

SEQ ID NO: 22324 - RNA, 24 nt, Human
acuccgagugcagcucauccugac

SEQ ID NO: 22325 - RNA, 24 nt, Human
ugaucucguuggacugcguggcua

SEQ ID NO: 22326 - RNA, 24 nt, Human
ugagaaaaacagaagauaaaugua

SEQ ID NO: 22327 - RNA, 24 nt, Human
uaaggaccuguuuggggcagcagg

SEQ ID NO: 22328 - RNA, 23 nt, Human
ugugcagaagaaauggaaggauu

SEQ ID NO: 22329 - RNA, 24 nt, Human
uugucuuuccccaucauuuguccu

SEQ ID NO: 22330 - RNA, 24 nt, Human
ucaauuuuuauuuugguuuucuua

SEQ ID NO: 22331 - RNA, 24 nt, Human
agggcugaaguaccagcugaggug

SEQ ID NO: 22332 - RNA, 24 nt, Human
cccacaaucagacaugggcaacua

SEQ ID NO: 22333 - RNA, 24 nt, Human
caccggugccuccuccaucucccu

SEQ ID NO: 22334 - RNA, 24 nt, Human
agugcuugauggauaaauguuugg

SEQ ID NO: 22335 - RNA, 24 nt, Human
ucagggaaaucuuaaaaggauuau

SEQ ID NO: 22336 - RNA, 24 nt, Human
uggcgugucugaggugcacgaaga

SEQ ID NO: 22337 - RNA, 24 nt, Human
ugaaaugaccaaaguacacaaaug

SEQ ID NO: 22338 - RNA, 24 nt, Human
ugggaccacgggcaugagccacca

SEQ ID NO: 22339 - RNA, 24 nt, Human
aucaaugucaauauccuaguuuug

SEQ ID NO: 22340 - RNA, 22 nt, Human
uacaauuggauagaacuaacac

SEQ ID NO: 22341 - RNA, 24 nt, Human
uuccaguucgagaucaccuucgag

SEQ ID NO: 22342 - RNA, 24 nt, Human
ggacaagaauuauuagaguggcua

SEQ ID NO: 22343 - RNA, 24 nt, Human
ugcauuugauccaggacuauagau

SEQ ID NO: 22344 - RNA, 24 nt, Human
uggcugcguuucauugcauugucu

SEQ ID NO: 22345 - RNA, 21 nt, Human
cgugcuaugacauugacgugg

SEQ ID NO: 22346 - RNA, 24 nt, Human
uacaucaauggggacaaguauuuc

SEQ ID NO: 22347 - RNA, 24 nt, Human
cacgcugcuccucaugcuggacua

SEQ ID NO: 22348 - RNA, 24 nt, Human
ccugcaguucgaggugcucauggc

SEQ ID NO: 22349 - RNA, 24 nt, Human
ucuccauuaggaguggggugcucc

SEQ ID NO: 22350 - RNA, 21 nt, Human
ugcgaggggggggacgcgcac

SEQ ID NO: 22351 - RNA, 24 nt, Human
uccacauacggccaucacuccugc

SEQ ID NO: 22352 - RNA, 23 nt, Human
cugaggcgagccgguagaucucc

SEQ ID NO: 22353 - RNA, 24 nt, Human
uucguucuuaaggcaugauggcgc

SEQ ID NO: 22354 - RNA, 24 nt, Human
ucuaugguggucgccaagucuugg

SEQ ID NO: 22355 - RNA, 24 nt, Human
ugguauggacaaauuauuuaaagu

SEQ ID NO: 22356 - RNA, 22 nt, Human
aauuucuuuuguacaagauugu

SEQ ID NO: 22357 - RNA, 24 nt, Human
ugggauucugagguaucgagugaa

SEQ ID NO: 22358 - RNA, 24 nt, Human
ucuguggugcauaaagacgacaca

SEQ ID NO: 22359 - RNA, 24 nt, Human
gauugcggggugcuauucaggugg

SEQ ID NO: 22360 - RNA, 24 nt, Human
ggguuucuggugacuacccgagaa

SEQ ID NO: 22361 - RNA, 24 nt, Human
ugagaaacccguuaugcauagggu

SEQ ID NO: 22362 - RNA, 24 nt, Human
ggccugaagacggcuuucaucaaa

SEQ ID NO: 22363 - RNA, 24 nt, Human
ggacagguguacagacauguucuu

SEQ ID NO: 22364 - RNA, 24 nt, Human
ucccagcaggacccucuucuuguu

SEQ ID NO: 22365 - RNA, 24 nt, Human
ucgaauggacacauuaccagugaa

SEQ ID NO: 22366 - RNA, 24 nt, Human
ggguagguggugauggugcaguag

SEQ ID NO: 22367 - RNA, 24 nt, Human
ucagugguggcgccugggcucagc

SEQ ID NO: 22368 - RNA, 24 nt, Human
ugucuugagugucaggauuucugg

SEQ ID NO: 22369 - RNA, 24 nt, Human
ucagaauugggaggaguccguagc

SEQ ID NO: 22370 - RNA, 24 nt, Human
ugaaaauacccccuuucuccauua

SEQ ID NO: 22371 - RNA, 24 nt, Human
uccaguaucccaaacuuucuaguc

SEQ ID NO: 22372 - RNA, 24 nt, Human
auaucauuugcgaacaagaauauu

SEQ ID NO: 22373 - RNA, 24 nt, Human
acagcauuugcgccuccauuccau

SEQ ID NO: 22374 - RNA, 24 nt, Human
aaaggcacuuugaaccuccuguaa

SEQ ID NO: 22375 - RNA, 24 nt, Human
uuaauccuuaucaaagcugucauu

SEQ ID NO: 22376 - RNA, 24 nt, Human
uuuaauguuuuuuaaaaugcuguu

SEQ ID NO: 22377 - RNA, 24 nt, Human
uacugugggauaaaagcagguuga

SEQ ID NO: 22378 - RNA, 24 nt, Human
gcccuggcucucugucuccuccca

SEQ ID NO: 22379 - RNA, 24 nt, Human
uauuguguguuaaucaucaaggaa

SEQ ID NO: 22380 - RNA, 24 nt, Human
aggcaggcaggcaggcaggcaucc

SEQ ID NO: 22381 - RNA, 24 nt, Human
ccuaaccccuggcuccauggaggu

SEQ ID NO: 22382 - RNA, 24 nt, Human
ucuagcucuuuuccugugguauug

SEQ ID NO: 22383 - RNA, 24 nt, Human
uaggguccccuccccaaggcucag

SEQ ID NO: 22384 - RNA, 24 nt, Human
uccgggcaccaagacugugccgga

SEQ ID NO: 22385 - RNA, 24 nt, Human
gaggaugccggugcgggcgcccgc

SEQ ID NO: 22386 - RNA, 24 nt, Human
uuaaauggccaauugaaacaaaca

SEQ ID NO: 22387 - RNA, 22 nt, Human
uacccgcgcuuauuuggcugga

SEQ ID NO: 22388 - RNA, 24 nt, Human
uaaugggucucaaaauucugugac

SEQ ID NO: 22389 - RNA, 24 nt, Human
ugagaugggaaagggcuccuucaa

SEQ ID NO: 22390 - RNA, 20 nt, Human
uggcagagccagaccgacuc

SEQ ID NO: 22391 - RNA, 24 nt, Human
ugaccuuggaagggguggcccggu

SEQ ID NO: 22392 - RNA, 24 nt, Human
caucacacugcgucagcgcccgcu

SEQ ID NO: 22393 - RNA, 24 nt, Human
cggcaaggucccagcauuugaggg

SEQ ID NO: 22394 - RNA, 24 nt, Human
ccccggccgcccaugcugcuggcg

SEQ ID NO: 22395 - RNA, 24 nt, Human
uugcaugcuuccuccuuugcucuu

SEQ ID NO: 22396 - RNA, 24 nt, Human
ucacggagauuccggaggcucaga

SEQ ID NO: 22397 - RNA, 24 nt, Human
ugccaggaauuccagguuggaggg

SEQ ID NO: 22398 - RNA, 24 nt, Human
uccauccucaagccacgauaagag

SEQ ID NO: 22399 - RNA, 24 nt, Human
ucccagggcuccagggcccuccuc

SEQ ID NO: 22400 - RNA, 24 nt, Human
cgugaaccaggcuguuaagugcac

SEQ ID NO: 22401 - RNA, 24 nt, Human
ugagauuuccuucgucccugacau

SEQ ID NO: 22402 - RNA, 24 nt, Human
guaggucaucuuggacggugccag

SEQ ID NO: 22403 - RNA, 24 nt, Human
caauccgcaugaaugaugcaccca

SEQ ID NO: 22404 - RNA, 24 nt, Human
uccccaacauggaagcauaugccg

SEQ ID NO: 22405 - RNA, 24 nt, Human
cugcuucguguacccgcuggauuu

SEQ ID NO: 22406 - RNA, 19 nt, Human
uggcaaccgcgauccuccu

SEQ ID NO: 22407 - RNA, 24 nt, Human
ugcuggggacgacgcuccccgagc

SEQ ID NO: 22408 - RNA, 22 nt, Human
uaccaaguacugcgcagaaaug

SEQ ID NO: 22409 - RNA, 24 nt, Human
cauugugggcuacguggaaacccu

SEQ ID NO: 22410 - RNA, 21 nt, Human
uucaagggauggaaagucacc

SEQ ID NO: 22411 - RNA, 24 nt, Human
ucugaucuauaaaugcgguggcau

SEQ ID NO: 22412 - RNA, 24 nt, Human
ucuaaugugauaaggcugcacguu

SEQ ID NO: 22413 - RNA, 24 nt, Human
ugagaucuccuuacccucuguugc

SEQ ID NO: 22414 - RNA, 24 nt, Human
ucccugugcgugaacgaggugccc

SEQ ID NO: 22415 - RNA, 23 nt, Human
uccauucugaucaacuaaagaaa

SEQ ID NO: 22416 - RNA, 19 nt, Human
ugggaccacauugaagggu

SEQ ID NO: 22417 - RNA, 22 nt, Human
uccgugcgcguugcugcggccg

SEQ ID NO: 22418 - RNA, 24 nt, Human
ugcauguaauaauguugaguggca

SEQ ID NO: 22419 - RNA, 24 nt, Human
agcaaucucaggagagcaagaccc

SEQ ID NO: 22420 - RNA, 24 nt, Human
ucccugggaaaugcugcacuucag

SEQ ID NO: 22421 - RNA, 24 nt, Human
ugagaugggaaagggcuccuucaa

SEQ ID NO: 22422 - RNA, 24 nt, Human
accccuggugguggaggucaucca

SEQ ID NO: 22423 - RNA, 24 nt, Human
ggcgaagauggccucaggagugca

SEQ ID NO: 22424 - RNA, 22 nt, Human
uucaaagggauggaaagucacc

SEQ ID NO: 22425 - RNA, 24 nt, Human
ucaaggcgagcgagggcgagagug

SEQ ID NO: 22426 - RNA, 24 nt, Human
gugcugguaguugcagaacucugg

SEQ ID NO: 22427 - RNA, 24 nt, Human
uagugugucuggauucugcaucug

SEQ ID NO: 22428 - RNA, 24 nt, Human
uuugaucaucuaugacgacuuauc

SEQ ID NO: 22429 - RNA, 24 nt, Human
ucgcagggggacuuuuacauuagg

SEQ ID NO: 22430 - RNA, 24 nt, Human
cugcagugauauugaugaguguag

SEQ ID NO: 22431 - RNA, 24 nt, Human
guggguguuuggugugaggcugcg

SEQ ID NO: 22432 - RNA, 22 nt, Human
ggaugcgugcauuuaucagauc

SEQ ID NO: 22433 - RNA, 24 nt, Human
uacagugaaacugcgaauggcuca

SEQ ID NO: 22434 - RNA, 24 nt, Human
ucuagauuuucauauaauguauua

SEQ ID NO: 22435 - RNA, 18 nt, Human
ucaucaguucauccaucu

SEQ ID NO: 22436 - RNA, 23 nt, Human
gacacauuuccuucuaaagguuc

SEQ ID NO: 22437 - RNA, 21 nt, Human
cuccugggucccacugguucu

SEQ ID NO: 22438 - RNA, 24 nt, Human
cgacaggaugcagaaggagaucac

SEQ ID NO: 22439 - RNA, 24 nt, Human
ucacuggaugguaauguaaccuua

SEQ ID NO: 22440 - RNA, 24 nt, Human
uaaauguaaaccaugauuucuuuu

SEQ ID NO: 22441 - RNA, 24 nt, Human
uccgggguagcaggggcugcucug

SEQ ID NO: 22442 - RNA, 24 nt, Human
uagaagagaacggacggcgauggc

SEQ ID NO: 22443 - RNA, 24 nt, Human
aggcagaggggagacuugcagcuc

SEQ ID NO: 22444 - RNA, 24 nt, Human
ugagaugggaaagggcuccuucaa

SEQ ID NO: 22445 - RNA, 24 nt, Human
cuccagggcagguggcugccuccc

SEQ ID NO: 22446 - RNA, 24 nt, Human
ugcuggaaaggcgcccagggccca

SEQ ID NO: 22447 - RNA, 24 nt, Human
gcacguggcggccgccgagcuggg

SEQ ID NO: 22448 - RNA, 24 nt, Human
aaaaaaccuuucgugguaccgacu

SEQ ID NO: 22449 - RNA, 24 nt, Human
uacagaaggaaaacaacuuuuuau

SEQ ID NO: 22450 - RNA, 24 nt, Human
ucugaucuauaaaugcgguggcau

SEQ ID NO: 22451 - RNA, 24 nt, Human
acgcgccugggcaacgacuuccac

SEQ ID NO: 22452 - RNA, 24 nt, Human
ucugaucuauaaaugcgguggcau

SEQ ID NO: 22453 - RNA, 24 nt, Human
ccuuggguucaagggaugggaaag

SEQ ID NO: 22454 - RNA, 24 nt, Human
ucugaucuauaaaugcgguggcau

SEQ ID NO: 22455 - RNA, 18 nt, Human
ugaagcagaaugggagug

SEQ ID NO: 22456 - RNA, 24 nt, Human
cugcggccgacacucaugaaggcc

SEQ ID NO: 22457 - RNA, 24 nt, Human
gcgcaugccguggcugccgguguu

SEQ ID NO: 22458 - RNA, 24 nt, Human
ucaauuuuuauuuugguuuucuua

SEQ ID NO: 22459 - RNA, 24 nt, Human
auagaaaagucccagcaggagguu

SEQ ID NO: 22460 - RNA, 24 nt, Human
gggcaguuuguugaaggccugggc

SEQ ID NO: 22461 - RNA, 24 nt, Human
ugguaguggauuagugaaagucuc

SEQ ID NO: 22462 - RNA, 24 nt, Human
aagcuguaaggccuguagcucugg

SEQ ID NO: 22463 - RNA, 24 nt, Human
ugaucucguuggacugcguggcua

SEQ ID NO: 22464 - RNA, 24 nt, Human
caucggauuuugcagcuucugggc

SEQ ID NO: 22465 - RNA, 24 nt, Human
ugguugaauggguaacaugcauug

SEQ ID NO: 22466 - RNA, 24 nt, Human
uucacaaaaauacacauacagaag

SEQ ID NO: 22467 - RNA, 24 nt, Human
agacgagauguacuuggaccagaa

SEQ ID NO: 22468 - RNA, 24 nt, Human
uggaagguggggggagaugccaca

SEQ ID NO: 22469 - RNA, 24 nt, Human
ugagcugguguaccuggacagggc

SEQ ID NO: 22470 - RNA, 24 nt, Human
agaggagggaagggagaaagggau

SEQ ID NO: 22471 - RNA, 24 nt, Human
ucuucagagaaacagacuguucau

SEQ ID NO: 22472 - RNA, 24 nt, Human
acucagguugaguucuguggccag

SEQ ID NO: 22473 - RNA, 24 nt, Human
uuugcugcugcaggaauucucaag

SEQ ID NO: 22474 - RNA, 24 nt, Human
acccugggugaugugcugcccucg

SEQ ID NO: 22475 - RNA, 24 nt, Human
agacgagauguacuuggaccagaa

SEQ ID NO: 22476 - RNA, 24 nt, Human
uucacaguaguucccagggcagca

SEQ ID NO: 22477 - RNA, 24 nt, Human
uguguugaucaagacuucaaaucc

SEQ ID NO: 22478 - RNA, 24 nt, Human
ccuugugucgcgugcugcucuucc

SEQ ID NO: 22479 - RNA, 24 nt, Human
uagcaggcuuccugcagacuguau

SEQ ID NO: 22480 - RNA, 24 nt, Human
cccugguaggcccauccuccccgu

SEQ ID NO: 22481 - RNA, 24 nt, Human
gagcauugacuuccuuucucuccc

SEQ ID NO: 22482 - RNA, 24 nt, Human
uguuucuuuagcucuccuccaaga

SEQ ID NO: 22483 - RNA, 24 nt, Human
uguggcaacuguggucgcaauguc

SEQ ID NO: 22484 - RNA, 24 nt, Human
uggcugaauuucuagaugaccagg

SEQ ID NO: 22485 - RNA, 24 nt, Human
caggugcuuuaucuuuaaaaaaag

SEQ ID NO: 22486 - RNA, 24 nt, Human
accaagaagucagauggaaacaau

SEQ ID NO: 22487 - RNA, 24 nt, Human
uuuggcaaagacuuggugcagaug

SEQ ID NO: 22488 - RNA, 21 nt, Human
uaccguaucuguaggcauccu

SEQ ID NO: 22489 - RNA, 24 nt, Human
uuuccuguccccugcugcuccuuc

SEQ ID NO: 22490 - RNA, 24 nt, Human
uauggcaagucacuuugacagaca

SEQ ID NO: 22491 - RNA, 24 nt, Human
uacaccacucccaagaagaauaag

SEQ ID NO: 22492 - RNA, 24 nt, Human
ugugccguggcacgauggcgagga

SEQ ID NO: 22493 - RNA, 24 nt, Human
ucacacuaacuuaaaagacagggu

SEQ ID NO: 22494 - RNA, 24 nt, Human
ucagucuuauuugggcagaaggaa

SEQ ID NO: 22495 - RNA, 24 nt, Human
ggggauggguaaaagggaugaugg

SEQ ID NO: 22496 - RNA, 24 nt, Human
ggaaggacuaggagggaaaacugg

SEQ ID NO: 22497 - RNA, 24 nt, Human
uacugcuuuuaccacuuugauacc

SEQ ID NO: 22498 - RNA, 24 nt, Human
uaggaaaagcaaguagacucauca

SEQ ID NO: 22499 - RNA, 24 nt, Human
uuaauucaugaagcuuacuuuuuu

SEQ ID NO: 22500 - RNA, 21 nt, Human
ucccagguucaagcgauucuc

SEQ ID NO: 22501 - RNA, 20 nt, Human
ucauucaaaucuauucacuc

SEQ ID NO: 22502 - RNA, 24 nt, Human
uguugcuuguuuuauuuuuugucc

SEQ ID NO: 22503 - RNA, 24 nt, Human
ugugaugauucuuuugcuuucuac

SEQ ID NO: 22504 - RNA, 24 nt, Human
ugugcagagaaauagcagagugau

SEQ ID NO: 22505 - RNA, 24 nt, Human
gaucaaaggcugguggguguucca

SEQ ID NO: 22506 - RNA, 24 nt, Human
gaccauccgggagagcauccucau

SEQ ID NO: 22507 - RNA, 24 nt, Human
ugguaguggauuagugaaagucuc

SEQ ID NO: 22508 - RNA, 24 nt, Human
aagcuguaaggccuguagcucugg

SEQ ID NO: 22509 - RNA, 24 nt, Human
uuaauauuugcaugcaaugucuaa

SEQ ID NO: 22510 - RNA, 17 nt, Human
uaugacaguuuuugacu

SEQ ID NO: 22511 - RNA, 24 nt, Human
cauuaggaugucagcugacccuug

SEQ ID NO: 22512 - RNA, 24 nt, Human
uuuauaauuaucucauuuguuaag

SEQ ID NO: 22513 - RNA, 24 nt, Human
uaugaaccuuuccccaagaagggc

SEQ ID NO: 22514 - RNA, 24 nt, Human
uaaaagacuuucuucgaaaccuca

SEQ ID NO: 22515 - RNA, 24 nt, Human
uuccuuccugugcacauguaugug

SEQ ID NO: 22516 - RNA, 24 nt, Human
ugugcagucagcuuaugcucagcc

SEQ ID NO: 22517 - RNA, 24 nt, Human
uccaggaagggccugguguugcag

SEQ ID NO: 22518 - RNA, 24 nt, Human
uuagcccaaaaauggcauuugauu

SEQ ID NO: 22519 - RNA, 24 nt, Human
ugugagcccacauucaacauuuuu

SEQ ID NO: 22520 - RNA, 24 nt, Human
uugaagauccauaacuaucuucug

SEQ ID NO: 22521 - RNA, 24 nt, Human
uaacuggguugacauugggcugaa

SEQ ID NO: 22522 - RNA, 24 nt, Human
cugcggcaggacagacacuccacu

SEQ ID NO: 22523 - RNA, 24 nt, Human
uagcaugcugucggguauucguau

SEQ ID NO: 22524 - RNA, 24 nt, Human
aacaccauuuauugauuagggugu

SEQ ID NO: 22525 - RNA, 24 nt, Human
guaguauaauuugaguuuggguaa

SEQ ID NO: 22526 - RNA, 24 nt, Human
uggcauuauuucuggauucucaau

SEQ ID NO: 22527 - RNA, 24 nt, Human
ccgcgccgaccggcugcagccgca

SEQ ID NO: 22528 - RNA, 24 nt, Human
ucgcggcaggcccggcugauggcg

SEQ ID NO: 22529 - RNA, 24 nt, Human
gugcagcagaccuguaaaugucuu

SEQ ID NO: 22530 - RNA, 24 nt, Human
uaaccuggcaacuaaguggauuac

SEQ ID NO: 22531 - RNA, 24 nt, Human
acuggaugggaauuuccacucuuc

SEQ ID NO: 22532 - RNA, 24 nt, Human
ugauuggguuguugugaggauuaa

SEQ ID NO: 22533 - RNA, 24 nt, Human
gucaagaaaggaggggagaaccca

SEQ ID NO: 22534 - RNA, 24 nt, Human
uaccaagaaugcauaauagucuca

SEQ ID NO: 22535 - RNA, 24 nt, Human
uuguacuugacuuucuuuuuuauu

SEQ ID NO: 22536 - RNA, 24 nt, Human
ucagcuaaucaguauuacuuugua

SEQ ID NO: 22537 - RNA, 24 nt, Human
uucaaaaugaaguuauauaacuac

SEQ ID NO: 22538 - RNA, 24 nt, Human
uacaggaagaaguuccuugugcua

SEQ ID NO: 22539 - RNA, 24 nt, Human
uuuguuaggauagaucuuaagcag

SEQ ID NO: 22540 - RNA, 24 nt, Human
aaugggacugcugaagaguggaca

SEQ ID NO: 22541 - RNA, 24 nt, Human
agucuugugaaaguguaaugugcg

SEQ ID NO: 22542 - RNA, 24 nt, Human
uaauaugucucauccucggccuug

SEQ ID NO: 22543 - RNA, 24 nt, Human
uccauaacugauuuccaagcuggu

SEQ ID NO: 22544 - RNA, 24 nt, Human
ucagcaagagggauucgcuggcug

SEQ ID NO: 22545 - RNA, 24 nt, Human
uggaaacugccaaaccuccuguca

SEQ ID NO: 22546 - RNA, 24 nt, Human
agaauccacauaaaagaagaaacu

SEQ ID NO: 22547 - RNA, 24 nt, Human
aauggaauauaaauaucacaaagu

SEQ ID NO: 22548 - RNA, 22 nt, Human
ugccuaggauauuaaaacauaa

SEQ ID NO: 22549 - RNA, 24 nt, Human
ugcaugaaggugaaguaaggaggc

SEQ ID NO: 22550 - RNA, 24 nt, Human
gccacuguacucuagccugggcaa

SEQ ID NO: 22551 - RNA, 24 nt, Human
uuaauaguuagacuuuaucucauu

SEQ ID NO: 22552 - RNA, 24 nt, Human
uuacucauucguuucuuaguguau

SEQ ID NO: 22553 - RNA, 24 nt, Human
ugauaugauagauuuuuguauuga

SEQ ID NO: 22554 - RNA, 24 nt, Human
cauuuuauuuucacuuauggacau

SEQ ID NO: 22555 - RNA, 24 nt, Human
agagcugaaccgauaugagaaagu

SEQ ID NO: 22556 - RNA, 24 nt, Human
uaauuuguuacaguagccauagaa

SEQ ID NO: 22557 - RNA, 24 nt, Human
ugaugagcaguugaaccugugccu

SEQ ID NO: 22558 - RNA, 24 nt, Human
augaagcagauauggcucucccgc

SEQ ID NO: 22559 - RNA, 24 nt, Human
guccugcuggaagcccaugucacu

SEQ ID NO: 22560 - RNA, 24 nt, Human
gagccccagcuccagugccuacug

SEQ ID NO: 22561 - RNA, 24 nt, Human
ugacaacaggacacagaugcaaug

SEQ ID NO: 22562 - RNA, 24 nt, Human
acagaguguuaaugcucaacgaug

SEQ ID NO: 22563 - RNA, 19 nt, Human
ugaaagacaagaggguggc

SEQ ID NO: 22564 - RNA, 24 nt, Human
ccccggcggagcuggcccgcggug

SEQ ID NO: 22565 - RNA, 24 nt, Human
cuucccagcggccccgugcggccc

SEQ ID NO: 22566 - RNA, 24 nt, Human
guaguucucuccaccagcacgggg

SEQ ID NO: 22567 - RNA, 24 nt, Human
agacgagauguacuuggaccagaa

SEQ ID NO: 22568 - RNA, 24 nt, Human
ugcuguaggucuuagagccugguu

SEQ ID NO: 22569 - RNA, 24 nt, Human
agaacucauaaggguaguugggga

SEQ ID NO: 22570 - RNA, 22 nt, Human
uacugggugaauagcacuuucc

SEQ ID NO: 22571 - RNA, 24 nt, Human
agauaggaaguggccuuuagggga

SEQ ID NO: 22572 - RNA, 24 nt, Human
ucaguuggaagacacccugaaauc

SEQ ID NO: 22573 - RNA, 24 nt, Human
uucauuguggacaaaguuauuauu

SEQ ID NO: 22574 - RNA, 24 nt, Human
agacgagauguacuuggaccagaa

SEQ ID NO: 22575 - RNA, 24 nt, Human
ugagaacaucagagugaaaaacau

SEQ ID NO: 22576 - RNA, 24 nt, Human
uguagaguuuuguguuaugagugg

SEQ ID NO: 22577 - RNA, 24 nt, Human
guaguucucuccaccagcacgggg

SEQ ID NO: 22578 - RNA, 24 nt, Human
agacgagauguacuuggaccagaa

SEQ ID NO: 22579 - RNA, 24 nt, Human
aagcuuuauggguguuaauugaaa

SEQ ID NO: 22580 - RNA, 21 nt, Human
uaacucaaaguuuuuaaagaa

SEQ ID NO: 22581 - RNA, 24 nt, Human
gcagggccuguggggagugggcgc

SEQ ID NO: 22582 - RNA, 24 nt, Human
ugccucaaggcaucgcgcucuuca

SEQ ID NO: 22583 - RNA, 24 nt, Human
cagccgguguccgaacugaucgcg

SEQ ID NO: 22584 - RNA, 19 nt, Human
cggcgcaggcggcgcugcc

SEQ ID NO: 22585 - RNA, 24 nt, Human
ugccaguaauaaggaugcuaacaa

SEQ ID NO: 22586 - RNA, 24 nt, Human
aauugcacugauaaaacaaaaaca

SEQ ID NO: 22587 - RNA, 24 nt, Human
cucgucccggccccugcaguccgg

SEQ ID NO: 22588 - RNA, 24 nt, Human
uauguacacccauuauguuuucag

SEQ ID NO: 22589 - RNA, 19 nt, Human
acaaagcaagagaagaagc

SEQ ID NO: 22590 - RNA, 24 nt, Human
cagcggcagagagccauccucuau

SEQ ID NO: 22591 - RNA, 24 nt, Human
ugcccuggagaaagagaggaauga

SEQ ID NO: 22592 - RNA, 24 nt, Human
uuauaaaguucuauuguuacuagu

SEQ ID NO: 22593 - RNA, 24 nt, Human
cuucaccgagagccugggcucagc

SEQ ID NO: 22594 - RNA, 24 nt, Human
uggaaaaacaguuagucuggagcc

SEQ ID NO: 22595 - RNA, 24 nt, Human
uccacagugcugugaucccgaggg

SEQ ID NO: 22596 - RNA, 22 nt, Human
uggaggccccugaacagagggc

SEQ ID NO: 22597 - RNA, 24 nt, Human
ucaggccagcguccuccuccacag

SEQ ID NO: 22598 - RNA, 24 nt, Human
uagguuagaauguaaauuaaagug

SEQ ID NO: 22599 - RNA, 24 nt, Human
ugacuuguaguaagcagguuucug

SEQ ID NO: 22600 - RNA, 24 nt, Human
uugacccuuuguccugcacagcac

SEQ ID NO: 22601 - RNA, 24 nt, Human
ugaggugcuuguccauggcaucga

SEQ ID NO: 22602 - RNA, 22 nt, Human
ugaguugaaagcugcaguugau

SEQ ID NO: 22603 - RNA, 24 nt, Human
gauugugggggcugucguggucgc

SEQ ID NO: 22604 - RNA, 24 nt, Human
agcuguucagcguacucuuuuaga

SEQ ID NO: 22605 - RNA, 19 nt, Human
agggauggacagucaccgu

SEQ ID NO: 22606 - RNA, 24 nt, Human
ggccugaguuugaugacuccgggg

SEQ ID NO: 22607 - RNA, 24 nt, Human
caaccacucuuccgaugaaaagcc

SEQ ID NO: 22608 - RNA, 24 nt, Human
cuccugaaagucuggcugacucug

SEQ ID NO: 22609 - RNA, 24 nt, Human
ucccguguccugaacuuggguccc

SEQ ID NO: 22610 - RNA, 24 nt, Human
uccgaugugaagucuaucucugug

SEQ ID NO: 22611 - RNA, 24 nt, Human
ucagaagaaaauaaucuucucauu

SEQ ID NO: 22612 - RNA, 24 nt, Human
uuugcugaaggaggucaucccuug

SEQ ID NO: 22613 - RNA, 20 nt, Human
uagaauugaaucagacugua

SEQ ID NO: 22614 - RNA, 24 nt, Human
gauuacuuugaggcuugggaguuu

SEQ ID NO: 22615 - RNA, 24 nt, Human
ucagugaauauuugcuaagaacag

SEQ ID NO: 22616 - RNA, 24 nt, Human
ugggaagaauuuuauaagcgauac

SEQ ID NO: 22617 - RNA, 24 nt, Human
uguaaauugugacaccaaacacau

SEQ ID NO: 22618 - RNA, 24 nt, Human
ucacugcaaccucugccuccuggg

SEQ ID NO: 22619 - RNA, 24 nt, Human
ugggaucugcugagcuagaccacu

SEQ ID NO: 22620 - RNA, 24 nt, Human
ucccggagacacugagcugugaaa

SEQ ID NO: 22621 - RNA, 22 nt, Human
uuucacacaauucauguuagcu

SEQ ID NO: 22622 - RNA, 21 nt, Human
uucauuuuuacaagagaagac

SEQ ID NO: 22623 - RNA, 24 nt, Human
uguggcccuucucuuuaaguccga

SEQ ID NO: 22624 - RNA, 24 nt, Human
aaggagcugaagccugugccauag

SEQ ID NO: 22625 - RNA, 24 nt, Human
uucguaugauaucauguucugcau

SEQ ID NO: 22626 - RNA, 24 nt, Human
aggaagucagaggacucagacacc

SEQ ID NO: 22627 - RNA, 19 nt, Human
uaacauagcauuaaggugg

SEQ ID NO: 22628 - RNA, 24 nt, Human
ggauaucgucuuucaucacguucu

SEQ ID NO: 22629 - RNA, 24 nt, Human
uaagggguuauccgagagccagug

SEQ ID NO: 22630 - RNA, 24 nt, Human
cguaagugggcuaucaaauguuag

SEQ ID NO: 22631 - RNA, 24 nt, Human
ugggugcccgcuggcuacgcuugc

SEQ ID NO: 22632 - RNA, 24 nt, Human
ugaggcgcggcugccccggggagg

SEQ ID NO: 22633 - RNA, 24 nt, Human
uguggagcacggagggaaagaagc

SEQ ID NO: 22634 - RNA, 24 nt, Human
gacacguagauucgggcaagucca

SEQ ID NO: 22635 - RNA, 21 nt, Human
uucaagggauggaaagucacc

SEQ ID NO: 22636 - RNA, 24 nt, Human
uccaaaacucauccucuuccccaa

SEQ ID NO: 22637 - RNA, 21 nt, Human
uucaagggauggaaagucacc

SEQ ID NO: 22638 - RNA, 24 nt, Human
uugaucuugaagaaacugggcgug

SEQ ID NO: 22639 - RNA, 24 nt, Human
guauauguauauauauacacuaaa

SEQ ID NO: 22640 - RNA, 24 nt, Human
uccgugcgcguugcugcggccgug

SEQ ID NO: 22641 - RNA, 20 nt, Human
uugaagaaacugggcguguc

SEQ ID NO: 22642 - RNA, 24 nt, Human
aggaaggagauauagugaagagga

SEQ ID NO: 22643 - RNA, 24 nt, Human
guagaguuuucuucaggcuuaaag

SEQ ID NO: 22644 - RNA, 24 nt, Human
uugaucuugaagaaacugggcgug

SEQ ID NO: 22645 - RNA, 24 nt, Human
aggaaggagauauagugaagagga

SEQ ID NO: 22646 - RNA, 24 nt, Human
guagaguuuucuucaggcuuaaag

SEQ ID NO: 22647 - RNA, 24 nt, Human
aggaaggagauauagugaagagga

SEQ ID NO: 22648 - RNA, 24 nt, Human
uugaucuugaagaaacugggcgug

SEQ ID NO: 22649 - RNA, 24 nt, Human
aggaaggagauauagugaagagga

SEQ ID NO: 22650 - RNA, 24 nt, Human
guagaguuuucuucaggcuuaaag

SEQ ID NO: 22651 - RNA, 24 nt, Human
ugacaugaaaguucguaaaugcuc

SEQ ID NO: 22652 - RNA, 21 nt, Human
uucaagggauggaaagucacc

SEQ ID NO: 22653 - RNA, 24 nt, Human
auugugcacgcuuuuaaauagaga

SEQ ID NO: 22654 - RNA, 24 nt, Human
gagccggggagaggaagggugggu

SEQ ID NO: 22655 - RNA, 22 nt, Human
uacugggugaauagcacuuucc

SEQ ID NO: 22656 - RNA, 24 nt, Human
ucaguuggaagacacccugaaauc

SEQ ID NO: 22657 - RNA, 24 nt, Human
agagguucuaggaccucuccuacc

SEQ ID NO: 22658 - RNA, 24 nt, Human
cuccgggccgcgggccgccaaugg

SEQ ID NO: 22659 - RNA, 24 nt, Human
ugcccaggccagguggagcucugc

SEQ ID NO: 22660 - RNA, 24 nt, Human
uaaggccccuaacucuugcuggcu

SEQ ID NO: 22661 - RNA, 24 nt, Human
aaucugcugucuuauuguuccagg

SEQ ID NO: 22662 - RNA, 24 nt, Human
ugaaaggcauaauaauuugaguua

SEQ ID NO: 22663 - RNA, 24 nt, Human
uauuaaguguccauauuucucaag

SEQ ID NO: 22664 - RNA, 24 nt, Human
aguugcugagcugaagggaaagau

SEQ ID NO: 22665 - RNA, 24 nt, Human
ugacucauaacucuaagggccugg

SEQ ID NO: 22666 - RNA, 22 nt, Human
ucccgggaaagagaacuguccu

SEQ ID NO: 22667 - RNA, 21 nt, Human
uucaagggauggaaagucacc

SEQ ID NO: 22668 - RNA, 24 nt, Human
uccaccacuacuggccaucugauc

SEQ ID NO: 22669 - RNA, 22 nt, Human
uucaagggauggcaaagucacc

SEQ ID NO: 22670 - RNA, 24 nt, Human
ucugaucuauaaaugcgguggcau

SEQ ID NO: 22671 - RNA, 24 nt, Human
ucugaucuauaaaugcgguggcau

SEQ ID NO: 22672 - RNA, 24 nt, Human
ucugaucuauaaaugcgguggcau

SEQ ID NO: 22673 - RNA, 24 nt, Human
ucgguggugaugggcaucccgagc

SEQ ID NO: 22674 - RNA, 24 nt, Human
uggggaccccaaggagagagucag

SEQ ID NO: 22675 - RNA, 24 nt, Human
gcggauccgcuucaaaccgucccu

SEQ ID NO: 22676 - RNA, 24 nt, Human
ucugggcuguagcuguggucacgu

SEQ ID NO: 22677 - RNA, 21 nt, Human
uucaagggauggaaagucacc

SEQ ID NO: 22678 - RNA, 24 nt, Human
uccaccacuacuggccaucugauc

SEQ ID NO: 22679 - RNA, 24 nt, Human
cuggucccuucauccucgcugugg

SEQ ID NO: 22680 - RNA, 24 nt, Human
ugacugcguuccaugcggccuaug

SEQ ID NO: 22681 - RNA, 23 nt, Human
uuccagugaugagccccccaugg

SEQ ID NO: 22682 - RNA, 24 nt, Human
uaggugaugugcuugggaaagucc

SEQ ID NO: 22683 - RNA, 20 nt, Human
cacgcucuucagcaccaccc

SEQ ID NO: 22684 - RNA, 24 nt, Human
ucugaucuauaaaugcgguggcau

SEQ ID NO: 22685 - RNA, 24 nt, Human
uuuacaauauuauguuuccuauua

SEQ ID NO: 22686 - RNA, 24 nt, Human
ugcacggggcuuucugcauguaac

SEQ ID NO: 22687 - RNA, 24 nt, Human
ugccauugcuucuugccuguucug

SEQ ID NO: 22688 - RNA, 24 nt, Human
ugccucagagaacuucugcagccg

SEQ ID NO: 22689 - RNA, 24 nt, Human
gcuguggugggucuuguccagcca

SEQ ID NO: 22690 - RNA, 24 nt, Human
cccccagcccccugcuccuuugga

SEQ ID NO: 22691 - RNA, 24 nt, Human
cagccaccauucaggggacuggcg

SEQ ID NO: 22692 - RNA, 24 nt, Human
aggcgguggcuggcgguccgcccg

SEQ ID NO: 22693 - RNA, 24 nt, Human
ucacauggauuucugggcggagcg

SEQ ID NO: 22694 - RNA, 24 nt, Human
uaagagagauggacggagacauuc

SEQ ID NO: 22695 - RNA, 24 nt, Human
cgaggucggguuaggguccuggga

SEQ ID NO: 22696 - RNA, 24 nt, Human
aguuauguugcuuacuaugcacua

SEQ ID NO: 22697 - RNA, 24 nt, Human
cugggccucaaggcuaaaguuuua

SEQ ID NO: 22698 - RNA, 24 nt, Human
cucguggggccugagaaccucacc

SEQ ID NO: 22699 - RNA, 24 nt, Human
uuuuuggcccccuuggaguuuugg

SEQ ID NO: 22700 - RNA, 24 nt, Human
ucugccagucgcccugggagucgg

SEQ ID NO: 22701 - RNA, 24 nt, Human
acccaauacgcgacgugggcgagc

SEQ ID NO: 22702 - RNA, 24 nt, Human
uugaagaagaaggcggcuccuccg

SEQ ID NO: 22703 - RNA, 24 nt, Human
auggaccacauaguuuaagauuac

SEQ ID NO: 22704 - RNA, 24 nt, Human
uacuugguugcaaacucagaucuc

SEQ ID NO: 22705 - RNA, 24 nt, Human
ccuucagaauuuaaggguuuuaaa

SEQ ID NO: 22706 - RNA, 18 nt, Human
ugagaguggagaucugga

SEQ ID NO: 22707 - RNA, 24 nt, Human
ucacaguaugccugggcucuugga

SEQ ID NO: 22708 - RNA, 20 nt, Human
ucccagggcucaagggcugu

SEQ ID NO: 22709 - RNA, 24 nt, Human
ucuaacagauggccaggaggugac

SEQ ID NO: 22710 - RNA, 24 nt, Human
cgacaggaugcagaaggagaucac

SEQ ID NO: 22711 - RNA, 24 nt, Human
uaagauucuugaaggcaaaauuug

SEQ ID NO: 22712 - RNA, 24 nt, Human
ugagaaaacaagcauacuauaagu

SEQ ID NO: 22713 - RNA, 24 nt, Human
acagugcuacucuugaacacuauu

SEQ ID NO: 22714 - RNA, 24 nt, Human
ucagucccuaaaguucugugaaaa

SEQ ID NO: 22715 - RNA, 24 nt, Human
uguguacagugccagcacccacaa

SEQ ID NO: 22716 - RNA, 24 nt, Human
gagcguggguggaucuuggucacc

SEQ ID NO: 22717 - RNA, 24 nt, Human
uaccuaggaacaguacgauuuggg

SEQ ID NO: 22718 - RNA, 24 nt, Human
aaaguuaggucaggcguugacuga

SEQ ID NO: 22719 - RNA, 24 nt, Human
ucucacagaccccaaaacagcugc

SEQ ID NO: 22720 - RNA, 24 nt, Human
uuaauuuuuggggaaaaagcaagu

SEQ ID NO: 22721 - RNA, 23 nt, Human
aaacggaaccagaggauggagcu

SEQ ID NO: 22722 - RNA, 24 nt, Human
uacggugaccaucguggaccagau

SEQ ID NO: 22723 - RNA, 24 nt, Human
uggcaggcgccagcaccagaccug

SEQ ID NO: 22724 - RNA, 23 nt, Human
uucgacaggcuucuucucuggga

SEQ ID NO: 22725 - RNA, 24 nt, Human
ugagcugggcgagagguggcagag

SEQ ID NO: 22726 - RNA, 24 nt, Human
uugaacccaucuuucuauggcaug

SEQ ID NO: 22727 - RNA, 24 nt, Human
cuguacuuuaaguugauuuugaua

SEQ ID NO: 22728 - RNA, 24 nt, Human
uauguggcugggcuugguggcuca

SEQ ID NO: 22729 - RNA, 24 nt, Human
aaggauucggauguagcuuugccc

SEQ ID NO: 22730 - RNA, 24 nt, Human
acuacgggagggacagacacuucg

SEQ ID NO: 22731 - RNA, 24 nt, Human
uacccuguaaccauaaauauguag

SEQ ID NO: 22732 - RNA, 23 nt, Human
ucuuuugggcgccgggccccaga

SEQ ID NO: 22733 - RNA, 24 nt, Human
gggaaggaaaggggccugagcugg

SEQ ID NO: 22734 - RNA, 24 nt, Human
ccggagcacauuccugagcgcuga

SEQ ID NO: 22735 - RNA, 24 nt, Human
aagaagccgcccugguugcacaug

SEQ ID NO: 22736 - RNA, 24 nt, Human
aacauugucaguaaucuauuucuu

SEQ ID NO: 22737 - RNA, 24 nt, Human
uaggaggccagguacaaguucgug

SEQ ID NO: 22738 - RNA, 24 nt, Human
aagaugccaauggacacaguuugc

SEQ ID NO: 22739 - RNA, 24 nt, Human
uguggucagcuccaaagcuaugga

SEQ ID NO: 22740 - RNA, 21 nt, Human
uucaagggauggaaagucacc

SEQ ID NO: 22741 - RNA, 24 nt, Human
ccuggacaugcgucauugcuauuc

SEQ ID NO: 22742 - RNA, 24 nt, Human
uugaucuugaagaaacugggcgug

SEQ ID NO: 22743 - RNA, 24 nt, Human
aggaaggagauauagugaagagga

SEQ ID NO: 22744 - RNA, 24 nt, Human
ccucagcccuggaacaaggcuuca

SEQ ID NO: 22745 - RNA, 24 nt, Human
aaacaugugagagaaaccauaaag

SEQ ID NO: 22746 - RNA, 24 nt, Human
ugaaggguguggcaaggccuucau

SEQ ID NO: 22747 - RNA, 22 nt, Human
gaugucuacaaaauuggugggu

SEQ ID NO: 22748 - RNA, 24 nt, Human
ugagauuaugccugagguugugga

SEQ ID NO: 22749 - RNA, 24 nt, Human
guaguacuugugcugaccaaguau

SEQ ID NO: 22750 - RNA, 24 nt, Human
uaauauuaaauuuuaccauuugag

SEQ ID NO: 22751 - RNA, 24 nt, Human
uuagugaagaagaggaggaugaug

SEQ ID NO: 22752 - RNA, 18 nt, Human
ugugcagccgggacgguu

SEQ ID NO: 22753 - RNA, 24 nt, Human
agcuggugaugcccaacuacccau

SEQ ID NO: 22754 - RNA, 24 nt, Human
ugggauaacauugacgauggacua

SEQ ID NO: 22755 - RNA, 24 nt, Human
uccgugcgcguugcugcggccgug

SEQ ID NO: 22756 - RNA, 24 nt, Human
aggaaggagauauagugaagagga

SEQ ID NO: 22757 - RNA, 24 nt, Human
guagaguuuucuucaggcuuaaag

SEQ ID NO: 22758 - RNA, 24 nt, Human
ggacgccggagcucccacccucuu

SEQ ID NO: 22759 - RNA, 24 nt, Human
uuccgcacaucuuugaaucgcucc

SEQ ID NO: 22760 - RNA, 21 nt, Human
auaaaucuauucugcuaagag

SEQ ID NO: 22761 - RNA, 24 nt, Human
aagcugcauguggauccugagaac

SEQ ID NO: 22762 - RNA, 24 nt, Human
gaggagaaacccugggaaggcucc

SEQ ID NO: 22763 - RNA, 24 nt, Human
uuuuaagaucgugauucuggauga

SEQ ID NO: 22764 - RNA, 24 nt, Human
auuaaacauaacaugcaaauaauc

SEQ ID NO: 22765 - RNA, 23 nt, Human
uaccuuguucuacugcacccugg

SEQ ID NO: 22766 - RNA, 24 nt, Human
uaccuuguucuacugcacccuggu

SEQ ID NO: 22767 - RNA, 17 nt, Human
uggccguaccacuuggc

SEQ ID NO: 22768 - RNA, 24 nt, Human
agaguaagcucuauuaugaaauac

SEQ ID NO: 22769 - RNA, 24 nt, Human
cacugggcuuuugcuuuugugcuu

SEQ ID NO: 22770 - RNA, 24 nt, Human
uuaaucauucaaaucacuaucuga

SEQ ID NO: 22771 - RNA, 18 nt, Human
cugcucagugauugcgga

SEQ ID NO: 22772 - RNA, 24 nt, Human
ugugcagaagaaauggaaggauuc

SEQ ID NO: 22773 - RNA, 24 nt, Human
uaucaaggaagggcaggcgugaug

SEQ ID NO: 22774 - RNA, 24 nt, Human
ugugugcccccccgaggccgugcc

SEQ ID NO: 22775 - RNA, 24 nt, Human
uugaucuugaagaaacugggcgug

SEQ ID NO: 22776 - RNA, 24 nt, Human
uccgugcgcguugcugcggccgug

SEQ ID NO: 22777 - RNA, 24 nt, Human
aggaaggagauauagugaagagga

SEQ ID NO: 22778 - RNA, 24 nt, Human
guagaguuuucuucaggcuuaaag

SEQ ID NO: 22779 - RNA, 22 nt, Human
uagagacaggaucuugcuaugu

SEQ ID NO: 22780 - RNA, 24 nt, Human
caggaucuugcuauguugcccagg

SEQ ID NO: 22781 - RNA, 24 nt, Human
uaagcagcuuccuaucuuuuaaau

SEQ ID NO: 22782 - RNA, 24 nt, Human
uuuaagguagggggggaugaaggg

SEQ ID NO: 22783 - RNA, 24 nt, Human
uuccugagcagguagccugggggg

SEQ ID NO: 22784 - RNA, 24 nt, Human
cugcaacguucagagcaggcccau

SEQ ID NO: 22785 - RNA, 23 nt, Human
uggaacucugguauugcuuucua

SEQ ID NO: 22786 - RNA, 24 nt, Human
uauguuccaaagaaaugcggcuug

SEQ ID NO: 22787 - RNA, 24 nt, Human
cagcacuuugggaggccgaggcag

SEQ ID NO: 22788 - RNA, 24 nt, Human
ugguagaugcauguuuuuuguuac

SEQ ID NO: 22789 - RNA, 24 nt, Human
gggcauggccgcguguguggcagc

SEQ ID NO: 22790 - RNA, 24 nt, Human
aaagcagcaauucuauguucauag

SEQ ID NO: 22791 - RNA, 24 nt, Human
ggaggggaauuauuugaaucgugg

SEQ ID NO: 22792 - RNA, 24 nt, Human
aggccgugaggaccuucagccugu

SEQ ID NO: 22793 - RNA, 24 nt, Human
ugugcacccagcugcaggugcuga

SEQ ID NO: 22794 - RNA, 24 nt, Human
cagcagcagggaggggaggacugg

SEQ ID NO: 22795 - RNA, 24 nt, Human
uccaccuguugacaggacagcagg

SEQ ID NO: 22796 - RNA, 24 nt, Human
uauuaccucuguuguucacaggaa

SEQ ID NO: 22797 - RNA, 24 nt, Human
cauuguuuuacaaaauuuucuaau

SEQ ID NO: 22798 - RNA, 24 nt, Human
gaggagcagcucaguccagcguga

SEQ ID NO: 22799 - RNA, 18 nt, Human
aacagcuuucucaaaugu

SEQ ID NO: 22800 - RNA, 24 nt, Human
ugucagaaaacaaaacaaaaaaag

SEQ ID NO: 22801 - RNA, 24 nt, Human
ucucagucacguggaagccacggg

SEQ ID NO: 22802 - RNA, 24 nt, Human
uuuauaguaucaagugaggcuguu

SEQ ID NO: 22803 - RNA, 24 nt, Human
uauuccccaauguuuuaacugagu

SEQ ID NO: 22804 - RNA, 24 nt, Human
agacaggcuggcacagccccaggc

SEQ ID NO: 22805 - RNA, 24 nt, Human
aagcagcaccaauggggaugaccc

SEQ ID NO: 22806 - RNA, 24 nt, Human
aggaagagauggcagcuuuuuaag

SEQ ID NO: 22807 - RNA, 24 nt, Human
ugguauggaugcccuccugggguu

SEQ ID NO: 22808 - RNA, 24 nt, Human
cagcugccugccuauggucccacu

SEQ ID NO: 22809 - RNA, 24 nt, Human
ugacaguccaaaggguuccucggg

SEQ ID NO: 22810 - RNA, 24 nt, Human
uaacuaggaagguaacuuuuauua

SEQ ID NO: 22811 - RNA, 24 nt, Human
uuuccacaacgguugaacuaauuu

SEQ ID NO: 22812 - RNA, 24 nt, Human
uguaagcauuccuuuuucucugca

SEQ ID NO: 22813 - RNA, 24 nt, Human
uagguggcccuuccaguugaggca

SEQ ID NO: 22814 - RNA, 24 nt, Human
ucuagcuugcuuggacuuucagug

SEQ ID NO: 22815 - RNA, 24 nt, Human
ucacucauacuacagacacuuggc

SEQ ID NO: 22816 - RNA, 24 nt, Human
ugaaggaagggauuucaauuucug

SEQ ID NO: 22817 - RNA, 24 nt, Human
agaugcugaagcuguucagaaguu

SEQ ID NO: 22818 - RNA, 24 nt, Human
ugggaagagcauuaaugcuggagg

SEQ ID NO: 22819 - RNA, 24 nt, Human
uuaauacuguuguccccaguccgu

SEQ ID NO: 22820 - RNA, 24 nt, Human
ucacugcaaccucugccucccggg

SEQ ID NO: 22821 - RNA, 24 nt, Human
ucuacauuauggugaguuguagaa

SEQ ID NO: 22822 - RNA, 24 nt, Human
uagugcaugucuuggugugcuuuu

SEQ ID NO: 22823 - RNA, 24 nt, Human
uauuacagaagugaaacaaacuuc

SEQ ID NO: 22824 - RNA, 21 nt, Human
ugugcagacagaaauuucacc

SEQ ID NO: 22825 - RNA, 24 nt, Human
acuaaauuagaucagauuuugcua

SEQ ID NO: 22826 - RNA, 18 nt, Human
aacagcaugccaccacag

SEQ ID NO: 22827 - RNA, 24 nt, Human
uaagaacgaaagaauaguuaggau

SEQ ID NO: 22828 - RNA, 24 nt, Human
acaguagaccgcugacguuuccca

SEQ ID NO: 22829 - RNA, 24 nt, Human
uacuguaagaaauaguuuuauaaa

SEQ ID NO: 22830 - RNA, 24 nt, Human
uuucacuuuucucgaucacuaaac

SEQ ID NO: 22831 - RNA, 24 nt, Human
auugcaccuaguauuuccagacuu

SEQ ID NO: 22832 - RNA, 24 nt, Human
uaaaugcucauuuaugguuaauga

SEQ ID NO: 22833 - RNA, 24 nt, Human
ugugauggguuuuuugaaauuuga

SEQ ID NO: 22834 - RNA, 24 nt, Human
cacccuuucuuuaaauuuuuaaga

SEQ ID NO: 22835 - RNA, 24 nt, Human
uauuauuaaaguuaccuauuauug

SEQ ID NO: 22836 - RNA, 24 nt, Human
ugcuuggugaccgaauuacuaggu

SEQ ID NO: 22837 - RNA, 24 nt, Human
cuacaggccccucugucuggaaua

SEQ ID NO: 22838 - RNA, 24 nt, Human
aagcagaccuguuucaggguucgg

SEQ ID NO: 22839 - RNA, 23 nt, Human
aacauuuuaucuauucuuuguca

SEQ ID NO: 22840 - RNA, 24 nt, Human
uuaguauacagacgacagugaacu

SEQ ID NO: 22841 - RNA, 24 nt, Human
uuuguaggagacagggucucccug

SEQ ID NO: 22842 - RNA, 24 nt, Human
cucacgcccccccucgcgcgccuc

SEQ ID NO: 22843 - RNA, 24 nt, Human
ccaccaugccccagcccccgcguc

SEQ ID NO: 22844 - RNA, 21 nt, Human
ucccggcgccucguguugccc

SEQ ID NO: 22845 - RNA, 24 nt, Human
ugaacaguaguuaaauagggaaau

SEQ ID NO: 22846 - RNA, 24 nt, Human
uuaguauuaaagauuaggcuauag

SEQ ID NO: 22847 - RNA, 24 nt, Human
uuagcugcugggcuguggggaguu

SEQ ID NO: 22848 - RNA, 24 nt, Human
uuuuuaguaauugaauuucucugc

SEQ ID NO: 22849 - RNA, 24 nt, Human
uagcuagauauuccucacagugaa

SEQ ID NO: 22850 - RNA, 24 nt, Human
uuuccaaaaagccggccgucuaca

SEQ ID NO: 22851 - RNA, 23 nt, Human
ugaaauggaaacuauucaaaaaa

SEQ ID NO: 22852 - RNA, 24 nt, Human
agggauuaaauauagauguaauuu

SEQ ID NO: 22853 - RNA, 24 nt, Human
uguaagauggauaauguguauaag

SEQ ID NO: 22854 - RNA, 24 nt, Human
augcaauuuacuuuuaaagacaaa

SEQ ID NO: 22855 - RNA, 24 nt, Human
ucagugcaccauguguuugcuuug

SEQ ID NO: 22856 - RNA, 24 nt, Human
ugaaaagaucaggagacuaguuga

SEQ ID NO: 22857 - RNA, 24 nt, Human
ucucuuuuuuauaucucuuuggcg

SEQ ID NO: 22858 - RNA, 24 nt, Human
uuugauagagagguacguuugcgg

SEQ ID NO: 22859 - RNA, 24 nt, Human
uuuuuagaggauuuggcuuaaaaa

SEQ ID NO: 22860 - RNA, 24 nt, Human
uaugaggcccuagagcuccgggac

SEQ ID NO: 22861 - RNA, 24 nt, Human
uggcagcaccaggggacacaccug

SEQ ID NO: 22862 - RNA, 24 nt, Human
ggagaugggccaccgcccggcauc

SEQ ID NO: 22863 - RNA, 24 nt, Human
aaaccccccuuuucaacuuuccua

SEQ ID NO: 22864 - RNA, 24 nt, Human
uacuuggagugccugaaaccugua

SEQ ID NO: 22865 - RNA, 18 nt, Human
uggaaggacccccgaggc

SEQ ID NO: 22866 - RNA, 24 nt, Human
ugaaaggaaauauugcacuuucug

SEQ ID NO: 22867 - RNA, 24 nt, Human
uagaagaucuguuuguuuauauau

SEQ ID NO: 22868 - RNA, 24 nt, Human
ugcugcggccuuucaugcgcucca

SEQ ID NO: 22869 - RNA, 20 nt, Human
uggcagagagaagagcuggg

SEQ ID NO: 22870 - RNA, 24 nt, Human
ucucacuuagucaacuccugucaa

SEQ ID NO: 22871 - RNA, 24 nt, Human
gugauucucaccucccuccccacc

SEQ ID NO: 22872 - RNA, 24 nt, Human
uuaaaguggguaaucauaagcucc

SEQ ID NO: 22873 - RNA, 24 nt, Human
uaaaguuugcucgaagccuucagu

SEQ ID NO: 22874 - RNA, 24 nt, Human
uucgccgugguggccgaaaacgcc

SEQ ID NO: 22875 - RNA, 24 nt, Human
uaauauacuguauguuuacauuuu

SEQ ID NO: 22876 - RNA, 24 nt, Human
uauuaagcacuucugucagucuuu

SEQ ID NO: 22877 - RNA, 24 nt, Human
cugcugccuuccagugcugucauu

SEQ ID NO: 22878 - RNA, 24 nt, Human
uccccuggcucuccccugggcaca

SEQ ID NO: 22879 - RNA, 24 nt, Human
gcgaacagggcccucacccugccu

SEQ ID NO: 22880 - RNA, 24 nt, Human
guaguucucuccaccagcacgggg

SEQ ID NO: 22881 - RNA, 24 nt, Human
agacgagauguacuuggaccagaa

SEQ ID NO: 22882 - RNA, 24 nt, Human
uagcaguaaucagcucccagcgac

SEQ ID NO: 22883 - RNA, 24 nt, Human
ugguggucuugagcuuuuggccug

SEQ ID NO: 22884 - RNA, 20 nt, Human
cuugucccucucucacacuu

SEQ ID NO: 22885 - RNA, 24 nt, Human
guaguucucuccaccagcacgggg

SEQ ID NO: 22886 - RNA, 24 nt, Human
agacgagauguacuuggaccagaa

SEQ ID NO: 22887 - RNA, 24 nt, Human
ugcuguaggucuuagagccugguu

SEQ ID NO: 22888 - RNA, 24 nt, Human
ugcaggaacugggugugcacacgg

SEQ ID NO: 22889 - RNA, 24 nt, Human
caguaggcuucuauauauccugga

SEQ ID NO: 22890 - RNA, 24 nt, Human
accagcuucugcuaccuucaugcu

SEQ ID NO: 22891 - RNA, 24 nt, Human
guaguucucuccaccagcacgggg

SEQ ID NO: 22892 - RNA, 24 nt, Human
agacgagauguacuuggaccagaa

SEQ ID NO: 22893 - RNA, 24 nt, Human
gggcaugggucaagggcguccggg

SEQ ID NO: 22894 - RNA, 24 nt, Human
uaccguuuguaaggcgcuugcgca

SEQ ID NO: 22895 - RNA, 24 nt, Human
ugaaugaucaccugcaugucggca

SEQ ID NO: 22896 - RNA, 24 nt, Human
acccggagcggaguggggacuggc

SEQ ID NO: 22897 - RNA, 24 nt, Human
ugggcaaaacgggcuugccagugg

SEQ ID NO: 22898 - RNA, 24 nt, Human
guaguucucuccaccagcacgggg

SEQ ID NO: 22899 - RNA, 24 nt, Human
agacgagauguacuuggaccagaa

SEQ ID NO: 22900 - RNA, 24 nt, Human
ugcuguaggucuuagagccugguu

SEQ ID NO: 22901 - RNA, 24 nt, Human
uaacaguuggacacuauuucuugg

SEQ ID NO: 22902 - RNA, 24 nt, Human
ugcacagaucagugucagaagcau

SEQ ID NO: 22903 - RNA, 24 nt, Human
guaguucucuccaccagcacgggg

SEQ ID NO: 22904 - RNA, 24 nt, Human
agacgagauguacuuggaccagaa

SEQ ID NO: 22905 - RNA, 24 nt, Human
ucacugcaaccuccaccuccuggg

SEQ ID NO: 22906 - RNA, 24 nt, Human
gaccucaggugauccacccaccuc

SEQ ID NO: 22907 - RNA, 24 nt, Human
ugacuugugaggaaaaggaagaac

SEQ ID NO: 22908 - RNA, 24 nt, Human
uuuacaguauauacagucaggccu

SEQ ID NO: 22909 - RNA, 24 nt, Human
ugucaggaaggggaagcggguuuc

SEQ ID NO: 22910 - RNA, 24 nt, Human
guaguucucuccaccagcacgggg

SEQ ID NO: 22911 - RNA, 24 nt, Human
agacgagauguacuuggaccagaa

SEQ ID NO: 22912 - RNA, 24 nt, Human
agacgagauguacuuggaccagaa

SEQ ID NO: 22913 - RNA, 24 nt, Human
ugcuguaggucuuagagccugguu

SEQ ID NO: 22914 - RNA, 24 nt, Human
aaguggcuauuuuagagaaaaaga

SEQ ID NO: 22915 - RNA, 24 nt, Human
guaguucucuccaccagcacgggg

SEQ ID NO: 22916 - RNA, 24 nt, Human
agacgagauguacuuggaccagaa

SEQ ID NO: 22917 - RNA, 23 nt, Human
cuuugugucaccaugggcuaugg

SEQ ID NO: 22918 - RNA, 20 nt, Human
ugucaaguuaccuucugcag

SEQ ID NO: 22919 - RNA, 24 nt, Human
ugugaaggcugggccacgcagagg

SEQ ID NO: 22920 - RNA, 24 nt, Human
uaguucagauugaucuuaggucaa

SEQ ID NO: 22921 - RNA, 24 nt, Human
aggaggaagaaauguuuucuuagg

SEQ ID NO: 22922 - RNA, 24 nt, Human
caagcuccucuccccccucuuuuc

SEQ ID NO: 22923 - RNA, 24 nt, Human
ugugcugaccacaggaauuggauc

SEQ ID NO: 22924 - RNA, 24 nt, Human
aagcuugcuguggccauggugcug

SEQ ID NO: 22925 - RNA, 24 nt, Human
ccggccccgccguuccgacccccg

SEQ ID NO: 22926 - RNA, 24 nt, Human
accauuuuugauuugggcuuccgc

SEQ ID NO: 22927 - RNA, 24 nt, Human
ugagugccaaggacaccacuggaa

SEQ ID NO: 22928 - RNA, 24 nt, Human
uaucagaaggugagauugaauaau

SEQ ID NO: 22929 - RNA, 24 nt, Human
uguucuggagcuguuggacaaaua

SEQ ID NO: 22930 - RNA, 24 nt, Human
aggcagucacagaacaggggcaug

SEQ ID NO: 22931 - RNA, 24 nt, Human
cgggacccccgagcgugaaccccg

SEQ ID NO: 22932 - RNA, 24 nt, Human
uccaccauccaggugugcuuggau

SEQ ID NO: 22933 - RNA, 24 nt, Human
ucugaucaauccuucuuuuucucu

SEQ ID NO: 22934 - RNA, 24 nt, Human
ucaauuuuuauuuugguuuucuua

SEQ ID NO: 22935 - RNA, 24 nt, Human
aauggcucccuuugcccaagugaa

SEQ ID NO: 22936 - RNA, 24 nt, Human
uuagagcuugugucuaaaggguaa

SEQ ID NO: 22937 - RNA, 24 nt, Human
uaccuuugugcacaguugaauggg

SEQ ID NO: 22938 - RNA, 24 nt, Human
uuccacagccagauuugaccaagc

SEQ ID NO: 22939 - RNA, 24 nt, Human
ucacuggaucugcugcccagcauu

SEQ ID NO: 22940 - RNA, 24 nt, Human
uaacaaaccaaacuacuugauagc

SEQ ID NO: 22941 - RNA, 24 nt, Human
ugugugaagucuuaaauguuuuau

SEQ ID NO: 22942 - RNA, 24 nt, Human
aaauugcuguggggaggggggagg

SEQ ID NO: 22943 - RNA, 24 nt, Human
gaauugcaacugucagguuuugug

SEQ ID NO: 22944 - RNA, 24 nt, Human
uuccuauuuucaccaaaauugggg

SEQ ID NO: 22945 - RNA, 24 nt, Human
ucggcccagaacaaugcuaaagua

SEQ ID NO: 22946 - RNA, 20 nt, Human
uggcaccgccggauucuccu

SEQ ID NO: 22947 - RNA, 24 nt, Human
uauggaaucuugcggguucccgag

SEQ ID NO: 22948 - RNA, 24 nt, Human
agggguguuggcuacuccgccagc

SEQ ID NO: 22949 - RNA, 24 nt, Human
uaggaugcaggccuugccagaacu

SEQ ID NO: 22950 - RNA, 24 nt, Human
uaugcugcagcauaugguacuggc

SEQ ID NO: 22951 - RNA, 24 nt, Human
auugauggucagccaggugccuuc

SEQ ID NO: 22952 - RNA, 24 nt, Human
uuaaagggccgucauuuccauuag

SEQ ID NO: 22953 - RNA, 21 nt, Human
uucauuguucacuucuaaacc

SEQ ID NO: 22954 - RNA, 21 nt, Human
uuuucaggguuuuaaacacua

SEQ ID NO: 22955 - RNA, 24 nt, Human
ccccuguagcccaggacuaugcug

SEQ ID NO: 22956 - RNA, 24 nt, Human
ugcccagugaccugggggagccug

SEQ ID NO: 22957 - RNA, 24 nt, Human
uacaaagucauuguuugaacuugg

SEQ ID NO: 22958 - RNA, 24 nt, Human
ugugaugauuugaauuacaaaucc

SEQ ID NO: 22959 - RNA, 24 nt, Human
ugcaaggugaggacaggccccgaa

SEQ ID NO: 22960 - RNA, 20 nt, Human
uagaacaggaaggacucaug

SEQ ID NO: 22961 - RNA, 24 nt, Human
uagcaacagaaaugggccccacag

SEQ ID NO: 22962 - RNA, 24 nt, Human
ucacugagauccagaaaguagcaa

SEQ ID NO: 22963 - RNA, 24 nt, Human
uacacuguggacuggagaaaguca

SEQ ID NO: 22964 - RNA, 24 nt, Human
caagaacaaaauugcacaaggaaa

SEQ ID NO: 22965 - RNA, 24 nt, Human
ugguguugcauuagugaagauacu

SEQ ID NO: 22966 - RNA, 24 nt, Human
uaaaugaacauuugcaauuuuaaa

SEQ ID NO: 22967 - RNA, 24 nt, Human
caaaagcuuuuuauuccuccugcu

SEQ ID NO: 22968 - RNA, 24 nt, Human
uuaauccaagccugauuguacuag

SEQ ID NO: 22969 - RNA, 24 nt, Human
uauuguacacggucaucuguugaa

SEQ ID NO: 22970 - RNA, 24 nt, Human
ugaauggacggguucaggccugau

SEQ ID NO: 22971 - RNA, 24 nt, Human
uuaacuuauaagccucaacuucac

SEQ ID NO: 22972 - RNA, 24 nt, Human
ugcauuguuaucauuaaccagucu

SEQ ID NO: 22973 - RNA, 24 nt, Human
uaaugggucucaaaauucugugac

SEQ ID NO: 22974 - RNA, 24 nt, Human
uauuagggauaauauucauuuagc

SEQ ID NO: 22975 - RNA, 24 nt, Human
aggcaaaauugcagaauaacaaag

SEQ ID NO: 22976 - RNA, 24 nt, Human
uugcuggagcuggccuggugucuc

SEQ ID NO: 22977 - RNA, 24 nt, Human
uaauuuucagcuucgaagguggag

SEQ ID NO: 22978 - RNA, 24 nt, Human
uguugguuuuggccuugcaagagc

SEQ ID NO: 22979 - RNA, 24 nt, Human
ugggcucuuuaaaaaucaaaggua

SEQ ID NO: 22980 - RNA, 24 nt, Human
ggagcucagccagccguggugggg

SEQ ID NO: 22981 - RNA, 24 nt, Human
ggaguccugggggaggggcauggc

SEQ ID NO: 22982 - RNA, 24 nt, Human
uaauacagaguuauccuuuauuuu

SEQ ID NO: 22983 - RNA, 21 nt, Human
uaccccauaaguuuguuucca

SEQ ID NO: 22984 - RNA, 24 nt, Human
aauagugcugauaaaugccuugac

SEQ ID NO: 22985 - RNA, 24 nt, Human
uuuuuagcaacaaaauaauaggaa

SEQ ID NO: 22986 - RNA, 24 nt, Human
uggcucaggguggcuggcgcucac

SEQ ID NO: 22987 - RNA, 24 nt, Human
cuggagccucuguaccugugccca

SEQ ID NO: 22988 - RNA, 20 nt, Human
uuuggcauuuuuuggaccau

SEQ ID NO: 22989 - RNA, 24 nt, Human
uugaugaccuuggaugcuguaaag

SEQ ID NO: 22990 - RNA, 24 nt, Human
uauguaauauuuggguugaucuau

SEQ ID NO: 22991 - RNA, 24 nt, Human
acaguaacuaaaggcagaucuucu

SEQ ID NO: 22992 - RNA, 24 nt, Human
uaggucccaguugucaauuuuuuu

SEQ ID NO: 22993 - RNA, 21 nt, Human
ucuuguggacgcaagcuuccu

SEQ ID NO: 22994 - RNA, 24 nt, Human
uggcagcccuaccucugagauuuu

SEQ ID NO: 22995 - RNA, 24 nt, Human
uacagagugagacuccgucucaaa

SEQ ID NO: 22996 - RNA, 24 nt, Human
ugagaugggaaagggcuccuucaa

SEQ ID NO: 22997 - RNA, 24 nt, Human
cuuggucaagggauuggaagucac

SEQ ID NO: 22998 - RNA, 18 nt, Human
caagggccgcaaugaccu

SEQ ID NO: 22999 - RNA, 24 nt, Human
ugcccgagcccgacgcuaugucca

SEQ ID NO: 23000 - RNA, 24 nt, Human
acgaggcugggaauccuggagaac

SEQ ID NO: 23001 - RNA, 24 nt, Human
ucgcccagcgggagggggccaagu

SEQ ID NO: 23002 - RNA, 24 nt, Human
uuaaugguagauuugagcguauga

SEQ ID NO: 23003 - RNA, 24 nt, Human
cuggucugagccauaaagacugua

SEQ ID NO: 23004 - RNA, 24 nt, Human
uuugccuaucuggggcgccuggcu

SEQ ID NO: 23005 - RNA, 24 nt, Human
ugcguacauccacagguucacuaa

SEQ ID NO: 23006 - RNA, 24 nt, Human
ucacagggcuggugcggacgaacg

SEQ ID NO: 23007 - RNA, 24 nt, Human
ugacaauaggauaaaguuuuuuug

SEQ ID NO: 23008 - RNA, 24 nt, Human
uggggaccacguccugguggcugu

SEQ ID NO: 23009 - RNA, 24 nt, Human
cuugccgugcacggcugcaaguag

SEQ ID NO: 23010 - RNA, 24 nt, Human
uuggagcaaaguucacgaaggcca

SEQ ID NO: 23011 - RNA, 24 nt, Human
acucgguucaccuuugacaccugg

SEQ ID NO: 23012 - RNA, 24 nt, Human
uauugcucagacggucucacgaua

SEQ ID NO: 23013 - RNA, 24 nt, Human
agccgcugcggcccucacaguccg

SEQ ID NO: 23014 - RNA, 24 nt, Human
uucaggguaacaggaggaaaaaug

SEQ ID NO: 23015 - RNA, 24 nt, Human
uaaaauauauucauuucucaauuu

SEQ ID NO: 23016 - RNA, 24 nt, Human
cugugcugccccuuucacaucaaa

SEQ ID NO: 23017 - RNA, 24 nt, Human
ugcuccggauguucgacgcccagg

SEQ ID NO: 23018 - RNA, 24 nt, Human
aggcagcuucggacaggugugguc

SEQ ID NO: 23019 - RNA, 24 nt, Human
ucaacauugucgucauuggacacg

SEQ ID NO: 23020 - RNA, 24 nt, Human
aggaagucagcacuuacauuacga

SEQ ID NO: 23021 - RNA, 24 nt, Human
auggugccuguguccucgaugguc

SEQ ID NO: 23022 - RNA, 24 nt, Human
uuagaacaccagauacaaagcuaa

SEQ ID NO: 23023 - RNA, 24 nt, Human
uuaaaaaaccuuguguagauagga

SEQ ID NO: 23024 - RNA, 23 nt, Human
gaacaguguggccugaugaaacu

SEQ ID NO: 23025 - RNA, 24 nt, Human
acagugcagaaacuuacuuuugaa

SEQ ID NO: 23026 - RNA, 24 nt, Human
aacaaguuuaacugguuuguucca

SEQ ID NO: 23027 - RNA, 24 nt, Human
ugaaggaaaaaauuuugauguaac

SEQ ID NO: 23028 - RNA, 24 nt, Human
ucaguaauaauucauuauucguuu

SEQ ID NO: 23029 - RNA, 24 nt, Human
cgaggaacaucgagccaaggcacc

SEQ ID NO: 23030 - RNA, 24 nt, Human
aaaagccuuucaggaaguuccacc

SEQ ID NO: 23031 - RNA, 24 nt, Human
acagcugggccagacugaguacau

SEQ ID NO: 23032 - RNA, 24 nt, Human
uucccggggcccggggcggucaac

SEQ ID NO: 23033 - RNA, 24 nt, Human
uggcgugauaccaacgagucaaca

SEQ ID NO: 23034 - RNA, 24 nt, Human
ugagagcaagggaacagggcggau

SEQ ID NO: 23035 - RNA, 24 nt, Human
gacacauugacgucagguguacca

SEQ ID NO: 23036 - RNA, 24 nt, Human
ugcaacaauucacccgugcaugcc

SEQ ID NO: 23037 - RNA, 24 nt, Human
ugcugugugcucuuugaaaggaau

SEQ ID NO: 23038 - RNA, 20 nt, Human
uugguccaguuuuacgaaca

SEQ ID NO: 23039 - RNA, 24 nt, Human
gagugcucgccgccgugacguucg

SEQ ID NO: 23040 - RNA, 24 nt, Human
cagcacaguccuuuuuucuguucc

SEQ ID NO: 23041 - RNA, 24 nt, Human
ugccugcugcuggccuauaagauc

SEQ ID NO: 23042 - RNA, 21 nt, Human
acccugggggggguuuugggg

SEQ ID NO: 23043 - RNA, 24 nt, Human
ugaguagggguccaaaccauaggc

SEQ ID NO: 23044 - RNA, 24 nt, Human
uuugauagacaugcaacgugaaau

SEQ ID NO: 23045 - RNA, 24 nt, Human
uaccaagaaugcauaauagucuca

SEQ ID NO: 23046 - RNA, 24 nt, Human
uccacaguccugcauuuacugccu

SEQ ID NO: 23047 - RNA, 24 nt, Human
uauuugguuuugggcuuuagcugg

SEQ ID NO: 23048 - RNA, 24 nt, Human
uuaaaacaguagagcuagcaauga

SEQ ID NO: 23049 - RNA, 24 nt, Human
ugcccuguugcucuacauggccuu

SEQ ID NO: 23050 - RNA, 24 nt, Human
uguggucggguguuugcuggugcc

SEQ ID NO: 23051 - RNA, 24 nt, Human
ucucuuauaaaugacuuuugcaca

SEQ ID NO: 23052 - RNA, 24 nt, Human
uguguuggacaggugauuugcaag

SEQ ID NO: 23053 - RNA, 24 nt, Human
uggcggcggcagcggcggugacug

SEQ ID NO: 23054 - RNA, 22 nt, Human
uuucaagggauggaaagucacc

SEQ ID NO: 23055 - RNA, 24 nt, Human
ucugaucuauaaaugcgguggcau

SEQ ID NO: 23056 - RNA, 24 nt, Human
uauuuaauagagagacgccagcau

SEQ ID NO: 23057 - RNA, 24 nt, Human
uaacugaauaccacucuguaauug

SEQ ID NO: 23058 - RNA, 24 nt, Human
ucgguggugauggugcaucccgag

SEQ ID NO: 23059 - RNA, 24 nt, Human
uggggaccccaaggagagagucag

SEQ ID NO: 23060 - RNA, 24 nt, Human
cgacuccgauacaaccguaccuac

SEQ ID NO: 23061 - RNA, 24 nt, Human
ucugaucuauaaaugcgguggcau

SEQ ID NO: 23062 - RNA, 18 nt, Human
caagggccgcaaugaccu

SEQ ID NO: 23063 - RNA, 19 nt, Human
ucccaacgaucauguuaau

SEQ ID NO: 23064 - RNA, 24 nt, Human
aaugauacuuuucccacagcaaug

SEQ ID NO: 23065 - RNA, 24 nt, Human
cucccggcuuggguggcgcggccg

SEQ ID NO: 23066 - RNA, 24 nt, Human
ucugaucuauaaaugcgguggcau

SEQ ID NO: 23067 - RNA, 24 nt, Human
cacccguaucauuuauggaggcuc

SEQ ID NO: 23068 - RNA, 24 nt, Human
cacccuguaaugguugggaccagg

SEQ ID NO: 23069 - RNA, 24 nt, Human
uggcauuuagaauuuuguuccauu

SEQ ID NO: 23070 - RNA, 24 nt, Human
uccaccacuacuggccaucugauc

SEQ ID NO: 23071 - RNA, 24 nt, Human
ugacuacaaaggaaaauauguugu

SEQ ID NO: 23072 - RNA, 24 nt, Human
uccaaaguauauucucuuuuauug

SEQ ID NO: 23073 - RNA, 24 nt, Human
ugcgguggcagcucugucuggccg

SEQ ID NO: 23074 - RNA, 24 nt, Human
ucuacauugcauugacugggauuc

SEQ ID NO: 23075 - RNA, 24 nt, Human
uuccucagggccuggggaucuggc

SEQ ID NO: 23076 - RNA, 24 nt, Human
aagaagcuggugaucguuggggau

SEQ ID NO: 23077 - RNA, 24 nt, Human
uuaggacggaacagauccggggac

SEQ ID NO: 23078 - RNA, 24 nt, Human
agagguugauaggacugcuugggu

SEQ ID NO: 23079 - RNA, 24 nt, Human
aggcuuuaagaauuuuauccuaau

SEQ ID NO: 23080 - RNA, 24 nt, Human
ugaaucgaaugcgugggggaaauu

SEQ ID NO: 23081 - RNA, 22 nt, Human
uagacugugaaugauaaguuca

SEQ ID NO: 23082 - RNA, 19 nt, Human
cgagaggaggcugcugugu

SEQ ID NO: 23083 - RNA, 24 nt, Human
ugucgugacuacacagaguuacug

SEQ ID NO: 23084 - RNA, 24 nt, Human
uuuacagaggaacuguaguucaca

SEQ ID NO: 23085 - RNA, 24 nt, Human
uaaaaagaagugugaucuguuuuu

SEQ ID NO: 23086 - RNA, 23 nt, Human
uggcaaucaacuuaguagaaguc

SEQ ID NO: 23087 - RNA, 24 nt, Human
uugguuccucccggggcccccacu

SEQ ID NO: 23088 - RNA, 24 nt, Human
aggcaggagguggaaaccccaggg

SEQ ID NO: 23089 - RNA, 24 nt, Human
ucucccauucugagaaucuggguu

SEQ ID NO: 23090 - RNA, 21 nt, Human
uggggugucauuggcuugaaa

SEQ ID NO: 23091 - RNA, 24 nt, Human
uauuugaaggcagaaaacacccua

SEQ ID NO: 23092 - RNA, 24 nt, Human
ccccggguuucaauggcguugccc

SEQ ID NO: 23093 - RNA, 24 nt, Human
gacgaugugcggcggaugaacaag

SEQ ID NO: 23094 - RNA, 24 nt, Human
uuugaaagcuucagcgugccuuag

SEQ ID NO: 23095 - RNA, 22 nt, Human
uaacagguuccauuuuaauguc

SEQ ID NO: 23096 - RNA, 24 nt, Human
ugguaugguccugggaaauuaaac

SEQ ID NO: 23097 - RNA, 24 nt, Human
ucuaucacugucaucauaaacugg

SEQ ID NO: 23098 - RNA, 24 nt, Human
ugccauugucaggaaaggauuuag

SEQ ID NO: 23099 - RNA, 24 nt, Human
uuccugaauagcuaggaccacagg

SEQ ID NO: 23100 - RNA, 24 nt, Human
ugaguuggaauuaaaaggccccuc

SEQ ID NO: 23101 - RNA, 24 nt, Human
uuuaaaaguugauagaauaacugu

SEQ ID NO: 23102 - RNA, 24 nt, Human
gauuugaaacuuuuuaauuaagga

SEQ ID NO: 23103 - RNA, 24 nt, Human
uuggcagugagccgagaucagccc

SEQ ID NO: 23104 - RNA, 21 nt, Human
uuccucaggccucaggaccua

SEQ ID NO: 23105 - RNA, 24 nt, Human
acagcccggaacacuggcaucauc

SEQ ID NO: 23106 - RNA, 24 nt, Human
uaccaugcggagaccaucaagaau

SEQ ID NO: 23107 - RNA, 24 nt, Human
uggcaaauagucauuuuacaauaa

SEQ ID NO: 23108 - RNA, 24 nt, Human
ucuuucagagcuaccccuaaaggc

SEQ ID NO: 23109 - RNA, 24 nt, Human
augaucccauugacuaguuuaaau

SEQ ID NO: 23110 - RNA, 24 nt, Human
ugaaagguacaggcaaguuauuuu

SEQ ID NO: 23111 - RNA, 24 nt, Human
uguuaugucucuuuagucucauuu

SEQ ID NO: 23112 - RNA, 24 nt, Human
cacuuuguccuucuuagguauauc

SEQ ID NO: 23113 - RNA, 24 nt, Human
auucaaguuauaaauuuuucacag

SEQ ID NO: 23114 - RNA, 24 nt, Human
gaacuuguaccauggacuucagac

SEQ ID NO: 23115 - RNA, 24 nt, Human
uuaaauacaacuacaauaugagcg

SEQ ID NO: 23116 - RNA, 24 nt, Human
aggaggaggagcgccgcuacuacc

SEQ ID NO: 23117 - RNA, 24 nt, Human
uggguguaauuaggugaaacacag

SEQ ID NO: 23118 - RNA, 24 nt, Human
uccaugugcuucccuaggcugagc

SEQ ID NO: 23119 - RNA, 24 nt, Human
ucacgaugaaauugaaccugguuu

SEQ ID NO: 23120 - RNA, 24 nt, Human
gagucaguuuuagauuggagcugg

SEQ ID NO: 23121 - RNA, 24 nt, Human
ugagaaagaaauucagauauggga

SEQ ID NO: 23122 - RNA, 24 nt, Human
uugaaaaguaugaagauuaaugaa

SEQ ID NO: 23123 - RNA, 24 nt, Human
gagucaguuuuagauuggagcugg

SEQ ID NO: 23124 - RNA, 24 nt, Human
ugagaaagaaauucagauauggga

SEQ ID NO: 23125 - RNA, 24 nt, Human
uugaaaaguaugaagauuaaugaa

SEQ ID NO: 23126 - RNA, 24 nt, Human
ugagaaagaaauucagauauggga

SEQ ID NO: 23127 - RNA, 24 nt, Human
uugaaaaguaugaagauuaaugaa

SEQ ID NO: 23128 - RNA, 18 nt, Human
uaagucuuggccguuccu

SEQ ID NO: 23129 - RNA, 24 nt, Human
ucuuacagccucugucucuuuauu

SEQ ID NO: 23130 - RNA, 24 nt, Human
uggaagugucuauacagaugugug

SEQ ID NO: 23131 - RNA, 24 nt, Human
ugagaaagaaauucagauauggga

SEQ ID NO: 23132 - RNA, 24 nt, Human
uugaaaaguaugaagauuaaugaa

SEQ ID NO: 23133 - RNA, 17 nt, Human
caggucccguggccgug

SEQ ID NO: 23134 - RNA, 23 nt, Human
caucacagcggcagccggucucc

SEQ ID NO: 23135 - RNA, 24 nt, Human
uguaaauacagaacuaggcacauc

SEQ ID NO: 23136 - RNA, 22 nt, Human
uucauggaauaugugcauuuuc

SEQ ID NO: 23137 - RNA, 24 nt, Human
uucgacuuuaauaagauguaacuc

SEQ ID NO: 23138 - RNA, 22 nt, Human
ugagucuauagaggcaguaggc

SEQ ID NO: 23139 - RNA, 24 nt, Human
ugcuuuguuuaccuacucaagccu

SEQ ID NO: 23140 - RNA, 24 nt, Human
ugggcaguauaauugauuugcagg

SEQ ID NO: 23141 - RNA, 24 nt, Human
uucccauuuugguccucauaauca

SEQ ID NO: 23142 - RNA, 24 nt, Human
ucgcugcguguucauccucucgag

SEQ ID NO: 23143 - RNA, 24 nt, Human
uggaagauggauaugaauuuuuug

SEQ ID NO: 23144 - RNA, 24 nt, Human
ucucugauauaagauacaguccuc

SEQ ID NO: 23145 - RNA, 24 nt, Human
uuaaggcaauuucaaaaaugcucc

SEQ ID NO: 23146 - RNA, 24 nt, Human
ucagugggugcuuggcugugcugg

SEQ ID NO: 23147 - RNA, 24 nt, Human
uacuuuucuuaaguuguuuaauua

SEQ ID NO: 23148 - RNA, 24 nt, Human
caacugaauuacccgguagacuga

SEQ ID NO: 23149 - RNA, 24 nt, Human
aagcuuuugccaaugaucuuuaau

SEQ ID NO: 23150 - RNA, 20 nt, Human
uugguucuguuucucuggag

SEQ ID NO: 23151 - RNA, 24 nt, Human
ugaauacacaucucugucagugug

SEQ ID NO: 23152 - RNA, 24 nt, Human
uuuuuagugcacuuaauauuagcu

SEQ ID NO: 23153 - RNA, 24 nt, Human
uaugugaauuugaguuugcuguuu

SEQ ID NO: 23154 - RNA, 23 nt, Human
ugggagccaggaauggggcuggg

SEQ ID NO: 23155 - RNA, 24 nt, Human
ugcugaagucugaacuugggccuc

SEQ ID NO: 23156 - RNA, 24 nt, Human
aggaaggacuaggcuacagaucag

SEQ ID NO: 23157 - RNA, 24 nt, Human
auuucauucacuggggaggaacaa

SEQ ID NO: 23158 - RNA, 23 nt, Human
uaaggcgaggcggaauuaaaccc

SEQ ID NO: 23159 - RNA, 24 nt, Human
uagcaaaucgagucuuaaauaauc

SEQ ID NO: 23160 - RNA, 24 nt, Human
ugagaaugaccccaagaccuuuga

SEQ ID NO: 23161 - RNA, 24 nt, Human
ugugaacgggaagaaggugcugca

SEQ ID NO: 23162 - RNA, 24 nt, Human
cuuccaaucugaugggcauguuug

SEQ ID NO: 23163 - RNA, 22 nt, Human
guggagggcagcuuugucuaca

SEQ ID NO: 23164 - RNA, 24 nt, Human
uuuaagcauuaucuugcaaaguag

SEQ ID NO: 23165 - RNA, 24 nt, Human
gagcagcaagacugaaacuguuga

SEQ ID NO: 23166 - RNA, 24 nt, Human
aagaagaugaauacaaagcuuucu

SEQ ID NO: 23167 - RNA, 22 nt, Human
caccgcgccccuuuuccagccc

SEQ ID NO: 23168 - RNA, 24 nt, Human
uccugcaucuuuaccgucucaggg

SEQ ID NO: 23169 - RNA, 24 nt, Human
ugcugcugcccaaggaccgcggag

SEQ ID NO: 23170 - RNA, 24 nt, Human
uguucuggagcuguuggacaaaua

SEQ ID NO: 23171 - RNA, 24 nt, Human
uugaucuugaagaaacugggcgug

SEQ ID NO: 23172 - RNA, 24 nt, Human
aggaaggagauauagugaagagga

SEQ ID NO: 23173 - RNA, 24 nt, Human
guagaguuuucuucaggcuuaaag

SEQ ID NO: 23174 - RNA, 24 nt, Human
uaagucuugaggaccuugcuugag

SEQ ID NO: 23175 - RNA, 24 nt, Human
acugcaccacuguacuacagcuug

SEQ ID NO: 23176 - RNA, 24 nt, Human
ugaggaaaacugggauaaugaccc

SEQ ID NO: 23177 - RNA, 22 nt, Human
uccgugcgcguugcugcggccg

SEQ ID NO: 23178 - RNA, 24 nt, Human
uugaucuugaagaaacugggcgug

SEQ ID NO: 23179 - RNA, 24 nt, Human
aggaaggagauauagugaagagga

SEQ ID NO: 23180 - RNA, 24 nt, Human
guagaguuuucuucaggcuuaaag

SEQ ID NO: 23181 - RNA, 24 nt, Human
cagcugcagauucugcuguucgac

SEQ ID NO: 23182 - RNA, 24 nt, Human
ucucuguggacaugaggauuggau

SEQ ID NO: 23183 - RNA, 24 nt, Human
uuagcauguggcaaugaugauugc

SEQ ID NO: 23184 - RNA, 24 nt, Human
acuuggagaaaugggauuugaaau

SEQ ID NO: 23185 - RNA, 22 nt, Human
uggcaaggaagaaaguguuccg

SEQ ID NO: 23186 - RNA, 24 nt, Human
ucacucaauuuaucaguaauggag

SEQ ID NO: 23187 - RNA, 19 nt, Human
ucagaagaggcuggccaca

SEQ ID NO: 23188 - RNA, 24 nt, Human
accaagguguccaaaugaggugac

SEQ ID NO: 23189 - RNA, 24 nt, Human
uauggcaagucacuuugacagaca

SEQ ID NO: 23190 - RNA, 24 nt, Human
ugagaauggcaaaauuagucgccu

SEQ ID NO: 23191 - RNA, 24 nt, Human
uacaccacucccaagaagaauaag

SEQ ID NO: 23192 - RNA, 24 nt, Human
agugacagcgacggcucccagagu

SEQ ID NO: 23193 - RNA, 24 nt, Human
ugagaugggaaagggcuccuucaa

SEQ ID NO: 23194 - RNA, 24 nt, Human
uugaucuugaagaaacugggcgug

SEQ ID NO: 23195 - RNA, 24 nt, Human
uuccaguuggugaggagcuguugg

SEQ ID NO: 23196 - RNA, 24 nt, Human
aggaaggagauauagugaagagga

SEQ ID NO: 23197 - RNA, 24 nt, Human
guagaguuuucuucaggcuuaaag

SEQ ID NO: 23198 - RNA, 24 nt, Human
aggaaggagauauagugaagagga

SEQ ID NO: 23199 - RNA, 22 nt, Human
uccgugcgcguugcugcggccg

SEQ ID NO: 23200 - RNA, 24 nt, Human
guagaguuuucuucaggcuuaaag

SEQ ID NO: 23201 - RNA, 22 nt, Human
uccgugcgcguugcugcggccg

SEQ ID NO: 23202 - RNA, 24 nt, Human
aggaaggagauauagugaagagga

SEQ ID NO: 23203 - RNA, 24 nt, Human
uaauagaaugggcauguauuguaa

SEQ ID NO: 23204 - RNA, 24 nt, Human
uauuaagcacuucugucagucuuu

SEQ ID NO: 23205 - RNA, 22 nt, Human
uccgugcgcguugcugcggccg

SEQ ID NO: 23206 - RNA, 24 nt, Human
uugaucuugaagaaacugggcgug

SEQ ID NO: 23207 - RNA, 24 nt, Human
aggaaggagauauagugaagagga

SEQ ID NO: 23208 - RNA, 24 nt, Human
aggaaggagauauagugaagagga

SEQ ID NO: 23209 - RNA, 24 nt, Human
uugaucuugaagaaacugggcgug

SEQ ID NO: 23210 - RNA, 24 nt, Human
guagaguuuucuucaggcuuaaag

SEQ ID NO: 23211 - RNA, 24 nt, Human
aggaaggagauauagugaagagga

SEQ ID NO: 23212 - RNA, 24 nt, Human
guagaguuuucuucaggcuuaaag

SEQ ID NO: 23213 - RNA, 24 nt, Human
aggaaggagauauagugaagagga

SEQ ID NO: 23214 - RNA, 22 nt, Human
uccgugcgcguugcugcggccg

SEQ ID NO: 23215 - RNA, 24 nt, Human
uugaucuugaagaaacugggcgug

SEQ ID NO: 23216 - RNA, 24 nt, Human
aggaaggagauauagugaagagga

SEQ ID NO: 23217 - RNA, 24 nt, Human
guagaguuuucuucaggcuuaaag

SEQ ID NO: 23218 - RNA, 22 nt, Human
uccgugcgcguugcugcggccg

SEQ ID NO: 23219 - RNA, 24 nt, Human
uugaucuugaagaaacugggcgug

SEQ ID NO: 23220 - RNA, 24 nt, Human
guagaguuuucuucaggcuuaaag

SEQ ID NO: 23221 - RNA, 24 nt, Human
guagaguuuucuucaggcuuaaag

SEQ ID NO: 23222 - RNA, 22 nt, Human
uccgugcgcguugcugcggccg

SEQ ID NO: 23223 - RNA, 24 nt, Human
uugaucuugaagaaacugggcgug

SEQ ID NO: 23224 - RNA, 24 nt, Human
aggaaggagauauagugaagagga

SEQ ID NO: 23225 - RNA, 22 nt, Human
uccgugcgcguugcugcggccg

SEQ ID NO: 23226 - RNA, 24 nt, Human
uugaucuugaagaaacugggcgug

SEQ ID NO: 23227 - RNA, 24 nt, Human
aggaaggagauauagugaagagga

SEQ ID NO: 23228 - RNA, 24 nt, Human
guagaguuuucuucaggcuuaaag

SEQ ID NO: 23229 - RNA, 24 nt, Human
uugaucuugaagaaacugggcgug

SEQ ID NO: 23230 - RNA, 24 nt, Human
aggaaggagauauagugaagagga

SEQ ID NO: 23231 - RNA, 24 nt, Human
guagaguuuucuucaggcuuaaag

SEQ ID NO: 23232 - RNA, 24 nt, Human
uugaucuugaagaaacugggcgug

SEQ ID NO: 23233 - RNA, 24 nt, Human
aggaaggagauauagugaagagga

SEQ ID NO: 23234 - RNA, 24 nt, Human
guagaguuuucuucaggcuuaaag

SEQ ID NO: 23235 - RNA, 22 nt, Human
uccgugcgcguugcugcggccg

SEQ ID NO: 23236 - RNA, 24 nt, Human
uugaucuugaagaaacugggcgug

SEQ ID NO: 23237 - RNA, 24 nt, Human
aggaaggagauauagugaagagga

SEQ ID NO: 23238 - RNA, 24 nt, Human
guagaguuuucuucaggcuuaaag

SEQ ID NO: 23239 - RNA, 22 nt, Human
uccgugcgcguugcugcggccg

SEQ ID NO: 23240 - RNA, 24 nt, Human
uugaucuugaagaaacugggcgug

SEQ ID NO: 23241 - RNA, 24 nt, Human
uuccaguuggugaggagcuguugg

SEQ ID NO: 23242 - RNA, 24 nt, Human
aggaaggagauauagugaagagga

SEQ ID NO: 23243 - RNA, 24 nt, Human
ucaguaaugcguucaggaguccac

SEQ ID NO: 23244 - RNA, 24 nt, Human
uuuuucuuaaccuuauugcaaggg

SEQ ID NO: 23245 - RNA, 18 nt, Human
uaccaucgcacguugguc

SEQ ID NO: 23246 - RNA, 24 nt, Human
aucaagauccuuacguuacucuga

SEQ ID NO: 23247 - RNA, 24 nt, Human
aggaaggagauauagugaagagga

SEQ ID NO: 23248 - RNA, 21 nt, Human
uaccucuguugaucuugaaga

SEQ ID NO: 23249 - RNA, 24 nt, Human
cuuuuaauaaguuuaauguucuuc

SEQ ID NO: 23250 - RNA, 24 nt, Human
ugccagaauuugauaccccugggc

SEQ ID NO: 23251 - RNA, 24 nt, Human
aggaaggagauauagugaagagga

SEQ ID NO: 23252 - RNA, 24 nt, Human
guagaguuuucuucaggcuuaaag

SEQ ID NO: 23253 - RNA, 24 nt, Human
uugaucuugaagaaacugggcgug

SEQ ID NO: 23254 - RNA, 24 nt, Human
aggaaggagauauagugaagagga

SEQ ID NO: 23255 - RNA, 22 nt, Human
uccgugcgcguugcugcggccg

SEQ ID NO: 23256 - RNA, 24 nt, Human
uugaucuugaagaaacugggcgug

SEQ ID NO: 23257 - RNA, 24 nt, Human
aggaaggagauauagugaagagga

SEQ ID NO: 23258 - RNA, 24 nt, Human
guagaguuuucuucaggcuuaaag

SEQ ID NO: 23259 - RNA, 24 nt, Human
ugaagcagaagcagauucggcgcg

SEQ ID NO: 23260 - RNA, 24 nt, Human
accugggugcagccgcaguccaag

SEQ ID NO: 23261 - RNA, 24 nt, Human
aggaaggagauauagugaagagga

SEQ ID NO: 23262 - RNA, 24 nt, Human
uagaacucagcccggcgcuccucu

SEQ ID NO: 23263 - RNA, 24 nt, Human
auggaucuuacuguccagagcacu

SEQ ID NO: 23264 - RNA, 20 nt, Human
uugaucuugaagaaacuggg

SEQ ID NO: 23265 - RNA, 22 nt, Human
uccgugcgcguugcugcggccg

SEQ ID NO: 23266 - RNA, 24 nt, Human
aggaaggagauauagugaagagga

SEQ ID NO: 23267 - RNA, 24 nt, Human
guagaguuuucuucaggcuuaaag

SEQ ID NO: 23268 - RNA, 24 nt, Human
uaagacuuggaagccacagaaaug

SEQ ID NO: 23269 - RNA, 24 nt, Human
uuaggucaaagaggcugcuuggag

SEQ ID NO: 23270 - RNA, 24 nt, Human
uccugugggugggacaagcugggc

SEQ ID NO: 23271 - RNA, 24 nt, Human
ugggauggaacccugcgccucugg

SEQ ID NO: 23272 - RNA, 24 nt, Human
cgcugcugcugguggcgcuacugg

SEQ ID NO: 23273 - RNA, 24 nt, Human
ugucuggagcuugaagaagugggu

SEQ ID NO: 23274 - RNA, 24 nt, Human
uagaagguuaggggcauuuguuga

SEQ ID NO: 23275 - RNA, 24 nt, Human
uauuuuacaaaaaaacaacugaac

SEQ ID NO: 23276 - RNA, 24 nt, Human
ugcgcuggacgcccgcuucuccug

SEQ ID NO: 23277 - RNA, 24 nt, Human
uugcuccaaggcugccacuuucuc

SEQ ID NO: 23278 - RNA, 24 nt, Human
uggaaggcgguguugacccugggg

SEQ ID NO: 23279 - RNA, 24 nt, Human
auggagcugcagagagcuccucca

SEQ ID NO: 23280 - RNA, 19 nt, Human
ugaccaguauucucauuuu

SEQ ID NO: 23281 - RNA, 24 nt, Human
agcggcucaugccuauaaucccag

SEQ ID NO: 23282 - RNA, 24 nt, Human
uuaacacuuguuuaaauuuuuuua

SEQ ID NO: 23283 - RNA, 21 nt, Human
uagggcucucggccgcgucca

SEQ ID NO: 23284 - RNA, 24 nt, Human
cacagcaacuucacucuacacacu

SEQ ID NO: 23285 - RNA, 24 nt, Human
cgccgcagugucuacuccggauca

SEQ ID NO: 23286 - RNA, 24 nt, Human
augcauugaucacaggcccauuug

SEQ ID NO: 23287 - RNA, 24 nt, Human
uaauucuuuuaauuugguuaucug

SEQ ID NO: 23288 - RNA, 24 nt, Human
cagcccgccagcugggccugggcu

SEQ ID NO: 23289 - RNA, 24 nt, Human
aaugguacagcaguuacaagagga

SEQ ID NO: 23290 - RNA, 24 nt, Human
gcccuuguggauacuuggaacugu

SEQ ID NO: 23291 - RNA, 24 nt, Human
ucaguguaaaucuuuaugauagau

SEQ ID NO: 23292 - RNA, 24 nt, Human
ucaggccagcguccuccuccacag

SEQ ID NO: 23293 - RNA, 24 nt, Human
uuucacacugaggacuaaucugcu

SEQ ID NO: 23294 - RNA, 24 nt, Human
uauaauguggauuguggcccugug

SEQ ID NO: 23295 - RNA, 20 nt, Human
ugaauggagacuaacgccca

SEQ ID NO: 23296 - RNA, 24 nt, Human
aaggugcccuuaaauguguugaau

SEQ ID NO: 23297 - RNA, 24 nt, Human
ugaauguuuauguguaauggcuaa

SEQ ID NO: 23298 - RNA, 24 nt, Human
uuagucacaugagccucuuggggu

SEQ ID NO: 23299 - RNA, 24 nt, Human
agugcaaagcgagacucugucuca

SEQ ID NO: 23300 - RNA, 24 nt, Human
ucucaucgcugcucaguacagcgg

SEQ ID NO: 23301 - RNA, 24 nt, Human
ccuggcacggcgguuccugggggg

SEQ ID NO: 23302 - RNA, 21 nt, Human
ugggaggggcugaauguggug

SEQ ID NO: 23303 - RNA, 24 nt, Human
aagcguuuugagcagaaaggauuc

SEQ ID NO: 23304 - RNA, 24 nt, Human
agcugguggugauugcacaaccga

SEQ ID NO: 23305 - RNA, 24 nt, Human
acaaagcaagagaagaagcagaga

SEQ ID NO: 23306 - RNA, 21 nt, Human
cauuggacaggacauccagcc

SEQ ID NO: 23307 - RNA, 24 nt, Human
uucaucuuauuaccacuuagcagc

SEQ ID NO: 23308 - RNA, 24 nt, Human
gggaauggccugcggugucgacag

SEQ ID NO: 23309 - RNA, 24 nt, Human
ucccuuagaaacuugggccaaacc

SEQ ID NO: 23310 - RNA, 24 nt, Human
aaguguccggcuccugggucucac

SEQ ID NO: 23311 - RNA, 24 nt, Human
uauaacaguauaguaaguuuuaga

SEQ ID NO: 23312 - RNA, 24 nt, Human
ucugugacuuccuuggagacucac

SEQ ID NO: 23313 - RNA, 24 nt, Human
ugcaaaaccagcguggcggccgcg

SEQ ID NO: 23314 - RNA, 24 nt, Human
acgccaugaaagcugccuuggccc

SEQ ID NO: 23315 - RNA, 24 nt, Human
cagcauuggugaaaccccgucucu

SEQ ID NO: 23316 - RNA, 24 nt, Human
uuuuguuuguuuguuuuaacuuuu

SEQ ID NO: 23317 - RNA, 24 nt, Human
aaaggaacuguuaaacugaaaaag

SEQ ID NO: 23318 - RNA, 24 nt, Human
agguucccccacguuccccccacc

SEQ ID NO: 23319 - RNA, 24 nt, Human
ccugggguuuccaccuccugccuc

SEQ ID NO: 23320 - RNA, 24 nt, Human
uugacgugccaucgaggacugcug

SEQ ID NO: 23321 - RNA, 20 nt, Human
aaggauggauggauggaugg

SEQ ID NO: 23322 - RNA, 24 nt, Human
ugagcaacgccccgcccuuuguug

SEQ ID NO: 23323 - RNA, 24 nt, Human
uaccucuaaaagccaaggagcagc

SEQ ID NO: 23324 - RNA, 19 nt, Human
ugggaugggugcacaacuc

SEQ ID NO: 23325 - RNA, 24 nt, Human
ugggugguauucugauugggaagg

SEQ ID NO: 23326 - RNA, 24 nt, Human
uauggcaagucacuuugacagaca

SEQ ID NO: 23327 - RNA, 24 nt, Human
ugagaauggcaaaauuagucgccu

SEQ ID NO: 23328 - RNA, 24 nt, Human
uacaccacucccaagaagaauaag

SEQ ID NO: 23329 - RNA, 24 nt, Human
uggcaccauggaugccuucgugaa

SEQ ID NO: 23330 - RNA, 24 nt, Human
ugagcuggugaagagcuggcucaa

SEQ ID NO: 23331 - RNA, 24 nt, Human
uggcucaggguggcuggcgcucac

SEQ ID NO: 23332 - RNA, 24 nt, Human
cuggagccucuguaccugugccca

SEQ ID NO: 23333 - RNA, 24 nt, Human
uuuauuuuucuuacacuuuuaagg

SEQ ID NO: 23334 - RNA, 24 nt, Human
uucauuggcaguauuuugugauga

SEQ ID NO: 23335 - RNA, 22 nt, Human
ucagaacauucugaacugcuga

SEQ ID NO: 23336 - RNA, 24 nt, Human
uuuguagucauuuuaaguagcaug

SEQ ID NO: 23337 - RNA, 24 nt, Human
gggcagucuugcuuuauucauccu

SEQ ID NO: 23338 - RNA, 24 nt, Human
uucaaguuaaucuagaaauuuauu

SEQ ID NO: 23339 - RNA, 24 nt, Human
uauggcaagucacuuugacagaca

SEQ ID NO: 23340 - RNA, 24 nt, Human
uugggggccggggggcccugaugg

SEQ ID NO: 23341 - RNA, 24 nt, Human
uacaccacucccaagaagaauaag

SEQ ID NO: 23342 - RNA, 24 nt, Human
ccagauccagagaaagcgcggaag

SEQ ID NO: 23343 - RNA, 24 nt, Human
uaagucacagcugaaaauaaaaag

SEQ ID NO: 23344 - RNA, 24 nt, Human
ugccuguagucccagcuacucagg

SEQ ID NO: 23345 - RNA, 24 nt, Human
gcucgaaucuuauaaugagauacc

SEQ ID NO: 23346 - RNA, 22 nt, Human
uuagaccgugcaauuauuaagc

SEQ ID NO: 23347 - RNA, 24 nt, Human
uucacaaaacaaguguaguagguu

SEQ ID NO: 23348 - RNA, 24 nt, Human
aacugggagacacuauuuaucugu

SEQ ID NO: 23349 - RNA, 24 nt, Human
aaugucacugucaccaagacugac

SEQ ID NO: 23350 - RNA, 24 nt, Human
uucguaccaagagcaccggugggg

SEQ ID NO: 23351 - RNA, 21 nt, Human
uccccgggaaaacguucguca

SEQ ID NO: 23352 - RNA, 24 nt, Human
ucggugccccucccgcuccagcca

SEQ ID NO: 23353 - RNA, 24 nt, Human
ugucauugguggccaugcugggaa

SEQ ID NO: 23354 - RNA, 24 nt, Human
aggcaucgggcagccacuuucacu

SEQ ID NO: 23355 - RNA, 24 nt, Human
ugagagccaugugcaagaggacag

SEQ ID NO: 23356 - RNA, 24 nt, Human
ugaacaaagagcuggagaucugcc

SEQ ID NO: 23357 - RNA, 24 nt, Human
augcagccuaaaaggugguugaaa

SEQ ID NO: 23358 - RNA, 24 nt, Human
aagaauccgucgcuaugauuucuc

SEQ ID NO: 23359 - RNA, 24 nt, Human
uaaaugauucacuccuuagcucca

SEQ ID NO: 23360 - RNA, 24 nt, Human
uucgcagggacuuccaugcucaug

SEQ ID NO: 23361 - RNA, 24 nt, Human
cuuccuggaguugauggaauaaag

SEQ ID NO: 23362 - RNA, 24 nt, Human
uccgugcugcgugcccagaguagu

SEQ ID NO: 23363 - RNA, 24 nt, Human
ggagaugaggauacaugugugaug

SEQ ID NO: 23364 - RNA, 17 nt, Human
uccaaggucaggugccc

SEQ ID NO: 23365 - RNA, 24 nt, Human
gaucaccugaggucaggaguuuga

SEQ ID NO: 23366 - RNA, 24 nt, Human
aggcagagugcccugaucuucccu

SEQ ID NO: 23367 - RNA, 24 nt, Human
cugggcccagauggccccuucuga

SEQ ID NO: 23368 - RNA, 24 nt, Human
ucugaacucgggccguuaaauaua

SEQ ID NO: 23369 - RNA, 24 nt, Human
uugguucuggaauauaggaggugc

SEQ ID NO: 23370 - RNA, 24 nt, Human
uuuaagaaaacuguaaaagccaag

SEQ ID NO: 23371 - RNA, 24 nt, Human
ccaguggccugucucucccagcgg

SEQ ID NO: 23372 - RNA, 24 nt, Human
uuacaaagaccacuaggaagaggu

SEQ ID NO: 23373 - RNA, 24 nt, Human
cgucauugucucugucauacgugc

SEQ ID NO: 23374 - RNA, 24 nt, Human
ugcugugggaagaagggccugauc

SEQ ID NO: 23375 - RNA, 24 nt, Human
acgcugcggggcgggcggacagac

SEQ ID NO: 23376 - RNA, 24 nt, Human
gggcauuggccuagcuaucucccu

SEQ ID NO: 23377 - RNA, 24 nt, Human
uuugcacacuuucauuggugucuu

SEQ ID NO: 23378 - RNA, 20 nt, Human
aacacggugaaaccccgucu

SEQ ID NO: 23379 - RNA, 20 nt, Human
uuuguaguucugaauacaca

SEQ ID NO: 23380 - RNA, 21 nt, Human
uucaagggauggaaagucacc

SEQ ID NO: 23381 - RNA, 24 nt, Human
gggcgccccaggcaccagggcgug

SEQ ID NO: 23382 - RNA, 24 nt, Human
agcccgugagugugccccagacac

SEQ ID NO: 23383 - RNA, 24 nt, Human
caccagaaagacagaaguuaaucc

SEQ ID NO: 23384 - RNA, 20 nt, Human
ugacuucaagcaauccccca

SEQ ID NO: 23385 - RNA, 24 nt, Human
aauuacauuuauguucuugggagc

SEQ ID NO: 23386 - RNA, 24 nt, Human
gcucaaggagaagaagcuggugaa

SEQ ID NO: 23387 - RNA, 24 nt, Human
uggcaccauggaugccuucgugaa

SEQ ID NO: 23388 - RNA, 24 nt, Human
cuggagccucuguaccugugccca

SEQ ID NO: 23389 - RNA, 24 nt, Human
uuccuacuaagucaaguuucaauu

SEQ ID NO: 23390 - RNA, 24 nt, Human
cauuucaggauaaauggucucugg

SEQ ID NO: 23391 - RNA, 24 nt, Human
uuuaugaagaaaaggugauugucc

SEQ ID NO: 23392 - RNA, 24 nt, Human
uuuuugguccugauaagaagcuga

SEQ ID NO: 23393 - RNA, 24 nt, Human
uuuucagucgccuuggcagaaaua

SEQ ID NO: 23394 - RNA, 24 nt, Human
aguguuuaguguugggauauaagu

SEQ ID NO: 23395 - RNA, 24 nt, Human
uuaguggucuuuuuaauguuuucu

SEQ ID NO: 23396 - RNA, 24 nt, Human
aaggcauuuucggcuucacugaca

SEQ ID NO: 23397 - RNA, 24 nt, Human
uggcuccaggauguauuuaacgug

SEQ ID NO: 23398 - RNA, 24 nt, Human
aucaucuuuccucaccgacagggc

SEQ ID NO: 23399 - RNA, 24 nt, Human
ucaggagagacagucgacaaucag

SEQ ID NO: 23400 - RNA, 17 nt, Human
uagcuccaaagaugcca

SEQ ID NO: 23401 - RNA, 24 nt, Human
uaucccagaggcauccuuccugga

SEQ ID NO: 23402 - RNA, 24 nt, Human
cuuguccccuguguucgugcuggu

SEQ ID NO: 23403 - RNA, 24 nt, Human
acucuguucuuccgccgcuccgcc

SEQ ID NO: 23404 - RNA, 24 nt, Human
ccuacauuucucggugcuacugau

SEQ ID NO: 23405 - RNA, 24 nt, Human
ugagacagagagccaagcuaaugu

SEQ ID NO: 23406 - RNA, 24 nt, Human
ucauugaugccccuuguaauguuu

SEQ ID NO: 23407 - RNA, 24 nt, Human
ucuuucaucauuaaacauccuucu

SEQ ID NO: 23408 - RNA, 24 nt, Human
uagccuuuaaguggaugguuucuc

SEQ ID NO: 23409 - RNA, 24 nt, Human
cauuugggguguuuaaacaauaac

SEQ ID NO: 23410 - RNA, 24 nt, Human
aaggugaccguaaggagucccuug

SEQ ID NO: 23411 - RNA, 24 nt, Human
caacggggaacgcacgcugauggu

SEQ ID NO: 23412 - RNA, 24 nt, Human
ugacgcgacgggaugccagcaaga

SEQ ID NO: 23413 - RNA, 24 nt, Human
ucaacauagggaggggauuugcuc

SEQ ID NO: 23414 - RNA, 24 nt, Human
uucagcaucuuuucaaguucuguc

SEQ ID NO: 23415 - RNA, 24 nt, Human
aacccuuuggggggggccuggguc

SEQ ID NO: 23416 - RNA, 24 nt, Human
caagugccuccgugaggagauuca

SEQ ID NO: 23417 - RNA, 24 nt, Human
ucaggauauagauuugccaccacu

SEQ ID NO: 23418 - RNA, 24 nt, Human
ugaggugccuguaucauuggcaca

SEQ ID NO: 23419 - RNA, 17 nt, Human
ugagguagaauuuacaa

SEQ ID NO: 23420 - RNA, 24 nt, Human
uucacauauugaagaagaucaaag

SEQ ID NO: 23421 - RNA, 24 nt, Human
ccacaggguaucugcacuuuucuu

SEQ ID NO: 23422 - RNA, 22 nt, Human
uccacuggguuggaaaccccaa

SEQ ID NO: 23423 - RNA, 21 nt, Human
uuggauauugggagacuuggc

SEQ ID NO: 23424 - RNA, 24 nt, Human
ugaggucucaacaugggugaugug

SEQ ID NO: 23425 - RNA, 24 nt, Human
aggaaacggcaaaugguguuuuaa

SEQ ID NO: 23426 - RNA, 24 nt, Human
aggcaggagguggaaaccccaggg

SEQ ID NO: 23427 - RNA, 24 nt, Human
aaacugguuuuauuuuaauuuuua

SEQ ID NO: 23428 - RNA, 21 nt, Human
ugccgcugcucugcgccgggg

SEQ ID NO: 23429 - RNA, 24 nt, Human
uauggcccugaggugaggggcagg

SEQ ID NO: 23430 - RNA, 24 nt, Human
uggccagaaacuuugguuuguguu

SEQ ID NO: 23431 - RNA, 24 nt, Human
aacgcguaaacgcggcccacuuua

SEQ ID NO: 23432 - RNA, 22 nt, Human
cacccccccucuuggucaccac

SEQ ID NO: 23433 - RNA, 24 nt, Human
gcgcagcuucaggguccgcaaggg

SEQ ID NO: 23434 - RNA, 19 nt, Human
ucugaccggcuucaagcuc

SEQ ID NO: 23435 - RNA, 24 nt, Human
ugaccaagaucuauugcacgauac

SEQ ID NO: 23436 - RNA, 23 nt, Human
uauguucccaccaguacccgaau

SEQ ID NO: 23437 - RNA, 24 nt, Human
cucuccacauuuugcuuaccgugc

SEQ ID NO: 23438 - RNA, 24 nt, Human
ugauuguuuugacaaguuuuuauu

SEQ ID NO: 23439 - RNA, 24 nt, Human
uauggcaagucacuuugacagaca

SEQ ID NO: 23440 - RNA, 24 nt, Human
ugucagcaggcugaccaaagagug

SEQ ID NO: 23441 - RNA, 24 nt, Human
guccuugucuuguuuaucuauuac

SEQ ID NO: 23442 - RNA, 24 nt, Human
uaccucaaaaaaaaaacaaacaca

SEQ ID NO: 23443 - RNA, 24 nt, Human
uaaaaggaacuaugucuggaaggc

SEQ ID NO: 23444 - RNA, 24 nt, Human
ugccuugcccccagacccaccagc

SEQ ID NO: 23445 - RNA, 24 nt, Human
uuuccggcgccgacucugaggccc

SEQ ID NO: 23446 - RNA, 24 nt, Human
ucucacuccacacggugccccgac

SEQ ID NO: 23447 - RNA, 19 nt, Human
ccccggaggaagcuugggg

SEQ ID NO: 23448 - RNA, 24 nt, Human
ucucgcucgggggucccgcgugcc

SEQ ID NO: 23449 - RNA, 20 nt, Human
uggcagagccagaccgacuc

SEQ ID NO: 23450 - RNA, 24 nt, Human
ugaccuuggaagggguggcccggu

SEQ ID NO: 23451 - RNA, 24 nt, Human
accaacuguggacuuggaauauca

SEQ ID NO: 23452 - RNA, 24 nt, Human
augaugcugagggaccuagugaaa

SEQ ID NO: 23453 - RNA, 24 nt, Human
aguuuggauucugaaaacuaacug

SEQ ID NO: 23454 - RNA, 24 nt, Human
uugcauccucaaucacccaggccu

SEQ ID NO: 23455 - RNA, 24 nt, Human
ucggguggugacuccagcgcagga

SEQ ID NO: 23456 - RNA, 24 nt, Human
uguccuugggaaaugggugaaauu

SEQ ID NO: 23457 - RNA, 24 nt, Human
ucccuggagggacuaggaugcugg

SEQ ID NO: 23458 - RNA, 24 nt, Human
ucucggagggccacuaaccggggu

SEQ ID NO: 23459 - RNA, 22 nt, Human
auggaaguugguucaauugugc

SEQ ID NO: 23460 - RNA, 24 nt, Human
aaauaugguaaguauaaacuucau

SEQ ID NO: 23461 - RNA, 24 nt, Human
gggcgcuggccucacggacgcugg

SEQ ID NO: 23462 - RNA, 24 nt, Human
uaugaacuggccacuuuucagaug

SEQ ID NO: 23463 - RNA, 24 nt, Human
uggaaucuugcggcauccacgaga

SEQ ID NO: 23464 - RNA, 20 nt, Human
uaauuuggggcaagagagua

SEQ ID NO: 23465 - RNA, 24 nt, Human
auacugcgcagggcagggguaggg

SEQ ID NO: 23466 - RNA, 24 nt, Human
ucaggccccugccgcccuacacga

SEQ ID NO: 23467 - RNA, 24 nt, Human
uaagaguaaacccacccaauaugg

SEQ ID NO: 23468 - RNA, 24 nt, Human
ucaaugguaaaaaaaaaaaaaaau

SEQ ID NO: 23469 - RNA, 24 nt, Human
uggcaagaaaagcuggcaacuucu

SEQ ID NO: 23470 - RNA, 24 nt, Human
ugggacugcugauaggaagauguc

SEQ ID NO: 23471 - RNA, 24 nt, Human
ucauucugaugauggauguuugag

SEQ ID NO: 23472 - RNA, 24 nt, Human
uaacaguaguuugcucauuuucau

SEQ ID NO: 23473 - RNA, 24 nt, Human
auagaacagauuaauauagagauu

SEQ ID NO: 23474 - RNA, 24 nt, Human
gcucaacagaugcuaagauuuuuc

SEQ ID NO: 23475 - RNA, 24 nt, Human
cuagugguggaagagaauggcugg

SEQ ID NO: 23476 - RNA, 24 nt, Human
uaacugacaacuguuuucaacucc

SEQ ID NO: 23477 - RNA, 24 nt, Human
ucagugaguggcucuugugccugc

SEQ ID NO: 23478 - RNA, 24 nt, Human
uuucucagaaugaugaugguucca

SEQ ID NO: 23479 - RNA, 24 nt, Human
aaggagccccaaagagaagggacg

SEQ ID NO: 23480 - RNA, 24 nt, Human
ugaaaaguuggaagauuuugcauc

SEQ ID NO: 23481 - RNA, 24 nt, Human
gcuauauuuuuuuuuaauuuuuag

SEQ ID NO: 23482 - RNA, 24 nt, Human
gugguccauuccuuuaauguccuu

SEQ ID NO: 23483 - RNA, 24 nt, Human
ugcuuuggugcucugcccaggagc

SEQ ID NO: 23484 - RNA, 24 nt, Human
ugacugcaaggaggaguucuggag

SEQ ID NO: 23485 - RNA, 24 nt, Human
uaggcgaaacccggcuggauaaua

SEQ ID NO: 23486 - RNA, 24 nt, Human
uaaggcaaaaaaaugguguugaac

SEQ ID NO: 23487 - RNA, 24 nt, Human
uuuaugcauuccccuuaauugugu

SEQ ID NO: 23488 - RNA, 24 nt, Human
cacuaagugcucaauaaauucuga

SEQ ID NO: 23489 - RNA, 24 nt, Human
ugacaguuuaacaagccuuaggaa

SEQ ID NO: 23490 - RNA, 24 nt, Human
uuguauggguuuagaugguaacau

SEQ ID NO: 23491 - RNA, 24 nt, Human
ccgcagcuucagcaccucggccca

SEQ ID NO: 23492 - RNA, 24 nt, Human
gcgcaaacuccucaacaacacucu

SEQ ID NO: 23493 - RNA, 24 nt, Human
aauggugucuuggaggcaaacuac

SEQ ID NO: 23494 - RNA, 24 nt, Human
uaaaaugcaauaugucuguuaguu

SEQ ID NO: 23495 - RNA, 24 nt, Human
aggaagcuaaggcugcguuggggu

SEQ ID NO: 23496 - RNA, 24 nt, Human
uuuuuugaaaagcuaaaugcuuaa

SEQ ID NO: 23497 - RNA, 24 nt, Human
ugagaaaaaauauauaaauucuaa

SEQ ID NO: 23498 - RNA, 19 nt, Human
uguugcccgaguuagucca

SEQ ID NO: 23499 - RNA, 21 nt, Human
uucaagggauggaaagucacc

SEQ ID NO: 23500 - RNA, 24 nt, Human
cccccuuuuuuuuuugccgacccc

SEQ ID NO: 23501 - RNA, 24 nt, Human
cgcccggggguacccagaggcggg

SEQ ID NO: 23502 - RNA, 24 nt, Human
uggguugguuuaaaaaaaaaaaaa

SEQ ID NO: 23503 - RNA, 24 nt, Human
ugcucagugaccuccaggagucug

SEQ ID NO: 23504 - RNA, 21 nt, Human
uaucccagcgacuaugauaug

SEQ ID NO: 23505 - RNA, 24 nt, Human
augaugcugucuuccugauuuuau

SEQ ID NO: 23506 - RNA, 17 nt, Human
ugugaggggguuccggg

SEQ ID NO: 23507 - RNA, 24 nt, Human
uaacugacaacuguuuucaacucc

SEQ ID NO: 23508 - RNA, 23 nt, Human
uuagaaauaaaaucuguuuucuu

SEQ ID NO: 23509 - RNA, 24 nt, Human
uugaucuugaagaaacugggcgug

SEQ ID NO: 23510 - RNA, 24 nt, Human
aggaaggagauauagugaagagga

SEQ ID NO: 23511 - RNA, 24 nt, Human
uagcuuuggugcccauuggcccgu

SEQ ID NO: 23512 - RNA, 24 nt, Human
guagaguuuucuucaggcuuaaag

SEQ ID NO: 23513 - RNA, 24 nt, Human
uagaauaaauauccuauuuaaagc

SEQ ID NO: 23514 - RNA, 24 nt, Human
uuaguauuauuuauuugacaacuc

SEQ ID NO: 23515 - RNA, 24 nt, Human
ucaagaaugaggaccuggagaaga

SEQ ID NO: 23516 - RNA, 24 nt, Human
aggcggcagaaugcagccagagga

SEQ ID NO: 23517 - RNA, 24 nt, Human
gaccgcagccgcugggauuugggg

SEQ ID NO: 23518 - RNA, 24 nt, Human
uacaaaguuccagaugcaacaugg

SEQ ID NO: 23519 - RNA, 24 nt, Human
cacccaucaacaugguuuuucacu

SEQ ID NO: 23520 - RNA, 24 nt, Human
uauaaaguacaacuugcuuuuagc

SEQ ID NO: 23521 - RNA, 23 nt, Human
uaugccacauagugugucaggag

SEQ ID NO: 23522 - RNA, 24 nt, Human
uaucacauuugguauuuagaaacu

SEQ ID NO: 23523 - RNA, 24 nt, Human
ugccucugucuuagaaaccuggag

SEQ ID NO: 23524 - RNA, 24 nt, Human
uaccauggaaacugagugaauggu

SEQ ID NO: 23525 - RNA, 24 nt, Human
uaccuguacagaauggauuacaua

SEQ ID NO: 23526 - RNA, 24 nt, Human
ggccauggaaauuaguacagaacc

SEQ ID NO: 23527 - RNA, 24 nt, Human
ucuuggauugauagcaacaaaggc

SEQ ID NO: 23528 - RNA, 24 nt, Human
gugaaguauuuuguuaccucaguc

SEQ ID NO: 23529 - RNA, 24 nt, Human
uauuauguggugaaauuuuguaaa

SEQ ID NO: 23530 - RNA, 24 nt, Human
ucauuuguaauuuaggggacuuac

SEQ ID NO: 23531 - RNA, 23 nt, Human
uguggugccuaucuccuguccag

SEQ ID NO: 23532 - RNA, 24 nt, Human
uccgcaaguggacaguuaaaggcc

SEQ ID NO: 23533 - RNA, 24 nt, Human
acccagcuggaagggacggauucc

SEQ ID NO: 23534 - RNA, 24 nt, Human
uauuucacuggcccaggugggggg

SEQ ID NO: 23535 - RNA, 24 nt, Human
ucccagggucaccagcaugaaugc

SEQ ID NO: 23536 - RNA, 24 nt, Human
uaccuccuucaccccagaauauuu

SEQ ID NO: 23537 - RNA, 24 nt, Human
ugaaaagcaguucucugaggagcg

SEQ ID NO: 23538 - RNA, 24 nt, Human
aggaggcucaccagcucuucuugg

SEQ ID NO: 23539 - RNA, 24 nt, Human
uggccggaaccuccucagcucucc

SEQ ID NO: 23540 - RNA, 24 nt, Human
gcuuguauaauguaaccguuuggg

SEQ ID NO: 23541 - RNA, 24 nt, Human
ugucuagucuugaagucccucauu

SEQ ID NO: 23542 - RNA, 24 nt, Human
ugagcagugggagcugcagaccag

SEQ ID NO: 23543 - RNA, 24 nt, Human
ccucccuuaaaaacuugggccaaa

SEQ ID NO: 23544 - RNA, 24 nt, Human
ugaaaaggguccggcuccgggguc

SEQ ID NO: 23545 - RNA, 21 nt, Human
ccugcggggcagggggcuguc

SEQ ID NO: 23546 - RNA, 24 nt, Human
aauugggcguggccccgucuucag

SEQ ID NO: 23547 - RNA, 23 nt, Human
ugucacggcauccuuugagauaa

SEQ ID NO: 23548 - RNA, 24 nt, Human
uuccggagccccggcgcgggcggg

SEQ ID NO: 23549 - RNA, 24 nt, Human
cagcugccccagggugugcagguu

SEQ ID NO: 23550 - RNA, 24 nt, Human
aggcggugcgcugggggcgggagc

SEQ ID NO: 23551 - RNA, 24 nt, Human
ccacccagcccaagaggcccaugu

SEQ ID NO: 23552 - RNA, 22 nt, Human
gaggaggccaccucggucuucc

SEQ ID NO: 23553 - RNA, 24 nt, Human
uaaacugcagagauuaaaaguuuc

SEQ ID NO: 23554 - RNA, 24 nt, Human
gcuuuugucagauggagugccggu

SEQ ID NO: 23555 - RNA, 24 nt, Human
cauccaucuucccuggaagucucc

SEQ ID NO: 23556 - RNA, 24 nt, Human
gggcagcacucaagcgcaucuuag

SEQ ID NO: 23557 - RNA, 24 nt, Human
cccucggugacuuccagccggugg

SEQ ID NO: 23558 - RNA, 24 nt, Human
accguguuuugugguuagcuccgu

SEQ ID NO: 23559 - RNA, 24 nt, Human
caccggcaaaguaccgacaucgac

SEQ ID NO: 23560 - RNA, 24 nt, Human
caggagcccgcagcaaggagugug

SEQ ID NO: 23561 - RNA, 18 nt, Human
aggcuugcagacccgcug

SEQ ID NO: 23562 - RNA, 24 nt, Human
agggagcagcguugcgucucagag

SEQ ID NO: 23563 - RNA, 24 nt, Human
uauggcaagucacuuugacagaca

SEQ ID NO: 23564 - RNA, 24 nt, Human
ugagaauggcaaaauuagucgccu

SEQ ID NO: 23565 - RNA, 24 nt, Human
uacaccacucccaagaagaauaag

SEQ ID NO: 23566 - RNA, 24 nt, Human
uugaagauccugcgguaugggaug

SEQ ID NO: 23567 - RNA, 24 nt, Human
uggaagguggauuuccccuaucag

SEQ ID NO: 23568 - RNA, 24 nt, Human
aaccccuuucugcuguucucccau

SEQ ID NO: 23569 - RNA, 24 nt, Human
uacaccuaauggcuuauucccuac

SEQ ID NO: 23570 - RNA, 24 nt, Human
ggaaagcauccuugucuccuuagu

SEQ ID NO: 23571 - RNA, 23 nt, Human
cugcuguuuucuagcccugucca

SEQ ID NO: 23572 - RNA, 22 nt, Human
aaaguuccagauugcaacaugg

SEQ ID NO: 23573 - RNA, 24 nt, Human
uguggaauauguagauucacuuuu

SEQ ID NO: 23574 - RNA, 24 nt, Human
uaacuuggcacuauuuucugcaua

SEQ ID NO: 23575 - RNA, 24 nt, Human
agugcaguggcagugaucacagcu

SEQ ID NO: 23576 - RNA, 24 nt, Human
uugcuugagcccaggagguggagg

SEQ ID NO: 23577 - RNA, 24 nt, Human
ugcauuguuaucauuaaccagucu

SEQ ID NO: 23578 - RNA, 24 nt, Human
uaaugggucucaaaauucugugac

SEQ ID NO: 23579 - RNA, 24 nt, Human
uauuagggauaauauucauuuagc

SEQ ID NO: 23580 - RNA, 24 nt, Human
aagcgacccaaagguggauagucu

SEQ ID NO: 23581 - RNA, 24 nt, Human
uaucaugggaaaauaugucggggu

SEQ ID NO: 23582 - RNA, 24 nt, Human
ugacuagaguugaaaccaaaagaa

SEQ ID NO: 23583 - RNA, 24 nt, Human
ugugaagcacuuacugagugggaa

SEQ ID NO: 23584 - RNA, 20 nt, Human
ugccauaggccggggugcca

SEQ ID NO: 23585 - RNA, 24 nt, Human
ugugguuuuugugugaugaaaugu

SEQ ID NO: 23586 - RNA, 24 nt, Human
gagcacaaccugcuaguuuggaaa

SEQ ID NO: 23587 - RNA, 22 nt, Human
ucugauugucuguuugcugauu

SEQ ID NO: 23588 - RNA, 24 nt, Human
uuccugagugucauuuucuucucu

SEQ ID NO: 23589 - RNA, 24 nt, Human
uggcuuacaaaacauguguuucua

SEQ ID NO: 23590 - RNA, 24 nt, Human
ucaaaguucacuuguauuguaccc

SEQ ID NO: 23591 - RNA, 24 nt, Human
agagagugugauuugguugugaua

SEQ ID NO: 23592 - RNA, 24 nt, Human
uuucucagauuuuuaguaaaugca

SEQ ID NO: 23593 - RNA, 24 nt, Human
uuucuugguuguaugugaucaugu

SEQ ID NO: 23594 - RNA, 24 nt, Human
caggggacuuggaauacaauccuu

SEQ ID NO: 23595 - RNA, 24 nt, Human
acagcccggaacacuggcaucauc

SEQ ID NO: 23596 - RNA, 24 nt, Human
uaccaugcggagaccaucaagaau

SEQ ID NO: 23597 - RNA, 24 nt, Human
ugguaggcaccccgcccucucccg

SEQ ID NO: 23598 - RNA, 24 nt, Human
ugagcaguuauuggaggaagagag

SEQ ID NO: 23599 - RNA, 24 nt, Human
uaugacaucgucaucuuaaaggaa

SEQ ID NO: 23600 - RNA, 19 nt, Human
uccguuuucggggugggua

SEQ ID NO: 23601 - RNA, 24 nt, Human
aggaaaucuacagaagggaaucug

SEQ ID NO: 23602 - RNA, 24 nt, Human
ucaaugaaacaagaugccacacaa

SEQ ID NO: 23603 - RNA, 24 nt, Human
uuaaaacagcagcuuuagggauag

SEQ ID NO: 23604 - RNA, 24 nt, Human
agggauuaucuacaccuucacuuu

SEQ ID NO: 23605 - RNA, 24 nt, Human
uuggaacuggaaaaauggcauaaa

SEQ ID NO: 23606 - RNA, 24 nt, Human
uggaauuuguaaggaaacgagguu

SEQ ID NO: 23607 - RNA, 24 nt, Human
uuucuugugagucagauauuuuua

SEQ ID NO: 23608 - RNA, 24 nt, Human
gggaagguauuaaacaaaaagacc

SEQ ID NO: 23609 - RNA, 24 nt, Human
guugucccuucuuccucccccgcu

SEQ ID NO: 23610 - RNA, 24 nt, Human
uuugucauuaaacaauauagguau

SEQ ID NO: 23611 - RNA, 24 nt, Human
ugacuaaaaacuccuuggauuuau

SEQ ID NO: 23612 - RNA, 24 nt, Human
uggaagacagcuacgggcagcagu

SEQ ID NO: 23613 - RNA, 24 nt, Human
ugaaugagcggcugaucagcaugg

SEQ ID NO: 23614 - RNA, 24 nt, Human
ucccuggcuuaugagcaggcugag

SEQ ID NO: 23615 - RNA, 24 nt, Human
ucugcaaguuugucgugaugcuga

SEQ ID NO: 23616 - RNA, 24 nt, Human
cagcaaccaaugaucccaccauuu

SEQ ID NO: 23617 - RNA, 24 nt, Human
acucugguuacugggcccgcgccg

SEQ ID NO: 23618 - RNA, 24 nt, Human
gagccgcacucuugaguccgaggc

SEQ ID NO: 23619 - RNA, 24 nt, Human
ggacagguguacagacauguucuu

SEQ ID NO: 23620 - RNA, 24 nt, Human
ucgaauggacacauuaccagugaa

SEQ ID NO: 23621 - RNA, 24 nt, Human
uggccugaugauccacagcggaga

SEQ ID NO: 23622 - RNA, 24 nt, Human
ugugugccauugcccaggcagagu

SEQ ID NO: 23623 - RNA, 24 nt, Human
uguguuaggaaugucaacagagca

SEQ ID NO: 23624 - RNA, 24 nt, Human
uuuguucguauuuagaaugggauc

SEQ ID NO: 23625 - RNA, 24 nt, Human
uagcuucuggccugagcuuggccu

SEQ ID NO: 23626 - RNA, 24 nt, Human
aacacguuggaaguguauccuccc

SEQ ID NO: 23627 - RNA, 24 nt, Human
uaacuggugcugccagcuuuauaa

SEQ ID NO: 23628 - RNA, 24 nt, Human
uggcugcagccaaggagcuggggg

SEQ ID NO: 23629 - RNA, 24 nt, Human
ggugaugggggcagccgggaggga

SEQ ID NO: 23630 - RNA, 21 nt, Human
uugcucagugacagagccuca

SEQ ID NO: 23631 - RNA, 20 nt, Human
ugagaugccauaagcugugg

SEQ ID NO: 23632 - RNA, 24 nt, Human
ucccuuagaaacuugggccaaacc

SEQ ID NO: 23633 - RNA, 24 nt, Human
aaguguccggcuccugggucucac

SEQ ID NO: 23634 - RNA, 24 nt, Human
uuccugaggggcuucuuaacuuuu

SEQ ID NO: 23635 - RNA, 17 nt, Human
ucuaguguccccccagc

SEQ ID NO: 23636 - RNA, 24 nt, Human
acccggguugucagcacccuccau

SEQ ID NO: 23637 - RNA, 24 nt, Human
gccccuggggaaucguggucuaua

SEQ ID NO: 23638 - RNA, 24 nt, Human
ucugcacgacgcacuggcccagga

SEQ ID NO: 23639 - RNA, 24 nt, Human
ugaaggacgagcgugugcccaaga

SEQ ID NO: 23640 - RNA, 24 nt, Human
ucugagguugccaucagccagggc

SEQ ID NO: 23641 - RNA, 20 nt, Human
uggguugaucuauaaacacu

SEQ ID NO: 23642 - RNA, 20 nt, Human
uuuggcauuuuuuggaccau

SEQ ID NO: 23643 - RNA, 24 nt, Human
uugaugaccuuggaugcuguaaag

SEQ ID NO: 23644 - RNA, 24 nt, Human
ucaguagagaguuggcgguggcgu

SEQ ID NO: 23645 - RNA, 24 nt, Human
cagaguguacuuagaaacaugaaa

SEQ ID NO: 23646 - RNA, 24 nt, Human
uaagauguguuuauuugguuuugg

SEQ ID NO: 23647 - RNA, 24 nt, Human
caucguggcugaggugcuggugcu

SEQ ID NO: 23648 - RNA, 24 nt, Human
agagcagcgggcagcaccagaaug

SEQ ID NO: 23649 - RNA, 24 nt, Human
uauaucguccauauguaauuauau

SEQ ID NO: 23650 - RNA, 24 nt, Human
uuacauaguuuuaaaacaugcaaa

SEQ ID NO: 23651 - RNA, 24 nt, Human
uucacagggugcuuggacuguacc

SEQ ID NO: 23652 - RNA, 24 nt, Human
uacuucaguuauggacagaaagaa

SEQ ID NO: 23653 - RNA, 24 nt, Human
ugagaauggcaaaauuagucgccu

SEQ ID NO: 23654 - RNA, 24 nt, Human
uacaccacucccaagaagaauaag

SEQ ID NO: 23655 - RNA, 24 nt, Human
uggccgaagagcagaagcgucggg

SEQ ID NO: 23656 - RNA, 24 nt, Human
ucuuuuuuuguaauuagaauacug

SEQ ID NO: 23657 - RNA, 24 nt, Human
acugaccuuuaggacaguagucua

SEQ ID NO: 23658 - RNA, 24 nt, Human
uccacacaaauaggcacacauaua

SEQ ID NO: 23659 - RNA, 18 nt, Human
uaugcaaggcacugcgca

SEQ ID NO: 23660 - RNA, 24 nt, Human
uaucguagggggcggcgcggcggg

SEQ ID NO: 23661 - RNA, 24 nt, Human
uuagauguuugucacuucaaucca

SEQ ID NO: 23662 - RNA, 24 nt, Human
ugagcaguguaugucaggacuugu

SEQ ID NO: 23663 - RNA, 24 nt, Human
uagagcuagugaauuagccuauuu

SEQ ID NO: 23664 - RNA, 24 nt, Human
ucuauggugguaggagaguacagg

SEQ ID NO: 23665 - RNA, 24 nt, Human
agaagcccaaaggaauugcacugu

SEQ ID NO: 23666 - RNA, 24 nt, Human
cagcaugcuggggagugcggucag

SEQ ID NO: 23667 - RNA, 24 nt, Human
cuggauuaccucucuuaaaaugac

SEQ ID NO: 23668 - RNA, 24 nt, Human
uggauaacuauuucuaauaugaaa

SEQ ID NO: 23669 - RNA, 24 nt, Human
ugaucucguuggacugcguggcua

SEQ ID NO: 23670 - RNA, 24 nt, Human
caggugguugcuuugaacuuuauu

SEQ ID NO: 23671 - RNA, 24 nt, Human
ucccguugguuuuacucuaucccu

SEQ ID NO: 23672 - RNA, 24 nt, Human
uaacucuagaaaucccugaaguuc

SEQ ID NO: 23673 - RNA, 24 nt, Human
cagcaugaacgugccuuauauccc

SEQ ID NO: 23674 - RNA, 24 nt, Human
uaagaaaaaagauucauucucugu

SEQ ID NO: 23675 - RNA, 24 nt, Human
uaguucagauugaucuuaggucaa

SEQ ID NO: 23676 - RNA, 24 nt, Human
uacaccacucccaagaagaauaag

SEQ ID NO: 23677 - RNA, 24 nt, Human
uaugacaggucaccguguguaaau

SEQ ID NO: 23678 - RNA, 24 nt, Human
ugaggugcgggugcgcgggccugg

SEQ ID NO: 23679 - RNA, 24 nt, Human
auuguucauuaaagaucuauaauc

SEQ ID NO: 23680 - RNA, 23 nt, Human
uguguacaugccggggcauuugc

SEQ ID NO: 23681 - RNA, 24 nt, Human
ugugcagaagaaauggaaggauuc

SEQ ID NO: 23682 - RNA, 24 nt, Human
uaucaaggaagggcaggcgugaug

SEQ ID NO: 23683 - RNA, 24 nt, Human
uucaaauuucuuucuuuuuuaauu

SEQ ID NO: 23684 - RNA, 24 nt, Human
ucaauuuuuauuuugguuuucuua

SEQ ID NO: 23685 - RNA, 24 nt, Human
uagcggccccgaacggcuaggcuc

SEQ ID NO: 23686 - RNA, 24 nt, Human
agguaggugaagcagagaaagaag

SEQ ID NO: 23687 - RNA, 24 nt, Human
ccuuacucccucuuuaagauugcg

SEQ ID NO: 23688 - RNA, 24 nt, Human
uuagagcuggcagcagcaucucag

SEQ ID NO: 23689 - RNA, 24 nt, Human
uguuuuggggggguugugcugggg

SEQ ID NO: 23690 - RNA, 24 nt, Human
ucgggccucgguggugccuggguc

SEQ ID NO: 23691 - RNA, 19 nt, Human
ccccaaggaguuccucuuu

SEQ ID NO: 23692 - RNA, 19 nt, Human
ugacuugguucguuagugg

SEQ ID NO: 23693 - RNA, 24 nt, Human
gugcauucuccuuguggauuuuug

SEQ ID NO: 23694 - RNA, 24 nt, Human
ugaugcaagccuuuuucaguucaa

SEQ ID NO: 23695 - RNA, 24 nt, Human
caggaucaggaggggagaagaagg

SEQ ID NO: 23696 - RNA, 24 nt, Human
uggggugugcugggagggucacca

SEQ ID NO: 23697 - RNA, 24 nt, Human
uccccagcaaccaggccuggccuc

SEQ ID NO: 23698 - RNA, 24 nt, Human
uacaggacaagggcagccccaccc

SEQ ID NO: 23699 - RNA, 24 nt, Human
acuuaaguucuuaagaaaggauaa

SEQ ID NO: 23700 - RNA, 24 nt, Human
aaagugccacuuugaaugguuguu

SEQ ID NO: 23701 - RNA, 24 nt, Human
ucagugagguaaaucggaaugcac

SEQ ID NO: 23702 - RNA, 24 nt, Human
uugaaugguacaguuugagaucuu

SEQ ID NO: 23703 - RNA, 20 nt, Human
uguccagaauuuccagaagu

SEQ ID NO: 23704 - RNA, 24 nt, Human
uguggcccuucucuuuaaguccga

SEQ ID NO: 23705 - RNA, 24 nt, Human
ugcuaggguguucaaaggucagug

SEQ ID NO: 23706 - RNA, 24 nt, Human
caucaguauuauccauauuuaaaa

SEQ ID NO: 23707 - RNA, 24 nt, Human
uaaagcgaccaacuugaacuuucu

SEQ ID NO: 23708 - RNA, 24 nt, Human
aggcaggagugaaaauugggucug

SEQ ID NO: 23709 - RNA, 24 nt, Human
cagcaggugauuucuuaaugcuuu

SEQ ID NO: 23710 - RNA, 24 nt, Human
uaauugcugugauuucguucaggu

SEQ ID NO: 23711 - RNA, 19 nt, Human
uccaccagaaaacuugauc

SEQ ID NO: 23712 - RNA, 24 nt, Human
agagguggacauggcgugcggcuu

SEQ ID NO: 23713 - RNA, 24 nt, Human
gugcauguccuucaugguagguga

SEQ ID NO: 23714 - RNA, 24 nt, Human
ugagggaaaagcuacaguggccac

SEQ ID NO: 23715 - RNA, 24 nt, Human
aagcucauccauuagcugcguccu

SEQ ID NO: 23716 - RNA, 22 nt, Human
uauguaguguuacuccggacgu

SEQ ID NO: 23717 - RNA, 24 nt, Human
ccgcagcuucagcaccucggccca

SEQ ID NO: 23718 - RNA, 24 nt, Human
uauguugguuuaauuaauaauaug

SEQ ID NO: 23719 - RNA, 24 nt, Human
ugguaguuggaaacaaaucauaau

SEQ ID NO: 23720 - RNA, 24 nt, Human
ugugcagucuugcuuacaaggagg

SEQ ID NO: 23721 - RNA, 24 nt, Human
uaguucagauugaucuuaggucaa

SEQ ID NO: 23722 - RNA, 24 nt, Human
ucggcgcugggucgccaaagcaga

SEQ ID NO: 23723 - RNA, 24 nt, Human
aucagauucuuggcuguuaaggaa

SEQ ID NO: 23724 - RNA, 24 nt, Human
aaauaggagcuaggagacaacaag

SEQ ID NO: 23725 - RNA, 23 nt, Human
guagcaguccacaauggaauaga

SEQ ID NO: 23726 - RNA, 20 nt, Human
ccugcagcacguggggcugu

SEQ ID NO: 23727 - RNA, 24 nt, Human
cuuacagcccugcaggcccagccg

SEQ ID NO: 23728 - RNA, 17 nt, Human
ccccuggggcauacuac

SEQ ID NO: 23729 - RNA, 24 nt, Human
uauuagggagugagggagcacaaa

SEQ ID NO: 23730 - RNA, 24 nt, Human
acuccacuccacuuggcugugauc

SEQ ID NO: 23731 - RNA, 24 nt, Human
uuaggcucuuauuccuggcuaccu

SEQ ID NO: 23732 - RNA, 24 nt, Human
acucguuccugcacuuggccauca

SEQ ID NO: 23733 - RNA, 24 nt, Human
uaccugaucaaguuuauugcagcc

SEQ ID NO: 23734 - RNA, 24 nt, Human
uuaauaaaccgcuaauccgaaaau

SEQ ID NO: 23735 - RNA, 24 nt, Human
uaguucauagaaaacuugaggauc

SEQ ID NO: 23736 - RNA, 24 nt, Human
gggcauccauauagucacuccagg

SEQ ID NO: 23737 - RNA, 24 nt, Human
gggcauucaggauagucagagaaa

SEQ ID NO: 23738 - RNA, 19 nt, Human
aggaagacgggaggauucu

SEQ ID NO: 23739 - RNA, 24 nt, Human
ugaggcaauacuccaacaggguga

SEQ ID NO: 23740 - RNA, 21 nt, Human
aagcuggucuccacacagugc

SEQ ID NO: 23741 - RNA, 24 nt, Human
cgagcaucauccucuccuggcuga

SEQ ID NO: 23742 - RNA, 24 nt, Human
ucagugcagcagcagcuucaucca

SEQ ID NO: 23743 - RNA, 24 nt, Human
aacagcauuaacauccccaucuga

SEQ ID NO: 23744 - RNA, 24 nt, Human
uaauaaguggaagaauuuguuaag

SEQ ID NO: 23745 - RNA, 24 nt, Human
ucucacucuguugccuaggcucgg

SEQ ID NO: 23746 - RNA, 24 nt, Human
caugacaugugaaaaucugacuca

SEQ ID NO: 23747 - RNA, 24 nt, Human
gacacuuuauacuaguuacuuagg

SEQ ID NO: 23748 - RNA, 24 nt, Human
uaauaaggccccugauauucauau

SEQ ID NO: 23749 - RNA, 19 nt, Human
uaguucuccugcccagccu

SEQ ID NO: 23750 - RNA, 24 nt, Human
uacuuuauaagcaaaguuuaaaca

SEQ ID NO: 23751 - RNA, 24 nt, Human
ugucugaauaaaggauacaaggau

SEQ ID NO: 23752 - RNA, 24 nt, Human
uaaaauccacaucaauagcacacg

SEQ ID NO: 23753 - RNA, 24 nt, Human
uuuucauuacuuccauacaaagca

SEQ ID NO: 23754 - RNA, 24 nt, Human
gggcauccuucaucuggacaaggg

SEQ ID NO: 23755 - RNA, 23 nt, Human
uucacauuugaguguccuggaca

SEQ ID NO: 23756 - RNA, 24 nt, Human
uguguacguauguauauacacaua

SEQ ID NO: 23757 - RNA, 24 nt, Human
uauaguaugaaucuaccauuaugu

SEQ ID NO: 23758 - RNA, 24 nt, Human
ugccguggcggcggcugcccuccu

SEQ ID NO: 23759 - RNA, 24 nt, Human
gcguagcuuuccugugguuuucca

SEQ ID NO: 23760 - RNA, 24 nt, Human
uggcgccgcuuuuuagcuuggacu

SEQ ID NO: 23761 - RNA, 24 nt, Human
ucuucauuagcuuggaguggcgca

SEQ ID NO: 23762 - RNA, 24 nt, Human
uaagugccuuuguucacuuggcau

SEQ ID NO: 23763 - RNA, 24 nt, Human
uacaguuuuuuuauccuuuuagau

SEQ ID NO: 23764 - RNA, 24 nt, Human
ggaugagacguuugcuguccugag

SEQ ID NO: 23765 - RNA, 24 nt, Human
uggcaagggucccuccauuaagca

SEQ ID NO: 23766 - RNA, 24 nt, Human
gcacauggugggucccgauuggcg

SEQ ID NO: 23767 - RNA, 24 nt, Human
cauuuuguauauacugggacagcg

SEQ ID NO: 23768 - RNA, 24 nt, Human
accugguggugaggcucuccauga

SEQ ID NO: 23769 - RNA, 24 nt, Human
gaacuucggauuuuuucuaacugg

SEQ ID NO: 23770 - RNA, 24 nt, Human
uacaccacucccaagaagaauaag

SEQ ID NO: 23771 - RNA, 24 nt, Human
ucuagcuucaucaggcauauuuua

SEQ ID NO: 23772 - RNA, 23 nt, Human
uaaggcgaggcggaauuaaaccc

SEQ ID NO: 23773 - RNA, 24 nt, Human
uaaaggaccugagauccgaacugg

SEQ ID NO: 23774 - RNA, 24 nt, Human
ugcaaaaccagcguggcggccgcg

SEQ ID NO: 23775 - RNA, 24 nt, Human
ugucacaccuuugcuuauggccug

SEQ ID NO: 23776 - RNA, 24 nt, Human
cuuggccucuucuuuccggcagga

SEQ ID NO: 23777 - RNA, 24 nt, Human
cucacgggacagaaccacaugcua

SEQ ID NO: 23778 - RNA, 20 nt, Human
aaccccaugacucgccccuc

SEQ ID NO: 23779 - RNA, 24 nt, Human
cucacuguaaccucugccucccgg

SEQ ID NO: 23780 - RNA, 24 nt, Human
uaagaguaguuaucuuuauacagu

SEQ ID NO: 23781 - RNA, 24 nt, Human
uaaauaauccuggcauuauaggga

SEQ ID NO: 23782 - RNA, 24 nt, Human
uagugcaugucuuggugugcuuuu

SEQ ID NO: 23783 - RNA, 24 nt, Human
uucauuuuuuuaauggaaagaaaa

SEQ ID NO: 23784 - RNA, 24 nt, Human
gcgcguggugcggcccgacucgga

SEQ ID NO: 23785 - RNA, 24 nt, Human
gaggacuccaagaacuucgacgag

SEQ ID NO: 23786 - RNA, 24 nt, Human
ugagcaguguaugucaggacuugu

SEQ ID NO: 23787 - RNA, 24 nt, Human
uagagcuagugaauuagccuauuu

SEQ ID NO: 23788 - RNA, 24 nt, Human
aagaacuacaggucagaaauggaa

SEQ ID NO: 23789 - RNA, 20 nt, Human
uauguagggcaucacuuuau

SEQ ID NO: 23790 - RNA, 24 nt, Human
cgccucggccgcccuggacgagcu

SEQ ID NO: 23791 - RNA, 24 nt, Human
ccaggccaaaaaggcucaacauuu

SEQ ID NO: 23792 - RNA, 24 nt, Human
uggcaccauggaugccuucgugaa

SEQ ID NO: 23793 - RNA, 24 nt, Human
uggcucaggguggcuggcgcucac

SEQ ID NO: 23794 - RNA, 24 nt, Human
cuggagccucuguaccugugccca

SEQ ID NO: 23795 - RNA, 24 nt, Human
uaucuaacucaugauuacaaaacu

SEQ ID NO: 23796 - RNA, 24 nt, Human
uugcuguacagauuuuaaaaaacc

SEQ ID NO: 23797 - RNA, 24 nt, Human
uacaucaaaaucaagucccuggcu

SEQ ID NO: 23798 - RNA, 24 nt, Human
uacagcacaauauuucaauggaau

SEQ ID NO: 23799 - RNA, 24 nt, Human
cuggauuugacauccagugggguu

SEQ ID NO: 23800 - RNA, 20 nt, Human
ugcuggggccgugucgaugu

SEQ ID NO: 23801 - RNA, 23 nt, Human
ugagcccagugcugaaggggcuu

SEQ ID NO: 23802 - RNA, 24 nt, Human
uauuccuuuuuucucacauuugag

SEQ ID NO: 23803 - RNA, 24 nt, Human
uuaaugaaaacuaauugaaaguac

SEQ ID NO: 23804 - RNA, 24 nt, Human
uaaggaacuuuuuacugggaacua

SEQ ID NO: 23805 - RNA, 24 nt, Human
caggggaggccggccacaaaugca

SEQ ID NO: 23806 - RNA, 24 nt, Human
acgaacaggggguaagcccaacgc

SEQ ID NO: 23807 - RNA, 24 nt, Human
agagaucagauuaaauauuucuuu

SEQ ID NO: 23808 - RNA, 24 nt, Human
uggaaaagugauguggguagccaa

SEQ ID NO: 23809 - RNA, 24 nt, Human
uuauaaaaaaugaaaguggaguuu

SEQ ID NO: 23810 - RNA, 24 nt, Human
uucuaugguaaugcucuuacggau

SEQ ID NO: 23811 - RNA, 17 nt, Human
uggcucaucugugugua

SEQ ID NO: 23812 - RNA, 24 nt, Human
agggaguggggacuugcaggaagc

SEQ ID NO: 23813 - RNA, 24 nt, Human
gauuguuucucuucacccccaaca

SEQ ID NO: 23814 - RNA, 24 nt, Human
uccacaaugguugaacuaguuuac

SEQ ID NO: 23815 - RNA, 24 nt, Human
aggaaggcuggcaccucuggcucu

SEQ ID NO: 23816 - RNA, 24 nt, Human
ugagaaaugcuaucaacaucugug

SEQ ID NO: 23817 - RNA, 24 nt, Human
gacacugggguugggaaaucaagc

SEQ ID NO: 23818 - RNA, 24 nt, Human
augcugcugagccccggcacugcc

SEQ ID NO: 23819 - RNA, 24 nt, Human
uuccucaucugggacacugcuggu

SEQ ID NO: 23820 - RNA, 24 nt, Human
gggacagauacuggcgauccuuaa

SEQ ID NO: 23821 - RNA, 24 nt, Human
uuccuuggugugggagugagggca

SEQ ID NO: 23822 - RNA, 24 nt, Human
ggccucuggagcuuccgcgccgac

SEQ ID NO: 23823 - RNA, 24 nt, Human
agugguaccggcggccgcuguggg

SEQ ID NO: 23824 - RNA, 24 nt, Human
augauuccaacuuaucagagaccu

SEQ ID NO: 23825 - RNA, 24 nt, Human
ugauaagacucaggaauucugaaa

SEQ ID NO: 23826 - RNA, 24 nt, Human
uagaauauaauuuggcauaugauu

SEQ ID NO: 23827 - RNA, 24 nt, Human
uauugugccugucaggauucuuga

SEQ ID NO: 23828 - RNA, 24 nt, Human
ucacugaugcauaaacuggucacc

SEQ ID NO: 23829 - RNA, 22 nt, Human
ugaagugucggcgugugccggg

SEQ ID NO: 23830 - RNA, 24 nt, Human
ucaccagugaccccagucagugcc

SEQ ID NO: 23831 - RNA, 18 nt, Human
ugaaucacuguuucaaga

SEQ ID NO: 23832 - RNA, 24 nt, Human
ucggaggaagugauaauuuuaagc

SEQ ID NO: 23833 - RNA, 24 nt, Human
ugcaaaaggugguacgaucgaagg

SEQ ID NO: 23834 - RNA, 24 nt, Human
uuagaggaggcggggguccccugg

SEQ ID NO: 23835 - RNA, 24 nt, Human
ucccugggcgcagggugcagggug

SEQ ID NO: 23836 - RNA, 24 nt, Human
agagggaauguucuggagcugcca

SEQ ID NO: 23837 - RNA, 24 nt, Human
cgggagcugaagcccguccuuagc

SEQ ID NO: 23838 - RNA, 24 nt, Human
ucuuaagugucaucuggcaucuuc

SEQ ID NO: 23839 - RNA, 24 nt, Human
ugauauccuuguuuuuaacuguug

SEQ ID NO: 23840 - RNA, 24 nt, Human
aagcauccucaagcucccaguuaa

SEQ ID NO: 23841 - RNA, 24 nt, Human
uacccacuuauaaauagcacugau

SEQ ID NO: 23842 - RNA, 24 nt, Human
uaugaucaaaccuauagucugucg

SEQ ID NO: 23843 - RNA, 24 nt, Human
auuucagcuaugucugauuuuuuu

SEQ ID NO: 23844 - RNA, 24 nt, Human
ugcauuguuaucauuaaccagucu

SEQ ID NO: 23845 - RNA, 24 nt, Human
uaaugggucucaaaauucugugac

SEQ ID NO: 23846 - RNA, 24 nt, Human
ggacagguguacagacauguucuu

SEQ ID NO: 23847 - RNA, 24 nt, Human
ucgaauggacacauuaccagugaa

SEQ ID NO: 23848 - RNA, 24 nt, Human
uccgccaucuucccggccgccuga

SEQ ID NO: 23849 - RNA, 24 nt, Human
ggacagguguacagacauguucuu

SEQ ID NO: 23850 - RNA, 24 nt, Human
cuaccaggucucuaggggccugag

SEQ ID NO: 23851 - RNA, 23 nt, Human
agaggacucggagcucacacuug

SEQ ID NO: 23852 - RNA, 24 nt, Human
ugagaucuugggcaaaucacuuag

SEQ ID NO: 23853 - RNA, 24 nt, Human
uaucagcgucugaugccuucuucc

SEQ ID NO: 23854 - RNA, 24 nt, Human
cggcaucccuccggauucugcugc

SEQ ID NO: 23855 - RNA, 24 nt, Human
uggccugaugauccacagcggaga

SEQ ID NO: 23856 - RNA, 24 nt, Human
ugugugccauugcccaggcagagu

SEQ ID NO: 23857 - RNA, 24 nt, Human
caggaugcccucucaggaucaggg

SEQ ID NO: 23858 - RNA, 20 nt, Human
ugggaagguuuguuuuuuac

SEQ ID NO: 23859 - RNA, 24 nt, Human
acauaggugugaauuuauccauua

SEQ ID NO: 23860 - RNA, 24 nt, Human
uauggcaagucacuuugacagaca

SEQ ID NO: 23861 - RNA, 24 nt, Human
uacaccacucccaagaagaauaag

SEQ ID NO: 23862 - RNA, 24 nt, Human
aggcaggagguggaaaccccaggg

SEQ ID NO: 23863 - RNA, 24 nt, Human
uccccgugacaggugggccugagg

SEQ ID NO: 23864 - RNA, 24 nt, Human
guggauggccugaugauccacagc

SEQ ID NO: 23865 - RNA, 24 nt, Human
uauuacaggagugugccauuagcc

SEQ ID NO: 23866 - RNA, 24 nt, Human
ucuggaauaucugauauagggguu

SEQ ID NO: 23867 - RNA, 24 nt, Human
agccagugaagggcgagucagggc

SEQ ID NO: 23868 - RNA, 24 nt, Human
uguugagaguggaguuacugcagg

SEQ ID NO: 23869 - RNA, 24 nt, Human
uuccuugggagaugccauaaagca

SEQ ID NO: 23870 - RNA, 20 nt, Human
uguuggggcccgggggggcc

SEQ ID NO: 23871 - RNA, 24 nt, Human
uggcagaagauggugacuggagug

SEQ ID NO: 23872 - RNA, 24 nt, Human
aaggaugcugcuagacuaaggaau

SEQ ID NO: 23873 - RNA, 24 nt, Human
acccagagauauuaaaauaauuuu

SEQ ID NO: 23874 - RNA, 24 nt, Human
uguaguuuuaauaagcaugacauu

SEQ ID NO: 23875 - RNA, 24 nt, Human
aguguaaucuuugcaagcguauau

SEQ ID NO: 23876 - RNA, 24 nt, Human
auuucauucacuggggaggaacaa

SEQ ID NO: 23877 - RNA, 23 nt, Human
uaaggcgaggcggaauuaaaccc

SEQ ID NO: 23878 - RNA, 24 nt, Human
uagcaaaucgagucuuaaauaauc

SEQ ID NO: 23879 - RNA, 24 nt, Human
gcuacugugugaauagaaaguaag

SEQ ID NO: 23880 - RNA, 24 nt, Human
uuugcauuuguuuacucuauuuuu

SEQ ID NO: 23881 - RNA, 21 nt, Human
ugagugaggacuccaagaaug

SEQ ID NO: 23882 - RNA, 24 nt, Human
ugcucgugcaguuugaguacugga

SEQ ID NO: 23883 - RNA, 24 nt, Human
ugcuggguggggccaggcauaacc

SEQ ID NO: 23884 - RNA, 24 nt, Human
aggggcacaguucuauugccacca

SEQ ID NO: 23885 - RNA, 24 nt, Human
uggauacagagggccaacuguauu

SEQ ID NO: 23886 - RNA, 24 nt, Human
ugugaauaagcagacagaaagaau

SEQ ID NO: 23887 - RNA, 24 nt, Human
cuaguuaaaaaaaaaaaucaauga

SEQ ID NO: 23888 - RNA, 24 nt, Human
uauacuguauuguuuuuauuugua

SEQ ID NO: 23889 - RNA, 20 nt, Human
gcgcagugguccucgcacgu

SEQ ID NO: 23890 - RNA, 24 nt, Human
uacacuaguuggcccgaacuuggu

SEQ ID NO: 23891 - RNA, 24 nt, Human
uggcuaaguccuggacuggcuuaa

SEQ ID NO: 23892 - RNA, 24 nt, Human
uuaaaaauauuuauccuguuagaa

SEQ ID NO: 23893 - RNA, 24 nt, Human
ugcagcaagaucaugugcauacac

SEQ ID NO: 23894 - RNA, 24 nt, Human
uuaaaaagcaaaauaaacuugguu

SEQ ID NO: 23895 - RNA, 24 nt, Human
aggaggcuauugagggcaccuaca

SEQ ID NO: 23896 - RNA, 24 nt, Human
uggcguggugaccaagaugaagau

SEQ ID NO: 23897 - RNA, 24 nt, Human
uacagaucucuucagcucaccaaa

SEQ ID NO: 23898 - RNA, 24 nt, Human
uaugauguauauuaaauauucuga

SEQ ID NO: 23899 - RNA, 24 nt, Human
auuguccuaaguuccagaaugaaa

SEQ ID NO: 23900 - RNA, 24 nt, Human
uuugaagauuucuuuuuuccauuu

SEQ ID NO: 23901 - RNA, 22 nt, Human
cugccaggagacaaaggcuugc

SEQ ID NO: 23902 - RNA, 24 nt, Human
uugcagaggagcgagcuggaacgc

SEQ ID NO: 23903 - RNA, 24 nt, Human
ugagguuauccucauugauccauu

SEQ ID NO: 23904 - RNA, 24 nt, Human
uucgccgugguggccgaaaacgcc

SEQ ID NO: 23905 - RNA, 24 nt, Human
uuaacauuucuccccucacucccu

SEQ ID NO: 23906 - RNA, 24 nt, Human
uauauaaauguugcaagccauuau

SEQ ID NO: 23907 - RNA, 24 nt, Human
uuccugaauucaguaagcaaguua

SEQ ID NO: 23908 - RNA, 24 nt, Human
uaucaguggauggcauaauuaacu

SEQ ID NO: 23909 - RNA, 24 nt, Human
uuuagacuccauauuaagggggua

SEQ ID NO: 23910 - RNA, 24 nt, Human
accauuuaguguaauuaugguaug

SEQ ID NO: 23911 - RNA, 24 nt, Human
agaugcuaaagaaaacccuuaugg

SEQ ID NO: 23912 - RNA, 24 nt, Human
ucagccaaucagauugcaggcaaa

SEQ ID NO: 23913 - RNA, 24 nt, Human
uucccugggugccacgggucacac

SEQ ID NO: 23914 - RNA, 24 nt, Human
ucagugcaaccagagacccuuucg

SEQ ID NO: 23915 - RNA, 24 nt, Human
cagcaucucagguccucuagaggg

SEQ ID NO: 23916 - RNA, 24 nt, Human
ugguaggugggccccucgcuuucu

SEQ ID NO: 23917 - RNA, 24 nt, Human
aggacccugauccuugcgcucugc

SEQ ID NO: 23918 - RNA, 24 nt, Human
uuucacaggcauuuacucauggcu

SEQ ID NO: 23919 - RNA, 19 nt, Human
uacaguuacucccgggacc

SEQ ID NO: 23920 - RNA, 24 nt, Human
agcuugugaaguuuaaauccaaau

SEQ ID NO: 23921 - RNA, 24 nt, Human
ccaguacagaucguuucucaucuc

SEQ ID NO: 23922 - RNA, 24 nt, Human
uggguuccaaagggggagauauca

SEQ ID NO: 23923 - RNA, 24 nt, Human
ccugaccccugggcuggccuggga

SEQ ID NO: 23924 - RNA, 24 nt, Human
aaagcaaaugaggcagaaaggccc

SEQ ID NO: 23925 - RNA, 24 nt, Human
uauggcaagucacuuugacagaca

SEQ ID NO: 23926 - RNA, 24 nt, Human
ugagaauggcaaaauuagucgccu

SEQ ID NO: 23927 - RNA, 24 nt, Human
uacaccacucccaagaagaauaag

SEQ ID NO: 23928 - RNA, 19 nt, Human
uaaguaauagcuacaauac

SEQ ID NO: 23929 - RNA, 24 nt, Human
caaaagcagcugccugaaugaguu

SEQ ID NO: 23930 - RNA, 24 nt, Human
uauggcaagucacuuugacagaca

SEQ ID NO: 23931 - RNA, 24 nt, Human
ugagaauggcaaaauuagucgccu

SEQ ID NO: 23932 - RNA, 24 nt, Human
uacaccacucccaagaagaauaag

SEQ ID NO: 23933 - RNA, 24 nt, Human
agggauugagccaagaggugaggg

SEQ ID NO: 23934 - RNA, 24 nt, Human
auagcgcaaccuucucacacuaca

SEQ ID NO: 23935 - RNA, 24 nt, Human
ucaagcgcggucguaccugcucgu

SEQ ID NO: 23936 - RNA, 24 nt, Human
gcuuauuuauuuaaaaaaagucaa

SEQ ID NO: 23937 - RNA, 24 nt, Human
aaggauagugucacaugcucaaac

SEQ ID NO: 23938 - RNA, 24 nt, Human
aaagaucauuugaaaccaguuuuu

SEQ ID NO: 23939 - RNA, 24 nt, Human
uugcauguagaguucgacgcugga

SEQ ID NO: 23940 - RNA, 24 nt, Human
uaucuugagguccuggucuuuuaa

SEQ ID NO: 23941 - RNA, 24 nt, Human
gggcaucaucgacagugccuucgg

SEQ ID NO: 23942 - RNA, 24 nt, Human
ugaaaagaagaccagauuuugaac

SEQ ID NO: 23943 - RNA, 24 nt, Human
uauauugugauuuaugcuuuaaga

SEQ ID NO: 23944 - RNA, 24 nt, Human
uaaguaaugaacccaauuccacaa

SEQ ID NO: 23945 - RNA, 24 nt, Human
uucacaguaguucccagggcagca

SEQ ID NO: 23946 - RNA, 24 nt, Human
cuguaccuaugggaagccugucac

SEQ ID NO: 23947 - RNA, 17 nt, Human
cacagauucacugcugu

SEQ ID NO: 23948 - RNA, 24 nt, Human
ucagcaggaggacgacugaugagc

SEQ ID NO: 23949 - RNA, 24 nt, Human
gugaaguugacgcucaagagcagg

SEQ ID NO: 23950 - RNA, 24 nt, Human
cuagagaagucagaagaaucagaa

SEQ ID NO: 23951 - RNA, 22 nt, Human
uuuguaaacaugaaguuacuau

SEQ ID NO: 23952 - RNA, 24 nt, Human
uauuuuacuaugauaguugagaaa

SEQ ID NO: 23953 - RNA, 24 nt, Human
uugaagcaagaccuugcaaagacu

SEQ ID NO: 23954 - RNA, 24 nt, Human
accauggugagcccauuggcaggg

SEQ ID NO: 23955 - RNA, 24 nt, Human
uggcuggggucggggagggguaca

SEQ ID NO: 23956 - RNA, 24 nt, Human
ugggaacgacgcguauccguucug

SEQ ID NO: 23957 - RNA, 24 nt, Human
uguauaaucaucaaagccauucau

SEQ ID NO: 23958 - RNA, 23 nt, Human
uacaccuucuuggcacagcagca

SEQ ID NO: 23959 - RNA, 24 nt, Human
gagcugauuugauggacaauggag

SEQ ID NO: 23960 - RNA, 24 nt, Human
uauggugcggaggcccuggagagg

SEQ ID NO: 23961 - RNA, 24 nt, Human
uugaaagguauauuaaaauuaagg

SEQ ID NO: 23962 - RNA, 24 nt, Human
ucuacagucugugaauauaccaau

SEQ ID NO: 23963 - RNA, 24 nt, Human
gugcagcgcgucacccgggccagc

SEQ ID NO: 23964 - RNA, 24 nt, Human
cauuggaaauuggaagcgguuuau

SEQ ID NO: 23965 - RNA, 24 nt, Human
ucuggugugugaaggucggugggu

SEQ ID NO: 23966 - RNA, 23 nt, Human
cacccuggggcaguagcagggcc

SEQ ID NO: 23967 - RNA, 20 nt, Human
ugcugggagaccuuggccac

SEQ ID NO: 23968 - RNA, 24 nt, Human
uauccagggcagcauugaagucag

SEQ ID NO: 23969 - RNA, 23 nt, Human
gacuguguauccuucaaagaccc

SEQ ID NO: 23970 - RNA, 24 nt, Human
acucccgccuuaccugcgguggca

SEQ ID NO: 23971 - RNA, 24 nt, Human
uauggcaaggaccugauggagaag

SEQ ID NO: 23972 - RNA, 24 nt, Human
aaggagcuugguucggagacaggc

SEQ ID NO: 23973 - RNA, 24 nt, Human
ucuugcugugcaaagagacuggug

SEQ ID NO: 23974 - RNA, 24 nt, Human
uguuguaacauccccccagugggg

SEQ ID NO: 23975 - RNA, 24 nt, Human
acccuugugaacacauguacucca

SEQ ID NO: 23976 - RNA, 24 nt, Human
gggaauaggggaucuggggacagg

SEQ ID NO: 23977 - RNA, 19 nt, Human
aggcaggucacggugggga

SEQ ID NO: 23978 - RNA, 24 nt, Human
acuugcuggauaugauguaccggg

SEQ ID NO: 23979 - RNA, 24 nt, Human
ucuggugggucugauacagguagc

SEQ ID NO: 23980 - RNA, 24 nt, Human
uaaggaaaaaaagggcuuuaaaaa

SEQ ID NO: 23981 - RNA, 24 nt, Human
aggcauuacuauuguucuggucua

SEQ ID NO: 23982 - RNA, 24 nt, Human
uuuaaaaugaauauauguaacaug

SEQ ID NO: 23983 - RNA, 24 nt, Human
aaucuggaccaaguacgaauacac

SEQ ID NO: 23984 - RNA, 24 nt, Human
uucaagcaaaacaguucucaggaa

SEQ ID NO: 23985 - RNA, 24 nt, Human
agugaucugccauaccacugugac

SEQ ID NO: 23986 - RNA, 24 nt, Human
uggaaucugucacacguuuggaac

SEQ ID NO: 23987 - RNA, 24 nt, Human
uggguaauuaagguuuaaaaauau

SEQ ID NO: 23988 - RNA, 24 nt, Human
agggagacuuuguacauuucaggc

SEQ ID NO: 23989 - RNA, 22 nt, Human
uccgugcgcguugcugcggccg

SEQ ID NO: 23990 - RNA, 24 nt, Human
uugaucuugaagaaacugggcgug

SEQ ID NO: 23991 - RNA, 24 nt, Human
ucagugccgggaaccaaugcagac

SEQ ID NO: 23992 - RNA, 24 nt, Human
aggaaggagauauagugaagagga

SEQ ID NO: 23993 - RNA, 24 nt, Human
ugaaagugcucacaaacuucaaga

SEQ ID NO: 23994 - RNA, 24 nt, Human
uguggacgagcaggaggaggcggc

SEQ ID NO: 23995 - RNA, 24 nt, Human
uaagcagccaaaacagaagauuuc

SEQ ID NO: 23996 - RNA, 24 nt, Human
agggggaucccgcguuagaugacc

SEQ ID NO: 23997 - RNA, 24 nt, Human
uggaaguuggaacaauuuugcucc

SEQ ID NO: 23998 - RNA, 24 nt, Human
uggagccccccccgcgaauuuccu

SEQ ID NO: 23999 - RNA, 24 nt, Human
ugaguacacgaugcccacccuccu

SEQ ID NO: 24000 - RNA, 24 nt, Human
cagcagcaauaauuucccagaugc

SEQ ID NO: 24001 - RNA, 24 nt, Human
ugagcagauggaggcagagauagc

SEQ ID NO: 24002 - RNA, 24 nt, Human
acagacacauugacaugggugggu

SEQ ID NO: 24003 - RNA, 24 nt, Human
aucauuuuaggaucaacacuguau

SEQ ID NO: 24004 - RNA, 24 nt, Human
ucccaugguuugaaguaguggguu

SEQ ID NO: 24005 - RNA, 24 nt, Human
uucccaugccccaggcuccugcag

SEQ ID NO: 24006 - RNA, 24 nt, Human
ugugugggcucacugcuuuacuau

SEQ ID NO: 24007 - RNA, 24 nt, Human
cugugcugccccuuucacaucaaa

SEQ ID NO: 24008 - RNA, 24 nt, Human
cacagguacaaacacauucggggg

SEQ ID NO: 24009 - RNA, 24 nt, Human
uaugagcaucuucaacaauauucc

SEQ ID NO: 24010 - RNA, 24 nt, Human
uuggaaggggcguuguccaguucc

SEQ ID NO: 24011 - RNA, 24 nt, Human
uuagggcagguguuuagguggaag

SEQ ID NO: 24012 - RNA, 24 nt, Human
ugaaagucauccucgccagucccg

SEQ ID NO: 24013 - RNA, 24 nt, Human
uauggggaagggugucucaaaggc

SEQ ID NO: 24014 - RNA, 24 nt, Human
uacgccacaucgcugacuguggug

SEQ ID NO: 24015 - RNA, 24 nt, Human
ugaagaggaaucaggaccuggcuc

SEQ ID NO: 24016 - RNA, 24 nt, Human
uuaggguauugugugggaaaaccc

SEQ ID NO: 24017 - RNA, 24 nt, Human
ucaauagugucacagguauuaagc

SEQ ID NO: 24018 - RNA, 24 nt, Human
auauaacuaauaguauuaggaugu

SEQ ID NO: 24019 - RNA, 24 nt, Human
uaacaagaaaaggcaauugguuag

SEQ ID NO: 24020 - RNA, 24 nt, Human
uugaagauccauaacuaucuucug

SEQ ID NO: 24021 - RNA, 24 nt, Human
uaacuggguugacauugggcugaa

SEQ ID NO: 24022 - RNA, 24 nt, Human
ugugcaguugggagauguucagcu

SEQ ID NO: 24023 - RNA, 24 nt, Human
aaucacauuuacuuuuuucuacau

SEQ ID NO: 24024 - RNA, 24 nt, Human
uaugguauccugaagcaccugccc

SEQ ID NO: 24025 - RNA, 24 nt, Human
ugaccaggacaucuacgggcgcga

SEQ ID NO: 24026 - RNA, 24 nt, Human
ucuccugcucggacagcuucucuu

SEQ ID NO: 24027 - RNA, 24 nt, Human
uaacucuccaagccuucugggaug

SEQ ID NO: 24028 - RNA, 24 nt, Human
uuagcaaacagaagcaauugcacc

SEQ ID NO: 24029 - RNA, 24 nt, Human
uugcuuccucccaacaaggcagcu

SEQ ID NO: 24030 - RNA, 19 nt, Human
uaccacauuuacucuggcc

SEQ ID NO: 24031 - RNA, 24 nt, Human
cacuccaugaaguagcugcgguac

SEQ ID NO: 24032 - RNA, 24 nt, Human
ucuuuccggucauaauuuaaccuu

SEQ ID NO: 24033 - RNA, 24 nt, Human
ucugccuucucagccaauugaaau

SEQ ID NO: 24034 - RNA, 20 nt, Human
ucagguggaaaaagaaagaa

SEQ ID NO: 24035 - RNA, 24 nt, Human
uaggucccgagguggagucggggg

SEQ ID NO: 24036 - RNA, 24 nt, Human
uaggauguccucauaugggcuuag

SEQ ID NO: 24037 - RNA, 24 nt, Human
uguauauauuuaacacacacaucu

SEQ ID NO: 24038 - RNA, 24 nt, Human
ugccucagcuuccugaauagcugg

SEQ ID NO: 24039 - RNA, 24 nt, Human
gggaauucuuuauuuaguaauguc

SEQ ID NO: 24040 - RNA, 17 nt, Human
ggggaugggaagucacc

SEQ ID NO: 24041 - RNA, 21 nt, Human
uuuuuuguuugaaguucccag

SEQ ID NO: 24042 - RNA, 18 nt, Human
ugagcagcugcccagccc

SEQ ID NO: 24043 - RNA, 24 nt, Human
gcucauuugcaggggggagccaaa

SEQ ID NO: 24044 - RNA, 24 nt, Human
cuggcgcugaguacgucguggagu

SEQ ID NO: 24045 - RNA, 24 nt, Human
ugauuccaccagggaccauucucc

SEQ ID NO: 24046 - RNA, 24 nt, Human
uaagugaacuuguagucuuauuug

SEQ ID NO: 24047 - RNA, 24 nt, Human
uaguggguuuuuuuucugagguuu

SEQ ID NO: 24048 - RNA, 24 nt, Human
cguacauauauauauauaaacaca

SEQ ID NO: 24049 - RNA, 18 nt, Human
uuuguuguaaugaguuca

SEQ ID NO: 24050 - RNA, 24 nt, Human
gagcgggcuuauaaacccucugug

SEQ ID NO: 24051 - RNA, 24 nt, Human
uugguugugguuaaugaauauguu

SEQ ID NO: 24052 - RNA, 24 nt, Human
accagcugucuuuacaaugauaac

SEQ ID NO: 24053 - RNA, 24 nt, Human
ugagaaugcacauuucuauaaauu

SEQ ID NO: 24054 - RNA, 24 nt, Human
ugagcuggauugacauagcccuug

SEQ ID NO: 24055 - RNA, 23 nt, Human
uagccagccgugaagccaaacug

SEQ ID NO: 24056 - RNA, 24 nt, Human
ucacucgggaggaagaugugccug

SEQ ID NO: 24057 - RNA, 24 nt, Human
ugaguaaagaaaugucguacucca

SEQ ID NO: 24058 - RNA, 24 nt, Human
ugggaugcccccccuuuucaaacc

SEQ ID NO: 24059 - RNA, 19 nt, Human
ugccaaagacucguggggg

SEQ ID NO: 24060 - RNA, 24 nt, Human
gcagcagggaagggcuuugccuga

SEQ ID NO: 24061 - RNA, 24 nt, Human
gagcagcugccuucaggcccugcg

SEQ ID NO: 24062 - RNA, 24 nt, Human
ugcagcagcugccggcgcaccggc

SEQ ID NO: 24063 - RNA, 24 nt, Human
ugaauuggccccguccaaguuaga

SEQ ID NO: 24064 - RNA, 24 nt, Human
ucaggaguugguguccugccugcg

SEQ ID NO: 24065 - RNA, 24 nt, Human
aagcugaccagcgagcucaaguuc

SEQ ID NO: 24066 - RNA, 24 nt, Human
ugauacgagaauagauggucuuga

SEQ ID NO: 24067 - RNA, 24 nt, Human
aggcccaagagcuucugcuaggug

SEQ ID NO: 24068 - RNA, 24 nt, Human
uggcaaagggcugagguucucucg

SEQ ID NO: 24069 - RNA, 21 nt, Human
cauuggacaggacauccagcc

SEQ ID NO: 24070 - RNA, 24 nt, Human
cagcggcagagagccauccucuau

SEQ ID NO: 24071 - RNA, 19 nt, Human
acaaagcaagagaagaagc

SEQ ID NO: 24072 - RNA, 24 nt, Human
cagcggcagagagccauccucuau

SEQ ID NO: 24073 - RNA, 24 nt, Human
uuagugggaagcuccaggcccugc

SEQ ID NO: 24074 - RNA, 24 nt, Human
caucaagauccccgagggcugcgu

SEQ ID NO: 24075 - RNA, 24 nt, Human
ugugacugauugcuuuuccugcag

SEQ ID NO: 24076 - RNA, 21 nt, Human
uggaaggagagcugaucucau

SEQ ID NO: 24077 - RNA, 24 nt, Human
cgccaagauuccagaguaagucag

SEQ ID NO: 24078 - RNA, 24 nt, Human
uauuucacagauaaugagaccuua

SEQ ID NO: 24079 - RNA, 17 nt, Human
agggggccucauuugug

SEQ ID NO: 24080 - RNA, 24 nt, Human
aucccgguguguggcccagcuugu

SEQ ID NO: 24081 - RNA, 23 nt, Human
ugaaaaguuggaaacaguggcac

SEQ ID NO: 24082 - RNA, 19 nt, Human
ucggcagugggguaacgga

SEQ ID NO: 24083 - RNA, 24 nt, Human
agugguaucuggaggacagggcac

SEQ ID NO: 24084 - RNA, 24 nt, Human
gacugcuuccggauccguuacaga

SEQ ID NO: 24085 - RNA, 24 nt, Human
uaccucagcguucacaggccugug

SEQ ID NO: 24086 - RNA, 24 nt, Human
ccuggcuuggucuccgcuuguugu

SEQ ID NO: 24087 - RNA, 24 nt, Human
uagguggcguauuagaauggugcc

SEQ ID NO: 24088 - RNA, 24 nt, Human
uaagaauaugcugccaauuucugu

SEQ ID NO: 24089 - RNA, 24 nt, Human
ugagccuauuuuguggccccugug

SEQ ID NO: 24090 - RNA, 24 nt, Human
uuuuacuucucgccuaugcucaag

SEQ ID NO: 24091 - RNA, 24 nt, Human
acggaguuucaccauguuggccag

SEQ ID NO: 24092 - RNA, 24 nt, Human
uagaugcagacagugaggauggag

SEQ ID NO: 24093 - RNA, 24 nt, Human
uccaugcuguguccugacuggguc

SEQ ID NO: 24094 - RNA, 24 nt, Human
auaguacaaauuagaugcagcgua

SEQ ID NO: 24095 - RNA, 24 nt, Human
ugccucagguuacgaggucuuggc

SEQ ID NO: 24096 - RNA, 24 nt, Human
uuuuauguagucauuaauuuuuag

SEQ ID NO: 24097 - RNA, 24 nt, Human
uguguacagagaaucacauguaua

SEQ ID NO: 24098 - RNA, 24 nt, Human
uaauguucugucacgugaaauauu

SEQ ID NO: 24099 - RNA, 24 nt, Human
cuaggaaaaugccaaaauggaauu

SEQ ID NO: 24100 - RNA, 24 nt, Human
uugaaggggccacaaguguuauua

SEQ ID NO: 24101 - RNA, 24 nt, Human
augaagcagcuuucuguuuucagu

SEQ ID NO: 24102 - RNA, 24 nt, Human
uagaagauaaaaggcauucuguau

SEQ ID NO: 24103 - RNA, 24 nt, Human
aacagauacaagguaaaauucaaa

SEQ ID NO: 24104 - RNA, 24 nt, Human
ugcagcuuucaggaguuugggccc

SEQ ID NO: 24105 - RNA, 24 nt, Human
uggaaacgccaacuauaaccccuc

SEQ ID NO: 24106 - RNA, 24 nt, Human
uugaaggcuucggagacccuguuc

SEQ ID NO: 24107 - RNA, 24 nt, Human
uccacuggcgaaagaugccuuucu

SEQ ID NO: 24108 - RNA, 24 nt, Human
uagagugguggcucccagaauccc

SEQ ID NO: 24109 - RNA, 24 nt, Human
aagaugcucuucaguacucagaau

SEQ ID NO: 24110 - RNA, 24 nt, Human
gcgguuccugcggaagccgaacgu

SEQ ID NO: 24111 - RNA, 24 nt, Human
cccaggagugucugcccuacgcgg

SEQ ID NO: 24112 - RNA, 21 nt, Human
uucaagggauggaaagucacc

SEQ ID NO: 24113 - RNA, 24 nt, Human
ucugaucuauaaaugcgguggcau

SEQ ID NO: 24114 - RNA, 24 nt, Human
ugaaugaguacuuaaaaauaucag

SEQ ID NO: 24115 - RNA, 17 nt, Human
gagcaagacuccgucuc

SEQ ID NO: 24116 - RNA, 18 nt, Human
uagcaaguguuacacaau

SEQ ID NO: 24117 - RNA, 17 nt, Human
uaggcauuccccugugg

SEQ ID NO: 24118 - RNA, 24 nt, Human
uauuccacuuuauguggauuagua

SEQ ID NO: 24119 - RNA, 24 nt, Human
aucaaguuuuaaauccuccuccuu

SEQ ID NO: 24120 - RNA, 24 nt, Human
uuggaagaggagagaugcaucgag

SEQ ID NO: 24121 - RNA, 24 nt, Human
cuuauggucaugcugcaauuuguu

SEQ ID NO: 24122 - RNA, 24 nt, Human
aacaaguaacuccaaagugucaga

SEQ ID NO: 24123 - RNA, 24 nt, Human
ugaaagagacagucgacggaugug

SEQ ID NO: 24124 - RNA, 24 nt, Human
ucaguuacuuucacuaucucaauc

SEQ ID NO: 24125 - RNA, 24 nt, Human
uaaugggucucaaaauucugugac

SEQ ID NO: 24126 - RNA, 24 nt, Human
uaaagcuuaaaacaguaggaguuu

SEQ ID NO: 24127 - RNA, 24 nt, Human
uacaguaucaugggcugagguggg

SEQ ID NO: 24128 - RNA, 24 nt, Human
ucagagcagcccuggagacaggag

SEQ ID NO: 24129 - RNA, 24 nt, Human
uaugcugucugucaguguacagua

SEQ ID NO: 24130 - RNA, 24 nt, Human
uggcacgcggagcuagcgacgguc

SEQ ID NO: 24131 - RNA, 24 nt, Human
augaauuucuucaaucuuuaacuc

SEQ ID NO: 24132 - RNA, 21 nt, Human
aaguaugccugggucuuggau

SEQ ID NO: 24133 - RNA, 24 nt, Human
uccaccacuacuggccaucugauc

SEQ ID NO: 24134 - RNA, 24 nt, Human
aggcaguguccuggaugaaaugcc

SEQ ID NO: 24135 - RNA, 24 nt, Human
uacguggugauauggucagugacu

SEQ ID NO: 24136 - RNA, 24 nt, Human
uccccagugucuuugggggucugu

SEQ ID NO: 24137 - RNA, 24 nt, Human
ugcgaucauggagaguuaaagagg

SEQ ID NO: 24138 - RNA, 24 nt, Human
uuaauccugauaaagaagauuguu

SEQ ID NO: 24139 - RNA, 24 nt, Human
uuuccaccccucaaaccuuggcuc

SEQ ID NO: 24140 - RNA, 24 nt, Human
ugacaagagacuuaacuuaucuug

SEQ ID NO: 24141 - RNA, 22 nt, Human
aacaguguuuucuuuuugggua

SEQ ID NO: 24142 - RNA, 24 nt, Human
uguugauguccaaauugaccagga

SEQ ID NO: 24143 - RNA, 24 nt, Human
agcaaggugguaaaagauacaacc

SEQ ID NO: 24144 - RNA, 24 nt, Human
uaagaucuuaagggguccgagggg

SEQ ID NO: 24145 - RNA, 22 nt, Human
cuuuugguggugcuggaguugg

SEQ ID NO: 24146 - RNA, 22 nt, Human
caccggagaaaacugacgaccc

SEQ ID NO: 24147 - RNA, 24 nt, Human
ucgcaugggacaggcacacgaugc

SEQ ID NO: 24148 - RNA, 18 nt, Human
ggccugguacuguggcug

SEQ ID NO: 24149 - RNA, 24 nt, Human
ucugccauuacuggacaucauucu

SEQ ID NO: 24150 - RNA, 24 nt, Human
agaaaucagaaguugccagcuuuu

SEQ ID NO: 24151 - RNA, 24 nt, Human
uuuaugauuuaugaguuuagaaaa

SEQ ID NO: 24152 - RNA, 24 nt, Human
accuuuuuuuuauuuauuuuuggc

SEQ ID NO: 24153 - RNA, 24 nt, Human
ugcguuuauaaaacuaguuuuuaa

SEQ ID NO: 24154 - RNA, 24 nt, Human
uuugcccacaguaaauguacaacu

SEQ ID NO: 24155 - RNA, 24 nt, Human
aaauucacuuuaugaaucaauaag

SEQ ID NO: 24156 - RNA, 24 nt, Human
uggaacaaagaauagaguucaagu

SEQ ID NO: 24157 - RNA, 24 nt, Human
ccagcaauuugggcucacaaaugg

SEQ ID NO: 24158 - RNA, 24 nt, Human
agaccacucaggcuggacgacgag

SEQ ID NO: 24159 - RNA, 17 nt, Human
uagguugguaccagcag

SEQ ID NO: 24160 - RNA, 24 nt, Human
ucgcucagacggccccaaccgugg

SEQ ID NO: 24161 - RNA, 24 nt, Human
uagaauguuaagaagaggagagau

SEQ ID NO: 24162 - RNA, 24 nt, Human
gaucauuggaagaaucacuuucag

SEQ ID NO: 24163 - RNA, 24 nt, Human
aggaaucauuugguuugggucccu

SEQ ID NO: 24164 - RNA, 24 nt, Human
ugacuggagccaugacuaugauaa

SEQ ID NO: 24165 - RNA, 24 nt, Human
ucagcaccgauauggacggacgac

SEQ ID NO: 24166 - RNA, 24 nt, Human
agcaguuuuuaggucugucaguac

SEQ ID NO: 24167 - RNA, 24 nt, Human
ucgaauaauugaacccgggaacuc

SEQ ID NO: 24168 - RNA, 24 nt, Human
ucgcccaaauguguggaugaaguu

SEQ ID NO: 24169 - RNA, 24 nt, Human
agaggucucaagaaccauggacuc

SEQ ID NO: 24170 - RNA, 24 nt, Human
gaccagugcgagguaugcugcccc

SEQ ID NO: 24171 - RNA, 24 nt, Human
uaccaggcaguugacaggccaccc

SEQ ID NO: 24172 - RNA, 21 nt, Human
gaaguggagaucugugaagug

SEQ ID NO: 24173 - RNA, 24 nt, Human
ugauguggaguggcauuuccuuaa

SEQ ID NO: 24174 - RNA, 23 nt, Human
aucuccuucagcgcgagccaccg

SEQ ID NO: 24175 - RNA, 24 nt, Human
gcgcggcuccaagaaggcauccgc

SEQ ID NO: 24176 - RNA, 19 nt, Human
gucagguucaaccaguacu

SEQ ID NO: 24177 - RNA, 24 nt, Human
uuggggccaauuucugguuggaaa

SEQ ID NO: 24178 - RNA, 18 nt, Human
acucucccagugagggau

SEQ ID NO: 24179 - RNA, 24 nt, Human
acugcagggccuccagggccgggu

SEQ ID NO: 24180 - RNA, 24 nt, Human
gggaaaggggauauuuaaaaaugu

SEQ ID NO: 24181 - RNA, 24 nt, Human
ugaagcuugcuacaguuuucuagg

SEQ ID NO: 24182 - RNA, 22 nt, Human
cauguugggaaaaccaugugcc

SEQ ID NO: 24183 - RNA, 24 nt, Human
uccgucuuuaugcugucacuugca

SEQ ID NO: 24184 - RNA, 24 nt, Human
uacugcgagcaguucuuccaauuc

SEQ ID NO: 24185 - RNA, 17 nt, Human
gggcauggaaagucacc

SEQ ID NO: 24186 - RNA, 24 nt, Human
ucugaucuauaaaugcgguggcau

SEQ ID NO: 24187 - RNA, 24 nt, Human
ucagcaccgaccgggaggccucca

SEQ ID NO: 24188 - RNA, 21 nt, Human
caaccaccaguacaaccuggc

SEQ ID NO: 24189 - RNA, 20 nt, Human
ccgcgccgccuuugugcugc

SEQ ID NO: 24190 - RNA, 24 nt, Human
uuaauauauguacacccauuaugu

SEQ ID NO: 24191 - RNA, 24 nt, Human
cagaggcaaaucagaaagucacgg

SEQ ID NO: 24192 - RNA, 24 nt, Human
acggggcgggggcggggcggcagu

SEQ ID NO: 24193 - RNA, 17 nt, Human
uacacuguagaugugga

SEQ ID NO: 24194 - RNA, 24 nt, Human
accaggcaaauucuuaguccuacu

SEQ ID NO: 24195 - RNA, 22 nt, Human
ugacaagaauuucuacgaagug

SEQ ID NO: 24196 - RNA, 19 nt, Human
ugcccaggagcagaugcgg

SEQ ID NO: 24197 - RNA, 24 nt, Human
uuuagagucuucaaacucuauuuc

SEQ ID NO: 24198 - RNA, 24 nt, Human
ucacuguagaccccaaauaccauc

SEQ ID NO: 24199 - RNA, 24 nt, Human
ucugaucuauaaaugcgguggcau

SEQ ID NO: 24200 - RNA, 21 nt, Human
uucaagggauggaaagucacc

SEQ ID NO: 24201 - RNA, 24 nt, Human
agcgugcugcuucugcaaaagauu

SEQ ID NO: 24202 - RNA, 24 nt, Human
ggagaggaaugaccuguuucuuuc

SEQ ID NO: 24203 - RNA, 24 nt, Human
aucauccuuuucuuuuucuuauua

SEQ ID NO: 24204 - RNA, 24 nt, Human
caggggaggccggccacaaaugca

SEQ ID NO: 24205 - RNA, 24 nt, Human
ccugucaagccccgcagcagcagc

SEQ ID NO: 24206 - RNA, 24 nt, Human
auagcucuagggaucucagcaggg

SEQ ID NO: 24207 - RNA, 24 nt, Human
ggauauagggucgaagccccacuc

SEQ ID NO: 24208 - RNA, 24 nt, Human
uuuguagucacucauaggccagac

SEQ ID NO: 24209 - RNA, 24 nt, Human
ugcgggcaagcgucacccugcugg

SEQ ID NO: 24210 - RNA, 24 nt, Human
cuacggggaugacuaccgggccag

SEQ ID NO: 24211 - RNA, 24 nt, Human
cauugugcuggaggaugagggcag

SEQ ID NO: 24212 - RNA, 24 nt, Human
ugugguuuuaaaagagucccucaa

SEQ ID NO: 24213 - RNA, 24 nt, Human
ucucugguuguucacauuccaaaa

SEQ ID NO: 24214 - RNA, 24 nt, Human
ugucgcaggcugcucugucucuua

SEQ ID NO: 24215 - RNA, 24 nt, Human
gcugcagagagcuuuaauggcaau

SEQ ID NO: 24216 - RNA, 24 nt, Human
uaggggaagucagacuaaucccug

SEQ ID NO: 24217 - RNA, 24 nt, Human
gcugcagugcccuucauugcacga

SEQ ID NO: 24218 - RNA, 24 nt, Human
uccaugugagcauguauuucuuga

SEQ ID NO: 24219 - RNA, 24 nt, Human
aauuucuccucugcagggugagcu

SEQ ID NO: 24220 - RNA, 22 nt, Human
ugggaaccuguguuugucauau

SEQ ID NO: 24221 - RNA, 24 nt, Human
aaggggaccauaaggcauuuuggg

SEQ ID NO: 24222 - RNA, 24 nt, Human
ucugcaggcccaggacagugggcu

SEQ ID NO: 24223 - RNA, 24 nt, Human
agcuguguggccucaagcagccuu

SEQ ID NO: 24224 - RNA, 24 nt, Human
uaauagaccaguuaacccaggagu

SEQ ID NO: 24225 - RNA, 24 nt, Human
caaggcccagaagacgaugauuca

SEQ ID NO: 24226 - RNA, 24 nt, Human
ugggaugauaugggaugauggaag

SEQ ID NO: 24227 - RNA, 24 nt, Human
accaaggaaaacucacuaccauga

SEQ ID NO: 24228 - RNA, 24 nt, Human
agugauuugcuuuugccuccuagg

SEQ ID NO: 24229 - RNA, 24 nt, Human
ucagagaaacuuucguucaguaua

SEQ ID NO: 24230 - RNA, 23 nt, Human
aaauagcugugaaacuagauuuu

SEQ ID NO: 24231 - RNA, 24 nt, Human
acuagauuuuccuauaaaugaucu

SEQ ID NO: 24232 - RNA, 24 nt, Human
uaugcaguucugagucugugccac

SEQ ID NO: 24233 - RNA, 24 nt, Human
uuuuggggguaaaaaaggcaacca

SEQ ID NO: 24234 - RNA, 24 nt, Human
aggguucaguuucuuuuuccccag

SEQ ID NO: 24235 - RNA, 24 nt, Human
ucccuucccuucccaaaauucagg

SEQ ID NO: 24236 - RNA, 24 nt, Human
ugguguuucucucuugggggcuuu

SEQ ID NO: 24237 - RNA, 24 nt, Human
ugagaucgguuccgcaggagcugg

SEQ ID NO: 24238 - RNA, 22 nt, Human
ggcccggccgcgcucaccguca

SEQ ID NO: 24239 - RNA, 24 nt, Human
ugacagcaaaggcacagacauucu

SEQ ID NO: 24240 - RNA, 24 nt, Human
ucccuuacucaaaacaaaaucgaa

SEQ ID NO: 24241 - RNA, 24 nt, Human
acuagauucuguccuguugcacug

SEQ ID NO: 24242 - RNA, 24 nt, Human
acuuucaugccauagaccaggggu

SEQ ID NO: 24243 - RNA, 24 nt, Human
uguuuauuuaucaagguuuacaug

SEQ ID NO: 24244 - RNA, 24 nt, Human
ugaaaugguguaacccuauaaagc

SEQ ID NO: 24245 - RNA, 24 nt, Human
aaagggaacaauuaaggggagacu

SEQ ID NO: 24246 - RNA, 24 nt, Human
uccagguacaccagcugcguaccg

SEQ ID NO: 24247 - RNA, 23 nt, Human
ucgaacugcacgcccugcucggc

SEQ ID NO: 24248 - RNA, 24 nt, Human
aaucacauuuacuuuuuucuacau

SEQ ID NO: 24249 - RNA, 24 nt, Human
uaugguauccugaagcaccugccc

SEQ ID NO: 24250 - RNA, 24 nt, Human
uuagagccguauggugagcagccu

SEQ ID NO: 24251 - RNA, 24 nt, Human
aagcaggccaagcgcuccaacucg

SEQ ID NO: 24252 - RNA, 24 nt, Human
caggugcccaucgaggugucgcuc

SEQ ID NO: 24253 - RNA, 24 nt, Human
uccuuugggccuggccuguucugu

SEQ ID NO: 24254 - RNA, 20 nt, Human
uuagaguuuuaauuguugac

SEQ ID NO: 24255 - RNA, 22 nt, Human
uagaguccuccguuccucuugg

SEQ ID NO: 24256 - RNA, 24 nt, Human
ucagugccugauggaguggccggg

SEQ ID NO: 24257 - RNA, 24 nt, Human
uggaaagagacuaagaacaagacu

SEQ ID NO: 24258 - RNA, 24 nt, Human
uggaagcagcgagggaaaauuuaa

SEQ ID NO: 24259 - RNA, 24 nt, Human
ucagucacacagaaucugcuuugu

SEQ ID NO: 24260 - RNA, 24 nt, Human
ccuugggcuuaaaauggaaagcuu

SEQ ID NO: 24261 - RNA, 24 nt, Human
uguugcuaggaaaugggaaaaggg

SEQ ID NO: 24262 - RNA, 24 nt, Human
guguaucuguaucuauaucauaca

SEQ ID NO: 24263 - RNA, 24 nt, Human
uaacagguguaagaguguugaaaa

SEQ ID NO: 24264 - RNA, 24 nt, Human
ugugcagaagaaaugggaaggauu

SEQ ID NO: 24265 - RNA, 21 nt, Human
auggagacaaggugguggcag

SEQ ID NO: 24266 - RNA, 20 nt, Human
uguccagaauuuccagaagu

SEQ ID NO: 24267 - RNA, 24 nt, Human
ugagugcccccagggaggggcugg

SEQ ID NO: 24268 - RNA, 24 nt, Human
uguaaguaacuucacauuaaaaaa

SEQ ID NO: 24269 - RNA, 22 nt, Human
uggcuucuggguuccacuccuu

SEQ ID NO: 24270 - RNA, 24 nt, Human
aggaaggagauauagugaagagga

SEQ ID NO: 24271 - RNA, 24 nt, Human
ucagugcgggaaccaaugcagacu

SEQ ID NO: 24272 - RNA, 24 nt, Human
guagaguuuucuucaggcuuaaag

SEQ ID NO: 24273 - RNA, 17 nt, Human
ugucucagaaucaacau

SEQ ID NO: 24274 - RNA, 24 nt, Human
uuagugaacagaauugaaaaggug

SEQ ID NO: 24275 - RNA, 24 nt, Human
uuggcugacaccguggaggguaaa

SEQ ID NO: 24276 - RNA, 24 nt, Human
aagaaucuugccuuucuccuucag

SEQ ID NO: 24277 - RNA, 24 nt, Human
ugacugaacuuugggcagaugcuc

SEQ ID NO: 24278 - RNA, 24 nt, Human
ggugcaguggaaggaaaaauaggu

SEQ ID NO: 24279 - RNA, 24 nt, Human
cacaguuucagaacugaguaagga

SEQ ID NO: 24280 - RNA, 24 nt, Human
uguaaagauugccuuuguucuguc

SEQ ID NO: 24281 - RNA, 22 nt, Human
auaaaggucaaacaucagugag

SEQ ID NO: 24282 - RNA, 24 nt, Human
uuaggagccuucugacuuaggguu

SEQ ID NO: 24283 - RNA, 24 nt, Human
uuccugccauccuaauaagagccc

SEQ ID NO: 24284 - RNA, 24 nt, Human
aagguuuuaguuuauuuuucccaa

SEQ ID NO: 24285 - RNA, 24 nt, Human
auaagucgauuuuauacucaaagu

SEQ ID NO: 24286 - RNA, 24 nt, Human
gcgcagcuucaggggccgcaaggg

SEQ ID NO: 24287 - RNA, 19 nt, Human
ucugaccggcuucaagcuc

SEQ ID NO: 24288 - RNA, 24 nt, Human
cacccuuugggaucuugggcuuaa

SEQ ID NO: 24289 - RNA, 24 nt, Human
aucuucuuuaggcccuuuuuguug

SEQ ID NO: 24290 - RNA, 24 nt, Human
aaccauuugagcgcuuggcacaaa

SEQ ID NO: 24291 - RNA, 22 nt, Human
ccucugagauucuggggguggg

SEQ ID NO: 24292 - RNA, 23 nt, Human
uugcggccgcuggagcccgagcc

SEQ ID NO: 24293 - RNA, 24 nt, Human
gccacauuuaccauggucggaauu

SEQ ID NO: 24294 - RNA, 24 nt, Human
gcuuucaucuccagccuucuccau

SEQ ID NO: 24295 - RNA, 23 nt, Human
uacacgugaaguugggugaacac

SEQ ID NO: 24296 - RNA, 24 nt, Human
ccagccccggauaccuggacugcu

SEQ ID NO: 24297 - RNA, 24 nt, Human
ugagaagaguguuccuggccuugc

SEQ ID NO: 24298 - RNA, 24 nt, Human
auaguuuagccucaaaaaaauaaa

SEQ ID NO: 24299 - RNA, 24 nt, Human
acugugcccuuccccuccugaaag

SEQ ID NO: 24300 - RNA, 24 nt, Human
ucacugaggagggggccuuggcgg

SEQ ID NO: 24301 - RNA, 24 nt, Human
uauggagcggcgcuucccggacac

SEQ ID NO: 24302 - RNA, 17 nt, Human
ccccagagacaucggcu

SEQ ID NO: 24303 - RNA, 24 nt, Human
agaaggaaguggucucugcccagc

SEQ ID NO: 24304 - RNA, 24 nt, Human
uuuuucgccgauacucuucacagc

SEQ ID NO: 24305 - RNA, 24 nt, Human
aauggcagagucuggugcugacga

SEQ ID NO: 24306 - RNA, 24 nt, Human
ugagcaguguaugucaggacuugu

SEQ ID NO: 24307 - RNA, 24 nt, Human
uagagcuagugaauuagccuauuu

SEQ ID NO: 24308 - RNA, 24 nt, Human
ugggagcagcagccaaguccgcgg

SEQ ID NO: 24309 - RNA, 24 nt, Human
aaaauucaaccuauacaaaaagga

SEQ ID NO: 24310 - RNA, 24 nt, Human
uucccggagaugcggcgcgcagga

SEQ ID NO: 24311 - RNA, 24 nt, Human
gcgcaaagccgugcggagauugga

SEQ ID NO: 24312 - RNA, 24 nt, Human
uuaaaaucaucaccuacuuuucaa

SEQ ID NO: 24313 - RNA, 24 nt, Human
auggauacaacuauuuggauuggu

SEQ ID NO: 24314 - RNA, 24 nt, Human
ccccauaugccgccccggagcugu

SEQ ID NO: 24315 - RNA, 24 nt, Human
ugacuuuggcuucagcaacgaguu

SEQ ID NO: 24316 - RNA, 24 nt, Human
agggagccaauaauagucuuuauc

SEQ ID NO: 24317 - RNA, 24 nt, Human
cuggaaggccuucccgguuaaccc

SEQ ID NO: 24318 - RNA, 24 nt, Human
aagcagaaccuggaugagcuugga

SEQ ID NO: 24319 - RNA, 24 nt, Human
uugcugccuguuaauuaccauuug

SEQ ID NO: 24320 - RNA, 24 nt, Human
uuugcacaguagaugcagaacuag

SEQ ID NO: 24321 - RNA, 24 nt, Human
uaaggucaucgauacggagcagga

SEQ ID NO: 24322 - RNA, 24 nt, Human
ccugcaggucucgggggugacgcu

SEQ ID NO: 24323 - RNA, 24 nt, Human
uauuccucccugcagcccuugccc

SEQ ID NO: 24324 - RNA, 24 nt, Human
aagguccucuuacuuauuccgccu

SEQ ID NO: 24325 - RNA, 24 nt, Human
aguggaccagagccuucgucugga

SEQ ID NO: 24326 - RNA, 24 nt, Human
uaagaaaacggacucuccccacag

SEQ ID NO: 24327 - RNA, 24 nt, Human
uauggcaagucacuuugacagaca

SEQ ID NO: 24328 - RNA, 24 nt, Human
uacaccacucccaagaagaauaag

SEQ ID NO: 24329 - RNA, 24 nt, Human
uuggucauagucuuuucguaucau

SEQ ID NO: 24330 - RNA, 24 nt, Human
ugguauguauuuauagcaauugua

SEQ ID NO: 24331 - RNA, 24 nt, Human
ucacgcgagacucccacucgagga

SEQ ID NO: 24332 - RNA, 21 nt, Human
guccuuggauuucucuuucuc

SEQ ID NO: 24333 - RNA, 24 nt, Human
acaaaacagcccugcugcaaagau

SEQ ID NO: 24334 - RNA, 24 nt, Human
ggaguagagcacauagguucuuug

SEQ ID NO: 24335 - RNA, 24 nt, Human
uguaauauuuuaggucaucuaauc

SEQ ID NO: 24336 - RNA, 24 nt, Human
ucccagauggcuguugggucaagu

SEQ ID NO: 24337 - RNA, 24 nt, Human
uggaaagcugagccugagagacag

SEQ ID NO: 24338 - RNA, 24 nt, Human
uaugugguuugaaucggauguaga

SEQ ID NO: 24339 - RNA, 24 nt, Human
uuuaaauauacaauacaucauaca

SEQ ID NO: 24340 - RNA, 24 nt, Human
acaccagaaaguuauccaacaguu

SEQ ID NO: 24341 - RNA, 22 nt, Human
uuccccuuuuugucaauaggug

SEQ ID NO: 24342 - RNA, 24 nt, Human
aacucuguacagauuuauuuauug

SEQ ID NO: 24343 - RNA, 24 nt, Human
uguuauggacccccaaauucugag

SEQ ID NO: 24344 - RNA, 24 nt, Human
uaccggguucucggaguacggggg

SEQ ID NO: 24345 - RNA, 24 nt, Human
ucagaaggcacaaagagcuguauu

SEQ ID NO: 24346 - RNA, 24 nt, Human
gggcgcccacaaugucgcgcgcgc

SEQ ID NO: 24347 - RNA, 24 nt, Human
gugcagagaaccauugcaagacuu

SEQ ID NO: 24348 - RNA, 24 nt, Human
gggaaguuuggcgucauuugcuug

SEQ ID NO: 24349 - RNA, 24 nt, Human
cccggaguccgagacugcuugagc

SEQ ID NO: 24350 - RNA, 24 nt, Human
uguaccgaaagaugguguucuaca

SEQ ID NO: 24351 - RNA, 24 nt, Human
ucacggucccgccggcgccaccac

SEQ ID NO: 24352 - RNA, 24 nt, Human
uaugacagcguggagcaggauggc

SEQ ID NO: 24353 - RNA, 24 nt, Human
ugauuguccaaguguacucuucaa

SEQ ID NO: 24354 - RNA, 24 nt, Human
uagcgguaucaugggugguaacau

SEQ ID NO: 24355 - RNA, 24 nt, Human
ucgccgccuaggcggggcagggug

SEQ ID NO: 24356 - RNA, 20 nt, Human
cuggaucgauccugcgauua

SEQ ID NO: 24357 - RNA, 24 nt, Human
aauuguuuguuguuaacuuguaua

SEQ ID NO: 24358 - RNA, 24 nt, Human
ucccuggggggccacccaaaucgg

SEQ ID NO: 24359 - RNA, 24 nt, Human
uuaaaacaggcaauuuaaaaaacc

SEQ ID NO: 24360 - RNA, 24 nt, Human
augguacuuagagucgggaugcac

SEQ ID NO: 24361 - RNA, 24 nt, Human
cuauucuaaagaaaaaaaugggau

SEQ ID NO: 24362 - RNA, 24 nt, Human
uaaguaauugugggucucaaaaac

SEQ ID NO: 24363 - RNA, 24 nt, Human
aaugauacuuuucccacagcaaug

SEQ ID NO: 24364 - RNA, 22 nt, Human
cucccggcuuggguggcgcggc

SEQ ID NO: 24365 - RNA, 20 nt, Human
uaggugguuauguuccaccc

SEQ ID NO: 24366 - RNA, 24 nt, Human
gugggccuguuccuccaugccggc

SEQ ID NO: 24367 - RNA, 24 nt, Human
cuggugcugcugaacgagaugagc

SEQ ID NO: 24368 - RNA, 24 nt, Human
acugcacuccagccugggcaagag

SEQ ID NO: 24369 - RNA, 24 nt, Human
auuaagcagauagggagaagggaa

SEQ ID NO: 24370 - RNA, 24 nt, Human
aaugauacuuuucccacagcaaug

SEQ ID NO: 24371 - RNA, 24 nt, Human
gaccuggacaaguauguggaaaua

SEQ ID NO: 24372 - RNA, 24 nt, Human
cugcggccgacacucaugaaggcc

SEQ ID NO: 24373 - RNA, 24 nt, Human
cucccggcuuggguggcgcggccg

SEQ ID NO: 24374 - RNA, 24 nt, Human
aaugauacuuuucccacagcaaug

SEQ ID NO: 24375 - RNA, 24 nt, Human
uugaagggggccgcgcgcuuggcg

SEQ ID NO: 24376 - RNA, 24 nt, Human
ugcggggugacggugguguagggg

SEQ ID NO: 24377 - RNA, 24 nt, Human
uuacuuugaaaggcucuacaaagu

SEQ ID NO: 24378 - RNA, 20 nt, Human
caucccacuggauccacacc

SEQ ID NO: 24379 - RNA, 21 nt, Human
uacaucucuucuuccuauguu

SEQ ID NO: 24380 - RNA, 24 nt, Human
ggacugaauuuauuguggaaguaa

SEQ ID NO: 24381 - RNA, 22 nt, Human
aacagagucauccagccaaugg

SEQ ID NO: 24382 - RNA, 20 nt, Human
caucccacuggauccacacc

SEQ ID NO: 24383 - RNA, 24 nt, Human
ucccccagcugcucugccccuuuc

SEQ ID NO: 24384 - RNA, 23 nt, Human
uccagcagauuacucgggauuuc

SEQ ID NO: 24385 - RNA, 24 nt, Human
ugggaaacuccgaggacagagggc

SEQ ID NO: 24386 - RNA, 24 nt, Human
ugugugccauugcccaggcagagu

SEQ ID NO: 24387 - RNA, 24 nt, Human
ugucacaggacaaucuuaaaggag

SEQ ID NO: 24388 - RNA, 24 nt, Human
uacaaguaucacaguaacauaccu

SEQ ID NO: 24389 - RNA, 24 nt, Human
cucggggacguggcucccaacuuu

SEQ ID NO: 24390 - RNA, 24 nt, Human
cugcagguagacaggcugagcgcg

SEQ ID NO: 24391 - RNA, 24 nt, Human
ucagaaaagcgcucagcacacagu

SEQ ID NO: 24392 - RNA, 24 nt, Human
uuuuuuguuguuguuguuuuugau

SEQ ID NO: 24393 - RNA, 24 nt, Human
uugguucuuucgucugcuacagug

SEQ ID NO: 24394 - RNA, 19 nt, Human
cacugcguuuaccggugug

SEQ ID NO: 24395 - RNA, 24 nt, Human
uuaguaauuaguuguuagauagcu

SEQ ID NO: 24396 - RNA, 19 nt, Human
uuacuuagauuucaugagg

SEQ ID NO: 24397 - RNA, 24 nt, Human
aagaaguugaucuugugugaugac

SEQ ID NO: 24398 - RNA, 24 nt, Human
caagaggaaagcauuccucaaacc

SEQ ID NO: 24399 - RNA, 22 nt, Human
uagguugcagaagcacagcuga

SEQ ID NO: 24400 - RNA, 24 nt, Human
aucaguugcccuuuaugaucucag

SEQ ID NO: 24401 - RNA, 24 nt, Human
cacaguguuauuuguuguaccuga

SEQ ID NO: 24402 - RNA, 24 nt, Human
uggaauagcgucuuccauguggga

SEQ ID NO: 24403 - RNA, 24 nt, Human
uaaagaaagaaaauuacagccugc

SEQ ID NO: 24404 - RNA, 24 nt, Human
uggaagaugcucaacaccuccucc

SEQ ID NO: 24405 - RNA, 24 nt, Human
ugaccaggaaauacaacgagcugc

SEQ ID NO: 24406 - RNA, 24 nt, Human
uggcuuguagaagggacggcucag

SEQ ID NO: 24407 - RNA, 21 nt, Human
ugggaggggcugaauguggug

SEQ ID NO: 24408 - RNA, 24 nt, Human
aagcguuuugagcagaaaggauuc

SEQ ID NO: 24409 - RNA, 24 nt, Human
uauuauguaugguuguaaauucau

SEQ ID NO: 24410 - RNA, 24 nt, Human
uugcaguuaauuugaaaacuuugg

SEQ ID NO: 24411 - RNA, 24 nt, Human
uaagugaauaucaaugcuucuuuu

SEQ ID NO: 24412 - RNA, 24 nt, Human
uagcuguaacacgaagggcuccga

SEQ ID NO: 24413 - RNA, 24 nt, Human
uaagugagcguuuauuuuauucac

SEQ ID NO: 24414 - RNA, 24 nt, Human
uagguucaacuacucaauuucaug

SEQ ID NO: 24415 - RNA, 24 nt, Human
ggucauuaccuuauugaguuuaga

SEQ ID NO: 24416 - RNA, 24 nt, Human
uuuagacuugacgcaacgggaggu

SEQ ID NO: 24417 - RNA, 24 nt, Human
aaauggaaucuagaagcuaaauuu

SEQ ID NO: 24418 - RNA, 22 nt, Human
uuuacagaaaauucuagaacaa

SEQ ID NO: 24419 - RNA, 24 nt, Human
ucuggcacaggaaauggucuccaa

SEQ ID NO: 24420 - RNA, 24 nt, Human
uauacaguggcacguugcuuauag

SEQ ID NO: 24421 - RNA, 24 nt, Human
uaacaucguggaaagccuggauag

SEQ ID NO: 24422 - RNA, 24 nt, Human
ucauacuuuccuuugauuucccag

SEQ ID NO: 24423 - RNA, 24 nt, Human
uauuaguauuuuuccggugaacag

SEQ ID NO: 24424 - RNA, 24 nt, Human
augguacuuaauuacuuguguggu

SEQ ID NO: 24425 - RNA, 23 nt, Human
cgagcacacgggcuacacggggc

SEQ ID NO: 24426 - RNA, 24 nt, Human
uugcucccugcgggccccgccgag

SEQ ID NO: 24427 - RNA, 24 nt, Human
uaaggaagggucaucauaaucaug

SEQ ID NO: 24428 - RNA, 24 nt, Human
agccccuggccaggugucaccucc

SEQ ID NO: 24429 - RNA, 24 nt, Human
ugucgggggagggcugccgucgag

SEQ ID NO: 24430 - RNA, 24 nt, Human
gaguacacaccaaucauccauacc

SEQ ID NO: 24431 - RNA, 24 nt, Human
uacgcugcauuaucuagugauaga

SEQ ID NO: 24432 - RNA, 24 nt, Human
uuaaagaggguguacgggaguuuc

SEQ ID NO: 24433 - RNA, 24 nt, Human
uccgugcugcgugcccagaguagu

SEQ ID NO: 24434 - RNA, 24 nt, Human
caccgcguauaacuuuccagccca

SEQ ID NO: 24435 - RNA, 24 nt, Human
uuaguaggcguugaucaugaguca

SEQ ID NO: 24436 - RNA, 23 nt, Human
ugacauggaucuauuugaguaca

SEQ ID NO: 24437 - RNA, 24 nt, Human
caguguuuguagacuuggaaccca

SEQ ID NO: 24438 - RNA, 24 nt, Human
gagggaacuggccuuuccuaggga

SEQ ID NO: 24439 - RNA, 24 nt, Human
uacaagcccccgccgagcgaaugu

SEQ ID NO: 24440 - RNA, 24 nt, Human
uccaggcccuuguccugcaggcug

SEQ ID NO: 24441 - RNA, 24 nt, Human
uccacaguuucggacgcaguauau

SEQ ID NO: 24442 - RNA, 24 nt, Human
uugaagcaccuuggggccuuguaa

SEQ ID NO: 24443 - RNA, 24 nt, Human
gagcugcuggaggcuggcuacuug

SEQ ID NO: 24444 - RNA, 24 nt, Human
ucugcaguaggucugccggcgaug

SEQ ID NO: 24445 - RNA, 18 nt, Human
ugggaccucuucagagaa

SEQ ID NO: 24446 - RNA, 24 nt, Human
uaccggaaaagcggcaugucaaaa

SEQ ID NO: 24447 - RNA, 24 nt, Human
uaaaaguuguuuugaaaagacaau

SEQ ID NO: 24448 - RNA, 20 nt, Human
uuuaucugacagugaaucug

SEQ ID NO: 24449 - RNA, 24 nt, Human
ggucuugauccugaaagaauaauu

SEQ ID NO: 24450 - RNA, 24 nt, Human
ugacaauacuugggaaccugaaga

SEQ ID NO: 24451 - RNA, 24 nt, Human
uucaaagccuccacgacucuguuu

SEQ ID NO: 24452 - RNA, 24 nt, Human
ucaguacgagugugcgugagugug

SEQ ID NO: 24453 - RNA, 23 nt, Human
uggaaaauaagcaucuagaaggu

SEQ ID NO: 24454 - RNA, 24 nt, Human
aaucaagcuuuggacuaauuaugc

SEQ ID NO: 24455 - RNA, 24 nt, Human
uccaggaugggucuccaucucuug

SEQ ID NO: 24456 - RNA, 24 nt, Human
uuucagaauucccagaguuuacuc

SEQ ID NO: 24457 - RNA, 24 nt, Human
aagaacucaagucagaaucagcca

SEQ ID NO: 24458 - RNA, 24 nt, Human
uguuuuaagaaaauggcagacaaa

SEQ ID NO: 24459 - RNA, 24 nt, Human
gacaggccgcacgccuauuuugga

SEQ ID NO: 24460 - RNA, 24 nt, Human
uauggcaagucacuuugacagaca

SEQ ID NO: 24461 - RNA, 24 nt, Human
uacaccacucccaagaagaauaag

SEQ ID NO: 24462 - RNA, 24 nt, Human
uuaaauuuuuuagagaugaaugaa

SEQ ID NO: 24463 - RNA, 24 nt, Human
gcgcgcaaaccggaggggucugga

SEQ ID NO: 24464 - RNA, 21 nt, Human
ucaguccacauaggccuuugu

SEQ ID NO: 24465 - RNA, 17 nt, Human
uagcuuagacuaggaua

SEQ ID NO: 24466 - RNA, 24 nt, Human
uucacaaucccuuuacuuuaauuu

SEQ ID NO: 24467 - RNA, 24 nt, Human
uacaggaagugccaaguucaaugc

SEQ ID NO: 24468 - RNA, 24 nt, Human
caacauggcagccuuuuccuuaga

SEQ ID NO: 24469 - RNA, 24 nt, Human
aagaauuucaaacuauguuguaau

SEQ ID NO: 24470 - RNA, 24 nt, Human
uggcaaauggacagaacaaucauu

SEQ ID NO: 24471 - RNA, 24 nt, Human
aggcaaacaaguccagagagagca

SEQ ID NO: 24472 - RNA, 24 nt, Human
uccaugaaaaagaccaagguccug

SEQ ID NO: 24473 - RNA, 19 nt, Human
guggagugugcugugcccc

SEQ ID NO: 24474 - RNA, 24 nt, Human
gaaacuuucacaauguccggagcc

SEQ ID NO: 24475 - RNA, 24 nt, Human
uucauguagaggaaccacaccagg

SEQ ID NO: 24476 - RNA, 24 nt, Human
gauaacauuauuauguugccuucu

SEQ ID NO: 24477 - RNA, 24 nt, Human
aaugugcugguaacugcuuugcuu

SEQ ID NO: 24478 - RNA, 24 nt, Human
ucacaucuugcuguuccggcgccc

SEQ ID NO: 24479 - RNA, 24 nt, Human
gaacacacuuggcagauggaggaa

SEQ ID NO: 24480 - RNA, 24 nt, Human
aggcccggcaggcuugggucggga

SEQ ID NO: 24481 - RNA, 24 nt, Human
uuucauuugaagaacauuuucaau

SEQ ID NO: 24482 - RNA, 24 nt, Human
aaggcucuagaugaguuucuuggu

SEQ ID NO: 24483 - RNA, 24 nt, Human
uccaaaauuuccucccugaucuug

SEQ ID NO: 24484 - RNA, 24 nt, Human
uauaaagugaaauagaacuuauuu

SEQ ID NO: 24485 - RNA, 19 nt, Human
gaugcaaaauguuugcagu

SEQ ID NO: 24486 - RNA, 24 nt, Human
aaauggaaucuagaagcuaaauuu

SEQ ID NO: 24487 - RNA, 22 nt, Human
uuuacagaaaauucuagaacaa

SEQ ID NO: 24488 - RNA, 24 nt, Human
uggcuacgaauggggccgccagaa

SEQ ID NO: 24489 - RNA, 24 nt, Human
caaugggugaucgggcaugacccc

SEQ ID NO: 24490 - RNA, 24 nt, Human
agguuccagcacaaaggagucugu

SEQ ID NO: 24491 - RNA, 19 nt, Human
ccgcugagggaggcacagg

SEQ ID NO: 24492 - RNA, 24 nt, Human
uuuauacaauaggcuuggucaaaa

SEQ ID NO: 24493 - RNA, 24 nt, Human
uauugcacuuggggaaugaguaca

SEQ ID NO: 24494 - RNA, 24 nt, Human
uuuuacauucaucauggcuacagg

SEQ ID NO: 24495 - RNA, 24 nt, Human
agcaaauuuggauguagacugaca

SEQ ID NO: 24496 - RNA, 24 nt, Human
cagcugcaucugcgccaccugcug

SEQ ID NO: 24497 - RNA, 24 nt, Human
uugcauuuauguuuuugcagucaa

SEQ ID NO: 24498 - RNA, 24 nt, Human
uuagaagauauauauaaccaaugc

SEQ ID NO: 24499 - RNA, 24 nt, Human
ucccuguaucucccauggaagaug

SEQ ID NO: 24500 - RNA, 24 nt, Human
ugaggggucaggcagaauauggug

SEQ ID NO: 24501 - RNA, 24 nt, Human
cuccugaggaugcuacucccgagc

SEQ ID NO: 24502 - RNA, 24 nt, Human
uucaccugcgcuguggacacugag

SEQ ID NO: 24503 - RNA, 24 nt, Human
uguguuuguagacuuggaacccac

SEQ ID NO: 24504 - RNA, 24 nt, Human
caccggucuucagggcuucuuggu

SEQ ID NO: 24505 - RNA, 24 nt, Human
cucucgggcucuacucagacuagc

SEQ ID NO: 24506 - RNA, 24 nt, Human
ucuggucgcggcuggcccgccccg

SEQ ID NO: 24507 - RNA, 24 nt, Human
uccaggaggagagccaggccugcc

SEQ ID NO: 24508 - RNA, 24 nt, Human
ucacuuggacuuuaucugggcaau

SEQ ID NO: 24509 - RNA, 24 nt, Human
augcagugcuucuuucuguaauuu

SEQ ID NO: 24510 - RNA, 24 nt, Human
uuaccgaaucacccucuuauuuuu

SEQ ID NO: 24511 - RNA, 24 nt, Human
uuagauuaucuuauuugaaaguau

SEQ ID NO: 24512 - RNA, 24 nt, Human
ggacgaggcugguggcgacgggcu

SEQ ID NO: 24513 - RNA, 24 nt, Human
ucucugcuugguuaggguuagugu

SEQ ID NO: 24514 - RNA, 24 nt, Human
gagcggggcgagggccgaggucgu

SEQ ID NO: 24515 - RNA, 24 nt, Human
uuggacggaacagauccggggacu

SEQ ID NO: 24516 - RNA, 24 nt, Human
uggcagggaaggaaagaauugcau

SEQ ID NO: 24517 - RNA, 24 nt, Human
ucagagugcauuuuuuuuuuuggu

SEQ ID NO: 24518 - RNA, 24 nt, Human
uaagaugcaaagagguuggaucaa

SEQ ID NO: 24519 - RNA, 21 nt, Human
caucccgaggagcaacccgug

SEQ ID NO: 24520 - RNA, 23 nt, Human
cggcuucgacgggacgacgaugc

SEQ ID NO: 24521 - RNA, 24 nt, Human
gcccagagcaagagaggcauccuc

SEQ ID NO: 24522 - RNA, 24 nt, Human
aaugguacagcaguuacaagagga

SEQ ID NO: 24523 - RNA, 24 nt, Human
uugcauuauuccugcauauucagu

SEQ ID NO: 24524 - RNA, 24 nt, Human
aauaagccaauacuuagaucuacu

SEQ ID NO: 24525 - RNA, 24 nt, Human
ucgcuguauguuugccuuggacaa

SEQ ID NO: 24526 - RNA, 24 nt, Human
uguacgccgccagcugggugagca

SEQ ID NO: 24527 - RNA, 24 nt, Human
guagcacugguugccagugcugug

SEQ ID NO: 24528 - RNA, 24 nt, Human
ugagaauggcaaaauuagucgccu

SEQ ID NO: 24529 - RNA, 24 nt, Human
uacaccacucccaagaagaauaag

SEQ ID NO: 24530 - RNA, 24 nt, Human
ugacauuguuggcaguuaaaaucu

SEQ ID NO: 24531 - RNA, 24 nt, Human
uauaagaaaauuauucaaacugau

SEQ ID NO: 24532 - RNA, 24 nt, Human
uguaaaauaaucuucugacaucag

SEQ ID NO: 24533 - RNA, 23 nt, Human
gugcuucguuuuugaaguguuga

SEQ ID NO: 24534 - RNA, 24 nt, Human
gggaaggaaaggggccugagcugg

SEQ ID NO: 24535 - RNA, 24 nt, Human
uggccuggggcugcucccugcccg

SEQ ID NO: 24536 - RNA, 24 nt, Human
ccggagcacauuccugagcgcuga

SEQ ID NO: 24537 - RNA, 24 nt, Human
ucggugcagcaugcggacucacug

SEQ ID NO: 24538 - RNA, 22 nt, Human
caccugagcgccgcaccgcuuc

SEQ ID NO: 24539 - RNA, 24 nt, Human
acaggaccgggcgagcccuggggc

SEQ ID NO: 24540 - RNA, 24 nt, Human
uauggcaagauuugaugggcuaca

SEQ ID NO: 24541 - RNA, 24 nt, Human
cauggcuagcaagccccuucaugu

SEQ ID NO: 24542 - RNA, 24 nt, Human
ccuccgaguuagcuuuugaaugca

SEQ ID NO: 24543 - RNA, 24 nt, Human
ucccugcuccucugugagguggac

SEQ ID NO: 24544 - RNA, 24 nt, Human
ccgcucucucuccaugccggagac

SEQ ID NO: 24545 - RNA, 24 nt, Human
uuccuucgggagagcggccagcgg

SEQ ID NO: 24546 - RNA, 24 nt, Human
ugaaaguguaaaugugcgaugggc

SEQ ID NO: 24547 - RNA, 17 nt, Human
uaaaaaauauuaggaua

SEQ ID NO: 24548 - RNA, 24 nt, Human
caccaggcacuuccuccuugucau

SEQ ID NO: 24549 - RNA, 24 nt, Human
uaaugcauaccuggguucaaacca

SEQ ID NO: 24550 - RNA, 24 nt, Human
caucaaaggauuuucccaucgcuc

SEQ ID NO: 24551 - RNA, 24 nt, Human
ugugcagaagaaauggaaggauuc

SEQ ID NO: 24552 - RNA, 24 nt, Human
uaucaaggaagggcaggcgugaug

SEQ ID NO: 24553 - RNA, 24 nt, Human
uaagaguguugaaaaaaaaauuca

SEQ ID NO: 24554 - RNA, 24 nt, Human
uucaaauuucuuucuuuuuuaauu

SEQ ID NO: 24555 - RNA, 24 nt, Human
uuaguaauuacucuaggagauuuu

SEQ ID NO: 24556 - RNA, 24 nt, Human
ugaauggacggguucaggccugau

SEQ ID NO: 24557 - RNA, 24 nt, Human
gggggacaguaaguuaguuccuuu

SEQ ID NO: 24558 - RNA, 24 nt, Human
uauauggaaauuguauaaaauguu

SEQ ID NO: 24559 - RNA, 24 nt, Human
gaccuuuggaaauauaaggaaaua

SEQ ID NO: 24560 - RNA, 24 nt, Human
aacagguaaccacuugagaggaug

SEQ ID NO: 24561 - RNA, 24 nt, Human
uagaauuacuaaccuuacugcccc

SEQ ID NO: 24562 - RNA, 24 nt, Human
uggaaagugggcgccauuaccuug

SEQ ID NO: 24563 - RNA, 24 nt, Human
ccugcaguuugaaaucauugcuau

SEQ ID NO: 24564 - RNA, 24 nt, Human
aaggaccugcccacugugcuuccu

SEQ ID NO: 24565 - RNA, 24 nt, Human
aaauacgugucgguguggucacaa

SEQ ID NO: 24566 - RNA, 24 nt, Human
ccagugcagggccgggccgagguc

SEQ ID NO: 24567 - RNA, 24 nt, Human
uggguaaaagcuuguugagaaaau

SEQ ID NO: 24568 - RNA, 24 nt, Human
gcgcagccugguccugggggacaa

SEQ ID NO: 24569 - RNA, 24 nt, Human
caucagccgcggcgccuuccagga

SEQ ID NO: 24570 - RNA, 22 nt, Human
uggcucgccgacauccacccac

SEQ ID NO: 24571 - RNA, 22 nt, Human
cuaaagaaagagaacagaaugu

SEQ ID NO: 24572 - RNA, 24 nt, Human
ugcugcuuuuuucacaaaugaacc

SEQ ID NO: 24573 - RNA, 24 nt, Human
aagaaugugguaacaaauucuggg

SEQ ID NO: 24574 - RNA, 24 nt, Human
aguuauuuuauuuuuucuaaaaac

SEQ ID NO: 24575 - RNA, 24 nt, Human
uuaaaguuauuuacauuuaauggc

SEQ ID NO: 24576 - RNA, 24 nt, Human
ugccccaggaugggugaguucaac

SEQ ID NO: 24577 - RNA, 24 nt, Human
uuucugcuggagaucaucgcuggu

SEQ ID NO: 24578 - RNA, 24 nt, Human
uauggcaagucacuuugacagaca

SEQ ID NO: 24579 - RNA, 24 nt, Human
uacaccacucccaagaagaauaag

SEQ ID NO: 24580 - RNA, 22 nt, Human
uguggcaaugcccguugcucag

SEQ ID NO: 24581 - RNA, 24 nt, Human
aacacaauuaguuacuguuaaacu

SEQ ID NO: 24582 - RNA, 20 nt, Human
gacugugugugcuggugugu

SEQ ID NO: 24583 - RNA, 24 nt, Human
ggaguucuuucauguccucugcuu

SEQ ID NO: 24584 - RNA, 24 nt, Human
ugggaugaucucaaggggcaccuu

SEQ ID NO: 24585 - RNA, 24 nt, Human
uggaagaugcuggaggagaaaccc

SEQ ID NO: 24586 - RNA, 24 nt, Human
ugagauuacagggcaugaggccac

SEQ ID NO: 24587 - RNA, 24 nt, Human
ccccggguucaagcaacuuuccug

SEQ ID NO: 24588 - RNA, 23 nt, Human
uggagagguggaaugugucuggc

SEQ ID NO: 24589 - RNA, 24 nt, Human
uggggaaaaacauuaaaauuaaaa

SEQ ID NO: 24590 - RNA, 24 nt, Human
uacagaguacucugaaaaaagaaa

SEQ ID NO: 24591 - RNA, 24 nt, Human
uacuuuauaaauuagucccucauu

SEQ ID NO: 24592 - RNA, 24 nt, Human
uaguagaaucaggcacugcucgca

SEQ ID NO: 24593 - RNA, 24 nt, Human
ugucuaagaaaacaaaaaagagaa

SEQ ID NO: 24594 - RNA, 24 nt, Human
caugacccaccccagcagauagac

SEQ ID NO: 24595 - RNA, 24 nt, Human
cgagcagccucucgccauuucccg

SEQ ID NO: 24596 - RNA, 24 nt, Human
uccuggaagcaaggcggcucuagc

SEQ ID NO: 24597 - RNA, 24 nt, Human
uuuacagacuggagcagcucgauu

SEQ ID NO: 24598 - RNA, 24 nt, Human
cauuggggcuuuccagcucucaca

SEQ ID NO: 24599 - RNA, 19 nt, Human
uguuccggaguucuugcuc

SEQ ID NO: 24600 - RNA, 24 nt, Human
ugccuggccggcgccgcagucggc

SEQ ID NO: 24601 - RNA, 24 nt, Human
aggcaauuugguuaccugcaaugg

SEQ ID NO: 24602 - RNA, 24 nt, Human
ccuuuuuucagggccauaaugaca

SEQ ID NO: 24603 - RNA, 19 nt, Human
uggaauggggguuaaugag

SEQ ID NO: 24604 - RNA, 24 nt, Human
ugaugugccccauggacauaucac

SEQ ID NO: 24605 - RNA, 24 nt, Human
ugugaagcguucccaccggcgccu

SEQ ID NO: 24606 - RNA, 19 nt, Human
uaacauagcauuaaggugg

SEQ ID NO: 24607 - RNA, 24 nt, Human
ggauaucgucuuucaucacguucu

SEQ ID NO: 24608 - RNA, 24 nt, Human
uauccuaagaucagcugggcaugg

SEQ ID NO: 24609 - RNA, 24 nt, Human
ugaaaguaauuaauuuaugacaua

SEQ ID NO: 24610 - RNA, 18 nt, Human
uaucaguagugguccugg

SEQ ID NO: 24611 - RNA, 24 nt, Human
gcgaggcuuuugauggggcucggg

SEQ ID NO: 24612 - RNA, 24 nt, Human
ucacuuccgaccugcuggccugcc

SEQ ID NO: 24613 - RNA, 24 nt, Human
ucaggccagggauacaaagcgggg

SEQ ID NO: 24614 - RNA, 24 nt, Human
ugacccguggauuggcaaguuauu

SEQ ID NO: 24615 - RNA, 22 nt, Human
auuguacucuuucuuuuuaggc

SEQ ID NO: 24616 - RNA, 24 nt, Human
cugcagcagcaugcacuucuuggu

SEQ ID NO: 24617 - RNA, 24 nt, Human
uuauagcugaauuaucccuuuucu

SEQ ID NO: 24618 - RNA, 24 nt, Human
uagaggcagaggagcggaaggcag

SEQ ID NO: 24619 - RNA, 24 nt, Human
uuggagcagaacuacugagaaaaa

SEQ ID NO: 24620 - RNA, 24 nt, Human
ugagauucuugcucaccgucuggg

SEQ ID NO: 24621 - RNA, 24 nt, Human
ucuacaguuucgucuccaggucag

SEQ ID NO: 24622 - RNA, 24 nt, Human
uaccaggugaauauuggcuuggaa

SEQ ID NO: 24623 - RNA, 24 nt, Human
agccgguaaugcccucauggaugg

SEQ ID NO: 24624 - RNA, 24 nt, Human
uaacaucagaucccagaaaacagu

SEQ ID NO: 24625 - RNA, 24 nt, Human
uauagcaagaccccaucucuaaaa

SEQ ID NO: 24626 - RNA, 24 nt, Human
ugaggaaacuaaacucuguggaag

SEQ ID NO: 24627 - RNA, 24 nt, Human
cagcggcagagagccauccucuau

SEQ ID NO: 24628 - RNA, 24 nt, Human
uauggcaagucacuuugacagaca

SEQ ID NO: 24629 - RNA, 24 nt, Human
ugagaauggcaaaauuagucgccu

SEQ ID NO: 24630 - RNA, 24 nt, Human
uacaccacucccaagaagaauaag

SEQ ID NO: 24631 - RNA, 24 nt, Human
ucagcagucuugguuaucacauuu

SEQ ID NO: 24632 - RNA, 23 nt, Human
uaugccacauagugugucaggag

SEQ ID NO: 24633 - RNA, 24 nt, Human
uacaauggaugaggcucuggauuu

SEQ ID NO: 24634 - RNA, 24 nt, Human
ugaguacauggaguagagaggcca

SEQ ID NO: 24635 - RNA, 24 nt, Human
uucucgauuaaaauacacacgauc

SEQ ID NO: 24636 - RNA, 24 nt, Human
uggaauagguacuucucgaaauuc

SEQ ID NO: 24637 - RNA, 24 nt, Human
caccaguaggccuuugugaagugg

SEQ ID NO: 24638 - RNA, 24 nt, Human
cgggaucagugguuuaaacaagcg

SEQ ID NO: 24639 - RNA, 24 nt, Human
uuaguaagagugaaauagauuucc

SEQ ID NO: 24640 - RNA, 24 nt, Human
uauggcaagucacuuugacagaca

SEQ ID NO: 24641 - RNA, 24 nt, Human
ugagaauggcaaaauuagucgccu

SEQ ID NO: 24642 - RNA, 24 nt, Human
uacaccacucccaagaagaauaag

SEQ ID NO: 24643 - RNA, 20 nt, Human
ugcguugaucauucucagau

SEQ ID NO: 24644 - RNA, 24 nt, Human
cauucaucugcggagccaaaacca

SEQ ID NO: 24645 - RNA, 24 nt, Human
acccgcugccucaucaccuucgca

SEQ ID NO: 24646 - RNA, 22 nt, Human
ucauauguagacaugagggucc

SEQ ID NO: 24647 - RNA, 24 nt, Human
ugggagaagccaagaaguggcugc

SEQ ID NO: 24648 - RNA, 24 nt, Human
aggguuauaauaauguuaacaugg

SEQ ID NO: 24649 - RNA, 24 nt, Human
aagaugccgcauuuggauuggaug

SEQ ID NO: 24650 - RNA, 24 nt, Human
aggacaaaaaggaguaggcgacgg

SEQ ID NO: 24651 - RNA, 24 nt, Human
uggacaggcaugauuauugggcca

SEQ ID NO: 24652 - RNA, 24 nt, Human
gauuacaggcaugagucaccauac

SEQ ID NO: 24653 - RNA, 24 nt, Human
ugggcaaguuggugagguucugca

SEQ ID NO: 24654 - RNA, 24 nt, Human
gugcugccccuugaggaagcaaag

SEQ ID NO: 24655 - RNA, 24 nt, Human
uuggacauucucgcuaucuccugu

SEQ ID NO: 24656 - RNA, 24 nt, Human
uacaccacucccaagaagaauaag

SEQ ID NO: 24657 - RNA, 24 nt, Human
uaguucucucucucucccucgggc

SEQ ID NO: 24658 - RNA, 23 nt, Human
uguccaggaugcucaggcuguag

SEQ ID NO: 24659 - RNA, 24 nt, Human
accuugggaucuugugcugugaag

SEQ ID NO: 24660 - RNA, 24 nt, Human
gagcccucagcccuggaacaaggc

SEQ ID NO: 24661 - RNA, 24 nt, Human
ggaccugaggcagaacuggggugg

SEQ ID NO: 24662 - RNA, 24 nt, Human
ucuuuugggauguauuauaugccu

SEQ ID NO: 24663 - RNA, 24 nt, Human
gaguacuuuguaaccacuuugaua

SEQ ID NO: 24664 - RNA, 24 nt, Human
ccagagccugggugcagucaaagg

SEQ ID NO: 24665 - RNA, 24 nt, Human
uugccugggucuuggauuaaacug

SEQ ID NO: 24666 - RNA, 24 nt, Human
caucugaucuauaaaugcgguggc

SEQ ID NO: 24667 - RNA, 24 nt, Human
uuaaagcacaguucuuggauccac

SEQ ID NO: 24668 - RNA, 24 nt, Human
ccacggagaaggguugugggcccc

SEQ ID NO: 24669 - RNA, 24 nt, Human
gcggaccugcaggugccgcggagc

SEQ ID NO: 24670 - RNA, 20 nt, Human
uuagcccacaggccaaggug

SEQ ID NO: 24671 - RNA, 23 nt, Human
uccaagcgagggugcuucugagg

SEQ ID NO: 24672 - RNA, 24 nt, Human
uucccagaagaauaaaaguuucuc

SEQ ID NO: 24673 - RNA, 24 nt, Human
ugacuucauggugcuacaauaacc

SEQ ID NO: 24674 - RNA, 24 nt, Human
aagcugcaucgcuugaaaaaaguu

SEQ ID NO: 24675 - RNA, 24 nt, Human
aaagcccaggaagaagacgaggau

SEQ ID NO: 24676 - RNA, 24 nt, Human
uaagucagccaagugugucgugcc

SEQ ID NO: 24677 - RNA, 19 nt, Human
ugucaaaggagacccuggc

SEQ ID NO: 24678 - RNA, 24 nt, Human
aaggagcagcgacuggacccagag

SEQ ID NO: 24679 - RNA, 24 nt, Human
cagcaggcugcugagcgccuggag

SEQ ID NO: 24680 - RNA, 24 nt, Human
ucccaggaagaucuggccucuguc

SEQ ID NO: 24681 - RNA, 24 nt, Human
ucuggagagcuuuggauccugggu

SEQ ID NO: 24682 - RNA, 24 nt, Human
acuuagcaacuggucacucauccu

SEQ ID NO: 24683 - RNA, 23 nt, Human
ugccaaggaccaggaugauggag

SEQ ID NO: 24684 - RNA, 24 nt, Human
uuacaagugagaacaugugguguu

SEQ ID NO: 24685 - RNA, 24 nt, Human
uagcuaguuauccugaugcucucc

SEQ ID NO: 24686 - RNA, 24 nt, Human
uaucaacguaucaccuagguauua

SEQ ID NO: 24687 - RNA, 24 nt, Human
ucaggagaccauugcaucauuggc

SEQ ID NO: 24688 - RNA, 24 nt, Human
gacgugaagccuuguuugaagagc

SEQ ID NO: 24689 - RNA, 24 nt, Human
aggcauguuggagacuugggcaau

SEQ ID NO: 24690 - RNA, 24 nt, Human
ucuuaauuaauuagaaaauaugug

SEQ ID NO: 24691 - RNA, 24 nt, Human
aggaacucagacaaauaugaaugu

SEQ ID NO: 24692 - RNA, 24 nt, Human
ugcaauagaaguucaugaaguacu

SEQ ID NO: 24693 - RNA, 24 nt, Human
ggggcccaccacccacuuugggag

SEQ ID NO: 24694 - RNA, 24 nt, Human
uaaguccguguggcuuuuucuuac

SEQ ID NO: 24695 - RNA, 24 nt, Human
agccagaaaccaggguggcuucca

SEQ ID NO: 24696 - RNA, 24 nt, Human
uuggugugaggaaggaagacuuua

SEQ ID NO: 24697 - RNA, 24 nt, Human
auuucauucacuggggaggaacaa

SEQ ID NO: 24698 - RNA, 23 nt, Human
uaaggcgaggcggaauuaaaccc

SEQ ID NO: 24699 - RNA, 24 nt, Human
uagcaaaucgagucuuaaauaauc

SEQ ID NO: 24700 - RNA, 24 nt, Human
uauggcaaggaccugauggagaag

SEQ ID NO: 24701 - RNA, 24 nt, Human
uaagcugguuuaugaaaaagaccu

SEQ ID NO: 24702 - RNA, 24 nt, Human
aagacuuuccccuauugauuaucu

SEQ ID NO: 24703 - RNA, 24 nt, Human
ugccauguaggcaucugucuggag

SEQ ID NO: 24704 - RNA, 24 nt, Human
aagggugccucuaaaagcuugaca

SEQ ID NO: 24705 - RNA, 24 nt, Human
uugcaugguucccuuucauacuac

SEQ ID NO: 24706 - RNA, 24 nt, Human
uaagaugcuagaaauucaauggga

SEQ ID NO: 24707 - RNA, 24 nt, Human
agcaagucccuguaauaagauagg

SEQ ID NO: 24708 - RNA, 24 nt, Human
uauguuaucuucugcaauuccaga

SEQ ID NO: 24709 - RNA, 24 nt, Human
ugagaaaaaaauugcacagaauac

SEQ ID NO: 24710 - RNA, 24 nt, Human
uauuucaccauacuauggagaaua

SEQ ID NO: 24711 - RNA, 24 nt, Human
uuccaugguucuccaagcacgggc

SEQ ID NO: 24712 - RNA, 24 nt, Human
uggcguaauaucgaagaggcccgc

SEQ ID NO: 24713 - RNA, 24 nt, Human
ugcgugcaggccuccacggccccg

SEQ ID NO: 24714 - RNA, 24 nt, Human
ugaaauuucugguacuuuguauau

SEQ ID NO: 24715 - RNA, 22 nt, Human
uaaaacauagcaaauggcauca

SEQ ID NO: 24716 - RNA, 24 nt, Human
ugagcccuccagacaauuuuuaag

SEQ ID NO: 24717 - RNA, 24 nt, Human
aggacaguguuccacaggcagauc

SEQ ID NO: 24718 - RNA, 24 nt, Human
uaaguaacauuuggccuuuuggug

SEQ ID NO: 24719 - RNA, 24 nt, Human
caucucaguccuauuuuugaguuu

SEQ ID NO: 24720 - RNA, 20 nt, Human
gacaagcugcaugugggauc

SEQ ID NO: 24721 - RNA, 24 nt, Human
gaggagaaacccugggaaggcucc

SEQ ID NO: 24722 - RNA, 24 nt, Human
ugggcaggaaggaugugaggacuc

SEQ ID NO: 24723 - RNA, 24 nt, Human
uaauuuuucuugcaauuguaaucu

SEQ ID NO: 24724 - RNA, 24 nt, Human
ucucaauacguuuacagagggugc

SEQ ID NO: 24725 - RNA, 24 nt, Human
uauuacuguuguagucccucacuu

SEQ ID NO: 24726 - RNA, 24 nt, Human
ugccugaaguuuucagaaaagcug

SEQ ID NO: 24727 - RNA, 24 nt, Human
ugugaaggcgacauguauaaugac

SEQ ID NO: 24728 - RNA, 24 nt, Human
ugagacuaaggcuuucgacccugg

SEQ ID NO: 24729 - RNA, 24 nt, Human
uggaugcugccucagacaaaggca

SEQ ID NO: 24730 - RNA, 24 nt, Human
ugaccaggcuagaccacacgugcc

SEQ ID NO: 24731 - RNA, 24 nt, Human
ccuccauuuccuugaaaacugaac

SEQ ID NO: 24732 - RNA, 21 nt, Human
cuuugaggaguucucagcgcc

SEQ ID NO: 24733 - RNA, 24 nt, Human
gccauuuggggaaaucgcaugccg

SEQ ID NO: 24734 - RNA, 24 nt, Human
uggguggugguggcuguggccaug

SEQ ID NO: 24735 - RNA, 24 nt, Human
auggugcuuucacaaaauggagag

SEQ ID NO: 24736 - RNA, 24 nt, Human
uaccugugcaugacagaugagggg

SEQ ID NO: 24737 - RNA, 24 nt, Human
uauugugcaccauauggaaguacu

SEQ ID NO: 24738 - RNA, 22 nt, Human
ucagugaaagaauuagucuggg

SEQ ID NO: 24739 - RNA, 24 nt, Human
cagccuauugugggaccucgugau

SEQ ID NO: 24740 - RNA, 24 nt, Human
uuagauagccuacaucuuucuccc

SEQ ID NO: 24741 - RNA, 24 nt, Human
uauuaguucugucccucuaagaga

SEQ ID NO: 24742 - RNA, 24 nt, Human
uuaguauacagacgacagugaacu

SEQ ID NO: 24743 - RNA, 24 nt, Human
uuggaaagagaccagaaccgaagc

SEQ ID NO: 24744 - RNA, 18 nt, Human
uacagguugggaggggag

SEQ ID NO: 24745 - RNA, 24 nt, Human
ccucaagucggguaugaaggagcu

SEQ ID NO: 24746 - RNA, 24 nt, Human
caaaagacaaagccagcccacucc

SEQ ID NO: 24747 - RNA, 24 nt, Human
cagccccugggcagccacguucug

SEQ ID NO: 24748 - RNA, 24 nt, Human
aagaaggcauuuucacacaaggcu

SEQ ID NO: 24749 - RNA, 24 nt, Human
caugaggccgcgccuguguccagc

SEQ ID NO: 24750 - RNA, 24 nt, Human
ugucugugucuaucucccuaucug

SEQ ID NO: 24751 - RNA, 24 nt, Human
uggguuagagccccacccuuagga

SEQ ID NO: 24752 - RNA, 24 nt, Human
aguugcuccagaaaaaccuguaaa

SEQ ID NO: 24753 - RNA, 24 nt, Human
gagccgagcgaagcgaugccuaaa

SEQ ID NO: 24754 - RNA, 24 nt, Human
uuguauguuuggauugcagaagaa

SEQ ID NO: 24755 - RNA, 24 nt, Human
uugaucuugaagaaacugggcgug

SEQ ID NO: 24756 - RNA, 24 nt, Human
aggaaggagauauagugaagagga

SEQ ID NO: 24757 - RNA, 24 nt, Human
guagaguuuucuucaggcuuaaag

SEQ ID NO: 24758 - RNA, 24 nt, Human
cagcagccaagacuguuuagcuga

SEQ ID NO: 24759 - RNA, 24 nt, Human
cuuggaguuauacagguaugaaau

SEQ ID NO: 24760 - RNA, 21 nt, Human
ugggcauguggaucaucuagg

SEQ ID NO: 24761 - RNA, 24 nt, Human
uacuucauaaauaugaauuauguu

SEQ ID NO: 24762 - RNA, 24 nt, Human
guucacaccagcuuguuucaguuu

SEQ ID NO: 24763 - RNA, 24 nt, Human
caaccuuugaaacccuuugcuuau

SEQ ID NO: 24764 - RNA, 24 nt, Human
gauggcagugcaaauauccaagaa

SEQ ID NO: 24765 - RNA, 24 nt, Human
uggccugaugauccacagcggaga

SEQ ID NO: 24766 - RNA, 24 nt, Human
ugugugccauugcccaggcagagu

SEQ ID NO: 24767 - RNA, 24 nt, Human
ucagaacucauuuggugguggcaa

SEQ ID NO: 24768 - RNA, 24 nt, Human
uaaguacauaggucuuuauuuaaa

SEQ ID NO: 24769 - RNA, 18 nt, Human
gucccgguguagaaugcc

SEQ ID NO: 24770 - RNA, 24 nt, Human
uaagaaaugcaguccaauuuuaua

SEQ ID NO: 24771 - RNA, 24 nt, Human
aggcaggggcccuggagaggaugc

SEQ ID NO: 24772 - RNA, 24 nt, Human
auggugccugauuccugcaugguc

SEQ ID NO: 24773 - RNA, 24 nt, Human
ugccauggagcgacaggacggcag

SEQ ID NO: 24774 - RNA, 24 nt, Human
aggggguuugcuggggaacuggcg

SEQ ID NO: 24775 - RNA, 19 nt, Human
ucccauggcccagggagcc

SEQ ID NO: 24776 - RNA, 24 nt, Human
ugacaaggugagagggagaggagg

SEQ ID NO: 24777 - RNA, 24 nt, Human
ugaguaugauuaugugugaaaguu

SEQ ID NO: 24778 - RNA, 24 nt, Human
uaauguguguguauauauguaugu

SEQ ID NO: 24779 - RNA, 24 nt, Human
gugaaaguagucuuguuuuaugag

SEQ ID NO: 24780 - RNA, 24 nt, Human
aaccucuucuguggagucugcgug

SEQ ID NO: 24781 - RNA, 24 nt, Human
ucccucuggcugaagacugagaag

SEQ ID NO: 24782 - RNA, 24 nt, Human
aaccccuuucugcuguucucccau

SEQ ID NO: 24783 - RNA, 24 nt, Human
uuuguaaguguucaguuucuacac

SEQ ID NO: 24784 - RNA, 24 nt, Human
uggccugaugauccacagcuggag

SEQ ID NO: 24785 - RNA, 24 nt, Human
aggcagcucgacaaggaacguguc

SEQ ID NO: 24786 - RNA, 24 nt, Human
caaaauguccuuuaggucccuagg

SEQ ID NO: 24787 - RNA, 24 nt, Human
ucagugaaaguguacuguuuacau

SEQ ID NO: 24788 - RNA, 24 nt, Human
augcaccucacuaaggcucaucug

SEQ ID NO: 24789 - RNA, 23 nt, Human
ucagugcgguucagcucaaggga

SEQ ID NO: 24790 - RNA, 24 nt, Human
uuccucaggaacagagaacuuugc

SEQ ID NO: 24791 - RNA, 24 nt, Human
ucaguugccuuccugguacgcguc

SEQ ID NO: 24792 - RNA, 24 nt, Human
ucuccauuugaccauuguuuaguc

SEQ ID NO: 24793 - RNA, 24 nt, Human
uacgugaggugugcuugggacugu

SEQ ID NO: 24794 - RNA, 24 nt, Human
uguggauauaguuuucccuguugg

SEQ ID NO: 24795 - RNA, 24 nt, Human
ugacuaaagaaaccugcugcacau

SEQ ID NO: 24796 - RNA, 24 nt, Human
gagcaugcaucuucucggugagcc

SEQ ID NO: 24797 - RNA, 24 nt, Human
uuuguaauucuguauauucuauac

SEQ ID NO: 24798 - RNA, 24 nt, Human
uauguggauauuuuuuaaguggac

SEQ ID NO: 24799 - RNA, 24 nt, Human
uuuaucaguuaauaauauuaauca

SEQ ID NO: 24800 - RNA, 24 nt, Human
uccccaaccccagggacuccccuu

SEQ ID NO: 24801 - RNA, 19 nt, Human
uuucgcagagcugaagauc

SEQ ID NO: 24802 - RNA, 24 nt, Human
cgucuggugggaugcgcacccccu

SEQ ID NO: 24803 - RNA, 24 nt, Human
uggaaaaugcgggggccauacaug

SEQ ID NO: 24804 - RNA, 24 nt, Human
ugacagugauggggagcugggauc

SEQ ID NO: 24805 - RNA, 22 nt, Human
uauacugcucuuagccagaguc

SEQ ID NO: 24806 - RNA, 24 nt, Human
acgcggagcccagcgggcgcgcgu

SEQ ID NO: 24807 - RNA, 24 nt, Human
uaacaugaguguacuaacuaccuu

SEQ ID NO: 24808 - RNA, 24 nt, Human
aucagcuuuucaccucuccaguuu

SEQ ID NO: 24809 - RNA, 24 nt, Human
ucccaauacccauuuauccuauuu

SEQ ID NO: 24810 - RNA, 20 nt, Human
uacacuuaacuucuccuaga

SEQ ID NO: 24811 - RNA, 24 nt, Human
augaauccaaacguggugaggggg

SEQ ID NO: 24812 - RNA, 24 nt, Human
uacugggcgccugucacccaggaa

SEQ ID NO: 24813 - RNA, 24 nt, Human
cagcaaccagcagggcuccagcgg

SEQ ID NO: 24814 - RNA, 24 nt, Human
uuucucauccucuggccaauggaa

SEQ ID NO: 24815 - RNA, 24 nt, Human
aaguaucuaucaaucugucguuac

SEQ ID NO: 24816 - RNA, 24 nt, Human
uggcagucagaaaaacccauaucu

SEQ ID NO: 24817 - RNA, 24 nt, Human
ucuaggagcccugaauagaggcgc

SEQ ID NO: 24818 - RNA, 24 nt, Human
ugagucuuccagggucaagucauu

SEQ ID NO: 24819 - RNA, 24 nt, Human
gaggugauucauuaaauuaauaga

SEQ ID NO: 24820 - RNA, 24 nt, Human
ucaaaaauuaccagaaauaauucu

SEQ ID NO: 24821 - RNA, 24 nt, Human
uucaaugccacuauccuucccauc

SEQ ID NO: 24822 - RNA, 24 nt, Human
accaccuucuaucuuugagugcca

SEQ ID NO: 24823 - RNA, 24 nt, Human
gaggaccuggguagcuaaggcagu

SEQ ID NO: 24824 - RNA, 24 nt, Human
agggaagauucgagacagcaaucg

SEQ ID NO: 24825 - RNA, 24 nt, Human
agugguugcagucaugucaacagg

SEQ ID NO: 24826 - RNA, 24 nt, Human
uuacucaaugccuugaauugaggg

SEQ ID NO: 24827 - RNA, 21 nt, Human
ucacagaguuuuccuuuuuuu

SEQ ID NO: 24828 - RNA, 24 nt, Human
agugguaugaucucaguugaaugc

SEQ ID NO: 24829 - RNA, 24 nt, Human
ucacaccaaaauguauuuauuaca

SEQ ID NO: 24830 - RNA, 24 nt, Human
acaaggguucuaaaaacuuggaca

SEQ ID NO: 24831 - RNA, 24 nt, Human
gggaaagacaggggaacaucaaag

SEQ ID NO: 24832 - RNA, 24 nt, Human
aagcacaaaaucugacaaugaaac

SEQ ID NO: 24833 - RNA, 21 nt, Human
uggccgaguggcucauucaga

SEQ ID NO: 24834 - RNA, 24 nt, Human
ugcacauaccacguggcgggaccu

SEQ ID NO: 24835 - RNA, 24 nt, Human
uggaaucuaccaacuguuuagggc

SEQ ID NO: 24836 - RNA, 24 nt, Human
aggcauuggcaugaccaaagcuga

SEQ ID NO: 24837 - RNA, 24 nt, Human
accauggugagcccauuggcaggg

SEQ ID NO: 24838 - RNA, 24 nt, Human
ugggguccaggucgucgccgcccu

SEQ ID NO: 24839 - RNA, 24 nt, Human
cggccaguggucuugucgaagagg

SEQ ID NO: 24840 - RNA, 24 nt, Human
gacagggcuuccaccgcgagcuuc

SEQ ID NO: 24841 - RNA, 24 nt, Human
augcugcccuggggaaccaacugg

SEQ ID NO: 24842 - RNA, 24 nt, Human
uggccugaugauccacagcggaga

SEQ ID NO: 24843 - RNA, 24 nt, Human
gagcguccguccagcaggcuugac

SEQ ID NO: 24844 - RNA, 24 nt, Human
uccaggguauugaaagugccugag

SEQ ID NO: 24845 - RNA, 24 nt, Human
ugcacagauacugaaugggugugu

SEQ ID NO: 24846 - RNA, 24 nt, Human
uuaucauugccuggucaaggaagc

SEQ ID NO: 24847 - RNA, 24 nt, Human
caguggcugcccaaggaagccugc

SEQ ID NO: 24848 - RNA, 24 nt, Human
uugauggcuguggucuaugcaucu

SEQ ID NO: 24849 - RNA, 24 nt, Human
cgaggucauuuguugcguugaauu

SEQ ID NO: 24850 - RNA, 24 nt, Human
cagcauucuggggcuuguaacacu

SEQ ID NO: 24851 - RNA, 24 nt, Human
ucagugguggcgccugggcucagc

SEQ ID NO: 24852 - RNA, 24 nt, Human
uggaaaugaugagauuauuuccug

SEQ ID NO: 24853 - RNA, 24 nt, Human
ucuagaauaccagaaacaucuacu

SEQ ID NO: 24854 - RNA, 24 nt, Human
ugacaaguacauguuccuuuggga

SEQ ID NO: 24855 - RNA, 24 nt, Human
cauugagaaucuguaccaaaaccu

SEQ ID NO: 24856 - RNA, 24 nt, Human
cacccaggaggagugggcuuugcu

SEQ ID NO: 24857 - RNA, 24 nt, Human
aagcaucugaguuugagaccaugg

SEQ ID NO: 24858 - RNA, 24 nt, Human
aaugugcugguaacugcuuugcuu

SEQ ID NO: 24859 - RNA, 24 nt, Human
cguucagcagagucagggaugggu

SEQ ID NO: 24860 - RNA, 20 nt, Human
ugugacgcagugagcgugcu

SEQ ID NO: 24861 - RNA, 24 nt, Human
cgacggcauccggggccuguacca

SEQ ID NO: 24862 - RNA, 17 nt, Human
ucuaccguuccgcugcc

SEQ ID NO: 24863 - RNA, 22 nt, Human
ugccuugggucccuucaguagc

SEQ ID NO: 24864 - RNA, 24 nt, Human
ugucaggaaggggaagcggguuuc

SEQ ID NO: 24865 - RNA, 24 nt, Human
cagcagcagcaaaagaggucagcu

SEQ ID NO: 24866 - RNA, 24 nt, Human
aguuuggauucugaaaacuaacug

SEQ ID NO: 24867 - RNA, 24 nt, Human
cagauccaagagauauauuuggca

SEQ ID NO: 24868 - RNA, 24 nt, Human
ucuggaguucuuccgccaggugau

SEQ ID NO: 24869 - RNA, 23 nt, Human
uucauuggaggguugagcuuuga

SEQ ID NO: 24870 - RNA, 24 nt, Human
uaugccacuguggaggagguggau

SEQ ID NO: 24871 - RNA, 20 nt, Human
uggccggaagcugggcgggu

SEQ ID NO: 24872 - RNA, 17 nt, Human
gaggauggaguccgcgc

SEQ ID NO: 24873 - RNA, 24 nt, Human
cucuccuuugauaaagaugcgaug

SEQ ID NO: 24874 - RNA, 22 nt, Human
ugggcgcauccuugauuggcau

SEQ ID NO: 24875 - RNA, 24 nt, Human
cgaguacaagccccaggaugcuac

SEQ ID NO: 24876 - RNA, 24 nt, Human
ugacgcagcguuuccccccauccc

SEQ ID NO: 24877 - RNA, 24 nt, Human
caugacccccucccgaguggacug

SEQ ID NO: 24878 - RNA, 24 nt, Human
ucccagcuaguucacuccuuucgc

SEQ ID NO: 24879 - RNA, 23 nt, Human
ucagagcggagccgacagagagc

SEQ ID NO: 24880 - RNA, 24 nt, Human
cggcaguccugauggcccggcaug

SEQ ID NO: 24881 - RNA, 24 nt, Human
cuuccaguggaaaaggcauuuugg

SEQ ID NO: 24882 - RNA, 17 nt, Human
uuagcccuuggcccauc

SEQ ID NO: 24883 - RNA, 24 nt, Human
cuccaucccacacccccaggggcu

SEQ ID NO: 24884 - RNA, 24 nt, Human
gugcagagacucuuccaggucaaa

SEQ ID NO: 24885 - RNA, 24 nt, Human
cgaugcgaugcuccaggugcuggg

SEQ ID NO: 24886 - RNA, 24 nt, Human
ccugaaguacaagaaaggaggugu

SEQ ID NO: 24887 - RNA, 24 nt, Human
caaugccaagcuggagauggugcc

SEQ ID NO: 24888 - RNA, 24 nt, Human
caugcagaugaugccguauuuacc

SEQ ID NO: 24889 - RNA, 24 nt, Human
aagcguuaucugucaaagcaauuc

SEQ ID NO: 24890 - RNA, 24 nt, Human
gcuuccuuaucccaccccagagac

SEQ ID NO: 24891 - RNA, 24 nt, Human
agaaggaaguggucucugcccagc

SEQ ID NO: 24892 - RNA, 24 nt, Human
uauuauacuuaaaugaacucaagu

SEQ ID NO: 24893 - RNA, 24 nt, Human
ccaggccaaaaaggcucaacauuu

SEQ ID NO: 24894 - RNA, 24 nt, Human
cuggagcagguccaccggccccua

SEQ ID NO: 24895 - RNA, 24 nt, Human
ucaaaggucuucucggauggaagu

SEQ ID NO: 24896 - RNA, 24 nt, Human
uaugcagccuccugcucucccgag

SEQ ID NO: 24897 - RNA, 24 nt, Human
gcuggagcuauucacuuccagcgu

SEQ ID NO: 24898 - RNA, 24 nt, Human
ugggacuccuguuacccgcaaguc

SEQ ID NO: 24899 - RNA, 24 nt, Human
uucaacuaaugcaauagacuuaaa

SEQ ID NO: 24900 - RNA, 24 nt, Human
cgagcaaaaaggcaaagaccaaga

SEQ ID NO: 24901 - RNA, 24 nt, Human
cuugaacaauaaugagucgcuucu

SEQ ID NO: 24902 - RNA, 24 nt, Human
uguguacauauauguguguauaua

SEQ ID NO: 24903 - RNA, 23 nt, Human
uaaugggaauucuaauaauauga

SEQ ID NO: 24904 - RNA, 24 nt, Human
acuuucaggagaggcaagcagauu

SEQ ID NO: 24905 - RNA, 24 nt, Human
uuugacacugcaaacucaguggau

SEQ ID NO: 24906 - RNA, 24 nt, Human
ucccucaaguuucauuugugaagc

SEQ ID NO: 24907 - RNA, 24 nt, Human
cugaaguaucugaaaaauaugaaa

SEQ ID NO: 24908 - RNA, 24 nt, Human
acaaagcaagagaagaagcagaga

SEQ ID NO: 24909 - RNA, 21 nt, Human
cauuggacaggacauccagcc

SEQ ID NO: 24910 - RNA, 24 nt, Human
cagcggcagagagccauccucuau

SEQ ID NO: 24911 - RNA, 19 nt, Human
ucccauggacuugcccggg

SEQ ID NO: 24912 - RNA, 24 nt, Human
uccccuggaaaaggccucucggcg

SEQ ID NO: 24913 - RNA, 24 nt, Human
ucgcucagccaggagaugagaugc

SEQ ID NO: 24914 - RNA, 24 nt, Human
cucgcuccccacggccgcggugca

SEQ ID NO: 24915 - RNA, 24 nt, Human
ugucccggacagugcgugcgagcg

SEQ ID NO: 24916 - RNA, 24 nt, Human
acugccuugugaugccucccuaga

SEQ ID NO: 24917 - RNA, 19 nt, Human
ugaguggacauuauuggca

SEQ ID NO: 24918 - RNA, 24 nt, Human
aauacaguuuuuagucaaaguggc

SEQ ID NO: 24919 - RNA, 24 nt, Human
uuggugccuauauuguaacaauua

SEQ ID NO: 24920 - RNA, 24 nt, Human
guaguaaauucuguaaaauacuuu

SEQ ID NO: 24921 - RNA, 24 nt, Human
acagaaagguugggcgacguuggg

SEQ ID NO: 24922 - RNA, 24 nt, Human
uugaucuugaagaaacugggcgug

SEQ ID NO: 24923 - RNA, 24 nt, Human
cauuaaggcuguggauaagcuggg

SEQ ID NO: 24924 - RNA, 24 nt, Human
aggaaggagauauagugaagagga

SEQ ID NO: 24925 - RNA, 24 nt, Human
guagaguuuucuucaggcuuaaag

SEQ ID NO: 24926 - RNA, 24 nt, Human
acaguaacagcagcacagacccaa

SEQ ID NO: 24927 - RNA, 24 nt, Human
ugagaauagagucuuucuucuuuc

SEQ ID NO: 24928 - RNA, 24 nt, Human
uugaucuugaagaaacugggcgug

SEQ ID NO: 24929 - RNA, 24 nt, Human
aggaaggagauauagugaagagga

SEQ ID NO: 24930 - RNA, 24 nt, Human
ugaaagcccccgguaucauuccuc

SEQ ID NO: 24931 - RNA, 24 nt, Human
guagaguuuucuucaggcuuaaag

SEQ ID NO: 24932 - RNA, 24 nt, Human
uugaucuugaagaaacugggcgug

SEQ ID NO: 24933 - RNA, 23 nt, Human
uccgugcgcguugcugcggccgu

SEQ ID NO: 24934 - RNA, 24 nt, Human
aggaaggagauauagugaagagga

SEQ ID NO: 24935 - RNA, 24 nt, Human
guagaguuuucuucaggcuuaaag

SEQ ID NO: 24936 - RNA, 24 nt, Human
uugaucuugaagaaacugggcgug

SEQ ID NO: 24937 - RNA, 24 nt, Human
aggaaggagauauagugaagagga

SEQ ID NO: 24938 - RNA, 24 nt, Human
guagaguuuucuucaggcuuaaag

SEQ ID NO: 24939 - RNA, 24 nt, Human
uggaaagcucccucaccagagugc

SEQ ID NO: 24940 - RNA, 24 nt, Human
ugacaccagacccuccauucaagc

SEQ ID NO: 24941 - RNA, 24 nt, Human
uggcaugugccuuaugacccucgu

SEQ ID NO: 24942 - RNA, 20 nt, Human
uagaaugcauuuccugggcu

SEQ ID NO: 24943 - RNA, 24 nt, Human
cauucuugcugucuggauccagag

SEQ ID NO: 24944 - RNA, 24 nt, Human
ccagcaccggcugcggcuccgguu

SEQ ID NO: 24945 - RNA, 24 nt, Human
caccgcugucaacauggcccgcgc

SEQ ID NO: 24946 - RNA, 24 nt, Human
cucgcggggcucccuggcagaucc

SEQ ID NO: 24947 - RNA, 24 nt, Human
cgccguggagcugcagugcuggug

SEQ ID NO: 24948 - RNA, 24 nt, Human
cacuggggugggcaugagcguucu

SEQ ID NO: 24949 - RNA, 24 nt, Human
cggcacggucugaucgcggaaauu

SEQ ID NO: 24950 - RNA, 24 nt, Human
uuccuggggacucccuuuuaguac

SEQ ID NO: 24951 - RNA, 24 nt, Human
agaaauugcccaacucaugucccu

SEQ ID NO: 24952 - RNA, 24 nt, Human
aggcauuggcaugaccaaagcuga

SEQ ID NO: 24953 - RNA, 24 nt, Human
ugugugcgcagagugcaucauuuc

SEQ ID NO: 24954 - RNA, 24 nt, Human
ucccucaggccacccugacccuac

SEQ ID NO: 24955 - RNA, 24 nt, Human
cggcgggcucugcgcuccgccccu

SEQ ID NO: 24956 - RNA, 24 nt, Human
uucuccaugaucccgcuggccggg

SEQ ID NO: 24957 - RNA, 21 nt, Human
ugccgcagaugcccaccggaa

SEQ ID NO: 24958 - RNA, 24 nt, Human
ccagcgcaaauauaagaugacuga

SEQ ID NO: 24959 - RNA, 24 nt, Human
uucaaugugcugugccaugacaug

SEQ ID NO: 24960 - RNA, 24 nt, Human
aagaggacugugcauuuuugcuau

SEQ ID NO: 24961 - RNA, 24 nt, Human
ugcagcaguguguggagcaggggg

SEQ ID NO: 24962 - RNA, 24 nt, Human
uacuccgcguaggcccgugacgug

SEQ ID NO: 24963 - RNA, 24 nt, Human
agacaggcuggcacagccccaggc

SEQ ID NO: 24964 - RNA, 24 nt, Human
aagcagcaccaauggggaugaccc

SEQ ID NO: 24965 - RNA, 24 nt, Human
acgccguguuuccucuuucggccg

SEQ ID NO: 24966 - RNA, 24 nt, Human
uagaaaagagauagcaucuucuuu

SEQ ID NO: 24967 - RNA, 24 nt, Human
agucauggcaaauagaauugggcu

SEQ ID NO: 24968 - RNA, 24 nt, Human
ugaaucgacaguuucuuuuccggc

SEQ ID NO: 24969 - RNA, 24 nt, Human
acgaaguuaaagucugacacggcu

SEQ ID NO: 24970 - RNA, 24 nt, Human
cugcagcgaccacagaccugggcu

SEQ ID NO: 24971 - RNA, 24 nt, Human
caggagaucgcugcgcuggccagg

SEQ ID NO: 24972 - RNA, 24 nt, Human
uacagcaggcuguaccagugcagg

SEQ ID NO: 24973 - RNA, 24 nt, Human
ucaggagaccauugcaucauuggc

SEQ ID NO: 24974 - RNA, 24 nt, Human
ugauuuucucuauuauuuguccuu

SEQ ID NO: 24975 - RNA, 24 nt, Human
uguuugauauaccguuguguuaca

SEQ ID NO: 24976 - RNA, 24 nt, Human
agacugccagugaccaagcaacca

SEQ ID NO: 24977 - RNA, 24 nt, Human
cucccguugcugggagaaucucau

SEQ ID NO: 24978 - RNA, 24 nt, Human
ugucauggcugggugaagagccug

SEQ ID NO: 24979 - RNA, 24 nt, Human
augcuucggaugcacaaucugcau

SEQ ID NO: 24980 - RNA, 24 nt, Human
uccacuggcgaaagaugccuuucu

SEQ ID NO: 24981 - RNA, 24 nt, Human
uagagugguggcucccagaauccc

SEQ ID NO: 24982 - RNA, 24 nt, Human
agauaacuggccccgauuucugcu

SEQ ID NO: 24983 - RNA, 24 nt, Human
ucuggcuucccaauuccugacuug

SEQ ID NO: 24984 - RNA, 19 nt, Human
uagaagacagguggucugc

SEQ ID NO: 24985 - RNA, 24 nt, Human
ugagggagagagagcagcuccaca

SEQ ID NO: 24986 - RNA, 24 nt, Human
uggagggagguuuggcagauggag

SEQ ID NO: 24987 - RNA, 24 nt, Human
aggcugccaucugucuuguagggc

SEQ ID NO: 24988 - RNA, 23 nt, Human
augcagggggggugggggggggc

SEQ ID NO: 24989 - RNA, 24 nt, Human
ugaggacaggcaucgccgagacuc

SEQ ID NO: 24990 - RNA, 24 nt, Human
ccccuggggaacaggccgucgcgg

SEQ ID NO: 24991 - RNA, 24 nt, Human
ccagccuagccuuguggggagcaa

SEQ ID NO: 24992 - RNA, 24 nt, Human
ucgaagagcuggagaccaaggccg

SEQ ID NO: 24993 - RNA, 24 nt, Human
uucgccuccuguuucagcggugac

SEQ ID NO: 24994 - RNA, 24 nt, Human
cuggagcagguccaccggccccua

SEQ ID NO: 24995 - RNA, 24 nt, Human
uuucucgggaggaccgagcaccuu

SEQ ID NO: 24996 - RNA, 24 nt, Human
gaugcaaaauaaccaagaaguuaa

SEQ ID NO: 24997 - RNA, 24 nt, Human
ccacacaggcucauucucaacugg

SEQ ID NO: 24998 - RNA, 24 nt, Human
ugcccauugcucucccacuccacg

SEQ ID NO: 24999 - RNA, 24 nt, Human
uuaguauacagacgacagugaacu

SEQ ID NO: 25000 - RNA, 24 nt, Human
uuggugaccgaauuacuagugacu

SEQ ID NO: 25001 - RNA, 24 nt, Human
caugucaccuaaaugcacuugaug

SEQ ID NO: 25002 - RNA, 24 nt, Human
uauuauuaaaguuaccuauuauug

SEQ ID NO: 25003 - RNA, 24 nt, Human
ugcaaagaauucauagcaguuaau

SEQ ID NO: 25004 - RNA, 24 nt, Human
uucuuuggaaaucuaguuuggaau

SEQ ID NO: 25005 - RNA, 24 nt, Human
auaaaguuucuuggcaguaguuua

SEQ ID NO: 25006 - RNA, 24 nt, Human
uacaccacucccaagaagaauaag

SEQ ID NO: 25007 - RNA, 24 nt, Human
ucgaugaaccggucccugaaguug

SEQ ID NO: 25008 - RNA, 24 nt, Human
gcgcacugauuccgggccccagag

SEQ ID NO: 25009 - RNA, 24 nt, Human
ugaguagaaguaaauacauuauag

SEQ ID NO: 25010 - RNA, 24 nt, Human
uuuaugcuuuaaguacgaaagggu

SEQ ID NO: 25011 - RNA, 24 nt, Human
uaagaaauucugagugucuucuug

SEQ ID NO: 25012 - RNA, 24 nt, Human
uuuuguugugugccauuuugcagc

SEQ ID NO: 25013 - RNA, 24 nt, Human
uacauggaugacugugguggcaug

SEQ ID NO: 25014 - RNA, 24 nt, Human
ugaaaauggaaaguucaaguacag

SEQ ID NO: 25015 - RNA, 24 nt, Human
ugagaccaaaaugucaaaauaaua

SEQ ID NO: 25016 - RNA, 24 nt, Human
uguguguguguuucuccaauccuu

SEQ ID NO: 25017 - RNA, 24 nt, Human
ccugaccucaaguggauaugccug

SEQ ID NO: 25018 - RNA, 24 nt, Human
uaaaagccucuugagccaaggaau

SEQ ID NO: 25019 - RNA, 23 nt, Human
ugcccugggguuucugcccgcac

SEQ ID NO: 25020 - RNA, 21 nt, Human
uaacuaaggcuuuaaaagguc

SEQ ID NO: 25021 - RNA, 24 nt, Human
uacaccacucccaagaagaauaag

SEQ ID NO: 25022 - RNA, 24 nt, Human
uuggaagaauguuauaaugaaugu

SEQ ID NO: 25023 - RNA, 24 nt, Human
uguacagaaugaagccaacaaaua

SEQ ID NO: 25024 - RNA, 24 nt, Human
cuuccaaucugaugggcauguuug

SEQ ID NO: 25025 - RNA, 22 nt, Human
guggagggcagcuuugucuaca

SEQ ID NO: 25026 - RNA, 24 nt, Human
cugacgcugaagcuggugagccug

SEQ ID NO: 25027 - RNA, 24 nt, Human
cgagugugaauucccugcaagaac

SEQ ID NO: 25028 - RNA, 24 nt, Human
uggcuggucggguauugacaucca

SEQ ID NO: 25029 - RNA, 24 nt, Human
uguccagaagauccuggagcacau

SEQ ID NO: 25030 - RNA, 24 nt, Human
uugcuaccccugggcguuugauug

SEQ ID NO: 25031 - RNA, 24 nt, Human
ugagaugggaaagggcuccuucaa

SEQ ID NO: 25032 - RNA, 21 nt, Human
aaguaugccugggucuuggau

SEQ ID NO: 25033 - RNA, 22 nt, Human
uuccaagggauggacagucacc

SEQ ID NO: 25034 - RNA, 24 nt, Human
ucugaucuauaaaugcgguggcau

SEQ ID NO: 25035 - RNA, 24 nt, Human
ucccaaaggcggcaagcuccuucc

SEQ ID NO: 25036 - RNA, 24 nt, Human
acgcuuuguacgcucugcguuccc

SEQ ID NO: 25037 - RNA, 19 nt, Human
agggauggcacacgucacc

SEQ ID NO: 25038 - RNA, 24 nt, Human
uaccugaggugcaccggaggugaa

SEQ ID NO: 25039 - RNA, 24 nt, Human
cuugggacccugggccuucucggg

SEQ ID NO: 25040 - RNA, 24 nt, Human
aguggugcuguggaaugcccagcc

SEQ ID NO: 25041 - RNA, 24 nt, Human
auggcaauauugagaggugggguu

SEQ ID NO: 25042 - RNA, 24 nt, Human
uagcaucuuugugggggauuuuuu

SEQ ID NO: 25043 - RNA, 24 nt, Human
ggcgcuugaggacccggggagacc

SEQ ID NO: 25044 - RNA, 24 nt, Human
agggggcggcggcggcggcggcgg

SEQ ID NO: 25045 - RNA, 24 nt, Human
acuauaacuguuaaacuuaaguuc

SEQ ID NO: 25046 - RNA, 24 nt, Human
uaagggcuuccggaacggggcugu

SEQ ID NO: 25047 - RNA, 24 nt, Human
ucaucgagaaccauggaguugaac

SEQ ID NO: 25048 - RNA, 24 nt, Human
cgacagcagcggggcuggguguuc

SEQ ID NO: 25049 - RNA, 24 nt, Human
cuggggccugcugaggugggggug

SEQ ID NO: 25050 - RNA, 24 nt, Human
gaugauacaugucagugcugugga

SEQ ID NO: 25051 - RNA, 24 nt, Human
ucugucagccaguacucccauuaa

SEQ ID NO: 25052 - RNA, 24 nt, Human
uaaguagaaaugggauguuuuguu

SEQ ID NO: 25053 - RNA, 22 nt, Human
acaaagcuuucaguuucaaauc

SEQ ID NO: 25054 - RNA, 20 nt, Human
ccggccucuacggcuucauc

SEQ ID NO: 25055 - RNA, 24 nt, Human
ucuccagaaaugcuuuggguucau

SEQ ID NO: 25056 - RNA, 24 nt, Human
uugaucuugaagaaacugggcgug

SEQ ID NO: 25057 - RNA, 24 nt, Human
aggaaggagauauagugaagagga

SEQ ID NO: 25058 - RNA, 24 nt, Human
uuagcugacagucagcugugggga

SEQ ID NO: 25059 - RNA, 24 nt, Human
agggagaacuuccuuuccagggcu

SEQ ID NO: 25060 - RNA, 21 nt, Human
acccgcgucuuuguggccccg

SEQ ID NO: 25061 - RNA, 24 nt, Human
gcgacccuuugcgcaaacacacca

SEQ ID NO: 25062 - RNA, 23 nt, Human
uugaaaaauuugagaaggaggcu

SEQ ID NO: 25063 - RNA, 17 nt, Human
agggauggaaagucacc

SEQ ID NO: 25064 - RNA, 24 nt, Human
cagcggcccuuguuucuucuuacc

SEQ ID NO: 25065 - RNA, 24 nt, Human
aggaauuccagaguccuggucagc

SEQ ID NO: 25066 - RNA, 24 nt, Human
uauaguacgaacuugacuggccgu

SEQ ID NO: 25067 - RNA, 24 nt, Human
guguauugacaacagagaaacaga

SEQ ID NO: 25068 - RNA, 24 nt, Human
ucuagauaauuuuauauuuuugag

SEQ ID NO: 25069 - RNA, 24 nt, Human
aguacagugguagcaguuggacug

SEQ ID NO: 25070 - RNA, 24 nt, Human
uggcucagagcuacaauuuauuac

SEQ ID NO: 25071 - RNA, 24 nt, Human
uaacgugguguugugccugcuggc

SEQ ID NO: 25072 - RNA, 24 nt, Human
ucccugggcgaccugcaguuugca

SEQ ID NO: 25073 - RNA, 24 nt, Human
uggguccacgggguggccauggga

SEQ ID NO: 25074 - RNA, 24 nt, Human
uaagaggguaaugaaaccuuccuu

SEQ ID NO: 25075 - RNA, 24 nt, Human
acccuaaaaaaucuucgggugaca

SEQ ID NO: 25076 - RNA, 24 nt, Human
uaauagguaguuuuuauagaacua

SEQ ID NO: 25077 - RNA, 24 nt, Human
ucagugaguaauaauuaaucaacg

SEQ ID NO: 25078 - RNA, 24 nt, Human
uuaaucauguuccgucuguggugc

SEQ ID NO: 25079 - RNA, 21 nt, Human
ugcaauggccaccucuuuaaa

SEQ ID NO: 25080 - RNA, 24 nt, Human
gucaucuuuucauuaaguggauuc

SEQ ID NO: 25081 - RNA, 24 nt, Human
uuagagcucgguuugcaacgcugu

SEQ ID NO: 25082 - RNA, 24 nt, Human
gagaacaccccgggggccaaggac

SEQ ID NO: 25083 - RNA, 24 nt, Human
agaguggaucggugaagugugucg

SEQ ID NO: 25084 - RNA, 18 nt, Human
ucccacauggguugcagg

SEQ ID NO: 25085 - RNA, 24 nt, Human
gcgcacuguggaugugggaaaggc

SEQ ID NO: 25086 - RNA, 24 nt, Human
ucacggguaaaaacucuaaaaggu

SEQ ID NO: 25087 - RNA, 24 nt, Human
auagaaccccuucugacugagcaa

SEQ ID NO: 25088 - RNA, 24 nt, Human
ugaccuggauggcugcccagucug

SEQ ID NO: 25089 - RNA, 24 nt, Human
uggagaguuucucugcauguuuga

SEQ ID NO: 25090 - RNA, 24 nt, Human
ccgcacccgccgccucccgccccc

SEQ ID NO: 25091 - RNA, 24 nt, Human
ucccugggcggccaccuccagaag

SEQ ID NO: 25092 - RNA, 24 nt, Human
agaaaggaguuauugggggaauca

SEQ ID NO: 25093 - RNA, 21 nt, Human
uaccuggccacaguucaagcc

SEQ ID NO: 25094 - RNA, 24 nt, Human
ucgcaagaggugaguccgucuugu

SEQ ID NO: 25095 - RNA, 24 nt, Human
cagcgucaaggguuccacacuguu

SEQ ID NO: 25096 - RNA, 17 nt, Human
ucggacaggcgcugagc

SEQ ID NO: 25097 - RNA, 24 nt, Human
uggcuucgugcuugggguagaucu

SEQ ID NO: 25098 - RNA, 24 nt, Human
agagacuaauuauugcacuuaaau

SEQ ID NO: 25099 - RNA, 24 nt, Human
cuagccccagggaagggagagccu

SEQ ID NO: 25100 - RNA, 24 nt, Human
ucacacucucucucucugcugugu

SEQ ID NO: 25101 - RNA, 24 nt, Human
uguggugugugugcacacucucug

SEQ ID NO: 25102 - RNA, 24 nt, Human
uuugcucugagggguccugucuuc

SEQ ID NO: 25103 - RNA, 24 nt, Human
ucccagauggcuguggggucaagu

SEQ ID NO: 25104 - RNA, 24 nt, Human
gugcgcugccggccgcggcuucag

SEQ ID NO: 25105 - RNA, 24 nt, Human
ucgcuagucuccguauggcccgug

SEQ ID NO: 25106 - RNA, 23 nt, Human
cauccagacuggccccagaggac

SEQ ID NO: 25107 - RNA, 24 nt, Human
uggcaucugguggcuaagcugguc

SEQ ID NO: 25108 - RNA, 24 nt, Human
ucuuugggcggaagacaggucagg

SEQ ID NO: 25109 - RNA, 24 nt, Human
uccaaacuucaccaucuggauacu

SEQ ID NO: 25110 - RNA, 24 nt, Human
ugcaacagauaguucuuccacauc

SEQ ID NO: 25111 - RNA, 19 nt, Human
ugucuagaguuguagcuuc

SEQ ID NO: 25112 - RNA, 24 nt, Human
cugcggccacuggguuucggccuc

SEQ ID NO: 25113 - RNA, 24 nt, Human
ugagcugugccuucgccaccccuu

SEQ ID NO: 25114 - RNA, 24 nt, Human
ugacuucccuauggacaaccucau

SEQ ID NO: 25115 - RNA, 24 nt, Human
caaaggcccuggcaacgucaacau

SEQ ID NO: 25116 - RNA, 20 nt, Human
ugaggugacagucacggagg

SEQ ID NO: 25117 - RNA, 20 nt, Human
ugaggggguguggcacggga

SEQ ID NO: 25118 - RNA, 24 nt, Human
ucaacauuuugugugauccagcau

SEQ ID NO: 25119 - RNA, 18 nt, Human
uauuccagcgucuucagg

SEQ ID NO: 25120 - RNA, 24 nt, Human
uagaaaauuauuguuugucugugc

SEQ ID NO: 25121 - RNA, 24 nt, Human
cuaugcauucauggcucuggacgc

SEQ ID NO: 25122 - RNA, 24 nt, Human
ucgcugaggggguucgugcggcuc

SEQ ID NO: 25123 - RNA, 24 nt, Human
uuuaagcacaguaauagaggugag

SEQ ID NO: 25124 - RNA, 24 nt, Human
gggaccaacugggacucauuaugg

SEQ ID NO: 25125 - RNA, 21 nt, Human
gaacacgggcccgacuucccc

SEQ ID NO: 25126 - RNA, 24 nt, Human
uccacaggaaacgcaaacucaugu

SEQ ID NO: 25127 - RNA, 24 nt, Human
cggcagggcuccgagaccucggcu

SEQ ID NO: 25128 - RNA, 24 nt, Human
caacagaagccuuagugcgaacug

SEQ ID NO: 25129 - RNA, 24 nt, Human
cuucgcgggggcggcgggcggccc

SEQ ID NO: 25130 - RNA, 24 nt, Human
cgggagggcaaggucgagccguug

SEQ ID NO: 25131 - RNA, 24 nt, Human
ugcuguuggcgucgccgcccgccg

SEQ ID NO: 25132 - RNA, 24 nt, Human
cuguaccacacggcgcgguggcac

SEQ ID NO: 25133 - RNA, 24 nt, Human
uuaaugggaaauggagagacuacc

SEQ ID NO: 25134 - RNA, 24 nt, Human
uaugacaaugaaaucuguguguau

SEQ ID NO: 25135 - RNA, 24 nt, Human
cuuucagacuuagaauaauguuga

SEQ ID NO: 25136 - RNA, 24 nt, Human
aggaaaucuacagaagggaaucug

SEQ ID NO: 25137 - RNA, 24 nt, Human
acagacacauugacaugggugggu

SEQ ID NO: 25138 - RNA, 24 nt, Human
ucacacucggcuccgcgccgccuc

SEQ ID NO: 25139 - RNA, 24 nt, Human
gacccugugcgacagcugggcuga

SEQ ID NO: 25140 - RNA, 24 nt, Human
ugccccagcggaagugcuccaucc

SEQ ID NO: 25141 - RNA, 24 nt, Human
agcacugaccgaccauugccauuu

SEQ ID NO: 25142 - RNA, 24 nt, Human
uucacuuuaccuucugccaaaugc

SEQ ID NO: 25143 - RNA, 24 nt, Human
ugcugugugcucuuugaaaggaau

SEQ ID NO: 25144 - RNA, 24 nt, Human
cuccucagagucucuccuauuuuu

SEQ ID NO: 25145 - RNA, 20 nt, Human
uugguccaguuuuacgaaca

SEQ ID NO: 25146 - RNA, 24 nt, Human
agcacuuugggaggcugagguggg

SEQ ID NO: 25147 - RNA, 24 nt, Human
cucgggcagcuagguuugggauuu

SEQ ID NO: 25148 - RNA, 24 nt, Human
caaaccuaugguuaacuuggauaa

SEQ ID NO: 25149 - RNA, 24 nt, Human
uguccagaccauugucuuccaacc

SEQ ID NO: 25150 - RNA, 24 nt, Human
uauggcaaggaccugauggagaag

SEQ ID NO: 25151 - RNA, 24 nt, Human
aaggagcuuugguucggagacagg

SEQ ID NO: 25152 - RNA, 24 nt, Human
gacacgguuguuuacaccagcaaa

SEQ ID NO: 25153 - RNA, 21 nt, Human
ugagaccauugccgcguuugc

SEQ ID NO: 25154 - RNA, 24 nt, Human
aagcauucacuuaauauuuuaguu

SEQ ID NO: 25155 - RNA, 24 nt, Human
ugaggacaaguggagccacaaggg

SEQ ID NO: 25156 - RNA, 21 nt, Human
ucaaucucaccuucugauaua

SEQ ID NO: 25157 - RNA, 24 nt, Human
cgggaccagugcuucggggaccgc

SEQ ID NO: 25158 - RNA, 24 nt, Human
uugacacaguggaucucugugcca

SEQ ID NO: 25159 - RNA, 24 nt, Human
uccaucgggguguuccaacuuuca

SEQ ID NO: 25160 - RNA, 24 nt, Human
ugguauuugagucuccuagaaucu

SEQ ID NO: 25161 - RNA, 24 nt, Human
uucauuuuccaguugguauuugag

SEQ ID NO: 25162 - RNA, 24 nt, Human
acccuguuguugcccaggccuaaa

SEQ ID NO: 25163 - RNA, 24 nt, Human
ugagaucuagggauaccacagaaa

SEQ ID NO: 25164 - RNA, 24 nt, Human
aaaggaacuugcuccauuguuuga

SEQ ID NO: 25165 - RNA, 24 nt, Human
uauugugcuucauccguucagcug

SEQ ID NO: 25166 - RNA, 24 nt, Human
ucuacguauugcaggugguguugg

SEQ ID NO: 25167 - RNA, 24 nt, Human
ugagauagucuuauaagaaucacg

SEQ ID NO: 25168 - RNA, 23 nt, Human
uguuggguugcauguggaguaca

SEQ ID NO: 25169 - RNA, 24 nt, Human
cucuggaaauggugaggcgagggg

SEQ ID NO: 25170 - RNA, 24 nt, Human
ccccgaaaaggcgcucggggagcg

SEQ ID NO: 25171 - RNA, 24 nt, Human
uuuauccuuuauguguguuaaaau

SEQ ID NO: 25172 - RNA, 24 nt, Human
uauguuauuaaaucaaaacaaaac

SEQ ID NO: 25173 - RNA, 24 nt, Human
ccucagugauaagaaagaugccuc

SEQ ID NO: 25174 - RNA, 24 nt, Human
uagucuccaaauauaguguuuuag

SEQ ID NO: 25175 - RNA, 18 nt, Human
uagcaccauggacggggu

SEQ ID NO: 25176 - RNA, 24 nt, Human
agccuuuauugggucagggcuugc

SEQ ID NO: 25177 - RNA, 24 nt, Human
ucuugcaggaagcuugacaaaugc

SEQ ID NO: 25178 - RNA, 24 nt, Human
ugggauggggaucucguuggacug

SEQ ID NO: 25179 - RNA, 24 nt, Human
agccaggggcggcagcaggggggg

SEQ ID NO: 25180 - RNA, 24 nt, Human
uuugaaaaaaacaaaaaauaaaug

SEQ ID NO: 25181 - RNA, 24 nt, Human
ucuuagugcuucauucuauugguu

SEQ ID NO: 25182 - RNA, 24 nt, Human
uauugugcucuuguuggcuccuau

SEQ ID NO: 25183 - RNA, 24 nt, Human
uggggcugcgcggggccgggcgag

SEQ ID NO: 25184 - RNA, 24 nt, Human
ccgcugcuggggcugcugcucggc

SEQ ID NO: 25185 - RNA, 24 nt, Human
uggaaagcucagaauguaaaaaua

SEQ ID NO: 25186 - RNA, 24 nt, Human
uacaaucacagauauccuauggag

SEQ ID NO: 25187 - RNA, 17 nt, Human
cagcauggggggauugg

SEQ ID NO: 25188 - RNA, 24 nt, Human
agagugagaaaacacaaugucuau

SEQ ID NO: 25189 - RNA, 24 nt, Human
uaagguacgagaggcacaaaguga

SEQ ID NO: 25190 - RNA, 24 nt, Human
uacacacugugagacucugcuaca

SEQ ID NO: 25191 - RNA, 24 nt, Human
uggaagaaaagcaaaucgugacga

SEQ ID NO: 25192 - RNA, 24 nt, Human
ggagcacggggugacuugcuuggg

SEQ ID NO: 25193 - RNA, 24 nt, Human
ugccucaggugacgggccgugaga

SEQ ID NO: 25194 - RNA, 22 nt, Human
ugacugcagcucacguccagcc

SEQ ID NO: 25195 - RNA, 24 nt, Human
uguggcaguuacugauguggacca

SEQ ID NO: 25196 - RNA, 24 nt, Human
ugggaagacauccugagcgaugag

SEQ ID NO: 25197 - RNA, 24 nt, Human
uccaggauguuaccguuccugcug

SEQ ID NO: 25198 - RNA, 22 nt, Human
aagcgcccgcuucccacgcccc

SEQ ID NO: 25199 - RNA, 24 nt, Human
ugggaucauucugacagccaguca

SEQ ID NO: 25200 - RNA, 24 nt, Human
uauuuugugguggcaaauguuugg

SEQ ID NO: 25201 - RNA, 24 nt, Human
uuaaagugguuugaauaaaguaga

SEQ ID NO: 25202 - RNA, 24 nt, Human
ucgggccggcuggccgggcgcggg

SEQ ID NO: 25203 - RNA, 24 nt, Human
acgcugagugaccugcucacgggc

SEQ ID NO: 25204 - RNA, 24 nt, Human
ucgguggccgccagcugccuggug

SEQ ID NO: 25205 - RNA, 24 nt, Human
gagcaggccggaaguggcuuuccg

SEQ ID NO: 25206 - RNA, 24 nt, Human
gaucgugccgggcgggggcaugga

SEQ ID NO: 25207 - RNA, 24 nt, Human
ccggagcgagcgcgaggacgaggu

SEQ ID NO: 25208 - RNA, 24 nt, Human
cugccucgaggaugaagugcaaac

SEQ ID NO: 25209 - RNA, 24 nt, Human
uuaguauacagacgacagugaacu

SEQ ID NO: 25210 - RNA, 24 nt, Human
uuugccggaaccagguacagugaa

SEQ ID NO: 25211 - RNA, 23 nt, Human
uucaucucuuguggacagugagc

SEQ ID NO: 25212 - RNA, 24 nt, Human
ucagccucuucccugcccuguggu

SEQ ID NO: 25213 - RNA, 24 nt, Human
ucuccagaaaugcuuuggguucau

SEQ ID NO: 25214 - RNA, 24 nt, Human
aggaaggagauauagugaagagga

SEQ ID NO: 25215 - RNA, 24 nt, Human
uaggugcccaccaccaggcugggc

SEQ ID NO: 25216 - RNA, 24 nt, Human
ggagguugcagugagcagagauug

SEQ ID NO: 25217 - RNA, 24 nt, Human
uuaguugucacaaacaaauucaca

SEQ ID NO: 25218 - RNA, 24 nt, Human
ugggagaaaguaaagaaaaacugg

SEQ ID NO: 25219 - RNA, 19 nt, Human
uauagcauaaagauggaug

SEQ ID NO: 25220 - RNA, 24 nt, Human
uuugagaaggaagccuggcuugcc

SEQ ID NO: 25221 - RNA, 24 nt, Human
uaaaaagagagcuuuaguaaguaa

SEQ ID NO: 25222 - RNA, 24 nt, Human
uugaucuugaagaaacugggcgug

SEQ ID NO: 25223 - RNA, 24 nt, Human
ucagagcuacacauugagaaccug

SEQ ID NO: 25224 - RNA, 24 nt, Human
uacaagaucacugacucugaggac

SEQ ID NO: 25225 - RNA, 24 nt, Human
ucuccagaaaugcuuuggguucau

SEQ ID NO: 25226 - RNA, 24 nt, Human
aggaaggagauauagugaagagga

SEQ ID NO: 25227 - RNA, 24 nt, Human
ugaaagcccccgguaucauuccuc

SEQ ID NO: 25228 - RNA, 23 nt, Human
ugccaaggaccaggaugauggag

SEQ ID NO: 25229 - RNA, 24 nt, Human
aagaagacaagucgcauguuccag

SEQ ID NO: 25230 - RNA, 20 nt, Human
cugcgcccccuccugccagg

SEQ ID NO: 25231 - RNA, 20 nt, Human
gggcacaggcagaggccagc

SEQ ID NO: 25232 - RNA, 17 nt, Human
ucccaaagcuggcugga

SEQ ID NO: 25233 - RNA, 24 nt, Human
ccaggccggcagcaauauggccuc

SEQ ID NO: 25234 - RNA, 24 nt, Human
uccaucgucaugcucaaccagcug

SEQ ID NO: 25235 - RNA, 24 nt, Human
uugaucuugaagaaacugggcgug

SEQ ID NO: 25236 - RNA, 24 nt, Human
guagaguuuucuucaggcuuaaag

SEQ ID NO: 25237 - RNA, 24 nt, Human
uugaauuagaugcaauggaucacu

SEQ ID NO: 25238 - RNA, 22 nt, Human
uaccauguccgcccaggcgcag

SEQ ID NO: 25239 - RNA, 24 nt, Human
ugcaagagucaccuucuggacugc

SEQ ID NO: 25240 - RNA, 24 nt, Human
agagguaaugagaaguaguuggau

SEQ ID NO: 25241 - RNA, 18 nt, Human
aagaagguaaaaucccua

SEQ ID NO: 25242 - RNA, 24 nt, Human
ucuaugggaccaguggcuuggauu

SEQ ID NO: 25243 - RNA, 24 nt, Human
uccagugaaauuguaagcuucaau

SEQ ID NO: 25244 - RNA, 24 nt, Human
uagcugccuggggcuggcccugcu

SEQ ID NO: 25245 - RNA, 24 nt, Human
ggacagguguacagacauguucuu

SEQ ID NO: 25246 - RNA, 24 nt, Human
ucagugggcuggacauggaggaag

SEQ ID NO: 25247 - RNA, 24 nt, Human
gcccuguuuccaaaaacgcguaca

SEQ ID NO: 25248 - RNA, 24 nt, Human
ucugcgggguugagccuggugggc

SEQ ID NO: 25249 - RNA, 24 nt, Human
ccccacacucugagucugcccuau

SEQ ID NO: 25250 - RNA, 24 nt, Human
uggggucggggacagagcggugac

SEQ ID NO: 25251 - RNA, 24 nt, Human
uccuugggcguccuugcuguuuug

SEQ ID NO: 25252 - RNA, 24 nt, Human
uuagagccguauggugagcagccu

SEQ ID NO: 25253 - RNA, 24 nt, Human
cauccucggccgugggcugcagga

SEQ ID NO: 25254 - RNA, 24 nt, Human
ugagaccuaccaccagcaggggca

SEQ ID NO: 25255 - RNA, 23 nt, Human
ggagaacuucucaauauuggaaa

SEQ ID NO: 25256 - RNA, 24 nt, Human
uauggcaagucacuuugacagaca

SEQ ID NO: 25257 - RNA, 24 nt, Human
ugagaauggcaaaauuagucgccu

SEQ ID NO: 25258 - RNA, 24 nt, Human
uacaccacucccaagaagaauaag

SEQ ID NO: 25259 - RNA, 24 nt, Human
uauggcaagucacuuugacagaca

SEQ ID NO: 25260 - RNA, 24 nt, Human
ugagaauggcaaaauuagucgccu

SEQ ID NO: 25261 - RNA, 24 nt, Human
uacaccacucccaagaagaauaag

SEQ ID NO: 25262 - RNA, 24 nt, Human
guggugcgggccuguggucucagc

SEQ ID NO: 25263 - RNA, 24 nt, Human
aagaauuuacaggccgggcgaggu

SEQ ID NO: 25264 - RNA, 24 nt, Human
uacuuggagugccugaaaccugua

SEQ ID NO: 25265 - RNA, 24 nt, Human
uguuacuagcacuuugagaaugag

SEQ ID NO: 25266 - RNA, 24 nt, Human
ucccuccagccucuccuccauucc

SEQ ID NO: 25267 - RNA, 24 nt, Human
uauuaugucuucauuuaguggugu

SEQ ID NO: 25268 - RNA, 24 nt, Human
uaauguacucucuuaauauguuaa

SEQ ID NO: 25269 - RNA, 24 nt, Human
ucgcucagccaggagaugagaugc

SEQ ID NO: 25270 - RNA, 24 nt, Human
ugucccggacagugcgugcgagcg

SEQ ID NO: 25271 - RNA, 21 nt, Human
cauuggacaggacauccagcc

SEQ ID NO: 25272 - RNA, 24 nt, Human
cagcggcagagagccauccucuau

SEQ ID NO: 25273 - RNA, 24 nt, Human
accgaguuaaauaucagagagucc

SEQ ID NO: 25274 - RNA, 24 nt, Human
uuuuccuagcuacaucugguaccu

SEQ ID NO: 25275 - RNA, 24 nt, Human
ugccagugggcuccagcuugggug

SEQ ID NO: 25276 - RNA, 24 nt, Human
ugagagccucaguuuucucgucua

SEQ ID NO: 25277 - RNA, 24 nt, Human
uugaucuugaagaaacugggcgug

SEQ ID NO: 25278 - RNA, 24 nt, Human
aggaaggagauauagugaagagga

SEQ ID NO: 25279 - RNA, 23 nt, Human
ugacaauccccuugacguucuau

SEQ ID NO: 25280 - RNA, 21 nt, Human
ugggaggggcugaauguggug

SEQ ID NO: 25281 - RNA, 24 nt, Human
aaggaaccauggccaacugugagc

SEQ ID NO: 25282 - RNA, 24 nt, Human
aagcguuuugagcagaaaggauuc

SEQ ID NO: 25283 - RNA, 24 nt, Human
ucuccagaaaugcuuuggguucau

SEQ ID NO: 25284 - RNA, 24 nt, Human
uugaucuugaagaaacugggcgug

SEQ ID NO: 25285 - RNA, 24 nt, Human
aggaaggagauauagugaagagga

SEQ ID NO: 25286 - RNA, 24 nt, Human
uugaucuugaagaaacugggcgug

SEQ ID NO: 25287 - RNA, 24 nt, Human
aggaaggagauauagugaagagga

SEQ ID NO: 25288 - RNA, 21 nt, Human
uccgugcgcgugcugcggccg

SEQ ID NO: 25289 - RNA, 24 nt, Human
uugaucuugaagaaacugggcgug

SEQ ID NO: 25290 - RNA, 24 nt, Human
guagaguuuucuucaggcuuaaag

SEQ ID NO: 25291 - RNA, 24 nt, Human
uguggcccuucucuuuaaguccga

SEQ ID NO: 25292 - RNA, 24 nt, Human
cuacauggcaaucgggggcuaugu

SEQ ID NO: 25293 - RNA, 24 nt, Human
uuccaguuggugaggagcuguggg

SEQ ID NO: 25294 - RNA, 24 nt, Human
ggacgugguccgcgcccuuccucg

SEQ ID NO: 25295 - RNA, 24 nt, Human
gagcugauaccucuguugaucuug

SEQ ID NO: 25296 - RNA, 24 nt, Human
aggaaggagauauagugaagagga

SEQ ID NO: 25297 - RNA, 24 nt, Human
cagcacccugccuugucuccagga

SEQ ID NO: 25298 - RNA, 21 nt, Human
cagccccccugcacgcagccc

SEQ ID NO: 25299 - RNA, 24 nt, Human
agcagguguguaaacagaggguuc

SEQ ID NO: 25300 - RNA, 24 nt, Human
ugugggggccaagguuggggugag

SEQ ID NO: 25301 - RNA, 24 nt, Human
agcagguguguaaacagaggguuc

SEQ ID NO: 25302 - RNA, 17 nt, Human
gacaguggcuggucccc

SEQ ID NO: 25303 - RNA, 24 nt, Human
ucauacuuacugccggcugccccg

SEQ ID NO: 25304 - RNA, 24 nt, Human
uggguucgacuucagagcuuuuga

SEQ ID NO: 25305 - RNA, 24 nt, Human
gggccgagggacaauggucaccgu

SEQ ID NO: 25306 - RNA, 24 nt, Human
ugucacaugcaagucucuuuucug

SEQ ID NO: 25307 - RNA, 24 nt, Human
uucgcguaaccugcugauccuuuc

SEQ ID NO: 25308 - RNA, 24 nt, Human
cuggaacuauugcuggucucaaug

SEQ ID NO: 25309 - RNA, 24 nt, Human
ugauaugaaacauuggcccuuuau

SEQ ID NO: 25310 - RNA, 24 nt, Human
ucagaacgugaaaugcaagauagu

SEQ ID NO: 25311 - RNA, 24 nt, Human
ugaggagucaggcuuaaaacuugu

SEQ ID NO: 25312 - RNA, 19 nt, Human
gucacaguaacuggggggu

SEQ ID NO: 25313 - RNA, 24 nt, Human
uacuacagaaaauaugcagcuauc

SEQ ID NO: 25314 - RNA, 24 nt, Human
uugcugccaguccccauccugaag

SEQ ID NO: 25315 - RNA, 19 nt, Human
uaucacacuuacaaacuuu

SEQ ID NO: 25316 - RNA, 24 nt, Human
gggaagacugaagaaguguuaacu

SEQ ID NO: 25317 - RNA, 24 nt, Human
gugcuuagaacuuuaaggugcaaa

SEQ ID NO: 25318 - RNA, 24 nt, Human
uuccgauugcuggccguaguucua

SEQ ID NO: 25319 - RNA, 24 nt, Human
gagcuucggcgggcggcuggacgu

SEQ ID NO: 25320 - RNA, 24 nt, Human
cagcaccgucugccuggcugaugc

SEQ ID NO: 25321 - RNA, 23 nt, Human
uucccggugcuguucaccuauga

SEQ ID NO: 25322 - RNA, 22 nt, Human
uuccucagcuuuguucugugcc

SEQ ID NO: 25323 - RNA, 24 nt, Human
agagaggggcaguuaguauuagug

SEQ ID NO: 25324 - RNA, 24 nt, Human
uugcuuggauguuucuuugguguu

SEQ ID NO: 25325 - RNA, 24 nt, Human
ugaaagacaguauaauugagauua

SEQ ID NO: 25326 - RNA, 24 nt, Human
uagaaagcacuauauaaaaguugu

SEQ ID NO: 25327 - RNA, 24 nt, Human
uuaacuuguagaguuauugugaaa

SEQ ID NO: 25328 - RNA, 24 nt, Human
uucccaguuggaucucagaauugc

SEQ ID NO: 25329 - RNA, 24 nt, Human
uacuaugugccacucauuucucuc

SEQ ID NO: 25330 - RNA, 24 nt, Human
ugugguaauaaucguguaagauac

SEQ ID NO: 25331 - RNA, 24 nt, Human
ugaggcccgcacacauuauggagg

SEQ ID NO: 25332 - RNA, 22 nt, Human
uauuagggucauugugaauagg

SEQ ID NO: 25333 - RNA, 24 nt, Human
uugcagcccccccuagcucucccc

SEQ ID NO: 25334 - RNA, 24 nt, Human
ucagugguuuucggagagggcccu

SEQ ID NO: 25335 - RNA, 24 nt, Human
uguugggaaaaugcugcuuaugag

SEQ ID NO: 25336 - RNA, 18 nt, Human
ugaguggacugaugacca

SEQ ID NO: 25337 - RNA, 24 nt, Human
gagaaucuccucaagggcucagcu

SEQ ID NO: 25338 - RNA, 21 nt, Human
ugagaugauugauugacauga

SEQ ID NO: 25339 - RNA, 24 nt, Human
ucacuggauaucuugguaugugaa

SEQ ID NO: 25340 - RNA, 24 nt, Human
guccuuugggaugaagacuauagg

SEQ ID NO: 25341 - RNA, 24 nt, Human
uuaccaggaauuuuugaaaguuuu

SEQ ID NO: 25342 - RNA, 24 nt, Human
uagcacaacuggucuucagcacug

SEQ ID NO: 25343 - RNA, 24 nt, Human
uauaguucagacagcugcucagcg

SEQ ID NO: 25344 - RNA, 18 nt, Human
ugaggaaauuguucagag

SEQ ID NO: 25345 - RNA, 24 nt, Human
cuacugcuccccgcuggcgcgcag

SEQ ID NO: 25346 - RNA, 24 nt, Human
ggaguaaaaguuguuaaaggcaaa

SEQ ID NO: 25347 - RNA, 24 nt, Human
cgacauuguggacuuggcuucagu

SEQ ID NO: 25348 - RNA, 22 nt, Human
uuuguuaaaauccagugguuuc

SEQ ID NO: 25349 - RNA, 24 nt, Human
uucagagucagagaaagaagaauc

SEQ ID NO: 25350 - RNA, 24 nt, Human
uggaaauguguuuguggcauauag

SEQ ID NO: 25351 - RNA, 24 nt, Human
ucuguguguguagugagagugugu

SEQ ID NO: 25352 - RNA, 20 nt, Human
aauaaaaucuuguacuauga

SEQ ID NO: 25353 - RNA, 24 nt, Human
caauauggaaaauacauuggcuuu

SEQ ID NO: 25354 - RNA, 24 nt, Human
gggaaguguaaaaguuuacacuuu

SEQ ID NO: 25355 - RNA, 24 nt, Human
ucuaguuuuugaaagagaugcgga

SEQ ID NO: 25356 - RNA, 24 nt, Human
uagauuuuaacauauggacaacaa

SEQ ID NO: 25357 - RNA, 24 nt, Human
uuuguaggugcuuaauuuugccac

SEQ ID NO: 25358 - RNA, 24 nt, Human
uaaguugacucauacaguguuuau

SEQ ID NO: 25359 - RNA, 24 nt, Human
uagcguguauccaaauuucauuua

SEQ ID NO: 25360 - RNA, 24 nt, Human
ucucucggacaagcuguagguccu

SEQ ID NO: 25361 - RNA, 24 nt, Human
aauuaucugcuuucugcauuagaa

SEQ ID NO: 25362 - RNA, 24 nt, Human
acugguucaccuacaaugagacaa

SEQ ID NO: 25363 - RNA, 24 nt, Human
ucacauagguugugccaugagugg

SEQ ID NO: 25364 - RNA, 23 nt, Human
cucugcuucagagggugcccaga

SEQ ID NO: 25365 - RNA, 24 nt, Human
uggaagcacugauuguuuaaagau

SEQ ID NO: 25366 - RNA, 24 nt, Human
cacuuuaugggggcagaauggaac

SEQ ID NO: 25367 - RNA, 24 nt, Human
uccaacuuacuuccuucuguuaau

SEQ ID NO: 25368 - RNA, 24 nt, Human
caucgcuacuacaauuuuagaauu

SEQ ID NO: 25369 - RNA, 24 nt, Human
gaccauuuuccaucgccagcgacu

SEQ ID NO: 25370 - RNA, 24 nt, Human
uuaaacaacaaguccuuucaaucc

SEQ ID NO: 25371 - RNA, 24 nt, Human
agcacguucuagggaugggggcag

SEQ ID NO: 25372 - RNA, 24 nt, Human
aaggagcugcaggaaaagaggagg

SEQ ID NO: 25373 - RNA, 24 nt, Human
uggaaguaugauuuuccaacccaa

SEQ ID NO: 25374 - RNA, 24 nt, Human
uuccuuggcauagaccagcgccag

SEQ ID NO: 25375 - RNA, 24 nt, Human
ucccggagcgguggggcggggccu

SEQ ID NO: 25376 - RNA, 24 nt, Human
ucaguucuucccaggugaacagca

SEQ ID NO: 25377 - RNA, 24 nt, Human
gcagcaguuauucucuuguuuaca

SEQ ID NO: 25378 - RNA, 24 nt, Human
ccugcauuuacugccuuucacuua

SEQ ID NO: 25379 - RNA, 23 nt, Human
gugcugccacuuacuugcugccu

SEQ ID NO: 25380 - RNA, 24 nt, Human
uggguuaaagggagcacaugugau

SEQ ID NO: 25381 - RNA, 24 nt, Human
caccuccauccuccugcccagccg

SEQ ID NO: 25382 - RNA, 24 nt, Human
ucacgugauguuucccaggcacug

SEQ ID NO: 25383 - RNA, 22 nt, Human
ugagaagcaaagggaaugugga

SEQ ID NO: 25384 - RNA, 24 nt, Human
caugagaauaauguuuuaaaacca

SEQ ID NO: 25385 - RNA, 24 nt, Human
uauaaaguuugggcacuuagagca

SEQ ID NO: 25386 - RNA, 24 nt, Human
ugcagugauuauuuuuuaaagucu

SEQ ID NO: 25387 - RNA, 24 nt, Human
uaaaaccauuaccuuaaaauuuuu

SEQ ID NO: 25388 - RNA, 24 nt, Human
aacgcucuuuagcagacauggacu

SEQ ID NO: 25389 - RNA, 24 nt, Human
uggcagaaggcauuuacaaucucu

SEQ ID NO: 25390 - RNA, 24 nt, Human
uggcauuguaggugugagcagcca

SEQ ID NO: 25391 - RNA, 24 nt, Human
uggcuggaggugcaguggcgugau

SEQ ID NO: 25392 - RNA, 24 nt, Human
uaccaggaugggacccacagaacu

SEQ ID NO: 25393 - RNA, 24 nt, Human
agccgguaaugcccucauggaugg

SEQ ID NO: 25394 - RNA, 24 nt, Human
uaacuuuuucaccaguauugcacu

SEQ ID NO: 25395 - RNA, 24 nt, Human
uuccucaggcugcaaguggaggga

SEQ ID NO: 25396 - RNA, 24 nt, Human
cgucgggaggcgucguccuccagc

SEQ ID NO: 25397 - RNA, 24 nt, Human
cacccgguguccguccuggagggc

SEQ ID NO: 25398 - RNA, 24 nt, Human
gggcagcgcggaaggcagugcugu

SEQ ID NO: 25399 - RNA, 24 nt, Human
ugccuggagccaugugaaaaaaac

SEQ ID NO: 25400 - RNA, 24 nt, Human
uaugacccagguccaaaaguucca

SEQ ID NO: 25401 - RNA, 24 nt, Human
aggaaucaguacaagucaucaggg

SEQ ID NO: 25402 - RNA, 24 nt, Human
uuuuaugguuguguauguguugcu

SEQ ID NO: 25403 - RNA, 24 nt, Human
ccuggccccaggugauccacccac

SEQ ID NO: 25404 - RNA, 24 nt, Human
ucucgcucuguugcccaggcugga

SEQ ID NO: 25405 - RNA, 24 nt, Human
uauuaaaugaauuugugacuuagg

SEQ ID NO: 25406 - RNA, 24 nt, Human
cagaggguugccuauggugggcac

SEQ ID NO: 25407 - RNA, 22 nt, Human
uccgugcgcguugcugcggccg

SEQ ID NO: 25408 - RNA, 24 nt, Human
uugaucuugaagaaacugggcgug

SEQ ID NO: 25409 - RNA, 24 nt, Human
aggaaggagauauagugaagagga

SEQ ID NO: 25410 - RNA, 24 nt, Human
guagaguuuucuucaggcuuaaag

SEQ ID NO: 25411 - RNA, 24 nt, Human
ucggcacugagucccuggcaccag

SEQ ID NO: 25412 - RNA, 24 nt, Human
uucucaggaagaaguacccgggug

SEQ ID NO: 25413 - RNA, 24 nt, Human
ugaaagugcucacaaacuucaaga

SEQ ID NO: 25414 - RNA, 24 nt, Human
cauuccaugcagccuugcggaacu

SEQ ID NO: 25415 - RNA, 24 nt, Human
uguggacgagcaggaggaggcggc

SEQ ID NO: 25416 - RNA, 24 nt, Human
uauggcaagucacuuugacagaca

SEQ ID NO: 25417 - RNA, 24 nt, Human
uacaccacucccaagaagaauaag

SEQ ID NO: 25418 - RNA, 24 nt, Human
uagauggcuucuuucugauuaugu

SEQ ID NO: 25419 - RNA, 24 nt, Human
gggaaucaaguuugguguuaccau

SEQ ID NO: 25420 - RNA, 24 nt, Human
uacacuggugauuucucaagacaa

SEQ ID NO: 25421 - RNA, 24 nt, Human
uuggucguccaggcccagcgauag

SEQ ID NO: 25422 - RNA, 24 nt, Human
uauaaaacuuugauaguuacauug

SEQ ID NO: 25423 - RNA, 22 nt, Human
uagcaugccucuuaauuuuucu

SEQ ID NO: 25424 - RNA, 24 nt, Human
aacagguaaccacuugagaggaug

SEQ ID NO: 25425 - RNA, 24 nt, Human
uguaauagaaaauggauaaaaaua

SEQ ID NO: 25426 - RNA, 18 nt, Human
cuccugguguuggcgugg

SEQ ID NO: 25427 - RNA, 22 nt, Human
uaaguugacuaaggcaaacacu

SEQ ID NO: 25428 - RNA, 24 nt, Human
uucauagucagauugucaugccuu

SEQ ID NO: 25429 - RNA, 24 nt, Human
aagauugugauccaggagaaguga

SEQ ID NO: 25430 - RNA, 24 nt, Human
uccauucuggcucugguggaugga

SEQ ID NO: 25431 - RNA, 19 nt, Human
uaugcuguucaaaaauggg

SEQ ID NO: 25432 - RNA, 24 nt, Human
cuuugaggaagagggaucugggca

SEQ ID NO: 25433 - RNA, 24 nt, Human
aggaaaguggggaaaggugaaagg

SEQ ID NO: 25434 - RNA, 24 nt, Human
acuagacucuucacuguuagcuuu

SEQ ID NO: 25435 - RNA, 24 nt, Human
uaucaguccagacgggggccuuug

SEQ ID NO: 25436 - RNA, 24 nt, Human
ugagcagagcauucaugccacuga

SEQ ID NO: 25437 - RNA, 24 nt, Human
uacuacuauucucuucugcugagc

SEQ ID NO: 25438 - RNA, 24 nt, Human
uguguggggcacaugugggggggc

SEQ ID NO: 25439 - RNA, 24 nt, Human
uguguauagccucucuuuagagag

SEQ ID NO: 25440 - RNA, 24 nt, Human
ucugucucuucucuguucuccccc

SEQ ID NO: 25441 - RNA, 24 nt, Human
uguggcagaugccucccggccacu

SEQ ID NO: 25442 - RNA, 24 nt, Human
cccugcucccagcuagugggcugg

SEQ ID NO: 25443 - RNA, 24 nt, Human
ugcccuggagggcgggcuuccagu

SEQ ID NO: 25444 - RNA, 24 nt, Human
ucaacauucaacaacauccauaca

SEQ ID NO: 25445 - RNA, 24 nt, Human
ugugcagaccaagagcaccacaga

SEQ ID NO: 25446 - RNA, 24 nt, Human
uaguagcugucuguguaacucucc

SEQ ID NO: 25447 - RNA, 24 nt, Human
uaucacagcaguaacggcacccuu

SEQ ID NO: 25448 - RNA, 24 nt, Human
uaaaaccauuaccuuaaaaugggu

SEQ ID NO: 25449 - RNA, 24 nt, Human
uaucuggauuuuuauguuuuauua

SEQ ID NO: 25450 - RNA, 24 nt, Human
gaugcaaaauguuugcaguuugac

SEQ ID NO: 25451 - RNA, 24 nt, Human
aaauggaaucuagaagcuaaauuu

SEQ ID NO: 25452 - RNA, 22 nt, Human
uuuacagaaaauucuagaacaa

SEQ ID NO: 25453 - RNA, 24 nt, Human
auggagcuugagaucuucuuagcc

SEQ ID NO: 25454 - RNA, 24 nt, Human
accuguuuaugauccuggccucac

SEQ ID NO: 25455 - RNA, 24 nt, Human
uagcuuggaguccagcuucuccca

SEQ ID NO: 25456 - RNA, 24 nt, Human
aagaaaucagaggcuacaccgaaa

SEQ ID NO: 25457 - RNA, 24 nt, Human
uauguuggauucuuacuuacauuu

SEQ ID NO: 25458 - RNA, 24 nt, Human
uuuuccccuccaucuguuucuaga

SEQ ID NO: 25459 - RNA, 24 nt, Human
agucuucggauuucuucuuuucag

SEQ ID NO: 25460 - RNA, 24 nt, Human
uaaguuagacuaugauacuuaguu

SEQ ID NO: 25461 - RNA, 24 nt, Human
uuaguaucuuccauuuuaauaauu

SEQ ID NO: 25462 - RNA, 19 nt, Human
uacugcugaagaucugugg

SEQ ID NO: 25463 - RNA, 24 nt, Human
uaagcggauguacggcaagucgcu

SEQ ID NO: 25464 - RNA, 24 nt, Human
uggcaaaucaguggucagagcugg

SEQ ID NO: 25465 - RNA, 24 nt, Human
aggaccagcaaggaggcagcccua

SEQ ID NO: 25466 - RNA, 24 nt, Human
gagcagcagcaguggagggggcag

SEQ ID NO: 25467 - RNA, 24 nt, Human
uuacugcaaccucugccucccggg

SEQ ID NO: 25468 - RNA, 24 nt, Human
gaccuugugauccaccugccucag

SEQ ID NO: 25469 - RNA, 24 nt, Human
agcggcugucuucuguucaggacu

SEQ ID NO: 25470 - RNA, 24 nt, Human
ugugaggguuaccauuaucuuaaa

SEQ ID NO: 25471 - RNA, 24 nt, Human
aaaucaggggacugacaggugaug

SEQ ID NO: 25472 - RNA, 24 nt, Human
ggaguccagcagggccaguccugc

SEQ ID NO: 25473 - RNA, 24 nt, Human
aaggagaagaccguaccaaugaaa

SEQ ID NO: 25474 - RNA, 24 nt, Human
uugaaggcuugcgggcccacagug

SEQ ID NO: 25475 - RNA, 24 nt, Human
ucuaugcucagaauccaaugcgga

SEQ ID NO: 25476 - RNA, 24 nt, Human
uagaauuucuucuggguauuacag

SEQ ID NO: 25477 - RNA, 24 nt, Human
uggggagagcauccugcccaccac

SEQ ID NO: 25478 - RNA, 24 nt, Human
ucaaugcccuccuuuauccucauc

SEQ ID NO: 25479 - RNA, 24 nt, Human
acuuaaguucaaaggaggccuguu

SEQ ID NO: 25480 - RNA, 24 nt, Human
ugagggcaccggcggcccagaggu

SEQ ID NO: 25481 - RNA, 24 nt, Human
uuuuucaggcugugugggaagugg

SEQ ID NO: 25482 - RNA, 24 nt, Human
aagcaugcugggcccacaucugcu

SEQ ID NO: 25483 - RNA, 24 nt, Human
agagcaaaaaaacuccgucuaaaa

SEQ ID NO: 25484 - RNA, 24 nt, Human
gcgcauucccaagucagaugucgu

SEQ ID NO: 25485 - RNA, 24 nt, Human
uguuaacaugcacgcacuguagac

SEQ ID NO: 25486 - RNA, 24 nt, Human
cggcaugggguccgggggccuggc

SEQ ID NO: 25487 - RNA, 24 nt, Human
ugacauuugguaaauagcuaauug

SEQ ID NO: 25488 - RNA, 24 nt, Human
ucaggaucuggcuuagcggcgccg

SEQ ID NO: 25489 - RNA, 24 nt, Human
cccgccaguguccucagcugccuc

SEQ ID NO: 25490 - RNA, 24 nt, Human
ccucccagcccucuuugccggacg

SEQ ID NO: 25491 - RNA, 24 nt, Human
ugaggaacuuacaaugucucagaa

SEQ ID NO: 25492 - RNA, 24 nt, Human
uaggugcccuauagugugggguug

SEQ ID NO: 25493 - RNA, 24 nt, Human
ucggugugauugaugccccucaaa

SEQ ID NO: 25494 - RNA, 24 nt, Human
ggacugggaggaaacagcuggcca

SEQ ID NO: 25495 - RNA, 22 nt, Human
ugccucagagaacuucugcagc

SEQ ID NO: 25496 - RNA, 24 nt, Human
ucccucgcguuuaaagaggggaug

SEQ ID NO: 25497 - RNA, 24 nt, Human
uauauguguugaaaaccaaaauga

SEQ ID NO: 25498 - RNA, 24 nt, Human
aagaaugagagcuagaucgugacc

SEQ ID NO: 25499 - RNA, 24 nt, Human
gcccuguaugacaucugcuuccgc

SEQ ID NO: 25500 - RNA, 24 nt, Human
ccauccguggggccaucauccugg

SEQ ID NO: 25501 - RNA, 24 nt, Human
aguggcauccggggccggggucgc

SEQ ID NO: 25502 - RNA, 24 nt, Human
ugggggacugcagcccugcugacc

SEQ ID NO: 25503 - RNA, 24 nt, Human
aaguaccccgauagggaggguggg

SEQ ID NO: 25504 - RNA, 24 nt, Human
cuucguuuucuauuuauuuacauu

SEQ ID NO: 25505 - RNA, 24 nt, Human
acagugguaucucuaaauacugag

SEQ ID NO: 25506 - RNA, 24 nt, Human
agacuagaaaaaguucggcugauu

SEQ ID NO: 25507 - RNA, 24 nt, Human
uacaagaagauaauaaggguucuu

SEQ ID NO: 25508 - RNA, 24 nt, Human
aauuccuucacagagucgcguacu

SEQ ID NO: 25509 - RNA, 24 nt, Human
gcccugguuuggggcccggguucg

SEQ ID NO: 25510 - RNA, 24 nt, Human
ccugaccucgugauugaaauucug

SEQ ID NO: 25511 - RNA, 24 nt, Human
uagucugcacaauucaauaugaac

SEQ ID NO: 25512 - RNA, 24 nt, Human
uacaaaagugaaaauuaaaaguca

SEQ ID NO: 25513 - RNA, 24 nt, Human
ugacagagaugaccuaaaauuaau

SEQ ID NO: 25514 - RNA, 24 nt, Human
uugaaguuuaaccuuauuuugggu

SEQ ID NO: 25515 - RNA, 24 nt, Human
ugagggcagcagcgaggcacaggg

SEQ ID NO: 25516 - RNA, 24 nt, Human
cccgaggugggccaucacacucug

SEQ ID NO: 25517 - RNA, 24 nt, Human
ugugagucugaaguauugcccaaa

SEQ ID NO: 25518 - RNA, 24 nt, Human
uggcaagacagcucuggcucuggc

SEQ ID NO: 25519 - RNA, 24 nt, Human
ugucauggaugggccgucaaugaa

SEQ ID NO: 25520 - RNA, 24 nt, Human
augauacaaggaaguuagaaagca

SEQ ID NO: 25521 - RNA, 24 nt, Human
cgguggggcccgcuuguucaccgg

SEQ ID NO: 25522 - RNA, 24 nt, Human
aaguuucuuguucauuugaucugc

SEQ ID NO: 25523 - RNA, 24 nt, Human
ugcagcucucccgggagcagggaa

SEQ ID NO: 25524 - RNA, 24 nt, Human
uaauaaggauauuuugcuccagca

SEQ ID NO: 25525 - RNA, 24 nt, Human
gagccgagcgaagcgaugccuaaa

SEQ ID NO: 25526 - RNA, 24 nt, Human
ggagaagaucuuugggaguaagaa

SEQ ID NO: 25527 - RNA, 20 nt, Human
caccggaguggaguucgugc

SEQ ID NO: 25528 - RNA, 24 nt, Human
cguuaaaaaggggcgauauacggg

SEQ ID NO: 25529 - RNA, 23 nt, Human
cuagugguggcagggaagacuug

SEQ ID NO: 25530 - RNA, 24 nt, Human
ugccaggcagccuggggcagagug

SEQ ID NO: 25531 - RNA, 19 nt, Human
ucaggagcagguggacaag

SEQ ID NO: 25532 - RNA, 22 nt, Human
uccccaggucggcugagggcua

SEQ ID NO: 25533 - RNA, 24 nt, Human
uuccuucuuagguggcucaagcug

SEQ ID NO: 25534 - RNA, 24 nt, Human
caucauaucuaaagaacugcccag

SEQ ID NO: 25535 - RNA, 24 nt, Human
uauaauaauuaacaacagcaaaga

SEQ ID NO: 25536 - RNA, 24 nt, Human
ucacucaguuuuuaauaaaggcca

SEQ ID NO: 25537 - RNA, 24 nt, Human
uguucagaaauugaggcuaacauu

SEQ ID NO: 25538 - RNA, 24 nt, Human
ugagcucacucgggcuuagggagu

SEQ ID NO: 25539 - RNA, 24 nt, Human
ugagaaaaugaauucgagucuuug

SEQ ID NO: 25540 - RNA, 24 nt, Human
ccaugccgcugcagcccuccaucc

SEQ ID NO: 25541 - RNA, 24 nt, Human
ucccggguuaucccucgcuggcac

SEQ ID NO: 25542 - RNA, 24 nt, Human
uaaaagcauucuacaaggggguug

SEQ ID NO: 25543 - RNA, 24 nt, Human
gugguuccuaagccccgcagugaa

SEQ ID NO: 25544 - RNA, 24 nt, Human
gggcauuggccuagcuaucucccu

SEQ ID NO: 25545 - RNA, 24 nt, Human
aaccucuucuguggagucugcgug

SEQ ID NO: 25546 - RNA, 18 nt, Human
uggcaugguuccugacgg

SEQ ID NO: 25547 - RNA, 24 nt, Human
ucccucugcugguguuguuggggc

SEQ ID NO: 25548 - RNA, 24 nt, Human
caccauguuggccagacuguucuc

SEQ ID NO: 25549 - RNA, 24 nt, Human
ucuugcucugucacccaggcugga

SEQ ID NO: 25550 - RNA, 24 nt, Human
uaugccaccaauggugccaaguuc

SEQ ID NO: 25551 - RNA, 24 nt, Human
ucgcuggagcugacugcugcccgc

SEQ ID NO: 25552 - RNA, 24 nt, Human
uauggugcggaggcccuggagagg

SEQ ID NO: 25553 - RNA, 24 nt, Human
guggccgacgcgcugaccaacgcc

SEQ ID NO: 25554 - RNA, 24 nt, Human
ugaguuagccauuucuuuuucuuc

SEQ ID NO: 25555 - RNA, 24 nt, Human
uugaaaccagaacauuuuccccac

SEQ ID NO: 25556 - RNA, 24 nt, Human
agagcugggauuacaggccugagc

SEQ ID NO: 25557 - RNA, 17 nt, Human
ucagagaggacuugauc

SEQ ID NO: 25558 - RNA, 24 nt, Human
uacguucgagacccuccugcacca

SEQ ID NO: 25559 - RNA, 24 nt, Human
ggacagaagcugagauguuuggau

SEQ ID NO: 25560 - RNA, 24 nt, Human
agagauggugaagggccugugcgg

SEQ ID NO: 25561 - RNA, 24 nt, Human
cggcaguccugauggcccggcaug

SEQ ID NO: 25562 - RNA, 24 nt, Human
cuuccaguggaaaaggcauuuugg

SEQ ID NO: 25563 - RNA, 24 nt, Human
cuacuacugcaaggcaugcuuuga

SEQ ID NO: 25564 - RNA, 24 nt, Human
ccugcacuacugacaauggagcag

SEQ ID NO: 25565 - RNA, 24 nt, Human
cacagcaaacguuccaggccuggg

SEQ ID NO: 25566 - RNA, 23 nt, Human
cuggccucuagaacacccacugg

SEQ ID NO: 25567 - RNA, 24 nt, Human
uauggcaaggaccugauggagaag

SEQ ID NO: 25568 - RNA, 24 nt, Human
aaggagcuugguucggagacaggc

SEQ ID NO: 25569 - RNA, 24 nt, Human
uaucaucguggggcagcucaagag

SEQ ID NO: 25570 - RNA, 24 nt, Human
cagagugugguucagucagggagg

SEQ ID NO: 25571 - RNA, 20 nt, Human
uguccagaauuuccagaagu

SEQ ID NO: 25572 - RNA, 24 nt, Human
ugagugcccccagggaggggcugg

SEQ ID NO: 25573 - RNA, 24 nt, Human
uguggcccuucucuuuaaguccga

SEQ ID NO: 25574 - RNA, 18 nt, Human
ucacgcccagacaaugca

SEQ ID NO: 25575 - RNA, 24 nt, Human
uaccuuguguuuucgagccuauag

SEQ ID NO: 25576 - RNA, 24 nt, Human
uguggauauaguuuucccuguugg

SEQ ID NO: 25577 - RNA, 24 nt, Human
ugacuaaagaaaccugcugcacau

SEQ ID NO: 25578 - RNA, 24 nt, Human
gagcaugcaucuucucggugagcc

SEQ ID NO: 25579 - RNA, 24 nt, Human
guguaggugguuugaccagaggcg

SEQ ID NO: 25580 - RNA, 19 nt, Human
uuucucaucuuuuacuugg

SEQ ID NO: 25581 - RNA, 24 nt, Human
agacaggcuggcacagccccaggc

SEQ ID NO: 25582 - RNA, 24 nt, Human
aagcagcaccaauggggaugaccc

SEQ ID NO: 25583 - RNA, 24 nt, Human
uaguucagauugaucuuaggucaa

SEQ ID NO: 25584 - RNA, 24 nt, Human
uuggaucuucaugcccuggguucu

SEQ ID NO: 25585 - RNA, 24 nt, Human
uauuauacuuaaaugaacucaagu

SEQ ID NO: 25586 - RNA, 24 nt, Human
ugcgaaacuugccuuugcaguagg

SEQ ID NO: 25587 - RNA, 23 nt, Human
ugaaaaaaguucauacuaaauau

SEQ ID NO: 25588 - RNA, 24 nt, Human
auugccggguggcccccagcuguc

SEQ ID NO: 25589 - RNA, 24 nt, Human
ugaggugaacaagugcagccgcug

SEQ ID NO: 25590 - RNA, 24 nt, Human
acagcaaaaugaugccugagugcc

SEQ ID NO: 25591 - RNA, 24 nt, Human
uaaugguuuaauuuuauguggacg

SEQ ID NO: 25592 - RNA, 24 nt, Human
aagcaucccuguugguauaaauuu

SEQ ID NO: 25593 - RNA, 24 nt, Human
ugggaagaggagucaacuagaggc

SEQ ID NO: 25594 - RNA, 24 nt, Human
ucgaagaggagggauugcggcaau

SEQ ID NO: 25595 - RNA, 22 nt, Human
ugaaauuucggauugaagguaa

SEQ ID NO: 25596 - RNA, 24 nt, Human
uuccaguucaaagucgugucuuuc

SEQ ID NO: 25597 - RNA, 24 nt, Human
gacugcagggagaggcgucuccag

SEQ ID NO: 25598 - RNA, 24 nt, Human
uggaaggcgguguugacccugggg

SEQ ID NO: 25599 - RNA, 22 nt, Human
ccuggcccacccagguccccug

SEQ ID NO: 25600 - RNA, 24 nt, Human
cagggcccaaggucaacggaacau

SEQ ID NO: 25601 - RNA, 24 nt, Human
aaaugcuguuguaauugaccaaga

SEQ ID NO: 25602 - RNA, 24 nt, Human
uccgugacucuccauacgaguggu

SEQ ID NO: 25603 - RNA, 24 nt, Human
gcucaugguagggcggcugccucu

SEQ ID NO: 25604 - RNA, 24 nt, Human
uaccccuaaaagccaaaaugggaa

SEQ ID NO: 25605 - RNA, 21 nt, Human
aaguaugccugggucuuggau

SEQ ID NO: 25606 - RNA, 24 nt, Human
ucugaucuauaaaugcgguggcau

SEQ ID NO: 25607 - RNA, 24 nt, Human
auuugacucagccaucggggaccc

SEQ ID NO: 25608 - RNA, 24 nt, Human
uuuguuaaauuaauaaaacaugac

SEQ ID NO: 25609 - RNA, 24 nt, Human
ucacauggauuuuuggugggcauu

SEQ ID NO: 25610 - RNA, 24 nt, Human
uguaauguggcagauugugaaggg

SEQ ID NO: 25611 - RNA, 24 nt, Human
ucagggcaguguucugcugauggc

SEQ ID NO: 25612 - RNA, 24 nt, Human
uuaguucauucuucuaauaagccu

SEQ ID NO: 25613 - RNA, 24 nt, Human
uggaggccugagcccucagacccu

SEQ ID NO: 25614 - RNA, 24 nt, Human
ucaagcucccauggaccugugggc

SEQ ID NO: 25615 - RNA, 24 nt, Human
uauggcaaggaccugauggagaag

SEQ ID NO: 25616 - RNA, 24 nt, Human
aaggagcuuugguucggagacagg

SEQ ID NO: 25617 - RNA, 24 nt, Human
uagaggcccugcugagcugcuagc

SEQ ID NO: 25618 - RNA, 24 nt, Human
ugccaguagcuugcuuacgaccuu

SEQ ID NO: 25619 - RNA, 19 nt, Human
ugccugggcugcgcugcag

SEQ ID NO: 25620 - RNA, 24 nt, Human
cauaaagagcaaagcaguuguggu

SEQ ID NO: 25621 - RNA, 24 nt, Human
ugcucugugugcucacaaguguuc

SEQ ID NO: 25622 - RNA, 23 nt, Human
ugccccuuccaggcuugucucug

SEQ ID NO: 25623 - RNA, 24 nt, Human
ugaguuacaggcugugggaagaga

SEQ ID NO: 25624 - RNA, 24 nt, Human
uggcuugggucgagcucugucaca

SEQ ID NO: 25625 - RNA, 24 nt, Human
caccagggaggacagcugcuggca

SEQ ID NO: 25626 - RNA, 24 nt, Human
uuuaaacugugauacuuagccagg

SEQ ID NO: 25627 - RNA, 23 nt, Human
uuaaaauugugguaaugaugccu

SEQ ID NO: 25628 - RNA, 24 nt, Human
uauggcaaggaccugauggagaag

SEQ ID NO: 25629 - RNA, 24 nt, Human
aaggagcuugguucggagacaggc

SEQ ID NO: 25630 - RNA, 24 nt, Human
ugaagagagauugggcuucagccu

SEQ ID NO: 25631 - RNA, 24 nt, Human
caggagcuucugcugcugacccca

SEQ ID NO: 25632 - RNA, 24 nt, Human
ucggccagcguuucugcagucuuu

SEQ ID NO: 25633 - RNA, 24 nt, Human
cgggaucggagucuccucugcugg

SEQ ID NO: 25634 - RNA, 24 nt, Human
uagguuagaauguaaauuaaagug

SEQ ID NO: 25635 - RNA, 24 nt, Human
uaaggcguacggugagaacauugg

SEQ ID NO: 25636 - RNA, 24 nt, Human
gagcauuaucaaggaguaaggggg

SEQ ID NO: 25637 - RNA, 24 nt, Human
uucccaccuaagcccugugcuaua

SEQ ID NO: 25638 - RNA, 24 nt, Human
uuugauggcuuucacaugcucauu

SEQ ID NO: 25639 - RNA, 24 nt, Human
uaauuuguauggguuuagauggua

SEQ ID NO: 25640 - RNA, 24 nt, Human
ugcuuggugaccgaauuacuagug

SEQ ID NO: 25641 - RNA, 24 nt, Human
gagauucuucaagcaaucacuaug

SEQ ID NO: 25642 - RNA, 24 nt, Human
uggcagcccaaggcuuuguuguag

SEQ ID NO: 25643 - RNA, 18 nt, Human
uggaauaggauuuuacau

SEQ ID NO: 25644 - RNA, 24 nt, Human
cuagcaaauugaguauaaagagua

SEQ ID NO: 25645 - RNA, 24 nt, Human
ucaaaguuuuaugcuaaauucuga

SEQ ID NO: 25646 - RNA, 22 nt, Human
ucaaagggccaaugaugaccuu

SEQ ID NO: 25647 - RNA, 22 nt, Human
ucuaaagccuacaaaguuaacc

SEQ ID NO: 25648 - RNA, 24 nt, Human
ccuuuaguaagguggugcagaaac

SEQ ID NO: 25649 - RNA, 23 nt, Human
uuaaaagaucacugaaguuggau

SEQ ID NO: 25650 - RNA, 24 nt, Human
uuauucuccaacaacuggaacuug

SEQ ID NO: 25651 - RNA, 24 nt, Human
uugggcccgagaagagguuuuuuu

SEQ ID NO: 25652 - RNA, 24 nt, Human
auacagcaguguugacaaguuaug

SEQ ID NO: 25653 - RNA, 24 nt, Human
uacaaauaaaaacauugagaaaag

SEQ ID NO: 25654 - RNA, 24 nt, Human
ugugguuuuaaaagagucccucaa

SEQ ID NO: 25655 - RNA, 24 nt, Human
ucucugguuguucacauuccaaaa

SEQ ID NO: 25656 - RNA, 24 nt, Human
ugucgcaggcugcucugucucuua

SEQ ID NO: 25657 - RNA, 24 nt, Human
ugggucuuugugcugaggcaggac

SEQ ID NO: 25658 - RNA, 24 nt, Human
ugagaaaccaaggugugaaucugu

SEQ ID NO: 25659 - RNA, 21 nt, Human
ugggaaagcugcuuggaagcc

SEQ ID NO: 25660 - RNA, 24 nt, Human
acgcguugucuucaucaaaaaguc

SEQ ID NO: 25661 - RNA, 24 nt, Human
ugccaaggguccugacggccucgu

SEQ ID NO: 25662 - RNA, 24 nt, Human
ccugccuggugacagcuucuacau

SEQ ID NO: 25663 - RNA, 24 nt, Human
cagcuuaccccauucuguacagag

SEQ ID NO: 25664 - RNA, 23 nt, Human
cacauguauguccagccuguagu

SEQ ID NO: 25665 - RNA, 24 nt, Human
uguguucacccccgacuuccagga

SEQ ID NO: 25666 - RNA, 24 nt, Human
ucacuuguccaccuuccagcagau

SEQ ID NO: 25667 - RNA, 24 nt, Human
uggaaucuugcggcauccacgaga

SEQ ID NO: 25668 - RNA, 24 nt, Human
caacaagcagacucaaccaggccu

SEQ ID NO: 25669 - RNA, 24 nt, Human
aagcugccacucagugaccaggcc

SEQ ID NO: 25670 - RNA, 24 nt, Human
ugacgcggcauggcaagaacugca

SEQ ID NO: 25671 - RNA, 24 nt, Human
ugacgcaaagggauaugugaagcc

SEQ ID NO: 25672 - RNA, 24 nt, Human
augaaacuuaaagaugaauguuuu

SEQ ID NO: 25673 - RNA, 24 nt, Human
aauaacacaauaacaggagacuuc

SEQ ID NO: 25674 - RNA, 23 nt, Human
uaaggcgaggcggaauuaaaccc

SEQ ID NO: 25675 - RNA, 24 nt, Human
uagcaaaucgagucuuaaauaauc

SEQ ID NO: 25676 - RNA, 24 nt, Human
auuucauucacuggggaggaacaa

SEQ ID NO: 25677 - RNA, 24 nt, Human
aaauguacaauauguauaauuuuu

SEQ ID NO: 25678 - RNA, 24 nt, Human
gaccuuuucuuccuggacuauuga

SEQ ID NO: 25679 - RNA, 24 nt, Human
uuuuaagauucaaggggaacgaau

SEQ ID NO: 25680 - RNA, 24 nt, Human
acuuguacccgggucccgcggaga

SEQ ID NO: 25681 - RNA, 24 nt, Human
uaucugcugcgccugagaugagua

SEQ ID NO: 25682 - RNA, 21 nt, Human
ugccgcagaugcccaccggaa

SEQ ID NO: 25683 - RNA, 24 nt, Human
uggaugauccagcaggaaacaguu

SEQ ID NO: 25684 - RNA, 22 nt, Human
uacaaugucauuguuugggacc

SEQ ID NO: 25685 - RNA, 24 nt, Human
ugaggagauguugcugaagcaucu

SEQ ID NO: 25686 - RNA, 24 nt, Human
ucuaaaccaaacaggaaaggugca

SEQ ID NO: 25687 - RNA, 24 nt, Human
ugccaaugaaagacugagccccuc

SEQ ID NO: 25688 - RNA, 24 nt, Human
ugauucgggagguguguggcuuug

SEQ ID NO: 25689 - RNA, 24 nt, Human
ugaccaagaacgugagcaagccca

SEQ ID NO: 25690 - RNA, 24 nt, Human
ugguguugcauuagugaagauacu

SEQ ID NO: 25691 - RNA, 24 nt, Human
uaaaugaacauuugcaauuuuaaa

SEQ ID NO: 25692 - RNA, 24 nt, Human
ugggagggggcagcugggcugagc

SEQ ID NO: 25693 - RNA, 24 nt, Human
acucgcgcgggggguaauucgggg

SEQ ID NO: 25694 - RNA, 21 nt, Human
uaccgcuuauugagacagucc

SEQ ID NO: 25695 - RNA, 24 nt, Human
uuaguccuauauuuuaauaauuug

SEQ ID NO: 25696 - RNA, 24 nt, Human
uaccagauuucagaacuuauauuu

SEQ ID NO: 25697 - RNA, 23 nt, Human
ugagaacaaggaugagaucucca

SEQ ID NO: 25698 - RNA, 24 nt, Human
uacgucgaacaauguagcagccac

SEQ ID NO: 25699 - RNA, 24 nt, Human
agguggugcaucuaucuauggcaa

SEQ ID NO: 25700 - RNA, 24 nt, Human
ucccguggaagguucaggaagcga

SEQ ID NO: 25701 - RNA, 24 nt, Human
ucccaucgagcugguugucuucuu

SEQ ID NO: 25702 - RNA, 24 nt, Human
acaaagcaagagaagaagcagaga

SEQ ID NO: 25703 - RNA, 21 nt, Human
cauuggacaggacauccagcc

SEQ ID NO: 25704 - RNA, 24 nt, Human
cagcggcagagagccauccucuau

SEQ ID NO: 25705 - RNA, 24 nt, Human
cggcggcaccgaggaccgccuguc

SEQ ID NO: 25706 - RNA, 24 nt, Human
cggcaagguggccuuccgcgacug

SEQ ID NO: 25707 - RNA, 24 nt, Human
cacccguaagcgcuacgcgcaccu

SEQ ID NO: 25708 - RNA, 24 nt, Human
acacaagcacauacugaaggcacu

SEQ ID NO: 25709 - RNA, 24 nt, Human
gagcauuuccuugggugaucauag

SEQ ID NO: 25710 - RNA, 24 nt, Human
ugacaagcaagaccaccucagcug

SEQ ID NO: 25711 - RNA, 22 nt, Human
uauugugucaggccugaaauac

SEQ ID NO: 25712 - RNA, 24 nt, Human
uuggcagcuauggaccucggccug

SEQ ID NO: 25713 - RNA, 24 nt, Human
uggaggaggaugacgaugaugagc

SEQ ID NO: 25714 - RNA, 24 nt, Human
gucgcgccaccucgcgggcgaccc

SEQ ID NO: 25715 - RNA, 24 nt, Human
ugugggaauuguuuuucaucuguu

SEQ ID NO: 25716 - RNA, 24 nt, Human
uaggucuccaacucuuguaaaaag

SEQ ID NO: 25717 - RNA, 24 nt, Human
ugagaugggcaaauaggcuuaacu

SEQ ID NO: 25718 - RNA, 24 nt, Human
uauggcaagucacuuugacagaca

SEQ ID NO: 25719 - RNA, 24 nt, Human
ugagaauggcaaaauuagucgccu

SEQ ID NO: 25720 - RNA, 24 nt, Human
uacaccacucccaagaagaauaag

SEQ ID NO: 25721 - RNA, 23 nt, Human
ugcccggugagcuucuuauagac

SEQ ID NO: 25722 - RNA, 20 nt, Human
ucaguuggaggaacggggaa

SEQ ID NO: 25723 - RNA, 22 nt, Human
gacaggguuccccugugguucc

SEQ ID NO: 25724 - RNA, 21 nt, Human
aaccuggaggccacuggagcu

SEQ ID NO: 25725 - RNA, 24 nt, Human
aggaaggagauauagugaagagga

SEQ ID NO: 25726 - RNA, 24 nt, Human
guagaguuuucuucaggcuuaaag

SEQ ID NO: 25727 - RNA, 24 nt, Human
aggaaggagauauagugaagagga

SEQ ID NO: 25728 - RNA, 24 nt, Human
uaccagaaacguuuccaugauggg

SEQ ID NO: 25729 - RNA, 24 nt, Human
uguguucacccccgacuuccagga

SEQ ID NO: 25730 - RNA, 24 nt, Human
auagugccuuuuuccuuauuucaa

SEQ ID NO: 25731 - RNA, 24 nt, Human
guacuccagccugugugacagagc

SEQ ID NO: 25732 - RNA, 19 nt, Human
uaguauugagcaagucaac

SEQ ID NO: 25733 - RNA, 24 nt, Human
agaaagaccuccugacuccauguu

SEQ ID NO: 25734 - RNA, 24 nt, Human
uuuuuagcuaaggaaaauaagauu

SEQ ID NO: 25735 - RNA, 24 nt, Human
aagaauucaacuaugcaaauuugu

SEQ ID NO: 25736 - RNA, 24 nt, Human
ugaagugucuuguguagucauauu

SEQ ID NO: 25737 - RNA, 24 nt, Human
uggguacguguccuaaaggauucc

SEQ ID NO: 25738 - RNA, 24 nt, Human
gggcauggguguugccgggcccgg

SEQ ID NO: 25739 - RNA, 24 nt, Human
uagcaaacaucuucgugugagcua

SEQ ID NO: 25740 - RNA, 24 nt, Human
uagaaucuuucugugguauauaau

SEQ ID NO: 25741 - RNA, 24 nt, Human
uuaaugaagggauuaaguucauaa

SEQ ID NO: 25742 - RNA, 24 nt, Human
agguucccccacguuccccccacc

SEQ ID NO: 25743 - RNA, 24 nt, Human
ugcaacuacugcaaagacgcgggc

SEQ ID NO: 25744 - RNA, 24 nt, Human
ugagacaacggaaaggcacucucu

SEQ ID NO: 25745 - RNA, 24 nt, Human
uaggcccggcauaugguuccccaa

SEQ ID NO: 25746 - RNA, 24 nt, Human
agaccucgagaaggcuuuggauuu

SEQ ID NO: 25747 - RNA, 24 nt, Human
uuugaaauggucaccaaagagaag

SEQ ID NO: 25748 - RNA, 24 nt, Human
ugaaaagaaacuagucauuuauuu

SEQ ID NO: 25749 - RNA, 24 nt, Human
uuuuacauucaucauggcuacagg

SEQ ID NO: 25750 - RNA, 24 nt, Human
uuuuuaguagcaaauuuggaugua

SEQ ID NO: 25751 - RNA, 24 nt, Human
cgagggaccuggcacguacauccc

SEQ ID NO: 25752 - RNA, 24 nt, Human
ugagggacuagagcgcauuggauu

SEQ ID NO: 25753 - RNA, 24 nt, Human
uaugucagguuaaagggaaaaggu

SEQ ID NO: 25754 - RNA, 24 nt, Human
uucuuggugggacucggcugcccc

SEQ ID NO: 25755 - RNA, 20 nt, Human
uaucacuuuccggagcuggu

SEQ ID NO: 25756 - RNA, 24 nt, Human
ugcaagaccugccagauucugugc

SEQ ID NO: 25757 - RNA, 24 nt, Human
ucuccaaaaauuuggagaaagagc

SEQ ID NO: 25758 - RNA, 24 nt, Human
aagcugccugccuguugccaaagc

SEQ ID NO: 25759 - RNA, 24 nt, Human
ugcuugaaugugcugaugacaggg

SEQ ID NO: 25760 - RNA, 18 nt, Human
aaacaggauuggcgcuuu

SEQ ID NO: 25761 - RNA, 24 nt, Human
ucgcggaccggcguccccggcgcg

SEQ ID NO: 25762 - RNA, 24 nt, Human
uggaaagcagguagaguuggcuuu

SEQ ID NO: 25763 - RNA, 24 nt, Human
uauggcaagucacuuugacagaca

SEQ ID NO: 25764 - RNA, 24 nt, Human
uacaccacucccaagaagaauaag

SEQ ID NO: 25765 - RNA, 24 nt, Human
uauuuuguuuguauguauuuagag

SEQ ID NO: 25766 - RNA, 24 nt, Human
acuuauuggacaauuaugauuuuu

SEQ ID NO: 25767 - RNA, 24 nt, Human
agucugaagaugggcauuaugcaa

SEQ ID NO: 25768 - RNA, 20 nt, Human
ucccugagcggagggguggc

SEQ ID NO: 25769 - RNA, 24 nt, Human
ggccgugguccgcgcccuuccucg

SEQ ID NO: 25770 - RNA, 24 nt, Human
gcacuagaucuggacuccgacccg

SEQ ID NO: 25771 - RNA, 24 nt, Human
aguggcucagcuucucuuauggug

SEQ ID NO: 25772 - RNA, 24 nt, Human
gcgcguugcugcggccgugguccg

SEQ ID NO: 25773 - RNA, 24 nt, Human
uugaucuugaagaaacugggcgug

SEQ ID NO: 25774 - RNA, 24 nt, Human
cauuaaggcuguggauaagcuggg

SEQ ID NO: 25775 - RNA, 24 nt, Human
aggaaggagauauagugaagagga

SEQ ID NO: 25776 - RNA, 24 nt, Human
guagaguuuucuucaggcuuaaag

SEQ ID NO: 25777 - RNA, 24 nt, Human
auuggccucauccugccaaccaca

SEQ ID NO: 25778 - RNA, 24 nt, Human
ucagugccuugccaggaucccauc

SEQ ID NO: 25779 - RNA, 24 nt, Human
uucgagagguucgagacggggacg

SEQ ID NO: 25780 - RNA, 23 nt, Human
cagcggggcagcuugucucccuu

SEQ ID NO: 25781 - RNA, 22 nt, Human
uuccauggucaaaaaauggcag

SEQ ID NO: 25782 - RNA, 21 nt, Human
ucacuguaauguuaaugaaau

SEQ ID NO: 25783 - RNA, 24 nt, Human
uuaauuugacuuggaauugucuua

SEQ ID NO: 25784 - RNA, 24 nt, Human
uuuuauuuuuuuacugaguagaaa

SEQ ID NO: 25785 - RNA, 24 nt, Human
agaguuccaauagcugguucuaua

SEQ ID NO: 25786 - RNA, 24 nt, Human
uaccagcagaaucuucugggugcu

SEQ ID NO: 25787 - RNA, 24 nt, Human
agaggauuuggaauauggaaggca

SEQ ID NO: 25788 - RNA, 24 nt, Human
cagcugagaccuguuccugcaagc

SEQ ID NO: 25789 - RNA, 24 nt, Human
uggagugcagccagagcccugcug

SEQ ID NO: 25790 - RNA, 24 nt, Human
cuuucgggacuggcugaggccuag

SEQ ID NO: 25791 - RNA, 24 nt, Human
ugggaugggcagcugagcuguggg

SEQ ID NO: 25792 - RNA, 24 nt, Human
gcuuguuuuuccaccagaccccga

SEQ ID NO: 25793 - RNA, 24 nt, Human
uguacagucagugaaauugaagaa

SEQ ID NO: 25794 - RNA, 24 nt, Human
uuuuuuauguuggcacgaauugga

SEQ ID NO: 25795 - RNA, 24 nt, Human
uaccucacugcagccuccaacucc

SEQ ID NO: 25796 - RNA, 24 nt, Human
ugggaugcccucauguugggaagc

SEQ ID NO: 25797 - RNA, 24 nt, Human
uuuccggguggugaaaaagcccuc

SEQ ID NO: 25798 - RNA, 24 nt, Human
cagcggcagagagccauccucuau

SEQ ID NO: 25799 - RNA, 24 nt, Human
uucuucacgggcagcaagcuggug

SEQ ID NO: 25800 - RNA, 24 nt, Human
ccggaccccaccucuucccugccg

SEQ ID NO: 25801 - RNA, 24 nt, Human
cagcgcgcaccccggcggggcuuu

SEQ ID NO: 25802 - RNA, 24 nt, Human
ucccugacgcggagcuccaugguc

SEQ ID NO: 25803 - RNA, 24 nt, Human
caagaucgcagucaccguggcggu

SEQ ID NO: 25804 - RNA, 24 nt, Human
caacauggcgcugcacccagauac

SEQ ID NO: 25805 - RNA, 24 nt, Human
uggcaugaaggucuacaacuccac

SEQ ID NO: 25806 - RNA, 24 nt, Human
aucacaauauggucugguccaauc

SEQ ID NO: 25807 - RNA, 24 nt, Human
ugauggggcuccaacagccaggcu

SEQ ID NO: 25808 - RNA, 24 nt, Human
uagauugacuuacagcagggagag

SEQ ID NO: 25809 - RNA, 24 nt, Human
cuggagccucuguaccugugccca

SEQ ID NO: 25810 - RNA, 24 nt, Human
agauguguccauauuauguccaua

SEQ ID NO: 25811 - RNA, 24 nt, Human
uagagcuagugaauuagccuauuu

SEQ ID NO: 25812 - RNA, 24 nt, Human
gcuugcgcugugagcugaggcggu

SEQ ID NO: 25813 - RNA, 23 nt, Human
ucagggaggagcuuuaucuuuau

SEQ ID NO: 25814 - RNA, 18 nt, Human
caccacagcuucuuguag

SEQ ID NO: 25815 - RNA, 24 nt, Human
auuguucugcuguucuuuguccaa

SEQ ID NO: 25816 - RNA, 24 nt, Human
ugacugacacgucugaccccugag

SEQ ID NO: 25817 - RNA, 24 nt, Human
caggaugcaguagaugcccugaug

SEQ ID NO: 25818 - RNA, 24 nt, Human
acaaagcaagagaagaagcagaga

SEQ ID NO: 25819 - RNA, 21 nt, Human
cauuggacaggacauccagcc

SEQ ID NO: 25820 - RNA, 24 nt, Human
cagcggcagagagccauccucuau

SEQ ID NO: 25821 - RNA, 24 nt, Human
uccacguugcugugucgugaggug

SEQ ID NO: 25822 - RNA, 24 nt, Human
caggaucuugcuauguugcccagg

SEQ ID NO: 25823 - RNA, 24 nt, Human
ugaaaacaggauuaaaccguuagu

SEQ ID NO: 25824 - RNA, 24 nt, Human
ugaaagaaagcuauaguggcauag

SEQ ID NO: 25825 - RNA, 24 nt, Human
ugccacugaaaacuuagguccugu

SEQ ID NO: 25826 - RNA, 24 nt, Human
acuacuguucgaagauuuuuggaa

SEQ ID NO: 25827 - RNA, 23 nt, Human
aagaggcugccuugacuuguugg

SEQ ID NO: 25828 - RNA, 24 nt, Human
uagcagugaguacuguguggaaaa

SEQ ID NO: 25829 - RNA, 24 nt, Human
uaaauaauccuggcauuauaggga

SEQ ID NO: 25830 - RNA, 24 nt, Human
uacuuuaguucauuuaauuuuaau

SEQ ID NO: 25831 - RNA, 24 nt, Human
cguggagcggcagccggucuggac

SEQ ID NO: 25832 - RNA, 23 nt, Human
cccggccccuccccucucccucc

SEQ ID NO: 25833 - RNA, 24 nt, Human
agugcagugucgagacuuacaccu

SEQ ID NO: 25834 - RNA, 24 nt, Human
ugggagguccaagaucaaggugcc

SEQ ID NO: 25835 - RNA, 22 nt, Human
uucaucuuucauugcugcaagg

SEQ ID NO: 25836 - RNA, 24 nt, Human
aggaaggagauauagugaagagga

SEQ ID NO: 25837 - RNA, 24 nt, Human
ugcccauugggcguggcaggugaa

SEQ ID NO: 25838 - RNA, 24 nt, Human
cagcagggacagggcaaagggcuc

SEQ ID NO: 25839 - RNA, 24 nt, Human
ugggagggccaggcgucggguuau

SEQ ID NO: 25840 - RNA, 24 nt, Human
ugcugugugcugccagaugaccag

SEQ ID NO: 25841 - RNA, 17 nt, Human
ugugcagccccucagag

SEQ ID NO: 25842 - RNA, 24 nt, Human
ucuccagaaaugcuuuggguucau

SEQ ID NO: 25843 - RNA, 24 nt, Human
uuuggccucuuuccgaaguuccgu

SEQ ID NO: 25844 - RNA, 24 nt, Human
aggaaggagauauagugaagagga

SEQ ID NO: 25845 - RNA, 24 nt, Human
uugaucuugaagaaacugggcgug

SEQ ID NO: 25846 - RNA, 24 nt, Human
aggaaggagauauagugaagagga

SEQ ID NO: 25847 - RNA, 24 nt, Human
guagaguuuucuucaggcuuaaag

SEQ ID NO: 25848 - RNA, 24 nt, Human
ugagaauggcaaaauuagucgccu

SEQ ID NO: 25849 - RNA, 24 nt, Human
uacaccacucccaagaagaauaag

SEQ ID NO: 25850 - RNA, 24 nt, Human
ucuaugauuuucauauauauacga

SEQ ID NO: 25851 - RNA, 24 nt, Human
uugcccacuucccgugcuccaagu

SEQ ID NO: 25852 - RNA, 24 nt, Human
ugcagcaguguguggagcaggggg

SEQ ID NO: 25853 - RNA, 24 nt, Human
ggucaaagugugggggucccccag

SEQ ID NO: 25854 - RNA, 24 nt, Human
agcagguucuucgugaguuccucg

SEQ ID NO: 25855 - RNA, 23 nt, Human
uccacgggccucccagagugaag

SEQ ID NO: 25856 - RNA, 24 nt, Human
uguguuuguagacuuggaacccac

SEQ ID NO: 25857 - RNA, 24 nt, Human
caccggucuucagggcuucuuggu

SEQ ID NO: 25858 - RNA, 24 nt, Human
accccgucgccuccgccggcuacc

SEQ ID NO: 25859 - RNA, 24 nt, Human
ugcaagagucaccuucuggacugc

SEQ ID NO: 25860 - RNA, 24 nt, Human
ugaggagccaaagcuauguaugug

SEQ ID NO: 25861 - RNA, 24 nt, Human
gcgcacgccacagggccaguuuug

SEQ ID NO: 25862 - RNA, 19 nt, Human
uagaacccaggauuaggga

SEQ ID NO: 25863 - RNA, 24 nt, Human
uaguugauuuccaguugcacuauu

SEQ ID NO: 25864 - RNA, 24 nt, Human
ugcuagugaugaucugguaauaua

SEQ ID NO: 25865 - RNA, 24 nt, Human
uuuguuaggauagaucuuaagcag

SEQ ID NO: 25866 - RNA, 24 nt, Human
agucuugugaaaguguaaugugcg

SEQ ID NO: 25867 - RNA, 24 nt, Human
aaugggacugcugaagaguggaca

SEQ ID NO: 25868 - RNA, 24 nt, Human
uggccaggccaccugcaccaggga

SEQ ID NO: 25869 - RNA, 24 nt, Human
uggcuugggucgagcucugucaca

SEQ ID NO: 25870 - RNA, 24 nt, Human
aggcagaccagcuuuauuuuugaa

SEQ ID NO: 25871 - RNA, 24 nt, Human
ggagcagcgagacaagcagccgug

SEQ ID NO: 25872 - RNA, 24 nt, Human
aggaugucuuugauggagaagccc

SEQ ID NO: 25873 - RNA, 24 nt, Human
uauuagggauaauauucauuuagc

SEQ ID NO: 25874 - RNA, 24 nt, Human
uuguccugugcuggggcugacagg

SEQ ID NO: 25875 - RNA, 24 nt, Human
uaaaaaguuguggcaaagauggcu

SEQ ID NO: 25876 - RNA, 23 nt, Human
uuugaccuggggcggaaaaaggc

SEQ ID NO: 25877 - RNA, 24 nt, Human
agccauauuuacaucauccuguuu

SEQ ID NO: 25878 - RNA, 24 nt, Human
ugagaaugaccuuuacuuuccuau

SEQ ID NO: 25879 - RNA, 24 nt, Human
ugucagaucacaccuuuuugccuu

SEQ ID NO: 25880 - RNA, 24 nt, Human
ucucuggacucagucuguuaacau

SEQ ID NO: 25881 - RNA, 24 nt, Human
uugcauucauuacauucaaaaggc

SEQ ID NO: 25882 - RNA, 24 nt, Human
agauauaugcucucgaacagugug

SEQ ID NO: 25883 - RNA, 24 nt, Human
aggcguugagucaccgugcccggc

SEQ ID NO: 25884 - RNA, 24 nt, Human
ucacugcaaccuccaccuccuggg

SEQ ID NO: 25885 - RNA, 24 nt, Human
ggucauuaccuuauugaguuuaga

SEQ ID NO: 25886 - RNA, 24 nt, Human
uuuagacuugacgcaacgggaggu

SEQ ID NO: 25887 - RNA, 24 nt, Human
uugacauuccuuuucugcuuugua

SEQ ID NO: 25888 - RNA, 24 nt, Human
ucuguguugcccaagcuggacuug

SEQ ID NO: 25889 - RNA, 24 nt, Human
gugauucucugugccaaucucugc

SEQ ID NO: 25890 - RNA, 24 nt, Human
guccccgacaccgagacagccagc

SEQ ID NO: 25891 - RNA, 24 nt, Human
gagcgugucccgccggcccugaac

SEQ ID NO: 25892 - RNA, 24 nt, Human
cgacauggacaagaacagcggcuc

SEQ ID NO: 25893 - RNA, 24 nt, Human
uaaguaaugugguuuugccaugac

SEQ ID NO: 25894 - RNA, 24 nt, Human
ucuaaagguaugaaucaaauaggu

SEQ ID NO: 25895 - RNA, 21 nt, Human
ugcccuggugcccaccccugu

SEQ ID NO: 25896 - RNA, 24 nt, Human
ggagguugggggggcaggagcuuc

SEQ ID NO: 25897 - RNA, 24 nt, Human
uggaaucuugcggcauccacgaga

SEQ ID NO: 25898 - RNA, 24 nt, Human
uauggugcggaggcccuggagagg

SEQ ID NO: 25899 - RNA, 24 nt, Human
uaucugaaaacuacaccgcugugg

SEQ ID NO: 25900 - RNA, 24 nt, Human
ugcacauaccacguggcgggaccu

SEQ ID NO: 25901 - RNA, 24 nt, Human
ucuggagaaggagaggaugaugcg

SEQ ID NO: 25902 - RNA, 24 nt, Human
ucauagcguccagcgauccagaca

SEQ ID NO: 25903 - RNA, 24 nt, Human
gaacugguccuuucacuuugagau

SEQ ID NO: 25904 - RNA, 24 nt, Human
uaucaagucagcacacaccuuuuc

SEQ ID NO: 25905 - RNA, 24 nt, Human
ucaaugagucgcuugugaauucuc

SEQ ID NO: 25906 - RNA, 24 nt, Human
ugagaacaacaagccccaaagaca

SEQ ID NO: 25907 - RNA, 24 nt, Human
uacuaaauuauguugcugcaaagu

SEQ ID NO: 25908 - RNA, 24 nt, Human
ucauuuauuuuguacuguguuagg

SEQ ID NO: 25909 - RNA, 24 nt, Human
acauacucaccucuucccauaauc

SEQ ID NO: 25910 - RNA, 24 nt, Human
uuugcaucuggacaaauacuaaau

SEQ ID NO: 25911 - RNA, 24 nt, Human
uuagaaguuaugcuuuaaaauguu

SEQ ID NO: 25912 - RNA, 24 nt, Human
aggaaggcuggcaccucuggcucu

SEQ ID NO: 25913 - RNA, 24 nt, Human
agccuaaucuggaagaucuggcau

SEQ ID NO: 25914 - RNA, 24 nt, Human
cuggcucuuuccaguccuagcagg

SEQ ID NO: 25915 - RNA, 24 nt, Human
ucgacccaucaggacgccagagcu

SEQ ID NO: 25916 - RNA, 24 nt, Human
guugcucuucauggggcggcggcg

SEQ ID NO: 25917 - RNA, 22 nt, Human
ucagacgaaggcucaaggggga

SEQ ID NO: 25918 - RNA, 24 nt, Human
uuggcaguaguuuauguaagucaa

SEQ ID NO: 25919 - RNA, 24 nt, Human
uccacuggcgaaagaugccuuucu

SEQ ID NO: 25920 - RNA, 24 nt, Human
uaguucagauugaucuuaggucaa

SEQ ID NO: 25921 - RNA, 24 nt, Human
uagagugguggcucccagaauccc

SEQ ID NO: 25922 - RNA, 24 nt, Human
uccccgagcugcgcuggcugcccg

SEQ ID NO: 25923 - RNA, 23 nt, Human
uugcggccgcuggagcccgagcc

SEQ ID NO: 25924 - RNA, 24 nt, Human
ugauaugaaacauuggcccuuuau

SEQ ID NO: 25925 - RNA, 24 nt, Human
uaaguauauagauacuauugcauu

SEQ ID NO: 25926 - RNA, 24 nt, Human
uucgcaaaggagguuggaaggaca

SEQ ID NO: 25927 - RNA, 24 nt, Human
uuuuuuuucaaaccaggugucuga

SEQ ID NO: 25928 - RNA, 21 nt, Human
uuggucuuaagcaguguuaga

SEQ ID NO: 25929 - RNA, 24 nt, Human
cuucccuguggcuuagcugguggc

SEQ ID NO: 25930 - RNA, 24 nt, Human
cuggccccucgggugacccuuccc

SEQ ID NO: 25931 - RNA, 24 nt, Human
aauucagagacuucuugauuugga

SEQ ID NO: 25932 - RNA, 24 nt, Human
aguggaaaaaucuggaacucaagg

SEQ ID NO: 25933 - RNA, 24 nt, Human
uggcacacagccuggugguguucc

SEQ ID NO: 25934 - RNA, 24 nt, Human
agcuguugccuccgcgugcgcagu

SEQ ID NO: 25935 - RNA, 24 nt, Human
uuccuguaccguuuucuguuuuug

SEQ ID NO: 25936 - RNA, 24 nt, Human
ucccugcaaagaugacacuccucu

SEQ ID NO: 25937 - RNA, 24 nt, Human
uggcacaacggugacucgcggggc

SEQ ID NO: 25938 - RNA, 24 nt, Human
cggaaacccagcacguguguagag

SEQ ID NO: 25939 - RNA, 24 nt, Human
aaggggacaaaaaaaaaaaaggga

SEQ ID NO: 25940 - RNA, 24 nt, Human
cggccggaggaggccauggagccc

SEQ ID NO: 25941 - RNA, 24 nt, Human
ugauauguuucuuuacagaaugca

SEQ ID NO: 25942 - RNA, 24 nt, Human
ugcauggagugcccaaugggugga

SEQ ID NO: 25943 - RNA, 24 nt, Human
uggaaggccuuucaaaagccucac

SEQ ID NO: 25944 - RNA, 24 nt, Human
uaacauaguuguuucucuggggac

SEQ ID NO: 25945 - RNA, 24 nt, Human
uguaacagcacacugcauuccggg

SEQ ID NO: 25946 - RNA, 24 nt, Human
ucccggcaccaaggccgcaggcgg

SEQ ID NO: 25947 - RNA, 24 nt, Human
cacagcaagcccaggcucuaccag

SEQ ID NO: 25948 - RNA, 24 nt, Human
uuaaaugaacacagaggagagaag

SEQ ID NO: 25949 - RNA, 24 nt, Human
uggaaaucuucuucgaagccaugg

SEQ ID NO: 25950 - RNA, 24 nt, Human
uaauagauuuuuaauuuuacaggg

SEQ ID NO: 25951 - RNA, 24 nt, Human
ucuugcucugucacccaggaugga

SEQ ID NO: 25952 - RNA, 24 nt, Human
ugacugagucggcccauucuguuu

SEQ ID NO: 25953 - RNA, 24 nt, Human
uaccagggccauauuagcagugaa

SEQ ID NO: 25954 - RNA, 18 nt, Human
uggcagaaccacuaagcu

SEQ ID NO: 25955 - RNA, 20 nt, Human
ugguauagugaaugaaugaa

SEQ ID NO: 25956 - RNA, 24 nt, Human
uauuugguuuuguuggagaguguc

SEQ ID NO: 25957 - RNA, 24 nt, Human
gcgcguugcugcggccgugguccg

SEQ ID NO: 25958 - RNA, 24 nt, Human
aggaaggagauauagugaagagga

SEQ ID NO: 25959 - RNA, 24 nt, Human
cuuuauuuguuuuuuucguauagu

SEQ ID NO: 25960 - RNA, 21 nt, Human
ugucuggcggcaccaccaugu

SEQ ID NO: 25961 - RNA, 24 nt, Human
ugaccgcagcucgguggcgagcga

SEQ ID NO: 25962 - RNA, 24 nt, Human
uacaggaauguccuggccauccua

SEQ ID NO: 25963 - RNA, 24 nt, Human
ucagcaagcaggaguaugacgagu

SEQ ID NO: 25964 - RNA, 24 nt, Human
ugccuucuaaaggcugacauaccu

SEQ ID NO: 25965 - RNA, 24 nt, Human
ucuggaacacucucuaaauuuccc

SEQ ID NO: 25966 - RNA, 24 nt, Human
uggaaugugccucugcugacuugu

SEQ ID NO: 25967 - RNA, 24 nt, Human
uguagaacuuaggcuacaagacua

SEQ ID NO: 25968 - RNA, 24 nt, Human
ugggaggaacagggcuaggaugga

SEQ ID NO: 25969 - RNA, 24 nt, Human
ugcauggacaucauccaauucauu

SEQ ID NO: 25970 - RNA, 24 nt, Human
uugaaguagcguauucuuggagcu

SEQ ID NO: 25971 - RNA, 24 nt, Human
aggaaggagauauagugaagagga

SEQ ID NO: 25972 - RNA, 24 nt, Human
uggcagcccaaggcuuuguuguag

SEQ ID NO: 25973 - RNA, 24 nt, Human
cuuugauucagcaagccacaacag

SEQ ID NO: 25974 - RNA, 24 nt, Human
ugguaucuaugucucugaacccag

SEQ ID NO: 25975 - RNA, 22 nt, Human
uccgcaggguucggaugagacc

SEQ ID NO: 25976 - RNA, 24 nt, Human
uuuaaggagauguguuaccgauac

SEQ ID NO: 25977 - RNA, 24 nt, Human
auaaaucuucuauauugagaauug

SEQ ID NO: 25978 - RNA, 24 nt, Human
uuucuagagaaagauacaagggca

SEQ ID NO: 25979 - RNA, 24 nt, Human
uuuauguugcaugucaguuuccua

SEQ ID NO: 25980 - RNA, 24 nt, Human
uauuauggggaaaaaacugcaugu

SEQ ID NO: 25981 - RNA, 24 nt, Human
aaggaaacccuuguauucuuguga

SEQ ID NO: 25982 - RNA, 24 nt, Human
ugugugccauugcccaggcagagu

SEQ ID NO: 25983 - RNA, 24 nt, Human
uguaaugugccugugccuguggcc

SEQ ID NO: 25984 - RNA, 24 nt, Human
augguuauuauuccuaaauuuuca

SEQ ID NO: 25985 - RNA, 24 nt, Human
uaugagguuaguuaagcugcauuu

SEQ ID NO: 25986 - RNA, 24 nt, Human
cuccucccgccgcuuccguaaccu

SEQ ID NO: 25987 - RNA, 24 nt, Human
ucuugcgcuguaugacaucguccu

SEQ ID NO: 25988 - RNA, 24 nt, Human
uagcauuacuauagagauggcgca

SEQ ID NO: 25989 - RNA, 24 nt, Human
ccacaagugaaaaacaugguucag

SEQ ID NO: 25990 - RNA, 24 nt, Human
agggaccugggagccgggcagggg

SEQ ID NO: 25991 - RNA, 23 nt, Human
ucauacaggccaugucuugcaag

SEQ ID NO: 25992 - RNA, 24 nt, Human
uguggucuuguacauuuuggcuag

SEQ ID NO: 25993 - RNA, 22 nt, Human
ucagaucaacccauagucucac

SEQ ID NO: 25994 - RNA, 24 nt, Human
uggaauaaaagauuuuauaaccug

SEQ ID NO: 25995 - RNA, 24 nt, Human
uggcauuagguauuuggcuguuua

SEQ ID NO: 25996 - RNA, 24 nt, Human
ugagucaaagugaagaauuuccuc

SEQ ID NO: 25997 - RNA, 24 nt, Human
uaugguuuugcaauaugauugaug

SEQ ID NO: 25998 - RNA, 24 nt, Human
uauuagggauaauauucauuuagc

SEQ ID NO: 25999 - RNA, 24 nt, Human
uuuaacuuuuuuaaugggucucaa

SEQ ID NO: 26000 - RNA, 24 nt, Human
uuccucaaagguguagccaggagg

SEQ ID NO: 26001 - RNA, 24 nt, Human
ugaugguguagguggucuggcuuu

SEQ ID NO: 26002 - RNA, 24 nt, Human
aaaaguacuguguaauuucuaaau

SEQ ID NO: 26003 - RNA, 24 nt, Human
cagccccccugcacgcagcccgac

SEQ ID NO: 26004 - RNA, 24 nt, Human
ucacugcgcccucagcuggcaagc

SEQ ID NO: 26005 - RNA, 20 nt, Human
uacugggggacaaacaagcu

SEQ ID NO: 26006 - RNA, 24 nt, Human
acuccauuguccccuccucuggcu

SEQ ID NO: 26007 - RNA, 24 nt, Human
uuagugcuuuuaaaccaacuugcg

SEQ ID NO: 26008 - RNA, 24 nt, Human
aaugacccuuuugcuuuaggguuu

SEQ ID NO: 26009 - RNA, 24 nt, Human
gcccugcacauauaccaucucugg

SEQ ID NO: 26010 - RNA, 24 nt, Human
ucccguggaagguucaggaagcga

SEQ ID NO: 26011 - RNA, 21 nt, Human
agcucagugggcggcgugugc

SEQ ID NO: 26012 - RNA, 24 nt, Human
aagcaucugaguuugagaccaugg

SEQ ID NO: 26013 - RNA, 24 nt, Human
aaugugcugguaacugcuuugcuu

SEQ ID NO: 26014 - RNA, 24 nt, Human
ugaaaaguuggaagauuuugcauc

SEQ ID NO: 26015 - RNA, 24 nt, Human
ggacugggccgucgcacacgccag

SEQ ID NO: 26016 - RNA, 24 nt, Human
uccacaucagccaucugcuggccc

SEQ ID NO: 26017 - RNA, 24 nt, Human
ucagccugcucacgcugugaugac

SEQ ID NO: 26018 - RNA, 24 nt, Human
ugugaugcccuuagauguccgggg

SEQ ID NO: 26019 - RNA, 24 nt, Human
ugagaagacggucgaacuugacua

SEQ ID NO: 26020 - RNA, 24 nt, Human
acuccuugcggggcuucaguugca

SEQ ID NO: 26021 - RNA, 24 nt, Human
ccggaccccaccucuucccugccg

SEQ ID NO: 26022 - RNA, 24 nt, Human
cagcgcgcaccccggcggggcuuu

SEQ ID NO: 26023 - RNA, 24 nt, Human
cguguccauggggcgcccagucgc

SEQ ID NO: 26024 - RNA, 24 nt, Human
uuaagugguugaauucgcugcuug

SEQ ID NO: 26025 - RNA, 24 nt, Human
uugaucuugaagaaacugggcgug

SEQ ID NO: 26026 - RNA, 24 nt, Human
guagaguuuucuucaggcuuaaag

SEQ ID NO: 26027 - RNA, 24 nt, Human
aggaaggagauauagugaagagga

SEQ ID NO: 26028 - RNA, 24 nt, Human
guagaguuuucuucaggcuuaaag

SEQ ID NO: 26029 - RNA, 24 nt, Human
uucaucccaacaucuacccugaug

SEQ ID NO: 26030 - RNA, 24 nt, Human
aggcauugaucaugggcccagaag

SEQ ID NO: 26031 - RNA, 24 nt, Human
cgagagcagcgcggagcgguggag

SEQ ID NO: 26032 - RNA, 24 nt, Human
ugcuagccacagguggcugugaug

SEQ ID NO: 26033 - RNA, 23 nt, Human
ccgaggcucgcccggugucgugc

SEQ ID NO: 26034 - RNA, 24 nt, Human
ucggguauuagguuggcuaaccac

SEQ ID NO: 26035 - RNA, 24 nt, Human
aggaaggagauauagugaagagga

SEQ ID NO: 26036 - RNA, 24 nt, Human
aggaaggagauauagugaagagga

SEQ ID NO: 26037 - RNA, 24 nt, Human
cgggcgaauaacagggcugccagu

SEQ ID NO: 26038 - RNA, 24 nt, Human
acccgggaaagaggguaacucccg

SEQ ID NO: 26039 - RNA, 24 nt, Human
ugcagaugcguuucgacgggcugc

SEQ ID NO: 26040 - RNA, 24 nt, Human
cgaggccgacuaccugagcucgca

SEQ ID NO: 26041 - RNA, 24 nt, Human
caugaugcccgaggagaagcuggu

SEQ ID NO: 26042 - RNA, 24 nt, Human
ucgugccacgccaugcuguacgcc

SEQ ID NO: 26043 - RNA, 24 nt, Human
uuaauacuuuuauaauuucuuacg

SEQ ID NO: 26044 - RNA, 24 nt, Human
cagcuuaccccauucuguacagag

SEQ ID NO: 26045 - RNA, 23 nt, Human
cacauguauguccagccuguagu

SEQ ID NO: 26046 - RNA, 24 nt, Human
ugaggaccagugcacugaguacau

SEQ ID NO: 26047 - RNA, 24 nt, Human
ugguagguagggguagggccagag

SEQ ID NO: 26048 - RNA, 24 nt, Human
uuagagugugggagagagaaauag

SEQ ID NO: 26049 - RNA, 24 nt, Human
ugagagaggagauggaaaccuggu

SEQ ID NO: 26050 - RNA, 24 nt, Human
aaggaagugaauaaguuucagaug

SEQ ID NO: 26051 - RNA, 24 nt, Human
ugaccagacuuuuccagaagugcc

SEQ ID NO: 26052 - RNA, 20 nt, Human
uuccaaagaaagguacugug

SEQ ID NO: 26053 - RNA, 24 nt, Human
gcgugucuuaagauauuggugaug

SEQ ID NO: 26054 - RNA, 24 nt, Human
aggaaggagauauagugaagagga

SEQ ID NO: 26055 - RNA, 24 nt, Human
ugagaucaagugcuaggacuggau

SEQ ID NO: 26056 - RNA, 24 nt, Human
ugaaaagugccaggggcaauuucu

SEQ ID NO: 26057 - RNA, 24 nt, Human
uccaaauaguggccaagcugggac

SEQ ID NO: 26058 - RNA, 24 nt, Human
agggaagugugcggagggcuucca

SEQ ID NO: 26059 - RNA, 24 nt, Human
ucuccagaaaugcuuuggguucau

SEQ ID NO: 26060 - RNA, 24 nt, Human
uugaucuugaagaaacugggcgug

SEQ ID NO: 26061 - RNA, 24 nt, Human
guagaguuuucuucaggcuuaaag

SEQ ID NO: 26062 - RNA, 24 nt, Human
caaggccaucucccuaaacccaug

SEQ ID NO: 26063 - RNA, 24 nt, Human
gauaacauuauuauguugccuucu

SEQ ID NO: 26064 - RNA, 24 nt, Human
gaacacacuuggcagauggaggaa

SEQ ID NO: 26065 - RNA, 24 nt, Human
gcgcagccgacgcgggaaugaagc

SEQ ID NO: 26066 - RNA, 22 nt, Human
ccgccgcgggcucguccuccuc

SEQ ID NO: 26067 - RNA, 23 nt, Human
caggauccaaggguuuugaauuc

SEQ ID NO: 26068 - RNA, 24 nt, Human
caucaaacuauguccugggaauac

SEQ ID NO: 26069 - RNA, 24 nt, Human
ucagagaaagaaaaaccaauaucu

SEQ ID NO: 26070 - RNA, 24 nt, Human
uauuggccuucuuuaaaucccuau

SEQ ID NO: 26071 - RNA, 24 nt, Human
cuuucauaaauuguucuuggaggc

SEQ ID NO: 26072 - RNA, 24 nt, Human
gugguccugaacagcaaguggaaa

SEQ ID NO: 26073 - RNA, 24 nt, Human
cuagaccccaauggauugcaagga

SEQ ID NO: 26074 - RNA, 24 nt, Human
ugaggaucuugggaagcagcagca

SEQ ID NO: 26075 - RNA, 24 nt, Human
ugccaugugcucccugaccugaag

SEQ ID NO: 26076 - RNA, 24 nt, Human
uccacuaguuaacugagggacaag

SEQ ID NO: 26077 - RNA, 24 nt, Human
ucccuggaccagcccgguggcacc

SEQ ID NO: 26078 - RNA, 19 nt, Human
ugacauguauacuugcugc

SEQ ID NO: 26079 - RNA, 24 nt, Human
gcucuguucaucuuauucgccagc

SEQ ID NO: 26080 - RNA, 24 nt, Human
ucugagguugccaucagccagggc

SEQ ID NO: 26081 - RNA, 24 nt, Human
uguggugguggggaggguggguac

SEQ ID NO: 26082 - RNA, 24 nt, Human
ugggaaagagcuccggugacagaa

SEQ ID NO: 26083 - RNA, 24 nt, Human
caagaacaagucauugcugugcac

SEQ ID NO: 26084 - RNA, 24 nt, Human
gaguaggcacgucaaaaguuuugg

SEQ ID NO: 26085 - RNA, 24 nt, Human
cauagcaaaugaaucuaaaaaguu

SEQ ID NO: 26086 - RNA, 24 nt, Human
uaacuuuuguuccaccacccauag

SEQ ID NO: 26087 - RNA, 24 nt, Human
aagcguacugcucaucaucgauau

SEQ ID NO: 26088 - RNA, 24 nt, Human
ucuagaauagcccaaucuuauagu

SEQ ID NO: 26089 - RNA, 24 nt, Human
gcucucuuguaaaaagcaaaaucc

SEQ ID NO: 26090 - RNA, 24 nt, Human
uagcuggagaccuugaaaacauug

SEQ ID NO: 26091 - RNA, 24 nt, Human
aggaaggagauauagugaagagga

SEQ ID NO: 26092 - RNA, 24 nt, Human
uaaccaauaggaaaccccuaaagg

SEQ ID NO: 26093 - RNA, 24 nt, Human
uacuguuuuccccaaaguggaaca

SEQ ID NO: 26094 - RNA, 19 nt, Human
ucaguggauuucuuugagc

SEQ ID NO: 26095 - RNA, 24 nt, Human
uugaucuugaagaaacugggcgug

SEQ ID NO: 26096 - RNA, 24 nt, Human
uccgugcgcgugcugcggccgugg

SEQ ID NO: 26097 - RNA, 24 nt, Human
ucaaauggaaagaaguuugauucc

SEQ ID NO: 26098 - RNA, 24 nt, Human
uggcucggguggcagucucccuaa

SEQ ID NO: 26099 - RNA, 22 nt, Human
uccaaaggagagauuuauuuga

SEQ ID NO: 26100 - RNA, 24 nt, Human
ccgcgcccccggccgaccccgacg

SEQ ID NO: 26101 - RNA, 24 nt, Human
aggaagcugcugccgacgcacccg

SEQ ID NO: 26102 - RNA, 24 nt, Human
cagcuccuaguggagaccucgggc

SEQ ID NO: 26103 - RNA, 24 nt, Human
uguguguauacagcgcggaauaau

SEQ ID NO: 26104 - RNA, 24 nt, Human
ugagcccccacccaucccugugcg

SEQ ID NO: 26105 - RNA, 24 nt, Human
uauuguuacugccgcugauuugug

SEQ ID NO: 26106 - RNA, 24 nt, Human
gaccccuucgucagagaaucuggg

SEQ ID NO: 26107 - RNA, 24 nt, Human
aggcauaugugucgugugggcgug

SEQ ID NO: 26108 - RNA, 24 nt, Human
aggaagcacguggaggagggacgg

SEQ ID NO: 26109 - RNA, 24 nt, Human
cuuacacuuaaggccaaauucuuc

SEQ ID NO: 26110 - RNA, 24 nt, Human
uaguucacuuguuuuuccucuuug

SEQ ID NO: 26111 - RNA, 24 nt, Human
aucaguuuccauuucuuaugcagg

SEQ ID NO: 26112 - RNA, 24 nt, Human
uaagacaucagauguucaaaaaag

SEQ ID NO: 26113 - RNA, 24 nt, Human
ugugaaacucuucaaguauaucug

SEQ ID NO: 26114 - RNA, 24 nt, Human
uuaguggacagcacuuaguagcug

SEQ ID NO: 26115 - RNA, 24 nt, Human
uauggcaagucacuuugacagaca

SEQ ID NO: 26116 - RNA, 24 nt, Human
ugagaauggcaaaauuagucgccu

SEQ ID NO: 26117 - RNA, 24 nt, Human
uacaccacucccaagaagaauaag

SEQ ID NO: 26118 - RNA, 24 nt, Human
guagaguuuucuucaggcuuaaag

SEQ ID NO: 26119 - RNA, 24 nt, Human
uugaucuugaagaaacugggcgug

SEQ ID NO: 26120 - RNA, 24 nt, Human
aggaaggagauauagugaagagga

SEQ ID NO: 26121 - RNA, 24 nt, Human
guagaguuuucuucaggcuuaaag

SEQ ID NO: 26122 - RNA, 24 nt, Human
ugaagagcguauucuuggagcuga

SEQ ID NO: 26123 - RNA, 24 nt, Human
aggaaggagauauagugaagagga

SEQ ID NO: 26124 - RNA, 24 nt, Human
guagaguuuucuucaggcuuaaag

SEQ ID NO: 26125 - RNA, 24 nt, Human
ucccggauccaggcguccgggauc

SEQ ID NO: 26126 - RNA, 24 nt, Human
ggacaccagaccaccgccuuccgu

SEQ ID NO: 26127 - RNA, 24 nt, Human
ugugguugugagucugagcuugug

SEQ ID NO: 26128 - RNA, 24 nt, Human
ccgcagcgcggaacccccuaggcg

SEQ ID NO: 26129 - RNA, 21 nt, Human
uacuuuagucuauucuuaguu

SEQ ID NO: 26130 - RNA, 24 nt, Human
ugugaucuugaagaaacugggcgu

SEQ ID NO: 26131 - RNA, 24 nt, Human
gcgcguugcugcggccgugguccg

SEQ ID NO: 26132 - RNA, 24 nt, Human
uagcuuggugccaauggucguggu

SEQ ID NO: 26133 - RNA, 24 nt, Human
uucaagcagaagaaaugguagagu

SEQ ID NO: 26134 - RNA, 24 nt, Human
uuccaguuggugaggagcuguggg

SEQ ID NO: 26135 - RNA, 24 nt, Human
aggaaggagauauagugaagagga

SEQ ID NO: 26136 - RNA, 24 nt, Human
cgaggccgacuaccugagcucgca

SEQ ID NO: 26137 - RNA, 21 nt, Human
uucaauagccaguugcuuguu

SEQ ID NO: 26138 - RNA, 17 nt, Human
gagcaggugguaguggg

SEQ ID NO: 26139 - RNA, 24 nt, Human
aaccagaaaguaagguguucuacu

SEQ ID NO: 26140 - RNA, 24 nt, Human
aggcagucacagaacaggggcaug

SEQ ID NO: 26141 - RNA, 24 nt, Human
ccuuugguuucugccggccucggg

SEQ ID NO: 26142 - RNA, 24 nt, Human
cuggucaccaaaggaagagugcca

SEQ ID NO: 26143 - RNA, 24 nt, Human
gggcuagggcugagccucaggugg

SEQ ID NO: 26144 - RNA, 24 nt, Human
cagcgcauggagggguagugcugg

SEQ ID NO: 26145 - RNA, 24 nt, Human
uggauucuugggagcuggauacuc

SEQ ID NO: 26146 - RNA, 24 nt, Human
cuagcccaggaggggacgccguug

SEQ ID NO: 26147 - RNA, 24 nt, Human
ucgaagacgggauuggccaugagu

SEQ ID NO: 26148 - RNA, 24 nt, Human
agauuacacuguuaccgagauccc

SEQ ID NO: 26149 - RNA, 24 nt, Human
caacagaaaguaagguguucuacu

SEQ ID NO: 26150 - RNA, 24 nt, Human
aggcagucacagaacaggggcaug

SEQ ID NO: 26151 - RNA, 24 nt, Human
gagaagccgagccgaguauccagg

SEQ ID NO: 26152 - RNA, 24 nt, Human
uggcaggggaggacagaacuuuga

SEQ ID NO: 26153 - RNA, 24 nt, Human
aguccagagguucaagagccuggg

SEQ ID NO: 26154 - RNA, 23 nt, Human
uaaccgcaaaacucuagaggggg

SEQ ID NO: 26155 - RNA, 24 nt, Human
uuuuaauugauagcaaaauaguuu

SEQ ID NO: 26156 - RNA, 24 nt, Human
uaacguaguaguugucugcucuuu

SEQ ID NO: 26157 - RNA, 21 nt, Human
aaggggcccgggaacaccugc

SEQ ID NO: 26158 - RNA, 24 nt, Human
aaggggcccggaacaccugucuca

SEQ ID NO: 26159 - RNA, 24 nt, Human
caccgcguuggggacaguugcccc

SEQ ID NO: 26160 - RNA, 18 nt, Human
gccccgggggggcccgcu

SEQ ID NO: 26161 - RNA, 24 nt, Human
ucccgauacaccuuacuuacugug

SEQ ID NO: 26162 - RNA, 20 nt, Human
caccggagcacaccuaggga

SEQ ID NO: 26163 - RNA, 24 nt, Human
ugaagaacaucaccuaagagauua

SEQ ID NO: 26164 - RNA, 24 nt, Human
uaaugagagauccaaacaccaagc

SEQ ID NO: 26165 - RNA, 24 nt, Human
uggaaccaaagagagcugucucca

SEQ ID NO: 26166 - RNA, 24 nt, Human
accaaauuucugcauucgagucuu

SEQ ID NO: 26167 - RNA, 24 nt, Human
gauuagccuuuucucugccuugcu

SEQ ID NO: 26168 - RNA, 24 nt, Human
uaccccucgucacuugcaacuugc

SEQ ID NO: 26169 - RNA, 24 nt, Human
auaguaccaacuuugguugccaga

SEQ ID NO: 26170 - RNA, 24 nt, Human
ccgcguuguccgauguucaugagu

SEQ ID NO: 26171 - RNA, 24 nt, Human
ugaccauagaagagcugacgaccg

SEQ ID NO: 26172 - RNA, 24 nt, Human
guuaagugauagcucgccuucgaa

SEQ ID NO: 26173 - RNA, 24 nt, Human
uugaagccaguggggcaccaauuc

SEQ ID NO: 26174 - RNA, 19 nt, Human
uaccauggcagggucacaa

SEQ ID NO: 26175 - RNA, 23 nt, Human
uaaaauacauuuuauguuaaugu

SEQ ID NO: 26176 - RNA, 24 nt, Human
ucaaaguagaauuauaaagaagau

SEQ ID NO: 26177 - RNA, 24 nt, Human
ugagugcaagagauugaagaguuc

SEQ ID NO: 26178 - RNA, 24 nt, Human
ugacaucguccugcuuaucacuga

SEQ ID NO: 26179 - RNA, 24 nt, Human
ugaguuguuggagcuggacauccg

SEQ ID NO: 26180 - RNA, 24 nt, Human
auggggcuuacuccucugagaaac

SEQ ID NO: 26181 - RNA, 24 nt, Human
cugggccucgugcgggucccgcug

SEQ ID NO: 26182 - RNA, 24 nt, Human
cugccugcgccucaccgaggccga

SEQ ID NO: 26183 - RNA, 24 nt, Human
ugcagaugcguuucgacgggcugc

SEQ ID NO: 26184 - RNA, 24 nt, Human
ucgugccacgccaugcuguacgcc

SEQ ID NO: 26185 - RNA, 24 nt, Human
ucauuagaagagcuuuuuacucuu

SEQ ID NO: 26186 - RNA, 24 nt, Human
cccccagcccaucacccuguguac

SEQ ID NO: 26187 - RNA, 24 nt, Human
ugagaagauagcgaaauacauugg

SEQ ID NO: 26188 - RNA, 24 nt, Human
uaccuugcaccuuaugccaaguau

SEQ ID NO: 26189 - RNA, 24 nt, Human
auaaacuaauuaagugaaggagau

SEQ ID NO: 26190 - RNA, 24 nt, Human
ugagauguccgucuauucuugaag

SEQ ID NO: 26191 - RNA, 24 nt, Human
aaggguccggggcggagugccguu

SEQ ID NO: 26192 - RNA, 24 nt, Human
ucucuuaugacuacaacccaaacc

SEQ ID NO: 26193 - RNA, 21 nt, Human
ugggaggggcugaauguggug

SEQ ID NO: 26194 - RNA, 24 nt, Human
aagcguuuugagcagaaaggauuc

SEQ ID NO: 26195 - RNA, 24 nt, Human
cgacauugauaaauguucuccagg

SEQ ID NO: 26196 - RNA, 21 nt, Human
gauucuguggagagugcagag

SEQ ID NO: 26197 - RNA, 24 nt, Human
ugagaaugaccccaagaccuuuga

SEQ ID NO: 26198 - RNA, 24 nt, Human
ugugaacgggaagaaggugcugca

SEQ ID NO: 26199 - RNA, 24 nt, Human
cuuccaaucugaugggcauguuug

SEQ ID NO: 26200 - RNA, 22 nt, Human
guggagggcagcuuugucuaca

SEQ ID NO: 26201 - RNA, 24 nt, Human
gugcaaccucggccgaggccuucc

SEQ ID NO: 26202 - RNA, 24 nt, Human
gcucauuugcaggggggagccaaa

SEQ ID NO: 26203 - RNA, 24 nt, Human
ugugaggaggaccugaugcccgag

SEQ ID NO: 26204 - RNA, 24 nt, Human
ucccccgucgcugccccgccccug

SEQ ID NO: 26205 - RNA, 24 nt, Human
cuacgggcuguacgacgaccgugg

SEQ ID NO: 26206 - RNA, 24 nt, Human
uaccccuucuagugaggcuaaaga

SEQ ID NO: 26207 - RNA, 24 nt, Human
uaaaacucauagacccaggucucc

SEQ ID NO: 26208 - RNA, 24 nt, Human
uacaggggugagccacugcgcccu

SEQ ID NO: 26209 - RNA, 20 nt, Human
uuuggaaggcgggaaggggg

SEQ ID NO: 26210 - RNA, 24 nt, Human
gcugcacccuaucuuggagaccuu

SEQ ID NO: 26211 - RNA, 24 nt, Human
ugagggaagggagguggaagcuca

SEQ ID NO: 26212 - RNA, 24 nt, Human
accacaguacuccuucuauauagu

SEQ ID NO: 26213 - RNA, 24 nt, Human
uuuacauuuaaaaaauagaaggaa

SEQ ID NO: 26214 - RNA, 24 nt, Human
acauaugaaugcacgauaugaaga

SEQ ID NO: 26215 - RNA, 24 nt, Human
ugugcagaagaaauggaaggauuc

SEQ ID NO: 26216 - RNA, 24 nt, Human
uuuuauuuuucaauuuuuauuuug

SEQ ID NO: 26217 - RNA, 24 nt, Human
uucaaauuucuuucuuuuuuaauu

SEQ ID NO: 26218 - RNA, 24 nt, Human
ucuuaagcuggaccucacugucgg

SEQ ID NO: 26219 - RNA, 23 nt, Human
uugaaggaccacacagguagugg

SEQ ID NO: 26220 - RNA, 24 nt, Human
cuagccucuacgucuucugagauc

SEQ ID NO: 26221 - RNA, 24 nt, Human
uauggcaagucacuuugacagaca

SEQ ID NO: 26222 - RNA, 24 nt, Human
uacaccacucccaagaagaauaag

SEQ ID NO: 26223 - RNA, 24 nt, Human
uccuugggaacgggguucuccguc

SEQ ID NO: 26224 - RNA, 24 nt, Human
ugacucccagucucguuuuauugc

SEQ ID NO: 26225 - RNA, 24 nt, Human
ccuuuuuuuuugaaaaagggcgcc

SEQ ID NO: 26226 - RNA, 24 nt, Human
ugggaaggaccagcaggaggcagc

SEQ ID NO: 26227 - RNA, 22 nt, Human
uccgugcgcguugcugcggccg

SEQ ID NO: 26228 - RNA, 24 nt, Human
uugaucuugaagaaacugggcgug

SEQ ID NO: 26229 - RNA, 24 nt, Human
aggaaggagauauagugaagagga

SEQ ID NO: 26230 - RNA, 24 nt, Human
guagaguuuucuucaggcuuaaag

SEQ ID NO: 26231 - RNA, 24 nt, Human
ugccauaugguuuuucagaaacau

SEQ ID NO: 26232 - RNA, 24 nt, Human
uaauauaggaacaaacuuaggcuc

SEQ ID NO: 26233 - RNA, 24 nt, Human
uaugauauacauaugauacauauc

SEQ ID NO: 26234 - RNA, 22 nt, Human
uuccucaggggugagguuuggg

SEQ ID NO: 26235 - RNA, 24 nt, Human
uaccgugaaccuccagaagccauc

SEQ ID NO: 26236 - RNA, 24 nt, Human
cuuccuccguguuggagaccuggu

SEQ ID NO: 26237 - RNA, 24 nt, Human
ucucugguuguucacauuccaaaa

SEQ ID NO: 26238 - RNA, 24 nt, Human
ugugguuuuaaaagagucccucaa

SEQ ID NO: 26239 - RNA, 24 nt, Human
cuggguccccucugcaagcucaga

SEQ ID NO: 26240 - RNA, 24 nt, Human
uuaguauuauuuauuugacaacuc

SEQ ID NO: 26241 - RNA, 24 nt, Human
ucacauagguugugccaugagugg

SEQ ID NO: 26242 - RNA, 24 nt, Human
acugguucaccuacaaugagacaa

SEQ ID NO: 26243 - RNA, 18 nt, Human
aaggaccccagcuguuuc

SEQ ID NO: 26244 - RNA, 23 nt, Human
cucugcuucagagggugcccaga

SEQ ID NO: 26245 - RNA, 24 nt, Human
cgccguggcuaguggcgcgcacgg

SEQ ID NO: 26246 - RNA, 24 nt, Human
acgcaucgauucgcgguaagacag

SEQ ID NO: 26247 - RNA, 24 nt, Human
aggaaggagauauagugaagagga

SEQ ID NO: 26248 - RNA, 24 nt, Human
uacacggucguggacgagauguuc

SEQ ID NO: 26249 - RNA, 17 nt, Human
ucagugcgggaaccaau

SEQ ID NO: 26250 - RNA, 24 nt, Human
aggaaggagauauagugaagagga

SEQ ID NO: 26251 - RNA, 24 nt, Human
guagaguuuucuucaggcuuaaag

SEQ ID NO: 26252 - RNA, 23 nt, Human
aggaaggagauagugaagaggac

SEQ ID NO: 26253 - RNA, 24 nt, Human
uucaucuuucauugcugcaaggaa

SEQ ID NO: 26254 - RNA, 24 nt, Human
accagcuucugcuaccuucaugcu

SEQ ID NO: 26255 - RNA, 24 nt, Human
uggaaugcuagauggccaagccuc

SEQ ID NO: 26256 - RNA, 24 nt, Human
gggcguugagaaaaggugacucuc

SEQ ID NO: 26257 - RNA, 24 nt, Human
gaggagaaacccugggaaggcucc

SEQ ID NO: 26258 - RNA, 24 nt, Human
uggcaagaaauccaagcuggaguu

SEQ ID NO: 26259 - RNA, 24 nt, Human
cacuacaccauuggcaaggagauc

SEQ ID NO: 26260 - RNA, 24 nt, Human
cuuguaggucuauauuuaucuuca

SEQ ID NO: 26261 - RNA, 24 nt, Human
uacuaaguuuauuuugcaaguguu

SEQ ID NO: 26262 - RNA, 21 nt, Human
ugggaggggcugaauguggug

SEQ ID NO: 26263 - RNA, 24 nt, Human
aagcguuuugagcagaaaggauuc

SEQ ID NO: 26264 - RNA, 24 nt, Human
gcgcggccuggugggcgagaucau

SEQ ID NO: 26265 - RNA, 24 nt, Human
ucuggaguucuuccgccaggguga

SEQ ID NO: 26266 - RNA, 24 nt, Human
uccccgauggcccacugcgugacc

SEQ ID NO: 26267 - RNA, 19 nt, Human
uaccgcuuugagacagucc

SEQ ID NO: 26268 - RNA, 22 nt, Human
ugggagggggcagcugggcuga

SEQ ID NO: 26269 - RNA, 24 nt, Human
uuaacagagggaugagaaaaagua

SEQ ID NO: 26270 - RNA, 24 nt, Human
cagcugccgcaaagucucguccac

SEQ ID NO: 26271 - RNA, 24 nt, Human
aagcugcaccagcgcguggagcag

SEQ ID NO: 26272 - RNA, 24 nt, Human
gcagccccaggcagacccccgcgc

SEQ ID NO: 26273 - RNA, 24 nt, Human
uguagaaugcuuuuaggccuucuu

SEQ ID NO: 26274 - RNA, 24 nt, Human
uggcuuugaacauucacugcgggg

SEQ ID NO: 26275 - RNA, 24 nt, Human
agcuuccauacgagccaggccaau

SEQ ID NO: 26276 - RNA, 24 nt, Human
uaacagcaauguucagggaacaaa

SEQ ID NO: 26277 - RNA, 24 nt, Human
uucauggacacuuaucacuucccc

SEQ ID NO: 26278 - RNA, 24 nt, Human
augcucaacccguauuuucuggcu

SEQ ID NO: 26279 - RNA, 24 nt, Human
uggcacggcaaucgccauccuuuc

SEQ ID NO: 26280 - RNA, 24 nt, Human
ucacugcagcagcgcacucacaug

SEQ ID NO: 26281 - RNA, 24 nt, Human
auaauauuguuugguaaauguuuc

SEQ ID NO: 26282 - RNA, 24 nt, Human
agaaauguugagucuguacuaaac

SEQ ID NO: 26283 - RNA, 24 nt, Human
ucuaagguuuaaauaggaguggug

SEQ ID NO: 26284 - RNA, 21 nt, Human
uauuuugucuuacugaaauug

SEQ ID NO: 26285 - RNA, 24 nt, Human
cgccaagaccugcuucaccuuuug

SEQ ID NO: 26286 - RNA, 24 nt, Human
gucaucuucuacaccuaggcuguc

SEQ ID NO: 26287 - RNA, 21 nt, Human
uugaaccauguguuaccgggc

SEQ ID NO: 26288 - RNA, 21 nt, Human
aaaaggcuuugcacaagagaa

SEQ ID NO: 26289 - RNA, 23 nt, Human
cacacccaaacaaacccaaggau

SEQ ID NO: 26290 - RNA, 24 nt, Human
cgugcagacucgacagcaccugaa

SEQ ID NO: 26291 - RNA, 24 nt, Human
uuaguucauucuucuaauaagccu

SEQ ID NO: 26292 - RNA, 24 nt, Human
uguuucaacugugcuccuguuugu

SEQ ID NO: 26293 - RNA, 24 nt, Human
gugaauuuuugaaacuggacagag

SEQ ID NO: 26294 - RNA, 24 nt, Human
ggggagcgagcacgucgcuccgca

SEQ ID NO: 26295 - RNA, 24 nt, Human
acgcaagcaggaggcgggggaguc

SEQ ID NO: 26296 - RNA, 24 nt, Human
ugccaauauacaguuagaauauca

SEQ ID NO: 26297 - RNA, 24 nt, Human
uaugugcaguuauuaucacaugaa

SEQ ID NO: 26298 - RNA, 24 nt, Human
uacacuguggccucaaccucccag

SEQ ID NO: 26299 - RNA, 24 nt, Human
ucccucuugcuuuauagcuagcug

SEQ ID NO: 26300 - RNA, 24 nt, Human
ucucuuguccucagugucucuucu

SEQ ID NO: 26301 - RNA, 24 nt, Human
ugaagacaccccuuuaauugcuau

SEQ ID NO: 26302 - RNA, 24 nt, Human
caaggguaacucauaaagucaagg

SEQ ID NO: 26303 - RNA, 17 nt, Human
ccagugcaagaaugggg

SEQ ID NO: 26304 - RNA, 24 nt, Human
gccccgaggcccggcggggcggcg

SEQ ID NO: 26305 - RNA, 24 nt, Human
gcccggaggccguggcgcucgcgc

SEQ ID NO: 26306 - RNA, 24 nt, Human
cucugcaucucgcggcgccgcgac

SEQ ID NO: 26307 - RNA, 24 nt, Human
cgggggccgcaccuuggaggagau

SEQ ID NO: 26308 - RNA, 24 nt, Human
uuuacagauccggccaggaccccg

SEQ ID NO: 26309 - RNA, 24 nt, Human
caucgcaauuucuuuguacaauag

SEQ ID NO: 26310 - RNA, 24 nt, Human
uuaguacaguuuuucuggugaccu

SEQ ID NO: 26311 - RNA, 24 nt, Human
uuucuagagcccaagcuccauuag

SEQ ID NO: 26312 - RNA, 24 nt, Human
uaccuuaaucaccugagguucugg

SEQ ID NO: 26313 - RNA, 24 nt, Human
uucaugaacauuuugcccugaacu

SEQ ID NO: 26314 - RNA, 24 nt, Human
uaagagccacucucucgguuggcg

SEQ ID NO: 26315 - RNA, 24 nt, Human
uuucugcuguaggcugggcuacag

SEQ ID NO: 26316 - RNA, 24 nt, Human
cuguucuagauauuugagauuagg

SEQ ID NO: 26317 - RNA, 24 nt, Human
uuguagguauguauaggaaaaaua

SEQ ID NO: 26318 - RNA, 24 nt, Human
gagcgguucauuuauuuggaaacu

SEQ ID NO: 26319 - RNA, 24 nt, Human
uguucuggagcuguuggacaaaua

SEQ ID NO: 26320 - RNA, 24 nt, Human
aaccagaaaguaagguguucuacu

SEQ ID NO: 26321 - RNA, 24 nt, Human
uaccgccaccgccgcgccgauucc

SEQ ID NO: 26322 - RNA, 24 nt, Human
aggcagucacagaacaggggcaug

SEQ ID NO: 26323 - RNA, 24 nt, Human
uguagguaacucuccuccagucgg

SEQ ID NO: 26324 - RNA, 24 nt, Human
ggaggauaaaggaacucuuugcac

SEQ ID NO: 26325 - RNA, 24 nt, Human
aggaaggaguuuggccacauugga

SEQ ID NO: 26326 - RNA, 22 nt, Human
caccggagcacaccuagggauc

SEQ ID NO: 26327 - RNA, 24 nt, Human
uggaguccucgggggccgugcacu

SEQ ID NO: 26328 - RNA, 24 nt, Human
cuccucuagcuuauuuggugucuc

SEQ ID NO: 26329 - RNA, 24 nt, Human
uuggacggaacagauccggggacu

SEQ ID NO: 26330 - RNA, 24 nt, Human
cuacaccuaccucucucugggcuu

SEQ ID NO: 26331 - RNA, 24 nt, Human
cuugccaaccgaaccaugagcucc

SEQ ID NO: 26332 - RNA, 24 nt, Human
uggaucacuggucauuccuacguc

SEQ ID NO: 26333 - RNA, 24 nt, Human
uggcaugagcucaugcaaugaggc

SEQ ID NO: 26334 - RNA, 24 nt, Human
uggcuccacaggcaaacccaaggg

SEQ ID NO: 26335 - RNA, 24 nt, Human
uguucuggagcuguuggacaaaua

SEQ ID NO: 26336 - RNA, 24 nt, Human
aaccagaaaguaagguguucuacu

SEQ ID NO: 26337 - RNA, 22 nt, Human
cacucgguguacguccuggagg

SEQ ID NO: 26338 - RNA, 24 nt, Human
caccgggaggugaccccugaccag

SEQ ID NO: 26339 - RNA, 21 nt, Human
uccugggucccgggagggcuc

SEQ ID NO: 26340 - RNA, 24 nt, Human
uauggcaagucacuuugacagaca

SEQ ID NO: 26341 - RNA, 24 nt, Human
uacaccacucccaagaagaauaag

SEQ ID NO: 26342 - RNA, 24 nt, Human
uaccuuugcacaaagugaaaucuc

SEQ ID NO: 26343 - RNA, 24 nt, Human
uggggugggguccaggaaucuguu

SEQ ID NO: 26344 - RNA, 24 nt, Human
cgugcccccugcgagaagauguug

SEQ ID NO: 26345 - RNA, 22 nt, Human
cucguggugagcguguaaauua

SEQ ID NO: 26346 - RNA, 21 nt, Human
aacacagugaaaccccaucuc

SEQ ID NO: 26347 - RNA, 24 nt, Human
aagaagccgcccugguugcacaug

SEQ ID NO: 26348 - RNA, 24 nt, Human
uagaauuucuucuugguauuaaag

SEQ ID NO: 26349 - RNA, 24 nt, Human
cuaggcccacaaagggggguccaa

SEQ ID NO: 26350 - RNA, 24 nt, Human
uaucuuaauccuuccacauacaga

SEQ ID NO: 26351 - RNA, 23 nt, Human
aaagacaagauaaucaauacaug

SEQ ID NO: 26352 - RNA, 24 nt, Human
ucaaguacauucccagucguggcc

SEQ ID NO: 26353 - RNA, 20 nt, Human
gaccuggggcggaaaaaggc

SEQ ID NO: 26354 - RNA, 24 nt, Human
uuugaucaggagaacgugguuacu

SEQ ID NO: 26355 - RNA, 24 nt, Human
uucucgugugaaugaggguuuuau

SEQ ID NO: 26356 - RNA, 24 nt, Human
uuccuuggcuccucaggcuggggu

SEQ ID NO: 26357 - RNA, 24 nt, Human
ugugaugcaggugaucguguaaug

SEQ ID NO: 26358 - RNA, 24 nt, Human
uaugacacagagacagggggcaau

SEQ ID NO: 26359 - RNA, 24 nt, Human
ccaccgggaccuggucagcacaga

SEQ ID NO: 26360 - RNA, 24 nt, Human
ugaaugcuguaucggcacagggaa

SEQ ID NO: 26361 - RNA, 24 nt, Human
gcuuuguucaaugcuuccacucua

SEQ ID NO: 26362 - RNA, 23 nt, Human
gacugugggguggauugggagaa

SEQ ID NO: 26363 - RNA, 24 nt, Human
guggagugccagcgucacaccuac

SEQ ID NO: 26364 - RNA, 24 nt, Human
gcugcaguccauuggcaccgagaa

SEQ ID NO: 26365 - RNA, 24 nt, Human
agccguagaauuugaccuugcgaa

SEQ ID NO: 26366 - RNA, 20 nt, Human
uuaagggggauaacuugggc

SEQ ID NO: 26367 - RNA, 24 nt, Human
ggccgugguccgcgcccuuccucg

SEQ ID NO: 26368 - RNA, 24 nt, Human
ugaacaaagucagaucuggucaga

SEQ ID NO: 26369 - RNA, 24 nt, Human
aguggagacuguugaaugugagau

SEQ ID NO: 26370 - RNA, 24 nt, Human
uggaacagugugacugagaacauc

SEQ ID NO: 26371 - RNA, 24 nt, Human
cucccggguuaaggcugggguuug

SEQ ID NO: 26372 - RNA, 24 nt, Human
aggccgcacuccacuaccugcguu

SEQ ID NO: 26373 - RNA, 24 nt, Human
ucacugggccugccucaacuguaa

SEQ ID NO: 26374 - RNA, 24 nt, Human
ucuaguaccccuuugcauaccaac

SEQ ID NO: 26375 - RNA, 24 nt, Human
uguugggaaggagccgggcagcag

SEQ ID NO: 26376 - RNA, 24 nt, Human
ucucagggaugccacaaccauggg

SEQ ID NO: 26377 - RNA, 24 nt, Human
ggacuaggccuggaggccgccgcg

SEQ ID NO: 26378 - RNA, 24 nt, Human
ccugccucaugagggcuccaaugu

SEQ ID NO: 26379 - RNA, 23 nt, Human
uuugaccuggggcggaaaaaggc

SEQ ID NO: 26380 - RNA, 24 nt, Human
aauuuuguaacucagaucuugcug

SEQ ID NO: 26381 - RNA, 24 nt, Human
gcucaucguguggcugcuggugaa

SEQ ID NO: 26382 - RNA, 24 nt, Human
uuuuaugcagaugaucagucaaca

SEQ ID NO: 26383 - RNA, 24 nt, Human
ugggacuuugaccugcaauuaggu

SEQ ID NO: 26384 - RNA, 24 nt, Human
cuagaaccacaggagaauggcgug

SEQ ID NO: 26385 - RNA, 20 nt, Human
uaaaggucaugaggcugaag

SEQ ID NO: 26386 - RNA, 24 nt, Human
uccuagggcugucugggcuggucu

SEQ ID NO: 26387 - RNA, 24 nt, Human
cucccaccucccugaaacugucca

SEQ ID NO: 26388 - RNA, 24 nt, Human
uggugccccucccaggcuccuuuu

SEQ ID NO: 26389 - RNA, 19 nt, Human
acgcagccgcacgugguau

SEQ ID NO: 26390 - RNA, 18 nt, Human
cuuggcucuggggagggg

SEQ ID NO: 26391 - RNA, 24 nt, Human
uagaacaaauaggucggacaccgg

SEQ ID NO: 26392 - RNA, 24 nt, Human
ucgacccaucaggacgccagagcu

SEQ ID NO: 26393 - RNA, 24 nt, Human
aacuuuacaaaaaauggcagcaaa

SEQ ID NO: 26394 - RNA, 24 nt, Human
aggcugcgacgcugcacggcacca

SEQ ID NO: 26395 - RNA, 24 nt, Human
uucaaaguaccgaaaaccuucucc

SEQ ID NO: 26396 - RNA, 24 nt, Human
uaguauguugugucucuggaauau

SEQ ID NO: 26397 - RNA, 24 nt, Human
ccuacaaaauucccugucaaugac

SEQ ID NO: 26398 - RNA, 24 nt, Human
ugugcaccgccggccucguuugaa

SEQ ID NO: 26399 - RNA, 23 nt, Human
gacucugugagcugaccccgcuu

SEQ ID NO: 26400 - RNA, 24 nt, Human
cauucgagggccggggucgcggcc

SEQ ID NO: 26401 - RNA, 21 nt, Human
cgugcagcuaagggggcccgg

SEQ ID NO: 26402 - RNA, 24 nt, Human
ucacguggugagccaaucauacca

SEQ ID NO: 26403 - RNA, 24 nt, Human
caggguggccgugagccgcaccca

SEQ ID NO: 26404 - RNA, 24 nt, Human
ucuacaguuuaaugguuuuuuuga

SEQ ID NO: 26405 - RNA, 24 nt, Human
ugauaaaagacaauaauuaaauac

SEQ ID NO: 26406 - RNA, 20 nt, Human
cacuggaaggaacgcccgca

SEQ ID NO: 26407 - RNA, 20 nt, Human
uagcaagcgggggguaaggc

SEQ ID NO: 26408 - RNA, 24 nt, Human
aaauguacccaguauuccuaggua

SEQ ID NO: 26409 - RNA, 23 nt, Human
cuccaggggcgugacaacgucca

SEQ ID NO: 26410 - RNA, 24 nt, Human
aauugcucgacacaaccugcagaa

SEQ ID NO: 26411 - RNA, 24 nt, Human
agcgggugaagcuaucaagcccag

SEQ ID NO: 26412 - RNA, 24 nt, Human
acgagauuuggucguaguggggcg

SEQ ID NO: 26413 - RNA, 24 nt, Human
ucacugccaccagaagacugugga

SEQ ID NO: 26414 - RNA, 21 nt, Human
uaccugggguaagaugccagg

SEQ ID NO: 26415 - RNA, 18 nt, Human
gacccggggucuucaagc

SEQ ID NO: 26416 - RNA, 24 nt, Human
ugucucaggcccagugccccggag

SEQ ID NO: 26417 - RNA, 24 nt, Human
gagcagucuaaccccuaugccugu

SEQ ID NO: 26418 - RNA, 24 nt, Human
ugggauaaccauugcccuacugga

SEQ ID NO: 26419 - RNA, 24 nt, Human
gacaccuuccggcuucuggggucc

SEQ ID NO: 26420 - RNA, 24 nt, Human
uagugggcaccuuuauuuuuagau

SEQ ID NO: 26421 - RNA, 24 nt, Human
ugacucagugcucaggaucuuaug

SEQ ID NO: 26422 - RNA, 24 nt, Human
cagcugccacaggccuggaggagu

SEQ ID NO: 26423 - RNA, 24 nt, Human
agcacugaccgaccauugccauuu

SEQ ID NO: 26424 - RNA, 24 nt, Human
uucacuuuaccuucugccaaaugc

SEQ ID NO: 26425 - RNA, 17 nt, Human
ucugacccagugugcgc

SEQ ID NO: 26426 - RNA, 24 nt, Human
ugagagaagcagcugggggcccuc

SEQ ID NO: 26427 - RNA, 24 nt, Human
aagggccuguaccaaggcuuuaac

SEQ ID NO: 26428 - RNA, 24 nt, Human
ugcaggguauuaucaucuaccgag

SEQ ID NO: 26429 - RNA, 24 nt, Human
uuagaauuuggggggaaaauuugg

SEQ ID NO: 26430 - RNA, 21 nt, Human
aagugcugucuccauggucgg

SEQ ID NO: 26431 - RNA, 24 nt, Human
ucucuuggcacuucaaggguuguu

SEQ ID NO: 26432 - RNA, 24 nt, Human
accaagaucuuccacccgaacgug

SEQ ID NO: 26433 - RNA, 24 nt, Human
aagcuccucccgagcugggccccg

SEQ ID NO: 26434 - RNA, 24 nt, Human
uucuucacgggcagcaagcuggug

SEQ ID NO: 26435 - RNA, 24 nt, Human
ccggaccccaccucuucccugccg

SEQ ID NO: 26436 - RNA, 24 nt, Human
ccaaaguuugccggcugcaaguga

SEQ ID NO: 26437 - RNA, 24 nt, Human
uugaauauuuaucuagagaauaca

SEQ ID NO: 26438 - RNA, 24 nt, Human
uauguacccacuuagucauguaag

SEQ ID NO: 26439 - RNA, 24 nt, Human
cagggacaaauggauagagaagaa

SEQ ID NO: 26440 - RNA, 24 nt, Human
uggcuucgugcuugggguagaucu

SEQ ID NO: 26441 - RNA, 24 nt, Human
uucauuggcaguauuuugugauga

SEQ ID NO: 26442 - RNA, 22 nt, Human
ucagaacauucugaacugcuga

SEQ ID NO: 26443 - RNA, 24 nt, Human
ugaaugacaacuuuauuuuucuua

SEQ ID NO: 26444 - RNA, 19 nt, Human
caucacgcuucccuucugg

SEQ ID NO: 26445 - RNA, 22 nt, Human
ugaaaagguggucuauguuggc

SEQ ID NO: 26446 - RNA, 24 nt, Human
uggcaaacugguacuuugggaacu

SEQ ID NO: 26447 - RNA, 24 nt, Human
cacuggaucacaaguucguuuggu

SEQ ID NO: 26448 - RNA, 24 nt, Human
aaaguuaggcaggaaaaaggaaag

SEQ ID NO: 26449 - RNA, 24 nt, Human
ccuguauuuuaaugagaaaaaaaa

SEQ ID NO: 26450 - RNA, 24 nt, Human
cacacuuuuaauaaugcuucauaa

SEQ ID NO: 26451 - RNA, 24 nt, Human
ugcauuguuaucauuaaccagucu

SEQ ID NO: 26452 - RNA, 24 nt, Human
uauuagggauaauauucauuuagc

SEQ ID NO: 26453 - RNA, 24 nt, Human
aaaguuaaagcgaugccauuaguu

SEQ ID NO: 26454 - RNA, 24 nt, Human
guggugcugccgcugcucccuggc

SEQ ID NO: 26455 - RNA, 17 nt, Human
uauguuaucaggcuaca

SEQ ID NO: 26456 - RNA, 24 nt, Human
uaaugggucucaaaauucugugac

SEQ ID NO: 26457 - RNA, 24 nt, Human
uauuagggauaauauucauuuagc

SEQ ID NO: 26458 - RNA, 24 nt, Human
uaucaaggaagggcaggcgugaug

SEQ ID NO: 26459 - RNA, 24 nt, Human
uucaaauuucuuucuuuuuuaauu

SEQ ID NO: 26460 - RNA, 24 nt, Human
ucaauuuuuauuuugguuuucuua

SEQ ID NO: 26461 - RNA, 24 nt, Human
agaguuguucauccagggagacag

SEQ ID NO: 26462 - RNA, 24 nt, Human
ggccugggcacccuuagaggggag

SEQ ID NO: 26463 - RNA, 24 nt, Human
agcuacugggugagcuggacuacc

SEQ ID NO: 26464 - RNA, 24 nt, Human
auugugcuuguuucaaaaugcuuu

SEQ ID NO: 26465 - RNA, 24 nt, Human
ccacugcacuacagccugggcaac

SEQ ID NO: 26466 - RNA, 24 nt, Human
uaaguugcauacuuuuuacuuuuu

SEQ ID NO: 26467 - RNA, 24 nt, Human
aggcagccgcaccauggagucuuc

SEQ ID NO: 26468 - RNA, 24 nt, Human
ugagucacaaacugcgucuuggag

SEQ ID NO: 26469 - RNA, 24 nt, Human
ugaaaugcuacacaccucuugucu

SEQ ID NO: 26470 - RNA, 24 nt, Human
gaccuggcaacuaauaggacuaga

SEQ ID NO: 26471 - RNA, 24 nt, Human
uacccuggaccaaguuggcuacaa

SEQ ID NO: 26472 - RNA, 24 nt, Human
gcccugauaaugcguugaaagcua

SEQ ID NO: 26473 - RNA, 24 nt, Human
ccagaaaguagucgcagugaagcc

SEQ ID NO: 26474 - RNA, 24 nt, Human
ccaaaguuugccggcugcaaguga

SEQ ID NO: 26475 - RNA, 24 nt, Human
cucgucccggccccugcaguccgg

SEQ ID NO: 26476 - RNA, 24 nt, Human
ucagaugcuccugguguugcuggu

SEQ ID NO: 26477 - RNA, 22 nt, Human
cugcaccugcgacugucgccgc

SEQ ID NO: 26478 - RNA, 24 nt, Human
ccucaaugauguuugcaaaggagc

SEQ ID NO: 26479 - RNA, 24 nt, Human
uuccuugagcacaggaguuccaga

SEQ ID NO: 26480 - RNA, 24 nt, Human
ccucuccgguguggggcgcccgcg

SEQ ID NO: 26481 - RNA, 24 nt, Human
agccauagcuacgugcguucgcua

SEQ ID NO: 26482 - RNA, 24 nt, Human
gaggagucacccaggagucauuug

SEQ ID NO: 26483 - RNA, 24 nt, Human
aggaaggagauauagugaagagga

SEQ ID NO: 26484 - RNA, 24 nt, Human
auuugcucucuucccauuucugau

SEQ ID NO: 26485 - RNA, 24 nt, Human
uuccaaggcccccagugaacuccu

SEQ ID NO: 26486 - RNA, 24 nt, Human
gauccaaucagaugcagagaaugu

SEQ ID NO: 26487 - RNA, 24 nt, Human
aaugguacagcaguuacaagagga

SEQ ID NO: 26488 - RNA, 24 nt, Human
uauuagaguauagacuacaaggag

SEQ ID NO: 26489 - RNA, 24 nt, Human
uucauauagguaaauuccauaggu

SEQ ID NO: 26490 - RNA, 24 nt, Human
gguucagacaaguaauuucacauu

SEQ ID NO: 26491 - RNA, 24 nt, Human
uuaauaggaaaaagcauauaauac

SEQ ID NO: 26492 - RNA, 24 nt, Human
caccacagccauugcugaggccug

SEQ ID NO: 26493 - RNA, 24 nt, Human
uucgauuugauacuuaaacuugag

SEQ ID NO: 26494 - RNA, 21 nt, Human
ucagaauaaagacaucagcca

SEQ ID NO: 26495 - RNA, 24 nt, Human
gcuuugguucaaaaggaaacacua

SEQ ID NO: 26496 - RNA, 24 nt, Human
uguaguuuuuacccagguucuauc

SEQ ID NO: 26497 - RNA, 24 nt, Human
uuagugaacacucugggcccccua

SEQ ID NO: 26498 - RNA, 24 nt, Human
uuacugagaauaaaacuguuacag

SEQ ID NO: 26499 - RNA, 17 nt, Human
uacucuggggaggaacc

SEQ ID NO: 26500 - RNA, 24 nt, Human
uuggugauggagccuguggaaacg

SEQ ID NO: 26501 - RNA, 24 nt, Human
augucucugccaagucgacaaaca

SEQ ID NO: 26502 - RNA, 24 nt, Human
uaucucagaugccacaagaagagc

SEQ ID NO: 26503 - RNA, 24 nt, Human
uuucauggcccuuucaacguccug

SEQ ID NO: 26504 - RNA, 24 nt, Human
gggaagacugaagaaguguuaacu

SEQ ID NO: 26505 - RNA, 24 nt, Human
uuuguacacauuaagcucuuuaga

SEQ ID NO: 26506 - RNA, 24 nt, Human
uuacaugcuuugagguuggguaug

SEQ ID NO: 26507 - RNA, 24 nt, Human
uuuuaaaacuucucauacugaaaa

SEQ ID NO: 26508 - RNA, 24 nt, Human
uugaucuugaagaaacugggcgug

SEQ ID NO: 26509 - RNA, 24 nt, Human
aggaaggagauauagugaagagga

SEQ ID NO: 26510 - RNA, 24 nt, Human
uugguuccaagacgcguaggcgag

SEQ ID NO: 26511 - RNA, 24 nt, Human
ugugcagaagaaauggaaggauuc

SEQ ID NO: 26512 - RNA, 24 nt, Human
uucaaauuucuuucuuuuuuaauu

SEQ ID NO: 26513 - RNA, 24 nt, Human
uaaggaaauguugagggcaagcca

SEQ ID NO: 26514 - RNA, 24 nt, Human
uagaaguaguauguuauuccuggu

SEQ ID NO: 26515 - RNA, 22 nt, Human
cuacuggauaucugacuggagc

SEQ ID NO: 26516 - RNA, 24 nt, Human
aagcagguuagcgugaagguggua

SEQ ID NO: 26517 - RNA, 24 nt, Human
ucagugcacacacugauuuuucac

SEQ ID NO: 26518 - RNA, 21 nt, Human
uugaaacugaaguaggccuac

SEQ ID NO: 26519 - RNA, 24 nt, Human
gagacuuuuuccauucccucacgg

SEQ ID NO: 26520 - RNA, 24 nt, Human
ugaguuuaauuuaauauguaauac

SEQ ID NO: 26521 - RNA, 24 nt, Human
uaagguaguacuuuucuuuuuaua

SEQ ID NO: 26522 - RNA, 24 nt, Human
uguaaagaugcuuuuucucaugca

SEQ ID NO: 26523 - RNA, 24 nt, Human
uugguacaggcaggaucuugccac

SEQ ID NO: 26524 - RNA, 24 nt, Human
uggggcccaagugauccuccuacc

SEQ ID NO: 26525 - RNA, 24 nt, Human
ggacagguguacagacauguucuu

SEQ ID NO: 26526 - RNA, 24 nt, Human
ucgaauggacacauuaccagugaa

SEQ ID NO: 26527 - RNA, 24 nt, Human
cugccagucggugccccucccgcu

SEQ ID NO: 26528 - RNA, 24 nt, Human
ugagaaaugugacagaggcauuua

SEQ ID NO: 26529 - RNA, 24 nt, Human
ucuaaaaacuugauaaaaugaaau

SEQ ID NO: 26530 - RNA, 24 nt, Human
uacccuucaugcaugaaagacaaa

SEQ ID NO: 26531 - RNA, 24 nt, Human
caaguucggaccucuaguacaaua

SEQ ID NO: 26532 - RNA, 24 nt, Human
ugucugggaaagauaucggugaga

SEQ ID NO: 26533 - RNA, 23 nt, Human
uaucagguccaaacucugccagg

SEQ ID NO: 26534 - RNA, 24 nt, Human
gaggaugcccauguggagcacaga

SEQ ID NO: 26535 - RNA, 24 nt, Human
ucacagagucuguccggagcccac

SEQ ID NO: 26536 - RNA, 24 nt, Human
ucccugcaggugucuugccccuau

SEQ ID NO: 26537 - RNA, 24 nt, Human
aggugguugcuuugaacuuuauuu

SEQ ID NO: 26538 - RNA, 21 nt, Human
caucggauuuugcagcuucug

SEQ ID NO: 26539 - RNA, 24 nt, Human
ugaucucguuggacugcguggcua

SEQ ID NO: 26540 - RNA, 24 nt, Human
ggcgaagugguugacauccaggga

SEQ ID NO: 26541 - RNA, 24 nt, Human
cgagugugccagagucuccagaau

SEQ ID NO: 26542 - RNA, 20 nt, Human
uauaguguggaucaggaaaa

SEQ ID NO: 26543 - RNA, 24 nt, Human
uagguggggugaucagauaggccg

SEQ ID NO: 26544 - RNA, 19 nt, Human
uuaacaagaaagguaaucu

SEQ ID NO: 26545 - RNA, 24 nt, Human
aaccagcuucgaggcaagaagucc

SEQ ID NO: 26546 - RNA, 24 nt, Human
ugacuggucugcgccgucaacugg

SEQ ID NO: 26547 - RNA, 24 nt, Human
ugugucaacuguguccagggugug

SEQ ID NO: 26548 - RNA, 24 nt, Human
ucaagaaggagucuuugacauuaa

SEQ ID NO: 26549 - RNA, 24 nt, Human
uacaguuuacagacaagagguuuc

SEQ ID NO: 26550 - RNA, 24 nt, Human
caaggaacacaaaagacucaaaca

SEQ ID NO: 26551 - RNA, 24 nt, Human
uuccagugcauuaugaugagcccg

SEQ ID NO: 26552 - RNA, 24 nt, Human
ugcgcaugagacccuggcuagaga

SEQ ID NO: 26553 - RNA, 22 nt, Human
aagaaucugggacuaccaagug

SEQ ID NO: 26554 - RNA, 24 nt, Human
uggcacagaaucugggaauuugua

SEQ ID NO: 26555 - RNA, 24 nt, Human
uaugagaagauauuuacacuuuua

SEQ ID NO: 26556 - RNA, 20 nt, Human
uggccggaagcugggcgggu

SEQ ID NO: 26557 - RNA, 24 nt, Human
cgaguacaagccccaggaugcuac

SEQ ID NO: 26558 - RNA, 24 nt, Human
ucaguaaacaagugcugaaaaaga

SEQ ID NO: 26559 - RNA, 18 nt, Human
uaggacgucuuccucucc

SEQ ID NO: 26560 - RNA, 24 nt, Human
uguggaagguaucguccccagcgc

SEQ ID NO: 26561 - RNA, 24 nt, Human
uguuauggccgcgccaccgggcgu

SEQ ID NO: 26562 - RNA, 24 nt, Human
ugaaauggcugcaccaugucggcc

SEQ ID NO: 26563 - RNA, 24 nt, Human
ugcccacucccacauccggggacu

SEQ ID NO: 26564 - RNA, 24 nt, Human
caagcccaguaagaggucugaccg

SEQ ID NO: 26565 - RNA, 24 nt, Human
uacaacccacauauugggggcuac

SEQ ID NO: 26566 - RNA, 24 nt, Human
uagaucauuagcucagugaccucc

SEQ ID NO: 26567 - RNA, 24 nt, Human
ucccugcugggcugcugugcagag

SEQ ID NO: 26568 - RNA, 24 nt, Human
uauggaacccaccacaaccccaca

SEQ ID NO: 26569 - RNA, 22 nt, Human
ugccuggauuuuugugcugcag

SEQ ID NO: 26570 - RNA, 24 nt, Human
ugcuguagcuuuucugagugccuc

SEQ ID NO: 26571 - RNA, 24 nt, Human
acugguucaccuacaaugagacaa

SEQ ID NO: 26572 - RNA, 24 nt, Human
agccauugggauccagacaucaga

SEQ ID NO: 26573 - RNA, 24 nt, Human
uuuggaggaguugaugagaaagga

SEQ ID NO: 26574 - RNA, 24 nt, Human
gucacuuguggggcagaccgcaau

SEQ ID NO: 26575 - RNA, 24 nt, Human
ugccuuagcguuuguggacacuuc

SEQ ID NO: 26576 - RNA, 21 nt, Human
uugaacucaucaagauguucg

SEQ ID NO: 26577 - RNA, 24 nt, Human
uucccgcgcugagcuacaggacuc

SEQ ID NO: 26578 - RNA, 24 nt, Human
uagggcauuauuaugcgagaauuu

SEQ ID NO: 26579 - RNA, 24 nt, Human
agggggaggaggggaagugaggcc

SEQ ID NO: 26580 - RNA, 24 nt, Human
uaccccaaugcuauucucgugaua

SEQ ID NO: 26581 - RNA, 24 nt, Human
uuggugcacgacuggcgaaggggg

SEQ ID NO: 26582 - RNA, 24 nt, Human
caccauaggccagaauugggccca

SEQ ID NO: 26583 - RNA, 23 nt, Human
cagcggggcagcuugucucccuu

SEQ ID NO: 26584 - RNA, 24 nt, Human
uggcuacgcccucaaucccugacc

SEQ ID NO: 26585 - RNA, 24 nt, Human
uugaaaaugcuugcaguuugaccu

SEQ ID NO: 26586 - RNA, 24 nt, Human
uccgcacacuugaggaguuacuga

SEQ ID NO: 26587 - RNA, 24 nt, Human
gcccaaauccaaaaaccuucagcc

SEQ ID NO: 26588 - RNA, 24 nt, Human
ugagggcgacguguccucugaacg

SEQ ID NO: 26589 - RNA, 24 nt, Human
uggcaaguuuggggccuacaugca

SEQ ID NO: 26590 - RNA, 24 nt, Human
uggaagagggacuccaaugggcau

SEQ ID NO: 26591 - RNA, 24 nt, Human
aagcagaaagggaagagaagcgag

SEQ ID NO: 26592 - RNA, 24 nt, Human
uucccaugccccaggcuccugcag

SEQ ID NO: 26593 - RNA, 24 nt, Human
agagguacuguugcagccgcugca

SEQ ID NO: 26594 - RNA, 24 nt, Human
agggguggggcugacgucaggagc

SEQ ID NO: 26595 - RNA, 24 nt, Human
ucugcaguccauagaagagcguga

SEQ ID NO: 26596 - RNA, 24 nt, Human
gggcucugugguuccuggcgucuc

SEQ ID NO: 26597 - RNA, 24 nt, Human
uaaucuuaucagaaaaaaacgaca

SEQ ID NO: 26598 - RNA, 24 nt, Human
uccaaacccgaaacacgcgaccag

SEQ ID NO: 26599 - RNA, 24 nt, Human
gacuccuuaggaggagugagacag

SEQ ID NO: 26600 - RNA, 24 nt, Human
ucuuaaguaauugguuaguuaaca

SEQ ID NO: 26601 - RNA, 21 nt, Human
uugcagguggguaguggguca

SEQ ID NO: 26602 - RNA, 24 nt, Human
acgcauagccaaggggaagcgcga

SEQ ID NO: 26603 - RNA, 24 nt, Human
uagaauuucggcguuuugcugcaa

SEQ ID NO: 26604 - RNA, 17 nt, Human
uauccuaggugguugcc

SEQ ID NO: 26605 - RNA, 24 nt, Human
uuggacggaacagauccggggacu

SEQ ID NO: 26606 - RNA, 24 nt, Human
cggcacgaggcugcgaaccacgug

SEQ ID NO: 26607 - RNA, 24 nt, Human
uuggcacaguugaugcugacuuuu

SEQ ID NO: 26608 - RNA, 24 nt, Human
gcucauuugcaggggggagccaaa

SEQ ID NO: 26609 - RNA, 24 nt, Human
cuggcgcugaguacgucguggagu

SEQ ID NO: 26610 - RNA, 24 nt, Human
uaaaguggauauuguugccaucaa

SEQ ID NO: 26611 - RNA, 24 nt, Human
ugagaacgggaagcuugucaucaa

SEQ ID NO: 26612 - RNA, 24 nt, Human
acucaaggccgaccggcggaauag

SEQ ID NO: 26613 - RNA, 24 nt, Human
ugaacaucuccuucccagccacug

SEQ ID NO: 26614 - RNA, 24 nt, Human
gggaagggcugucaacaaugagcc

SEQ ID NO: 26615 - RNA, 24 nt, Human
uucgugagugcuggcgucccgggu

SEQ ID NO: 26616 - RNA, 24 nt, Human
caagaugaccucacuaaccagugg

SEQ ID NO: 26617 - RNA, 24 nt, Human
ugaguggaaucucuaagugcuuug

SEQ ID NO: 26618 - RNA, 24 nt, Human
acaaugacuuuuguaaggauuggu

SEQ ID NO: 26619 - RNA, 24 nt, Human
aagcuuuuuuuuaacaggaaaaga

SEQ ID NO: 26620 - RNA, 24 nt, Human
uaaaaucuacaaaucagcccucga

SEQ ID NO: 26621 - RNA, 24 nt, Human
agccaauggucgagcagauccagu

SEQ ID NO: 26622 - RNA, 24 nt, Human
uaaggucaucgauacggagcagga

SEQ ID NO: 26623 - RNA, 24 nt, Human
ugccuuaaacugggccugaagacg

SEQ ID NO: 26624 - RNA, 24 nt, Human
ugccacuggccuugccuuuggcac

SEQ ID NO: 26625 - RNA, 24 nt, Human
cuuggccuuggccuuggccuuggc

SEQ ID NO: 26626 - RNA, 24 nt, Human
cauuguuggccugcaucuucuuua

SEQ ID NO: 26627 - RNA, 24 nt, Human
gcaaagauugccuuguccccaaga

SEQ ID NO: 26628 - RNA, 24 nt, Human
ugugcaauccucuugggguuggug

SEQ ID NO: 26629 - RNA, 24 nt, Human
uccucagucuccccagagcggugg

SEQ ID NO: 26630 - RNA, 24 nt, Human
ucugcugguaucagaagccgggcg

SEQ ID NO: 26631 - RNA, 24 nt, Human
ugguguguggaacugcugcaagcu

SEQ ID NO: 26632 - RNA, 24 nt, Human
agaguuccuaucagacugagauug

SEQ ID NO: 26633 - RNA, 24 nt, Human
uaacuuuauuuuaagcuucuauua

SEQ ID NO: 26634 - RNA, 24 nt, Human
cgagcagauggccagccacagcgc

SEQ ID NO: 26635 - RNA, 24 nt, Human
agacaugcgggucgcccauacccg

SEQ ID NO: 26636 - RNA, 24 nt, Human
ugcuggggacgacgcuccccgagc

SEQ ID NO: 26637 - RNA, 24 nt, Human
ggggauggcccccgccgaauucuc

SEQ ID NO: 26638 - RNA, 22 nt, Human
ucaguauuucugauugucuaua

SEQ ID NO: 26639 - RNA, 24 nt, Human
ggacagguguacagacauguucuu

SEQ ID NO: 26640 - RNA, 24 nt, Human
ucgaauggacacauuaccagugaa

SEQ ID NO: 26641 - RNA, 24 nt, Human
gcccugugccuuccugaagugcug

SEQ ID NO: 26642 - RNA, 24 nt, Human
uguguccucgccaacccccgaccu

SEQ ID NO: 26643 - RNA, 24 nt, Human
cggaaugggccaacucacucggug

SEQ ID NO: 26644 - RNA, 24 nt, Human
ugugguuuuagcaccuuggggaga

SEQ ID NO: 26645 - RNA, 24 nt, Human
uuggagaaccuguucugacuuuag

SEQ ID NO: 26646 - RNA, 24 nt, Human
uggguuaggguguguguucaccuu

SEQ ID NO: 26647 - RNA, 24 nt, Human
aggccugaggcggggguggacugc

SEQ ID NO: 26648 - RNA, 24 nt, Human
ugcaaggaggggaucaaggacggu

SEQ ID NO: 26649 - RNA, 24 nt, Human
cgcgcgggguuggcugccuauuuu

SEQ ID NO: 26650 - RNA, 24 nt, Human
ucugucucauacuuuggcguugua

SEQ ID NO: 26651 - RNA, 24 nt, Human
ugaauccaugucuuaaccagcagg

SEQ ID NO: 26652 - RNA, 24 nt, Human
ugacuugaauccaaaguguauaca

SEQ ID NO: 26653 - RNA, 24 nt, Human
aaagguccugguucacccuggaga

SEQ ID NO: 26654 - RNA, 24 nt, Human
uugccuggcuccuggcacuugacu

SEQ ID NO: 26655 - RNA, 24 nt, Human
guccagaagcuggcccuguacgag

SEQ ID NO: 26656 - RNA, 24 nt, Human
uaugaacauugaacaaccucucac

SEQ ID NO: 26657 - RNA, 24 nt, Human
uucccuuucacuaagaacacacgg

SEQ ID NO: 26658 - RNA, 24 nt, Human
uacaagcaauaguuauggggaucu

SEQ ID NO: 26659 - RNA, 24 nt, Human
aauuguugggggcuucaggggucc

SEQ ID NO: 26660 - RNA, 18 nt, Human
ugaugguagagacagacu

SEQ ID NO: 26661 - RNA, 20 nt, Human
caccugguuuguccuaaggc

SEQ ID NO: 26662 - RNA, 24 nt, Human
ucgggccccuccaucguccaccgc

SEQ ID NO: 26663 - RNA, 24 nt, Human
ugcagaaggagaucaccgcccugg

SEQ ID NO: 26664 - RNA, 24 nt, Human
uggaaucuugcggcauccacgaga

SEQ ID NO: 26665 - RNA, 24 nt, Human
uccggacauuuaaaauauugauau

SEQ ID NO: 26666 - RNA, 24 nt, Human
ugggacccuccgaaauaacgccgg

SEQ ID NO: 26667 - RNA, 24 nt, Human
gagcaggggugggcggaggucacc

SEQ ID NO: 26668 - RNA, 24 nt, Human
uaauacgagagguaaucagauggu

SEQ ID NO: 26669 - RNA, 24 nt, Human
ucugaucuauaaaugcgguggcau

SEQ ID NO: 26670 - RNA, 24 nt, Human
uauuggacaaauuugguggggagc

SEQ ID NO: 26671 - RNA, 24 nt, Human
uguuuuguuuaucuuucucuuuca

SEQ ID NO: 26672 - RNA, 21 nt, Human
uucaagggauggaaagucacc

SEQ ID NO: 26673 - RNA, 24 nt, Human
ugccaagacugugccgcccccaca

SEQ ID NO: 26674 - RNA, 24 nt, Human
uagccaagcuacaggaagcaguag

SEQ ID NO: 26675 - RNA, 24 nt, Human
uaggauaggugaaaauggugaucc

SEQ ID NO: 26676 - RNA, 24 nt, Human
ucugaucuauaaaugcgguggcau

SEQ ID NO: 26677 - RNA, 21 nt, Human
uucaagggauggaaagucacc

SEQ ID NO: 26678 - RNA, 24 nt, Human
uccaccacuacuggccaucugauc

SEQ ID NO: 26679 - RNA, 21 nt, Human
uucaagggauggaaagucacc

SEQ ID NO: 26680 - RNA, 21 nt, Human
uucaagggauggaaagucacc

SEQ ID NO: 26681 - RNA, 24 nt, Human
ugccgggucccagccccaagccag

SEQ ID NO: 26682 - RNA, 24 nt, Human
cggcuucaucggccucugcuggcu

SEQ ID NO: 26683 - RNA, 24 nt, Human
acgcugagugaccugcucacgggc

SEQ ID NO: 26684 - RNA, 24 nt, Human
ucgguggccgccagcugccuggug

SEQ ID NO: 26685 - RNA, 24 nt, Human
gugguuccuacgggagggccugcu

SEQ ID NO: 26686 - RNA, 24 nt, Human
cuugcggaccuuccucgagcgcca

SEQ ID NO: 26687 - RNA, 24 nt, Human
ugauuugauccuggaaguaacugc

SEQ ID NO: 26688 - RNA, 24 nt, Human
ccagcccgccggcccugagcuccg

SEQ ID NO: 26689 - RNA, 20 nt, Human
uggaacuguccaagucucag

SEQ ID NO: 26690 - RNA, 24 nt, Human
accccaguaaaacccgcgggguga

SEQ ID NO: 26691 - RNA, 24 nt, Human
ugacagccaacaggguuaugauac

SEQ ID NO: 26692 - RNA, 18 nt, Human
uccccgggggggcccgcc

SEQ ID NO: 26693 - RNA, 24 nt, Human
cguggcgaaaaaagaugccacucc

SEQ ID NO: 26694 - RNA, 24 nt, Human
ugucggggaugcugcugggaaagu

SEQ ID NO: 26695 - RNA, 24 nt, Human
cuugcgcccguggaggaacgcugc

SEQ ID NO: 26696 - RNA, 24 nt, Human
aggaaucuuuaauuuaucaacacc

SEQ ID NO: 26697 - RNA, 24 nt, Human
cugcggccgaugagaagaagaagg

SEQ ID NO: 26698 - RNA, 24 nt, Human
agacaccaacgggucccaguucuu

SEQ ID NO: 26699 - RNA, 24 nt, Human
aggguuccuguccaguuucccccu

SEQ ID NO: 26700 - RNA, 24 nt, Human
uguuacagcuguugucggacuggc

SEQ ID NO: 26701 - RNA, 24 nt, Human
uaccaggccccguccccucccccg

SEQ ID NO: 26702 - RNA, 24 nt, Human
uuucuggauccuuggagcuuagcu

SEQ ID NO: 26703 - RNA, 24 nt, Human
ugugagcaagguuugcuguccaag

SEQ ID NO: 26704 - RNA, 21 nt, Human
uucaagggauggaaagucacc

SEQ ID NO: 26705 - RNA, 24 nt, Human
uugaauccuuaugaacggaguuaa

SEQ ID NO: 26706 - RNA, 24 nt, Human
uucaagaaaauauugccuauggcc

SEQ ID NO: 26707 - RNA, 24 nt, Human
gaagcccauugaaaaauuugagaa

SEQ ID NO: 26708 - RNA, 22 nt, Human
uggcaagugggaauggccgaug

SEQ ID NO: 26709 - RNA, 22 nt, Human
gguagagagagaaagguggagc

SEQ ID NO: 26710 - RNA, 24 nt, Human
acuuuguggagugccugaugugca

SEQ ID NO: 26711 - RNA, 24 nt, Human
aaggcacaccgagcaugugguucg

SEQ ID NO: 26712 - RNA, 19 nt, Human
ucagaagaugacuauucau

SEQ ID NO: 26713 - RNA, 24 nt, Human
uguuguuuugguccugauaagaag

SEQ ID NO: 26714 - RNA, 24 nt, Human
ggacauggucugggacuucuggag

SEQ ID NO: 26715 - RNA, 24 nt, Human
agggaucccauauuguuuccaucu

SEQ ID NO: 26716 - RNA, 24 nt, Human
acgagccgaggccuccugcagugu

SEQ ID NO: 26717 - RNA, 24 nt, Human
ucucacgccgcggccucacccggc

SEQ ID NO: 26718 - RNA, 24 nt, Human
uucagccugcaggaccucugcugc

SEQ ID NO: 26719 - RNA, 24 nt, Human
cuggaucaaggagaucgaugagca

SEQ ID NO: 26720 - RNA, 24 nt, Human
ccacugccgacaucugcgccccgc

SEQ ID NO: 26721 - RNA, 24 nt, Human
ugggauuacaggcaugagccacug

SEQ ID NO: 26722 - RNA, 24 nt, Human
uagcaggugcaaacuucauucaaa

SEQ ID NO: 26723 - RNA, 24 nt, Human
aaggacaucgcauguuuaaaaugu

SEQ ID NO: 26724 - RNA, 24 nt, Human
ccccgggggggggggggggggugu

SEQ ID NO: 26725 - RNA, 18 nt, Human
uccacagguguaaacguc

SEQ ID NO: 26726 - RNA, 24 nt, Human
uaagcaugauucucuguggagacu

SEQ ID NO: 26727 - RNA, 21 nt, Human
uuuaaauuuguuuuauuuucc

SEQ ID NO: 26728 - RNA, 24 nt, Human
uuaauugugaauacaugcuguuac

SEQ ID NO: 26729 - RNA, 24 nt, Human
uuucugaucgauauuuuuguguaa

SEQ ID NO: 26730 - RNA, 24 nt, Human
uguuguggugauggaggggggcug

SEQ ID NO: 26731 - RNA, 19 nt, Human
caagggguuggcugguguc

SEQ ID NO: 26732 - RNA, 20 nt, Human
uagcguguauagugcaucuc

SEQ ID NO: 26733 - RNA, 22 nt, Human
uagaaggagccuggacucugau

SEQ ID NO: 26734 - RNA, 24 nt, Human
uuucagaagagucagaugggcuuc

SEQ ID NO: 26735 - RNA, 24 nt, Human
uaguaaccaucagcuuguggccaa

SEQ ID NO: 26736 - RNA, 24 nt, Human
ugcauguaacaagucuuuuuuaca

SEQ ID NO: 26737 - RNA, 24 nt, Human
uaucugcuuuuuuuuauuuugcaa

SEQ ID NO: 26738 - RNA, 24 nt, Human
uuuuauggacaggcaauuuaguca

SEQ ID NO: 26739 - RNA, 24 nt, Human
cauuuuuuguauucuuuaagauuu

SEQ ID NO: 26740 - RNA, 24 nt, Human
uaaggcucuucauuuccccuggag

SEQ ID NO: 26741 - RNA, 24 nt, Human
uagcccaagcccugaagucacugc

SEQ ID NO: 26742 - RNA, 24 nt, Human
uggcaaaauucuacugaagacaca

SEQ ID NO: 26743 - RNA, 24 nt, Human
ucuaagcuauuuacuuauucuagu

SEQ ID NO: 26744 - RNA, 24 nt, Human
uggcaaugugcucccuguggcaac

SEQ ID NO: 26745 - RNA, 24 nt, Human
ucccucacacuucuccgccgccua

SEQ ID NO: 26746 - RNA, 24 nt, Human
uguucuggagcuguuggacaaaua

SEQ ID NO: 26747 - RNA, 24 nt, Human
uaccaggaagcauuugaaauuagu

SEQ ID NO: 26748 - RNA, 24 nt, Human
aaccagaaaguaagguguucuacu

SEQ ID NO: 26749 - RNA, 24 nt, Human
ucugucccuaaagaacugguggca

SEQ ID NO: 26750 - RNA, 24 nt, Human
ucccccagagccaugcccgagaua

SEQ ID NO: 26751 - RNA, 24 nt, Human
ucagugccaggccauccacugcag

SEQ ID NO: 26752 - RNA, 24 nt, Human
agggugcuugggcugguaucuggc

SEQ ID NO: 26753 - RNA, 24 nt, Human
uaguacacuccauuccuggggaag

SEQ ID NO: 26754 - RNA, 21 nt, Human
ucugucaggcuuugggacuga

SEQ ID NO: 26755 - RNA, 24 nt, Human
uucacaguuccccgggcgccuuug

SEQ ID NO: 26756 - RNA, 24 nt, Human
aucaccguaacuucagaacaucag

SEQ ID NO: 26757 - RNA, 24 nt, Human
cuuugagucuuuacagaaaagccu

SEQ ID NO: 26758 - RNA, 24 nt, Human
acugcaagcuacaaagccaccaag

SEQ ID NO: 26759 - RNA, 24 nt, Human
ugggaugcauaaugccagcaaguu

SEQ ID NO: 26760 - RNA, 24 nt, Human
uuucuuguuuuuccuggucuugau

SEQ ID NO: 26761 - RNA, 24 nt, Human
uuuuucaaauuauagaaguuguag

SEQ ID NO: 26762 - RNA, 24 nt, Human
gucacagucuuucccuuacucccu

SEQ ID NO: 26763 - RNA, 24 nt, Human
ugacagcugguagaggcagacauc

SEQ ID NO: 26764 - RNA, 24 nt, Human
aagacuuuuauuuguccagaugac

SEQ ID NO: 26765 - RNA, 24 nt, Human
aggugaugaugggcagccuggugu

SEQ ID NO: 26766 - RNA, 24 nt, Human
aagcugcaccgacugcacuucauc

SEQ ID NO: 26767 - RNA, 24 nt, Human
ucagucaaacuaagcagguacuca

SEQ ID NO: 26768 - RNA, 24 nt, Human
cagaacauaggccuccacaccaaa

SEQ ID NO: 26769 - RNA, 24 nt, Human
acccuguucaaucgccccagcagu

SEQ ID NO: 26770 - RNA, 24 nt, Human
cuggugcuagagggagaggaaacg

SEQ ID NO: 26771 - RNA, 24 nt, Human
cagccgcugccagcccugcuccug

SEQ ID NO: 26772 - RNA, 18 nt, Human
uauuauggagcugggcgu

SEQ ID NO: 26773 - RNA, 19 nt, Human
uaacucccugugucugcau

SEQ ID NO: 26774 - RNA, 23 nt, Human
ccuggcuucaggagggagcggag

SEQ ID NO: 26775 - RNA, 24 nt, Human
cacccauucccuggacagggcugu

SEQ ID NO: 26776 - RNA, 24 nt, Human
ucccugugccagcccccuugucgc

SEQ ID NO: 26777 - RNA, 24 nt, Human
ucacccaggauccaaagcuuuuca

SEQ ID NO: 26778 - RNA, 24 nt, Human
cacugggugggacgggguacugga

SEQ ID NO: 26779 - RNA, 24 nt, Human
ucgacaucugaguucucgcuggcu

SEQ ID NO: 26780 - RNA, 24 nt, Human
gagguuccuucacugugcgugcug

SEQ ID NO: 26781 - RNA, 24 nt, Human
uaucccaucacccuuuauuuggag

SEQ ID NO: 26782 - RNA, 24 nt, Human
uguggcacucucuguggucaucgc

SEQ ID NO: 26783 - RNA, 24 nt, Human
cagcggagcacggagaccgccuug

SEQ ID NO: 26784 - RNA, 24 nt, Human
uauggcaagucacuuugacagaca

SEQ ID NO: 26785 - RNA, 24 nt, Human
uacaccacucccaagaagaauaag

SEQ ID NO: 26786 - RNA, 24 nt, Human
auccaguugggcagcagggaaagg

SEQ ID NO: 26787 - RNA, 24 nt, Human
uuguuguuuguuuuguuuuuuuuu

SEQ ID NO: 26788 - RNA, 24 nt, Human
uccuaggagucugaaggccucgcu

SEQ ID NO: 26789 - RNA, 21 nt, Human
ugugaugagcaggaucagagu

SEQ ID NO: 26790 - RNA, 24 nt, Human
cagcacccacgaguuccugcauga

SEQ ID NO: 26791 - RNA, 24 nt, Human
acaggcuacaucuggauggggaca

SEQ ID NO: 26792 - RNA, 24 nt, Human
gggcagggccugaaguguuggggg

SEQ ID NO: 26793 - RNA, 24 nt, Human
ccugcagggcucggccguaggaga

SEQ ID NO: 26794 - RNA, 24 nt, Human
uuggugcuuuguggcucaccacag

SEQ ID NO: 26795 - RNA, 23 nt, Human
ucaagggucguguguuugaagug

SEQ ID NO: 26796 - RNA, 22 nt, Human
uuccauggucaaaaaauggcag

SEQ ID NO: 26797 - RNA, 24 nt, Human
agaggcuguccaggagcugcccag

SEQ ID NO: 26798 - RNA, 24 nt, Human
aggcggccaaaggcccuuccuguc

SEQ ID NO: 26799 - RNA, 21 nt, Human
uccccagguggccagggcgga

SEQ ID NO: 26800 - RNA, 24 nt, Human
ccugcagggcucggccguaggaga

SEQ ID NO: 26801 - RNA, 24 nt, Human
aaaggaacauaauaaaauggccca

SEQ ID NO: 26802 - RNA, 24 nt, Human
ugggucaucagcuacauauacauc

SEQ ID NO: 26803 - RNA, 23 nt, Human
uuuaacuuugcaaacccauuguc

SEQ ID NO: 26804 - RNA, 24 nt, Human
gcgcuuugagaggccauauacugu

SEQ ID NO: 26805 - RNA, 24 nt, Human
uuagaacaagcauuuaaaaaaaac

SEQ ID NO: 26806 - RNA, 20 nt, Human
uugggcucauuuggaaaucu

SEQ ID NO: 26807 - RNA, 24 nt, Human
ugucaagugcaguggauacgacag

SEQ ID NO: 26808 - RNA, 24 nt, Human
ugacgcgacuuuagggaaagaaac

SEQ ID NO: 26809 - RNA, 24 nt, Human
uaaugugcggacgccgggagcuuc

SEQ ID NO: 26810 - RNA, 24 nt, Human
gugaacgggcagcgacgagugcag

SEQ ID NO: 26811 - RNA, 24 nt, Human
uaucucuuuugcagaaguccaggu

SEQ ID NO: 26812 - RNA, 24 nt, Human
uggaaaagguuuuuaaacaccacu

SEQ ID NO: 26813 - RNA, 24 nt, Human
ggacagguguacagacauguucuu

SEQ ID NO: 26814 - RNA, 24 nt, Human
ucgaauggacacauuaccagugaa

SEQ ID NO: 26815 - RNA, 24 nt, Human
uugguuagaauaaguaaaauuuca

SEQ ID NO: 26816 - RNA, 24 nt, Human
ggguaugggauugaugagggcaug

SEQ ID NO: 26817 - RNA, 24 nt, Human
gugaauuuuugaaacuggacagag

SEQ ID NO: 26818 - RNA, 24 nt, Human
uuucauguuuagguuaacaggcac

SEQ ID NO: 26819 - RNA, 24 nt, Human
agggguuuauaucugaguauauca

SEQ ID NO: 26820 - RNA, 24 nt, Human
uauuuugguuuauuuuuucuucca

SEQ ID NO: 26821 - RNA, 24 nt, Human
caguuuauauucuuaauuccccau

SEQ ID NO: 26822 - RNA, 21 nt, Human
ugugacucaaaugaggggucc

SEQ ID NO: 26823 - RNA, 24 nt, Human
ugaauggacggguucaggccugau

SEQ ID NO: 26824 - RNA, 24 nt, Human
ugugcagaagaaauggaaggauuc

SEQ ID NO: 26825 - RNA, 24 nt, Human
uaucaaggaagggcaggcgugaug

SEQ ID NO: 26826 - RNA, 24 nt, Human
uucaaauuucuuucuuuuuuaauu

SEQ ID NO: 26827 - RNA, 24 nt, Human
ucaauuuuuauuuugguuuucuua

SEQ ID NO: 26828 - RNA, 24 nt, Human
caauuuguugaucucagggcacgu

SEQ ID NO: 26829 - RNA, 24 nt, Human
ccccugugcaccguggacguguga

SEQ ID NO: 26830 - RNA, 24 nt, Human
ugcaugugagggggaaugaggugu

SEQ ID NO: 26831 - RNA, 24 nt, Human
agaaaucucugcauccccagaacu

SEQ ID NO: 26832 - RNA, 24 nt, Human
cugacucaugaacagguggaggaa

SEQ ID NO: 26833 - RNA, 24 nt, Human
ugacagagaggaccagggugagaa

SEQ ID NO: 26834 - RNA, 24 nt, Human
ugaggaaacaugcucaguucaugc

SEQ ID NO: 26835 - RNA, 24 nt, Human
uuucucccuuuaauuauauuccgg

SEQ ID NO: 26836 - RNA, 22 nt, Human
ucaagguguuggcaacauguca

SEQ ID NO: 26837 - RNA, 24 nt, Human
guucaaggggauggaaagucaccg

SEQ ID NO: 26838 - RNA, 24 nt, Human
uauuagggauaauauucauuuagc

SEQ ID NO: 26839 - RNA, 24 nt, Human
uacuuugugauggaguacgugaau

SEQ ID NO: 26840 - RNA, 23 nt, Human
ugacccagcuccacuccugcuuc

SEQ ID NO: 26841 - RNA, 24 nt, Human
ugugaauaauuguauauaucucua

SEQ ID NO: 26842 - RNA, 24 nt, Human
ugccauggccaucuuuuucuuugu

SEQ ID NO: 26843 - RNA, 24 nt, Human
uggucugucgucggcaugauaggg

SEQ ID NO: 26844 - RNA, 24 nt, Human
uugaucuugaagaaacugggcgug

SEQ ID NO: 26845 - RNA, 24 nt, Human
uccgugcgcguugcugcggccgug

SEQ ID NO: 26846 - RNA, 24 nt, Human
guagaguuuucuucaggcuuaaag

SEQ ID NO: 26847 - RNA, 24 nt, Human
aggccgggccugggauagaagagu

SEQ ID NO: 26848 - RNA, 24 nt, Human
uugaagcuuuuacagcuggagacu

SEQ ID NO: 26849 - RNA, 24 nt, Human
uucauuggcaguauuuugugauga

SEQ ID NO: 26850 - RNA, 22 nt, Human
ucagaacauucugaacugcuga

SEQ ID NO: 26851 - RNA, 24 nt, Human
cagugcucuugacauuuuggacca

SEQ ID NO: 26852 - RNA, 24 nt, Human
auuguccuuaaacuggugaaugga

SEQ ID NO: 26853 - RNA, 24 nt, Human
ccugaccucgugauugaaauucug

SEQ ID NO: 26854 - RNA, 24 nt, Human
uagucugcacaauucaauaugaac

SEQ ID NO: 26855 - RNA, 24 nt, Human
uaacuuuucgccauggaacaacga

SEQ ID NO: 26856 - RNA, 24 nt, Human
acaguaccuggaaaaacggggaca

SEQ ID NO: 26857 - RNA, 24 nt, Human
aaccuggccguggcugacuucugu

SEQ ID NO: 26858 - RNA, 24 nt, Human
agaggcuggggugacucauggaua

SEQ ID NO: 26859 - RNA, 21 nt, Human
uuugaagugcuuuucgauggg

SEQ ID NO: 26860 - RNA, 18 nt, Human
ugagaggggagaggagga

SEQ ID NO: 26861 - RNA, 24 nt, Human
ucccaucgagcugguugucuucuu

SEQ ID NO: 26862 - RNA, 24 nt, Human
acaaagcaagagaagaagcagaga

SEQ ID NO: 26863 - RNA, 21 nt, Human
cauuggacaggacauccagcc

SEQ ID NO: 26864 - RNA, 24 nt, Human
cagcggcagagagccauccucuau

SEQ ID NO: 26865 - RNA, 24 nt, Human
uauggcaagucacuuugacagaca

SEQ ID NO: 26866 - RNA, 24 nt, Human
uacaccacucccaagaagaauaag

SEQ ID NO: 26867 - RNA, 24 nt, Human
acacaguaguccccacguggccca

SEQ ID NO: 26868 - RNA, 24 nt, Human
uggacguggguggcuauggcagcc

SEQ ID NO: 26869 - RNA, 17 nt, Human
cagcagccggagugugg

SEQ ID NO: 26870 - RNA, 24 nt, Human
ugugaagagcggagcccauccuuu

SEQ ID NO: 26871 - RNA, 24 nt, Human
agucgggaacaugaagggagacug

SEQ ID NO: 26872 - RNA, 24 nt, Human
ugugggaaaugguggggagugcca

SEQ ID NO: 26873 - RNA, 24 nt, Human
ugugcuggcuacaugugaugcugc

SEQ ID NO: 26874 - RNA, 24 nt, Human
uacccgagaaaagggucgcccguu

SEQ ID NO: 26875 - RNA, 24 nt, Human
aggaagagggagaagcugaggcuu

SEQ ID NO: 26876 - RNA, 24 nt, Human
uuacagcgauuggucaaucucuau

SEQ ID NO: 26877 - RNA, 24 nt, Human
cgagagccagcccugcccuuggaa

SEQ ID NO: 26878 - RNA, 24 nt, Human
ugauggaagcccgguucccugagg

SEQ ID NO: 26879 - RNA, 24 nt, Human
uacaccacucccaagaagaauaag

SEQ ID NO: 26880 - RNA, 24 nt, Human
aacacugguguguuuugaaguuga

SEQ ID NO: 26881 - RNA, 24 nt, Human
uuuagaaaaucuggguuagccuga

SEQ ID NO: 26882 - RNA, 24 nt, Human
ccauuagauaaauaccuuucaagu

SEQ ID NO: 26883 - RNA, 24 nt, Human
cgagugucacuagagguggacgug

SEQ ID NO: 26884 - RNA, 24 nt, Human
gagcagcugaacgagcaguauaac

SEQ ID NO: 26885 - RNA, 23 nt, Human
ugucccagcucugcucccucccg

SEQ ID NO: 26886 - RNA, 24 nt, Human
ugagguaauguggccacggccccc

SEQ ID NO: 26887 - RNA, 24 nt, Human
uaagcucaggucccugcuggugcc

SEQ ID NO: 26888 - RNA, 24 nt, Human
uccauccugagguuuggggggaga

SEQ ID NO: 26889 - RNA, 24 nt, Human
ccagucaaagccgccuuaaauuuc

SEQ ID NO: 26890 - RNA, 24 nt, Human
uuagcugggcgugguggugcacgc

SEQ ID NO: 26891 - RNA, 24 nt, Human
uauaaaaguccacaccuccucaga

SEQ ID NO: 26892 - RNA, 24 nt, Human
acgcgcugcccggccagaaaacgg

SEQ ID NO: 26893 - RNA, 24 nt, Human
uacaagaucacugacucugaggac

SEQ ID NO: 26894 - RNA, 24 nt, Human
uaaugggucucaaaauucugugac

SEQ ID NO: 26895 - RNA, 24 nt, Human
uauuagggauaauauucauuuagc

SEQ ID NO: 26896 - RNA, 24 nt, Human
ccgcugcucugcgccggggccugg

SEQ ID NO: 26897 - RNA, 24 nt, Human
uggaggccccugaacaggagggcu

SEQ ID NO: 26898 - RNA, 24 nt, Human
uccacagugcugugaucccgaggg

SEQ ID NO: 26899 - RNA, 24 nt, Human
ucaggccagcguccuccuccacag

SEQ ID NO: 26900 - RNA, 24 nt, Human
acugguauaaaacacaguuuaaac

SEQ ID NO: 26901 - RNA, 24 nt, Human
uguuaccagcaccaugcuuuucag

SEQ ID NO: 26902 - RNA, 24 nt, Human
ggagaguaaaguaggcaagaauga

SEQ ID NO: 26903 - RNA, 24 nt, Human
uugaucuugaagaaacugggcgug

SEQ ID NO: 26904 - RNA, 24 nt, Human
ucuccagaaaugcuuuggguucau

SEQ ID NO: 26905 - RNA, 24 nt, Human
aggaaggagauauagugaagagga

SEQ ID NO: 26906 - RNA, 20 nt, Human
uaacuguauucaugugauug

SEQ ID NO: 26907 - RNA, 24 nt, Human
uuccugaguucuucaauggaaaaa

SEQ ID NO: 26908 - RNA, 24 nt, Human
uaucuaaggauuauucugcugaag

SEQ ID NO: 26909 - RNA, 24 nt, Human
uggggaccugcgagcuggccuaau

SEQ ID NO: 26910 - RNA, 24 nt, Human
ugugaaagugaaacaagcaugagu

SEQ ID NO: 26911 - RNA, 24 nt, Human
ugccaaggcucagcaucuucucca

SEQ ID NO: 26912 - RNA, 24 nt, Human
ucagugcauuuuuaaaauaguuaa

SEQ ID NO: 26913 - RNA, 24 nt, Human
ggagguugcagugagccgagaucg

SEQ ID NO: 26914 - RNA, 24 nt, Human
ugugugcacguacauacuguauag

SEQ ID NO: 26915 - RNA, 24 nt, Human
ccggcgccggcaucgcggccaacu

SEQ ID NO: 26916 - RNA, 23 nt, Human
acaaagcaagagaagaagcagag

SEQ ID NO: 26917 - RNA, 21 nt, Human
cauuggacaggacauccagcc

SEQ ID NO: 26918 - RNA, 24 nt, Human
cagcggcagagagccauccucuau

SEQ ID NO: 26919 - RNA, 24 nt, Human
cuuugugugaauagcuugcuccac

SEQ ID NO: 26920 - RNA, 22 nt, Human
augaaccaacugggacucaccc

SEQ ID NO: 26921 - RNA, 24 nt, Human
ccugccaaugcaacagccacggaa

SEQ ID NO: 26922 - RNA, 23 nt, Human
ccgccgcgcccccgccgccgccc

SEQ ID NO: 26923 - RNA, 24 nt, Human
uggaaagguuggcaggcagcuccc

SEQ ID NO: 26924 - RNA, 24 nt, Human
acccguuuugccucgugccgaauu

SEQ ID NO: 26925 - RNA, 24 nt, Human
gucccggucaagugguucuucugc

SEQ ID NO: 26926 - RNA, 24 nt, Human
cgugccuuaaaagagauaauuuuc

SEQ ID NO: 26927 - RNA, 24 nt, Human
caccccccacgcccagcuuaauuu

SEQ ID NO: 26928 - RNA, 24 nt, Human
uuauaccagaagaucagggucuca

SEQ ID NO: 26929 - RNA, 24 nt, Human
gacagcagcaggaugaagcuggau

SEQ ID NO: 26930 - RNA, 24 nt, Human
uaucucaaguuagggaaaugagag

SEQ ID NO: 26931 - RNA, 24 nt, Human
ucugaagccaacauggcuuauuuc

SEQ ID NO: 26932 - RNA, 24 nt, Human
uuagauagcuaaaauaucccuuaa

SEQ ID NO: 26933 - RNA, 24 nt, Human
uuacaguggucuuuucaugggagu

SEQ ID NO: 26934 - RNA, 24 nt, Human
uaaguguuugcagccauauguguc

SEQ ID NO: 26935 - RNA, 24 nt, Human
uggaagaugcucaacaccuccucc

SEQ ID NO: 26936 - RNA, 24 nt, Human
uuccgagaguucugugccacgagg

SEQ ID NO: 26937 - RNA, 24 nt, Human
aggcaaaagcaagaaauggcggca

SEQ ID NO: 26938 - RNA, 24 nt, Human
aggccuggggccagaaagggguua

SEQ ID NO: 26939 - RNA, 18 nt, Human
ugggauccccccaacccc

SEQ ID NO: 26940 - RNA, 24 nt, Human
guacuggagucuuuugggaggcca

SEQ ID NO: 26941 - RNA, 23 nt, Human
aagagcacugaucguacuggcuc

SEQ ID NO: 26942 - RNA, 24 nt, Human
cuugacucuguguacauccuaccc

SEQ ID NO: 26943 - RNA, 24 nt, Human
uagcuguucuuuauugacauggaa

SEQ ID NO: 26944 - RNA, 24 nt, Human
ugggagaaaccucccaggugccag

SEQ ID NO: 26945 - RNA, 24 nt, Human
caugugcagucuccauguacaagu

SEQ ID NO: 26946 - RNA, 21 nt, Human
uuaguacuuaugggacuggcu

SEQ ID NO: 26947 - RNA, 24 nt, Human
ucuuauguaaccgaauccauuuac

SEQ ID NO: 26948 - RNA, 24 nt, Human
gcuaacgauguuccuuaugccuaa

SEQ ID NO: 26949 - RNA, 24 nt, Human
ugaauguaaaaucccuuauguugu

SEQ ID NO: 26950 - RNA, 24 nt, Human
uuaaugaugcagacaacuuggugu

SEQ ID NO: 26951 - RNA, 24 nt, Human
uguagccacccuccugggcccggc

SEQ ID NO: 26952 - RNA, 24 nt, Human
aagcugcuuucuucucugccuccu

SEQ ID NO: 26953 - RNA, 24 nt, Human
ugcgcagccuuaacaagggggcac

SEQ ID NO: 26954 - RNA, 24 nt, Human
ugaggcaggagaaucacuugaacc

SEQ ID NO: 26955 - RNA, 24 nt, Human
acuggcucccugcacugugugugc

SEQ ID NO: 26956 - RNA, 24 nt, Human
ugugcaggggcaaaggcgauuauc

SEQ ID NO: 26957 - RNA, 24 nt, Human
ccaggccaaaaaggcucaacauuu

SEQ ID NO: 26958 - RNA, 24 nt, Human
aggaaaaaagcuucugaaaugaag

SEQ ID NO: 26959 - RNA, 24 nt, Human
aagaaucuuuaccuuuacccuuuc

SEQ ID NO: 26960 - RNA, 17 nt, Human
uaggugcugagccuggc

SEQ ID NO: 26961 - RNA, 23 nt, Human
gagaauguauugugugcauugag

SEQ ID NO: 26962 - RNA, 24 nt, Human
ugaggcagagaauugcuugaaccc

SEQ ID NO: 26963 - RNA, 24 nt, Human
uuggauacaaguucuggcauuggu

SEQ ID NO: 26964 - RNA, 24 nt, Human
uauuacacacggauguaagcauuu

SEQ ID NO: 26965 - RNA, 24 nt, Human
ugacuagagagacgggcugacacc

SEQ ID NO: 26966 - RNA, 24 nt, Human
agggaaggagggucgcccggaucc

SEQ ID NO: 26967 - RNA, 24 nt, Human
uuccaguacuccugcccuuccuuc

SEQ ID NO: 26968 - RNA, 24 nt, Human
cuggguccccucugcaagcucaga

SEQ ID NO: 26969 - RNA, 24 nt, Human
uguucuggagcuguuggacaaaua

SEQ ID NO: 26970 - RNA, 24 nt, Human
aaccagaaaguaagguguucuacu

SEQ ID NO: 26971 - RNA, 24 nt, Human
uggaauagcagagacuccggaggg

SEQ ID NO: 26972 - RNA, 24 nt, Human
uugcuccugagccaucuucuuaac

SEQ ID NO: 26973 - RNA, 24 nt, Human
ugggauguccugccugcggagggg

SEQ ID NO: 26974 - RNA, 24 nt, Human
auggagcagugucucagccacuug

SEQ ID NO: 26975 - RNA, 24 nt, Human
ugcauuguuaucauuaaccagucu

SEQ ID NO: 26976 - RNA, 24 nt, Human
uaaugggucucaaaauucugugac

SEQ ID NO: 26977 - RNA, 24 nt, Human
uauuagggauaauauucauuuagc

SEQ ID NO: 26978 - RNA, 24 nt, Human
ucuuugggacaccugaagaaaauc

SEQ ID NO: 26979 - RNA, 17 nt, Human
gacagagcgacugcagc

SEQ ID NO: 26980 - RNA, 24 nt, Human
uauuacacuggaggaucacaaacu

SEQ ID NO: 26981 - RNA, 24 nt, Human
uauaaaauguaauacaagggcaua

SEQ ID NO: 26982 - RNA, 19 nt, Human
uugcuuggcccugacugau

SEQ ID NO: 26983 - RNA, 24 nt, Human
uacugcaugaugcuucugucuauc

SEQ ID NO: 26984 - RNA, 24 nt, Human
ugggcugugggccugcgcugcguc

SEQ ID NO: 26985 - RNA, 24 nt, Human
uauggcaagucacuuugacagaca

SEQ ID NO: 26986 - RNA, 24 nt, Human
ugagaauggcaaaauuagucgccu

SEQ ID NO: 26987 - RNA, 24 nt, Human
uacaccacucccaagaagaauaag

SEQ ID NO: 26988 - RNA, 24 nt, Human
ucugaagagugcuucagcugaugg

SEQ ID NO: 26989 - RNA, 24 nt, Human
uggcgucacuuuccugccaacuuu

SEQ ID NO: 26990 - RNA, 24 nt, Human
uaaacaccagcagauacuauuacu

SEQ ID NO: 26991 - RNA, 24 nt, Human
uuggaccaguuuugaaguuggggu

SEQ ID NO: 26992 - RNA, 24 nt, Human
agcugguuuggaacuccuggccuc

SEQ ID NO: 26993 - RNA, 24 nt, Human
gccucaguuucccaagugacuagg

SEQ ID NO: 26994 - RNA, 24 nt, Human
uacaguauaguauaaauacaacuu

SEQ ID NO: 26995 - RNA, 24 nt, Human
aagcggccucugagggaggcaaac

SEQ ID NO: 26996 - RNA, 24 nt, Human
cuuucucugggucucugugcuuug

SEQ ID NO: 26997 - RNA, 24 nt, Human
ucccaggggcuacccuuuccugcu

SEQ ID NO: 26998 - RNA, 24 nt, Human
ucaguaauguccuguuugcccuuc

SEQ ID NO: 26999 - RNA, 24 nt, Human
uugaagaguucuccugaugauuga

SEQ ID NO: 27000 - RNA, 24 nt, Human
ccaguggaagcuuugacaucauua

SEQ ID NO: 27001 - RNA, 24 nt, Human
ugaggugggaggauuuuuugagcc

SEQ ID NO: 27002 - RNA, 24 nt, Human
uaggagggcaggcucuucacuccc

SEQ ID NO: 27003 - RNA, 24 nt, Human
ccccaguagaagugaugggcugcu

SEQ ID NO: 27004 - RNA, 24 nt, Human
uaucaugaagccucagaaacacug

SEQ ID NO: 27005 - RNA, 24 nt, Human
uacagaaucuaaugcauaacuggu

SEQ ID NO: 27006 - RNA, 24 nt, Human
ugguagagauauauauuuauauau

SEQ ID NO: 27007 - RNA, 21 nt, Human
ugugcagaggguuagaggcca

SEQ ID NO: 27008 - RNA, 21 nt, Human
uacagugaggggugaauggaa

SEQ ID NO: 27009 - RNA, 20 nt, Human
ugacuggaggcaacaagggc

SEQ ID NO: 27010 - RNA, 24 nt, Human
ucacggcgcgggacgugacgcggg

SEQ ID NO: 27011 - RNA, 24 nt, Human
ucccaauguugacguuggccaggg

SEQ ID NO: 27012 - RNA, 24 nt, Human
agaagaagaagaaauggcaaagag

SEQ ID NO: 27013 - RNA, 24 nt, Human
ucugaucaauccuucuuuuucucu

SEQ ID NO: 27014 - RNA, 24 nt, Human
uaacagguguaagaguguugaaaa

SEQ ID NO: 27015 - RNA, 24 nt, Human
agagagcuucagcauguaaaauuu

SEQ ID NO: 27016 - RNA, 24 nt, Human
uuaaaagugagaagaaaaugaguu

SEQ ID NO: 27017 - RNA, 24 nt, Human
ugguauggaauaaacuucccauuu

SEQ ID NO: 27018 - RNA, 24 nt, Human
uaaggauaguuuuaauuuucuuau

SEQ ID NO: 27019 - RNA, 24 nt, Human
cuagugguuuaauaggcuugcuau

SEQ ID NO: 27020 - RNA, 23 nt, Human
uaaaauuguguugggagcaggga

SEQ ID NO: 27021 - RNA, 24 nt, Human
uugaaugucacauaauuucaugga

SEQ ID NO: 27022 - RNA, 24 nt, Human
uuagcaaauagagagaaauauaga

SEQ ID NO: 27023 - RNA, 23 nt, Human
uuccaaauucugggcugguuuuc

SEQ ID NO: 27024 - RNA, 24 nt, Human
ugagucucacucugaccuaugaga

SEQ ID NO: 27025 - RNA, 24 nt, Human
uuuacauaaccucagugggaaaac

SEQ ID NO: 27026 - RNA, 24 nt, Human
ugccguuacagccuuccucccggg

SEQ ID NO: 27027 - RNA, 24 nt, Human
ucauaagugcucugcugcacugua

SEQ ID NO: 27028 - RNA, 24 nt, Human
caucugguucagacucugcucauc

SEQ ID NO: 27029 - RNA, 24 nt, Human
cacugggcaggccugaccuugcug

SEQ ID NO: 27030 - RNA, 24 nt, Human
uauuauuauaaugcagauauuuca

SEQ ID NO: 27031 - RNA, 24 nt, Human
uuagcaauauuuugauaaaacuuu

SEQ ID NO: 27032 - RNA, 24 nt, Human
uacaagguaucauuucagagagug

SEQ ID NO: 27033 - RNA, 24 nt, Human
ugagaaacagucaucucaauaaau

SEQ ID NO: 27034 - RNA, 24 nt, Human
uagcuucccuuugaggguguguga

SEQ ID NO: 27035 - RNA, 20 nt, Human
uaagucuaugaucuuggaau

SEQ ID NO: 27036 - RNA, 24 nt, Human
uuuugcaauagauagauuuaaagu

SEQ ID NO: 27037 - RNA, 24 nt, Human
ucuagaauaauuaaaagccacaaa

SEQ ID NO: 27038 - RNA, 24 nt, Human
uacauuuugugauaacuuuuucuu

SEQ ID NO: 27039 - RNA, 24 nt, Human
auugcauacuggaaaagaagccaa

SEQ ID NO: 27040 - RNA, 24 nt, Human
aaaaaucugauugguggggaucuc

SEQ ID NO: 27041 - RNA, 24 nt, Human
uaacccagagagagucuggguucu

SEQ ID NO: 27042 - RNA, 24 nt, Human
guaaaacaagauuuggaugacaug

SEQ ID NO: 27043 - RNA, 24 nt, Human
ucagcaacuuuguggccccaagug

SEQ ID NO: 27044 - RNA, 24 nt, Human
ccaggccaaaaaggcucaacauuu

SEQ ID NO: 27045 - RNA, 24 nt, Human
ugacugugcgggguggucugucug

SEQ ID NO: 27046 - RNA, 24 nt, Human
uuaauuaucuggauaacagcaaaa

SEQ ID NO: 27047 - RNA, 24 nt, Human
uuagucccagguuguucucauucg

SEQ ID NO: 27048 - RNA, 24 nt, Human
cuugcagaaaaucacggugggcac

SEQ ID NO: 27049 - RNA, 24 nt, Human
acuuugucauuuguuucuuuaagu

SEQ ID NO: 27050 - RNA, 24 nt, Human
uauaagagucauggaaaaagacag

SEQ ID NO: 27051 - RNA, 20 nt, Human
ucuguacugagcucuguuuu

SEQ ID NO: 27052 - RNA, 24 nt, Human
agaccgggauccauucucuccucg

SEQ ID NO: 27053 - RNA, 24 nt, Human
ugggggacugcagcccugcugacc

SEQ ID NO: 27054 - RNA, 24 nt, Human
aaguaccccgauagggaggguggg

SEQ ID NO: 27055 - RNA, 24 nt, Human
uucgaaguucaugcaaccaacuaa

SEQ ID NO: 27056 - RNA, 24 nt, Human
acgacauuccacacccuauuauca

SEQ ID NO: 27057 - RNA, 24 nt, Human
acacagcucucgucuaagcaaugg

SEQ ID NO: 27058 - RNA, 24 nt, Human
aggcaugacuaagggguaaggguu

SEQ ID NO: 27059 - RNA, 24 nt, Human
cgcccagaaacgucaguggugcug

SEQ ID NO: 27060 - RNA, 24 nt, Human
uggaaggcuggacuacuuccuccu

SEQ ID NO: 27061 - RNA, 24 nt, Human
aggcagcucccuucccccaggaag

SEQ ID NO: 27062 - RNA, 24 nt, Human
uacaucaaaaucaagucccuggcu

SEQ ID NO: 27063 - RNA, 24 nt, Human
cgcccagaucaaggcucauguagc

SEQ ID NO: 27064 - RNA, 24 nt, Human
gcccggaagaucaagucgugcucc

SEQ ID NO: 27065 - RNA, 24 nt, Human
cuuacgcuuugaucucagcacaac

SEQ ID NO: 27066 - RNA, 24 nt, Human
uaauuuuuuaauauuuguauuuuu

SEQ ID NO: 27067 - RNA, 24 nt, Human
cagcuucgaucuccugggcugaag

SEQ ID NO: 27068 - RNA, 24 nt, Human
aaaggaacuugcuccauuguuuga

SEQ ID NO: 27069 - RNA, 24 nt, Human
caaggaagcaaacuuggacuuucc

SEQ ID NO: 27070 - RNA, 24 nt, Human
acauguaugacucauggccacaaa

SEQ ID NO: 27071 - RNA, 24 nt, Human
acgcagcuuggaucggugcugggg

SEQ ID NO: 27072 - RNA, 24 nt, Human
uggccagugaguuggcaaucagcu

SEQ ID NO: 27073 - RNA, 24 nt, Human
uggggugggagcagaaggaaggcu

SEQ ID NO: 27074 - RNA, 24 nt, Human
ugagagccuggcgcagcugggacu

SEQ ID NO: 27075 - RNA, 19 nt, Human
uccacgguuacaauccagc

SEQ ID NO: 27076 - RNA, 24 nt, Human
aguggcgcugagcaguagcuuuaa

SEQ ID NO: 27077 - RNA, 24 nt, Human
ugauuuaaaagaaggaaaaaaaaa

SEQ ID NO: 27078 - RNA, 24 nt, Human
uuagagugaaguaauugggaaacu

SEQ ID NO: 27079 - RNA, 24 nt, Human
ugagagccuggcgcagcugggacu

SEQ ID NO: 27080 - RNA, 19 nt, Human
uagaagggaugucaguggc

SEQ ID NO: 27081 - RNA, 19 nt, Human
uccacgguuacaauccagc

SEQ ID NO: 27082 - RNA, 24 nt, Human
gagucaguuuuagauuggagcugg

SEQ ID NO: 27083 - RNA, 24 nt, Human
ugagaaagaaauucagauauggga

SEQ ID NO: 27084 - RNA, 24 nt, Human
uugaaaaguaugaagauuaaugaa

SEQ ID NO: 27085 - RNA, 24 nt, Human
gagccggacaagccgauucccagc

SEQ ID NO: 27086 - RNA, 24 nt, Human
cgucgcgguggaggccacggggga

SEQ ID NO: 27087 - RNA, 18 nt, Human
aacauggucuucccccuc

SEQ ID NO: 27088 - RNA, 24 nt, Human
gagucaguuuuagauuggagcugg

SEQ ID NO: 27089 - RNA, 24 nt, Human
ugagaaagaaauucagauauggga

SEQ ID NO: 27090 - RNA, 24 nt, Human
uugaaaaguaugaagauuaaugaa

SEQ ID NO: 27091 - RNA, 24 nt, Human
gagucaguuuuagauuggagcugg

SEQ ID NO: 27092 - RNA, 24 nt, Human
ugagaaagaaauucagauauggga

SEQ ID NO: 27093 - RNA, 24 nt, Human
ugagaaagaaauucagauauggga

SEQ ID NO: 27094 - RNA, 24 nt, Human
uugaaaaguaugaagauuaaugaa

SEQ ID NO: 27095 - RNA, 24 nt, Human
gagucaguuuuagauuggagcugg

SEQ ID NO: 27096 - RNA, 24 nt, Human
uaaggagcuugaugggcagcuaga

SEQ ID NO: 27097 - RNA, 24 nt, Human
uaaaaugaaagucaaagaaaagga

SEQ ID NO: 27098 - RNA, 24 nt, Human
uuggaucuccacguuuaaguacug

SEQ ID NO: 27099 - RNA, 21 nt, Human
ugugguggaagauaaugacaa

SEQ ID NO: 27100 - RNA, 24 nt, Human
uguguuagaagaagaggauccggg

SEQ ID NO: 27101 - RNA, 24 nt, Human
aacacuuuguuguagcugcccucc

SEQ ID NO: 27102 - RNA, 24 nt, Human
gcccucaggagccucugcuccccu

SEQ ID NO: 27103 - RNA, 24 nt, Human
ugggaucggcacucagggggucug

SEQ ID NO: 27104 - RNA, 24 nt, Human
ucucaggaaagcuggugucugauu

SEQ ID NO: 27105 - RNA, 24 nt, Human
uugaagccaguaauuagagacauc

SEQ ID NO: 27106 - RNA, 24 nt, Human
uaguagagacgggguuucaccaug

SEQ ID NO: 27107 - RNA, 24 nt, Human
uugaaauuaguaauaucuguagaa

SEQ ID NO: 27108 - RNA, 24 nt, Human
cagcggcagagagccauccucuau

SEQ ID NO: 27109 - RNA, 24 nt, Human
uuagaaguggcuauuaagagacga

SEQ ID NO: 27110 - RNA, 22 nt, Human
uccgugcgcguugcugcggccg

SEQ ID NO: 27111 - RNA, 24 nt, Human
uugaucuugaagaaacugggcgug

SEQ ID NO: 27112 - RNA, 24 nt, Human
aggaaggagauauagugaagagga

SEQ ID NO: 27113 - RNA, 24 nt, Human
guagaguuuucuucaggcuuaaag

SEQ ID NO: 27114 - RNA, 24 nt, Human
uaccuguggugacuuucagauuua

SEQ ID NO: 27115 - RNA, 24 nt, Human
uuuggccaaauguaggauggaugg

SEQ ID NO: 27116 - RNA, 24 nt, Human
uuggauggaggccuggcaggaggg

SEQ ID NO: 27117 - RNA, 24 nt, Human
aguggauccggcgcaccauccccu

SEQ ID NO: 27118 - RNA, 24 nt, Human
aaaguacagaaccaauuuagaaag

SEQ ID NO: 27119 - RNA, 20 nt, Human
uaccucaauguuccucggag

SEQ ID NO: 27120 - RNA, 24 nt, Human
accuugauugaagcccuguugaag

SEQ ID NO: 27121 - RNA, 21 nt, Human
ucccgggucucuguugcucuc

SEQ ID NO: 27122 - RNA, 24 nt, Human
agcuauugaaagaguucugagcag

SEQ ID NO: 27123 - RNA, 24 nt, Human
uguucaggauacggcugauuugau

SEQ ID NO: 27124 - RNA, 24 nt, Human
acaaagugaguaacugugccaaau

SEQ ID NO: 27125 - RNA, 24 nt, Human
uggguuuuuggcauguagcaguuu

SEQ ID NO: 27126 - RNA, 24 nt, Human
ugaggaaugggaucagauaucgag

SEQ ID NO: 27127 - RNA, 24 nt, Human
uucauaaucacaggccacaggggu

SEQ ID NO: 27128 - RNA, 24 nt, Human
uaugguauccugaagcaccugccc

SEQ ID NO: 27129 - RNA, 24 nt, Human
gaugcaaaauguuugcaguuugac

SEQ ID NO: 27130 - RNA, 24 nt, Human
aaauggaaucuagaagcuaaauuu

SEQ ID NO: 27131 - RNA, 24 nt, Human
uauuucacuggaaaauucuguaaa

SEQ ID NO: 27132 - RNA, 24 nt, Human
ucuaaggcccugugggaugaaaag

SEQ ID NO: 27133 - RNA, 24 nt, Human
auggcgccaguuccccagcaaacc

SEQ ID NO: 27134 - RNA, 24 nt, Human
uaaagcucaaauugcucuuaaacu

SEQ ID NO: 27135 - RNA, 24 nt, Human
acugugcccuuccccuccugaaag

SEQ ID NO: 27136 - RNA, 24 nt, Human
ucaguuaagguuauuguugugggu

SEQ ID NO: 27137 - RNA, 24 nt, Human
uaacaugacuguauguguggacug

SEQ ID NO: 27138 - RNA, 17 nt, Human
ucaggcucccuuguaag

SEQ ID NO: 27139 - RNA, 24 nt, Human
gugcacaaguucccauaagccuag

SEQ ID NO: 27140 - RNA, 24 nt, Human
uaaggauuuuuccucgaacuuggg

SEQ ID NO: 27141 - RNA, 24 nt, Human
ccaggggacucuggucgguuacug

SEQ ID NO: 27142 - RNA, 24 nt, Human
aagaaccaugguggauagacuaga

SEQ ID NO: 27143 - RNA, 24 nt, Human
cccuggggacccuagagagggugu

SEQ ID NO: 27144 - RNA, 24 nt, Human
aggcaucuggggguggaugugacg

SEQ ID NO: 27145 - RNA, 24 nt, Human
agugaagagaaccagaaaaagucu

SEQ ID NO: 27146 - RNA, 24 nt, Human
cgggcaccuggaguugauucagcu

SEQ ID NO: 27147 - RNA, 24 nt, Human
cccucagcggccgcgaccgaguca

SEQ ID NO: 27148 - RNA, 24 nt, Human
cauugcaucugaggacuuguuuuc

SEQ ID NO: 27149 - RNA, 24 nt, Human
aaggcuucuugaaguaaauguucu

SEQ ID NO: 27150 - RNA, 24 nt, Human
uugcaaaaaaguuuucuggaauag

SEQ ID NO: 27151 - RNA, 24 nt, Human
uaccaggaagauccaugaucuggg

SEQ ID NO: 27152 - RNA, 24 nt, Human
ccuugguuugauuaccuccccugg

SEQ ID NO: 27153 - RNA, 24 nt, Human
ggagauggcucugcuguccugugu

SEQ ID NO: 27154 - RNA, 24 nt, Human
cauccugaacuuccagcaguuccc

SEQ ID NO: 27155 - RNA, 22 nt, Human
cuccaguggauguauggcugcg

SEQ ID NO: 27156 - RNA, 22 nt, Human
acgcugcagcgcgcggaaaacc

SEQ ID NO: 27157 - RNA, 24 nt, Human
uuacaucgcccuugaacgaggacc

SEQ ID NO: 27158 - RNA, 24 nt, Human
ugauuagcaaauauaucaucugaa

SEQ ID NO: 27159 - RNA, 24 nt, Human
acagggaaaaauauauuuuuuuca

SEQ ID NO: 27160 - RNA, 24 nt, Human
uauacaauauauuuauaguauuac

SEQ ID NO: 27161 - RNA, 24 nt, Human
aauuuuaguuauaaauuagugaag

SEQ ID NO: 27162 - RNA, 24 nt, Human
acccagugaggcacgacgugguuu

SEQ ID NO: 27163 - RNA, 24 nt, Human
ugagagcaagaaggcuggaaaugc

SEQ ID NO: 27164 - RNA, 24 nt, Human
ugcacgggagaccaaaacgagucc

SEQ ID NO: 27165 - RNA, 24 nt, Human
gccccggguucccguggcuaccgg

SEQ ID NO: 27166 - RNA, 24 nt, Human
aggcuggcgccgggggucugcggg

SEQ ID NO: 27167 - RNA, 24 nt, Human
agccaggaaccccaaacguccggc

SEQ ID NO: 27168 - RNA, 24 nt, Human
aauggcacucugauuaaacugcau

SEQ ID NO: 27169 - RNA, 20 nt, Human
uagacagaugggaaaggcag

SEQ ID NO: 27170 - RNA, 24 nt, Human
caugucuuaagagcgggaagaaaa

SEQ ID NO: 27171 - RNA, 21 nt, Human
uaccacagcaaacuucauuca

SEQ ID NO: 27172 - RNA, 24 nt, Human
uuaucugugagacugaagagccuc

SEQ ID NO: 27173 - RNA, 24 nt, Human
uagaauggauguaaauuaccugcu

SEQ ID NO: 27174 - RNA, 24 nt, Human
ugaaaagagccaugcugucuaguc

SEQ ID NO: 27175 - RNA, 20 nt, Human
cucccgagucuggcccucug

SEQ ID NO: 27176 - RNA, 24 nt, Human
gcggaaggcccggcggccgcgcug

SEQ ID NO: 27177 - RNA, 24 nt, Human
ugcccaggccagguggagcucugc

SEQ ID NO: 27178 - RNA, 24 nt, Human
uguuccgccugaggcgagugacgc

SEQ ID NO: 27179 - RNA, 24 nt, Human
aggggaugacugugaauggcuuca

SEQ ID NO: 27180 - RNA, 24 nt, Human
uuccuugggagaugccauaaagca

SEQ ID NO: 27181 - RNA, 24 nt, Human
gaggagaaacccugggaaggcucc

SEQ ID NO: 27182 - RNA, 24 nt, Human
ugagugaacugcacugugacaagc

SEQ ID NO: 27183 - RNA, 24 nt, Human
uaacagguguaagaguguugaaaa

SEQ ID NO: 27184 - RNA, 24 nt, Human
ucaguuaaaaaagaagaagaagaa

SEQ ID NO: 27185 - RNA, 24 nt, Human
gagcugauaccucuguugaucuug

SEQ ID NO: 27186 - RNA, 24 nt, Human
ucuccagaaaugcuuuggguucau

SEQ ID NO: 27187 - RNA, 24 nt, Human
aggaaggagauauagugaagagga

SEQ ID NO: 27188 - RNA, 24 nt, Human
caagcuccucuccccccucuuuuc

SEQ ID NO: 27189 - RNA, 24 nt, Human
ugcccguacccccucuccucucug

SEQ ID NO: 27190 - RNA, 24 nt, Human
gggcaggaacaagcuccagccuuc

SEQ ID NO: 27191 - RNA, 24 nt, Human
uagcugagccagccagcucugccu

SEQ ID NO: 27192 - RNA, 24 nt, Human
ucagugagaggggggcagcagggg

SEQ ID NO: 27193 - RNA, 24 nt, Human
cuagcauccugggaguccuuuucu

SEQ ID NO: 27194 - RNA, 24 nt, Human
uuuuuugucaagcaugucagacaa

SEQ ID NO: 27195 - RNA, 20 nt, Human
uacaagcacacccaugaggg

SEQ ID NO: 27196 - RNA, 24 nt, Human
uuccauugacauucuuagcacagc

SEQ ID NO: 27197 - RNA, 24 nt, Human
agagauuggugaggauuuggauaa

SEQ ID NO: 27198 - RNA, 24 nt, Human
ugggcgaaggaaaaggccuggccu

SEQ ID NO: 27199 - RNA, 24 nt, Human
cagcggcgcgggaucggccaaagc

SEQ ID NO: 27200 - RNA, 24 nt, Human
cugacgcugaagcuggugagccug

SEQ ID NO: 27201 - RNA, 24 nt, Human
ccugaucugcgcagcccggcgggc

SEQ ID NO: 27202 - RNA, 23 nt, Human
cgagcagcucagaccaugucgcc

SEQ ID NO: 27203 - RNA, 24 nt, Human
agaaagccgguccugggcugaaga

SEQ ID NO: 27204 - RNA, 24 nt, Human
uauggcaagucacuuugacagaca

SEQ ID NO: 27205 - RNA, 24 nt, Human
uuaaagaacaucuauaaauacaua

SEQ ID NO: 27206 - RNA, 24 nt, Human
ugaaugcuuguggcaucugcccca

SEQ ID NO: 27207 - RNA, 24 nt, Human
ccucccgucacuccacgcagcugg

SEQ ID NO: 27208 - RNA, 24 nt, Human
cgugggaaccuguccccaggcugg

SEQ ID NO: 27209 - RNA, 24 nt, Human
aggaauguuuggguggcgucaagg

SEQ ID NO: 27210 - RNA, 24 nt, Human
ggguacguggcgcaugcgguaaca

SEQ ID NO: 27211 - RNA, 24 nt, Human
uguuaauauacucgaaguuccucu

SEQ ID NO: 27212 - RNA, 24 nt, Human
ucaagaguucagauauacagauaa

SEQ ID NO: 27213 - RNA, 20 nt, Human
uacaagaugcgcugcagcag

SEQ ID NO: 27214 - RNA, 24 nt, Human
cagcuuauauaccuccagggccau

SEQ ID NO: 27215 - RNA, 24 nt, Human
acacagaggaugauuaauaauuuc

SEQ ID NO: 27216 - RNA, 24 nt, Human
aggugguggugauaaaggauaaau

SEQ ID NO: 27217 - RNA, 24 nt, Human
ugaaaguuuucauuuccuuuuuaa

SEQ ID NO: 27218 - RNA, 24 nt, Human
ucugucauuauuuacacauaugua

SEQ ID NO: 27219 - RNA, 24 nt, Human
uugcacugcauggagggcauuggc

SEQ ID NO: 27220 - RNA, 21 nt, Human
ucuugggaagcucuuaauugu

SEQ ID NO: 27221 - RNA, 24 nt, Human
aguugauucccauuuuccuuugga

SEQ ID NO: 27222 - RNA, 22 nt, Human
ugaggaagagugagggaaggcg

SEQ ID NO: 27223 - RNA, 24 nt, Human
ccgcagggcaucugccuccuggcu

SEQ ID NO: 27224 - RNA, 21 nt, Human
cagcagccucgaggaagagug

SEQ ID NO: 27225 - RNA, 24 nt, Human
cgugggcagcagcacaggccaggc

SEQ ID NO: 27226 - RNA, 24 nt, Human
ucaguagagacaggguuuugccau

SEQ ID NO: 27227 - RNA, 24 nt, Human
ugguuuggaguuaauguaaugagg

SEQ ID NO: 27228 - RNA, 24 nt, Human
ucacugcaaccucugccuccuggg

SEQ ID NO: 27229 - RNA, 24 nt, Human
accccaauccuucaucuacauaaa

SEQ ID NO: 27230 - RNA, 24 nt, Human
cuucaaaggugaguccucaacuga

SEQ ID NO: 27231 - RNA, 24 nt, Human
aguucuguggaggacaggccuagu

SEQ ID NO: 27232 - RNA, 24 nt, Human
uccuuggagaagacagcacaaugg

SEQ ID NO: 27233 - RNA, 24 nt, Human
ugucacuaacauuaaagaaagagg

SEQ ID NO: 27234 - RNA, 21 nt, Human
ucaguaagugauuaaaaguac

SEQ ID NO: 27235 - RNA, 24 nt, Human
uuaaaucaaguuuaccuaucaaau

SEQ ID NO: 27236 - RNA, 24 nt, Human
uuagcaauuuuuuucauaauauaa

SEQ ID NO: 27237 - RNA, 24 nt, Human
uaaggagaaaccacauaggauaaa

SEQ ID NO: 27238 - RNA, 18 nt, Human
uggcuggauuugggcgcc

SEQ ID NO: 27239 - RNA, 18 nt, Human
uagcucggcgccuggguu

SEQ ID NO: 27240 - RNA, 24 nt, Human
uaugacgcagccacccaggaguuu

SEQ ID NO: 27241 - RNA, 24 nt, Human
cacuccgcaggaaaguugagagca

SEQ ID NO: 27242 - RNA, 24 nt, Human
uagaauaugggccuggaggcucca

SEQ ID NO: 27243 - RNA, 24 nt, Human
ugggacagauguucacuuuaaugu

SEQ ID NO: 27244 - RNA, 24 nt, Human
uuuugcaucaacaaauuuucgaga

SEQ ID NO: 27245 - RNA, 24 nt, Human
aucauuguaaaaaaagcaccugga

SEQ ID NO: 27246 - RNA, 24 nt, Human
uagaccacauauuacucuuuaauu

SEQ ID NO: 27247 - RNA, 24 nt, Human
uuccaguaaaaaguucuuauuccu

SEQ ID NO: 27248 - RNA, 24 nt, Human
cauggcucuuaggaaugacgccaa

SEQ ID NO: 27249 - RNA, 24 nt, Human
ugcgcagccuuaaaagggggcaca

SEQ ID NO: 27250 - RNA, 24 nt, Human
cauugcacuccagccuggugacaa

SEQ ID NO: 27251 - RNA, 24 nt, Human
ugaaugcaaucucugcuuccuggg

SEQ ID NO: 27252 - RNA, 24 nt, Human
uggugggugcaaauugguaugcuc

SEQ ID NO: 27253 - RNA, 24 nt, Human
uuccagagucucuguagaaaccuu

SEQ ID NO: 27254 - RNA, 24 nt, Human
ugggagcagaggauggagcaccaa

SEQ ID NO: 27255 - RNA, 24 nt, Human
acacugugccaugaucuguaggag

SEQ ID NO: 27256 - RNA, 24 nt, Human
uacauaauuacucagucauggaaa

SEQ ID NO: 27257 - RNA, 24 nt, Human
agaaggaccauagugaucauuuaa

SEQ ID NO: 27258 - RNA, 24 nt, Human
ugacagugugcaacucucauugga

SEQ ID NO: 27259 - RNA, 23 nt, Human
gaccuucccggcccagccugugg

SEQ ID NO: 27260 - RNA, 24 nt, Human
cucccguguucccggcugguuguc

SEQ ID NO: 27261 - RNA, 24 nt, Human
cccaaaagaccggcugccgccugc

SEQ ID NO: 27262 - RNA, 22 nt, Human
uggcaccgggccaccgccaccc

SEQ ID NO: 27263 - RNA, 24 nt, Human
ugaaaaaagguauccguuaugaaa

SEQ ID NO: 27264 - RNA, 24 nt, Human
ugguaguggauuagugaaagucuc

SEQ ID NO: 27265 - RNA, 24 nt, Human
ugaaagcacuggcagccaggaaca

SEQ ID NO: 27266 - RNA, 24 nt, Human
aagcuguaaggccuguagcucugg

SEQ ID NO: 27267 - RNA, 24 nt, Human
ugcauuguuaucauuaaccagucu

SEQ ID NO: 27268 - RNA, 24 nt, Human
ugaggggaucuuggccucacggug

SEQ ID NO: 27269 - RNA, 24 nt, Human
ucaaguggauacaagucuggcauu

SEQ ID NO: 27270 - RNA, 24 nt, Human
uauuacacacggauguaagcauuu

SEQ ID NO: 27271 - RNA, 24 nt, Human
uguguuuguagacuuggaacccac

SEQ ID NO: 27272 - RNA, 24 nt, Human
caccggucuucagggcuucuuggu

SEQ ID NO: 27273 - RNA, 23 nt, Human
gugaauggggcaaaaaaacaaaa

SEQ ID NO: 27274 - RNA, 17 nt, Human
gcuggcagcuuccaugu

SEQ ID NO: 27275 - RNA, 24 nt, Human
uccuggguuaaccuuuguuggcug

SEQ ID NO: 27276 - RNA, 24 nt, Human
aaggauaguucucucugguuauca

SEQ ID NO: 27277 - RNA, 24 nt, Human
uauuccaauuacuaucucuuccug

SEQ ID NO: 27278 - RNA, 24 nt, Human
uggaagacagcuguuugugcacua

SEQ ID NO: 27279 - RNA, 24 nt, Human
uuaguaauuaguuguuagauagcu

SEQ ID NO: 27280 - RNA, 24 nt, Human
ucaaauuaagacuuuuccaaaaca

SEQ ID NO: 27281 - RNA, 24 nt, Human
uucaugaggaaacauguauuugca

SEQ ID NO: 27282 - RNA, 24 nt, Human
uuugucagauugcuuaugcccgua

SEQ ID NO: 27283 - RNA, 24 nt, Human
auugauggucagccaggugccuuc

SEQ ID NO: 27284 - RNA, 24 nt, Human
ugacagugugcaacucucauugga

SEQ ID NO: 27285 - RNA, 24 nt, Human
uguuucaagcuccugauucuuucu

SEQ ID NO: 27286 - RNA, 24 nt, Human
ggacagguguacagacauguucuu

SEQ ID NO: 27287 - RNA, 24 nt, Human
ucgaauggacacauuaccagugaa

SEQ ID NO: 27288 - RNA, 24 nt, Human
uucguuaggaacugagaugccuuc

SEQ ID NO: 27289 - RNA, 24 nt, Human
uaauugaaauaaaauucuaggcug

SEQ ID NO: 27290 - RNA, 24 nt, Human
acgaaaaucagguaguuggugaag

SEQ ID NO: 27291 - RNA, 24 nt, Human
uagugugccuucacguuguucuug

SEQ ID NO: 27292 - RNA, 24 nt, Human
cugcaagcccugcucgucuggcug

SEQ ID NO: 27293 - RNA, 24 nt, Human
ugcauuguuaucauuaaccagucu

SEQ ID NO: 27294 - RNA, 24 nt, Human
uauuagggauaauauucauuuagc

SEQ ID NO: 27295 - RNA, 24 nt, Human
uaaugggucucaaaauucugugac

SEQ ID NO: 27296 - RNA, 22 nt, Human
uagcaugccucuuaauuuuucu

SEQ ID NO: 27297 - RNA, 24 nt, Human
uauaaaacuuugauaguuacauug

SEQ ID NO: 27298 - RNA, 24 nt, Human
aacagguaaccacuugagaggaug

SEQ ID NO: 27299 - RNA, 24 nt, Human
ggagcauaguuuuuuccauuuaaa

SEQ ID NO: 27300 - RNA, 24 nt, Human
uuugcguaggccacuggguuuucu

SEQ ID NO: 27301 - RNA, 24 nt, Human
uggcaguccaaagaccaagaauca

SEQ ID NO: 27302 - RNA, 24 nt, Human
ugaccaggcuagaccacacgugcc

SEQ ID NO: 27303 - RNA, 24 nt, Human
ugagacuaaggcuuucgacccugg

SEQ ID NO: 27304 - RNA, 24 nt, Human
gaugcaaaauguuugcaguuugac

SEQ ID NO: 27305 - RNA, 24 nt, Human
uauaagauuuuagcaauacuucca

SEQ ID NO: 27306 - RNA, 24 nt, Human
uaauauaucauauagaucacagga

SEQ ID NO: 27307 - RNA, 24 nt, Human
aggaagucaaaauaauaucacuuu

SEQ ID NO: 27308 - RNA, 21 nt, Human
ucagcaagcugggauaauaag

SEQ ID NO: 27309 - RNA, 24 nt, Human
uuuacaguauauacagucaggccu

SEQ ID NO: 27310 - RNA, 22 nt, Human
ugccuugggucccuucaguagc

SEQ ID NO: 27311 - RNA, 24 nt, Human
ugucaggaaggggaagcggguuuc

SEQ ID NO: 27312 - RNA, 24 nt, Human
uauggcaagucacuuugacagaca

SEQ ID NO: 27313 - RNA, 24 nt, Human
ugagaauggcaaaauuagucgccu

SEQ ID NO: 27314 - RNA, 24 nt, Human
uacaccacucccaagaagaauaag

SEQ ID NO: 27315 - RNA, 24 nt, Human
ucccuguggccuguacccgucccu

SEQ ID NO: 27316 - RNA, 24 nt, Human
uuucacagcuaacauucauuuaau

SEQ ID NO: 27317 - RNA, 24 nt, Human
uuagauucuccagauaguguagga

SEQ ID NO: 27318 - RNA, 24 nt, Human
uuaaaggaaacauccagggccccu

SEQ ID NO: 27319 - RNA, 24 nt, Human
uuuaucacauaguaaggaaugcug

SEQ ID NO: 27320 - RNA, 24 nt, Human
acaaagcaagagaagaagcagaga

SEQ ID NO: 27321 - RNA, 21 nt, Human
cauuggacaggacauccagcc

SEQ ID NO: 27322 - RNA, 24 nt, Human
cagcggcagagagccauccucuau

SEQ ID NO: 27323 - RNA, 24 nt, Human
uauggcaagucacuuugacagaca

SEQ ID NO: 27324 - RNA, 24 nt, Human
ugagaauggcaaaauuagucgccu

SEQ ID NO: 27325 - RNA, 24 nt, Human
uacaccacucccaagaagaauaag

SEQ ID NO: 27326 - RNA, 24 nt, Human
ucccaucgagcugguugucuucuu

SEQ ID NO: 27327 - RNA, 24 nt, Human
acaaagcaagagaagaagcagaga

SEQ ID NO: 27328 - RNA, 21 nt, Human
cauuggacaggacauccagcc

SEQ ID NO: 27329 - RNA, 24 nt, Human
cagcggcagagagccauccucuau

SEQ ID NO: 27330 - RNA, 21 nt, Human
caccgagucgccucacucgag

SEQ ID NO: 27331 - RNA, 24 nt, Human
uguuguguacaauguuugaaagac

SEQ ID NO: 27332 - RNA, 24 nt, Human
ugauaguaacucacuucucucuca

SEQ ID NO: 27333 - RNA, 21 nt, Human
ucugacaguucugcgacaagc

SEQ ID NO: 27334 - RNA, 24 nt, Human
gcugaacccccugcucaccgccag

SEQ ID NO: 27335 - RNA, 24 nt, Human
uucaaauuucuuucuuuuuuaauu

SEQ ID NO: 27336 - RNA, 22 nt, Human
ugugcagaagaaauggaaggau

SEQ ID NO: 27337 - RNA, 24 nt, Human
gugcauuuucaaggaagggcaggc

SEQ ID NO: 27338 - RNA, 24 nt, Human
uaagaguguugaaaaaaaaauuca

SEQ ID NO: 27339 - RNA, 24 nt, Human
ugugcagaagaaauggaaggauuc

SEQ ID NO: 27340 - RNA, 24 nt, Human
uaucaaggaagggcaggcgugaug

SEQ ID NO: 27341 - RNA, 24 nt, Human
uucaaauuucuuucuuuuuuaauu

SEQ ID NO: 27342 - RNA, 24 nt, Human
ucaauuuuuauuuugguuuucuua

SEQ ID NO: 27343 - RNA, 24 nt, Human
uaacagguguaagaguguugaaaa

SEQ ID NO: 27344 - RNA, 24 nt, Human
ugugcagaagaaauggaaggauuc

SEQ ID NO: 27345 - RNA, 24 nt, Human
aagaagaagaagaaauggcaaaga

SEQ ID NO: 27346 - RNA, 24 nt, Human
uggcuuauuuguuuuguauucaau

SEQ ID NO: 27347 - RNA, 24 nt, Human
uccaggacuguuuuccuacagcgu

SEQ ID NO: 27348 - RNA, 24 nt, Human
uguguacggugcacacacacagug

SEQ ID NO: 27349 - RNA, 24 nt, Human
gcucaggguuuuuagaacuucagc

SEQ ID NO: 27350 - RNA, 24 nt, Human
uguucauauuuaugcagugccucu

SEQ ID NO: 27351 - RNA, 20 nt, Human
ucugaggaugcggaugucgu

SEQ ID NO: 27352 - RNA, 24 nt, Human
uacaauucucuguuauuagggaga

SEQ ID NO: 27353 - RNA, 24 nt, Human
uugaucucacuuauauucugagug

SEQ ID NO: 27354 - RNA, 24 nt, Human
ugucugaggcggucaugagacacu

SEQ ID NO: 27355 - RNA, 24 nt, Human
uguaauccaucccuugaguuuuuu

SEQ ID NO: 27356 - RNA, 24 nt, Human
uguagaacucagccuucuuggaaa

SEQ ID NO: 27357 - RNA, 24 nt, Human
ucuccgaguuugcgacucgcggac

SEQ ID NO: 27358 - RNA, 24 nt, Human
uggaaagcagguagaguuggcuug

SEQ ID NO: 27359 - RNA, 24 nt, Human
uaaaugcagauaugugugugcgcu

SEQ ID NO: 27360 - RNA, 24 nt, Human
uaccaggaagcagcuguagguggg

SEQ ID NO: 27361 - RNA, 24 nt, Human
ucccugguggcccucaacugccuu

SEQ ID NO: 27362 - RNA, 24 nt, Human
ugcauuguuaucauuaaccagucu

SEQ ID NO: 27363 - RNA, 24 nt, Human
uaaugggucucaaaauucugugac

SEQ ID NO: 27364 - RNA, 24 nt, Human
uauuagggauaauauucauuuagc

SEQ ID NO: 27365 - RNA, 24 nt, Human
cgugcaucuuggucucaaugucga

SEQ ID NO: 27366 - RNA, 24 nt, Human
gucaaguuguuuccauuaaaaagu

SEQ ID NO: 27367 - RNA, 24 nt, Human
ucgaauggacacauuaccagugaa

SEQ ID NO: 27368 - RNA, 24 nt, Human
ggacagguguacagacauguucuu

SEQ ID NO: 27369 - RNA, 24 nt, Human
aagcagcugcccagcccgcccuuc

SEQ ID NO: 27370 - RNA, 24 nt, Human
cagccuggacuuaccaccacuaaa

SEQ ID NO: 27371 - RNA, 24 nt, Human
gaggugagaacaaagcugcgugug

SEQ ID NO: 27372 - RNA, 24 nt, Human
ugacaagaggcagggaugcuggaa

SEQ ID NO: 27373 - RNA, 24 nt, Human
ucccuggaccagcccgguggcacc

SEQ ID NO: 27374 - RNA, 24 nt, Human
ccccugaggcuggagcccccaugg

SEQ ID NO: 27375 - RNA, 24 nt, Human
aaagauggucggcugcuuuuggua

SEQ ID NO: 27376 - RNA, 24 nt, Human
ggacagguguacagacauguucuu

SEQ ID NO: 27377 - RNA, 24 nt, Human
uggcaccauggaugccuucgugaa

SEQ ID NO: 27378 - RNA, 24 nt, Human
ugacguggugaagguucgccugca

SEQ ID NO: 27379 - RNA, 24 nt, Human
uaccuccuucaccccagaauauuu

SEQ ID NO: 27380 - RNA, 24 nt, Human
ugaaaagcaguucucugaggagcg

SEQ ID NO: 27381 - RNA, 24 nt, Human
caugccccaacguggccuggaggu

SEQ ID NO: 27382 - RNA, 24 nt, Human
ugcuagcucaagauucacaauguu

SEQ ID NO: 27383 - RNA, 24 nt, Human
gaacuggaagauugcucuccgagu

SEQ ID NO: 27384 - RNA, 24 nt, Human
uucacaagcuaacuuccacuaauc

SEQ ID NO: 27385 - RNA, 24 nt, Human
uaugaucaaggauauggaaauuac

SEQ ID NO: 27386 - RNA, 24 nt, Human
uaaaguaacccaucuugcaggacg

SEQ ID NO: 27387 - RNA, 24 nt, Human
ugggagggguaggaguauucaggu

SEQ ID NO: 27388 - RNA, 24 nt, Human
ucgcaggcuuaucuugcauuuuga

SEQ ID NO: 27389 - RNA, 24 nt, Human
cagccgguguccgaacugaucgcg

SEQ ID NO: 27390 - RNA, 19 nt, Human
cggcgcaggcggcgcugcc

SEQ ID NO: 27391 - RNA, 24 nt, Human
ccuugcuuguuaaauuuuuuuuuu

SEQ ID NO: 27392 - RNA, 24 nt, Human
agagaagcgggguuauaaagagag

SEQ ID NO: 27393 - RNA, 24 nt, Human
auccaguugaugggcugccagauc

SEQ ID NO: 27394 - RNA, 24 nt, Human
aguccuuuugugaacuuuuaacgg

SEQ ID NO: 27395 - RNA, 24 nt, Human
ucuggccucugaaacacuaccacu

SEQ ID NO: 27396 - RNA, 24 nt, Human
ucggugcucagcggcggcaggcca

SEQ ID NO: 27397 - RNA, 24 nt, Human
uguagauagucuacauuaugauau

SEQ ID NO: 27398 - RNA, 24 nt, Human
aaaaacuaaaaacaaaugucaacu

SEQ ID NO: 27399 - RNA, 24 nt, Human
agaauacuauagagcaaguaaacc

SEQ ID NO: 27400 - RNA, 24 nt, Human
uguuuggagaacauacauguguga

SEQ ID NO: 27401 - RNA, 20 nt, Human
uaccugguauuaauaaaaug

SEQ ID NO: 27402 - RNA, 24 nt, Human
uaacagaaggaccuuucuuaaaug

SEQ ID NO: 27403 - RNA, 18 nt, Human
aggugcuucuaagcccag

SEQ ID NO: 27404 - RNA, 24 nt, Human
uacuauguaauccggauccaggau

SEQ ID NO: 27405 - RNA, 24 nt, Human
aagcaggaaucugagauuuccaag

SEQ ID NO: 27406 - RNA, 24 nt, Human
guagcccuggggccccgcugugcc

SEQ ID NO: 27407 - RNA, 24 nt, Human
ucagcucccucuugaacuccaggg

SEQ ID NO: 27408 - RNA, 24 nt, Human
cagcauaagaauuaaaaacaguua

SEQ ID NO: 27409 - RNA, 24 nt, Human
uugaaaagcuggaaaauauggagu

SEQ ID NO: 27410 - RNA, 21 nt, Human
ugggauccuaaagaaagcauc

SEQ ID NO: 27411 - RNA, 24 nt, Human
uccgcaccgagggggcggggggca

SEQ ID NO: 27412 - RNA, 24 nt, Human
uguugggcaacuggggugaaggga

SEQ ID NO: 27413 - RNA, 24 nt, Human
gcgccuggcgcucagccuccagcu

SEQ ID NO: 27414 - RNA, 24 nt, Human
uggcaggaagggggcagccugcaa

SEQ ID NO: 27415 - RNA, 24 nt, Human
ccucccgggccagcugccccagcc

SEQ ID NO: 27416 - RNA, 24 nt, Human
uacuguguggugacguccccuaug

SEQ ID NO: 27417 - RNA, 24 nt, Human
uaggcuucucauauaaggccccgu

SEQ ID NO: 27418 - RNA, 24 nt, Human
ugcaugaagaaauuucgguuuccc

SEQ ID NO: 27419 - RNA, 24 nt, Human
aggcagucacagaacaggggcaug

SEQ ID NO: 27420 - RNA, 24 nt, Human
ucccgaaggauccgcacgcagucc

SEQ ID NO: 27421 - RNA, 24 nt, Human
uuucagcgugauccgugcgcaucc

SEQ ID NO: 27422 - RNA, 24 nt, Human
guccgagugagccgcguguggaac

SEQ ID NO: 27423 - RNA, 24 nt, Human
cguuacaucuguuuuuauuucacu

SEQ ID NO: 27424 - RNA, 24 nt, Human
uaaaugaagauucagacuuuguaa

SEQ ID NO: 27425 - RNA, 19 nt, Human
ugaauauacauacacugca

SEQ ID NO: 27426 - RNA, 24 nt, Human
aguaagugguggagaauuguacaa

SEQ ID NO: 27427 - RNA, 24 nt, Human
ugggguuggcuggcccugcuucug

SEQ ID NO: 27428 - RNA, 24 nt, Human
uggcaggcggcgaagcgcucugga

SEQ ID NO: 27429 - RNA, 24 nt, Human
cauugcacuccaggccugggcaac

SEQ ID NO: 27430 - RNA, 24 nt, Human
acccucauagccgccuacuccggg

SEQ ID NO: 27431 - RNA, 24 nt, Human
ugggagauggggccacuggaucca

SEQ ID NO: 27432 - RNA, 24 nt, Human
ucagugcuccaguuggguacuagu

SEQ ID NO: 27433 - RNA, 21 nt, Human
uaagcuagucguucuuggcuc

SEQ ID NO: 27434 - RNA, 24 nt, Human
uugaauguuugauacaaaggaugg

SEQ ID NO: 27435 - RNA, 24 nt, Human
ucgcccagauucaggcguguaaac

SEQ ID NO: 27436 - RNA, 24 nt, Human
uaacugcugaacuaguuccucagg

SEQ ID NO: 27437 - RNA, 24 nt, Human
cgcugcuggcccucgggcugcggg

SEQ ID NO: 27438 - RNA, 24 nt, Human
ugcgggagccgggcuaggacgccg

SEQ ID NO: 27439 - RNA, 24 nt, Human
ucugucuucaggaaagcaaaacua

SEQ ID NO: 27440 - RNA, 24 nt, Human
augaaguucugguugcuggauuug

SEQ ID NO: 27441 - RNA, 24 nt, Human
uugaagccaaacagccaaauucug

SEQ ID NO: 27442 - RNA, 24 nt, Human
gugaacuuaauuugcauuuaugcc

SEQ ID NO: 27443 - RNA, 24 nt, Human
cagcagcccaagcugucaggaucu

SEQ ID NO: 27444 - RNA, 24 nt, Human
caggaccaaggaucagacaaaggu

SEQ ID NO: 27445 - RNA, 22 nt, Human
uggcaugaagaaggaauagagc

SEQ ID NO: 27446 - RNA, 24 nt, Human
uucacugcccggagguuggagugc

SEQ ID NO: 27447 - RNA, 24 nt, Human
cauugugcgggccucugaggcugu

SEQ ID NO: 27448 - RNA, 24 nt, Human
ucagucagaaauagguauugcuua

SEQ ID NO: 27449 - RNA, 24 nt, Human
ucccucggagugccaggaaagguc

SEQ ID NO: 27450 - RNA, 24 nt, Human
ucagcccccugagggcaaugccuc

SEQ ID NO: 27451 - RNA, 24 nt, Human
uaugacgagacggcaggcaugcug

SEQ ID NO: 27452 - RNA, 24 nt, Human
uggcagagacgcucuaugacacca

SEQ ID NO: 27453 - RNA, 24 nt, Human
ugaaagaaaaugagagcagaaagu

SEQ ID NO: 27454 - RNA, 24 nt, Human
ugaaaguauuggcauucaaaaaga

SEQ ID NO: 27455 - RNA, 24 nt, Human
uauaaaauaaaaaguccacaauga

SEQ ID NO: 27456 - RNA, 24 nt, Human
ugagaaugaccccaagaccuuuga

SEQ ID NO: 27457 - RNA, 24 nt, Human
cuuccaaucugaugggcauguuug

SEQ ID NO: 27458 - RNA, 22 nt, Human
guggagggcagcuuugucuaca

SEQ ID NO: 27459 - RNA, 24 nt, Human
ugggaugcccucauguugggaagc

SEQ ID NO: 27460 - RNA, 22 nt, Human
ucacuugggacaggaggucauc

SEQ ID NO: 27461 - RNA, 24 nt, Human
caccugaaggugcuguaugacgcc

SEQ ID NO: 27462 - RNA, 24 nt, Human
agguggugcuggcugaaggcaucc

SEQ ID NO: 27463 - RNA, 24 nt, Human
uugaaugguugcugcacuuugguc

SEQ ID NO: 27464 - RNA, 20 nt, Human
cagcccgugggcgccuggcg

SEQ ID NO: 27465 - RNA, 20 nt, Human
uacuucacgcuaucuaagug

SEQ ID NO: 27466 - RNA, 20 nt, Human
ugcauuguagacaacaucga

SEQ ID NO: 27467 - RNA, 24 nt, Human
ggccgagugggcaccaucauggga

SEQ ID NO: 27468 - RNA, 24 nt, Human
uuugauggaugcauuuccaugaug

SEQ ID NO: 27469 - RNA, 24 nt, Human
cuuugagacuggguucccaucgcu

SEQ ID NO: 27470 - RNA, 24 nt, Human
uuaaagcagcuuagauugcauguu

SEQ ID NO: 27471 - RNA, 24 nt, Human
ugucgagugaugaguuugcuaaua

SEQ ID NO: 27472 - RNA, 18 nt, Human
uaugguauaaucuuuaau

SEQ ID NO: 27473 - RNA, 24 nt, Human
cacccgcaguaaccacugaacguc

SEQ ID NO: 27474 - RNA, 24 nt, Human
gugaaguauuuuguuaccucaguc

SEQ ID NO: 27475 - RNA, 24 nt, Human
cagcggcuuagcuccggcgucugc

SEQ ID NO: 27476 - RNA, 24 nt, Human
uuguccugugcuggggcugacagg

SEQ ID NO: 27477 - RNA, 23 nt, Human
uuugaccuggggcggaaaaaggc

SEQ ID NO: 27478 - RNA, 24 nt, Human
uuugaccauuugcuauggacauug

SEQ ID NO: 27479 - RNA, 20 nt, Human
uacuguggaccucacucagg

SEQ ID NO: 27480 - RNA, 24 nt, Human
agugcaggaguucaggugcgguac

SEQ ID NO: 27481 - RNA, 21 nt, Human
ucauugggaucaagaacucga

SEQ ID NO: 27482 - RNA, 24 nt, Human
uaaguacauaggucuuuauuuaaa

SEQ ID NO: 27483 - RNA, 24 nt, Human
acgaaaauugaacauucugacucg

SEQ ID NO: 27484 - RNA, 24 nt, Human
agcccgucacacucgcuucaagga

SEQ ID NO: 27485 - RNA, 24 nt, Human
ucuauucaugaacaaugcuauuuc

SEQ ID NO: 27486 - RNA, 24 nt, Human
uugaucuugaagaaacugggcgug

SEQ ID NO: 27487 - RNA, 24 nt, Human
uugguuccaagacgcguaggcgag

SEQ ID NO: 27488 - RNA, 24 nt, Human
guagaguuuucuucaggcuuaaag

SEQ ID NO: 27489 - RNA, 24 nt, Human
aggaaggagauauagugaagagga

SEQ ID NO: 27490 - RNA, 24 nt, Human
aggcaccacagugggaggcuggua

SEQ ID NO: 27491 - RNA, 18 nt, Human
ucagcagagaugacaggc

SEQ ID NO: 27492 - RNA, 24 nt, Human
uugaagccaguggggcaccaaucc

SEQ ID NO: 27493 - RNA, 24 nt, Human
ucugcaggcccaggacagugggcu

SEQ ID NO: 27494 - RNA, 24 nt, Human
ucgcacugucuuaaaauuccuaau

SEQ ID NO: 27495 - RNA, 24 nt, Human
uauuacucaggauuggaauucugc

SEQ ID NO: 27496 - RNA, 24 nt, Human
uacccuuggaagaauuaugaauuu

SEQ ID NO: 27497 - RNA, 24 nt, Human
guugcaauuggguuguuuuugauu

SEQ ID NO: 27498 - RNA, 24 nt, Human
uaucaaguaagcuuagugaaaauc

SEQ ID NO: 27499 - RNA, 24 nt, Human
auccaguugggcagcagggaaagg

SEQ ID NO: 27500 - RNA, 24 nt, Human
uagcgggguacuaggcagauuuua

SEQ ID NO: 27501 - RNA, 24 nt, Human
ucagucagguuggaauggaucuga

SEQ ID NO: 27502 - RNA, 24 nt, Human
uugacauuugaaggggcgaugacc

SEQ ID NO: 27503 - RNA, 24 nt, Human
uaagggaagaguagacagggaagg

SEQ ID NO: 27504 - RNA, 24 nt, Human
ucuggauucgguucuuggcuggga

SEQ ID NO: 27505 - RNA, 24 nt, Human
ugguguggcgcauagugcagagcc

SEQ ID NO: 27506 - RNA, 24 nt, Human
cuuggccagagcggagggggcucg

SEQ ID NO: 27507 - RNA, 24 nt, Human
ugcaaguuguggagagaaggagca

SEQ ID NO: 27508 - RNA, 24 nt, Human
uuuccaguucucuguguugucuuu

SEQ ID NO: 27509 - RNA, 24 nt, Human
aaggugaacuugucacuugguaug

SEQ ID NO: 27510 - RNA, 24 nt, Human
ugguggucuugagcuuuuggccug

SEQ ID NO: 27511 - RNA, 24 nt, Human
uucauaaaauuaagaccauguaag

SEQ ID NO: 27512 - RNA, 24 nt, Human
uuuguuggaaggugauggcucucc

SEQ ID NO: 27513 - RNA, 24 nt, Human
uaaaacauuuuauuuuaauuguua

SEQ ID NO: 27514 - RNA, 24 nt, Human
gggcacugaagaugaugcgaccca

SEQ ID NO: 27515 - RNA, 24 nt, Human
uuccugauguauacagugcuugua

SEQ ID NO: 27516 - RNA, 24 nt, Human
cugcaugcaucugcugcuggaggc

SEQ ID NO: 27517 - RNA, 24 nt, Human
cugcugcacuggccgccaaguaug

SEQ ID NO: 27518 - RNA, 24 nt, Human
gcagccuucggugcagucgucacu

SEQ ID NO: 27519 - RNA, 24 nt, Human
uaagguucucuggaguccccuugg

SEQ ID NO: 27520 - RNA, 24 nt, Human
uguuggauuggcaccugcugcaca

SEQ ID NO: 27521 - RNA, 24 nt, Human
ugacauggcuuuagauccuguuua

SEQ ID NO: 27522 - RNA, 24 nt, Human
uagcgcgcaguccgagagggccgg

SEQ ID NO: 27523 - RNA, 24 nt, Human
gcacuauugugaugaggcgccccu

SEQ ID NO: 27524 - RNA, 24 nt, Human
uagcgugcuuccgcacggcgagcc

SEQ ID NO: 27525 - RNA, 24 nt, Human
ggauaacaggauuauuuggucuuc

SEQ ID NO: 27526 - RNA, 24 nt, Human
ugagggaggaccggauuuauacau

SEQ ID NO: 27527 - RNA, 24 nt, Human
ugagcaaagaggccaagcagagac

SEQ ID NO: 27528 - RNA, 24 nt, Human
uagcagaguggaucuuguacuaac

SEQ ID NO: 27529 - RNA, 24 nt, Human
ucaguauaauaguugaauguguua

SEQ ID NO: 27530 - RNA, 24 nt, Human
uaagaaaacaggcuugaauuucac

SEQ ID NO: 27531 - RNA, 24 nt, Human
cuuggcccuggagaacaaaaaaaa

SEQ ID NO: 27532 - RNA, 24 nt, Human
uuucaccauguuggccaggcucgu

SEQ ID NO: 27533 - RNA, 23 nt, Human
uacaguuuguaguguuaaccucu

SEQ ID NO: 27534 - RNA, 24 nt, Human
gguggaggucacgcgcuugucgcu

SEQ ID NO: 27535 - RNA, 24 nt, Human
gugguugguguaaaugagugaggc

SEQ ID NO: 27536 - RNA, 19 nt, Human
cuuggauuaaggcgacagc

SEQ ID NO: 27537 - RNA, 24 nt, Human
ugagaaggcagguuccauugaaga

SEQ ID NO: 27538 - RNA, 24 nt, Human
auaauacacguuuccuaauguggg

SEQ ID NO: 27539 - RNA, 24 nt, Human
ugcaauggaccugauucuaguuua

SEQ ID NO: 27540 - RNA, 18 nt, Human
cccucggugccugcugug

SEQ ID NO: 27541 - RNA, 24 nt, Human
ugcauuguuaucauuaaccagucu

SEQ ID NO: 27542 - RNA, 24 nt, Human
uauuagggauaauauucauuuagc

SEQ ID NO: 27543 - RNA, 24 nt, Human
ggggagcagacaaguaccacuccg

SEQ ID NO: 27544 - RNA, 24 nt, Human
uaguuuagagucucauuaggaagc

SEQ ID NO: 27545 - RNA, 24 nt, Human
agcacuuugugcuggacgagugug

SEQ ID NO: 27546 - RNA, 24 nt, Human
uacaagcuacaaaauagcaucucu

SEQ ID NO: 27547 - RNA, 24 nt, Human
aaggaaacccuuguauucuuguga

SEQ ID NO: 27548 - RNA, 22 nt, Human
guggagggcagcuuugucuaca

SEQ ID NO: 27549 - RNA, 24 nt, Human
ugcccguaggacguaccuguugcc

SEQ ID NO: 27550 - RNA, 24 nt, Human
ucccccaguaccuccaagcaagua

SEQ ID NO: 27551 - RNA, 24 nt, Human
acccugguuugugaguugccccgg

SEQ ID NO: 27552 - RNA, 24 nt, Human
uggaggaggaugacgaugaugagc

SEQ ID NO: 27553 - RNA, 24 nt, Human
ugaagaaauggaagucuggagagg

SEQ ID NO: 27554 - RNA, 24 nt, Human
aagcaaacccaacccucgugauua

SEQ ID NO: 27555 - RNA, 24 nt, Human
ucuagagggguuggaugguccuau

SEQ ID NO: 27556 - RNA, 24 nt, Human
ugucucagccuugccaggguuaua

SEQ ID NO: 27557 - RNA, 24 nt, Human
uugcuugaaccugagaggcggagg

SEQ ID NO: 27558 - RNA, 24 nt, Human
ugugaaggcccugaacucugggag

SEQ ID NO: 27559 - RNA, 18 nt, Human
caucaaguguuuaguuua

SEQ ID NO: 27560 - RNA, 24 nt, Human
cugcagcacugucauccuugcucc

SEQ ID NO: 27561 - RNA, 24 nt, Human
ucuugcugaucagagcuugguugg

SEQ ID NO: 27562 - RNA, 24 nt, Human
aguugcuccagaaaaaccuguaaa

SEQ ID NO: 27563 - RNA, 24 nt, Human
gagcugagcgaagcgaugccuaaa

SEQ ID NO: 27564 - RNA, 24 nt, Human
uuguauguuuggauugcagaagaa

SEQ ID NO: 27565 - RNA, 24 nt, Human
gugaagugacugcuacccgguugc

SEQ ID NO: 27566 - RNA, 24 nt, Human
uggcuuuuauguaugauaccuaau

SEQ ID NO: 27567 - RNA, 24 nt, Human
gagcagcaacccacaguagguagg

SEQ ID NO: 27568 - RNA, 24 nt, Human
gagcagucaggguggaugggaagu

SEQ ID NO: 27569 - RNA, 24 nt, Human
uggucagggggcugcuggcugagc

SEQ ID NO: 27570 - RNA, 22 nt, Human
uuggacaacugccccuuccaug

SEQ ID NO: 27571 - RNA, 24 nt, Human
acaaagcaagagaagaagcagaga

SEQ ID NO: 27572 - RNA, 21 nt, Human
cauuggacaggacauccagcc

SEQ ID NO: 27573 - RNA, 24 nt, Human
cagcggcagagagccauccucuau

SEQ ID NO: 27574 - RNA, 24 nt, Human
agggagcgugggauuccggacugu

SEQ ID NO: 27575 - RNA, 24 nt, Human
gcucaaggugcagcgccucugcuc

SEQ ID NO: 27576 - RNA, 24 nt, Human
uuuucaaaaauuaccguggggggc

SEQ ID NO: 27577 - RNA, 24 nt, Human
aauugcgcuuaagaaaaauacuac

SEQ ID NO: 27578 - RNA, 24 nt, Human
gagccugcgggcggaagaggaagc

SEQ ID NO: 27579 - RNA, 24 nt, Human
ggacacgaggauacgcagcaagag

SEQ ID NO: 27580 - RNA, 24 nt, Human
agcccgagccaguccugagugggu

SEQ ID NO: 27581 - RNA, 24 nt, Human
uucuaggaggguggggucugccug

SEQ ID NO: 27582 - RNA, 24 nt, Human
ugccucaagcucuucucugccuca

SEQ ID NO: 27583 - RNA, 24 nt, Human
acgcgcugcccggccagaaaacgg

SEQ ID NO: 27584 - RNA, 24 nt, Human
gggcaucguggcugaggugcuggu

SEQ ID NO: 27585 - RNA, 24 nt, Human
gggcaaucuuccuggccaucaucc

SEQ ID NO: 27586 - RNA, 23 nt, Human
ccgccgcgcccccgccgccgccc

SEQ ID NO: 27587 - RNA, 24 nt, Human
uaggcccagguuuggcuggaaggu

SEQ ID NO: 27588 - RNA, 24 nt, Human
acgggaguggcccuucggcucccg

SEQ ID NO: 27589 - RNA, 24 nt, Human
uauauuguaacuauugaaguuacc

SEQ ID NO: 27590 - RNA, 24 nt, Human
uuaguuggugaauauguauuuucu

SEQ ID NO: 27591 - RNA, 24 nt, Human
accagauugaaaugguuugccauc

SEQ ID NO: 27592 - RNA, 23 nt, Human
cucgugccgcacugaacuggacc

SEQ ID NO: 27593 - RNA, 23 nt, Human
aggcccuagaacaaggugaagug

SEQ ID NO: 27594 - RNA, 24 nt, Human
agaacgcgccaaaggguagccccg

SEQ ID NO: 27595 - RNA, 24 nt, Human
ugucuugaguguugcgccucggcu

SEQ ID NO: 27596 - RNA, 24 nt, Human
cauuacuuccgggcacaugcccac

SEQ ID NO: 27597 - RNA, 24 nt, Human
uuccuaugugucucagcuuggggc

SEQ ID NO: 27598 - RNA, 22 nt, Human
uaucaggggccaucggaaaggc

SEQ ID NO: 27599 - RNA, 24 nt, Human
gucaugaaggcccugugggugcag

SEQ ID NO: 27600 - RNA, 24 nt, Human
uguggauggccccuccgggaaacu

SEQ ID NO: 27601 - RNA, 24 nt, Human
uauugugccaucaaugaccccuuc

SEQ ID NO: 27602 - RNA, 24 nt, Human
gcucauuugcaggggggagccaaa

SEQ ID NO: 27603 - RNA, 24 nt, Human
uggcucaggguggcuggcgcucac

SEQ ID NO: 27604 - RNA, 24 nt, Human
ugaggagucugcaguuccugagag

SEQ ID NO: 27605 - RNA, 24 nt, Human
ucugcagccauccugaaccccagu

SEQ ID NO: 27606 - RNA, 22 nt, Human
ucugaagaugucgaugucugug

SEQ ID NO: 27607 - RNA, 24 nt, Human
uaguaguugguggguaaauagaaa

SEQ ID NO: 27608 - RNA, 24 nt, Human
uaacagguuuccuuaugugccuca

SEQ ID NO: 27609 - RNA, 24 nt, Human
agaggacagaagcagaccacucug

SEQ ID NO: 27610 - RNA, 24 nt, Human
ugaauuggcuguguucaaggcaug

SEQ ID NO: 27611 - RNA, 21 nt, Human
uccgguagguggagguugcag

SEQ ID NO: 27612 - RNA, 24 nt, Human
ugacaaaaauggauguauuaauug

SEQ ID NO: 27613 - RNA, 24 nt, Human
cucugcucaaaaaaaaaacaauuc

SEQ ID NO: 27614 - RNA, 24 nt, Human
ucuccagagagugggaaggcugau

SEQ ID NO: 27615 - RNA, 24 nt, Human
uguaauccccccuguacuuaccua

SEQ ID NO: 27616 - RNA, 24 nt, Human
uauuuuguugcugaucaaauacug

SEQ ID NO: 27617 - RNA, 24 nt, Human
ucaguagccguccccccggaaagg

SEQ ID NO: 27618 - RNA, 24 nt, Human
uccacugauuucucaucuuccucc

SEQ ID NO: 27619 - RNA, 23 nt, Human
gcaguggaggggccacaucugga

SEQ ID NO: 27620 - RNA, 23 nt, Human
aagcaggcacaaaugcaugagca

SEQ ID NO: 27621 - RNA, 22 nt, Human
auaaaguuuaaugaccucaucc

SEQ ID NO: 27622 - RNA, 24 nt, Human
uucaucuuguuuuuccuuggcuuc

SEQ ID NO: 27623 - RNA, 24 nt, Human
ucuuucuuuuuaauguguccagcu

SEQ ID NO: 27624 - RNA, 24 nt, Human
guggaaugacucuuugaccacgcg

SEQ ID NO: 27625 - RNA, 24 nt, Human
agguagcaaauuccucccuguaaa

SEQ ID NO: 27626 - RNA, 24 nt, Human
auggagcaguagucaaguuuggcc

SEQ ID NO: 27627 - RNA, 24 nt, Human
ugugcaaaguguggacugccgcuc

SEQ ID NO: 27628 - RNA, 24 nt, Human
ggcccgggcccccuuuuuaaaacc

SEQ ID NO: 27629 - RNA, 24 nt, Human
aggaguuucuuccaaacuucacca

SEQ ID NO: 27630 - RNA, 24 nt, Human
uaggggcacuaguuucagaaaaaa

SEQ ID NO: 27631 - RNA, 24 nt, Human
ugaguuguuggugccugcccuucc

SEQ ID NO: 27632 - RNA, 24 nt, Human
aagcguuaucugcaaagcaauucg

SEQ ID NO: 27633 - RNA, 24 nt, Human
cuggcugggcccaagugggguggg

SEQ ID NO: 27634 - RNA, 24 nt, Human
uguguuuguagacuuggaacccac

SEQ ID NO: 27635 - RNA, 24 nt, Human
uguggauauaguuuucccuguugg

SEQ ID NO: 27636 - RNA, 24 nt, Human
ugacuaaagaaaccugcugcacau

SEQ ID NO: 27637 - RNA, 24 nt, Human
gagcaugcaucuucucggugagcc

SEQ ID NO: 27638 - RNA, 24 nt, Human
caugcacggaggacacgcccauug

SEQ ID NO: 27639 - RNA, 24 nt, Human
uucauccgcgggcaaacuauaggc

SEQ ID NO: 27640 - RNA, 24 nt, Human
uaaccacaacgaggcggcgggaau

SEQ ID NO: 27641 - RNA, 24 nt, Human
acugcagccugggagacagaguga

SEQ ID NO: 27642 - RNA, 24 nt, Human
uagaaguauacgugugugucucca

SEQ ID NO: 27643 - RNA, 24 nt, Human
augcaguucacuuuugcagugccc

SEQ ID NO: 27644 - RNA, 24 nt, Human
ucaaauccgugacacuggagcagu

SEQ ID NO: 27645 - RNA, 24 nt, Human
uaacagguguaagaguguugaaaa

SEQ ID NO: 27646 - RNA, 24 nt, Human
uggcuuauuuguuuuguauucaau

SEQ ID NO: 27647 - RNA, 24 nt, Human
ucaguuaaaaaagaagaagaagaa

SEQ ID NO: 27648 - RNA, 24 nt, Human
ucugaucaauccuucuuuuucucu

SEQ ID NO: 27649 - RNA, 24 nt, Human
uaaugggucucaaaauucugugac

SEQ ID NO: 27650 - RNA, 24 nt, Human
uauuagggauaauauucauuuagc

SEQ ID NO: 27651 - RNA, 24 nt, Human
agggauuaaauauagauguaauuu

SEQ ID NO: 27652 - RNA, 22 nt, Human
ugacacggugaaacccugucuc

SEQ ID NO: 27653 - RNA, 24 nt, Human
cucacgccuguaaucccagcacuu

SEQ ID NO: 27654 - RNA, 24 nt, Human
uaacagguguaagaguguugaaaa

SEQ ID NO: 27655 - RNA, 24 nt, Human
ugugcagaagaaauggaaggauuc

SEQ ID NO: 27656 - RNA, 24 nt, Human
uaucaaggaagggcaggcgugaug

SEQ ID NO: 27657 - RNA, 24 nt, Human
agaggaagaagaaauggcaaagag

SEQ ID NO: 27658 - RNA, 24 nt, Human
aaguauauaguaaugaaaagccuu

SEQ ID NO: 27659 - RNA, 24 nt, Human
uaauaugcccuauggcuggaaauu

SEQ ID NO: 27660 - RNA, 24 nt, Human
agcuggggggcaagaaccccuaua

SEQ ID NO: 27661 - RNA, 24 nt, Human
ugugaagcccgagaugcaggaagg

SEQ ID NO: 27662 - RNA, 24 nt, Human
uggcauguauagugagguuaagga

SEQ ID NO: 27663 - RNA, 24 nt, Human
cgcccguaauccgcuaccaggaag

SEQ ID NO: 27664 - RNA, 24 nt, Human
uggugugagggaaucaagaagaac

SEQ ID NO: 27665 - RNA, 20 nt, Human
aacauggugaaacuccaucu

SEQ ID NO: 27666 - RNA, 24 nt, Human
ugggaggcugaggcacaagaauca

SEQ ID NO: 27667 - RNA, 24 nt, Human
uuccuggaaggguagauucugcua

SEQ ID NO: 27668 - RNA, 24 nt, Human
ucuuguggugguagagccagaaga

SEQ ID NO: 27669 - RNA, 24 nt, Human
aagcuucaagugaccagucagcac

SEQ ID NO: 27670 - RNA, 24 nt, Human
ugaaguggucugcucauaguuugu

SEQ ID NO: 27671 - RNA, 24 nt, Human
cagcaguaccaacaccugcccucg

SEQ ID NO: 27672 - RNA, 24 nt, Human
acaccauccggaagaugaagaacg

SEQ ID NO: 27673 - RNA, 24 nt, Human
uugaucuugaagaaacugggcgug

SEQ ID NO: 27674 - RNA, 24 nt, Human
guagaguuuucuucaggcuuaaag

SEQ ID NO: 27675 - RNA, 24 nt, Human
uauuuuuaaaacuuuauuuuaaaa

SEQ ID NO: 27676 - RNA, 21 nt, Human
uuuguaagcuucugagauugc

SEQ ID NO: 27677 - RNA, 24 nt, Human
cuggaaggcauacccuacaauuua

SEQ ID NO: 27678 - RNA, 24 nt, Human
ugccucaagcucuucucugccuca

SEQ ID NO: 27679 - RNA, 24 nt, Human
aauugauuaaugacaugagggcac

SEQ ID NO: 27680 - RNA, 24 nt, Human
uuagaaaaacuaggaaaaaagaua

SEQ ID NO: 27681 - RNA, 24 nt, Human
ugcauuguuaucauuaaccagucu

SEQ ID NO: 27682 - RNA, 24 nt, Human
cauuucaaauauaguuuuaaugac

SEQ ID NO: 27683 - RNA, 24 nt, Human
uaguagagaugcgacucacggaga

SEQ ID NO: 27684 - RNA, 24 nt, Human
ugcucugugugcucacaaguguuc

SEQ ID NO: 27685 - RNA, 23 nt, Human
ugccccuuccaggcuugucucug

SEQ ID NO: 27686 - RNA, 24 nt, Human
cagcucacgcgguugucguggcca

SEQ ID NO: 27687 - RNA, 24 nt, Human
ccagccccgcagcccuggccugua

SEQ ID NO: 27688 - RNA, 24 nt, Human
ucauaguggcaggguggggguggg

SEQ ID NO: 27689 - RNA, 24 nt, Human
ugccaggaaagggacauggaccca

SEQ ID NO: 27690 - RNA, 24 nt, Human
aggcugcagccucaugccaugucu

SEQ ID NO: 27691 - RNA, 24 nt, Human
gaggauccuguccuggcuguagcc

SEQ ID NO: 27692 - RNA, 24 nt, Human
ucuaccagcguucuuuugaguucu

SEQ ID NO: 27693 - RNA, 24 nt, Human
guccuggaauuguaaagauguguc

SEQ ID NO: 27694 - RNA, 24 nt, Human
uugcuuccuguauuggcugcaagu

SEQ ID NO: 27695 - RNA, 24 nt, Human
caucacagaggcucuuaaagugug

SEQ ID NO: 27696 - RNA, 24 nt, Human
ucuaacagccugcccgugcuuucc

SEQ ID NO: 27697 - RNA, 24 nt, Human
ugcgggaagccggacucugggcgu

SEQ ID NO: 27698 - RNA, 24 nt, Human
auggugcuuugcucuguguuugug

SEQ ID NO: 27699 - RNA, 24 nt, Human
uguuaaauuaaaauuuuuuuuuuu

SEQ ID NO: 27700 - RNA, 24 nt, Human
gagguucuggaugaaggcugaaca

SEQ ID NO: 27701 - RNA, 24 nt, Human
aucgcccucuacauggcuucgcag

SEQ ID NO: 27702 - RNA, 24 nt, Human
uuaguucuugaaacaaaauacuuc

SEQ ID NO: 27703 - RNA, 24 nt, Human
uguucuggagcuguuggacaaaua

SEQ ID NO: 27704 - RNA, 24 nt, Human
aggcagucacagaacaggggcaug

SEQ ID NO: 27705 - RNA, 24 nt, Human
aaccagaaaguaagguguucuacu

SEQ ID NO: 27706 - RNA, 24 nt, Human
cggccaggcugggcgcgcagggcc

SEQ ID NO: 27707 - RNA, 24 nt, Human
gugcaaccucggccgaggccuucc

SEQ ID NO: 27708 - RNA, 24 nt, Human
ugcgauguuuuaccuggcugcggc

SEQ ID NO: 27709 - RNA, 20 nt, Human
cugcgcccccuccugccagg

SEQ ID NO: 27710 - RNA, 24 nt, Human
gcagcagaaaggccgcggcauggg

SEQ ID NO: 27711 - RNA, 24 nt, Human
uucuguguucuggugaggccaugg

SEQ ID NO: 27712 - RNA, 24 nt, Human
cuugucaucuuuccagcuuccugu

SEQ ID NO: 27713 - RNA, 24 nt, Human
uuaguucuaaagaucagagaaaaa

SEQ ID NO: 27714 - RNA, 24 nt, Human
uaagaagaacuuaaagguagaggc

SEQ ID NO: 27715 - RNA, 24 nt, Human
cagagaguauaaugaagaaucuua

SEQ ID NO: 27716 - RNA, 24 nt, Human
uccaaaaggagcugcaauuuuaaa

SEQ ID NO: 27717 - RNA, 24 nt, Human
gagcagaagacagagcuggugugc

SEQ ID NO: 27718 - RNA, 24 nt, Human
uccccaagcugcugcccaaggucc

SEQ ID NO: 27719 - RNA, 24 nt, Human
uggaacacuacaucuuggaaacag

SEQ ID NO: 27720 - RNA, 20 nt, Human
ugagagaacacuccacgaug

SEQ ID NO: 27721 - RNA, 24 nt, Human
aaagcaaaugaggcagaaaggccc

SEQ ID NO: 27722 - RNA, 17 nt, Human
ugucacgguccgcggag

SEQ ID NO: 27723 - RNA, 24 nt, Human
gcuuuugggaagcaggacguucuc

SEQ ID NO: 27724 - RNA, 24 nt, Human
gccccuggcuugggcgaccauguc

SEQ ID NO: 27725 - RNA, 23 nt, Human
uaggaagauaggcgacucugggc

SEQ ID NO: 27726 - RNA, 24 nt, Human
uuccuggguauggaguccuguccu

SEQ ID NO: 27727 - RNA, 24 nt, Human
caggagccaaacaggccgcaagag

SEQ ID NO: 27728 - RNA, 24 nt, Human
uguggauauaguuuucccuguugg

SEQ ID NO: 27729 - RNA, 24 nt, Human
ugacuaaagaaaccugcugcacau

SEQ ID NO: 27730 - RNA, 24 nt, Human
gagcaugcaucuucucggugagcc

SEQ ID NO: 27731 - RNA, 22 nt, Human
ugagacagaauuugaaauuguu

SEQ ID NO: 27732 - RNA, 24 nt, Human
agggaccaggagcugcugcgaacu

SEQ ID NO: 27733 - RNA, 24 nt, Human
uccuugggcgcggggcuucaucau

SEQ ID NO: 27734 - RNA, 24 nt, Human
aggggucacuuccagaacugaguc

SEQ ID NO: 27735 - RNA, 24 nt, Human
caugcgccugguggaggccugugg

SEQ ID NO: 27736 - RNA, 24 nt, Human
aaccuuuguacuuguuuuccuccu

SEQ ID NO: 27737 - RNA, 17 nt, Human
uccaugagagaauauaa

SEQ ID NO: 27738 - RNA, 24 nt, Human
cagccuggacuuaccaccacuaaa

SEQ ID NO: 27739 - RNA, 24 nt, Human
ggcccggagcggagcgcgcccugc

SEQ ID NO: 27740 - RNA, 24 nt, Human
cgacggaaagaucggggaaacucc

SEQ ID NO: 27741 - RNA, 24 nt, Human
uuggcacacucuauccgaaauuug

SEQ ID NO: 27742 - RNA, 24 nt, Human
ucuggccucugaaacacuaccacu

SEQ ID NO: 27743 - RNA, 24 nt, Human
acucgcugcacaagaacagcguca

SEQ ID NO: 27744 - RNA, 24 nt, Human
gcccccucccucuuaauuuaauuc

SEQ ID NO: 27745 - RNA, 24 nt, Human
uaugucaccaugcaguugccagug

SEQ ID NO: 27746 - RNA, 23 nt, Human
gaugacacuuaagaccuacuugu

SEQ ID NO: 27747 - RNA, 24 nt, Human
cuggugcagagccgcgagggugug

SEQ ID NO: 27748 - RNA, 24 nt, Human
ugagucaagagucauggauccagg

SEQ ID NO: 27749 - RNA, 24 nt, Human
uugaaucuuucuggaagaaauggu

SEQ ID NO: 27750 - RNA, 24 nt, Human
uccacuggcgaaagaugccuuucu

SEQ ID NO: 27751 - RNA, 24 nt, Human
uaguucagauugaucuuaggucaa

SEQ ID NO: 27752 - RNA, 21 nt, Human
guggaucccagaaucccgaag

SEQ ID NO: 27753 - RNA, 24 nt, Human
acgcguguuguugggacucuggga

SEQ ID NO: 27754 - RNA, 24 nt, Human
uaagagguuggaacgccugggccu

SEQ ID NO: 27755 - RNA, 24 nt, Human
cguaaguugccauuggccuuuggg

SEQ ID NO: 27756 - RNA, 24 nt, Human
agucgauacucggacgccgagagc

SEQ ID NO: 27757 - RNA, 24 nt, Human
ccuggcuaagaaguugcuuccugu

SEQ ID NO: 27758 - RNA, 24 nt, Human
uguggccaguaccaagagucggug

SEQ ID NO: 27759 - RNA, 24 nt, Human
cucccuaggcgucccaucucgcuu

SEQ ID NO: 27760 - RNA, 24 nt, Human
uuuugaaaucguacucuucaaagg

SEQ ID NO: 27761 - RNA, 24 nt, Human
ucugcauuggcugcugggcauaug

SEQ ID NO: 27762 - RNA, 23 nt, Human
uucaugcccucuugcaucguuaa

SEQ ID NO: 27763 - RNA, 24 nt, Human
guccccuucagcaaggagggcggc

SEQ ID NO: 27764 - RNA, 24 nt, Human
acgcagccccagcccggccccccu

SEQ ID NO: 27765 - RNA, 24 nt, Human
ugcauuguuaucauuaaccagucu

SEQ ID NO: 27766 - RNA, 24 nt, Human
uauuagggauaauauucauuuagc

SEQ ID NO: 27767 - RNA, 24 nt, Human
uaaugggucucaaaauucugugac

SEQ ID NO: 27768 - RNA, 24 nt, Human
ccagugcagucucuggcaucucua

SEQ ID NO: 27769 - RNA, 24 nt, Human
uggcaguacgggcccugcaccggg

SEQ ID NO: 27770 - RNA, 24 nt, Human
gcgcaugguggcccggcccccuau

SEQ ID NO: 27771 - RNA, 24 nt, Human
uuggaaccgaucuuguaauaagaa

SEQ ID NO: 27772 - RNA, 23 nt, Human
ucauaggucacauuccacaagga

SEQ ID NO: 27773 - RNA, 24 nt, Human
cagcgguauucuggugcuuauggu

SEQ ID NO: 27774 - RNA, 22 nt, Human
accguggugaagggcauccggc

SEQ ID NO: 27775 - RNA, 24 nt, Human
uuugcagacuaugaagccuacaug

SEQ ID NO: 27776 - RNA, 24 nt, Human
ggcgccaacguggagauggccgag

SEQ ID NO: 27777 - RNA, 24 nt, Human
gggcaaguucuccagugaccggac

SEQ ID NO: 27778 - RNA, 24 nt, Human
ucagugccugauggaguggccggg

SEQ ID NO: 27779 - RNA, 24 nt, Human
uuugcaauugggucagauggucuu

SEQ ID NO: 27780 - RNA, 24 nt, Human
cuccucccaacugauauccaggcu

SEQ ID NO: 27781 - RNA, 24 nt, Human
uaccaugcaggccuuuuuggaccu

SEQ ID NO: 27782 - RNA, 24 nt, Human
uggcaggccaugggcccucaggau

SEQ ID NO: 27783 - RNA, 24 nt, Human
ggaguggugggcaauuagccuguc

SEQ ID NO: 27784 - RNA, 24 nt, Human
ugcuggaaucacuuuugccaaagg

SEQ ID NO: 27785 - RNA, 24 nt, Human
ugaagucauuuuccuuugugagag

SEQ ID NO: 27786 - RNA, 24 nt, Human
ugugcagaagaaauggaaggauuc

SEQ ID NO: 27787 - RNA, 24 nt, Human
uggcaauaucaaggaagggcaggc

SEQ ID NO: 27788 - RNA, 24 nt, Human
uucaaauuucuuucuuuuuuaauu

SEQ ID NO: 27789 - RNA, 24 nt, Human
ucaauuuuuauuuugguuuucuua

SEQ ID NO: 27790 - RNA, 24 nt, Human
ucuuuuggcuuaauuuagaauacu

SEQ ID NO: 27791 - RNA, 24 nt, Human
uucccaugccccaggcuccugcag

SEQ ID NO: 27792 - RNA, 24 nt, Human
uuccuagauaacaucuagucuuag

SEQ ID NO: 27793 - RNA, 24 nt, Human
ccuccaagcagugugaugucgacu

SEQ ID NO: 27794 - RNA, 24 nt, Human
uacauggagagccuccaguuucuc

SEQ ID NO: 27795 - RNA, 24 nt, Human
ccccgaaucagugacucggaaagu

SEQ ID NO: 27796 - RNA, 24 nt, Human
uggacagaaaaaaguuucacaguu

SEQ ID NO: 27797 - RNA, 19 nt, Human
uauaagaagacacuguauc

SEQ ID NO: 27798 - RNA, 24 nt, Human
cuuuagcuguaaacugaaaacaau

SEQ ID NO: 27799 - RNA, 24 nt, Human
uguauacauauuauauauaaauau

SEQ ID NO: 27800 - RNA, 24 nt, Human
cuggagcagguccaccggccccua

SEQ ID NO: 27801 - RNA, 24 nt, Human
ccaggccaaaaaagcucaacauuu

SEQ ID NO: 27802 - RNA, 18 nt, Human
caccgcaguucaguaugc

SEQ ID NO: 27803 - RNA, 22 nt, Human
cgccgggacagcagacugccgg

SEQ ID NO: 27804 - RNA, 24 nt, Human
ccggagcggagcgcgcccugcccu

SEQ ID NO: 27805 - RNA, 24 nt, Human
gaaggugcugacuuccuugggaga

SEQ ID NO: 27806 - RNA, 24 nt, Human
gugaagauuguccccaguggaugg

SEQ ID NO: 27807 - RNA, 24 nt, Human
uagcaaaggugcaucugucauccg

SEQ ID NO: 27808 - RNA, 24 nt, Human
uaccuggaccaaacaaaugggauu

SEQ ID NO: 27809 - RNA, 24 nt, Human
ucccuuuuccccucaaaggagaac

SEQ ID NO: 27810 - RNA, 24 nt, Human
uugggauuauagguaugagucucc

SEQ ID NO: 27811 - RNA, 24 nt, Human
uauagaacgucccggcccauacuu

SEQ ID NO: 27812 - RNA, 24 nt, Human
agguggguuucagggcgcugagaa

SEQ ID NO: 27813 - RNA, 22 nt, Human
uaaguguagacgcggcccaggc

SEQ ID NO: 27814 - RNA, 24 nt, Human
uugaucuugaagaaacugggcgug

SEQ ID NO: 27815 - RNA, 23 nt, Human
uccgugcgcguugcugcggccgu

SEQ ID NO: 27816 - RNA, 24 nt, Human
ucaagcuacuuccugagcuucucu

SEQ ID NO: 27817 - RNA, 19 nt, Human
ucugaagccuuguucacuu

SEQ ID NO: 27818 - RNA, 24 nt, Human
ugaagcugaggccauuuuuacaag

SEQ ID NO: 27819 - RNA, 23 nt, Human
uauuucgccccaggagagagagg

SEQ ID NO: 27820 - RNA, 24 nt, Human
gcgccuuugaaggggggggggggu

SEQ ID NO: 27821 - RNA, 19 nt, Human
guccuuuuucccccccccu

SEQ ID NO: 27822 - RNA, 24 nt, Human
uuuuugggaaaaaaacaaaauuuu

SEQ ID NO: 27823 - RNA, 24 nt, Human
ugugaugaugaagcaugguuacau

SEQ ID NO: 27824 - RNA, 24 nt, Human
ccgccgggaagcugguuuuacccg

SEQ ID NO: 27825 - RNA, 24 nt, Human
cgguauggagagcggcacacgccg

SEQ ID NO: 27826 - RNA, 19 nt, Human
uaucugagcuccugcugcc

SEQ ID NO: 27827 - RNA, 18 nt, Human
ugccaaggaaauuugggg

SEQ ID NO: 27828 - RNA, 24 nt, Human
guggagggcccuauggacacccca

SEQ ID NO: 27829 - RNA, 24 nt, Human
ugagaaugaccccaagaccuuuga

SEQ ID NO: 27830 - RNA, 24 nt, Human
cuuccaaucugaugggcauguuug

SEQ ID NO: 27831 - RNA, 22 nt, Human
guggagggcagcuuugucuaca

SEQ ID NO: 27832 - RNA, 20 nt, Human
uacaacguuuggggaccaau

SEQ ID NO: 27833 - RNA, 24 nt, Human
uucgaugguuaagaaaggggcgug

SEQ ID NO: 27834 - RNA, 24 nt, Human
ugcagcaguguguggagcaggggg

SEQ ID NO: 27835 - RNA, 24 nt, Human
ugagguugugcaauggguugugaa

SEQ ID NO: 27836 - RNA, 24 nt, Human
caagucccaggacccccggaaucc

SEQ ID NO: 27837 - RNA, 19 nt, Human
uccucggggccgcuugugg

SEQ ID NO: 27838 - RNA, 24 nt, Human
aggcggagcugcugaaccugagga

SEQ ID NO: 27839 - RNA, 23 nt, Human
uuggcauuuuacuagggagcagg

SEQ ID NO: 27840 - RNA, 24 nt, Human
acuaggaauucugucauccccagu

SEQ ID NO: 27841 - RNA, 24 nt, Human
uuuuugguuuugacaucauucauu

SEQ ID NO: 27842 - RNA, 24 nt, Human
ucagaacucauuuggugguggcaa

SEQ ID NO: 27843 - RNA, 24 nt, Human
uuagcuguggccacuguggauuuu

SEQ ID NO: 27844 - RNA, 24 nt, Human
aauauuauuacaagguuucagagg

SEQ ID NO: 27845 - RNA, 24 nt, Human
uaaguucugauuuauuuucuuacu

SEQ ID NO: 27846 - RNA, 24 nt, Human
uagaauucauuauuuaauuuaccu

SEQ ID NO: 27847 - RNA, 24 nt, Human
guggcccgcuauagucguuagccg

SEQ ID NO: 27848 - RNA, 24 nt, Human
acgcaauuccuuugucgcgaugcc

SEQ ID NO: 27849 - RNA, 24 nt, Human
agccugggcaauauagugagaccu

SEQ ID NO: 27850 - RNA, 24 nt, Human
ccaguguaggcugggagugguggc

SEQ ID NO: 27851 - RNA, 24 nt, Human
ucaaagaaccucuggguccauggg

SEQ ID NO: 27852 - RNA, 24 nt, Human
caggauccacaugcagcuugucac

SEQ ID NO: 27853 - RNA, 24 nt, Human
ucccaaggaagucagcaccuucuu

SEQ ID NO: 27854 - RNA, 24 nt, Human
cgggagcaccagcucgcuaucaag

SEQ ID NO: 27855 - RNA, 24 nt, Human
uggcuaaagaaggaaaacuccauu

SEQ ID NO: 27856 - RNA, 24 nt, Human
uucccuggagguaagcggcccuca

SEQ ID NO: 27857 - RNA, 24 nt, Human
ucucgcuauguugaugaggcuggu

SEQ ID NO: 27858 - RNA, 24 nt, Human
aguggaacguugguacccuuggau

SEQ ID NO: 27859 - RNA, 24 nt, Human
uaccuuacagugcuacauuaucuc

SEQ ID NO: 27860 - RNA, 24 nt, Human
ugaacguuggacccuuggauuugc

SEQ ID NO: 27861 - RNA, 24 nt, Human
uaagcuccaccauuaccccugaag

SEQ ID NO: 27862 - RNA, 24 nt, Human
cauuaaagcuguggauagcuuggu

SEQ ID NO: 27863 - RNA, 24 nt, Human
uugaucuugaagaaacugggcgug

SEQ ID NO: 27864 - RNA, 24 nt, Human
uuccaguuggugaggagcuguugg

SEQ ID NO: 27865 - RNA, 24 nt, Human
guagaguuuucuucaggcuuaaag

SEQ ID NO: 27866 - RNA, 24 nt, Human
uauggcaagucacuuugacagaca

SEQ ID NO: 27867 - RNA, 24 nt, Human
uacaccacucccaagaagaauaag

SEQ ID NO: 27868 - RNA, 24 nt, Human
uuaaugcaguauguucuuuuuauu

SEQ ID NO: 27869 - RNA, 24 nt, Human
cagcaucagucuuaguuuguauag

SEQ ID NO: 27870 - RNA, 24 nt, Human
uauggcaagucacuuugacagaca

SEQ ID NO: 27871 - RNA, 24 nt, Human
ugagaauggcaaaauuagucgccu

SEQ ID NO: 27872 - RNA, 24 nt, Human
uacaccacucccaagaagaauaag

SEQ ID NO: 27873 - RNA, 24 nt, Human
aggaaggagauauagugaagagga

SEQ ID NO: 27874 - RNA, 24 nt, Human
guagaguuuucuuuaggcuuaaag

SEQ ID NO: 27875 - RNA, 24 nt, Human
aagccagcacuauccuuggggaca

SEQ ID NO: 27876 - RNA, 24 nt, Human
uauuuugaggguggaaaauuaaaa

SEQ ID NO: 27877 - RNA, 24 nt, Human
uaaggaauugagcgcagaaaaguu

SEQ ID NO: 27878 - RNA, 24 nt, Human
aaggaaccauggccaacugugagc

SEQ ID NO: 27879 - RNA, 24 nt, Human
ugaaugacaggagggcagaccaca

SEQ ID NO: 27880 - RNA, 24 nt, Human
ucaggccugaccaacaguugugug

SEQ ID NO: 27881 - RNA, 24 nt, Human
uuuuauuuauuuuuuuuuuggguc

SEQ ID NO: 27882 - RNA, 24 nt, Human
ugugcauacuuaaagcucaguaca

SEQ ID NO: 27883 - RNA, 24 nt, Human
uugcugaaucuauaguugcuuccu

SEQ ID NO: 27884 - RNA, 24 nt, Human
acuugcagagagaguuuucuacug

SEQ ID NO: 27885 - RNA, 24 nt, Human
ucggaacugaacaguggaauucca

SEQ ID NO: 27886 - RNA, 24 nt, Human
acagaacaaagggcgagcucuaaa

SEQ ID NO: 27887 - RNA, 24 nt, Human
agaccggagcacuggccaguggag

SEQ ID NO: 27888 - RNA, 24 nt, Human
uggcugcaaggacccggcccaggg

SEQ ID NO: 27889 - RNA, 24 nt, Human
ugggcagaaacugcaggggcccca

SEQ ID NO: 27890 - RNA, 24 nt, Human
augcuguucgacgacaccaagugu

SEQ ID NO: 27891 - RNA, 24 nt, Human
cauuccagacaggacaaggaccau

SEQ ID NO: 27892 - RNA, 24 nt, Human
ucagccccccaacagcuuccucag

SEQ ID NO: 27893 - RNA, 24 nt, Human
guuccuguaaacauccaucgcagc

SEQ ID NO: 27894 - RNA, 24 nt, Human
ccuuuaguggaacucuucuccuca

SEQ ID NO: 27895 - RNA, 24 nt, Human
guacagcaagcacugacagugagu

SEQ ID NO: 27896 - RNA, 24 nt, Human
uauggcaagucacuuugacagaca

SEQ ID NO: 27897 - RNA, 24 nt, Human
uacaccacucccaagaagaauaag

SEQ ID NO: 27898 - RNA, 24 nt, Human
augcagccuaaaaggugguugaaa

SEQ ID NO: 27899 - RNA, 24 nt, Human
ugccaguucccccuggugaaccau

SEQ ID NO: 27900 - RNA, 24 nt, Human
agaccuggaauccaaccgcacaau

SEQ ID NO: 27901 - RNA, 24 nt, Human
ucugcaggagugcaaugcuauggc

SEQ ID NO: 27902 - RNA, 23 nt, Human
uuccagaggaggagcagggaucu

SEQ ID NO: 27903 - RNA, 24 nt, Human
caugaggccagccgugccucccag

SEQ ID NO: 27904 - RNA, 21 nt, Human
uggguguggacgucuaugacc

SEQ ID NO: 27905 - RNA, 21 nt, Human
aaguauguaaugauuuaauua

SEQ ID NO: 27906 - RNA, 24 nt, Human
uuaaaacugcaagaaaaugcuaca

SEQ ID NO: 27907 - RNA, 24 nt, Human
ugugguggcgacuggcgcgaccca

SEQ ID NO: 27908 - RNA, 24 nt, Human
caagaucgugcgcggggaccagcc

SEQ ID NO: 27909 - RNA, 18 nt, Human
ugaaagcauucaggucug

SEQ ID NO: 27910 - RNA, 24 nt, Human
ugcuuggagagaccccgcagagcc

SEQ ID NO: 27911 - RNA, 24 nt, Human
ucuggcaggaagcauccagggccc

SEQ ID NO: 27912 - RNA, 24 nt, Human
caggguuucaccauguuggccagg

SEQ ID NO: 27913 - RNA, 24 nt, Human
ccuugcccacagcccuuccagcug

SEQ ID NO: 27914 - RNA, 24 nt, Human
uuuuguauaacuuuuauucuuaga

SEQ ID NO: 27915 - RNA, 24 nt, Human
acaguccaaaugaaguuaaagugg

SEQ ID NO: 27916 - RNA, 24 nt, Human
aggcagcgcgcccggcucccgcgc

SEQ ID NO: 27917 - RNA, 24 nt, Human
uggaagcgacggcccguacaaaga

SEQ ID NO: 27918 - RNA, 24 nt, Human
uuccuggucggguccagugugaaa

SEQ ID NO: 27919 - RNA, 24 nt, Human
ucuccagugaacuguuuuagaaaa

SEQ ID NO: 27920 - RNA, 24 nt, Human
uugcuucuacuuuugaggcgcuuc

SEQ ID NO: 27921 - RNA, 24 nt, Human
uagcaacagaaaugggccccacag

SEQ ID NO: 27922 - RNA, 24 nt, Human
gugcggcggcgcaaggggucagca

SEQ ID NO: 27923 - RNA, 24 nt, Human
ugcauuguuaucauuaaccagucu

SEQ ID NO: 27924 - RNA, 24 nt, Human
uaaugggucucaaaauucugugac

SEQ ID NO: 27925 - RNA, 24 nt, Human
aaccagcgcguuucucaccggcuu

SEQ ID NO: 27926 - RNA, 21 nt, Human
ugaccaggguacggcaggcgc

SEQ ID NO: 27927 - RNA, 22 nt, Human
ucacuuccggaucggggucgac

SEQ ID NO: 27928 - RNA, 24 nt, Human
aagcggcagcggaggcggcgggcc

SEQ ID NO: 27929 - RNA, 24 nt, Human
uggcuuaguacaaaaauccauagu

SEQ ID NO: 27930 - RNA, 24 nt, Human
caagguguuuuuauugaggucuca

SEQ ID NO: 27931 - RNA, 24 nt, Human
uucaagcugacagagaagcugacg

SEQ ID NO: 27932 - RNA, 21 nt, Human
aagcuggucuccacacagugc

SEQ ID NO: 27933 - RNA, 24 nt, Human
ucagagcaacggcccaagucuggg

SEQ ID NO: 27934 - RNA, 24 nt, Human
ucagugugcaaaagugcuuugaag

SEQ ID NO: 27935 - RNA, 24 nt, Human
uugguacuugagucaaagacgaca

SEQ ID NO: 27936 - RNA, 24 nt, Human
caccauaggaguugccaucagaga

SEQ ID NO: 27937 - RNA, 24 nt, Human
uaccccaguccacgguguucuggc

SEQ ID NO: 27938 - RNA, 24 nt, Human
uggggucaugccgaacacccauga

SEQ ID NO: 27939 - RNA, 24 nt, Human
uggaagacagcuacgggcagcagu

SEQ ID NO: 27940 - RNA, 24 nt, Human
uugaucuugaagaaacugggcgug

SEQ ID NO: 27941 - RNA, 24 nt, Human
aggaaggagauauagugaagagga

SEQ ID NO: 27942 - RNA, 24 nt, Human
uagcuuggugccaauuggucgugg

SEQ ID NO: 27943 - RNA, 24 nt, Human
guagaguuuucuucaggcuuaaag

SEQ ID NO: 27944 - RNA, 24 nt, Human
ccugucuaaccucuucuguggagu

SEQ ID NO: 27945 - RNA, 18 nt, Human
uggcaugguuccugacgg

SEQ ID NO: 27946 - RNA, 24 nt, Human
ucugugguuggggcagccuggggc

SEQ ID NO: 27947 - RNA, 24 nt, Human
uuuguagcuccggccccgccguuc

SEQ ID NO: 27948 - RNA, 24 nt, Human
aggcuguggccaucuacggcauca

SEQ ID NO: 27949 - RNA, 24 nt, Human
cugcggccguugaguaguuuucaa

SEQ ID NO: 27950 - RNA, 24 nt, Human
cagcagcuccaagaaggaaccaag

SEQ ID NO: 27951 - RNA, 24 nt, Human
gacacauuacggcaggcaaggaca

SEQ ID NO: 27952 - RNA, 24 nt, Human
uaacuuagcuaagcccuuugcaca

SEQ ID NO: 27953 - RNA, 24 nt, Human
ucuuuauucauuuauuuauuuauu

SEQ ID NO: 27954 - RNA, 24 nt, Human
aaucaaguucaccgaaaaucagug

SEQ ID NO: 27955 - RNA, 24 nt, Human
ugugauaaauugauuaauguuaga

SEQ ID NO: 27956 - RNA, 24 nt, Human
agacuggaaucaugagcaacaaug

SEQ ID NO: 27957 - RNA, 24 nt, Human
acuggcacguagugggcggaucgc

SEQ ID NO: 27958 - RNA, 24 nt, Human
uucaaaguuauuuuuuagucgcug

SEQ ID NO: 27959 - RNA, 24 nt, Human
uaagguccagguugauucacucca

SEQ ID NO: 27960 - RNA, 24 nt, Human
auaucauuuaaacgaaugagcaau

SEQ ID NO: 27961 - RNA, 24 nt, Human
uucaauaauuaacucuagcacgua

SEQ ID NO: 27962 - RNA, 24 nt, Human
uugccagguuauaaaaaugagggc

SEQ ID NO: 27963 - RNA, 23 nt, Human
aacacuucuugcuaccagggaug

SEQ ID NO: 27964 - RNA, 24 nt, Human
ucaaacggaacacaacccacucuc

SEQ ID NO: 27965 - RNA, 24 nt, Human
uauaaagauauauguguaagguuu

SEQ ID NO: 27966 - RNA, 24 nt, Human
uuaacaaaauuucuguagucaaau

SEQ ID NO: 27967 - RNA, 24 nt, Human
aucaaguuucuuuuuuauuuuuuu

SEQ ID NO: 27968 - RNA, 24 nt, Human
accaguaggucagccaucuggaaa

SEQ ID NO: 27969 - RNA, 24 nt, Human
gggauuggucauauagguggacag

SEQ ID NO: 27970 - RNA, 24 nt, Human
acccuuacaaggcaauuuuguggg

SEQ ID NO: 27971 - RNA, 24 nt, Human
ugcauuguuaucauuaaccagucu

SEQ ID NO: 27972 - RNA, 24 nt, Human
uaaugggucucaaaauucugugac

SEQ ID NO: 27973 - RNA, 24 nt, Human
uauuagggauaauauucauuuagc

SEQ ID NO: 27974 - RNA, 24 nt, Human
uugcugaaucuauaguugcuuccu

SEQ ID NO: 27975 - RNA, 24 nt, Human
acuugcagagagaguuuucuacug

SEQ ID NO: 27976 - RNA, 24 nt, Human
ucggaacugaacaguggaauucca

SEQ ID NO: 27977 - RNA, 24 nt, Human
gcuuuuuuuuccuccacgauuaaa

SEQ ID NO: 27978 - RNA, 24 nt, Human
ugguauaaaauauguagaguauaa

SEQ ID NO: 27979 - RNA, 24 nt, Human
agagugagugggauuuaugaguua

SEQ ID NO: 27980 - RNA, 24 nt, Human
accagucuguacaaaccuuacagc

SEQ ID NO: 27981 - RNA, 24 nt, Human
uauugcaaauacuuaaaauucuua

SEQ ID NO: 27982 - RNA, 24 nt, Human
uaaaugguguugacaccaacuucu

SEQ ID NO: 27983 - RNA, 24 nt, Human
uagauggcuucuuucugauuaugu

SEQ ID NO: 27984 - RNA, 24 nt, Human
uaauauuaagccugauauucuuau

SEQ ID NO: 27985 - RNA, 21 nt, Human
caguguaccagaacauaugua

SEQ ID NO: 27986 - RNA, 24 nt, Human
cucguucaauuucuauaacauuua

SEQ ID NO: 27987 - RNA, 24 nt, Human
uuuaauaugacuucuucaauugga

SEQ ID NO: 27988 - RNA, 24 nt, Human
cuuaaaauguuauuugauaaauuu

SEQ ID NO: 27989 - RNA, 24 nt, Human
uuaguggauuuggcuguuacuauu

SEQ ID NO: 27990 - RNA, 24 nt, Human
aguaaucuuuuguaacaagccuca

SEQ ID NO: 27991 - RNA, 24 nt, Human
uuagcaaagguuggaggugucuug

SEQ ID NO: 27992 - RNA, 24 nt, Human
cuggaagugcaaaugguguguuug

SEQ ID NO: 27993 - RNA, 24 nt, Human
ucaguguggucaguguuaccaucc

SEQ ID NO: 27994 - RNA, 24 nt, Human
ucuguaauccucuauucguggcga

SEQ ID NO: 27995 - RNA, 24 nt, Human
ugacugagaaggcaccuuggaacu

SEQ ID NO: 27996 - RNA, 24 nt, Human
ucucacugcgcuggcaccuggggc

SEQ ID NO: 27997 - RNA, 24 nt, Human
cuccagggggguggcacuggcagu

SEQ ID NO: 27998 - RNA, 24 nt, Human
uggaaguauuauagaaaaagaagg

SEQ ID NO: 27999 - RNA, 24 nt, Human
aagcagcugcccagcccgcccuuc

SEQ ID NO: 28000 - RNA, 24 nt, Human
ucaaaaaaggaaagaaaaauaggc

SEQ ID NO: 28001 - RNA, 24 nt, Human
ucugcaauuugguauaaauguuag

SEQ ID NO: 28002 - RNA, 21 nt, Human
gaggugccagucaugcugacg

SEQ ID NO: 28003 - RNA, 24 nt, Human
uacaccacucccaagaagaauaag

SEQ ID NO: 28004 - RNA, 24 nt, Human
uauggcaagucacuuugacagaca

SEQ ID NO: 28005 - RNA, 24 nt, Human
ugagaauggcaaaauuagucgccu

SEQ ID NO: 28006 - RNA, 24 nt, Human
uacaccacucccaagaagaauaag

SEQ ID NO: 28007 - RNA, 17 nt, Human
uauccgaccuucaggcc

SEQ ID NO: 28008 - RNA, 24 nt, Human
uucaaguugauguugacgaugaca

SEQ ID NO: 28009 - RNA, 24 nt, Human
gagguggcugacgaggacaagcag

SEQ ID NO: 28010 - RNA, 24 nt, Human
ccagccgaacuuccauccgcagcu

SEQ ID NO: 28011 - RNA, 24 nt, Human
ugggaguaucuuuucuaccugugg

SEQ ID NO: 28012 - RNA, 24 nt, Human
uaugugaugaaaaaguauagcuuu

SEQ ID NO: 28013 - RNA, 24 nt, Human
ucuugguuaugacaaagucauuac

SEQ ID NO: 28014 - RNA, 24 nt, Human
ugacaugacagcacggacgggcga

SEQ ID NO: 28015 - RNA, 24 nt, Human
ugguauguacggagccaccgggac

SEQ ID NO: 28016 - RNA, 24 nt, Human
aggcggcggcgcccccggcccgag

SEQ ID NO: 28017 - RNA, 24 nt, Human
aagcagaaagggaagagaagcgag

SEQ ID NO: 28018 - RNA, 24 nt, Human
uucccaugccccaggcuccugcag

SEQ ID NO: 28019 - RNA, 24 nt, Human
cagcuugcuucccuggcaguggag

SEQ ID NO: 28020 - RNA, 24 nt, Human
uggcucaggaaggauucagccugg

SEQ ID NO: 28021 - RNA, 24 nt, Human
aacagcuuccagagccgaaaacca

SEQ ID NO: 28022 - RNA, 24 nt, Human
uuccccuauaauaggaaacaagca

SEQ ID NO: 28023 - RNA, 24 nt, Human
auaaagcuguuuaagaaaaauguu

SEQ ID NO: 28024 - RNA, 24 nt, Human
uagccgguucugauccacguugca

SEQ ID NO: 28025 - RNA, 24 nt, Human
ucugcaggcccaggacagugggcu

SEQ ID NO: 28026 - RNA, 24 nt, Human
ucccuguggcucugaauuuuuauu

SEQ ID NO: 28027 - RNA, 24 nt, Human
ugagauggcccagucuugauacag

SEQ ID NO: 28028 - RNA, 24 nt, Human
ugcauuguuaucauuaaccagucu

SEQ ID NO: 28029 - RNA, 24 nt, Human
uauuagggauaauauucauuuagc

SEQ ID NO: 28030 - RNA, 24 nt, Human
uuuaacuuuuuuaaugggucucaa

SEQ ID NO: 28031 - RNA, 24 nt, Human
ucacaaccacggcccuggaggagc

SEQ ID NO: 28032 - RNA, 24 nt, Human
ccuccuucccaggcucuggggcag

SEQ ID NO: 28033 - RNA, 24 nt, Human
agguaguaaacuccccaggugggc

SEQ ID NO: 28034 - RNA, 24 nt, Human
ugacccgugagugugcugcuggag

SEQ ID NO: 28035 - RNA, 24 nt, Human
ucgcaggaccuugugcugacagac

SEQ ID NO: 28036 - RNA, 24 nt, Human
ugcaagcuuucauacugacuacua

SEQ ID NO: 28037 - RNA, 17 nt, Human
uguggcagcgauggcgc

SEQ ID NO: 28038 - RNA, 24 nt, Human
gggccggggcgggcccgaggccuc

SEQ ID NO: 28039 - RNA, 24 nt, Human
ugaggucaggaaaggggaaggacg

SEQ ID NO: 28040 - RNA, 20 nt, Human
uagaacaggaaggacucaug

SEQ ID NO: 28041 - RNA, 24 nt, Human
ccugucugcucuccucuaacuagg

SEQ ID NO: 28042 - RNA, 24 nt, Human
cagcggccucuagcuccgucuccc

SEQ ID NO: 28043 - RNA, 24 nt, Human
ucugacagugaaaagcagcaacaa

SEQ ID NO: 28044 - RNA, 24 nt, Human
aacccauugccugugcucuccggg

SEQ ID NO: 28045 - RNA, 24 nt, Human
uguaagacguuaaaguguugcuua

SEQ ID NO: 28046 - RNA, 24 nt, Human
uacuugaauagcuugguuaaauga

SEQ ID NO: 28047 - RNA, 23 nt, Human
uaccacacaaaggcauuggcugc

SEQ ID NO: 28048 - RNA, 24 nt, Human
ucugcacgacgcacuggcccagga

SEQ ID NO: 28049 - RNA, 24 nt, Human
ucugagguugccaucagccagggc

SEQ ID NO: 28050 - RNA, 24 nt, Human
cucacauauauauaaaaaugaacu

SEQ ID NO: 28051 - RNA, 24 nt, Human
uggaaggcugaagcggguagauca

SEQ ID NO: 28052 - RNA, 21 nt, Human
ucaaauccugugcugcuguuc

SEQ ID NO: 28053 - RNA, 24 nt, Human
uacagcauguuguccagagccaac

SEQ ID NO: 28054 - RNA, 24 nt, Human
uugacuuugagcaggaggcaguug

SEQ ID NO: 28055 - RNA, 24 nt, Human
gcagcagcagccugcuccccgcac

SEQ ID NO: 28056 - RNA, 24 nt, Human
ugcauuguuaucauuaaccagucu

SEQ ID NO: 28057 - RNA, 24 nt, Human
uauuagggauaauauucauuuagc

SEQ ID NO: 28058 - RNA, 24 nt, Human
aggcuccgggcuguuccacuuucu

SEQ ID NO: 28059 - RNA, 24 nt, Human
ugugcagaagaaauggaaggauuc

SEQ ID NO: 28060 - RNA, 24 nt, Human
uaucaaggaagggcaggcgugaug

SEQ ID NO: 28061 - RNA, 24 nt, Human
uucaaauuucuuucuuuuuuaauu

SEQ ID NO: 28062 - RNA, 24 nt, Human
ucaauuuuuauuuugguuuucuua

SEQ ID NO: 28063 - RNA, 24 nt, Human
uauauuaccaauagcugauuuuuu

SEQ ID NO: 28064 - RNA, 24 nt, Human
aaugauacuucucuuuuuuugcug

SEQ ID NO: 28065 - RNA, 24 nt, Human
gcuauaauaaauaaacuucaacac

SEQ ID NO: 28066 - RNA, 24 nt, Human
ugagagcagauuggcugaugcccc

SEQ ID NO: 28067 - RNA, 24 nt, Human
uggaggaggaugacgaugaugagc

SEQ ID NO: 28068 - RNA, 24 nt, Human
caggacacaauguggcugaccugg

SEQ ID NO: 28069 - RNA, 24 nt, Human
ugaagaggaaucaggaccuggcuc

SEQ ID NO: 28070 - RNA, 18 nt, Human
uccacaagaacuguacaa

SEQ ID NO: 28071 - RNA, 24 nt, Human
uaccagacccuuggccuccugaca

SEQ ID NO: 28072 - RNA, 24 nt, Human
uggaaagagcagaauggcuuccuc

SEQ ID NO: 28073 - RNA, 24 nt, Human
uauuuuauugcaggaggugggggu

SEQ ID NO: 28074 - RNA, 24 nt, Human
ugacuaggcagacuguaucccuga

SEQ ID NO: 28075 - RNA, 24 nt, Human
uuuugagugacauuuauuuagcag

SEQ ID NO: 28076 - RNA, 24 nt, Human
uccacuggcgaaagaugccuuucu

SEQ ID NO: 28077 - RNA, 24 nt, Human
uaguucagauugaucuuaggucaa

SEQ ID NO: 28078 - RNA, 24 nt, Human
uaaugcuauugauggaaagggucc

SEQ ID NO: 28079 - RNA, 24 nt, Human
ccagcgagguaccuguguccuggg

SEQ ID NO: 28080 - RNA, 24 nt, Human
ccugaaguacaagaaaggaggugu

SEQ ID NO: 28081 - RNA, 24 nt, Human
uccaggugcugggccccaagccgg

SEQ ID NO: 28082 - RNA, 24 nt, Human
ugaugagaaccccuucgcccaggg

SEQ ID NO: 28083 - RNA, 24 nt, Human
ccguggcgcgcauccucugacucu

SEQ ID NO: 28084 - RNA, 24 nt, Human
agcccuuggaggcucagagcagcu

SEQ ID NO: 28085 - RNA, 24 nt, Human
ggguauggggagggagggagccag

SEQ ID NO: 28086 - RNA, 24 nt, Human
ugccuccuucugugccucuaccau

SEQ ID NO: 28087 - RNA, 24 nt, Human
agaauaaagggggggauggacagg

SEQ ID NO: 28088 - RNA, 24 nt, Human
ccugccgccggaauccugaagccc

SEQ ID NO: 28089 - RNA, 24 nt, Human
acccagugccugugacuuugagua

SEQ ID NO: 28090 - RNA, 24 nt, Human
augaaugucucccccaaaacuggc

SEQ ID NO: 28091 - RNA, 24 nt, Human
uuuguuguuuucucuucccuaccu

SEQ ID NO: 28092 - RNA, 24 nt, Human
cugucagaaugcugugugggaagg

SEQ ID NO: 28093 - RNA, 24 nt, Human
aggcauggccauucagaggguacu

SEQ ID NO: 28094 - RNA, 24 nt, Human
uaauuccacagaagugaauaaagc

SEQ ID NO: 28095 - RNA, 24 nt, Human
uuggaggaccagaugggugggagc

SEQ ID NO: 28096 - RNA, 24 nt, Human
aagcacacugucuuucucagcguu

SEQ ID NO: 28097 - RNA, 24 nt, Human
uuuguuccuaaagccaccucucag

SEQ ID NO: 28098 - RNA, 24 nt, Human
uauuguguaaaguuuauagaagua

SEQ ID NO: 28099 - RNA, 24 nt, Human
uuaaaagucuugaaacgauguuug

SEQ ID NO: 28100 - RNA, 24 nt, Human
uggaacccuuucacuucaaacuca

SEQ ID NO: 28101 - RNA, 24 nt, Human
cccaugaugaauagcaagaaagua

SEQ ID NO: 28102 - RNA, 24 nt, Human
ggacugggaaggaggggugugggc

SEQ ID NO: 28103 - RNA, 24 nt, Human
ugguauggaugcccuccuggguuu

SEQ ID NO: 28104 - RNA, 24 nt, Human
gggaggcucuggccggcguagucc

SEQ ID NO: 28105 - RNA, 24 nt, Human
uggaauuacaggugugagccacug

SEQ ID NO: 28106 - RNA, 24 nt, Human
cugggcccagagccagccacacuc

SEQ ID NO: 28107 - RNA, 24 nt, Human
agguggguaguggggaggagagcu

SEQ ID NO: 28108 - RNA, 24 nt, Human
uuaucuuguguuuagagguuguuu

SEQ ID NO: 28109 - RNA, 24 nt, Human
uucccaugccucccucucauugga

SEQ ID NO: 28110 - RNA, 24 nt, Human
uucgagcaaguuuuggugcuacug

SEQ ID NO: 28111 - RNA, 24 nt, Human
ugcuagaauuauugagauauuuau

SEQ ID NO: 28112 - RNA, 24 nt, Human
ucagcagcgugccacauggccacc

SEQ ID NO: 28113 - RNA, 24 nt, Human
aggaaacaugggcagaggggccca

SEQ ID NO: 28114 - RNA, 24 nt, Human
uuuuuugucccuuuuauauccuau

SEQ ID NO: 28115 - RNA, 24 nt, Human
uagaacuauaaaacagguuuccau

SEQ ID NO: 28116 - RNA, 24 nt, Human
ucagggauggucacaguccagcca

SEQ ID NO: 28117 - RNA, 24 nt, Human
ugcccuggcccuugaccccguccu

SEQ ID NO: 28118 - RNA, 24 nt, Human
aagcugccagcccacugccuccau

SEQ ID NO: 28119 - RNA, 24 nt, Human
cugggcccugggcgcuccauuuug

SEQ ID NO: 28120 - RNA, 24 nt, Human
uaggagcagcugcaauugcaccug

SEQ ID NO: 28121 - RNA, 24 nt, Human
acuggccucugcuguuccugucuu

SEQ ID NO: 28122 - RNA, 24 nt, Human
ccaguccaggccuucguacagccc

SEQ ID NO: 28123 - RNA, 24 nt, Human
uauacugggcaccauuugagcacg

SEQ ID NO: 28124 - RNA, 24 nt, Human
ugacaugcuguucuggaagagcaa

SEQ ID NO: 28125 - RNA, 24 nt, Human
uaacaggaacaaggauuccgugcu

SEQ ID NO: 28126 - RNA, 24 nt, Human
uucgugcagucugcaaauuuuccc

SEQ ID NO: 28127 - RNA, 20 nt, Human
uaaaacaacauaauaccaua

SEQ ID NO: 28128 - RNA, 24 nt, Human
uucguauuauugucuuuauuucgu

SEQ ID NO: 28129 - RNA, 24 nt, Human
uauaaagcauucagaaaacauuuu

SEQ ID NO: 28130 - RNA, 22 nt, Human
uucaaucgaugcuuuacaugca

SEQ ID NO: 28131 - RNA, 24 nt, Human
acuuugggugguguagauacagau

SEQ ID NO: 28132 - RNA, 18 nt, Human
uauuuaggaacauuccau

SEQ ID NO: 28133 - RNA, 24 nt, Human
ucguacgugcugugcuacgacccg

SEQ ID NO: 28134 - RNA, 24 nt, Human
ugaagaacaucaccuaagagauua

SEQ ID NO: 28135 - RNA, 24 nt, Human
uucauuggaggguugagcuuugaa

SEQ ID NO: 28136 - RNA, 23 nt, Human
cagcgcaggaauaucucuggaag

SEQ ID NO: 28137 - RNA, 24 nt, Human
uguguuuguagacuuggaacccac

SEQ ID NO: 28138 - RNA, 24 nt, Human
uugcaugaaacauucuuaacguga

SEQ ID NO: 28139 - RNA, 24 nt, Human
aggcagguuaaguuccuugaugcc

SEQ ID NO: 28140 - RNA, 24 nt, Human
ugagcccagaacgaaggaacacgg

SEQ ID NO: 28141 - RNA, 24 nt, Human
ugggcuagcugcgugcggagccug

SEQ ID NO: 28142 - RNA, 24 nt, Human
ugcgauggcacgccagugcuggag

SEQ ID NO: 28143 - RNA, 24 nt, Human
aaggagcugucggugcugucgcuc

SEQ ID NO: 28144 - RNA, 24 nt, Human
cuccugcuucuacacacagccgca

SEQ ID NO: 28145 - RNA, 24 nt, Human
cucuccuccccacccaagaagaag

SEQ ID NO: 28146 - RNA, 24 nt, Human
uaguguacuuuguggccuccguag

SEQ ID NO: 28147 - RNA, 21 nt, Human
ccgcugccgccccacgugcgc

SEQ ID NO: 28148 - RNA, 24 nt, Human
uggcaggagcagcuccccuccugg

SEQ ID NO: 28149 - RNA, 24 nt, Human
ggacugggccgucgcacacgccag

SEQ ID NO: 28150 - RNA, 24 nt, Human
ugaaaaguuggaagauuuugcauc

SEQ ID NO: 28151 - RNA, 23 nt, Human
uaaaaucucugcaaugcaaaaga

SEQ ID NO: 28152 - RNA, 24 nt, Human
ugagaauguccgagaauucuucuu

SEQ ID NO: 28153 - RNA, 24 nt, Human
cgggggccgcaccuuggaggagau

SEQ ID NO: 28154 - RNA, 24 nt, Human
uuuacagauccggccaggaccccg

SEQ ID NO: 28155 - RNA, 24 nt, Human
cgaggcagcagcugccggcguucu

SEQ ID NO: 28156 - RNA, 24 nt, Human
uugaaccaaaugggauuuguuugg

SEQ ID NO: 28157 - RNA, 24 nt, Human
caaccgggcauuugguuacgugug

SEQ ID NO: 28158 - RNA, 24 nt, Human
uauggcaagucacuuugacagaca

SEQ ID NO: 28159 - RNA, 24 nt, Human
ugagaauggcaaaauuagucgccu

SEQ ID NO: 28160 - RNA, 24 nt, Human
uacaccacucccaagaagaauaag

SEQ ID NO: 28161 - RNA, 24 nt, Human
aagcugcagaguguggaauacgug

SEQ ID NO: 28162 - RNA, 24 nt, Human
aaggagcuaggcaaguucacuggc

SEQ ID NO: 28163 - RNA, 24 nt, Human
gagcggcucaagacccacagugcc

SEQ ID NO: 28164 - RNA, 17 nt, Human
gugcauguggcugugga

SEQ ID NO: 28165 - RNA, 24 nt, Human
uuauagggucaccuucgagucacc

SEQ ID NO: 28166 - RNA, 24 nt, Human
ccagcacucgaagcugcuggacuu

SEQ ID NO: 28167 - RNA, 24 nt, Human
caccaggugguagaagacggcuac

SEQ ID NO: 28168 - RNA, 19 nt, Human
uaacccacccgcauuccgc

SEQ ID NO: 28169 - RNA, 24 nt, Human
auugugcucuuuccagauccucaa

SEQ ID NO: 28170 - RNA, 24 nt, Human
ucgaccacagaugcucugaacguu

SEQ ID NO: 28171 - RNA, 24 nt, Human
uguuauggggauaagcuggugagg

SEQ ID NO: 28172 - RNA, 24 nt, Human
uccacggggaguuuguuguaaagg

SEQ ID NO: 28173 - RNA, 24 nt, Human
acggagcaugaaaagacuuucccc

SEQ ID NO: 28174 - RNA, 24 nt, Human
uucgaugggggcugggagggcuuu

SEQ ID NO: 28175 - RNA, 24 nt, Human
ugccaagcuuuuuuuugcaaccgg

SEQ ID NO: 28176 - RNA, 24 nt, Human
gagaaggguguuuggaugggcccu

SEQ ID NO: 28177 - RNA, 24 nt, Human
ugagaaugaccccaagaccuuuga

SEQ ID NO: 28178 - RNA, 20 nt, Human
uaggguuuuuucuuuccuug

SEQ ID NO: 28179 - RNA, 24 nt, Human
uaagucacauggcuucugucuugg

SEQ ID NO: 28180 - RNA, 24 nt, Human
uccgcagagaacagacuuggcccu

SEQ ID NO: 28181 - RNA, 24 nt, Human
uuguauuguucuuuuugcaucgug

SEQ ID NO: 28182 - RNA, 24 nt, Human
ugcgauugacuggggcgacuuugg

SEQ ID NO: 28183 - RNA, 24 nt, Human
ggcugguggacagaaggcacugca

SEQ ID NO: 28184 - RNA, 24 nt, Human
ucagagcucugcugcagggccugc

SEQ ID NO: 28185 - RNA, 24 nt, Human
uguggccgacccgccugcgacgcu

SEQ ID NO: 28186 - RNA, 24 nt, Human
uguaugcagcggcugugcugcugg

SEQ ID NO: 28187 - RNA, 24 nt, Human
uaaguaggagaaaccaaaccauaa

SEQ ID NO: 28188 - RNA, 24 nt, Human
aagcaggaaagaauggucuugaug

SEQ ID NO: 28189 - RNA, 24 nt, Human
uggccugaugauccacagcggaga

SEQ ID NO: 28190 - RNA, 24 nt, Human
uacuguacuuuaagacauggaauu

SEQ ID NO: 28191 - RNA, 24 nt, Human
agaccauagcaggauuuaacauuu

SEQ ID NO: 28192 - RNA, 24 nt, Human
uauuagguagcccuugggaagaga

SEQ ID NO: 28193 - RNA, 24 nt, Human
uacuugggcgugcgggagaaagaa

SEQ ID NO: 28194 - RNA, 19 nt, Human
cguuggguguuagucugca

SEQ ID NO: 28195 - RNA, 24 nt, Human
uacaagaucacugacucugaggac

SEQ ID NO: 28196 - RNA, 21 nt, Human
caccgagucgccucacucgag

SEQ ID NO: 28197 - RNA, 24 nt, Human
ccaccacccgggccugccgccuga

SEQ ID NO: 28198 - RNA, 24 nt, Human
ccccccagagccggcgcccucucc

SEQ ID NO: 28199 - RNA, 24 nt, Human
cuccugcagcccagucccuacgug

SEQ ID NO: 28200 - RNA, 24 nt, Human
ugcagugcacaugauccggaaggu

SEQ ID NO: 28201 - RNA, 24 nt, Human
acagaagaauugaaaaucggaugg

SEQ ID NO: 28202 - RNA, 24 nt, Human
agauacugacagaugagagccuca

SEQ ID NO: 28203 - RNA, 24 nt, Human
uguucuggagcuguuggacaaaua

SEQ ID NO: 28204 - RNA, 24 nt, Human
aaccagaaaguaagguguucuacu

SEQ ID NO: 28205 - RNA, 24 nt, Human
acccugagcuuccugcggcgcguc

SEQ ID NO: 28206 - RNA, 24 nt, Human
ugucauguggagcccuguccagag

SEQ ID NO: 28207 - RNA, 24 nt, Human
agugcagaccucugacccuggagu

SEQ ID NO: 28208 - RNA, 24 nt, Human
aagcagauuguguggaaugguccu

SEQ ID NO: 28209 - RNA, 24 nt, Human
ugaaagcagcaagaaguaugcuga

SEQ ID NO: 28210 - RNA, 24 nt, Human
ucaguaaugcguucaggaguccac

SEQ ID NO: 28211 - RNA, 24 nt, Human
acgcuuugucaugcuucuucagua

SEQ ID NO: 28212 - RNA, 22 nt, Human
cgagaucugcgucaacgugcuc

SEQ ID NO: 28213 - RNA, 24 nt, Human
uacaccacucccaagaagaauaag

SEQ ID NO: 28214 - RNA, 24 nt, Human
caagagagacggggccggaggggu

SEQ ID NO: 28215 - RNA, 24 nt, Human
cccgcuccguggccuccuuccucc

SEQ ID NO: 28216 - RNA, 24 nt, Human
cgucacaggugcagcucguggguu

SEQ ID NO: 28217 - RNA, 24 nt, Human
uuuuaauuuauuugugaggagucg

SEQ ID NO: 28218 - RNA, 21 nt, Human
uggggagugggguggggggag

SEQ ID NO: 28219 - RNA, 24 nt, Human
acccuuuaaacagagagaguuuau

SEQ ID NO: 28220 - RNA, 24 nt, Human
ccccgguuuucuuuguuccaaggg

SEQ ID NO: 28221 - RNA, 24 nt, Human
aacauuuuuuuuuuuccccggggg

SEQ ID NO: 28222 - RNA, 24 nt, Human
uuucggggagagggagacccuuuu

SEQ ID NO: 28223 - RNA, 24 nt, Human
uuaguagagaugggguuucaacuu

SEQ ID NO: 28224 - RNA, 22 nt, Human
uccaccuuucugaaacugcagu

SEQ ID NO: 28225 - RNA, 24 nt, Human
aagcagcccaucuguguuccauca

SEQ ID NO: 28226 - RNA, 24 nt, Human
cguccagacuacggaccugucugg

SEQ ID NO: 28227 - RNA, 24 nt, Human
ucacuuugagggcaagccuucucg

SEQ ID NO: 28228 - RNA, 21 nt, Human
ucuugguucuuugcugucugg

SEQ ID NO: 28229 - RNA, 24 nt, Human
uuccguuucugagacuuugccagc

SEQ ID NO: 28230 - RNA, 24 nt, Human
ugaauauuguuuucauacugcugu

SEQ ID NO: 28231 - RNA, 24 nt, Human
uucaacuaccuagaaauaguuacc

SEQ ID NO: 28232 - RNA, 23 nt, Human
uacagcacauaccucucagaauc

SEQ ID NO: 28233 - RNA, 24 nt, Human
ugagugaaccuagagacaaaugcu

SEQ ID NO: 28234 - RNA, 24 nt, Human
acuaaaaaagagacauagaagccg

SEQ ID NO: 28235 - RNA, 20 nt, Human
ugagaugccauaagcugugg

SEQ ID NO: 28236 - RNA, 24 nt, Human
uaaugggucucaaaauucugugac

SEQ ID NO: 28237 - RNA, 24 nt, Human
uggcagcgggauggggaggaccag

SEQ ID NO: 28238 - RNA, 24 nt, Human
ugugauguggcaggaggaaacaga

SEQ ID NO: 28239 - RNA, 24 nt, Human
ucacccugagaugggagccaucuu

SEQ ID NO: 28240 - RNA, 23 nt, Human
acgcugcagcgcacggacccccc

SEQ ID NO: 28241 - RNA, 24 nt, Human
agcucuuuagcccacagcagauuc

SEQ ID NO: 28242 - RNA, 24 nt, Human
ugagagagacagaagguaaaauug

SEQ ID NO: 28243 - RNA, 24 nt, Human
uuuaaagucagcaagaaugaggag

SEQ ID NO: 28244 - RNA, 24 nt, Human
ugggaugaacaguuugacaaggag

SEQ ID NO: 28245 - RNA, 24 nt, Human
cugaagccagacaaagagaucgug

SEQ ID NO: 28246 - RNA, 24 nt, Human
uaggaacuacaucauggacuucca

SEQ ID NO: 28247 - RNA, 24 nt, Human
ugcaagcaaguauucaagaaggug

SEQ ID NO: 28248 - RNA, 24 nt, Human
uacuggaagauguuggucaacgag

SEQ ID NO: 28249 - RNA, 24 nt, Human
aggaaggagauauagugaagagga

SEQ ID NO: 28250 - RNA, 24 nt, Human
ugagugcaugucugguacagauaa

SEQ ID NO: 28251 - RNA, 24 nt, Human
uccuugaccucugacccgccgacc

SEQ ID NO: 28252 - RNA, 24 nt, Human
uguccaagcugagcccugaggagg

SEQ ID NO: 28253 - RNA, 24 nt, Human
uucaugacaucuacccagcuggau

SEQ ID NO: 28254 - RNA, 21 nt, Human
ugacauggagguggagcugcu

SEQ ID NO: 28255 - RNA, 18 nt, Human
uaagauccuaaagggccc

SEQ ID NO: 28256 - RNA, 24 nt, Human
aggcaagucuucugaaaaccugug

SEQ ID NO: 28257 - RNA, 24 nt, Human
ugcuaaaacagaauaccauaaauu

SEQ ID NO: 28258 - RNA, 24 nt, Human
ugggauuacaggcaugagccaccg

SEQ ID NO: 28259 - RNA, 24 nt, Human
uaauuugcagcuuaauguauaacu

SEQ ID NO: 28260 - RNA, 24 nt, Human
uuaaaggauuguugugauuuggcg

SEQ ID NO: 28261 - RNA, 24 nt, Human
ucauuggguaaucucaucugcuuu

SEQ ID NO: 28262 - RNA, 24 nt, Human
ugaggaccagugcacugaguacau

SEQ ID NO: 28263 - RNA, 24 nt, Human
aggcagcggcuguggcagcccggc

SEQ ID NO: 28264 - RNA, 24 nt, Human
uguuacugugucuaucuaggaaaa

SEQ ID NO: 28265 - RNA, 24 nt, Human
ugggaagugaggagcgccucuucc

SEQ ID NO: 28266 - RNA, 24 nt, Human
uugaacagcgccuggaggagcagu

SEQ ID NO: 28267 - RNA, 24 nt, Human
cgacagcagcggggcuggguguuc

SEQ ID NO: 28268 - RNA, 24 nt, Human
uggcagagcuugaggaugcggucc

SEQ ID NO: 28269 - RNA, 24 nt, Human
gccacgcugcccagcaggccggcu

SEQ ID NO: 28270 - RNA, 24 nt, Human
uggcagagcuugaggaugcggucc

SEQ ID NO: 28271 - RNA, 24 nt, Human
uguauaaauaaaacauuuuuuaau

SEQ ID NO: 28272 - RNA, 24 nt, Human
aggaaggagauauagugaagagga

SEQ ID NO: 28273 - RNA, 24 nt, Human
ugccucgauaguggcagcuuucaa

SEQ ID NO: 28274 - RNA, 24 nt, Human
uagcucuauguuggcgucguauga

SEQ ID NO: 28275 - RNA, 24 nt, Human
cacuguacuuaaacuccagaaaga

SEQ ID NO: 28276 - RNA, 24 nt, Human
uaauguuuauacugggcuagauuu

SEQ ID NO: 28277 - RNA, 24 nt, Human
ggagacuggggcuccggcagaggc

SEQ ID NO: 28278 - RNA, 20 nt, Human
uagaacaggaaggacucaug

SEQ ID NO: 28279 - RNA, 24 nt, Human
uagcaacagaaaugggccccacag

SEQ ID NO: 28280 - RNA, 24 nt, Human
uaacucuuuucacucucaucuucc

SEQ ID NO: 28281 - RNA, 24 nt, Human
uggguugaacaguuugaauuggcu

SEQ ID NO: 28282 - RNA, 24 nt, Human
ucugcauuggcugcugggcauaug

SEQ ID NO: 28283 - RNA, 23 nt, Human
uucaugccucuuugcaucguuaa

SEQ ID NO: 28284 - RNA, 24 nt, Human
cacuucuuggcuaccuugcaguuc

SEQ ID NO: 28285 - RNA, 24 nt, Human
aagcagcuuauuguagguguggcg

SEQ ID NO: 28286 - RNA, 22 nt, Human
uagcaugccucuuaauuuuucu

SEQ ID NO: 28287 - RNA, 24 nt, Human
aacagguaaccacuugagaggaug

SEQ ID NO: 28288 - RNA, 24 nt, Human
ugcauuguuaucauuaaccagucu

SEQ ID NO: 28289 - RNA, 24 nt, Human
uaaugggucucaaaauucugugac

SEQ ID NO: 28290 - RNA, 24 nt, Human
uauuagggauaauauucauuuagc

SEQ ID NO: 28291 - RNA, 24 nt, Human
uauaaaacuuugauaguuacauug

SEQ ID NO: 28292 - RNA, 22 nt, Human
uagcaugccucuuaauuuuucu

SEQ ID NO: 28293 - RNA, 24 nt, Human
aacagguaaccacuugagaggaug

SEQ ID NO: 28294 - RNA, 24 nt, Human
ucccuguaauaagauaggcacaac

SEQ ID NO: 28295 - RNA, 24 nt, Human
ugagaccguacucagagugaggau

SEQ ID NO: 28296 - RNA, 24 nt, Human
uaucucagucucugcauaagagga

SEQ ID NO: 28297 - RNA, 24 nt, Human
aaggagcccagaucauaaugcagu

SEQ ID NO: 28298 - RNA, 19 nt, Human
cuccucaguacguuuuggc

SEQ ID NO: 28299 - RNA, 24 nt, Human
aacuguguuuggaacugguauaaa

SEQ ID NO: 28300 - RNA, 24 nt, Human
ucccuguaaugcccgucuuuccug

SEQ ID NO: 28301 - RNA, 24 nt, Human
ugaggaguuccggaaccccaaggc

SEQ ID NO: 28302 - RNA, 18 nt, Human
ugugucuuuaccaaggga

SEQ ID NO: 28303 - RNA, 24 nt, Human
uaaugggucucaaaauucugugac

SEQ ID NO: 28304 - RNA, 24 nt, Human
uucaaauuucuuucuuuuuuaauu

SEQ ID NO: 28305 - RNA, 24 nt, Human
uccaguaucccaaacuuucuaguc

SEQ ID NO: 28306 - RNA, 24 nt, Human
ugucaaggaggaguuuaaggccuu

SEQ ID NO: 28307 - RNA, 24 nt, Human
ucacuggggugccauuguucagcu

SEQ ID NO: 28308 - RNA, 24 nt, Human
uggcaggacuuggaggcugucccu

SEQ ID NO: 28309 - RNA, 24 nt, Human
uuugccccuggucccucccaaauc

SEQ ID NO: 28310 - RNA, 24 nt, Human
auggugcugugucaagaaggaccu

SEQ ID NO: 28311 - RNA, 24 nt, Human
uaguauguaaauguuacuugaauc

SEQ ID NO: 28312 - RNA, 24 nt, Human
uacucuguggauauccccuuggac

SEQ ID NO: 28313 - RNA, 24 nt, Human
uacaagacaggcaagaacaagugg

SEQ ID NO: 28314 - RNA, 24 nt, Human
gaggauccaagcuuacguacgcgu

SEQ ID NO: 28315 - RNA, 24 nt, Human
ccgccuucugagcaguuuugauuu

SEQ ID NO: 28316 - RNA, 24 nt, Human
uaaggaaagcagauguuuaauuuc

SEQ ID NO: 28317 - RNA, 24 nt, Human
uauauuaaauucuauauaaaauau

SEQ ID NO: 28318 - RNA, 24 nt, Human
uucaaguacugcauaaaagcugau

SEQ ID NO: 28319 - RNA, 24 nt, Human
guugcauuugcugagucuguucuc

SEQ ID NO: 28320 - RNA, 23 nt, Human
ugagagcuuucucuggagugaug

SEQ ID NO: 28321 - RNA, 17 nt, Human
cauggcccagaaucugg

SEQ ID NO: 28322 - RNA, 24 nt, Human
ugacaggaugcagaaggagaucac

SEQ ID NO: 28323 - RNA, 24 nt, Human
uagcauuugcugcauggguuaauu

SEQ ID NO: 28324 - RNA, 24 nt, Human
uggaaucuugcggcauccacgaga

SEQ ID NO: 28325 - RNA, 24 nt, Human
ucaccaguaucuuuuuucugaagg

SEQ ID NO: 28326 - RNA, 24 nt, Human
ugacgagggugcacacgccgcugg

SEQ ID NO: 28327 - RNA, 24 nt, Human
ugacgugcuggaacucagagaggu

SEQ ID NO: 28328 - RNA, 24 nt, Human
uccgucaucaucaaagucaaagau

SEQ ID NO: 28329 - RNA, 24 nt, Human
uguguccucgcccucucccgugag

SEQ ID NO: 28330 - RNA, 24 nt, Human
ugacuggucuaguuuuaaugccag

SEQ ID NO: 28331 - RNA, 24 nt, Human
uguccagguguucagaccucuugg

SEQ ID NO: 28332 - RNA, 24 nt, Human
caccauguuggccaggcuggucuc

SEQ ID NO: 28333 - RNA, 24 nt, Human
uauuuuauuuuuuggauggagucu

SEQ ID NO: 28334 - RNA, 24 nt, Human
ucacucaguuuuuaauaaaggcca

SEQ ID NO: 28335 - RNA, 24 nt, Human
uguucagaaauugaggcuaacauu

SEQ ID NO: 28336 - RNA, 24 nt, Human
ucccugacuguccgcaggccuggg

SEQ ID NO: 28337 - RNA, 24 nt, Human
uucaccugcagccgggcaugagcc

SEQ ID NO: 28338 - RNA, 24 nt, Human
aggguuccuguccaguuucccccu

SEQ ID NO: 28339 - RNA, 24 nt, Human
gggcagcgccuggcgggcggcccg

SEQ ID NO: 28340 - RNA, 24 nt, Human
uugaucagccugcacacaguggag

SEQ ID NO: 28341 - RNA, 24 nt, Human
aaaucauugcaguaccucaaccug

SEQ ID NO: 28342 - RNA, 23 nt, Human
caccaccuugcaucuucgagaca

SEQ ID NO: 28343 - RNA, 24 nt, Human
uccacacaaauaggcacacauaua

SEQ ID NO: 28344 - RNA, 24 nt, Human
cagcaguaggggcugggcuuccag

SEQ ID NO: 28345 - RNA, 18 nt, Human
uaugcaaggcacugcgca

SEQ ID NO: 28346 - RNA, 24 nt, Human
uacuugaauagcuugguuaaauga

SEQ ID NO: 28347 - RNA, 24 nt, Human
ugggaugacugcauccuuuuuuuu

SEQ ID NO: 28348 - RNA, 24 nt, Human
gccccgagcccggcccccuccacc

SEQ ID NO: 28349 - RNA, 24 nt, Human
cagcagcauucaccaagcccuacu

SEQ ID NO: 28350 - RNA, 24 nt, Human
agguguuguaggcauagucacaga

SEQ ID NO: 28351 - RNA, 24 nt, Human
cugcgccccaaggcuuugacccag

SEQ ID NO: 28352 - RNA, 24 nt, Human
ucugcuguguauguaugccaagga

SEQ ID NO: 28353 - RNA, 20 nt, Human
ugccauagccaguaacaucu

SEQ ID NO: 28354 - RNA, 24 nt, Human
gcagaugcucugugugauuuguac

SEQ ID NO: 28355 - RNA, 24 nt, Human
cacagcacaauuuuacuccaggga

SEQ ID NO: 28356 - RNA, 23 nt, Human
aaagaguauuugaacuuguugac

SEQ ID NO: 28357 - RNA, 23 nt, Human
agaguccuaucuggggucuccuc

SEQ ID NO: 28358 - RNA, 19 nt, Human
uauagcccaagaggguuuu

SEQ ID NO: 28359 - RNA, 24 nt, Human
uguacuguaaaccuuugaccugug

SEQ ID NO: 28360 - RNA, 24 nt, Human
ugaaugacaacuuuauuuuucuua

SEQ ID NO: 28361 - RNA, 24 nt, Human
guaaugcuaugauggaaagggucc

SEQ ID NO: 28362 - RNA, 24 nt, Human
aggaaggagauauagugaagagga

SEQ ID NO: 28363 - RNA, 24 nt, Human
uauuacaauucacuggccgucguu

SEQ ID NO: 28364 - RNA, 24 nt, Human
guguauggggcagaacauaggccu

SEQ ID NO: 28365 - RNA, 24 nt, Human
uauuacaauucacuggccgucguu

SEQ ID NO: 28366 - RNA, 24 nt, Human
uggcguaauagcgaagaggcccgc

SEQ ID NO: 28367 - RNA, 24 nt, Human
augguccacaaaggcggaagauga

SEQ ID NO: 28368 - RNA, 24 nt, Human
agagaccuuuaaacagcagaagag

SEQ ID NO: 28369 - RNA, 24 nt, Human
augaacacugauugaauaccuaug

SEQ ID NO: 28370 - RNA, 24 nt, Human
uuccaguacuccugcccuuccuuc

SEQ ID NO: 28371 - RNA, 24 nt, Human
cuggguccccucugcaagcucaga

SEQ ID NO: 28372 - RNA, 21 nt, Human
ucucugggagauacucagucc

SEQ ID NO: 28373 - RNA, 24 nt, Human
uccugcgccugcccuuuccgcgcc

SEQ ID NO: 28374 - RNA, 24 nt, Human
accccgauccugcugcgccgccuu

SEQ ID NO: 28375 - RNA, 24 nt, Human
uccccgaggccgcgccgggagcuc

SEQ ID NO: 28376 - RNA, 24 nt, Human
ugccuggucaaucaguccucggga

SEQ ID NO: 28377 - RNA, 24 nt, Human
uugaacgguuauccauagcauuuu

SEQ ID NO: 28378 - RNA, 19 nt, Human
uaagauggcugauuuacua

SEQ ID NO: 28379 - RNA, 24 nt, Human
agaaaacauuguguguauaagauc

SEQ ID NO: 28380 - RNA, 24 nt, Human
gagcggccgcgaagaggugacacc

SEQ ID NO: 28381 - RNA, 24 nt, Human
uagaauguaaaaagucauuuuaga

SEQ ID NO: 28382 - RNA, 24 nt, Human
uuagaauuggaauuacuuccuuac

SEQ ID NO: 28383 - RNA, 24 nt, Human
ugugccaaggagggaccacaggag

SEQ ID NO: 28384 - RNA, 19 nt, Human
caacaggaggaacgggugg

SEQ ID NO: 28385 - RNA, 24 nt, Human
uuucacaccaugcuguccaggcug

SEQ ID NO: 28386 - RNA, 24 nt, Human
cuucaagaugaccaagcgggagga

SEQ ID NO: 28387 - RNA, 24 nt, Human
aagcacaaggcgccugucaucgac

SEQ ID NO: 28388 - RNA, 24 nt, Human
acgcugcuguaucucccugugggc

SEQ ID NO: 28389 - RNA, 24 nt, Human
ugaaugggucuaguccaguuuauu

SEQ ID NO: 28390 - RNA, 24 nt, Human
cugccgggaaagagcuccugaagu

SEQ ID NO: 28391 - RNA, 24 nt, Human
uagcucccccagcggcuucucugu

SEQ ID NO: 28392 - RNA, 24 nt, Human
caacugauuaccauuuacagugau

SEQ ID NO: 28393 - RNA, 24 nt, Human
aguguucgacuacaguuauagaga

SEQ ID NO: 28394 - RNA, 17 nt, Human
uuaaaguugucugcaau

SEQ ID NO: 28395 - RNA, 24 nt, Human
cagccgcccgccgcccgccgggga

SEQ ID NO: 28396 - RNA, 24 nt, Human
ugccggagcccgcgcgcccagccg

SEQ ID NO: 28397 - RNA, 24 nt, Human
cucugcaggggaggaagcaccugg

SEQ ID NO: 28398 - RNA, 24 nt, Human
uauggcaagucacuuugacagaca

SEQ ID NO: 28399 - RNA, 24 nt, Human
ugagaauggcaaaauuagucgccu

SEQ ID NO: 28400 - RNA, 24 nt, Human
uacaccacucccaagaagaauaag

SEQ ID NO: 28401 - RNA, 24 nt, Human
ugaguucauugaacuauuucuuaa

SEQ ID NO: 28402 - RNA, 24 nt, Human
ccuugaguuccuucauggcaauga

SEQ ID NO: 28403 - RNA, 24 nt, Human
gggcacugaagaugaugcgaccca

SEQ ID NO: 28404 - RNA, 24 nt, Human
uacagugcuuguaaaagguuugaa

SEQ ID NO: 28405 - RNA, 22 nt, Human
ucccuaaagaaaaagaugaaaa

SEQ ID NO: 28406 - RNA, 22 nt, Human
cgccgggacagcagacugccgg

SEQ ID NO: 28407 - RNA, 24 nt, Human
cagccuggacuuaccaccacuaaa

SEQ ID NO: 28408 - RNA, 24 nt, Human
ggcccggagcggagcgcgcccugc

SEQ ID NO: 28409 - RNA, 24 nt, Human
ucacucagcgggggacacaggaag

SEQ ID NO: 28410 - RNA, 24 nt, Human
uccacaacaacuucggagugcucu

SEQ ID NO: 28411 - RNA, 24 nt, Human
uuucacagaacaggaaaccucccc

SEQ ID NO: 28412 - RNA, 19 nt, Human
gggaaugggaaugaaggga

SEQ ID NO: 28413 - RNA, 24 nt, Human
uuuuuuguuucuaaaagauguuua

SEQ ID NO: 28414 - RNA, 24 nt, Human
gaugguaugaaaacuuauuaggaa

SEQ ID NO: 28415 - RNA, 19 nt, Human
cuucaagaagggcuggucc

SEQ ID NO: 28416 - RNA, 24 nt, Human
ggaaauggucuuaaaagauacugc

SEQ ID NO: 28417 - RNA, 24 nt, Human
cuugcacugcaccccagacaguuu

SEQ ID NO: 28418 - RNA, 24 nt, Human
acgcaaccagggccggcugggagc

SEQ ID NO: 28419 - RNA, 24 nt, Human
cugacacacggagagucacaggcu

SEQ ID NO: 28420 - RNA, 24 nt, Human
uaggucaggagccuugggauggcu

SEQ ID NO: 28421 - RNA, 24 nt, Human
ggauaaaagcggucgaagaagccg

SEQ ID NO: 28422 - RNA, 24 nt, Human
cuggccgugugggacccgggcccg

SEQ ID NO: 28423 - RNA, 24 nt, Human
uuccauugacauucuuagcacagc

SEQ ID NO: 28424 - RNA, 24 nt, Human
uauaaugaggcacggcuuauugca

SEQ ID NO: 28425 - RNA, 24 nt, Human
gucccaaaggcagaaggcaguauu

SEQ ID NO: 28426 - RNA, 24 nt, Human
ugauaaguugccauuguucaccuu

SEQ ID NO: 28427 - RNA, 24 nt, Human
uaucaaaagauauauuucaggauc

SEQ ID NO: 28428 - RNA, 24 nt, Human
aggaaagugcuccauagaaaguaa

SEQ ID NO: 28429 - RNA, 24 nt, Human
uuuaagaucacucuaggaucccca

SEQ ID NO: 28430 - RNA, 24 nt, Human
uggcuucauuauuaacauccugua

SEQ ID NO: 28431 - RNA, 24 nt, Human
cagcagaaaaauuaacacaguuga

SEQ ID NO: 28432 - RNA, 24 nt, Human
aucaugcuuuuaugcaagacuugg

SEQ ID NO: 28433 - RNA, 24 nt, Human
aggggcuccugaaagaccuacugc

SEQ ID NO: 28434 - RNA, 20 nt, Human
ucccucugggaucugagccu

SEQ ID NO: 28435 - RNA, 24 nt, Human
uuccgcacaucuuugaaucgcucc

SEQ ID NO: 28436 - RNA, 24 nt, Human
ucggaucagcuucuugggggccuc

SEQ ID NO: 28437 - RNA, 24 nt, Human
uggaaaacgugagaggucagacuc

SEQ ID NO: 28438 - RNA, 24 nt, Human
agagauggcagcagcagcugcagg

SEQ ID NO: 28439 - RNA, 24 nt, Human
cagcugcagcugagacugcggcgg

SEQ ID NO: 28440 - RNA, 24 nt, Human
uugaaugcaucuuguuuauaacug

SEQ ID NO: 28441 - RNA, 24 nt, Human
augcagcaggugucacagaaggac

SEQ ID NO: 28442 - RNA, 24 nt, Human
cuuuuccaaaauuaugacaacaaa

SEQ ID NO: 28443 - RNA, 24 nt, Human
uuuguacuguucuuuggucuguug

SEQ ID NO: 28444 - RNA, 22 nt, Human
uacauucugaaauauuuacaga

SEQ ID NO: 28445 - RNA, 24 nt, Human
uugaaaguuuuuaauauuuauuga

SEQ ID NO: 28446 - RNA, 24 nt, Human
uguacaggcagaugaaaccagguc

SEQ ID NO: 28447 - RNA, 24 nt, Human
uguauggauauguguaaauguuau

SEQ ID NO: 28448 - RNA, 24 nt, Human
ugacugugcgggguggucugucug

SEQ ID NO: 28449 - RNA, 24 nt, Human
ucccugaaccucugccagaagcuc

SEQ ID NO: 28450 - RNA, 23 nt, Human
uuuguggucucuuccacuuucuc

SEQ ID NO: 28451 - RNA, 24 nt, Human
cucccuggccucauccuagagagg

SEQ ID NO: 28452 - RNA, 24 nt, Human
gcgccguggggugggugcuccugg

SEQ ID NO: 28453 - RNA, 24 nt, Human
uggaauauaguaguauggagacca

SEQ ID NO: 28454 - RNA, 24 nt, Human
uuagcaaauagagagaaauauaga

SEQ ID NO: 28455 - RNA, 17 nt, Human
cagcagggacuuuuauc

SEQ ID NO: 28456 - RNA, 24 nt, Human
ugaaagcuuuugaacagcugagaa

SEQ ID NO: 28457 - RNA, 18 nt, Human
ugccagguaggaagcccc

SEQ ID NO: 28458 - RNA, 24 nt, Human
ugugcagaagaaauggaaggauuc

SEQ ID NO: 28459 - RNA, 24 nt, Human
uaucaaggaagggcaggcgugaug

SEQ ID NO: 28460 - RNA, 24 nt, Human
uaagaguguugaaaaaaaaauuca

SEQ ID NO: 28461 - RNA, 24 nt, Human
uucaaauuucuuucuuuuuuaauu

SEQ ID NO: 28462 - RNA, 24 nt, Human
aguuuggauucugaaaacuaacug

SEQ ID NO: 28463 - RNA, 24 nt, Human
uugcauccucaaucacccaggccu

SEQ ID NO: 28464 - RNA, 18 nt, Human
cagcggcggcgcgaggag

SEQ ID NO: 28465 - RNA, 24 nt, Human
uagcaaaucgagucuuaaauaauc

SEQ ID NO: 28466 - RNA, 20 nt, Human
uaaggcgaggcggaauuaaa

SEQ ID NO: 28467 - RNA, 24 nt, Human
ucacaagggccggcacuucugcag

SEQ ID NO: 28468 - RNA, 18 nt, Human
aaacgggcuucacaaacc

SEQ ID NO: 28469 - RNA, 24 nt, Human
cuuuggaugacacccaccggcaac

SEQ ID NO: 28470 - RNA, 24 nt, Human
ugaucucguuggacugcguggcua

SEQ ID NO: 28471 - RNA, 24 nt, Human
uucuggguccggggcgaggggccc

SEQ ID NO: 28472 - RNA, 22 nt, Human
ucgcugccguucggugcgcagu

SEQ ID NO: 28473 - RNA, 24 nt, Human
ucccugaauaucugaacuucauua

SEQ ID NO: 28474 - RNA, 24 nt, Human
uuagaacucuuuacugaacuggcg

SEQ ID NO: 28475 - RNA, 24 nt, Human
uagcuuggugccaauaggucgugg

SEQ ID NO: 28476 - RNA, 24 nt, Human
uugaucuugaagaaacugggcgug

SEQ ID NO: 28477 - RNA, 23 nt, Human
uccgugcgcguugcugcggccgu

SEQ ID NO: 28478 - RNA, 24 nt, Human
aggaaggagauauagugaagagga

SEQ ID NO: 28479 - RNA, 24 nt, Human
uauguauacuuuuuucacuggcuu

SEQ ID NO: 28480 - RNA, 24 nt, Human
ccuaaggauaccuauuuucuuuau

SEQ ID NO: 28481 - RNA, 24 nt, Human
acaggccccaccacccaccacgac

SEQ ID NO: 28482 - RNA, 24 nt, Human
uggaaggaacaauuuaaaagcacu

SEQ ID NO: 28483 - RNA, 24 nt, Human
ucucacucugucaccuaggcugaa

SEQ ID NO: 28484 - RNA, 24 nt, Human
uuuacaguauggauagcuccuccu

SEQ ID NO: 28485 - RNA, 23 nt, Human
ucagggcgccuccucuccugugc

SEQ ID NO: 28486 - RNA, 24 nt, Human
uggccaggcuggucucgaacuccu

SEQ ID NO: 28487 - RNA, 24 nt, Human
aggcaugucacaagggcuggggcg

SEQ ID NO: 28488 - RNA, 24 nt, Human
agucuguggcgaccagaacacaga

SEQ ID NO: 28489 - RNA, 24 nt, Human
gggaagaucuaggagaagaggaag

SEQ ID NO: 28490 - RNA, 24 nt, Human
cuagggcgggguggggaggagggg

SEQ ID NO: 28491 - RNA, 24 nt, Human
ugagggcaaaauggguugacgcga

SEQ ID NO: 28492 - RNA, 24 nt, Human
uaacuaaaauuucagacagcgaug

SEQ ID NO: 28493 - RNA, 24 nt, Human
guccaguucacagacauuguggaa

SEQ ID NO: 28494 - RNA, 24 nt, Human
agcaggcgaguccaggaggggccg

SEQ ID NO: 28495 - RNA, 24 nt, Human
ugagggaaggacugcuggguuggc

SEQ ID NO: 28496 - RNA, 24 nt, Human
ugccuugucuccaggagguccgaa

SEQ ID NO: 28497 - RNA, 24 nt, Human
cagccccccugcacgcagcccgac

SEQ ID NO: 28498 - RNA, 24 nt, Human
ucccucggugacaucuugcccgcc

SEQ ID NO: 28499 - RNA, 24 nt, Human
uccaaagcaucguaaucaggagcc

SEQ ID NO: 28500 - RNA, 24 nt, Human
uucuucuuuuuguggcuguggaca

SEQ ID NO: 28501 - RNA, 24 nt, Human
uacacaacauacuuuuauguuucu

SEQ ID NO: 28502 - RNA, 22 nt, Human
uuuguccauuuguaauaugaga

SEQ ID NO: 28503 - RNA, 24 nt, Human
ugccugaagcuaaaaauauauacg

SEQ ID NO: 28504 - RNA, 23 nt, Human
aaaggaggauguucaggacucug

SEQ ID NO: 28505 - RNA, 24 nt, Human
uucucuguuuggaggcugcaccca

SEQ ID NO: 28506 - RNA, 24 nt, Human
ccacacaggcucauucucaacugg

SEQ ID NO: 28507 - RNA, 24 nt, Human
uuuucuguguagucuucauuaacg

SEQ ID NO: 28508 - RNA, 24 nt, Human
ugggggugggaagauggaauacug

SEQ ID NO: 28509 - RNA, 24 nt, Human
guucgugucuuuggcaucaacaaa

SEQ ID NO: 28510 - RNA, 24 nt, Human
ggcccaguccugcuaguggcaagu

SEQ ID NO: 28511 - RNA, 24 nt, Human
gggaaggcacugaaacagaggacu

SEQ ID NO: 28512 - RNA, 24 nt, Human
ucacugaugcauaaacuggucacc

SEQ ID NO: 28513 - RNA, 24 nt, Human
ucuacaaucuaagaaggauuucag

SEQ ID NO: 28514 - RNA, 24 nt, Human
uggcagcaggugccucucagcugg

SEQ ID NO: 28515 - RNA, 24 nt, Human
cagucggcgauccaccagguucug

SEQ ID NO: 28516 - RNA, 24 nt, Human
ucuugguacucacagauuucagcc

SEQ ID NO: 28517 - RNA, 24 nt, Human
uuaacagaccauugaaaaacagua

SEQ ID NO: 28518 - RNA, 24 nt, Human
acgcacggaccgacgggaagguuu

SEQ ID NO: 28519 - RNA, 24 nt, Human
gggcauuucuuggcaaauguaggg

SEQ ID NO: 28520 - RNA, 24 nt, Human
ggacagguguacagacauguucuu

SEQ ID NO: 28521 - RNA, 24 nt, Human
uauuugaaggcagaaaacacccua

SEQ ID NO: 28522 - RNA, 24 nt, Human
uaguggaggcuaaauuuaaauugu

SEQ ID NO: 28523 - RNA, 24 nt, Human
ugaaauugggauuggagacaggua

SEQ ID NO: 28524 - RNA, 24 nt, Human
auaaugauaaaaauagauguaucc

SEQ ID NO: 28525 - RNA, 24 nt, Human
ucccuggagcugagcccacccugg

SEQ ID NO: 28526 - RNA, 24 nt, Human
uaaaugcgcuugauggccucggcu

SEQ ID NO: 28527 - RNA, 24 nt, Human
uucaccuuuaucugaccaaaccgc

SEQ ID NO: 28528 - RNA, 24 nt, Human
ucuaucauaugugucaaauccaag

SEQ ID NO: 28529 - RNA, 24 nt, Human
gugcugggcccccccaggugaagc

SEQ ID NO: 28530 - RNA, 24 nt, Human
agggguccggugcugucgcgggaa

SEQ ID NO: 28531 - RNA, 24 nt, Human
uuaguauuauuuauuugacaacuc

SEQ ID NO: 28532 - RNA, 24 nt, Human
aaggugaacuugucacuugguaug

SEQ ID NO: 28533 - RNA, 24 nt, Human
ugguggucuugagcuuuuggccug

SEQ ID NO: 28534 - RNA, 24 nt, Human
ugaguugaaacucuuggaggaagc

SEQ ID NO: 28535 - RNA, 24 nt, Human
guuaucaggcacggaaucuaucuc

SEQ ID NO: 28536 - RNA, 24 nt, Human
aaggagcaugauaguaucuauuua

SEQ ID NO: 28537 - RNA, 24 nt, Human
cauuacuagcaacacuggaguggc

SEQ ID NO: 28538 - RNA, 22 nt, Human
uuuacugucuauaccauugaaa

SEQ ID NO: 28539 - RNA, 24 nt, Human
ugcauuguuaucauuaaccagucu

SEQ ID NO: 28540 - RNA, 24 nt, Human
uauuagggauaauauucauuuagc

SEQ ID NO: 28541 - RNA, 24 nt, Human
uaaugggucucaaaauucugugac

SEQ ID NO: 28542 - RNA, 24 nt, Human
uauuugguucaaaauauaaagggc

SEQ ID NO: 28543 - RNA, 24 nt, Human
uauaguuuagggaggcaaaaucaa

SEQ ID NO: 28544 - RNA, 24 nt, Human
ucgcaucaucagcaccaucacgag

SEQ ID NO: 28545 - RNA, 24 nt, Human
ucagcccuccccacccuagcucuc

SEQ ID NO: 28546 - RNA, 24 nt, Human
agaguugagucccgggucaggagu

SEQ ID NO: 28547 - RNA, 24 nt, Human
ugggacauaagcaaagauuuggug

SEQ ID NO: 28548 - RNA, 24 nt, Human
uuggucacugguccaggaaacagg

SEQ ID NO: 28549 - RNA, 24 nt, Human
uggguguauaacuacaguauuaau

SEQ ID NO: 28550 - RNA, 22 nt, Human
ugauacaaguucuggcauuggu

SEQ ID NO: 28551 - RNA, 24 nt, Human
uauuacacacggauguaagcauuu

SEQ ID NO: 28552 - RNA, 24 nt, Human
ggcccggggggaggcaucaaaguc

SEQ ID NO: 28553 - RNA, 24 nt, Human
aggcuucgcugggagcugagaaca

SEQ ID NO: 28554 - RNA, 24 nt, Human
ugaggccgcauguauauaagcaaa

SEQ ID NO: 28555 - RNA, 24 nt, Human
uaggaaauucuguugcgugcuaac

SEQ ID NO: 28556 - RNA, 24 nt, Human
uucauuuuauauauauauauauau

SEQ ID NO: 28557 - RNA, 24 nt, Human
uaaguugccuacaguauucagccc

SEQ ID NO: 28558 - RNA, 24 nt, Human
guugcaauggugagaucucaaaaa

SEQ ID NO: 28559 - RNA, 18 nt, Human
uguggaggaucaaggcug

SEQ ID NO: 28560 - RNA, 24 nt, Human
acuggauucggaaugugcugauuu

SEQ ID NO: 28561 - RNA, 24 nt, Human
uuuaaaaguuucuguaccaauauc

SEQ ID NO: 28562 - RNA, 24 nt, Human
uuggaugcauaucaaucugcuaag

SEQ ID NO: 28563 - RNA, 24 nt, Human
agcuugucacgccugugcacagcg

SEQ ID NO: 28564 - RNA, 24 nt, Human
gggcaggaguuaauauggccagaa

SEQ ID NO: 28565 - RNA, 24 nt, Human
uaaugggucucaaaauucugugac

SEQ ID NO: 28566 - RNA, 24 nt, Human
uaaugggucucaaaauucugugac

SEQ ID NO: 28567 - RNA, 24 nt, Human
uauuagggauaauauucauuuagc

SEQ ID NO: 28568 - RNA, 24 nt, Human
ugcauuguuaucauuaaccagucu

SEQ ID NO: 28569 - RNA, 24 nt, Human
uaaugggucucaaaauucugugac

SEQ ID NO: 28570 - RNA, 24 nt, Human
uauuagggauaauauucauuuagc

SEQ ID NO: 28571 - RNA, 24 nt, Human
uaaugggucucaaaauucugugac

SEQ ID NO: 28572 - RNA, 24 nt, Human
uauuagggauaauauucauuuagc

SEQ ID NO: 28573 - RNA, 22 nt, Human
uuccauggucaaaaaauggcag

SEQ ID NO: 28574 - RNA, 24 nt, Human
gaccagcaccauggcgguuggcaa

SEQ ID NO: 28575 - RNA, 18 nt, Human
acugaagacauuggggac

SEQ ID NO: 28576 - RNA, 24 nt, Human
caccaggcgaugaccucgcccccc

SEQ ID NO: 28577 - RNA, 24 nt, Human
uuggacggcggccggcugcggccu

SEQ ID NO: 28578 - RNA, 24 nt, Human
ucccugagaggcccgggcccgcag

SEQ ID NO: 28579 - RNA, 24 nt, Human
uagaggguuggauuuugauuugga

SEQ ID NO: 28580 - RNA, 24 nt, Human
uggaguuggauuuucagugacuuc

SEQ ID NO: 28581 - RNA, 24 nt, Human
ugcauuguuaucauuaaccagucu

SEQ ID NO: 28582 - RNA, 24 nt, Human
uaaugggucucaaaauucugugac

SEQ ID NO: 28583 - RNA, 24 nt, Human
uauuagggauaauauucauuuagc

SEQ ID NO: 28584 - RNA, 24 nt, Human
cuccuucccgugugagaagggcca

SEQ ID NO: 28585 - RNA, 24 nt, Human
ugccaagcacgcagaucccaugga

SEQ ID NO: 28586 - RNA, 24 nt, Human
ccuggaccaaaugagcugaagcug

SEQ ID NO: 28587 - RNA, 24 nt, Human
ugacaauacuugggaaccugaaga

SEQ ID NO: 28588 - RNA, 24 nt, Human
ugaaguguccucaaauguaaugcu

SEQ ID NO: 28589 - RNA, 17 nt, Human
ucugacagugaaucuga

SEQ ID NO: 28590 - RNA, 24 nt, Human
uuucucaggauuacugugguuucu

SEQ ID NO: 28591 - RNA, 24 nt, Human
uaccagucuaaucuugccuuaaau

SEQ ID NO: 28592 - RNA, 19 nt, Human
uggcuaguugggccacugc

SEQ ID NO: 28593 - RNA, 22 nt, Human
uggcaugaagaaggaauagagc

SEQ ID NO: 28594 - RNA, 24 nt, Human
uuuuugggaguuauuaauucuuua

SEQ ID NO: 28595 - RNA, 24 nt, Human
agcuggugcaggccugccgccugg

SEQ ID NO: 28596 - RNA, 24 nt, Human
gagcgugcggaggaccagcaggag

SEQ ID NO: 28597 - RNA, 24 nt, Human
ucgaaagggcuuggguucaaaaaa

SEQ ID NO: 28598 - RNA, 24 nt, Human
uggcaggaucagcauugaagaaug

SEQ ID NO: 28599 - RNA, 24 nt, Human
caagugccucucgagcgcuacgug

SEQ ID NO: 28600 - RNA, 24 nt, Human
gugaggcgccggggcccacugagu

SEQ ID NO: 28601 - RNA, 24 nt, Human
agucaagaaaaggaagaugaacuu

SEQ ID NO: 28602 - RNA, 24 nt, Human
uaaaucgagacuuggccaugaacc

SEQ ID NO: 28603 - RNA, 24 nt, Human
gggggugggugaggggcgaggcug

SEQ ID NO: 28604 - RNA, 20 nt, Human
accugcuggugaaccacuuc

SEQ ID NO: 28605 - RNA, 24 nt, Human
ugaaaucguccgcccucugccccg

SEQ ID NO: 28606 - RNA, 24 nt, Human
aaauaccauaccaucaaaugguca

SEQ ID NO: 28607 - RNA, 24 nt, Human
cugcaagaccucauucaaauugau

SEQ ID NO: 28608 - RNA, 24 nt, Human
gggaaaugguuccuuuccguuaag

SEQ ID NO: 28609 - RNA, 19 nt, Human
acaaagcaagagaagaagc

SEQ ID NO: 28610 - RNA, 21 nt, Human
cauuggacaggacauccagcc

SEQ ID NO: 28611 - RNA, 22 nt, Human
ucacuugggacaggaggucauc

SEQ ID NO: 28612 - RNA, 24 nt, Human
ccagagcggggucgccucugggcc

SEQ ID NO: 28613 - RNA, 24 nt, Human
caccugaaggugcuguaugacgcc

SEQ ID NO: 28614 - RNA, 24 nt, Human
guggaucuuucucagccugagccg

SEQ ID NO: 28615 - RNA, 24 nt, Human
ucuuugacaauaguagcuuacuaa

SEQ ID NO: 28616 - RNA, 24 nt, Human
uaacaaaauccguucucucucuuc

SEQ ID NO: 28617 - RNA, 24 nt, Human
ccagaaugggacauggguucaucu

SEQ ID NO: 28618 - RNA, 24 nt, Human
cuagugcacacgccuugcaagcga

SEQ ID NO: 28619 - RNA, 20 nt, Human
aaacacacccaccaccaaca

SEQ ID NO: 28620 - RNA, 24 nt, Human
aagcagaccucuccagggggaggu

SEQ ID NO: 28621 - RNA, 24 nt, Human
uucaacuagaaaggagcuaaagcc

SEQ ID NO: 28622 - RNA, 24 nt, Human
ucagacuaaaggaagaauuagaug

SEQ ID NO: 28623 - RNA, 24 nt, Human
ggaaaacaaaguacaaagguuacg

SEQ ID NO: 28624 - RNA, 24 nt, Human
uacccggguccgugggaaguuggc

SEQ ID NO: 28625 - RNA, 24 nt, Human
cugcagguugucagcgaugccggc

SEQ ID NO: 28626 - RNA, 24 nt, Human
uuccaaaguuuauacgggaagaca

SEQ ID NO: 28627 - RNA, 24 nt, Human
ucaaaucuccccaaauugauguau

SEQ ID NO: 28628 - RNA, 24 nt, Human
ugaagggcacaagguugggccugg

SEQ ID NO: 28629 - RNA, 24 nt, Human
cgcccuaaccccaaccccaacgug

SEQ ID NO: 28630 - RNA, 24 nt, Human
uggaagaagccgaggagggggagg

SEQ ID NO: 28631 - RNA, 24 nt, Human
cgaacacacaugcgcgacgcagcg

SEQ ID NO: 28632 - RNA, 24 nt, Human
ugcaguugcccuaaggaaaaauaa

SEQ ID NO: 28633 - RNA, 18 nt, Human
ugccuggggcccacugca

SEQ ID NO: 28634 - RNA, 24 nt, Human
acaggaucugacuggugggcacaa

SEQ ID NO: 28635 - RNA, 24 nt, Human
uaagaaaugcaguccaauuuuaua

SEQ ID NO: 28636 - RNA, 24 nt, Human
cauuuuacauaaaagggaaguauc

SEQ ID NO: 28637 - RNA, 24 nt, Human
ucuggcgccuccugcaggcguccc

SEQ ID NO: 28638 - RNA, 24 nt, Human
caugauggcgcggcugaggcacga

SEQ ID NO: 28639 - RNA, 24 nt, Human
cugacaguuggugagagggacgga

SEQ ID NO: 28640 - RNA, 24 nt, Human
uaaaaagcaguugggacuaagaua

SEQ ID NO: 28641 - RNA, 24 nt, Human
uucaccuugaucacggggcccuug

SEQ ID NO: 28642 - RNA, 24 nt, Human
ugaccaugcgcacgugaggcucug

SEQ ID NO: 28643 - RNA, 24 nt, Human
aggaaaccugcaaggcaaguucuc

SEQ ID NO: 28644 - RNA, 24 nt, Human
ugaaugucaaccaguuuuugcuuu

SEQ ID NO: 28645 - RNA, 23 nt, Human
cagcugguuuugggggugaaggg

SEQ ID NO: 28646 - RNA, 24 nt, Human
uccccuaagcuccagggcccaggg

SEQ ID NO: 28647 - RNA, 24 nt, Human
ugaccgcgcagaccaccucgccau

SEQ ID NO: 28648 - RNA, 24 nt, Human
aggcagucacagaacaggggcaug

SEQ ID NO: 28649 - RNA, 24 nt, Human
aaccagaaaguaagguguucuacu

SEQ ID NO: 28650 - RNA, 24 nt, Human
ccgcguucgcgcuuucgaccagag

SEQ ID NO: 28651 - RNA, 24 nt, Human
ugacaagugccguggguugggcuu

SEQ ID NO: 28652 - RNA, 24 nt, Human
cauuguaacgcaaggugccauucc

SEQ ID NO: 28653 - RNA, 24 nt, Human
uagcacacacacaugaggaacuuu

SEQ ID NO: 28654 - RNA, 24 nt, Human
ggucuagggugaggcauaggcauu

SEQ ID NO: 28655 - RNA, 24 nt, Human
uguuuuuuuuuuuuuuggaccgga

SEQ ID NO: 28656 - RNA, 24 nt, Human
cgagcagcgccacccgcccugggc

SEQ ID NO: 28657 - RNA, 24 nt, Human
uggagcccuggaugccccaccaug

SEQ ID NO: 28658 - RNA, 24 nt, Human
uuugauguuucugguccauggggu

SEQ ID NO: 28659 - RNA, 24 nt, Human
uggcugcaguguugcggaggccag

SEQ ID NO: 28660 - RNA, 24 nt, Human
ucagaaagguagcccugugucuuc

SEQ ID NO: 28661 - RNA, 24 nt, Human
aacgugaaaaaaaggauggaauaa

SEQ ID NO: 28662 - RNA, 20 nt, Human
ucacugggcggggggaggag

SEQ ID NO: 28663 - RNA, 24 nt, Human
uucgucaugcccguggaccuugag

SEQ ID NO: 28664 - RNA, 24 nt, Human
agucugaguuuacuuaugccugcu

SEQ ID NO: 28665 - RNA, 24 nt, Human
guuugcgugacgguuccacgucac

SEQ ID NO: 28666 - RNA, 24 nt, Human
uugcucaggcuugagugcacuggc

SEQ ID NO: 28667 - RNA, 24 nt, Human
guucgggugaugaugguuccacgu

SEQ ID NO: 28668 - RNA, 24 nt, Human
agggagagccgggcuuccgaggac

SEQ ID NO: 28669 - RNA, 24 nt, Human
cgggaccagcaaggagcucccagg

SEQ ID NO: 28670 - RNA, 22 nt, Human
aaccgggcagcaucuucagccc

SEQ ID NO: 28671 - RNA, 20 nt, Human
cuugucccucucucacacuu

SEQ ID NO: 28672 - RNA, 24 nt, Human
aaggugaacuugucacuugguaug

SEQ ID NO: 28673 - RNA, 24 nt, Human
ugguggucuugagcuuuuggccug

SEQ ID NO: 28674 - RNA, 24 nt, Human
ugagacaagccaugaggaacucug

SEQ ID NO: 28675 - RNA, 24 nt, Human
gacacguuaugaacgaucgggucc

SEQ ID NO: 28676 - RNA, 24 nt, Human
uuugcacagccacacugcggccuu

SEQ ID NO: 28677 - RNA, 24 nt, Human
ugcaacaacucgagacaacagaga

SEQ ID NO: 28678 - RNA, 24 nt, Human
ugagaacuccaggauuguccugca

SEQ ID NO: 28679 - RNA, 24 nt, Human
uaccggcugcaggagcaugugcgu

SEQ ID NO: 28680 - RNA, 24 nt, Human
ccggugccgugucccgguucgcuc

SEQ ID NO: 28681 - RNA, 24 nt, Human
cagcagcgucuacuuccgcagcgu

SEQ ID NO: 28682 - RNA, 24 nt, Human
ucaagagcacccugauuuggcuag

SEQ ID NO: 28683 - RNA, 24 nt, Human
cggccugacuuaggccgagcgcgg

SEQ ID NO: 28684 - RNA, 24 nt, Human
uggcggccgggccggguugggggg

SEQ ID NO: 28685 - RNA, 18 nt, Human
cauucuguaauaauagcu

SEQ ID NO: 28686 - RNA, 24 nt, Human
ugaaagucgugcuuuaaaccuaac

SEQ ID NO: 28687 - RNA, 24 nt, Human
uacauugacuauggaaauacugaa

SEQ ID NO: 28688 - RNA, 24 nt, Human
aguaagauuaucuccagccaaaau

SEQ ID NO: 28689 - RNA, 24 nt, Human
aacccggcauucccaguuuaauug

SEQ ID NO: 28690 - RNA, 24 nt, Human
aggggucugcggccucgucuccag

SEQ ID NO: 28691 - RNA, 24 nt, Human
gauuguugggaaccugaggucugc

SEQ ID NO: 28692 - RNA, 24 nt, Human
agugcagacuucccugcuuagguu

SEQ ID NO: 28693 - RNA, 24 nt, Human
cucacauugucuccagggccucgg

SEQ ID NO: 28694 - RNA, 24 nt, Human
ugacugaguuucuggagucccaca

SEQ ID NO: 28695 - RNA, 24 nt, Human
ccagccuucgagagcuaugagucc

SEQ ID NO: 28696 - RNA, 24 nt, Human
ucugcaggcgugccccggcggcgg

SEQ ID NO: 28697 - RNA, 23 nt, Human
gaccgcuucccugcagugccccg

SEQ ID NO: 28698 - RNA, 24 nt, Human
ugggaaacgcgagcgcaggcggca

SEQ ID NO: 28699 - RNA, 24 nt, Human
agaggacuucggcgacgcuucccc

SEQ ID NO: 28700 - RNA, 24 nt, Human
cuggccccugcgcugccagcugga

SEQ ID NO: 28701 - RNA, 24 nt, Human
ugacuggaccggaagcggguuagu

SEQ ID NO: 28702 - RNA, 24 nt, Human
uccuaagucuuauuccaagcuaag

SEQ ID NO: 28703 - RNA, 24 nt, Human
acacugggcuuuuaacacaagacu

SEQ ID NO: 28704 - RNA, 24 nt, Human
uucaaaugaaucuucaaauuggaa

SEQ ID NO: 28705 - RNA, 24 nt, Human
uaaugggucucaaauucugugaca

SEQ ID NO: 28706 - RNA, 24 nt, Human
uuaaauggccaauugaaacaaaca

SEQ ID NO: 28707 - RNA, 24 nt, Human
ucacucaguuuuuaauaaaggcca

SEQ ID NO: 28708 - RNA, 24 nt, Human
uguucagaaauugaggcuaacauu

SEQ ID NO: 28709 - RNA, 24 nt, Human
ugagaaacuuuugauuguuuucaa

SEQ ID NO: 28710 - RNA, 24 nt, Human
uuccugguugcuuuucauaagagg

SEQ ID NO: 28711 - RNA, 24 nt, Human
cucacccacuccucagccuccagg

SEQ ID NO: 28712 - RNA, 24 nt, Human
ugccucagaggcucugggcagcca

SEQ ID NO: 28713 - RNA, 24 nt, Human
ucauagcguccagcgauccagaca

SEQ ID NO: 28714 - RNA, 24 nt, Human
ucccugagugggucgggggaggca

SEQ ID NO: 28715 - RNA, 24 nt, Human
uggcaggaaggggaggcaaggcca

SEQ ID NO: 28716 - RNA, 24 nt, Human
uaaaauagacuuuuaaaauuacaa

SEQ ID NO: 28717 - RNA, 20 nt, Human
aaucagguugaacagggcca

SEQ ID NO: 28718 - RNA, 24 nt, Human
ucauucaggagcagguuauuuaac

SEQ ID NO: 28719 - RNA, 24 nt, Human
ucauuuuuuucuucugcugcguuu

SEQ ID NO: 28720 - RNA, 24 nt, Human
aacacauuacugauagaggaaguc

SEQ ID NO: 28721 - RNA, 24 nt, Human
aagcccauacauaacaguggaggu

SEQ ID NO: 28722 - RNA, 24 nt, Human
uaaguauagaaucuuaaugguugc

SEQ ID NO: 28723 - RNA, 21 nt, Human
uauacaaguuaugagagcauu

SEQ ID NO: 28724 - RNA, 24 nt, Human
aucagauuacauaaauuauacaau

SEQ ID NO: 28725 - RNA, 24 nt, Human
ugaccacagcuguaggauugccag

SEQ ID NO: 28726 - RNA, 24 nt, Human
uuccagcgucucgggcuccuugca

SEQ ID NO: 28727 - RNA, 24 nt, Human
ugggagcggcggcagcuguugggg

SEQ ID NO: 28728 - RNA, 24 nt, Human
uacagaagaugcuuccugauguau

SEQ ID NO: 28729 - RNA, 24 nt, Human
uuggaugugaaaaggaugucaggg

SEQ ID NO: 28730 - RNA, 24 nt, Human
ucccccugucacucaggcugucca

SEQ ID NO: 28731 - RNA, 24 nt, Human
ucuggauucgguucuuggcuggga

SEQ ID NO: 28732 - RNA, 24 nt, Human
ugguguggcgcauagugcaaagcc

SEQ ID NO: 28733 - RNA, 24 nt, Human
uucacagcaaaguguggugcgauc

SEQ ID NO: 28734 - RNA, 21 nt, Human
uccccggaggcgcuuucccuu

SEQ ID NO: 28735 - RNA, 24 nt, Human
agugaaucaggccggcuucaccuu

SEQ ID NO: 28736 - RNA, 24 nt, Human
ucaguuggagagagcguugaggag

SEQ ID NO: 28737 - RNA, 19 nt, Human
uaagucgcauuaauauccu

SEQ ID NO: 28738 - RNA, 24 nt, Human
ggccaaagaacuaaagggcaagca

SEQ ID NO: 28739 - RNA, 24 nt, Human
uccaucauaauuauuuacuguuga

SEQ ID NO: 28740 - RNA, 24 nt, Human
uaacugcauuugcgccaccugcug

SEQ ID NO: 28741 - RNA, 24 nt, Human
cagcauucuggggcuuguaacacu

SEQ ID NO: 28742 - RNA, 24 nt, Human
ucagugguggcgccugggcucagc

SEQ ID NO: 28743 - RNA, 24 nt, Human
ucacuauggugguugacuacagaa

SEQ ID NO: 28744 - RNA, 24 nt, Human
aggaagacauccccagcgaaaaga

SEQ ID NO: 28745 - RNA, 24 nt, Human
ugccaaggauguagaauaaauaag

SEQ ID NO: 28746 - RNA, 24 nt, Human
acgcuccgcuccagcccgggcauc

SEQ ID NO: 28747 - RNA, 24 nt, Human
ccagggggggcaguggggugggcc

SEQ ID NO: 28748 - RNA, 24 nt, Human
ccagggcgcgucgcgcuggccguu

SEQ ID NO: 28749 - RNA, 24 nt, Human
aggcagaguggagagaaacaacuc

SEQ ID NO: 28750 - RNA, 24 nt, Human
uucagcugcaucugcgccaccugc

SEQ ID NO: 28751 - RNA, 24 nt, Human
ucagugguggcgccugggcucagc

SEQ ID NO: 28752 - RNA, 22 nt, Human
ugucaaggggucucugggaagu

SEQ ID NO: 28753 - RNA, 24 nt, Human
ccuuacugucccaggaaacugcag

SEQ ID NO: 28754 - RNA, 24 nt, Human
uagcuuggugccaauuggucgugg

SEQ ID NO: 28755 - RNA, 23 nt, Human
uccgugcgcguugcugcggccgu

SEQ ID NO: 28756 - RNA, 24 nt, Human
aggaaggagauauagugaagagga

SEQ ID NO: 28757 - RNA, 21 nt, Human
aagagcgucaacaauuuacgg

SEQ ID NO: 28758 - RNA, 24 nt, Human
ucuguccugcguccucuguccccg

SEQ ID NO: 28759 - RNA, 24 nt, Human
cagugggugauccccuacaucagg

SEQ ID NO: 28760 - RNA, 24 nt, Human
ucagagcuacacauugagaaccug

SEQ ID NO: 28761 - RNA, 24 nt, Human
caucguggcugaggugcuggugcu

SEQ ID NO: 28762 - RNA, 24 nt, Human
ucagccccacacauuagccucgcu

SEQ ID NO: 28763 - RNA, 24 nt, Human
uuccugaggggcuucuuaacuuuu

SEQ ID NO: 28764 - RNA, 17 nt, Human
ucuaguguccccccagc

SEQ ID NO: 28765 - RNA, 21 nt, Human
gucgucgacacgccgggagcg

SEQ ID NO: 28766 - RNA, 24 nt, Human
ggacucaacuccacccacuaccuc

SEQ ID NO: 28767 - RNA, 24 nt, Human
uguggugguggggaggguggguac

SEQ ID NO: 28768 - RNA, 24 nt, Human
uauauggauuuaccucauucuuuu

SEQ ID NO: 28769 - RNA, 22 nt, Human
cgccgggacagcagacugccgg

SEQ ID NO: 28770 - RNA, 24 nt, Human
cagccuggacuuaccaccacuaaa

SEQ ID NO: 28771 - RNA, 24 nt, Human
ggcccggagcggagcgcgcccugc

SEQ ID NO: 28772 - RNA, 24 nt, Human
uggccugaugauccacagcggaga

SEQ ID NO: 28773 - RNA, 24 nt, Human
ugugugccauugcccaggcagagu

SEQ ID NO: 28774 - RNA, 24 nt, Human
ucccugcugaggccuguccccacc

SEQ ID NO: 28775 - RNA, 24 nt, Human
ugcugcggcccgcagggcccgugg

SEQ ID NO: 28776 - RNA, 24 nt, Human
gcggcgcgccggcccaacaucgga

SEQ ID NO: 28777 - RNA, 24 nt, Human
ugcucuggggguucgccggggccg

SEQ ID NO: 28778 - RNA, 24 nt, Human
ugggcugccuccaggugacagcaa

SEQ ID NO: 28779 - RNA, 24 nt, Human
acucugguggauauggccaggaug

SEQ ID NO: 28780 - RNA, 24 nt, Human
uguuauguggaucuguguggaaag

SEQ ID NO: 28781 - RNA, 24 nt, Human
agaagaagaagaaauggcaaagag

SEQ ID NO: 28782 - RNA, 24 nt, Human
caugagaauaauguuuuaaaacca

SEQ ID NO: 28783 - RNA, 24 nt, Human
uauaaaguuugggcacuuagagca

SEQ ID NO: 28784 - RNA, 24 nt, Human
uuacuguacauagagagacagguu

SEQ ID NO: 28785 - RNA, 24 nt, Human
auggugcaauaauuuaaguggcau

SEQ ID NO: 28786 - RNA, 24 nt, Human
cgaggccgcgguuucccccugggc

SEQ ID NO: 28787 - RNA, 24 nt, Human
gagcuggcagugccugacggcgcg

SEQ ID NO: 28788 - RNA, 24 nt, Human
uggcgccgaagcaggacccgaagc

SEQ ID NO: 28789 - RNA, 24 nt, Human
ugugcagaagaaauggaaggauuc

SEQ ID NO: 28790 - RNA, 24 nt, Human
uaucaaggaagggcaggcgugaug

SEQ ID NO: 28791 - RNA, 24 nt, Human
uucaaauuucuuucuuuuuuaauu

SEQ ID NO: 28792 - RNA, 24 nt, Human
caggucacuccauuugaaaacuag

SEQ ID NO: 28793 - RNA, 24 nt, Human
cauuguaucaaauguuuugggcac

SEQ ID NO: 28794 - RNA, 20 nt, Human
ucccucugggaucugagccu

SEQ ID NO: 28795 - RNA, 24 nt, Human
ucggaucagcuucuugggggccuc

SEQ ID NO: 28796 - RNA, 22 nt, Human
aggcaggcuaagcgggauggcu

SEQ ID NO: 28797 - RNA, 24 nt, Human
ggagacaguaaaggugaugggggc

SEQ ID NO: 28798 - RNA, 21 nt, Human
uugcucagugacagagccuca

SEQ ID NO: 28799 - RNA, 24 nt, Human
ugaaccuaggagggugggaauggc

SEQ ID NO: 28800 - RNA, 24 nt, Human
ugccaugguuuugcacuaugauua

SEQ ID NO: 28801 - RNA, 24 nt, Human
aacuguaucccguugaugcacuaa

SEQ ID NO: 28802 - RNA, 24 nt, Human
aaagcagcaauucuauguucauag

SEQ ID NO: 28803 - RNA, 24 nt, Human
ugccaagaugcgggagugguuuuc

SEQ ID NO: 28804 - RNA, 24 nt, Human
aggcacuuuucggggccgucuggc

SEQ ID NO: 28805 - RNA, 24 nt, Human
uguaguaguuguuggggcccagga

SEQ ID NO: 28806 - RNA, 24 nt, Human
aacacuuuguugaagcugcccuuc

SEQ ID NO: 28807 - RNA, 24 nt, Human
uugaagaagaggauccggguggcc

SEQ ID NO: 28808 - RNA, 24 nt, Human
gcgcagcuucaggggccgcaaggg

SEQ ID NO: 28809 - RNA, 24 nt, Human
uuugcuccugacgucccucagaug

SEQ ID NO: 28810 - RNA, 24 nt, Human
uguaaaggguguccucucagauuu

SEQ ID NO: 28811 - RNA, 18 nt, Human
uaguucauagggaaggga

SEQ ID NO: 28812 - RNA, 24 nt, Human
ucuaugauaguguggguggagaua

SEQ ID NO: 28813 - RNA, 24 nt, Human
accacagagagcccuuacaaagac

SEQ ID NO: 28814 - RNA, 24 nt, Human
ucacugcacuccagccugggauac

SEQ ID NO: 28815 - RNA, 24 nt, Human
ugaagaaaaauugagaaaguagaa

SEQ ID NO: 28816 - RNA, 24 nt, Human
cacacuguuaaaggguuuuuuggg

SEQ ID NO: 28817 - RNA, 24 nt, Human
uucacuuccuacuuaggcuaggcc

SEQ ID NO: 28818 - RNA, 24 nt, Human
ugugguuuuaaaagagucccucaa

SEQ ID NO: 28819 - RNA, 24 nt, Human
ucucugguuguucacauuccaaaa

SEQ ID NO: 28820 - RNA, 24 nt, Human
ugucgcaggcugcucugucucuua

SEQ ID NO: 28821 - RNA, 24 nt, Human
ugauggugaaugugugcggacaca

SEQ ID NO: 28822 - RNA, 24 nt, Human
uuucuuggaagaaguggaagaaau

SEQ ID NO: 28823 - RNA, 24 nt, Human
ucccugcaggcacgacauagcaca

SEQ ID NO: 28824 - RNA, 17 nt, Human
uacugcauuugcucucu

SEQ ID NO: 28825 - RNA, 24 nt, Human
gggaacaaggcaguguucuuuacc

SEQ ID NO: 28826 - RNA, 24 nt, Human
ucuuugguuuuaagaguaaauucu

SEQ ID NO: 28827 - RNA, 24 nt, Human
cauucugccucuuccuucucuugu

SEQ ID NO: 28828 - RNA, 24 nt, Human
ugacucaggaccacgcugacuagg

SEQ ID NO: 28829 - RNA, 24 nt, Human
cugcagcucccucacagugcuucg

SEQ ID NO: 28830 - RNA, 22 nt, Human
ucugucuuggaggaggaucgac

SEQ ID NO: 28831 - RNA, 24 nt, Human
ccuggaaauccccuccccuucccc

SEQ ID NO: 28832 - RNA, 24 nt, Human
ugacaagagcaaccggucuacaac

SEQ ID NO: 28833 - RNA, 24 nt, Human
agugagugugugcuuauaaagguc

SEQ ID NO: 28834 - RNA, 24 nt, Human
gcuuauguguauaauccagcccuu

SEQ ID NO: 28835 - RNA, 24 nt, Human
caggugccucugccauagcuucug

SEQ ID NO: 28836 - RNA, 24 nt, Human
uccaucggggagggcgaaggcccu

SEQ ID NO: 28837 - RNA, 24 nt, Human
auagaugaaguaaaaguuugguag

SEQ ID NO: 28838 - RNA, 24 nt, Human
ucaauuuuuauuuugguuuucuua

SEQ ID NO: 28839 - RNA, 24 nt, Human
aggcauaggccccucaugaccugc

SEQ ID NO: 28840 - RNA, 17 nt, Human
uaauaugucugugcagc

SEQ ID NO: 28841 - RNA, 24 nt, Human
ugaugaggccagagugaugugaag

SEQ ID NO: 28842 - RNA, 24 nt, Human
ucuuuguuguuuaaauauaaacag

SEQ ID NO: 28843 - RNA, 24 nt, Human
accauguaaaagugagcucagacg

SEQ ID NO: 28844 - RNA, 24 nt, Human
aggcaucccguaaaguuguaguug

SEQ ID NO: 28845 - RNA, 24 nt, Human
uacauuagccaccaguggcaaaga

SEQ ID NO: 28846 - RNA, 24 nt, Human
ucuguauuuugcaagccucgaaac

SEQ ID NO: 28847 - RNA, 24 nt, Human
uagcaucauuugggaaagucaagc

SEQ ID NO: 28848 - RNA, 24 nt, Human
cggcugcccauugcucucccacuc

SEQ ID NO: 28849 - RNA, 24 nt, Human
cucgaucggggcugggagggcuuu

SEQ ID NO: 28850 - RNA, 24 nt, Human
uugaagcuuuuacagcuggagacu

SEQ ID NO: 28851 - RNA, 24 nt, Human
uucauuggcaguauuuugugauga

SEQ ID NO: 28852 - RNA, 22 nt, Human
ucagaacauucugaacugcuga

SEQ ID NO: 28853 - RNA, 24 nt, Human
ugaaugacaacuuuauuuuucuua

SEQ ID NO: 28854 - RNA, 24 nt, Human
uauuagggauaauauucauuuagc

SEQ ID NO: 28855 - RNA, 24 nt, Human
uaaugggucucaaaauucugugac

SEQ ID NO: 28856 - RNA, 24 nt, Human
gguggugacgauggugaaguacac

SEQ ID NO: 28857 - RNA, 24 nt, Human
caagauguuugccaaacuuuguaa

SEQ ID NO: 28858 - RNA, 24 nt, Human
uauaggaauacauacaaucuauau

SEQ ID NO: 28859 - RNA, 24 nt, Human
uaaaugguguugacaccaacuucu

SEQ ID NO: 28860 - RNA, 24 nt, Human
uagcuugugguuaauaagucaauu

SEQ ID NO: 28861 - RNA, 24 nt, Human
uuuuuuuuauuuucacuuuuaaug

SEQ ID NO: 28862 - RNA, 24 nt, Human
ucugcaauuugguauaaauguuag

SEQ ID NO: 28863 - RNA, 23 nt, Human
ugaaaaaaguucauacuaaauau

SEQ ID NO: 28864 - RNA, 24 nt, Human
ucacuagugcugagauuacaggca

SEQ ID NO: 28865 - RNA, 24 nt, Human
gacagauucucgcuuugucaccag

SEQ ID NO: 28866 - RNA, 24 nt, Human
uccucuguuuguauguauuugaag

SEQ ID NO: 28867 - RNA, 24 nt, Human
ucaaaaaaucgaugggacugaaga

SEQ ID NO: 28868 - RNA, 24 nt, Human
ccccaguagaagugaugggcugcu

SEQ ID NO: 28869 - RNA, 24 nt, Human
uuaguucuuaaagcaaaaaacaga

SEQ ID NO: 28870 - RNA, 24 nt, Human
uaccuggaaaggaccgugggcacu

SEQ ID NO: 28871 - RNA, 24 nt, Human
acugaaucgaugguaauaauguug

SEQ ID NO: 28872 - RNA, 24 nt, Human
gugcuccuuguggccuuccuugag

SEQ ID NO: 28873 - RNA, 24 nt, Human
ugagggccaucauucugguuccca

SEQ ID NO: 28874 - RNA, 24 nt, Human
ugagauugcuguccucccaaaggu

SEQ ID NO: 28875 - RNA, 24 nt, Human
cuggaaggcauacccuacaauuua

SEQ ID NO: 28876 - RNA, 24 nt, Human
accuggugguguuugucugugguc

SEQ ID NO: 28877 - RNA, 24 nt, Human
caggaacacaugagcaucuggucc

SEQ ID NO: 28878 - RNA, 18 nt, Human
uuugaggaaaggagagaa

SEQ ID NO: 28879 - RNA, 24 nt, Human
ugaguacauuuuaaugggcuuucu

SEQ ID NO: 28880 - RNA, 24 nt, Human
agagaaucauaaauucugcaaagu

SEQ ID NO: 28881 - RNA, 24 nt, Human
ucgccguggucucccaaaaugcua

SEQ ID NO: 28882 - RNA, 24 nt, Human
ucuggaccuaggcuggucucaaca

SEQ ID NO: 28883 - RNA, 23 nt, Human
cacugcagucaccaucuucugcc

SEQ ID NO: 28884 - RNA, 24 nt, Human
agagaagcagagcuuucugaacua

SEQ ID NO: 28885 - RNA, 24 nt, Human
ugugaucauauugauucuuaagac

SEQ ID NO: 28886 - RNA, 24 nt, Human
aauuucucaaacuauaucaauauc

SEQ ID NO: 28887 - RNA, 24 nt, Human
ucaaaggugcuagaacaaaucguc

SEQ ID NO: 28888 - RNA, 24 nt, Human
uauuugcaacuacaugauuucaca

SEQ ID NO: 28889 - RNA, 24 nt, Human
ugcccuugacuuugggggguugcc

SEQ ID NO: 28890 - RNA, 24 nt, Human
aggaaccaugggaaagaauaugau

SEQ ID NO: 28891 - RNA, 22 nt, Human
uuagauccuaggugaugccugg

SEQ ID NO: 28892 - RNA, 24 nt, Human
ucagaccaucacaauguccacucu

SEQ ID NO: 28893 - RNA, 24 nt, Human
aggccgagguccgcggccaggugc

SEQ ID NO: 28894 - RNA, 24 nt, Human
acgggccgcuuuccacaaugcagu

SEQ ID NO: 28895 - RNA, 24 nt, Human
uggccggcacgggcagacaacgcg

SEQ ID NO: 28896 - RNA, 24 nt, Human
gagcuugucuuuuugcccuugggc

SEQ ID NO: 28897 - RNA, 24 nt, Human
uacuugaaaauuaauaaguuugaa

SEQ ID NO: 28898 - RNA, 24 nt, Human
augacccagcaaaccaaugguagg

SEQ ID NO: 28899 - RNA, 24 nt, Human
uauuuguuuuacuguauauuuaaa

SEQ ID NO: 28900 - RNA, 24 nt, Human
uggugcuugugucccgaggugcca

SEQ ID NO: 28901 - RNA, 24 nt, Human
uaugcaggcccuggaacuagaagg

SEQ ID NO: 28902 - RNA, 17 nt, Human
uuacaugggaauugucc

SEQ ID NO: 28903 - RNA, 24 nt, Human
ugcuuggugaccgaauuacuagug

SEQ ID NO: 28904 - RNA, 24 nt, Human
uuagaagaagagaugcugucuugg

SEQ ID NO: 28905 - RNA, 24 nt, Human
ucacuugguuggucguauuguagc

SEQ ID NO: 28906 - RNA, 24 nt, Human
uuuugaucacaaggggaaauuuaa

SEQ ID NO: 28907 - RNA, 24 nt, Human
ggugcaaaaauucuuaagacuucu

SEQ ID NO: 28908 - RNA, 24 nt, Human
uucaauuagcagucuagacauuuc

SEQ ID NO: 28909 - RNA, 24 nt, Human
ugaaagccucuuucuuuucaggcu

SEQ ID NO: 28910 - RNA, 24 nt, Human
ugugcuaaucuaaagaacgaauca

SEQ ID NO: 28911 - RNA, 24 nt, Human
uucauuggcaguauuuugugauga

SEQ ID NO: 28912 - RNA, 22 nt, Human
ucagaacauucugaacugcuga

SEQ ID NO: 28913 - RNA, 24 nt, Human
ugaaugacaacuuuauuuuucuua

SEQ ID NO: 28914 - RNA, 24 nt, Human
uauuaggcaaguuaggugcacuga

SEQ ID NO: 28915 - RNA, 24 nt, Human
uaucuuguauucauuaaaaauauu

SEQ ID NO: 28916 - RNA, 24 nt, Human
aagcuuccauguauauugauaaau

SEQ ID NO: 28917 - RNA, 24 nt, Human
uguaaauuccaguggcuuuaccuc

SEQ ID NO: 28918 - RNA, 24 nt, Human
ccagccccgcagcccuggccugua

SEQ ID NO: 28919 - RNA, 24 nt, Human
uguaaugagaauuuuuaaaaaauu

SEQ ID NO: 28920 - RNA, 24 nt, Human
auuauuuuccuuucuggacuucca

SEQ ID NO: 28921 - RNA, 24 nt, Human
uacccuugaacuucugggcucagg

SEQ ID NO: 28922 - RNA, 22 nt, Human
ugggauuacagguguaagccac

SEQ ID NO: 28923 - RNA, 24 nt, Human
uugagggacaguugccuccuucag

SEQ ID NO: 28924 - RNA, 23 nt, Human
uugcuaguguuauugauauugug

SEQ ID NO: 28925 - RNA, 24 nt, Human
uacaaggauauauuaaugauauua

SEQ ID NO: 28926 - RNA, 24 nt, Human
ugagccucuguucuaaauccuccg

SEQ ID NO: 28927 - RNA, 24 nt, Human
cagcgugccaucaugcugcuggag

SEQ ID NO: 28928 - RNA, 24 nt, Human
aaggagcgucugcuggacgagcug

SEQ ID NO: 28929 - RNA, 20 nt, Human
uggcagagccagaccgacuc

SEQ ID NO: 28930 - RNA, 24 nt, Human
ugacgagccuccccuguaugccug

SEQ ID NO: 28931 - RNA, 24 nt, Human
uuucagggauaggaacuguuaaua

SEQ ID NO: 28932 - RNA, 24 nt, Human
ugaggauaauggcuuccagcuuca

SEQ ID NO: 28933 - RNA, 24 nt, Human
uuacauagguaaacgugucccaug

SEQ ID NO: 28934 - RNA, 24 nt, Human
ucuggauucgguucuuggcuggga

SEQ ID NO: 28935 - RNA, 24 nt, Human
ugguguggcgcauagugcagagcc

SEQ ID NO: 28936 - RNA, 24 nt, Human
uucacagcaaaguguggugcgauc

SEQ ID NO: 28937 - RNA, 24 nt, Human
auaaaaccaauaaaagaucuccca

SEQ ID NO: 28938 - RNA, 20 nt, Human
uguccagaauuuccagaagu

SEQ ID NO: 28939 - RNA, 24 nt, Human
ugagugcccccagggaggggcugg

SEQ ID NO: 28940 - RNA, 24 nt, Human
uguggcccuucucuuuaaguccga

SEQ ID NO: 28941 - RNA, 24 nt, Human
cgaggcccuggagcaggccaucau

SEQ ID NO: 28942 - RNA, 19 nt, Human
ucaguccccuuuggaagcu

SEQ ID NO: 28943 - RNA, 24 nt, Human
ugcaaaaccagcguggcggccgcg

SEQ ID NO: 28944 - RNA, 24 nt, Human
gagcagugcguacaugguugugcg

SEQ ID NO: 28945 - RNA, 24 nt, Human
ugucacaaaaacucacucaucaac

SEQ ID NO: 28946 - RNA, 24 nt, Human
uuaguaugcuguguccuucauaag

SEQ ID NO: 28947 - RNA, 24 nt, Human
uuagugcuacuucugugaauucau

SEQ ID NO: 28948 - RNA, 24 nt, Human
aagcaaacgaagggcaagauugug

SEQ ID NO: 28949 - RNA, 18 nt, Human
uacagggccuuggcuucc

SEQ ID NO: 28950 - RNA, 24 nt, Human
ugccaguagcaaccguucucuaug

SEQ ID NO: 28951 - RNA, 24 nt, Human
caccucuucccuucaucuccaggg

SEQ ID NO: 28952 - RNA, 18 nt, Human
uauaaagugaaggaaaga

SEQ ID NO: 28953 - RNA, 24 nt, Human
ccagaagccucucuccugcaauua

SEQ ID NO: 28954 - RNA, 22 nt, Human
uggcaagcaagaagcgggagcu

SEQ ID NO: 28955 - RNA, 24 nt, Human
uauaugucucuuuaaauuuaaauc

SEQ ID NO: 28956 - RNA, 24 nt, Human
caagcauacucaucauuucuuugu

SEQ ID NO: 28957 - RNA, 24 nt, Human
uccagagucucaaggggcuggggc

SEQ ID NO: 28958 - RNA, 24 nt, Human
cugccacagcugcaaggaccaggc

SEQ ID NO: 28959 - RNA, 23 nt, Human
ugagguggcuaggcuugacacac

SEQ ID NO: 28960 - RNA, 24 nt, Human
uggguacaucaccgcgugucggca

SEQ ID NO: 28961 - RNA, 24 nt, Human
ucucaaguagcugggacuacaggc

SEQ ID NO: 28962 - RNA, 17 nt, Human
uacaaggaguagauuau

SEQ ID NO: 28963 - RNA, 21 nt, Human
aggaaaccuggaggcuacuac

SEQ ID NO: 28964 - RNA, 24 nt, Human
gugaauuguaccuauuucugauga

SEQ ID NO: 28965 - RNA, 24 nt, Human
ucuaucuguccaccaucuugccuu

SEQ ID NO: 28966 - RNA, 24 nt, Human
uauguuccacaggcuggucuugaa

SEQ ID NO: 28967 - RNA, 24 nt, Human
uacacuguucuccagcacucucug

SEQ ID NO: 28968 - RNA, 24 nt, Human
gaucauacuccacugugguccuga

SEQ ID NO: 28969 - RNA, 24 nt, Human
ugugguuuuaaaagagucccucaa

SEQ ID NO: 28970 - RNA, 24 nt, Human
ucucugguuguucacauuccaaaa

SEQ ID NO: 28971 - RNA, 24 nt, Human
ugucgcaggcugcucugucucuua

SEQ ID NO: 28972 - RNA, 24 nt, Human
aucacuuuacaauuacugaaaaag

SEQ ID NO: 28973 - RNA, 24 nt, Human
uggaaaggaugucccuacccuagg

SEQ ID NO: 28974 - RNA, 24 nt, Human
uuaaaaguaguaacuagaacaguu

SEQ ID NO: 28975 - RNA, 24 nt, Human
uggcagcacccacgaugcgggacc

SEQ ID NO: 28976 - RNA, 24 nt, Human
cuuggacuggccuccaggcagccc

SEQ ID NO: 28977 - RNA, 24 nt, Human
cgugcagagggcccgcuggggccc

SEQ ID NO: 28978 - RNA, 24 nt, Human
acugguuuucugguuuuccaucug

SEQ ID NO: 28979 - RNA, 24 nt, Human
guccuuagagaugggaaucuugac

SEQ ID NO: 28980 - RNA, 24 nt, Human
ugagugcaacggaaagggcuauca

SEQ ID NO: 28981 - RNA, 24 nt, Human
uugcauagcucaaaaaguuugaaa

SEQ ID NO: 28982 - RNA, 24 nt, Human
aggaagacccacagagcuguauua

SEQ ID NO: 28983 - RNA, 24 nt, Human
uucagauacuugguaaguggucaa

SEQ ID NO: 28984 - RNA, 17 nt, Human
ugucaaguaaaaaaaaa

SEQ ID NO: 28985 - RNA, 24 nt, Human
gcucaaggagaagaagcuggugaa

SEQ ID NO: 28986 - RNA, 24 nt, Human
uaggcacugagggaucugaguagg

SEQ ID NO: 28987 - RNA, 24 nt, Human
gggcagggucuauggggacgaaag

SEQ ID NO: 28988 - RNA, 23 nt, Human
caccccucccucccucuuuccca

SEQ ID NO: 28989 - RNA, 24 nt, Human
uugcuuaggggucccaggcuugcg

SEQ ID NO: 28990 - RNA, 24 nt, Human
uaaacaggaugcccuccaccucuc

SEQ ID NO: 28991 - RNA, 24 nt, Human
gggaccuggccgagcacaaaccug

SEQ ID NO: 28992 - RNA, 23 nt, Human
ucagcaggccagcggccuuggga

SEQ ID NO: 28993 - RNA, 24 nt, Human
gggcaucugcugucgcugccucgg

SEQ ID NO: 28994 - RNA, 24 nt, Human
aggaaauggggugugaugggucaa

SEQ ID NO: 28995 - RNA, 24 nt, Human
ugcaaccaaacucauaacuaauac

SEQ ID NO: 28996 - RNA, 24 nt, Human
uggcagcugguuuucccuacaaca

SEQ ID NO: 28997 - RNA, 24 nt, Human
uaagcuacuuuuccaguaguuugc

SEQ ID NO: 28998 - RNA, 24 nt, Human
uaaaaaacaaaucaauguaaggac

SEQ ID NO: 28999 - RNA, 24 nt, Human
ugccagguugagaauaucccaggu

SEQ ID NO: 29000 - RNA, 24 nt, Human
ugaucagguggcagcgguggcggc

SEQ ID NO: 29001 - RNA, 24 nt, Human
ugccugagcaaacuggaaacuggu

SEQ ID NO: 29002 - RNA, 24 nt, Human
acaauggccauacucuguugagga

SEQ ID NO: 29003 - RNA, 24 nt, Human
uuggcacagacauuuuaaucuugu

SEQ ID NO: 29004 - RNA, 24 nt, Human
uuuguuuuugaguauuccugaaag

SEQ ID NO: 29005 - RNA, 24 nt, Human
uagaagaugcucaguguccuggau

SEQ ID NO: 29006 - RNA, 24 nt, Human
agaaagacaaagaauuauuacugg

SEQ ID NO: 29007 - RNA, 20 nt, Human
uuuguggucgaaagagucgg

SEQ ID NO: 29008 - RNA, 24 nt, Human
ggaggagaaugagggaggagaggg

SEQ ID NO: 29009 - RNA, 24 nt, Human
ucccuaagggacuggcauaggguu

SEQ ID NO: 29010 - RNA, 24 nt, Human
agcuauugcuauucaauggagacg

SEQ ID NO: 29011 - RNA, 24 nt, Human
ucucuacucugauuuaacuguucu

SEQ ID NO: 29012 - RNA, 24 nt, Human
ugcugugugccccacuccaaccug

SEQ ID NO: 29013 - RNA, 24 nt, Human
uauggugcugcaugcccaagauuu

SEQ ID NO: 29014 - RNA, 24 nt, Human
uuagugugggccuaacccaagggg

SEQ ID NO: 29015 - RNA, 24 nt, Human
uuucccagucugucgauuuaugcc

SEQ ID NO: 29016 - RNA, 24 nt, Human
ugagauuggccuggaugcagcugc

SEQ ID NO: 29017 - RNA, 18 nt, Human
uaagugccaacaugacug

SEQ ID NO: 29018 - RNA, 24 nt, Human
uugccggcucaacuucuccgacuc

SEQ ID NO: 29019 - RNA, 24 nt, Human
caacucaggcucuagcuucuccag

SEQ ID NO: 29020 - RNA, 24 nt, Human
gucccauuugucuuaaguccuggu

SEQ ID NO: 29021 - RNA, 24 nt, Human
aagcagaaggcaguuaugaugaca

SEQ ID NO: 29022 - RNA, 24 nt, Human
ugaccagacuuuuccagaagugcc

SEQ ID NO: 29023 - RNA, 17 nt, Human
uaacauggauggguuga

SEQ ID NO: 29024 - RNA, 22 nt, Human
uuccaaagaaagguacugugga

SEQ ID NO: 29025 - RNA, 24 nt, Human
ucucuugugggcaggggugggggu

SEQ ID NO: 29026 - RNA, 24 nt, Human
aggaaggagauauagugaagagga

SEQ ID NO: 29027 - RNA, 24 nt, Human
guagaguuuucuucaggcuuaaag

SEQ ID NO: 29028 - RNA, 24 nt, Human
uaaaacaaaacaaaagucauuuca

SEQ ID NO: 29029 - RNA, 24 nt, Human
uagagucagugacagggaggcagc

SEQ ID NO: 29030 - RNA, 24 nt, Human
uauagagugagcugauuugggcuc

SEQ ID NO: 29031 - RNA, 24 nt, Human
cuuggcacaggucacuugcacaua

SEQ ID NO: 29032 - RNA, 24 nt, Human
ucacaucguuguuggggaugacgg

SEQ ID NO: 29033 - RNA, 24 nt, Human
uagaaugccuauaccuacauuggu

SEQ ID NO: 29034 - RNA, 24 nt, Human
aucguuuuaaaguuaugaaggcaa

SEQ ID NO: 29035 - RNA, 24 nt, Human
aggcggcguggacagcggcccggc

SEQ ID NO: 29036 - RNA, 24 nt, Human
uuaguccccucucccaccacucag

SEQ ID NO: 29037 - RNA, 24 nt, Human
uggcuccaaggaaucuucccacgg

SEQ ID NO: 29038 - RNA, 24 nt, Human
ucuuaaggcacaccugcugccugu

SEQ ID NO: 29039 - RNA, 24 nt, Human
uauuaugucaguuuauucucuuua

SEQ ID NO: 29040 - RNA, 24 nt, Human
cgaggaggaggcugcgguggcggc

SEQ ID NO: 29041 - RNA, 21 nt, Human
cugugcguggcgagcagugga

SEQ ID NO: 29042 - RNA, 24 nt, Human
ugagggaaauugaggcccugcagu

SEQ ID NO: 29043 - RNA, 24 nt, Human
cagaagaagcagacucagccuuca

SEQ ID NO: 29044 - RNA, 24 nt, Human
agggguccggugcugucgcgggaa

SEQ ID NO: 29045 - RNA, 24 nt, Human
uaaggugaauaagcuugauuguuu

SEQ ID NO: 29046 - RNA, 22 nt, Human
ucccuaaagaaaaagaugaaaa

SEQ ID NO: 29047 - RNA, 24 nt, Human
aagccggacucuauggggcgggac

SEQ ID NO: 29048 - RNA, 24 nt, Human
uuggaucaucucagugggggaaau

SEQ ID NO: 29049 - RNA, 24 nt, Human
uaacuugccaucucaguuuccccg

SEQ ID NO: 29050 - RNA, 24 nt, Human
ucagguccuggggugcugaggaaa

SEQ ID NO: 29051 - RNA, 24 nt, Human
uguugggggcacucccaucuggag

SEQ ID NO: 29052 - RNA, 24 nt, Human
cuggggcuggugggugcaccccug

SEQ ID NO: 29053 - RNA, 24 nt, Human
ucgaccacagaugcucugaacguu

SEQ ID NO: 29054 - RNA, 24 nt, Human
ugugaccaugucggugggaaaagu

SEQ ID NO: 29055 - RNA, 24 nt, Human
uguuauggggauaagcuggugagg

SEQ ID NO: 29056 - RNA, 24 nt, Human
uacaguaugggacaaacagcugac

SEQ ID NO: 29057 - RNA, 19 nt, Human
ugcggauauacaggaucug

SEQ ID NO: 29058 - RNA, 24 nt, Human
uggcucugcccagguggggugggg

SEQ ID NO: 29059 - RNA, 24 nt, Human
uagaggcagaggagcggaaggcag

SEQ ID NO: 29060 - RNA, 24 nt, Human
uuggagcagaacuacugagaaaaa

SEQ ID NO: 29061 - RNA, 24 nt, Human
aggcagugcaccccugggcagagc

SEQ ID NO: 29062 - RNA, 24 nt, Human
uugaucuugaagaaacugggcgug

SEQ ID NO: 29063 - RNA, 24 nt, Human
guagaguuuucuucaggcuuaaag

SEQ ID NO: 29064 - RNA, 24 nt, Human
aacauuauuuauuguaaauguagu

SEQ ID NO: 29065 - RNA, 24 nt, Human
gacaggacgggggugagggaauga

SEQ ID NO: 29066 - RNA, 24 nt, Human
aaccgcuggcccuucccgagugug

SEQ ID NO: 29067 - RNA, 24 nt, Human
uggaugaaucuggcucguuuuaaa

SEQ ID NO: 29068 - RNA, 24 nt, Human
ucugucagacccugugaccugcga

SEQ ID NO: 29069 - RNA, 24 nt, Human
cuuucccccuccuuuuucucuuuu

SEQ ID NO: 29070 - RNA, 23 nt, Human
cguuuggggucccaugauuguuc

SEQ ID NO: 29071 - RNA, 24 nt, Human
uaggggaacaagauagaacacugg

SEQ ID NO: 29072 - RNA, 24 nt, Human
cauuguguuuucucagaaacuaau

SEQ ID NO: 29073 - RNA, 22 nt, Human
cgccgggacagcagacugccgg

SEQ ID NO: 29074 - RNA, 24 nt, Human
cagccuggacuuaccaccacuaaa

SEQ ID NO: 29075 - RNA, 24 nt, Human
ggcccggagcggagcgcgcccugc

SEQ ID NO: 29076 - RNA, 24 nt, Human
cagcucaauucacagaucagacug

SEQ ID NO: 29077 - RNA, 24 nt, Human
cuuuaaauuaaaccaaagaaaaaa

SEQ ID NO: 29078 - RNA, 24 nt, Human
ugacauugagggagucguugugcu

SEQ ID NO: 29079 - RNA, 24 nt, Human
uaccuugaugacccccuccagccc

SEQ ID NO: 29080 - RNA, 24 nt, Human
uccccgauggcccacugcgugacc

SEQ ID NO: 29081 - RNA, 22 nt, Human
ugggagggggcagcugggcuga

SEQ ID NO: 29082 - RNA, 24 nt, Human
ucccaucgagcugguugucuucuu

SEQ ID NO: 29083 - RNA, 20 nt, Human
uggaaugccaucaccggaua

SEQ ID NO: 29084 - RNA, 24 nt, Human
uuagucauugauccuggaguucug

SEQ ID NO: 29085 - RNA, 24 nt, Human
aagcugccuaggugccugacccag

SEQ ID NO: 29086 - RNA, 24 nt, Human
uauugggauuaacacuugugaaaa

SEQ ID NO: 29087 - RNA, 24 nt, Human
agccagaauugcccaucauggugu

SEQ ID NO: 29088 - RNA, 24 nt, Human
ugccuggaaagaggaugugggugg

SEQ ID NO: 29089 - RNA, 24 nt, Human
accagucuguacaaaccuuacagc

SEQ ID NO: 29090 - RNA, 24 nt, Human
uauugcaaauacuuaaaauucuua

SEQ ID NO: 29091 - RNA, 24 nt, Human
uaaaugguguugacaccaacuucu

SEQ ID NO: 29092 - RNA, 24 nt, Human
aggcaggggcagaauccuggaggg

SEQ ID NO: 29093 - RNA, 24 nt, Human
acccucggcggccugauucccagg

SEQ ID NO: 29094 - RNA, 24 nt, Human
agcaagaaggcacgagguccccuc

SEQ ID NO: 29095 - RNA, 24 nt, Human
agguuccagcacaaaggagucugu

SEQ ID NO: 29096 - RNA, 24 nt, Human
uauguggcaucgguccaagcaucc

SEQ ID NO: 29097 - RNA, 24 nt, Human
uugaucuugaagaaacugggcgug

SEQ ID NO: 29098 - RNA, 24 nt, Human
aggaaggagauauagugaagagga

SEQ ID NO: 29099 - RNA, 24 nt, Human
guagaguuuucuucaggcuuaaag

SEQ ID NO: 29100 - RNA, 24 nt, Human
uugaagcuuuuacagcuggagacu

SEQ ID NO: 29101 - RNA, 24 nt, Human
uucauuggcaguauuuugugauga

SEQ ID NO: 29102 - RNA, 24 nt, Human
ugaaugacaacuuuauuuuucuua

SEQ ID NO: 29103 - RNA, 24 nt, Human
acgagguuuggagaaucgaaacug

SEQ ID NO: 29104 - RNA, 24 nt, Human
uuccugaggggcuucuuaacuuuu

SEQ ID NO: 29105 - RNA, 17 nt, Human
ucuaguguccccccagc

SEQ ID NO: 29106 - RNA, 24 nt, Human
uguccaguagccgaacaguuuguu

SEQ ID NO: 29107 - RNA, 24 nt, Human
gaggagaaacccugggaaggcucc

SEQ ID NO: 29108 - RNA, 24 nt, Human
uucgucucaguuguuccuguuuuu

SEQ ID NO: 29109 - RNA, 24 nt, Human
ugaguucgggaucauucuuuuaca

SEQ ID NO: 29110 - RNA, 24 nt, Human
uaaugggucucaaaauucugugac

SEQ ID NO: 29111 - RNA, 24 nt, Human
uauuagggauaauauucauuuagc

SEQ ID NO: 29112 - RNA, 24 nt, Human
uccacuggcgaaagaugccuuucu

SEQ ID NO: 29113 - RNA, 24 nt, Human
uaguucagauugaucuuaggucaa

SEQ ID NO: 29114 - RNA, 24 nt, Human
cggauagagugguggcuuccagaa

SEQ ID NO: 29115 - RNA, 24 nt, Human
uacaggggugagccacugcgcccu

SEQ ID NO: 29116 - RNA, 24 nt, Human
ugccuaggcuggagugcaguggug

SEQ ID NO: 29117 - RNA, 24 nt, Human
ugaucucguuggacugcguggcua

SEQ ID NO: 29118 - RNA, 24 nt, Human
uuuuuuuuuuuuuuuuugacaggg

SEQ ID NO: 29119 - RNA, 24 nt, Human
ugcauuguuaucauuaaccagucu

SEQ ID NO: 29120 - RNA, 24 nt, Human
uaaugggucucaaaauucugugac

SEQ ID NO: 29121 - RNA, 24 nt, Human
uuagugcaguccuucaagccacaa

SEQ ID NO: 29122 - RNA, 24 nt, Human
uggaauggugguaggauuucacag

SEQ ID NO: 29123 - RNA, 24 nt, Human
uuccuggacucggggguauuuugg

SEQ ID NO: 29124 - RNA, 18 nt, Human
ccggucgcccacucccag

SEQ ID NO: 29125 - RNA, 24 nt, Human
uuuguccuccugggucagggagaa

SEQ ID NO: 29126 - RNA, 22 nt, Human
uaaugugguacacauauguccc

SEQ ID NO: 29127 - RNA, 24 nt, Human
uggcuuccucugaacacacaaacc

SEQ ID NO: 29128 - RNA, 24 nt, Human
uccacuggcgaaagaugccuuucu

SEQ ID NO: 29129 - RNA, 24 nt, Human
uucaaauugaucuuaggucaaugg

SEQ ID NO: 29130 - RNA, 21 nt, Human
guggaucccagaaucccgaag

SEQ ID NO: 29131 - RNA, 24 nt, Human
ucacauggauucacuggcuaauaa

SEQ ID NO: 29132 - RNA, 24 nt, Human
caauuggugguuuuuaaaacuggu

SEQ ID NO: 29133 - RNA, 24 nt, Human
uaaaauaauaugaaaugcagacuu

SEQ ID NO: 29134 - RNA, 24 nt, Human
caacugaaccacugucuugacuuu

SEQ ID NO: 29135 - RNA, 24 nt, Human
uuccuggcucugcaguuggguacu

SEQ ID NO: 29136 - RNA, 24 nt, Human
uguggacucagacuggaauuuaca

SEQ ID NO: 29137 - RNA, 24 nt, Human
uuucugggugugucuguggggaug

SEQ ID NO: 29138 - RNA, 24 nt, Human
gaagugaaaauuguucaguccaag

SEQ ID NO: 29139 - RNA, 24 nt, Human
aaaaagaccugcgcugcgaacccu

SEQ ID NO: 29140 - RNA, 24 nt, Human
acccuuuuggcauuguugccacca

SEQ ID NO: 29141 - RNA, 24 nt, Human
guccugcuggcaacggaaucgcgg

SEQ ID NO: 29142 - RNA, 22 nt, Human
uuccgugaccuucugaguggcu

SEQ ID NO: 29143 - RNA, 24 nt, Human
caagggccuggcuccucuuccugu

SEQ ID NO: 29144 - RNA, 24 nt, Human
agcagcucuuuuuucccuucuucu

SEQ ID NO: 29145 - RNA, 24 nt, Human
uugaagccaauuguuuuccaaaua

SEQ ID NO: 29146 - RNA, 24 nt, Human
caccugagcugcagucugacauca

SEQ ID NO: 29147 - RNA, 24 nt, Human
ucacuguagaccccaaauaccauc

SEQ ID NO: 29148 - RNA, 24 nt, Human
uuggucauaagucuuuucguauca

SEQ ID NO: 29149 - RNA, 24 nt, Human
ucggaccccuaccagcuccagacc

SEQ ID NO: 29150 - RNA, 24 nt, Human
cucgugccgcacugaacuggaccu

SEQ ID NO: 29151 - RNA, 24 nt, Human
uaguuguuuuagggcuuuuuauug

SEQ ID NO: 29152 - RNA, 24 nt, Human
cugcagggggccguggacccuccu

SEQ ID NO: 29153 - RNA, 24 nt, Human
gacaguucuauucuuucucauucg

SEQ ID NO: 29154 - RNA, 24 nt, Human
ucuccagaaaugcuuuggguucau

SEQ ID NO: 29155 - RNA, 24 nt, Human
uacagggccaugucagaauauguc

SEQ ID NO: 29156 - RNA, 24 nt, Human
uuugucagucuugggaucucuuuu

SEQ ID NO: 29157 - RNA, 24 nt, Human
uggaaagggagggggauucacuac

SEQ ID NO: 29158 - RNA, 24 nt, Human
uucagcugcaucugcgccaccugc

SEQ ID NO: 29159 - RNA, 24 nt, Human
ucagugguggcgccugggcucagc

SEQ ID NO: 29160 - RNA, 24 nt, Human
gaucacuaaagccucagacuccug

SEQ ID NO: 29161 - RNA, 24 nt, Human
gaaugugugugugccaaggcccca

SEQ ID NO: 29162 - RNA, 24 nt, Human
ugaaugcacaauugaaagagugaa

SEQ ID NO: 29163 - RNA, 24 nt, Human
uuuccuagacugaauugaagaaug

SEQ ID NO: 29164 - RNA, 24 nt, Human
gugacacucuggaaaucuuggaug

SEQ ID NO: 29165 - RNA, 24 nt, Human
ugccugccccucucuggcccacug

SEQ ID NO: 29166 - RNA, 24 nt, Human
ugugaaaauuuugcuguagcgaug

SEQ ID NO: 29167 - RNA, 24 nt, Human
ccucccagccccgguguggagucc

SEQ ID NO: 29168 - RNA, 24 nt, Human
uaaguccccaaucugguugccggc

SEQ ID NO: 29169 - RNA, 17 nt, Human
ugugaugaacacaucuc

SEQ ID NO: 29170 - RNA, 24 nt, Human
uuggcggccgagagccccugcacu

SEQ ID NO: 29171 - RNA, 24 nt, Human
uucuucugaaagcuguuaaagaug

SEQ ID NO: 29172 - RNA, 24 nt, Human
uaaugggucucaaaauucugugac

SEQ ID NO: 29173 - RNA, 24 nt, Human
ugcauuguuaucauuaaccagucu

SEQ ID NO: 29174 - RNA, 24 nt, Human
uaaugggucucaaaauucugugac

SEQ ID NO: 29175 - RNA, 24 nt, Human
uauuagggauaauauucauuuagc

SEQ ID NO: 29176 - RNA, 17 nt, Human
ccuugggguguaggcug

SEQ ID NO: 29177 - RNA, 24 nt, Human
uacaagccccugaugagcuugcca

SEQ ID NO: 29178 - RNA, 24 nt, Human
uagcauagguccugcucuguggau

SEQ ID NO: 29179 - RNA, 24 nt, Human
gacuccucucugguuuagggggug

SEQ ID NO: 29180 - RNA, 24 nt, Human
ucauucugcauggaucuguguuuc

SEQ ID NO: 29181 - RNA, 24 nt, Human
cauuggagggggcagcugugccau

SEQ ID NO: 29182 - RNA, 24 nt, Human
cggcaucggcuucggucugggugg

SEQ ID NO: 29183 - RNA, 24 nt, Human
ucccuggggucagccgcucuggcu

SEQ ID NO: 29184 - RNA, 24 nt, Human
ccuugcugguggcuuugggggccc

SEQ ID NO: 29185 - RNA, 24 nt, Human
uucacuuuaccuucugccaaaugc

SEQ ID NO: 29186 - RNA, 17 nt, Human
ucugacccagugugcgc

SEQ ID NO: 29187 - RNA, 24 nt, Human
guggaccugccacugguggaggug

SEQ ID NO: 29188 - RNA, 24 nt, Human
ucuggauucgguucuuggcuggga

SEQ ID NO: 29189 - RNA, 24 nt, Human
ugaguaaagagaaagagagaagga

SEQ ID NO: 29190 - RNA, 17 nt, Human
caccggagccugucccu

SEQ ID NO: 29191 - RNA, 24 nt, Human
uccacagcgccuggcucccgugcu

SEQ ID NO: 29192 - RNA, 24 nt, Human
ccacugggcaguggucacugggcu

SEQ ID NO: 29193 - RNA, 24 nt, Human
ucaaugcugccauugccaccauca

SEQ ID NO: 29194 - RNA, 24 nt, Human
caccacagccauugcugaggccug

SEQ ID NO: 29195 - RNA, 24 nt, Human
gggcacugaagaugaugcgaccca

SEQ ID NO: 29196 - RNA, 24 nt, Human
acuccacuccacuuggcugugauc

SEQ ID NO: 29197 - RNA, 24 nt, Human
acucguuccugcacuuggccauca

SEQ ID NO: 29198 - RNA, 24 nt, Human
aaggaacagcuugcacaugugccc

SEQ ID NO: 29199 - RNA, 19 nt, Human
uaccugcgcauugggaacu

SEQ ID NO: 29200 - RNA, 24 nt, Human
uuccaugguccagaagugcaagcu

SEQ ID NO: 29201 - RNA, 19 nt, Human
ugagugccggggccuugaa

SEQ ID NO: 29202 - RNA, 24 nt, Human
uuuguacaaaaauacugucaaaau

SEQ ID NO: 29203 - RNA, 24 nt, Human
cuggaaggcauacccuacaauuua

SEQ ID NO: 29204 - RNA, 23 nt, Human
uugaaagguauauuaaaauuaag

SEQ ID NO: 29205 - RNA, 22 nt, Human
uaacagccugcccgugcuuucc

SEQ ID NO: 29206 - RNA, 24 nt, Human
ugagaauuagugguuuagcccuua

SEQ ID NO: 29207 - RNA, 24 nt, Human
ucugaaauauucgauucaauugca

SEQ ID NO: 29208 - RNA, 24 nt, Human
aucauuuacacucccaagaacagu

SEQ ID NO: 29209 - RNA, 24 nt, Human
ucucugauaaccagugaugaugag

SEQ ID NO: 29210 - RNA, 24 nt, Human
ugagaugguaucucauugugguuu

SEQ ID NO: 29211 - RNA, 20 nt, Human
uugccuguucacucugauga

SEQ ID NO: 29212 - RNA, 24 nt, Human
guugcugggagugccuaucauugu

SEQ ID NO: 29213 - RNA, 24 nt, Human
ugcccgaauucggccucgagaucu

SEQ ID NO: 29214 - RNA, 24 nt, Human
ucacgucguucuaagggcauugcc

SEQ ID NO: 29215 - RNA, 24 nt, Human
uaaguacauaggucuuuauuuaaa

SEQ ID NO: 29216 - RNA, 18 nt, Human
guccagguguauaaugcc

SEQ ID NO: 29217 - RNA, 24 nt, Human
ucgcagcugcaaauaaucagaagc

SEQ ID NO: 29218 - RNA, 24 nt, Human
caucaaacggagcugggagucgcu

SEQ ID NO: 29219 - RNA, 24 nt, Human
ucagccccccaacagcuuccucag

SEQ ID NO: 29220 - RNA, 24 nt, Human
guuccuguaaacacccaucgcagc

SEQ ID NO: 29221 - RNA, 24 nt, Human
uaccuguacagaauggauuacaua

SEQ ID NO: 29222 - RNA, 24 nt, Human
uaaccaaaaacauaaagcgauaau

SEQ ID NO: 29223 - RNA, 24 nt, Human
uauauauacacacauauauauacg

SEQ ID NO: 29224 - RNA, 24 nt, Human
uguaaaaagcuuaguuuuguuuua

SEQ ID NO: 29225 - RNA, 24 nt, Human
cuaggucuguggggcauuacuggu

SEQ ID NO: 29226 - RNA, 24 nt, Human
uccccgaaagcacuggagaagggg

SEQ ID NO: 29227 - RNA, 24 nt, Human
uuguauagcauuccaccacaugaa

SEQ ID NO: 29228 - RNA, 24 nt, Human
ccuaccgcgacuucacaccuacga

SEQ ID NO: 29229 - RNA, 24 nt, Human
aaggcgccguacgaccccgagcgu

SEQ ID NO: 29230 - RNA, 24 nt, Human
uggcgugguuuaauacucgauaug

SEQ ID NO: 29231 - RNA, 24 nt, Human
cuccacagguagcucuagcauggg

SEQ ID NO: 29232 - RNA, 24 nt, Human
uaaguuaacagugugcugugccac

SEQ ID NO: 29233 - RNA, 24 nt, Human
uccacgaagcuggcuaaggaggug

SEQ ID NO: 29234 - RNA, 24 nt, Human
guugccauaacaaaguaguacaga

SEQ ID NO: 29235 - RNA, 24 nt, Human
uggaaagccauuucucuuuaaaaa

SEQ ID NO: 29236 - RNA, 24 nt, Human
ugugcaaaagaaauggaaggauuc

SEQ ID NO: 29237 - RNA, 24 nt, Human
uaucaaggaagggcaggcgugaug

SEQ ID NO: 29238 - RNA, 24 nt, Human
uucaaauuucuuucuuuuuuaauu

SEQ ID NO: 29239 - RNA, 24 nt, Human
uaagaguguugaaaaaaaaauuca

SEQ ID NO: 29240 - RNA, 24 nt, Human
cauggcuaagcaggcucaggugcc

SEQ ID NO: 29241 - RNA, 24 nt, Human
aaagaccaagggaaugcaaguccc

SEQ ID NO: 29242 - RNA, 21 nt, Human
ucccaaagauucaucuugaag

SEQ ID NO: 29243 - RNA, 24 nt, Human
uccggcagaggcggaggccugcuc

SEQ ID NO: 29244 - RNA, 24 nt, Human
aaggggccgcggcucggagcuggg

SEQ ID NO: 29245 - RNA, 24 nt, Human
ggacccggccggucccccgagggu

SEQ ID NO: 29246 - RNA, 24 nt, Human
ucucaacucguucgccuacucagc

SEQ ID NO: 29247 - RNA, 24 nt, Human
cagcgggagauucaccaggacugg

SEQ ID NO: 29248 - RNA, 24 nt, Human
ugcaaauuaugccuaugacauugg

SEQ ID NO: 29249 - RNA, 24 nt, Human
uaaguuugaacagaaggguugauc

SEQ ID NO: 29250 - RNA, 24 nt, Human
uacauuguguuaaaacagaagaua

SEQ ID NO: 29251 - RNA, 24 nt, Human
uuugacaucuuguaaauuuuaggu

SEQ ID NO: 29252 - RNA, 21 nt, Human
caaggguuucggacaacgugg

SEQ ID NO: 29253 - RNA, 24 nt, Human
ucagucaucaaaacaauguccauc

SEQ ID NO: 29254 - RNA, 24 nt, Human
uacaccacucccaagaagaauaag

SEQ ID NO: 29255 - RNA, 24 nt, Human
ugugguggcaggccccucaaagcc

SEQ ID NO: 29256 - RNA, 24 nt, Human
uuagugcaugguauuauaaaacaa

SEQ ID NO: 29257 - RNA, 24 nt, Human
ucccagaguacugggauuaugggc

SEQ ID NO: 29258 - RNA, 24 nt, Human
uccuuggucccuuugaauuuguau

SEQ ID NO: 29259 - RNA, 24 nt, Human
ucuaagggcaaacuccagcagcca

SEQ ID NO: 29260 - RNA, 24 nt, Human
acguggguguauccugcgacugcg

SEQ ID NO: 29261 - RNA, 24 nt, Human
cacccgcguauugcagggacguac

SEQ ID NO: 29262 - RNA, 24 nt, Human
aacugcuucugcauaccuuuugug

SEQ ID NO: 29263 - RNA, 24 nt, Human
cuugcauaucuuaaucgacauucc

SEQ ID NO: 29264 - RNA, 24 nt, Human
uaccuuguuauugcugucucaaca

SEQ ID NO: 29265 - RNA, 24 nt, Human
uggcauccggggccgggggucgcg

SEQ ID NO: 29266 - RNA, 24 nt, Human
ugagaaacauaguuaaauaacuga

SEQ ID NO: 29267 - RNA, 24 nt, Human
ucuugugcaguucauuggugauua

SEQ ID NO: 29268 - RNA, 24 nt, Human
uagaauguaucucuuugauuaaua

SEQ ID NO: 29269 - RNA, 24 nt, Human
uagacgucauuccucuugugacuu

SEQ ID NO: 29270 - RNA, 24 nt, Human
ugaagucaguaaccuaacugcaau

SEQ ID NO: 29271 - RNA, 24 nt, Human
ggacagguguacagacauguucuu

SEQ ID NO: 29272 - RNA, 24 nt, Human
ucgaauggacacauuaccagugaa

SEQ ID NO: 29273 - RNA, 24 nt, Human
uuuaaaaaaaugaagaaucaaacu

SEQ ID NO: 29274 - RNA, 17 nt, Human
caucaaguuacaaaagg

SEQ ID NO: 29275 - RNA, 24 nt, Human
ugaacacauacagaacugaauuaa

SEQ ID NO: 29276 - RNA, 24 nt, Human
gaagaagacaacauacauaaaaag

SEQ ID NO: 29277 - RNA, 24 nt, Human
aggaagacauguccagugugucca

SEQ ID NO: 29278 - RNA, 24 nt, Human
aagcagcugcucccgcgcacgugu

SEQ ID NO: 29279 - RNA, 24 nt, Human
ugacaggagccucugacgggacga

SEQ ID NO: 29280 - RNA, 24 nt, Human
gaggaucccuuagcuguguauuac

SEQ ID NO: 29281 - RNA, 24 nt, Human
ugggcacgguuaugaaauauuuug

SEQ ID NO: 29282 - RNA, 24 nt, Human
uaaaucaugugcucuguaaucaag

SEQ ID NO: 29283 - RNA, 20 nt, Human
ucccacugaggaucaucuuc

SEQ ID NO: 29284 - RNA, 24 nt, Human
acuuuuuuuuuuuuuugcuuuuaa

SEQ ID NO: 29285 - RNA, 24 nt, Human
ucaccacuggggaccagucaaagg

SEQ ID NO: 29286 - RNA, 24 nt, Human
cagcuuccucgccaccagggagaa

SEQ ID NO: 29287 - RNA, 22 nt, Human
ugauacaaguucuggcauuggu

SEQ ID NO: 29288 - RNA, 24 nt, Human
uauuacacacggauguaagcauuu

SEQ ID NO: 29289 - RNA, 24 nt, Human
uaucucuaccagugguucucaaac

SEQ ID NO: 29290 - RNA, 24 nt, Human
uaccgcauccuucuuuuccucagc

SEQ ID NO: 29291 - RNA, 24 nt, Human
auccagguggcccccaaauccagu

SEQ ID NO: 29292 - RNA, 24 nt, Human
cagcauucuggggcuuguaacacu

SEQ ID NO: 29293 - RNA, 24 nt, Human
ugcauuguuaucauuaaccagucu

SEQ ID NO: 29294 - RNA, 24 nt, Human
uauuagggauaauauucauuuagc

SEQ ID NO: 29295 - RNA, 24 nt, Human
uccaugagucacaugcuucccuua

SEQ ID NO: 29296 - RNA, 21 nt, Human
ucacaggccagcugcggacac

SEQ ID NO: 29297 - RNA, 24 nt, Human
agaagaagaagaaauggcaaagag

SEQ ID NO: 29298 - RNA, 24 nt, Human
uggcuuauuuguuuuguauucaau

SEQ ID NO: 29299 - RNA, 24 nt, Human
ucugaucaauccuucuuuuucucu

SEQ ID NO: 29300 - RNA, 24 nt, Human
ucuuuuuuuuuucacuuggaauua

SEQ ID NO: 29301 - RNA, 24 nt, Human
uucacauuuccuuauuugcuuaug

SEQ ID NO: 29302 - RNA, 24 nt, Human
aucauccuagaaagcccgcccugu

SEQ ID NO: 29303 - RNA, 24 nt, Human
uagcgugugccuauggucccagcu

SEQ ID NO: 29304 - RNA, 24 nt, Human
agccaggaggucaaggcugcagug

SEQ ID NO: 29305 - RNA, 24 nt, Human
aguacaaugcugagaagccuaaga

SEQ ID NO: 29306 - RNA, 24 nt, Human
uauuuugguuuucuuacaaagguu

SEQ ID NO: 29307 - RNA, 24 nt, Human
uaggagcaaugaucagaugggugc

SEQ ID NO: 29308 - RNA, 24 nt, Human
uauuacggauucaaagacuuauuu

SEQ ID NO: 29309 - RNA, 24 nt, Human
uugcuucuccaaggucauucuuaa

SEQ ID NO: 29310 - RNA, 24 nt, Human
cuuuauggguacuucucaucuugu

SEQ ID NO: 29311 - RNA, 24 nt, Human
aucauauacauuaaaauaccacca

SEQ ID NO: 29312 - RNA, 24 nt, Human
agggauaggcucacuuuguuaaua

SEQ ID NO: 29313 - RNA, 24 nt, Human
ugcauuguuaucauuaaccagucu

SEQ ID NO: 29314 - RNA, 24 nt, Human
uauuagggauaauauucauuuagc

SEQ ID NO: 29315 - RNA, 24 nt, Human
uuuaacuuuuuuaaugggucucaa

SEQ ID NO: 29316 - RNA, 24 nt, Human
agguaguagucguacuucuucucg

SEQ ID NO: 29317 - RNA, 24 nt, Human
uggugggaggguaggaggugcagc

SEQ ID NO: 29318 - RNA, 24 nt, Human
uaaggaaauguugagggcaagcca

SEQ ID NO: 29319 - RNA, 21 nt, Human
gagaaucugagacaucuugcc

SEQ ID NO: 29320 - RNA, 24 nt, Human
cagccagcaccucuuuauagaacc

SEQ ID NO: 29321 - RNA, 24 nt, Human
uggcauaguggugauaauugacau

SEQ ID NO: 29322 - RNA, 23 nt, Human
uggcaguaucuugugacuuuggu

SEQ ID NO: 29323 - RNA, 24 nt, Human
ugacuauaucaucaaccaguuuuc

SEQ ID NO: 29324 - RNA, 24 nt, Human
gccaauuaucuagcuuuuugucau

SEQ ID NO: 29325 - RNA, 24 nt, Human
uagguugagagaaugugacuauga

SEQ ID NO: 29326 - RNA, 24 nt, Human
ugcauuguuaucauuaaccagucu

SEQ ID NO: 29327 - RNA, 24 nt, Human
uauuagggauaauauucauuuagc

SEQ ID NO: 29328 - RNA, 24 nt, Human
uuuaacuuuuuuaaugggucucaa

SEQ ID NO: 29329 - RNA, 24 nt, Human
ugagcuccauacauggguguuauu

SEQ ID NO: 29330 - RNA, 24 nt, Human
uaucaaggaagggcaggcgugaug

SEQ ID NO: 29331 - RNA, 24 nt, Human
agaagaagaagaaauggcaaagag

SEQ ID NO: 29332 - RNA, 24 nt, Human
uguggauauaguuuucccuguugg

SEQ ID NO: 29333 - RNA, 24 nt, Human
ugacuaaagaaaccugcugcacau

SEQ ID NO: 29334 - RNA, 24 nt, Human
gagcaugcaucuucucggugagcc

SEQ ID NO: 29335 - RNA, 24 nt, Human
ucgacgcucaaggucugggcgccu

SEQ ID NO: 29336 - RNA, 24 nt, Human
cucugccuuucucagggccuggag

SEQ ID NO: 29337 - RNA, 24 nt, Human
caccugcacagcaguuaacagcag

SEQ ID NO: 29338 - RNA, 24 nt, Human
ccccggagcccagccagcucugcc

SEQ ID NO: 29339 - RNA, 24 nt, Human
uaaaagaccauccauccagucugc

SEQ ID NO: 29340 - RNA, 24 nt, Human
ugggagucucgggcagaucaccau

SEQ ID NO: 29341 - RNA, 24 nt, Human
ucagcccacaugagcaacaccacc

SEQ ID NO: 29342 - RNA, 24 nt, Human
ugaauggacggguucaggccugau

SEQ ID NO: 29343 - RNA, 24 nt, Human
acaggaacaccagcggccucuccu

SEQ ID NO: 29344 - RNA, 24 nt, Human
ugcauuguuaucauuaaccagucu

SEQ ID NO: 29345 - RNA, 24 nt, Human
uauuagggauaauauucauuuagc

SEQ ID NO: 29346 - RNA, 21 nt, Human
uaugacaccagcuucugcgug

SEQ ID NO: 29347 - RNA, 24 nt, Human
ugucguugcagagcucuguaguua

SEQ ID NO: 29348 - RNA, 24 nt, Human
uuaaaaaucugcaucuuccacuau

SEQ ID NO: 29349 - RNA, 24 nt, Human
uuuuccuagcuacaucugguaccu

SEQ ID NO: 29350 - RNA, 24 nt, Human
acugguugcuucuggugggaucau

SEQ ID NO: 29351 - RNA, 24 nt, Human
uucgaaguucaugcaaccaacuaa

SEQ ID NO: 29352 - RNA, 24 nt, Human
uuuguacaaaaauacugucaaaau

SEQ ID NO: 29353 - RNA, 24 nt, Human
guggauguuuauuuaaaacaaaaa

SEQ ID NO: 29354 - RNA, 24 nt, Human
uguggauauaguuuucccuguugg

SEQ ID NO: 29355 - RNA, 24 nt, Human
ugacuaaagaaaccugcugcacau

SEQ ID NO: 29356 - RNA, 24 nt, Human
gagcaugcaucuucucggugagcc

SEQ ID NO: 29357 - RNA, 24 nt, Human
uaucccacugugucugguaugugu

SEQ ID NO: 29358 - RNA, 24 nt, Human
ccgggucgacccacgcguccgcac

SEQ ID NO: 29359 - RNA, 24 nt, Human
ugacuaaagaaaccugcugcacau

SEQ ID NO: 29360 - RNA, 24 nt, Human
gagcaugcaucuucucggugagcc

SEQ ID NO: 29361 - RNA, 24 nt, Human
ugggagcguguggguucuuaaaca

SEQ ID NO: 29362 - RNA, 19 nt, Human
uaccagaguuaagcugucc

SEQ ID NO: 29363 - RNA, 24 nt, Human
ucaguucccagacuagauugauac

SEQ ID NO: 29364 - RNA, 24 nt, Human
uggcugcgagggcgaggacguggu

SEQ ID NO: 29365 - RNA, 20 nt, Human
ucagcagagaugacaggggc

SEQ ID NO: 29366 - RNA, 24 nt, Human
uugaagccaguggggcaccaaucc

SEQ ID NO: 29367 - RNA, 24 nt, Human
uugugggagccuaguggagagcag

SEQ ID NO: 29368 - RNA, 24 nt, Human
aaguagcugggauuacaggcaugu

SEQ ID NO: 29369 - RNA, 22 nt, Human
cgccgggacagcagacugccgg

SEQ ID NO: 29370 - RNA, 24 nt, Human
guuccuguaaaauccaucgcagcu

SEQ ID NO: 29371 - RNA, 24 nt, Human
ggacuggagcugcuugccaaggua

SEQ ID NO: 29372 - RNA, 24 nt, Human
uggcugagcaucauggaccuuccu

SEQ ID NO: 29373 - RNA, 24 nt, Human
ucugcaauuugguauaaauguuag

SEQ ID NO: 29374 - RNA, 24 nt, Human
ucaggccaaaguagccaugguaag

SEQ ID NO: 29375 - RNA, 24 nt, Human
cuuggagaccucccucucagucaa

SEQ ID NO: 29376 - RNA, 24 nt, Human
aaaaaacauuauaaaaaauucaua

SEQ ID NO: 29377 - RNA, 24 nt, Human
uacaagguuuguugaauacuaguu

SEQ ID NO: 29378 - RNA, 24 nt, Human
ucuaaagugcauucuugcagcuaa

SEQ ID NO: 29379 - RNA, 24 nt, Human
uauuauggucaaugaaaaaaccgg

SEQ ID NO: 29380 - RNA, 24 nt, Human
aagggccccccacccuccaccuuu

SEQ ID NO: 29381 - RNA, 24 nt, Human
aaagggacauuuuuaacggggggg

SEQ ID NO: 29382 - RNA, 24 nt, Human
acgaggggucccaagucuagcccg

SEQ ID NO: 29383 - RNA, 24 nt, Human
gcgcguugcugcggccgugguccg

SEQ ID NO: 29384 - RNA, 24 nt, Human
ugcauuguuaucauuaaccagucu

SEQ ID NO: 29385 - RNA, 24 nt, Human
uaaugggucucaaaauucugugac

SEQ ID NO: 29386 - RNA, 24 nt, Human
uauuagggauaauauucauuuagc

SEQ ID NO: 29387 - RNA, 24 nt, Human
gcacaacucccucagcccacagug

SEQ ID NO: 29388 - RNA, 24 nt, Human
ggagacagaugagaaaugagaaca

SEQ ID NO: 29389 - RNA, 24 nt, Human
cagcacaagccucaugcacaguag

SEQ ID NO: 29390 - RNA, 24 nt, Human
agguguuggagguugcacugagcu

SEQ ID NO: 29391 - RNA, 24 nt, Human
cgucaugucuaagucagagucucc

SEQ ID NO: 29392 - RNA, 24 nt, Human
augaauuuuguuuuguacugucac

SEQ ID NO: 29393 - RNA, 24 nt, Human
uaaaugaacauuugcaauuuuaaa

SEQ ID NO: 29394 - RNA, 24 nt, Human
gcugaaguauguccuguuuuucuu

SEQ ID NO: 29395 - RNA, 24 nt, Human
uccacaacaacuucggagugcucu

SEQ ID NO: 29396 - RNA, 24 nt, Human
agguggaggcugcaaugagccaag

SEQ ID NO: 29397 - RNA, 24 nt, Human
ugagagguggagguugcagugagc

SEQ ID NO: 29398 - RNA, 24 nt, Human
ugaaaaaugucacuucaguaaaaa

SEQ ID NO: 29399 - RNA, 24 nt, Human
uuuaaguauuuacuuuaaaaaauu

SEQ ID NO: 29400 - RNA, 24 nt, Human
uauaaaauuuaccuuuaaguauuu

SEQ ID NO: 29401 - RNA, 24 nt, Human
uucaacuguccuuauuguccauua

SEQ ID NO: 29402 - RNA, 24 nt, Human
uccccgauggcccacugcgugacc

SEQ ID NO: 29403 - RNA, 19 nt, Human
uaccgcuuugagacagucc

SEQ ID NO: 29404 - RNA, 24 nt, Human
ucauacucagacaauuguauuacu

SEQ ID NO: 29405 - RNA, 24 nt, Human
uguauacaugaagcuuagauuaau

SEQ ID NO: 29406 - RNA, 19 nt, Human
uacuuauguuuaauuguac

SEQ ID NO: 29407 - RNA, 24 nt, Human
uggaaaugguuuuaaaggauuacu

SEQ ID NO: 29408 - RNA, 24 nt, Human
uguguuguggucuggggagaaugu

SEQ ID NO: 29409 - RNA, 22 nt, Human
ugauagcaacaacaggaaucuc

SEQ ID NO: 29410 - RNA, 24 nt, Human
uagguucagacuucagguaucucu

SEQ ID NO: 29411 - RNA, 24 nt, Human
ugagcuucucgccaaguucuuuau

SEQ ID NO: 29412 - RNA, 24 nt, Human
ugugaggucucuaacuagcuguau

SEQ ID NO: 29413 - RNA, 24 nt, Human
ucuugugcagccuuuaugagggca

SEQ ID NO: 29414 - RNA, 24 nt, Human
aaggacccuggguucuucugucag

SEQ ID NO: 29415 - RNA, 24 nt, Human
ucccggaaccacaagauugucaau

SEQ ID NO: 29416 - RNA, 24 nt, Human
agugcauagugaggccacugcugc

SEQ ID NO: 29417 - RNA, 20 nt, Human
uucguggaugccacaggacu

SEQ ID NO: 29418 - RNA, 24 nt, Human
aaagauggucggcugcuuuuggua

SEQ ID NO: 29419 - RNA, 24 nt, Human
ggacagguguacagacauguucuu

SEQ ID NO: 29420 - RNA, 24 nt, Human
uguggauauaguuuucccuguugg

SEQ ID NO: 29421 - RNA, 24 nt, Human
ugacuaaagaaaccugcugcacau

SEQ ID NO: 29422 - RNA, 24 nt, Human
gagcaugcaucuucucggugagcc

SEQ ID NO: 29423 - RNA, 24 nt, Human
aggcaaggugacgggacuggaagc

SEQ ID NO: 29424 - RNA, 24 nt, Human
aacaguguaggucuuggugaagcc

SEQ ID NO: 29425 - RNA, 24 nt, Human
acugaaucgaugguaauaauguug

SEQ ID NO: 29426 - RNA, 24 nt, Human
ccuuugaucucccacaccaaaaga

SEQ ID NO: 29427 - RNA, 24 nt, Human
uagguaauuuuagagaguauaauu

SEQ ID NO: 29428 - RNA, 24 nt, Human
gcucuuauugcaaaagacauuaau

SEQ ID NO: 29429 - RNA, 24 nt, Human
ugugaauuuaaccucucccgaucu

SEQ ID NO: 29430 - RNA, 24 nt, Human
agugguagauugguucauacgaug

SEQ ID NO: 29431 - RNA, 24 nt, Human
ugccagagggagggccaugggccg

SEQ ID NO: 29432 - RNA, 24 nt, Human
guggugcaggggacaagaggcugu

SEQ ID NO: 29433 - RNA, 24 nt, Human
cugggcgcccucuuaccgcucacg

SEQ ID NO: 29434 - RNA, 24 nt, Human
uucaaggcaauggcuuuuuaaauc

SEQ ID NO: 29435 - RNA, 24 nt, Human
uugcugccuguuguuuccucugga

SEQ ID NO: 29436 - RNA, 24 nt, Human
uauguucuuugucuuaaucuuagc

SEQ ID NO: 29437 - RNA, 24 nt, Human
aucaauuuuugguguauugauuuc

SEQ ID NO: 29438 - RNA, 24 nt, Human
cacccguucccagggcuccuaagu

SEQ ID NO: 29439 - RNA, 24 nt, Human
uaccaguuucuuauuuuuacacau

SEQ ID NO: 29440 - RNA, 17 nt, Human
uuagagagaggauaugu

SEQ ID NO: 29441 - RNA, 21 nt, Human
cauuggacaggacauccagcc

SEQ ID NO: 29442 - RNA, 24 nt, Human
cagcggcagagagccauccucuau

SEQ ID NO: 29443 - RNA, 24 nt, Human
aggaauugaaaguuaaagcaucuc

SEQ ID NO: 29444 - RNA, 22 nt, Human
ugaaacagacagauaaaguucc

SEQ ID NO: 29445 - RNA, 24 nt, Human
uugcgggucugucagguuuggaaa

SEQ ID NO: 29446 - RNA, 24 nt, Human
aggcaggggguggggaaggcggug

SEQ ID NO: 29447 - RNA, 24 nt, Human
ucuugcuggggucgaagcaguugg

SEQ ID NO: 29448 - RNA, 24 nt, Human
cacccugucuccccuggucucacu

SEQ ID NO: 29449 - RNA, 19 nt, Human
ugccuuggauguuuucagc

SEQ ID NO: 29450 - RNA, 23 nt, Human
ccaccaggccuucuagagcagca

SEQ ID NO: 29451 - RNA, 22 nt, Human
uagcaugccucuuaauuuuucu

SEQ ID NO: 29452 - RNA, 24 nt, Human
uauaaaacuuugauaguuacauug

SEQ ID NO: 29453 - RNA, 24 nt, Human
aacagguaaccacuugagaggaug

SEQ ID NO: 29454 - RNA, 24 nt, Human
caccugaaagaaacuucauacuug

SEQ ID NO: 29455 - RNA, 24 nt, Human
ucgaccacagaugcucugaacguu

SEQ ID NO: 29456 - RNA, 24 nt, Human
uguuauggggauaagcuggugagg

SEQ ID NO: 29457 - RNA, 21 nt, Human
ugggaggggcugaauguggug

SEQ ID NO: 29458 - RNA, 24 nt, Human
aagcguuuugagcagaaaggauuc

SEQ ID NO: 29459 - RNA, 24 nt, Human
aaggaaccauggccaacugugagc

SEQ ID NO: 29460 - RNA, 24 nt, Human
aauuuuaguuauaaauuagugaag

SEQ ID NO: 29461 - RNA, 24 nt, Human
uaaaugcgcuugauggccucggcu

SEQ ID NO: 29462 - RNA, 24 nt, Human
ucucucaucuuugaaaggccauaa

SEQ ID NO: 29463 - RNA, 24 nt, Human
aggggucacuuccagaacugaguc

SEQ ID NO: 29464 - RNA, 24 nt, Human
uaccgugcagcuggaugacguacc

SEQ ID NO: 29465 - RNA, 24 nt, Human
caaaggcccuggcaaacgucaaca

SEQ ID NO: 29466 - RNA, 20 nt, Human
ugaggugacagucacggagg

SEQ ID NO: 29467 - RNA, 24 nt, Human
uggcaagucacuuugacagacauu

SEQ ID NO: 29468 - RNA, 24 nt, Human
ugagaauggcaaaauuagucgccu

SEQ ID NO: 29469 - RNA, 24 nt, Human
uacaccacucccaagaagaauaag

SEQ ID NO: 29470 - RNA, 19 nt, Human
gaccauuucuacccugccu

SEQ ID NO: 29471 - RNA, 24 nt, Human
ugucucagggacggucacccauua

SEQ ID NO: 29472 - RNA, 24 nt, Human
ugcauuguuaucauuaaccagucu

SEQ ID NO: 29473 - RNA, 24 nt, Human
uaaugggucucaaaauucugugac

SEQ ID NO: 29474 - RNA, 24 nt, Human
ggaaaacaaguacaaagguuacgg

SEQ ID NO: 29475 - RNA, 24 nt, Human
caagcuccucuccccccucuuuuc

SEQ ID NO: 29476 - RNA, 24 nt, Human
cagcaguagcagccccucccacag

SEQ ID NO: 29477 - RNA, 24 nt, Human
uaccuaaaaauguggaaauggcuu

SEQ ID NO: 29478 - RNA, 24 nt, Human
uggagugcaguggcacaaucuugg

SEQ ID NO: 29479 - RNA, 24 nt, Human
ugugacucuucucucaaccuuggg

SEQ ID NO: 29480 - RNA, 17 nt, Human
gggaauccugcggcagg

SEQ ID NO: 29481 - RNA, 24 nt, Human
ugccaccacccuugucuuccucug

SEQ ID NO: 29482 - RNA, 24 nt, Human
uauuagggauaauauucauuuagc

SEQ ID NO: 29483 - RNA, 24 nt, Human
uuuaacuuuuuuaaugggucucaa

SEQ ID NO: 29484 - RNA, 24 nt, Human
cuaacccuggcugcacauuggaag

SEQ ID NO: 29485 - RNA, 24 nt, Human
uuccugaggcccgagccacacccu

SEQ ID NO: 29486 - RNA, 24 nt, Human
aauuuuguucaggucccuuuuaau

SEQ ID NO: 29487 - RNA, 24 nt, Human
caaggcaacccagggacuacaacu

SEQ ID NO: 29488 - RNA, 20 nt, Human
uguccagaauuuccagaagu

SEQ ID NO: 29489 - RNA, 24 nt, Human
gccccguguuggaugcagugucuc

SEQ ID NO: 29490 - RNA, 24 nt, Human
ugagugcccccagggaggggcugg

SEQ ID NO: 29491 - RNA, 24 nt, Human
uguggcccuucucuuuaaguccga

SEQ ID NO: 29492 - RNA, 24 nt, Human
acugguucaccuacaaugagacaa

SEQ ID NO: 29493 - RNA, 24 nt, Human
ucacauagguugugccaugagugg

SEQ ID NO: 29494 - RNA, 24 nt, Human
ucuacagccauggggauccagaca

SEQ ID NO: 29495 - RNA, 20 nt, Human
cagagggugcccagagcucc

SEQ ID NO: 29496 - RNA, 24 nt, Human
uccccgcguagccgcugcuccucc

SEQ ID NO: 29497 - RNA, 24 nt, Human
uguccugguuuauguuaccagcaa

SEQ ID NO: 29498 - RNA, 24 nt, Human
cauugaaacuucccccaaaucuga

SEQ ID NO: 29499 - RNA, 24 nt, Human
uuggcccacaucuguuuaaucuuc

SEQ ID NO: 29500 - RNA, 24 nt, Human
uucgaaguucaugcaaccaacuaa

SEQ ID NO: 29501 - RNA, 24 nt, Human
uuuguacaaaaauacugucaaaau

SEQ ID NO: 29502 - RNA, 24 nt, Human
acgacauuccacacccuauuauca

SEQ ID NO: 29503 - RNA, 24 nt, Human
agaauaccuggcgcugaaacagcc

SEQ ID NO: 29504 - RNA, 22 nt, Human
uagaguccuccguuccucuugg

SEQ ID NO: 29505 - RNA, 24 nt, Human
ucagugccugauggaguggccggg

SEQ ID NO: 29506 - RNA, 24 nt, Human
cgagcaguaagugguuuuguuguu

SEQ ID NO: 29507 - RNA, 23 nt, Human
uauuuugcauguuucaacuguuc

SEQ ID NO: 29508 - RNA, 24 nt, Human
cuuguugucuucauaguauuuguu

SEQ ID NO: 29509 - RNA, 24 nt, Human
uggaaaaacuaagggaugcuuuag

SEQ ID NO: 29510 - RNA, 24 nt, Human
cgaccugcgcuaccugucggagga

SEQ ID NO: 29511 - RNA, 24 nt, Human
aacacuguuucagucaagaaugaa

SEQ ID NO: 29512 - RNA, 24 nt, Human
uuucuaguugcuaagauuugccaa

SEQ ID NO: 29513 - RNA, 24 nt, Human
uuugccagucagccuaguucuucu

SEQ ID NO: 29514 - RNA, 24 nt, Human
uguucagccccuaaacgaauggca

SEQ ID NO: 29515 - RNA, 19 nt, Human
agggauggaacgucaccgu

SEQ ID NO: 29516 - RNA, 24 nt, Human
ucaguuuuauugacuuccagcauu

SEQ ID NO: 29517 - RNA, 18 nt, Human
uguguuaaauuaauuugu

SEQ ID NO: 29518 - RNA, 24 nt, Human
ugaaaacguccccauuuugggacu

SEQ ID NO: 29519 - RNA, 24 nt, Human
acuccaauugcuuggaugacaguc

SEQ ID NO: 29520 - RNA, 24 nt, Human
ugagaagagugaaguuuuaugaug

SEQ ID NO: 29521 - RNA, 20 nt, Human
gagcaggcucagucacucca

SEQ ID NO: 29522 - RNA, 24 nt, Human
uuuauggccaagucacuuugacag

SEQ ID NO: 29523 - RNA, 24 nt, Human
uacaccacucccaagaagaauaag

SEQ ID NO: 29524 - RNA, 24 nt, Human
aaaugcuaacaucccugccuggua

SEQ ID NO: 29525 - RNA, 24 nt, Human
uuuaaauaucucaagagcauacca

SEQ ID NO: 29526 - RNA, 24 nt, Human
ucuaccucugagaguuuuucauca

SEQ ID NO: 29527 - RNA, 24 nt, Human
ugaagucauuuuccuuugugagag

SEQ ID NO: 29528 - RNA, 24 nt, Human
ucugcaauuugguauaaauguuag

SEQ ID NO: 29529 - RNA, 23 nt, Human
ugaaaaaaguucauacuaaauau

SEQ ID NO: 29530 - RNA, 24 nt, Human
aacuguaucccguugaugcacuaa

SEQ ID NO: 29531 - RNA, 24 nt, Human
aaagcagcaauucuauguucauag

SEQ ID NO: 29532 - RNA, 19 nt, Human
ugccccguuuaaggucagg

SEQ ID NO: 29533 - RNA, 24 nt, Human
uuucugaacugacucccaguuaug

SEQ ID NO: 29534 - RNA, 24 nt, Human
agcgcucuucuucggaguugcgcc

SEQ ID NO: 29535 - RNA, 24 nt, Human
cgccagugagcagugagagggaac

SEQ ID NO: 29536 - RNA, 24 nt, Human
uaagagaucuaggaaugaggaguc

SEQ ID NO: 29537 - RNA, 24 nt, Human
uaaguaacaccuccucaccuaugg

SEQ ID NO: 29538 - RNA, 24 nt, Human
ucuguacaucuuacuggguuuaau

SEQ ID NO: 29539 - RNA, 24 nt, Human
ccagggggggcaguggggugggcc

SEQ ID NO: 29540 - RNA, 24 nt, Human
gcgcuggccguuccagccgggguc

SEQ ID NO: 29541 - RNA, 24 nt, Human
cuacggggaugacuaccgggccag

SEQ ID NO: 29542 - RNA, 24 nt, Human
cauugugcuggaggaugagggcag

SEQ ID NO: 29543 - RNA, 24 nt, Human
guggggccagagugagccccuucc

SEQ ID NO: 29544 - RNA, 24 nt, Human
auggaaccuggggggguucucucc

SEQ ID NO: 29545 - RNA, 24 nt, Human
acuggauugacaguauccuggccu

SEQ ID NO: 29546 - RNA, 24 nt, Human
ucagugguggaggaguucucggug

SEQ ID NO: 29547 - RNA, 24 nt, Human
ucuccaggugaagcagaaaggugc

SEQ ID NO: 29548 - RNA, 23 nt, Human
uucacaguaugaguuagaaugca

SEQ ID NO: 29549 - RNA, 24 nt, Human
uuugaucaggagaacgugguuacu

SEQ ID NO: 29550 - RNA, 24 nt, Human
ugcauuguuaucauuaaccagucu

SEQ ID NO: 29551 - RNA, 24 nt, Human
uauuagggauaauauucauuuagc

SEQ ID NO: 29552 - RNA, 24 nt, Human
ugcauuguuaucauuaaccagucu

SEQ ID NO: 29553 - RNA, 24 nt, Human
uauuagggauaauauucauuuagc

SEQ ID NO: 29554 - RNA, 24 nt, Human
uuuaacuuuuuuaaugggucucaa

SEQ ID NO: 29555 - RNA, 24 nt, Human
ugcauuguuaucauuaaccagucu

SEQ ID NO: 29556 - RNA, 24 nt, Human
uauuagggauaauauucauuuagc

SEQ ID NO: 29557 - RNA, 24 nt, Human
uuuaacuuuuuuaaugggucucaa

SEQ ID NO: 29558 - RNA, 24 nt, Human
ugugcagaagaaauggaaggauuc

SEQ ID NO: 29559 - RNA, 24 nt, Human
uggcuuauuuguuuuguauucaau

SEQ ID NO: 29560 - RNA, 18 nt, Human
uaucaaggaagggcaggc

SEQ ID NO: 29561 - RNA, 24 nt, Human
ucaguuaaaaaagaagaagaagaa

SEQ ID NO: 29562 - RNA, 24 nt, Human
ucaguuaaaaaagaagaagaagaa

SEQ ID NO: 29563 - RNA, 24 nt, Human
ucugaucaauccuucuuuuucucu

SEQ ID NO: 29564 - RNA, 24 nt, Human
ucaaugcuucauacuuuuucuugg

SEQ ID NO: 29565 - RNA, 24 nt, Human
aggcagcucacgcgguugucgugg

SEQ ID NO: 29566 - RNA, 24 nt, Human
uugcaguugaagucgucguagcca

SEQ ID NO: 29567 - RNA, 21 nt, Human
uaucaaguggcauccacgcuu

SEQ ID NO: 29568 - RNA, 24 nt, Human
ugcuagagaggaaauggcugcuuc

SEQ ID NO: 29569 - RNA, 24 nt, Human
uucagugucucagaccuugcccca

SEQ ID NO: 29570 - RNA, 23 nt, Human
cacccuuuaugguuucggcgguu

SEQ ID NO: 29571 - RNA, 24 nt, Human
uaggauccuguuuuauaguauaga

SEQ ID NO: 29572 - RNA, 24 nt, Human
uguaaagaaugcuucuuguucauu

SEQ ID NO: 29573 - RNA, 24 nt, Human
ugaaugaaugugaaggccuaggac

SEQ ID NO: 29574 - RNA, 24 nt, Human
caugauaauccauuaaucuaucaa

SEQ ID NO: 29575 - RNA, 24 nt, Human
ugagaaguccaagguugagggcca

SEQ ID NO: 29576 - RNA, 24 nt, Human
ucaggucuucaucuucuuacaaag

SEQ ID NO: 29577 - RNA, 24 nt, Human
uguaagauuuguuauauauccuua

SEQ ID NO: 29578 - RNA, 24 nt, Human
uacaccguccggaaggcauuggcc

SEQ ID NO: 29579 - RNA, 24 nt, Human
ccccggccagcccgccugagauga

SEQ ID NO: 29580 - RNA, 24 nt, Human
uagcuccgguagaaggccccaacc

SEQ ID NO: 29581 - RNA, 21 nt, Human
ugccuuugaaguagccggcca

SEQ ID NO: 29582 - RNA, 24 nt, Human
uauuacagauacaaauaagaguac

SEQ ID NO: 29583 - RNA, 24 nt, Human
augaauuuuugugaacaggagugu

SEQ ID NO: 29584 - RNA, 19 nt, Human
ucgcauagaguggaugcua

SEQ ID NO: 29585 - RNA, 24 nt, Human
uagcauaauagaaaaguggagaau

SEQ ID NO: 29586 - RNA, 22 nt, Human
auggacacagagucccagacgu

SEQ ID NO: 29587 - RNA, 22 nt, Human
cacccuuugggaucuugggcuu

SEQ ID NO: 29588 - RNA, 24 nt, Human
cuuggccuuggccuuggccuuggc

SEQ ID NO: 29589 - RNA, 24 nt, Human
cauuguuggccugcaucuucuuua

SEQ ID NO: 29590 - RNA, 24 nt, Human
ggaggagauaaaauaauucauucu

SEQ ID NO: 29591 - RNA, 24 nt, Human
accaguuuccaucaggauuuauca

SEQ ID NO: 29592 - RNA, 24 nt, Human
agcaguucuuuuuuuuuuuccuuu

SEQ ID NO: 29593 - RNA, 24 nt, Human
auguagguuuuacaauauuccaug

SEQ ID NO: 29594 - RNA, 24 nt, Human
uauuuugggggguaggaaacgggu

SEQ ID NO: 29595 - RNA, 24 nt, Human
uguuuugucuauaugugcggcuuu

SEQ ID NO: 29596 - RNA, 24 nt, Human
uugaagccaguggggcaccaaucc

SEQ ID NO: 29597 - RNA, 24 nt, Human
uaccauggggagggucacauuuca

SEQ ID NO: 29598 - RNA, 20 nt, Human
ucccacacaauaaugucuuc

SEQ ID NO: 29599 - RNA, 24 nt, Human
aagaacacagaauuuauuuguagc

SEQ ID NO: 29600 - RNA, 24 nt, Human
agccuaaucuggaagaucuggcau

SEQ ID NO: 29601 - RNA, 24 nt, Human
uuguaagaguggaauuaacugccc

SEQ ID NO: 29602 - RNA, 24 nt, Human
ccaguacagaucguuucucaucuc

SEQ ID NO: 29603 - RNA, 24 nt, Human
ugaucucguuggacugcguggcua

SEQ ID NO: 29604 - RNA, 24 nt, Human
caggugguugcuuugaacuuuauu

SEQ ID NO: 29605 - RNA, 24 nt, Human
ggcccuugacauugugcgaaacug

SEQ ID NO: 29606 - RNA, 24 nt, Human
uguguuuguagacuuggaacccac

SEQ ID NO: 29607 - RNA, 24 nt, Human
ugauggacgcguguguucaacuau

SEQ ID NO: 29608 - RNA, 24 nt, Human
uggcaagcaguccaagcggagucu

SEQ ID NO: 29609 - RNA, 24 nt, Human
gguaugcuuauacacuuacacuuu

SEQ ID NO: 29610 - RNA, 24 nt, Human
ucgcuccguggccuuagcugugcu

SEQ ID NO: 29611 - RNA, 18 nt, Human
uaucaaggaagggcaggc

SEQ ID NO: 29612 - RNA, 24 nt, Human
ucaguuaaaaaagaagaagaagaa

SEQ ID NO: 29613 - RNA, 24 nt, Human
ucaauuuuuauuuugguuuucuua

SEQ ID NO: 29614 - RNA, 24 nt, Human
uccacaggccuuggccagcggggg

SEQ ID NO: 29615 - RNA, 24 nt, Human
uaggaccucgccaucucccuuaau

SEQ ID NO: 29616 - RNA, 21 nt, Human
cauuggggaagaauccaacug

SEQ ID NO: 29617 - RNA, 24 nt, Human
uagagugguggcucccagaauccc

SEQ ID NO: 29618 - RNA, 20 nt, Human
ugagagaacacuccacgaug

SEQ ID NO: 29619 - RNA, 24 nt, Human
ccugaccccugggcuggccuggga

SEQ ID NO: 29620 - RNA, 24 nt, Human
aaagcaaaugaggcagaaaggccc

SEQ ID NO: 29621 - RNA, 24 nt, Human
uauuaugcuugguuauaauuuuuc

SEQ ID NO: 29622 - RNA, 24 nt, Human
cgguaagguugucagguaguaagg

SEQ ID NO: 29623 - RNA, 19 nt, Human
uacaagguuuuuuccuagu

SEQ ID NO: 29624 - RNA, 24 nt, Human
accucauuccuauaucauugcagu

SEQ ID NO: 29625 - RNA, 24 nt, Human
ggaggauaaaggaacucuuugcac

SEQ ID NO: 29626 - RNA, 24 nt, Human
uuaaagguccucagggugcucucc

SEQ ID NO: 29627 - RNA, 24 nt, Human
uuuacaguuuauuauuuuacuccu

SEQ ID NO: 29628 - RNA, 24 nt, Human
cagcgccccgcgcggcccugcaag

SEQ ID NO: 29629 - RNA, 24 nt, Human
ucgcagcgccagggguuggcgccc

SEQ ID NO: 29630 - RNA, 24 nt, Human
guaggcccugaagaacacccucau

SEQ ID NO: 29631 - RNA, 24 nt, Human
uagcaguacaaaaucuuugacuau

SEQ ID NO: 29632 - RNA, 24 nt, Human
uuuugcucuuguugcccaggcuga

SEQ ID NO: 29633 - RNA, 24 nt, Human
ugaggacugugaagauaacuuuca

SEQ ID NO: 29634 - RNA, 24 nt, Human
uauuaaauuuugauguugccucag

SEQ ID NO: 29635 - RNA, 24 nt, Human
ugcaguaggaaaggaggcugcagg

SEQ ID NO: 29636 - RNA, 24 nt, Human
ugagugcaacggaaagggcuauca

SEQ ID NO: 29637 - RNA, 22 nt, Human
ucaggucggggagccggucggg

SEQ ID NO: 29638 - RNA, 24 nt, Human
cugcaucguccacuccggucggcg

SEQ ID NO: 29639 - RNA, 24 nt, Human
uuggcggggccuuggacuaccacu

SEQ ID NO: 29640 - RNA, 24 nt, Human
uuguaugcagaaauagauaugaaa

SEQ ID NO: 29641 - RNA, 24 nt, Human
uuagagauuugcauauguaaaaca

SEQ ID NO: 29642 - RNA, 24 nt, Human
ccgccgccuccgggccgcguccgu

SEQ ID NO: 29643 - RNA, 24 nt, Human
ugguaugugaguuuuaucucaauc

SEQ ID NO: 29644 - RNA, 24 nt, Human
uucagauauuggucuguuucacua

SEQ ID NO: 29645 - RNA, 24 nt, Human
augccugcugcuaguugacuacag

SEQ ID NO: 29646 - RNA, 20 nt, Human
ucugaccucccaggaagugu

SEQ ID NO: 29647 - RNA, 24 nt, Human
uauaauaauuaacaacagcaaaga

SEQ ID NO: 29648 - RNA, 24 nt, Human
uauuucguugagcagugguuucgu

SEQ ID NO: 29649 - RNA, 24 nt, Human
agagguugcacugagcugagaucg

SEQ ID NO: 29650 - RNA, 24 nt, Human
caucacuugaggccaggaguucaa

SEQ ID NO: 29651 - RNA, 24 nt, Human
ugugcagaagaaauggaaggauuc

SEQ ID NO: 29652 - RNA, 24 nt, Human
uaucaaggaagggcaggcgugaug

SEQ ID NO: 29653 - RNA, 24 nt, Human
uucaaauuucuuucuuuuuuaauu

SEQ ID NO: 29654 - RNA, 24 nt, Human
uacaauuuuaacaaucacuuaaaa

SEQ ID NO: 29655 - RNA, 24 nt, Human
ccuauagccaauauaagcagucac

SEQ ID NO: 29656 - RNA, 24 nt, Human
aggcugcaggacaugagcaccagc

SEQ ID NO: 29657 - RNA, 24 nt, Human
cacccgacagcuucgugcacaugu

SEQ ID NO: 29658 - RNA, 24 nt, Human
aguggagagccacacgugugaaau

SEQ ID NO: 29659 - RNA, 24 nt, Human
aggaguuucauugccagugggaga

SEQ ID NO: 29660 - RNA, 24 nt, Human
gaggagaaacccugggaaggcucc

SEQ ID NO: 29661 - RNA, 24 nt, Human
accuuuugcccagcuugagugaac

SEQ ID NO: 29662 - RNA, 24 nt, Human
aaggacuccuacgugggcgacgag

SEQ ID NO: 29663 - RNA, 24 nt, Human
guggggcacgucucgguugucggg

SEQ ID NO: 29664 - RNA, 24 nt, Human
agccauugaaacagaugaucugac

SEQ ID NO: 29665 - RNA, 24 nt, Human
aagaagaaaacgaaaagaagaaac

SEQ ID NO: 29666 - RNA, 24 nt, Human
ugccauaggccggggugccaaguc

SEQ ID NO: 29667 - RNA, 24 nt, Human
ugcauuguuaucauugaccagucu

SEQ ID NO: 29668 - RNA, 24 nt, Human
aaguaugucuaauuuaaacguaua

SEQ ID NO: 29669 - RNA, 24 nt, Human
ugcauuguuaucauuaaccagucu

SEQ ID NO: 29670 - RNA, 24 nt, Human
gagcuuccugaaugccuuuccgaa

SEQ ID NO: 29671 - RNA, 24 nt, Human
cagcgugacuccugcaccuugugc

SEQ ID NO: 29672 - RNA, 24 nt, Human
uaacugaaaguuggggaagaccac

SEQ ID NO: 29673 - RNA, 24 nt, Human
caugcaccacaucccagcucugcu

SEQ ID NO: 29674 - RNA, 22 nt, Human
ccucaggaagagaaucgaggcu

SEQ ID NO: 29675 - RNA, 24 nt, Human
ucgcuggggggacacuagaagcac

SEQ ID NO: 29676 - RNA, 24 nt, Human
uaguagagaugggguuucaccaug

SEQ ID NO: 29677 - RNA, 24 nt, Human
ccaaagugccgggauuacagacau

SEQ ID NO: 29678 - RNA, 24 nt, Human
ucacugcaaccuccaccuccuggg

SEQ ID NO: 29679 - RNA, 23 nt, Human
uacuaugcauaugguccaauauc

SEQ ID NO: 29680 - RNA, 24 nt, Human
uagcauugaaggacucggggauau

SEQ ID NO: 29681 - RNA, 24 nt, Human
uguaaugugccugugccuguggcc

SEQ ID NO: 29682 - RNA, 24 nt, Human
ugaaacaguaugaaugcaaagaau

SEQ ID NO: 29683 - RNA, 24 nt, Human
uucagccagacgucaaacuucacc

SEQ ID NO: 29684 - RNA, 24 nt, Human
aagcuuucuuucugaguucauacc

SEQ ID NO: 29685 - RNA, 24 nt, Human
ucuguucugaguguccccaaaaaa

SEQ ID NO: 29686 - RNA, 24 nt, Human
aaucaguaaagucugauguuuuga

SEQ ID NO: 29687 - RNA, 18 nt, Human
uaccuaauggccuugucu

SEQ ID NO: 29688 - RNA, 24 nt, Human
ucgcugguggauugugggguccgc

SEQ ID NO: 29689 - RNA, 24 nt, Human
agggaccuaagacaggcaggaggg

SEQ ID NO: 29690 - RNA, 24 nt, Human
uaccugaaaccaaaccguuaacaa

SEQ ID NO: 29691 - RNA, 24 nt, Human
ucgaagauaugaggcggugaagug

SEQ ID NO: 29692 - RNA, 24 nt, Human
ugcugcggugagcgugagacccgc

SEQ ID NO: 29693 - RNA, 24 nt, Human
ugagagaauaaaguauuuuggaaa

SEQ ID NO: 29694 - RNA, 23 nt, Human
uuacuaguaucgguuaccacugc

SEQ ID NO: 29695 - RNA, 24 nt, Human
uaucauacauuaauccaucuuagc

SEQ ID NO: 29696 - RNA, 24 nt, Human
agcauguaguauacagacauucug

SEQ ID NO: 29697 - RNA, 24 nt, Human
augaauuaauguuuuucccuguuu

SEQ ID NO: 29698 - RNA, 24 nt, Human
uacacguuaagaaaauaaacaaaa

SEQ ID NO: 29699 - RNA, 24 nt, Human
augaaucuuucauuugguagaccg

SEQ ID NO: 29700 - RNA, 24 nt, Human
ugagaacauuccugcaaagucucc

SEQ ID NO: 29701 - RNA, 24 nt, Human
ccuggccccaggugauccacccac

SEQ ID NO: 29702 - RNA, 24 nt, Human
ucucgcucuguugcccaggcugga

SEQ ID NO: 29703 - RNA, 24 nt, Human
uugaaagguauauuaaaauuaagg

SEQ ID NO: 29704 - RNA, 24 nt, Human
ucuacagucugugaauauaccaau

SEQ ID NO: 29705 - RNA, 24 nt, Human
gugaaacuuuucuagaauuauuuu

SEQ ID NO: 29706 - RNA, 24 nt, Human
agauguguuugucuugacucacua

SEQ ID NO: 29707 - RNA, 24 nt, Human
agauugcuauuacuggacaugauc

SEQ ID NO: 29708 - RNA, 24 nt, Human
cugguuccaacaguucuucucaga

SEQ ID NO: 29709 - RNA, 24 nt, Human
uauggugcggaggcccuggagagg

SEQ ID NO: 29710 - RNA, 24 nt, Human
gcugcagucagcuaccuugaccua

SEQ ID NO: 29711 - RNA, 24 nt, Human
uaggacaagacaagugccagccag

SEQ ID NO: 29712 - RNA, 24 nt, Human
gagcaggaagaugugccacuuccu

SEQ ID NO: 29713 - RNA, 24 nt, Human
uugcagcugaggcacagcaaugac

SEQ ID NO: 29714 - RNA, 24 nt, Human
ugaaacaguaacuugauuuaaagu

SEQ ID NO: 29715 - RNA, 24 nt, Human
uggaaacccagcucuccugucucc

SEQ ID NO: 29716 - RNA, 17 nt, Human
ugggauaggcugguucc

SEQ ID NO: 29717 - RNA, 24 nt, Human
ugaccaaggauugcccuugugcuu

SEQ ID NO: 29718 - RNA, 24 nt, Human
ucuaccagcuaacacauccaccac

SEQ ID NO: 29719 - RNA, 24 nt, Human
caccagcacugcacccuaaucaaa

SEQ ID NO: 29720 - RNA, 24 nt, Human
cacacggcauguucucucuuugca

SEQ ID NO: 29721 - RNA, 24 nt, Human
aacuguaucccguugaugcacuaa

SEQ ID NO: 29722 - RNA, 24 nt, Human
aaagcagcaauucuauguucauag

SEQ ID NO: 29723 - RNA, 24 nt, Human
ggaggggaauuauuugaaucgugg

SEQ ID NO: 29724 - RNA, 24 nt, Human
uucucugugguuggggaaaaggug

SEQ ID NO: 29725 - RNA, 24 nt, Human
ucaggaacgaagauucagggaaug

SEQ ID NO: 29726 - RNA, 23 nt, Human
uaagacugaaaaaaaccucgugc

SEQ ID NO: 29727 - RNA, 24 nt, Human
acauggcauuuucucugugucucu

SEQ ID NO: 29728 - RNA, 22 nt, Human
aagagcuaaaacugaugacagu

SEQ ID NO: 29729 - RNA, 24 nt, Human
aacccuuuggcuuuuuucagagaa

SEQ ID NO: 29730 - RNA, 24 nt, Human
ucugguuuuauuauucaaauuaag

SEQ ID NO: 29731 - RNA, 24 nt, Human
uaugccauugucuuuguaauucuu

SEQ ID NO: 29732 - RNA, 24 nt, Human
agagaauucucuuauccaacauca

SEQ ID NO: 29733 - RNA, 24 nt, Human
aagaugccgcauugggaugggaug

SEQ ID NO: 29734 - RNA, 24 nt, Human
ugaggugacgaggaagcccaaggc

SEQ ID NO: 29735 - RNA, 24 nt, Human
cggcugcccauugcucucccacuc

SEQ ID NO: 29736 - RNA, 24 nt, Human
ucgauggaggacgggaggccuuug

SEQ ID NO: 29737 - RNA, 24 nt, Human
ucucugggccgccaggcuuucagc

SEQ ID NO: 29738 - RNA, 24 nt, Human
gaggagaaacccugggaaggcucc

SEQ ID NO: 29739 - RNA, 24 nt, Human
uccagggcuggaccaggcgccucc

SEQ ID NO: 29740 - RNA, 24 nt, Human
cucccggccagcaggaugugccau

SEQ ID NO: 29741 - RNA, 24 nt, Human
acuagaacacuugacuaaaauuau

SEQ ID NO: 29742 - RNA, 21 nt, Human
uaccagguaauuaaugcucau

SEQ ID NO: 29743 - RNA, 24 nt, Human
uaaauucuguuaguugcuaagaag

SEQ ID NO: 29744 - RNA, 24 nt, Human
ggacgcggaguccgugugcgguuc

SEQ ID NO: 29745 - RNA, 24 nt, Human
uuuuccguuccuacagucccgguu

SEQ ID NO: 29746 - RNA, 24 nt, Human
ugcagaguccuuacuuuaucgcca

SEQ ID NO: 29747 - RNA, 24 nt, Human
ucugaagugcacuuuuuugaaaca

SEQ ID NO: 29748 - RNA, 24 nt, Human
accauacagguggcccauguauaa

SEQ ID NO: 29749 - RNA, 24 nt, Human
uacaaggaugaccaacucuuggau

SEQ ID NO: 29750 - RNA, 24 nt, Human
uccgggcagaugacaccuuugagg

SEQ ID NO: 29751 - RNA, 23 nt, Human
uucaguguuuauuauccuccagg

SEQ ID NO: 29752 - RNA, 24 nt, Human
uuccuugcagcaggaacccacuua

SEQ ID NO: 29753 - RNA, 24 nt, Human
ucaaggauaggcuuuauucugcaa

SEQ ID NO: 29754 - RNA, 24 nt, Human
uauuuuauacacucuaugcugagu

SEQ ID NO: 29755 - RNA, 24 nt, Human
ugaaaggugaguuucauuguuuag

SEQ ID NO: 29756 - RNA, 23 nt, Human
ucacacuguagccacaaagggug

SEQ ID NO: 29757 - RNA, 24 nt, Human
ucccugaguggcugcaucucuucu

SEQ ID NO: 29758 - RNA, 18 nt, Human
ccacgggugaaccaggug

SEQ ID NO: 29759 - RNA, 24 nt, Human
cuggaacagacacuggcucucugu

SEQ ID NO: 29760 - RNA, 24 nt, Human
aggcggccuccccgaagggccagc

SEQ ID NO: 29761 - RNA, 24 nt, Human
uucaaauuucuuucuuuuuuaauu

SEQ ID NO: 29762 - RNA, 24 nt, Human
ucaauuuuuauuuugguuuucuua

SEQ ID NO: 29763 - RNA, 24 nt, Human
ucccugggaguaauuuuggugaag

SEQ ID NO: 29764 - RNA, 24 nt, Human
ucccccagcagccaggaacggggc

SEQ ID NO: 29765 - RNA, 24 nt, Human
ugcagaaaaucugcccugaaauuc

SEQ ID NO: 29766 - RNA, 24 nt, Human
ucacugggacaguugcuuuuauua

SEQ ID NO: 29767 - RNA, 24 nt, Human
cccuugaaaaaagcuuugccuccu

SEQ ID NO: 29768 - RNA, 24 nt, Human
uggcuuauuuguuuuguauucaau

SEQ ID NO: 29769 - RNA, 24 nt, Human
ugcccagauaaaguccaagugauu

SEQ ID NO: 29770 - RNA, 24 nt, Human
uaaauaauccuggcauuauaggga

SEQ ID NO: 29771 - RNA, 24 nt, Human
ucccccaggcaacuaaaccugcag

SEQ ID NO: 29772 - RNA, 24 nt, Human
uacuuuaguucauuuaauuuuaau

SEQ ID NO: 29773 - RNA, 23 nt, Human
uugaaagguauauuaaaauuaag

SEQ ID NO: 29774 - RNA, 24 nt, Human
uauuuuuaaaacuuuauuuuaaaa

SEQ ID NO: 29775 - RNA, 21 nt, Human
uuuguaagcuucugagauugc

SEQ ID NO: 29776 - RNA, 24 nt, Human
cuggaaggcauacccuacaauuua

SEQ ID NO: 29777 - RNA, 24 nt, Human
uuccuggccaucaccaccgacugc

SEQ ID NO: 29778 - RNA, 24 nt, Human
ugacuuguuuuuguuuucuggauu

SEQ ID NO: 29779 - RNA, 24 nt, Human
uguuuccccuucuaaagcucaaga

SEQ ID NO: 29780 - RNA, 24 nt, Human
gggaaggaaaggggccugagcugg

SEQ ID NO: 29781 - RNA, 24 nt, Human
ugccagggcguguugggcaggaau

SEQ ID NO: 29782 - RNA, 24 nt, Human
uaaguacauaggucuuuauuuaaa

SEQ ID NO: 29783 - RNA, 24 nt, Human
ugaaagcaccauggcauaaagucu

SEQ ID NO: 29784 - RNA, 24 nt, Human
ccucuguucaacaauacaguccuu

SEQ ID NO: 29785 - RNA, 24 nt, Human
caucgugugaacuauagaguuugu

SEQ ID NO: 29786 - RNA, 24 nt, Human
uuagaggacugcuuugccuuuuga

SEQ ID NO: 29787 - RNA, 24 nt, Human
uggccagugaguuggcaaucagcu

SEQ ID NO: 29788 - RNA, 24 nt, Human
cacuguuugaggaccaguguuccg

SEQ ID NO: 29789 - RNA, 18 nt, Human
cauugcacuugcuuuugc

SEQ ID NO: 29790 - RNA, 21 nt, Human
ugggccucugguccugcccag

SEQ ID NO: 29791 - RNA, 24 nt, Human
ugaggcagggggaucaugagguca

SEQ ID NO: 29792 - RNA, 24 nt, Human
ucucuaaaauaaauaaauaggccg

SEQ ID NO: 29793 - RNA, 24 nt, Human
ucgcugugccacaucugcagcuca

SEQ ID NO: 29794 - RNA, 24 nt, Human
uguggaaaaccuggaagauggcug

SEQ ID NO: 29795 - RNA, 20 nt, Human
ugagagaacacuccacgaug

SEQ ID NO: 29796 - RNA, 24 nt, Human
ccugaccccugggcuggccuggga

SEQ ID NO: 29797 - RNA, 24 nt, Human
aaagcaaaugaggcagaaaggccc

SEQ ID NO: 29798 - RNA, 22 nt, Human
uaucccuuuuuaucaggucagg

SEQ ID NO: 29799 - RNA, 22 nt, Human
uguaauugugaaaaaagaacuc

SEQ ID NO: 29800 - RNA, 24 nt, Human
ucucaugauaauaguuuccuucac

SEQ ID NO: 29801 - RNA, 24 nt, Human
ugaucucguuggacugcguggcua

SEQ ID NO: 29802 - RNA, 24 nt, Human
agguauguauguuuucacaguuag

SEQ ID NO: 29803 - RNA, 24 nt, Human
acaggguuucaucauguuggcgca

SEQ ID NO: 29804 - RNA, 24 nt, Human
ucccagaauuuaaaauuuccuugc

SEQ ID NO: 29805 - RNA, 24 nt, Human
ugaaguugucggaguccccaucgg

SEQ ID NO: 29806 - RNA, 24 nt, Human
cuggagcagguccaccggccccua

SEQ ID NO: 29807 - RNA, 24 nt, Human
ccaggccaaaaaggcucaacauuu

SEQ ID NO: 29808 - RNA, 24 nt, Human
acggagaagaagcccuggugugug

SEQ ID NO: 29809 - RNA, 18 nt, Human
ugaauagauuuaugaauu

SEQ ID NO: 29810 - RNA, 24 nt, Human
uagggugcuuaaagcuaacuaguc

SEQ ID NO: 29811 - RNA, 24 nt, Human
aggagauaaauacuuuauuucaaa

SEQ ID NO: 29812 - RNA, 18 nt, Human
ucaaggguaugcaugugu

SEQ ID NO: 29813 - RNA, 24 nt, Human
acagugcccugccuuggcugucag

SEQ ID NO: 29814 - RNA, 24 nt, Human
uggaauucgagguaggccggccuc

SEQ ID NO: 29815 - RNA, 24 nt, Human
ucugcaccucacccugaucuccuc

SEQ ID NO: 29816 - RNA, 24 nt, Human
cgagcagaacucucugcccgcauc

SEQ ID NO: 29817 - RNA, 24 nt, Human
uccccugauaaugcaucaccuucc

SEQ ID NO: 29818 - RNA, 24 nt, Human
aggaagccccgugccacuccagug

SEQ ID NO: 29819 - RNA, 24 nt, Human
ugggagcgcagguagucaaggacg

SEQ ID NO: 29820 - RNA, 24 nt, Human
ucagaguacauauuuggggugcgg

SEQ ID NO: 29821 - RNA, 24 nt, Human
uugugcuaaagggaaaggaggauc

SEQ ID NO: 29822 - RNA, 24 nt, Human
ugaaaaaauuuagacuguaaccgc

SEQ ID NO: 29823 - RNA, 24 nt, Human
uugaaugaaaccauaacuccacuu

SEQ ID NO: 29824 - RNA, 22 nt, Human
aacaugcuuaugaugcauagga

SEQ ID NO: 29825 - RNA, 24 nt, Human
cauaagauuauuccaugauuaaaa

SEQ ID NO: 29826 - RNA, 24 nt, Human
gaugcaaaauguuugcaguuugac

SEQ ID NO: 29827 - RNA, 24 nt, Human
aaauggaaucuagaagcuaaauuu

SEQ ID NO: 29828 - RNA, 24 nt, Human
uggaucucgggacuugaggauuuu

SEQ ID NO: 29829 - RNA, 24 nt, Human
uaucaguacuuucuguuugaaaaa

SEQ ID NO: 29830 - RNA, 24 nt, Human
uaauauuggguauagauguaaguc

SEQ ID NO: 29831 - RNA, 24 nt, Human
aacacugcccagcuuugaggagau

SEQ ID NO: 29832 - RNA, 24 nt, Human
uggcuaaacuggugucaucacuac

SEQ ID NO: 29833 - RNA, 24 nt, Human
ggugaugggggcagccgggaggga

SEQ ID NO: 29834 - RNA, 24 nt, Human
ucagugccuugccaggaucccauc

SEQ ID NO: 29835 - RNA, 24 nt, Human
caggagccggaaagcagccuugcu

SEQ ID NO: 29836 - RNA, 24 nt, Human
ccccugagggagaggaaaggugaa

SEQ ID NO: 29837 - RNA, 24 nt, Human
ugcaaagacucccccugacccacc

SEQ ID NO: 29838 - RNA, 23 nt, Human
uuacaacaaucgagugcuggaca

SEQ ID NO: 29839 - RNA, 24 nt, Human
ugcuagcugaggugccaacuaugg

SEQ ID NO: 29840 - RNA, 24 nt, Human
ugagauucuugcucaccgucuggg

SEQ ID NO: 29841 - RNA, 24 nt, Human
agaaugcaaauauauuuuuacugu

SEQ ID NO: 29842 - RNA, 24 nt, Human
agagauaaaaugaaguguuaacag

SEQ ID NO: 29843 - RNA, 24 nt, Human
uaucaaggaagggcaggcgugaug

SEQ ID NO: 29844 - RNA, 24 nt, Human
agaagaagaagaaauggcaaagag

SEQ ID NO: 29845 - RNA, 24 nt, Human
uaagaguguugaaaaaaaaauuca

SEQ ID NO: 29846 - RNA, 24 nt, Human
cuagguuuauagauaguugggugg

SEQ ID NO: 29847 - RNA, 24 nt, Human
ugaguagguggccugcaguaaugu

SEQ ID NO: 29848 - RNA, 24 nt, Human
aaagaacaagaguugaagaucuau

SEQ ID NO: 29849 - RNA, 24 nt, Human
aaggauucucgugccucagccucc

SEQ ID NO: 29850 - RNA, 24 nt, Human
gggcagugucucucacccagucug

SEQ ID NO: 29851 - RNA, 24 nt, Human
gugcagaauugagggccgaguaga

SEQ ID NO: 29852 - RNA, 24 nt, Human
ccaggccaaaaaggcucaacauuu

SEQ ID NO: 29853 - RNA, 24 nt, Human
ugggagaaaggcgcugagcguggc

SEQ ID NO: 29854 - RNA, 24 nt, Human
gcccuggaacagaguuacagauac

SEQ ID NO: 29855 - RNA, 24 nt, Human
ugaguagaaugggcucaugggcaa

SEQ ID NO: 29856 - RNA, 22 nt, Human
cgccgggacagcagacugccgg

SEQ ID NO: 29857 - RNA, 24 nt, Human
cacccguaacuguaaccuauccuu

SEQ ID NO: 29858 - RNA, 24 nt, Human
ccagcacacacacgugucuagcca

SEQ ID NO: 29859 - RNA, 24 nt, Human
ucucagggacucuggcugggccag

SEQ ID NO: 29860 - RNA, 19 nt, Human
ugugaugggaagaggggcu

SEQ ID NO: 29861 - RNA, 24 nt, Human
ggucaaggauuguaauauugccag

SEQ ID NO: 29862 - RNA, 23 nt, Human
ggaguucuugggaaaggguuggg

SEQ ID NO: 29863 - RNA, 24 nt, Human
cauuguuugccauugccugcuuug

SEQ ID NO: 29864 - RNA, 24 nt, Human
uugcuugaacccgggaggcggagg

SEQ ID NO: 29865 - RNA, 19 nt, Human
uagauuguauauugaaaau

SEQ ID NO: 29866 - RNA, 24 nt, Human
gugcuuccaaggccuauaacauag

SEQ ID NO: 29867 - RNA, 24 nt, Human
uugaaaaugcugaauuauuguaau

SEQ ID NO: 29868 - RNA, 24 nt, Human
uaccccaugagagggcagcuccug

SEQ ID NO: 29869 - RNA, 24 nt, Human
ugucacaaauacaucauuuauagg

SEQ ID NO: 29870 - RNA, 24 nt, Human
uucauguuuacgcugauauauauc

SEQ ID NO: 29871 - RNA, 24 nt, Human
uuugugaacacaaauucuccacaa

SEQ ID NO: 29872 - RNA, 24 nt, Human
ugagccgagaucgcgccacugugc

SEQ ID NO: 29873 - RNA, 24 nt, Human
ccacaaggagaagacucucggggg

SEQ ID NO: 29874 - RNA, 24 nt, Human
uucgagcacuggccuacuggcacu

SEQ ID NO: 29875 - RNA, 24 nt, Human
agggaaggagggucgcccggaucc

SEQ ID NO: 29876 - RNA, 24 nt, Human
uacuucuagcuuuuuuccuauuuu

SEQ ID NO: 29877 - RNA, 24 nt, Human
gcccugugccuggcacuugugcug

SEQ ID NO: 29878 - RNA, 24 nt, Human
gacaguuugaugcaucucaauuca

SEQ ID NO: 29879 - RNA, 24 nt, Human
ugagaauggcaaaauuagucgccu

SEQ ID NO: 29880 - RNA, 24 nt, Human
uacaccacucccaagaagaauaag

SEQ ID NO: 29881 - RNA, 24 nt, Human
uagaaaaacauaaagacagaagaa

SEQ ID NO: 29882 - RNA, 24 nt, Human
aggcgguccugaacuccugaccuc

SEQ ID NO: 29883 - RNA, 24 nt, Human
ucucgcucuuuuugcccaggcugg

SEQ ID NO: 29884 - RNA, 24 nt, Human
ugagaaugaccccaagaccuuuga

SEQ ID NO: 29885 - RNA, 24 nt, Human
uaccuggaccagcccugccuugag

SEQ ID NO: 29886 - RNA, 24 nt, Human
cgagcgggcgcuggcaccgaggcc

SEQ ID NO: 29887 - RNA, 24 nt, Human
ugugaacgggaagaaggugcugca

SEQ ID NO: 29888 - RNA, 22 nt, Human
guggagggcagcuuugucuaca

SEQ ID NO: 29889 - RNA, 24 nt, Human
uggcaggaacggagugguugguag

SEQ ID NO: 29890 - RNA, 18 nt, Human
ugaguuggcugcgagggg

SEQ ID NO: 29891 - RNA, 24 nt, Human
aagcauuuuaaaaaagaggugauc

SEQ ID NO: 29892 - RNA, 24 nt, Human
ucuccagaaaugcuuuggguucau

SEQ ID NO: 29893 - RNA, 24 nt, Human
uugaucuugaagaaacugggcgug

SEQ ID NO: 29894 - RNA, 24 nt, Human
guagaguuuucuucaggcuuaaag

SEQ ID NO: 29895 - RNA, 24 nt, Human
uagcucugaagauaacuuaucaua

SEQ ID NO: 29896 - RNA, 24 nt, Human
guuucaggcccugggccaggcacu

SEQ ID NO: 29897 - RNA, 24 nt, Human
aagcaccccugccccagggucccg

SEQ ID NO: 29898 - RNA, 24 nt, Human
agaguuacaggacagaaggauaau

SEQ ID NO: 29899 - RNA, 24 nt, Human
uucaaauaacaaaaguagauucug

SEQ ID NO: 29900 - RNA, 24 nt, Human
ugccucagugacagcagcauauuu

SEQ ID NO: 29901 - RNA, 24 nt, Human
ucuacagcuguuaucauguugacc

SEQ ID NO: 29902 - RNA, 17 nt, Human
cagcagccggagugugg

SEQ ID NO: 29903 - RNA, 24 nt, Human
gugcucaguccuacagcugcaugg

SEQ ID NO: 29904 - RNA, 24 nt, Human
aaagagcccacccaaggcuguuac

SEQ ID NO: 29905 - RNA, 19 nt, Human
ugggaaaaugcaggucugg

SEQ ID NO: 29906 - RNA, 24 nt, Human
agucauuguauguagagguggagu

SEQ ID NO: 29907 - RNA, 22 nt, Human
uaacucaggcaucucuggaucc

SEQ ID NO: 29908 - RNA, 24 nt, Human
aaggaggacacuggggauaauucc

SEQ ID NO: 29909 - RNA, 24 nt, Human
aggcagaccagcuuuauuuuugaa

SEQ ID NO: 29910 - RNA, 24 nt, Human
ugcguucagugagagagacaaagu

SEQ ID NO: 29911 - RNA, 24 nt, Human
cguggagcggagcaaggccaggcg

SEQ ID NO: 29912 - RNA, 19 nt, Human
cuuuguguggcuacaugac

SEQ ID NO: 29913 - RNA, 24 nt, Human
uaugcuucaacaccuucuucaacu

SEQ ID NO: 29914 - RNA, 24 nt, Human
ugcauguagugauccggggcuccc

SEQ ID NO: 29915 - RNA, 24 nt, Human
uaaauuguuuuaaaugagauagga

SEQ ID NO: 29916 - RNA, 24 nt, Human
uuagugaauaucaaguuuugauuu

SEQ ID NO: 29917 - RNA, 24 nt, Human
uggcaagaucaucagagagaucuu

SEQ ID NO: 29918 - RNA, 24 nt, Human
uugcuucggugggugacgcgguac

SEQ ID NO: 29919 - RNA, 24 nt, Human
uuacccuacgcugccagguggagg

SEQ ID NO: 29920 - RNA, 23 nt, Human
cucgugccgcacugaacuggacc

SEQ ID NO: 29921 - RNA, 24 nt, Human
gcugaaguauguccuguuuuucuu

SEQ ID NO: 29922 - RNA, 24 nt, Human
cagcauccaccguuaccacucaga

SEQ ID NO: 29923 - RNA, 24 nt, Human
uccacaacaacuucggagugcucu

SEQ ID NO: 29924 - RNA, 24 nt, Human
cuccggugugucuccucuuccuug

SEQ ID NO: 29925 - RNA, 24 nt, Human
ugaggauaaauggcuuucagcccu

SEQ ID NO: 29926 - RNA, 24 nt, Human
uggcuggacuaugucagggcucgu

SEQ ID NO: 29927 - RNA, 23 nt, Human
uggaugagcugcccagccuugca

SEQ ID NO: 29928 - RNA, 24 nt, Human
caccaguagggagcuagcuggcug

SEQ ID NO: 29929 - RNA, 24 nt, Human
aaauaggaaauagccguauaugua

SEQ ID NO: 29930 - RNA, 23 nt, Human
ugagggugcccgcccggaccguc

SEQ ID NO: 29931 - RNA, 24 nt, Human
cacagguaggaggcugggcacaaa

SEQ ID NO: 29932 - RNA, 24 nt, Human
guccauggaaauagagcugugguu

SEQ ID NO: 29933 - RNA, 24 nt, Human
guacaggggcugguaggaguacgc

SEQ ID NO: 29934 - RNA, 24 nt, Human
uaggacgcagcuguugccaugacg

SEQ ID NO: 29935 - RNA, 24 nt, Human
uuucaggguuuuggucuaucucau

SEQ ID NO: 29936 - RNA, 24 nt, Human
ggccgagugggcaccaucauggga

SEQ ID NO: 29937 - RNA, 24 nt, Human
ucauuggcaucaugggagggcccc

SEQ ID NO: 29938 - RNA, 24 nt, Human
ugcauuguuaucauuaaccagucu

SEQ ID NO: 29939 - RNA, 24 nt, Human
uauuagggauaauauucauuuagc

SEQ ID NO: 29940 - RNA, 24 nt, Human
uuuaacuuuuuuaaugggucucaa

SEQ ID NO: 29941 - RNA, 24 nt, Human
uucaaauuucuuucuuuuuuaauu

SEQ ID NO: 29942 - RNA, 24 nt, Human
agcuccuugauuugugaccuugac

SEQ ID NO: 29943 - RNA, 24 nt, Human
aaagggacugaacuagccucuggu

SEQ ID NO: 29944 - RNA, 24 nt, Human
uggaggagcacggugcaagcugcg

SEQ ID NO: 29945 - RNA, 24 nt, Human
ugacuguauuucaauugggcaugu

SEQ ID NO: 29946 - RNA, 24 nt, Human
ugcuaggggcuguguacagagugc

SEQ ID NO: 29947 - RNA, 24 nt, Human
ucgcguaccgugcggcuugcugac

SEQ ID NO: 29948 - RNA, 24 nt, Human
ugacccagggacacguggggugug

SEQ ID NO: 29949 - RNA, 19 nt, Human
uaacucccugugucugcau

SEQ ID NO: 29950 - RNA, 24 nt, Human
ucguugcugcuucugccugugcug

SEQ ID NO: 29951 - RNA, 24 nt, Human
gauggcuccggcggcuuggggaaa

SEQ ID NO: 29952 - RNA, 24 nt, Human
cugcucccuggccagcccccuugu

SEQ ID NO: 29953 - RNA, 24 nt, Human
uugaagcuuuuacagcuggagacu

SEQ ID NO: 29954 - RNA, 22 nt, Human
ucagaacauucugaacugcuga

SEQ ID NO: 29955 - RNA, 24 nt, Human
ugaaugacaacuuuauuuuucuua

SEQ ID NO: 29956 - RNA, 24 nt, Human
gucaccuugggcaaggacuucgca

SEQ ID NO: 29957 - RNA, 24 nt, Human
cucguccagagcccagguaauccg

SEQ ID NO: 29958 - RNA, 24 nt, Human
ugagguagggacgugccguaggcc

SEQ ID NO: 29959 - RNA, 24 nt, Human
ucccaagccagaaagaaguuaacu

SEQ ID NO: 29960 - RNA, 24 nt, Human
uuuugguucucagccucucucgaa

SEQ ID NO: 29961 - RNA, 24 nt, Human
ucuauguugaugaccauaacuggg

SEQ ID NO: 29962 - RNA, 24 nt, Human
ucauugauuuuuuuuuuuuuuuuu

SEQ ID NO: 29963 - RNA, 19 nt, Human
uugaauuacagggggguuu

SEQ ID NO: 29964 - RNA, 24 nt, Human
ucacggguccaaauguacaaaaaa

SEQ ID NO: 29965 - RNA, 24 nt, Human
agagggcaucguggcccaggcagg

SEQ ID NO: 29966 - RNA, 24 nt, Human
ugagaagggagggacuuggcuccc

SEQ ID NO: 29967 - RNA, 24 nt, Human
agaggagaugccaucccagcacgg

SEQ ID NO: 29968 - RNA, 24 nt, Human
ugagguggccuccugcccugauca

SEQ ID NO: 29969 - RNA, 24 nt, Human
uugcauggcgccugcuggaggagg

SEQ ID NO: 29970 - RNA, 24 nt, Human
uuugcuagaaacugguccaaagau

SEQ ID NO: 29971 - RNA, 24 nt, Human
uaaugcacaguaugagaaaugaac

SEQ ID NO: 29972 - RNA, 17 nt, Human
ccgccgccgccgccucg

SEQ ID NO: 29973 - RNA, 24 nt, Human
uuggacauauuuuaggaagauuuu

SEQ ID NO: 29974 - RNA, 24 nt, Human
aaaugcagugucagcaaaccgaaa

SEQ ID NO: 29975 - RNA, 18 nt, Human
cauugggucuaagggaga

SEQ ID NO: 29976 - RNA, 24 nt, Human
uaacaguauuuccagugacaaugc

SEQ ID NO: 29977 - RNA, 24 nt, Human
uuuacagugagcuuucccauguuu

SEQ ID NO: 29978 - RNA, 24 nt, Human
uugggccgaucagggcuucaguua

SEQ ID NO: 29979 - RNA, 24 nt, Human
ggacagguguacagacauguucuu

SEQ ID NO: 29980 - RNA, 24 nt, Human
ucgaauggacacauuaccagugaa

SEQ ID NO: 29981 - RNA, 24 nt, Human
uaaaaccucaauuacugguaauug

SEQ ID NO: 29982 - RNA, 24 nt, Human
ucacuccauaauaagaaguuaagg

SEQ ID NO: 29983 - RNA, 24 nt, Human
ugaaaaauaaagccaaaaugccaa

SEQ ID NO: 29984 - RNA, 24 nt, Human
aagcaggccauugagcugaguccu

SEQ ID NO: 29985 - RNA, 24 nt, Human
aggaaggguggacacaacugaagu

SEQ ID NO: 29986 - RNA, 24 nt, Human
aguuuguugaagaagccuuggaaa

SEQ ID NO: 29987 - RNA, 24 nt, Human
ugagaaugucauguugauccaucc

SEQ ID NO: 29988 - RNA, 24 nt, Human
uuggucagcggcauuaucuuggcc

SEQ ID NO: 29989 - RNA, 24 nt, Human
ugaaaacuuggcuuccucacugaa

SEQ ID NO: 29990 - RNA, 22 nt, Human
ugucagugagcagaagagugaa

SEQ ID NO: 29991 - RNA, 24 nt, Human
agauuucggaaauucuaaaagguu

SEQ ID NO: 29992 - RNA, 24 nt, Human
ucucugggccgccaggcuuucagc

SEQ ID NO: 29993 - RNA, 24 nt, Human
ccugaaaggcaggguucuguggaa

SEQ ID NO: 29994 - RNA, 22 nt, Human
uccuguugcguuuaggcaccca

SEQ ID NO: 29995 - RNA, 24 nt, Human
ucacugacucccugaagccgagac

SEQ ID NO: 29996 - RNA, 24 nt, Human
ccgggcccucucucccacuuuuuc

SEQ ID NO: 29997 - RNA, 24 nt, Human
agaagaagaagaaauggcaaagag

SEQ ID NO: 29998 - RNA, 24 nt, Human
ucugaucaauccuucuuuuucucu

SEQ ID NO: 29999 - RNA, 24 nt, Human
ucaauuuuuauuuugguuuucuua

SEQ ID NO: 30000 - RNA, 24 nt, Human
gaggauccaagcuuacguacgcgu

SEQ ID NO: 30001 - RNA, 24 nt, Human
uggcguaauagcgaagaggcccgc

SEQ ID NO: 30002 - RNA, 24 nt, Human
cagcagcgccggcgggcuaagccc

SEQ ID NO: 30003 - RNA, 24 nt, Human
uuguauccuguugugaugucacug

SEQ ID NO: 30004 - RNA, 22 nt, Human
uuuguuauacuuuuggagcugu

SEQ ID NO: 30005 - RNA, 24 nt, Human
uuuuugaacacuuuugcuuuaaca

SEQ ID NO: 30006 - RNA, 24 nt, Human
uacuggguuuuugguuuuagaaac

SEQ ID NO: 30007 - RNA, 24 nt, Human
uguucagccccuaaacgaauggca

SEQ ID NO: 30008 - RNA, 24 nt, Human
uauagggaaagcugguacgccugc

SEQ ID NO: 30009 - RNA, 24 nt, Human
gaggauccaagcuuacguacgcgu

SEQ ID NO: 30010 - RNA, 24 nt, Human
ugguaaagacuauauuuuguacuu

SEQ ID NO: 30011 - RNA, 24 nt, Human
agagcacugagcuccacccuuuuc

SEQ ID NO: 30012 - RNA, 24 nt, Human
ugaguucacaauagauguauggau

SEQ ID NO: 30013 - RNA, 24 nt, Human
uauuacugugaagacgguuauuug

SEQ ID NO: 30014 - RNA, 24 nt, Human
ccgggucgacccacgcguccgauu

SEQ ID NO: 30015 - RNA, 24 nt, Human
uguuuugguuaccauagauuucua

SEQ ID NO: 30016 - RNA, 24 nt, Human
uucacaauagauguauggauuugu

SEQ ID NO: 30017 - RNA, 24 nt, Human
ccgggucgacccacgcguccgcuu

SEQ ID NO: 30018 - RNA, 24 nt, Human
uuccuuguagaaaaccuaucucca

SEQ ID NO: 30019 - RNA, 17 nt, Human
ugguuuguuucaagcag

SEQ ID NO: 30020 - RNA, 24 nt, Human
agagaagauccuuggaagaauugu

SEQ ID NO: 30021 - RNA, 24 nt, Human
ugcggaggaagagcagcaggacag

SEQ ID NO: 30022 - RNA, 24 nt, Human
caggagcccaggacagaggucaaa

SEQ ID NO: 30023 - RNA, 24 nt, Human
aggccuguaugcugggccagugag

SEQ ID NO: 30024 - RNA, 24 nt, Human
aaggagcgguuccaugccagcgug

SEQ ID NO: 30025 - RNA, 24 nt, Human
ugugcagaagaaauggaaggauuc

SEQ ID NO: 30026 - RNA, 24 nt, Human
uaucaaggaagggcaggcgugaug

SEQ ID NO: 30027 - RNA, 24 nt, Human
uucaaauuucuuucuuuuuuaauu

SEQ ID NO: 30028 - RNA, 24 nt, Human
acuuuguucaggaagaaauccgug

SEQ ID NO: 30029 - RNA, 24 nt, Human
aagcaggaggcagacccagcugga

SEQ ID NO: 30030 - RNA, 24 nt, Human
aagcauucacuuaauauuuuaguu

SEQ ID NO: 30031 - RNA, 21 nt, Human
ucaaucucaccuucugauaua

SEQ ID NO: 30032 - RNA, 24 nt, Human
acuugcuggucaugcucugaaacu

SEQ ID NO: 30033 - RNA, 24 nt, Human
aagcgcucagaucggcaaggggca

SEQ ID NO: 30034 - RNA, 24 nt, Human
aucaucccccacuaccuggauucc

SEQ ID NO: 30035 - RNA, 24 nt, Human
cgccugaagagacucggucacgga

SEQ ID NO: 30036 - RNA, 24 nt, Human
uaguguuugcagaaauuuuuaaaa

SEQ ID NO: 30037 - RNA, 24 nt, Human
uacaggauuugcaggauuggaaac

SEQ ID NO: 30038 - RNA, 24 nt, Human
uggcagagauaacaaaugacaacu

SEQ ID NO: 30039 - RNA, 23 nt, Human
uuuguaguaucaggacagugaga

SEQ ID NO: 30040 - RNA, 24 nt, Human
uagguuuucuaguauggaauuauc

SEQ ID NO: 30041 - RNA, 24 nt, Human
uuaaagauuuuauauuauuuuuaa

SEQ ID NO: 30042 - RNA, 24 nt, Human
uaguggaucuggcacguggguguu

SEQ ID NO: 30043 - RNA, 24 nt, Human
gcccugaaggauggagaugguagu

SEQ ID NO: 30044 - RNA, 24 nt, Human
uguuuaguuuauauaaauguauau

SEQ ID NO: 30045 - RNA, 24 nt, Human
uauaaaaagaaaacuuaaaggccc

SEQ ID NO: 30046 - RNA, 24 nt, Human
acaaagcaagagaagaagcagaga

SEQ ID NO: 30047 - RNA, 21 nt, Human
cauuggacaggacauccagcc

SEQ ID NO: 30048 - RNA, 24 nt, Human
cagcggcagagagccauccucuau

SEQ ID NO: 30049 - RNA, 24 nt, Human
gggaacacucauuucccuacaggu

SEQ ID NO: 30050 - RNA, 24 nt, Human
cuuggccuucgccuccuuaugaug

SEQ ID NO: 30051 - RNA, 24 nt, Human
cgagcaguaagugguuuuguuguu

SEQ ID NO: 30052 - RNA, 23 nt, Human
uauuuugcauguuucaacuguuc

SEQ ID NO: 30053 - RNA, 24 nt, Human
cuuguugucuucauaguauuuguu

SEQ ID NO: 30054 - RNA, 22 nt, Human
uacugggugaauagcacuuucc

SEQ ID NO: 30055 - RNA, 24 nt, Human
agauaggaaguggccuuuagggga

SEQ ID NO: 30056 - RNA, 24 nt, Human
ucaguuggaagacacccugaaauc

SEQ ID NO: 30057 - RNA, 24 nt, Human
uaaguuucucucucuguugauuac

SEQ ID NO: 30058 - RNA, 24 nt, Human
uuuauucaacccauauuuacuggg

SEQ ID NO: 30059 - RNA, 24 nt, Human
caugaaccacaugaauuaccuccc

SEQ ID NO: 30060 - RNA, 24 nt, Human
uaucuucaaggucuacauguucaa

SEQ ID NO: 30061 - RNA, 20 nt, Human
cauucauuacugggggaggu

SEQ ID NO: 30062 - RNA, 22 nt, Human
ugcccuguggccucgcuccucg

SEQ ID NO: 30063 - RNA, 24 nt, Human
cagcauggaggaugaggugcagcg

SEQ ID NO: 30064 - RNA, 24 nt, Human
uugcccgggagggcagccaugagg

SEQ ID NO: 30065 - RNA, 24 nt, Human
aggcugcuauaacaaaauuccuuc

SEQ ID NO: 30066 - RNA, 24 nt, Human
cccuaagguccugaucuaugaggc

SEQ ID NO: 30067 - RNA, 22 nt, Human
uuccgugucugcaucuguggga

SEQ ID NO: 30068 - RNA, 24 nt, Human
gcagugcucgccgacucggugcac

SEQ ID NO: 30069 - RNA, 22 nt, Human
ugcaucagagauggauauucaa

SEQ ID NO: 30070 - RNA, 24 nt, Human
uccacuggcgaaagaugccuuucu

SEQ ID NO: 30071 - RNA, 24 nt, Human
uaguucagauugaucuuaggucaa

SEQ ID NO: 30072 - RNA, 24 nt, Human
gcucugggucgcccaaagcagaau

SEQ ID NO: 30073 - RNA, 24 nt, Human
uauugcuuucauaauuuauacuaa

SEQ ID NO: 30074 - RNA, 24 nt, Human
auuugcucuuucugacaucucggu

SEQ ID NO: 30075 - RNA, 22 nt, Human
uauugugucaggccugaaauac

SEQ ID NO: 30076 - RNA, 24 nt, Human
uuggcagcuauggaccucggccug

SEQ ID NO: 30077 - RNA, 24 nt, Human
uggaggaggaugacgaugaugagc

SEQ ID NO: 30078 - RNA, 24 nt, Human
uucuucacgggcagcaagcuggug

SEQ ID NO: 30079 - RNA, 24 nt, Human
ugggauggguagaagaggcccggg

SEQ ID NO: 30080 - RNA, 24 nt, Human
ucugcagucuuauccaggcucucc

SEQ ID NO: 30081 - RNA, 24 nt, Human
ugaaaucagcaaagagcagaugca

SEQ ID NO: 30082 - RNA, 24 nt, Human
uuugcaaugauguccugucucugc

SEQ ID NO: 30083 - RNA, 18 nt, Human
ugccauagcugagcugga

SEQ ID NO: 30084 - RNA, 22 nt, Human
ucgcucagcuccuggggcuccu

SEQ ID NO: 30085 - RNA, 24 nt, Human
ucccaggugccagaugugacaucc

SEQ ID NO: 30086 - RNA, 21 nt, Human
cagcggcaguggaucugggac

SEQ ID NO: 30087 - RNA, 24 nt, Human
ucuauucagacuucaucaguuuuu

SEQ ID NO: 30088 - RNA, 24 nt, Human
aagaagcacauugcauuuggcuca

SEQ ID NO: 30089 - RNA, 24 nt, Human
ugcauuguuaucauuaaccagucu

SEQ ID NO: 30090 - RNA, 24 nt, Human
uauuagggauaauauucauuuagc

SEQ ID NO: 30091 - RNA, 24 nt, Human
uaaugggucucaaaauucugugac

SEQ ID NO: 30092 - RNA, 24 nt, Human
ugugaaggguuugcugggggccaa

SEQ ID NO: 30093 - RNA, 24 nt, Human
accagguacaugcacuggguaccc

SEQ ID NO: 30094 - RNA, 17 nt, Human
uguaaagacccugggua

SEQ ID NO: 30095 - RNA, 24 nt, Human
caacggagacugccuacuggggcc

SEQ ID NO: 30096 - RNA, 24 nt, Human
uaggagaaaaaguccuacuuuucu

SEQ ID NO: 30097 - RNA, 24 nt, Human
cuggccggccagggagcccacagu

SEQ ID NO: 30098 - RNA, 24 nt, Human
cguucagugauugucgcugggcac

SEQ ID NO: 30099 - RNA, 24 nt, Human
uaaugggucucaaaauucugugac

SEQ ID NO: 30100 - RNA, 24 nt, Human
aggggcugggcggggugguggggg

SEQ ID NO: 30101 - RNA, 24 nt, Human
uuacccuacgcugccagguggagg

SEQ ID NO: 30102 - RNA, 24 nt, Human
ucccaagggcuggagcuguuugag

SEQ ID NO: 30103 - RNA, 23 nt, Human
cucgugccgcacugaacuggacc

SEQ ID NO: 30104 - RNA, 24 nt, Human
ucagucuauagugggaaagcaggu

SEQ ID NO: 30105 - RNA, 24 nt, Human
ugaaggucaaagucacguuguucu

SEQ ID NO: 30106 - RNA, 24 nt, Human
aaauaggaaauagccguauaugua

SEQ ID NO: 30107 - RNA, 24 nt, Human
acuacuuccuauaaauuucuccug

SEQ ID NO: 30108 - RNA, 24 nt, Human
uuuaaccaugccaaugucucacac

SEQ ID NO: 30109 - RNA, 24 nt, Human
ugcugugcggccugggcgcuggcg

SEQ ID NO: 30110 - RNA, 24 nt, Human
uacgguuccauccccaaggcggcc

SEQ ID NO: 30111 - RNA, 24 nt, Human
ucgagucccgggcgcucaccuguu

SEQ ID NO: 30112 - RNA, 24 nt, Human
gggaagucggaggagugggcggac

SEQ ID NO: 30113 - RNA, 24 nt, Human
uaugagcacucgcugggcaagcuu

SEQ ID NO: 30114 - RNA, 24 nt, Human
aggaaggagauauagugaagagga

SEQ ID NO: 30115 - RNA, 24 nt, Human
aucgcgcucgcugggacccgaguu

SEQ ID NO: 30116 - RNA, 24 nt, Human
ugcccgugccaccugcccugcccu

SEQ ID NO: 30117 - RNA, 24 nt, Human
ugcuugcugcucuguguguugcgc

SEQ ID NO: 30118 - RNA, 24 nt, Human
ccugcacaccccugagcugccugu

SEQ ID NO: 30119 - RNA, 24 nt, Human
uauggcaagucacuuugacagaca

SEQ ID NO: 30120 - RNA, 24 nt, Human
ugagaauggcaaaauuagucgccu

SEQ ID NO: 30121 - RNA, 24 nt, Human
uacaccacucccaagaagaauaag

SEQ ID NO: 30122 - RNA, 24 nt, Human
uccaaagcaucguaaucaggagcc

SEQ ID NO: 30123 - RNA, 24 nt, Human
uugaacuuggccacaucaauguca

SEQ ID NO: 30124 - RNA, 17 nt, Human
ucuuguagcaaccugga

SEQ ID NO: 30125 - RNA, 18 nt, Human
uauugcuuccguggagug

SEQ ID NO: 30126 - RNA, 24 nt, Human
uaugguagcggaggugaaauaugc

SEQ ID NO: 30127 - RNA, 24 nt, Human
uuugucccucauccuuguuuacuc

SEQ ID NO: 30128 - RNA, 24 nt, Human
cccccauuucgagcggggcuucuc

SEQ ID NO: 30129 - RNA, 24 nt, Human
cggccucgggccugggagccgggc

SEQ ID NO: 30130 - RNA, 24 nt, Human
cacacaguuuccauaaaaaaacau

SEQ ID NO: 30131 - RNA, 24 nt, Human
ucccuguaauucugugggucccuu

SEQ ID NO: 30132 - RNA, 24 nt, Human
ugagguggguggaucacaagguca

SEQ ID NO: 30133 - RNA, 24 nt, Human
aggaaacaguaaaggugauggggg

SEQ ID NO: 30134 - RNA, 24 nt, Human
uauuagggauaauauucauuuagc

SEQ ID NO: 30135 - RNA, 24 nt, Human
ugccggcaccaagaagcaguucca

SEQ ID NO: 30136 - RNA, 24 nt, Human
aggaggcuauugagggcaccuaca

SEQ ID NO: 30137 - RNA, 24 nt, Human
uggcguggugaccaagaugaagau

SEQ ID NO: 30138 - RNA, 24 nt, Human
ugaguuuugggauggucacaugac

SEQ ID NO: 30139 - RNA, 24 nt, Human
acuuguguuuuguguuucaaaguu

SEQ ID NO: 30140 - RNA, 24 nt, Human
uaaugggucucaaaauucugugac

SEQ ID NO: 30141 - RNA, 24 nt, Human
uggaagaaagaggaaaucagaguc

SEQ ID NO: 30142 - RNA, 24 nt, Human
uaaguucuacuauacgcgugacuu

SEQ ID NO: 30143 - RNA, 24 nt, Human
uaucacaggccuuaggcuggaaga

SEQ ID NO: 30144 - RNA, 24 nt, Human
uuugacacugucuugccuucuucu

SEQ ID NO: 30145 - RNA, 22 nt, Human
caugaaccacagaaggggccuu

SEQ ID NO: 30146 - RNA, 24 nt, Human
uggccuggacagccuccuucagcc

SEQ ID NO: 30147 - RNA, 24 nt, Human
uacucggagauccagagggagcgg

SEQ ID NO: 30148 - RNA, 18 nt, Human
uggaagccaagcggcugc

SEQ ID NO: 30149 - RNA, 24 nt, Human
ugccugaggagccuguguuacuca

SEQ ID NO: 30150 - RNA, 22 nt, Human
aggcagggcuccgcugcgccuc

SEQ ID NO: 30151 - RNA, 24 nt, Human
cagcuuaagcucauuugcuauuuu

SEQ ID NO: 30152 - RNA, 24 nt, Human
accacauuaggcauuaccaguaca

SEQ ID NO: 30153 - RNA, 24 nt, Human
ucuuaaggugguaacauuuuaugg

SEQ ID NO: 30154 - RNA, 24 nt, Human
aaccuuuuuaaaaaauggagauga

SEQ ID NO: 30155 - RNA, 24 nt, Human
uuucugguaacuuacuugaaucuu

SEQ ID NO: 30156 - RNA, 24 nt, Human
uaccuuuaauugucaucuaagaua

SEQ ID NO: 30157 - RNA, 24 nt, Human
ucugccuccuccucccuuucuccc

SEQ ID NO: 30158 - RNA, 24 nt, Human
uugaaugucuguuucuucguuccu

SEQ ID NO: 30159 - RNA, 24 nt, Human
uagcuucauauaucuggaaugagc

SEQ ID NO: 30160 - RNA, 24 nt, Human
ccacugcacucuagccugggggag

SEQ ID NO: 30161 - RNA, 24 nt, Human
uuuuugguaaagaaaaaauauuug

SEQ ID NO: 30162 - RNA, 24 nt, Human
ucagugagauacaaaaagcuccuu

SEQ ID NO: 30163 - RNA, 24 nt, Human
uccaaagugagcgauacgaauagu

SEQ ID NO: 30164 - RNA, 24 nt, Human
ugaccagacuuuuccagaagugcc

SEQ ID NO: 30165 - RNA, 17 nt, Human
uaacauggauggguuga

SEQ ID NO: 30166 - RNA, 24 nt, Human
ucuuguguagagaucuauaaaauc

SEQ ID NO: 30167 - RNA, 24 nt, Human
uggcagggaagguccuuccaacag

SEQ ID NO: 30168 - RNA, 23 nt, Human
ugucuuggaaaucugaagccugc

SEQ ID NO: 30169 - RNA, 24 nt, Human
ucacugccuccugccuuccuuaug

SEQ ID NO: 30170 - RNA, 24 nt, Human
uggggauuggccagcugacaugcu

SEQ ID NO: 30171 - RNA, 24 nt, Human
acaggagugguccuuauccgguuu

SEQ ID NO: 30172 - RNA, 24 nt, Human
cugcccccucggucacucucuucc

SEQ ID NO: 30173 - RNA, 24 nt, Human
ccugagcgauucucuggcuccagc

SEQ ID NO: 30174 - RNA, 24 nt, Human
uggaucguguagaucgagaaauug

SEQ ID NO: 30175 - RNA, 24 nt, Human
acuugaugcuccauccucuccaau

SEQ ID NO: 30176 - RNA, 24 nt, Human
caagugauuuauugaugagacauc

SEQ ID NO: 30177 - RNA, 24 nt, Human
uuuuaagauagucuucugcaguua

SEQ ID NO: 30178 - RNA, 24 nt, Human
uccccaaggugucagagaagacca

SEQ ID NO: 30179 - RNA, 24 nt, Human
uccaccaacaaccccucccaggcu

SEQ ID NO: 30180 - RNA, 24 nt, Human
uggaagaugcucaacaccuccucc

SEQ ID NO: 30181 - RNA, 24 nt, Human
ugaccaggaaauacaacgagcugc

SEQ ID NO: 30182 - RNA, 24 nt, Human
ccgcaaccuccaccucccagguuc

SEQ ID NO: 30183 - RNA, 24 nt, Human
aaaaguacuaaaugaaucccuaua

SEQ ID NO: 30184 - RNA, 24 nt, Human
ucuagggaaagaauacaggcggau

SEQ ID NO: 30185 - RNA, 24 nt, Human
ugguaucgcuguacacgacagagg

SEQ ID NO: 30186 - RNA, 24 nt, Human
ugagucaaagucacaucauaagca

SEQ ID NO: 30187 - RNA, 24 nt, Human
agacaggcuggcacagccccaggc

SEQ ID NO: 30188 - RNA, 24 nt, Human
aaaaggacauauuaaauguauuua

SEQ ID NO: 30189 - RNA, 19 nt, Human
ccguacacgcucagcgucg

SEQ ID NO: 30190 - RNA, 24 nt, Human
ccgggucgacccacgcguccgcug

SEQ ID NO: 30191 - RNA, 24 nt, Human
uacacgacucccaucuaggcugaa

SEQ ID NO: 30192 - RNA, 17 nt, Human
ucucguugcuucauggu

SEQ ID NO: 30193 - RNA, 24 nt, Human
aagcgccccagauguggggaacag

SEQ ID NO: 30194 - RNA, 24 nt, Human
uggcacguuuguugaaacccagca

SEQ ID NO: 30195 - RNA, 24 nt, Human
ugacuucuuauuaccaaggacacu

SEQ ID NO: 30196 - RNA, 24 nt, Human
ugccaagguuacuaacaucacgaa

SEQ ID NO: 30197 - RNA, 24 nt, Human
ucuuuguuguuuaaauauaaacag

SEQ ID NO: 30198 - RNA, 24 nt, Human
accauguaaaagugagcucagacg

SEQ ID NO: 30199 - RNA, 24 nt, Human
uaaugggucucaaaauucugugac

SEQ ID NO: 30200 - RNA, 24 nt, Human
uauuagggauaauauucauuuagc

SEQ ID NO: 30201 - RNA, 24 nt, Human
uuaaagagguuaucucugauuaaa

SEQ ID NO: 30202 - RNA, 24 nt, Human
uaauauuugauauuuuaaccuacc

SEQ ID NO: 30203 - RNA, 24 nt, Human
uuucugcugauuuacaucuuuccu

SEQ ID NO: 30204 - RNA, 24 nt, Human
uuccaugacccugacaagcagguu

SEQ ID NO: 30205 - RNA, 24 nt, Human
uuaugauuauuuuauuuaaaaaaa

SEQ ID NO: 30206 - RNA, 24 nt, Human
uggaagaaugacacgggcucagga

SEQ ID NO: 30207 - RNA, 24 nt, Human
uauuccggcuggaguccccagaaa

SEQ ID NO: 30208 - RNA, 24 nt, Human
aggcaucgggcagccacuuucacu

SEQ ID NO: 30209 - RNA, 24 nt, Human
ucagauggcaacucccagggccca

SEQ ID NO: 30210 - RNA, 24 nt, Human
aaggacucacaggagggagggaca

SEQ ID NO: 30211 - RNA, 21 nt, Human
aaguaugccugggucuuggau

SEQ ID NO: 30212 - RNA, 24 nt, Human
uacagggacaucucaggcugacug

SEQ ID NO: 30213 - RNA, 24 nt, Human
uaguucagauugaucuuaggucaa

SEQ ID NO: 30214 - RNA, 24 nt, Human
uagagugguggcucccaaaauccc

SEQ ID NO: 30215 - RNA, 24 nt, Human
gugcaaugaauguguuacuuucgu

SEQ ID NO: 30216 - RNA, 24 nt, Human
ucaggaacggaaugugauccaauc

SEQ ID NO: 30217 - RNA, 18 nt, Human
aaggagcuaguagauuuc

SEQ ID NO: 30218 - RNA, 24 nt, Human
uaugagagugugcuuuacugagaa

SEQ ID NO: 30219 - RNA, 24 nt, Human
ucacaaccacggcccuggaggagc

SEQ ID NO: 30220 - RNA, 24 nt, Human
ccuccuucccaggcucuggggcag

SEQ ID NO: 30221 - RNA, 24 nt, Human
agguaguaaacuccccaggugggc

SEQ ID NO: 30222 - RNA, 24 nt, Human
agaaguaugaggaauacuugacca

SEQ ID NO: 30223 - RNA, 23 nt, Human
ucccuaaguaggaagacaguuug

SEQ ID NO: 30224 - RNA, 24 nt, Human
cuuguaaaaaucaaugaauggcaa

SEQ ID NO: 30225 - RNA, 17 nt, Human
uacgugguugagaaggu

SEQ ID NO: 30226 - RNA, 24 nt, Human
uaacaagaaaaggcaauugguuag

SEQ ID NO: 30227 - RNA, 24 nt, Human
uugaagauccauaacuaucuucug

SEQ ID NO: 30228 - RNA, 24 nt, Human
uggcaaguuuggggccuacaugca

SEQ ID NO: 30229 - RNA, 24 nt, Human
gugcagcgcgucacccgggccagc

SEQ ID NO: 30230 - RNA, 24 nt, Human
ugaagggcaaacaguuuaguucaa

SEQ ID NO: 30231 - RNA, 24 nt, Human
caugucuuaagagcgggaagaaaa

SEQ ID NO: 30232 - RNA, 24 nt, Human
cuagaguugugagaaaaccagaga

SEQ ID NO: 30233 - RNA, 24 nt, Human
aaggggccuggggcaccaaacaau

SEQ ID NO: 30234 - RNA, 24 nt, Human
cuggacccccucauccugacgcuc

SEQ ID NO: 30235 - RNA, 21 nt, Human
uggguugacaaauaucagggu

SEQ ID NO: 30236 - RNA, 24 nt, Human
aggcuguagauggagcagauguug

SEQ ID NO: 30237 - RNA, 24 nt, Human
guguagcugucccagaugaugagc

SEQ ID NO: 30238 - RNA, 24 nt, Human
ccgcaauccuuccaacucucagcc

SEQ ID NO: 30239 - RNA, 20 nt, Human
ggccugggggaaccgagcuc

SEQ ID NO: 30240 - RNA, 18 nt, Human
uaacguagcgaucuuggc

SEQ ID NO: 30241 - RNA, 22 nt, Human
uaaggugaacucgguggcgccc

SEQ ID NO: 30242 - RNA, 24 nt, Human
uggcauccggggccggggucgcgg

SEQ ID NO: 30243 - RNA, 24 nt, Human
ugucacacccacaagcuccuuggg

SEQ ID NO: 30244 - RNA, 18 nt, Human
aacagcuuucucaaaugu

SEQ ID NO: 30245 - RNA, 24 nt, Human
ugucagaaaacaaaacaaaaaaag

SEQ ID NO: 30246 - RNA, 24 nt, Human
agccccgacaccgucucgcccucc

SEQ ID NO: 30247 - RNA, 24 nt, Human
uaucccagaggcauccuuccugga

SEQ ID NO: 30248 - RNA, 24 nt, Human
uugaaaagguauaagaauacaaau

SEQ ID NO: 30249 - RNA, 24 nt, Human
augacucucgugauggaggaaagg

SEQ ID NO: 30250 - RNA, 24 nt, Human
agagcgugcccggccaggccaucc

SEQ ID NO: 30251 - RNA, 24 nt, Human
uccgcagaguuugggcgccaggcg

SEQ ID NO: 30252 - RNA, 24 nt, Human
uuugcagauauuauguguauauau

SEQ ID NO: 30253 - RNA, 24 nt, Human
ugccaucaccaucuauguguccaa

SEQ ID NO: 30254 - RNA, 24 nt, Human
acacguauagugaaaaaauuuauu

SEQ ID NO: 30255 - RNA, 24 nt, Human
uuagagacaagaguaccaaagcgg

SEQ ID NO: 30256 - RNA, 24 nt, Human
ugaggcuuagagagaggaggcagc

SEQ ID NO: 30257 - RNA, 24 nt, Human
uccaccacuacuggccaucugauc

SEQ ID NO: 30258 - RNA, 24 nt, Human
accacuuuugugcaccugucccca

SEQ ID NO: 30259 - RNA, 24 nt, Human
agccuagaaaugucuguguuaagu

SEQ ID NO: 30260 - RNA, 24 nt, Human
ugacugaauucuucaaaaauguca

SEQ ID NO: 30261 - RNA, 24 nt, Human
ugccucagagaguccacguccaga

SEQ ID NO: 30262 - RNA, 24 nt, Human
ccagggcagaauugaugugugauu

SEQ ID NO: 30263 - RNA, 22 nt, Human
uaacagacaggguuccuguggu

SEQ ID NO: 30264 - RNA, 24 nt, Human
aggaacuugucugacuuuaagugu

SEQ ID NO: 30265 - RNA, 24 nt, Human
ugacaugacgggguacacuccgga

SEQ ID NO: 30266 - RNA, 24 nt, Human
uucucuguauccccuuacaggcag

SEQ ID NO: 30267 - RNA, 24 nt, Human
ugcaagggcgggcuguauugagaa

SEQ ID NO: 30268 - RNA, 22 nt, Human
gggguugggccugugucuccag

SEQ ID NO: 30269 - RNA, 18 nt, Human
uauuauggagcugggcgu

SEQ ID NO: 30270 - RNA, 24 nt, Human
cuccaaagcuugagaaggaaaugg

SEQ ID NO: 30271 - RNA, 24 nt, Human
ugauuaguaucuacaaggcacuua

SEQ ID NO: 30272 - RNA, 24 nt, Human
uagaaguauguuacuggcucuuaa

SEQ ID NO: 30273 - RNA, 24 nt, Human
uuugugcuagggugaugucaauug

SEQ ID NO: 30274 - RNA, 24 nt, Human
ucaguuaaaaaagaagaagaagaa

SEQ ID NO: 30275 - RNA, 24 nt, Human
ucugaucaauccuucuuuuucucu

SEQ ID NO: 30276 - RNA, 24 nt, Human
ucaauuuuuauuuugguuuucuua

SEQ ID NO: 30277 - RNA, 24 nt, Human
uucacucuaagucauguauguuuc

SEQ ID NO: 30278 - RNA, 21 nt, Human
uaaaacauagcaaauggcaaa

SEQ ID NO: 30279 - RNA, 24 nt, Human
caucugguguugagacuucggggu

SEQ ID NO: 30280 - RNA, 24 nt, Human
uaaguuggcugugcugaaauacua

SEQ ID NO: 30281 - RNA, 24 nt, Human
uucaugggaagccacuuugacagg

SEQ ID NO: 30282 - RNA, 24 nt, Human
uaccgccaguccauguucagugcu

SEQ ID NO: 30283 - RNA, 22 nt, Human
uaagggcaucgucgugggcauc

SEQ ID NO: 30284 - RNA, 24 nt, Human
acgcugugcccaauacaagaagga

SEQ ID NO: 30285 - RNA, 24 nt, Human
uaaugcucauuuagacugacacag

SEQ ID NO: 30286 - RNA, 24 nt, Human
uacuccucauggggcuugaccauu

SEQ ID NO: 30287 - RNA, 24 nt, Human
ucuccaaaagacaaaacagaacaa

SEQ ID NO: 30288 - RNA, 24 nt, Human
ugacauggagccuuugauuaguuu

SEQ ID NO: 30289 - RNA, 24 nt, Human
ugaaaagauaggaaaaaauagaaa

SEQ ID NO: 30290 - RNA, 24 nt, Human
aguuggcugauguuggaauuuuug

SEQ ID NO: 30291 - RNA, 24 nt, Human
ucggaagcggagcaaggucgaggc

SEQ ID NO: 30292 - RNA, 24 nt, Human
gcgcagcuucaggggccgcaaggg

SEQ ID NO: 30293 - RNA, 24 nt, Human
uguaagcucucagcacugaucaug

SEQ ID NO: 30294 - RNA, 24 nt, Human
caggacccuugaccagccaggccu

SEQ ID NO: 30295 - RNA, 24 nt, Human
uccaccacuacuggccaucugauc

SEQ ID NO: 30296 - RNA, 22 nt, Human
uagcagcaaaguccgguuccau

SEQ ID NO: 30297 - RNA, 24 nt, Human
ucacuguuggacgauuggcagaau

SEQ ID NO: 30298 - RNA, 22 nt, Human
uccccaucucuuuuuccccaca

SEQ ID NO: 30299 - RNA, 21 nt, Human
uucaagggauggaaagucacc

SEQ ID NO: 30300 - RNA, 24 nt, Human
gaccauuggaccucgaggggcacg

SEQ ID NO: 30301 - RNA, 22 nt, Human
gacccuguuaacuacuacguug

SEQ ID NO: 30302 - RNA, 24 nt, Human
ugugugccauugcccaggcagagu

SEQ ID NO: 30303 - RNA, 24 nt, Human
uucagaagagguuggcuuuccaga

SEQ ID NO: 30304 - RNA, 24 nt, Human
ugcucggacggaaagcggggcugc

SEQ ID NO: 30305 - RNA, 24 nt, Human
uggccuggcugaaggagcaucugu

SEQ ID NO: 30306 - RNA, 24 nt, Human
uugcugggccccauggaaggcagc

SEQ ID NO: 30307 - RNA, 24 nt, Human
caaccagagacccccaggcccaag

SEQ ID NO: 30308 - RNA, 24 nt, Human
caccagggccucaucagcaaccug

SEQ ID NO: 30309 - RNA, 24 nt, Human
cuucaagggcauggaacacgucac

SEQ ID NO: 30310 - RNA, 24 nt, Human
uccacuggcgaaagaugccuuucu

SEQ ID NO: 30311 - RNA, 24 nt, Human
uaguucagauugaucuuaggucaa

SEQ ID NO: 30312 - RNA, 21 nt, Human
guggaucccagaaucccgaag

SEQ ID NO: 30313 - RNA, 20 nt, Human
uagcacaagugccagucgga

SEQ ID NO: 30314 - RNA, 20 nt, Human
ucccuaaaugcaguagauua

SEQ ID NO: 30315 - RNA, 21 nt, Human
gggcaggggugaggcagguuu

SEQ ID NO: 30316 - RNA, 24 nt, Human
uugcucccugucgucugcaccaua

SEQ ID NO: 30317 - RNA, 24 nt, Human
cagcggcagagagccauccucuau

SEQ ID NO: 30318 - RNA, 24 nt, Human
aggcgguguccgagcccacgacgg

SEQ ID NO: 30319 - RNA, 24 nt, Human
cuugcaggguggcugaagcccugg

SEQ ID NO: 30320 - RNA, 24 nt, Human
ugucaaggacucccaagcugcucu

SEQ ID NO: 30321 - RNA, 24 nt, Human
caauuccagaucaaaggcaucauu

SEQ ID NO: 30322 - RNA, 24 nt, Human
ugccuugcccccagacccaccagc

SEQ ID NO: 30323 - RNA, 24 nt, Human
uuuccggcgccgacucugaggccc

SEQ ID NO: 30324 - RNA, 24 nt, Human
ucucacuccacacggugccccgac

SEQ ID NO: 30325 - RNA, 24 nt, Human
aaacaguaguacaagcuccccuca

SEQ ID NO: 30326 - RNA, 21 nt, Human
cucccgcugcccaccaacacc

SEQ ID NO: 30327 - RNA, 24 nt, Human
cuggacaaggugaagcuggacucc

SEQ ID NO: 30328 - RNA, 24 nt, Human
uggggacauuccuguagcaaccag

SEQ ID NO: 30329 - RNA, 24 nt, Human
ugguaacgucccccaggcaaagcu

SEQ ID NO: 30330 - RNA, 24 nt, Human
uaaaugguaaacgugauaucauga

SEQ ID NO: 30331 - RNA, 22 nt, Human
gucaauauccauaaaugaaggg

SEQ ID NO: 30332 - RNA, 24 nt, Human
agcgcucagccaccaccgcgggac

SEQ ID NO: 30333 - RNA, 24 nt, Human
uaccgugcauccuugcagauggaa

SEQ ID NO: 30334 - RNA, 24 nt, Human
uuccugggaacuucaaacaaaaaa

SEQ ID NO: 30335 - RNA, 24 nt, Human
uggaugagcagagggagcggguac

SEQ ID NO: 30336 - RNA, 24 nt, Human
cuauccagggcucuucccacagcu

SEQ ID NO: 30337 - RNA, 19 nt, Human
ucccugcggugugggcaga

SEQ ID NO: 30338 - RNA, 24 nt, Human
uaggcccccugaauaaaggcuaug

SEQ ID NO: 30339 - RNA, 24 nt, Human
uggacagagaaugaaauaucaugu

SEQ ID NO: 30340 - RNA, 24 nt, Human
cagugcugagggguuagggccaga

SEQ ID NO: 30341 - RNA, 24 nt, Human
cagguccagcccuggggcaaguaa

SEQ ID NO: 30342 - RNA, 24 nt, Human
ccugucaccccaccauggagaaaa

SEQ ID NO: 30343 - RNA, 24 nt, Human
caugccaccuggauuggcucauca

SEQ ID NO: 30344 - RNA, 24 nt, Human
ucacaggauccuuagggugucacu

SEQ ID NO: 30345 - RNA, 24 nt, Human
uagcacugacagaagcccugaggc

SEQ ID NO: 30346 - RNA, 24 nt, Human
ugagauacugaacacaaaguugcu

SEQ ID NO: 30347 - RNA, 24 nt, Human
ggccagcggaaaguuuuauuuacc

SEQ ID NO: 30348 - RNA, 24 nt, Human
aaggacaccaaccacgagugacac

SEQ ID NO: 30349 - RNA, 24 nt, Human
uggaucaccugaggucaggaguuc

SEQ ID NO: 30350 - RNA, 24 nt, Human
aguggaaacuggcagucccaaacc

SEQ ID NO: 30351 - RNA, 21 nt, Human
uucaagggauggaaagucacc

SEQ ID NO: 30352 - RNA, 24 nt, Human
ucugaucuauaaaugcgguggcau

SEQ ID NO: 30353 - RNA, 24 nt, Human
ucaaguuguaugccaaaaauaaca

SEQ ID NO: 30354 - RNA, 23 nt, Human
ucccagccagcccgggcccuggg

SEQ ID NO: 30355 - RNA, 17 nt, Human
ugacguugggccuuugg

SEQ ID NO: 30356 - RNA, 24 nt, Human
ccacccagcccaagaggcccaugu

SEQ ID NO: 30357 - RNA, 24 nt, Human
cuggaggacgacccuaagaaccgg

SEQ ID NO: 30358 - RNA, 24 nt, Human
agaaaacgugagguggccaugaug

SEQ ID NO: 30359 - RNA, 24 nt, Human
uccaccacuacuggccaucugauc

SEQ ID NO: 30360 - RNA, 24 nt, Human
cuugguccacggcgaugcgcaagu

SEQ ID NO: 30361 - RNA, 24 nt, Human
acgggaugcaguacagcaccgauu

SEQ ID NO: 30362 - RNA, 24 nt, Human
cuguguuuuuagcaucuuugggag

SEQ ID NO: 30363 - RNA, 24 nt, Human
agagaaaagccuguuuaccaagga

SEQ ID NO: 30364 - RNA, 24 nt, Human
aggaaucagagaucauugauuucu

SEQ ID NO: 30365 - RNA, 24 nt, Human
ugggaugaccugugaacgagacag

SEQ ID NO: 30366 - RNA, 24 nt, Human
ucaaauccaccaaugaaaucaaag

SEQ ID NO: 30367 - RNA, 24 nt, Human
ucuuaagggcuccuugauggaugc

SEQ ID NO: 30368 - RNA, 24 nt, Human
aacgugcacaugggauccaugggc

SEQ ID NO: 30369 - RNA, 21 nt, Human
uucauucuuaauuuauguaag

SEQ ID NO: 30370 - RNA, 24 nt, Human
uuuaagauugaagauguccaauau

SEQ ID NO: 30371 - RNA, 24 nt, Human
uuugagcaugaaaauaaaucuuua

SEQ ID NO: 30372 - RNA, 24 nt, Human
uauucaguugagacauguauuaca

SEQ ID NO: 30373 - RNA, 20 nt, Human
aggcuucacuagcauacagu

SEQ ID NO: 30374 - RNA, 24 nt, Human
aagcauuucauggggugagagggg

SEQ ID NO: 30375 - RNA, 24 nt, Human
aagcaaacauucaaaaccccaagg

SEQ ID NO: 30376 - RNA, 24 nt, Human
ugcguuuauccacaggauaaagcc

SEQ ID NO: 30377 - RNA, 24 nt, Human
ugagccuggacggacgggggcugg

SEQ ID NO: 30378 - RNA, 24 nt, Human
auuguauucaucaccagucaccuc

SEQ ID NO: 30379 - RNA, 22 nt, Human
uaucugaaaaaaucauagaaaa

SEQ ID NO: 30380 - RNA, 24 nt, Human
uucacauaaauauaaauuauauau

SEQ ID NO: 30381 - RNA, 24 nt, Human
uauaacaguuaucuuacuuaacag

SEQ ID NO: 30382 - RNA, 24 nt, Human
ucuauggugggagccuuaaaaggg

SEQ ID NO: 30383 - RNA, 24 nt, Human
uuaccuggcggcgggcgggcgcgg

SEQ ID NO: 30384 - RNA, 24 nt, Human
cgccugggcacuugggcuccgggc

SEQ ID NO: 30385 - RNA, 24 nt, Human
ugcuggugggcgucgggcggcggc

SEQ ID NO: 30386 - RNA, 24 nt, Human
auaaccuugcuguuugucuauuuu

SEQ ID NO: 30387 - RNA, 24 nt, Human
uugguuuuuguugcuuucuggaau

SEQ ID NO: 30388 - RNA, 24 nt, Human
agccauugaaacagaugaucugac

SEQ ID NO: 30389 - RNA, 24 nt, Human
aagaagaaacaaaagaaagcauca

SEQ ID NO: 30390 - RNA, 24 nt, Human
ugggaggccgaaguggguggauug

SEQ ID NO: 30391 - RNA, 24 nt, Human
aggcagugggcugacuggugaaaa

SEQ ID NO: 30392 - RNA, 24 nt, Human
uuuuuugguagagacaggguuucg

SEQ ID NO: 30393 - RNA, 24 nt, Human
aucacuguguucauucuaaacuuc

SEQ ID NO: 30394 - RNA, 24 nt, Human
uguaugcauagacaccuaucuaaa

SEQ ID NO: 30395 - RNA, 24 nt, Human
ugcauuguuaucauuaaccagucu

SEQ ID NO: 30396 - RNA, 24 nt, Human
uauuagggauaauauucauuuagc

SEQ ID NO: 30397 - RNA, 24 nt, Human
uuuaacuuuuuuaaugggucucaa

SEQ ID NO: 30398 - RNA, 19 nt, Human
uaggcacgauggccaggug

SEQ ID NO: 30399 - RNA, 24 nt, Human
uauuagggauaauauucauuuagc

SEQ ID NO: 30400 - RNA, 24 nt, Human
uaauuuuuguauuuuuaguagaga

SEQ ID NO: 30401 - RNA, 24 nt, Human
ugugugaugagaacauguuugggc

SEQ ID NO: 30402 - RNA, 24 nt, Human
uaaugggucucaaaauucugugac

SEQ ID NO: 30403 - RNA, 24 nt, Human
ugggauguggaaauacuggcuuca

SEQ ID NO: 30404 - RNA, 24 nt, Human
aagcagcccaggggccugaaauac

SEQ ID NO: 30405 - RNA, 24 nt, Human
uggcaaggagguaaggaaaugaaa

SEQ ID NO: 30406 - RNA, 24 nt, Human
ugcauuguuaucauuaaccagucu

SEQ ID NO: 30407 - RNA, 24 nt, Human
uuuaacuuuuuuaaugggucucaa

SEQ ID NO: 30408 - RNA, 24 nt, Human
uuccucauaaauaguuccuuauuu

SEQ ID NO: 30409 - RNA, 24 nt, Human
uaggggcuuuccaugugcagggca

SEQ ID NO: 30410 - RNA, 24 nt, Human
ucuuuggaacguuguccuggacuu

SEQ ID NO: 30411 - RNA, 19 nt, Human
ucauacucaccuuccucgc

SEQ ID NO: 30412 - RNA, 24 nt, Human
uuuauuuuugccuuuuuuuuuuuu

SEQ ID NO: 30413 - RNA, 22 nt, Human
uggaguauguucuugaguucug

SEQ ID NO: 30414 - RNA, 24 nt, Human
ccuuucgccagcugccguaauagc

SEQ ID NO: 30415 - RNA, 24 nt, Human
acugcacuccagccugggcaacag

SEQ ID NO: 30416 - RNA, 24 nt, Human
uacuugaaagaacacacugcuugg

SEQ ID NO: 30417 - RNA, 24 nt, Human
uuggaucugcuucaaugguuucuc

SEQ ID NO: 30418 - RNA, 24 nt, Human
uaguauaguggggaguuagguagu

SEQ ID NO: 30419 - RNA, 24 nt, Human
uugcaccauuguugaacagggaau

SEQ ID NO: 30420 - RNA, 24 nt, Human
ugaagaucagauagcuauaggugu

SEQ ID NO: 30421 - RNA, 24 nt, Human
aggcagaaaacaccaggauuccuu

SEQ ID NO: 30422 - RNA, 24 nt, Human
ugugugcuaggagcuggagcgcua

SEQ ID NO: 30423 - RNA, 24 nt, Human
ugaagaacaucaccuaagagauua

SEQ ID NO: 30424 - RNA, 24 nt, Human
uccccaacgcgaucucaaguucag

SEQ ID NO: 30425 - RNA, 24 nt, Human
uccacgguuagccugcuguagagg

SEQ ID NO: 30426 - RNA, 24 nt, Human
gaccaggcagggucaggcugaccu

SEQ ID NO: 30427 - RNA, 24 nt, Human
ugacacgaggggaggggucugugu

SEQ ID NO: 30428 - RNA, 24 nt, Human
uguuguacuugaggaacacucggu

SEQ ID NO: 30429 - RNA, 24 nt, Human
uauugggcagauaaagagaagaaa

SEQ ID NO: 30430 - RNA, 24 nt, Human
acuugcuggucaugcucugaaacu

SEQ ID NO: 30431 - RNA, 24 nt, Human
ucugcagucaauuuguuuuguacc

SEQ ID NO: 30432 - RNA, 24 nt, Human
aggcaguccugggaccuccuguuc

SEQ ID NO: 30433 - RNA, 21 nt, Human
cgcugcuuaaaaaccgagaug

SEQ ID NO: 30434 - RNA, 24 nt, Human
uagauuauuggauaauugucauua

SEQ ID NO: 30435 - RNA, 24 nt, Human
auggaucccugauggauucaccau

SEQ ID NO: 30436 - RNA, 24 nt, Human
gaacugguccuuucacuuugagau

SEQ ID NO: 30437 - RNA, 24 nt, Human
uaucaagucagcacacaccuuuuc

SEQ ID NO: 30438 - RNA, 24 nt, Human
ucaaugagucgcuugugaauucuc

SEQ ID NO: 30439 - RNA, 24 nt, Human
ugugauuuaucuuuuugcugaggg

SEQ ID NO: 30440 - RNA, 24 nt, Human
ugaauguacauuaagaugaaguca

SEQ ID NO: 30441 - RNA, 24 nt, Human
ugaagggaagcaguccgaacauau

SEQ ID NO: 30442 - RNA, 24 nt, Human
cauuggcucuugaacugauggcug

SEQ ID NO: 30443 - RNA, 24 nt, Human
aaagguaccacucacuacauuaca

SEQ ID NO: 30444 - RNA, 24 nt, Human
ucucacccuagagugacagcuauc

SEQ ID NO: 30445 - RNA, 21 nt, Human
uagcuacaugugcuuuggccc

SEQ ID NO: 30446 - RNA, 23 nt, Human
uggcucaagaucagauuccugac

SEQ ID NO: 30447 - RNA, 24 nt, Human
agggauuaaauauagauguaauuu

SEQ ID NO: 30448 - RNA, 24 nt, Human
uguaagauggauaauguguauaag

SEQ ID NO: 30449 - RNA, 24 nt, Human
uaaugggucucaaaauucugugac

SEQ ID NO: 30450 - RNA, 24 nt, Human
ugcauuguuaucauuaaccagucu

SEQ ID NO: 30451 - RNA, 24 nt, Human
uaaugggucucaaaauucugugac

SEQ ID NO: 30452 - RNA, 24 nt, Human
uauuagggauaauauucauuuagc

SEQ ID NO: 30453 - RNA, 24 nt, Human
cuagacaggaaaucagcugagacc

SEQ ID NO: 30454 - RNA, 24 nt, Human
ugccagggggaagagcgauggguc

SEQ ID NO: 30455 - RNA, 24 nt, Human
uucggggaaguaguccuugaccag

SEQ ID NO: 30456 - RNA, 24 nt, Human
ucgcugacgaaugaugacaagaca

SEQ ID NO: 30457 - RNA, 24 nt, Human
ugaaagaagaagauggggaaaagg

SEQ ID NO: 30458 - RNA, 24 nt, Human
uccugggucccgggagggcuccuu

SEQ ID NO: 30459 - RNA, 24 nt, Human
uggggccaggacagggaagcugga

SEQ ID NO: 30460 - RNA, 24 nt, Human
ccagauccagagaaagcgcggaag

SEQ ID NO: 30461 - RNA, 17 nt, Human
uccacguucaugucaca

SEQ ID NO: 30462 - RNA, 24 nt, Human
uggcaagucacuuugacagacauu

SEQ ID NO: 30463 - RNA, 24 nt, Human
uacaccacucccaagaagaauaag

SEQ ID NO: 30464 - RNA, 24 nt, Human
ugccagggcaucuggaaguucugg

SEQ ID NO: 30465 - RNA, 24 nt, Human
gugcagugaguggccucaaaguug

SEQ ID NO: 30466 - RNA, 22 nt, Human
ugccugguaggagcggaggaca

SEQ ID NO: 30467 - RNA, 24 nt, Human
uaaguacauaggucuuuauuuaaa

SEQ ID NO: 30468 - RNA, 24 nt, Human
uggaggagggagaggggagagcag

SEQ ID NO: 30469 - RNA, 24 nt, Human
ucccacagaagcuacagcugccag

SEQ ID NO: 30470 - RNA, 24 nt, Human
aaggagacagucuuggaggugcug

SEQ ID NO: 30471 - RNA, 24 nt, Human
ugagcguuagucaaagguacagga

SEQ ID NO: 30472 - RNA, 24 nt, Human
augcagagggagcaggagcugagg

SEQ ID NO: 30473 - RNA, 23 nt, Human
uugggugauugaaccggauagcu

SEQ ID NO: 30474 - RNA, 24 nt, Human
uguaaaagaaaguguuauaaaagc

SEQ ID NO: 30475 - RNA, 24 nt, Human
ugcauuguuaucauuaaccagucu

SEQ ID NO: 30476 - RNA, 24 nt, Human
uauuagggauaauauucauuuagc

SEQ ID NO: 30477 - RNA, 24 nt, Human
uuuaacuuuuuuaaugggucucaa

SEQ ID NO: 30478 - RNA, 24 nt, Human
ucaauagauauaucgaacguaagc

SEQ ID NO: 30479 - RNA, 24 nt, Human
ggagcaccuggagcgcaugaagcg

SEQ ID NO: 30480 - RNA, 21 nt, Human
aucaugcuuuauaggcucucc

SEQ ID NO: 30481 - RNA, 18 nt, Human
cugugcuuccaguuuugc

SEQ ID NO: 30482 - RNA, 24 nt, Human
ugccuggagugacagagccuuccu

SEQ ID NO: 30483 - RNA, 24 nt, Human
uauggcaagucacuuugacagaca

SEQ ID NO: 30484 - RNA, 24 nt, Human
aagcuggcuguccugaaauauuau

SEQ ID NO: 30485 - RNA, 24 nt, Human
uacaccacucccaagaagaauaag

SEQ ID NO: 30486 - RNA, 24 nt, Human
uguaaugacaacaauuuaggcauc

SEQ ID NO: 30487 - RNA, 24 nt, Human
uauguagagaaaauugcaugacuu

SEQ ID NO: 30488 - RNA, 24 nt, Human
uuaauguucgcugcugcaguuaug

SEQ ID NO: 30489 - RNA, 24 nt, Human
uguuauggggauaagcuggugagg

SEQ ID NO: 30490 - RNA, 24 nt, Human
aguuacuuauuaaaaaaaaaacac

SEQ ID NO: 30491 - RNA, 24 nt, Human
uuuauucuaguaacuggcuacaag

SEQ ID NO: 30492 - RNA, 24 nt, Human
ccagcaaucccgcgcgguuuguca

SEQ ID NO: 30493 - RNA, 24 nt, Human
aaugcaggguguaagggguccggg

SEQ ID NO: 30494 - RNA, 24 nt, Human
aacgugaaaaaaaggauggaauaa

SEQ ID NO: 30495 - RNA, 24 nt, Human
ggugaugggggcagccgggaggga

SEQ ID NO: 30496 - RNA, 21 nt, Human
uugcucagugacagagccuca

SEQ ID NO: 30497 - RNA, 24 nt, Human
agcccaugguaucggaagaaauuc

SEQ ID NO: 30498 - RNA, 24 nt, Human
aagaagcauuuauuagcaugcagg

SEQ ID NO: 30499 - RNA, 24 nt, Human
ugaagacaaccuugaggagggagc

SEQ ID NO: 30500 - RNA, 24 nt, Human
uacaagugauucuccugccucagc

SEQ ID NO: 30501 - RNA, 24 nt, Human
uugcauggacaucaggauuccucu

SEQ ID NO: 30502 - RNA, 24 nt, Human
uguuauggucuuuaugaaaacaaa

SEQ ID NO: 30503 - RNA, 24 nt, Human
ugggagcgagaaaguaguugugaa

SEQ ID NO: 30504 - RNA, 24 nt, Human
uaguggagauaggguuucaccaug

SEQ ID NO: 30505 - RNA, 24 nt, Human
acccaguaaccauucuguccaauu

SEQ ID NO: 30506 - RNA, 24 nt, Human
uucccauucagauucuucuugaua

SEQ ID NO: 30507 - RNA, 24 nt, Human
ccaaagcuguccaccagccccacu

SEQ ID NO: 30508 - RNA, 24 nt, Human
aggcaugcuuugagggaagacucc

SEQ ID NO: 30509 - RNA, 24 nt, Human
uuuaagaacuuauuuuuauuuuau

SEQ ID NO: 30510 - RNA, 24 nt, Human
aggaaaugucaaaaaggcaaaaug

SEQ ID NO: 30511 - RNA, 24 nt, Human
ucaguuggaaaacccccugaaauu

SEQ ID NO: 30512 - RNA, 24 nt, Human
uuuguggugccaccgcaguugcag

SEQ ID NO: 30513 - RNA, 19 nt, Human
uaucugagcuccugcugcc

SEQ ID NO: 30514 - RNA, 24 nt, Human
uuggcuagcacggugaaacccugu

SEQ ID NO: 30515 - RNA, 24 nt, Human
cagcuccaccccucacuaacuguu

SEQ ID NO: 30516 - RNA, 24 nt, Human
ugaggugaacaagugcagccgcug

SEQ ID NO: 30517 - RNA, 24 nt, Human
aagacguugccuucaaagaccugg

SEQ ID NO: 30518 - RNA, 24 nt, Human
uacacuguggccucaaccucccag

SEQ ID NO: 30519 - RNA, 24 nt, Human
ucccucuugcuuuauagcuagcug

SEQ ID NO: 30520 - RNA, 24 nt, Human
uuggaccaccacaugacaucauuu

SEQ ID NO: 30521 - RNA, 24 nt, Human
uaaaagcaguuuccauguguuuuc

SEQ ID NO: 30522 - RNA, 22 nt, Human
ucccuuauguuuucaguauauu

SEQ ID NO: 30523 - RNA, 24 nt, Human
uccacggugagcuugcuguagagg

SEQ ID NO: 30524 - RNA, 24 nt, Human
ucgcugggauagaagccuuugacc

SEQ ID NO: 30525 - RNA, 20 nt, Human
ugcguguagugguugugcag

SEQ ID NO: 30526 - RNA, 24 nt, Human
cauucgggagaucuuccggaccaa

SEQ ID NO: 30527 - RNA, 24 nt, Human
cugaagcugucugggggagaugau

SEQ ID NO: 30528 - RNA, 22 nt, Human
gagcugaagggaacugugcgcc

SEQ ID NO: 30529 - RNA, 24 nt, Human
uauaauaauuaacaacagcaaaga

SEQ ID NO: 30530 - RNA, 24 nt, Human
ugaaguggucugcucauaguuugu

SEQ ID NO: 30531 - RNA, 24 nt, Human
ugagaccgcuuguuuucugcaggu

SEQ ID NO: 30532 - RNA, 24 nt, Human
ugccuuugcauugguuuggcuuug

SEQ ID NO: 30533 - RNA, 24 nt, Human
uuuuccuagcuacaucugguaccu

SEQ ID NO: 30534 - RNA, 24 nt, Human
ucuccaacgacucugcccccgaug

SEQ ID NO: 30535 - RNA, 24 nt, Human
cuggagcagguccaccggccccua

SEQ ID NO: 30536 - RNA, 24 nt, Human
auugaaggaauaggaaaagaggag

SEQ ID NO: 30537 - RNA, 24 nt, Human
auggagcuaaaaguugauuuucau

SEQ ID NO: 30538 - RNA, 24 nt, Human
ugaucucguuggacugcguggcua

SEQ ID NO: 30539 - RNA, 24 nt, Human
cuuugggaugcaaggcaguuguuc

SEQ ID NO: 30540 - RNA, 24 nt, Human
cuaauucuggagugaaauauuagc

SEQ ID NO: 30541 - RNA, 24 nt, Human
uaagaagccagucagccugcccau

SEQ ID NO: 30542 - RNA, 24 nt, Human
ucugaacuuaaaagaggaagaaag

SEQ ID NO: 30543 - RNA, 24 nt, Human
guccugaguggccuggaagaagac

SEQ ID NO: 30544 - RNA, 24 nt, Human
cacaguuuaggucuaggguugucu

SEQ ID NO: 30545 - RNA, 24 nt, Human
uuaguuaacccugaguaauuacua

SEQ ID NO: 30546 - RNA, 24 nt, Human
uuagaacauagaauauuaucaauu

SEQ ID NO: 30547 - RNA, 24 nt, Human
acccaaagguggauagucugagaa

SEQ ID NO: 30548 - RNA, 24 nt, Human
uaaugggucucaaaauucugugac

SEQ ID NO: 30549 - RNA, 24 nt, Human
uauuagggauaauauucauuuagc

SEQ ID NO: 30550 - RNA, 24 nt, Human
acggagggcuccgggcucuguaug

SEQ ID NO: 30551 - RNA, 24 nt, Human
uacuucauauuacacauacuuuuc

SEQ ID NO: 30552 - RNA, 24 nt, Human
ugugcagaagaaauggaaggauuc

SEQ ID NO: 30553 - RNA, 24 nt, Human
uaucaaggaagggcaggcgugaug

SEQ ID NO: 30554 - RNA, 24 nt, Human
uucaaauuucuuucuuuuuuaauu

SEQ ID NO: 30555 - RNA, 24 nt, Human
ucaauuuuuauuuugguuuucuua

SEQ ID NO: 30556 - RNA, 24 nt, Human
ugcacauuuccucaucugucugac

SEQ ID NO: 30557 - RNA, 24 nt, Human
ugaaaaaggagaauuucaagucag

SEQ ID NO: 30558 - RNA, 24 nt, Human
uaaugggucucaaaauucugugac

SEQ ID NO: 30559 - RNA, 24 nt, Human
uauuagggauaauauucauuuagc

SEQ ID NO: 30560 - RNA, 24 nt, Human
accaccgaggagggagccguggcc

SEQ ID NO: 30561 - RNA, 24 nt, Human
ugugucuuuuagcuacagaggagg

SEQ ID NO: 30562 - RNA, 24 nt, Human
ugguugggugugcguucuucuuug

SEQ ID NO: 30563 - RNA, 24 nt, Human
uacgucgucagcaagacguugaac

SEQ ID NO: 30564 - RNA, 24 nt, Human
uggaaguggccugccgccauuuug

SEQ ID NO: 30565 - RNA, 24 nt, Human
ugacucaaugcaagcaaggccuuu

SEQ ID NO: 30566 - RNA, 24 nt, Human
gagcaggugugaguugccuuccau

SEQ ID NO: 30567 - RNA, 24 nt, Human
uucauguuaacuucuuuucuggaa

SEQ ID NO: 30568 - RNA, 24 nt, Human
uggcaguaaguguuuaucuggccu

SEQ ID NO: 30569 - RNA, 24 nt, Human
uaaacuagaaugacauuugcucag

SEQ ID NO: 30570 - RNA, 24 nt, Human
ugugcagaagaaauggaaggauuc

SEQ ID NO: 30571 - RNA, 24 nt, Human
uucaaauuucuuucuuuuuuaauu

SEQ ID NO: 30572 - RNA, 24 nt, Human
ugugcagaagaaauggaaggauuc

SEQ ID NO: 30573 - RNA, 24 nt, Human
uaucaaggaagggcaggcgugaug

SEQ ID NO: 30574 - RNA, 24 nt, Human
uucaaauuucuuucuuuuuuaauu

SEQ ID NO: 30575 - RNA, 24 nt, Human
ucaauuuuuauuuugguuuucuua

SEQ ID NO: 30576 - RNA, 20 nt, Human
uauuuuagauuacuugguug

SEQ ID NO: 30577 - RNA, 24 nt, Human
agcuguaggugccauucggaccag

SEQ ID NO: 30578 - RNA, 24 nt, Human
ccagcagugcaaugagacagacag

SEQ ID NO: 30579 - RNA, 24 nt, Human
uagcaagauaauuuggggcaagag

SEQ ID NO: 30580 - RNA, 24 nt, Human
aguugcuauguuuuauuuugcuag

SEQ ID NO: 30581 - RNA, 24 nt, Human
uaugauaauuuauuagguuauacu

SEQ ID NO: 30582 - RNA, 24 nt, Human
gacccuaucucagaaagagggagu

SEQ ID NO: 30583 - RNA, 24 nt, Human
cuacagcaccagagguacuuagua

SEQ ID NO: 30584 - RNA, 24 nt, Human
ucagaaggucuaggugagcuuuuc

SEQ ID NO: 30585 - RNA, 24 nt, Human
aaaggugcucaguuagagauucua

SEQ ID NO: 30586 - RNA, 24 nt, Human
uaaaagcagcaauaucaugucuug

SEQ ID NO: 30587 - RNA, 24 nt, Human
gcucauuugcaggggggagccaaa

SEQ ID NO: 30588 - RNA, 24 nt, Human
ugguaucuguagauggcuacauga

SEQ ID NO: 30589 - RNA, 24 nt, Human
uagcaucuuugugggggauuuuuu

SEQ ID NO: 30590 - RNA, 24 nt, Human
ucuuggguuaucuguggggugaga

SEQ ID NO: 30591 - RNA, 18 nt, Human
ugccaugacgugucccac

SEQ ID NO: 30592 - RNA, 24 nt, Human
cgagucugcaccgaccucuucagg

SEQ ID NO: 30593 - RNA, 24 nt, Human
aagaacuacaggucagaaauggaa

SEQ ID NO: 30594 - RNA, 20 nt, Human
uauguagggcaucacuuuau

SEQ ID NO: 30595 - RNA, 24 nt, Human
aguaguugugagcucuauucuaaa

SEQ ID NO: 30596 - RNA, 24 nt, Human
uuauuguugcuguuguuaauuaca

SEQ ID NO: 30597 - RNA, 21 nt, Human
uaaaaugcauuauaucuggag

SEQ ID NO: 30598 - RNA, 22 nt, Human
agcacuauuuguuuacugcacu

SEQ ID NO: 30599 - RNA, 24 nt, Human
aaauaugguaaguauaaacuucau

SEQ ID NO: 30600 - RNA, 21 nt, Human
ugggaggggcugaauguggug

SEQ ID NO: 30601 - RNA, 24 nt, Human
aaggaaccauggccaacugugagc

SEQ ID NO: 30602 - RNA, 24 nt, Human
aagcguuuugagcagaaaggauuc

SEQ ID NO: 30603 - RNA, 21 nt, Human
gauucuguggagagugcagag

SEQ ID NO: 30604 - RNA, 24 nt, Human
uauggcaagucacuuugacagaca

SEQ ID NO: 30605 - RNA, 24 nt, Human
ugagaauggcaaaauuagucgccu

SEQ ID NO: 30606 - RNA, 24 nt, Human
uacaccacucccaagaagaauaag

SEQ ID NO: 30607 - RNA, 24 nt, Human
cuccugaccucgugauccgcccgc

SEQ ID NO: 30608 - RNA, 24 nt, Human
ugggauugcggggggcgcgaccuc

SEQ ID NO: 30609 - RNA, 24 nt, Human
ugucauacagcuucuucacagccu

SEQ ID NO: 30610 - RNA, 24 nt, Human
uagcuguaguacauguuuucauug

SEQ ID NO: 30611 - RNA, 24 nt, Human
uauuucacuggaaaauucuguaaa

SEQ ID NO: 30612 - RNA, 17 nt, Human
uaccuuaccucugacuc

SEQ ID NO: 30613 - RNA, 24 nt, Human
ugaaaagcagguauccaaaagaac

SEQ ID NO: 30614 - RNA, 22 nt, Human
ugggacaagacucuaugaaagc

SEQ ID NO: 30615 - RNA, 24 nt, Human
gagcugggugagcgagcgggcggg

SEQ ID NO: 30616 - RNA, 24 nt, Human
ccgcaggcugaucccgccguccac

SEQ ID NO: 30617 - RNA, 24 nt, Human
uuucuaguugcuaagauuugccaa

SEQ ID NO: 30618 - RNA, 24 nt, Human
uuugccagucagccuaguucuucu

SEQ ID NO: 30619 - RNA, 24 nt, Human
uguucagccccuaaacgaauggca

SEQ ID NO: 30620 - RNA, 24 nt, Human
uuggcccacaucuguuuaaucuuc

SEQ ID NO: 30621 - RNA, 24 nt, Human
uucgaaguucaugcaaccaacuaa

SEQ ID NO: 30622 - RNA, 24 nt, Human
uuuguacaaaaauacugucaaaau

SEQ ID NO: 30623 - RNA, 24 nt, Human
acgacauuccacacccuauuauca

SEQ ID NO: 30624 - RNA, 24 nt, Human
uagggaguuuucacacguuucuug

SEQ ID NO: 30625 - RNA, 24 nt, Human
caguucauuccuauaucuuuagac

SEQ ID NO: 30626 - RNA, 24 nt, Human
uccacacaaauaggcacacauaua

SEQ ID NO: 30627 - RNA, 24 nt, Human
uacucuaguucaacaaagaguuau

SEQ ID NO: 30628 - RNA, 24 nt, Human
uguuucuuauagcaaacuguuguu

SEQ ID NO: 30629 - RNA, 24 nt, Human
uaaagcuaacaaaucaaaggcaca

SEQ ID NO: 30630 - RNA, 24 nt, Human
ccgggucgacccacgcguccgcau

SEQ ID NO: 30631 - RNA, 24 nt, Human
ugcagauuccuuuggccacuguau

SEQ ID NO: 30632 - RNA, 23 nt, Human
uuugauguaaguuacugacaagc

SEQ ID NO: 30633 - RNA, 24 nt, Human
ugaguccacuugucccuccacaga

SEQ ID NO: 30634 - RNA, 24 nt, Human
uugcaccucguggcugcuuuguuc

SEQ ID NO: 30635 - RNA, 24 nt, Human
uugcuggugagagugucuuuuagu

SEQ ID NO: 30636 - RNA, 18 nt, Human
ucucaaaaaaagagaaag

SEQ ID NO: 30637 - RNA, 24 nt, Human
gaggauccaagcuuacguacgcgu

SEQ ID NO: 30638 - RNA, 24 nt, Human
gggaaagcugguacgccugcaggu

SEQ ID NO: 30639 - RNA, 24 nt, Human
ugauuggauuauuagauuuuuacc

SEQ ID NO: 30640 - RNA, 24 nt, Human
uggcagagggugguagcccuuacu

SEQ ID NO: 30641 - RNA, 24 nt, Human
uggcguaauagcgaagaggcccgc

SEQ ID NO: 30642 - RNA, 24 nt, Human
gaggauccaagcuuacguacgcgu

SEQ ID NO: 30643 - RNA, 24 nt, Human
ggagguguugagcaucuuccacug

SEQ ID NO: 30644 - RNA, 24 nt, Human
accacauuuucuuuauccacucgu

SEQ ID NO: 30645 - RNA, 24 nt, Human
uaaaagccagaguuggagacacag

SEQ ID NO: 30646 - RNA, 24 nt, Human
agccauugggauccagacaucaga

SEQ ID NO: 30647 - RNA, 23 nt, Human
gcaggacaacugaggucgccucc

SEQ ID NO: 30648 - RNA, 24 nt, Human
cgcccggaacuggcucgggcacgc

SEQ ID NO: 30649 - RNA, 24 nt, Human
uauggcaagucacuuugacagaca

SEQ ID NO: 30650 - RNA, 24 nt, Human
ugagaauggcaaaauuagucgccu

SEQ ID NO: 30651 - RNA, 24 nt, Human
uauggcaagucacuugacagacau

SEQ ID NO: 30652 - RNA, 24 nt, Human
ugagaauggcaaaauuagucgccu

SEQ ID NO: 30653 - RNA, 24 nt, Human
uacaccacucccaagaagaauaag

SEQ ID NO: 30654 - RNA, 24 nt, Human
ugcaucagaagaagaaaugucagg

SEQ ID NO: 30655 - RNA, 24 nt, Human
aggacuuucucauguaauucuaug

SEQ ID NO: 30656 - RNA, 24 nt, Human
cagcaugagacuagaggcugggga

SEQ ID NO: 30657 - RNA, 24 nt, Human
cagcuggggucacggcuacagagg

SEQ ID NO: 30658 - RNA, 24 nt, Human
ugggauuggcacaagacucugcua

SEQ ID NO: 30659 - RNA, 24 nt, Human
cgcacauauucuccaacaucguga

SEQ ID NO: 30660 - RNA, 24 nt, Human
ggacuggagcugcuugccaaggua

SEQ ID NO: 30661 - RNA, 24 nt, Human
ugccacggcucacccccaacgguc

SEQ ID NO: 30662 - RNA, 24 nt, Human
uuggagcgaaugcggaauccaacu

SEQ ID NO: 30663 - RNA, 24 nt, Human
ugccugggguguuguccucuucuu

SEQ ID NO: 30664 - RNA, 24 nt, Human
uugguguaucgagcauggagaccg

SEQ ID NO: 30665 - RNA, 24 nt, Human
uccccaaaccaguccucggcccug

SEQ ID NO: 30666 - RNA, 24 nt, Human
uauuagggauaauauucauuuagc

SEQ ID NO: 30667 - RNA, 22 nt, Human
ccucauggacugaguucuggga

SEQ ID NO: 30668 - RNA, 24 nt, Human
cacuguuugucagcuuaaaauuca

SEQ ID NO: 30669 - RNA, 24 nt, Human
uguaaacaccaaagaaccauuacc

SEQ ID NO: 30670 - RNA, 24 nt, Human
cgacagcagcggggcuggguguuc

SEQ ID NO: 30671 - RNA, 24 nt, Human
cuggggccugcugaggugggggug

SEQ ID NO: 30672 - RNA, 24 nt, Human
uuaauggaagaagaugaagaugcu

SEQ ID NO: 30673 - RNA, 22 nt, Human
uagaguucuccgagugcuuuuc

SEQ ID NO: 30674 - RNA, 24 nt, Human
gaccaguagccacuuuaacuuuuu

SEQ ID NO: 30675 - RNA, 24 nt, Human
uucaugauguagaucacauaccgg

SEQ ID NO: 30676 - RNA, 24 nt, Human
aacccuuuaaucgagccaugcuuu

SEQ ID NO: 30677 - RNA, 24 nt, Human
ucacauagguugugccaugagugg

SEQ ID NO: 30678 - RNA, 24 nt, Human
agccauugggauccagacaucaga

SEQ ID NO: 30679 - RNA, 24 nt, Human
uggcacgauggcggaugugaccuu

SEQ ID NO: 30680 - RNA, 24 nt, Human
ccggcacgcuggcugauggcgugg

SEQ ID NO: 30681 - RNA, 24 nt, Human
uacgccgaguuuuuuccgggugau

SEQ ID NO: 30682 - RNA, 24 nt, Human
uugaucuugaagaaacugggcgug

SEQ ID NO: 30683 - RNA, 24 nt, Human
aggaaggagauauagugaagagga

SEQ ID NO: 30684 - RNA, 24 nt, Human
guagaguuuucuucaggcuuaaag

SEQ ID NO: 30685 - RNA, 20 nt, Human
gagcagcuuguccuccagga

SEQ ID NO: 30686 - RNA, 24 nt, Human
ggccaggggcucggccuggcucag

SEQ ID NO: 30687 - RNA, 24 nt, Human
uggcaacuuugggaguacucuuuu

SEQ ID NO: 30688 - RNA, 24 nt, Human
uagaauggggagaguaacaauagc

SEQ ID NO: 30689 - RNA, 24 nt, Human
uagaaguuccaccuccuaggcugg

SEQ ID NO: 30690 - RNA, 24 nt, Human
uaacauggugaaacucugacucua

SEQ ID NO: 30691 - RNA, 24 nt, Human
uaaugggucucaaaauucugugac

SEQ ID NO: 30692 - RNA, 24 nt, Human
ugagaaacagucaucucaauaaau

SEQ ID NO: 30693 - RNA, 24 nt, Human
uagcuucccuuugaggguguguga

SEQ ID NO: 30694 - RNA, 24 nt, Human
ugcauuguuaucauuaaccagucu

SEQ ID NO: 30695 - RNA, 24 nt, Human
uauuagggauaauauucauuuagc

SEQ ID NO: 30696 - RNA, 24 nt, Human
uauacgguaccaucacaucauuug

SEQ ID NO: 30697 - RNA, 24 nt, Human
auugcacaugucaugugaguugga

SEQ ID NO: 30698 - RNA, 24 nt, Human
uggaaaaucuacaacauggagugu

SEQ ID NO: 30699 - RNA, 24 nt, Human
uuuccaaggcuuguuuuccaugaa

SEQ ID NO: 30700 - RNA, 24 nt, Human
ugcuggagauggagggcugcaugc

SEQ ID NO: 30701 - RNA, 24 nt, Human
cacgcugugucgcgccucuccucc

SEQ ID NO: 30702 - RNA, 23 nt, Human
cuggaaccagcugucuguggaga

SEQ ID NO: 30703 - RNA, 23 nt, Human
ucggaaggcgagaacuggucucu

SEQ ID NO: 30704 - RNA, 24 nt, Human
ugaggcccgggauguaggcacugg

SEQ ID NO: 30705 - RNA, 19 nt, Human
uaaaaggaggcgacuguuu

SEQ ID NO: 30706 - RNA, 20 nt, Human
uagcuggcauugauaaggca

SEQ ID NO: 30707 - RNA, 24 nt, Human
cgcccagaucaaggcucauguagc

SEQ ID NO: 30708 - RNA, 24 nt, Human
gcccggaagaucaagucgugcucc

SEQ ID NO: 30709 - RNA, 24 nt, Human
ucaauuuuuauuuugguuuucuua

SEQ ID NO: 30710 - RNA, 24 nt, Human
ccagccccgcagcccuggccugua

SEQ ID NO: 30711 - RNA, 24 nt, Human
aggcagcucacgcgguugucgugg

SEQ ID NO: 30712 - RNA, 24 nt, Human
uugcaguugaagucgucguagcca

SEQ ID NO: 30713 - RNA, 24 nt, Human
ugagaauggcaaaauuagucgccu

SEQ ID NO: 30714 - RNA, 24 nt, Human
ucuggccccggagaaaaguuuuuu

SEQ ID NO: 30715 - RNA, 24 nt, Human
uacaccacucccaagaagaauaag

SEQ ID NO: 30716 - RNA, 24 nt, Human
aaguacuccuguuggugcgaaagg

SEQ ID NO: 30717 - RNA, 24 nt, Human
ugcuuggugaccgaauuacuagug

SEQ ID NO: 30718 - RNA, 24 nt, Human
gugaaggggauggccuaauauggg

SEQ ID NO: 30719 - RNA, 24 nt, Human
cagcauucuggggcuuguaacacu

SEQ ID NO: 30720 - RNA, 24 nt, Human
ucagugguggcgccugggcucagc

SEQ ID NO: 30721 - RNA, 24 nt, Human
ugugcagaagaaauggaaggauuc

SEQ ID NO: 30722 - RNA, 24 nt, Human
uaucaaggaagggcaggcgugaug

SEQ ID NO: 30723 - RNA, 24 nt, Human
uucaaauuucuuucuuuuuuaauu

SEQ ID NO: 30724 - RNA, 24 nt, Human
ucaauuuuuauuuugguuuucuua

SEQ ID NO: 30725 - RNA, 20 nt, Human
ccgcccuucagccgguccug

SEQ ID NO: 30726 - RNA, 24 nt, Human
cagccuggacuuaccaccacuaaa

SEQ ID NO: 30727 - RNA, 24 nt, Human
cagucggcgauccaccagguucug

SEQ ID NO: 30728 - RNA, 23 nt, Human
ucagaaaaagagagagcaccauu

SEQ ID NO: 30729 - RNA, 24 nt, Human
uggggcacuggccuggcucacgug

SEQ ID NO: 30730 - RNA, 24 nt, Human
ccccaguagaagugaugggcugcu

SEQ ID NO: 30731 - RNA, 24 nt, Human
uaucaugaagccucagaaacacug

SEQ ID NO: 30732 - RNA, 24 nt, Human
uacagaaucuaaugcauaacuggu

SEQ ID NO: 30733 - RNA, 24 nt, Human
uaggucccgagguggagucggggg

SEQ ID NO: 30734 - RNA, 24 nt, Human
uguauauauuuaacacacacaucu

SEQ ID NO: 30735 - RNA, 24 nt, Human
cagagcacuguacuuuuuuuuuuu

SEQ ID NO: 30736 - RNA, 23 nt, Human
gugcauccauugucagaggucug

SEQ ID NO: 30737 - RNA, 24 nt, Human
ucucuggggagaagagcaaaugca

SEQ ID NO: 30738 - RNA, 24 nt, Human
uuagucacaugagccucuuggggu

SEQ ID NO: 30739 - RNA, 24 nt, Human
agugcaaagcgagacucugucuca

SEQ ID NO: 30740 - RNA, 24 nt, Human
ugucuauacuucucgugguuccac

SEQ ID NO: 30741 - RNA, 20 nt, Human
uucuggguggcagugauggc

SEQ ID NO: 30742 - RNA, 24 nt, Human
uucgggccgggucucggccgccgg

SEQ ID NO: 30743 - RNA, 24 nt, Human
ccgagggggguucggaggcgucug

SEQ ID NO: 30744 - RNA, 24 nt, Human
ucgcacccugaggaacugcggcuc

SEQ ID NO: 30745 - RNA, 17 nt, Human
caggacauauugcaucu

SEQ ID NO: 30746 - RNA, 24 nt, Human
acuaaaguacaacaggaauucuuc

SEQ ID NO: 30747 - RNA, 24 nt, Human
ugacuauagaauauaauuggcaua

SEQ ID NO: 30748 - RNA, 24 nt, Human
uaucuggucuuugcaagcagucuu

SEQ ID NO: 30749 - RNA, 24 nt, Human
uaguuuguuucuguacuuuuaaau

SEQ ID NO: 30750 - RNA, 24 nt, Human
ugacggugguauagaccucuccug

SEQ ID NO: 30751 - RNA, 24 nt, Human
cacuaugucgccuuuggguagcaa

SEQ ID NO: 30752 - RNA, 24 nt, Human
aaaguuaucgguauuaccagcuau

SEQ ID NO: 30753 - RNA, 24 nt, Human
aaccuguaacauaagcauuuccca

SEQ ID NO: 30754 - RNA, 24 nt, Human
uuuauagaaaaauaaagaaaauaa

SEQ ID NO: 30755 - RNA, 23 nt, Human
ccgccgcgcccccgccgccgccc

SEQ ID NO: 30756 - RNA, 24 nt, Human
ugcccacauguaccucgccacaac

SEQ ID NO: 30757 - RNA, 24 nt, Human
agaagaagaagaaauggcaaagag

SEQ ID NO: 30758 - RNA, 24 nt, Human
ucugaucaauccuucuuuuucucu

SEQ ID NO: 30759 - RNA, 24 nt, Human
ucaauuuuuauuuugguuuucuua

SEQ ID NO: 30760 - RNA, 24 nt, Human
uguacaguguguauauauauacau

SEQ ID NO: 30761 - RNA, 24 nt, Human
agcaagaugaacagaaucuguauu

SEQ ID NO: 30762 - RNA, 24 nt, Human
ucagaugcgagaucaacucuaaua

SEQ ID NO: 30763 - RNA, 24 nt, Human
uccccaugaguucagaauuauuua

SEQ ID NO: 30764 - RNA, 24 nt, Human
ugaagacaccauugacgccccaac

SEQ ID NO: 30765 - RNA, 24 nt, Human
uggguugacuuuugagcaggaggc

SEQ ID NO: 30766 - RNA, 23 nt, Human
aagcagcaagugacagaggaggg

SEQ ID NO: 30767 - RNA, 19 nt, Human
acaaaguuaauuuuuacag

SEQ ID NO: 30768 - RNA, 24 nt, Human
uuuaagcaauaaaaauuggcaugu

SEQ ID NO: 30769 - RNA, 24 nt, Human
ccaccugggucuggacugcaugag

SEQ ID NO: 30770 - RNA, 24 nt, Human
aaggugcagacgcccggcccgugc

SEQ ID NO: 30771 - RNA, 24 nt, Human
uagcgcagucucggccucgccguu

SEQ ID NO: 30772 - RNA, 24 nt, Human
aauuucagaccuuugacaucagug

SEQ ID NO: 30773 - RNA, 24 nt, Human
caguaugaauuuuccgaugucgug

SEQ ID NO: 30774 - RNA, 24 nt, Human
uuuguaguuucuaucccauaugaa

SEQ ID NO: 30775 - RNA, 24 nt, Human
cugcucugccaauuucuggauuuc

SEQ ID NO: 30776 - RNA, 24 nt, Human
ucucaaggccugacagacagaagg

SEQ ID NO: 30777 - RNA, 23 nt, Human
uaccucugcaccccuggaaaguc

SEQ ID NO: 30778 - RNA, 24 nt, Human
uccguagucuggugggccucugua

SEQ ID NO: 30779 - RNA, 24 nt, Human
ugacucagauuuuaauuuugauuu

SEQ ID NO: 30780 - RNA, 24 nt, Human
cauuuuacauaaaagggaaguauc

SEQ ID NO: 30781 - RNA, 24 nt, Human
uaagaaaugcaguccaauuuuaua

SEQ ID NO: 30782 - RNA, 24 nt, Human
ugguagagaugggguuucaccaug

SEQ ID NO: 30783 - RNA, 19 nt, Human
ucccugagcaccgccaggc

SEQ ID NO: 30784 - RNA, 24 nt, Human
uagauuaugaagcaaugugugaag

SEQ ID NO: 30785 - RNA, 24 nt, Human
uagaaggcuggagucuaaauuggg

SEQ ID NO: 30786 - RNA, 24 nt, Human
accacauucgaaggcuugaugcag

SEQ ID NO: 30787 - RNA, 24 nt, Human
uacaucuccacggugaagacgcug

SEQ ID NO: 30788 - RNA, 24 nt, Human
caccagaaggagugaugaucaacg

SEQ ID NO: 30789 - RNA, 24 nt, Human
ucucugcgaacauuccuuuuaacc

SEQ ID NO: 30790 - RNA, 24 nt, Human
uggucagaacccgggagggccugc

SEQ ID NO: 30791 - RNA, 24 nt, Human
ugccugggcugggaggcaaggaca

SEQ ID NO: 30792 - RNA, 24 nt, Human
uuccuggucgaguccagugugaaa

SEQ ID NO: 30793 - RNA, 24 nt, Human
uguggagagaaaucagcauuauua

SEQ ID NO: 30794 - RNA, 24 nt, Human
cuggugcagcgagcccgggaguug

SEQ ID NO: 30795 - RNA, 24 nt, Human
aggaggcuauugagggcaccuaca

SEQ ID NO: 30796 - RNA, 24 nt, Human
uggcguggugaccaagaugaagau

SEQ ID NO: 30797 - RNA, 24 nt, Human
aaagaggauucauucaaacccuag

SEQ ID NO: 30798 - RNA, 24 nt, Human
cgaggggaccugcacauucagucc

SEQ ID NO: 30799 - RNA, 24 nt, Human
uggcugggcagggccaugucacgg

SEQ ID NO: 30800 - RNA, 24 nt, Human
uagccucacucuccauucucugcc

SEQ ID NO: 30801 - RNA, 24 nt, Human
agauggagaaccgugauuaccggg

SEQ ID NO: 30802 - RNA, 24 nt, Human
cugccaugcccccuggcuugguca

SEQ ID NO: 30803 - RNA, 24 nt, Human
uggcacgaaagcuacaggauguau

SEQ ID NO: 30804 - RNA, 24 nt, Human
ucccauauauauaaccauauccau

SEQ ID NO: 30805 - RNA, 24 nt, Human
uauauguauguguguguguauaua

SEQ ID NO: 30806 - RNA, 24 nt, Human
uccaaucuaaaugcagagagacau

SEQ ID NO: 30807 - RNA, 24 nt, Human
ugcaagaaccggucacuuaucagu

SEQ ID NO: 30808 - RNA, 21 nt, Human
uggcccagcucugagggcggg

SEQ ID NO: 30809 - RNA, 24 nt, Human
gggagccugggucgacaugcucuu

SEQ ID NO: 30810 - RNA, 24 nt, Human
acgcaaccgggcgacugcugggug

SEQ ID NO: 30811 - RNA, 24 nt, Human
ugagacaaaugugggcccuccuga

SEQ ID NO: 30812 - RNA, 23 nt, Human
uucgaagggcacgaguucgaggc

SEQ ID NO: 30813 - RNA, 24 nt, Human
acuuagagaaauagccacauucaa

SEQ ID NO: 30814 - RNA, 24 nt, Human
uaauugcaucaguguuuaccucuc

SEQ ID NO: 30815 - RNA, 20 nt, Human
cagcacccgaaugccugcug

SEQ ID NO: 30816 - RNA, 24 nt, Human
gucacguugagagccaacaccaug

SEQ ID NO: 30817 - RNA, 24 nt, Human
acccaguggcuugacggcaaacac

SEQ ID NO: 30818 - RNA, 24 nt, Human
uaacgcgucacuggagaaacccaa

SEQ ID NO: 30819 - RNA, 24 nt, Human
uucaugcauuacugcguuuauuuc

SEQ ID NO: 30820 - RNA, 24 nt, Human
aagggaacuuccaggcuuucaguc

SEQ ID NO: 30821 - RNA, 24 nt, Human
auaggccagugagcccaggccccu

SEQ ID NO: 30822 - RNA, 24 nt, Human
uugcuguuuggcagauggugaggg

SEQ ID NO: 30823 - RNA, 24 nt, Human
ugugcagaagaaauggaaggauuc

SEQ ID NO: 30824 - RNA, 24 nt, Human
uaucaaggaagggcaggcgugaug

SEQ ID NO: 30825 - RNA, 24 nt, Human
uucaaauuucuuucuuuuuuaauu

SEQ ID NO: 30826 - RNA, 24 nt, Human
ucaauuuuuauuuugguuuucuua

SEQ ID NO: 30827 - RNA, 24 nt, Human
agguuccagcacaaaggagucugu

SEQ ID NO: 30828 - RNA, 19 nt, Human
ccgcugagggaggcacagg

SEQ ID NO: 30829 - RNA, 24 nt, Human
uauuuggaaaagagacaguugaau

SEQ ID NO: 30830 - RNA, 24 nt, Human
uauuugaaggcagaaaacacccua

SEQ ID NO: 30831 - RNA, 24 nt, Human
gcgcucugcagcuugguccucaca

SEQ ID NO: 30832 - RNA, 24 nt, Human
acaaucuugccuuccaugccccag

SEQ ID NO: 30833 - RNA, 24 nt, Human
ugcauuguuaucauuaaccagucu

SEQ ID NO: 30834 - RNA, 24 nt, Human
uaaugggucucaaaauucugugac

SEQ ID NO: 30835 - RNA, 24 nt, Human
uauuagggauaauauucauuuagc

SEQ ID NO: 30836 - RNA, 24 nt, Human
uaagugauuuacaauuucuguuuc

SEQ ID NO: 30837 - RNA, 24 nt, Human
gugcugccuccucugaggcuggca

SEQ ID NO: 30838 - RNA, 22 nt, Human
ugugccugcagaggagcugcuc

SEQ ID NO: 30839 - RNA, 22 nt, Human
uuuguacaaacuaaaugaggug

SEQ ID NO: 30840 - RNA, 24 nt, Human
ugaagaaaccaagacccugaaaag

SEQ ID NO: 30841 - RNA, 24 nt, Human
ucugcaauuugguauaaauguuag

SEQ ID NO: 30842 - RNA, 24 nt, Human
cacacggcauguucucucuuugca

SEQ ID NO: 30843 - RNA, 24 nt, Human
aacuguaucccguugaugcacuaa

SEQ ID NO: 30844 - RNA, 24 nt, Human
aaagcagcaauucuauguucauag

SEQ ID NO: 30845 - RNA, 24 nt, Human
ggaggggaauuauuugaaucgugg

SEQ ID NO: 30846 - RNA, 22 nt, Human
ucuuccucagugaugacucgag

SEQ ID NO: 30847 - RNA, 24 nt, Human
ccucccgucacuccacgcagcugg

SEQ ID NO: 30848 - RNA, 24 nt, Human
ugugcagaagaaauggaaggauuc

SEQ ID NO: 30849 - RNA, 24 nt, Human
uaucaaggaagggcaggcgugaug

SEQ ID NO: 30850 - RNA, 24 nt, Human
uucaaauuucuuucuuuuuuaauu

SEQ ID NO: 30851 - RNA, 24 nt, Human
ugagguaucguuuacugcaaagaa

SEQ ID NO: 30852 - RNA, 24 nt, Human
agaagaagaagaaauggcaaagag

SEQ ID NO: 30853 - RNA, 22 nt, Human
ugugcaaaagaaauggaaggau

SEQ ID NO: 30854 - RNA, 24 nt, Human
ugcagaggaauuccacggggcggg

SEQ ID NO: 30855 - RNA, 24 nt, Human
uggcagacaauccccggcugagcg

SEQ ID NO: 30856 - RNA, 24 nt, Human
ugcauuguuaucauuaaccagucu

SEQ ID NO: 30857 - RNA, 24 nt, Human
uauuagggauaauauucauuuagc

SEQ ID NO: 30858 - RNA, 24 nt, Human
uuuaacuuuuuuaaugggucucaa

SEQ ID NO: 30859 - RNA, 24 nt, Human
uagaaaauuacuacaaaguaaaac

SEQ ID NO: 30860 - RNA, 24 nt, Human
ucagcaguuggaaagcucucuauu

SEQ ID NO: 30861 - RNA, 24 nt, Human
uuugacccaggguugucuccccuc

SEQ ID NO: 30862 - RNA, 24 nt, Human
ggacaagaaguacuaccccagcuc

SEQ ID NO: 30863 - RNA, 24 nt, Human
ugagcgggucaauggggcaacacg

SEQ ID NO: 30864 - RNA, 24 nt, Human
uaagggguauaccuggcccggggc

SEQ ID NO: 30865 - RNA, 24 nt, Human
ugaccucaagugauccgcucgcuc

SEQ ID NO: 30866 - RNA, 24 nt, Human
ucacucaguuuuuaauaaaggcca

SEQ ID NO: 30867 - RNA, 17 nt, Human
uacugcauuugcucucu

SEQ ID NO: 30868 - RNA, 24 nt, Human
gggaacaaggcaguguucuuuacc

SEQ ID NO: 30869 - RNA, 24 nt, Human
uaaugcgugggaggauugaaaaug

SEQ ID NO: 30870 - RNA, 24 nt, Human
cacuguguucaauuuugaguuucc

SEQ ID NO: 30871 - RNA, 24 nt, Human
uagaagaucuguuuguuuauauau

SEQ ID NO: 30872 - RNA, 24 nt, Human
ggccugggcacccuuagaggggag

SEQ ID NO: 30873 - RNA, 24 nt, Human
acgcugaauuauaauuagccacac

SEQ ID NO: 30874 - RNA, 24 nt, Human
uuggaucuuuuggauuucuuuuuu

SEQ ID NO: 30875 - RNA, 24 nt, Human
ggccugggcacccuuagaggggag

SEQ ID NO: 30876 - RNA, 24 nt, Human
aggcugggaugccaauguucucgu

SEQ ID NO: 30877 - RNA, 24 nt, Human
uggagccaggcaaggcaaagugau

SEQ ID NO: 30878 - RNA, 23 nt, Human
ccgggccgaggcgucaggucgcc

SEQ ID NO: 30879 - RNA, 24 nt, Human
cuagcaccagccugggccgcacac

SEQ ID NO: 30880 - RNA, 24 nt, Human
uuaguuggcccuucuuucagcacu

SEQ ID NO: 30881 - RNA, 24 nt, Human
ucagucucaaguauaacuacaaua

SEQ ID NO: 30882 - RNA, 24 nt, Human
uggcuuggcuugggcucagaggcc

SEQ ID NO: 30883 - RNA, 24 nt, Human
gacaagaaaaaaacauguuuggua

SEQ ID NO: 30884 - RNA, 24 nt, Human
ucaaagauaaauccaaauacugca

SEQ ID NO: 30885 - RNA, 24 nt, Human
uacgugcaagucacagggaaugcc

SEQ ID NO: 30886 - RNA, 24 nt, Human
uggcagugguggaggugggcauug

SEQ ID NO: 30887 - RNA, 24 nt, Human
aaggcuuugcacagcuauuguuca

SEQ ID NO: 30888 - RNA, 24 nt, Human
aagcaggcagcggggauguagcuc

SEQ ID NO: 30889 - RNA, 24 nt, Human
ucucagguuuuaaauguugcaaau

SEQ ID NO: 30890 - RNA, 24 nt, Human
ucuagccagagcccuucacugcca

SEQ ID NO: 30891 - RNA, 24 nt, Human
ugaguaaugugaaauugaguuuuu

SEQ ID NO: 30892 - RNA, 18 nt, Human
cauugguugaaaugccug

SEQ ID NO: 30893 - RNA, 23 nt, Human
aaggaagauggugaucagacagc

SEQ ID NO: 30894 - RNA, 24 nt, Human
caaugguaaaaaaugcagccgggg

SEQ ID NO: 30895 - RNA, 24 nt, Human
cucucggucggccuaggcuuucug

SEQ ID NO: 30896 - RNA, 24 nt, Human
cucucggcccguuccucgcguucc

SEQ ID NO: 30897 - RNA, 24 nt, Human
auaacuguagcaaugaacuuuuag

SEQ ID NO: 30898 - RNA, 24 nt, Human
uauuuuuuuaauacaauagcugcc

SEQ ID NO: 30899 - RNA, 24 nt, Human
ggggacuacaaugugccacgucgg

SEQ ID NO: 30900 - RNA, 24 nt, Human
ggagguuucggcaguggcauccgg

SEQ ID NO: 30901 - RNA, 24 nt, Human
aucuugguuuuguuucuggaggga

SEQ ID NO: 30902 - RNA, 24 nt, Human
uggacagaagucaugaugaugggg

SEQ ID NO: 30903 - RNA, 24 nt, Human
uuuaaacuuuugcauuguaaaaag

SEQ ID NO: 30904 - RNA, 24 nt, Human
uuggauauuuucaccucugggaua

SEQ ID NO: 30905 - RNA, 24 nt, Human
uaaauggaauguaucuuugucauu

SEQ ID NO: 30906 - RNA, 24 nt, Human
gucccuuuguuuauccuacauaug

SEQ ID NO: 30907 - RNA, 24 nt, Human
ugccuuaauaucauuguuggcuaa

SEQ ID NO: 30908 - RNA, 24 nt, Human
uacaagcccccgccgagcgaaugu

SEQ ID NO: 30909 - RNA, 24 nt, Human
ggaggacacgaagcaaaugaugag

SEQ ID NO: 30910 - RNA, 24 nt, Human
ucucagaaugcuucuuucuugucu

SEQ ID NO: 30911 - RNA, 24 nt, Human
ugucauaggcaucgacgaggggca

SEQ ID NO: 30912 - RNA, 21 nt, Human
ucccccuuuccccaaccuggg

SEQ ID NO: 30913 - RNA, 24 nt, Human
aggaggucaaggaccgcugcaccc

SEQ ID NO: 30914 - RNA, 24 nt, Human
uagcaguaauuuaucagaggucac

SEQ ID NO: 30915 - RNA, 24 nt, Human
uuagcaaauagagagaaauauaga

SEQ ID NO: 30916 - RNA, 24 nt, Human
ugagucuagagauauuugugaaau

SEQ ID NO: 30917 - RNA, 24 nt, Human
uguuucaccgcccugccuagaucu

SEQ ID NO: 30918 - RNA, 24 nt, Human
uaaaccgcgcaccauacagacagc

SEQ ID NO: 30919 - RNA, 24 nt, Human
ucccagggcugggggacuuccuuc

SEQ ID NO: 30920 - RNA, 24 nt, Human
acuccuuuucagaagcagccuguu

SEQ ID NO: 30921 - RNA, 24 nt, Human
ucuuaauuugauuuucuuuuucuu

SEQ ID NO: 30922 - RNA, 23 nt, Human
cagcacacaaccagaaccuagag

SEQ ID NO: 30923 - RNA, 24 nt, Human
uccacuuucaguuugcaauaccac

SEQ ID NO: 30924 - RNA, 24 nt, Human
uggaagcauuccaccaugaggagc

SEQ ID NO: 30925 - RNA, 18 nt, Human
uacuguauuuuuauguug

SEQ ID NO: 30926 - RNA, 24 nt, Human
uuugugguuaccaguuauuuuuac

SEQ ID NO: 30927 - RNA, 24 nt, Human
uauaggaauaaucucagugaauuc

SEQ ID NO: 30928 - RNA, 24 nt, Human
uucucaagcuucuauaaacaguuc

SEQ ID NO: 30929 - RNA, 24 nt, Human
cccacguaccugcaggacaccguc

SEQ ID NO: 30930 - RNA, 23 nt, Human
uuggagccugucagccccagcac

SEQ ID NO: 30931 - RNA, 24 nt, Human
uaguuuguuuauguacccccacca

SEQ ID NO: 30932 - RNA, 24 nt, Human
uggaaugcuaaaccaacggcccgg

SEQ ID NO: 30933 - RNA, 24 nt, Human
aauggcacucugauuaaacugcau

SEQ ID NO: 30934 - RNA, 24 nt, Human
ugaaaggggcagcacagucauuua

SEQ ID NO: 30935 - RNA, 24 nt, Human
cugaagacuacugugacucugucc

SEQ ID NO: 30936 - RNA, 21 nt, Human
uggcuaaagaggaccuguggg

SEQ ID NO: 30937 - RNA, 24 nt, Human
uuuggcaauugguagaguaaaucc

SEQ ID NO: 30938 - RNA, 24 nt, Human
uggggaccccaagggagagaguca

SEQ ID NO: 30939 - RNA, 24 nt, Human
gagaagccuacugcgcgagauucu

SEQ ID NO: 30940 - RNA, 24 nt, Human
ccgggucgacccacgcguccgaca

SEQ ID NO: 30941 - RNA, 24 nt, Human
uccccagaaauugacugagagaca

SEQ ID NO: 30942 - RNA, 24 nt, Human
gggcaggaguaggugccaaaucug

SEQ ID NO: 30943 - RNA, 22 nt, Human
uucaugcaauuuggaauuggug

SEQ ID NO: 30944 - RNA, 21 nt, Human
uaaaagauauuucuccaugcc

SEQ ID NO: 30945 - RNA, 24 nt, Human
auagcccacugagccccgagacag

SEQ ID NO: 30946 - RNA, 24 nt, Human
uuccuguucccugaucaacuuccu

SEQ ID NO: 30947 - RNA, 24 nt, Human
uggcagugagguggcccagacccu

SEQ ID NO: 30948 - RNA, 24 nt, Human
gaaguuaugacagacuucgaacua

SEQ ID NO: 30949 - RNA, 24 nt, Human
uuccagaagugugauugggaauaa

SEQ ID NO: 30950 - RNA, 20 nt, Human
uaucacuuuccggagcuggu

SEQ ID NO: 30951 - RNA, 21 nt, Human
uugcuggggccuaauguucuc

SEQ ID NO: 30952 - RNA, 24 nt, Human
uuaacccaugcagcaaaugcuacg

SEQ ID NO: 30953 - RNA, 24 nt, Human
gugcagaaugagggccgaguagau

SEQ ID NO: 30954 - RNA, 24 nt, Human
ugguggugcgugccuguaguccca

SEQ ID NO: 30955 - RNA, 24 nt, Human
cauggcacugaacuugucgugguc

SEQ ID NO: 30956 - RNA, 24 nt, Human
ucuggcacaggaaauggucuccaa

SEQ ID NO: 30957 - RNA, 24 nt, Human
accauggugagcccauuggcaggg

SEQ ID NO: 30958 - RNA, 24 nt, Human
ccucgagaggggggaucucaucag

SEQ ID NO: 30959 - RNA, 24 nt, Human
cuuuugggcaucauauaccccaug

SEQ ID NO: 30960 - RNA, 24 nt, Human
ugcauuguuaucauuaaccagucu

SEQ ID NO: 30961 - RNA, 24 nt, Human
uaaugggucucaaaauucugugac

SEQ ID NO: 30962 - RNA, 24 nt, Human
uauuagggauaauauucauuuagc

SEQ ID NO: 30963 - RNA, 24 nt, Human
uugcaugccaugugacccgugugc

SEQ ID NO: 30964 - RNA, 24 nt, Human
uggaagguaguagauucuggacaa

SEQ ID NO: 30965 - RNA, 24 nt, Human
uagaaggugguagauuucucacuc

SEQ ID NO: 30966 - RNA, 24 nt, Human
aaguauaggcgauagaaauugaaa

SEQ ID NO: 30967 - RNA, 24 nt, Human
cagcccccagaaagggucaauuga

SEQ ID NO: 30968 - RNA, 24 nt, Human
ugagcucaguaacaucuuagcgag

SEQ ID NO: 30969 - RNA, 24 nt, Human
aaagguucuagggcagggaaaaug

SEQ ID NO: 30970 - RNA, 24 nt, Human
uggcaugggcuuucgugucccacu

SEQ ID NO: 30971 - RNA, 24 nt, Human
gcgggccgucaagccacgcggcga

SEQ ID NO: 30972 - RNA, 24 nt, Human
uucacagaggccaggagucgcaga

SEQ ID NO: 30973 - RNA, 21 nt, Human
uuccuggaauagguaagaaaa

SEQ ID NO: 30974 - RNA, 21 nt, Human
uguugcaggguauugcauggu

SEQ ID NO: 30975 - RNA, 21 nt, Human
uccugcugcugcugcugcugc

SEQ ID NO: 30976 - RNA, 24 nt, Human
uuccagaaaccacugggugguccu

SEQ ID NO: 30977 - RNA, 24 nt, Human
aagcggacaggggaguauccuucg

SEQ ID NO: 30978 - RNA, 24 nt, Human
uugaauuuauugagcuagauauug

SEQ ID NO: 30979 - RNA, 18 nt, Human
uaacagggaggggcgcgg

SEQ ID NO: 30980 - RNA, 24 nt, Human
aaugggauggauaauuaucguaua

SEQ ID NO: 30981 - RNA, 24 nt, Human
cacccaugugaccaaggaacguug

SEQ ID NO: 30982 - RNA, 22 nt, Human
aacacugugauuaagggaacau

SEQ ID NO: 30983 - RNA, 24 nt, Human
aacaguauaauagcauuuacaaua

SEQ ID NO: 30984 - RNA, 24 nt, Human
ccucccugcuccuugcagucauuu

SEQ ID NO: 30985 - RNA, 24 nt, Human
uuuaaaaucccaugccaaacuguc

SEQ ID NO: 30986 - RNA, 22 nt, Human
uacagcuuagccucuguccuuu

SEQ ID NO: 30987 - RNA, 20 nt, Human
uccacaauuuccacuuuuaa

SEQ ID NO: 30988 - RNA, 24 nt, Human
uaguuuaaaacauuuugaucacag

SEQ ID NO: 30989 - RNA, 24 nt, Human
uauucuguaguauuuuucugauuc

SEQ ID NO: 30990 - RNA, 24 nt, Human
uacauaauuagccugagcuagggu

SEQ ID NO: 30991 - RNA, 24 nt, Human
uguggauauaguuuucccuguugg

SEQ ID NO: 30992 - RNA, 24 nt, Human
ugacuaaagaaaccugcugcacau

SEQ ID NO: 30993 - RNA, 24 nt, Human
gagcaugcaucuucucggugagcc

SEQ ID NO: 30994 - RNA, 24 nt, Human
aguuaaguuuuucccuucaucugg

SEQ ID NO: 30995 - RNA, 24 nt, Human
uccaacauuucuccaaaaguuauc

SEQ ID NO: 30996 - RNA, 23 nt, Human
ugagaugcaguuugcaggugggu

SEQ ID NO: 30997 - RNA, 24 nt, Human
ugugaccuugagaaccucaucuca

SEQ ID NO: 30998 - RNA, 23 nt, Human
uggguuucuucccugacccuccc

SEQ ID NO: 30999 - RNA, 24 nt, Human
aauggcacauggacugguguuagc

SEQ ID NO: 31000 - RNA, 23 nt, Human
uugcuuguuaucagucuguucag

SEQ ID NO: 31001 - RNA, 24 nt, Human
agucauuuuggccuccauugugga

SEQ ID NO: 31002 - RNA, 24 nt, Human
ccagcaccggcugcggcuccgguu

SEQ ID NO: 31003 - RNA, 23 nt, Human
uggaaugcugggggugguggcgc

SEQ ID NO: 31004 - RNA, 24 nt, Human
uuuauaauugcuauaggaaauaau

SEQ ID NO: 31005 - RNA, 24 nt, Human
ugaguacaguucagccuuacucug

SEQ ID NO: 31006 - RNA, 24 nt, Human
uccacagcaguuucaucaguuucc

SEQ ID NO: 31007 - RNA, 24 nt, Human
uaccuuaguaggcacagaguacac

SEQ ID NO: 31008 - RNA, 24 nt, Human
ugggaggccaagacgagcagauca

SEQ ID NO: 31009 - RNA, 24 nt, Human
uuuccugugggauugguggugaua

SEQ ID NO: 31010 - RNA, 24 nt, Human
uaggagguaagagaacacuguggg

SEQ ID NO: 31011 - RNA, 24 nt, Human
acgcuucauccuggcuccuggauu

SEQ ID NO: 31012 - RNA, 22 nt, Human
ucagaccaacauguccccugcc

SEQ ID NO: 31013 - RNA, 22 nt, Human
uuguaaguuuacauuuuaauga

SEQ ID NO: 31014 - RNA, 24 nt, Human
augguacuauguagcuggugugcu

SEQ ID NO: 31015 - RNA, 24 nt, Human
aagaguccaccuugcagcuggugc

SEQ ID NO: 31016 - RNA, 24 nt, Human
acaaagccugccaggcugagcccu

SEQ ID NO: 31017 - RNA, 24 nt, Human
cauuuggaaaaucuacuguacagg

SEQ ID NO: 31018 - RNA, 24 nt, Human
uggauggaggcgcucagagccagc

SEQ ID NO: 31019 - RNA, 24 nt, Human
gaaugggguugggggccccaccuc

SEQ ID NO: 31020 - RNA, 24 nt, Human
uaggucccgagguggagucggggg

SEQ ID NO: 31021 - RNA, 24 nt, Human
uguauauauuuaacacacacaucu

SEQ ID NO: 31022 - RNA, 24 nt, Human
uugcaccucguggcugcuuuguuc

SEQ ID NO: 31023 - RNA, 23 nt, Human
uaccgcauguccugugccagccu

SEQ ID NO: 31024 - RNA, 24 nt, Human
ucaggccgggugugguggcucaug

SEQ ID NO: 31025 - RNA, 21 nt, Human
ucaguauaaguuccacaaggc

SEQ ID NO: 31026 - RNA, 24 nt, Human
uuugggggugggagugagagaacg

SEQ ID NO: 31027 - RNA, 24 nt, Human
ucagggguuucucacucucuuccu

SEQ ID NO: 31028 - RNA, 24 nt, Human
ugagauguacagucauccuggauc

SEQ ID NO: 31029 - RNA, 24 nt, Human
ugucaaagugacuugccauaaaca

SEQ ID NO: 31030 - RNA, 24 nt, Human
ucucuugugcuuauucuucuuggg

SEQ ID NO: 31031 - RNA, 17 nt, Human
ucuggcuggaugugcug

SEQ ID NO: 31032 - RNA, 21 nt, Human
ucaggaacugaugagguucuc

SEQ ID NO: 31033 - RNA, 24 nt, Human
aagcacaaaaucugacaaugaaac

SEQ ID NO: 31034 - RNA, 24 nt, Human
accuugugguagcagggaccaugc

SEQ ID NO: 31035 - RNA, 24 nt, Human
ucgggggaguucagugaccuuuug

SEQ ID NO: 31036 - RNA, 19 nt, Human
ucaguguguguguaaguga

SEQ ID NO: 31037 - RNA, 24 nt, Human
uguuguguuuuuagaggugcuauc

SEQ ID NO: 31038 - RNA, 24 nt, Human
uaucaagucagcacacaccuuuuc

SEQ ID NO: 31039 - RNA, 22 nt, Human
ugagucaggagcaggagcgugc

SEQ ID NO: 31040 - RNA, 24 nt, Human
ucucaaagucuugguacgcauucc

SEQ ID NO: 31041 - RNA, 24 nt, Human
gcccauggucaucuguggagggac

SEQ ID NO: 31042 - RNA, 24 nt, Human
cuagaccuacucgauuucuucguu

SEQ ID NO: 31043 - RNA, 24 nt, Human
ugagucucgacagaacgcuguucu

SEQ ID NO: 31044 - RNA, 24 nt, Human
uaggcuacgcuuacagagcccuuu

SEQ ID NO: 31045 - RNA, 18 nt, Human
uagcucggcgccuggguu

SEQ ID NO: 31046 - RNA, 24 nt, Human
uaugacgcagccacccaggaguuu

SEQ ID NO: 31047 - RNA, 24 nt, Human
aagccaccuaugacgcagccaccc

SEQ ID NO: 31048 - RNA, 24 nt, Human
caggagccaggcggggcaugcacg

SEQ ID NO: 31049 - RNA, 24 nt, Human
ugagaguugcauuuuuauuuuuua

SEQ ID NO: 31050 - RNA, 24 nt, Human
ugcauuguuaucauuaaccagucu

SEQ ID NO: 31051 - RNA, 24 nt, Human
uauuagggauaauauucauuuagc

SEQ ID NO: 31052 - RNA, 24 nt, Human
uuuaacuuuuuuaaugggucucaa

SEQ ID NO: 31053 - RNA, 24 nt, Human
uauuaugaacaauacaaaugcauu

SEQ ID NO: 31054 - RNA, 24 nt, Human
uaauacacguaaaccacaaaagag

SEQ ID NO: 31055 - RNA, 24 nt, Human
cugacacacggagagucacaggcu

SEQ ID NO: 31056 - RNA, 24 nt, Human
ucaaaauuuuaauauaaaaaagug

SEQ ID NO: 31057 - RNA, 24 nt, Human
uaaguuaaggcuaugguugcucua

SEQ ID NO: 31058 - RNA, 24 nt, Human
ugaaugacaauauauggaguagca

SEQ ID NO: 31059 - RNA, 24 nt, Human
cucucaggccaccugccuucagcu

SEQ ID NO: 31060 - RNA, 23 nt, Human
uguggcugugaagauguaucgaa

SEQ ID NO: 31061 - RNA, 24 nt, Human
ucaggaaaggaggaugaaauuaga

SEQ ID NO: 31062 - RNA, 24 nt, Human
uauuaaggaacugaugcaucugag

SEQ ID NO: 31063 - RNA, 24 nt, Human
ugaguuacuagaaagcuuccugga

SEQ ID NO: 31064 - RNA, 24 nt, Human
uaguuugcuuuuaaguagaaaaac

SEQ ID NO: 31065 - RNA, 24 nt, Human
uaagguuucgagagcauuccuacu

SEQ ID NO: 31066 - RNA, 24 nt, Human
uugaagaagacugaugagacuagg

SEQ ID NO: 31067 - RNA, 24 nt, Human
ugagaaaacuucugagugcagcau

SEQ ID NO: 31068 - RNA, 24 nt, Human
cuaagacuuuaagggcccacacag

SEQ ID NO: 31069 - RNA, 24 nt, Human
ucacugcagcugccccucccuggc

SEQ ID NO: 31070 - RNA, 24 nt, Human
uuucacacucagaauuuaauuucu

SEQ ID NO: 31071 - RNA, 24 nt, Human
ucuacagucugugaauauaccaau

SEQ ID NO: 31072 - RNA, 24 nt, Human
ugccugaaaagcuggguguccuug

SEQ ID NO: 31073 - RNA, 24 nt, Human
ccaccgagcucuggacgcugagga

SEQ ID NO: 31074 - RNA, 21 nt, Human
uaccguguuggccaggcuggu

SEQ ID NO: 31075 - RNA, 24 nt, Human
ugggaauacaggcaugagccacca

SEQ ID NO: 31076 - RNA, 23 nt, Human
ucagccuuccgaguagcuggagc

SEQ ID NO: 31077 - RNA, 24 nt, Human
uugaaugcacaaaagcaacagguc

SEQ ID NO: 31078 - RNA, 24 nt, Human
aucuggccugcuuccaggcugcag

SEQ ID NO: 31079 - RNA, 24 nt, Human
uaccaggaugguuaccaggaugac

SEQ ID NO: 31080 - RNA, 24 nt, Human
augucaaauccugguauccuuccc

SEQ ID NO: 31081 - RNA, 24 nt, Human
uauguaaccuuagacucagccagu

SEQ ID NO: 31082 - RNA, 24 nt, Human
uaugaacauagacuagagaaaccg

SEQ ID NO: 31083 - RNA, 24 nt, Human
uacacuuuugagacuuuuuggugg

SEQ ID NO: 31084 - RNA, 24 nt, Human
aauuauauucuggaaauugcagua

SEQ ID NO: 31085 - RNA, 24 nt, Human
uggaauugaaaugucauuauugua

SEQ ID NO: 31086 - RNA, 24 nt, Human
uaguauauauuuuaacaacuugaa

SEQ ID NO: 31087 - RNA, 24 nt, Human
aguuguuuuaccuauuagacugua

SEQ ID NO: 31088 - RNA, 24 nt, Human
ucgcucccguccggcccggguccc

SEQ ID NO: 31089 - RNA, 24 nt, Human
ucgcucuggaacaccugggaucug

SEQ ID NO: 31090 - RNA, 24 nt, Human
caauugauaaaucuuauaccauuu

SEQ ID NO: 31091 - RNA, 24 nt, Human
aucaugcuuaaugggagaaaacug

SEQ ID NO: 31092 - RNA, 24 nt, Human
uacagguuagaaaauuugaggcac

SEQ ID NO: 31093 - RNA, 24 nt, Human
uggugguaaauauaaaugaguuuc

SEQ ID NO: 31094 - RNA, 18 nt, Human
aacagcuuucucaaaugu

SEQ ID NO: 31095 - RNA, 24 nt, Human
ugucagaaaacaaaacaaaaaagu

SEQ ID NO: 31096 - RNA, 24 nt, Human
ugcaggagugaguaggccugcugu

SEQ ID NO: 31097 - RNA, 24 nt, Human
uucacaguguaaagcaggaaaugg

SEQ ID NO: 31098 - RNA, 23 nt, Human
uaaagagagugaggcgcaacaca

SEQ ID NO: 31099 - RNA, 24 nt, Human
ugcaggagugaguaggccugcugu

SEQ ID NO: 31100 - RNA, 24 nt, Human
uaaagagagugaggcacaacacaa

SEQ ID NO: 31101 - RNA, 24 nt, Human
uuuacaucccucauucacagugua

SEQ ID NO: 31102 - RNA, 24 nt, Human
uagagcuagugaauuagccuauuu

SEQ ID NO: 31103 - RNA, 24 nt, Human
uauguuauauuaaaaccuuguucc

SEQ ID NO: 31104 - RNA, 24 nt, Human
gucuccacaugagccagaaacaca

SEQ ID NO: 31105 - RNA, 24 nt, Human
cccugagugagcaccugguuacca

SEQ ID NO: 31106 - RNA, 24 nt, Human
ugcauuguuaucauuaaccagucu

SEQ ID NO: 31107 - RNA, 23 nt, Human
uggcacagauuucagcuccuacu

SEQ ID NO: 31108 - RNA, 24 nt, Human
ucuuugaccugagguauagaguug

SEQ ID NO: 31109 - RNA, 24 nt, Human
caaguccaaacuaaauauuuaaug

SEQ ID NO: 31110 - RNA, 24 nt, Human
ugaauagucaggucuugcaguaca

SEQ ID NO: 31111 - RNA, 24 nt, Human
uucacuuccuacuuaggcuaggcc

SEQ ID NO: 31112 - RNA, 24 nt, Human
ccuugaguuccuucauggcaauga

SEQ ID NO: 31113 - RNA, 19 nt, Human
uauaaagugagaaugaaaa

SEQ ID NO: 31114 - RNA, 24 nt, Human
ucugcaauuugguauaaauguuag

SEQ ID NO: 31115 - RNA, 24 nt, Human
cacacggcauguucucucuuugca

SEQ ID NO: 31116 - RNA, 24 nt, Human
aacuguaucccguugaugcacuaa

SEQ ID NO: 31117 - RNA, 24 nt, Human
aaagcagcaauucuauguucauag

SEQ ID NO: 31118 - RNA, 24 nt, Human
ggaggggaauuauuugaaucgugg

SEQ ID NO: 31119 - RNA, 24 nt, Human
aagguguaguacuuggcaggguuc

SEQ ID NO: 31120 - RNA, 24 nt, Human
caacgagcuaaagcucaaauugcu

SEQ ID NO: 31121 - RNA, 24 nt, Human
acugugcccuuccccuccugaaag

SEQ ID NO: 31122 - RNA, 24 nt, Human
ucaguuaagguuauuguugugggu

SEQ ID NO: 31123 - RNA, 24 nt, Human
agggauacacuuguccaggggcuu

SEQ ID NO: 31124 - RNA, 24 nt, Human
aagcaugggauggcaggagaaaga

SEQ ID NO: 31125 - RNA, 24 nt, Human
aggcauuugaagaugaaaugaaaa

SEQ ID NO: 31126 - RNA, 24 nt, Human
ucggggauucugcugggcaacugg

SEQ ID NO: 31127 - RNA, 24 nt, Human
accccuuaccaccaaaggaaguaa

SEQ ID NO: 31128 - RNA, 24 nt, Human
ugccucgggccccccucgcgcgcc

SEQ ID NO: 31129 - RNA, 24 nt, Human
uacaggaugugcccgagcucgugg

SEQ ID NO: 31130 - RNA, 24 nt, Human
uggcaccauggaugccuucgugaa

SEQ ID NO: 31131 - RNA, 24 nt, Human
uggcucaggguggcuggcgcucac

SEQ ID NO: 31132 - RNA, 24 nt, Human
uguccaagauuguccagaccuacc

SEQ ID NO: 31133 - RNA, 24 nt, Human
gcaaaugggaccacgugcggcagu

SEQ ID NO: 31134 - RNA, 24 nt, Human
ucaguugacuggcggcuauaaacc

SEQ ID NO: 31135 - RNA, 22 nt, Human
cugcccccucugcugaugcccc

SEQ ID NO: 31136 - RNA, 24 nt, Human
uauguugccaucaaugaccccuuc

SEQ ID NO: 31137 - RNA, 24 nt, Human
ugggauuacaggcgugagcaccau

SEQ ID NO: 31138 - RNA, 24 nt, Human
uauuagggauaauauucauuuagc

SEQ ID NO: 31139 - RNA, 24 nt, Human
uaaugggucucaaaauucugugac

SEQ ID NO: 31140 - RNA, 24 nt, Human
ugaaaugucuuuaaaggaugaauu

SEQ ID NO: 31141 - RNA, 24 nt, Human
uugcuggagggaaucaguagcacu

SEQ ID NO: 31142 - RNA, 24 nt, Human
cauggacccugacuggcucauugg

SEQ ID NO: 31143 - RNA, 24 nt, Human
ucugucccugccccuagucaccua

SEQ ID NO: 31144 - RNA, 24 nt, Human
ucccgagacaacgaucucucucuu

SEQ ID NO: 31145 - RNA, 24 nt, Human
cuccuuuuuaccauuuuacagucc

SEQ ID NO: 31146 - RNA, 24 nt, Human
gugggacgcggccugugcccugau

SEQ ID NO: 31147 - RNA, 24 nt, Human
ucucgaguagcugggauuacaggc

SEQ ID NO: 31148 - RNA, 24 nt, Human
ucacgcccggccccaucucuuuga

SEQ ID NO: 31149 - RNA, 24 nt, Human
uuaguaccuuaaaaaauacacccu

SEQ ID NO: 31150 - RNA, 24 nt, Human
uaaaugcauacaugauuuugguua

SEQ ID NO: 31151 - RNA, 24 nt, Human
cggcaagguuuuauguacauaugu

SEQ ID NO: 31152 - RNA, 24 nt, Human
uggcaagaaaagcuggcaacuucu

SEQ ID NO: 31153 - RNA, 24 nt, Human
ucaauggagugagcccaaagguuc

SEQ ID NO: 31154 - RNA, 24 nt, Human
uggucagacacauuuagggaugac

SEQ ID NO: 31155 - RNA, 24 nt, Human
cgagggccgccccuacugccgccg

SEQ ID NO: 31156 - RNA, 24 nt, Human
ucuuauugcuuauuuggucguaau

SEQ ID NO: 31157 - RNA, 24 nt, Human
ucggaacagucauuucaccuacua

SEQ ID NO: 31158 - RNA, 24 nt, Human
uuccuauguguuaauaugaagauc

SEQ ID NO: 31159 - RNA, 24 nt, Human
ugggauuucaccauguuggccagg

SEQ ID NO: 31160 - RNA, 24 nt, Human
ugugguauuugaaauuuaauaagu

SEQ ID NO: 31161 - RNA, 24 nt, Human
cccuggcugaaggccuuacucgag

SEQ ID NO: 31162 - RNA, 24 nt, Human
guacggaggccuggcugugcugcu

SEQ ID NO: 31163 - RNA, 24 nt, Human
uaggaaccgaugccagugggaggg

SEQ ID NO: 31164 - RNA, 24 nt, Human
ugguugcauuucauuuuuggagaa

SEQ ID NO: 31165 - RNA, 24 nt, Human
uuccaaguuucaaagaaaugucaa

SEQ ID NO: 31166 - RNA, 24 nt, Human
uaaguuaaugaauaguuuuuguuu

SEQ ID NO: 31167 - RNA, 24 nt, Human
uauugcaaauacuuaaaauucuua

SEQ ID NO: 31168 - RNA, 24 nt, Human
uaaaugguguugacaccaacuucu

SEQ ID NO: 31169 - RNA, 24 nt, Human
cuauauguguccuguggcauuccu

SEQ ID NO: 31170 - RNA, 24 nt, Human
uccuucaguucagauugcagaggu

SEQ ID NO: 31171 - RNA, 24 nt, Human
uaaguucaucaucaaaaggaaagu

SEQ ID NO: 31172 - RNA, 24 nt, Human
gcucugugcccugggugugcagug

SEQ ID NO: 31173 - RNA, 24 nt, Human
ucuggacaggacccacgaggagac

SEQ ID NO: 31174 - RNA, 24 nt, Human
uauaguguuaggucagacacggcu

SEQ ID NO: 31175 - RNA, 24 nt, Human
aggaagaguccuggggggaccgcg

SEQ ID NO: 31176 - RNA, 24 nt, Human
gaggcgccggccggcuggcgcagu

SEQ ID NO: 31177 - RNA, 24 nt, Human
uguguacuagaacgacugagcgug

SEQ ID NO: 31178 - RNA, 24 nt, Human
ugcuguguacuagaacgacugagc

SEQ ID NO: 31179 - RNA, 24 nt, Human
agagucccugcuguguacuagaac

SEQ ID NO: 31180 - RNA, 24 nt, Human
uaaaauccauuuauguugcuuuca

SEQ ID NO: 31181 - RNA, 24 nt, Human
uacacaguucauucuaccugugag

SEQ ID NO: 31182 - RNA, 24 nt, Human
uagaauuucuagggcugggaagca

SEQ ID NO: 31183 - RNA, 23 nt, Human
ugaguugaccaagagaaagagaa

SEQ ID NO: 31184 - RNA, 24 nt, Human
ucccucgguccggcggcggcggcg

SEQ ID NO: 31185 - RNA, 23 nt, Human
uuuuaagcacagaccuggggaga

SEQ ID NO: 31186 - RNA, 24 nt, Human
cgugcagaagugagccaucaucgc

SEQ ID NO: 31187 - RNA, 24 nt, Human
uguugcuauggggcaaaagagauc

SEQ ID NO: 31188 - RNA, 24 nt, Human
uugaucuugaagaaacugggcgug

SEQ ID NO: 31189 - RNA, 24 nt, Human
aggaaggagauauagugaagagga

SEQ ID NO: 31190 - RNA, 24 nt, Human
guagaguuuucuucaggcuuaaag

SEQ ID NO: 31191 - RNA, 24 nt, Human
agagaggaugagaggcaggagagc

SEQ ID NO: 31192 - RNA, 24 nt, Human
ugccaaggcaaccagcuuccagag

SEQ ID NO: 31193 - RNA, 24 nt, Human
uauggcaagucacuuugacagaca

SEQ ID NO: 31194 - RNA, 24 nt, Human
ugagaauggcaaaauuagucgccu

SEQ ID NO: 31195 - RNA, 24 nt, Human
uacaccacucccaagaagaauaag

SEQ ID NO: 31196 - RNA, 24 nt, Human
uuggacaacccugcucgaaucccu

SEQ ID NO: 31197 - RNA, 24 nt, Human
uuuuucuuagugccucugugcauu

SEQ ID NO: 31198 - RNA, 24 nt, Human
cccugcgccaguucuucgaccggg

SEQ ID NO: 31199 - RNA, 24 nt, Human
acccgguggucagcgccaagagca

SEQ ID NO: 31200 - RNA, 21 nt, Human
gacaucuucaggcuugcuuca

SEQ ID NO: 31201 - RNA, 24 nt, Human
guuauguauuagaggcagaaggcc

SEQ ID NO: 31202 - RNA, 24 nt, Human
accugguucgugaacagcucgggu

SEQ ID NO: 31203 - RNA, 24 nt, Human
ugaagugcaguggugggcacgauc

SEQ ID NO: 31204 - RNA, 24 nt, Human
uugaucuugaagaaacugggcgug

SEQ ID NO: 31205 - RNA, 23 nt, Human
uccgugcgcguugcugcggccgu

SEQ ID NO: 31206 - RNA, 24 nt, Human
aggaaggagauauagugaagagga

SEQ ID NO: 31207 - RNA, 24 nt, Human
guagaguuuucuucaggcuuaaag

SEQ ID NO: 31208 - RNA, 24 nt, Human
aaggacacaugguccuugguuucu

SEQ ID NO: 31209 - RNA, 19 nt, Human
ugaaacagcacaucuccag

SEQ ID NO: 31210 - RNA, 20 nt, Human
uaacaaagguacuaagcaca

SEQ ID NO: 31211 - RNA, 22 nt, Human
ugccugagccugcugcuagccc

SEQ ID NO: 31212 - RNA, 24 nt, Human
uggcugaauugaucccuagggcac

SEQ ID NO: 31213 - RNA, 24 nt, Human
aacuuuuuggucacacucucaaca

SEQ ID NO: 31214 - RNA, 24 nt, Human
uguucagaaauugaggcuaacauu

SEQ ID NO: 31215 - RNA, 24 nt, Human
aggaagcggcuguaugugcugaca

SEQ ID NO: 31216 - RNA, 24 nt, Human
cuggaacugagggacaaagguuuu

SEQ ID NO: 31217 - RNA, 24 nt, Human
uguagauagucuacauuaugauau

SEQ ID NO: 31218 - RNA, 24 nt, Human
uucaacauauguaacguuauucuc

SEQ ID NO: 31219 - RNA, 24 nt, Human
ugcauuguuaucauuaaccagucu

SEQ ID NO: 31220 - RNA, 24 nt, Human
uauuagggauaauauucauuuagc

SEQ ID NO: 31221 - RNA, 24 nt, Human
uuuaacuuuuuuaaugggucucaa

SEQ ID NO: 31222 - RNA, 24 nt, Human
uugaagcuuuuacagcuggagacu

SEQ ID NO: 31223 - RNA, 24 nt, Human
uucauuggcaguauuuugugauga

SEQ ID NO: 31224 - RNA, 22 nt, Human
ucagaacauucugaacugcuga

SEQ ID NO: 31225 - RNA, 24 nt, Human
ugaaugacaacuuuauuuuucuua

SEQ ID NO: 31226 - RNA, 24 nt, Human
ccgggucgacccacgcguccgguu

SEQ ID NO: 31227 - RNA, 24 nt, Human
ggagcucaggguggccggcauuca

SEQ ID NO: 31228 - RNA, 24 nt, Human
uagcuccacuccggggaacggacu

SEQ ID NO: 31229 - RNA, 24 nt, Human
ggggagaagagcggagcgugugag

SEQ ID NO: 31230 - RNA, 24 nt, Human
uaucuggaucgaugguacuggaga

SEQ ID NO: 31231 - RNA, 24 nt, Human
uaguaagaacagaaagguuaucuu

SEQ ID NO: 31232 - RNA, 19 nt, Human
ugucaaggcccggucugug

SEQ ID NO: 31233 - RNA, 24 nt, Human
ucuaaagccugauuuaguauuguc

SEQ ID NO: 31234 - RNA, 24 nt, Human
uucaaauuucuuucuuuuuuaauu

SEQ ID NO: 31235 - RNA, 24 nt, Human
ucaauuuuuauuuugguuuucuua

SEQ ID NO: 31236 - RNA, 21 nt, Human
ugggaggggcugaauguggug

SEQ ID NO: 31237 - RNA, 24 nt, Human
gaagauagagaacagauuagaaau

SEQ ID NO: 31238 - RNA, 24 nt, Human
uguuuguuuaaaaaauaagaaacc

SEQ ID NO: 31239 - RNA, 24 nt, Human
uacauuugguggaguuugagacca

SEQ ID NO: 31240 - RNA, 24 nt, Human
aguuguuguuuuuccugucuaaug

SEQ ID NO: 31241 - RNA, 24 nt, Human
ugauagaguuggcuuucugagucc

SEQ ID NO: 31242 - RNA, 20 nt, Human
ccgcccagcgagugcgugag

SEQ ID NO: 31243 - RNA, 24 nt, Human
ugagguccccguaggugggcguug

SEQ ID NO: 31244 - RNA, 23 nt, Human
uggugcuauaccuucacagcagc

SEQ ID NO: 31245 - RNA, 22 nt, Human
ugccuugggucccuucaguagc

SEQ ID NO: 31246 - RNA, 24 nt, Human
ugucaggaaggggaagcggguuuc

SEQ ID NO: 31247 - RNA, 24 nt, Human
uuccuuaaccuccucaugccgccu

SEQ ID NO: 31248 - RNA, 24 nt, Human
ugaggaaaaacgcuugaagggcaa

SEQ ID NO: 31249 - RNA, 24 nt, Human
ucagagucagaacaggauuaaaga

SEQ ID NO: 31250 - RNA, 24 nt, Human
ucgaaacaccuguguuaggaccca

SEQ ID NO: 31251 - RNA, 24 nt, Human
uacguguucccgccauagccccuu

SEQ ID NO: 31252 - RNA, 19 nt, Human
ucuguacgugguugagaag

SEQ ID NO: 31253 - RNA, 24 nt, Human
acgccggaccgcguaagagacgau

SEQ ID NO: 31254 - RNA, 24 nt, Human
uugaaguauucaagucaaacaacg

SEQ ID NO: 31255 - RNA, 22 nt, Human
cggugugacuuccaggggagga

SEQ ID NO: 31256 - RNA, 24 nt, Human
agucaugguuuguuuuugcuucug

SEQ ID NO: 31257 - RNA, 24 nt, Human
agccugugguccucagggauggga

SEQ ID NO: 31258 - RNA, 24 nt, Human
aaaccagcggucucaauggacaga

SEQ ID NO: 31259 - RNA, 24 nt, Human
ggggaggaucagccucggcauuau

SEQ ID NO: 31260 - RNA, 24 nt, Human
uaucuuaccuugcuagauuuagac

SEQ ID NO: 31261 - RNA, 24 nt, Human
auguugcuaaauaacuguuucuag

SEQ ID NO: 31262 - RNA, 24 nt, Human
uagagcucgaaugggcauugggcu

SEQ ID NO: 31263 - RNA, 24 nt, Human
gugaaguaccuuuuggcuaaagac

SEQ ID NO: 31264 - RNA, 19 nt, Human
ucugaccggcuucaagcuc

SEQ ID NO: 31265 - RNA, 24 nt, Human
cacccuugguucucucaguuucac

SEQ ID NO: 31266 - RNA, 24 nt, Human
auugcaauuaaacauggacagaaa

SEQ ID NO: 31267 - RNA, 24 nt, Human
ugggaaaaagcuaucugggugcaa

SEQ ID NO: 31268 - RNA, 18 nt, Human
uuugaugguggugucuag

SEQ ID NO: 31269 - RNA, 24 nt, Human
ugaagucuugcucuuucacccaug

SEQ ID NO: 31270 - RNA, 20 nt, Human
ugagagaacacuccacgaug

SEQ ID NO: 31271 - RNA, 24 nt, Human
aaagcaaaugaggcagaaaggucc

SEQ ID NO: 31272 - RNA, 24 nt, Human
uggaaucuuggguuuuguuuuugu

SEQ ID NO: 31273 - RNA, 24 nt, Human
ucccucagugauccuuuuacucuc

SEQ ID NO: 31274 - RNA, 24 nt, Human
uuccccccuucuaaaagggaaagc

SEQ ID NO: 31275 - RNA, 24 nt, Human
uaacuuuagcuccaggguaaaauc

SEQ ID NO: 31276 - RNA, 24 nt, Human
augccuuuccagauuuucuucugg

SEQ ID NO: 31277 - RNA, 17 nt, Human
cauggcccaguggaggc

SEQ ID NO: 31278 - RNA, 24 nt, Human
aaggauucugcuuguagauugcuu

SEQ ID NO: 31279 - RNA, 20 nt, Human
ucagaaaguaaaggugacug

SEQ ID NO: 31280 - RNA, 24 nt, Human
cguggcuaccgggcgcggcgcccc

SEQ ID NO: 31281 - RNA, 24 nt, Human
ucugaucuauaaaugcgguggcau

SEQ ID NO: 31282 - RNA, 24 nt, Human
acuaccauccuggcuggacugucc

SEQ ID NO: 31283 - RNA, 23 nt, Human
uuggacugcuuaaguuggcuaau

SEQ ID NO: 31284 - RNA, 24 nt, Human
agcgagaggacgcgucacucugcc

SEQ ID NO: 31285 - RNA, 24 nt, Human
ugacacggccacccuacugccugg

SEQ ID NO: 31286 - RNA, 24 nt, Human
aguuggguuuaacagaugacuuug

SEQ ID NO: 31287 - RNA, 22 nt, Human
uagcauugaaggacucgugagg

SEQ ID NO: 31288 - RNA, 24 nt, Human
uagcauugaaggacucggggauau

SEQ ID NO: 31289 - RNA, 24 nt, Human
caagggacuucugcaauccaugga

SEQ ID NO: 31290 - RNA, 24 nt, Human
cgccuggacgccuaccccagugga

SEQ ID NO: 31291 - RNA, 24 nt, Human
uuuuauggguuuuaaguggggaag

SEQ ID NO: 31292 - RNA, 24 nt, Human
ucacaccacgugcacuucagccug

SEQ ID NO: 31293 - RNA, 24 nt, Human
gagccgagcgaagcgaugccuaaa

SEQ ID NO: 31294 - RNA, 24 nt, Human
uccauuagcuuugcaggauggaca

SEQ ID NO: 31295 - RNA, 24 nt, Human
uggacggaacagauccggggacuc

SEQ ID NO: 31296 - RNA, 21 nt, Human
uaagagccuucugagcccagc

SEQ ID NO: 31297 - RNA, 24 nt, Human
ucacuccauagccagauucaauuu

SEQ ID NO: 31298 - RNA, 24 nt, Human
ugacgaggcauuuggcuaccuuaa

SEQ ID NO: 31299 - RNA, 24 nt, Human
uuggcugcguacuccacuggucug

SEQ ID NO: 31300 - RNA, 24 nt, Human
ugcacuguugcugacuacuacucu

SEQ ID NO: 31301 - RNA, 24 nt, Human
uacccgugccggcaggaauacacc

SEQ ID NO: 31302 - RNA, 24 nt, Human
aggcauccaugggcacccugguga

SEQ ID NO: 31303 - RNA, 24 nt, Human
uugaucagaugggaagaugguuug

SEQ ID NO: 31304 - RNA, 24 nt, Human
ugcuuggugaccgaauuacuagug

SEQ ID NO: 31305 - RNA, 24 nt, Human
gagauucuucaagcaaucacuaug

SEQ ID NO: 31306 - RNA, 24 nt, Human
ucucugcaaaaugucauagcuuau

SEQ ID NO: 31307 - RNA, 24 nt, Human
uuuauguugcaugucaguuuccua

SEQ ID NO: 31308 - RNA, 24 nt, Human
ucgccgagggggcugagauaguga

SEQ ID NO: 31309 - RNA, 24 nt, Human
cgacgugugacuuuuucccccggg

SEQ ID NO: 31310 - RNA, 24 nt, Human
uccugcugcuuucauugacaguau

SEQ ID NO: 31311 - RNA, 24 nt, Human
ugaagagccgaauagcaagcuguu

SEQ ID NO: 31312 - RNA, 24 nt, Human
accggguggucgggcugugauaga

SEQ ID NO: 31313 - RNA, 24 nt, Human
uguucaaacgccggcggguguuga

SEQ ID NO: 31314 - RNA, 24 nt, Human
gccagagugagaguuuccacacuc

SEQ ID NO: 31315 - RNA, 24 nt, Human
uuaguuauauaagugaaauuucua

SEQ ID NO: 31316 - RNA, 24 nt, Human
ggugaugguugucauguguggguc

SEQ ID NO: 31317 - RNA, 24 nt, Human
gacccaggcaccaugcacaggcau

SEQ ID NO: 31318 - RNA, 24 nt, Human
ucuagauuuggccauuugaugaug

SEQ ID NO: 31319 - RNA, 24 nt, Human
aauuucgugaagaaccagguugcu

SEQ ID NO: 31320 - RNA, 24 nt, Human
cgaguugugugaugcuacauauga

SEQ ID NO: 31321 - RNA, 24 nt, Human
uaggaaauucuguugcgugcuaac

SEQ ID NO: 31322 - RNA, 24 nt, Human
ugcauuguuaucauuaaccagucu

SEQ ID NO: 31323 - RNA, 24 nt, Human
uaaugggucucaaaauucugugac

SEQ ID NO: 31324 - RNA, 24 nt, Human
uauuagggauaauauucauuuagc

SEQ ID NO: 31325 - RNA, 24 nt, Human
uuacuggggagugcugaaggcucc

SEQ ID NO: 31326 - RNA, 24 nt, Human
uuaaugcuaguccucaggauuuaa

SEQ ID NO: 31327 - RNA, 23 nt, Human
ugugcagaagaaauggaaggauu

SEQ ID NO: 31328 - RNA, 18 nt, Human
uaucaaggaagggcaggc

SEQ ID NO: 31329 - RNA, 24 nt, Human
uucaaauuucuuucuuuuuuuaau

SEQ ID NO: 31330 - RNA, 24 nt, Human
ugcauuguuaucauuaaccagucu

SEQ ID NO: 31331 - RNA, 24 nt, Human
uaaugggucucaaaauucugugac

SEQ ID NO: 31332 - RNA, 24 nt, Human
uggcagguauuagggauaauauuc

SEQ ID NO: 31333 - RNA, 24 nt, Human
ugcauuguuaucauuaaccagucu

SEQ ID NO: 31334 - RNA, 24 nt, Human
uaaugggucucaaaauucugugac

SEQ ID NO: 31335 - RNA, 24 nt, Human
uauuagggauaauauucauuuagc

SEQ ID NO: 31336 - RNA, 22 nt, Human
gagcugguucuucaccuguggc

SEQ ID NO: 31337 - RNA, 24 nt, Human
uggaagcccgagaagucuguccca

SEQ ID NO: 31338 - RNA, 24 nt, Human
gacccuguuccugcaccaguuggu

SEQ ID NO: 31339 - RNA, 24 nt, Human
cucgugugucuacgucuauuccua

SEQ ID NO: 31340 - RNA, 24 nt, Human
ugucuagugaugaguuugcuaaua

SEQ ID NO: 31341 - RNA, 24 nt, Human
ccuaccaccaacucguccaacuga

SEQ ID NO: 31342 - RNA, 24 nt, Human
ugugcagaagaaauggaaggauuc

SEQ ID NO: 31343 - RNA, 24 nt, Human
uucaaauuucuuucuuuuuuaauu

SEQ ID NO: 31344 - RNA, 24 nt, Human
ucaauuuuuauuuugguuuucuua

SEQ ID NO: 31345 - RNA, 24 nt, Human
caucagacagguccgucaaaaucu

SEQ ID NO: 31346 - RNA, 24 nt, Human
ucccugcugacuuacaccggggaa

SEQ ID NO: 31347 - RNA, 21 nt, Human
aucacaguuacuuucucagca

SEQ ID NO: 31348 - RNA, 24 nt, Human
caccugcaaaacaaaacaccagca

SEQ ID NO: 31349 - RNA, 17 nt, Human
uuaccuggguuccuggc

SEQ ID NO: 31350 - RNA, 24 nt, Human
uacaaugaauauuaauacauauug

SEQ ID NO: 31351 - RNA, 21 nt, Human
uaaauuuuaacuauuguacag

SEQ ID NO: 31352 - RNA, 24 nt, Human
ugcaauguauuuuccugcuuuuca

SEQ ID NO: 31353 - RNA, 24 nt, Human
uaggguggugggaacaggcccuac

SEQ ID NO: 31354 - RNA, 24 nt, Human
ucacugcagccuugaacuccuggg

SEQ ID NO: 31355 - RNA, 20 nt, Human
cugguaccaccacacccaca

SEQ ID NO: 31356 - RNA, 24 nt, Human
uuggcgccgagagccccugcacuc

SEQ ID NO: 31357 - RNA, 24 nt, Human
uaccgcgugcucaaugggcucugc

SEQ ID NO: 31358 - RNA, 24 nt, Human
ccugcaugcucugggccagggcca

SEQ ID NO: 31359 - RNA, 24 nt, Human
uaacaggcuuaauaaauucuuuaa

SEQ ID NO: 31360 - RNA, 24 nt, Human
uagcagauugguauaaggauugua

SEQ ID NO: 31361 - RNA, 24 nt, Human
ugaaauguacacuugaauaguuug

SEQ ID NO: 31362 - RNA, 24 nt, Human
ggagcaagagcaagaucaccguga

SEQ ID NO: 31363 - RNA, 24 nt, Human
uggaaaauuucguaugaguucuga

SEQ ID NO: 31364 - RNA, 21 nt, Human
ugcacugggggucccaggugu

SEQ ID NO: 31365 - RNA, 19 nt, Human
ucagugucaggauccaggu

SEQ ID NO: 31366 - RNA, 24 nt, Human
cagaaggaaauagauuaaggaaau

SEQ ID NO: 31367 - RNA, 24 nt, Human
uggacucugcucagcuguguccgu

SEQ ID NO: 31368 - RNA, 21 nt, Human
uacuaugccauguaaauagac

SEQ ID NO: 31369 - RNA, 24 nt, Human
acugaaagggaaaacccacaaucu

SEQ ID NO: 31370 - RNA, 24 nt, Human
ugccaagaaagacugagccccucc

SEQ ID NO: 31371 - RNA, 24 nt, Human
ggacagguguacagacauguucuu

SEQ ID NO: 31372 - RNA, 24 nt, Human
ccagaccgauguucuuguaguacc

SEQ ID NO: 31373 - RNA, 24 nt, Human
ucgaauggacacauuaccagugaa

SEQ ID NO: 31374 - RNA, 24 nt, Human
uaacaaaaggaaaaugugacuuaa

SEQ ID NO: 31375 - RNA, 24 nt, Human
uggguaacauaugcaccaaaaaga

SEQ ID NO: 31376 - RNA, 24 nt, Human
uucauauagucuuguauuauauac

SEQ ID NO: 31377 - RNA, 24 nt, Human
uccuugagccauuucucuguguaa

SEQ ID NO: 31378 - RNA, 24 nt, Human
ucuguuuuguuucuguuuucugug

SEQ ID NO: 31379 - RNA, 24 nt, Human
uaaaaguaagcauguagaaggagg

SEQ ID NO: 31380 - RNA, 24 nt, Human
acuggcugaaggaaaauuuguauu

SEQ ID NO: 31381 - RNA, 24 nt, Human
uuggagagccagcaaaccaagaag

SEQ ID NO: 31382 - RNA, 24 nt, Human
uuaguuuugcaaacggcaugauuc

SEQ ID NO: 31383 - RNA, 24 nt, Human
uuugcagaacuucuuuguccuugg

SEQ ID NO: 31384 - RNA, 24 nt, Human
ugagaaacagucaucucaauaaau

SEQ ID NO: 31385 - RNA, 24 nt, Human
uagcuucccuuugaggguguguga

SEQ ID NO: 31386 - RNA, 24 nt, Human
uccccugcaccuacagagcccuag

SEQ ID NO: 31387 - RNA, 22 nt, Human
ugggacaagacucuaugaaagc

SEQ ID NO: 31388 - RNA, 24 nt, Human
aggaaaauuuguauuauuucaauu

SEQ ID NO: 31389 - RNA, 22 nt, Human
uacgacacagggcagggcaaga

SEQ ID NO: 31390 - RNA, 24 nt, Human
gaaguucaguuguggagaauggga

SEQ ID NO: 31391 - RNA, 24 nt, Human
ugccccagaccaaaacagcucgca

SEQ ID NO: 31392 - RNA, 24 nt, Human
ggagcugguuguacuuggcaagcg

SEQ ID NO: 31393 - RNA, 24 nt, Human
uccaauguccuuugucuuaagauu

SEQ ID NO: 31394 - RNA, 24 nt, Human
uaacagaaugaaguuaauuuuuau

SEQ ID NO: 31395 - RNA, 24 nt, Human
uugguuuuugcaauaaugcuagca

SEQ ID NO: 31396 - RNA, 24 nt, Human
uuuguugucguucccccugcuuaa

SEQ ID NO: 31397 - RNA, 24 nt, Human
cuuaucuucuucaugcugggucug

SEQ ID NO: 31398 - RNA, 24 nt, Human
uauuucacaaaccgccuggacaug

SEQ ID NO: 31399 - RNA, 24 nt, Human
agcgcuggagacguugcugcaugu

SEQ ID NO: 31400 - RNA, 24 nt, Human
uaccggcugcaggagcaugugcgu

SEQ ID NO: 31401 - RNA, 24 nt, Human
cagcagcgucuacuuccgcagcgu

SEQ ID NO: 31402 - RNA, 24 nt, Human
cuuugaguuucacaaacuccucuu

SEQ ID NO: 31403 - RNA, 24 nt, Human
uaaggagcaaauggaauaggggau

SEQ ID NO: 31404 - RNA, 24 nt, Human
uugaugcucgaugaaugcugggaa

SEQ ID NO: 31405 - RNA, 24 nt, Human
uuccaaggcccccagugaacuccu

SEQ ID NO: 31406 - RNA, 24 nt, Human
aggggcuaacaauggacacccaga

SEQ ID NO: 31407 - RNA, 24 nt, Human
uggguagacgccacccgccccguc

SEQ ID NO: 31408 - RNA, 24 nt, Human
uccauaaauaccauaguuaaaugu

SEQ ID NO: 31409 - RNA, 24 nt, Human
ugugaagcuacagacuccauuaua

SEQ ID NO: 31410 - RNA, 22 nt, Human
uaguuccaugaaacaagcuaaa

SEQ ID NO: 31411 - RNA, 24 nt, Human
ccuuuaguguaguguaugguuaau

SEQ ID NO: 31412 - RNA, 24 nt, Human
uugggugguugguguaaaugagug

SEQ ID NO: 31413 - RNA, 24 nt, Human
ugaguagguggccugcaguaaugu

SEQ ID NO: 31414 - RNA, 24 nt, Human
uagaagcauuugcgguggacaaug

SEQ ID NO: 31415 - RNA, 24 nt, Human
ucagagcuuuggcuaggaaugauu

SEQ ID NO: 31416 - RNA, 24 nt, Human
aagcagccgugcugccaggucacc

SEQ ID NO: 31417 - RNA, 24 nt, Human
ucaccacugccuuuucuuccucug

SEQ ID NO: 31418 - RNA, 20 nt, Human
uguccagaauuuccagaagu

SEQ ID NO: 31419 - RNA, 24 nt, Human
uguggcccuucucuuuaaguccga

SEQ ID NO: 31420 - RNA, 23 nt, Human
ugaauugugucaaaaaaaaaaac

SEQ ID NO: 31421 - RNA, 24 nt, Human
uuaguauuuugcuucaugucuuca

SEQ ID NO: 31422 - RNA, 24 nt, Human
uuaguaauaaccagaauaauucau

SEQ ID NO: 31423 - RNA, 24 nt, Human
uaaguaacuuuuuauagcaagaug

SEQ ID NO: 31424 - RNA, 21 nt, Human
caccacgccuucaccugcagu

SEQ ID NO: 31425 - RNA, 24 nt, Human
ucccggcaugcagugcuuugcgcc

SEQ ID NO: 31426 - RNA, 24 nt, Human
cuguccggucgcgcuucacuucug

SEQ ID NO: 31427 - RNA, 24 nt, Human
ggccuggaggagggggucgcgcga

SEQ ID NO: 31428 - RNA, 24 nt, Human
aaauggaaucuagaagcuaaauuu

SEQ ID NO: 31429 - RNA, 24 nt, Human
ugaagcaagcuccggagacuucuu

SEQ ID NO: 31430 - RNA, 24 nt, Human
ucagguccuccucccccuccacca

SEQ ID NO: 31431 - RNA, 24 nt, Human
uccaccacuacuggccaucugauc

SEQ ID NO: 31432 - RNA, 24 nt, Human
ccauccguggggccaucauccugg

SEQ ID NO: 31433 - RNA, 24 nt, Human
aguggcauccggggccggggucgc

SEQ ID NO: 31434 - RNA, 24 nt, Human
uuacugcuggucauggucaaaaag

SEQ ID NO: 31435 - RNA, 24 nt, Human
uaaggcagguuuuauagaaccauu

SEQ ID NO: 31436 - RNA, 24 nt, Human
uuagaacaucuaagcacgucaccu

SEQ ID NO: 31437 - RNA, 24 nt, Human
uccaccacuacuggccaucugauc

SEQ ID NO: 31438 - RNA, 21 nt, Human
uucaagggauggaaagucacc

SEQ ID NO: 31439 - RNA, 24 nt, Human
ucugaucuauaaaugcgguggcau

SEQ ID NO: 31440 - RNA, 24 nt, Human
uugcuggggacgacgcuccccgag

SEQ ID NO: 31441 - RNA, 24 nt, Human
acucuguucuuccgccgcuccgcc

SEQ ID NO: 31442 - RNA, 24 nt, Human
gcuacagcuucaccaccacggccg

SEQ ID NO: 31443 - RNA, 22 nt, Human
ucgggggcccgcaggggaugcc

SEQ ID NO: 31444 - RNA, 24 nt, Human
agggagcaggucacaggucaccau

SEQ ID NO: 31445 - RNA, 21 nt, Human
uucaagggauggaaagucacc

SEQ ID NO: 31446 - RNA, 24 nt, Human
uggaaucuugcgggauccaaggag

SEQ ID NO: 31447 - RNA, 21 nt, Human
ucuuagguuuccuguaccgcu

SEQ ID NO: 31448 - RNA, 21 nt, Human
uucaagggauggaaagucacc

SEQ ID NO: 31449 - RNA, 24 nt, Human
ucagguggaccaucuucuagggcc

SEQ ID NO: 31450 - RNA, 24 nt, Human
uggaaugccugagaggccaguggg

SEQ ID NO: 31451 - RNA, 24 nt, Human
cggcaucgggggcggcaucggggg

SEQ ID NO: 31452 - RNA, 24 nt, Human
ugaccaugcagaaccucaacgacc

SEQ ID NO: 31453 - RNA, 24 nt, Human
uacacuguggccucaaccucccag

SEQ ID NO: 31454 - RNA, 24 nt, Human
ucccucuugcuuuauagcuagcug

SEQ ID NO: 31455 - RNA, 24 nt, Human
uaaagcaaguugucugacuuaauu

SEQ ID NO: 31456 - RNA, 24 nt, Human
uuucuaguuuuguauuuuaaaaag

SEQ ID NO: 31457 - RNA, 24 nt, Human
acgagaagaauggccccccuccuc

SEQ ID NO: 31458 - RNA, 22 nt, Human
ugccucagagaacuucugcagc

SEQ ID NO: 31459 - RNA, 24 nt, Human
uagcauugaaggacucggggauau

SEQ ID NO: 31460 - RNA, 22 nt, Human
augguccgaucguagucgccgu

SEQ ID NO: 31461 - RNA, 24 nt, Human
uuuuggguuuaccaccucauagau

SEQ ID NO: 31462 - RNA, 24 nt, Human
aguggauccggcgcaccauccccu

SEQ ID NO: 31463 - RNA, 24 nt, Human
ggaguagggagguuuggggaggga

SEQ ID NO: 31464 - RNA, 24 nt, Human
cugcagugggacuccaccggaucc

SEQ ID NO: 31465 - RNA, 24 nt, Human
acuguucucugcagugaaucugag

SEQ ID NO: 31466 - RNA, 20 nt, Human
ugagaaagaagggauguugc

SEQ ID NO: 31467 - RNA, 24 nt, Human
uggaagcuaagaaucuccuggggu

SEQ ID NO: 31468 - RNA, 20 nt, Human
ucaaaggugugagagggaaa

SEQ ID NO: 31469 - RNA, 24 nt, Human
uggaaggauuucgcugcuucccga

SEQ ID NO: 31470 - RNA, 21 nt, Human
cggcuugguggagguggccag

SEQ ID NO: 31471 - RNA, 24 nt, Human
ugacaucgcccugcaaauccacuu

SEQ ID NO: 31472 - RNA, 24 nt, Human
gggcaugcagcgccuggcgcagcu

SEQ ID NO: 31473 - RNA, 24 nt, Human
agucaugguccccaucaugcagga

SEQ ID NO: 31474 - RNA, 24 nt, Human
ucagagccuuguagacagcagcca

SEQ ID NO: 31475 - RNA, 24 nt, Human
uaggugucccuuuugguaaaaaau

SEQ ID NO: 31476 - RNA, 24 nt, Human
ugaguagguggcccgcaguaaugu

SEQ ID NO: 31477 - RNA, 24 nt, Human
uguaacaaaaaggaguuaucgcau

SEQ ID NO: 31478 - RNA, 24 nt, Human
ucugaaauauuuacuuuacauuaa

SEQ ID NO: 31479 - RNA, 24 nt, Human
uuaauucuuaucuaccuucuacau

SEQ ID NO: 31480 - RNA, 24 nt, Human
aaguguacuuaaaacauaguaguu

SEQ ID NO: 31481 - RNA, 24 nt, Human
ugaacagaguucaaauacaggacu

SEQ ID NO: 31482 - RNA, 24 nt, Human
aaagcuaugaaacuguauagggcu

SEQ ID NO: 31483 - RNA, 24 nt, Human
ugugcaagagugaaccgggaggga

SEQ ID NO: 31484 - RNA, 24 nt, Human
ggggaagaaaugauaagggggggu

SEQ ID NO: 31485 - RNA, 24 nt, Human
uauuaccaaaaaaggcauauacuu

SEQ ID NO: 31486 - RNA, 24 nt, Human
acuacuguguuauccgggauauca

SEQ ID NO: 31487 - RNA, 20 nt, Human
uaaguccagugcucgcugcc

SEQ ID NO: 31488 - RNA, 24 nt, Human
agagccaucugguccucagacaug

SEQ ID NO: 31489 - RNA, 24 nt, Human
cagcaccaccaccaucaaggucau

SEQ ID NO: 31490 - RNA, 24 nt, Human
uguggucggguguuugcuggugcc

SEQ ID NO: 31491 - RNA, 24 nt, Human
ugaguugagcugauugaugcccuc

SEQ ID NO: 31492 - RNA, 24 nt, Human
aaaggaaacauaaagugcuucuag

SEQ ID NO: 31493 - RNA, 24 nt, Human
uggcauggacuguggucaugaguc

SEQ ID NO: 31494 - RNA, 17 nt, Human
cagcguagggcuggggu

SEQ ID NO: 31495 - RNA, 24 nt, Human
uauaaaguuguucacacguagguc

SEQ ID NO: 31496 - RNA, 24 nt, Human
uguagaugcuaacacuggccaauu

SEQ ID NO: 31497 - RNA, 24 nt, Human
uuaaaggugaaauuugggugggaa

SEQ ID NO: 31498 - RNA, 24 nt, Human
aaccuguagagagaccuuaaggau

SEQ ID NO: 31499 - RNA, 24 nt, Human
uagguuauucagcccaggauacug

SEQ ID NO: 31500 - RNA, 24 nt, Human
ugacaguaaauccuggcaccaaag

SEQ ID NO: 31501 - RNA, 24 nt, Human
agcguuuaacccgugugggcuuug

SEQ ID NO: 31502 - RNA, 24 nt, Human
uuccuccccuuguaggaccaaccg

SEQ ID NO: 31503 - RNA, 24 nt, Human
uucagcaaccaggagaccugugug

SEQ ID NO: 31504 - RNA, 24 nt, Human
ugaguggaggaacugcacuauggu

SEQ ID NO: 31505 - RNA, 24 nt, Human
ggagacugucuccucaaguucucg

SEQ ID NO: 31506 - RNA, 24 nt, Human
ucucuugggaccaccuguuggggc

SEQ ID NO: 31507 - RNA, 24 nt, Human
ugggaaaucuacuccuuugggcga

SEQ ID NO: 31508 - RNA, 24 nt, Human
cauuggccaucuccugacugcccu

SEQ ID NO: 31509 - RNA, 24 nt, Human
uaaugagcuccuaugaaagaaugc

SEQ ID NO: 31510 - RNA, 22 nt, Human
uggaaugugucuggcacagaaa

SEQ ID NO: 31511 - RNA, 24 nt, Human
auggcggagcugugcccagggcug

SEQ ID NO: 31512 - RNA, 24 nt, Human
acccuguggaucugggaguguggc

SEQ ID NO: 31513 - RNA, 24 nt, Human
ugccagggccugaaggacuccccc

SEQ ID NO: 31514 - RNA, 20 nt, Human
ugacagcaagaggaaccacu

SEQ ID NO: 31515 - RNA, 24 nt, Human
cguccguggccaucugaucuauaa

SEQ ID NO: 31516 - RNA, 24 nt, Human
aagcauuucagacaggcauuccuu

SEQ ID NO: 31517 - RNA, 24 nt, Human
uuuaaaauauacaugauagacaca

SEQ ID NO: 31518 - RNA, 24 nt, Human
ucuacagacaccacauggcuugca

SEQ ID NO: 31519 - RNA, 24 nt, Human
uaugcaaggucaagagcggagggg

SEQ ID NO: 31520 - RNA, 24 nt, Human
ucuagcaccuguccgguuccccac

SEQ ID NO: 31521 - RNA, 24 nt, Human
ugaggcaggcuguucugagguccc

SEQ ID NO: 31522 - RNA, 24 nt, Human
acagcacagacauaacugaagaaa

SEQ ID NO: 31523 - RNA, 24 nt, Human
uguauuguacuuuuaaucacuuac

SEQ ID NO: 31524 - RNA, 24 nt, Human
ugggcagugccacccgcagaugac

SEQ ID NO: 31525 - RNA, 24 nt, Human
cacaggguaccagcgacuaguaug

SEQ ID NO: 31526 - RNA, 24 nt, Human
ugggaagcaguaugcaagauaugg

SEQ ID NO: 31527 - RNA, 24 nt, Human
ccugcagugcacgguuucuuccag

SEQ ID NO: 31528 - RNA, 24 nt, Human
aggcggccaaaacagccgcgggcg

SEQ ID NO: 31529 - RNA, 24 nt, Human
cgggcacagccagccgcggggcgu

SEQ ID NO: 31530 - RNA, 22 nt, Human
uugguggugcuggagucggcaa

SEQ ID NO: 31531 - RNA, 17 nt, Human
cggcaaguacgugcccc

SEQ ID NO: 31532 - RNA, 24 nt, Human
gugcugccgacgugauucccuggg

SEQ ID NO: 31533 - RNA, 24 nt, Human
uccccuuuuguuauguaaaaaugu

SEQ ID NO: 31534 - RNA, 24 nt, Human
cacuccggacgugauuaaccagcc

SEQ ID NO: 31535 - RNA, 24 nt, Human
cgggggaagcaacaaagcaugggc

SEQ ID NO: 31536 - RNA, 24 nt, Human
uuccagugggggacugguuuggca

SEQ ID NO: 31537 - RNA, 24 nt, Human
ucugaucuauaaaugcgguggcau

SEQ ID NO: 31538 - RNA, 24 nt, Human
aagcauuugauacuggagaaaguu

SEQ ID NO: 31539 - RNA, 24 nt, Human
gaggaccuucaggggucucaggag

SEQ ID NO: 31540 - RNA, 24 nt, Human
uagaagguggagaugcuggcaaca

SEQ ID NO: 31541 - RNA, 24 nt, Human
uagaagaaugaauaaggugucuac

SEQ ID NO: 31542 - RNA, 24 nt, Human
aggcggucugcguggcacugaagu

SEQ ID NO: 31543 - RNA, 19 nt, Human
cacacaguggggcagugac

SEQ ID NO: 31544 - RNA, 21 nt, Human
uucaagggauggaaagucacc

SEQ ID NO: 31545 - RNA, 21 nt, Human
uucaagggauggaaagucacc

SEQ ID NO: 31546 - RNA, 24 nt, Human
ucgguggugaugggcaucccgagc

SEQ ID NO: 31547 - RNA, 24 nt, Human
gcgcuccaaggagcucaaccuggu

SEQ ID NO: 31548 - RNA, 24 nt, Human
uaugaaauucauaaauaaagaauu

SEQ ID NO: 31549 - RNA, 24 nt, Human
ugccguggaggccuccuucaagug

SEQ ID NO: 31550 - RNA, 17 nt, Human
aguacagaugcagagga

SEQ ID NO: 31551 - RNA, 24 nt, Human
acggaucuuccgacuucuggaugu

SEQ ID NO: 31552 - RNA, 24 nt, Human
uguaucaaucagcugacuguucug

SEQ ID NO: 31553 - RNA, 24 nt, Human
uugaagcugagucaauucaagaua

SEQ ID NO: 31554 - RNA, 24 nt, Human
ugcaaagagaaacuaggggaaaau

SEQ ID NO: 31555 - RNA, 24 nt, Human
ugccuugcuugcuugagcuucagc

SEQ ID NO: 31556 - RNA, 24 nt, Human
uaccccucgucacuugcaacuugc

SEQ ID NO: 31557 - RNA, 24 nt, Human
uugcccggcccacuccuccacagg

SEQ ID NO: 31558 - RNA, 24 nt, Human
uuggcccagauggugagcggccuu

SEQ ID NO: 31559 - RNA, 24 nt, Human
ugacuucuugcaggcacaccgcac

SEQ ID NO: 31560 - RNA, 24 nt, Human
agggaucccauauuguuccaucuu

SEQ ID NO: 31561 - RNA, 24 nt, Human
ucccugggcccugauggcuagccu

SEQ ID NO: 31562 - RNA, 24 nt, Human
gagcagccaucagagcccagugcu

SEQ ID NO: 31563 - RNA, 24 nt, Human
aggcugcaggaagaggcaggugug

SEQ ID NO: 31564 - RNA, 24 nt, Human
ugagguggggguggggcugacucu

SEQ ID NO: 31565 - RNA, 24 nt, Human
ugaaugacaacuuuauuuuucuua

SEQ ID NO: 31566 - RNA, 19 nt, Human
uggcucaaaagcagcacac

SEQ ID NO: 31567 - RNA, 24 nt, Human
uggcagaguaaagauuauuccugu

SEQ ID NO: 31568 - RNA, 24 nt, Human
uccuggugcaaaauggcaacucuu

SEQ ID NO: 31569 - RNA, 24 nt, Human
acccaauggcacugccacgcuauc

SEQ ID NO: 31570 - RNA, 24 nt, Human
ugccuguguggaguggucgugaag

SEQ ID NO: 31571 - RNA, 24 nt, Human
cucggguuucucgccuuuggccgg

SEQ ID NO: 31572 - RNA, 20 nt, Human
uguccagaauuuccagaagu

SEQ ID NO: 31573 - RNA, 24 nt, Human
ugggauuagugagaaaugaacuuc

SEQ ID NO: 31574 - RNA, 24 nt, Human
gacacugucuggguacuguugcag

SEQ ID NO: 31575 - RNA, 24 nt, Human
gcgaaaauuaacccuucuggauca

SEQ ID NO: 31576 - RNA, 24 nt, Human
auacugcaucuuaaagguagcaaa

SEQ ID NO: 31577 - RNA, 24 nt, Human
uggaauuucugggguauagcacau

SEQ ID NO: 31578 - RNA, 24 nt, Human
acccgcagcugcccccuuuguucc

SEQ ID NO: 31579 - RNA, 24 nt, Human
uggcucgagguugcaggacucuuu

SEQ ID NO: 31580 - RNA, 21 nt, Human
gucaccuuggcuugcugaguu

SEQ ID NO: 31581 - RNA, 24 nt, Human
uaauuggcuuacagaucugaucgc

SEQ ID NO: 31582 - RNA, 24 nt, Human
guuuuauuucucucuuucuugagu

SEQ ID NO: 31583 - RNA, 24 nt, Human
uaacugggggggacaucucgugca

SEQ ID NO: 31584 - RNA, 24 nt, Human
ugggaccggcuucauucccuuugg

SEQ ID NO: 31585 - RNA, 24 nt, Human
ugccgcaaugaugaaccgcagaac

SEQ ID NO: 31586 - RNA, 24 nt, Human
ugccaaggauguagaauaaauaag

SEQ ID NO: 31587 - RNA, 24 nt, Human
acgcuccgcuccagcccgggcauc

SEQ ID NO: 31588 - RNA, 24 nt, Human
ugacauccagacugcuguacggac

SEQ ID NO: 31589 - RNA, 24 nt, Human
ucugcaauugcuauccacaugaug

SEQ ID NO: 31590 - RNA, 24 nt, Human
uccugcuccugacucaccgcuguu

SEQ ID NO: 31591 - RNA, 24 nt, Human
cacucuguucccgcccuccucuga

SEQ ID NO: 31592 - RNA, 24 nt, Human
cggcagggaacggccugggacaac

SEQ ID NO: 31593 - RNA, 18 nt, Human
ugacguggacauccgcaa

SEQ ID NO: 31594 - RNA, 19 nt, Human
ugucuggacgggugugggg

SEQ ID NO: 31595 - RNA, 21 nt, Human
uccaguggauguauggcugcg

SEQ ID NO: 31596 - RNA, 24 nt, Human
cgucacgccacccgggcgggcgag

SEQ ID NO: 31597 - RNA, 24 nt, Human
cuacguugcuguggacauauugau

SEQ ID NO: 31598 - RNA, 24 nt, Human
ugauugggggaaauaauuuucaca

SEQ ID NO: 31599 - RNA, 24 nt, Human
uccguggauacagaaaucucugca

SEQ ID NO: 31600 - RNA, 24 nt, Human
aacauuuuucugauaauucugcua

SEQ ID NO: 31601 - RNA, 20 nt, Human
uaccuugagucuaggccugg

SEQ ID NO: 31602 - RNA, 24 nt, Human
aucaccuuucccaccugcacggaa

SEQ ID NO: 31603 - RNA, 18 nt, Human
ugaaaggcccuggucucu

SEQ ID NO: 31604 - RNA, 24 nt, Human
ugacugguggauauagaacgaggg

SEQ ID NO: 31605 - RNA, 20 nt, Human
ugagagaacacuccacgaug

SEQ ID NO: 31606 - RNA, 24 nt, Human
ccugaccccugggcuggccuggga

SEQ ID NO: 31607 - RNA, 24 nt, Human
aaagcaaaugaggcagaaaggccc

SEQ ID NO: 31608 - RNA, 24 nt, Human
uguuuuggggccccuuuccccggc

SEQ ID NO: 31609 - RNA, 24 nt, Human
uguaggguaacuuuugaaguagau

SEQ ID NO: 31610 - RNA, 24 nt, Human
uagugcuccuuaggccuuuaagcu

SEQ ID NO: 31611 - RNA, 24 nt, Human
ugugacugauugcuuuuccugcag

SEQ ID NO: 31612 - RNA, 21 nt, Human
uggaaggagagcugaucucau

SEQ ID NO: 31613 - RNA, 24 nt, Human
cgccaagauuccaaaguaagucag

SEQ ID NO: 31614 - RNA, 18 nt, Human
ugccugggauggccaggc

SEQ ID NO: 31615 - RNA, 24 nt, Human
cgucaagaccaugaccaucucuuc

SEQ ID NO: 31616 - RNA, 24 nt, Human
gugcugcccaaggaugaccaggag

SEQ ID NO: 31617 - RNA, 24 nt, Human
uaaaagaccuugaaauccaugacg

SEQ ID NO: 31618 - RNA, 24 nt, Human
uaggucccgagguggagucggggg

SEQ ID NO: 31619 - RNA, 24 nt, Human
uguauauauuuaacacacacaucu

SEQ ID NO: 31620 - RNA, 24 nt, Human
ucagcagggccuucaagcacagcc

SEQ ID NO: 31621 - RNA, 24 nt, Human
uccacacaaauaggcacacauaua

SEQ ID NO: 31622 - RNA, 24 nt, Human
cagcaguaggggcugggcuuccag

SEQ ID NO: 31623 - RNA, 18 nt, Human
uaugcaaggcacugcgca

SEQ ID NO: 31624 - RNA, 24 nt, Human
uacuuuguaaguccguuugcgaga

SEQ ID NO: 31625 - RNA, 24 nt, Human
uccccgugcugcuccuuccguaag

SEQ ID NO: 31626 - RNA, 24 nt, Human
uaaacgguaaagagauuuuuacuu

SEQ ID NO: 31627 - RNA, 24 nt, Human
cggcucggcugugccccacgcuuc

SEQ ID NO: 31628 - RNA, 24 nt, Human
ccagaagcaccuagcagagcugaa

SEQ ID NO: 31629 - RNA, 24 nt, Human
aggcugccaucagaggggccccgg

SEQ ID NO: 31630 - RNA, 24 nt, Human
uugcugggcaccccgcaaugaccu

SEQ ID NO: 31631 - RNA, 24 nt, Human
cacccugucaaaacggaccaauca

SEQ ID NO: 31632 - RNA, 24 nt, Human
ugugucuagcucaggguuuguaaa

SEQ ID NO: 31633 - RNA, 22 nt, Human
aaacuccaaacguuugcuggca

SEQ ID NO: 31634 - RNA, 24 nt, Human
cagcagcagcuucagcgggaaugc

SEQ ID NO: 31635 - RNA, 19 nt, Human
guggagugugcugugcccc

SEQ ID NO: 31636 - RNA, 24 nt, Human
ugcuuggagagagauaaugacugc

SEQ ID NO: 31637 - RNA, 17 nt, Human
uggcucuggcgggcccc

SEQ ID NO: 31638 - RNA, 24 nt, Human
uaucccaaucacagacacaggccg

SEQ ID NO: 31639 - RNA, 23 nt, Human
cguggaacccuaggggcaagggg

SEQ ID NO: 31640 - RNA, 24 nt, Human
gucacgcuucacggcgcaucgugg

SEQ ID NO: 31641 - RNA, 24 nt, Human
uuuaaagaaagguggucguucucg

SEQ ID NO: 31642 - RNA, 24 nt, Human
gucaauguuccauucccgauucau

SEQ ID NO: 31643 - RNA, 24 nt, Human
gcgaaaccucggagcucgcagggc

SEQ ID NO: 31644 - RNA, 24 nt, Human
uacgugauggccauauaauaguga

SEQ ID NO: 31645 - RNA, 24 nt, Human
uccaaugugugaggauggcuggac

SEQ ID NO: 31646 - RNA, 24 nt, Human
cugaagcuguggcuggugucccug

SEQ ID NO: 31647 - RNA, 18 nt, Human
uuccucuggcucggcucc

SEQ ID NO: 31648 - RNA, 24 nt, Human
ugacgaaugggcaaaauuagucgc

SEQ ID NO: 31649 - RNA, 24 nt, Human
uacaccacucccaagaagaauaag

SEQ ID NO: 31650 - RNA, 24 nt, Human
ccgccgcgcccccgccgccgcccu

SEQ ID NO: 31651 - RNA, 24 nt, Human
gcucucuuuuucuaauguaaaugu

SEQ ID NO: 31652 - RNA, 24 nt, Human
cagagugguuagcuguccgguugg

SEQ ID NO: 31653 - RNA, 24 nt, Human
cagcagaaccugugucaggccgcu

SEQ ID NO: 31654 - RNA, 24 nt, Human
agggagcuaaccauggccacaaug

SEQ ID NO: 31655 - RNA, 24 nt, Human
aaauggaaucuagaagcuaaauuu

SEQ ID NO: 31656 - RNA, 24 nt, Human
guggccccacacaccagucccagc

SEQ ID NO: 31657 - RNA, 24 nt, Human
ucccucugggcagcagcucccuuc

SEQ ID NO: 31658 - RNA, 24 nt, Human
uggaaacuuugaaagcacugguag

SEQ ID NO: 31659 - RNA, 21 nt, Human
uacacacucuuacauugugcu

SEQ ID NO: 31660 - RNA, 24 nt, Human
ugugcauagugcugggauggaggg

SEQ ID NO: 31661 - RNA, 24 nt, Human
ugggaugaaugaaaaaaaaaaaaa

SEQ ID NO: 31662 - RNA, 24 nt, Human
uaaacuaccagugaaaagcgaaua

SEQ ID NO: 31663 - RNA, 24 nt, Human
uggaagaugcucaacaccuccucc

SEQ ID NO: 31664 - RNA, 24 nt, Human
uguguuuguagacuuggaacccac

SEQ ID NO: 31665 - RNA, 17 nt, Human
uacaauauuugcaacuu

SEQ ID NO: 31666 - RNA, 21 nt, Human
uuccucugauguauaauaaau

SEQ ID NO: 31667 - RNA, 24 nt, Human
uuuggcuucccugggccccagucg

SEQ ID NO: 31668 - RNA, 24 nt, Human
aagcuucgcuggcuugccggcccc

SEQ ID NO: 31669 - RNA, 24 nt, Human
gagcuuguuuuccugcaacuagac

SEQ ID NO: 31670 - RNA, 24 nt, Human
uaaggagcgugcaaccuacauccc

SEQ ID NO: 31671 - RNA, 19 nt, Human
caaccagcggccaagccag

SEQ ID NO: 31672 - RNA, 24 nt, Human
uggcuagacagaguucuuucucag

SEQ ID NO: 31673 - RNA, 24 nt, Human
ucccuuggggguggcuugccccca

SEQ ID NO: 31674 - RNA, 24 nt, Human
ugugucggcucugcuacuucaaga

SEQ ID NO: 31675 - RNA, 24 nt, Human
uggcugggggcaagagcuccacaa

SEQ ID NO: 31676 - RNA, 24 nt, Human
guggacccgggggccacuggccca

SEQ ID NO: 31677 - RNA, 24 nt, Human
cauuaggggcucggcgcccccgac

SEQ ID NO: 31678 - RNA, 19 nt, Human
uaccauguccgcccaggcg

SEQ ID NO: 31679 - RNA, 24 nt, Human
gggcaugggggugcgguggugggg

SEQ ID NO: 31680 - RNA, 24 nt, Human
aagcuucugcuggggauaggaauu

SEQ ID NO: 31681 - RNA, 24 nt, Human
cccuuuguaccuuccaaaaaauua

SEQ ID NO: 31682 - RNA, 24 nt, Human
aacggcugagggugggggcagugu

SEQ ID NO: 31683 - RNA, 24 nt, Human
uccuugagcacccugauaugcaac

SEQ ID NO: 31684 - RNA, 17 nt, Human
ucaaguggaugaagcgg

SEQ ID NO: 31685 - RNA, 24 nt, Human
ucgcuggcucagcacugucuaugc

SEQ ID NO: 31686 - RNA, 24 nt, Human
aggaggcuauugagggcaccuaca

SEQ ID NO: 31687 - RNA, 24 nt, Human
uguuaugggcgaugcaaaccugau

SEQ ID NO: 31688 - RNA, 24 nt, Human
aaagaaagagaaauagaaagcgac

SEQ ID NO: 31689 - RNA, 24 nt, Human
ucuuuuuuuuuuuuuuuuccccuu

SEQ ID NO: 31690 - RNA, 24 nt, Human
uuggagaugcacaacagucaguga

SEQ ID NO: 31691 - RNA, 24 nt, Human
ugagaaaauagcagaaacagauuu

SEQ ID NO: 31692 - RNA, 24 nt, Human
agucuguggcuagugacauucuac

SEQ ID NO: 31693 - RNA, 24 nt, Human
uuauauaguuaguuuuaaaaaucu

SEQ ID NO: 31694 - RNA, 24 nt, Human
uaggcccccuuugcaggcagucuu

SEQ ID NO: 31695 - RNA, 24 nt, Human
ugagaccaucgcucaauaauggaa

SEQ ID NO: 31696 - RNA, 24 nt, Human
agaaaccaaccgggcccaccgucu

SEQ ID NO: 31697 - RNA, 24 nt, Human
uggccugaugauccacagcggaga

SEQ ID NO: 31698 - RNA, 24 nt, Human
uucauuggcaguauuuugugauga

SEQ ID NO: 31699 - RNA, 24 nt, Human
aggaagugauaauaguggcaacau

SEQ ID NO: 31700 - RNA, 24 nt, Human
uugaagccaguggggcaccaaucc

SEQ ID NO: 31701 - RNA, 24 nt, Human
uaccauggcgaggucacauuucac

SEQ ID NO: 31702 - RNA, 24 nt, Human
cauuuugcaacauccugcaacacc

SEQ ID NO: 31703 - RNA, 24 nt, Human
uaaauggccgggaccuugguuggu

SEQ ID NO: 31704 - RNA, 24 nt, Human
acauugacaaucuaggguauauau

SEQ ID NO: 31705 - RNA, 24 nt, Human
ugugguuuuaaaagagucccucaa

SEQ ID NO: 31706 - RNA, 24 nt, Human
ucucugguuguucacauuccaaaa

SEQ ID NO: 31707 - RNA, 24 nt, Human
ugucgcaggcugcucugucucuua

SEQ ID NO: 31708 - RNA, 24 nt, Human
accaaguaauugccaauauucaca

SEQ ID NO: 31709 - RNA, 24 nt, Human
uagguuagaauucuucuuuaaauu

SEQ ID NO: 31710 - RNA, 24 nt, Human
agagcaaaagccuuggguuucucg

SEQ ID NO: 31711 - RNA, 24 nt, Human
uaguauuuuaaagaaagaacagau

SEQ ID NO: 31712 - RNA, 24 nt, Human
uguuuaauguuaagucaugacaau

SEQ ID NO: 31713 - RNA, 24 nt, Human
uuaaaacucaaaaucauuaguugg

SEQ ID NO: 31714 - RNA, 24 nt, Human
ugauaauucuugagacaaaaggug

SEQ ID NO: 31715 - RNA, 24 nt, Human
guaaagaacaauauaagauuucgg

SEQ ID NO: 31716 - RNA, 24 nt, Human
uauggcaagucacuuuugacagac

SEQ ID NO: 31717 - RNA, 24 nt, Human
ugagaauggcaaaauuagucgccu

SEQ ID NO: 31718 - RNA, 24 nt, Human
uacaccacucccaagaagaauaag

SEQ ID NO: 31719 - RNA, 24 nt, Human
aagagcaccaccauuauuaccacc

SEQ ID NO: 31720 - RNA, 24 nt, Human
ucuuuauuuccuccguuccaauga

SEQ ID NO: 31721 - RNA, 24 nt, Human
ucuccagcagcggcaccucagugu

SEQ ID NO: 31722 - RNA, 24 nt, Human
aagaaucuguuacuucgaguugcu

SEQ ID NO: 31723 - RNA, 24 nt, Human
agucauugaacuucagcucuggaa

SEQ ID NO: 31724 - RNA, 24 nt, Human
uaaugaguaggugagagggucugg

SEQ ID NO: 31725 - RNA, 24 nt, Human
ucaguucgggaccgcaccacgcca

SEQ ID NO: 31726 - RNA, 24 nt, Human
ggcugguggccugagcgggaggcc

SEQ ID NO: 31727 - RNA, 24 nt, Human
uggaagaaaagagcaucgacuuga

SEQ ID NO: 31728 - RNA, 24 nt, Human
cuggaaggcauacccuacaauuua

SEQ ID NO: 31729 - RNA, 20 nt, Human
uuuguaagcuucugagauug

SEQ ID NO: 31730 - RNA, 24 nt, Human
uugaaagguauauuaaaauuaagg

SEQ ID NO: 31731 - RNA, 24 nt, Human
uccagccugugugagcagagcgag

SEQ ID NO: 31732 - RNA, 24 nt, Human
ugagguaugauaauugccugaacc

SEQ ID NO: 31733 - RNA, 24 nt, Human
aaggugcuuuuguccuuccaauug

SEQ ID NO: 31734 - RNA, 24 nt, Human
cccccuguucggggaacccucccg

SEQ ID NO: 31735 - RNA, 24 nt, Human
cacaccuuuugacaacacuguuug

SEQ ID NO: 31736 - RNA, 19 nt, Human
ucgccgggcacgcagggaa

SEQ ID NO: 31737 - RNA, 24 nt, Human
ugagcaguucggugagaggaccac

SEQ ID NO: 31738 - RNA, 24 nt, Human
uaugaaguuaaaugacugguucag

SEQ ID NO: 31739 - RNA, 24 nt, Human
aaaaaucuggugaaauugccggca

SEQ ID NO: 31740 - RNA, 24 nt, Human
cuugcccuucuggaaauuaccccg

SEQ ID NO: 31741 - RNA, 24 nt, Human
gugcagcugagccacaaagcaaac

SEQ ID NO: 31742 - RNA, 24 nt, Human
uuuaauuauuccucuagcucuccc

SEQ ID NO: 31743 - RNA, 24 nt, Human
ucuagagucuguugccaacauguu

SEQ ID NO: 31744 - RNA, 23 nt, Human
uguaaagcuguuacacccauuuc

SEQ ID NO: 31745 - RNA, 21 nt, Human
cagaagccaugauggugaaaa

SEQ ID NO: 31746 - RNA, 24 nt, Human
aaauagugaauuugauaugaaauc

SEQ ID NO: 31747 - RNA, 24 nt, Human
ugggaggccaguggcagcagcagg

SEQ ID NO: 31748 - RNA, 24 nt, Human
ugaaaugauacacauguuuuaaau

SEQ ID NO: 31749 - RNA, 24 nt, Human
uguugccaacaccuugagaagcau

SEQ ID NO: 31750 - RNA, 24 nt, Human
uuaguucauucuucuaauaagccu

SEQ ID NO: 31751 - RNA, 24 nt, Human
aagcguuaucugucaaagcaauuc

SEQ ID NO: 31752 - RNA, 24 nt, Human
uuucccaguggaguaaagaaaguc

SEQ ID NO: 31753 - RNA, 22 nt, Human
ggagccaaugacuccacaaguc

SEQ ID NO: 31754 - RNA, 24 nt, Human
uugaaagguauauuaaaauuaagg

SEQ ID NO: 31755 - RNA, 24 nt, Human
cuggaaggcauacccuacacuuua

SEQ ID NO: 31756 - RNA, 21 nt, Human
uuuguaagcuucugagauugc

SEQ ID NO: 31757 - RNA, 24 nt, Human
uaagauagauauauaugaguagaa

SEQ ID NO: 31758 - RNA, 24 nt, Human
uguacaaaaccuaauuuguuguca

SEQ ID NO: 31759 - RNA, 24 nt, Human
ugcauuguuaucauuaaccagucu

SEQ ID NO: 31760 - RNA, 24 nt, Human
ucuagcaauauuugaagugcuggc

SEQ ID NO: 31761 - RNA, 24 nt, Human
uuccagggcucguuuuuuggcuuc

SEQ ID NO: 31762 - RNA, 24 nt, Human
ugugcagaagaaauggaaggauuc

SEQ ID NO: 31763 - RNA, 24 nt, Human
uucaaauuucuuucuuuuuuaauu

SEQ ID NO: 31764 - RNA, 24 nt, Human
auaaauuuaaauuccauuccucag

SEQ ID NO: 31765 - RNA, 24 nt, Human
gugguugguguaaaugagugaggc

SEQ ID NO: 31766 - RNA, 24 nt, Human
cgcagguagaggcuuacuagaagu

SEQ ID NO: 31767 - RNA, 24 nt, Human
uuuguuuugagguuaguuugauua

SEQ ID NO: 31768 - RNA, 24 nt, Human
ugaguagguggccugcaguaaugu

SEQ ID NO: 31769 - RNA, 24 nt, Human
ugcauuguuaucauuaaccagucu

SEQ ID NO: 31770 - RNA, 24 nt, Human
uauuagggauaauauucauuuagc

SEQ ID NO: 31771 - RNA, 24 nt, Human
uuuaacuuuuuuaaugggucucaa

SEQ ID NO: 31772 - RNA, 24 nt, Human
ucuauaggccuaacuucauuuuua

SEQ ID NO: 31773 - RNA, 24 nt, Human
uagcaugccacuaaaagaggcaga

SEQ ID NO: 31774 - RNA, 24 nt, Human
uccuugguaguuuaacucuggaag

SEQ ID NO: 31775 - RNA, 24 nt, Human
cgugaccccuguccccacacugac

SEQ ID NO: 31776 - RNA, 24 nt, Human
cuaggagcuaugguggcuguugug

SEQ ID NO: 31777 - RNA, 24 nt, Human
ugagaugcaggauuucuucacacc

SEQ ID NO: 31778 - RNA, 24 nt, Human
agaguuguucauccagggagacag

SEQ ID NO: 31779 - RNA, 24 nt, Human
ggccugggcacccuuagaggggag

SEQ ID NO: 31780 - RNA, 24 nt, Human
agcuacugggugagcuggacuacc

SEQ ID NO: 31781 - RNA, 22 nt, Human
aggcagggaaaagaggccaggu

SEQ ID NO: 31782 - RNA, 24 nt, Human
gucacguugagagccaacaccaug

SEQ ID NO: 31783 - RNA, 20 nt, Human
cagcacccgaaugccugcug

SEQ ID NO: 31784 - RNA, 24 nt, Human
uuugugaggcgguucaauggugaa

SEQ ID NO: 31785 - RNA, 24 nt, Human
uggaggcugaauggggucucgucc

SEQ ID NO: 31786 - RNA, 24 nt, Human
agcccgcgccaguccgacgucaug

SEQ ID NO: 31787 - RNA, 24 nt, Human
agcuggaugaccucgucaacuggg

SEQ ID NO: 31788 - RNA, 24 nt, Human
gggaaucagucuaaagcugugcuc

SEQ ID NO: 31789 - RNA, 24 nt, Human
auagaaccauuauaguaacgucaa

SEQ ID NO: 31790 - RNA, 24 nt, Human
gggaaaauuuuuuuuuuuucucuc

SEQ ID NO: 31791 - RNA, 24 nt, Human
gacccuggccauggcccugauggg

SEQ ID NO: 31792 - RNA, 24 nt, Human
acaaccuucagaugagaacugcuu

SEQ ID NO: 31793 - RNA, 24 nt, Human
agaggcuacagcgaaccaacauca

SEQ ID NO: 31794 - RNA, 24 nt, Human
uuuuaaggaaaauuaggagaaaua

SEQ ID NO: 31795 - RNA, 24 nt, Human
aggcagggugaucacuugaaggca

SEQ ID NO: 31796 - RNA, 24 nt, Human
uguguauaaagauggggggagcuu

SEQ ID NO: 31797 - RNA, 24 nt, Human
ggacaagggcugcccgcgugucca

SEQ ID NO: 31798 - RNA, 24 nt, Human
ugauagguggguccaagcagaguu

SEQ ID NO: 31799 - RNA, 24 nt, Human
gaguacauaaucagugccacacag

SEQ ID NO: 31800 - RNA, 24 nt, Human
gcccacuuuuugaugggguuguuu

SEQ ID NO: 31801 - RNA, 24 nt, Human
uccacaaggguugaacuaauuuac

SEQ ID NO: 31802 - RNA, 24 nt, Human
uauggcaagucacuuugacagaca

SEQ ID NO: 31803 - RNA, 24 nt, Human
ugagaauggcaaaauuagucgccu

SEQ ID NO: 31804 - RNA, 24 nt, Human
uacaccacucccaagaagaauaag

SEQ ID NO: 31805 - RNA, 24 nt, Human
uuagccuccagaggcggcuccucu

SEQ ID NO: 31806 - RNA, 24 nt, Human
uggcgggggugguggggccucagc

SEQ ID NO: 31807 - RNA, 24 nt, Human
cuccuugccuucggcacuggcggg

SEQ ID NO: 31808 - RNA, 24 nt, Human
uaucugaggaacaaccaacuaguu

SEQ ID NO: 31809 - RNA, 24 nt, Human
uggaaaucugcagaggccuccgga

SEQ ID NO: 31810 - RNA, 24 nt, Human
uaggugcaauguccuaauaccuug

SEQ ID NO: 31811 - RNA, 24 nt, Human
ugcauuguuaucauuaaccagucu

SEQ ID NO: 31812 - RNA, 24 nt, Human
uauuagggauaauauucauuuagc

SEQ ID NO: 31813 - RNA, 24 nt, Human
uuuaacuuuuuuaaugggucucaa

SEQ ID NO: 31814 - RNA, 24 nt, Human
ugcauuguuaucauuaaccagucu

SEQ ID NO: 31815 - RNA, 24 nt, Human
uauuagggauaauauucauuuagc

SEQ ID NO: 31816 - RNA, 24 nt, Human
uuuaacuuuuuuaaugggucucaa

SEQ ID NO: 31817 - RNA, 24 nt, Human
uauuagggauaauauucauuuagc

SEQ ID NO: 31818 - RNA, 24 nt, Human
aggcacuauggccuugucugggau

SEQ ID NO: 31819 - RNA, 24 nt, Human
uaaccaaaaacauaaagcgauaau

SEQ ID NO: 31820 - RNA, 24 nt, Human
ugcgggaaaugggggggucugaaa

SEQ ID NO: 31821 - RNA, 24 nt, Human
uuggccauuacaaagacacaggaa

SEQ ID NO: 31822 - RNA, 24 nt, Human
uggaagcagcggaggaaggagacg

SEQ ID NO: 31823 - RNA, 22 nt, Human
uuugaacuaugauuuaguagca

SEQ ID NO: 31824 - RNA, 24 nt, Human
ccuugcugcaaacugcuuuucuug

SEQ ID NO: 31825 - RNA, 24 nt, Human
gucacguugcaaccuuuuguuucc

SEQ ID NO: 31826 - RNA, 23 nt, Human
uguccaggaugcucaggcuguag

SEQ ID NO: 31827 - RNA, 24 nt, Human
ggaccugaggcagaacuggggugg

SEQ ID NO: 31828 - RNA, 22 nt, Human
uccgugcgcguugcugcggccg

SEQ ID NO: 31829 - RNA, 24 nt, Human
aggaaggagauauagugaagagga

SEQ ID NO: 31830 - RNA, 24 nt, Human
aggaaggagauauagugaagagga

SEQ ID NO: 31831 - RNA, 24 nt, Human
ccgggucgacccacgcguccgguu

SEQ ID NO: 31832 - RNA, 24 nt, Human
uggacagccaugcggagcuucuag

SEQ ID NO: 31833 - RNA, 24 nt, Human
uggaaagugggcgccauuaccuug

SEQ ID NO: 31834 - RNA, 24 nt, Human
ucuggagccaucgcgauugauucc

SEQ ID NO: 31835 - RNA, 24 nt, Human
accacggauaacaccccucccccu

SEQ ID NO: 31836 - RNA, 24 nt, Human
caccuuuugcuuuuugcacuguuu

SEQ ID NO: 31837 - RNA, 24 nt, Human
uauggcaagucacuuugacagaca

SEQ ID NO: 31838 - RNA, 24 nt, Human
ugagaauggcaaaauuagucgccu

SEQ ID NO: 31839 - RNA, 24 nt, Human
uacaccacucccaagaagaauaag

SEQ ID NO: 31840 - RNA, 24 nt, Human
auacaccauucauuguaggaaaau

SEQ ID NO: 31841 - RNA, 24 nt, Human
uugcugcugagacucaggcaugca

SEQ ID NO: 31842 - RNA, 21 nt, Human
uaagaaacuccauuuugaucu

SEQ ID NO: 31843 - RNA, 24 nt, Human
uauauugucacaucugccuugagu

SEQ ID NO: 31844 - RNA, 24 nt, Human
uauguuuguuuucucaucccaaaa

SEQ ID NO: 31845 - RNA, 18 nt, Human
ugagcgaagcacgagugu

SEQ ID NO: 31846 - RNA, 24 nt, Human
acggaaccacaucuaggccacaaa

SEQ ID NO: 31847 - RNA, 24 nt, Human
agccugcaucgaagaaguacugcc

SEQ ID NO: 31848 - RNA, 24 nt, Human
agccagaugcgccugacugccgcg

SEQ ID NO: 31849 - RNA, 22 nt, Human
gugcguggccgucaccugcggg

SEQ ID NO: 31850 - RNA, 24 nt, Human
gcggagcgaggaggagugggcuca

SEQ ID NO: 31851 - RNA, 24 nt, Human
ucgggugcgcugcuggcuguugcg

SEQ ID NO: 31852 - RNA, 24 nt, Human
aagcugauugucucucccugcagc

SEQ ID NO: 31853 - RNA, 20 nt, Human
cagcgccccggcagggugcc

SEQ ID NO: 31854 - RNA, 24 nt, Human
acuugauuuucauuaauccagagc

SEQ ID NO: 31855 - RNA, 24 nt, Human
uugcagcacgucagcaucaauauc

SEQ ID NO: 31856 - RNA, 24 nt, Human
uucccggacaucgacugaggccca

SEQ ID NO: 31857 - RNA, 24 nt, Human
uuugacacguguauccacggguca

SEQ ID NO: 31858 - RNA, 24 nt, Human
uuagggaaauuacuacacuguugu

SEQ ID NO: 31859 - RNA, 24 nt, Human
uuuaaugugaaugcuaaaugaaua

SEQ ID NO: 31860 - RNA, 24 nt, Human
guagcugugcugccuuaacaucga

SEQ ID NO: 31861 - RNA, 24 nt, Human
uagcagcauggacuuacuuucaca

SEQ ID NO: 31862 - RNA, 17 nt, Human
uguggagugaaggcggc

SEQ ID NO: 31863 - RNA, 24 nt, Human
ucaguguagcuccuggggacuuca

SEQ ID NO: 31864 - RNA, 24 nt, Human
cacaaccacggccgucuuguuuuc

SEQ ID NO: 31865 - RNA, 22 nt, Human
ugaaggggacaguggugcaagu

SEQ ID NO: 31866 - RNA, 24 nt, Human
cagccuggacuuaccaccacuaaa

SEQ ID NO: 31867 - RNA, 24 nt, Human
ggcccggagcggagcgcgcccugc

SEQ ID NO: 31868 - RNA, 24 nt, Human
acuccaugcccaagugccuguaau

SEQ ID NO: 31869 - RNA, 20 nt, Human
ucguugggucacgccuuucc

SEQ ID NO: 31870 - RNA, 24 nt, Human
uaacagguguaagaguguugaaaa

SEQ ID NO: 31871 - RNA, 24 nt, Human
ugugcagaagaaauggaaggauuc

SEQ ID NO: 31872 - RNA, 24 nt, Human
uaucaaggaagggcaggcgugaug

SEQ ID NO: 31873 - RNA, 24 nt, Human
uucaaauuucuuucuuuuuuaauu

SEQ ID NO: 31874 - RNA, 24 nt, Human
uugaaacaccuuaacccuguugcc

SEQ ID NO: 31875 - RNA, 24 nt, Human
agagguacuguugcagccgcugca

SEQ ID NO: 31876 - RNA, 24 nt, Human
uucccaugccccaggcuccugcag

SEQ ID NO: 31877 - RNA, 24 nt, Human
ugggccgaggagcacccccuccag

SEQ ID NO: 31878 - RNA, 24 nt, Human
ucccccauuuugcaggggagggaa

SEQ ID NO: 31879 - RNA, 24 nt, Human
uuuggccaucauauagcccauggu

SEQ ID NO: 31880 - RNA, 24 nt, Human
caugaagggcuacuuaacucaugu

SEQ ID NO: 31881 - RNA, 24 nt, Human
ccccuguugccaccuguuuuuguc

SEQ ID NO: 31882 - RNA, 24 nt, Human
ugaccugguuuuuggucaacucau

SEQ ID NO: 31883 - RNA, 24 nt, Human
ugugguucucggggcugcccuuug

SEQ ID NO: 31884 - RNA, 24 nt, Human
cuuggccuuggccuuggccuuggc

SEQ ID NO: 31885 - RNA, 24 nt, Human
cauuguuggccugcaucuucuuua

SEQ ID NO: 31886 - RNA, 24 nt, Human
gagcuugcggcugacacccuuugg

SEQ ID NO: 31887 - RNA, 24 nt, Human
uugaucuugaagaaacugggcgug

SEQ ID NO: 31888 - RNA, 24 nt, Human
aggaaggagauauagugaagagga

SEQ ID NO: 31889 - RNA, 24 nt, Human
guagaguuuucuucaggcuuaaag

SEQ ID NO: 31890 - RNA, 24 nt, Human
caccuuuucuaucauacacaauau

SEQ ID NO: 31891 - RNA, 24 nt, Human
agccuccagaauagcuaggaguag

SEQ ID NO: 31892 - RNA, 24 nt, Human
uuuauaucugauuuuuuuuuuuaa

SEQ ID NO: 31893 - RNA, 24 nt, Human
uagaaggaauuauagauguugagu

SEQ ID NO: 31894 - RNA, 24 nt, Human
ucugcguucccucccucugggccu

SEQ ID NO: 31895 - RNA, 24 nt, Human
uaccagugugcuuggguuugccau

SEQ ID NO: 31896 - RNA, 24 nt, Human
ucccaagcugccaagccccugccu

SEQ ID NO: 31897 - RNA, 24 nt, Human
ugggcuggacccaguggggagaau

SEQ ID NO: 31898 - RNA, 24 nt, Human
cacucucuuccaagaaagaccuug

SEQ ID NO: 31899 - RNA, 24 nt, Human
ugcuacagcuuuggcucugguggu

SEQ ID NO: 31900 - RNA, 24 nt, Human
ggaguauguauucccgugugccag

SEQ ID NO: 31901 - RNA, 24 nt, Human
acccugagaguguggcuggggagu

SEQ ID NO: 31902 - RNA, 24 nt, Human
agaggaccaagagcauguuccaga

SEQ ID NO: 31903 - RNA, 21 nt, Human
uggaauguucauaguguccuc

SEQ ID NO: 31904 - RNA, 24 nt, Human
uauggcaagucacuuugacagaca

SEQ ID NO: 31905 - RNA, 24 nt, Human
uacaccacucccaagaagaauaag

SEQ ID NO: 31906 - RNA, 24 nt, Human
uaaugggucucaaaauucugugac

SEQ ID NO: 31907 - RNA, 24 nt, Human
uauuagggauaauauucauuuagc

SEQ ID NO: 31908 - RNA, 24 nt, Human
augggccccaccagugcaacugcc

SEQ ID NO: 31909 - RNA, 24 nt, Human
aaaguacuugccgcucuaccccug

SEQ ID NO: 31910 - RNA, 24 nt, Human
uggaaaccgagccuguaggugaca

SEQ ID NO: 31911 - RNA, 24 nt, Human
cuccauggccaaagcgagagcauu

SEQ ID NO: 31912 - RNA, 24 nt, Human
aaccagaaaguaagguguucuacu

SEQ ID NO: 31913 - RNA, 24 nt, Human
uggccugaugauccacagcggaga

SEQ ID NO: 31914 - RNA, 24 nt, Human
ugugugccauugcccaggcagagu

SEQ ID NO: 31915 - RNA, 24 nt, Human
uauggggaacgggugucucaaagg

SEQ ID NO: 31916 - RNA, 24 nt, Human
uuggcacagauaaucgcaucugug

SEQ ID NO: 31917 - RNA, 24 nt, Human
uaaguugguugcuuuuuggugauu

SEQ ID NO: 31918 - RNA, 23 nt, Human
ucuguggggaguaacaagggcuc

SEQ ID NO: 31919 - RNA, 24 nt, Human
guaauguuacucuucuccugccug

SEQ ID NO: 31920 - RNA, 24 nt, Human
uacccaaaugugacacugggcuca

SEQ ID NO: 31921 - RNA, 24 nt, Human
cuguacccauguuaugugacucuc

SEQ ID NO: 31922 - RNA, 24 nt, Human
aacccuuuggcuuuuuucagagaa

SEQ ID NO: 31923 - RNA, 24 nt, Human
uaugccauugucuuuguaauucuu

SEQ ID NO: 31924 - RNA, 24 nt, Human
ucugguuuuauuauucaaauuaag

SEQ ID NO: 31925 - RNA, 24 nt, Human
agaagaaaaagaaauggcaaagag

SEQ ID NO: 31926 - RNA, 24 nt, Human
ucaauuuuuauuuugguuuucuua

SEQ ID NO: 31927 - RNA, 24 nt, Human
uaggguggagggcagggugggcag

SEQ ID NO: 31928 - RNA, 23 nt, Human
uguagggagugggggcugcuaga

SEQ ID NO: 31929 - RNA, 24 nt, Human
uauucauguaaagugauuaucaca

SEQ ID NO: 31930 - RNA, 24 nt, Human
uuccggaucauccgggaaagggac

SEQ ID NO: 31931 - RNA, 24 nt, Human
uggcacgcucgaacuuccggcccu

SEQ ID NO: 31932 - RNA, 24 nt, Human
ucuucaguaccagaggugccugau

SEQ ID NO: 31933 - RNA, 24 nt, Human
uuaacagauuaauccuaaugguac

SEQ ID NO: 31934 - RNA, 21 nt, Human
ucgaagagauacucgcccagc

SEQ ID NO: 31935 - RNA, 24 nt, Human
caccccagggucugcucaggugug

SEQ ID NO: 31936 - RNA, 24 nt, Human
ggucaacaggagucgggccucucu

SEQ ID NO: 31937 - RNA, 24 nt, Human
uauuuuacuaugauaguugagaaa

SEQ ID NO: 31938 - RNA, 24 nt, Human
uaccggcuucagcagaggcgcaag

SEQ ID NO: 31939 - RNA, 24 nt, Human
uacagaguaacuugauaaccugug

SEQ ID NO: 31940 - RNA, 24 nt, Human
uuugcuguaacuugaagauuuacc

SEQ ID NO: 31941 - RNA, 24 nt, Human
ucgaagauagcaacuucaucaggg

SEQ ID NO: 31942 - RNA, 21 nt, Human
uucaagggauggaaagucacc

SEQ ID NO: 31943 - RNA, 24 nt, Human
agcaagcucaagcuuuuuauacgu

SEQ ID NO: 31944 - RNA, 24 nt, Human
ucuccauguccacagcugauuucc

SEQ ID NO: 31945 - RNA, 24 nt, Human
uagcauaaguuugagggugaugca

SEQ ID NO: 31946 - RNA, 24 nt, Human
uagauggcagaacuuuugaggugc

SEQ ID NO: 31947 - RNA, 24 nt, Human
aguuauugaagauuaggaucaagg

SEQ ID NO: 31948 - RNA, 19 nt, Human
caugucacuagcuuccugu

SEQ ID NO: 31949 - RNA, 24 nt, Human
auccgggugaagaagcaggucugg

SEQ ID NO: 31950 - RNA, 24 nt, Human
auaggucacaagucugauauaagu

SEQ ID NO: 31951 - RNA, 24 nt, Human
gggcagugcugguaguagggugua

SEQ ID NO: 31952 - RNA, 24 nt, Human
uuugcuccugacgucccucagaug

SEQ ID NO: 31953 - RNA, 24 nt, Human
uaaagggaaauaguggaaagccug

SEQ ID NO: 31954 - RNA, 24 nt, Human
uggccaggaaugcagcggccgugc

SEQ ID NO: 31955 - RNA, 24 nt, Human
acgcugccaagcuccccaugucca

SEQ ID NO: 31956 - RNA, 24 nt, Human
guccaguuuguacccuuccgggac

SEQ ID NO: 31957 - RNA, 24 nt, Human
uccacaggggauguggccggaggg

SEQ ID NO: 31958 - RNA, 24 nt, Human
cuuugagggggcugaugcggagga

SEQ ID NO: 31959 - RNA, 24 nt, Human
uggcgagggacucguuaccaucac

SEQ ID NO: 31960 - RNA, 24 nt, Human
uucagcaccaucgccuccagcuac

SEQ ID NO: 31961 - RNA, 24 nt, Human
ucagguauugcuguuagauauccc

SEQ ID NO: 31962 - RNA, 24 nt, Human
ucauaugcauaguaccgagaaacu

SEQ ID NO: 31963 - RNA, 24 nt, Human
uacccaacuuaaucggccuugugg

SEQ ID NO: 31964 - RNA, 24 nt, Human
ucggaauuccagcuuaauuuggcc

SEQ ID NO: 31965 - RNA, 24 nt, Human
uauaaaguugguugcugcaaaauc

SEQ ID NO: 31966 - RNA, 24 nt, Human
uagcauugaaggacucggggauau

SEQ ID NO: 31967 - RNA, 24 nt, Human
uagcauugaaggacucggggauau

SEQ ID NO: 31968 - RNA, 24 nt, Human
uagcauugaaggacucggggauau

SEQ ID NO: 31969 - RNA, 24 nt, Human
agugcagucacuuuggggaaaugc

SEQ ID NO: 31970 - RNA, 24 nt, Human
ugccuggaguaggucaguaaagaa

SEQ ID NO: 31971 - RNA, 24 nt, Human
ucagcagaaauuaaaacuaaugaa

SEQ ID NO: 31972 - RNA, 24 nt, Human
uguaaauucuaccuucugcaaaua

SEQ ID NO: 31973 - RNA, 24 nt, Human
aaagggaaugauagcauugaagga

SEQ ID NO: 31974 - RNA, 22 nt, Human
uagcauugaaggacucgugagg

SEQ ID NO: 31975 - RNA, 24 nt, Human
uagcauugaaggacucggggauau

SEQ ID NO: 31976 - RNA, 24 nt, Human
uuccgguuuaagagaugggcauuu

SEQ ID NO: 31977 - RNA, 24 nt, Human
uggcaucgcuguccucccgcuccu

SEQ ID NO: 31978 - RNA, 20 nt, Human
uggcgcagcuggcggacagc

SEQ ID NO: 31979 - RNA, 24 nt, Human
aggcuuuggagaaagagggcagcc

SEQ ID NO: 31980 - RNA, 21 nt, Human
uggggucagcccucuucccgg

SEQ ID NO: 31981 - RNA, 22 nt, Human
uaucccagcgacuaugauaugc

SEQ ID NO: 31982 - RNA, 24 nt, Human
ucccuuggguagacaaaauccaac

SEQ ID NO: 31983 - RNA, 24 nt, Human
ugaggaacuucaucucuauggauu

SEQ ID NO: 31984 - RNA, 24 nt, Human
ucgcccaggaugaggauggcaucc

SEQ ID NO: 31985 - RNA, 24 nt, Human
ucgguucgcuggagagaggcgagc

SEQ ID NO: 31986 - RNA, 24 nt, Human
ugggcccagcugcggcgggggcug

SEQ ID NO: 31987 - RNA, 24 nt, Human
ugccaucaccaucuauguguccaa

SEQ ID NO: 31988 - RNA, 24 nt, Human
uacaggacacuguuggcuuuagag

SEQ ID NO: 31989 - RNA, 24 nt, Human
ccaccacccgggccugccgccuga

SEQ ID NO: 31990 - RNA, 24 nt, Human
ccccccagagccggcgcccucucc

SEQ ID NO: 31991 - RNA, 24 nt, Human
uguuagagaguucgguuaacuuag

SEQ ID NO: 31992 - RNA, 24 nt, Human
ucgcaguaauuuaugcucuuugcu

SEQ ID NO: 31993 - RNA, 24 nt, Human
ugugucaggcaugacaugaauggu

SEQ ID NO: 31994 - RNA, 24 nt, Human
uuuguaaucacuggcaaugucucu

SEQ ID NO: 31995 - RNA, 21 nt, Human
uucaagggauggaaagucacc

SEQ ID NO: 31996 - RNA, 24 nt, Human
ucugaucuauaaaugcgguggcau

SEQ ID NO: 31997 - RNA, 24 nt, Human
ugggaaaaacuugggggcccaggg

SEQ ID NO: 31998 - RNA, 24 nt, Human
caggacccgucgccaugggccgug

SEQ ID NO: 31999 - RNA, 20 nt, Human
ucaguaggccaguccaggug

SEQ ID NO: 32000 - RNA, 24 nt, Human
aaacaccuacagaugcaucuugca

SEQ ID NO: 32001 - RNA, 24 nt, Human
uuagcagaugacuuugcuggcaag

SEQ ID NO: 32002 - RNA, 24 nt, Human
ggaggagauaaaauaauucauucu

SEQ ID NO: 32003 - RNA, 24 nt, Human
agcaguucuuuuuuuuuuuccuuu

SEQ ID NO: 32004 - RNA, 24 nt, Human
auguagguuuuacaauauuccaug

SEQ ID NO: 32005 - RNA, 24 nt, Human
ugaacaggaggcucaagccccagg

SEQ ID NO: 32006 - RNA, 24 nt, Human
aggcaggugaagugucuccccgca

SEQ ID NO: 32007 - RNA, 24 nt, Human
ucucuggcuguucgucccaucguc

SEQ ID NO: 32008 - RNA, 24 nt, Human
ugaggccaugugaguaggauccug

SEQ ID NO: 32009 - RNA, 24 nt, Human
aaguaaauaggcuauuuuuucuua

SEQ ID NO: 32010 - RNA, 17 nt, Human
ucugaaagaacuagugg

SEQ ID NO: 32011 - RNA, 24 nt, Human
ugccugaaaacuuccuuaagcagc

SEQ ID NO: 32012 - RNA, 24 nt, Human
cagcggacccuuggacggcagcgc

SEQ ID NO: 32013 - RNA, 24 nt, Human
caccuugaugagaccauugccgcg

SEQ ID NO: 32014 - RNA, 24 nt, Human
ugggagauuuaucaagcguuuuga

SEQ ID NO: 32015 - RNA, 24 nt, Human
guagcccagcagacaggacacucc

SEQ ID NO: 32016 - RNA, 24 nt, Human
agagcugugggccagcagccagca

SEQ ID NO: 32017 - RNA, 24 nt, Human
uguuuccucauuuauuauaaacac

SEQ ID NO: 32018 - RNA, 23 nt, Human
ucugaacugcuccacucugguga

SEQ ID NO: 32019 - RNA, 21 nt, Human
cacucgguugaagacggguca

SEQ ID NO: 32020 - RNA, 24 nt, Human
uggcaggaaugggaggcauccaga

SEQ ID NO: 32021 - RNA, 24 nt, Human
cgagaagaagcuaaaacaagaccu

SEQ ID NO: 32022 - RNA, 24 nt, Human
acuggagggguucaaagguucgcg

SEQ ID NO: 32023 - RNA, 24 nt, Human
ugauauggcgaccuauuuugggcg

SEQ ID NO: 32024 - RNA, 24 nt, Human
aggcguugucccuuugccgagaca

SEQ ID NO: 32025 - RNA, 24 nt, Human
ccuuuguucccaggacuuuaaggc

SEQ ID NO: 32026 - RNA, 24 nt, Human
ugaaacauaugaaauugcugcauu

SEQ ID NO: 32027 - RNA, 24 nt, Human
cccccguuuuaaacccguauccaa

SEQ ID NO: 32028 - RNA, 24 nt, Human
uggaggcugagugccguuugcggu

SEQ ID NO: 32029 - RNA, 24 nt, Human
agugcaguucucaaauggcugccu

SEQ ID NO: 32030 - RNA, 24 nt, Human
uugguggugaagugaguagcugca

SEQ ID NO: 32031 - RNA, 24 nt, Human
ucuguaguggauguacuacagcuc

SEQ ID NO: 32032 - RNA, 24 nt, Human
ucugaaacauuuuacuucauauua

SEQ ID NO: 32033 - RNA, 24 nt, Human
acggagggcuccgggcucuguaug

SEQ ID NO: 32034 - RNA, 24 nt, Human
ugaagagauaggcuucauagauua

SEQ ID NO: 32035 - RNA, 24 nt, Human
uccaccacuacuggccaucugauc

SEQ ID NO: 32036 - RNA, 24 nt, Human
uucaaugcuguuuaauuauggauu

SEQ ID NO: 32037 - RNA, 24 nt, Human
uugcaguuacaaagcuaccaggaa

SEQ ID NO: 32038 - RNA, 24 nt, Human
uuaaugauuauaaaucaggaucua

SEQ ID NO: 32039 - RNA, 24 nt, Human
caggcccucccguugggugauggc

SEQ ID NO: 32040 - RNA, 24 nt, Human
ccccugagggagaggaaaggugaa

SEQ ID NO: 32041 - RNA, 22 nt, Human
uuacaacaaucgagugcuggac

SEQ ID NO: 32042 - RNA, 24 nt, Human
ugcaaagacucccccugacccacc

SEQ ID NO: 32043 - RNA, 24 nt, Human
cacuuugugagcucaucaucaguc

SEQ ID NO: 32044 - RNA, 18 nt, Human
cagcugggccaucugcca

SEQ ID NO: 32045 - RNA, 24 nt, Human
uggcagccucaucaagaugacuga

SEQ ID NO: 32046 - RNA, 24 nt, Human
uggcugccgacgugauucccuggg

SEQ ID NO: 32047 - RNA, 24 nt, Human
accuuuugcugugauggccgcguc

SEQ ID NO: 32048 - RNA, 19 nt, Human
cuuggauuaaggcgacagc

SEQ ID NO: 32049 - RNA, 24 nt, Human
ugguugauauugcuaggguggcgc

SEQ ID NO: 32050 - RNA, 24 nt, Human
aagcagaaagggaagagaagcgag

SEQ ID NO: 32051 - RNA, 24 nt, Human
uacaaugaauauuaauacauauug

SEQ ID NO: 32052 - RNA, 24 nt, Human
uguacaaaaccuaauuuguuguca

SEQ ID NO: 32053 - RNA, 24 nt, Human
uaggccccagcuccaacauuggga

SEQ ID NO: 32054 - RNA, 24 nt, Human
ugggaacucacagagaggacugca

SEQ ID NO: 32055 - RNA, 22 nt, Human
uaagaugagugcuagagacuug

SEQ ID NO: 32056 - RNA, 24 nt, Human
uccagagcaggaccauguagucac

SEQ ID NO: 32057 - RNA, 21 nt, Human
aaguaugccugggucuuggau

SEQ ID NO: 32058 - RNA, 21 nt, Human
uucaagggauggaaagucacc

SEQ ID NO: 32059 - RNA, 24 nt, Human
aagcagggugucuugacccauggc

SEQ ID NO: 32060 - RNA, 20 nt, Human
agaucaggacucugaaagac

SEQ ID NO: 32061 - RNA, 24 nt, Human
uccgucguagaggcuccgugcgga

SEQ ID NO: 32062 - RNA, 24 nt, Human
ugagaugggaaagggcuccuucaa

SEQ ID NO: 32063 - RNA, 24 nt, Human
uacagggacaucucaggcugacug

SEQ ID NO: 32064 - RNA, 21 nt, Human
uucaagggauggaaagucacc

SEQ ID NO: 32065 - RNA, 21 nt, Human
uucaagggauggaaagucacc

SEQ ID NO: 32066 - RNA, 24 nt, Human
ucugaucuauaaaugcgguggcau

SEQ ID NO: 32067 - RNA, 24 nt, Human
ugagaauggcaaaauuagucgccu

SEQ ID NO: 32068 - RNA, 24 nt, Human
uacaccacucccaagaagaauaag

SEQ ID NO: 32069 - RNA, 24 nt, Human
ucugaucuauaaaugcgguggcau

SEQ ID NO: 32070 - RNA, 24 nt, Human
aggcagcuuugccuucucuccccu

SEQ ID NO: 32071 - RNA, 24 nt, Human
gcccuuuuucccuuuucuccaugc

SEQ ID NO: 32072 - RNA, 24 nt, Human
uugaugcaugugguuaauguugca

SEQ ID NO: 32073 - RNA, 24 nt, Human
uauuaagcacuucugucagucuuu

SEQ ID NO: 32074 - RNA, 24 nt, Human
aaugacuccgucaccaagagcagu

SEQ ID NO: 32075 - RNA, 24 nt, Human
ucugaggagaccacgacugggguc

SEQ ID NO: 32076 - RNA, 21 nt, Human
uuacuuugauccucgugaggc

SEQ ID NO: 32077 - RNA, 24 nt, Human
ugaacagguuguucuggaauugau

SEQ ID NO: 32078 - RNA, 24 nt, Human
uacugugucuccagggcuauacgg

SEQ ID NO: 32079 - RNA, 24 nt, Human
ugagaugggaaagggcuccuucaa

SEQ ID NO: 32080 - RNA, 21 nt, Human
uucaagggauggaaagucacc

SEQ ID NO: 32081 - RNA, 24 nt, Human
uggaauggagaccccugaacucau

SEQ ID NO: 32082 - RNA, 24 nt, Human
ugaaaaugaaaacuguuccucucu

SEQ ID NO: 32083 - RNA, 24 nt, Human
cggcgaaacucuccuccccucggc

SEQ ID NO: 32084 - RNA, 24 nt, Human
gagcuuguucagcuuuucauccuc

SEQ ID NO: 32085 - RNA, 24 nt, Human
cauuguuucugguucucuucgucu

SEQ ID NO: 32086 - RNA, 21 nt, Human
cacagcucggucagcagcgcu

SEQ ID NO: 32087 - RNA, 24 nt, Human
uucauaguuacuuaauuaucuaaa

SEQ ID NO: 32088 - RNA, 24 nt, Human
uuuguauuuaccccaaaaucuuuu

SEQ ID NO: 32089 - RNA, 24 nt, Human
ugagcaccgaggauucaccaugga

SEQ ID NO: 32090 - RNA, 24 nt, Human
ugagaugggaaagggcuccuucaa

SEQ ID NO: 32091 - RNA, 22 nt, Human
uucaagggauggaaaagucacc

SEQ ID NO: 32092 - RNA, 24 nt, Human
aggcugugcagacgguggaccccu

SEQ ID NO: 32093 - RNA, 24 nt, Human
uucaugaggacaacggacagcugg

SEQ ID NO: 32094 - RNA, 24 nt, Human
ucaggagaccauugcaucauuggc

SEQ ID NO: 32095 - RNA, 23 nt, Human
ucaagggucguguguuugaagug

SEQ ID NO: 32096 - RNA, 22 nt, Human
uuccauggucaaaaaauggcag

SEQ ID NO: 32097 - RNA, 24 nt, Human
aggcagagaggcaugcaggcgggg

SEQ ID NO: 32098 - RNA, 24 nt, Human
ccgcagcuucagcaccucggccca

SEQ ID NO: 32099 - RNA, 24 nt, Human
ugagaugggaaagggcuccuucaa

SEQ ID NO: 32100 - RNA, 21 nt, Human
uucaagggauggaaagucacc

SEQ ID NO: 32101 - RNA, 24 nt, Human
ucccauagacacucaggucccucc

SEQ ID NO: 32102 - RNA, 24 nt, Human
ggugcggacuccaaggaggugcac

SEQ ID NO: 32103 - RNA, 24 nt, Human
ccccggagucuagaucugcugggg

SEQ ID NO: 32104 - RNA, 24 nt, Human
ugcgguaaugauggccuggacgcu

SEQ ID NO: 32105 - RNA, 24 nt, Human
acugcauucuaacaccaaucgguc

SEQ ID NO: 32106 - RNA, 24 nt, Human
ucugaucuauaaaugcgguggcau

SEQ ID NO: 32107 - RNA, 24 nt, Human
uuaaugcucugucuuccauuuguu

SEQ ID NO: 32108 - RNA, 24 nt, Human
uaccagguuuaaauguagucuucu

SEQ ID NO: 32109 - RNA, 22 nt, Human
ugucaugguugcagcauuugaa

SEQ ID NO: 32110 - RNA, 24 nt, Human
cuggagcucacguucauguugugc

SEQ ID NO: 32111 - RNA, 24 nt, Human
cuaagacuuuaagggcccacacag

SEQ ID NO: 32112 - RNA, 24 nt, Human
ucacugcagcugccccucccuggc

SEQ ID NO: 32113 - RNA, 24 nt, Human
gaagucacacucagaauuuaauuu

SEQ ID NO: 32114 - RNA, 24 nt, Human
uaugcuagcccucaucauagaugu

SEQ ID NO: 32115 - RNA, 24 nt, Human
accgcaccuguccacgucaugcuc

SEQ ID NO: 32116 - RNA, 24 nt, Human
agagagucuaucccggaccuauuc

SEQ ID NO: 32117 - RNA, 21 nt, Human
uggaauccugguggucccacc

SEQ ID NO: 32118 - RNA, 24 nt, Human
ugcauuguuaucauuaaccagucu

SEQ ID NO: 32119 - RNA, 24 nt, Human
uauuagggauaauauucauuuagc

SEQ ID NO: 32120 - RNA, 24 nt, Human
agaaagcugauggugugcccgucu

SEQ ID NO: 32121 - RNA, 24 nt, Human
uucgucacccgcaggauacccgcc

SEQ ID NO: 32122 - RNA, 24 nt, Human
uagcaacagaaaugggccccacag

SEQ ID NO: 32123 - RNA, 24 nt, Human
ucccaagaagaaccuuuucuucag

SEQ ID NO: 32124 - RNA, 24 nt, Human
ugcauuguuaucauuaaccagucu

SEQ ID NO: 32125 - RNA, 24 nt, Human
uauuagggauaauauucauuuagc

SEQ ID NO: 32126 - RNA, 24 nt, Human
uuuaacuuuuuuaaugggucucaa

SEQ ID NO: 32127 - RNA, 24 nt, Human
uugaagccaguggggcaccaaucc

SEQ ID NO: 32128 - RNA, 24 nt, Human
uaccauggcgaggguacauuucac

SEQ ID NO: 32129 - RNA, 24 nt, Human
ccgaagauguuaguuaauagauau

SEQ ID NO: 32130 - RNA, 24 nt, Human
ugacacaaaagcaccguaaaagag

SEQ ID NO: 32131 - RNA, 24 nt, Human
uuuguacaaaaauacugucaaaau

SEQ ID NO: 32132 - RNA, 24 nt, Human
acgacauuccacacccuauuauca

SEQ ID NO: 32133 - RNA, 24 nt, Human
uggaagaugcucaacaccuccucc

SEQ ID NO: 32134 - RNA, 24 nt, Human
ugagguggucgugaagcucuuuga

SEQ ID NO: 32135 - RNA, 24 nt, Human
uaaugggucucaaaauucugugac

SEQ ID NO: 32136 - RNA, 24 nt, Human
uucauauuguuccagagucaugua

SEQ ID NO: 32137 - RNA, 24 nt, Human
uucaaauauuuccauuuuuuaaac

SEQ ID NO: 32138 - RNA, 24 nt, Human
uaccaaguaccaguuucuuauauu

SEQ ID NO: 32139 - RNA, 24 nt, Human
ucccuggaccagcccgguggcacc

SEQ ID NO: 32140 - RNA, 24 nt, Human
ugagaaugcuguuacagaugcugu

SEQ ID NO: 32141 - RNA, 24 nt, Human
uggguuuuuuggucuucgacgcuc

SEQ ID NO: 32142 - RNA, 24 nt, Human
ccccggagcccagccagcucugcc

SEQ ID NO: 32143 - RNA, 24 nt, Human
uauagggaguaauuagggaccuaa

SEQ ID NO: 32144 - RNA, 24 nt, Human
uguugucuuucacccaaaauuugu

SEQ ID NO: 32145 - RNA, 24 nt, Human
ugcauuguuaucauuaaccagucu

SEQ ID NO: 32146 - RNA, 24 nt, Human
uauuagggauaauauucauuuagc

SEQ ID NO: 32147 - RNA, 24 nt, Human
uaaugggucucaaaauucugugac

SEQ ID NO: 32148 - RNA, 24 nt, Human
uuaguuauuagguuucuucaagug

SEQ ID NO: 32149 - RNA, 24 nt, Human
ucccucuguccccugccagcuccc

SEQ ID NO: 32150 - RNA, 24 nt, Human
uggguucucugucgcagagccugg

SEQ ID NO: 32151 - RNA, 24 nt, Human
uuagauggagacggguaagcaaug

SEQ ID NO: 32152 - RNA, 24 nt, Human
ucuggccucaccugugccuggucu

SEQ ID NO: 32153 - RNA, 24 nt, Human
ugggacucuggggccugcucccag

SEQ ID NO: 32154 - RNA, 24 nt, Human
aggcuacaacccauuugccccauu

SEQ ID NO: 32155 - RNA, 24 nt, Human
cuugccguugggagucuccuguau

SEQ ID NO: 32156 - RNA, 24 nt, Human
uauguguauauauauguacguaac

SEQ ID NO: 32157 - RNA, 24 nt, Human
uguauagacccaguuggcaaucau

SEQ ID NO: 32158 - RNA, 24 nt, Human
uaguaggacucuuuaaaccuuuug

SEQ ID NO: 32159 - RNA, 24 nt, Human
acaaagucaguucucgaucaaggu

SEQ ID NO: 32160 - RNA, 24 nt, Human
aggcaggaaggggguaugaucugg

SEQ ID NO: 32161 - RNA, 24 nt, Human
ccccagaggguuucccaaguuggg

SEQ ID NO: 32162 - RNA, 22 nt, Human
cucacauucugcugacugagcg

SEQ ID NO: 32163 - RNA, 24 nt, Human
ucuugggguggaacggggaccacc

SEQ ID NO: 32164 - RNA, 24 nt, Human
uccaagaauuuuugugauggaagc

SEQ ID NO: 32165 - RNA, 24 nt, Human
gggaaagcugguacgccugcaggu

SEQ ID NO: 32166 - RNA, 24 nt, Human
ugucaaguccuggacccuucccug

SEQ ID NO: 32167 - RNA, 24 nt, Human
uauggcaagucacuuugacagaca

SEQ ID NO: 32168 - RNA, 24 nt, Human
uacaccacucccaagaagaauaag

SEQ ID NO: 32169 - RNA, 24 nt, Human
cauugcuagaagccggucgaggag

SEQ ID NO: 32170 - RNA, 24 nt, Human
uugcuucagacuauuacaaagaca

SEQ ID NO: 32171 - RNA, 24 nt, Human
uauggcaagucacuuugacagaca

SEQ ID NO: 32172 - RNA, 24 nt, Human
ugagaauggcaaaauuagucgccu

SEQ ID NO: 32173 - RNA, 24 nt, Human
uacaccacucccaagaagaauaag

SEQ ID NO: 32174 - RNA, 24 nt, Human
uuccccugauagcaagaaaaagac

SEQ ID NO: 32175 - RNA, 24 nt, Human
aggggggugggaagguuaacaaaa

SEQ ID NO: 32176 - RNA, 24 nt, Human
aggcagccagaaaccugcggaaaa

SEQ ID NO: 32177 - RNA, 24 nt, Human
uacaggauuugagcaccauacagg

SEQ ID NO: 32178 - RNA, 22 nt, Human
uauuaaacugaacacugucagc

SEQ ID NO: 32179 - RNA, 24 nt, Human
cgacaccgaggugguuugugcucc

SEQ ID NO: 32180 - RNA, 24 nt, Human
uggaguuuucagccaaaaagagcc

SEQ ID NO: 32181 - RNA, 24 nt, Human
uuauauguuauuauaaaagcuaau

SEQ ID NO: 32182 - RNA, 24 nt, Human
aacacuucugucccuaacgaaucu

SEQ ID NO: 32183 - RNA, 24 nt, Human
aagaguguuauucucaaggcuuua

SEQ ID NO: 32184 - RNA, 24 nt, Human
ugcaagaagccccggaggcuaucc

SEQ ID NO: 32185 - RNA, 24 nt, Human
ugccagcacggugguuaaagggga

SEQ ID NO: 32186 - RNA, 24 nt, Human
ucccugugggcucccuuugggggu

SEQ ID NO: 32187 - RNA, 24 nt, Human
uuuuaaacuuauuuuacgaauuuu

SEQ ID NO: 32188 - RNA, 24 nt, Human
uauggcaagucacuuugacagaca

SEQ ID NO: 32189 - RNA, 24 nt, Human
ugagaauggcaaaauuagucgccu

SEQ ID NO: 32190 - RNA, 24 nt, Human
uacaccacucccaagaagaauaag

SEQ ID NO: 32191 - RNA, 24 nt, Human
auggccccaguuccccagcaaacc

SEQ ID NO: 32192 - RNA, 24 nt, Human
caaagugcugggauugccggugug

SEQ ID NO: 32193 - RNA, 22 nt, Human
gaccucgugauccacucaucuc

SEQ ID NO: 32194 - RNA, 24 nt, Human
uaccucgcgaacacguuuccaaaa

SEQ ID NO: 32195 - RNA, 24 nt, Human
ugguauugggaauaauaccucaca

SEQ ID NO: 32196 - RNA, 24 nt, Human
uacuccagccugagugacagagcg

SEQ ID NO: 32197 - RNA, 24 nt, Human
uggagugggacaaccagacccgau

SEQ ID NO: 32198 - RNA, 24 nt, Human
uaacggaccuggaaauccaugacg

SEQ ID NO: 32199 - RNA, 24 nt, Human
acugguuggcggccggcaagaaaa

SEQ ID NO: 32200 - RNA, 24 nt, Human
uagcuguuuucgcuuuuauguacu

SEQ ID NO: 32201 - RNA, 24 nt, Human
uggcaaggcgagggcacccuggcc

SEQ ID NO: 32202 - RNA, 24 nt, Human
cugcggccgaugagaagaagaagg

SEQ ID NO: 32203 - RNA, 24 nt, Human
guagggcaaaggacaucuuccuuu

SEQ ID NO: 32204 - RNA, 24 nt, Human
agacaccaacggguccaguucuuc

SEQ ID NO: 32205 - RNA, 24 nt, Human
uucauguugcacccuuguuucuac

SEQ ID NO: 32206 - RNA, 24 nt, Human
ucaaugauuguguagccaaugccu

SEQ ID NO: 32207 - RNA, 24 nt, Human
ugagaauggcaaaauuagucgccu

SEQ ID NO: 32208 - RNA, 24 nt, Human
uacaccacucccaagaagaauaag

SEQ ID NO: 32209 - RNA, 24 nt, Human
agcacugaccgaccauugccauuu

SEQ ID NO: 32210 - RNA, 24 nt, Human
uucacuuuaccuucugccaaaugc

SEQ ID NO: 32211 - RNA, 24 nt, Human
uggcugaggagcagcuuuagguau

SEQ ID NO: 32212 - RNA, 24 nt, Human
cagaaucccgggcuugggagcccc

SEQ ID NO: 32213 - RNA, 24 nt, Human
ugccaaggagguagcugaugaggu

SEQ ID NO: 32214 - RNA, 24 nt, Human
aaggacuccuacgugggcgacgag

SEQ ID NO: 32215 - RNA, 24 nt, Human
acucuguucuuccgccgcuccgcc

SEQ ID NO: 32216 - RNA, 24 nt, Human
gcuacagcuucaccaccacggccg

SEQ ID NO: 32217 - RNA, 24 nt, Human
ugacgagcuaugcauacugaacaa

SEQ ID NO: 32218 - RNA, 24 nt, Human
uccuggggccacuguugggggugg

SEQ ID NO: 32219 - RNA, 24 nt, Human
ucagaacacaugggugcaucauca

SEQ ID NO: 32220 - RNA, 24 nt, Human
caagaccggggaggugccgcugga

SEQ ID NO: 32221 - RNA, 24 nt, Human
ucaaaguacuguaaucccagcguu

SEQ ID NO: 32222 - RNA, 24 nt, Human
ccuugguucaagggauggaaaguc

SEQ ID NO: 32223 - RNA, 24 nt, Human
cuuguaccucuuuuugguuggcua

SEQ ID NO: 32224 - RNA, 24 nt, Human
uacuugcuccccgccggcucaggc

SEQ ID NO: 32225 - RNA, 24 nt, Human
uggcuucuaaguaauuccaauuuu

SEQ ID NO: 32226 - RNA, 24 nt, Human
ggagaagccagucuggggcuuggg

SEQ ID NO: 32227 - RNA, 24 nt, Human
acagugagaucuggaugucauuac

SEQ ID NO: 32228 - RNA, 24 nt, Human
uaggguaacguggacucauuccag

SEQ ID NO: 32229 - RNA, 24 nt, Human
uuggagcagggacuguggaguuua

SEQ ID NO: 32230 - RNA, 22 nt, Human
ugcuaugcugaucgagaaguuu

SEQ ID NO: 32231 - RNA, 24 nt, Human
ucugugguccggcuccuggugaca

SEQ ID NO: 32232 - RNA, 23 nt, Human
gaccggcuucucccgccccggcc

SEQ ID NO: 32233 - RNA, 24 nt, Human
agaggaacacaaggacugcccaga

SEQ ID NO: 32234 - RNA, 24 nt, Human
cagcagggggggcgggagcucuac

SEQ ID NO: 32235 - RNA, 24 nt, Human
uauuagggauaauauucauuuagc

SEQ ID NO: 32236 - RNA, 24 nt, Human
uaaugggucucaaaauucugugac

SEQ ID NO: 32237 - RNA, 23 nt, Human
gagcagcagaacaagguccugga

SEQ ID NO: 32238 - RNA, 24 nt, Human
ucuccggucauuccugguagauau

SEQ ID NO: 32239 - RNA, 24 nt, Human
agacuauaucuguagaaacuuuau

SEQ ID NO: 32240 - RNA, 24 nt, Human
uugauugcguggcccaugugaugc

SEQ ID NO: 32241 - RNA, 24 nt, Human
uaaugggucucaaaauucugugac

SEQ ID NO: 32242 - RNA, 23 nt, Human
ucuugcuuacaaggagggguuac

SEQ ID NO: 32243 - RNA, 23 nt, Human
ugugcagaagaaauggaaggauu

SEQ ID NO: 32244 - RNA, 24 nt, Human
uugccagucuccucauccauguau

SEQ ID NO: 32245 - RNA, 18 nt, Human
uaucaaggaagggcaggc

SEQ ID NO: 32246 - RNA, 24 nt, Human
uucaaauuucuuucuuuuuuaauu

SEQ ID NO: 32247 - RNA, 24 nt, Human
uuaaugccugugcaauugccauua

SEQ ID NO: 32248 - RNA, 24 nt, Human
gggcaaugaugagacuguggcacu

SEQ ID NO: 32249 - RNA, 18 nt, Human
uaacuggcuucuguccca

SEQ ID NO: 32250 - RNA, 24 nt, Human
acaaagcaagagaagaagcagaga

SEQ ID NO: 32251 - RNA, 21 nt, Human
cauuggacaggacauccagcc

SEQ ID NO: 32252 - RNA, 24 nt, Human
aaggacaucacagguaaacugaag

SEQ ID NO: 32253 - RNA, 23 nt, Human
aagagcacugaucguacuggcuc

SEQ ID NO: 32254 - RNA, 24 nt, Human
gaguuugcuuacacuuacgcugcc

SEQ ID NO: 32255 - RNA, 24 nt, Human
uacuaagugacuaaggggcaggua

SEQ ID NO: 32256 - RNA, 24 nt, Human
uucaucacucaggauggcuuguga

SEQ ID NO: 32257 - RNA, 24 nt, Human
uuaucugcuguuccgacuugguuu

SEQ ID NO: 32258 - RNA, 24 nt, Human
aauuaagcacauuccucgauucca

SEQ ID NO: 32259 - RNA, 22 nt, Human
ucuccagcgacaaggcuaaggc

SEQ ID NO: 32260 - RNA, 24 nt, Human
ucccuccaacaacagcaaggagga

SEQ ID NO: 32261 - RNA, 24 nt, Human
gaggugauucauuaaauuaauaga

SEQ ID NO: 32262 - RNA, 24 nt, Human
ugagucuuccagggucaagucauu

SEQ ID NO: 32263 - RNA, 24 nt, Human
agaagaagaagaaauggcaaagag

SEQ ID NO: 32264 - RNA, 24 nt, Human
uugaagcccuguagaaugacacgc

SEQ ID NO: 32265 - RNA, 24 nt, Human
uagaauacaaugauugucuguccg

SEQ ID NO: 32266 - RNA, 20 nt, Human
uaucaaggaagggcaggccu

SEQ ID NO: 32267 - RNA, 24 nt, Human
ucugaucaauccuucuuuuucucu

SEQ ID NO: 32268 - RNA, 24 nt, Human
ucaauuuuuauuuugguuuucuua

SEQ ID NO: 32269 - RNA, 24 nt, Human
uaaugggucucaaaauucugugac

SEQ ID NO: 32270 - RNA, 24 nt, Human
uuucugaagcucugaagcucauuc

SEQ ID NO: 32271 - RNA, 24 nt, Human
ucaccuggugaugaaaucccauca

SEQ ID NO: 32272 - RNA, 24 nt, Human
uugaaauuaggaucauuuuaccau

SEQ ID NO: 32273 - RNA, 24 nt, Human
uaccauacauuuuguaaaaaacac

SEQ ID NO: 32274 - RNA, 24 nt, Human
ugaauaaaaaugacauuucuuugu

SEQ ID NO: 32275 - RNA, 20 nt, Human
ugaauacggcaucgaggaua

SEQ ID NO: 32276 - RNA, 24 nt, Human
uaguauuugggcuccacuucacug

SEQ ID NO: 32277 - RNA, 24 nt, Human
ugagcucggaggggaauugccuuu

SEQ ID NO: 32278 - RNA, 24 nt, Human
uuuggggucucgcugaccucgcug

SEQ ID NO: 32279 - RNA, 23 nt, Human
uggccagguggcgaauucgggac

SEQ ID NO: 32280 - RNA, 24 nt, Human
ucaucauggcuuacgcacugaaga

SEQ ID NO: 32281 - RNA, 24 nt, Human
uauuaggguaauauucauuuagcc

SEQ ID NO: 32282 - RNA, 24 nt, Human
ucccugugaaaggcaggcucgggu

SEQ ID NO: 32283 - RNA, 24 nt, Human
cccccauucuccaacccccaagcu

SEQ ID NO: 32284 - RNA, 24 nt, Human
cugggcccgcgcgcugcuccggga

SEQ ID NO: 32285 - RNA, 17 nt, Human
ucaguugguaacauccc

SEQ ID NO: 32286 - RNA, 19 nt, Human
uacguuauuugagucuagc

SEQ ID NO: 32287 - RNA, 24 nt, Human
ugcacuguggucuugccccuuggc

SEQ ID NO: 32288 - RNA, 24 nt, Human
ucccucagacggccuugggccagu

SEQ ID NO: 32289 - RNA, 24 nt, Human
ccccugguggcagcgaccagaucc

SEQ ID NO: 32290 - RNA, 24 nt, Human
uaacauaggggucaagauccaggg

SEQ ID NO: 32291 - RNA, 23 nt, Human
ccagcgaauuacaggcggcggaa

SEQ ID NO: 32292 - RNA, 24 nt, Human
uggcauggugcccaucguggagcc

SEQ ID NO: 32293 - RNA, 24 nt, Human
uggcuuuuauguaugauaccuaau

SEQ ID NO: 32294 - RNA, 24 nt, Human
uccccagcauuuucucaccuggau

SEQ ID NO: 32295 - RNA, 24 nt, Human
uacacaggugccuaugcaaguaca

SEQ ID NO: 32296 - RNA, 23 nt, Human
ccagaaaaggugucacacuuuug

SEQ ID NO: 32297 - RNA, 24 nt, Human
agguaugugcaggggacuccugga

SEQ ID NO: 32298 - RNA, 24 nt, Human
uguggagacucagucugugaagcu

SEQ ID NO: 32299 - RNA, 21 nt, Human
uucaagggauggaaagucacc

SEQ ID NO: 32300 - RNA, 20 nt, Human
ucacugguauugccccccuc

SEQ ID NO: 32301 - RNA, 24 nt, Human
ugccgaguggccugacuggcagcc

SEQ ID NO: 32302 - RNA, 24 nt, Human
ucaugguggagcugguagaugagc

SEQ ID NO: 32303 - RNA, 24 nt, Human
gcgcagcuucaggggccgcaaggg

SEQ ID NO: 32304 - RNA, 19 nt, Human
ucugaccggcuucaagcuc

SEQ ID NO: 32305 - RNA, 24 nt, Human
uuccugguggcgcagaugagugag

SEQ ID NO: 32306 - RNA, 24 nt, Human
uaacacacauggagcugccaccuc

SEQ ID NO: 32307 - RNA, 24 nt, Human
ugacaauacuugggaaccugaaga

SEQ ID NO: 32308 - RNA, 17 nt, Human
ucugacagugaaucuga

SEQ ID NO: 32309 - RNA, 24 nt, Human
cggauagacacuacacaccuccug

SEQ ID NO: 32310 - RNA, 24 nt, Human
uggugucgaccuugcaggcagcgg

SEQ ID NO: 32311 - RNA, 24 nt, Human
cccccgacuguccagagaagguug

SEQ ID NO: 32312 - RNA, 24 nt, Human
ggugcaauugacgcagcuugguau

SEQ ID NO: 32313 - RNA, 24 nt, Human
uccaccacuacuggccaucugauc

SEQ ID NO: 32314 - RNA, 24 nt, Human
ccuugggucacagggauggaaagu

SEQ ID NO: 32315 - RNA, 24 nt, Human
uaccugguuggaaggcugugucgu

SEQ ID NO: 32316 - RNA, 24 nt, Human
ugauaucgaucgguaccugcgaga

SEQ ID NO: 32317 - RNA, 24 nt, Human
ugccugaauuuucggcauuggcgu

SEQ ID NO: 32318 - RNA, 20 nt, Human
ccgcgccgccuuugugcugc

SEQ ID NO: 32319 - RNA, 24 nt, Human
uggcaucacugagaagguguuuuc

SEQ ID NO: 32320 - RNA, 24 nt, Human
uacaaagugacuaauggggcuuuu

SEQ ID NO: 32321 - RNA, 23 nt, Human
ccgcauaccuaccagcauaaucu

SEQ ID NO: 32322 - RNA, 24 nt, Human
agaguaguuucauguaguacuuau

SEQ ID NO: 32323 - RNA, 24 nt, Human
aaucucagcaaacauauuucuuuc

SEQ ID NO: 32324 - RNA, 24 nt, Human
uggggccacacuaguccccaccag

SEQ ID NO: 32325 - RNA, 24 nt, Human
cagcgggcagggcugcccuguaac

SEQ ID NO: 32326 - RNA, 20 nt, Human
gcccaugugugcacauccug

SEQ ID NO: 32327 - RNA, 24 nt, Human
agggauaccucagaguuuccaaag

SEQ ID NO: 32328 - RNA, 20 nt, Human
ugauaugcuccagaauaaag

SEQ ID NO: 32329 - RNA, 24 nt, Human
uuagagaagagcggcauugugcuc

SEQ ID NO: 32330 - RNA, 23 nt, Human
uucgcuccccuuugucaaggccg

SEQ ID NO: 32331 - RNA, 24 nt, Human
gcugcaguuccucccucuucccua

SEQ ID NO: 32332 - RNA, 24 nt, Human
ugcauggaucugccaaauuuuaua

SEQ ID NO: 32333 - RNA, 24 nt, Human
uuggaauaucgacuuggaaggagc

SEQ ID NO: 32334 - RNA, 24 nt, Human
uuggagaaacaaagggcccgcagg

SEQ ID NO: 32335 - RNA, 24 nt, Human
ucuuguguucacuuuaaaacccau

SEQ ID NO: 32336 - RNA, 24 nt, Human
ugucagaggcuccuguggauuugg

SEQ ID NO: 32337 - RNA, 24 nt, Human
uuuugcauuccuguggauuauucu

SEQ ID NO: 32338 - RNA, 24 nt, Human
ucuauauacuggugaguuuauggg

SEQ ID NO: 32339 - RNA, 24 nt, Human
cauuuacucuugagggaacagguc

SEQ ID NO: 32340 - RNA, 24 nt, Human
uggaggcugagugccguuugcggu

SEQ ID NO: 32341 - RNA, 24 nt, Human
aagaaacucacagauaaguccauu

SEQ ID NO: 32342 - RNA, 24 nt, Human
uuaguggcuuugggguaguuuaug

SEQ ID NO: 32343 - RNA, 24 nt, Human
uuggaaguguggagucaccagaag

SEQ ID NO: 32344 - RNA, 24 nt, Human
uuagaaauguucugaagggaguac

SEQ ID NO: 32345 - RNA, 24 nt, Human
ucaauaauagagacuuuaaguaca

SEQ ID NO: 32346 - RNA, 24 nt, Human
ucacuugaagcuaucauugguggg

SEQ ID NO: 32347 - RNA, 24 nt, Human
ugccagacuuccguugagucacau

SEQ ID NO: 32348 - RNA, 18 nt, Human
ugucucuucccgccgccc

SEQ ID NO: 32349 - RNA, 24 nt, Human
uccuucacuccaguuaauggcacu

SEQ ID NO: 32350 - RNA, 24 nt, Human
uugaagaauuugacuguuagguuu

SEQ ID NO: 32351 - RNA, 24 nt, Human
ucuggaguucuguuuccuccuguu

SEQ ID NO: 32352 - RNA, 24 nt, Human
ccuacagucccagcuacuaggcag

SEQ ID NO: 32353 - RNA, 18 nt, Human
aaccuguacccgugcaca

SEQ ID NO: 32354 - RNA, 24 nt, Human
ucccgggguaaucacuccccaaua

SEQ ID NO: 32355 - RNA, 24 nt, Human
ugaggcccggggauguaggcacug

SEQ ID NO: 32356 - RNA, 24 nt, Human
gauuauggcuucagcacucugccg

SEQ ID NO: 32357 - RNA, 24 nt, Human
uagcaaagggcagccagugugugc

SEQ ID NO: 32358 - RNA, 24 nt, Human
gcucaagugugauaaggaugagca

SEQ ID NO: 32359 - RNA, 24 nt, Human
aggcguuuaguuggaucauaucau

SEQ ID NO: 32360 - RNA, 24 nt, Human
uccuugguuccagaacccagcaau

SEQ ID NO: 32361 - RNA, 24 nt, Human
ugaaauacacccguggucuccgga

SEQ ID NO: 32362 - RNA, 24 nt, Human
cauugaacuaaaugcugagguuuu

SEQ ID NO: 32363 - RNA, 24 nt, Human
aaggacccaagagcgcggggcgau

SEQ ID NO: 32364 - RNA, 21 nt, Human
uggcauggucauguguaugca

SEQ ID NO: 32365 - RNA, 23 nt, Human
uuccucguaauuuucgcuugugg

SEQ ID NO: 32366 - RNA, 24 nt, Human
uacaacuuauagaaaagguaaagg

SEQ ID NO: 32367 - RNA, 24 nt, Human
cacaguucugucuuggccagggac

SEQ ID NO: 32368 - RNA, 24 nt, Human
ccgccgcccgaggucagccgcucc

SEQ ID NO: 32369 - RNA, 21 nt, Human
ucuggagaaacugcugccuca

SEQ ID NO: 32370 - RNA, 24 nt, Human
ggggagggugagugucuguguagg

SEQ ID NO: 32371 - RNA, 24 nt, Human
gagccccauccccgcgcugguggg

SEQ ID NO: 32372 - RNA, 24 nt, Human
uggccugaugauccacagcggaga

SEQ ID NO: 32373 - RNA, 24 nt, Human
ugugugccauugcccaggcagagu

SEQ ID NO: 32374 - RNA, 24 nt, Human
uauggcaagucacuuugacagaca

SEQ ID NO: 32375 - RNA, 24 nt, Human
uacaccacucccaagaagaauaag

SEQ ID NO: 32376 - RNA, 24 nt, Human
ugacagaggccucccuggccaggu

SEQ ID NO: 32377 - RNA, 24 nt, Human
caagguucacucguuagccccuca

SEQ ID NO: 32378 - RNA, 24 nt, Human
ucccugagacuuccuuagguuguc

SEQ ID NO: 32379 - RNA, 24 nt, Human
uuugcuccugacgucccucagaug

SEQ ID NO: 32380 - RNA, 24 nt, Human
uacaccacucccaagaagaauaag

SEQ ID NO: 32381 - RNA, 21 nt, Human
uaugacaucucaugcugaccc

SEQ ID NO: 32382 - RNA, 24 nt, Human
uuacuccagaaagacauauacgga

SEQ ID NO: 32383 - RNA, 23 nt, Human
aaagagccagugguuguugagac

SEQ ID NO: 32384 - RNA, 24 nt, Human
uuaguauucgggagaaaaacgugg

SEQ ID NO: 32385 - RNA, 24 nt, Human
aaccuuuuuaaaaaauggagauga

SEQ ID NO: 32386 - RNA, 24 nt, Human
uguacagucgacugcaaaugaaac

SEQ ID NO: 32387 - RNA, 24 nt, Human
uuucauggagaaguuacaugcggu

SEQ ID NO: 32388 - RNA, 24 nt, Human
uaagaugccccugaaagauguucc

SEQ ID NO: 32389 - RNA, 21 nt, Human
uugguccugaaauuuaagucu

SEQ ID NO: 32390 - RNA, 24 nt, Human
uuagauggcugauauuuucaaucu

SEQ ID NO: 32391 - RNA, 24 nt, Human
ugauagcauuuuccccaugcuccu

SEQ ID NO: 32392 - RNA, 24 nt, Human
uggcuaugguuccucuuccgcauc

SEQ ID NO: 32393 - RNA, 24 nt, Human
cgagguuccuugggucauggugcc

SEQ ID NO: 32394 - RNA, 22 nt, Human
aggcaggacucggcugagggcc

SEQ ID NO: 32395 - RNA, 24 nt, Human
uggaauuuuguguaucugggcuuc

SEQ ID NO: 32396 - RNA, 24 nt, Human
acagagcuuuucuccaugagcuau

SEQ ID NO: 32397 - RNA, 24 nt, Human
aucaccuauuuaauaaagacgaaa

SEQ ID NO: 32398 - RNA, 22 nt, Human
ucagggccaaacccggggagga

SEQ ID NO: 32399 - RNA, 24 nt, Human
cuccggggccacgguccuaaacgg

SEQ ID NO: 32400 - RNA, 24 nt, Human
uacguaguaaaauuuucuuuauca

SEQ ID NO: 32401 - RNA, 24 nt, Human
uccuugaggagcgaaggcuaguga

SEQ ID NO: 32402 - RNA, 22 nt, Human
uuuggccuggcacggggggggg

SEQ ID NO: 32403 - RNA, 24 nt, Human
uaugcaaauugcaagaaaucgcag

SEQ ID NO: 32404 - RNA, 24 nt, Human
uaugauagauguggccgucuugua

SEQ ID NO: 32405 - RNA, 24 nt, Human
cucgauuaaaauacacacaucuua

SEQ ID NO: 32406 - RNA, 24 nt, Human
gcucuugggaugcaggcucagccc

SEQ ID NO: 32407 - RNA, 20 nt, Human
ucccgggguuaucacucccc

SEQ ID NO: 32408 - RNA, 24 nt, Human
gcagcaacccaggcauuugugccc

SEQ ID NO: 32409 - RNA, 24 nt, Human
uaaugggucucaaaauucugugac

SEQ ID NO: 32410 - RNA, 24 nt, Human
ugagcacuuuaacuggcacauucu

SEQ ID NO: 32411 - RNA, 24 nt, Human
ugaccugaaauuuuuaguauuuac

SEQ ID NO: 32412 - RNA, 19 nt, Human
uagaauauaaaagauauua

SEQ ID NO: 32413 - RNA, 24 nt, Human
ugcauguguauuaucacacacaua

SEQ ID NO: 32414 - RNA, 24 nt, Human
acgaagaucugagugcuagguaua

SEQ ID NO: 32415 - RNA, 24 nt, Human
acucaguuucccuacaggugaucu

SEQ ID NO: 32416 - RNA, 24 nt, Human
ccaggccaucgaagcucgcgcgcc

SEQ ID NO: 32417 - RNA, 21 nt, Human
acgcggccaaugugggcugga

SEQ ID NO: 32418 - RNA, 21 nt, Human
uucaagggauggaaagucacc

SEQ ID NO: 32419 - RNA, 24 nt, Human
ucaacacccggcuucggaagcugg

SEQ ID NO: 32420 - RNA, 24 nt, Human
uugcuggggacgacgcuccccgag

SEQ ID NO: 32421 - RNA, 24 nt, Human
cuuuucaugaacuauucuggucgu

SEQ ID NO: 32422 - RNA, 19 nt, Human
aaggaggugugcgacgcgu

SEQ ID NO: 32423 - RNA, 24 nt, Human
augcauaguauaguaggaagcuau

SEQ ID NO: 32424 - RNA, 24 nt, Human
ugacaagcccuugcgccugccucu

SEQ ID NO: 32425 - RNA, 21 nt, Human
uucaagggauggaaagucacc

SEQ ID NO: 32426 - RNA, 24 nt, Human
uccaccacuacuggccaucugauc

SEQ ID NO: 32427 - RNA, 21 nt, Human
uucaagggauggaaagucacc

SEQ ID NO: 32428 - RNA, 21 nt, Human
uucaagggauggaaagucacc

SEQ ID NO: 32429 - RNA, 24 nt, Human
ugagaugggaaagggcuccuucaa

SEQ ID NO: 32430 - RNA, 21 nt, Human
uucaagggauggaaagucacc

SEQ ID NO: 32431 - RNA, 24 nt, Human
agaagguaauauucaguuaccaga

SEQ ID NO: 32432 - RNA, 24 nt, Human
ugggacuugagcuggacccauggg

SEQ ID NO: 32433 - RNA, 24 nt, Human
cugcauuccacucaucagcuucac

SEQ ID NO: 32434 - RNA, 24 nt, Human
agugugaaguauagggaagaacaa

SEQ ID NO: 32435 - RNA, 24 nt, Human
ucuguaugcucaccacgguguagg

SEQ ID NO: 32436 - RNA, 24 nt, Human
ugagaugggaaagggcuccuucaa

SEQ ID NO: 32437 - RNA, 21 nt, Human
aaguaugccugggucuuggau

SEQ ID NO: 32438 - RNA, 21 nt, Human
uucaagggauggaaagucacc

SEQ ID NO: 32439 - RNA, 21 nt, Human
uucaagggauggaaagucacc

SEQ ID NO: 32440 - RNA, 21 nt, Human
aaguaugccugggucuuggau

SEQ ID NO: 32441 - RNA, 21 nt, Human
uucaagggauggaaagucacc

SEQ ID NO: 32442 - RNA, 23 nt, Human
uugaaaaauuugagaaggaggcu

SEQ ID NO: 32443 - RNA, 24 nt, Human
ccauccguggggccaucauccugg

SEQ ID NO: 32444 - RNA, 24 nt, Human
ggccggggccgaggccgcggagcu

SEQ ID NO: 32445 - RNA, 24 nt, Human
cacuauuugagaauaagagguccc

SEQ ID NO: 32446 - RNA, 24 nt, Human
uacacugaagauaaagcaaaaggc

SEQ ID NO: 32447 - RNA, 20 nt, Human
acuugggucugguuucuuuc

SEQ ID NO: 32448 - RNA, 24 nt, Human
uuccucagguuuguuuguagagca

SEQ ID NO: 32449 - RNA, 18 nt, Human
uggcugggauguuucuug

SEQ ID NO: 32450 - RNA, 24 nt, Human
cauuuucuuuugguaguuguuucu

SEQ ID NO: 32451 - RNA, 24 nt, Human
ugcucuggcaaccucgcaguguca

SEQ ID NO: 32452 - RNA, 24 nt, Human
ugacaguggcuuugguuugcuccu

SEQ ID NO: 32453 - RNA, 24 nt, Human
uuugaugugcacgucggcuugagu

SEQ ID NO: 32454 - RNA, 24 nt, Human
uugggggcccucgcuguguguugu

SEQ ID NO: 32455 - RNA, 24 nt, Human
uaaugggucucaaaauucugugac

SEQ ID NO: 32456 - RNA, 24 nt, Human
ucugaucuauaaaugcgguggcau

SEQ ID NO: 32457 - RNA, 21 nt, Human
uucaagggauggaaagucacc

SEQ ID NO: 32458 - RNA, 21 nt, Human
uucaagggauggaaagucacc

SEQ ID NO: 32459 - RNA, 24 nt, Human
ucugaucuauaaaugcgguggcgu

SEQ ID NO: 32460 - RNA, 24 nt, Human
ucccggagaguaaauccucuuucc

SEQ ID NO: 32461 - RNA, 24 nt, Human
ugggaggaagaucuccagcuucag

SEQ ID NO: 32462 - RNA, 24 nt, Human
agagaacaaaacuaauguuaauau

SEQ ID NO: 32463 - RNA, 24 nt, Human
uauauggauccaauggcaagauca

SEQ ID NO: 32464 - RNA, 24 nt, Human
uguguagggcuggaagcauuaccc

SEQ ID NO: 32465 - RNA, 21 nt, Human
uucaagggauggaaagucacc

SEQ ID NO: 32466 - RNA, 24 nt, Human
ucugaucuauaaaugcgguggcau

SEQ ID NO: 32467 - RNA, 24 nt, Human
gagugcgucauauguuguuccuag

SEQ ID NO: 32468 - RNA, 24 nt, Human
ugagaugggaaagggcuccuucaa

SEQ ID NO: 32469 - RNA, 21 nt, Human
uucaagggauggaaagucacc

SEQ ID NO: 32470 - RNA, 24 nt, Human
uaauuuuuuuuauaacuacacaga

SEQ ID NO: 32471 - RNA, 24 nt, Human
cuccccgacccauacagggccucc

SEQ ID NO: 32472 - RNA, 24 nt, Human
ggagcggagugggucgggcggggc

SEQ ID NO: 32473 - RNA, 24 nt, Human
gccugcuuuggccgcucaagggaa

SEQ ID NO: 32474 - RNA, 24 nt, Human
ucgaccauuuuccgcaccucucca

SEQ ID NO: 32475 - RNA, 21 nt, Human
gucaagggauggaaagucacc

SEQ ID NO: 32476 - RNA, 24 nt, Human
ucugaucuauaaaugcgguggcau

SEQ ID NO: 32477 - RNA, 24 nt, Human
uguugaauuuuuaucaaaagcuuu

SEQ ID NO: 32478 - RNA, 24 nt, Human
ucaaggagaaugcuuccaguuuuu

SEQ ID NO: 32479 - RNA, 24 nt, Human
uaaugggucucaaaauucugugac

SEQ ID NO: 32480 - RNA, 24 nt, Human
ugguggucauccuggcagcuggug

SEQ ID NO: 32481 - RNA, 24 nt, Human
uggaaagugagguauuaauacuug

SEQ ID NO: 32482 - RNA, 24 nt, Human
uaaaggcccuuauucccacaaauc

SEQ ID NO: 32483 - RNA, 24 nt, Human
gggaagccaaaggucagcucaaaa

SEQ ID NO: 32484 - RNA, 24 nt, Human
uuccaggaucgcgaggcagcagcg

SEQ ID NO: 32485 - RNA, 24 nt, Human
ucucaaacuugaucaggugcaacc

SEQ ID NO: 32486 - RNA, 24 nt, Human
cagcugcucggcugucccuaggag

SEQ ID NO: 32487 - RNA, 24 nt, Human
cuggcccccagaucugccccucca

SEQ ID NO: 32488 - RNA, 24 nt, Human
ugaacacagagguggaucaggcug

SEQ ID NO: 32489 - RNA, 23 nt, Human
uaaguagaagggaaguguaaggu

SEQ ID NO: 32490 - RNA, 24 nt, Human
ucaaagcuuaacauuugaaaccug

SEQ ID NO: 32491 - RNA, 24 nt, Human
uugcaugaaacauucuuaacguga

SEQ ID NO: 32492 - RNA, 17 nt, Human
ugagggaaaaaggacuu

SEQ ID NO: 32493 - RNA, 24 nt, Human
uguuuggauaaaaguugaugugug

SEQ ID NO: 32494 - RNA, 24 nt, Human
ugcauucuuaucaccuaguauaua

SEQ ID NO: 32495 - RNA, 24 nt, Human
ugaaggaaauuacaaaaaaaaaac

SEQ ID NO: 32496 - RNA, 24 nt, Human
ucaaagcacaugacuaaaaugaaa

SEQ ID NO: 32497 - RNA, 24 nt, Human
guggacuguccucuacagaaggaa

SEQ ID NO: 32498 - RNA, 24 nt, Human
uaucagacagcaauuagugaaaac

SEQ ID NO: 32499 - RNA, 24 nt, Human
cugggccaccugucagccccucgu

SEQ ID NO: 32500 - RNA, 24 nt, Human
ugagaagaccuuccgcaucgagag

SEQ ID NO: 32501 - RNA, 24 nt, Human
cucggcaucuguggacucugcgcu

SEQ ID NO: 32502 - RNA, 24 nt, Human
cauaccagcucaacagguucaauu

SEQ ID NO: 32503 - RNA, 24 nt, Human
gaaccacaccaucacgaucccgug

SEQ ID NO: 32504 - RNA, 24 nt, Human
uaacucggccgugaccagugcccc

SEQ ID NO: 32505 - RNA, 17 nt, Human
cauugcugaaagguggu

SEQ ID NO: 32506 - RNA, 24 nt, Human
uaccuuaucaaggacggaagguug

SEQ ID NO: 32507 - RNA, 24 nt, Human
uucaagacaugaugagaggaaguu

SEQ ID NO: 32508 - RNA, 24 nt, Human
acucugugcuuauaucaucacaga

SEQ ID NO: 32509 - RNA, 20 nt, Human
ugacuuauguaauucccuuu

SEQ ID NO: 32510 - RNA, 24 nt, Human
ugaagaacauuaccuaagagauua

SEQ ID NO: 32511 - RNA, 24 nt, Human
ucccugaggccaacucuuccugau

SEQ ID NO: 32512 - RNA, 24 nt, Human
uaaaaggagcagacuauuuuaaaa

SEQ ID NO: 32513 - RNA, 24 nt, Human
uaccggaucauacaauuaacugag

SEQ ID NO: 32514 - RNA, 24 nt, Human
uaggaacuguagaccccaaguuga

SEQ ID NO: 32515 - RNA, 24 nt, Human
ugagguauaauuuacugcaaagaa

SEQ ID NO: 32516 - RNA, 24 nt, Human
ugaaaacaaaagaacuucacugag

SEQ ID NO: 32517 - RNA, 24 nt, Human
ucugaucuauaaaugcgguggcau

SEQ ID NO: 32518 - RNA, 24 nt, Human
uauuuugucauauuuuuguaaaac

SEQ ID NO: 32519 - RNA, 24 nt, Human
cgcgcggacuggacgccacgccgc

SEQ ID NO: 32520 - RNA, 24 nt, Human
ccgccgcaccuuuguacgagccug

SEQ ID NO: 32521 - RNA, 24 nt, Human
cgggcacaggugggguccgucagg

SEQ ID NO: 32522 - RNA, 24 nt, Human
aacgccguugccaccgaggaggcg

SEQ ID NO: 32523 - RNA, 24 nt, Human
aucuauguuagcguuccuggaucc

SEQ ID NO: 32524 - RNA, 24 nt, Human
ugugaaggugaugagauuuccauc

SEQ ID NO: 32525 - RNA, 24 nt, Human
uaggaaagguuuacaagaaguuag

SEQ ID NO: 32526 - RNA, 24 nt, Human
uaaguaaaaacgcugggucaaaac

SEQ ID NO: 32527 - RNA, 24 nt, Human
ccagcuggucuuaugguaaaguua

SEQ ID NO: 32528 - RNA, 24 nt, Human
ugagagagcuuucucgugggcacc

SEQ ID NO: 32529 - RNA, 24 nt, Human
caccgcaacgggcaaacaugagcc

SEQ ID NO: 32530 - RNA, 24 nt, Human
gugaauauaacuucagagcuucgu

SEQ ID NO: 32531 - RNA, 24 nt, Human
uggcaacguuaggcacagucagac

SEQ ID NO: 32532 - RNA, 24 nt, Human
ccagugcagucucuuggcaucucu

SEQ ID NO: 32533 - RNA, 24 nt, Human
uggcaguacgggcccugcaccggg

SEQ ID NO: 32534 - RNA, 24 nt, Human
ugcggaucaagggccuguaccaag

SEQ ID NO: 32535 - RNA, 24 nt, Human
uguaauccccccuguacuuaccua

SEQ ID NO: 32536 - RNA, 24 nt, Human
uauuuuguugcugaucaaauacug

SEQ ID NO: 32537 - RNA, 24 nt, Human
aagcugccccccauuucuguaacc

SEQ ID NO: 32538 - RNA, 24 nt, Human
aaccugcaggcagaaccugaaagg

SEQ ID NO: 32539 - RNA, 24 nt, Human
cauugcacuccagccugggcgaca

SEQ ID NO: 32540 - RNA, 24 nt, Human
ugaguggaucaucugaggucagga

SEQ ID NO: 32541 - RNA, 19 nt, Human
uacuauguggccacaugcc

SEQ ID NO: 32542 - RNA, 24 nt, Human
uguauauuacacuggcuacuacuu

SEQ ID NO: 32543 - RNA, 23 nt, Human
ugucauaaacugccccagcucuu

SEQ ID NO: 32544 - RNA, 24 nt, Human
acacugcacuccagccugggcaag

SEQ ID NO: 32545 - RNA, 24 nt, Human
ucccuguacaguguuaccaucccc

SEQ ID NO: 32546 - RNA, 21 nt, Human
ugggaggggcugaauguggug

SEQ ID NO: 32547 - RNA, 24 nt, Human
aaggaaccauggccaacugugagc

SEQ ID NO: 32548 - RNA, 24 nt, Human
aagcguuuugagcagaaaggauuc

SEQ ID NO: 32549 - RNA, 21 nt, Human
gauucuguggagagugcagag

SEQ ID NO: 32550 - RNA, 24 nt, Human
ucaaagguagcacuuguugaaacu

SEQ ID NO: 32551 - RNA, 24 nt, Human
uagccacacaaauaaugagaguuu

SEQ ID NO: 32552 - RNA, 24 nt, Human
ugacuuuggcuucagcaacgaguu

SEQ ID NO: 32553 - RNA, 24 nt, Human
ucuggagccugggagucauccugu

SEQ ID NO: 32554 - RNA, 24 nt, Human
uugugggggauggaagaaugggau

SEQ ID NO: 32555 - RNA, 24 nt, Human
aagaaccaacccaggacagagcca

SEQ ID NO: 32556 - RNA, 24 nt, Human
uucaucuugugucuuauucaagua

SEQ ID NO: 32557 - RNA, 24 nt, Human
uauggcaagucacuuugacagaca

SEQ ID NO: 32558 - RNA, 24 nt, Human
ugagaauggcaaaauuagucgccu

SEQ ID NO: 32559 - RNA, 24 nt, Human
uacaccacucccaagaagaauaag

SEQ ID NO: 32560 - RNA, 24 nt, Human
ggaggccaacgagagugaggaggu

SEQ ID NO: 32561 - RNA, 24 nt, Human
uaagagaaagguccucaaagauuc

SEQ ID NO: 32562 - RNA, 24 nt, Human
uuggugccuucuuucaucaugccu

SEQ ID NO: 32563 - RNA, 24 nt, Human
cugcggccgaugagaagaagaagg

SEQ ID NO: 32564 - RNA, 24 nt, Human
uaccugaaaaaccggauuugauuc

SEQ ID NO: 32565 - RNA, 24 nt, Human
ugagauacgauaugauaaacaggc

SEQ ID NO: 32566 - RNA, 24 nt, Human
ugggaugaggguggagcaccacuc

SEQ ID NO: 32567 - RNA, 24 nt, Human
uugauuguaucauggugauuuaug

SEQ ID NO: 32568 - RNA, 24 nt, Human
uaagacccaaccagauaccaugau

SEQ ID NO: 32569 - RNA, 24 nt, Human
uuaaccuaagcuaguguguaugug

SEQ ID NO: 32570 - RNA, 24 nt, Human
aguagguagugucaagccagagau

SEQ ID NO: 32571 - RNA, 24 nt, Human
uaaggaccuguuuggugcagcagg

SEQ ID NO: 32572 - RNA, 24 nt, Human
aucauuguaaccaauccugucaga

SEQ ID NO: 32573 - RNA, 24 nt, Human
ugcauuguuaucauuaaccagucu

SEQ ID NO: 32574 - RNA, 24 nt, Human
uauuagggauaauauucauuuagc

SEQ ID NO: 32575 - RNA, 24 nt, Human
uaaugggucucaaaauucugugac

SEQ ID NO: 32576 - RNA, 24 nt, Human
ugugauaaacuggugacacgccuc

SEQ ID NO: 32577 - RNA, 24 nt, Human
uauuaaacacuucauuauaaaaua

SEQ ID NO: 32578 - RNA, 24 nt, Human
uaagauaggcuaggcuaagcuggg

SEQ ID NO: 32579 - RNA, 24 nt, Human
uacacauucaguuaaaaacuguac

SEQ ID NO: 32580 - RNA, 24 nt, Human
uguugugaaugggaaugggguaua

SEQ ID NO: 32581 - RNA, 24 nt, Human
uaaucugggggcgggguauagggg

SEQ ID NO: 32582 - RNA, 24 nt, Human
uuaccaccuugucagaauuuuuuc

SEQ ID NO: 32583 - RNA, 24 nt, Human
uaggaucaacauuggauaaagguc

SEQ ID NO: 32584 - RNA, 23 nt, Human
gaugacacuuaagaacuacuugu

SEQ ID NO: 32585 - RNA, 24 nt, Human
cuuugauucagcaagccacaacag

SEQ ID NO: 32586 - RNA, 21 nt, Human
uaucucaagcccagaaagaug

SEQ ID NO: 32587 - RNA, 24 nt, Human
ugaugugcggucgccugcccuucu

SEQ ID NO: 32588 - RNA, 24 nt, Human
ucacauggauggaauaaacuugug

SEQ ID NO: 32589 - RNA, 24 nt, Human
cauucuucacugagugcugcugac

SEQ ID NO: 32590 - RNA, 24 nt, Human
guaguacuuuuacacguuguauga

SEQ ID NO: 32591 - RNA, 24 nt, Human
ugggcacaagggcuuaauuuaugg

SEQ ID NO: 32592 - RNA, 24 nt, Human
acaaagcaagagaagaagcagaga

SEQ ID NO: 32593 - RNA, 21 nt, Human
cauuggacaggacauccagcc

SEQ ID NO: 32594 - RNA, 24 nt, Human
cagcggcagagagccauccucuau

SEQ ID NO: 32595 - RNA, 24 nt, Human
agcuggaagcgcaaggcagccgcc

SEQ ID NO: 32596 - RNA, 24 nt, Human
gacaccacuccucucugcagcacu

SEQ ID NO: 32597 - RNA, 24 nt, Human
cuccggguuuguuuggaaaauuuu

SEQ ID NO: 32598 - RNA, 24 nt, Human
acccgaguauggcugaccuuccug

SEQ ID NO: 32599 - RNA, 24 nt, Human
ucccccagacgugaugucucucuc

SEQ ID NO: 32600 - RNA, 24 nt, Human
cucccucaucccgucagcagcuag

SEQ ID NO: 32601 - RNA, 24 nt, Human
cacagaguauggaaguagcuccga

SEQ ID NO: 32602 - RNA, 24 nt, Human
uucccaugccccaggcuccugcag

SEQ ID NO: 32603 - RNA, 24 nt, Human
uaugggucccccaauggggauccc

SEQ ID NO: 32604 - RNA, 24 nt, Human
ugagaacuccaggauuguccugca

SEQ ID NO: 32605 - RNA, 23 nt, Human
ugcagguagguaggggauggcag

SEQ ID NO: 32606 - RNA, 24 nt, Human
ugagugcccagggcugaggguggc

SEQ ID NO: 32607 - RNA, 24 nt, Human
ucaggugguuuuuagugucugcaa

SEQ ID NO: 32608 - RNA, 24 nt, Human
uauccugccaacucuaucgugguc

SEQ ID NO: 32609 - RNA, 24 nt, Human
uugcaaaggccuuuucgccgcgaa

SEQ ID NO: 32610 - RNA, 24 nt, Human
ucaccccucccccgaaggaaaaac

SEQ ID NO: 32611 - RNA, 24 nt, Human
gcccagggccccuccacaccagcc

SEQ ID NO: 32612 - RNA, 24 nt, Human
ugugugccauugcccaggcagagu

SEQ ID NO: 32613 - RNA, 24 nt, Human
auccugccagucccggcguucaau

SEQ ID NO: 32614 - RNA, 24 nt, Human
uaaugggucucaaaauucugugac

SEQ ID NO: 32615 - RNA, 24 nt, Human
uuagcaacauggcugagccuuuca

SEQ ID NO: 32616 - RNA, 24 nt, Human
uaccaugcaggcuacuccauguuu

SEQ ID NO: 32617 - RNA, 24 nt, Human
cguuccgagcccccgccgccgucg

SEQ ID NO: 32618 - RNA, 24 nt, Human
ugcauuguuaucauuaaccagucu

SEQ ID NO: 32619 - RNA, 24 nt, Human
uaaugggucucaaaauucugugac

SEQ ID NO: 32620 - RNA, 24 nt, Human
uauuagggauaauauucauuuagc

SEQ ID NO: 32621 - RNA, 24 nt, Human
ugccaguaucacauaaugauaauc

SEQ ID NO: 32622 - RNA, 24 nt, Human
ugggaaggaccagcaggaggcagc

SEQ ID NO: 32623 - RNA, 24 nt, Human
uguggaugagagguuuccaggcug

SEQ ID NO: 32624 - RNA, 24 nt, Human
ugagauccucaucacgggacaccu

SEQ ID NO: 32625 - RNA, 24 nt, Human
acgcgcugcccggccagaaaacgg

SEQ ID NO: 32626 - RNA, 24 nt, Human
agcccggagcgcgccggcuggacc

SEQ ID NO: 32627 - RNA, 24 nt, Human
ccuuacucccucuuuaagauugcg

SEQ ID NO: 32628 - RNA, 24 nt, Human
ugaaggcacaccacugaaauggca

SEQ ID NO: 32629 - RNA, 24 nt, Human
ugagauaacugaaagggaagcaga

SEQ ID NO: 32630 - RNA, 24 nt, Human
uagcagagauuaccaaugcuugcu

SEQ ID NO: 32631 - RNA, 23 nt, Human
auggagcccugaauguugaccug

SEQ ID NO: 32632 - RNA, 23 nt, Human
uaccguggugacgugguuuccca

SEQ ID NO: 32633 - RNA, 24 nt, Human
aucacuguccuuccacuaaucacu

SEQ ID NO: 32634 - RNA, 24 nt, Human
uuacugcuuccauuuuaggacacu

SEQ ID NO: 32635 - RNA, 24 nt, Human
aaugugauccugcuuacuguaacu

SEQ ID NO: 32636 - RNA, 24 nt, Human
cuggcccuucucuucaucaaaucc

SEQ ID NO: 32637 - RNA, 24 nt, Human
aucauuguaaaucuuuuuuuuuuu

SEQ ID NO: 32638 - RNA, 24 nt, Human
gugaagaucagauauguaugaaug

SEQ ID NO: 32639 - RNA, 23 nt, Human
uucaaauaguccugggcgugcuu

SEQ ID NO: 32640 - RNA, 24 nt, Human
ucagguggaugcgagaaauaucca

SEQ ID NO: 32641 - RNA, 24 nt, Human
ucccugcuuccccuucaccauucc

SEQ ID NO: 32642 - RNA, 24 nt, Human
auaguucuuaacgguuuuucucug

SEQ ID NO: 32643 - RNA, 24 nt, Human
uggaagacucagaguccccagagu

SEQ ID NO: 32644 - RNA, 20 nt, Human
cagccgaagaguugcaggug

SEQ ID NO: 32645 - RNA, 20 nt, Human
cuggagcagccgggcggagg

SEQ ID NO: 32646 - RNA, 24 nt, Human
uugauucugcuuuaccacauaugu

SEQ ID NO: 32647 - RNA, 21 nt, Human
gucaauauccauaaaugaagg

SEQ ID NO: 32648 - RNA, 24 nt, Human
uguuagucaagaguccucaguagg

SEQ ID NO: 32649 - RNA, 24 nt, Human
uaaaugguaaacgugauaucauga

SEQ ID NO: 32650 - RNA, 24 nt, Human
ucauggacuaaacuaggucagagu

SEQ ID NO: 32651 - RNA, 24 nt, Human
cuccugccgguucccgagggcugg

SEQ ID NO: 32652 - RNA, 24 nt, Human
uugaugcuucgugucucuugcggg

SEQ ID NO: 32653 - RNA, 24 nt, Human
ucuuucuucucucuucgguccucc

SEQ ID NO: 32654 - RNA, 24 nt, Human
ugaaagggggaaacaaagaacagc

SEQ ID NO: 32655 - RNA, 24 nt, Human
uuucuauuuuagugguuaaaaugu

SEQ ID NO: 32656 - RNA, 23 nt, Human
uggccugaugauccacagcggag

SEQ ID NO: 32657 - RNA, 24 nt, Human
ugugugccauugcccaggcagagu

SEQ ID NO: 32658 - RNA, 24 nt, Human
caugaagacaauguugugcuccuc

SEQ ID NO: 32659 - RNA, 22 nt, Human
ucccugaggagaaagguguggc

SEQ ID NO: 32660 - RNA, 20 nt, Human
uacaacuugcuguuacuuga

SEQ ID NO: 32661 - RNA, 24 nt, Human
uggcaggaaugggaggcauccaga

SEQ ID NO: 32662 - RNA, 24 nt, Human
uugggcccaugaagaaagugcugg

SEQ ID NO: 32663 - RNA, 24 nt, Human
cagcuuccuuauguacagcgauga

SEQ ID NO: 32664 - RNA, 24 nt, Human
ugccgugugacuggugggaugaac

SEQ ID NO: 32665 - RNA, 24 nt, Human
ugaaggagacgaauguauuuggug

SEQ ID NO: 32666 - RNA, 24 nt, Human
agccagagauucggggcaguagau

SEQ ID NO: 32667 - RNA, 24 nt, Human
uuaacauugcauaaacacuuuuca

SEQ ID NO: 32668 - RNA, 24 nt, Human
uaagaaaacacacucuuuuuuaca

SEQ ID NO: 32669 - RNA, 24 nt, Human
cugguccacguacuccuguagcuc

SEQ ID NO: 32670 - RNA, 24 nt, Human
ugccugggugcugcgggagaaguc

SEQ ID NO: 32671 - RNA, 24 nt, Human
gucucuuuuuuggggaugagagca

SEQ ID NO: 32672 - RNA, 20 nt, Human
ccccugaggcgcagccgccu

SEQ ID NO: 32673 - RNA, 24 nt, Human
aaggucuaugugaucggaggcuuu

SEQ ID NO: 32674 - RNA, 24 nt, Human
agugcaguggcgugaucucggcuc

SEQ ID NO: 32675 - RNA, 24 nt, Human
ugcauuguuaucauuaaccagucu

SEQ ID NO: 32676 - RNA, 24 nt, Human
uauuagggauaauauucauuuagc

SEQ ID NO: 32677 - RNA, 24 nt, Human
ucucgcuuugucacccuggcugga

SEQ ID NO: 32678 - RNA, 21 nt, Human
uaccacuggcacuucuauagg

SEQ ID NO: 32679 - RNA, 24 nt, Human
augaagaugaaccuacuguaguac

SEQ ID NO: 32680 - RNA, 24 nt, Human
ugugcagaagaaauggaaggauuc

SEQ ID NO: 32681 - RNA, 24 nt, Human
uucaaauuucuuucuuuuuuaauu

SEQ ID NO: 32682 - RNA, 22 nt, Human
uggcuuauuuguuuguauucaa

SEQ ID NO: 32683 - RNA, 24 nt, Human
uauuuuggguuucuuacaaagggu

SEQ ID NO: 32684 - RNA, 24 nt, Human
ugcauuguuaucauuaaccagucu

SEQ ID NO: 32685 - RNA, 24 nt, Human
uaaugggucucaaaauucugugac

SEQ ID NO: 32686 - RNA, 24 nt, Human
uauuagggauaauauucauuuagc

SEQ ID NO: 32687 - RNA, 24 nt, Human
uaaguguuugcagccauauguguc

SEQ ID NO: 32688 - RNA, 24 nt, Human
uauugccuugcacagaaguuuuua

SEQ ID NO: 32689 - RNA, 24 nt, Human
aagcgcuccaaggauuuuuugauu

SEQ ID NO: 32690 - RNA, 24 nt, Human
uaccugucaacgguuuguggagaa

SEQ ID NO: 32691 - RNA, 24 nt, Human
gggccggggugcugaaggagaagc

SEQ ID NO: 32692 - RNA, 24 nt, Human
uacaaugcugcuggcuucaaagcc

SEQ ID NO: 32693 - RNA, 24 nt, Human
accaguauugucacuuuauuuuuu

SEQ ID NO: 32694 - RNA, 24 nt, Human
cacuccagccuggugugacagagc

SEQ ID NO: 32695 - RNA, 17 nt, Human
uacaacccuuucauuuu

SEQ ID NO: 32696 - RNA, 24 nt, Human
cggcaucgggggcggcaucggggg

SEQ ID NO: 32697 - RNA, 24 nt, Human
ucucugugugaugaccuuggaugc

SEQ ID NO: 32698 - RNA, 24 nt, Human
uaccagggugauuggauggauuuc

SEQ ID NO: 32699 - RNA, 24 nt, Human
ucccaaauuaacuuguguccaaaa

SEQ ID NO: 32700 - RNA, 24 nt, Human
ugacuucagugaauauuuugguau

SEQ ID NO: 32701 - RNA, 24 nt, Human
uguaagauggauaauguguauaag

SEQ ID NO: 32702 - RNA, 24 nt, Human
cagaaugugcuugccauaggugua

SEQ ID NO: 32703 - RNA, 24 nt, Human
uguaacauguauacuuggucuuga

SEQ ID NO: 32704 - RNA, 20 nt, Human
uguaaaagcuucaauuccug

SEQ ID NO: 32705 - RNA, 24 nt, Human
ugaaucaucaaaugcauugaaaag

SEQ ID NO: 32706 - RNA, 23 nt, Human
uugaaaaauuugagaaggaggcu

SEQ ID NO: 32707 - RNA, 21 nt, Human
caccggcauggacaagucacc

SEQ ID NO: 32708 - RNA, 23 nt, Human
uagauugucaaauucuucuuacu

SEQ ID NO: 32709 - RNA, 24 nt, Human
uauuuuguauucuucauggugccc

SEQ ID NO: 32710 - RNA, 24 nt, Human
uugguggugaagugaguagcugca

SEQ ID NO: 32711 - RNA, 24 nt, Human
ucuguaguggauguacuacagcuc

SEQ ID NO: 32712 - RNA, 23 nt, Human
ucaagggucguguguuugaagug

SEQ ID NO: 32713 - RNA, 24 nt, Human
augaagauccugugaacucuggcg

SEQ ID NO: 32714 - RNA, 24 nt, Human
uguggagggacucaguggccuccg

SEQ ID NO: 32715 - RNA, 24 nt, Human
caucacacgccucuuugugguguc

SEQ ID NO: 32716 - RNA, 24 nt, Human
auuaauuucacugacugacaggcu

SEQ ID NO: 32717 - RNA, 24 nt, Human
cagcaggcgggggcagccuggcag

SEQ ID NO: 32718 - RNA, 24 nt, Human
ucguucugccaucguuuccugaac

SEQ ID NO: 32719 - RNA, 24 nt, Human
uaaaugguaaacgugauaucauga

SEQ ID NO: 32720 - RNA, 21 nt, Human
gucaauauccauaaaugaagg

SEQ ID NO: 32721 - RNA, 24 nt, Human
ucauggacuaaacuaggucagagu

SEQ ID NO: 32722 - RNA, 24 nt, Human
cugggccucugauuuccccaucug

SEQ ID NO: 32723 - RNA, 24 nt, Human
ugggggacacaggcacagggcaag

SEQ ID NO: 32724 - RNA, 24 nt, Human
cucccggguggcaucaagugacuc

SEQ ID NO: 32725 - RNA, 24 nt, Human
aacaaaacaaagaaauaagggucu

SEQ ID NO: 32726 - RNA, 24 nt, Human
ugaggcuagggaggguccuccucc

SEQ ID NO: 32727 - RNA, 24 nt, Human
uauuauuggaccaacuccgaaagu

SEQ ID NO: 32728 - RNA, 24 nt, Human
gaguguguguuaucuucauaaccc

SEQ ID NO: 32729 - RNA, 24 nt, Human
guccuuuuaguaugaacugggaug

SEQ ID NO: 32730 - RNA, 24 nt, Human
accaggggccaaccgggauaaaau

SEQ ID NO: 32731 - RNA, 24 nt, Human
uauugcuuucaauuuauccacugu

SEQ ID NO: 32732 - RNA, 24 nt, Human
uaaccaaaaacauaaagcgauaau

SEQ ID NO: 32733 - RNA, 24 nt, Human
ucccggagcccuuagagagacuca

SEQ ID NO: 32734 - RNA, 24 nt, Human
guuccaggccaccccugcccccag

SEQ ID NO: 32735 - RNA, 22 nt, Human
ugaaggaguggggcugccggug

SEQ ID NO: 32736 - RNA, 24 nt, Human
ugacagggagucugcccaaaguug

SEQ ID NO: 32737 - RNA, 24 nt, Human
uucguccaggugcuggaagaugcu

SEQ ID NO: 32738 - RNA, 24 nt, Human
ugaaguagagccauucaaaaugcc

SEQ ID NO: 32739 - RNA, 24 nt, Human
ucucgcucuguugcccaggcugga

SEQ ID NO: 32740 - RNA, 24 nt, Human
aaagugcuggcguuacagguauga

SEQ ID NO: 32741 - RNA, 24 nt, Human
ucuggauucgguucuuggcuggga

SEQ ID NO: 32742 - RNA, 24 nt, Human
ugguguggcgcauagugcagagcc

SEQ ID NO: 32743 - RNA, 24 nt, Human
uucacagcaaaguguggugcgauc

SEQ ID NO: 32744 - RNA, 24 nt, Human
uagcauguccuccuccccuacuug

SEQ ID NO: 32745 - RNA, 24 nt, Human
uccuugaucaucuuccucugcagu

SEQ ID NO: 32746 - RNA, 24 nt, Human
ucuguucuuagaauuucugucucu

SEQ ID NO: 32747 - RNA, 24 nt, Human
ucccuaagucagcaagaggaacau

SEQ ID NO: 32748 - RNA, 24 nt, Human
uuacugcuagaacggagugaacgg

SEQ ID NO: 32749 - RNA, 24 nt, Human
agacaauuuuuggagauacugagg

SEQ ID NO: 32750 - RNA, 24 nt, Human
aaaugccaaggugagacucguaca

SEQ ID NO: 32751 - RNA, 24 nt, Human
agagguggacuauuuguacacaua

SEQ ID NO: 32752 - RNA, 24 nt, Human
ugugcagaagaaauggaaggauuc

SEQ ID NO: 32753 - RNA, 24 nt, Human
uucaaauuucuuucuuuuuuaauu

SEQ ID NO: 32754 - RNA, 24 nt, Human
uguaaucuuauugucuccugagua

SEQ ID NO: 32755 - RNA, 24 nt, Human
uagcuuuucuuacuucaguuuuua

SEQ ID NO: 32756 - RNA, 24 nt, Human
uugaaaauagucauuuugaauccu

SEQ ID NO: 32757 - RNA, 23 nt, Human
cguggcuaaaucuuuaccuucuc

SEQ ID NO: 32758 - RNA, 24 nt, Human
ugccccgucugauugccaagguug

SEQ ID NO: 32759 - RNA, 24 nt, Human
aggcaauggaaucaagacaguuau

SEQ ID NO: 32760 - RNA, 24 nt, Human
cuagaacauuccagaggucgccca

SEQ ID NO: 32761 - RNA, 24 nt, Human
uccgugcgcguugcugcggccgug

SEQ ID NO: 32762 - RNA, 24 nt, Human
uugaucuugaagaaacugggcgug

SEQ ID NO: 32763 - RNA, 24 nt, Human
aggaaggagauauagugaagagga

SEQ ID NO: 32764 - RNA, 24 nt, Human
uacagauuguccacacaguauacu

SEQ ID NO: 32765 - RNA, 24 nt, Human
uggaauggauagguaacuugggug

SEQ ID NO: 32766 - RNA, 24 nt, Human
cauuuuuguuuuaagaguuggggg

SEQ ID NO: 32767 - RNA, 24 nt, Human
cuagugccaguuuucuuguuugcc

SEQ ID NO: 32768 - RNA, 21 nt, Human
uggaauagauaaauucaugga

SEQ ID NO: 32769 - RNA, 24 nt, Human
gcccguugcuguggcucuagacac

SEQ ID NO: 32770 - RNA, 24 nt, Human
gacuaugguguuugcgucauucau

SEQ ID NO: 32771 - RNA, 24 nt, Human
gggcagcaacgaacgggugugaac

SEQ ID NO: 32772 - RNA, 24 nt, Human
uggaagugggcagcaagaucuacg

SEQ ID NO: 32773 - RNA, 24 nt, Human
auaggacaauacaaaguaucuuca

SEQ ID NO: 32774 - RNA, 24 nt, Human
ccgcaggucauaacuggccgaugg

SEQ ID NO: 32775 - RNA, 24 nt, Human
cuggaugggagggguccccucgga

SEQ ID NO: 32776 - RNA, 24 nt, Human
cacagguucugccucagauucucc

SEQ ID NO: 32777 - RNA, 24 nt, Human
ucugugggcaccugcugcucugga

SEQ ID NO: 32778 - RNA, 23 nt, Human
cacuguuuggucugaggggcauc

SEQ ID NO: 32779 - RNA, 24 nt, Human
uuguucagacggugucucuccugu

SEQ ID NO: 32780 - RNA, 24 nt, Human
ucuauggugggagccuuaaaaggg

SEQ ID NO: 32781 - RNA, 24 nt, Human
gggaugcauuuuaccacgcuguau

SEQ ID NO: 32782 - RNA, 17 nt, Human
aacccucugugucgccu

SEQ ID NO: 32783 - RNA, 24 nt, Human
guucauuagcgugaagauguugga

SEQ ID NO: 32784 - RNA, 24 nt, Human
ucggcagugggguaacggaaaaag

SEQ ID NO: 32785 - RNA, 24 nt, Human
ugggacagguaucgguuugucacc

SEQ ID NO: 32786 - RNA, 24 nt, Human
uggguagccacuauccuugucuag

SEQ ID NO: 32787 - RNA, 24 nt, Human
aauguuuuuaaagcuguucaugau

SEQ ID NO: 32788 - RNA, 24 nt, Human
uaauuuaaaaaggcaaaacaaugc

SEQ ID NO: 32789 - RNA, 24 nt, Human
ucguacuuucuugcuauucacaac

SEQ ID NO: 32790 - RNA, 24 nt, Human
uguggugggcagggcacuguugau

SEQ ID NO: 32791 - RNA, 24 nt, Human
uguuuucccaaaucaccuaaauau

SEQ ID NO: 32792 - RNA, 24 nt, Human
cagcgugucaggaaccucagagca

SEQ ID NO: 32793 - RNA, 24 nt, Human
uauuacaauucacuggccgcguuu

SEQ ID NO: 32794 - RNA, 24 nt, Human
aauuagccaaccaugagucauuua

SEQ ID NO: 32795 - RNA, 24 nt, Human
ccagagguggaggccacggaggca

SEQ ID NO: 32796 - RNA, 24 nt, Human
gggcaugaaaaccggcaggguguu

SEQ ID NO: 32797 - RNA, 24 nt, Human
uuuagaguaucuuggcaaaauggu

SEQ ID NO: 32798 - RNA, 24 nt, Human
ucuuuggucuuuggaagugggcag

SEQ ID NO: 32799 - RNA, 24 nt, Human
guacuccacaguucauuucuucac

SEQ ID NO: 32800 - RNA, 24 nt, Human
ggccgagugggcaccaucauggga

SEQ ID NO: 32801 - RNA, 24 nt, Human
uugacaauuuuauuuucacauuuc

SEQ ID NO: 32802 - RNA, 24 nt, Human
uuucuaguugcuaagauuugccaa

SEQ ID NO: 32803 - RNA, 24 nt, Human
uuugccagucagccuaguucuucu

SEQ ID NO: 32804 - RNA, 24 nt, Human
uguucagccccuaaacgaauggca

SEQ ID NO: 32805 - RNA, 24 nt, Human
cucugguuuaggcgcccgaaaggc

SEQ ID NO: 32806 - RNA, 24 nt, Human
uacaagcugucagccccaaggcag

SEQ ID NO: 32807 - RNA, 24 nt, Human
uggccugaugauccacagcggaga

SEQ ID NO: 32808 - RNA, 24 nt, Human
ugugugccauugcccaggcagagu

SEQ ID NO: 32809 - RNA, 24 nt, Human
ucagaacuuuagauaggauguugg

SEQ ID NO: 32810 - RNA, 24 nt, Human
ugaauggaaguaaggacuuuuuuu

SEQ ID NO: 32811 - RNA, 24 nt, Human
ugcauuguuaucauuaaccagucu

SEQ ID NO: 32812 - RNA, 24 nt, Human
ucuacaaguguuugcuauuuacaa

SEQ ID NO: 32813 - RNA, 24 nt, Human
gcugaaguauguccuguuuuucuu

SEQ ID NO: 32814 - RNA, 24 nt, Human
cagcauccaccguuaccacucaga

SEQ ID NO: 32815 - RNA, 24 nt, Human
ugaaggguuuuguguguuuaggcc

SEQ ID NO: 32816 - RNA, 24 nt, Human
gugaauuguaccuauuucugauga

SEQ ID NO: 32817 - RNA, 24 nt, Human
agagguuuuguauugagggccagu

SEQ ID NO: 32818 - RNA, 24 nt, Human
agccuggauggugcagacagcacu

SEQ ID NO: 32819 - RNA, 22 nt, Human
ugaggagaacauuaacucuuca

SEQ ID NO: 32820 - RNA, 24 nt, Human
ucccuuugcuuugucuacccgcug

SEQ ID NO: 32821 - RNA, 24 nt, Human
ucauugauuguguggugagaaucc

SEQ ID NO: 32822 - RNA, 24 nt, Human
caugucccuucgcgggaaggcugu

SEQ ID NO: 32823 - RNA, 21 nt, Human
ucuggagaaacugcugccuca

SEQ ID NO: 32824 - RNA, 24 nt, Human
gggcacuccgugauggccccugcc

SEQ ID NO: 32825 - RNA, 24 nt, Human
ggacuuagguguggcccuuccaca

SEQ ID NO: 32826 - RNA, 24 nt, Human
aagcauuuggaccgagccucuuuc

SEQ ID NO: 32827 - RNA, 24 nt, Human
ccuuuugggauggccccaucuguu

SEQ ID NO: 32828 - RNA, 24 nt, Human
gggaggccggauuacaauucacug

SEQ ID NO: 32829 - RNA, 24 nt, Human
uggaaaaaucgcggaaaauuuuug

SEQ ID NO: 32830 - RNA, 21 nt, Human
uaaaugagagagaacgaagac

SEQ ID NO: 32831 - RNA, 24 nt, Human
ugagaagcaaaauacaaaaguuag

SEQ ID NO: 32832 - RNA, 24 nt, Human
cagcucaaauggaauauugucgca

SEQ ID NO: 32833 - RNA, 24 nt, Human
uggaauccaguucccuuuagaccu

SEQ ID NO: 32834 - RNA, 24 nt, Human
ugguaguggauuagugaaagucuc

SEQ ID NO: 32835 - RNA, 24 nt, Human
uccgagggccggcccggcgggggg

SEQ ID NO: 32836 - RNA, 24 nt, Human
agggaaguugggacgaagcccagg

SEQ ID NO: 32837 - RNA, 24 nt, Human
ugcuguacuucaucagaaaacacc

SEQ ID NO: 32838 - RNA, 24 nt, Human
ugagagccuggaacacaugacccu

SEQ ID NO: 32839 - RNA, 24 nt, Human
cuugcacaaguugcggcagcugcc

SEQ ID NO: 32840 - RNA, 24 nt, Human
cagcggcagagagccauuccucua

SEQ ID NO: 32841 - RNA, 24 nt, Human
uauggcaagucacuuugacagaca

SEQ ID NO: 32842 - RNA, 24 nt, Human
ugagaauggcaaaauuagucgccu

SEQ ID NO: 32843 - RNA, 24 nt, Human
uacaccacucccaagaagaauaag

SEQ ID NO: 32844 - RNA, 24 nt, Human
aauuaauuauuuaacacgaauuca

SEQ ID NO: 32845 - RNA, 24 nt, Human
uuaaaccuguuuuauggauggcag

SEQ ID NO: 32846 - RNA, 24 nt, Human
uguguaaagccaguuuuuaugauu

SEQ ID NO: 32847 - RNA, 24 nt, Human
ugaauagcaaauucugguauaucg

SEQ ID NO: 32848 - RNA, 24 nt, Human
auggagcauggacuuuugcuaacu

SEQ ID NO: 32849 - RNA, 24 nt, Human
cuuuucaacaguuucacauccagc

SEQ ID NO: 32850 - RNA, 24 nt, Human
gugcagcaccaccagcguguccag

SEQ ID NO: 32851 - RNA, 24 nt, Human
accuaguacuuugagaaaguuaua

SEQ ID NO: 32852 - RNA, 24 nt, Human
aaagugcugagauuacacgcauga

SEQ ID NO: 32853 - RNA, 24 nt, Human
uagaggaggcugaagugcuugaca

SEQ ID NO: 32854 - RNA, 24 nt, Human
ucuguaauucaguguuccaaccac

SEQ ID NO: 32855 - RNA, 19 nt, Human
gggaaugucuguguccuug

SEQ ID NO: 32856 - RNA, 24 nt, Human
ccuguccccacaacucucccuggg

SEQ ID NO: 32857 - RNA, 24 nt, Human
uaaauagggggccaugggaggggg

SEQ ID NO: 32858 - RNA, 24 nt, Human
uguaaaauucauugcuuguggaau

SEQ ID NO: 32859 - RNA, 24 nt, Human
aaaguuaccagaauuuauaauuua

SEQ ID NO: 32860 - RNA, 24 nt, Human
ugcauuguuaucauuaaccagucu

SEQ ID NO: 32861 - RNA, 24 nt, Human
uauuagggauaauauucauuuagc

SEQ ID NO: 32862 - RNA, 24 nt, Human
uaaugggucucaaaauucugugac

SEQ ID NO: 32863 - RNA, 24 nt, Human
cccacguuuuccucuucuccucuu

SEQ ID NO: 32864 - RNA, 24 nt, Human
aagcacacccuuuuaagacuacuu

SEQ ID NO: 32865 - RNA, 24 nt, Human
acagacuacgagggaguuugacag

SEQ ID NO: 32866 - RNA, 24 nt, Human
uaagagaaggccaaaguuucuuga

SEQ ID NO: 32867 - RNA, 24 nt, Human
uuacagaacggguuggggucgaga

SEQ ID NO: 32868 - RNA, 24 nt, Human
ucagauaguggccuaaaaaaauuu

SEQ ID NO: 32869 - RNA, 24 nt, Human
gucacauuaagcaaacaacauagg

SEQ ID NO: 32870 - RNA, 24 nt, Human
uauuguccauacaguagcgggaau

SEQ ID NO: 32871 - RNA, 24 nt, Human
uucccuuuugggggccccuuuauu

SEQ ID NO: 32872 - RNA, 24 nt, Human
uguguuguuugccccccggcugau

SEQ ID NO: 32873 - RNA, 24 nt, Human
augaagcaucacauaggucgguga

SEQ ID NO: 32874 - RNA, 24 nt, Human
uccacuugcugaacaggucaaggc

SEQ ID NO: 32875 - RNA, 24 nt, Human
ucugcauucucgcuuccuggaggg

SEQ ID NO: 32876 - RNA, 21 nt, Human
ucuggagaaacugcugccuca

SEQ ID NO: 32877 - RNA, 24 nt, Human
uguguaugcucugguggugguguc

SEQ ID NO: 32878 - RNA, 24 nt, Human
uaaaauuuccuucugggauuaaca

SEQ ID NO: 32879 - RNA, 19 nt, Human
uguguugaggagggcugcc

SEQ ID NO: 32880 - RNA, 24 nt, Human
ugggaugaauuccaaauucuguug

SEQ ID NO: 32881 - RNA, 24 nt, Human
ugugauaugcuuauacacuuacac

SEQ ID NO: 32882 - RNA, 24 nt, Human
ugaaagucucguggcggcgggacc

SEQ ID NO: 32883 - RNA, 24 nt, Human
ccccaggugcugccucagccaggg

SEQ ID NO: 32884 - RNA, 24 nt, Human
agagaggauggaucacagggucua

SEQ ID NO: 32885 - RNA, 24 nt, Human
uauaucaaguuugucucugaaaua

SEQ ID NO: 32886 - RNA, 24 nt, Human
ugcaguugguggaggcucgcgggc

SEQ ID NO: 32887 - RNA, 24 nt, Human
uaaaggcaucauucaaaaggauuu

SEQ ID NO: 32888 - RNA, 24 nt, Human
uuuagacuugacgcaacgggaggu

SEQ ID NO: 32889 - RNA, 24 nt, Human
aacuguaucccguugaugcacuaa

SEQ ID NO: 32890 - RNA, 24 nt, Human
aaagcagcaauucuauguucauag

SEQ ID NO: 32891 - RNA, 24 nt, Human
auguaccagugcugccacgggagc

SEQ ID NO: 32892 - RNA, 24 nt, Human
caccccucauccugucucggauug

SEQ ID NO: 32893 - RNA, 24 nt, Human
uggugcuggacgccuggcacgggg

SEQ ID NO: 32894 - RNA, 24 nt, Human
ucuaggaauacuaguauaucgcuc

SEQ ID NO: 32895 - RNA, 20 nt, Human
augacccugugcaaguuuuc

SEQ ID NO: 32896 - RNA, 24 nt, Human
uaagggaacuauuauguccauguu

SEQ ID NO: 32897 - RNA, 24 nt, Human
uaaguuuaauguuaauuccaugcu

SEQ ID NO: 32898 - RNA, 23 nt, Human
ucugcuggucucccaccucccgc

SEQ ID NO: 32899 - RNA, 24 nt, Human
cucccuugaaacccugggccacuc

SEQ ID NO: 32900 - RNA, 24 nt, Human
ugcccgaagcgcgugccgcaguuc

SEQ ID NO: 32901 - RNA, 24 nt, Human
ucccgaggugcaucugcaggagcu

SEQ ID NO: 32902 - RNA, 20 nt, Human
ugcuggggggucgggggcag

SEQ ID NO: 32903 - RNA, 24 nt, Human
cgagggcaaggguggcccugaagg

SEQ ID NO: 32904 - RNA, 24 nt, Human
cgaugugggcucuguuuuggguuc

SEQ ID NO: 32905 - RNA, 24 nt, Human
uaacggccgcgguacccuaaaccg

SEQ ID NO: 32906 - RNA, 24 nt, Human
cuaugaguguggcgaaaaaaggga

SEQ ID NO: 32907 - RNA, 24 nt, Human
cagccuccugaguaccuaagggag

SEQ ID NO: 32908 - RNA, 24 nt, Human
guucgggugaugaugguuccacgu

SEQ ID NO: 32909 - RNA, 24 nt, Human
guucgggugaugaugguuccacgu

SEQ ID NO: 32910 - RNA, 24 nt, Human
ugaaaauguuaaaguguuugaguc

SEQ ID NO: 32911 - RNA, 24 nt, Human
uggaagcauuuucugugcuuugau

SEQ ID NO: 32912 - RNA, 24 nt, Human
aggaagcacaaaagacuuguugag

SEQ ID NO: 32913 - RNA, 24 nt, Human
ugagguccccagucuacguaggaa

SEQ ID NO: 32914 - RNA, 24 nt, Human
aaggagcuggcuuuguggggcugc

SEQ ID NO: 32915 - RNA, 24 nt, Human
aggcaggagaaucacuugaacccg

SEQ ID NO: 32916 - RNA, 24 nt, Human
uauuacagggaaauaagaacacug

SEQ ID NO: 32917 - RNA, 24 nt, Human
ucuacagucuucacaugccccacu

SEQ ID NO: 32918 - RNA, 24 nt, Human
uaauuugagaggaaaaacuauuaa

SEQ ID NO: 32919 - RNA, 24 nt, Human
uucaagcuaugucauaccugccuc

SEQ ID NO: 32920 - RNA, 24 nt, Human
uuaguagagaugggauuucaccau

SEQ ID NO: 32921 - RNA, 24 nt, Human
uacccugcacccagaacuuaguag

SEQ ID NO: 32922 - RNA, 24 nt, Human
ucucacuuugucacccaggcugga

SEQ ID NO: 32923 - RNA, 24 nt, Human
ccagggaaaucaaaguugcuacaa

SEQ ID NO: 32924 - RNA, 24 nt, Human
cuggaucuugaucuucugcgagug

SEQ ID NO: 32925 - RNA, 24 nt, Human
acugaaguccuggaccuugaccgu

SEQ ID NO: 32926 - RNA, 24 nt, Human
uccacuggcgaaagaugccuuucu

SEQ ID NO: 32927 - RNA, 24 nt, Human
uaguucagauugaucuuaggucaa

SEQ ID NO: 32928 - RNA, 24 nt, Human
uagagugguggcucccagaauccc

SEQ ID NO: 32929 - RNA, 24 nt, Human
ugucagggugggcacaggguccuc

SEQ ID NO: 32930 - RNA, 24 nt, Human
uggcagagaauacagucagucagg

SEQ ID NO: 32931 - RNA, 24 nt, Human
ucccugagccaugacugcuugacu

SEQ ID NO: 32932 - RNA, 24 nt, Human
gggaagguauuuauugauccacac

SEQ ID NO: 32933 - RNA, 24 nt, Human
agagcugaaccaugucaaggguag

SEQ ID NO: 32934 - RNA, 24 nt, Human
cuuuuaaacaaccagaucccacaa

SEQ ID NO: 32935 - RNA, 24 nt, Human
aggcaggcaagcggauuuuugguc

SEQ ID NO: 32936 - RNA, 24 nt, Human
ucgaauggacacauuaccagugaa

SEQ ID NO: 32937 - RNA, 24 nt, Human
ggagcaccuggagcgcaugaagcg

SEQ ID NO: 32938 - RNA, 24 nt, Human
ugaaaaacugaauucugcaacaga

SEQ ID NO: 32939 - RNA, 23 nt, Human
uuacaacaaucgagugcuggaca

SEQ ID NO: 32940 - RNA, 24 nt, Human
aagggcuuugagaaaaggcuuuga

SEQ ID NO: 32941 - RNA, 24 nt, Human
agaaaccacgaguucccuccauuu

SEQ ID NO: 32942 - RNA, 24 nt, Human
cuaguuuaaucugcuaauaugaaa

SEQ ID NO: 32943 - RNA, 18 nt, Human
ucaauaucacuuaucaaa

SEQ ID NO: 32944 - RNA, 24 nt, Human
uccagcagauucaaagccaggcac

SEQ ID NO: 32945 - RNA, 21 nt, Human
uucacagucugggacguggga

SEQ ID NO: 32946 - RNA, 24 nt, Human
uaguuaccagaguguacagauuuu

SEQ ID NO: 32947 - RNA, 24 nt, Human
aaagaggccccugagagcauguuu

SEQ ID NO: 32948 - RNA, 24 nt, Human
aggcggcauggaucucagcgagcu

SEQ ID NO: 32949 - RNA, 24 nt, Human
cauaugguccaauaucaaagggaa

SEQ ID NO: 32950 - RNA, 24 nt, Human
uagcauugaaggacucggggauau

SEQ ID NO: 32951 - RNA, 24 nt, Human
uagcauucgaaggacucggggaua

SEQ ID NO: 32952 - RNA, 24 nt, Human
ugaaggacucguggauaucuaaca

SEQ ID NO: 32953 - RNA, 24 nt, Human
uagcauucgaaggacucggggaua

SEQ ID NO: 32954 - RNA, 24 nt, Human
uagcauugaaggacucggggauau

SEQ ID NO: 32955 - RNA, 24 nt, Human
uaucagaguaacgagaagacaaac

SEQ ID NO: 32956 - RNA, 24 nt, Human
uaaagugccuucagccaagaccau

SEQ ID NO: 32957 - RNA, 24 nt, Human
aagaggccaggguggccacgggug

SEQ ID NO: 32958 - RNA, 24 nt, Human
cuccccuacucggggcacaggggu

SEQ ID NO: 32959 - RNA, 24 nt, Human
uuauauccauuugagagaugagga

SEQ ID NO: 32960 - RNA, 24 nt, Human
uucacugccgcucugucugcaaac

SEQ ID NO: 32961 - RNA, 24 nt, Human
uacucgggauuuuuccuacaaaaa

SEQ ID NO: 32962 - RNA, 24 nt, Human
uucacauuauuucccucaucuuag

SEQ ID NO: 32963 - RNA, 24 nt, Human
uaguagguugcucaccaauuucug

SEQ ID NO: 32964 - RNA, 20 nt, Human
ugggaugcuggccuuaagau

SEQ ID NO: 32965 - RNA, 24 nt, Human
gggaacucacacgcugacccccga

SEQ ID NO: 32966 - RNA, 24 nt, Human
ugaggaguaaguguacaaugugau

SEQ ID NO: 32967 - RNA, 24 nt, Human
uuuuucuuuggggauucgguccgg

SEQ ID NO: 32968 - RNA, 24 nt, Human
aacaaguaugcuuggggagucuuc

SEQ ID NO: 32969 - RNA, 24 nt, Human
aagaacacuuuuuggggcagccuu

SEQ ID NO: 32970 - RNA, 24 nt, Human
acuuugagggguguuggagagggg

SEQ ID NO: 32971 - RNA, 24 nt, Human
caacgagcuaaagcucagauuguc

SEQ ID NO: 32972 - RNA, 24 nt, Human
acugugcccuuccccuccugaaag

SEQ ID NO: 32973 - RNA, 24 nt, Human
ucaguuaagguuauuguugugggu

SEQ ID NO: 32974 - RNA, 22 nt, Human
uuugaacuaugauuuaguagca

SEQ ID NO: 32975 - RNA, 24 nt, Human
ccuugcugcaaacugcuuuucuug

SEQ ID NO: 32976 - RNA, 24 nt, Human
aagcaggagaaucacuugaaccca

SEQ ID NO: 32977 - RNA, 22 nt, Human
uggguccuggucuccucugugc

SEQ ID NO: 32978 - RNA, 24 nt, Human
ucagucuucuccuaagagugacaa

SEQ ID NO: 32979 - RNA, 24 nt, Human
uaauuuuuagacagaagcaggaca

SEQ ID NO: 32980 - RNA, 23 nt, Human
uuaagaccuuuuuuucuugagua

SEQ ID NO: 32981 - RNA, 24 nt, Human
uguccaggaucaacgggauaccau

SEQ ID NO: 32982 - RNA, 24 nt, Human
ucccucacaugcacaguucacagu

SEQ ID NO: 32983 - RNA, 24 nt, Human
ucugcagccuguggaccccagccc

SEQ ID NO: 32984 - RNA, 24 nt, Human
agacuauaucuguagaaacuuuau

SEQ ID NO: 32985 - RNA, 24 nt, Human
uugauugcguggcccaugugaugc

SEQ ID NO: 32986 - RNA, 24 nt, Human
uuugcuauuucuucuagcaaauuu

SEQ ID NO: 32987 - RNA, 24 nt, Human
uguaaaacaucaacucagccaggc

SEQ ID NO: 32988 - RNA, 24 nt, Human
uacgcgagcgcgcgcgcccucugg

SEQ ID NO: 32989 - RNA, 24 nt, Human
cauaaccagggacaccaaacaguu

SEQ ID NO: 32990 - RNA, 24 nt, Human
gggaauauuuugaggguuuuuauu

SEQ ID NO: 32991 - RNA, 24 nt, Human
agcuguuuuggccugugucucccu

SEQ ID NO: 32992 - RNA, 24 nt, Human
uuuguuaaauuaauaaaacaugac

SEQ ID NO: 32993 - RNA, 24 nt, Human
uugaagccaguaauuagagacauc

SEQ ID NO: 32994 - RNA, 24 nt, Human
uuaguauacagacgacagugaacu

SEQ ID NO: 32995 - RNA, 21 nt, Human
ucacgagggggauguggcacc

SEQ ID NO: 32996 - RNA, 24 nt, Human
ugagaagugggugagggcaugcaa

SEQ ID NO: 32997 - RNA, 24 nt, Human
uaguaugcagguuggucagggcag

SEQ ID NO: 32998 - RNA, 24 nt, Human
ugcauuguuaucauuaaccagucu

SEQ ID NO: 32999 - RNA, 24 nt, Human
uauuagggauaauauucauuuagc

SEQ ID NO: 33000 - RNA, 24 nt, Human
uuuaacuuuuuuaaugggucucaa

SEQ ID NO: 33001 - RNA, 24 nt, Human
ucccugggcagagcuaggacaggg

SEQ ID NO: 33002 - RNA, 24 nt, Human
uaccuggauuuuaggacuggauuu

SEQ ID NO: 33003 - RNA, 24 nt, Human
uacaguggacucagcccugcaacu

SEQ ID NO: 33004 - RNA, 24 nt, Human
uauuggcaucacucaccagagaag

SEQ ID NO: 33005 - RNA, 24 nt, Human
aacuguaucccguugaugcacuaa

SEQ ID NO: 33006 - RNA, 24 nt, Human
aaagcagcaauucuauguucauag

SEQ ID NO: 33007 - RNA, 24 nt, Human
uaagacuaggggcuugguauauau

SEQ ID NO: 33008 - RNA, 24 nt, Human
ucacuguaagcauccaguaggcag

SEQ ID NO: 33009 - RNA, 24 nt, Human
ucagcuuuugggucaucugggucc

SEQ ID NO: 33010 - RNA, 24 nt, Human
uacucuugucuaauauuaacuagu

SEQ ID NO: 33011 - RNA, 24 nt, Human
uaauguacagaacuaaauuuuuua

SEQ ID NO: 33012 - RNA, 24 nt, Human
uuaacauucacugauguagauuaa

SEQ ID NO: 33013 - RNA, 24 nt, Human
uugaaagguauauuaaaauuaagg

SEQ ID NO: 33014 - RNA, 17 nt, Human
uauagcauguuugaauu

SEQ ID NO: 33015 - RNA, 24 nt, Human
ucugccagccaaaauucuuugccu

SEQ ID NO: 33016 - RNA, 24 nt, Human
uagcagcuacggguccucuggcuc

SEQ ID NO: 33017 - RNA, 17 nt, Human
uaccuggcugcgugugc

SEQ ID NO: 33018 - RNA, 24 nt, Human
uuuaagcuaaauugccuuuuaaau

SEQ ID NO: 33019 - RNA, 24 nt, Human
cagcauucuggggcuuguaacacu

SEQ ID NO: 33020 - RNA, 24 nt, Human
cauucagagacagaguuucaccgu

SEQ ID NO: 33021 - RNA, 24 nt, Human
uaugaccaacugaaagagugggaa

SEQ ID NO: 33022 - RNA, 24 nt, Human
ugugcagaagaaauggaaggauuc

SEQ ID NO: 33023 - RNA, 24 nt, Human
uaucaaggaagggcaggcgugaug

SEQ ID NO: 33024 - RNA, 24 nt, Human
uucaaauuucuuucuuuuuuaauu

SEQ ID NO: 33025 - RNA, 24 nt, Human
cccaguagcccggccgcgugacca

SEQ ID NO: 33026 - RNA, 24 nt, Human
cacgcuguagaacacgcggccgug

SEQ ID NO: 33027 - RNA, 23 nt, Human
uggaaaaaaaaauaaaaaucuga

SEQ ID NO: 33028 - RNA, 23 nt, Human
aagcgacccaaagguggauaguc

SEQ ID NO: 33029 - RNA, 24 nt, Human
accacaauggauuuaugcauucaa

SEQ ID NO: 33030 - RNA, 24 nt, Human
uggcaagaugaugaagaaagcugg

SEQ ID NO: 33031 - RNA, 24 nt, Human
ugccugggcugaggucuugggggc

SEQ ID NO: 33032 - RNA, 24 nt, Human
ucccagucuccucuuccaacucug

SEQ ID NO: 33033 - RNA, 24 nt, Human
ugauggggcgaggaggggugcugg

SEQ ID NO: 33034 - RNA, 24 nt, Human
uggcaaacacgguauaaaacaagu

SEQ ID NO: 33035 - RNA, 21 nt, Human
aacauuuuuuacagcaaaacc

SEQ ID NO: 33036 - RNA, 24 nt, Human
ggagaguaaaguaggcaagaauga

SEQ ID NO: 33037 - RNA, 24 nt, Human
uagguuauuggggaacagguggug

SEQ ID NO: 33038 - RNA, 24 nt, Human
ucaggagugcaacgagguaaaagc

SEQ ID NO: 33039 - RNA, 24 nt, Human
caggacaccagccccaucuugcag

SEQ ID NO: 33040 - RNA, 19 nt, Human
uacaggcucgcaccugggg

SEQ ID NO: 33041 - RNA, 24 nt, Human
ucaccaagucuggaugaccacuac

SEQ ID NO: 33042 - RNA, 24 nt, Human
uuuguauuuugaacaaaaauagca

SEQ ID NO: 33043 - RNA, 24 nt, Human
uagaaaguuaacauuucaggagca

SEQ ID NO: 33044 - RNA, 24 nt, Human
uucgcgcguuacggcgccgccucc

SEQ ID NO: 33045 - RNA, 24 nt, Human
gccccggguucccguggcuaccgg

SEQ ID NO: 33046 - RNA, 24 nt, Human
ggagcagaugauaggcucggccug

SEQ ID NO: 33047 - RNA, 24 nt, Human
gauggcaccaugccagacacgggu

SEQ ID NO: 33048 - RNA, 24 nt, Human
uuagaauuggaauuacuuccuuac

SEQ ID NO: 33049 - RNA, 24 nt, Human
aggaaugccugggagugggggugc

SEQ ID NO: 33050 - RNA, 24 nt, Human
ugacgggaaccaggaacuaugaag

SEQ ID NO: 33051 - RNA, 23 nt, Human
ugagaggaacgcaagcgaggggu

SEQ ID NO: 33052 - RNA, 18 nt, Human
uacaccgugacgugugug

SEQ ID NO: 33053 - RNA, 24 nt, Human
cagcaggcugaacccagaagggua

SEQ ID NO: 33054 - RNA, 24 nt, Human
uccgcuccaucauggaggagugcg

SEQ ID NO: 33055 - RNA, 17 nt, Human
ugaaugagcaacauggg

SEQ ID NO: 33056 - RNA, 24 nt, Human
uguaaauaaaguuucauauguacc

SEQ ID NO: 33057 - RNA, 24 nt, Human
caucaaaauccaccaugaucaagu

SEQ ID NO: 33058 - RNA, 24 nt, Human
ccgcugcccgacgcuucuguucgg

SEQ ID NO: 33059 - RNA, 24 nt, Human
caccguggagcuuguugaugagcu

SEQ ID NO: 33060 - RNA, 24 nt, Human
ucccugggaagcccaaaggacuuu

SEQ ID NO: 33061 - RNA, 24 nt, Human
uacacuuuguaaaucuaaagagaa

SEQ ID NO: 33062 - RNA, 24 nt, Human
aggaagcgagaaugcagaguuucc

SEQ ID NO: 33063 - RNA, 23 nt, Human
ucgcuggcucccacuuugucucc

SEQ ID NO: 33064 - RNA, 24 nt, Human
gauuugcagcuacgaaaucaucac

SEQ ID NO: 33065 - RNA, 24 nt, Human
aagcaguacgacagcauuuugagg

SEQ ID NO: 33066 - RNA, 24 nt, Human
acagaagauguuggugaagaucag

SEQ ID NO: 33067 - RNA, 21 nt, Human
ugaccaggguacggcaggcgc

SEQ ID NO: 33068 - RNA, 24 nt, Human
gagcagauaaccauuguuucucgg

SEQ ID NO: 33069 - RNA, 24 nt, Human
aagcggcagcggaggcggcgggcc

SEQ ID NO: 33070 - RNA, 18 nt, Human
uggcuaaauauuucauuc

SEQ ID NO: 33071 - RNA, 23 nt, Human
caggagccuguguacacagggcc

SEQ ID NO: 33072 - RNA, 24 nt, Human
cugguggguuucaucccaggcaga

SEQ ID NO: 33073 - RNA, 24 nt, Human
uggcucacgccuguaaucccggca

SEQ ID NO: 33074 - RNA, 24 nt, Human
uggaggcacugaaagaccagcaga

SEQ ID NO: 33075 - RNA, 24 nt, Human
ccaggacacuucugaguacaucau

SEQ ID NO: 33076 - RNA, 24 nt, Human
aagacccccaauaguggagagggc

SEQ ID NO: 33077 - RNA, 24 nt, Human
aaggugccauuuuaaauuuuauuu

SEQ ID NO: 33078 - RNA, 24 nt, Human
guuuacuuuuuggcuggagcggag

SEQ ID NO: 33079 - RNA, 24 nt, Human
uuggcggacacugggggaggagag

SEQ ID NO: 33080 - RNA, 24 nt, Human
ugcgguuuggcccgcgggagaggg

SEQ ID NO: 33081 - RNA, 24 nt, Human
ucaggauuuuauacuaguugcuga

SEQ ID NO: 33082 - RNA, 24 nt, Human
uggaagcaagagugauuuuggagg

SEQ ID NO: 33083 - RNA, 24 nt, Human
ucacaaggauucauggauggaaaa

SEQ ID NO: 33084 - RNA, 24 nt, Human
ucagugcaaccagagacccuuucg

SEQ ID NO: 33085 - RNA, 24 nt, Human
uggggugggggccgccugaggcug

SEQ ID NO: 33086 - RNA, 24 nt, Human
ugccuuaguaucucgggcccacug

SEQ ID NO: 33087 - RNA, 24 nt, Human
ccugcagcgcucuguaccguuuag

SEQ ID NO: 33088 - RNA, 24 nt, Human
ucagaccccgggcagcuggugguu

SEQ ID NO: 33089 - RNA, 18 nt, Human
caccacagcuucuuguag

SEQ ID NO: 33090 - RNA, 24 nt, Human
ugccgcuuccuuccuguggcuuuc

SEQ ID NO: 33091 - RNA, 24 nt, Human
cugaagacuacugugacucugucc

SEQ ID NO: 33092 - RNA, 21 nt, Human
uggcuaaagaggaccuguggg

SEQ ID NO: 33093 - RNA, 24 nt, Human
gaauuggaaguauuuuucaaagac

SEQ ID NO: 33094 - RNA, 24 nt, Human
uaagggcuuggggucuuagaagcu

SEQ ID NO: 33095 - RNA, 24 nt, Human
ucuagcacucucagucgcuguaca

SEQ ID NO: 33096 - RNA, 24 nt, Human
cuuuccuucauaugguuugaugug

SEQ ID NO: 33097 - RNA, 24 nt, Human
uagcauucaguguaccauaccuau

SEQ ID NO: 33098 - RNA, 24 nt, Human
uauaaaauguaauacaagggcaua

SEQ ID NO: 33099 - RNA, 24 nt, Human
ucacuacaaucuccaccucccagg

SEQ ID NO: 33100 - RNA, 24 nt, Human
caccaaguccagcuaauuuuugua

SEQ ID NO: 33101 - RNA, 24 nt, Human
gguuguggaucuguuuguuucugc

SEQ ID NO: 33102 - RNA, 22 nt, Human
uggaaacuuuaccugguaccua

SEQ ID NO: 33103 - RNA, 24 nt, Human
cauugggcgaagcugggccaugcu

SEQ ID NO: 33104 - RNA, 24 nt, Human
ucccugaguguggaagagcagcug

SEQ ID NO: 33105 - RNA, 22 nt, Human
aucgagugaucuuaagcaguuc

SEQ ID NO: 33106 - RNA, 20 nt, Human
uucccagucacaugauguug

SEQ ID NO: 33107 - RNA, 24 nt, Human
ugucuuguccacaugugaggaaag

SEQ ID NO: 33108 - RNA, 24 nt, Human
gaugcaaaauguuugcaguuugac

SEQ ID NO: 33109 - RNA, 24 nt, Human
agaaagcaggcaccagggcugacc

SEQ ID NO: 33110 - RNA, 24 nt, Human
agggaaccagauuuaguucuuuac

SEQ ID NO: 33111 - RNA, 24 nt, Human
uagcggccuggguuguuaccagcu

SEQ ID NO: 33112 - RNA, 24 nt, Human
uggcaggaaugggaggcauccaga

SEQ ID NO: 33113 - RNA, 24 nt, Human
ugagacagagcugggcaugcgcca

SEQ ID NO: 33114 - RNA, 24 nt, Human
ucagcacacucgagcucugaagug

SEQ ID NO: 33115 - RNA, 23 nt, Human
ucaagggucguguguuugaagug

SEQ ID NO: 33116 - RNA, 24 nt, Human
uccaaggguuuaguucuuggcuuu

SEQ ID NO: 33117 - RNA, 18 nt, Human
ucccuggaccucucuugc

SEQ ID NO: 33118 - RNA, 24 nt, Human
uggcagggcccagugcugggccgg

SEQ ID NO: 33119 - RNA, 24 nt, Human
agccagcagaacucacccuggggu

SEQ ID NO: 33120 - RNA, 24 nt, Human
ucuuugguggcuguggucgggugu

SEQ ID NO: 33121 - RNA, 24 nt, Human
ugcccuguugcucuacauggccuu

SEQ ID NO: 33122 - RNA, 24 nt, Human
cuuucuauccacuagcguucggac

SEQ ID NO: 33123 - RNA, 24 nt, Human
aguuacuaguuuaaugggugaaaa

SEQ ID NO: 33124 - RNA, 21 nt, Human
cggcauggagaaacccaucuc

SEQ ID NO: 33125 - RNA, 24 nt, Human
gucaguuuuuguaagaagggguaa

SEQ ID NO: 33126 - RNA, 23 nt, Human
ugagucaggggcccagccuaggc

SEQ ID NO: 33127 - RNA, 24 nt, Human
uguggggggcugggggagguccaa

SEQ ID NO: 33128 - RNA, 24 nt, Human
uuuuugguuauugguuuuuuugua

SEQ ID NO: 33129 - RNA, 24 nt, Human
aggaagauggacacauggucacug

SEQ ID NO: 33130 - RNA, 24 nt, Human
ugguagcagguccaccggccccua

SEQ ID NO: 33131 - RNA, 24 nt, Human
gugcagaaugagggccgaguagau

SEQ ID NO: 33132 - RNA, 24 nt, Human
ccaggccaaaaaggcucaacauuu

SEQ ID NO: 33133 - RNA, 24 nt, Human
uauaaaagaaugaaauggaaaaau

SEQ ID NO: 33134 - RNA, 24 nt, Human
uagaagguguucacuuuuuacaca

SEQ ID NO: 33135 - RNA, 24 nt, Human
uuaacauaugucaugcuuacagga

SEQ ID NO: 33136 - RNA, 24 nt, Human
ugacaagugaaucuccaugugggu

SEQ ID NO: 33137 - RNA, 24 nt, Human
agagguauaccugucucuaaagga

SEQ ID NO: 33138 - RNA, 24 nt, Human
uuugcagauuccggauacgacagc

SEQ ID NO: 33139 - RNA, 24 nt, Human
gucacguugagagccaacaccaug

SEQ ID NO: 33140 - RNA, 24 nt, Human
uaugguaauauuacagcccgacac

SEQ ID NO: 33141 - RNA, 24 nt, Human
uauuagggauaauauucauuuagc

SEQ ID NO: 33142 - RNA, 24 nt, Human
uaaugggucucaaaauucugugac

SEQ ID NO: 33143 - RNA, 24 nt, Human
uaaccaagcagauggagaaaacca

SEQ ID NO: 33144 - RNA, 24 nt, Human
ugguacagaccaaguauguggaag

SEQ ID NO: 33145 - RNA, 24 nt, Human
ucccugggaagcugcaugaugugg

SEQ ID NO: 33146 - RNA, 24 nt, Human
uaggaucucacuauguugcccagg

SEQ ID NO: 33147 - RNA, 24 nt, Human
cagcagcaacuuucgcgguggccu

SEQ ID NO: 33148 - RNA, 24 nt, Human
uuugccuccuucauagacaaggua

SEQ ID NO: 33149 - RNA, 24 nt, Human
ugaagauaacagcuguggacaaga

SEQ ID NO: 33150 - RNA, 24 nt, Human
cggaaacaagugaaaaaguccaag

SEQ ID NO: 33151 - RNA, 24 nt, Human
ugcaaaaccagcguggcggcgcgc

SEQ ID NO: 33152 - RNA, 24 nt, Human
ugccagcaccguuuugugguuagc

SEQ ID NO: 33153 - RNA, 22 nt, Human
agaaacuggaagaagggucuuu

SEQ ID NO: 33154 - RNA, 24 nt, Human
uugaugauaugaaugaucuggauu

SEQ ID NO: 33155 - RNA, 24 nt, Human
uauuagggauaauauucauuuagc

SEQ ID NO: 33156 - RNA, 24 nt, Human
aaccuuuuuaaaaaauggagauga

SEQ ID NO: 33157 - RNA, 24 nt, Human
uugcaauuuuacuguaaguuugaa

SEQ ID NO: 33158 - RNA, 24 nt, Human
uggcaagcucauccucauuuccac

SEQ ID NO: 33159 - RNA, 24 nt, Human
uaccggacugugugccgggggauc

SEQ ID NO: 33160 - RNA, 24 nt, Human
ugacaugaaguugcaaggucaccu

SEQ ID NO: 33161 - RNA, 24 nt, Human
ucuagaccugccugcuuuaucuaa

SEQ ID NO: 33162 - RNA, 24 nt, Human
ucagaguguagucaacaguaaguu

SEQ ID NO: 33163 - RNA, 24 nt, Human
uaugauacagagaugucuaaaaac

SEQ ID NO: 33164 - RNA, 24 nt, Human
uggcauggggcuggaaggggggau

SEQ ID NO: 33165 - RNA, 24 nt, Human
ugcaaaaccagcguggcggccgcg

SEQ ID NO: 33166 - RNA, 24 nt, Human
uccuggagacucacuuccuagaug

SEQ ID NO: 33167 - RNA, 24 nt, Human
aggccuuuguggaucuucaugccc

SEQ ID NO: 33168 - RNA, 24 nt, Human
aaggucccaccauccccgcaggaa

SEQ ID NO: 33169 - RNA, 24 nt, Human
ugggguccuagccucaguuugaag

SEQ ID NO: 33170 - RNA, 24 nt, Human
agggcagcucgggagguccaguag

SEQ ID NO: 33171 - RNA, 24 nt, Human
gcccagugcugaguugucuucgag

SEQ ID NO: 33172 - RNA, 24 nt, Human
caggccccuuggccccccuggagg

SEQ ID NO: 33173 - RNA, 17 nt, Human
ugaccaguuccugccgc

SEQ ID NO: 33174 - RNA, 17 nt, Human
ucgcaaagaucaagagc

SEQ ID NO: 33175 - RNA, 24 nt, Human
ggucauuaccuuauugaguuuaga

SEQ ID NO: 33176 - RNA, 24 nt, Human
uuuagacuugacgcaacgggaggu

SEQ ID NO: 33177 - RNA, 21 nt, Human
cuugucgugugucccugaagu

SEQ ID NO: 33178 - RNA, 24 nt, Human
uugaagccacgcccucuuucccac

SEQ ID NO: 33179 - RNA, 24 nt, Human
ccacccagcccaagaggcccaugu

SEQ ID NO: 33180 - RNA, 24 nt, Human
acacugagcaccuggugaauggcc

SEQ ID NO: 33181 - RNA, 24 nt, Human
uaaggucacaugcacagguacuga

SEQ ID NO: 33182 - RNA, 24 nt, Human
uacuagguuagagcucacccucau

SEQ ID NO: 33183 - RNA, 21 nt, Human
gucacguuguccagcuccacc

SEQ ID NO: 33184 - RNA, 24 nt, Human
uuuccagguacucaggaacuaggc

SEQ ID NO: 33185 - RNA, 24 nt, Human
cacugagugaaagcugcucauugc

SEQ ID NO: 33186 - RNA, 24 nt, Human
augcucccagagauacaagccaau

SEQ ID NO: 33187 - RNA, 24 nt, Human
guggacuguucuugcggcgauuuu

SEQ ID NO: 33188 - RNA, 24 nt, Human
uguaaacccagcuaacagaaaaau

SEQ ID NO: 33189 - RNA, 24 nt, Human
aggguguuauuacggaaaaagcua

SEQ ID NO: 33190 - RNA, 24 nt, Human
uggauaaauaugguaacggguauu

SEQ ID NO: 33191 - RNA, 24 nt, Human
aaggcgccacagggggccaucagg

SEQ ID NO: 33192 - RNA, 24 nt, Human
caccagggaggacagcugcuggca

SEQ ID NO: 33193 - RNA, 24 nt, Human
aagauugcuuuucuugaaaugcuc

SEQ ID NO: 33194 - RNA, 24 nt, Human
uacuuuguaaacaaacaacuguga

SEQ ID NO: 33195 - RNA, 24 nt, Human
ugcaaagucuucugcuggugggug

SEQ ID NO: 33196 - RNA, 20 nt, Human
uuucuuguacaucuuucuac

SEQ ID NO: 33197 - RNA, 24 nt, Human
uuaggugucugucaaucuuggccu

SEQ ID NO: 33198 - RNA, 24 nt, Human
cagccuggacuuaccaccacuaaa

SEQ ID NO: 33199 - RNA, 24 nt, Human
ggcccggagcggagcgcgcccugc

SEQ ID NO: 33200 - RNA, 24 nt, Human
uugaacaggagaugaccuucaggc

SEQ ID NO: 33201 - RNA, 24 nt, Human
cuugccuucguucaguauguuaau

SEQ ID NO: 33202 - RNA, 24 nt, Human
cuucaguaggcagcgagcaucugu

SEQ ID NO: 33203 - RNA, 22 nt, Human
ugauacaaguucuggcauuggu

SEQ ID NO: 33204 - RNA, 24 nt, Human
uauuacacacggauguaagcauuu

SEQ ID NO: 33205 - RNA, 24 nt, Human
cacacggguucucacgcaacaacg

SEQ ID NO: 33206 - RNA, 22 nt, Human
ugucacaguuccgaggcagcag

SEQ ID NO: 33207 - RNA, 24 nt, Human
auagaggcuguuggcgcuggacag

SEQ ID NO: 33208 - RNA, 24 nt, Human
ccucccagcugacagguccugccc

SEQ ID NO: 33209 - RNA, 24 nt, Human
uucaaauuucuuucuuuuuuaauu

SEQ ID NO: 33210 - RNA, 24 nt, Human
uggauacauaucuauguuuacgcg

SEQ ID NO: 33211 - RNA, 24 nt, Human
uggcguaauagcgaagaggcccgc

SEQ ID NO: 33212 - RNA, 24 nt, Human
agagcaaaagccuuggguuucucg

SEQ ID NO: 33213 - RNA, 24 nt, Human
uguaaaguuguuguguuuuuuuuu

SEQ ID NO: 33214 - RNA, 24 nt, Human
uggccugaugauccacagcggaga

SEQ ID NO: 33215 - RNA, 24 nt, Human
ugugugccauugcccaggcagagu

SEQ ID NO: 33216 - RNA, 24 nt, Human
acagagaguuacccguacagagag

SEQ ID NO: 33217 - RNA, 24 nt, Human
uagcucagagagaggucacuacua

SEQ ID NO: 33218 - RNA, 24 nt, Human
cagcucccaggauguguucgggaa

SEQ ID NO: 33219 - RNA, 24 nt, Human
agugggugaggaggucgguugagu

SEQ ID NO: 33220 - RNA, 24 nt, Human
cugaccuucaaguccuagauggca

SEQ ID NO: 33221 - RNA, 24 nt, Human
uggcguaauagcgaagaggccgca

SEQ ID NO: 33222 - RNA, 19 nt, Human
uucucagugguuccaacac

SEQ ID NO: 33223 - RNA, 24 nt, Human
uggugggugggaguggguagauaa

SEQ ID NO: 33224 - RNA, 24 nt, Human
uacacauuauaaaauguaucagau

SEQ ID NO: 33225 - RNA, 24 nt, Human
uaaaagauguauaagguuaaguuu

SEQ ID NO: 33226 - RNA, 22 nt, Human
gccacaguucagaagccaggcu

SEQ ID NO: 33227 - RNA, 24 nt, Human
ugucaaggggucaguguaggguag

SEQ ID NO: 33228 - RNA, 24 nt, Human
ucaccaaagaacaaaccagaccac

SEQ ID NO: 33229 - RNA, 24 nt, Human
ugagagcccugaacagagauuuac

SEQ ID NO: 33230 - RNA, 24 nt, Human
ccccugaaggcaaggccagggaga

SEQ ID NO: 33231 - RNA, 24 nt, Human
cagcccagggcaagcugagagaug

SEQ ID NO: 33232 - RNA, 24 nt, Human
gagcacucugaggggccugugggc

SEQ ID NO: 33233 - RNA, 24 nt, Human
uuuauacauacagacacucccuug

SEQ ID NO: 33234 - RNA, 24 nt, Human
uaacauggugaaaccccgucucua

SEQ ID NO: 33235 - RNA, 22 nt, Human
ugggauauguuagaagugucau

SEQ ID NO: 33236 - RNA, 24 nt, Human
agggguccggugcugucgcgggaa

SEQ ID NO: 33237 - RNA, 24 nt, Human
uuaguauuauuuauuugacaacuc

SEQ ID NO: 33238 - RNA, 24 nt, Human
ucuaaaaacaggaaaaauaucagu

SEQ ID NO: 33239 - RNA, 24 nt, Human
agaucuguugccaucauggccccu

SEQ ID NO: 33240 - RNA, 24 nt, Human
uagaauuaucuaaauguuucuuga

SEQ ID NO: 33241 - RNA, 24 nt, Human
aaaaagccaaaacuaaaaggucaa

SEQ ID NO: 33242 - RNA, 24 nt, Human
cuaccacaccuggcuuaaaggugc

SEQ ID NO: 33243 - RNA, 24 nt, Human
uguuacaacuuuagaauuuuagua

SEQ ID NO: 33244 - RNA, 24 nt, Human
uucaaguucaguccauguguccuc

SEQ ID NO: 33245 - RNA, 24 nt, Human
ucggagcuguggcugccggugugu

SEQ ID NO: 33246 - RNA, 24 nt, Human
cuccugaucaggcggccgucuggu

SEQ ID NO: 33247 - RNA, 24 nt, Human
accgagcgcucguccagggaaggc

SEQ ID NO: 33248 - RNA, 24 nt, Human
ucacugcaguccacgaggccacac

SEQ ID NO: 33249 - RNA, 24 nt, Human
aggcggggaggaucgcuugaggcc

SEQ ID NO: 33250 - RNA, 24 nt, Human
ugaggcagagaggcccacugucug

SEQ ID NO: 33251 - RNA, 24 nt, Human
uagccacuccccacacaccccagg

SEQ ID NO: 33252 - RNA, 22 nt, Human
agggaccaagaugucuauuacu

SEQ ID NO: 33253 - RNA, 24 nt, Human
ucaguaggccuggaaucucuucuc

SEQ ID NO: 33254 - RNA, 24 nt, Human
aggcggggaggaucgcuugaggcc

SEQ ID NO: 33255 - RNA, 24 nt, Human
ugaggcagagaggcccacugucug

SEQ ID NO: 33256 - RNA, 24 nt, Human
uagccacuccccacacaccccagg

SEQ ID NO: 33257 - RNA, 24 nt, Human
uucaagccugacuguguaaacguu

SEQ ID NO: 33258 - RNA, 24 nt, Human
uaauuuacaaccaguuaagaauua

SEQ ID NO: 33259 - RNA, 24 nt, Human
uugaaugaaaccauaacuccacuu

SEQ ID NO: 33260 - RNA, 22 nt, Human
aacaugcuuaugaugcauagga

SEQ ID NO: 33261 - RNA, 24 nt, Human
uuccugggcccccugcaccccucc

SEQ ID NO: 33262 - RNA, 24 nt, Human
agacguggaacaucucguucgcgg

SEQ ID NO: 33263 - RNA, 24 nt, Human
uacuacgucggcguggccuccugc

SEQ ID NO: 33264 - RNA, 24 nt, Human
uucauaauuuucagcuacaaaaua

SEQ ID NO: 33265 - RNA, 24 nt, Human
uucaucaugcaaacaucauagagu

SEQ ID NO: 33266 - RNA, 24 nt, Human
aaugguauuguuuuaaauuuuuau

SEQ ID NO: 33267 - RNA, 24 nt, Human
ucgguguaugccuucucggcgcgc

SEQ ID NO: 33268 - RNA, 24 nt, Human
cgccccuucuaccccggugguuug

SEQ ID NO: 33269 - RNA, 24 nt, Human
uaugggaggugcuaugggcauaaa

SEQ ID NO: 33270 - RNA, 24 nt, Human
uuuaagccugaaauuguccuguga

SEQ ID NO: 33271 - RNA, 24 nt, Human
uagcaaggcuccacuuugccccag

SEQ ID NO: 33272 - RNA, 24 nt, Human
accccaggacaugcaagagccuca

SEQ ID NO: 33273 - RNA, 24 nt, Human
ccucaucgucgugcagaaugaggg

SEQ ID NO: 33274 - RNA, 24 nt, Human
gagcagcagcaguggagggggcag

SEQ ID NO: 33275 - RNA, 24 nt, Human
ucccaauguugacguuggccaggg

SEQ ID NO: 33276 - RNA, 24 nt, Human
guccagucaccaccugcagccucg

SEQ ID NO: 33277 - RNA, 24 nt, Human
agaagaagaagaaauggcaaagag

SEQ ID NO: 33278 - RNA, 24 nt, Human
ugugcagaagaaauggaaggauuc

SEQ ID NO: 33279 - RNA, 24 nt, Human
uaucaaggaagggcaggcgugaug

SEQ ID NO: 33280 - RNA, 24 nt, Human
uauuuuuuaauuuuacaccugaac

SEQ ID NO: 33281 - RNA, 18 nt, Human
ucuuacaucacuugguac

SEQ ID NO: 33282 - RNA, 24 nt, Human
ugaggagagagugugcucagaacu

SEQ ID NO: 33283 - RNA, 24 nt, Human
uggcauccagcaggucgcugggug

SEQ ID NO: 33284 - RNA, 24 nt, Human
ggacaugugcuucagaaccuggau

SEQ ID NO: 33285 - RNA, 19 nt, Human
ucgaguacugguuccgcug

SEQ ID NO: 33286 - RNA, 24 nt, Human
uagaggcagaaaagugcagaagga

SEQ ID NO: 33287 - RNA, 24 nt, Human
gaaggcuggacagcauggccaucg

SEQ ID NO: 33288 - RNA, 24 nt, Human
uacaggaguggccauuugcaccua

SEQ ID NO: 33289 - RNA, 24 nt, Human
ugcaagaacgcggcagguggcugg

SEQ ID NO: 33290 - RNA, 24 nt, Human
uacaagcacgcguuacccuuccug

SEQ ID NO: 33291 - RNA, 24 nt, Human
ugccugggcacagcucacgggcag

SEQ ID NO: 33292 - RNA, 24 nt, Human
ucugucuucgaccaacugaagcaa

SEQ ID NO: 33293 - RNA, 24 nt, Human
ccuggccaacauggugaaacccca

SEQ ID NO: 33294 - RNA, 24 nt, Human
uggaauuggaggccgggcgcagug

SEQ ID NO: 33295 - RNA, 20 nt, Human
ugagagaacacuccacgaug

SEQ ID NO: 33296 - RNA, 24 nt, Human
ccugaccccugggcuggccuggga

SEQ ID NO: 33297 - RNA, 24 nt, Human
aaagcaaaugaggcagaaaggccc

SEQ ID NO: 33298 - RNA, 24 nt, Human
uuugccaaaaccacgcuuguagau

SEQ ID NO: 33299 - RNA, 24 nt, Human
uuaguucauucuucuaauaagccu

SEQ ID NO: 33300 - RNA, 24 nt, Human
caugcagaugaugccguauuuacc

SEQ ID NO: 33301 - RNA, 24 nt, Human
ccucacaaauauucagcugggaag

SEQ ID NO: 33302 - RNA, 24 nt, Human
ggcccagaacuuuguccucagagc

SEQ ID NO: 33303 - RNA, 24 nt, Human
gaguacugaauacaaugagaaguu

SEQ ID NO: 33304 - RNA, 24 nt, Human
ccuccagcacagccuauauggagc

SEQ ID NO: 33305 - RNA, 24 nt, Human
ugaggcagacgccugaacagggac

SEQ ID NO: 33306 - RNA, 24 nt, Human
gcccugggauucgagcaggagaug

SEQ ID NO: 33307 - RNA, 24 nt, Human
acucuguucuuccgccgcuccgcc

SEQ ID NO: 33308 - RNA, 24 nt, Human
ccgcuucgccaacuacaucgacaa

SEQ ID NO: 33309 - RNA, 24 nt, Human
ugaugggggugauauacgugccuu

SEQ ID NO: 33310 - RNA, 21 nt, Human
gcccgguguucaccgggcugg

SEQ ID NO: 33311 - RNA, 21 nt, Human
uagaggccaugugugagguag

SEQ ID NO: 33312 - RNA, 24 nt, Human
gcccccugagguccaugcagcccu

SEQ ID NO: 33313 - RNA, 24 nt, Human
caacguugaaggucagugugaugg

SEQ ID NO: 33314 - RNA, 24 nt, Human
ucgcagcagcucugccaguagcgc

SEQ ID NO: 33315 - RNA, 24 nt, Human
ucccggacgaagacgcugccauug

SEQ ID NO: 33316 - RNA, 24 nt, Human
gacgcuguugggcuugaacuuccc

SEQ ID NO: 33317 - RNA, 24 nt, Human
gcuugcucacguucuuggucacuu

SEQ ID NO: 33318 - RNA, 24 nt, Human
agcacugaccgaccauugccauuu

SEQ ID NO: 33319 - RNA, 24 nt, Human
uucacuuuaccuucugccaaaugc

SEQ ID NO: 33320 - RNA, 24 nt, Human
agaaagacguuuuccaaaaugcuu

SEQ ID NO: 33321 - RNA, 24 nt, Human
aggaaggagauuaggagacucuga

SEQ ID NO: 33322 - RNA, 24 nt, Human
ucuuacagcccccaggcaugugga

SEQ ID NO: 33323 - RNA, 20 nt, Human
ccgcgccgccuuggugcugc

SEQ ID NO: 33324 - RNA, 24 nt, Human
cugcccggccugcccugguugggg

SEQ ID NO: 33325 - RNA, 24 nt, Human
augcauuuccuggagaauauaucc

SEQ ID NO: 33326 - RNA, 24 nt, Human
aggcggcguggacagcggccccgg

SEQ ID NO: 33327 - RNA, 24 nt, Human
uaugcaggccaucaaguguguggu

SEQ ID NO: 33328 - RNA, 24 nt, Human
ugaccagauuacgcccccuaaucc

SEQ ID NO: 33329 - RNA, 24 nt, Human
gacugcuugcaauccuugacuagu

SEQ ID NO: 33330 - RNA, 24 nt, Human
gagcuuguuuuccugcaacuagac

SEQ ID NO: 33331 - RNA, 24 nt, Human
uaaggagcgugcaaccuacauccc

SEQ ID NO: 33332 - RNA, 24 nt, Human
ccggccccuaaccugcugugcacc

SEQ ID NO: 33333 - RNA, 24 nt, Human
uauuuugucuucauggaauauauc

SEQ ID NO: 33334 - RNA, 22 nt, Human
cgccgggacagcagacugccgg

SEQ ID NO: 33335 - RNA, 24 nt, Human
cagccuggacuuaccaccacuaaa

SEQ ID NO: 33336 - RNA, 24 nt, Human
aagcagcaccaauggggaugaccc

SEQ ID NO: 33337 - RNA, 24 nt, Human
acugcaguggugcaaucucagcuc

SEQ ID NO: 33338 - RNA, 24 nt, Human
ugugcagaagaaauggaaggauuc

SEQ ID NO: 33339 - RNA, 24 nt, Human
uucaaauuucuuucuuuuuuaauu

SEQ ID NO: 33340 - RNA, 24 nt, Human
ucaauuuuuauuuugguuuucuua

SEQ ID NO: 33341 - RNA, 24 nt, Human
uuaguauuauuuauuugacaacuc

SEQ ID NO: 33342 - RNA, 17 nt, Human
uaauaugucugugcagc

SEQ ID NO: 33343 - RNA, 24 nt, Human
ugaggaggauaccgaugucagagg

SEQ ID NO: 33344 - RNA, 24 nt, Human
cauacaaggcgacguguggguucu

SEQ ID NO: 33345 - RNA, 18 nt, Human
uccggaaaugugucaugg

SEQ ID NO: 33346 - RNA, 24 nt, Human
uguuguacggcugugggaccggcg

SEQ ID NO: 33347 - RNA, 24 nt, Human
agaguccauucuggucccucaggc

SEQ ID NO: 33348 - RNA, 24 nt, Human
ucugagguugccaucagccagggc

SEQ ID NO: 33349 - RNA, 21 nt, Human
ugggauggguucaaagugugg

SEQ ID NO: 33350 - RNA, 24 nt, Human
ugauaacgacaggagaaaguuuca

SEQ ID NO: 33351 - RNA, 24 nt, Human
ugggagcggcggcagcuguugggg

SEQ ID NO: 33352 - RNA, 24 nt, Human
ucacuagugauugugagcugagau

SEQ ID NO: 33353 - RNA, 24 nt, Human
auacuccaaguucaaacugcuucc

SEQ ID NO: 33354 - RNA, 17 nt, Human
uaccuagaccuucacac

SEQ ID NO: 33355 - RNA, 24 nt, Human
cacccccacuuaggcuccugcacu

SEQ ID NO: 33356 - RNA, 24 nt, Human
cacaccuguaaucccagcacuuug

SEQ ID NO: 33357 - RNA, 24 nt, Human
ucacugagcgagguacaguucaca

SEQ ID NO: 33358 - RNA, 24 nt, Human
cacugauuuuauauauuaccccgu

SEQ ID NO: 33359 - RNA, 24 nt, Human
uaauagguuguggaaaguggguaa

SEQ ID NO: 33360 - RNA, 24 nt, Human
aauaaguauucauuggaauauaug

SEQ ID NO: 33361 - RNA, 24 nt, Human
gagcuucccaggagcaggucuggg

SEQ ID NO: 33362 - RNA, 24 nt, Human
uacuacuccucucauuauauaugu

SEQ ID NO: 33363 - RNA, 19 nt, Human
gggcguggugcugaaggag

SEQ ID NO: 33364 - RNA, 24 nt, Human
uacaagaucacugacucugaggac

SEQ ID NO: 33365 - RNA, 24 nt, Human
ugaagagauaccugaagucugaac

SEQ ID NO: 33366 - RNA, 24 nt, Human
gccccuugguguggucauuguaag

SEQ ID NO: 33367 - RNA, 24 nt, Human
cugcugcacgugaagcggggcgac

SEQ ID NO: 33368 - RNA, 19 nt, Human
acaaagcaagagaagaagc

SEQ ID NO: 33369 - RNA, 21 nt, Human
cauuggacaggacauccagcc

SEQ ID NO: 33370 - RNA, 24 nt, Human
cagcggcagagagccauccucuau

SEQ ID NO: 33371 - RNA, 24 nt, Human
ugggacaagcuggucaagguaugg

SEQ ID NO: 33372 - RNA, 24 nt, Human
cauggacccugacuggcucauugg

SEQ ID NO: 33373 - RNA, 24 nt, Human
gcaggagaggaugggcgcagcccu

SEQ ID NO: 33374 - RNA, 24 nt, Human
ugacaaguguguuugagcuggaag

SEQ ID NO: 33375 - RNA, 23 nt, Human
caugagcauaacacgcacgggca

SEQ ID NO: 33376 - RNA, 24 nt, Human
uaauuguauagaaccucucagcag

SEQ ID NO: 33377 - RNA, 22 nt, Human
acuauauuaagauaaauuggcc

SEQ ID NO: 33378 - RNA, 24 nt, Human
uggaaugcuaaacguaugccauuu

SEQ ID NO: 33379 - RNA, 24 nt, Human
ucggaccuggaggaggaccugggc

SEQ ID NO: 33380 - RNA, 24 nt, Human
uaauagacagagugggagaugcca

SEQ ID NO: 33381 - RNA, 24 nt, Human
uaagugccuuuguggacagauuau

SEQ ID NO: 33382 - RNA, 24 nt, Human
gcgcauucgucuuccgagcgcuac

SEQ ID NO: 33383 - RNA, 24 nt, Human
gaccgcgaggaggacggcuugggg

SEQ ID NO: 33384 - RNA, 23 nt, Human
ucccaggguugacgaauucgcag

SEQ ID NO: 33385 - RNA, 24 nt, Human
ugaggagcugcagagccugggcug

SEQ ID NO: 33386 - RNA, 24 nt, Human
ucagaaccuggacugcgggguccc

SEQ ID NO: 33387 - RNA, 17 nt, Human
cacccugcucuccgagc

SEQ ID NO: 33388 - RNA, 24 nt, Human
uguauaaaggucgauuguaagacu

SEQ ID NO: 33389 - RNA, 24 nt, Human
ucugaagugaggguggagguggag

SEQ ID NO: 33390 - RNA, 24 nt, Human
uggcagcccaggccaagcugagca

SEQ ID NO: 33391 - RNA, 24 nt, Human
gagcacucugaggggccugugggc

SEQ ID NO: 33392 - RNA, 24 nt, Human
ugcaaggagcuccccaagggcccg

SEQ ID NO: 33393 - RNA, 24 nt, Human
aggcaaggccacgggagacuggug

SEQ ID NO: 33394 - RNA, 24 nt, Human
aguggcaacugccaaaagugauuc

SEQ ID NO: 33395 - RNA, 24 nt, Human
ggagaucacgccacugcacuccag

SEQ ID NO: 33396 - RNA, 24 nt, Human
agagagaaaacaguaaguuggaaa

SEQ ID NO: 33397 - RNA, 24 nt, Human
ucacaaggucaggagaucgagacc

SEQ ID NO: 33398 - RNA, 24 nt, Human
uuaaugauuaauguaaagggucug

SEQ ID NO: 33399 - RNA, 24 nt, Human
uacugggugaauagcacuuuccuu

SEQ ID NO: 33400 - RNA, 24 nt, Human
uggaagaucuuagaauugccugcc

SEQ ID NO: 33401 - RNA, 24 nt, Human
ucacuuggaagacucccugaaauc

SEQ ID NO: 33402 - RNA, 24 nt, Human
uuuaaaguguacaauucaguguug

SEQ ID NO: 33403 - RNA, 24 nt, Human
uggcuucuuucauuuacauguuua

SEQ ID NO: 33404 - RNA, 24 nt, Human
ugacaaaaggagggguacuuuuuc

SEQ ID NO: 33405 - RNA, 24 nt, Human
uacccuggcuggagugcagugacg

SEQ ID NO: 33406 - RNA, 24 nt, Human
ugaccaggaaauacaacgagcugc

SEQ ID NO: 33407 - RNA, 24 nt, Human
uaucaaggaagggcaggcgugaug

SEQ ID NO: 33408 - RNA, 24 nt, Human
uucaaauuucuuucuuuuuuaauu

SEQ ID NO: 33409 - RNA, 24 nt, Human
ucugaucaauccuucuuuuucucu

SEQ ID NO: 33410 - RNA, 24 nt, Human
ucaauuuuuauuuugguuuucuua

SEQ ID NO: 33411 - RNA, 24 nt, Human
acaccagccuguuacuaacagccu

SEQ ID NO: 33412 - RNA, 24 nt, Human
uaaugggucucaaaauucugugac

SEQ ID NO: 33413 - RNA, 24 nt, Human
uuggugggucuugguggggcccag

SEQ ID NO: 33414 - RNA, 24 nt, Human
ccgguccugggcuuaucccugcaa

SEQ ID NO: 33415 - RNA, 24 nt, Human
caguguugaggaccaucuugccug

SEQ ID NO: 33416 - RNA, 24 nt, Human
uguuguuuugguccugauaggaag

SEQ ID NO: 33417 - RNA, 24 nt, Human
agaaaacuugucacauguaugguu

SEQ ID NO: 33418 - RNA, 24 nt, Human
uggacgguuggugcaagugcaucc

SEQ ID NO: 33419 - RNA, 24 nt, Human
aacccuuucuccuuccuggggccu

SEQ ID NO: 33420 - RNA, 24 nt, Human
uggaggccccuggagccagauggc

SEQ ID NO: 33421 - RNA, 24 nt, Human
ucccaaaccuggcuuggggucaag

SEQ ID NO: 33422 - RNA, 20 nt, Human
uguccagaauuuccagaagu

SEQ ID NO: 33423 - RNA, 24 nt, Human
ugagugcccccagggagggugcug

SEQ ID NO: 33424 - RNA, 24 nt, Human
uguggcccuucucuuuaaguccga

SEQ ID NO: 33425 - RNA, 24 nt, Human
uaacuacaauuuaauuucacguug

SEQ ID NO: 33426 - RNA, 24 nt, Human
aacauuccaacccuuaaagcuaaa

SEQ ID NO: 33427 - RNA, 24 nt, Human
uguauaguaauggccuucagcauc

SEQ ID NO: 33428 - RNA, 24 nt, Human
aacaggauguuuaacucuuuuauc

SEQ ID NO: 33429 - RNA, 20 nt, Human
ugggauuuuuuuuuuuuuuu

SEQ ID NO: 33430 - RNA, 24 nt, Human
acagugcucuucgccagaaguugg

SEQ ID NO: 33431 - RNA, 24 nt, Human
caugugguuugcgguaacaccacc

SEQ ID NO: 33432 - RNA, 24 nt, Human
uaccauggucuagaagugcacugg

SEQ ID NO: 33433 - RNA, 24 nt, Human
uggaaugauauuuuaggaauaacg

SEQ ID NO: 33434 - RNA, 24 nt, Human
ugcaaggaggggaucaaggacggu

SEQ ID NO: 33435 - RNA, 24 nt, Human
aggacagagaagcaaacagagcuc

SEQ ID NO: 33436 - RNA, 24 nt, Human
uacuacgccaugaagauccucaag

SEQ ID NO: 33437 - RNA, 24 nt, Human
ggggagcagacaaguaccacuccg

SEQ ID NO: 33438 - RNA, 24 nt, Human
ccacacagauucugcauggccccu

SEQ ID NO: 33439 - RNA, 24 nt, Human
gaccguaauuguggcugcacugga

SEQ ID NO: 33440 - RNA, 24 nt, Human
ugucauaggcaucgacgaggggca

SEQ ID NO: 33441 - RNA, 20 nt, Human
uucacaaauucucucugcgg

SEQ ID NO: 33442 - RNA, 24 nt, Human
uaauuaguuuuggucaucguauuu

SEQ ID NO: 33443 - RNA, 24 nt, Human
uaaaucuaaggauggugggcuuuc

SEQ ID NO: 33444 - RNA, 24 nt, Human
uccacauuccaggagcugugcgac

SEQ ID NO: 33445 - RNA, 20 nt, Human
uacaagcaaagacccgacgu

SEQ ID NO: 33446 - RNA, 24 nt, Human
cgaggucaguaccacgcccgaccc

SEQ ID NO: 33447 - RNA, 24 nt, Human
ugagaaaagccaacuuagacaaga

SEQ ID NO: 33448 - RNA, 24 nt, Human
ggaugagacguuugcuguccugag

SEQ ID NO: 33449 - RNA, 24 nt, Human
uggcaagggucccuccauuaagca

SEQ ID NO: 33450 - RNA, 24 nt, Human
gcacauggugggucccgauuggcg

SEQ ID NO: 33451 - RNA, 24 nt, Human
uacaccguuaaaacccugagugga

SEQ ID NO: 33452 - RNA, 24 nt, Human
uuguguguguguuucuccaauccu

SEQ ID NO: 33453 - RNA, 24 nt, Human
uauacacccuuuuuuuccuucucu

SEQ ID NO: 33454 - RNA, 24 nt, Human
uugcaugggccuuacuucuauaac

SEQ ID NO: 33455 - RNA, 22 nt, Human
ugauagggucuaccacaucugu

SEQ ID NO: 33456 - RNA, 24 nt, Human
ugguaggagugcucaugguucugu

SEQ ID NO: 33457 - RNA, 24 nt, Human
ucuucaguaaucgacauuccacua

SEQ ID NO: 33458 - RNA, 22 nt, Human
uuccuguggaccugacaguuaa

SEQ ID NO: 33459 - RNA, 24 nt, Human
guccuuguccucuccaaacaccag

SEQ ID NO: 33460 - RNA, 24 nt, Human
uucagggacaaggagaaugcgugg

SEQ ID NO: 33461 - RNA, 24 nt, Human
cgaguucaguccugcucuccgcac

SEQ ID NO: 33462 - RNA, 19 nt, Human
cauggcucuaacgacaggu

SEQ ID NO: 33463 - RNA, 24 nt, Human
uaguagacuacagugaggaaaauu

SEQ ID NO: 33464 - RNA, 24 nt, Human
ugaggauaugcuuggucggguauu

SEQ ID NO: 33465 - RNA, 24 nt, Human
ugguuugguaaagaaauccaaaga

SEQ ID NO: 33466 - RNA, 24 nt, Human
uggcaaggagcggcccgaaguggu

SEQ ID NO: 33467 - RNA, 24 nt, Human
caguggccucugugagccccagcc

SEQ ID NO: 33468 - RNA, 24 nt, Human
ugauggucucaagggucguguguu

SEQ ID NO: 33469 - RNA, 22 nt, Human
ugucaagacuaccgaugguuac

SEQ ID NO: 33470 - RNA, 20 nt, Human
cauggaucuuacccgugaca

SEQ ID NO: 33471 - RNA, 24 nt, Human
ugugauugaagauuucagagaggu

SEQ ID NO: 33472 - RNA, 24 nt, Human
agguacgagccuggcuuguuuauu

SEQ ID NO: 33473 - RNA, 24 nt, Human
ugaguggcuuugcaggccuggugg

SEQ ID NO: 33474 - RNA, 24 nt, Human
caccuuguggccccuagcaggccc

SEQ ID NO: 33475 - RNA, 24 nt, Human
cgugaccucaaguguccacugcug

SEQ ID NO: 33476 - RNA, 24 nt, Human
cacuacaccauuggcaaggagauc

SEQ ID NO: 33477 - RNA, 24 nt, Human
uaucuugguuuuccacagcuauug

SEQ ID NO: 33478 - RNA, 24 nt, Human
ugauuauaggcaggaaauccaagc

SEQ ID NO: 33479 - RNA, 21 nt, Human
uaccauagcuaaaggauugcu

SEQ ID NO: 33480 - RNA, 24 nt, Human
cuuaaauucucuggguuuuguuuu

SEQ ID NO: 33481 - RNA, 24 nt, Human
cacacgguggagccaacggaggcc

SEQ ID NO: 33482 - RNA, 22 nt, Human
ucccugaccuccagagccaagg

SEQ ID NO: 33483 - RNA, 24 nt, Human
uggagugauggugcucagcgcaac

SEQ ID NO: 33484 - RNA, 24 nt, Human
acucgauucuguagccggcucugc

SEQ ID NO: 33485 - RNA, 24 nt, Human
cgugcacauucacaccccagcagg

SEQ ID NO: 33486 - RNA, 24 nt, Human
ugugcagaagaaauggaaggauuc

SEQ ID NO: 33487 - RNA, 24 nt, Human
uucaaauuucuuucuuuuuuaauu

SEQ ID NO: 33488 - RNA, 24 nt, Human
uaccagagauggggugaugauuau

SEQ ID NO: 33489 - RNA, 24 nt, Human
auuaugcugcaaauagaucccagg

SEQ ID NO: 33490 - RNA, 24 nt, Human
uuggcccguuuggaagcggcacgc

SEQ ID NO: 33491 - RNA, 24 nt, Human
uagccuggcuagguaaggaaaggg

SEQ ID NO: 33492 - RNA, 24 nt, Human
uccugguagggagugcguagcagg

SEQ ID NO: 33493 - RNA, 21 nt, Human
ugacaagaguugcccugcagg

SEQ ID NO: 33494 - RNA, 22 nt, Human
ugacuuugguuuuggggaaagg

SEQ ID NO: 33495 - RNA, 24 nt, Human
ucuuucacuggaauugcaaaggga

SEQ ID NO: 33496 - RNA, 24 nt, Human
ucaguuaaaaaagaagaagaagaa

SEQ ID NO: 33497 - RNA, 24 nt, Human
ucugaucaauccuucuuuuucucu

SEQ ID NO: 33498 - RNA, 24 nt, Human
ucaauuuuuauuuugguuuucuua

SEQ ID NO: 33499 - RNA, 22 nt, Human
ugccuugggucccuucaguagc

SEQ ID NO: 33500 - RNA, 24 nt, Human
ugucaggaaggggaagcggguuuc

SEQ ID NO: 33501 - RNA, 24 nt, Human
ugucuaagaucguguuuacuaccu

SEQ ID NO: 33502 - RNA, 24 nt, Human
ugagaauggcaaaauuagucgccu

SEQ ID NO: 33503 - RNA, 24 nt, Human
uacaccacucccaagaagaauaag

SEQ ID NO: 33504 - RNA, 24 nt, Human
augaacucagggccgguuguggcc

SEQ ID NO: 33505 - RNA, 24 nt, Human
ugacuacaagucuugugcucauga

SEQ ID NO: 33506 - RNA, 24 nt, Human
uccagcagauucaaagccaggcac

SEQ ID NO: 33507 - RNA, 24 nt, Human
uugaagccaguggggcaccaaucc

SEQ ID NO: 33508 - RNA, 24 nt, Human
uaccauggcgagggucacauuuca

SEQ ID NO: 33509 - RNA, 24 nt, Human
uaucaaggaagggcaggcgugaug

SEQ ID NO: 33510 - RNA, 24 nt, Human
uaagaguguugaaaaaaaaauuca

SEQ ID NO: 33511 - RNA, 24 nt, Human
uaaugggucucaaaauucugugac

SEQ ID NO: 33512 - RNA, 24 nt, Human
ugagaauggcaaaauuagucgccu

SEQ ID NO: 33513 - RNA, 24 nt, Human
acagugcagaaacuuacuuugaaa

SEQ ID NO: 33514 - RNA, 24 nt, Human
ucacagaagaaaagccugguucau

SEQ ID NO: 33515 - RNA, 24 nt, Human
ugugaaguggauaucaaucauugu

SEQ ID NO: 33516 - RNA, 24 nt, Human
uccacauuuauuuauugauuuuuc

SEQ ID NO: 33517 - RNA, 24 nt, Human
uguaaucauaagcaucugcgaaug

SEQ ID NO: 33518 - RNA, 24 nt, Human
gcagcgcaaacuugaccugcaaag

SEQ ID NO: 33519 - RNA, 24 nt, Human
aagugcccgccaaagcuguggccc

SEQ ID NO: 33520 - RNA, 24 nt, Human
gagcguuuccuaagcuccacugaa

SEQ ID NO: 33521 - RNA, 24 nt, Human
uccggaggugucacccucaauggc

SEQ ID NO: 33522 - RNA, 24 nt, Human
guaaaguuugucggcaaagaagag

SEQ ID NO: 33523 - RNA, 24 nt, Human
uucauuggcaguauuuugugauga

SEQ ID NO: 33524 - RNA, 24 nt, Human
ugguauauuuauguaugugugugu

SEQ ID NO: 33525 - RNA, 24 nt, Human
ugauuugaauauugugguacaacu

SEQ ID NO: 33526 - RNA, 24 nt, Human
gagcguuuccuaagcuccacugaa

SEQ ID NO: 33527 - RNA, 24 nt, Human
uccggaggugucacccucaauggc

SEQ ID NO: 33528 - RNA, 24 nt, Human
uaucacggaaucuuuuccagaguu

SEQ ID NO: 33529 - RNA, 24 nt, Human
uauuuuaaaauggcugguaauuau

SEQ ID NO: 33530 - RNA, 24 nt, Human
augcaucacucaagucaaagccug

SEQ ID NO: 33531 - RNA, 24 nt, Human
ugggcagaagaaaaggggcguucu

SEQ ID NO: 33532 - RNA, 24 nt, Human
uugacggaaaaggcacuuaaaugu

SEQ ID NO: 33533 - RNA, 24 nt, Human
uggcacgcucgaacuuccggcccu

SEQ ID NO: 33534 - RNA, 24 nt, Human
uacaccuuuuggcccuugcgagga

SEQ ID NO: 33535 - RNA, 24 nt, Human
cacaaccacggccgucuuguuuuc

SEQ ID NO: 33536 - RNA, 24 nt, Human
cagcauggaggacugugacugaug

SEQ ID NO: 33537 - RNA, 24 nt, Human
uuaggagucucaggucuccccggg

SEQ ID NO: 33538 - RNA, 24 nt, Human
ccgcugcccugccgccagggcuug

SEQ ID NO: 33539 - RNA, 24 nt, Human
uggaaugcaguggcacgaucucgg

SEQ ID NO: 33540 - RNA, 24 nt, Human
cagccuucagucugauccaccaga

SEQ ID NO: 33541 - RNA, 24 nt, Human
guuuucuuggugaagagcagaauu

SEQ ID NO: 33542 - RNA, 24 nt, Human
agcuggacuucuggcgggggccug

SEQ ID NO: 33543 - RNA, 21 nt, Human
uuuuuuggcaaugaauucugg

SEQ ID NO: 33544 - RNA, 24 nt, Human
aggcggaagugcaggguugugauc

SEQ ID NO: 33545 - RNA, 21 nt, Human
aaaugggaacaauaucaauau

SEQ ID NO: 33546 - RNA, 24 nt, Human
auuuauuuuuaaaauaauuuauca

SEQ ID NO: 33547 - RNA, 24 nt, Human
auagccuguugcgucaugugauuc

SEQ ID NO: 33548 - RNA, 24 nt, Human
aggcacagcacaguccuccggcuu

SEQ ID NO: 33549 - RNA, 24 nt, Human
ugagaauggcaaaauuagucgccu

SEQ ID NO: 33550 - RNA, 24 nt, Human
uacaccacucccaagaagaauaag

SEQ ID NO: 33551 - RNA, 24 nt, Human
ucccugugucuccccagguaguaa

SEQ ID NO: 33552 - RNA, 24 nt, Human
uuuuguggagugauggguaacgau

SEQ ID NO: 33553 - RNA, 24 nt, Human
ugacgucacucacucugagaccua

SEQ ID NO: 33554 - RNA, 24 nt, Human
uggcauagucaauccaacaauaag

SEQ ID NO: 33555 - RNA, 24 nt, Human
uggcauccgagagagacuggagca

SEQ ID NO: 33556 - RNA, 24 nt, Human
cccccauuaaggcacuauggcgug

SEQ ID NO: 33557 - RNA, 24 nt, Human
uggguucuuuggagaaaauaauga

SEQ ID NO: 33558 - RNA, 24 nt, Human
ugccugcgccugcuccuguuauca

SEQ ID NO: 33559 - RNA, 24 nt, Human
gaacaugcuacuuagacauggaga

SEQ ID NO: 33560 - RNA, 24 nt, Human
gucggcucucccaccugccccucu

SEQ ID NO: 33561 - RNA, 20 nt, Human
ucccacuuaaacacaggccc

SEQ ID NO: 33562 - RNA, 24 nt, Human
uuggggcagaacuagguaccaagc

SEQ ID NO: 33563 - RNA, 24 nt, Human
uaauguaguaggagaugggguaaa

SEQ ID NO: 33564 - RNA, 24 nt, Human
ucccuggaccagcccgguggcacc

SEQ ID NO: 33565 - RNA, 24 nt, Human
ugaggacaaggcagacgugcaguc

SEQ ID NO: 33566 - RNA, 24 nt, Human
agccuggauggugcagacagcacu

SEQ ID NO: 33567 - RNA, 22 nt, Human
gcugcagccccacaccucuccu

SEQ ID NO: 33568 - RNA, 24 nt, Human
agaggcuacaucuacacagggcgg

SEQ ID NO: 33569 - RNA, 24 nt, Human
gaccuggucuuuggcgucagggau

SEQ ID NO: 33570 - RNA, 24 nt, Human
uaaaauuuuauaaaucuccccuau

SEQ ID NO: 33571 - RNA, 24 nt, Human
uauguguauauauacauauauaca

SEQ ID NO: 33572 - RNA, 22 nt, Human
uacauuauguuaccugaugaua

SEQ ID NO: 33573 - RNA, 24 nt, Human
ugaaagugcucacaaacuucaaga

SEQ ID NO: 33574 - RNA, 24 nt, Human
uguggacgagcaggaggaggcggc

SEQ ID NO: 33575 - RNA, 24 nt, Human
uugaucuugaagaaacugggcgug

SEQ ID NO: 33576 - RNA, 24 nt, Human
aggaaggagauauagugaagagga

SEQ ID NO: 33577 - RNA, 24 nt, Human
guagaguuuucuucaggcuuaaag

SEQ ID NO: 33578 - RNA, 24 nt, Human
uaaccgaaaacguucagguugguc

SEQ ID NO: 33579 - RNA, 24 nt, Human
ucaagaaaccccuucuccuaaccc

SEQ ID NO: 33580 - RNA, 24 nt, Human
ucucgcucugucacccaggcugga

SEQ ID NO: 33581 - RNA, 24 nt, Human
ugcauuguuaucauuaaccagucu

SEQ ID NO: 33582 - RNA, 24 nt, Human
uauuagggauaauauucauuuagc

SEQ ID NO: 33583 - RNA, 24 nt, Human
uaaugggucucaaaauucugugac

SEQ ID NO: 33584 - RNA, 24 nt, Human
ucacugcauuccagccugggugac

SEQ ID NO: 33585 - RNA, 24 nt, Human
ugacaugcgucaugucuggguucu

SEQ ID NO: 33586 - RNA, 24 nt, Human
guagcggaaccagauugcagggau

SEQ ID NO: 33587 - RNA, 24 nt, Human
aagccccccaaagaacaagggaaa

SEQ ID NO: 33588 - RNA, 24 nt, Human
aaguggccuugugaucaugagggu

SEQ ID NO: 33589 - RNA, 24 nt, Human
cuuccggucuggcuuccaaaagga

SEQ ID NO: 33590 - RNA, 24 nt, Human
uagcauugaaggacucggggauau

SEQ ID NO: 33591 - RNA, 24 nt, Human
uagcauugaaggacucggggauau

SEQ ID NO: 33592 - RNA, 24 nt, Human
uuaaacccgucaauuuuuaaccug

SEQ ID NO: 33593 - RNA, 24 nt, Human
ggggauuucuggcucuuuccucuu

SEQ ID NO: 33594 - RNA, 24 nt, Human
uugcauggcgccugcuggaggagg

SEQ ID NO: 33595 - RNA, 24 nt, Human
gccccuggcagacauagcugcuuc

SEQ ID NO: 33596 - RNA, 24 nt, Human
uggacuugcccuuugacaaggggc

SEQ ID NO: 33597 - RNA, 24 nt, Human
cgaggugggcggaucacuugaggu

SEQ ID NO: 33598 - RNA, 24 nt, Human
uagaagcauuucucacuguccuca

SEQ ID NO: 33599 - RNA, 24 nt, Human
ugacaugagauacccaaugccguc

SEQ ID NO: 33600 - RNA, 24 nt, Human
ucugcauaguacuugauuuugggc

SEQ ID NO: 33601 - RNA, 24 nt, Human
ugauauguauauuaucauauuaua

SEQ ID NO: 33602 - RNA, 24 nt, Human
cugucugcaaguugaggagcaagg

SEQ ID NO: 33603 - RNA, 24 nt, Human
ucaggagaccauugcaucauuggc

SEQ ID NO: 33604 - RNA, 24 nt, Human
uacccuguucaacuacuggcuucg

SEQ ID NO: 33605 - RNA, 24 nt, Human
uggaaacauauuagaucuuuguac

SEQ ID NO: 33606 - RNA, 24 nt, Human
cuugacacuuccauugcccaugaa

SEQ ID NO: 33607 - RNA, 24 nt, Human
uggaacgggaugauauuuaugugu

SEQ ID NO: 33608 - RNA, 24 nt, Human
aucacuuacggucagcccuuucuu

SEQ ID NO: 33609 - RNA, 22 nt, Human
agccagcgccugcagcuccugg

SEQ ID NO: 33610 - RNA, 24 nt, Human
ccugcagauccucaucaaggucaa

SEQ ID NO: 33611 - RNA, 24 nt, Human
uugaaaacggcaaggccaacuccg

SEQ ID NO: 33612 - RNA, 24 nt, Human
ccugacacugcccgcuacuacaag

SEQ ID NO: 33613 - RNA, 24 nt, Human
uccaccaacaaccccucccaggcu

SEQ ID NO: 33614 - RNA, 24 nt, Human
uggaagaugcucaacaccuccucc

SEQ ID NO: 33615 - RNA, 24 nt, Human
ugaccaggaaauacaacgagcugc

SEQ ID NO: 33616 - RNA, 24 nt, Human
ccuggcacccagcucagcucccac

SEQ ID NO: 33617 - RNA, 24 nt, Human
ugcucauugguacggcgggguuuc

SEQ ID NO: 33618 - RNA, 24 nt, Human
uccaccaacaaccccucccaggcu

SEQ ID NO: 33619 - RNA, 24 nt, Human
uggaagaugcucaacaccuccucc

SEQ ID NO: 33620 - RNA, 24 nt, Human
ugaccaggaaauacaacgagcugc

SEQ ID NO: 33621 - RNA, 24 nt, Human
acugaacugcgcugccagugcuug

SEQ ID NO: 33622 - RNA, 24 nt, Human
uuuuagguguaaaauaauuaaggg

SEQ ID NO: 33623 - RNA, 24 nt, Human
accacguuccuugccuuucgauug

SEQ ID NO: 33624 - RNA, 24 nt, Human
cuggucccccuugaaacggcuguc

SEQ ID NO: 33625 - RNA, 24 nt, Human
uguugcagugaagccaacagagac

SEQ ID NO: 33626 - RNA, 24 nt, Human
ugagaagaauguaauccaagugau

SEQ ID NO: 33627 - RNA, 24 nt, Human
uaacacucacaacaaaagcuaagu

SEQ ID NO: 33628 - RNA, 22 nt, Human
aggcagccaccuggcgagucug

SEQ ID NO: 33629 - RNA, 24 nt, Human
ucucuccaauucgcugagccaucc

SEQ ID NO: 33630 - RNA, 21 nt, Human
gaccccuucaaccugggcgga

SEQ ID NO: 33631 - RNA, 24 nt, Human
uuccugaacagucagcgauuccag

SEQ ID NO: 33632 - RNA, 24 nt, Human
uucaacuuugauguucaugacgau

SEQ ID NO: 33633 - RNA, 24 nt, Human
ccaugcaggcaagguggugcugag

SEQ ID NO: 33634 - RNA, 24 nt, Human
uacacagaaucgccagaucgacag

SEQ ID NO: 33635 - RNA, 24 nt, Human
ugggaagugguuaagugugcccac

SEQ ID NO: 33636 - RNA, 17 nt, Human
ugcaguggccuaccgag

SEQ ID NO: 33637 - RNA, 20 nt, Human
cacugagucacaucauuccc

SEQ ID NO: 33638 - RNA, 24 nt, Human
ucauucauuuggcccaaaaucacg

SEQ ID NO: 33639 - RNA, 24 nt, Human
uacugcacacgucccuagagccua

SEQ ID NO: 33640 - RNA, 20 nt, Human
cacuguguggccggcagggu

SEQ ID NO: 33641 - RNA, 24 nt, Human
ugaaccuaagagcagguccucgag

SEQ ID NO: 33642 - RNA, 24 nt, Human
uaggaggauguggcuguugggguu

SEQ ID NO: 33643 - RNA, 24 nt, Human
ugggggaacuggagccugcugacc

SEQ ID NO: 33644 - RNA, 24 nt, Human
uuucggggcuccgggcccuagagg

SEQ ID NO: 33645 - RNA, 24 nt, Human
uuaggucugcuacucaaaugaacu

SEQ ID NO: 33646 - RNA, 24 nt, Human
agccaggaacauggacugaaguau

SEQ ID NO: 33647 - RNA, 24 nt, Human
ugccacagaacacuugacagugcu

SEQ ID NO: 33648 - RNA, 24 nt, Human
uuaccgguauuguaagaacaagcc

SEQ ID NO: 33649 - RNA, 24 nt, Human
uccaugagggcuucccaaugugcu

SEQ ID NO: 33650 - RNA, 23 nt, Human
uuugaccuggggcggaaaaaggc

SEQ ID NO: 33651 - RNA, 23 nt, Human
ugccuuuggaaagccccaggcac

SEQ ID NO: 33652 - RNA, 23 nt, Human
ucggauucuucuuucuuugcuuc

SEQ ID NO: 33653 - RNA, 24 nt, Human
uaggagcagguccaccggccccua

SEQ ID NO: 33654 - RNA, 24 nt, Human
ccaggccaaaaaggcucaacauuu

SEQ ID NO: 33655 - RNA, 24 nt, Human
ugaguagcuugccaaccugacccu

SEQ ID NO: 33656 - RNA, 24 nt, Human
uguccuggguggguggcuggccag

SEQ ID NO: 33657 - RNA, 24 nt, Human
uggcagcugcagaaacagcaguuc

SEQ ID NO: 33658 - RNA, 24 nt, Human
acucgcgccaguggaggugacauc

SEQ ID NO: 33659 - RNA, 24 nt, Human
cugcaguguuccccgagccuguua

SEQ ID NO: 33660 - RNA, 24 nt, Human
uggaugguggccucacccagauug

SEQ ID NO: 33661 - RNA, 24 nt, Human
ugagaugggaaagggcuccuucaa

SEQ ID NO: 33662 - RNA, 24 nt, Human
aggccauuaacuguuugaugcgag

SEQ ID NO: 33663 - RNA, 24 nt, Human
acucgcaguccuucuucucuggcc

SEQ ID NO: 33664 - RNA, 24 nt, Human
aggaagugguccccugauuccaaa

SEQ ID NO: 33665 - RNA, 19 nt, Human
ugccucaucccuuaguuuc

SEQ ID NO: 33666 - RNA, 18 nt, Human
cagccgggguauucaggc

SEQ ID NO: 33667 - RNA, 24 nt, Human
cuggcgccucagcuccucgcgcuc

SEQ ID NO: 33668 - RNA, 24 nt, Human
ucgccgguccaggucguagggccg

SEQ ID NO: 33669 - RNA, 24 nt, Human
cacuguguucaauuuugaguuucc

SEQ ID NO: 33670 - RNA, 24 nt, Human
uggauggauauacucguauuuccu

SEQ ID NO: 33671 - RNA, 24 nt, Human
ucacugcaaccuccgccucccagg

SEQ ID NO: 33672 - RNA, 24 nt, Human
uaaugggucucaaaauucugugac

SEQ ID NO: 33673 - RNA, 24 nt, Human
ucagucacuugcacaauuaauccu

SEQ ID NO: 33674 - RNA, 24 nt, Human
uuccaucggcuuuuccagggccca

SEQ ID NO: 33675 - RNA, 24 nt, Human
uccacuggcgaaagaugccuuucu

SEQ ID NO: 33676 - RNA, 24 nt, Human
uaguucagauugaucuuaggucaa

SEQ ID NO: 33677 - RNA, 24 nt, Human
uaacaagcuuaugaaguuaguauu

SEQ ID NO: 33678 - RNA, 24 nt, Human
gaagagccaggagcuacucagcaa

SEQ ID NO: 33679 - RNA, 24 nt, Human
acaggagugguccuuauccgguuu

SEQ ID NO: 33680 - RNA, 24 nt, Human
cugcccccucggucacucucuucc

SEQ ID NO: 33681 - RNA, 24 nt, Human
uuagauuguaauucuguaucaaug

SEQ ID NO: 33682 - RNA, 24 nt, Human
ugugaccaaagccuaagaagccag

SEQ ID NO: 33683 - RNA, 24 nt, Human
cacuggaccggggggcuggccgac

SEQ ID NO: 33684 - RNA, 24 nt, Human
uaugucaagucauuuccucagucc

SEQ ID NO: 33685 - RNA, 24 nt, Human
ugcacuacuuggaggucuaccuga

SEQ ID NO: 33686 - RNA, 22 nt, Human
augcuuccggcaggagacacaa

SEQ ID NO: 33687 - RNA, 24 nt, Human
aggaguagggagagcugagacuag

SEQ ID NO: 33688 - RNA, 24 nt, Human
ucagcucuauuccaggggcuccac

SEQ ID NO: 33689 - RNA, 23 nt, Human
aaauauguagaaaugaagagggu

SEQ ID NO: 33690 - RNA, 24 nt, Human
gagcugccaucugugguuuuccag

SEQ ID NO: 33691 - RNA, 24 nt, Human
uucuguccaaacagggggcauaua

SEQ ID NO: 33692 - RNA, 24 nt, Human
uauggcaagucacuuugacagaca

SEQ ID NO: 33693 - RNA, 24 nt, Human
ugagaauggcaaaauuagucgccu

SEQ ID NO: 33694 - RNA, 24 nt, Human
uacaccacucccaagaagaauaag

SEQ ID NO: 33695 - RNA, 24 nt, Human
uaacuugcuuaaggaaugucacaa

SEQ ID NO: 33696 - RNA, 24 nt, Human
uaccguagaaaacaggaccaagag

SEQ ID NO: 33697 - RNA, 24 nt, Human
ucuccgaguuugcgacucgcggac

SEQ ID NO: 33698 - RNA, 24 nt, Human
uggaaagcagguagaguuggcuuu

SEQ ID NO: 33699 - RNA, 24 nt, Human
agacagcacuguguuggcguacag

SEQ ID NO: 33700 - RNA, 24 nt, Human
ucucugguuguucacauuccaaaa

SEQ ID NO: 33701 - RNA, 24 nt, Human
ugucgcaggcugcucugucucuua

SEQ ID NO: 33702 - RNA, 24 nt, Human
aggcaacccuuucacaaaaccagg

SEQ ID NO: 33703 - RNA, 24 nt, Human
uucaaauuucuuucuuuuuuaauu

SEQ ID NO: 33704 - RNA, 24 nt, Human
ucaauuuuuauuuuggguuucuua

SEQ ID NO: 33705 - RNA, 24 nt, Human
uguugauacugcuggaauccagag

SEQ ID NO: 33706 - RNA, 24 nt, Human
uaaaaccuccuuuauggguuuguu

SEQ ID NO: 33707 - RNA, 24 nt, Human
uggaaucuugcggcauccacgaga

SEQ ID NO: 33708 - RNA, 24 nt, Human
uacuugaauagcuugguuaaauga

SEQ ID NO: 33709 - RNA, 24 nt, Human
agagaaaauguuagacguuaagug

SEQ ID NO: 33710 - RNA, 23 nt, Human
uaccacacaaaggcauuggcugc

SEQ ID NO: 33711 - RNA, 24 nt, Human
uagaagucugcggucugaggcucu

SEQ ID NO: 33712 - RNA, 24 nt, Human
ugagacuaaggcuuucgacccugg

SEQ ID NO: 33713 - RNA, 24 nt, Human
ucccaaagugcugggauuacaggc

SEQ ID NO: 33714 - RNA, 24 nt, Human
aaggaagugaauaaguuucagaug

SEQ ID NO: 33715 - RNA, 24 nt, Human
agacuuuuccagaagugccggacg

SEQ ID NO: 33716 - RNA, 21 nt, Human
uuugucagggaaacccggccc

SEQ ID NO: 33717 - RNA, 24 nt, Human
aggcaggaugggcagcucaggugg

SEQ ID NO: 33718 - RNA, 24 nt, Human
acugccagagggguugggaccagc

SEQ ID NO: 33719 - RNA, 24 nt, Human
uuugauacuauccuucugaaaagu

SEQ ID NO: 33720 - RNA, 24 nt, Human
acgggguuucaccauguuggccag

SEQ ID NO: 33721 - RNA, 24 nt, Human
uguucuggagcuguuggacaaaua

SEQ ID NO: 33722 - RNA, 24 nt, Human
uaccaggaagcauuugaaauuagu

SEQ ID NO: 33723 - RNA, 24 nt, Human
aaccagaaaguaagguguucuacu

SEQ ID NO: 33724 - RNA, 24 nt, Human
aacaugauuuaagguugaaauggc

SEQ ID NO: 33725 - RNA, 24 nt, Human
cuuuucacacaguuauuuuauuuu

SEQ ID NO: 33726 - RNA, 21 nt, Human
ugggaggggcugaauguggug

SEQ ID NO: 33727 - RNA, 24 nt, Human
aagcguuuugagcagaaaggauuc

SEQ ID NO: 33728 - RNA, 24 nt, Human
guagauuacacgagcugugcucag

SEQ ID NO: 33729 - RNA, 22 nt, Human
aagaaccuuccagcgcacucac

SEQ ID NO: 33730 - RNA, 24 nt, Human
ugugugccauugcccaggcagagu

SEQ ID NO: 33731 - RNA, 24 nt, Human
ugacuggaccggucccaacugcga

SEQ ID NO: 33732 - RNA, 24 nt, Human
ugugcacacauguaaccucuguga

SEQ ID NO: 33733 - RNA, 24 nt, Human
uagauuacauauccuuagcuaaaa

SEQ ID NO: 33734 - RNA, 24 nt, Human
uucacugucuccauuuguauugca

SEQ ID NO: 33735 - RNA, 24 nt, Human
uucugugucugagauuucuguaua

SEQ ID NO: 33736 - RNA, 24 nt, Human
ucuguacuuugugauaaguaagag

SEQ ID NO: 33737 - RNA, 20 nt, Human
uuuuccacaaauacuuacug

SEQ ID NO: 33738 - RNA, 24 nt, Human
uuuauauuuuugcaaaugucagga

SEQ ID NO: 33739 - RNA, 23 nt, Human
uuggcuccuacaaaugagugaaa

SEQ ID NO: 33740 - RNA, 24 nt, Human
uuuauauuuuugcaaaugucagga

SEQ ID NO: 33741 - RNA, 23 nt, Human
uuggcuccuacaaaugagugaaa

SEQ ID NO: 33742 - RNA, 24 nt, Human
ugcaagucgaguucgggaccacgc

SEQ ID NO: 33743 - RNA, 19 nt, Human
uauuacuaugagaagauag

SEQ ID NO: 33744 - RNA, 21 nt, Human
ugaggaaacaaccaggucccc

SEQ ID NO: 33745 - RNA, 24 nt, Human
uaugagaccauugggaaaacuacc

SEQ ID NO: 33746 - RNA, 24 nt, Human
uggcaaggucuguggugaagcaga

SEQ ID NO: 33747 - RNA, 22 nt, Human
ugauguuggagcugggcucuca

SEQ ID NO: 33748 - RNA, 24 nt, Human
aggcugauuccuuccuucuucucu

SEQ ID NO: 33749 - RNA, 24 nt, Human
ccgcccagggccuuccuguaagcu

SEQ ID NO: 33750 - RNA, 24 nt, Human
cuggccccaugcagccucccuggg

SEQ ID NO: 33751 - RNA, 24 nt, Human
aggaggcuuucccagcaggugcac

SEQ ID NO: 33752 - RNA, 24 nt, Human
uucacucuuucuagaagaggacuc

SEQ ID NO: 33753 - RNA, 22 nt, Human
uagguucucucgucgugaggca

SEQ ID NO: 33754 - RNA, 24 nt, Human
uaucaugccacucuccccuggccu

SEQ ID NO: 33755 - RNA, 24 nt, Human
guagaacacgucugguguggauaa

SEQ ID NO: 33756 - RNA, 24 nt, Human
aagguugucucaacuacagcuauc

SEQ ID NO: 33757 - RNA, 24 nt, Human
ugugaaguucaguauuauacuuau

SEQ ID NO: 33758 - RNA, 24 nt, Human
ugaauacacaucucugucagugug

SEQ ID NO: 33759 - RNA, 24 nt, Human
uuuuuagugcacuuaauauuagcu

SEQ ID NO: 33760 - RNA, 24 nt, Human
uaugugaauuugaguuugcuguuu

SEQ ID NO: 33761 - RNA, 24 nt, Human
uagcgucgccguuacuccgaggag

SEQ ID NO: 33762 - RNA, 24 nt, Human
uuucuggggcuugcgcgcaaaauc

SEQ ID NO: 33763 - RNA, 24 nt, Human
cgggcagaaggaggcugagaaagu

SEQ ID NO: 33764 - RNA, 24 nt, Human
accccagugugaccggcaaaauug

SEQ ID NO: 33765 - RNA, 24 nt, Human
gagcugcugcaggcggcggccggc

SEQ ID NO: 33766 - RNA, 24 nt, Human
uuccuggguucucacugucuuugc

SEQ ID NO: 33767 - RNA, 24 nt, Human
uggaucagagauuucuaugacagu

SEQ ID NO: 33768 - RNA, 24 nt, Human
uaucuggaucaucagauugugcuu

SEQ ID NO: 33769 - RNA, 24 nt, Human
acgcagcaucucagggcucaaagc

SEQ ID NO: 33770 - RNA, 24 nt, Human
ugcccaccuugcugcugugagugc

SEQ ID NO: 33771 - RNA, 24 nt, Human
uuaguucauagacccugucugcuc

SEQ ID NO: 33772 - RNA, 23 nt, Human
augaagcccuguguggucuggaa

SEQ ID NO: 33773 - RNA, 24 nt, Human
acccaguauccacaugcggugggg

SEQ ID NO: 33774 - RNA, 22 nt, Human
ugggaugguggccgauccugau

SEQ ID NO: 33775 - RNA, 24 nt, Human
cagcggcccuuguuucuucuuacc

SEQ ID NO: 33776 - RNA, 24 nt, Human
uggguguacggagcagcucuaagc

SEQ ID NO: 33777 - RNA, 24 nt, Human
aaccagaaaguaagguguucuacu

SEQ ID NO: 33778 - RNA, 17 nt, Human
uuucucagucuuuacua

SEQ ID NO: 33779 - RNA, 21 nt, Human
ucuacaguauucgguacagua

SEQ ID NO: 33780 - RNA, 22 nt, Human
cagacggucaucgucuagcaug

SEQ ID NO: 33781 - RNA, 21 nt, Human
cacugugcuugccgcccgggc

SEQ ID NO: 33782 - RNA, 24 nt, Human
ugagcgccccacccaugccugccu

SEQ ID NO: 33783 - RNA, 24 nt, Human
ucccggaacuccuucagguagcug

SEQ ID NO: 33784 - RNA, 24 nt, Human
ugagauaaagugccagucugccag

SEQ ID NO: 33785 - RNA, 24 nt, Human
aucaucuugaguuacuccuuuaag

SEQ ID NO: 33786 - RNA, 24 nt, Human
uagcucauucuuugcugugcccuu

SEQ ID NO: 33787 - RNA, 24 nt, Human
cacccgggagcggagguugcguga

SEQ ID NO: 33788 - RNA, 24 nt, Human
uagaacucagcccggcgcuccucu

SEQ ID NO: 33789 - RNA, 24 nt, Human
auggaucuuacuguccagagcacu

SEQ ID NO: 33790 - RNA, 23 nt, Human
aaagaagagagccgggggcugcc

SEQ ID NO: 33791 - RNA, 22 nt, Human
ucccgaagagccaggguuacca

SEQ ID NO: 33792 - RNA, 24 nt, Human
uauuuuggauuucucagaaguuga

SEQ ID NO: 33793 - RNA, 24 nt, Human
aggaaugcuaaaaguauggggagu

SEQ ID NO: 33794 - RNA, 21 nt, Human
uagguggcgacagggccuuga

SEQ ID NO: 33795 - RNA, 24 nt, Human
ucagguggcuccccgcggcgggcc

SEQ ID NO: 33796 - RNA, 21 nt, Human
uaucauuuuuguuacauauau

SEQ ID NO: 33797 - RNA, 24 nt, Human
ugaauggaagcuuuacauagaacc

SEQ ID NO: 33798 - RNA, 24 nt, Human
uccaucaccugcaacuuaaaugaa

SEQ ID NO: 33799 - RNA, 20 nt, Human
uauucagagaaucuaaagca

SEQ ID NO: 33800 - RNA, 24 nt, Human
uucagaguuaaaaagaagacuaac

SEQ ID NO: 33801 - RNA, 24 nt, Human
uccagagcuuuguuugaguucuca

SEQ ID NO: 33802 - RNA, 24 nt, Human
ggagcgcgaggaugaggcgaauga

SEQ ID NO: 33803 - RNA, 24 nt, Human
caggcagacgccaacggacacgca

SEQ ID NO: 33804 - RNA, 21 nt, Human
agggaaguauacaagcagagc

SEQ ID NO: 33805 - RNA, 18 nt, Human
ugccuggagcguggacag

SEQ ID NO: 33806 - RNA, 24 nt, Human
uuggucuuauuauguauuuccuga

SEQ ID NO: 33807 - RNA, 24 nt, Human
ugaaaaaggcgguauauaagcuga

SEQ ID NO: 33808 - RNA, 24 nt, Human
cauuguguguaacuuauucucaaa

SEQ ID NO: 33809 - RNA, 24 nt, Human
agagcagaagagcaguuuuaaaug

SEQ ID NO: 33810 - RNA, 24 nt, Human
uauuaggucccuguugaaggcuag

SEQ ID NO: 33811 - RNA, 24 nt, Human
uucauaaucuggucaugugggaau

SEQ ID NO: 33812 - RNA, 24 nt, Human
uggcuuagaguccuccugucuucc

SEQ ID NO: 33813 - RNA, 24 nt, Human
uaaccauuuugucaucuagcaagc

SEQ ID NO: 33814 - RNA, 24 nt, Human
uaaguugaaaacucaguaucuaug

SEQ ID NO: 33815 - RNA, 24 nt, Human
ugggugccaagauugaauaugaag

SEQ ID NO: 33816 - RNA, 24 nt, Human
uuuugcuggaagauucaacuaaag

SEQ ID NO: 33817 - RNA, 24 nt, Human
uuuaaauauauauauauuuaaugu

SEQ ID NO: 33818 - RNA, 24 nt, Human
ugaauguacauccagugacaucug

SEQ ID NO: 33819 - RNA, 24 nt, Human
uuuaaauaucucaagagcauacca

SEQ ID NO: 33820 - RNA, 24 nt, Human
ugaagucauuuuccuuugugagag

SEQ ID NO: 33821 - RNA, 24 nt, Human
ccuuacgaaccaugccuuccucag

SEQ ID NO: 33822 - RNA, 24 nt, Human
uucauguaaucuuugauguacuuc

SEQ ID NO: 33823 - RNA, 24 nt, Human
uaccuuaacgucagaauucccuaa

SEQ ID NO: 33824 - RNA, 19 nt, Human
uccagcuguccagcaugac

SEQ ID NO: 33825 - RNA, 24 nt, Human
ugagagguggaggaguucugaucc

SEQ ID NO: 33826 - RNA, 21 nt, Human
uucaagggauggaaagucacc

SEQ ID NO: 33827 - RNA, 24 nt, Human
ucugaucuauaaaugcgguggcau

SEQ ID NO: 33828 - RNA, 20 nt, Human
ugcccaggaagacagggcga

SEQ ID NO: 33829 - RNA, 24 nt, Human
ugaaaaggucaaaaugcggcaaau

SEQ ID NO: 33830 - RNA, 24 nt, Human
ucucuacugccgcugauggucaaa

SEQ ID NO: 33831 - RNA, 24 nt, Human
gauuagccuuuucucugccuugcu

SEQ ID NO: 33832 - RNA, 24 nt, Human
uagcggcgacggggagggugggcu

SEQ ID NO: 33833 - RNA, 24 nt, Human
cuggaaggcauacccuacaauuua

SEQ ID NO: 33834 - RNA, 23 nt, Human
uugaaagguauauuaaaauuaag

SEQ ID NO: 33835 - RNA, 24 nt, Human
uggccgaaucuuccuucaggauau

SEQ ID NO: 33836 - RNA, 24 nt, Human
ucuaaacuaaauuaggcaaauagu

SEQ ID NO: 33837 - RNA, 17 nt, Human
uacacugggcuuuugcc

SEQ ID NO: 33838 - RNA, 24 nt, Human
uguguuuguagacuuggaacccac

SEQ ID NO: 33839 - RNA, 24 nt, Human
cugccgggaaagagcuccugaagu

SEQ ID NO: 33840 - RNA, 24 nt, Human
caacugauuaccauuuacagugau

SEQ ID NO: 33841 - RNA, 24 nt, Human
agguagugcagugguuguaaagug

SEQ ID NO: 33842 - RNA, 24 nt, Human
ucaccauuaaaucuaucaguguuu

SEQ ID NO: 33843 - RNA, 24 nt, Human
ugagcugcaaggaaggaagaguag

SEQ ID NO: 33844 - RNA, 24 nt, Human
ugauuugcuucgacuagaaacucc

SEQ ID NO: 33845 - RNA, 21 nt, Human
uucaagggauggaaagucacc

SEQ ID NO: 33846 - RNA, 24 nt, Human
caguauguacacgcggugacacuc

SEQ ID NO: 33847 - RNA, 24 nt, Human
uucaccuuuaucugaccaaaccgc

SEQ ID NO: 33848 - RNA, 20 nt, Human
agcuauguaaaagagaacca

SEQ ID NO: 33849 - RNA, 24 nt, Human
agaagaagaagaaauggcaaagag

SEQ ID NO: 33850 - RNA, 24 nt, Human
uaucaaggaagggcaggcgugaug

SEQ ID NO: 33851 - RNA, 24 nt, Human
ucaauuuuuauuuugguuuucuua

SEQ ID NO: 33852 - RNA, 24 nt, Human
ggaucaggcuuuucugccagcagc

SEQ ID NO: 33853 - RNA, 24 nt, Human
aggcagggaggacucaggacuaca

SEQ ID NO: 33854 - RNA, 23 nt, Human
uucguagcucuuguagggugguc

SEQ ID NO: 33855 - RNA, 19 nt, Human
uaccgcuuugagacagucc

SEQ ID NO: 33856 - RNA, 22 nt, Human
uccccgauggcccacugcguga

SEQ ID NO: 33857 - RNA, 22 nt, Human
ugggagggggcagcugggcuga

SEQ ID NO: 33858 - RNA, 21 nt, Human
uggcaagcaugugguguuugg

SEQ ID NO: 33859 - RNA, 24 nt, Human
aauggcacugggggcaaguccauc

SEQ ID NO: 33860 - RNA, 24 nt, Human
ucagagcuacacauugagaaccug

SEQ ID NO: 33861 - RNA, 24 nt, Human
caccaucaucuucaucuacgagaa

SEQ ID NO: 33862 - RNA, 24 nt, Human
uacaagaucacugacucugaggac

SEQ ID NO: 33863 - RNA, 24 nt, Human
uacgcugggaccccgccaaggagc

SEQ ID NO: 33864 - RNA, 24 nt, Human
uaagcgaacgcccuuuggagcuua

SEQ ID NO: 33865 - RNA, 24 nt, Human
uggacagugggccgcaaagaaccu

SEQ ID NO: 33866 - RNA, 24 nt, Human
ccagagugcugggauuacaggcau

SEQ ID NO: 33867 - RNA, 24 nt, Human
caagaaggcuaauugguggugaga

SEQ ID NO: 33868 - RNA, 24 nt, Human
ucaauuuuuauuuugguuuucuua

SEQ ID NO: 33869 - RNA, 24 nt, Human
aagaguguugagcuaguuccuggu

SEQ ID NO: 33870 - RNA, 24 nt, Human
ugcaggaaugagagugauuuuaug

SEQ ID NO: 33871 - RNA, 24 nt, Human
ucgaauggacacauuaccagugaa

SEQ ID NO: 33872 - RNA, 24 nt, Human
ucccagcaggacccucuucuuguu

SEQ ID NO: 33873 - RNA, 24 nt, Human
ggacagguguacagacauguucuu

SEQ ID NO: 33874 - RNA, 24 nt, Human
uaggugcccucaauagccuccuug

SEQ ID NO: 33875 - RNA, 24 nt, Human
uuuguauucaguacaguugucauu

SEQ ID NO: 33876 - RNA, 24 nt, Human
uaccacacaauucauguaucuaaa

SEQ ID NO: 33877 - RNA, 23 nt, Human
uuuaacguuuucaugguaaugca

SEQ ID NO: 33878 - RNA, 24 nt, Human
ugcauuguuaucauuaaccagucu

SEQ ID NO: 33879 - RNA, 24 nt, Human
uauuagggauaauauucauuuagc

SEQ ID NO: 33880 - RNA, 24 nt, Human
uaaugggucucaaaauucugggac

SEQ ID NO: 33881 - RNA, 24 nt, Human
uaggaucaugaugguaaggcaaau

SEQ ID NO: 33882 - RNA, 24 nt, Human
uucacauuuuuuaaaaaguguauu

SEQ ID NO: 33883 - RNA, 24 nt, Human
uuccagguccucgaggucccacuc

SEQ ID NO: 33884 - RNA, 24 nt, Human
ugugcaugcccacagcccgaggcc

SEQ ID NO: 33885 - RNA, 24 nt, Human
guuuguuuaagguuuucuccaugg

SEQ ID NO: 33886 - RNA, 24 nt, Human
ucccucuuuaagauugcguaccca

SEQ ID NO: 33887 - RNA, 24 nt, Human
uuagagcuggcagcagcaucucag

SEQ ID NO: 33888 - RNA, 24 nt, Human
uggcucagaguccaguuuucuuaa

SEQ ID NO: 33889 - RNA, 24 nt, Human
agggagcuauuuuuugaagaugau

SEQ ID NO: 33890 - RNA, 24 nt, Human
uucaaauaggagccgauggaucug

SEQ ID NO: 33891 - RNA, 24 nt, Human
ucuugcgggagauugcugaagagu

SEQ ID NO: 33892 - RNA, 24 nt, Human
cgagaggcacagaaggagcuggag

SEQ ID NO: 33893 - RNA, 24 nt, Human
gagcacgugucaucuucccugcgg

SEQ ID NO: 33894 - RNA, 22 nt, Human
cauuucuuggcaauguggugcc

SEQ ID NO: 33895 - RNA, 17 nt, Human
uuucuaggauagucagu

SEQ ID NO: 33896 - RNA, 24 nt, Human
uuuggucguggacguggucagcca

SEQ ID NO: 33897 - RNA, 24 nt, Human
uauccaguaucuccgugauuaccu

SEQ ID NO: 33898 - RNA, 24 nt, Human
uggcaggccucggcuaaaggucug

SEQ ID NO: 33899 - RNA, 24 nt, Human
acgcggauucucuugcccacaauu

SEQ ID NO: 33900 - RNA, 24 nt, Human
cuuggauuuucuggaaagauuuca

SEQ ID NO: 33901 - RNA, 24 nt, Human
ugaaaccuccuauuccaugcguaa

SEQ ID NO: 33902 - RNA, 18 nt, Human
uguaauagacauccaaag

SEQ ID NO: 33903 - RNA, 23 nt, Human
ugugaauaccaccucugcaugcu

SEQ ID NO: 33904 - RNA, 24 nt, Human
uucucuguggacauugacucggag

SEQ ID NO: 33905 - RNA, 24 nt, Human
gaagugcggcuucuucaagcgagc

SEQ ID NO: 33906 - RNA, 21 nt, Human
acaaagcaaagaggaagaagc

SEQ ID NO: 33907 - RNA, 24 nt, Human
cagcggcagagagccauccucuau

SEQ ID NO: 33908 - RNA, 24 nt, Human
cuggaggugggcuuuggcauggcc

SEQ ID NO: 33909 - RNA, 24 nt, Human
ggggagcagacaaguaccacuccg

SEQ ID NO: 33910 - RNA, 24 nt, Human
gaccguaauuguggcugcacugga

SEQ ID NO: 33911 - RNA, 24 nt, Human
ugucauaggcaucgacgaggggca

SEQ ID NO: 33912 - RNA, 24 nt, Human
agauuacacuguuaccgagauccc

SEQ ID NO: 33913 - RNA, 24 nt, Human
ugagcaguguaugucaggacuugu

SEQ ID NO: 33914 - RNA, 24 nt, Human
uucauuguggacaaaguuauuauu

SEQ ID NO: 33915 - RNA, 24 nt, Human
uagagcuagugaauuagccuauuu

SEQ ID NO: 33916 - RNA, 24 nt, Human
uucacucaagacuaaaaacuaaag

SEQ ID NO: 33917 - RNA, 24 nt, Human
uguggggggcugggggagguccaa

SEQ ID NO: 33918 - RNA, 24 nt, Human
ccggaccccaccucuucccugccg

SEQ ID NO: 33919 - RNA, 24 nt, Human
caccugcagcuaugaugcccuucc

SEQ ID NO: 33920 - RNA, 24 nt, Human
uccccugcuaugcaagugccccug

SEQ ID NO: 33921 - RNA, 24 nt, Human
uaugauguggaagcugguuucagc

SEQ ID NO: 33922 - RNA, 24 nt, Human
uacaagguuccuuccacugaagca

SEQ ID NO: 33923 - RNA, 18 nt, Human
uuccuagguguaugugcc

SEQ ID NO: 33924 - RNA, 24 nt, Human
uaagaaauucgauugcgggucaag

SEQ ID NO: 33925 - RNA, 24 nt, Human
ugggagcggguggggaggucgagg

SEQ ID NO: 33926 - RNA, 24 nt, Human
ugacacgaggggaggggucugugu

SEQ ID NO: 33927 - RNA, 17 nt, Human
uggaaagugaggcgaga

SEQ ID NO: 33928 - RNA, 24 nt, Human
aguuuggauucugaaaacuaacug

SEQ ID NO: 33929 - RNA, 24 nt, Human
ccuuacucccucuuuaagauugcg

SEQ ID NO: 33930 - RNA, 24 nt, Human
cagauccaagagauauauuuggca

SEQ ID NO: 33931 - RNA, 24 nt, Human
ucccuggcuuaugagcaggcugag

SEQ ID NO: 33932 - RNA, 24 nt, Human
uaaugaguaggugagagggucugg

SEQ ID NO: 33933 - RNA, 24 nt, Human
gugauccacccgccucagccuccc

SEQ ID NO: 33934 - RNA, 24 nt, Human
caccgcguuccagccaccagcccu

SEQ ID NO: 33935 - RNA, 24 nt, Human
cuggaccagcuucaaguacauguc

SEQ ID NO: 33936 - RNA, 24 nt, Human
uucauggaaguaggagagaagacu

SEQ ID NO: 33937 - RNA, 24 nt, Human
ggagcagcuguaagugccauugcc

SEQ ID NO: 33938 - RNA, 24 nt, Human
uguuggggaugcugacgccucccc

SEQ ID NO: 33939 - RNA, 24 nt, Human
cagcugccaggcaggagucgguag

SEQ ID NO: 33940 - RNA, 24 nt, Human
ucacucaguuuuuaauaaaggcca

SEQ ID NO: 33941 - RNA, 24 nt, Human
uguucagaaauugaggcuaacauu

SEQ ID NO: 33942 - RNA, 24 nt, Human
auugcaaaauuacaacugagacag

SEQ ID NO: 33943 - RNA, 24 nt, Human
uuuauuggaaaauacccaaauaau

SEQ ID NO: 33944 - RNA, 24 nt, Human
uuaauuguuuaccuagauuauuua

SEQ ID NO: 33945 - RNA, 24 nt, Human
ucacaaccacggcccuggaggagc

SEQ ID NO: 33946 - RNA, 24 nt, Human
ccuccuucccaggcucuggggcag

SEQ ID NO: 33947 - RNA, 24 nt, Human
agguaguaaacuccccaggugggc

SEQ ID NO: 33948 - RNA, 24 nt, Human
ucgaauggacacauuaccagugaa

SEQ ID NO: 33949 - RNA, 23 nt, Human
ucucacaguucugggcuaggacu

SEQ ID NO: 33950 - RNA, 23 nt, Human
ucccauggcuuucaauguggggc

SEQ ID NO: 33951 - RNA, 24 nt, Human
agaguucugugucuggacuuggag

SEQ ID NO: 33952 - RNA, 24 nt, Human
gccccuuucgguuuuuuuuaaaaa

SEQ ID NO: 33953 - RNA, 24 nt, Human
uaucaugccacucuccccuggccu

SEQ ID NO: 33954 - RNA, 24 nt, Human
guagaacacgucugguguggauaa

SEQ ID NO: 33955 - RNA, 22 nt, Human
aagaaucaugaaauuuauaugg

SEQ ID NO: 33956 - RNA, 24 nt, Human
cgggaacagcuggcagcugugagg

SEQ ID NO: 33957 - RNA, 24 nt, Human
ugucccagcugagggccuuugucc

SEQ ID NO: 33958 - RNA, 24 nt, Human
ccacugggcccagccuauuugcaa

SEQ ID NO: 33959 - RNA, 24 nt, Human
auagcucacugcagccucuaccuc

SEQ ID NO: 33960 - RNA, 24 nt, Human
uagaagcuagcucccggcagcaug

SEQ ID NO: 33961 - RNA, 24 nt, Human
ucccugaauucccauccagaaauc

SEQ ID NO: 33962 - RNA, 24 nt, Human
ugaaaacuagcgaggucugcugua

SEQ ID NO: 33963 - RNA, 24 nt, Human
uaugugcaguuauuaucacaugaa

SEQ ID NO: 33964 - RNA, 24 nt, Human
cggcacgcgggggccccggggcgg

SEQ ID NO: 33965 - RNA, 23 nt, Human
gagcacagcgcagcgcgggcggc

SEQ ID NO: 33966 - RNA, 24 nt, Human
uuucuguauaugaauuuguuaaua

SEQ ID NO: 33967 - RNA, 17 nt, Human
ucuguccucuguagcac

SEQ ID NO: 33968 - RNA, 23 nt, Human
ugacaaggggcugcuucuggggu

SEQ ID NO: 33969 - RNA, 24 nt, Human
uccaccacuacuggccaucugauc

SEQ ID NO: 33970 - RNA, 24 nt, Human
uuucacgccgguuuuagucccgac

SEQ ID NO: 33971 - RNA, 23 nt, Human
ugggucagacguaggugacaagc

SEQ ID NO: 33972 - RNA, 24 nt, Human
uagguggcaccaaucuugacuauc

SEQ ID NO: 33973 - RNA, 24 nt, Human
ggggaacgauggccauggagucca

SEQ ID NO: 33974 - RNA, 24 nt, Human
acccuggcaguucuggcccucccg

SEQ ID NO: 33975 - RNA, 24 nt, Human
caggccacggcagaggcugagugu

SEQ ID NO: 33976 - RNA, 24 nt, Human
gugaagcucuacuacccgccccgu

SEQ ID NO: 33977 - RNA, 22 nt, Human
uuggaugcuugauaugaacauc

SEQ ID NO: 33978 - RNA, 24 nt, Human
ugaguacaccaugacgccccaacc

SEQ ID NO: 33979 - RNA, 21 nt, Human
uauccugcacuggcugugaac

SEQ ID NO: 33980 - RNA, 24 nt, Human
guggcagauuucacgaaaucuagc

SEQ ID NO: 33981 - RNA, 24 nt, Human
uaggugccauuagcucuuagggag

SEQ ID NO: 33982 - RNA, 24 nt, Human
aagcaguacgacagcauuuugagg

SEQ ID NO: 33983 - RNA, 24 nt, Human
gauuugcagcuacgaaaucaucac

SEQ ID NO: 33984 - RNA, 24 nt, Human
acagaagauguuucggugaagauc

SEQ ID NO: 33985 - RNA, 19 nt, Human
accacggccuggaggugcu

SEQ ID NO: 33986 - RNA, 24 nt, Human
ucagugaguaccccgaucuugacu

SEQ ID NO: 33987 - RNA, 24 nt, Human
gccgcgguccuagcgccgcucggc

SEQ ID NO: 33988 - RNA, 24 nt, Human
uucaagggauggaaagucaaccgu

SEQ ID NO: 33989 - RNA, 24 nt, Human
aaucauaugauggcaaaaauugag

SEQ ID NO: 33990 - RNA, 24 nt, Human
cguacaaaccuuccgaggcccucg

SEQ ID NO: 33991 - RNA, 24 nt, Human
uggguacgcaccccaggacccgga

SEQ ID NO: 33992 - RNA, 24 nt, Human
aaugagccuaaagaaaagcuguug

SEQ ID NO: 33993 - RNA, 21 nt, Human
uucaagggauggaaagucacc

SEQ ID NO: 33994 - RNA, 24 nt, Human
ucugaucuauaaaugcgguggcau

SEQ ID NO: 33995 - RNA, 24 nt, Human
aaccgugauucgacuacgucaagc

SEQ ID NO: 33996 - RNA, 24 nt, Human
uaucagguggcauagcgucuguug

SEQ ID NO: 33997 - RNA, 24 nt, Human
uagaaaguuaagaugggcuugaaa

SEQ ID NO: 33998 - RNA, 24 nt, Human
cccagcaggcucguaccaaaguca

SEQ ID NO: 33999 - RNA, 24 nt, Human
ugaaauauaugcauguaaaaacuu

SEQ ID NO: 34000 - RNA, 23 nt, Human
auggagcccugaauguugaccug

SEQ ID NO: 34001 - RNA, 24 nt, Human
cauugcuggcuauguguuuagaga

SEQ ID NO: 34002 - RNA, 24 nt, Human
aaccggauuuauuuuuuucacgac

SEQ ID NO: 34003 - RNA, 24 nt, Human
agggaguggaguggcacagaccua

SEQ ID NO: 34004 - RNA, 22 nt, Human
uucaagggauggaaaagucacc

SEQ ID NO: 34005 - RNA, 24 nt, Human
ucugaucuauaaaugcgguggcau

SEQ ID NO: 34006 - RNA, 24 nt, Human
uggaaugaagucugacuccuccag

SEQ ID NO: 34007 - RNA, 24 nt, Human
uguuuaaugaaugcauaugaggug

SEQ ID NO: 34008 - RNA, 24 nt, Human
gacgguacaagugacaauagcaau

SEQ ID NO: 34009 - RNA, 24 nt, Human
cagcaguaagcaacaauggcugau

SEQ ID NO: 34010 - RNA, 24 nt, Human
cgugguguccuaccccuucgacac

SEQ ID NO: 34011 - RNA, 24 nt, Human
uacauuaagaaaauuggcuacaac

SEQ ID NO: 34012 - RNA, 24 nt, Human
ucugaucuauaaaugcgguggcau

SEQ ID NO: 34013 - RNA, 24 nt, Human
ucugaucuauaaaugcgguggcau

SEQ ID NO: 34014 - RNA, 24 nt, Human
uagaauacaaaaagaaaguaaaaa

SEQ ID NO: 34015 - RNA, 22 nt, Human
ucccuaagcaggugguuuacua

SEQ ID NO: 34016 - RNA, 24 nt, Human
cagcccaguccaaaaggugccugc

SEQ ID NO: 34017 - RNA, 24 nt, Human
uguccugaugcugguggcauaggc

SEQ ID NO: 34018 - RNA, 18 nt, Human
uguugcggggggaauaac

SEQ ID NO: 34019 - RNA, 24 nt, Human
uuucucuuaacacaccccuuaaug

SEQ ID NO: 34020 - RNA, 24 nt, Human
agaugucuucaggaaaugcuaaaa

SEQ ID NO: 34021 - RNA, 17 nt, Human
cagcugguggaacugga

SEQ ID NO: 34022 - RNA, 24 nt, Human
uuucgggguagugugagcuuuuaa

SEQ ID NO: 34023 - RNA, 24 nt, Human
uaauagggguucccaaauucuguu

SEQ ID NO: 34024 - RNA, 24 nt, Human
uuuauuguggguuacagaucauaa

SEQ ID NO: 34025 - RNA, 17 nt, Human
ugcuaaggagggccccc

SEQ ID NO: 34026 - RNA, 24 nt, Human
gaaggcaaacauguucagaaguca

SEQ ID NO: 34027 - RNA, 24 nt, Human
ucaagcacaaaccaauuuguguug

SEQ ID NO: 34028 - RNA, 24 nt, Human
uuugugcaugcagaucgaaaacaa

SEQ ID NO: 34029 - RNA, 24 nt, Human
uaguaucuuuguacaucauaggac

SEQ ID NO: 34030 - RNA, 24 nt, Human
ugaguacacguagaccaagcaauc

SEQ ID NO: 34031 - RNA, 24 nt, Human
ucagugagcgugugggaacugaga

SEQ ID NO: 34032 - RNA, 24 nt, Human
acuuugaugauuugaaaggagaac

SEQ ID NO: 34033 - RNA, 21 nt, Human
uucaagggauggaaagucacc

SEQ ID NO: 34034 - RNA, 24 nt, Human
ugcauuguuaucauuaaccagucu

SEQ ID NO: 34035 - RNA, 24 nt, Human
uauuagggauaauauucauuuagc

SEQ ID NO: 34036 - RNA, 24 nt, Human
uuuaacuuuuuuaaugggucucaa

SEQ ID NO: 34037 - RNA, 24 nt, Human
ugcauuguuaucauuaaccagucu

SEQ ID NO: 34038 - RNA, 24 nt, Human
uaaugggucucaaaauucugugac

SEQ ID NO: 34039 - RNA, 24 nt, Human
acucagaguccggcagcauccucc

SEQ ID NO: 34040 - RNA, 24 nt, Human
uaggaggcacagggacgcugacua

SEQ ID NO: 34041 - RNA, 24 nt, Human
uguaaggcauugagauguuuaugu

SEQ ID NO: 34042 - RNA, 24 nt, Human
cagaagaagggauucacucaguac

SEQ ID NO: 34043 - RNA, 24 nt, Human
agcgagcggguagcggaccuugac

SEQ ID NO: 34044 - RNA, 23 nt, Human
gaaacaguuuggcucugguucuu

SEQ ID NO: 34045 - RNA, 17 nt, Human
ucccugggaacgggcug

SEQ ID NO: 34046 - RNA, 24 nt, Human
uuugcauucuucauucccuaucuu

SEQ ID NO: 34047 - RNA, 24 nt, Human
uauacaauucuuuauuuagguaac

SEQ ID NO: 34048 - RNA, 24 nt, Human
uaauuuagggaacauggggauaac

SEQ ID NO: 34049 - RNA, 24 nt, Human
aggccgaggcgggcaggugaucac

SEQ ID NO: 34050 - RNA, 24 nt, Human
gagcagucugaaugccagaaugga

SEQ ID NO: 34051 - RNA, 24 nt, Human
ugguaaauauucagaauguggucg

SEQ ID NO: 34052 - RNA, 24 nt, Human
gggaauugucucggaugcaucugg

SEQ ID NO: 34053 - RNA, 24 nt, Human
uaaguuguuuuauuaaguuaauuu

SEQ ID NO: 34054 - RNA, 24 nt, Human
ucuugcgggagauugcugaagagu

SEQ ID NO: 34055 - RNA, 24 nt, Human
cgagaggcacagaaggagcuggag

SEQ ID NO: 34056 - RNA, 24 nt, Human
cggcaaaauucgcaaggugcgcga

SEQ ID NO: 34057 - RNA, 24 nt, Human
ggguugggaccugccaugcaucuu

SEQ ID NO: 34058 - RNA, 24 nt, Human
ucugaucuauaaaugcgguggcau

SEQ ID NO: 34059 - RNA, 24 nt, Human
cugcagguugucagcgaugccggc

SEQ ID NO: 34060 - RNA, 20 nt, Human
cagcagugccuggcugcggc

SEQ ID NO: 34061 - RNA, 24 nt, Human
uuugcagcuuaacuucaaaugcaa

SEQ ID NO: 34062 - RNA, 24 nt, Human
uuagaguguauuucugaaacuagc

SEQ ID NO: 34063 - RNA, 24 nt, Human
uuugaugcaagaaaggccucucuu

SEQ ID NO: 34064 - RNA, 24 nt, Human
aguugcuccagaaaaaccuguaaa

SEQ ID NO: 34065 - RNA, 24 nt, Human
gagccgagcgaagcgaugccuaaa

SEQ ID NO: 34066 - RNA, 24 nt, Human
ucagggagggacucagcaaaugau

SEQ ID NO: 34067 - RNA, 24 nt, Human
caaucauugaauacaaaacaaaua

SEQ ID NO: 34068 - RNA, 24 nt, Human
uguucuugcccaagagugugucug

SEQ ID NO: 34069 - RNA, 24 nt, Human
ucaccaaggagaaccugcuggacu

SEQ ID NO: 34070 - RNA, 19 nt, Human
uguggaguucuaugcccca

SEQ ID NO: 34071 - RNA, 24 nt, Human
gggaaucuucaaugcaaucuuuuu

SEQ ID NO: 34072 - RNA, 18 nt, Human
caccgggguuagcccagg

SEQ ID NO: 34073 - RNA, 24 nt, Human
uaaaagaaggcaggugucucuuua

SEQ ID NO: 34074 - RNA, 24 nt, Human
acacugagcaccuggugaauggcc

SEQ ID NO: 34075 - RNA, 24 nt, Human
cgaccagugcugcugccuauggca

SEQ ID NO: 34076 - RNA, 24 nt, Human
ucauugaaaaaguccuggugggaa

SEQ ID NO: 34077 - RNA, 24 nt, Human
uagcuguuggcagcuaugguguuc

SEQ ID NO: 34078 - RNA, 24 nt, Human
acuccaggcuuggucuucugggca

SEQ ID NO: 34079 - RNA, 24 nt, Human
uugcugguaaucuuuccaggguag

SEQ ID NO: 34080 - RNA, 24 nt, Human
uaaauagugagacauaaauagagu

SEQ ID NO: 34081 - RNA, 24 nt, Human
uucaauuuguuaacagagcaaauu

SEQ ID NO: 34082 - RNA, 24 nt, Human
gugaugcugcugcugcugcuuucc

SEQ ID NO: 34083 - RNA, 24 nt, Human
aagcuccaggucccuucuccagcc

SEQ ID NO: 34084 - RNA, 21 nt, Human
ugucucaggacucugacacug

SEQ ID NO: 34085 - RNA, 24 nt, Human
cgcuccaagacguuguguguucgc

SEQ ID NO: 34086 - RNA, 24 nt, Human
uguggcuuuuuuaaggauaacuac

SEQ ID NO: 34087 - RNA, 24 nt, Human
uuaggaaaaaaauauuauaaucau

SEQ ID NO: 34088 - RNA, 19 nt, Human
uguaaauagucugccuucc

SEQ ID NO: 34089 - RNA, 24 nt, Human
ucugcuguguauguaugccaagga

SEQ ID NO: 34090 - RNA, 24 nt, Human
uggggucagaaaagagaaaugacc

SEQ ID NO: 34091 - RNA, 24 nt, Human
acucugguuauggggacacugacg

SEQ ID NO: 34092 - RNA, 24 nt, Human
ccgcugcccgacgcuucuguucgg

SEQ ID NO: 34093 - RNA, 24 nt, Human
ucuccagguucuucaauaucagug

SEQ ID NO: 34094 - RNA, 24 nt, Human
ugccuagaguuuaagcuaccucag

SEQ ID NO: 34095 - RNA, 24 nt, Human
ucuuuugugcugcugucauccuag

SEQ ID NO: 34096 - RNA, 24 nt, Human
gaugcagaguagcagaagcuccuc

SEQ ID NO: 34097 - RNA, 24 nt, Human
ucaguuaaaaaagaagaagaagaa

SEQ ID NO: 34098 - RNA, 24 nt, Human
uggcuuauuuguuuuguauucaau

SEQ ID NO: 34099 - RNA, 24 nt, Human
ggugaugggggcagccgggaggga

SEQ ID NO: 34100 - RNA, 20 nt, Human
gagcaauggaggaggcuagg

SEQ ID NO: 34101 - RNA, 23 nt, Human
ugccuuagauauuccuaauuacu

SEQ ID NO: 34102 - RNA, 24 nt, Human
ucgucuggagauauuuuugguugu

SEQ ID NO: 34103 - RNA, 24 nt, Human
auggugcacaggauagccccccac

SEQ ID NO: 34104 - RNA, 24 nt, Human
uauugcugcgaguuaucuaaacaa

SEQ ID NO: 34105 - RNA, 24 nt, Human
ugugcagaagaaauggaaggauuc

SEQ ID NO: 34106 - RNA, 24 nt, Human
uauuuugguuuucuuacaaagguu

SEQ ID NO: 34107 - RNA, 24 nt, Human
uaacagguguaagaguguugaaaa

SEQ ID NO: 34108 - RNA, 24 nt, Human
ugugcagaagaaauggaaggauuc

SEQ ID NO: 34109 - RNA, 24 nt, Human
uaucaaggaagggcaggcgugaug

SEQ ID NO: 34110 - RNA, 24 nt, Human
uucaaauuucuuucuuuuuuaauu

SEQ ID NO: 34111 - RNA, 24 nt, Human
acgcaggugccccgcgcuccccgc

SEQ ID NO: 34112 - RNA, 24 nt, Human
uggauccgucucucuaggcuuguc

SEQ ID NO: 34113 - RNA, 24 nt, Human
caucaggaugcaucacgaucauua

SEQ ID NO: 34114 - RNA, 24 nt, Human
gugcaggacuuugaugcuuggggu

SEQ ID NO: 34115 - RNA, 24 nt, Human
ccagacagcccuaccugugccaga

SEQ ID NO: 34116 - RNA, 23 nt, Human
cagcgcacugccacaagccccuc

SEQ ID NO: 34117 - RNA, 24 nt, Human
uaucaaggaagggcaggcgugaug

SEQ ID NO: 34118 - RNA, 24 nt, Human
ucaguuaaaaaagaagaagaagaa

SEQ ID NO: 34119 - RNA, 24 nt, Human
ucugaucaauccuucuuuuucucu

SEQ ID NO: 34120 - RNA, 24 nt, Human
ucaauuuuuauuuugguuuucuua

SEQ ID NO: 34121 - RNA, 18 nt, Human
uauugcuguuagauaucc

SEQ ID NO: 34122 - RNA, 24 nt, Human
uuagcugggcaugguggugugugc

SEQ ID NO: 34123 - RNA, 24 nt, Human
uggccuggucauggcugauccugc

SEQ ID NO: 34124 - RNA, 24 nt, Human
ugccaagcugcucuauagcaaugu

SEQ ID NO: 34125 - RNA, 24 nt, Human
ugaaggaagcuaucaacuccuaua

SEQ ID NO: 34126 - RNA, 24 nt, Human
ugccugcauggauggacaagaguu

SEQ ID NO: 34127 - RNA, 24 nt, Human
uaaagcacuaagguugauuuuugu

SEQ ID NO: 34128 - RNA, 20 nt, Human
acgcaucggauguauucuuu

SEQ ID NO: 34129 - RNA, 24 nt, Human
aagcagcagaggguccggcagggg

SEQ ID NO: 34130 - RNA, 24 nt, Human
ugagugauaaaggcugaguguuga

SEQ ID NO: 34131 - RNA, 24 nt, Human
uggcaaguaaaugcaguacuguuc

SEQ ID NO: 34132 - RNA, 24 nt, Human
aaaguuguguuccccaaugcuugg

SEQ ID NO: 34133 - RNA, 24 nt, Human
ugguggugggaggggacugaagcc

SEQ ID NO: 34134 - RNA, 24 nt, Human
gugcaucccugagagagugggcag

SEQ ID NO: 34135 - RNA, 24 nt, Human
uagguacccccaaucucacuuugg

SEQ ID NO: 34136 - RNA, 24 nt, Human
ucuauagcauuuuguugcuuccaa

SEQ ID NO: 34137 - RNA, 22 nt, Human
uguggcaagccaugucucggcg

SEQ ID NO: 34138 - RNA, 24 nt, Human
uuuaaagcacuuuucuguaaaagc

SEQ ID NO: 34139 - RNA, 24 nt, Human
ugauugcauuugaccuuuugaccu

SEQ ID NO: 34140 - RNA, 24 nt, Human
ugggaggcuggugcagccagaagg

SEQ ID NO: 34141 - RNA, 24 nt, Human
augaggcguggcggaagaugcguu

SEQ ID NO: 34142 - RNA, 24 nt, Human
uaagacacaaugaaaucuacaggg

SEQ ID NO: 34143 - RNA, 24 nt, Human
acccugugucugauaagucucaga

SEQ ID NO: 34144 - RNA, 21 nt, Human
cauagcacugucagcagucug

SEQ ID NO: 34145 - RNA, 22 nt, Human
ucauuugggaaauguaaaugug

SEQ ID NO: 34146 - RNA, 24 nt, Human
ggugauggcguugguaaaggcuuc

SEQ ID NO: 34147 - RNA, 24 nt, Human
cggguuggggggaaaguugguugg

SEQ ID NO: 34148 - RNA, 24 nt, Human
uauaaccaaauucuguaauuggga

SEQ ID NO: 34149 - RNA, 24 nt, Human
uaagugauuuuuggcuugcauacc

SEQ ID NO: 34150 - RNA, 24 nt, Human
ugccauucuguguuuccucuaaaa

SEQ ID NO: 34151 - RNA, 22 nt, Human
uguggacgagcaggaggaggcg

SEQ ID NO: 34152 - RNA, 24 nt, Human
cauuccaugcagccuugcggaacu

SEQ ID NO: 34153 - RNA, 24 nt, Human
ugagugguucuugugccuagccca

SEQ ID NO: 34154 - RNA, 24 nt, Human
ugaacagaugcuuaaccccacaug

SEQ ID NO: 34155 - RNA, 24 nt, Human
cagcccagggcaagcugagagaug

SEQ ID NO: 34156 - RNA, 24 nt, Human
gagcacucugaggggccugugggc

SEQ ID NO: 34157 - RNA, 24 nt, Human
ugaaggcaaggcagguagacggug

SEQ ID NO: 34158 - RNA, 22 nt, Human
aggugcaucaagagcccggggc

SEQ ID NO: 34159 - RNA, 24 nt, Human
uaggaccgucgugagacaugguca

SEQ ID NO: 34160 - RNA, 24 nt, Human
cgagcacccguuagaaagagcgug

SEQ ID NO: 34161 - RNA, 24 nt, Human
gagacaguggcgcgggcucugagc

SEQ ID NO: 34162 - RNA, 17 nt, Human
ugccagagccccuggac

SEQ ID NO: 34163 - RNA, 24 nt, Human
uugaagauccauaacuaucuucug

SEQ ID NO: 34164 - RNA, 24 nt, Human
uaacuggguugacauugggcugaa

SEQ ID NO: 34165 - RNA, 24 nt, Human
aagcugcugggacuggagcuaagc

SEQ ID NO: 34166 - RNA, 24 nt, Human
uauccggagucgauugagggccag

SEQ ID NO: 34167 - RNA, 24 nt, Human
ucagaagauaguuauggaucuuca

SEQ ID NO: 34168 - RNA, 24 nt, Human
uuaaugcuguguaaaaugguugaa

SEQ ID NO: 34169 - RNA, 24 nt, Human
uaggagacugggcaaaaccuguac

SEQ ID NO: 34170 - RNA, 24 nt, Human
ucagauaaccaaauuaaaagaauu

SEQ ID NO: 34171 - RNA, 24 nt, Human
cuaccggggaccgggacccggcgg

SEQ ID NO: 34172 - RNA, 24 nt, Human
cucgggcuucggaacacggagugg

SEQ ID NO: 34173 - RNA, 24 nt, Human
aggaaggagauauagugaagagga

SEQ ID NO: 34174 - RNA, 24 nt, Human
ugcauuguuaucauuaaccagucu

SEQ ID NO: 34175 - RNA, 24 nt, Human
uaaugggucucaaaauucugugac

SEQ ID NO: 34176 - RNA, 24 nt, Human
uauuagggauaauauucauuuagc

SEQ ID NO: 34177 - RNA, 24 nt, Human
uauaaugguacauucaaaacacau

SEQ ID NO: 34178 - RNA, 24 nt, Human
cggaaauaaaauuuuagaagauca

SEQ ID NO: 34179 - RNA, 24 nt, Human
uacugcuuucugcuuucaauggcu

SEQ ID NO: 34180 - RNA, 24 nt, Human
uacacugagaaguguuaaaaucau

SEQ ID NO: 34181 - RNA, 24 nt, Human
ugagguggucgugaagcucuuuga

SEQ ID NO: 34182 - RNA, 24 nt, Human
ucccggcuggcaaaccucacgcaa

SEQ ID NO: 34183 - RNA, 24 nt, Human
uggaagaugcucaacaccuccucc

SEQ ID NO: 34184 - RNA, 24 nt, Human
ugaccaggaaauacaacgagcugc

SEQ ID NO: 34185 - RNA, 24 nt, Human
ugguggggucccugccgccgcaga

SEQ ID NO: 34186 - RNA, 24 nt, Human
ucagccaguuguauccacagcuuc

SEQ ID NO: 34187 - RNA, 24 nt, Human
gccguguauguucagaacgugguc

SEQ ID NO: 34188 - RNA, 17 nt, Human
gagcaucugcaggaacc

SEQ ID NO: 34189 - RNA, 24 nt, Human
ugugcuggacucugaauucugggg

SEQ ID NO: 34190 - RNA, 24 nt, Human
uaaaugaagauaaagugguuucuu

SEQ ID NO: 34191 - RNA, 24 nt, Human
cagaaaacaguuggaaaaggcaag

SEQ ID NO: 34192 - RNA, 24 nt, Human
aucgcucauuuccuacggcccagg

SEQ ID NO: 34193 - RNA, 24 nt, Human
ugagcccguuugucagccgcagau

SEQ ID NO: 34194 - RNA, 24 nt, Human
guucaugggucgcuugaugugccc

SEQ ID NO: 34195 - RNA, 20 nt, Human
uacuauagaccaggauaggg

SEQ ID NO: 34196 - RNA, 24 nt, Human
uuaguguaagaguuugugggagug

SEQ ID NO: 34197 - RNA, 24 nt, Human
uaucacaaaaguccuaucaugggu

SEQ ID NO: 34198 - RNA, 24 nt, Human
uuaaaucaaguuuaccuauaucaa

SEQ ID NO: 34199 - RNA, 24 nt, Human
agagguagcaaaugaaaauuaaag

SEQ ID NO: 34200 - RNA, 24 nt, Human
aggcagaguggagagaaacaacuc

SEQ ID NO: 34201 - RNA, 24 nt, Human
ucuacaauaaccucaacccccuua

SEQ ID NO: 34202 - RNA, 24 nt, Human
ugagugcccccagggaggggcugg

SEQ ID NO: 34203 - RNA, 24 nt, Human
cgagggccccaacccagaacgaug

SEQ ID NO: 34204 - RNA, 22 nt, Human
uacucauugucauggaagggag

SEQ ID NO: 34205 - RNA, 24 nt, Human
gcccuggcucucugucuccuccca

SEQ ID NO: 34206 - RNA, 24 nt, Human
cucgauuaaaauacacacaucuua

SEQ ID NO: 34207 - RNA, 24 nt, Human
uuuaaacaaauuccauggaguuua

SEQ ID NO: 34208 - RNA, 24 nt, Human
caggauaguaagaaaaguacuacc

SEQ ID NO: 34209 - RNA, 24 nt, Human
uauaauaauuaacaacagcaaaga

SEQ ID NO: 34210 - RNA, 24 nt, Human
ugcuggaaaugcugacuuuuaacc

SEQ ID NO: 34211 - RNA, 21 nt, Human
uucaagggauggaaagucacc

SEQ ID NO: 34212 - RNA, 24 nt, Human
acggagcaugagaagacguucccc

SEQ ID NO: 34213 - RNA, 24 nt, Human
aagcauccucgcgcgacccgagag

SEQ ID NO: 34214 - RNA, 24 nt, Human
ucugcaccagcuggcccagucugu

SEQ ID NO: 34215 - RNA, 24 nt, Human
uaucaaggaagggcaggcgugaug

SEQ ID NO: 34216 - RNA, 24 nt, Human
ugugcagaagaaauggaaggauuc

SEQ ID NO: 34217 - RNA, 24 nt, Human
uaucaaggaagggcaggcgugaug

SEQ ID NO: 34218 - RNA, 24 nt, Human
uucaaauuucuuucuuuuuuaauu

SEQ ID NO: 34219 - RNA, 24 nt, Human
uuaaaguaaugaaugacguuuuaa

SEQ ID NO: 34220 - RNA, 24 nt, Human
uaugggacugauucugaaauucuu

SEQ ID NO: 34221 - RNA, 24 nt, Human
uaucaaggaagggcaggcgugaug

SEQ ID NO: 34222 - RNA, 24 nt, Human
gaaggcaccagcaaggacauuggu

SEQ ID NO: 34223 - RNA, 24 nt, Human
gagcagcaucugcugaagagacag

SEQ ID NO: 34224 - RNA, 24 nt, Human
uuaaagcaugagaaugugauaauu

SEQ ID NO: 34225 - RNA, 24 nt, Human
uaacagguguaagaguguugaaaa

SEQ ID NO: 34226 - RNA, 24 nt, Human
ugugcagaagaaauggaaggauuc

SEQ ID NO: 34227 - RNA, 24 nt, Human
uaucaaggaagggcaggcgugaug

SEQ ID NO: 34228 - RNA, 24 nt, Human
uucaaauuucuuucuuuuuuaauu

SEQ ID NO: 34229 - RNA, 24 nt, Human
gaccagccggaaagcauuggggau

SEQ ID NO: 34230 - RNA, 24 nt, Human
cggugcaggguggcucccaggagg

SEQ ID NO: 34231 - RNA, 24 nt, Human
aguaagccaauuguucucaaguau

SEQ ID NO: 34232 - RNA, 24 nt, Human
uauguugcccaggcuguucucaaa

SEQ ID NO: 34233 - RNA, 24 nt, Human
aacagcucuuuuacaaacaaguua

SEQ ID NO: 34234 - RNA, 24 nt, Human
gaucgggggaaaagggagauguag

SEQ ID NO: 34235 - RNA, 24 nt, Human
ugggauauccaauaaacugagaau

SEQ ID NO: 34236 - RNA, 21 nt, Human
aucacaguuacuuucucagca

SEQ ID NO: 34237 - RNA, 24 nt, Human
uauggcaagucacuuugacagaca

SEQ ID NO: 34238 - RNA, 24 nt, Human
ugagaauggcaaaauuagucgccu

SEQ ID NO: 34239 - RNA, 24 nt, Human
uacaccacucccaagaagaauaag

SEQ ID NO: 34240 - RNA, 24 nt, Human
ggacagguguacagacauguucuu

SEQ ID NO: 34241 - RNA, 24 nt, Human
ucgaauggacacauuaccagugaa

SEQ ID NO: 34242 - RNA, 24 nt, Human
uacaguaucauggcugagguggau

SEQ ID NO: 34243 - RNA, 24 nt, Human
uucaugcguuuaaucauugucucu

SEQ ID NO: 34244 - RNA, 24 nt, Human
aggaaagaaaaaaugucuacucag

SEQ ID NO: 34245 - RNA, 24 nt, Human
uaccugucacucuagaauguaggc

SEQ ID NO: 34246 - RNA, 24 nt, Human
agugacagaagaggccauuaggug

SEQ ID NO: 34247 - RNA, 24 nt, Human
uuuaauaguaccccaauucaguaa

SEQ ID NO: 34248 - RNA, 24 nt, Human
uagacuucguaguaugucacucuu

SEQ ID NO: 34249 - RNA, 24 nt, Human
gggcggaagacaggucaggccccu

SEQ ID NO: 34250 - RNA, 24 nt, Human
accacaauccgguuggucucugcc

SEQ ID NO: 34251 - RNA, 24 nt, Human
ccccggggucugcugugcaggcgc

SEQ ID NO: 34252 - RNA, 24 nt, Human
aagcuuuacaaaaaagauucuaac

SEQ ID NO: 34253 - RNA, 24 nt, Human
cuggcaccuuuacucucgccggcc

SEQ ID NO: 34254 - RNA, 24 nt, Human
cagagcccaagacccaggggagcc

SEQ ID NO: 34255 - RNA, 24 nt, Human
gaauugauuuccaagaaucggcau

SEQ ID NO: 34256 - RNA, 24 nt, Human
ugaaaaaaauucacuuuuagagga

SEQ ID NO: 34257 - RNA, 24 nt, Human
uuagcagcuguuuaauuccaauau

SEQ ID NO: 34258 - RNA, 24 nt, Human
aaugacaagaaaaaagucuguaaa

SEQ ID NO: 34259 - RNA, 24 nt, Human
acagcagcaacaguggcuucgggc

SEQ ID NO: 34260 - RNA, 24 nt, Human
aucccaucgggacccagauggcug

SEQ ID NO: 34261 - RNA, 24 nt, Human
ucucuuaucuaaaucucucuguuc

SEQ ID NO: 34262 - RNA, 24 nt, Human
guagcccuggggccccgcugugcc

SEQ ID NO: 34263 - RNA, 24 nt, Human
ugccccagcggaagugcuccaucc

SEQ ID NO: 34264 - RNA, 24 nt, Human
cugugcuccaggucggccugggcc

SEQ ID NO: 34265 - RNA, 24 nt, Human
aguagguagugucaagccagagau

SEQ ID NO: 34266 - RNA, 24 nt, Human
uaaggaccuguuuggggcagcagg

SEQ ID NO: 34267 - RNA, 24 nt, Human
ugacaucagccgacgccuggcacu

SEQ ID NO: 34268 - RNA, 24 nt, Human
uauuuuauugcccgaggugggggu

SEQ ID NO: 34269 - RNA, 24 nt, Human
ugccucguuguccccuggcgcuac

SEQ ID NO: 34270 - RNA, 22 nt, Human
caggcucagcgaagaaggaccc

SEQ ID NO: 34271 - RNA, 24 nt, Human
uuccauugugaagucucuuauggu

SEQ ID NO: 34272 - RNA, 24 nt, Human
uggcaagggacagcacucacacuc

SEQ ID NO: 34273 - RNA, 24 nt, Human
uaguauauuaggaaauccuaggau

SEQ ID NO: 34274 - RNA, 24 nt, Human
ugagaaugaccccaagaccuuuga

SEQ ID NO: 34275 - RNA, 24 nt, Human
ugugaacgggaagaaggugcugca

SEQ ID NO: 34276 - RNA, 24 nt, Human
cuuccaaucugaugggcauguuug

SEQ ID NO: 34277 - RNA, 22 nt, Human
guggagggcagcuuugucuaca

SEQ ID NO: 34278 - RNA, 24 nt, Human
ucgaauggacacauuaccagugaa

SEQ ID NO: 34279 - RNA, 24 nt, Human
ggacagguguacagacauguucuu

SEQ ID NO: 34280 - RNA, 24 nt, Human
accuuggugaccuugagcacguug

SEQ ID NO: 34281 - RNA, 24 nt, Human
ucuccagaaaugcuuuggguucau

SEQ ID NO: 34282 - RNA, 24 nt, Human
uugaucuugaagaaacugggcgug

SEQ ID NO: 34283 - RNA, 24 nt, Human
aggaaggagauauagugaagagga

SEQ ID NO: 34284 - RNA, 24 nt, Human
guagaguuuucuucaggcuuaaag

SEQ ID NO: 34285 - RNA, 21 nt, Human
aaccagagccugcugagcccc

SEQ ID NO: 34286 - RNA, 24 nt, Human
ugcccagugaccugggggagccug

SEQ ID NO: 34287 - RNA, 24 nt, Human
uaagagguuacagaacuauuagcu

SEQ ID NO: 34288 - RNA, 24 nt, Human
uggagcagauucggcggaucaugc

SEQ ID NO: 34289 - RNA, 24 nt, Human
caccaggugguagaagacgggcua

SEQ ID NO: 34290 - RNA, 24 nt, Human
acaaagcaagagaagaagcagaga

SEQ ID NO: 34291 - RNA, 21 nt, Human
cauuggacaggacauccagcc

SEQ ID NO: 34292 - RNA, 24 nt, Human
uggaaaugggaccuccagauccca

SEQ ID NO: 34293 - RNA, 24 nt, Human
aagaacccaccucuugugcuaccc

SEQ ID NO: 34294 - RNA, 24 nt, Human
uuacacuaaacauguauguagcuc

SEQ ID NO: 34295 - RNA, 24 nt, Human
ugagaugaagauacguuuccaaag

SEQ ID NO: 34296 - RNA, 24 nt, Human
ucuaaagcaaauccuuuguuaguu

SEQ ID NO: 34297 - RNA, 24 nt, Human
uaguagcagaucuccuuucuugau

SEQ ID NO: 34298 - RNA, 24 nt, Human
agagguuacaagucaaaaguuuua

SEQ ID NO: 34299 - RNA, 24 nt, Human
uaaguguuugcagccauauguguc

SEQ ID NO: 34300 - RNA, 24 nt, Human
agugcagagggcucauugggaaaa

SEQ ID NO: 34301 - RNA, 24 nt, Human
uaacugcgugcagaucaggggugg

SEQ ID NO: 34302 - RNA, 22 nt, Human
ugccauggugaugguaaacugg

SEQ ID NO: 34303 - RNA, 24 nt, Human
augccuccucuggguggugauacc

SEQ ID NO: 34304 - RNA, 24 nt, Human
ugggugcgugaugccuccucuggg

SEQ ID NO: 34305 - RNA, 22 nt, Human
uuucaagggauggaaaagucac

SEQ ID NO: 34306 - RNA, 24 nt, Human
ucugaucuauaaaugcgguggcau

SEQ ID NO: 34307 - RNA, 21 nt, Human
uucaagggauggcaagucacc

SEQ ID NO: 34308 - RNA, 24 nt, Human
uccaccacuacuggccaucugauc

SEQ ID NO: 34309 - RNA, 24 nt, Human
ugagacggcucucuugucuucucc

SEQ ID NO: 34310 - RNA, 24 nt, Human
ugagaugggaaagggcuccuucaa

SEQ ID NO: 34311 - RNA, 23 nt, Human
uucaagggauggcaagucaccgu

SEQ ID NO: 34312 - RNA, 21 nt, Human
aaguaugccugggucuuggau

SEQ ID NO: 34313 - RNA, 24 nt, Human
uggccaauuggaaccggguguugu

SEQ ID NO: 34314 - RNA, 22 nt, Human
ugacuaaggaauucugagacag

SEQ ID NO: 34315 - RNA, 24 nt, Human
ugcccguguguggugggaccucuu

SEQ ID NO: 34316 - RNA, 19 nt, Human
ggggauggaaagucaccgu

SEQ ID NO: 34317 - RNA, 24 nt, Human
agaaccauugaaaaauuugagaag

SEQ ID NO: 34318 - RNA, 24 nt, Human
aagaagccgcccugguugcacaug

SEQ ID NO: 34319 - RNA, 24 nt, Human
agagcacauuuuuguauaaacaaa

SEQ ID NO: 34320 - RNA, 24 nt, Human
uacuggguaugcugggaucauuaa

SEQ ID NO: 34321 - RNA, 24 nt, Human
uucccuuguccuauacagaugauc

SEQ ID NO: 34322 - RNA, 24 nt, Human
uagugcccaauaacuaguuuuguu

SEQ ID NO: 34323 - RNA, 20 nt, Human
uccaccagucacccauggag

SEQ ID NO: 34324 - RNA, 24 nt, Human
ugaaugaacucagugucaaauaac

SEQ ID NO: 34325 - RNA, 24 nt, Human
aaacaugcugagggcuuuguucau

SEQ ID NO: 34326 - RNA, 24 nt, Human
uggcauagaaaagaacauguucag

SEQ ID NO: 34327 - RNA, 24 nt, Human
cugcucccuggccagcccccuugu

SEQ ID NO: 34328 - RNA, 24 nt, Human
agaggaagaagccaagcacaggug

SEQ ID NO: 34329 - RNA, 24 nt, Human
gagaauucaccaaguggggcagga

SEQ ID NO: 34330 - RNA, 24 nt, Human
accgggucuugaacagcugguacc

SEQ ID NO: 34331 - RNA, 24 nt, Human
uagaaugcuguaaaaacuguuagg

SEQ ID NO: 34332 - RNA, 24 nt, Human
ugagguccaagcuguugcuguugu

SEQ ID NO: 34333 - RNA, 24 nt, Human
uggaaugccgacauguggccuuuc

SEQ ID NO: 34334 - RNA, 24 nt, Human
ucgcagaaugggcugacucggagg

SEQ ID NO: 34335 - RNA, 24 nt, Human
uagcauaguggucaagcuuguuuc

SEQ ID NO: 34336 - RNA, 24 nt, Human
agccuguuuaaucuggugcuuguu

SEQ ID NO: 34337 - RNA, 24 nt, Human
uucuucuuuuuguggcuguggaca

SEQ ID NO: 34338 - RNA, 24 nt, Human
uccgguaguugccuuugcgcagag

SEQ ID NO: 34339 - RNA, 24 nt, Human
accgcagccauguagacgggcgcg

SEQ ID NO: 34340 - RNA, 24 nt, Human
aggcaggagaaucgcuugaaccug

SEQ ID NO: 34341 - RNA, 24 nt, Human
aacuggcuauuucacguuuauggu

SEQ ID NO: 34342 - RNA, 24 nt, Human
uaaguuauuuauuucuggguuuua

SEQ ID NO: 34343 - RNA, 24 nt, Human
aggaaggagauauagugaagagga

SEQ ID NO: 34344 - RNA, 24 nt, Human
uccgugcgcguugcugcggccgug

SEQ ID NO: 34345 - RNA, 24 nt, Human
aggaaggagauauagugaagagga

SEQ ID NO: 34346 - RNA, 24 nt, Human
cauccgucguaacguguguccucc

SEQ ID NO: 34347 - RNA, 22 nt, Human
cgacacaccuuugggaaaugcc

SEQ ID NO: 34348 - RNA, 24 nt, Human
cggcagagaaguguggcuaagggg

SEQ ID NO: 34349 - RNA, 24 nt, Human
aaggagcgccuguaccuccuggcg

SEQ ID NO: 34350 - RNA, 24 nt, Human
cagcagcgcagucacagucggccc

SEQ ID NO: 34351 - RNA, 24 nt, Human
agaaucuucguuuucauuaaauau

SEQ ID NO: 34352 - RNA, 24 nt, Human
uagcagaauugcuugcagcaaacu

SEQ ID NO: 34353 - RNA, 24 nt, Human
uaugucuuuucugguuuguuguug

SEQ ID NO: 34354 - RNA, 24 nt, Human
uaagugcuuuuaaugucaaguuuu

SEQ ID NO: 34355 - RNA, 24 nt, Human
caagugccgucucaagcuccugcu

SEQ ID NO: 34356 - RNA, 24 nt, Human
uguggcuuuuggggagccagugug

SEQ ID NO: 34357 - RNA, 24 nt, Human
ggagaacgugcugggugagguugg

SEQ ID NO: 34358 - RNA, 24 nt, Human
uacccaguuuggggagaaaauuca

SEQ ID NO: 34359 - RNA, 24 nt, Human
uccacagaguuuaguuuccucauu

SEQ ID NO: 34360 - RNA, 22 nt, Human
uccgugcgcguugcugcggccg

SEQ ID NO: 34361 - RNA, 24 nt, Human
uugaucuugaagaaacugggcgug

SEQ ID NO: 34362 - RNA, 24 nt, Human
aggaaggagauauagugaagagga

SEQ ID NO: 34363 - RNA, 24 nt, Human
guagaguuuucuucaggcuuaaag

SEQ ID NO: 34364 - RNA, 24 nt, Human
cagcgugcaccuucacccgcugcu

SEQ ID NO: 34365 - RNA, 24 nt, Human
uggcaaagugggcuucagcaaggc

SEQ ID NO: 34366 - RNA, 20 nt, Human
cguggaggccgcggaggccg

SEQ ID NO: 34367 - RNA, 24 nt, Human
gagcagcagcggcgacucgaggcc

SEQ ID NO: 34368 - RNA, 24 nt, Human
uugaaugacgcccgggaccugcau

SEQ ID NO: 34369 - RNA, 24 nt, Human
uagaggccgcgcaaacuguuguga

SEQ ID NO: 34370 - RNA, 24 nt, Human
ccauggcaccugcccagcacccac

SEQ ID NO: 34371 - RNA, 24 nt, Human
gggcagugggcaccgucaaaguau

SEQ ID NO: 34372 - RNA, 24 nt, Human
cauuggaauggauuuggaacccac

SEQ ID NO: 34373 - RNA, 24 nt, Human
accgcacugucaugggccguaucg

SEQ ID NO: 34374 - RNA, 24 nt, Human
auagugcugucacaguugaaugua

SEQ ID NO: 34375 - RNA, 24 nt, Human
uaaaacaaccagcaugagcaauca

SEQ ID NO: 34376 - RNA, 24 nt, Human
ucacugguuuuguggcugccuccc

SEQ ID NO: 34377 - RNA, 24 nt, Human
ggacugcagaagugacugucuaua

SEQ ID NO: 34378 - RNA, 20 nt, Human
cccccgcgccgccuccccgc

SEQ ID NO: 34379 - RNA, 24 nt, Human
ugaugugcuaauuacagugcuagg

SEQ ID NO: 34380 - RNA, 24 nt, Human
ugcagaaaacacaucuuaaaauca

SEQ ID NO: 34381 - RNA, 24 nt, Human
uagcugcugcgggacuaccacuga

SEQ ID NO: 34382 - RNA, 17 nt, Human
ugaguguguggagacug

SEQ ID NO: 34383 - RNA, 24 nt, Human
caucggauuuugcagcuucugggc

SEQ ID NO: 34384 - RNA, 24 nt, Human
uggccugaugauccacagcggaga

SEQ ID NO: 34385 - RNA, 24 nt, Human
ugugugccauugcccaggcagagu

SEQ ID NO: 34386 - RNA, 24 nt, Human
ugagaacgagccagacuuggccag

SEQ ID NO: 34387 - RNA, 24 nt, Human
caaggaccaccgcaucucuacauu

SEQ ID NO: 34388 - RNA, 24 nt, Human
gugaauuuuugaaacuggaccaga

SEQ ID NO: 34389 - RNA, 20 nt, Human
uuugguugacagugcggugg

SEQ ID NO: 34390 - RNA, 24 nt, Human
agaagccaaguaucuucaagaccu

SEQ ID NO: 34391 - RNA, 24 nt, Human
uguugcuuuuuugcaguugucuuu

SEQ ID NO: 34392 - RNA, 24 nt, Human
uaccuuguuauugcugucucaaca

SEQ ID NO: 34393 - RNA, 24 nt, Human
uaguauuaauuuuuuuugguuggg

SEQ ID NO: 34394 - RNA, 22 nt, Human
aagaagccuugcagcuuccacc

SEQ ID NO: 34395 - RNA, 24 nt, Human
auggauuguagaguaagguuuugu

SEQ ID NO: 34396 - RNA, 24 nt, Human
ugccguaguugacgauguuguugu

SEQ ID NO: 34397 - RNA, 24 nt, Human
uguaugcagggcccggcaguaagc

SEQ ID NO: 34398 - RNA, 24 nt, Human
gggaaaguguucggcagggcagaa

SEQ ID NO: 34399 - RNA, 24 nt, Human
cauuguagauaagauguuauagca

SEQ ID NO: 34400 - RNA, 24 nt, Human
uggcagacagccaggcgauuuagg

SEQ ID NO: 34401 - RNA, 24 nt, Human
caugucaaccuuucugcauccuua

SEQ ID NO: 34402 - RNA, 24 nt, Human
ugaauucaaaaucagcaaaggucu

SEQ ID NO: 34403 - RNA, 22 nt, Human
ugucauagagagucccugucuc

SEQ ID NO: 34404 - RNA, 24 nt, Human
acccaguuaauguaauuccagaag

SEQ ID NO: 34405 - RNA, 24 nt, Human
caacaggaaguuuugggacuaagc

SEQ ID NO: 34406 - RNA, 24 nt, Human
uagcuuggccaacauggagaaacc

SEQ ID NO: 34407 - RNA, 24 nt, Human
ugaauaguuaugacagagaccaua

SEQ ID NO: 34408 - RNA, 24 nt, Human
ccaaagugcuggaauuacaggcau

SEQ ID NO: 34409 - RNA, 24 nt, Human
agugcaguggagugaccuugguuc

SEQ ID NO: 34410 - RNA, 24 nt, Human
uguggccagucuguaaguugugag

SEQ ID NO: 34411 - RNA, 24 nt, Human
ugcuggggucgcgcggcuuuggaa

SEQ ID NO: 34412 - RNA, 24 nt, Human
uuccaagagaagcacgguuuucuc

SEQ ID NO: 34413 - RNA, 24 nt, Human
agagguccuuaccucucugacagu

SEQ ID NO: 34414 - RNA, 24 nt, Human
uauuuguucucgaggaccagcuua

SEQ ID NO: 34415 - RNA, 24 nt, Human
ccacaaggacaaagggagcggcac

SEQ ID NO: 34416 - RNA, 24 nt, Human
aaaaccuaucaaggugcuccauug

SEQ ID NO: 34417 - RNA, 24 nt, Human
ucauucaaggguuaggaugcaggu

SEQ ID NO: 34418 - RNA, 24 nt, Human
uaggcuacuacucaucaauuaacu

SEQ ID NO: 34419 - RNA, 24 nt, Human
ugaaugcccuuguuuagaaugggu

SEQ ID NO: 34420 - RNA, 24 nt, Human
aucaaguuggcucuucaucuauau

SEQ ID NO: 34421 - RNA, 24 nt, Human
uggcagcaaugaaggcgcggguaa

SEQ ID NO: 34422 - RNA, 24 nt, Human
uaguaacuuuugugcauucugcaa

SEQ ID NO: 34423 - RNA, 24 nt, Human
aaaaaucauugaacauuuccucca

SEQ ID NO: 34424 - RNA, 24 nt, Human
ugcuggguagagaggcacuuucag

SEQ ID NO: 34425 - RNA, 24 nt, Human
ugaggucucccugcucuugguggc

SEQ ID NO: 34426 - RNA, 24 nt, Human
gcggguagacauggagggcuuucg

SEQ ID NO: 34427 - RNA, 24 nt, Human
ggggauugggcagcagagggcccc

SEQ ID NO: 34428 - RNA, 24 nt, Human
uuuaccauaauguuccuuaguggu

SEQ ID NO: 34429 - RNA, 24 nt, Human
ugagcacugguaaacaaucugcuu

SEQ ID NO: 34430 - RNA, 23 nt, Human
uaagugguguauuuacagggcua

SEQ ID NO: 34431 - RNA, 24 nt, Human
aggcuucuugggagagugaggaug

SEQ ID NO: 34432 - RNA, 24 nt, Human
aggaaggccgaccaggcaagaagc

SEQ ID NO: 34433 - RNA, 24 nt, Human
uggaagacauggcucguccggaca

SEQ ID NO: 34434 - RNA, 24 nt, Human
uuucccggaagcugcccggggggu

SEQ ID NO: 34435 - RNA, 24 nt, Human
uauagcaccaugaucacgcugucg

SEQ ID NO: 34436 - RNA, 24 nt, Human
uaagugacaaugcuuauggaaagc

SEQ ID NO: 34437 - RNA, 21 nt, Human
uucaagggauggaaagucacc

SEQ ID NO: 34438 - RNA, 24 nt, Human
caccuggguagggauuggcacacg

SEQ ID NO: 34439 - RNA, 24 nt, Human
uacgaaaauuggcuacaagcccga

SEQ ID NO: 34440 - RNA, 24 nt, Human
ugauugaaaagauacuaagaacua

SEQ ID NO: 34441 - RNA, 24 nt, Human
cauuucgaaugcuuuaaucaacag

SEQ ID NO: 34442 - RNA, 24 nt, Human
aagugcgcgaugagcuggagggcc

SEQ ID NO: 34443 - RNA, 24 nt, Human
cugcugcaggcagauuccuucugc

SEQ ID NO: 34444 - RNA, 24 nt, Human
cgggaagguaggcggcugcaggau

SEQ ID NO: 34445 - RNA, 24 nt, Human
gaggaccugguagcuaaggcagug

SEQ ID NO: 34446 - RNA, 24 nt, Human
uucaaugccacuauccuucccauc

SEQ ID NO: 34447 - RNA, 24 nt, Human
uggaagcugagcagaggccaguuc

SEQ ID NO: 34448 - RNA, 24 nt, Human
ucuuuuuuuugaaacagggucugg

SEQ ID NO: 34449 - RNA, 24 nt, Human
ucggaaggucucuuuacauguuag

SEQ ID NO: 34450 - RNA, 24 nt, Human
ugagucugcucaucuucuucaguu

SEQ ID NO: 34451 - RNA, 24 nt, Human
aggcuuugucauuuuuaugcaauu

SEQ ID NO: 34452 - RNA, 24 nt, Human
aacguggagcuuggcagcgagcug

SEQ ID NO: 34453 - RNA, 24 nt, Human
ugaggaccagaggcccuauugcuu

SEQ ID NO: 34454 - RNA, 24 nt, Human
uaugagaacauuucuaccucugga

SEQ ID NO: 34455 - RNA, 22 nt, Human
agucggugguuaucagugucuu

SEQ ID NO: 34456 - RNA, 24 nt, Human
cggcaguagaaauagcacaggccu

SEQ ID NO: 34457 - RNA, 24 nt, Human
uggaagacagcuacgggcagcagu

SEQ ID NO: 34458 - RNA, 24 nt, Human
ucccuggcuuaugagcaggcugag

SEQ ID NO: 34459 - RNA, 24 nt, Human
uacacacuguauugauccaaguau

SEQ ID NO: 34460 - RNA, 24 nt, Human
uagcagcuuuauucauaauugcca

SEQ ID NO: 34461 - RNA, 24 nt, Human
aggcauguguuggcaaaggcuguu

SEQ ID NO: 34462 - RNA, 24 nt, Human
uacagguuccaaaucgaggccgag

SEQ ID NO: 34463 - RNA, 24 nt, Human
cacgggccaggcccuccucucagg

SEQ ID NO: 34464 - RNA, 24 nt, Human
ugaagaaguaaaaaguggcaucaa

SEQ ID NO: 34465 - RNA, 24 nt, Human
ugacccaccuuuuauugaguccug

SEQ ID NO: 34466 - RNA, 24 nt, Human
ugagaggauacaaaaugucaucgu

SEQ ID NO: 34467 - RNA, 24 nt, Human
uaaaugguaaacgugauaucauga

SEQ ID NO: 34468 - RNA, 24 nt, Human
aaaugaccauuuuguuguuuucca

SEQ ID NO: 34469 - RNA, 21 nt, Human
ugccauggcuccagcucagau

SEQ ID NO: 34470 - RNA, 24 nt, Human
gaaagggauucucguuuugucgcc

SEQ ID NO: 34471 - RNA, 21 nt, Human
aaguaugccugggucuuggau

SEQ ID NO: 34472 - RNA, 24 nt, Human
uauauuguauuuaauauuggauuc

SEQ ID NO: 34473 - RNA, 18 nt, Human
ugauuggaaaacaagacg

SEQ ID NO: 34474 - RNA, 24 nt, Human
ugguguuuucucuuuuucucuguc

SEQ ID NO: 34475 - RNA, 24 nt, Human
accuaguacuuugagaaaguuaua

SEQ ID NO: 34476 - RNA, 24 nt, Human
aaagugcugagauuacacgcauga

SEQ ID NO: 34477 - RNA, 24 nt, Human
uuaaccacacaaucacauaaucaa

SEQ ID NO: 34478 - RNA, 24 nt, Human
ucuuugguaccucugcuuacugcc

SEQ ID NO: 34479 - RNA, 24 nt, Human
uguuuguuucuauucaaccaauuu

SEQ ID NO: 34480 - RNA, 24 nt, Human
ugagcagaggcuccugcuucuugg

SEQ ID NO: 34481 - RNA, 24 nt, Human
cucaucccccacggccucaguaaa

SEQ ID NO: 34482 - RNA, 24 nt, Human
caccagcaggagguccugcccccu

SEQ ID NO: 34483 - RNA, 20 nt, Human
ugaggugacagucacggagg

SEQ ID NO: 34484 - RNA, 24 nt, Human
uaccuggagguuggagacaggggc

SEQ ID NO: 34485 - RNA, 18 nt, Human
ccagagcaggagggaaga

SEQ ID NO: 34486 - RNA, 24 nt, Human
cugcugcccauggucuugaacuga

SEQ ID NO: 34487 - RNA, 24 nt, Human
uauccuagaaggacucacauucua

SEQ ID NO: 34488 - RNA, 24 nt, Human
uaguaccugugggcaguuggcuaa

SEQ ID NO: 34489 - RNA, 24 nt, Human
augcagccuaaaaggugguugaaa

SEQ ID NO: 34490 - RNA, 24 nt, Human
ugccaguucccccuggugaaccau

SEQ ID NO: 34491 - RNA, 24 nt, Human
aggccaugugggccaugaggucca

SEQ ID NO: 34492 - RNA, 24 nt, Human
ugcauuguuaucauuaaccagucu

SEQ ID NO: 34493 - RNA, 24 nt, Human
uuggaugaucuacggaaucugacc

SEQ ID NO: 34494 - RNA, 24 nt, Human
cucccaugcuggacuccgacggcu

SEQ ID NO: 34495 - RNA, 24 nt, Human
ugucacagcuguagaucaugcugc

SEQ ID NO: 34496 - RNA, 24 nt, Human
cgagccaauaccaucacuccuaug

SEQ ID NO: 34497 - RNA, 24 nt, Human
cugggccagggucaggaaaggggc

SEQ ID NO: 34498 - RNA, 24 nt, Human
cagccccccaugcggcaagcugga

SEQ ID NO: 34499 - RNA, 24 nt, Human
ugguggcucaugccuguaauccca

SEQ ID NO: 34500 - RNA, 24 nt, Human
uccacuuaaaaugaagagcauucc

SEQ ID NO: 34501 - RNA, 24 nt, Human
uguaaaaaaacccucugcacuucc

SEQ ID NO: 34502 - RNA, 24 nt, Human
aaguaugucuaauuuaaacguaua

SEQ ID NO: 34503 - RNA, 24 nt, Human
uauuguuaauuuucauacuuaaaa

SEQ ID NO: 34504 - RNA, 24 nt, Human
uuuguaaacuuacucaugcaaaau

SEQ ID NO: 34505 - RNA, 24 nt, Human
ccacccagguagcggggacuacag

SEQ ID NO: 34506 - RNA, 24 nt, Human
aagcaguccucccacuuggccucc

SEQ ID NO: 34507 - RNA, 24 nt, Human
cccccuggaggggcagggcaggca

SEQ ID NO: 34508 - RNA, 17 nt, Human
ccccugggcucagcagg

SEQ ID NO: 34509 - RNA, 24 nt, Human
ugggauguggauauacuggcuuca

SEQ ID NO: 34510 - RNA, 24 nt, Human
ucuguguuccugggacaccgcuga

SEQ ID NO: 34511 - RNA, 24 nt, Human
ugggagcagggauuggcugccauu

SEQ ID NO: 34512 - RNA, 24 nt, Human
uuaguucuuuuuuccagucuuccu

SEQ ID NO: 34513 - RNA, 22 nt, Human
guggucucguggaugccgcaag

SEQ ID NO: 34514 - RNA, 24 nt, Human
ugacauguuucuuuguuuuggaca

SEQ ID NO: 34515 - RNA, 21 nt, Human
uuaccagggguucgggacagc

SEQ ID NO: 34516 - RNA, 24 nt, Human
uuucacaacgauuuucugcuccuc

SEQ ID NO: 34517 - RNA, 24 nt, Human
ggacagguguacagacauguucuu

SEQ ID NO: 34518 - RNA, 24 nt, Human
ucgaauggacacauuaccagugaa

SEQ ID NO: 34519 - RNA, 24 nt, Human
aaacuccaaugguucagugacugu

SEQ ID NO: 34520 - RNA, 24 nt, Human
ggagaagcagagagccagaccaaa

SEQ ID NO: 34521 - RNA, 24 nt, Human
uauauuguuguuaaucaucaagga

SEQ ID NO: 34522 - RNA, 24 nt, Human
aacagguaauauaaaaccgauaca

SEQ ID NO: 34523 - RNA, 24 nt, Human
uugacaauuuuauuuucacauuug

SEQ ID NO: 34524 - RNA, 24 nt, Human
uuucgaaaacgggugauugguugc

SEQ ID NO: 34525 - RNA, 24 nt, Human
uccaugggggggaucucucguaga

SEQ ID NO: 34526 - RNA, 24 nt, Human
uauccuuucagaaccaccaaaaag

SEQ ID NO: 34527 - RNA, 24 nt, Human
uuuaugcucgcuugcugagacuuc

SEQ ID NO: 34528 - RNA, 24 nt, Human
uaccuccaccugaguuggaugaua

SEQ ID NO: 34529 - RNA, 24 nt, Human
aaccagccgaauggaguccuuuac

SEQ ID NO: 34530 - RNA, 24 nt, Human
ccagggguggggcugaucaagggc

SEQ ID NO: 34531 - RNA, 24 nt, Human
ugacaccaccccacuccucuuccu

SEQ ID NO: 34532 - RNA, 24 nt, Human
ucggugcuugguaccuggucucuc

SEQ ID NO: 34533 - RNA, 20 nt, Human
ucccagaguccgaccuggug

SEQ ID NO: 34534 - RNA, 24 nt, Human
uccucuggauucuggccaaugaaa

SEQ ID NO: 34535 - RNA, 24 nt, Human
guccucuucuuuucccagagcucc

SEQ ID NO: 34536 - RNA, 24 nt, Human
caauaccacuuccgcugucacggu

SEQ ID NO: 34537 - RNA, 21 nt, Human
accccgcucagcaccagggag

SEQ ID NO: 34538 - RNA, 24 nt, Human
agggcacagaccccgccagccugc

SEQ ID NO: 34539 - RNA, 24 nt, Human
ucacuacaaccuccgccuccuggc

SEQ ID NO: 34540 - RNA, 24 nt, Human
ucuccagguuagggugagccgccg

SEQ ID NO: 34541 - RNA, 24 nt, Human
uucacguccguucgcagcgucacc

SEQ ID NO: 34542 - RNA, 24 nt, Human
agacuauaucuguagaaacuuuau

SEQ ID NO: 34543 - RNA, 24 nt, Human
uacuucaggaacucuuuuucaaac

SEQ ID NO: 34544 - RNA, 24 nt, Human
ucucgcucuguugcccaggcugga

SEQ ID NO: 34545 - RNA, 24 nt, Human
aaagugcuggcguuacagguauga

SEQ ID NO: 34546 - RNA, 24 nt, Human
gggcugggccaguccaggagccgc

SEQ ID NO: 34547 - RNA, 24 nt, Human
uugguuggcucaccgagcugcagg

SEQ ID NO: 34548 - RNA, 24 nt, Human
ccaggacacuucugaguacaucau

SEQ ID NO: 34549 - RNA, 24 nt, Human
uuugagaauaacuuuaaugagaca

SEQ ID NO: 34550 - RNA, 24 nt, Human
uggcauuguacucuuucaucagga

SEQ ID NO: 34551 - RNA, 24 nt, Human
aggcaagagaaaugcuuguuucuu

SEQ ID NO: 34552 - RNA, 24 nt, Human
uaauguacagaacuaaauuuuuua

SEQ ID NO: 34553 - RNA, 24 nt, Human
acugcagucgagcuugggcgacag

SEQ ID NO: 34554 - RNA, 24 nt, Human
ggcgguugugaucaugaggucagg

SEQ ID NO: 34555 - RNA, 24 nt, Human
ugauggaagcggggcugcaggacg

SEQ ID NO: 34556 - RNA, 23 nt, Human
aggcagccguggaaucagggcag

SEQ ID NO: 34557 - RNA, 24 nt, Human
caaugcccaugaauauacccaaag

SEQ ID NO: 34558 - RNA, 18 nt, Human
ugacguggacauccgcaa

SEQ ID NO: 34559 - RNA, 24 nt, Human
uccagagcuuuguuugaguucuca

SEQ ID NO: 34560 - RNA, 24 nt, Human
ugcauuguuaucauuaaccagucu

SEQ ID NO: 34561 - RNA, 24 nt, Human
aagcgaccccaaaguggauagucu

SEQ ID NO: 34562 - RNA, 24 nt, Human
ucagugccacgcuugcagggugca

SEQ ID NO: 34563 - RNA, 24 nt, Human
uuggagggguggacaaucaucacg

SEQ ID NO: 34564 - RNA, 24 nt, Human
acguaagcaugagguuguugggga

SEQ ID NO: 34565 - RNA, 24 nt, Human
uccauagucuccuaccccuccugg

SEQ ID NO: 34566 - RNA, 24 nt, Human
gggcagagaacuccuugauguucu

SEQ ID NO: 34567 - RNA, 24 nt, Human
uuaguugaugaauucuugaagagc

SEQ ID NO: 34568 - RNA, 24 nt, Human
ucgcaccgccguagcgcacauacu

SEQ ID NO: 34569 - RNA, 24 nt, Human
uacccugugaucgcugaccgcaug

SEQ ID NO: 34570 - RNA, 17 nt, Human
ugccaggaaaagaugag

SEQ ID NO: 34571 - RNA, 21 nt, Human
ugagaugggguggggacacag

SEQ ID NO: 34572 - RNA, 24 nt, Human
uguacaagagugguauauuuuaca

SEQ ID NO: 34573 - RNA, 24 nt, Human
uauggcaagucacuuugacagaca

SEQ ID NO: 34574 - RNA, 24 nt, Human
ugagaauggcaaaauuagucgccu

SEQ ID NO: 34575 - RNA, 24 nt, Human
uacaccacucccaagaagaauaag

SEQ ID NO: 34576 - RNA, 24 nt, Human
uugagauaaucuucauuagguaua

SEQ ID NO: 34577 - RNA, 21 nt, Human
uggagggaaauagaagggcug

SEQ ID NO: 34578 - RNA, 24 nt, Human
aggaaucuguaaaccaaaugcagc

SEQ ID NO: 34579 - RNA, 24 nt, Human
uggaaaacugggcuaaauauauaa

SEQ ID NO: 34580 - RNA, 18 nt, Human
ucuuacagucugacuaac

SEQ ID NO: 34581 - RNA, 24 nt, Human
gaagaagacaacauacauaaaaag

SEQ ID NO: 34582 - RNA, 24 nt, Human
ugaacacauacagaacugaauuaa

SEQ ID NO: 34583 - RNA, 24 nt, Human
gacuguguuuuaccugugccagca

SEQ ID NO: 34584 - RNA, 24 nt, Human
aucauuuugagcaaaauaucuguu

SEQ ID NO: 34585 - RNA, 24 nt, Human
ugagguucagaacaugaacauuuu

SEQ ID NO: 34586 - RNA, 24 nt, Human
uggcagccgcauggacaggcagac

SEQ ID NO: 34587 - RNA, 24 nt, Human
aggcacugcuuauuccagugcagc

SEQ ID NO: 34588 - RNA, 24 nt, Human
cuuuaugucucacauucaugucau

SEQ ID NO: 34589 - RNA, 24 nt, Human
guggaucuaccauucugguguuug

SEQ ID NO: 34590 - RNA, 24 nt, Human
gucaggaugucugucaccgcugcg

SEQ ID NO: 34591 - RNA, 24 nt, Human
ugccacagagccuccauccagcuc

SEQ ID NO: 34592 - RNA, 24 nt, Human
uccggggagcaggaguuucaauuu

SEQ ID NO: 34593 - RNA, 24 nt, Human
uuuucaggaaagucuccuuugcac

SEQ ID NO: 34594 - RNA, 24 nt, Human
uuggaauauuaaggauagaaggaa

SEQ ID NO: 34595 - RNA, 24 nt, Human
acgaagaugaugaacuaaagccuu

SEQ ID NO: 34596 - RNA, 24 nt, Human
uccauggguuauacacgggaggag

SEQ ID NO: 34597 - RNA, 24 nt, Human
cgacgcguucauugcagccggcga

SEQ ID NO: 34598 - RNA, 18 nt, Human
aacagcuuucucaaaugu

SEQ ID NO: 34599 - RNA, 24 nt, Human
agacagaaaguuuggaucuuuagu

SEQ ID NO: 34600 - RNA, 24 nt, Human
ugucagaaaacaaaacaaaaaaag

SEQ ID NO: 34601 - RNA, 24 nt, Human
cgucaagacgcuggggcagcagca

SEQ ID NO: 34602 - RNA, 24 nt, Human
aaggagucaccuguaaucaaggug

SEQ ID NO: 34603 - RNA, 24 nt, Human
aaguauccagccuugauacccauu

SEQ ID NO: 34604 - RNA, 24 nt, Human
ucucuguggcagugcuuguugcuu

SEQ ID NO: 34605 - RNA, 24 nt, Human
agagauacuggaugcuuugcaaaa

SEQ ID NO: 34606 - RNA, 24 nt, Human
ugaaaaccugggcucagcaguuaa

SEQ ID NO: 34607 - RNA, 24 nt, Human
uaacuuagcuaagcccuuugcaca

SEQ ID NO: 34608 - RNA, 24 nt, Human
aaugaaccaggacuauuugaaugg

SEQ ID NO: 34609 - RNA, 24 nt, Human
uggcauuguguaagggcagccagc

SEQ ID NO: 34610 - RNA, 24 nt, Human
uggauuaagaaaaaacaccuaguc

SEQ ID NO: 34611 - RNA, 24 nt, Human
uccgcuccaucauggaggagugcg

SEQ ID NO: 34612 - RNA, 24 nt, Human
uuagcacagguccaauauccaugg

SEQ ID NO: 34613 - RNA, 24 nt, Human
ugcuccugucccuuccacuuccuc

SEQ ID NO: 34614 - RNA, 24 nt, Human
uuuccuggccccucacucauuuca

SEQ ID NO: 34615 - RNA, 24 nt, Human
ugaaaaaacugaggauuagagaag

SEQ ID NO: 34616 - RNA, 24 nt, Human
uauacaguuuguuuuuaaauuguc

SEQ ID NO: 34617 - RNA, 24 nt, Human
augauucucugagguuaaacaugg

SEQ ID NO: 34618 - RNA, 24 nt, Human
ggugaugggggcagccgggaggga

SEQ ID NO: 34619 - RNA, 24 nt, Human
uaaaaaggauuuaaaggcuuuuuu

SEQ ID NO: 34620 - RNA, 24 nt, Human
uaaaacaacuuguuuaggguuuua

SEQ ID NO: 34621 - RNA, 24 nt, Human
uugcugggccgguugggguacuug

SEQ ID NO: 34622 - RNA, 24 nt, Human
cuugaaguugcgcaugcagaugcg

SEQ ID NO: 34623 - RNA, 17 nt, Human
cagcagccggagugugg

SEQ ID NO: 34624 - RNA, 24 nt, Human
ugugaagagcggagcccauccuuu

SEQ ID NO: 34625 - RNA, 24 nt, Human
cgggagagggggccauaccggacc

SEQ ID NO: 34626 - RNA, 24 nt, Human
cuuggaccaugccagagggaaguc

SEQ ID NO: 34627 - RNA, 24 nt, Human
agucgggaacaugaagggagacug

SEQ ID NO: 34628 - RNA, 24 nt, Human
gcgccuuggucuggggggucugcg

SEQ ID NO: 34629 - RNA, 24 nt, Human
ugacuauagaauauaauuggcaua

SEQ ID NO: 34630 - RNA, 24 nt, Human
uggaaggaaaggcacgcgggccgg

SEQ ID NO: 34631 - RNA, 24 nt, Human
ccugugcagcaccgcgaggugcag

SEQ ID NO: 34632 - RNA, 24 nt, Human
ccugcauguguggcggguggagaa

SEQ ID NO: 34633 - RNA, 24 nt, Human
uuggauccaaagaacagaaucugu

SEQ ID NO: 34634 - RNA, 24 nt, Human
ugacuauagaauauaauuuggcau

SEQ ID NO: 34635 - RNA, 24 nt, Human
uacaguagugagaagaauauguuc

SEQ ID NO: 34636 - RNA, 24 nt, Human
aauugcauggguuuguagguacuu

SEQ ID NO: 34637 - RNA, 24 nt, Human
uaaguuccaucuaugccuauuuug

SEQ ID NO: 34638 - RNA, 19 nt, Human
uacaacacaauaacaaaau

SEQ ID NO: 34639 - RNA, 21 nt, Human
ugaaaggucuuagugucuguu

SEQ ID NO: 34640 - RNA, 24 nt, Human
ugauuacagaaaauguucuauuua

SEQ ID NO: 34641 - RNA, 24 nt, Human
ugggauauuucuaauaucuaguau

SEQ ID NO: 34642 - RNA, 23 nt, Human
ucugcauaggccucuagcgcacc

SEQ ID NO: 34643 - RNA, 24 nt, Human
uaaacuaccagugaaaagcgaaua

SEQ ID NO: 34644 - RNA, 24 nt, Human
uuguaagaguggaauuaacugccc

SEQ ID NO: 34645 - RNA, 24 nt, Human
uucaguauuuggaccugacauuuc

SEQ ID NO: 34646 - RNA, 24 nt, Human
uauguuaacuuuuacagaaaaaau

SEQ ID NO: 34647 - RNA, 24 nt, Human
caucugcucuuuucucuguccucc

SEQ ID NO: 34648 - RNA, 17 nt, Human
uaccaguaacccccgag

SEQ ID NO: 34649 - RNA, 24 nt, Human
uuugaaaguuuauuguuuucuuua

SEQ ID NO: 34650 - RNA, 23 nt, Human
aacagguuuauauaaaauaggag

SEQ ID NO: 34651 - RNA, 23 nt, Human
ccagcagucaagcgugccugugu

SEQ ID NO: 34652 - RNA, 24 nt, Human
caagacaagcacaaaagcaccacc

SEQ ID NO: 34653 - RNA, 24 nt, Human
uaaggcagaauuaucucccugcaa

SEQ ID NO: 34654 - RNA, 24 nt, Human
uaaguuucaagaguucagauauac

SEQ ID NO: 34655 - RNA, 22 nt, Human
ucccagagaaaguuggucagcu

SEQ ID NO: 34656 - RNA, 24 nt, Human
acucagcuggagcugaaggggaac

SEQ ID NO: 34657 - RNA, 21 nt, Human
uacccuguguacaacagcaag

SEQ ID NO: 34658 - RNA, 21 nt, Human
uaacugguugcucuuccuauu

SEQ ID NO: 34659 - RNA, 24 nt, Human
aucaguuuuuuugacauaauaacu

SEQ ID NO: 34660 - RNA, 19 nt, Human
uagaauaucucucgucugg

SEQ ID NO: 34661 - RNA, 19 nt, Human
uucaucuuucgcuuggcuc

SEQ ID NO: 34662 - RNA, 24 nt, Human
uccacuggcgaaagaugccuuucu

SEQ ID NO: 34663 - RNA, 24 nt, Human
uaugacuuaagaucuuuucuuuuu

SEQ ID NO: 34664 - RNA, 24 nt, Human
caggaggcugcuuagcaguuuuga

SEQ ID NO: 34665 - RNA, 24 nt, Human
ucuuauguuucuauggcuuugaag

SEQ ID NO: 34666 - RNA, 24 nt, Human
uuugcagaaaauaacagaagcauc

SEQ ID NO: 34667 - RNA, 24 nt, Human
uaaaagcuguauuuggaauaugug

SEQ ID NO: 34668 - RNA, 24 nt, Human
acuagauuuaaaauagugguuuua

SEQ ID NO: 34669 - RNA, 24 nt, Human
uugccgggggugugggccccgggc

SEQ ID NO: 34670 - RNA, 24 nt, Human
ucgccgccgccaugacugagcaga

SEQ ID NO: 34671 - RNA, 24 nt, Human
ugggauggaacccugcgccucugg

SEQ ID NO: 34672 - RNA, 24 nt, Human
ugucgcgguuuuucaccaccgguu

SEQ ID NO: 34673 - RNA, 23 nt, Human
agaaggcucuucagaaugaggau

SEQ ID NO: 34674 - RNA, 24 nt, Human
uggcaggaacauaaacagcaauuc

SEQ ID NO: 34675 - RNA, 24 nt, Human
ggauccugucagaacgcaaauuga

SEQ ID NO: 34676 - RNA, 24 nt, Human
caggggcauggccagauuguuucc

SEQ ID NO: 34677 - RNA, 24 nt, Human
ugggguaaugaaguauuucaguuu

SEQ ID NO: 34678 - RNA, 24 nt, Human
ugagggcagacugccaaguccugg

SEQ ID NO: 34679 - RNA, 24 nt, Human
aaauuccaaaucaaaacauaacuc

SEQ ID NO: 34680 - RNA, 24 nt, Human
uugaaguucacaagacgggaggcc

SEQ ID NO: 34681 - RNA, 24 nt, Human
uauuauauaauuaucuuccuuaua

SEQ ID NO: 34682 - RNA, 22 nt, Human
uaaguccugggugucuggugcc

SEQ ID NO: 34683 - RNA, 18 nt, Human
ucacuggggcucaggcgg

SEQ ID NO: 34684 - RNA, 24 nt, Human
uagguucugugguuucuucugagc

SEQ ID NO: 34685 - RNA, 24 nt, Human
accagcagaagccaggacaggccc

SEQ ID NO: 34686 - RNA, 17 nt, Human
ugcuguuuacucugcau

SEQ ID NO: 34687 - RNA, 24 nt, Human
uauugcuaggguggcgcuccaauu

SEQ ID NO: 34688 - RNA, 24 nt, Human
uaucaugucgcccacgcgggucac

SEQ ID NO: 34689 - RNA, 24 nt, Human
agggaauacaaauuuuggaggagg

SEQ ID NO: 34690 - RNA, 21 nt, Human
cugcugcccuccuucagcagc

SEQ ID NO: 34691 - RNA, 22 nt, Human
ucccaggguauacuccaccuuc

SEQ ID NO: 34692 - RNA, 24 nt, Human
aggcauuuugguuuuuuaaaaucu

SEQ ID NO: 34693 - RNA, 24 nt, Human
aaggcuucuugaaguaaauguucu

SEQ ID NO: 34694 - RNA, 24 nt, Human
uaacuuuagugaccuuuuaaaagu

SEQ ID NO: 34695 - RNA, 24 nt, Human
cauccagggucggacucccggggc

SEQ ID NO: 34696 - RNA, 24 nt, Human
agguuccagcacaaaggagucugu

SEQ ID NO: 34697 - RNA, 19 nt, Human
ccgcugagggaggcacagg

SEQ ID NO: 34698 - RNA, 24 nt, Human
uauuuggaaaagagacaguugaau

SEQ ID NO: 34699 - RNA, 23 nt, Human
uaaagcaugaccaggaucuucag

SEQ ID NO: 34700 - RNA, 24 nt, Human
uaaguaaugggauggucuucaguu

SEQ ID NO: 34701 - RNA, 24 nt, Human
cggguuggggggaaaguugguugg

SEQ ID NO: 34702 - RNA, 24 nt, Human
uggucaaagauaaaaacuaaguuu

SEQ ID NO: 34703 - RNA, 24 nt, Human
ugcccugguaucucaucuagaugg

SEQ ID NO: 34704 - RNA, 17 nt, Human
uacgugagaucugcucc

SEQ ID NO: 34705 - RNA, 24 nt, Human
uucguccugcaagggcaguggaug

SEQ ID NO: 34706 - RNA, 24 nt, Human
uguaggguuucucuccggagugga

SEQ ID NO: 34707 - RNA, 24 nt, Human
ugagaaguagcuucuggauguguu

SEQ ID NO: 34708 - RNA, 24 nt, Human
ugggcagacuuggugaccugucga

SEQ ID NO: 34709 - RNA, 24 nt, Human
uccaucuugguuuaauuagagaau

SEQ ID NO: 34710 - RNA, 24 nt, Human
uagaagcauuucuuuacugaaccu

SEQ ID NO: 34711 - RNA, 21 nt, Human
uucacugugaguuacugaugc

SEQ ID NO: 34712 - RNA, 24 nt, Human
cuuccaggcucacucagugguugu

SEQ ID NO: 34713 - RNA, 24 nt, Human
agugguucuuacuugauccaaaaa

SEQ ID NO: 34714 - RNA, 24 nt, Human
ccuggccaacauugugaaaccccg

SEQ ID NO: 34715 - RNA, 24 nt, Human
ugacaauacuugggaaccugaaga

SEQ ID NO: 34716 - RNA, 24 nt, Human
ugaaguguccucaaauuguaauug

SEQ ID NO: 34717 - RNA, 18 nt, Human
ugacagugaaucugauga

SEQ ID NO: 34718 - RNA, 24 nt, Human
auccugaaagaauaauuggugcca

SEQ ID NO: 34719 - RNA, 24 nt, Human
uuccuuggcauagaccagcgccag

SEQ ID NO: 34720 - RNA, 24 nt, Human
ccacagggucgcuggagccgccau

SEQ ID NO: 34721 - RNA, 20 nt, Human
caggaucugugccucaaccc

SEQ ID NO: 34722 - RNA, 20 nt, Human
uaccuugagggggggaagag

SEQ ID NO: 34723 - RNA, 24 nt, Human
uguagaacaaauguuugggguuac

SEQ ID NO: 34724 - RNA, 24 nt, Human
aggcagucacagaacaggggcaug

SEQ ID NO: 34725 - RNA, 24 nt, Human
aaccagaaaguaagguguucuacu

SEQ ID NO: 34726 - RNA, 24 nt, Human
aaggagcuggccguguuccgggag

SEQ ID NO: 34727 - RNA, 24 nt, Human
uggcaagcaucaccuuggccugga

SEQ ID NO: 34728 - RNA, 20 nt, Human
acagugggaauaauguuggc

SEQ ID NO: 34729 - RNA, 24 nt, Human
ucuaaaaucuucucacuuuuauaa

SEQ ID NO: 34730 - RNA, 24 nt, Human
ugcuuuguuuuuggcagucuuuau

SEQ ID NO: 34731 - RNA, 24 nt, Human
uugaaaggcaugugggcugcucau

SEQ ID NO: 34732 - RNA, 24 nt, Human
aaaauccucuaaaugauucugacu

SEQ ID NO: 34733 - RNA, 24 nt, Human
uucaccuuggcauucacacuuugu

SEQ ID NO: 34734 - RNA, 24 nt, Human
ucggugcaccugcuuuuuuucugc

SEQ ID NO: 34735 - RNA, 24 nt, Human
agaaggcccuggagaaguugcucc

SEQ ID NO: 34736 - RNA, 24 nt, Human
ugcccgaggagaagcugguugagg

SEQ ID NO: 34737 - RNA, 24 nt, Human
ugugaagggcuuccggaaugucau

SEQ ID NO: 34738 - RNA, 20 nt, Human
uguccagaauuuccagaagu

SEQ ID NO: 34739 - RNA, 24 nt, Human
ugagugcccccagggaggggcugg

SEQ ID NO: 34740 - RNA, 24 nt, Human
uguggcccuucucuuuaaguccga

SEQ ID NO: 34741 - RNA, 24 nt, Human
caucaagaaggcggggcuccggaa

SEQ ID NO: 34742 - RNA, 24 nt, Human
uacccuccacuaugaccgcuauac

SEQ ID NO: 34743 - RNA, 19 nt, Human
uaccgcacccagguucggc

SEQ ID NO: 34744 - RNA, 24 nt, Human
ugggauggguaugauguacagugg

SEQ ID NO: 34745 - RNA, 24 nt, Human
ucaggagccuccacuuuccccagu

SEQ ID NO: 34746 - RNA, 24 nt, Human
ugggggguguucugcuuggcacca

SEQ ID NO: 34747 - RNA, 24 nt, Human
uggaagagaaauggaagucggcuc

SEQ ID NO: 34748 - RNA, 24 nt, Human
ugccuaaagccacagguuuuauug

SEQ ID NO: 34749 - RNA, 22 nt, Human
uccgugcgcguugcugcggccg

SEQ ID NO: 34750 - RNA, 24 nt, Human
uugaucuugaagaaacugggcgug

SEQ ID NO: 34751 - RNA, 24 nt, Human
uauuagggauaauauucauuuagc

SEQ ID NO: 34752 - RNA, 24 nt, Human
uaaugggucucaaaauucugugac

SEQ ID NO: 34753 - RNA, 24 nt, Human
agaaagccgguccugggcugaaga

SEQ ID NO: 34754 - RNA, 24 nt, Human
uacacaucaauuugaguuguucag

SEQ ID NO: 34755 - RNA, 24 nt, Human
acaggauuuuuuuaaagagcaaga

SEQ ID NO: 34756 - RNA, 24 nt, Human
ucagucccacuccaggcuucaccc

SEQ ID NO: 34757 - RNA, 24 nt, Human
aagagcucauguugugccaccacc

SEQ ID NO: 34758 - RNA, 24 nt, Human
uacauugacguuauaaaggucuca

SEQ ID NO: 34759 - RNA, 24 nt, Human
aggcaucgcugugugaggacggca

SEQ ID NO: 34760 - RNA, 24 nt, Human
cagggcccugugguuggacuucac

SEQ ID NO: 34761 - RNA, 22 nt, Human
uagaagacaauggauuaccauc

SEQ ID NO: 34762 - RNA, 24 nt, Human
caccugcaguacuguggaguuuua

SEQ ID NO: 34763 - RNA, 23 nt, Human
uucacaggauggcaaguccccgu

SEQ ID NO: 34764 - RNA, 24 nt, Human
gacacguagauucgggcaagucca

SEQ ID NO: 34765 - RNA, 24 nt, Human
uggcauugagacuguauugacccu

SEQ ID NO: 34766 - RNA, 24 nt, Human
uaaugaacaaagguuauuuuuaaa

SEQ ID NO: 34767 - RNA, 24 nt, Human
ucugcaaaaccaauaaauacaaga

SEQ ID NO: 34768 - RNA, 24 nt, Human
uccaagauaucugaaaaaggaaac

SEQ ID NO: 34769 - RNA, 24 nt, Human
ugugacucaucugugggagggcag

SEQ ID NO: 34770 - RNA, 23 nt, Human
uuauaauggccauguuaauaagu

SEQ ID NO: 34771 - RNA, 24 nt, Human
uuccuuggaccacgaccagcuauc

SEQ ID NO: 34772 - RNA, 24 nt, Human
cucugcauucggcugugagugcca

SEQ ID NO: 34773 - RNA, 24 nt, Human
cauggugugcgccuuccugccaca

SEQ ID NO: 34774 - RNA, 24 nt, Human
ugugcagcgcgcggcccgggcagc

SEQ ID NO: 34775 - RNA, 24 nt, Human
uauagggcaagcgugcaggccauc

SEQ ID NO: 34776 - RNA, 24 nt, Human
ugguaugcuaaggagucaguacuu

SEQ ID NO: 34777 - RNA, 24 nt, Human
gugaagcuacucaauacgcgccac

SEQ ID NO: 34778 - RNA, 24 nt, Human
ugaccagggccugcugugugaccu

SEQ ID NO: 34779 - RNA, 24 nt, Human
caccaggugguagaagacgguacg

SEQ ID NO: 34780 - RNA, 24 nt, Human
aggcggcccuugucguuggugaug

SEQ ID NO: 34781 - RNA, 24 nt, Human
ccagaaccuucuucuuguccgacu

SEQ ID NO: 34782 - RNA, 24 nt, Human
ucgaaggucacucgaucuggggca

SEQ ID NO: 34783 - RNA, 24 nt, Human
ucgcugaucuugcccuugagcccc

SEQ ID NO: 34784 - RNA, 24 nt, Human
uaaaaaguuguggcaaagauggcu

SEQ ID NO: 34785 - RNA, 24 nt, Human
uuguccugugcuggggcugacaga

SEQ ID NO: 34786 - RNA, 20 nt, Human
uuugcagaauccuggagcag

SEQ ID NO: 34787 - RNA, 24 nt, Human
uuuguaguugaaaacauuucacca

SEQ ID NO: 34788 - RNA, 19 nt, Human
ugccauacuuauucagaaa

SEQ ID NO: 34789 - RNA, 19 nt, Human
uuggucgacuuuguuagaa

SEQ ID NO: 34790 - RNA, 24 nt, Human
aaggacacaaaaggaagcugugug

SEQ ID NO: 34791 - RNA, 20 nt, Human
uaccuuguccacuguggcau

SEQ ID NO: 34792 - RNA, 24 nt, Human
ugagaaccuuaguauacugauuga

SEQ ID NO: 34793 - RNA, 24 nt, Human
ugaccagacuuuuccagaagugcc

SEQ ID NO: 34794 - RNA, 17 nt, Human
uaacauggaugggcuga

SEQ ID NO: 34795 - RNA, 22 nt, Human
uuccaaagaaagguacugugga

SEQ ID NO: 34796 - RNA, 24 nt, Human
uuuguaggagcucuuuauauauug

SEQ ID NO: 34797 - RNA, 24 nt, Human
cagcauagccugauaggccucugg

SEQ ID NO: 34798 - RNA, 24 nt, Human
uggcauagcucagcacccaggaaa

SEQ ID NO: 34799 - RNA, 24 nt, Human
ccaccgagguaccuguguccuggg

SEQ ID NO: 34800 - RNA, 24 nt, Human
gcccgagugcacgugucugaggag

SEQ ID NO: 34801 - RNA, 24 nt, Human
ugcgagucagagcacucacgcccg

SEQ ID NO: 34802 - RNA, 24 nt, Human
uucaucgucaccuccagcuaguca

SEQ ID NO: 34803 - RNA, 24 nt, Human
ugggaaauaauucaguuugagagc

SEQ ID NO: 34804 - RNA, 24 nt, Human
acaacuuauccaaaugaauguguu

SEQ ID NO: 34805 - RNA, 24 nt, Human
aagaaccugacuuauuucaugcca

SEQ ID NO: 34806 - RNA, 24 nt, Human
aagcguuuugagcagaaaggauuc

SEQ ID NO: 34807 - RNA, 18 nt, Human
ugcguaauaacggggccc

SEQ ID NO: 34808 - RNA, 24 nt, Human
uacaggacaagggcagccccaccc

SEQ ID NO: 34809 - RNA, 24 nt, Human
uccccagcaaccaggccuggccuc

SEQ ID NO: 34810 - RNA, 24 nt, Human
ugagucuggagcagagaggggaga

SEQ ID NO: 34811 - RNA, 24 nt, Human
gugaggcagaacgcugccauccgu

SEQ ID NO: 34812 - RNA, 24 nt, Human
caugccaggcgccuuugugcauga

SEQ ID NO: 34813 - RNA, 24 nt, Human
caccuguaaucccagcuacuccga

SEQ ID NO: 34814 - RNA, 24 nt, Human
cuguacuuuuacacuccuuugucu

SEQ ID NO: 34815 - RNA, 21 nt, Human
uaccguggugacgugguuccc

SEQ ID NO: 34816 - RNA, 24 nt, Human
uggauuggugccccacuggcuuca

SEQ ID NO: 34817 - RNA, 24 nt, Human
uaccacagcuguugccgaggccug

SEQ ID NO: 34818 - RNA, 24 nt, Human
aaaaacuaaaaacaaaugucaacu

SEQ ID NO: 34819 - RNA, 24 nt, Human
agaauacuauagagcaaguaaacc

SEQ ID NO: 34820 - RNA, 24 nt, Human
ugagauacuuuuuuaugugugcuu

SEQ ID NO: 34821 - RNA, 24 nt, Human
uucauuguagauucuggauauuag

SEQ ID NO: 34822 - RNA, 24 nt, Human
uuguagguugccuguucacucaga

SEQ ID NO: 34823 - RNA, 24 nt, Human
ugggacagguaucgguuugucacc

SEQ ID NO: 34824 - RNA, 24 nt, Human
gagcagcagcagggugggcgagca

SEQ ID NO: 34825 - RNA, 24 nt, Human
auugauggucagccaggugccuuc

SEQ ID NO: 34826 - RNA, 23 nt, Human
gaugacacuuaagaccuacuugu

SEQ ID NO: 34827 - RNA, 24 nt, Human
uguagaacucagccuucuuggaaa

SEQ ID NO: 34828 - RNA, 21 nt, Human
uaucucaagcccagaaagaug

SEQ ID NO: 34829 - RNA, 19 nt, Human
uggcugcgcugugcccucg

SEQ ID NO: 34830 - RNA, 24 nt, Human
uauaagaaccugaucuccaagugu

SEQ ID NO: 34831 - RNA, 24 nt, Human
uagaccagccacagugccugauug

SEQ ID NO: 34832 - RNA, 24 nt, Human
uagcuuccugucucaggcuuucua

SEQ ID NO: 34833 - RNA, 24 nt, Human
aagcagcaggaacagaguugcuuu

SEQ ID NO: 34834 - RNA, 24 nt, Human
auccuguuuugaaauuccauucac

SEQ ID NO: 34835 - RNA, 24 nt, Human
ugccucugcagccuaauaauuuuu

SEQ ID NO: 34836 - RNA, 24 nt, Human
uacccuugaacuucugggcucagg

SEQ ID NO: 34837 - RNA, 24 nt, Human
ugguggucuugagcuuuuggccug

SEQ ID NO: 34838 - RNA, 24 nt, Human
gcagugggccuuggcucaagauca

SEQ ID NO: 34839 - RNA, 24 nt, Human
ucuuugauuucucuucaguagcac

SEQ ID NO: 34840 - RNA, 24 nt, Human
uaucugagucacuagaugaggagg

SEQ ID NO: 34841 - RNA, 24 nt, Human
ugaccagagauuacuuguccaaaa

SEQ ID NO: 34842 - RNA, 24 nt, Human
uaguggguggcauucucugagccu

SEQ ID NO: 34843 - RNA, 24 nt, Human
cguugcugugauagaacuuguggc

SEQ ID NO: 34844 - RNA, 24 nt, Human
uuggggcuucaacaugggaauuua

SEQ ID NO: 34845 - RNA, 24 nt, Human
cuucuccucuuggcuuguaggugg

SEQ ID NO: 34846 - RNA, 24 nt, Human
uaccccauaaauauguagagagca

SEQ ID NO: 34847 - RNA, 24 nt, Human
uugaagccacgcccucuuucccac

SEQ ID NO: 34848 - RNA, 24 nt, Human
uaucaaggaagggcaggcgugaug

SEQ ID NO: 34849 - RNA, 24 nt, Human
uucaaauuucuuucuuuuuuaauu

SEQ ID NO: 34850 - RNA, 24 nt, Human
uugaagccaguaauuagagacauc

SEQ ID NO: 34851 - RNA, 24 nt, Human
uguaauauuguuaagaaagaaagg

SEQ ID NO: 34852 - RNA, 24 nt, Human
ucuuguagcccacgaggaugaugg

SEQ ID NO: 34853 - RNA, 24 nt, Human
gugcacugccgcugaugucucaau

SEQ ID NO: 34854 - RNA, 24 nt, Human
uccagcuguucuuuccccuuagca

SEQ ID NO: 34855 - RNA, 24 nt, Human
uggaaaggaaacucugaagcgccg

SEQ ID NO: 34856 - RNA, 23 nt, Human
ccgccgcgcccccgccgccgccc

SEQ ID NO: 34857 - RNA, 24 nt, Human
ucugccacaaugcugauaacccag

SEQ ID NO: 34858 - RNA, 24 nt, Human
ugaggugagaccagcccuggcagg

SEQ ID NO: 34859 - RNA, 24 nt, Human
uuuugcuuacaaaguauauuuaag

SEQ ID NO: 34860 - RNA, 24 nt, Human
uagcgugggauagauugguuucuu

SEQ ID NO: 34861 - RNA, 24 nt, Human
ugguauacuacugcuuugcggaau

SEQ ID NO: 34862 - RNA, 24 nt, Human
uugaucuugaagaaacugggcgug

SEQ ID NO: 34863 - RNA, 24 nt, Human
aggaaggagauauagugaagagga

SEQ ID NO: 34864 - RNA, 24 nt, Human
guagaguuuucuucaggcuuaaag

SEQ ID NO: 34865 - RNA, 24 nt, Human
accugguggugaggcucuccauga

SEQ ID NO: 34866 - RNA, 24 nt, Human
gaacuucggauuuuuucuaacugg

SEQ ID NO: 34867 - RNA, 24 nt, Human
uaccugucuguaucgguucagagu

SEQ ID NO: 34868 - RNA, 24 nt, Human
uccuaggccuauuaauauuccgga

SEQ ID NO: 34869 - RNA, 24 nt, Human
uacgcguaucgauggcgccagcug

SEQ ID NO: 34870 - RNA, 24 nt, Human
aggcauagugagucaucauuacau

SEQ ID NO: 34871 - RNA, 24 nt, Human
uuaguaauauguucccuuaaaauu

SEQ ID NO: 34872 - RNA, 24 nt, Human
ugaaaagcgaagagaagaucaaag

SEQ ID NO: 34873 - RNA, 24 nt, Human
cagcagcuggacgcugagcugagg

SEQ ID NO: 34874 - RNA, 24 nt, Human
uuuuauucuugguaguuuuuggga

SEQ ID NO: 34875 - RNA, 24 nt, Human
ugcuuagaguaucagaaauaucuc

SEQ ID NO: 34876 - RNA, 24 nt, Human
uaccggaguccccacuggggcagc

SEQ ID NO: 34877 - RNA, 23 nt, Human
uccaccuuccucaggaaaaacca

SEQ ID NO: 34878 - RNA, 24 nt, Human
ugguagguggucugcuggguggcu

SEQ ID NO: 34879 - RNA, 21 nt, Human
gucaauauccauaaaugaagg

SEQ ID NO: 34880 - RNA, 24 nt, Human
uaaaugguaaacgugauaucauga

SEQ ID NO: 34881 - RNA, 24 nt, Human
ucauggacuaaacuaggucagagu

SEQ ID NO: 34882 - RNA, 24 nt, Human
ugacgaggggaagagaugagaaga

SEQ ID NO: 34883 - RNA, 24 nt, Human
aacauuuugugcagaaggcugaag

SEQ ID NO: 34884 - RNA, 24 nt, Human
ugauuuuagaucuauucaagagag

SEQ ID NO: 34885 - RNA, 24 nt, Human
uaagacgugcucaaucuguguucc

SEQ ID NO: 34886 - RNA, 24 nt, Human
uugaucuugaagaaacugggcgug

SEQ ID NO: 34887 - RNA, 24 nt, Human
aggaaggagauauagugaagagga

SEQ ID NO: 34888 - RNA, 24 nt, Human
guagaguuuucuucaggcuuaaag

SEQ ID NO: 34889 - RNA, 23 nt, Human
uggcagugcugauccucagaaac

SEQ ID NO: 34890 - RNA, 17 nt, Human
ucaguguccacagcgca

SEQ ID NO: 34891 - RNA, 17 nt, Human
ucgcugccccucgaggc

SEQ ID NO: 34892 - RNA, 22 nt, Human
ugugcaguuccucuccaauugc

SEQ ID NO: 34893 - RNA, 24 nt, Human
ugaggacaaguggagccacaaggg

SEQ ID NO: 34894 - RNA, 24 nt, Human
gucagggucaucaugauguacaaa

SEQ ID NO: 34895 - RNA, 24 nt, Human
uauacuuuggaggaucacagauug

SEQ ID NO: 34896 - RNA, 24 nt, Human
ucccuugcaguuguucgccccucu

SEQ ID NO: 34897 - RNA, 24 nt, Human
uuuuucguaagaagauuucgcucg

SEQ ID NO: 34898 - RNA, 24 nt, Human
ucuaucccauggagacugugaugu

SEQ ID NO: 34899 - RNA, 24 nt, Human
uugguugugauauguuaaccugca

SEQ ID NO: 34900 - RNA, 24 nt, Human
uggcauggccgaacaggcgcgucg

SEQ ID NO: 34901 - RNA, 24 nt, Human
uaggaucaugaugguaaggcaaau

SEQ ID NO: 34902 - RNA, 24 nt, Human
acgcagccugcugaggucgacuug

SEQ ID NO: 34903 - RNA, 24 nt, Human
aggcaggcagaucacaaggucagg

SEQ ID NO: 34904 - RNA, 24 nt, Human
ugagaguuacagacuagcaagucu

SEQ ID NO: 34905 - RNA, 24 nt, Human
uguauacaugaagcuuagauuaau

SEQ ID NO: 34906 - RNA, 24 nt, Human
uuagcuagguuaaaaacacauaau

SEQ ID NO: 34907 - RNA, 24 nt, Human
uaauggaagaacagaguauuuuaa

SEQ ID NO: 34908 - RNA, 24 nt, Human
ggccgugguggugaagcuguagcc

SEQ ID NO: 34909 - RNA, 24 nt, Human
ggaguccaucacgaugccaguggu

SEQ ID NO: 34910 - RNA, 24 nt, Human
uggcuagugagucuuccacaaaag

SEQ ID NO: 34911 - RNA, 24 nt, Human
aucaagacaugaauagcuaagguu

SEQ ID NO: 34912 - RNA, 17 nt, Human
ucaguguccacagcgca

SEQ ID NO: 34913 - RNA, 24 nt, Human
uauuuaguccaauaacauugaguu

SEQ ID NO: 34914 - RNA, 22 nt, Human
uuacuccuuaauaugugccaaa

SEQ ID NO: 34915 - RNA, 24 nt, Human
ugaggcagacgccugaacagggac

SEQ ID NO: 34916 - RNA, 20 nt, Human
aagcugcagcaguaaggaac

SEQ ID NO: 34917 - RNA, 24 nt, Human
uacaguagaaauggaaaacuacag

SEQ ID NO: 34918 - RNA, 24 nt, Human
uugaaagguauauuaaaauuaagg

SEQ ID NO: 34919 - RNA, 24 nt, Human
ucuacagucugugaauauaccaau

SEQ ID NO: 34920 - RNA, 24 nt, Human
cuggaaggcauacccuacaauuua

SEQ ID NO: 34921 - RNA, 24 nt, Human
uugaucuuuucuuucuucagcagu

SEQ ID NO: 34922 - RNA, 24 nt, Human
uccacagcuguuuucuuauuugga

SEQ ID NO: 34923 - RNA, 24 nt, Human
gaagguggaguaaaauuccuggca

SEQ ID NO: 34924 - RNA, 24 nt, Human
ugagggaaaccauagugaaccuca

SEQ ID NO: 34925 - RNA, 24 nt, Human
ugggagggggcagcugggcugagc

SEQ ID NO: 34926 - RNA, 19 nt, Human
uaccgcuuugagacagucc

SEQ ID NO: 34927 - RNA, 24 nt, Human
uccccgauggcccacugcgugacc

SEQ ID NO: 34928 - RNA, 24 nt, Human
ugaaagaaccuggaggcuauuaaa

SEQ ID NO: 34929 - RNA, 24 nt, Human
ccucauggccccaguccacaauug

SEQ ID NO: 34930 - RNA, 22 nt, Human
ugggaagggccaaagaggagua

SEQ ID NO: 34931 - RNA, 24 nt, Human
agccugcggagacagggcggccgg

SEQ ID NO: 34932 - RNA, 24 nt, Human
cccgcgagggggcgagcccggggg

SEQ ID NO: 34933 - RNA, 24 nt, Human
aagucgguuucuucuuaaucuccu

SEQ ID NO: 34934 - RNA, 24 nt, Human
uaaagaucaguaugacugcguaag

SEQ ID NO: 34935 - RNA, 24 nt, Human
aggcauauuccucccuuuccaaag

SEQ ID NO: 34936 - RNA, 24 nt, Human
guuugcgugacgguuccacaucac

SEQ ID NO: 34937 - RNA, 24 nt, Human
uugcucaggcuugagugcacuggc

SEQ ID NO: 34938 - RNA, 24 nt, Human
uucacuagguaaguaugcaaauuc

SEQ ID NO: 34939 - RNA, 23 nt, Human
caguacuguaacaagccauuugu

SEQ ID NO: 34940 - RNA, 24 nt, Human
uguagagacggggccuugccaugu

SEQ ID NO: 34941 - RNA, 24 nt, Human
ugaggacagacacucagggaauuu

SEQ ID NO: 34942 - RNA, 24 nt, Human
ugucauaggcggccuucuucaguu

SEQ ID NO: 34943 - RNA, 24 nt, Human
gcugcuccucaaucugcugcuuag

SEQ ID NO: 34944 - RNA, 24 nt, Human
ccuccagcuccuucucccgccggg

SEQ ID NO: 34945 - RNA, 24 nt, Human
uagcagcuauuauguauuuuucca

SEQ ID NO: 34946 - RNA, 24 nt, Human
uacuucauuuccagugaugggcug

SEQ ID NO: 34947 - RNA, 24 nt, Human
uaaugggucucaaaauuuugugac

SEQ ID NO: 34948 - RNA, 24 nt, Human
uauuagggauaauauucauuuagc

SEQ ID NO: 34949 - RNA, 24 nt, Human
augcauuuuuaauuuggaaaaaac

SEQ ID NO: 34950 - RNA, 21 nt, Human
uguuacagaggagcagaauca

SEQ ID NO: 34951 - RNA, 24 nt, Human
acuggauugacaguauccuggccu

SEQ ID NO: 34952 - RNA, 24 nt, Human
uucaugcauuucaucauuucucaa

SEQ ID NO: 34953 - RNA, 23 nt, Human
uucugugcccuuuaugauguguc

SEQ ID NO: 34954 - RNA, 24 nt, Human
uauuagggauaauauucauuuagc

SEQ ID NO: 34955 - RNA, 24 nt, Human
ggaucugucuagcuuuuggccacu

SEQ ID NO: 34956 - RNA, 24 nt, Human
uuaucugcuguuccgacuugguuu

SEQ ID NO: 34957 - RNA, 24 nt, Human
ucagcauguccagccuggggucug

SEQ ID NO: 34958 - RNA, 24 nt, Human
uauggcaagucacuuugacagaca

SEQ ID NO: 34959 - RNA, 24 nt, Human
ugagaauggcaaaauuagucgccu

SEQ ID NO: 34960 - RNA, 24 nt, Human
uacaccacucccaagaagaauaag

SEQ ID NO: 34961 - RNA, 24 nt, Human
gaagauggaggagaggcggcccaa

SEQ ID NO: 34962 - RNA, 24 nt, Human
uggggcucaacaaauggaaugugu

SEQ ID NO: 34963 - RNA, 24 nt, Human
uaccaggccggggccguguuggca

SEQ ID NO: 34964 - RNA, 24 nt, Human
cagcagugggcaccacugguccgc

SEQ ID NO: 34965 - RNA, 24 nt, Human
uaaugggucucaaaauucugugac

SEQ ID NO: 34966 - RNA, 24 nt, Human
ugcauuguuaucauuaaccagucu

SEQ ID NO: 34967 - RNA, 18 nt, Human
cauggcaacgucaccguu

SEQ ID NO: 34968 - RNA, 24 nt, Human
uguagagacgugcucgcgagucag

SEQ ID NO: 34969 - RNA, 24 nt, Human
ucacaaacuuccauuuguuuuucu

SEQ ID NO: 34970 - RNA, 24 nt, Human
uggccucgucugauccuacguucu

SEQ ID NO: 34971 - RNA, 24 nt, Human
uuguuuuuucuuuuggaccaguuc

SEQ ID NO: 34972 - RNA, 20 nt, Human
augauggugucacgugccuu

SEQ ID NO: 34973 - RNA, 24 nt, Human
aaaggagcugggagguccugauua

SEQ ID NO: 34974 - RNA, 23 nt, Human
ugaguaggcaaacuccaggccug

SEQ ID NO: 34975 - RNA, 24 nt, Human
ucugcaccagauggacaguggugc

SEQ ID NO: 34976 - RNA, 24 nt, Human
uguaagcgcuccaucuccaggacu

SEQ ID NO: 34977 - RNA, 24 nt, Human
gggcagugcagccagcccccgggc

SEQ ID NO: 34978 - RNA, 19 nt, Human
cagcaccuggaagcgcccc

SEQ ID NO: 34979 - RNA, 24 nt, Human
uauaaaacuuugauaguuacauug

SEQ ID NO: 34980 - RNA, 22 nt, Human
uagcaugccucuuaauuuuucu

SEQ ID NO: 34981 - RNA, 24 nt, Human
aacagguaaccacuugagaggaug

SEQ ID NO: 34982 - RNA, 24 nt, Human
ucccggaguggccgugaaacggug

SEQ ID NO: 34983 - RNA, 24 nt, Human
uauaugcacuuauugguauuggaa

SEQ ID NO: 34984 - RNA, 24 nt, Human
cgugcagucaggugggcgggugug

SEQ ID NO: 34985 - RNA, 24 nt, Human
uaugagaagcuggacuuccuuggg

SEQ ID NO: 34986 - RNA, 24 nt, Human
ucuaauauuagccuugucuuugau

SEQ ID NO: 34987 - RNA, 20 nt, Human
ugagagaacacuccacgaug

SEQ ID NO: 34988 - RNA, 24 nt, Human
aaagcaaaugaggcagaaaggccc

SEQ ID NO: 34989 - RNA, 24 nt, Human
uuucacggucgcagccaucuugcu

SEQ ID NO: 34990 - RNA, 24 nt, Human
uaacuguaaccgaaaguuuuuuca

SEQ ID NO: 34991 - RNA, 24 nt, Human
caggagcaaccacuggcccuaccg

SEQ ID NO: 34992 - RNA, 24 nt, Human
ugcgggcgccgggcugaagcuccg

SEQ ID NO: 34993 - RNA, 24 nt, Human
uuugcucacucgcaucagugggca

SEQ ID NO: 34994 - RNA, 24 nt, Human
ucaaagaccguaaagagaucccuc

SEQ ID NO: 34995 - RNA, 24 nt, Human
gagcagcgauggagaaauuaaaua

SEQ ID NO: 34996 - RNA, 24 nt, Human
gaagauugaggacuacuuuccaga

SEQ ID NO: 34997 - RNA, 24 nt, Human
uaaguccugauggaggcuuucuga

SEQ ID NO: 34998 - RNA, 24 nt, Human
gagcugccaaagccauccugccac

SEQ ID NO: 34999 - RNA, 24 nt, Human
uggaagaagauauccccauagcga

SEQ ID NO: 35000 - RNA, 17 nt, Human
ucaguguccacagcgca

SEQ ID NO: 35001 - RNA, 24 nt, Human
cagaagaacagcacccuccaccac

SEQ ID NO: 35002 - RNA, 24 nt, Human
ucaaugucauucuaccccucgcua

SEQ ID NO: 35003 - RNA, 22 nt, Human
cugcuccugccugcuucgauca

SEQ ID NO: 35004 - RNA, 24 nt, Human
uuagaaaaugcuuguuuccuccua

SEQ ID NO: 35005 - RNA, 24 nt, Human
ucgaccgggccgucgauggccaug

SEQ ID NO: 35006 - RNA, 24 nt, Human
uggaagacuuuuuuuucuuauuuu

SEQ ID NO: 35007 - RNA, 24 nt, Human
caugacaccaacagaagggaucaa

SEQ ID NO: 35008 - RNA, 24 nt, Human
ucuagacuauuuaaccaaagguau

SEQ ID NO: 35009 - RNA, 24 nt, Human
uuacaccugugccccacgacgggu

SEQ ID NO: 35010 - RNA, 24 nt, Human
ucaaugccacacaugagcccucag

SEQ ID NO: 35011 - RNA, 24 nt, Human
uaagaaauguguacuuggaacaag

SEQ ID NO: 35012 - RNA, 24 nt, Human
uagcagcucguuguauuuccuggu

SEQ ID NO: 35013 - RNA, 24 nt, Human
ggagguguugagcaucuuccacug

SEQ ID NO: 35014 - RNA, 24 nt, Human
uggaacuguguuugggagccucau

SEQ ID NO: 35015 - RNA, 24 nt, Human
caagggacaucgacacagcagcca

SEQ ID NO: 35016 - RNA, 24 nt, Human
uguggacagagccacuuggugcug

SEQ ID NO: 35017 - RNA, 24 nt, Human
ugugaccaauccuguuuuuccuau

SEQ ID NO: 35018 - RNA, 24 nt, Human
ugguauacuacugcuuugcggaau

SEQ ID NO: 35019 - RNA, 24 nt, Human
uauuuaaggauuauucugcugaag

SEQ ID NO: 35020 - RNA, 24 nt, Human
ugcccugugguguuuggcaugugc

SEQ ID NO: 35021 - RNA, 24 nt, Human
ucaguguuuuguacuucacugaau

SEQ ID NO: 35022 - RNA, 24 nt, Human
aucagauucaaaagggaauuuagu

SEQ ID NO: 35023 - RNA, 24 nt, Human
ugagaacuggcuccggggaaagaa

SEQ ID NO: 35024 - RNA, 24 nt, Human
ucccggcaccaaggccgcaggcgg

SEQ ID NO: 35025 - RNA, 24 nt, Human
uguaacagcacacugcauuccggg

SEQ ID NO: 35026 - RNA, 24 nt, Human
cacagcaagcccaggcucuaccag

SEQ ID NO: 35027 - RNA, 24 nt, Human
gagaagcagaaggaggucugggag

SEQ ID NO: 35028 - RNA, 24 nt, Human
uggcucacgccuguaaucccagca

SEQ ID NO: 35029 - RNA, 24 nt, Human
uuaaacccguauaaacuguuaagg

SEQ ID NO: 35030 - RNA, 24 nt, Human
uaguacuggcaggacauggggaug

SEQ ID NO: 35031 - RNA, 24 nt, Human
uuggugaugaugcagcacccuggg

SEQ ID NO: 35032 - RNA, 20 nt, Human
uuuggcauuuuuuggaccau

SEQ ID NO: 35033 - RNA, 24 nt, Human
ugaccuuggaugcuguaaagugau

SEQ ID NO: 35034 - RNA, 24 nt, Human
uauguaauauuuggguugaucuau

SEQ ID NO: 35035 - RNA, 24 nt, Human
ucaugaguucucauauuuuccaua

SEQ ID NO: 35036 - RNA, 24 nt, Human
ucuguuaucuccuuuugcgcgaca

SEQ ID NO: 35037 - RNA, 24 nt, Human
uaaaggaagaauuaaaccgcuguu

SEQ ID NO: 35038 - RNA, 24 nt, Human
ccugaaauucuuaaaggaugggag

SEQ ID NO: 35039 - RNA, 24 nt, Human
cuugaccccgcugccucagccucc

SEQ ID NO: 35040 - RNA, 24 nt, Human
ugcaagaaaaugaggaaucugaga

SEQ ID NO: 35041 - RNA, 24 nt, Human
uggcagggccauguggugguggua

SEQ ID NO: 35042 - RNA, 24 nt, Human
ggacagguguacagacauguucuu

SEQ ID NO: 35043 - RNA, 24 nt, Human
cagcaggacccucuuuuuguuuug

SEQ ID NO: 35044 - RNA, 24 nt, Human
ucgaauggacacauuaccagugaa

SEQ ID NO: 35045 - RNA, 24 nt, Human
uccaugagaauuuggaaugacagu

SEQ ID NO: 35046 - RNA, 20 nt, Human
ugaaagaagggagaagagua

SEQ ID NO: 35047 - RNA, 23 nt, Human
uacuguguuuucacucaaaccac

SEQ ID NO: 35048 - RNA, 24 nt, Human
uaacauguacuaaauauuacaguu

SEQ ID NO: 35049 - RNA, 24 nt, Human
agccaguguuauuugaaguaugua

SEQ ID NO: 35050 - RNA, 24 nt, Human
cuugcucauagucuucagcaagga

SEQ ID NO: 35051 - RNA, 24 nt, Human
ccggcgcgaagaggcuggacucgg

SEQ ID NO: 35052 - RNA, 24 nt, Human
caugacauuaggaacuuagcauuu

SEQ ID NO: 35053 - RNA, 24 nt, Human
ugggagcagcagccaaguccgcgg

SEQ ID NO: 35054 - RNA, 18 nt, Human
uggcguagcuucacuucu

SEQ ID NO: 35055 - RNA, 24 nt, Human
acugguuucuucacucugaagcag

SEQ ID NO: 35056 - RNA, 24 nt, Human
uucaaguaugucuguuguaaccaa

SEQ ID NO: 35057 - RNA, 17 nt, Human
uaauguguguguauauc

SEQ ID NO: 35058 - RNA, 24 nt, Human
uacaguuuauugucuaauacuagc

SEQ ID NO: 35059 - RNA, 24 nt, Human
uuuguccccugacagagauuccau

SEQ ID NO: 35060 - RNA, 24 nt, Human
uuggaagccacagaaaugcagaau

SEQ ID NO: 35061 - RNA, 24 nt, Human
ugccuggaaguuuaggucaaagag

SEQ ID NO: 35062 - RNA, 24 nt, Human
uagauacuuucaaaauuucuguua

SEQ ID NO: 35063 - RNA, 24 nt, Human
ucauugcugucauguucucuagcg

SEQ ID NO: 35064 - RNA, 24 nt, Human
uaauucuuuuaauuugguuaucug

SEQ ID NO: 35065 - RNA, 24 nt, Human
uauggcaagucacuuugacagaca

SEQ ID NO: 35066 - RNA, 24 nt, Human
aggcaaacaaauuucgaagagguu

SEQ ID NO: 35067 - RNA, 24 nt, Human
uacguggcccuccugcgagucacu

SEQ ID NO: 35068 - RNA, 24 nt, Human
acauaugaaugcacgauaugaaga

SEQ ID NO: 35069 - RNA, 24 nt, Human
uaagagcagacacaaccugagaug

SEQ ID NO: 35070 - RNA, 24 nt, Human
uagaagccuuugaccaagcauguc

SEQ ID NO: 35071 - RNA, 24 nt, Human
ucucugcagcuggacucuugacgu

SEQ ID NO: 35072 - RNA, 24 nt, Human
accgacuagcaccgcggccagucu

SEQ ID NO: 35073 - RNA, 24 nt, Human
gaggacucccaacccuggcuuggu

SEQ ID NO: 35074 - RNA, 24 nt, Human
uggaggccccuggagccagauggc

SEQ ID NO: 35075 - RNA, 24 nt, Human
ccagagccuggcugcccaucaugu

SEQ ID NO: 35076 - RNA, 20 nt, Human
uuagucaggcaauaaaaugc

SEQ ID NO: 35077 - RNA, 24 nt, Human
uagcugaaaagaacgcuagaccaa

SEQ ID NO: 35078 - RNA, 24 nt, Human
uauuacaauucacuggccgucguu

SEQ ID NO: 35079 - RNA, 24 nt, Human
augaccuucaggccauucagaaag

SEQ ID NO: 35080 - RNA, 24 nt, Human
uucauaagggcuuugccuucguuc

SEQ ID NO: 35081 - RNA, 24 nt, Human
ugagagugugggggaagagccuug

SEQ ID NO: 35082 - RNA, 24 nt, Human
uauggcaacaggccauucugggcc

SEQ ID NO: 35083 - RNA, 24 nt, Human
caccuggaacauugggaauuguuu

SEQ ID NO: 35084 - RNA, 24 nt, Human
acuguuuuuauuuaguuugauaug

SEQ ID NO: 35085 - RNA, 24 nt, Human
ccguucacccaacauuugcuuuug

SEQ ID NO: 35086 - RNA, 24 nt, Human
uugcauuguaacuuguggugugca

SEQ ID NO: 35087 - RNA, 24 nt, Human
ugugauguugaguuucucacuuac

SEQ ID NO: 35088 - RNA, 24 nt, Human
uauggcaagucacuuugacagaca

SEQ ID NO: 35089 - RNA, 24 nt, Human
ugaggugggaggacugcuuaaggc

SEQ ID NO: 35090 - RNA, 24 nt, Human
ugagaaacuugaucuaauauuuaa

SEQ ID NO: 35091 - RNA, 24 nt, Human
cgagaccauccuggccaacauagu

SEQ ID NO: 35092 - RNA, 24 nt, Human
ucuguguuuucauucguuuguacc

SEQ ID NO: 35093 - RNA, 24 nt, Human
uuugugagcuucgguguauuugcc

SEQ ID NO: 35094 - RNA, 24 nt, Human
uggcuggaguagcaaggaucuuca

SEQ ID NO: 35095 - RNA, 24 nt, Human
uauuguauugaugaugguuauucu

SEQ ID NO: 35096 - RNA, 24 nt, Human
ucagcagccucaggccuggaugca

SEQ ID NO: 35097 - RNA, 24 nt, Human
uaacucaugcauaccaaacauagc

SEQ ID NO: 35098 - RNA, 24 nt, Human
ugcaugaagggcaucccaucuugc

SEQ ID NO: 35099 - RNA, 24 nt, Human
ugacgccaaugaugacugcuagga

SEQ ID NO: 35100 - RNA, 24 nt, Human
ugaccugaaauuuuuaguauuuac

SEQ ID NO: 35101 - RNA, 19 nt, Human
uagaauauaaaagauauua

SEQ ID NO: 35102 - RNA, 24 nt, Human
ucacugcguucaauuuugaguuuc

SEQ ID NO: 35103 - RNA, 24 nt, Human
uaagcaggcagaguggaugaacgu

SEQ ID NO: 35104 - RNA, 24 nt, Human
caaugcaugaagggguuggugccg

SEQ ID NO: 35105 - RNA, 24 nt, Human
ugacugcacaggacucuggguucc

SEQ ID NO: 35106 - RNA, 24 nt, Human
gggcagugggguccgcaucguggu

SEQ ID NO: 35107 - RNA, 24 nt, Human
ucauugaggccauccgaagagcca

SEQ ID NO: 35108 - RNA, 18 nt, Human
uggcagaaccacuaagcu

SEQ ID NO: 35109 - RNA, 20 nt, Human
ugguauagugaaugaaugaa

SEQ ID NO: 35110 - RNA, 24 nt, Human
aggcaggagaaucgcuuaaacccg

SEQ ID NO: 35111 - RNA, 24 nt, Human
auugcacugcagccugggcaauaa

SEQ ID NO: 35112 - RNA, 24 nt, Human
gcccucuuucuccugggaucuugc

SEQ ID NO: 35113 - RNA, 24 nt, Human
uaagguauccgcuucaaggccucc

SEQ ID NO: 35114 - RNA, 24 nt, Human
uaguaguaucucauuuugguuuua

SEQ ID NO: 35115 - RNA, 24 nt, Human
uggcagauugauaccugccugguc

SEQ ID NO: 35116 - RNA, 24 nt, Human
uuccacgggcaugugacagucacc

SEQ ID NO: 35117 - RNA, 24 nt, Human
gcugaacccccugcucaccgccag

SEQ ID NO: 35118 - RNA, 24 nt, Human
gcgcagcuucaggggccgcaaggg

SEQ ID NO: 35119 - RNA, 24 nt, Human
caguguccgcugcagccagucgga

SEQ ID NO: 35120 - RNA, 24 nt, Human
uuucuacuaaaaauacaaaaaacu

SEQ ID NO: 35121 - RNA, 24 nt, Human
uuaucugcuguuccgacuugguuu

SEQ ID NO: 35122 - RNA, 24 nt, Human
ucagcauguccagccuggggucug

SEQ ID NO: 35123 - RNA, 24 nt, Human
ugaaguggucugcucauaguuugu

SEQ ID NO: 35124 - RNA, 24 nt, Human
ccuugaguuccuucauggcaauga

SEQ ID NO: 35125 - RNA, 24 nt, Human
ugguguggugauucgcuucugguu

SEQ ID NO: 35126 - RNA, 24 nt, Human
gccauguuucuucugugccuacca

SEQ ID NO: 35127 - RNA, 24 nt, Human
uacaugcauauauuucagcuuaug

SEQ ID NO: 35128 - RNA, 24 nt, Human
ucccuuguggugguaccucuaugu

SEQ ID NO: 35129 - RNA, 24 nt, Human
ugugaagaccuuuccugucccaca

SEQ ID NO: 35130 - RNA, 24 nt, Human
aagaaaauagggcuuuuggcauuc

SEQ ID NO: 35131 - RNA, 24 nt, Human
cuuucuugcucuuuaaaaaaaucc

SEQ ID NO: 35132 - RNA, 24 nt, Human
uucacauuuuaauguuucaguagc

SEQ ID NO: 35133 - RNA, 24 nt, Human
ucccuaauagaguuaagaagcuua

SEQ ID NO: 35134 - RNA, 24 nt, Human
uggguccugggcagauacagccuu

SEQ ID NO: 35135 - RNA, 24 nt, Human
ucauuuuuaaggucgggaguuaga

SEQ ID NO: 35136 - RNA, 24 nt, Human
ucuguaucuucucugguuuccugu

SEQ ID NO: 35137 - RNA, 24 nt, Human
uuaauacugugccuuugauaaguu

SEQ ID NO: 35138 - RNA, 24 nt, Human
agccuggugacaagaaucggacug

SEQ ID NO: 35139 - RNA, 17 nt, Human
ugacacagauggugucc

SEQ ID NO: 35140 - RNA, 24 nt, Human
ugcuaugagaaucuaaggcugcca

SEQ ID NO: 35141 - RNA, 24 nt, Human
ugggaucaaacgugggugauggua

SEQ ID NO: 35142 - RNA, 24 nt, Human
uaauauuaguuacccuuguuuuaa

SEQ ID NO: 35143 - RNA, 24 nt, Human
aggaaaacaguguuuuagaugaga

SEQ ID NO: 35144 - RNA, 19 nt, Human
ggagaagggggugggugcu

SEQ ID NO: 35145 - RNA, 24 nt, Human
uggggagggaagaggaggagaggg

SEQ ID NO: 35146 - RNA, 24 nt, Human
uccccguguugccuauuagcccuu

SEQ ID NO: 35147 - RNA, 24 nt, Human
uucguuguugcacaaaaucagcca

SEQ ID NO: 35148 - RNA, 24 nt, Human
guggaucccguggagccacauggc

SEQ ID NO: 35149 - RNA, 24 nt, Human
uacccaaggcccuuucaauuucua

SEQ ID NO: 35150 - RNA, 24 nt, Human
uuuaauuuucuucggugcuccuuc

SEQ ID NO: 35151 - RNA, 24 nt, Human
aggaaggaagucccaccaguguuu

SEQ ID NO: 35152 - RNA, 24 nt, Human
cccacauacuucccauucaucuca

SEQ ID NO: 35153 - RNA, 24 nt, Human
ucgcugggguccuugaagcugacg

SEQ ID NO: 35154 - RNA, 24 nt, Human
uacagguaagguccccaggagagc

SEQ ID NO: 35155 - RNA, 24 nt, Human
ugggaagugaugagucauuuugca

SEQ ID NO: 35156 - RNA, 24 nt, Human
acccaauugacuuuaguauuuuua

SEQ ID NO: 35157 - RNA, 24 nt, Human
ccucacuugagccugggaggcgga

SEQ ID NO: 35158 - RNA, 24 nt, Human
aaagugcugggauuacaggcauga

SEQ ID NO: 35159 - RNA, 24 nt, Human
uuuuuaguagagaugggguuucac

SEQ ID NO: 35160 - RNA, 24 nt, Human
acucgaguugauaauucccucuau

SEQ ID NO: 35161 - RNA, 24 nt, Human
gggcugggagagagagauuagauu

SEQ ID NO: 35162 - RNA, 24 nt, Human
ucggaaccacauaauuaaagacca

SEQ ID NO: 35163 - RNA, 24 nt, Human
ugagcgguugacccuccuggcucc

SEQ ID NO: 35164 - RNA, 24 nt, Human
ucagcuccagggugagccugcacc

SEQ ID NO: 35165 - RNA, 24 nt, Human
ucccuuggggggccuaagagcagc

SEQ ID NO: 35166 - RNA, 24 nt, Human
uaccuuagaagcuaaaugugucac

SEQ ID NO: 35167 - RNA, 24 nt, Human
ugaaaucuagucauuaaagagucu

SEQ ID NO: 35168 - RNA, 24 nt, Human
uaagucauugugucuaugaugcca

SEQ ID NO: 35169 - RNA, 23 nt, Human
ugaagucauaaacaguaaacaau

SEQ ID NO: 35170 - RNA, 20 nt, Human
cacuguguggccggcagggu

SEQ ID NO: 35171 - RNA, 24 nt, Human
ugaaccuaagagcagguccucgag

SEQ ID NO: 35172 - RNA, 24 nt, Human
uccaagauucuggagcaaucugac

SEQ ID NO: 35173 - RNA, 24 nt, Human
cuuggccuuggcucuggccuuggc

SEQ ID NO: 35174 - RNA, 24 nt, Human
gagcuugcggcugacacccuuugg

SEQ ID NO: 35175 - RNA, 24 nt, Human
uucaauuggcaaauguuuuucaau

SEQ ID NO: 35176 - RNA, 23 nt, Human
aggucuuucacggggauuggcug

SEQ ID NO: 35177 - RNA, 24 nt, Human
ucucauuguugcugaaugccccuc

SEQ ID NO: 35178 - RNA, 24 nt, Human
cacucggcaagccaggguuccagc

SEQ ID NO: 35179 - RNA, 24 nt, Human
ugaaaaaauaugaugacgacauuu

SEQ ID NO: 35180 - RNA, 19 nt, Human
gggcaaggaauccagcagc

SEQ ID NO: 35181 - RNA, 23 nt, Human
ugagcagucuguggcucaacugg

SEQ ID NO: 35182 - RNA, 24 nt, Human
uguauaguuucuguuauguaauac

SEQ ID NO: 35183 - RNA, 24 nt, Human
ugaaaacgaauuucuucuaaacau

SEQ ID NO: 35184 - RNA, 24 nt, Human
ccaggcuguggacuggaacuggac

SEQ ID NO: 35185 - RNA, 24 nt, Human
ccuugagucucggcuucgguccca

SEQ ID NO: 35186 - RNA, 24 nt, Human
uccaagcaaggugggcuggcuaac

SEQ ID NO: 35187 - RNA, 24 nt, Human
ccugaaauucuuaaaggaugggag

SEQ ID NO: 35188 - RNA, 24 nt, Human
ucgauguugcauguuauuuuuauc

SEQ ID NO: 35189 - RNA, 24 nt, Human
ccagagccgccuccaggaguagaa

SEQ ID NO: 35190 - RNA, 24 nt, Human
ucucuggccgccaccuccaggacc

SEQ ID NO: 35191 - RNA, 24 nt, Human
ugaauuguguuucagucacucugc

SEQ ID NO: 35192 - RNA, 24 nt, Human
caagaacaagccucucucgucuuc

SEQ ID NO: 35193 - RNA, 19 nt, Human
uaucugagcuccugcugcc

SEQ ID NO: 35194 - RNA, 24 nt, Human
ucacugcaagcuccggcuugguaa

SEQ ID NO: 35195 - RNA, 24 nt, Human
aaacguaucugguuuggguccuaa

SEQ ID NO: 35196 - RNA, 24 nt, Human
ucaguauuucuuugaaauucuaca

SEQ ID NO: 35197 - RNA, 24 nt, Human
agagggcaaggaaggagagaacag

SEQ ID NO: 35198 - RNA, 24 nt, Human
ugacuuauucccaucagcaccaaa

SEQ ID NO: 35199 - RNA, 24 nt, Human
ucuuuaggaucucucuugcacugu

SEQ ID NO: 35200 - RNA, 24 nt, Human
uauggcaagucacuugauacauua

SEQ ID NO: 35201 - RNA, 24 nt, Human
ugagaauggcaaaauuagucgccu

SEQ ID NO: 35202 - RNA, 24 nt, Human
uacaccacucccaagaagaauaag

SEQ ID NO: 35203 - RNA, 24 nt, Human
augguggcccuugcaaccuuaaga

SEQ ID NO: 35204 - RNA, 24 nt, Human
caaacagauguggcaccacuuggg

SEQ ID NO: 35205 - RNA, 23 nt, Human
uuagagcgaaaccuauaaucacu

SEQ ID NO: 35206 - RNA, 23 nt, Human
uggugaguguaaaugagugaggc

SEQ ID NO: 35207 - RNA, 24 nt, Human
ugaguagguggccugcaguaaugu

SEQ ID NO: 35208 - RNA, 24 nt, Human
ucccggaggacaagcggucucugc

SEQ ID NO: 35209 - RNA, 24 nt, Human
aggcauggcgcggggugacuuggc

SEQ ID NO: 35210 - RNA, 24 nt, Human
accagucuguacaaaccuuacagc

SEQ ID NO: 35211 - RNA, 24 nt, Human
uauugcaaauacuuaaaauucuua

SEQ ID NO: 35212 - RNA, 24 nt, Human
uaaaugguguugacaccaacuucu

SEQ ID NO: 35213 - RNA, 24 nt, Human
uguuaacguuauuggaaugcugcu

SEQ ID NO: 35214 - RNA, 24 nt, Human
aauguuauuuuauuagaucuaacu

SEQ ID NO: 35215 - RNA, 20 nt, Human
gauaacgucucagagcaugc

SEQ ID NO: 35216 - RNA, 24 nt, Human
ugguauggacugguacugccccaa

SEQ ID NO: 35217 - RNA, 24 nt, Human
cugcucccuggccagcccccuugu

SEQ ID NO: 35218 - RNA, 24 nt, Human
uuugacuguguccucacccaaauc

SEQ ID NO: 35219 - RNA, 24 nt, Human
ugaguuaagacuuucggagacugu

SEQ ID NO: 35220 - RNA, 24 nt, Human
ugagugcguggauccacaauucau

SEQ ID NO: 35221 - RNA, 24 nt, Human
uauaagauuuuagcaauacuucca

SEQ ID NO: 35222 - RNA, 24 nt, Human
uggaaugcaggacccucugugaca

SEQ ID NO: 35223 - RNA, 24 nt, Human
ugagaggcagaggcaggcuccugg

SEQ ID NO: 35224 - RNA, 24 nt, Human
ugcauggagggucuugucugcugu

SEQ ID NO: 35225 - RNA, 24 nt, Human
caagacaagcacaaaagcaccacc

SEQ ID NO: 35226 - RNA, 24 nt, Human
augcggcggcgaacggugucaaau

SEQ ID NO: 35227 - RNA, 24 nt, Human
ccucugagaacauuggaccaugca

SEQ ID NO: 35228 - RNA, 24 nt, Human
ucccaauguugacguuggccaggg

SEQ ID NO: 35229 - RNA, 24 nt, Human
gcgcagcugugcgggcugaggcgg

SEQ ID NO: 35230 - RNA, 24 nt, Human
acggauccugccagcuguuugugu

SEQ ID NO: 35231 - RNA, 21 nt, Human
uacguaguuagaaaaaggagg

SEQ ID NO: 35232 - RNA, 23 nt, Human
ugagaagugccaucauuuuaugc

SEQ ID NO: 35233 - RNA, 24 nt, Human
ugagaggcagaggcaggcuccugg

SEQ ID NO: 35234 - RNA, 24 nt, Human
uggaaugcaggacccucugugaca

SEQ ID NO: 35235 - RNA, 24 nt, Human
uaauuuuuguauuuuuaguagaga

SEQ ID NO: 35236 - RNA, 24 nt, Human
ugggauuacaggagcaugccacca

SEQ ID NO: 35237 - RNA, 19 nt, Human
uagcauugaaggacucgug

SEQ ID NO: 35238 - RNA, 24 nt, Human
uaacagcauacugaucacuacuuc

SEQ ID NO: 35239 - RNA, 24 nt, Human
uagcauugaaggacucggggauau

SEQ ID NO: 35240 - RNA, 24 nt, Human
augguccaauaucaaagggaauga

SEQ ID NO: 35241 - RNA, 24 nt, Human
uucaagcuccuggggaaauguugc

SEQ ID NO: 35242 - RNA, 24 nt, Human
gcagcagauucuaguagcugauuu

SEQ ID NO: 35243 - RNA, 24 nt, Human
uggccagaaguaaaagcacagcug

SEQ ID NO: 35244 - RNA, 24 nt, Human
ugucagagggaagucaaaguggag

SEQ ID NO: 35245 - RNA, 24 nt, Human
agacuauaucuguagaaacuuuau

SEQ ID NO: 35246 - RNA, 24 nt, Human
uugauugcguggcccaugugaugc

SEQ ID NO: 35247 - RNA, 24 nt, Human
uguauauauuuaacacacacaucu

SEQ ID NO: 35248 - RNA, 24 nt, Human
ucauucauuacauucuugaguuuu

SEQ ID NO: 35249 - RNA, 24 nt, Human
aguuuggauucugaaaacuaacug

SEQ ID NO: 35250 - RNA, 24 nt, Human
cagauccaagagauauauuuggca

SEQ ID NO: 35251 - RNA, 24 nt, Human
uccagcauccagcagaugagaagu

SEQ ID NO: 35252 - RNA, 24 nt, Human
uuuuacgaauuuucucagagguua

SEQ ID NO: 35253 - RNA, 24 nt, Human
uuucuggggcuugcgcgcaaaauc

SEQ ID NO: 35254 - RNA, 24 nt, Human
cgggcagaaggaggcugagaaagu

SEQ ID NO: 35255 - RNA, 24 nt, Human
acagugcugcaggcugagcugaca

SEQ ID NO: 35256 - RNA, 24 nt, Human
uccaucaucuuggggucuucuucu

SEQ ID NO: 35257 - RNA, 24 nt, Human
uauuaaggagcucauuaauuuugg

SEQ ID NO: 35258 - RNA, 24 nt, Human
acugguucaccuacaaugagacaa

SEQ ID NO: 35259 - RNA, 24 nt, Human
uaauuuccaucgugcaagaaugua

SEQ ID NO: 35260 - RNA, 24 nt, Human
agagaauaaucucuuuugacuucg

SEQ ID NO: 35261 - RNA, 24 nt, Human
uucaagugauuuuucuaccucugc

SEQ ID NO: 35262 - RNA, 24 nt, Human
ugugcugugcguagugccuacugc

SEQ ID NO: 35263 - RNA, 22 nt, Human
cgccgggacagcagacugccgg

SEQ ID NO: 35264 - RNA, 24 nt, Human
cagccuggacuuaccaccacuaaa

SEQ ID NO: 35265 - RNA, 24 nt, Human
ggcccggagcggagcgcgcccugc

SEQ ID NO: 35266 - RNA, 24 nt, Human
uaaauuauuauaccuaagaaaagg

SEQ ID NO: 35267 - RNA, 22 nt, Human
uuguuuguaacuucaauuuuug

SEQ ID NO: 35268 - RNA, 24 nt, Human
uauggcaguaauagucauuccuau

SEQ ID NO: 35269 - RNA, 24 nt, Human
uauuucauaaaaauacaaaaauau

SEQ ID NO: 35270 - RNA, 24 nt, Human
uuacuuggaauuuccucuguuaua

SEQ ID NO: 35271 - RNA, 22 nt, Human
uccacgaggcaaacgggucauc

SEQ ID NO: 35272 - RNA, 24 nt, Human
gaucauuugaggucaggcguuuga

SEQ ID NO: 35273 - RNA, 24 nt, Human
cauuacaugaaauuuuaagucuuu

SEQ ID NO: 35274 - RNA, 24 nt, Human
uaacugguuggaaaaacugugauc

SEQ ID NO: 35275 - RNA, 24 nt, Human
uuggaaggcugaggcugagaauca

SEQ ID NO: 35276 - RNA, 24 nt, Human
ucuccaguguaccuagggaacccu

SEQ ID NO: 35277 - RNA, 24 nt, Human
caucauuuaauuucuggggggggc

SEQ ID NO: 35278 - RNA, 22 nt, Human
ugucagaguucgauagaaauga

SEQ ID NO: 35279 - RNA, 24 nt, Human
uaccccagagccuagcaggccgac

SEQ ID NO: 35280 - RNA, 24 nt, Human
ccaggacuuacuucuuugacaugg

SEQ ID NO: 35281 - RNA, 24 nt, Human
ucacuuguuauuuauuaaguuuaa

SEQ ID NO: 35282 - RNA, 24 nt, Human
ucucugauuuguccaaagcuggaa

SEQ ID NO: 35283 - RNA, 24 nt, Human
ugggauuacaggcgugagacaccg

SEQ ID NO: 35284 - RNA, 24 nt, Human
uggccuagucagugccucgaggag

SEQ ID NO: 35285 - RNA, 22 nt, Human
ugugcaguggaguuguuaaguu

SEQ ID NO: 35286 - RNA, 18 nt, Human
ugaguagagauaaucaug

SEQ ID NO: 35287 - RNA, 20 nt, Human
ucaguccgugagauccugcc

SEQ ID NO: 35288 - RNA, 24 nt, Human
uucuugaucacuguggcuggggac

SEQ ID NO: 35289 - RNA, 24 nt, Human
aagcugcuucacgaaggcagauga

SEQ ID NO: 35290 - RNA, 24 nt, Human
uccccgaagacuuggccagguugg

SEQ ID NO: 35291 - RNA, 24 nt, Human
caaggggaucgagggcuggcgggg

SEQ ID NO: 35292 - RNA, 24 nt, Human
uggauugggggauagaggaacggu

SEQ ID NO: 35293 - RNA, 24 nt, Human
cagcugguuaauuuuucuccaaua

SEQ ID NO: 35294 - RNA, 21 nt, Human
uuuuaaggacuugagauaacu

SEQ ID NO: 35295 - RNA, 24 nt, Human
uggagugcaguggcaugaucucgg

SEQ ID NO: 35296 - RNA, 24 nt, Human
aggcagcucacgcgguugucgugg

SEQ ID NO: 35297 - RNA, 24 nt, Human
uugcaguugaagucgucguagcca

SEQ ID NO: 35298 - RNA, 24 nt, Human
ugaaagcuggcggggccugcuggg

SEQ ID NO: 35299 - RNA, 24 nt, Human
uuuacauuuacaaauuauaucaua

SEQ ID NO: 35300 - RNA, 24 nt, Human
uugaagcuugaaaauuuuauuuaa

SEQ ID NO: 35301 - RNA, 24 nt, Human
uuagaguagccuagcaguuuucaa

SEQ ID NO: 35302 - RNA, 24 nt, Human
cagcggcagagagccauccucuau

SEQ ID NO: 35303 - RNA, 24 nt, Human
auugauggucagccaggugccuuc

SEQ ID NO: 35304 - RNA, 24 nt, Human
gcugcagcauauuguacuggccug

SEQ ID NO: 35305 - RNA, 24 nt, Human
auguagccaucuacagauaccaga

SEQ ID NO: 35306 - RNA, 24 nt, Human
uucaagcacagagauacaaaucuu

SEQ ID NO: 35307 - RNA, 24 nt, Human
uaacauacaaagcuauaauuaaga

SEQ ID NO: 35308 - RNA, 24 nt, Human
uacagaagaaaucaauacaauaga

SEQ ID NO: 35309 - RNA, 18 nt, Human
ugagugucaguguuucuu

SEQ ID NO: 35310 - RNA, 24 nt, Human
ucuucaguuauuccacagcuaucu

SEQ ID NO: 35311 - RNA, 24 nt, Human
uauagagcugugccuuaaauauuu

SEQ ID NO: 35312 - RNA, 24 nt, Human
uaaguccugggggaaaaugaaaaa

SEQ ID NO: 35313 - RNA, 24 nt, Human
aagaagacugcacucacugcauuu

SEQ ID NO: 35314 - RNA, 24 nt, Human
uaaauaaauugcuuaaaaguguuc

SEQ ID NO: 35315 - RNA, 17 nt, Human
cagcccaauuaucuagc

SEQ ID NO: 35316 - RNA, 24 nt, Human
uucaucagugacacaaggauuuau

SEQ ID NO: 35317 - RNA, 24 nt, Human
uauguacauaguguuuucaauguu

SEQ ID NO: 35318 - RNA, 24 nt, Human
ccuuuuauacaaugcucaugaauc

SEQ ID NO: 35319 - RNA, 24 nt, Human
cuggccccacgcuuaccaaccuug

SEQ ID NO: 35320 - RNA, 24 nt, Human
ugacguuaguuauuauacugccgu

SEQ ID NO: 35321 - RNA, 24 nt, Human
caagggccuggcuccucuuccugu

SEQ ID NO: 35322 - RNA, 24 nt, Human
agcagcucuuuuuucccuucuucu

SEQ ID NO: 35323 - RNA, 24 nt, Human
uugaagccaauuguuuuccaaaua

SEQ ID NO: 35324 - RNA, 24 nt, Human
uggaagaugcucaacaccuccucc

SEQ ID NO: 35325 - RNA, 24 nt, Human
ugaccaggaaauacaacgagcugc

SEQ ID NO: 35326 - RNA, 17 nt, Human
ucugacagugaaucuga

SEQ ID NO: 35327 - RNA, 24 nt, Human
ugagcaaagaacugaagaagcaag

SEQ ID NO: 35328 - RNA, 24 nt, Human
agacaggguacgaccaucuuccag

SEQ ID NO: 35329 - RNA, 24 nt, Human
uauggagcaaagaaacuggugucc

SEQ ID NO: 35330 - RNA, 24 nt, Human
ugaucucguuggacugcguggcua

SEQ ID NO: 35331 - RNA, 24 nt, Human
caggugguugcuuugaacuuuauu

SEQ ID NO: 35332 - RNA, 20 nt, Human
cccacugugggaucugaggc

SEQ ID NO: 35333 - RNA, 24 nt, Human
uaacucccaacuugaaggcaguua

SEQ ID NO: 35334 - RNA, 21 nt, Human
uggcggaggcagagagucuuc

SEQ ID NO: 35335 - RNA, 24 nt, Human
uagaugcaggugagcucggugaca

SEQ ID NO: 35336 - RNA, 24 nt, Human
ucaagaauaccaaagcccauguca

SEQ ID NO: 35337 - RNA, 24 nt, Human
ugaguggggcuggggcaugguagu

SEQ ID NO: 35338 - RNA, 24 nt, Human
ugggauccugcagcucuagucucc

SEQ ID NO: 35339 - RNA, 24 nt, Human
ucaggcucagauagcugcuggccg

SEQ ID NO: 35340 - RNA, 24 nt, Human
agggggugggaggugugcauaaga

SEQ ID NO: 35341 - RNA, 24 nt, Human
uauuuuauugcaggaggugggggu

SEQ ID NO: 35342 - RNA, 24 nt, Human
ugggaugaucucaagggcaccuuu

SEQ ID NO: 35343 - RNA, 24 nt, Human
gaccguuuugggcaauccauuuuc

SEQ ID NO: 35344 - RNA, 24 nt, Human
gaggagaaacccugggaaggcucc

SEQ ID NO: 35345 - RNA, 24 nt, Human
uuccugaggggcuucuuaacuuuu

SEQ ID NO: 35346 - RNA, 17 nt, Human
ucuaguguccccccagc

SEQ ID NO: 35347 - RNA, 24 nt, Human
uuuccagaucuacgcugugccuug

SEQ ID NO: 35348 - RNA, 24 nt, Human
ugaguaaaucaaacuauauaauuu

SEQ ID NO: 35349 - RNA, 23 nt, Human
ucauuugggaaauguaaaugugc

SEQ ID NO: 35350 - RNA, 24 nt, Human
cuguguuuuuagcaucuuugggag

SEQ ID NO: 35351 - RNA, 24 nt, Human
gggaaggaaaggggccugagcugg

SEQ ID NO: 35352 - RNA, 24 nt, Human
uggccuggggcugcucccugcccg

SEQ ID NO: 35353 - RNA, 24 nt, Human
ccggagcacauuccugagcgcuga

SEQ ID NO: 35354 - RNA, 20 nt, Human
aaaguacuugccgcucuacc

SEQ ID NO: 35355 - RNA, 24 nt, Human
uucgcacaguaguauacagccgug

SEQ ID NO: 35356 - RNA, 24 nt, Human
ucuaaaacuacgaauacuaccuga

SEQ ID NO: 35357 - RNA, 24 nt, Human
gcgcagcuucaggggccgcaaggg

SEQ ID NO: 35358 - RNA, 20 nt, Human
ugagagaacacuccacgaug

SEQ ID NO: 35359 - RNA, 24 nt, Human
ccugaccccugggcuggccuggga

SEQ ID NO: 35360 - RNA, 24 nt, Human
aaagcaaaugaggcagaaaggccc

SEQ ID NO: 35361 - RNA, 20 nt, Human
uaagaaaauugggucagagg

SEQ ID NO: 35362 - RNA, 24 nt, Human
ugaacaccaguacuaggacuggau

SEQ ID NO: 35363 - RNA, 24 nt, Human
uccaaguaguugggacuacaggca

SEQ ID NO: 35364 - RNA, 24 nt, Human
auagcuuacuguagccucgaccuc

SEQ ID NO: 35365 - RNA, 24 nt, Human
uggcaugugcuuaugacccucgug

SEQ ID NO: 35366 - RNA, 24 nt, Human
cacccuaugucgucacuggcagcg

SEQ ID NO: 35367 - RNA, 24 nt, Human
uuugaacacugaaaccauuguugg

SEQ ID NO: 35368 - RNA, 24 nt, Human
uauacaguacaagcagaucauucu

SEQ ID NO: 35369 - RNA, 24 nt, Human
uuuguccgcuaucaguucacaccg

SEQ ID NO: 35370 - RNA, 24 nt, Human
uggccacccacugagccgcugcua

SEQ ID NO: 35371 - RNA, 24 nt, Human
aacauuauucccacugccagauag

SEQ ID NO: 35372 - RNA, 24 nt, Human
ugccuggacauugaugcuaacaug

SEQ ID NO: 35373 - RNA, 24 nt, Human
uuccugagcagguagccugggggg

SEQ ID NO: 35374 - RNA, 24 nt, Human
uaagcagcuuccuaucuuuuaaau

SEQ ID NO: 35375 - RNA, 17 nt, Human
uguguaggaagugcugg

SEQ ID NO: 35376 - RNA, 19 nt, Human
ugguauguuuguacgucuc

SEQ ID NO: 35377 - RNA, 24 nt, Human
ugugcauacuguagaaugguagua

SEQ ID NO: 35378 - RNA, 22 nt, Human
uaccucaggucauagacaucau

SEQ ID NO: 35379 - RNA, 24 nt, Human
aagucguagaaauuuauuuggaau

SEQ ID NO: 35380 - RNA, 24 nt, Human
aagcaacagcagguauuuuuguac

SEQ ID NO: 35381 - RNA, 24 nt, Human
ucggugaggugaguugccugcggc

SEQ ID NO: 35382 - RNA, 24 nt, Human
uagucuuaggaguaauacgcguuc

SEQ ID NO: 35383 - RNA, 24 nt, Human
ucccccagucagccuggcccugcu

SEQ ID NO: 35384 - RNA, 24 nt, Human
uguaauacccuuccugacacuggu

SEQ ID NO: 35385 - RNA, 24 nt, Human
ugagaugggaaagggcuccuucaa

SEQ ID NO: 35386 - RNA, 24 nt, Human
ccuugggucaagggauggcaaguc

SEQ ID NO: 35387 - RNA, 24 nt, Human
ucacuggaugguccuguaggcgag

SEQ ID NO: 35388 - RNA, 24 nt, Human
aagcacucacuuccugguuuccag

SEQ ID NO: 35389 - RNA, 24 nt, Human
uggcugggccaugccaugcaccuc

SEQ ID NO: 35390 - RNA, 24 nt, Human
uccuucucucuggugucuucaggc

SEQ ID NO: 35391 - RNA, 20 nt, Human
ugagagaacacuccacgaug

SEQ ID NO: 35392 - RNA, 24 nt, Human
aaugguaccauccugggagcccac

SEQ ID NO: 35393 - RNA, 24 nt, Human
uguguaaacaauagaauggaauga

SEQ ID NO: 35394 - RNA, 22 nt, Human
uccgugcgcguugcugcggccg

SEQ ID NO: 35395 - RNA, 24 nt, Human
uugaucuugaagaaacugggcgug

SEQ ID NO: 35396 - RNA, 24 nt, Human
aggaaggagauauagugaagagga

SEQ ID NO: 35397 - RNA, 24 nt, Human
guagaguuuucuucaggcuuaaag

SEQ ID NO: 35398 - RNA, 24 nt, Human
aagcgccugcgcaaggccaagaag

SEQ ID NO: 35399 - RNA, 24 nt, Human
uauaauaauuaacaacagcaaaga

SEQ ID NO: 35400 - RNA, 24 nt, Human
uggugcaguguaacgaugcacuuu

SEQ ID NO: 35401 - RNA, 24 nt, Human
uaaucugacuucucacuuccuaag

SEQ ID NO: 35402 - RNA, 24 nt, Human
aagcagauguggugauacugagau

SEQ ID NO: 35403 - RNA, 24 nt, Human
ugggaaggagcuggcugagucuug

SEQ ID NO: 35404 - RNA, 24 nt, Human
uagcaguacccucagguagucucc

SEQ ID NO: 35405 - RNA, 24 nt, Human
cagcacuuugggaggccaaggcgg

SEQ ID NO: 35406 - RNA, 24 nt, Human
uuucuuguguuuccgggaacguuc

SEQ ID NO: 35407 - RNA, 23 nt, Human
uacagcauauucuguucaaguau

SEQ ID NO: 35408 - RNA, 24 nt, Human
uggaagaagauugucuuugggcau

SEQ ID NO: 35409 - RNA, 24 nt, Human
ugacguucucagaauaguggcuag

SEQ ID NO: 35410 - RNA, 24 nt, Human
ugaggagaauggucggaaaagaga

SEQ ID NO: 35411 - RNA, 24 nt, Human
uuauacguaagaauaugcaguauu

SEQ ID NO: 35412 - RNA, 24 nt, Human
uacccaauagugaucucuucugcu

SEQ ID NO: 35413 - RNA, 24 nt, Human
uccaucaauuccaucguuuacguu

SEQ ID NO: 35414 - RNA, 24 nt, Human
ugaagggugcuugguuuuuucaaa

SEQ ID NO: 35415 - RNA, 24 nt, Human
ugagagaauguaagaacauauaga

SEQ ID NO: 35416 - RNA, 24 nt, Human
uacauucuccucuuuuccgugagu

SEQ ID NO: 35417 - RNA, 24 nt, Human
ccagaucgaggugaaucccuucag

SEQ ID NO: 35418 - RNA, 24 nt, Human
gugccgcccgcuuaggcagguucc

SEQ ID NO: 35419 - RNA, 24 nt, Human
uggcauacuaccucucaacauuga

SEQ ID NO: 35420 - RNA, 24 nt, Human
uuuuacucagugguggaguagacu

SEQ ID NO: 35421 - RNA, 24 nt, Human
cauagcaaaugaaucuaaaaaguu

SEQ ID NO: 35422 - RNA, 19 nt, Human
uagcuggaugcaguggaac

SEQ ID NO: 35423 - RNA, 24 nt, Human
uaugaggcccuagagcuccgggac

SEQ ID NO: 35424 - RNA, 24 nt, Human
ccccuguagcagcacaucgcugac

SEQ ID NO: 35425 - RNA, 24 nt, Human
ugagcagguccaccggccccuaca

SEQ ID NO: 35426 - RNA, 24 nt, Human
ccaggccaaaaaggcucaacauuu

SEQ ID NO: 35427 - RNA, 24 nt, Human
ucuggcacaggaaauggucuccaa

SEQ ID NO: 35428 - RNA, 24 nt, Human
ugugguggucuuggacaguaugug

SEQ ID NO: 35429 - RNA, 24 nt, Human
aucauggaaguuucauuuguugcg

SEQ ID NO: 35430 - RNA, 24 nt, Human
ugugcauggcagcuguuuuccuuu

SEQ ID NO: 35431 - RNA, 24 nt, Human
aggaauaauugcaucuaggggcug

SEQ ID NO: 35432 - RNA, 24 nt, Human
gggaagcagaaaaaccaagugcug

SEQ ID NO: 35433 - RNA, 24 nt, Human
uggaucacuugaggucaggaguuu

SEQ ID NO: 35434 - RNA, 24 nt, Human
uuagaagacauguuugaugcuuag

SEQ ID NO: 35435 - RNA, 24 nt, Human
ugaauaggcacagagggcaccugu

SEQ ID NO: 35436 - RNA, 24 nt, Human
auacugcgcgacaacaauuaacgc

SEQ ID NO: 35437 - RNA, 24 nt, Human
ugccugaaaaucgacaaacagaug

SEQ ID NO: 35438 - RNA, 24 nt, Human
uggaguauucugacugcgguugcu

SEQ ID NO: 35439 - RNA, 24 nt, Human
ucuaaagcuugucuuguagguucg

SEQ ID NO: 35440 - RNA, 24 nt, Human
auggugccaaaagacugguuuccc

SEQ ID NO: 35441 - RNA, 24 nt, Human
ucaugguuuuugaacguucgaacg

SEQ ID NO: 35442 - RNA, 24 nt, Human
uuacagaaguuauaaaaaaccaga

SEQ ID NO: 35443 - RNA, 24 nt, Human
ugacuucacggaggcgguacagcu

SEQ ID NO: 35444 - RNA, 24 nt, Human
cuagccucaagagggggaaguggc

SEQ ID NO: 35445 - RNA, 24 nt, Human
ugagaaguaggugagggcaugcaa

SEQ ID NO: 35446 - RNA, 24 nt, Human
uuggaacacauguuuacgaagaag

SEQ ID NO: 35447 - RNA, 24 nt, Human
uagcagagacugguggcauuuugc

SEQ ID NO: 35448 - RNA, 24 nt, Human
uagcaguaugagaaugaacuaaca

SEQ ID NO: 35449 - RNA, 24 nt, Human
uaaaugauacagaaauacguuuau

SEQ ID NO: 35450 - RNA, 24 nt, Human
uuaucaguauuuucucaauuuuag

SEQ ID NO: 35451 - RNA, 24 nt, Human
uugcagugagcugagaccaggcug

SEQ ID NO: 35452 - RNA, 24 nt, Human
ccccccuucccccuuuuuuguccc

SEQ ID NO: 35453 - RNA, 24 nt, Human
ucaggugccugggucugggucuca

SEQ ID NO: 35454 - RNA, 18 nt, Human
uagaagguauucuguucc

SEQ ID NO: 35455 - RNA, 24 nt, Human
uuuauuggguguuuacucugcccc

SEQ ID NO: 35456 - RNA, 24 nt, Human
ugacauaaagacugaaagaagccu

SEQ ID NO: 35457 - RNA, 24 nt, Human
guccuuguggccuuccuugaggag

SEQ ID NO: 35458 - RNA, 24 nt, Human
aacacugucaucuucuuauucacg

SEQ ID NO: 35459 - RNA, 24 nt, Human
uaggaugguuccugggcugauuga

SEQ ID NO: 35460 - RNA, 24 nt, Human
uccaugcaauuuucagaugaaaaa

SEQ ID NO: 35461 - RNA, 24 nt, Human
uagcuuguaauguccauuuaaauu

SEQ ID NO: 35462 - RNA, 18 nt, Human
uaucaaggaagggcaggc

SEQ ID NO: 35463 - RNA, 24 nt, Human
uaagaguguugaaaaaaaaauuca

SEQ ID NO: 35464 - RNA, 24 nt, Human
uucaaauuucuuucuuuuuuaauu

SEQ ID NO: 35465 - RNA, 24 nt, Human
gcuaaauuugcuagagaugugcug

SEQ ID NO: 35466 - RNA, 24 nt, Human
ucacugcaaccuccgccucccggg

SEQ ID NO: 35467 - RNA, 24 nt, Human
ugaaaaauuaaauugagauccagg

SEQ ID NO: 35468 - RNA, 24 nt, Human
uaugccaaugcaaccgugacuacu

SEQ ID NO: 35469 - RNA, 24 nt, Human
ugacaugcacagaaguggagagga

SEQ ID NO: 35470 - RNA, 24 nt, Human
cuggacuagcugggauuacaggug

SEQ ID NO: 35471 - RNA, 24 nt, Human
uagcaauaccuugugugcugacug

SEQ ID NO: 35472 - RNA, 19 nt, Human
ucaguggaauaccugcaga

SEQ ID NO: 35473 - RNA, 24 nt, Human
ugggaggccauggccuucgccagc

SEQ ID NO: 35474 - RNA, 24 nt, Human
ggccagggccucggggccgcuugu

SEQ ID NO: 35475 - RNA, 24 nt, Human
ccggucccgaaccucugaccuuau

SEQ ID NO: 35476 - RNA, 24 nt, Human
acacuggucugauuauuucuggaa

SEQ ID NO: 35477 - RNA, 22 nt, Human
ugucuugguuggcuugucagau

SEQ ID NO: 35478 - RNA, 17 nt, Human
ucccuuggacauugccc

SEQ ID NO: 35479 - RNA, 24 nt, Human
uagcguccgcuaggcugucugccu

SEQ ID NO: 35480 - RNA, 24 nt, Human
uacgccucuucauucccguccaug

SEQ ID NO: 35481 - RNA, 24 nt, Human
uugguacuugagucaaagacgaca

SEQ ID NO: 35482 - RNA, 24 nt, Human
aggaguugccaucagggauaacac

SEQ ID NO: 35483 - RNA, 24 nt, Human
agcggguggcccucucuggaacag

SEQ ID NO: 35484 - RNA, 24 nt, Human
aaggagccccaaagagaagggacg

SEQ ID NO: 35485 - RNA, 22 nt, Human
uuucagggcccugccuuuccca

SEQ ID NO: 35486 - RNA, 24 nt, Human
uggcugcgggaguccucauagaug

SEQ ID NO: 35487 - RNA, 23 nt, Human
ugccauggaggguaugaagugac

SEQ ID NO: 35488 - RNA, 24 nt, Human
caagccccagaaagacggcugggg

SEQ ID NO: 35489 - RNA, 24 nt, Human
cacugggcccgcccuggguaggca

SEQ ID NO: 35490 - RNA, 24 nt, Human
gggcagagggggcgugcggccucu

SEQ ID NO: 35491 - RNA, 24 nt, Human
ccuucuguugcuauuuugagaguc

SEQ ID NO: 35492 - RNA, 24 nt, Human
uguuuauuuaucaagguuuacaug

SEQ ID NO: 35493 - RNA, 24 nt, Human
ugaaaugguguaacccuauaaagc

SEQ ID NO: 35494 - RNA, 24 nt, Human
ugaggacaaggcagacgugcaguc

SEQ ID NO: 35495 - RNA, 24 nt, Human
ugccaugugcucccugaccugaag

SEQ ID NO: 35496 - RNA, 24 nt, Human
ugacuuaauauuuuggaguugaga

SEQ ID NO: 35497 - RNA, 24 nt, Human
uccauauuaaccacagacuguccu

SEQ ID NO: 35498 - RNA, 24 nt, Human
uaaaaaguugugggcaaagauggc

SEQ ID NO: 35499 - RNA, 24 nt, Human
aagaaaccuuuagaaggacuuaga

SEQ ID NO: 35500 - RNA, 24 nt, Human
uaucuuaauguagauuauaauuug

SEQ ID NO: 35501 - RNA, 24 nt, Human
uaguaugugccuacugugauuuuu

SEQ ID NO: 35502 - RNA, 24 nt, Human
uagaaaauuauggacauuuuuggu

SEQ ID NO: 35503 - RNA, 24 nt, Human
uaaaucaaacaugauugauuuaaa

SEQ ID NO: 35504 - RNA, 23 nt, Human
uaaggcgaggcggaauuaaaccc

SEQ ID NO: 35505 - RNA, 24 nt, Human
uagcaaaucgagucuuaaauaauc

SEQ ID NO: 35506 - RNA, 24 nt, Human
aguccuuuugugaacuuuuaaagg

SEQ ID NO: 35507 - RNA, 24 nt, Human
uauuacaccagaguugcuucguau

SEQ ID NO: 35508 - RNA, 24 nt, Human
gaucauacagucugccauggagaa

SEQ ID NO: 35509 - RNA, 24 nt, Human
ugucaagaguuauuuacauaugua

SEQ ID NO: 35510 - RNA, 24 nt, Human
ugugcagaagaaauggaaggauuc

SEQ ID NO: 35511 - RNA, 24 nt, Human
uaucaaggaagggcaggcgugaug

SEQ ID NO: 35512 - RNA, 24 nt, Human
uucaaauuucuuucuuuuuuaauu

SEQ ID NO: 35513 - RNA, 24 nt, Human
uaaauuauccuauuuuuuauucug

SEQ ID NO: 35514 - RNA, 24 nt, Human
uauccagagguaaagcccauugug

SEQ ID NO: 35515 - RNA, 24 nt, Human
cagcgugggcucccuuccaagcuu

SEQ ID NO: 35516 - RNA, 24 nt, Human
uaucaaggaagggcaggcgugaug

SEQ ID NO: 35517 - RNA, 24 nt, Human
uaacagguguaagaguguugaaaa

SEQ ID NO: 35518 - RNA, 24 nt, Human
ugcauuguuaucauuaaccagucu

SEQ ID NO: 35519 - RNA, 24 nt, Human
uguuaguuauuuuaggagacaguc

SEQ ID NO: 35520 - RNA, 24 nt, Human
uaccuguuuauagcggccggacag

SEQ ID NO: 35521 - RNA, 24 nt, Human
uucaucaauuggcaauuaagaugu

SEQ ID NO: 35522 - RNA, 24 nt, Human
acgacaguugguggcuugguggga

SEQ ID NO: 35523 - RNA, 24 nt, Human
uaucaaggaagggcaggcgugaug

SEQ ID NO: 35524 - RNA, 24 nt, Human
uauggcaagucacuuugacagaca

SEQ ID NO: 35525 - RNA, 24 nt, Human
ugagaauggcaaaauuagucgccu

SEQ ID NO: 35526 - RNA, 24 nt, Human
auguaacuugacgaguuaguaggg

SEQ ID NO: 35527 - RNA, 24 nt, Human
ucccucaugagugaccuuggugcc

SEQ ID NO: 35528 - RNA, 24 nt, Human
agucauugcugugggaguuuuccu

SEQ ID NO: 35529 - RNA, 23 nt, Human
ucgcuuugucauguuggccaggu

SEQ ID NO: 35530 - RNA, 24 nt, Human
ugggcccugccgcugacuggcugu

SEQ ID NO: 35531 - RNA, 24 nt, Human
uaaguaugaucaauaaauuuuaau

SEQ ID NO: 35532 - RNA, 24 nt, Human
aagcagcggcgccgcacacucaaa

SEQ ID NO: 35533 - RNA, 24 nt, Human
gcgccuggagcucgacgcgcugcg

SEQ ID NO: 35534 - RNA, 21 nt, Human
gucaauauccauaaaugaagg

SEQ ID NO: 35535 - RNA, 23 nt, Human
ugaaaggcuguccaccuugguug

SEQ ID NO: 35536 - RNA, 24 nt, Human
uuaguccugacuagacagcaaaag

SEQ ID NO: 35537 - RNA, 24 nt, Human
caccacagccauugcugaggccug

SEQ ID NO: 35538 - RNA, 24 nt, Human
acucugcacggcuacucggaccuc

SEQ ID NO: 35539 - RNA, 24 nt, Human
ggaccgggggcugggcuggccgca

SEQ ID NO: 35540 - RNA, 24 nt, Human
uacgugcugcccaucggcgacgcg

SEQ ID NO: 35541 - RNA, 24 nt, Human
ucauggacuaaacuaggucagagu

SEQ ID NO: 35542 - RNA, 24 nt, Human
ucaguaccuggccagagggguccu

SEQ ID NO: 35543 - RNA, 24 nt, Human
uaacuggggaaaacuaugaugcuu

SEQ ID NO: 35544 - RNA, 24 nt, Human
uugguaggggagcuuuuucuuuuc

SEQ ID NO: 35545 - RNA, 24 nt, Human
agaaggcccuggagaaguugcucc

SEQ ID NO: 35546 - RNA, 24 nt, Human
gggacugacauuccugaaccccug

SEQ ID NO: 35547 - RNA, 24 nt, Human
ucuuucgccaggcuggggacccgc

SEQ ID NO: 35548 - RNA, 24 nt, Human
aguuguguucuuugaugccuguga

SEQ ID NO: 35549 - RNA, 19 nt, Human
ugcggcaaccaaaucggcg

SEQ ID NO: 35550 - RNA, 24 nt, Human
uucggucagaguggugcugggaac

SEQ ID NO: 35551 - RNA, 24 nt, Human
ccucuggaggcugaagagggauuc

SEQ ID NO: 35552 - RNA, 24 nt, Human
ucuccaggcccaagucgugcucuc

SEQ ID NO: 35553 - RNA, 24 nt, Human
ccacugcucuccgggccucuccug

SEQ ID NO: 35554 - RNA, 24 nt, Human
ugcccaaagggagugacugucuuc

SEQ ID NO: 35555 - RNA, 22 nt, Human
uagcauucugguccuggcugca

SEQ ID NO: 35556 - RNA, 24 nt, Human
uacuguggcuaugagagcauuuaa

SEQ ID NO: 35557 - RNA, 24 nt, Human
caguacgugccccgcgccgugcuc

SEQ ID NO: 35558 - RNA, 24 nt, Human
aggcaggcuuagcagcuaagggag

SEQ ID NO: 35559 - RNA, 24 nt, Human
aagcauuuaauugaauuucucaau

SEQ ID NO: 35560 - RNA, 24 nt, Human
ugacaucgugguaggcuucaagca

SEQ ID NO: 35561 - RNA, 17 nt, Human
ccuggcuguuggguagg

SEQ ID NO: 35562 - RNA, 24 nt, Human
cagggcacgggugaggcacaagcg

SEQ ID NO: 35563 - RNA, 24 nt, Human
ugguuugugacuucugugauuuaa

SEQ ID NO: 35564 - RNA, 24 nt, Human
uuggaucaaauguuguccccgagu

SEQ ID NO: 35565 - RNA, 24 nt, Human
uccaagaacuaguucaccccagcu

SEQ ID NO: 35566 - RNA, 24 nt, Human
uguggcacaugucgucucuugcuu

SEQ ID NO: 35567 - RNA, 24 nt, Human
cuuuccuuuucauauguggcuggu

SEQ ID NO: 35568 - RNA, 24 nt, Human
gagcugcgggucgcggccggcgcc

SEQ ID NO: 35569 - RNA, 24 nt, Human
ggaggaagccgguuucuccuuucu

SEQ ID NO: 35570 - RNA, 24 nt, Human
gcucuuugcccacccgcgucaggc

SEQ ID NO: 35571 - RNA, 24 nt, Human
aguccuuuuuuauuuuuuuucccu

SEQ ID NO: 35572 - RNA, 24 nt, Human
ucuaaauuuuuaaaccuucuauca

SEQ ID NO: 35573 - RNA, 24 nt, Human
uuaaaguucauuuagaaacaucug

SEQ ID NO: 35574 - RNA, 24 nt, Human
aggcagcucacgcgguugucgugg

SEQ ID NO: 35575 - RNA, 24 nt, Human
uugcaguugaagucgucguagcca

SEQ ID NO: 35576 - RNA, 24 nt, Human
uucaucuaggggcagcgcacgguc

SEQ ID NO: 35577 - RNA, 24 nt, Human
gcaguucaggguggauucugugcu

SEQ ID NO: 35578 - RNA, 24 nt, Human
ucggaagccccccaucaaggugac

SEQ ID NO: 35579 - RNA, 22 nt, Human
aacaugcuuaugaugcauagga

SEQ ID NO: 35580 - RNA, 24 nt, Human
uaauuuacaaccaguuaagaauua

SEQ ID NO: 35581 - RNA, 24 nt, Human
ugguguggaggaagcaugauauuu

SEQ ID NO: 35582 - RNA, 24 nt, Human
aaaugcuuauuuccugaaguuccu

SEQ ID NO: 35583 - RNA, 24 nt, Human
uggcuggguggaacugagucuuuu

SEQ ID NO: 35584 - RNA, 20 nt, Human
ugagagaacacuccacgaug

SEQ ID NO: 35585 - RNA, 24 nt, Human
aaagcaaaugaggcagaaaggccc

SEQ ID NO: 35586 - RNA, 24 nt, Human
uccuugugauccacccaccuuggc

SEQ ID NO: 35587 - RNA, 24 nt, Human
uaucauuauaugucgagguugagu

SEQ ID NO: 35588 - RNA, 24 nt, Human
ucguauucuucgcuguuuccagaa

SEQ ID NO: 35589 - RNA, 24 nt, Human
uuuacaacaacuaagggaguguau

SEQ ID NO: 35590 - RNA, 24 nt, Human
guugcagaguguacaugaaacugu

SEQ ID NO: 35591 - RNA, 24 nt, Human
ugaaagguugagaaaggaaugguu

SEQ ID NO: 35592 - RNA, 24 nt, Human
gguuauuaagauacaggcugcugu

SEQ ID NO: 35593 - RNA, 24 nt, Human
uaguggacuucugugagauuguag

SEQ ID NO: 35594 - RNA, 24 nt, Human
ucgagaauuucucacaaugggugg

SEQ ID NO: 35595 - RNA, 21 nt, Human
ugcuaagcaaaggaccuguga

SEQ ID NO: 35596 - RNA, 24 nt, Human
uuuugcacagguacgugauccgac

SEQ ID NO: 35597 - RNA, 20 nt, Human
aagcucacaaacaauaggac

SEQ ID NO: 35598 - RNA, 24 nt, Human
aagaguuuaaaagacuugaaugga

SEQ ID NO: 35599 - RNA, 24 nt, Human
aaggugcuugugggccacaccaag

SEQ ID NO: 35600 - RNA, 24 nt, Human
uugcugcagucuggggcaugugag

SEQ ID NO: 35601 - RNA, 21 nt, Human
cagcaggguggacaaauaagc

SEQ ID NO: 35602 - RNA, 24 nt, Human
aagcauuuugagaacagguuggca

SEQ ID NO: 35603 - RNA, 24 nt, Human
acccaauuaaguuuuuuauauacu

SEQ ID NO: 35604 - RNA, 24 nt, Human
uagucugcugugaguuuuuauugg

SEQ ID NO: 35605 - RNA, 24 nt, Human
cuuggcuccccuuucuuccuucug

SEQ ID NO: 35606 - RNA, 24 nt, Human
aggaggccaccgaagcucggggac

SEQ ID NO: 35607 - RNA, 24 nt, Human
ugaaaguaggcugcacagcuaaau

SEQ ID NO: 35608 - RNA, 24 nt, Human
uacaauccugagaaccuggccacc

SEQ ID NO: 35609 - RNA, 24 nt, Human
ugugcagaagaaauggaaggauuc

SEQ ID NO: 35610 - RNA, 24 nt, Human
uaucaaggaagggcaggcgugaug

SEQ ID NO: 35611 - RNA, 24 nt, Human
uucaaauuucuuucuuuuuuaauu

SEQ ID NO: 35612 - RNA, 24 nt, Human
aggcacaguggcucacgccuguaa

SEQ ID NO: 35613 - RNA, 17 nt, Human
cacaggguuuagucucu

SEQ ID NO: 35614 - RNA, 24 nt, Human
uggcuuccauuugcuucaaauuug

SEQ ID NO: 35615 - RNA, 22 nt, Human
uaaacucucaaauuccccucgu

SEQ ID NO: 35616 - RNA, 24 nt, Human
ucugugguccagaagaaauuauuu

SEQ ID NO: 35617 - RNA, 24 nt, Human
uacgguagugaugaaauuauaagu

SEQ ID NO: 35618 - RNA, 23 nt, Human
ugugucauaugaguccucaagcu

SEQ ID NO: 35619 - RNA, 18 nt, Human
ugagaaugauuuaguagg

SEQ ID NO: 35620 - RNA, 24 nt, Human
uuugaacuggaagacuucuaaguu

SEQ ID NO: 35621 - RNA, 24 nt, Human
gugaagcaggauguauguggccuu

SEQ ID NO: 35622 - RNA, 24 nt, Human
uacgugagcguauaaucccaagau

SEQ ID NO: 35623 - RNA, 22 nt, Human
ucgcgguggccucuccaggguc

SEQ ID NO: 35624 - RNA, 24 nt, Human
ucuggccgacuccaggucccaaca

SEQ ID NO: 35625 - RNA, 24 nt, Human
uagcauugaaggacucggggauau

SEQ ID NO: 35626 - RNA, 24 nt, Human
uagcauugaaggacucggggauau

SEQ ID NO: 35627 - RNA, 24 nt, Human
uguauuggcucauuuauuugcaaa

SEQ ID NO: 35628 - RNA, 24 nt, Human
accacuguuggagguggggccugg

SEQ ID NO: 35629 - RNA, 24 nt, Human
uaaaauggccagagguuggggggc

SEQ ID NO: 35630 - RNA, 24 nt, Human
ggccugggcacccuuagaggggag

SEQ ID NO: 35631 - RNA, 24 nt, Human
agcuacugggugagcuggacuacc

SEQ ID NO: 35632 - RNA, 20 nt, Human
uacgcuggggcccaugcaga

SEQ ID NO: 35633 - RNA, 17 nt, Human
ugccaggaagcucuuug

SEQ ID NO: 35634 - RNA, 24 nt, Human
ugucauaggcaucgacgaggggca

SEQ ID NO: 35635 - RNA, 24 nt, Human
acaaggguucuaaaaacuuggaca

SEQ ID NO: 35636 - RNA, 18 nt, Human
ugaaaaagaaaaggaagg

SEQ ID NO: 35637 - RNA, 24 nt, Human
ugaggcaggagacuggcaugaacc

SEQ ID NO: 35638 - RNA, 22 nt, Human
uaacuuggugaaaccccggcuc

SEQ ID NO: 35639 - RNA, 24 nt, Human
cauggcacugagcagcuucuuuua

SEQ ID NO: 35640 - RNA, 24 nt, Human
uaugcuuucauucuggguggaaua

SEQ ID NO: 35641 - RNA, 24 nt, Human
ccagaacacagucacgaggauaau

SEQ ID NO: 35642 - RNA, 24 nt, Human
cacaaguugcagugugcuguuggc

SEQ ID NO: 35643 - RNA, 24 nt, Human
uggccuggcugaaggagcaucugu

SEQ ID NO: 35644 - RNA, 24 nt, Human
gggcagggaccuggacccccuuua

SEQ ID NO: 35645 - RNA, 24 nt, Human
gacccagcucucccccugcagcca

SEQ ID NO: 35646 - RNA, 24 nt, Human
ucacuggagccugcugggaacgug

SEQ ID NO: 35647 - RNA, 24 nt, Human
agaggagagugcuuggggcuugaa

SEQ ID NO: 35648 - RNA, 21 nt, Human
cuaaaguagcgugcuaggggc

SEQ ID NO: 35649 - RNA, 24 nt, Human
aggcaucgggcagccacuuucacu

SEQ ID NO: 35650 - RNA, 24 nt, Human
ucacuucuuugcagagccuuuuac

SEQ ID NO: 35651 - RNA, 24 nt, Human
ggcuaagugggacauuaguaacug

SEQ ID NO: 35652 - RNA, 24 nt, Human
uggcauggcucccuuuguccuucc

SEQ ID NO: 35653 - RNA, 24 nt, Human
agggagccuucaagcgagccuggc

SEQ ID NO: 35654 - RNA, 24 nt, Human
uaagguccugauccugaggaaguc

SEQ ID NO: 35655 - RNA, 24 nt, Human
ugagaugggugaccucugaaggag

SEQ ID NO: 35656 - RNA, 24 nt, Human
ccuuucuuucuguuuugagucgga

SEQ ID NO: 35657 - RNA, 24 nt, Human
uaagccauuuuaaggaguuucaug

SEQ ID NO: 35658 - RNA, 24 nt, Human
ugaaauacuaccuaguuacuucuu

SEQ ID NO: 35659 - RNA, 24 nt, Human
guuccaagcuacuucuuucuuugc

SEQ ID NO: 35660 - RNA, 24 nt, Human
aaaaggaaaauaaggggggugggg

SEQ ID NO: 35661 - RNA, 21 nt, Human
uuacuugaacacuugaguggc

SEQ ID NO: 35662 - RNA, 24 nt, Human
acccccuuguagggauggaccacg

SEQ ID NO: 35663 - RNA, 24 nt, Human
uaaauggaaucauccaauaugugg

SEQ ID NO: 35664 - RNA, 24 nt, Human
auggauggguaccauguuccuuug

SEQ ID NO: 35665 - RNA, 24 nt, Human
uggaagaugcucaacaccuccucc

SEQ ID NO: 35666 - RNA, 24 nt, Human
ugaccaggaaauacaacgagcugc

SEQ ID NO: 35667 - RNA, 24 nt, Human
uggaagaugcucaacaccuccucc

SEQ ID NO: 35668 - RNA, 24 nt, Human
ugaccaggaaauacaacgagcugc

SEQ ID NO: 35669 - RNA, 24 nt, Human
ugaggaccagugcacugaguacau

SEQ ID NO: 35670 - RNA, 24 nt, Human
aggcagcggcuguggcagcccggc

SEQ ID NO: 35671 - RNA, 24 nt, Human
gcgcagcuucaggggccgcaaggg

SEQ ID NO: 35672 - RNA, 19 nt, Human
ucugaccggcuucaagcuc

SEQ ID NO: 35673 - RNA, 24 nt, Human
uauugcauagugacuaccauuuca

SEQ ID NO: 35674 - RNA, 24 nt, Human
uaaagugaagauaauauuccuuaa

SEQ ID NO: 35675 - RNA, 24 nt, Human
uccuugggaaaagggguagcaaag

SEQ ID NO: 35676 - RNA, 24 nt, Human
ugugucggcucugcuacuucaaga

SEQ ID NO: 35677 - RNA, 24 nt, Human
gaccguaauuguggcugcacugga

SEQ ID NO: 35678 - RNA, 24 nt, Human
ugucauaggcaucgacgaggggca

SEQ ID NO: 35679 - RNA, 24 nt, Human
ccuuauggggggccgaauaacauu

SEQ ID NO: 35680 - RNA, 24 nt, Human
uagaacucaguuccaguacuguaa

SEQ ID NO: 35681 - RNA, 24 nt, Human
cuaggagacaaaaauguugauccc

SEQ ID NO: 35682 - RNA, 24 nt, Human
ucugcaaugaaaucauguugacug

SEQ ID NO: 35683 - RNA, 24 nt, Human
ucacuuaggggucaggaguucaag

SEQ ID NO: 35684 - RNA, 24 nt, Human
uugaaucugggaggcggagguugc

SEQ ID NO: 35685 - RNA, 24 nt, Human
ucaugcccgguaauccccagcacu

SEQ ID NO: 35686 - RNA, 24 nt, Human
ggaucugucuagcuuuuggccacu

SEQ ID NO: 35687 - RNA, 24 nt, Human
uuaucugcuguuccgacuugguuu

SEQ ID NO: 35688 - RNA, 24 nt, Human
uggguggaaaacauuggcucuucc

SEQ ID NO: 35689 - RNA, 24 nt, Human
uggcuugcaaccuggagaccucug

SEQ ID NO: 35690 - RNA, 24 nt, Human
ucucaggguccauaauuuguguag

SEQ ID NO: 35691 - RNA, 24 nt, Human
auggcagcuauucuuuggguaaac

SEQ ID NO: 35692 - RNA, 24 nt, Human
cguaagcagugguuauaaagagcu

SEQ ID NO: 35693 - RNA, 24 nt, Human
uacugaauuugaaacugaccuuuu

SEQ ID NO: 35694 - RNA, 24 nt, Human
cauggcuucuguuuccuuggggcc

SEQ ID NO: 35695 - RNA, 24 nt, Human
ugaggaacuaacugauuaguuguu

SEQ ID NO: 35696 - RNA, 24 nt, Human
gcccuucggaagccccggcgccag

SEQ ID NO: 35697 - RNA, 24 nt, Human
uaccgaugggaaguccuuauuauu

SEQ ID NO: 35698 - RNA, 24 nt, Human
cuccuggguuaguggccgcucaca

SEQ ID NO: 35699 - RNA, 24 nt, Human
uauuuuguugcugaucaaauacug

SEQ ID NO: 35700 - RNA, 24 nt, Human
uuguuuuguuuuuaaauaagaaua

SEQ ID NO: 35701 - RNA, 24 nt, Human
uguggucggguguuugcuggugcc

SEQ ID NO: 35702 - RNA, 23 nt, Human
cuugcauauuggagagugcaugu

SEQ ID NO: 35703 - RNA, 24 nt, Human
uaugccauauucauaaauuuaaaa

SEQ ID NO: 35704 - RNA, 24 nt, Human
uaggguauuucuccuugauaaaug

SEQ ID NO: 35705 - RNA, 21 nt, Human
uaccagugccacucugacagg

SEQ ID NO: 35706 - RNA, 24 nt, Human
ccaggacacuucugaguacaucau

SEQ ID NO: 35707 - RNA, 20 nt, Human
ccgcgccgccuuugugcugc

SEQ ID NO: 35708 - RNA, 24 nt, Human
agggagcuugagaaucagaucugu

SEQ ID NO: 35709 - RNA, 24 nt, Human
uagcaugcccagcccacagagagc

SEQ ID NO: 35710 - RNA, 24 nt, Human
ccacagagcagggggcaaaguucu

SEQ ID NO: 35711 - RNA, 24 nt, Human
uugagagcuguauuuagguaaaug

SEQ ID NO: 35712 - RNA, 24 nt, Human
ucacugcaaccucugccucccggg

SEQ ID NO: 35713 - RNA, 19 nt, Human
ccagucuacuagaaggggg

SEQ ID NO: 35714 - RNA, 23 nt, Human
uagggaccaaacucaaagguuuc

SEQ ID NO: 35715 - RNA, 24 nt, Human
aacacuugauacuagucugaugau

SEQ ID NO: 35716 - RNA, 24 nt, Human
uccuuuuuauucaaaugaaucaga

SEQ ID NO: 35717 - RNA, 24 nt, Human
aauugggccaaucagaaugguuau

SEQ ID NO: 35718 - RNA, 24 nt, Human
gagcaggaccggggcugaguaaau

SEQ ID NO: 35719 - RNA, 24 nt, Human
ucccggggcgucuucgugcagugg

SEQ ID NO: 35720 - RNA, 24 nt, Human
aggaaucagagaucauugauuucu

SEQ ID NO: 35721 - RNA, 24 nt, Human
uaagugcuccaaggagguggccac

SEQ ID NO: 35722 - RNA, 24 nt, Human
uuuuccuccugguccuccaaaaug

SEQ ID NO: 35723 - RNA, 24 nt, Human
uccacaggccuuggccagcggggg

SEQ ID NO: 35724 - RNA, 24 nt, Human
uaggaccucgccaucucccuuaau

SEQ ID NO: 35725 - RNA, 19 nt, Human
uuugcauaaaacaugcauu

SEQ ID NO: 35726 - RNA, 24 nt, Human
ugaguuaacugaucgguacuauug

SEQ ID NO: 35727 - RNA, 24 nt, Human
ucacugugcugcgugguggugugg

SEQ ID NO: 35728 - RNA, 24 nt, Human
ugugaaagaggcccacagguacuu

SEQ ID NO: 35729 - RNA, 24 nt, Human
gaauguacccgauguccacuaaca

SEQ ID NO: 35730 - RNA, 24 nt, Human
ggagguugcagugagcugagaugg

SEQ ID NO: 35731 - RNA, 24 nt, Human
ugccagaagacacucagcgaccug

SEQ ID NO: 35732 - RNA, 24 nt, Human
ucagagacaucuauuuuucugggc

SEQ ID NO: 35733 - RNA, 24 nt, Human
ucgccggccguucccguucccggc

SEQ ID NO: 35734 - RNA, 24 nt, Human
ccccuuuucccaguauuacugaau

SEQ ID NO: 35735 - RNA, 24 nt, Human
cccacacuaaaccugggacuacac

SEQ ID NO: 35736 - RNA, 24 nt, Human
uggcuugggacaagcuggucaggu

SEQ ID NO: 35737 - RNA, 24 nt, Human
ugagaauggcaaaauuagucgccu

SEQ ID NO: 35738 - RNA, 24 nt, Human
uacaccacucccaagaagaauaag

SEQ ID NO: 35739 - RNA, 24 nt, Human
ccucgagaggggggaucucaucag

SEQ ID NO: 35740 - RNA, 22 nt, Human
cauuaguggggaggaggguggg

SEQ ID NO: 35741 - RNA, 24 nt, Human
gauuacaaauaaggccucucauuu

SEQ ID NO: 35742 - RNA, 24 nt, Human
uaaaugcauuuuauuuuuagacaa

SEQ ID NO: 35743 - RNA, 24 nt, Human
caggacccgucgccaugggccgug

SEQ ID NO: 35744 - RNA, 24 nt, Human
uugaaggcuggccgggcguaccac

SEQ ID NO: 35745 - RNA, 24 nt, Human
uccagugcuuugagaagccgacgu

SEQ ID NO: 35746 - RNA, 24 nt, Human
accacauuuaaaauugcuuagaau

SEQ ID NO: 35747 - RNA, 24 nt, Human
aggcugcagucucccaaguagcug

SEQ ID NO: 35748 - RNA, 24 nt, Human
uaaaaugacugggugaagccgaac

SEQ ID NO: 35749 - RNA, 24 nt, Human
ccagggccauggcgaacccgaagc

SEQ ID NO: 35750 - RNA, 24 nt, Human
uagcucaaccuggugcuggacgag

SEQ ID NO: 35751 - RNA, 24 nt, Human
uaggagaacguaggguagucaagc

SEQ ID NO: 35752 - RNA, 24 nt, Human
ugaucuggcuggcuaggcgggugu

SEQ ID NO: 35753 - RNA, 24 nt, Human
ccucgagaggggggaucucaucag

SEQ ID NO: 35754 - RNA, 18 nt, Human
ugaagaaaauaaaauaaa

SEQ ID NO: 35755 - RNA, 24 nt, Human
uugcugcucaaacgaacccccaau

SEQ ID NO: 35756 - RNA, 24 nt, Human
ggccggagaagugcgccugggugc

SEQ ID NO: 35757 - RNA, 19 nt, Human
cccgccccccggccggggc

SEQ ID NO: 35758 - RNA, 23 nt, Human
uaacggguggauugccaccuggg

SEQ ID NO: 35759 - RNA, 18 nt, Human
ccagcggcagacucccag

SEQ ID NO: 35760 - RNA, 22 nt, Human
uucacggauggcaagucaccgu

SEQ ID NO: 35761 - RNA, 24 nt, Human
ucugaucuauaaaugcgguggcau

SEQ ID NO: 35762 - RNA, 24 nt, Human
ugagcgcgcagcugcgcgaggccg

SEQ ID NO: 35763 - RNA, 24 nt, Human
aaccaugcuggagaccagagcaac

SEQ ID NO: 35764 - RNA, 24 nt, Human
uauuagaagaaugaacuaacgugu

SEQ ID NO: 35765 - RNA, 24 nt, Human
uugcauggcccaccggggucgaag

SEQ ID NO: 35766 - RNA, 24 nt, Human
caccccaaucucugcccugccugc

SEQ ID NO: 35767 - RNA, 24 nt, Human
caugcccccuuuggcuugggggcc

SEQ ID NO: 35768 - RNA, 24 nt, Human
aaguggcagcaggacauacggcaa

SEQ ID NO: 35769 - RNA, 24 nt, Human
caccaaaagacauagagauucuua

SEQ ID NO: 35770 - RNA, 24 nt, Human
agcuaugacacaguggugcaaaca

SEQ ID NO: 35771 - RNA, 24 nt, Human
cacagcuuccuaauccuuaucuca

SEQ ID NO: 35772 - RNA, 24 nt, Human
uauggcaagucacuuugacagaca

SEQ ID NO: 35773 - RNA, 24 nt, Human
ugagaauggcaaaauuagucgccu

SEQ ID NO: 35774 - RNA, 24 nt, Human
uacaccacucccaagaagaauaag

SEQ ID NO: 35775 - RNA, 24 nt, Human
aacacguucuucugaaagguagcu

SEQ ID NO: 35776 - RNA, 24 nt, Human
uguaacaauacauuccaggccuuu

SEQ ID NO: 35777 - RNA, 24 nt, Human
cauuaccauucguuaugaaauaac

SEQ ID NO: 35778 - RNA, 17 nt, Human
cacacugucaaauuugc

SEQ ID NO: 35779 - RNA, 24 nt, Human
uaucgugaacagaaggcgccuggu

SEQ ID NO: 35780 - RNA, 24 nt, Human
aaggagcagcgccucugcugcugc

SEQ ID NO: 35781 - RNA, 24 nt, Human
aagcagcccaggacacuguugaau

SEQ ID NO: 35782 - RNA, 24 nt, Human
ugaggugugugaccacuuuacaga

SEQ ID NO: 35783 - RNA, 24 nt, Human
uauuacugcacaaaucuggaagga

SEQ ID NO: 35784 - RNA, 24 nt, Human
uaucagacuaaguaauuucccuuu

SEQ ID NO: 35785 - RNA, 24 nt, Human
uuucauaguuaaguaucauguuug

SEQ ID NO: 35786 - RNA, 24 nt, Human
aacccagaagaaacgagggagccc

SEQ ID NO: 35787 - RNA, 24 nt, Human
cagcgggcuggccugggguccccc

SEQ ID NO: 35788 - RNA, 24 nt, Human
ucaguaaauguauaaaaacacuuu

SEQ ID NO: 35789 - RNA, 24 nt, Human
ugaggaggaauucgcuuccagccu

SEQ ID NO: 35790 - RNA, 24 nt, Human
uagaaaaaagaaaaaaauccuggu

SEQ ID NO: 35791 - RNA, 24 nt, Human
ucgcccaggcuggagugcaguguc

SEQ ID NO: 35792 - RNA, 24 nt, Human
uaaguaauuauuuucacuugguug

SEQ ID NO: 35793 - RNA, 24 nt, Human
ccaaagugcugggauuacaggcgu

SEQ ID NO: 35794 - RNA, 24 nt, Human
cagaagccuguggacaggcccgug

SEQ ID NO: 35795 - RNA, 23 nt, Human
uuuucagaagggagccuguugac

SEQ ID NO: 35796 - RNA, 24 nt, Human
uuaguauuauuuauuugacaacuc

SEQ ID NO: 35797 - RNA, 24 nt, Human
uuuagaggcagacaacagcagggu

SEQ ID NO: 35798 - RNA, 24 nt, Human
cuucaggggcugcugcgccucucu

SEQ ID NO: 35799 - RNA, 24 nt, Human
ggacuuggaaggcuggugugacgu

SEQ ID NO: 35800 - RNA, 24 nt, Human
aagcacaggucauagacccugagg

SEQ ID NO: 35801 - RNA, 24 nt, Human
ugaguucaagauuuggcaaugucu

SEQ ID NO: 35802 - RNA, 23 nt, Human
aaggaagauggugaucagacagc

SEQ ID NO: 35803 - RNA, 19 nt, Human
ccccggggcccugguuggg

SEQ ID NO: 35804 - RNA, 24 nt, Human
uccccgaggccuggcuuauggugg

SEQ ID NO: 35805 - RNA, 22 nt, Human
aucucuuuaaugauuauuaaau

SEQ ID NO: 35806 - RNA, 24 nt, Human
agugcagaccucugacccuggagu

SEQ ID NO: 35807 - RNA, 24 nt, Human
ccuugggucgucgccugggccgcc

SEQ ID NO: 35808 - RNA, 24 nt, Human
ugucauguggagcccuguccagag

SEQ ID NO: 35809 - RNA, 24 nt, Human
caggacccgucgccaugggccgug

SEQ ID NO: 35810 - RNA, 24 nt, Human
cucauuguaaccuccaccucuugg

SEQ ID NO: 35811 - RNA, 24 nt, Human
gagaugggguuucaucauauuggu

SEQ ID NO: 35812 - RNA, 24 nt, Human
aucacacuauuugugaacacauua

SEQ ID NO: 35813 - RNA, 24 nt, Human
agaguuguucauccagggagacag

SEQ ID NO: 35814 - RNA, 24 nt, Human
ggccugggcacccuuagaggggag

SEQ ID NO: 35815 - RNA, 24 nt, Human
agcuacugggugagcuggacuacc

SEQ ID NO: 35816 - RNA, 24 nt, Human
uaaugggucucaaaauucugggac

SEQ ID NO: 35817 - RNA, 24 nt, Human
uauuagggauaauauucauuuagc

SEQ ID NO: 35818 - RNA, 19 nt, Human
ucguguggaguauggaagg

SEQ ID NO: 35819 - RNA, 20 nt, Human
aagaagcggauuagugcccc

SEQ ID NO: 35820 - RNA, 24 nt, Human
ugccaaggauguagaauaaauaag

SEQ ID NO: 35821 - RNA, 24 nt, Human
uguccuggaaagccacaaagucga

SEQ ID NO: 35822 - RNA, 22 nt, Human
ugagauuaucaaaagauguguc

SEQ ID NO: 35823 - RNA, 24 nt, Human
ugagaaggagaugagauucaguac

SEQ ID NO: 35824 - RNA, 24 nt, Human
agacauaauggggagagggauggc

SEQ ID NO: 35825 - RNA, 23 nt, Human
uuuguggaggccuucagaccccc

SEQ ID NO: 35826 - RNA, 24 nt, Human
uggaaaccccuccaccucccacuu

SEQ ID NO: 35827 - RNA, 24 nt, Human
ugacguggaggagccgaggcccac

SEQ ID NO: 35828 - RNA, 24 nt, Human
ucagcaccccucggcccgacgcac

SEQ ID NO: 35829 - RNA, 24 nt, Human
uagaggacuccaaaacaaaacggg

SEQ ID NO: 35830 - RNA, 24 nt, Human
aacacuugauacuagucugaugau

SEQ ID NO: 35831 - RNA, 24 nt, Human
gugcugggauaacuggcuaucaca

SEQ ID NO: 35832 - RNA, 24 nt, Human
uccuaagaaugugggaagauuagc

SEQ ID NO: 35833 - RNA, 24 nt, Human
uacugggugaauagcacuuuccuu

SEQ ID NO: 35834 - RNA, 24 nt, Human
uggcuagauguuuuguggaagauc

SEQ ID NO: 35835 - RNA, 24 nt, Human
ucaguuggaagacacccugaaauc

SEQ ID NO: 35836 - RNA, 24 nt, Human
ucgguucgcuggagagaggcgagc

SEQ ID NO: 35837 - RNA, 24 nt, Human
ugggcccagcugcggcgggggcug

SEQ ID NO: 35838 - RNA, 24 nt, Human
auggugccgagugguaacauggga

SEQ ID NO: 35839 - RNA, 24 nt, Human
ugcaaaaccagcguggcggccgcg

SEQ ID NO: 35840 - RNA, 24 nt, Human
acgccaugaaagcugccauggccu

SEQ ID NO: 35841 - RNA, 24 nt, Human
cgugaaggcuaucacagaagaugg

SEQ ID NO: 35842 - RNA, 23 nt, Human
ucugcgaaacucacacagcaaag

SEQ ID NO: 35843 - RNA, 20 nt, Human
uaacauagauggaaacaagu

SEQ ID NO: 35844 - RNA, 20 nt, Human
ucaugggagagaaaacauga

SEQ ID NO: 35845 - RNA, 24 nt, Human
guugcaccaucccugguuucucca

SEQ ID NO: 35846 - RNA, 24 nt, Human
gugaucagguaugcuguuagauau

SEQ ID NO: 35847 - RNA, 20 nt, Human
uaagaugacuauaguagagg

SEQ ID NO: 35848 - RNA, 24 nt, Human
uguugugaggaucaaauggaagga

SEQ ID NO: 35849 - RNA, 24 nt, Human
uuagcauuggaauucugaaggcuu

SEQ ID NO: 35850 - RNA, 24 nt, Human
uuagucagguuugagaaagcuuuu

SEQ ID NO: 35851 - RNA, 21 nt, Human
ugauaugcuguuagguuccug

SEQ ID NO: 35852 - RNA, 24 nt, Human
augaaguacaaauuuuuauaaaau

SEQ ID NO: 35853 - RNA, 24 nt, Human
ugagaauggaagaaauggauuuau

SEQ ID NO: 35854 - RNA, 20 nt, Human
uuaguccuugaaguuuuaag

SEQ ID NO: 35855 - RNA, 24 nt, Human
uaccuuaugggaaccuugcauggg

SEQ ID NO: 35856 - RNA, 24 nt, Human
ucccagaccgacgcuuuguucccc

SEQ ID NO: 35857 - RNA, 24 nt, Human
uaugaugccaacauuacucaaagc

SEQ ID NO: 35858 - RNA, 24 nt, Human
uacuuuagucauauguugauaaaa

SEQ ID NO: 35859 - RNA, 24 nt, Human
uccaggacaagaaccuguguucca

SEQ ID NO: 35860 - RNA, 24 nt, Human
ugccagggaccacaggcacccucg

SEQ ID NO: 35861 - RNA, 24 nt, Human
ucgcaguauggucugcaggucggg

SEQ ID NO: 35862 - RNA, 24 nt, Human
uuaguggcagguuaguugugugua

SEQ ID NO: 35863 - RNA, 24 nt, Human
agggggcaaaggcuacgggucaga

SEQ ID NO: 35864 - RNA, 24 nt, Human
cguuggaggccgccuuuucagaag

SEQ ID NO: 35865 - RNA, 24 nt, Human
uguacaguuucuccuaagaagaag

SEQ ID NO: 35866 - RNA, 22 nt, Human
uucaucuuguagcagcucugcc

SEQ ID NO: 35867 - RNA, 24 nt, Human
ggacaaggggcagacgagagcugu

SEQ ID NO: 35868 - RNA, 24 nt, Human
uuaagaguuguuuuguguccuauc

SEQ ID NO: 35869 - RNA, 24 nt, Human
ucacucaggagcauguuauucaau

SEQ ID NO: 35870 - RNA, 24 nt, Human
acuuagcuucaccuuugccauauc

SEQ ID NO: 35871 - RNA, 24 nt, Human
uagguugugucacuauuauuguuc

SEQ ID NO: 35872 - RNA, 24 nt, Human
uccaccaacaaccccucccaggcu

SEQ ID NO: 35873 - RNA, 17 nt, Human
uguccuggaugcugggc

SEQ ID NO: 35874 - RNA, 24 nt, Human
uagaauacauugauacaaaguaca

SEQ ID NO: 35875 - RNA, 24 nt, Human
cauugugugggaauucgcaguguu

SEQ ID NO: 35876 - RNA, 24 nt, Human
agacaggcuggcacagccccaggc

SEQ ID NO: 35877 - RNA, 24 nt, Human
aagcagcaccaauggggaugaccc

SEQ ID NO: 35878 - RNA, 24 nt, Human
uaccuaguaagaguagacuucuuu

SEQ ID NO: 35879 - RNA, 24 nt, Human
cugcagugaccccuccuggccagc

SEQ ID NO: 35880 - RNA, 24 nt, Human
uauaaaccuuggcuuuucauaagc

SEQ ID NO: 35881 - RNA, 24 nt, Human
ccagucuugcaagguuaacuucuc

SEQ ID NO: 35882 - RNA, 24 nt, Human
uacuuuuuucggaguuagggaggg

SEQ ID NO: 35883 - RNA, 24 nt, Human
uucaggcacauccaaagaguuccu

SEQ ID NO: 35884 - RNA, 24 nt, Human
ugcugcguaaucacgguuccucga

SEQ ID NO: 35885 - RNA, 24 nt, Human
gugaagcuuggaguccauacuuug

SEQ ID NO: 35886 - RNA, 24 nt, Human
gcgcgucgaccugcgccaucugcc

SEQ ID NO: 35887 - RNA, 24 nt, Human
acgacauuccccacgucuggccga

SEQ ID NO: 35888 - RNA, 24 nt, Human
cagcaggaagugcuggugaccccg

SEQ ID NO: 35889 - RNA, 24 nt, Human
cggcauggagaucgaugucgcgcu

SEQ ID NO: 35890 - RNA, 24 nt, Human
uuaaaauauauuagcaggucauua

SEQ ID NO: 35891 - RNA, 24 nt, Human
ugaguugguggaaaugugggcguu

SEQ ID NO: 35892 - RNA, 24 nt, Human
agacuggaguuuguuacugcaaac

SEQ ID NO: 35893 - RNA, 24 nt, Human
ugaggcggcauggaucucagcgag

SEQ ID NO: 35894 - RNA, 24 nt, Human
uguuauuguccccugccucgccug

SEQ ID NO: 35895 - RNA, 24 nt, Human
cgccugugcccgcggugugccgca

SEQ ID NO: 35896 - RNA, 24 nt, Human
gcggcggaacuuugcuacaagggg

SEQ ID NO: 35897 - RNA, 24 nt, Human
gaucacagggucuaaggguggcca

SEQ ID NO: 35898 - RNA, 24 nt, Human
aguggccauggcuagagggguaaa

SEQ ID NO: 35899 - RNA, 24 nt, Human
ugugaaagugaaacaagcaugagu

SEQ ID NO: 35900 - RNA, 24 nt, Human
gggcaggagaggcccagggcgugc

SEQ ID NO: 35901 - RNA, 24 nt, Human
uugcaugggaagcuugaguauugc

SEQ ID NO: 35902 - RNA, 24 nt, Human
uaccuucgugagggacuccguagg

SEQ ID NO: 35903 - RNA, 24 nt, Human
ugagaauggcaaaauuagucgccu

SEQ ID NO: 35904 - RNA, 24 nt, Human
uacaccacucccaagaagaauaag

SEQ ID NO: 35905 - RNA, 24 nt, Human
gagcggccgcgaagaggugacacc

SEQ ID NO: 35906 - RNA, 24 nt, Human
uggaaaaauucagaggccuaaagu

SEQ ID NO: 35907 - RNA, 24 nt, Human
uagaauguaaaaagucauuuuaga

SEQ ID NO: 35908 - RNA, 24 nt, Human
uauuuuaucacaggcuuacacuac

SEQ ID NO: 35909 - RNA, 24 nt, Human
aggcagaucacaaggucaggaguu

SEQ ID NO: 35910 - RNA, 24 nt, Human
acccuggucuggucucagaaauca

SEQ ID NO: 35911 - RNA, 24 nt, Human
caggugaagagugagguugucaug

SEQ ID NO: 35912 - RNA, 24 nt, Human
uuuaaguauucagcauuuuccagg

SEQ ID NO: 35913 - RNA, 24 nt, Human
uaugagcaguggaagaauuucgau

SEQ ID NO: 35914 - RNA, 24 nt, Human
cgccaaguuuuucgauuauagcua

SEQ ID NO: 35915 - RNA, 24 nt, Human
ucgaauggacacauuaccagugaa

SEQ ID NO: 35916 - RNA, 24 nt, Human
uccaccaacaaccccucccaggcu

SEQ ID NO: 35917 - RNA, 24 nt, Human
cuacggguggcucccagaacaucc

SEQ ID NO: 35918 - RNA, 24 nt, Human
ucacuguaaccuugaacuccuggg

SEQ ID NO: 35919 - RNA, 24 nt, Human
gcggacccaggccuggggcgagcg

SEQ ID NO: 35920 - RNA, 23 nt, Human
uggaacagggccgugugcgggcc

SEQ ID NO: 35921 - RNA, 24 nt, Human
cuuucaggcccgucucaagagcug

SEQ ID NO: 35922 - RNA, 24 nt, Human
uggaaugcagugauacuaacaugg

SEQ ID NO: 35923 - RNA, 24 nt, Human
cauccugggcucaaccuauccucc

SEQ ID NO: 35924 - RNA, 24 nt, Human
ucuaagucaguuguuucucgggcu

SEQ ID NO: 35925 - RNA, 24 nt, Human
uugguccugacuacuaccauuucg

SEQ ID NO: 35926 - RNA, 24 nt, Human
aaagauuuuuuuuuucuuaagaga

SEQ ID NO: 35927 - RNA, 24 nt, Human
cagcaguaggggcugggcuuccag

SEQ ID NO: 35928 - RNA, 24 nt, Human
uugaagccaguggggcaccaaucc

SEQ ID NO: 35929 - RNA, 19 nt, Human
uaccauggcgagggucaca

SEQ ID NO: 35930 - RNA, 24 nt, Human
gugguugguguaaaugagugaggc

SEQ ID NO: 35931 - RNA, 24 nt, Human
ugaguagguggccugcaguaaugu

SEQ ID NO: 35932 - RNA, 24 nt, Human
uugcaggcugagggagagaaagcu

SEQ ID NO: 35933 - RNA, 24 nt, Human
uggcauuugcagauguucagcccc

SEQ ID NO: 35934 - RNA, 24 nt, Human
ucccugaauuuucccccgggacaa

SEQ ID NO: 35935 - RNA, 24 nt, Human
aagaugccaguggcggugauggcg

SEQ ID NO: 35936 - RNA, 24 nt, Human
uggcagagagauuucccugggauc

SEQ ID NO: 35937 - RNA, 24 nt, Human
guguauggucagcuucuagcuuua

SEQ ID NO: 35938 - RNA, 24 nt, Human
uauuguugauuaaagaaaaucuag

SEQ ID NO: 35939 - RNA, 24 nt, Human
gaaggcacaacaguuaauggcugu

SEQ ID NO: 35940 - RNA, 18 nt, Human
ucaggcagugauaugagc

SEQ ID NO: 35941 - RNA, 24 nt, Human
augaagaucaucaagggcuccagu

SEQ ID NO: 35942 - RNA, 24 nt, Human
acguaggucaacucaguuaccuug

SEQ ID NO: 35943 - RNA, 24 nt, Human
ugagggaucuaaggcaccacuaug

SEQ ID NO: 35944 - RNA, 24 nt, Human
acguaggucaacucaguuaccuug

SEQ ID NO: 35945 - RNA, 24 nt, Human
uaugagggguguugucgucggugg

SEQ ID NO: 35946 - RNA, 24 nt, Human
ugggguaggggagaauauauugag

SEQ ID NO: 35947 - RNA, 24 nt, Human
uuggucaagggaaaacggggguau

SEQ ID NO: 35948 - RNA, 19 nt, Human
ccccagcaguccaagcucu

SEQ ID NO: 35949 - RNA, 24 nt, Human
aaagucacuuucacgaggugguca

SEQ ID NO: 35950 - RNA, 24 nt, Human
uuuguuggaauauauuuuaaaaau

SEQ ID NO: 35951 - RNA, 24 nt, Human
cauucuagcccauuaggcucccag

SEQ ID NO: 35952 - RNA, 24 nt, Human
uuaaagcaaauuaugauucacuca

SEQ ID NO: 35953 - RNA, 24 nt, Human
aggcagcucacgcgguugucgugg

SEQ ID NO: 35954 - RNA, 24 nt, Human
uugcaguugaagucgucguagcca

SEQ ID NO: 35955 - RNA, 24 nt, Human
uaaugggucucaaaauucugugac

SEQ ID NO: 35956 - RNA, 24 nt, Human
uauuagggauaauauucauuuagc

SEQ ID NO: 35957 - RNA, 24 nt, Human
uuaaauggccaauugaaacaaaca

SEQ ID NO: 35958 - RNA, 24 nt, Human
ugcauuguuaucauuaaccagucu

SEQ ID NO: 35959 - RNA, 24 nt, Human
uggcauggacuggcuuaacgacac

SEQ ID NO: 35960 - RNA, 24 nt, Human
uucauccccuaccucaucccaggc

SEQ ID NO: 35961 - RNA, 19 nt, Human
gugguuguccuuguuaucc

SEQ ID NO: 35962 - RNA, 24 nt, Human
uggggaaggguaugagguccuaug

SEQ ID NO: 35963 - RNA, 22 nt, Human
cucgggguucuccggggaaucc

SEQ ID NO: 35964 - RNA, 24 nt, Human
agaucagucgaugaucuaguaggc

SEQ ID NO: 35965 - RNA, 20 nt, Human
gggcuggggagcagaucuuc

SEQ ID NO: 35966 - RNA, 24 nt, Human
agggaucaccucagccaacucugc

SEQ ID NO: 35967 - RNA, 24 nt, Human
aaugguacagcaguuacaagagga

SEQ ID NO: 35968 - RNA, 24 nt, Human
gccuugugauacuguggaacugua

SEQ ID NO: 35969 - RNA, 24 nt, Human
ugagagagggcuaguaacugaaau

SEQ ID NO: 35970 - RNA, 24 nt, Human
ucaggaacagcuucuucuaaggga

SEQ ID NO: 35971 - RNA, 24 nt, Human
aaagaacuguaaaugcaauguaaa

SEQ ID NO: 35972 - RNA, 24 nt, Human
ugagaagaaaauaacagacaauau

SEQ ID NO: 35973 - RNA, 24 nt, Human
uaguuuuugugcugagaacagaua

SEQ ID NO: 35974 - RNA, 24 nt, Human
aggcaucccagucuucggucucca

SEQ ID NO: 35975 - RNA, 24 nt, Human
cguuuguugugaaucguacaggcu

SEQ ID NO: 35976 - RNA, 24 nt, Human
agagcucgggggaauaggggugug

SEQ ID NO: 35977 - RNA, 24 nt, Human
aggcagaugccacaccccaauuuc

SEQ ID NO: 35978 - RNA, 22 nt, Human
uucucauuuguucuccacgccc

SEQ ID NO: 35979 - RNA, 24 nt, Human
gaacugguccuuucacuuugagau

SEQ ID NO: 35980 - RNA, 24 nt, Human
uaucaagucagcacacaccuuuuc

SEQ ID NO: 35981 - RNA, 24 nt, Human
aucaugaguaucaaauuaaaugua

SEQ ID NO: 35982 - RNA, 24 nt, Human
acuccauugugguccauuuucuaa

SEQ ID NO: 35983 - RNA, 24 nt, Human
aagcagaggcuucucuccccaaga

SEQ ID NO: 35984 - RNA, 24 nt, Human
uguuuugugcccaggcuaccuugu

SEQ ID NO: 35985 - RNA, 24 nt, Human
gggcaucguggcgaccgaugcagg

SEQ ID NO: 35986 - RNA, 17 nt, Human
caucacagggugggccu

SEQ ID NO: 35987 - RNA, 23 nt, Human
ucacuuagucccugcgggugccu

SEQ ID NO: 35988 - RNA, 24 nt, Human
uguugaggaacuccccgaagugca

SEQ ID NO: 35989 - RNA, 24 nt, Human
aggggguggugcuuaccggugaac

SEQ ID NO: 35990 - RNA, 24 nt, Human
ugggugcuccaugaagagaugggg

SEQ ID NO: 35991 - RNA, 22 nt, Human
uaagugacuacgacggguuguu

SEQ ID NO: 35992 - RNA, 24 nt, Human
uccacaguuucuccggagggcuau

SEQ ID NO: 35993 - RNA, 24 nt, Human
caccggcagccgcagaggcacccc

SEQ ID NO: 35994 - RNA, 24 nt, Human
ccaggacccagaggacacaugcag

SEQ ID NO: 35995 - RNA, 21 nt, Human
uccaagggauggaaagucacc

SEQ ID NO: 35996 - RNA, 24 nt, Human
caagguguuaacaggccugggaau

SEQ ID NO: 35997 - RNA, 24 nt, Human
uccgucaugaucaacaaggccacg

SEQ ID NO: 35998 - RNA, 24 nt, Human
gcgcgggucaaccuggccacgugc

SEQ ID NO: 35999 - RNA, 24 nt, Human
ugcuuguggggaagcaggcccggg

SEQ ID NO: 36000 - RNA, 24 nt, Human
ugagaucaauaagaaauguucagg

SEQ ID NO: 36001 - RNA, 24 nt, Human
uggaagugcuucacgaggaaugcc

SEQ ID NO: 36002 - RNA, 24 nt, Human
gguuacgccaucuuuaagguucua

SEQ ID NO: 36003 - RNA, 24 nt, Human
uaaagcuaaaacauuugagaaauu

SEQ ID NO: 36004 - RNA, 24 nt, Human
cuugcucauuuauuugaaagaguc

SEQ ID NO: 36005 - RNA, 24 nt, Human
uagccuaguaauuagugguaagca

SEQ ID NO: 36006 - RNA, 24 nt, Human
cggaggucgagagggggcguucuc

SEQ ID NO: 36007 - RNA, 24 nt, Human
uggcauccuccuugccacaggucu

SEQ ID NO: 36008 - RNA, 24 nt, Human
uuuauccgcuuagcauggcccccg

SEQ ID NO: 36009 - RNA, 24 nt, Human
ucacauggggagaaaccuuggaca

SEQ ID NO: 36010 - RNA, 24 nt, Human
ugugcuaacuuuaauugauuccua

SEQ ID NO: 36011 - RNA, 24 nt, Human
ugaggguaaaacgggaaccgagga

SEQ ID NO: 36012 - RNA, 24 nt, Human
augcugcccugggacccaacuggu

SEQ ID NO: 36013 - RNA, 24 nt, Human
uggccugaugauccacagcggaga

SEQ ID NO: 36014 - RNA, 24 nt, Human
ucgcugacuggcauuuucacucgg

SEQ ID NO: 36015 - RNA, 24 nt, Human
caccgguguggcgccuggccgcgu

SEQ ID NO: 36016 - RNA, 24 nt, Human
uugaucuugaagaaacugggcgug

SEQ ID NO: 36017 - RNA, 23 nt, Human
uccgugcgcguugcugcggccgu

SEQ ID NO: 36018 - RNA, 24 nt, Human
ucauugguggugggaccauaauca

SEQ ID NO: 36019 - RNA, 24 nt, Human
aggaaggagauauagugaagagga

SEQ ID NO: 36020 - RNA, 24 nt, Human
ucagugcgggaaccaugcagacug

SEQ ID NO: 36021 - RNA, 24 nt, Human
uaggacacuuaacugcagggcacu

SEQ ID NO: 36022 - RNA, 24 nt, Human
ccucuguuccgaccuuucccgugc

SEQ ID NO: 36023 - RNA, 24 nt, Human
ucucaugucagaugugggccaaac

SEQ ID NO: 36024 - RNA, 24 nt, Human
cgagaagaacacaugguacuccag

SEQ ID NO: 36025 - RNA, 21 nt, Human
uagaaggcaaaugcaauuaua

SEQ ID NO: 36026 - RNA, 24 nt, Human
uuccaugauuuaaucuugccgccc

SEQ ID NO: 36027 - RNA, 24 nt, Human
uacugggucuugagcucuagagag

SEQ ID NO: 36028 - RNA, 24 nt, Human
uuaauacauuugugauuauggaau

SEQ ID NO: 36029 - RNA, 24 nt, Human
aggcugcuuucuugaagaaaacuu

SEQ ID NO: 36030 - RNA, 24 nt, Human
uggcaguagacucugaagcuaagg

SEQ ID NO: 36031 - RNA, 24 nt, Human
ccugccagucgugccucaucgcuu

SEQ ID NO: 36032 - RNA, 24 nt, Human
uggcaauguagagugacugugcug

SEQ ID NO: 36033 - RNA, 23 nt, Human
ugagcccaggagccugaaaccag

SEQ ID NO: 36034 - RNA, 24 nt, Human
uggaaaauuaguuaagggaaacgg

SEQ ID NO: 36035 - RNA, 24 nt, Human
augccuguaaggguuaacacauug

SEQ ID NO: 36036 - RNA, 24 nt, Human
uucagcuagaaaaaaaggagcaua

SEQ ID NO: 36037 - RNA, 24 nt, Human
uguguuuguagacuuggaacccac

SEQ ID NO: 36038 - RNA, 24 nt, Human
cacuacaccauuggcaaggagauc

SEQ ID NO: 36039 - RNA, 24 nt, Human
caccggucuucagggcuucuuggu

SEQ ID NO: 36040 - RNA, 24 nt, Human
uagcuugucggggacgguaaccgg

SEQ ID NO: 36041 - RNA, 24 nt, Human
acccagcaccccagguuuccacag

SEQ ID NO: 36042 - RNA, 24 nt, Human
uguuuauauuucuugguggugaaa

SEQ ID NO: 36043 - RNA, 24 nt, Human
aggcagucauauaggcacagaugc

SEQ ID NO: 36044 - RNA, 24 nt, Human
cguugcucaccgccgugcgccgca

SEQ ID NO: 36045 - RNA, 24 nt, Human
uauuucagauguuccugcaguaua

SEQ ID NO: 36046 - RNA, 24 nt, Human
uacugcuuccauucauuguuuacg

SEQ ID NO: 36047 - RNA, 24 nt, Human
uuacuguacacagaagugugugca

SEQ ID NO: 36048 - RNA, 20 nt, Human
uggaauguaaguaaaacuua

SEQ ID NO: 36049 - RNA, 24 nt, Human
uaaguuguaaacgucuuuuuaagc

SEQ ID NO: 36050 - RNA, 24 nt, Human
ugcagauuccuuuggccacuguau

SEQ ID NO: 36051 - RNA, 24 nt, Human
ucugaccacucuccugucauccag

SEQ ID NO: 36052 - RNA, 24 nt, Human
ugacuucaaagcccaugcaguagu

SEQ ID NO: 36053 - RNA, 24 nt, Human
ucuagcacauguaucaagacauca

SEQ ID NO: 36054 - RNA, 24 nt, Human
ugaggugaugaagaaaaucauuga

SEQ ID NO: 36055 - RNA, 24 nt, Human
uaagagcaguucagaugaugauca

SEQ ID NO: 36056 - RNA, 24 nt, Human
acugcagaaaauuauguguaucca

SEQ ID NO: 36057 - RNA, 22 nt, Human
uggaauuuucugggccgaauac

SEQ ID NO: 36058 - RNA, 24 nt, Human
ucuguggauugugaaguuuaucua

SEQ ID NO: 36059 - RNA, 24 nt, Human
uaauauguuaaaaacauuuugcuu

SEQ ID NO: 36060 - RNA, 24 nt, Human
ugucacauuccaagcagauuggcc

SEQ ID NO: 36061 - RNA, 24 nt, Human
uauaacauguaugcuuuucagaau

SEQ ID NO: 36062 - RNA, 24 nt, Human
uugaagccuuuugcaacuguccuu

SEQ ID NO: 36063 - RNA, 24 nt, Human
uguacauauacauaugcauacacu

SEQ ID NO: 36064 - RNA, 24 nt, Human
uucaagaaguagaugaaaaauuca

SEQ ID NO: 36065 - RNA, 24 nt, Human
agauauuuuuauagaaagcaauga

SEQ ID NO: 36066 - RNA, 24 nt, Human
ugagaacaaggucacggucagcug

SEQ ID NO: 36067 - RNA, 24 nt, Human
aauuugucagguggggauuucacc

SEQ ID NO: 36068 - RNA, 24 nt, Human
uagcuucauguuuguuucuaauga

SEQ ID NO: 36069 - RNA, 24 nt, Human
uuacauuaagcagaguaauuccag

SEQ ID NO: 36070 - RNA, 24 nt, Human
ugcaugggaagauuguaguuacuc

SEQ ID NO: 36071 - RNA, 24 nt, Human
uugcguggugcccgaagggcucuu

SEQ ID NO: 36072 - RNA, 24 nt, Human
ugccugugaaauccaaauuccagu

SEQ ID NO: 36073 - RNA, 24 nt, Human
uuuuccaugcacccugucauccuc

SEQ ID NO: 36074 - RNA, 24 nt, Human
ugggaauaccauagccaccuuuua

SEQ ID NO: 36075 - RNA, 24 nt, Human
gucaggugaaugacaaccaagugg

SEQ ID NO: 36076 - RNA, 24 nt, Human
uaacaguagauauguauauauuuu

SEQ ID NO: 36077 - RNA, 24 nt, Human
ugagaauuuuuuaacguaacuucc

SEQ ID NO: 36078 - RNA, 24 nt, Human
cacuguguucaauuuugaguuucc

SEQ ID NO: 36079 - RNA, 24 nt, Human
ugaaguggugaaaggaguuucuca

SEQ ID NO: 36080 - RNA, 21 nt, Human
ugagaacuugaaagcugcaga

SEQ ID NO: 36081 - RNA, 24 nt, Human
agauuacaggcaugagccacugca

SEQ ID NO: 36082 - RNA, 24 nt, Human
gcccugugaauaaugcugaaauga

SEQ ID NO: 36083 - RNA, 24 nt, Human
gaacugguccuuucacuuugagau

SEQ ID NO: 36084 - RNA, 24 nt, Human
uuaccagggguucgggacagccua

SEQ ID NO: 36085 - RNA, 24 nt, Human
uucuauagucauaucaucauguca

SEQ ID NO: 36086 - RNA, 24 nt, Human
uaaaugccacauuucguaacaaga

SEQ ID NO: 36087 - RNA, 24 nt, Human
agugguauguaguuuguuuacugu

SEQ ID NO: 36088 - RNA, 24 nt, Human
ugaaguggugaaaggaguuucuca

SEQ ID NO: 36089 - RNA, 21 nt, Human
ugagaacuugaaagcugcaga

SEQ ID NO: 36090 - RNA, 24 nt, Human
ucacugcguguugcgcaggagggu

SEQ ID NO: 36091 - RNA, 24 nt, Human
acucccauggcaucgaacuuuugu

SEQ ID NO: 36092 - RNA, 24 nt, Human
ugggaucgccugugaauugggaug

SEQ ID NO: 36093 - RNA, 24 nt, Human
gcagugggccccuagagagagcau

SEQ ID NO: 36094 - RNA, 24 nt, Human
ugugauguuugcaaaguaguucag

SEQ ID NO: 36095 - RNA, 24 nt, Human
gacugcuuucuugguggcgguggg

SEQ ID NO: 36096 - RNA, 24 nt, Human
uuuacagguaacuuacuuacuccu

SEQ ID NO: 36097 - RNA, 24 nt, Human
ugaaaaugaccaauauauagcugc

SEQ ID NO: 36098 - RNA, 24 nt, Human
uacagguaugagccaccacaccca

SEQ ID NO: 36099 - RNA, 24 nt, Human
aggcaauccacccgccuuggccuc

SEQ ID NO: 36100 - RNA, 24 nt, Human
uggaaugcuggauccuaucguaau

SEQ ID NO: 36101 - RNA, 24 nt, Human
auuccagugagauaaggaauuucu

SEQ ID NO: 36102 - RNA, 24 nt, Human
ugggguugggggcuaaauuaauug

SEQ ID NO: 36103 - RNA, 22 nt, Human
uauagcagugcuagcucugucu

SEQ ID NO: 36104 - RNA, 24 nt, Human
ugacauggugugagugugugggug

SEQ ID NO: 36105 - RNA, 24 nt, Human
ugugucggcucugcuacuucaaga

SEQ ID NO: 36106 - RNA, 24 nt, Human
ugucauaggcaucgacgaggggca

SEQ ID NO: 36107 - RNA, 20 nt, Human
ucacggcagcgagcgcacgc

SEQ ID NO: 36108 - RNA, 24 nt, Human
ugaaaggaaggaggaggaaaggaa

SEQ ID NO: 36109 - RNA, 24 nt, Human
uagaauagagggugaugacgguaa

SEQ ID NO: 36110 - RNA, 24 nt, Human
ugagaaacuuuugauuguuuucaa

SEQ ID NO: 36111 - RNA, 24 nt, Human
uccccuggguuuccauuaggguag

SEQ ID NO: 36112 - RNA, 24 nt, Human
ucauagggacaaaccgaggggguu

SEQ ID NO: 36113 - RNA, 24 nt, Human
ugguggucuugagcuuuuggccug

SEQ ID NO: 36114 - RNA, 24 nt, Human
aaggugaacuugucacuugguaug

SEQ ID NO: 36115 - RNA, 24 nt, Human
uuuuaauaggacugucuccaaagu

SEQ ID NO: 36116 - RNA, 24 nt, Human
ucccugaaagagauggucuccaag

SEQ ID NO: 36117 - RNA, 24 nt, Human
uucaccauuugcauuuauuugaua

SEQ ID NO: 36118 - RNA, 24 nt, Human
uuauuagaucucaaacucagcugc

SEQ ID NO: 36119 - RNA, 24 nt, Human
aagaagucauaccuuuuucuuaaa

SEQ ID NO: 36120 - RNA, 24 nt, Human
uguggcgcgacugggagcugagcc

SEQ ID NO: 36121 - RNA, 24 nt, Human
ugaaaggaaggggucagaguacau

SEQ ID NO: 36122 - RNA, 24 nt, Human
guaguucucuccaccagcacgggg

SEQ ID NO: 36123 - RNA, 24 nt, Human
agacgagauguacuuggaccagaa

SEQ ID NO: 36124 - RNA, 24 nt, Human
ugcuguaggucuuaaagccugguu

SEQ ID NO: 36125 - RNA, 20 nt, Human
uggacugggcugggcuaggc

SEQ ID NO: 36126 - RNA, 24 nt, Human
ucaggcuccugcuucccagagagu

SEQ ID NO: 36127 - RNA, 24 nt, Human
uguggcuccaaggaaucuucccac

SEQ ID NO: 36128 - RNA, 24 nt, Human
uggcugguggggaaccggguggac

SEQ ID NO: 36129 - RNA, 18 nt, Human
uguggaggaucaaggcug

SEQ ID NO: 36130 - RNA, 24 nt, Human
uuagugauuuuuuuuuucguaggu

SEQ ID NO: 36131 - RNA, 24 nt, Human
aucacaucaccaaaaagggggagg

SEQ ID NO: 36132 - RNA, 24 nt, Human
ucacuuugccauguuuccuucaca

SEQ ID NO: 36133 - RNA, 24 nt, Human
aaaacaguaucuuuagucacuuuc

SEQ ID NO: 36134 - RNA, 23 nt, Human
uggaaaguguuucauuuuguggc

SEQ ID NO: 36135 - RNA, 24 nt, Human
ccugcaguccccacucccugccuc

SEQ ID NO: 36136 - RNA, 24 nt, Human
ugaaggaagugagcacauuauuug

SEQ ID NO: 36137 - RNA, 24 nt, Human
ugagcaucaggauuuuauggauga

SEQ ID NO: 36138 - RNA, 24 nt, Human
uuuauugucuuuccacauauggag

SEQ ID NO: 36139 - RNA, 24 nt, Human
auccgguuacauguggcugguuuc

SEQ ID NO: 36140 - RNA, 24 nt, Human
cauguuaauuaaauggugguccuu

SEQ ID NO: 36141 - RNA, 24 nt, Human
caauugauaaaucuuauaccauuu

SEQ ID NO: 36142 - RNA, 24 nt, Human
ucacaaccacggcccuggaggagc

SEQ ID NO: 36143 - RNA, 24 nt, Human
agguaguaaacuccccaggugggc

SEQ ID NO: 36144 - RNA, 24 nt, Human
aaggaccuuuucaaaaaagcaagc

SEQ ID NO: 36145 - RNA, 24 nt, Human
ugaugagaaacaggauauuuugaa

SEQ ID NO: 36146 - RNA, 24 nt, Human
gggaaucagucuaaagcugugcuc

SEQ ID NO: 36147 - RNA, 24 nt, Human
auuuaauuuuuauuuuuuuaaacu

SEQ ID NO: 36148 - RNA, 24 nt, Human
auagaaccaaaauaguaacgucaa

SEQ ID NO: 36149 - RNA, 24 nt, Human
ucaguguuuuguacuucacugaau

SEQ ID NO: 36150 - RNA, 24 nt, Human
aaaauuaaaauaagaaaaccaaag

SEQ ID NO: 36151 - RNA, 24 nt, Human
ucuugcucugucgccuuggcucac

SEQ ID NO: 36152 - RNA, 24 nt, Human
agccugggcaacauagugagacuc

SEQ ID NO: 36153 - RNA, 24 nt, Human
uauggcaagucacuuugacagaca

SEQ ID NO: 36154 - RNA, 24 nt, Human
uacaccacucccaagaagaauaag

SEQ ID NO: 36155 - RNA, 24 nt, Human
uguuauuguccccugccucgccug

SEQ ID NO: 36156 - RNA, 24 nt, Human
cggcauggaucucagcgagcugga

SEQ ID NO: 36157 - RNA, 24 nt, Human
uaaaaaguuguggcaaagauggcu

SEQ ID NO: 36158 - RNA, 17 nt, Human
ugcauuggauauuagug

SEQ ID NO: 36159 - RNA, 22 nt, Human
uguuauguuuuaauagucaaug

SEQ ID NO: 36160 - RNA, 24 nt, Human
uguugaguuuugguuacuuguaca

SEQ ID NO: 36161 - RNA, 24 nt, Human
gaucacuuuugcccaggaguugaa

SEQ ID NO: 36162 - RNA, 24 nt, Human
ucaccugagccugggagaucaagu

SEQ ID NO: 36163 - RNA, 24 nt, Human
uaccuccuucaccccagaauauuu

SEQ ID NO: 36164 - RNA, 24 nt, Human
ugaaaagcaguucucugaggagcg

SEQ ID NO: 36165 - RNA, 24 nt, Human
aggaggcucaccagcucuucuugg

SEQ ID NO: 36166 - RNA, 24 nt, Human
cuuugggguuauuuuacgguacaa

SEQ ID NO: 36167 - RNA, 24 nt, Human
ugaaaacaaaagaacuucacugag

SEQ ID NO: 36168 - RNA, 24 nt, Human
gugaagcagacggcuguggugaug

SEQ ID NO: 36169 - RNA, 24 nt, Human
ucaccaggagcacgcccaugcaug

SEQ ID NO: 36170 - RNA, 24 nt, Human
agagacuauuuuauauucuguacu

SEQ ID NO: 36171 - RNA, 24 nt, Human
ugggagauggggagucaacauugg

SEQ ID NO: 36172 - RNA, 24 nt, Human
uauuuuauauucuguacuugccug

SEQ ID NO: 36173 - RNA, 24 nt, Human
ugccaugaagcucauuaaagccau

SEQ ID NO: 36174 - RNA, 24 nt, Human
ugagaaaacagauuuagagaaaua

SEQ ID NO: 36175 - RNA, 24 nt, Human
auaaaugucuggagccaaccuugg

SEQ ID NO: 36176 - RNA, 20 nt, Human
uggcacggcucuccucugcc

SEQ ID NO: 36177 - RNA, 24 nt, Human
ucacggaggggaaguagaugccaa

SEQ ID NO: 36178 - RNA, 24 nt, Human
aucaaguuuuaaauccuccuccuu

SEQ ID NO: 36179 - RNA, 21 nt, Human
uuuguuagaauaauagggauc

SEQ ID NO: 36180 - RNA, 24 nt, Human
uguugaaaagugguuuaaaccuga

SEQ ID NO: 36181 - RNA, 24 nt, Human
uguuacuugcuuugaguuggaagc

SEQ ID NO: 36182 - RNA, 24 nt, Human
ucuguggcuuggugagucugugug

SEQ ID NO: 36183 - RNA, 24 nt, Human
agccuuagaauaagaaaagcuuuu

SEQ ID NO: 36184 - RNA, 24 nt, Human
gaggaugccgcacagagauugacu

SEQ ID NO: 36185 - RNA, 24 nt, Human
ucauuguuuuuaaaacuguuuuau

SEQ ID NO: 36186 - RNA, 24 nt, Human
aggcaucccuagugaccauagccu

SEQ ID NO: 36187 - RNA, 24 nt, Human
cacuggaguaggacucuugcugca

SEQ ID NO: 36188 - RNA, 24 nt, Human
uagcagcauuaggucuauaggugg

SEQ ID NO: 36189 - RNA, 24 nt, Human
ugcuauaaauguugguuuaacacu

SEQ ID NO: 36190 - RNA, 24 nt, Human
gacccuucacuucugcugguguga

SEQ ID NO: 36191 - RNA, 24 nt, Human
uauuuuuuuauuauugugauagca

SEQ ID NO: 36192 - RNA, 24 nt, Human
ugagagagaagaaaaacuguguug

SEQ ID NO: 36193 - RNA, 23 nt, Human
uaccuggccccccgucaccacgu

SEQ ID NO: 36194 - RNA, 24 nt, Human
ccccgcagguccgggcacuagcac

SEQ ID NO: 36195 - RNA, 24 nt, Human
ugacuuguggagagauggccgucu

SEQ ID NO: 36196 - RNA, 24 nt, Human
acccgcugccgcuguccccgaggg

SEQ ID NO: 36197 - RNA, 22 nt, Human
ugaacuagagaaacaugguuau

SEQ ID NO: 36198 - RNA, 24 nt, Human
gucacucgcgcgcauacccaagga

SEQ ID NO: 36199 - RNA, 24 nt, Human
uccccggggauccugcagcucuag

SEQ ID NO: 36200 - RNA, 24 nt, Human
cccgccuuaauggggcauuuaaac

SEQ ID NO: 36201 - RNA, 24 nt, Human
uccacugucaagccuugggcgcgu

SEQ ID NO: 36202 - RNA, 24 nt, Human
ucugaucuauaaaugcgguggcau

SEQ ID NO: 36203 - RNA, 24 nt, Human
uaaaggaccugagauccgaacugg

SEQ ID NO: 36204 - RNA, 24 nt, Human
guaccagugcggagaccaucaaga

SEQ ID NO: 36205 - RNA, 21 nt, Human
ugacaguagguguauaugaca

SEQ ID NO: 36206 - RNA, 24 nt, Human
ugccagagggaggguguuacgagc

SEQ ID NO: 36207 - RNA, 21 nt, Human
uugcagggcgagcugccuguc

SEQ ID NO: 36208 - RNA, 21 nt, Human
ugacaguagguguauaugaca

SEQ ID NO: 36209 - RNA, 21 nt, Human
ugacaguagguguauaugaca

SEQ ID NO: 36210 - RNA, 24 nt, Human
aggcauuuuuauuuuuccuggcua

SEQ ID NO: 36211 - RNA, 24 nt, Human
uacaguacacaggaaugguuacga

SEQ ID NO: 36212 - RNA, 24 nt, Human
uggcaucuggagguggugggguug

SEQ ID NO: 36213 - RNA, 21 nt, Human
ugacaguagguguauaugaca

SEQ ID NO: 36214 - RNA, 24 nt, Human
uuccugauguauacagugcuugua

SEQ ID NO: 36215 - RNA, 24 nt, Human
uggguccguaccuucugauucagg

SEQ ID NO: 36216 - RNA, 18 nt, Human
uacacaggcuucuguggg

SEQ ID NO: 36217 - RNA, 24 nt, Human
ucggaucagcuucuugggggccuc

SEQ ID NO: 36218 - RNA, 24 nt, Human
agcgguacuuucuggcuggcuuga

SEQ ID NO: 36219 - RNA, 24 nt, Human
uuaauauuuuggagcuaaggagua

SEQ ID NO: 36220 - RNA, 24 nt, Human
ugaggaccagugcacugaguacau

SEQ ID NO: 36221 - RNA, 24 nt, Human
aggcagcggcuguggcagcccggc

SEQ ID NO: 36222 - RNA, 24 nt, Human
ucgaaaguggucuuggccagagag

SEQ ID NO: 36223 - RNA, 24 nt, Human
uagaagacccggcucucggcgucc

SEQ ID NO: 36224 - RNA, 24 nt, Human
uagcugauguccauggccucaugg

SEQ ID NO: 36225 - RNA, 24 nt, Human
uuuucuguguagucuucauuaacg

SEQ ID NO: 36226 - RNA, 24 nt, Human
uaucuuauuugcuuuguagucugc

SEQ ID NO: 36227 - RNA, 22 nt, Human
uuuacaauaaugaagcuacaaa

SEQ ID NO: 36228 - RNA, 19 nt, Human
ccgcugagggaggcacagg

SEQ ID NO: 36229 - RNA, 24 nt, Human
uggaggucguuggagucacuuccg

SEQ ID NO: 36230 - RNA, 24 nt, Human
aggcauggaggagcugugugguca

SEQ ID NO: 36231 - RNA, 24 nt, Human
ugugcagaagaaauggaaggauuc

SEQ ID NO: 36232 - RNA, 24 nt, Human
uucaaauuucuuucuuuuuuaauu

SEQ ID NO: 36233 - RNA, 24 nt, Human
ugcaagugacagcugaaagcaaac

SEQ ID NO: 36234 - RNA, 24 nt, Human
acaaagcuaauggguuaaugggug

SEQ ID NO: 36235 - RNA, 24 nt, Human
uggcaugacuauagcucacuguaa

SEQ ID NO: 36236 - RNA, 24 nt, Human
guucagcgcgggcucgcuuccaac

SEQ ID NO: 36237 - RNA, 23 nt, Human
uccaccuuccucaggaaaaacca

SEQ ID NO: 36238 - RNA, 24 nt, Human
cggcgcucuagaggcagagggagg

SEQ ID NO: 36239 - RNA, 24 nt, Human
cacccucuucuccaggcacacaca

SEQ ID NO: 36240 - RNA, 24 nt, Human
gccugcuucuccaccagcaccgcc

SEQ ID NO: 36241 - RNA, 24 nt, Human
ugggaugggcgguggcggcccggg

SEQ ID NO: 36242 - RNA, 24 nt, Human
aggcaggagucugacggcagcagc

SEQ ID NO: 36243 - RNA, 24 nt, Human
agagcccaucccuguccggggacu

SEQ ID NO: 36244 - RNA, 24 nt, Human
uggguucaggucguaugccaggug

SEQ ID NO: 36245 - RNA, 24 nt, Human
ucagaggcagcucaagcugggacc

SEQ ID NO: 36246 - RNA, 23 nt, Human
uacagcaaguaagucuugccuuu

SEQ ID NO: 36247 - RNA, 24 nt, Human
uaaucucccucuucaaucacaagc

SEQ ID NO: 36248 - RNA, 24 nt, Human
ucagaacucaagcaggagcugcug

SEQ ID NO: 36249 - RNA, 24 nt, Human
uacuuuauacacugaguguagaaa

SEQ ID NO: 36250 - RNA, 24 nt, Human
cucuccuuucuuuccuggagccuu

SEQ ID NO: 36251 - RNA, 24 nt, Human
ugaggcauaaagcagaaagagcaa

SEQ ID NO: 36252 - RNA, 24 nt, Human
uuuaauagccugaaaguggaaaac

SEQ ID NO: 36253 - RNA, 23 nt, Human
ugugcagaagaaauggaaggauu

SEQ ID NO: 36254 - RNA, 24 nt, Human
uaucaaggaagggcaggcgugaug

SEQ ID NO: 36255 - RNA, 24 nt, Human
ucaauuuuuauuuugguuuucuua

SEQ ID NO: 36256 - RNA, 24 nt, Human
ugagaauggcaaaauuagucgccu

SEQ ID NO: 36257 - RNA, 24 nt, Human
uaaguaacauuaacacaauguuga

SEQ ID NO: 36258 - RNA, 24 nt, Human
uuaggaaauaauuauuaaaacaug

SEQ ID NO: 36259 - RNA, 24 nt, Human
uggucaggcgagcccaagccuugg

SEQ ID NO: 36260 - RNA, 24 nt, Human
cuagaacagaacugaugauuacuc

SEQ ID NO: 36261 - RNA, 24 nt, Human
guccaguggcagacgugugacuca

SEQ ID NO: 36262 - RNA, 24 nt, Human
cauuggagaaauuaagaacgagga

SEQ ID NO: 36263 - RNA, 24 nt, Human
ugcauuguuaucauuaaccagucu

SEQ ID NO: 36264 - RNA, 24 nt, Human
uaaugggucucaaaauucugugac

SEQ ID NO: 36265 - RNA, 24 nt, Human
uauuagggauaauauucauuuagc

SEQ ID NO: 36266 - RNA, 24 nt, Human
ucacaaccacggcccuggaggagc

SEQ ID NO: 36267 - RNA, 24 nt, Human
aucucguuggacugcguggcuagc

SEQ ID NO: 36268 - RNA, 24 nt, Human
uuugaaaaaaacagaaaauaaaug

SEQ ID NO: 36269 - RNA, 24 nt, Human
ugacaccaccccacuccucuuccu

SEQ ID NO: 36270 - RNA, 24 nt, Human
ugauuuggucauuaccacauccag

SEQ ID NO: 36271 - RNA, 24 nt, Human
ucagccccacccaguccacguggu

SEQ ID NO: 36272 - RNA, 24 nt, Human
ucccuguuugguucauuguauugu

SEQ ID NO: 36273 - RNA, 24 nt, Human
uaugacuuaagaucuuuucuuuuu

SEQ ID NO: 36274 - RNA, 24 nt, Human
acagggcccugaugagcuguggag

SEQ ID NO: 36275 - RNA, 24 nt, Human
uucacguagcucuuuucugccuuu

SEQ ID NO: 36276 - RNA, 24 nt, Human
aucuuucuuuugauuaacuuguga

SEQ ID NO: 36277 - RNA, 24 nt, Human
ccacagucauaggcagugacgguc

SEQ ID NO: 36278 - RNA, 24 nt, Human
uaugagacuuuuucacguuggugc

SEQ ID NO: 36279 - RNA, 24 nt, Human
aaaaugcugucguacugcuucccc

SEQ ID NO: 36280 - RNA, 24 nt, Human
uggaacaaaucuugaaucuccaau

SEQ ID NO: 36281 - RNA, 24 nt, Human
ugcaauagaggcagaggcugagaa

SEQ ID NO: 36282 - RNA, 23 nt, Human
aacugugugggagggggcugugg

SEQ ID NO: 36283 - RNA, 24 nt, Human
ugcuaggggcuggccucagcccug

SEQ ID NO: 36284 - RNA, 23 nt, Human
ucuguccucuguagcacuuuuag

SEQ ID NO: 36285 - RNA, 24 nt, Human
uaagaacaugcuuauugauaaauc

SEQ ID NO: 36286 - RNA, 24 nt, Human
acagacacauugacaugggugggu

SEQ ID NO: 36287 - RNA, 24 nt, Human
uauuucuccaucuccaggucugga

SEQ ID NO: 36288 - RNA, 24 nt, Human
caugaagacagucgggugauggug

SEQ ID NO: 36289 - RNA, 24 nt, Human
aaacuccaaugguucagugacugu

SEQ ID NO: 36290 - RNA, 19 nt, Human
aaacagaugucuggacucu

SEQ ID NO: 36291 - RNA, 24 nt, Human
cucgauuaaaauacacacaucuua

SEQ ID NO: 36292 - RNA, 24 nt, Human
ugugcgcgcgcgcgugugcauuua

SEQ ID NO: 36293 - RNA, 18 nt, Human
uggcagaaccacuaagcu

SEQ ID NO: 36294 - RNA, 24 nt, Human
ugguauaguucuugagcaauuucc

SEQ ID NO: 36295 - RNA, 24 nt, Human
gcgcagcuucaggggccgcaaggg

SEQ ID NO: 36296 - RNA, 19 nt, Human
ucugaccggcuucaagcuc

SEQ ID NO: 36297 - RNA, 24 nt, Human
ccacagaagcuacagcugccaggu

SEQ ID NO: 36298 - RNA, 24 nt, Human
cauugcacuccacccugggcaaca

SEQ ID NO: 36299 - RNA, 24 nt, Human
cagagcuaggagaaggagaggggg

SEQ ID NO: 36300 - RNA, 24 nt, Human
uauuggcacuaguauaaaacagag

SEQ ID NO: 36301 - RNA, 24 nt, Human
aaugauuuuuucuaacuaauaaag

SEQ ID NO: 36302 - RNA, 24 nt, Human
gggcaaugcagccagcccccgggc

SEQ ID NO: 36303 - RNA, 24 nt, Human
ugcauuguuaucauuaaccagucu

SEQ ID NO: 36304 - RNA, 24 nt, Human
uaaugggucucaaaauucugugac

SEQ ID NO: 36305 - RNA, 24 nt, Human
uauuagggauaauauucauuuagc

SEQ ID NO: 36306 - RNA, 24 nt, Human
uaaugggucucaaaauucugugac

SEQ ID NO: 36307 - RNA, 24 nt, Human
ucgcgcugcuucucccgcuucuuc

SEQ ID NO: 36308 - RNA, 24 nt, Human
uacuaguccacgguuggcuacuag

SEQ ID NO: 36309 - RNA, 24 nt, Human
caugaugugcuccuccgcgaugcg

SEQ ID NO: 36310 - RNA, 24 nt, Human
cuaguccacgguuggcuacuaguc

SEQ ID NO: 36311 - RNA, 24 nt, Human
aggcagcggcuguggcagcccggc

SEQ ID NO: 36312 - RNA, 24 nt, Human
ugagaacuccucaugcacccugug

SEQ ID NO: 36313 - RNA, 24 nt, Human
uagcagcuaaugaagcccagcuuc

SEQ ID NO: 36314 - RNA, 24 nt, Human
caacguagagcgguuccagacucu

SEQ ID NO: 36315 - RNA, 24 nt, Human
uuuacaaaauaaaaggaaaaguga

SEQ ID NO: 36316 - RNA, 24 nt, Human
uaacagguguaagaguguugaaaa

SEQ ID NO: 36317 - RNA, 24 nt, Human
ugugcagaagaaauggaaggauuc

SEQ ID NO: 36318 - RNA, 24 nt, Human
uaucaaggaagggcaggcgugaug

SEQ ID NO: 36319 - RNA, 24 nt, Human
uucaaauuucuuucuuuuuuaauu

SEQ ID NO: 36320 - RNA, 24 nt, Human
ugcauuguuaucauuaaccagucu

SEQ ID NO: 36321 - RNA, 24 nt, Human
uaaugggucucaaaauucugugac

SEQ ID NO: 36322 - RNA, 24 nt, Human
uauuagggauaauauucauuuagc

SEQ ID NO: 36323 - RNA, 24 nt, Human
uaccuuaggaagcaguacaaaucu

SEQ ID NO: 36324 - RNA, 24 nt, Human
guggaagguaguagauaccaggaa

SEQ ID NO: 36325 - RNA, 24 nt, Human
agagggaccguauucuggggcuua

SEQ ID NO: 36326 - RNA, 24 nt, Human
ugacaggucgauguagcugaggac

SEQ ID NO: 36327 - RNA, 24 nt, Human
uaacuuaaucuccagccccucucc

SEQ ID NO: 36328 - RNA, 24 nt, Human
uugaggcagucuuaacucugucac

SEQ ID NO: 36329 - RNA, 19 nt, Human
uaucacaaucaguguuuga

SEQ ID NO: 36330 - RNA, 24 nt, Human
uaaaaucauuucagauaucaccau

SEQ ID NO: 36331 - RNA, 24 nt, Human
agcaaggaaagcagggcucaccaa

SEQ ID NO: 36332 - RNA, 24 nt, Human
uccaguuugcaaaagaucuucugu

SEQ ID NO: 36333 - RNA, 24 nt, Human
uacccaauaguuacuuuucugguc

SEQ ID NO: 36334 - RNA, 22 nt, Human
uucaggggguacaugugcaggu

SEQ ID NO: 36335 - RNA, 24 nt, Human
uagaaucauacagaauaguuucac

SEQ ID NO: 36336 - RNA, 24 nt, Human
ugacuauaaaccaaaaauaaaauu

SEQ ID NO: 36337 - RNA, 24 nt, Human
uaagaaacauuuacaggccuggug

SEQ ID NO: 36338 - RNA, 24 nt, Human
augaugccccugauuuugcauucu

SEQ ID NO: 36339 - RNA, 24 nt, Human
uuaauucauuuguaucuuuuaaaa

SEQ ID NO: 36340 - RNA, 24 nt, Human
acaggaagguauguccugucagua

SEQ ID NO: 36341 - RNA, 24 nt, Human
aauuguguaauguuuauauucuug

SEQ ID NO: 36342 - RNA, 24 nt, Human
uguuacuucuuugauaguucuuac

SEQ ID NO: 36343 - RNA, 24 nt, Human
uauuauauuggcgaccuucacagg

SEQ ID NO: 36344 - RNA, 24 nt, Human
aguuagaaucuguaaacuaaacca

SEQ ID NO: 36345 - RNA, 24 nt, Human
ugaggaaggacaaagauaaacagg

SEQ ID NO: 36346 - RNA, 24 nt, Human
uuaguuuacaaguuguaggugauu

SEQ ID NO: 36347 - RNA, 24 nt, Human
uaagcagaaaacuaugaagacuua

SEQ ID NO: 36348 - RNA, 24 nt, Human
gggcacugaagaugaugcgaccca

SEQ ID NO: 36349 - RNA, 24 nt, Human
uacagugcuuguaaaagguuugaa

SEQ ID NO: 36350 - RNA, 21 nt, Human
ugggaggggcugaauguggug

SEQ ID NO: 36351 - RNA, 24 nt, Human
aaggaaccauggccaacugugagc

SEQ ID NO: 36352 - RNA, 21 nt, Human
ucuggagaaacugcugccuca

SEQ ID NO: 36353 - RNA, 24 nt, Human
aauuugauagcaucuggucagugg

SEQ ID NO: 36354 - RNA, 24 nt, Human
uggcuucagcgugucccauaccac

SEQ ID NO: 36355 - RNA, 24 nt, Human
gcccuguggguuggaccuccuggg

SEQ ID NO: 36356 - RNA, 24 nt, Human
gagcagucauuaucuguugucuug

SEQ ID NO: 36357 - RNA, 17 nt, Human
uagcacagcuucuccuu

SEQ ID NO: 36358 - RNA, 24 nt, Human
uggacuggccgucagagcucguaa

SEQ ID NO: 36359 - RNA, 20 nt, Human
uucguggaugccacaggacu

SEQ ID NO: 36360 - RNA, 24 nt, Human
uggacagcgaggccaggauggagc

SEQ ID NO: 36361 - RNA, 20 nt, Human
uaaggcacuguuauacagaa

SEQ ID NO: 36362 - RNA, 24 nt, Human
caccugauaguugugaguagucca

SEQ ID NO: 36363 - RNA, 22 nt, Human
ugauacaaguucuggcauuggu

SEQ ID NO: 36364 - RNA, 24 nt, Human
uauuacacacggauguaagcauuu

SEQ ID NO: 36365 - RNA, 24 nt, Human
acgcucacugauuuucagcacaca

SEQ ID NO: 36366 - RNA, 24 nt, Human
acucagggccuuguacacagcagc

SEQ ID NO: 36367 - RNA, 24 nt, Human
uacuugaugggacaggcauugccc

SEQ ID NO: 36368 - RNA, 24 nt, Human
uauggcaagucacuuugacagaca

SEQ ID NO: 36369 - RNA, 24 nt, Human
uacaccacucccaagaagaauaag

SEQ ID NO: 36370 - RNA, 24 nt, Human
cuugccccguggccuuccuguucc

SEQ ID NO: 36371 - RNA, 24 nt, Human
gcugaagauggccggaaagcagau

SEQ ID NO: 36372 - RNA, 24 nt, Human
uccaagugagagaccacagcuucc

SEQ ID NO: 36373 - RNA, 24 nt, Human
uugguucgugagcaguuggugagu

SEQ ID NO: 36374 - RNA, 24 nt, Human
ugccagaaaagccuuacccauuuu

SEQ ID NO: 36375 - RNA, 24 nt, Human
gaauguuccccccauuggaaacug

SEQ ID NO: 36376 - RNA, 24 nt, Human
uuaguuuauucaaagcuuuucuua

SEQ ID NO: 36377 - RNA, 24 nt, Human
ugagggaagaagaucuccagcugg

SEQ ID NO: 36378 - RNA, 24 nt, Human
uauaacauguaugcuuuucagaau

SEQ ID NO: 36379 - RNA, 24 nt, Human
accccauggacccaggugcagagg

SEQ ID NO: 36380 - RNA, 24 nt, Human
uggggacaggugucuggguccccc

SEQ ID NO: 36381 - RNA, 24 nt, Human
uggaagaggagcagcccgaggagu

SEQ ID NO: 36382 - RNA, 24 nt, Human
uucaaguucuuuuauuucugggua

SEQ ID NO: 36383 - RNA, 24 nt, Human
ucuguggagagaucgcucgauuuu

SEQ ID NO: 36384 - RNA, 24 nt, Human
ccugugcuggagaaagaacacgac

SEQ ID NO: 36385 - RNA, 24 nt, Human
uggaguugccugcgcuuaaggacg

SEQ ID NO: 36386 - RNA, 24 nt, Human
agaaugcacuguggaauuugaggg

SEQ ID NO: 36387 - RNA, 24 nt, Human
ugacagaaaaacauucucaggacu

SEQ ID NO: 36388 - RNA, 24 nt, Human
gugccacaccaguagauuguucac

SEQ ID NO: 36389 - RNA, 24 nt, Human
uauugcccauaagccucaggauuu

SEQ ID NO: 36390 - RNA, 24 nt, Human
guggcccacauaggucucugggcg

SEQ ID NO: 36391 - RNA, 24 nt, Human
aaggaaccaaaaguacugguacuu

SEQ ID NO: 36392 - RNA, 24 nt, Human
ggggaaagggaggccaccuggaaa

SEQ ID NO: 36393 - RNA, 24 nt, Human
gagcagcagcugacaaaguuugca

SEQ ID NO: 36394 - RNA, 24 nt, Human
uguccuguccucgccaugaggccg

SEQ ID NO: 36395 - RNA, 24 nt, Human
ugagaaaacaccaaugaagcacuu

SEQ ID NO: 36396 - RNA, 24 nt, Human
gaagguuguuuggcuuguuuaaca

SEQ ID NO: 36397 - RNA, 24 nt, Human
uauuucaccauacuauggagaaua

SEQ ID NO: 36398 - RNA, 24 nt, Human
uuccaugguucuccaagcacgggc

SEQ ID NO: 36399 - RNA, 24 nt, Human
uuagaugaaagcccagugggaauu

SEQ ID NO: 36400 - RNA, 24 nt, Human
aaaaugcuucuaagaaccuguuug

SEQ ID NO: 36401 - RNA, 23 nt, Human
aucgucuuauuuaauuuucuuuc

SEQ ID NO: 36402 - RNA, 24 nt, Human
ugagaaagcaagauguuggcuacc

SEQ ID NO: 36403 - RNA, 24 nt, Human
ugaaaacaggauuaaacguuagua

SEQ ID NO: 36404 - RNA, 24 nt, Human
aguuaguuuuuuuauuauuauuau

SEQ ID NO: 36405 - RNA, 24 nt, Human
uggcaugugcccagcgacguggcc

SEQ ID NO: 36406 - RNA, 24 nt, Human
ccagcagugaguaucccuguugca

SEQ ID NO: 36407 - RNA, 24 nt, Human
acugcaguuuauuggacgugcguu

SEQ ID NO: 36408 - RNA, 24 nt, Human
agguggaguugaaaaacccaaaca

SEQ ID NO: 36409 - RNA, 24 nt, Human
gaacugguccuuucacuuugagau

SEQ ID NO: 36410 - RNA, 24 nt, Human
uaucaagucagcacacaccuuuuc

SEQ ID NO: 36411 - RNA, 21 nt, Human
ugauggaaguaaucugcuuaa

SEQ ID NO: 36412 - RNA, 24 nt, Human
uaagacaguuguguggugugauug

SEQ ID NO: 36413 - RNA, 24 nt, Human
aggaaggaugauaacguguggucc

SEQ ID NO: 36414 - RNA, 24 nt, Human
ugaaaucugauuuucuuauuucua

SEQ ID NO: 36415 - RNA, 24 nt, Human
cuccuggaugcucagcggaucgug

SEQ ID NO: 36416 - RNA, 22 nt, Human
cccccgugccuuggugacgaug

SEQ ID NO: 36417 - RNA, 19 nt, Human
caucauggggcagccaggc

SEQ ID NO: 36418 - RNA, 24 nt, Human
uacuauaugauuuuauggaagaag

SEQ ID NO: 36419 - RNA, 17 nt, Human
ugaguaguaaguucaac

SEQ ID NO: 36420 - RNA, 24 nt, Human
uuuaacaauauugauucucccaau

SEQ ID NO: 36421 - RNA, 24 nt, Human
ucaggccauuagaacccgaggggg

SEQ ID NO: 36422 - RNA, 18 nt, Human
agucauggcaugcccagu

SEQ ID NO: 36423 - RNA, 24 nt, Human
gagcgcccccggcgaagagcgggc

SEQ ID NO: 36424 - RNA, 24 nt, Human
uucgacaaagcccguguaccccug

SEQ ID NO: 36425 - RNA, 23 nt, Human
ugauauggaugaugaagaugaug

SEQ ID NO: 36426 - RNA, 24 nt, Human
gcagaccugacauccaguacccug

SEQ ID NO: 36427 - RNA, 24 nt, Human
ucaggccaguugcagccuucucag

SEQ ID NO: 36428 - RNA, 24 nt, Human
ugugauugauagucagggaccuuc

SEQ ID NO: 36429 - RNA, 24 nt, Human
ugauucuggaaguucugaggaaaa

SEQ ID NO: 36430 - RNA, 24 nt, Human
ccaccgagguaccuguguccuggg

SEQ ID NO: 36431 - RNA, 24 nt, Human
uggcagccgggagaggagcaagcg

SEQ ID NO: 36432 - RNA, 23 nt, Human
cagcgcagccacaggguucccca

SEQ ID NO: 36433 - RNA, 24 nt, Human
ugaauagucaggucuugcaguaca

SEQ ID NO: 36434 - RNA, 21 nt, Human
ugaguaagcgguauuaggcuc

SEQ ID NO: 36435 - RNA, 24 nt, Human
gagcugugcggugcccuccgggac

SEQ ID NO: 36436 - RNA, 24 nt, Human
cucucucuauuuuauuuuuuaaaa

SEQ ID NO: 36437 - RNA, 24 nt, Human
ugugugcaugcaugcgugugugug

SEQ ID NO: 36438 - RNA, 19 nt, Human
ugacacuaauccauguugu

SEQ ID NO: 36439 - RNA, 24 nt, Human
cuggccgacggcacccggcugcag

SEQ ID NO: 36440 - RNA, 24 nt, Human
ucgcaguaagccuggcaggccugu

SEQ ID NO: 36441 - RNA, 19 nt, Human
ugacgaggccacccagagc

SEQ ID NO: 36442 - RNA, 24 nt, Human
agacugugcaagaccccccuuggc

SEQ ID NO: 36443 - RNA, 24 nt, Human
uuagggaaaaugcacugaguuuga

SEQ ID NO: 36444 - RNA, 24 nt, Human
uggcaagccuccacucucugccca

SEQ ID NO: 36445 - RNA, 24 nt, Human
aggcacuggcagaugccgcccgcc

SEQ ID NO: 36446 - RNA, 24 nt, Human
uuacugcagccaacguuggaaaag

SEQ ID NO: 36447 - RNA, 24 nt, Human
ugacuacauacauagauggguagc

SEQ ID NO: 36448 - RNA, 24 nt, Human
uuaauucauauaguuauuguaagc

SEQ ID NO: 36449 - RNA, 24 nt, Human
ucauuguuucagcuggccaaaaaa

SEQ ID NO: 36450 - RNA, 24 nt, Human
aggaaaucugguucacagcaucug

SEQ ID NO: 36451 - RNA, 24 nt, Human
aggcaaggugacgggacuggaagc

SEQ ID NO: 36452 - RNA, 24 nt, Human
aacaguguaggucuuggugaagcc

SEQ ID NO: 36453 - RNA, 23 nt, Human
auuguccggaagaaagaugggag

SEQ ID NO: 36454 - RNA, 24 nt, Human
gugcauuggugauuuugaucauuc

SEQ ID NO: 36455 - RNA, 24 nt, Human
uuuaaaauaaauucuuaaucagag

SEQ ID NO: 36456 - RNA, 24 nt, Human
ugugcagaagaaauggaaggauuc

SEQ ID NO: 36457 - RNA, 24 nt, Human
ggggugccugggaggcuugcccau

SEQ ID NO: 36458 - RNA, 24 nt, Human
aggaagaagauggggcagggcugg

SEQ ID NO: 36459 - RNA, 24 nt, Human
aaacuaguauuucauaaaugcuga

SEQ ID NO: 36460 - RNA, 24 nt, Human
uuacuggauggcagaguugaauag

SEQ ID NO: 36461 - RNA, 24 nt, Human
gaaggugccgucuaggacuuucau

SEQ ID NO: 36462 - RNA, 24 nt, Human
acuuaaguucucuugaagggcaac

SEQ ID NO: 36463 - RNA, 19 nt, Human
caccgugggacgggaacac

SEQ ID NO: 36464 - RNA, 24 nt, Human
caacaugcguggagccaagugcua

SEQ ID NO: 36465 - RNA, 24 nt, Human
uccaaccaagaaaaccucaaagca

SEQ ID NO: 36466 - RNA, 24 nt, Human
uccuccucaucgcccuggaugguc

SEQ ID NO: 36467 - RNA, 24 nt, Human
cauugguccccaccuguucguaga

SEQ ID NO: 36468 - RNA, 24 nt, Human
ugggaacaggaagcucccuagggc

SEQ ID NO: 36469 - RNA, 23 nt, Human
ugucacagaacacugucuauucc

SEQ ID NO: 36470 - RNA, 24 nt, Human
uguacaaaccaguuuuauuaggga

SEQ ID NO: 36471 - RNA, 24 nt, Human
ucuagcacaagauuuuucuguaaa

SEQ ID NO: 36472 - RNA, 24 nt, Human
ucgguuguuaagaacuagagcuua

SEQ ID NO: 36473 - RNA, 24 nt, Human
uaagggcauccauuucacagguga

SEQ ID NO: 36474 - RNA, 24 nt, Human
gcacuaguuagaaugcguacgaga

SEQ ID NO: 36475 - RNA, 24 nt, Human
guccucccuuguggcuuccucagc

SEQ ID NO: 36476 - RNA, 22 nt, Human
cuuugugcugggccugcucuuc

SEQ ID NO: 36477 - RNA, 24 nt, Human
uguucagaaauugaggcuaacauu

SEQ ID NO: 36478 - RNA, 24 nt, Human
ucaggaauaugcggucauuuuauu

SEQ ID NO: 36479 - RNA, 24 nt, Human
acagcauuuggucugacuugugcc

SEQ ID NO: 36480 - RNA, 24 nt, Human
aucacuuuuaagagaaauguacac

SEQ ID NO: 36481 - RNA, 24 nt, Human
uauagugucauguauccucucaac

SEQ ID NO: 36482 - RNA, 24 nt, Human
ucccauaggacgggcccacacugc

SEQ ID NO: 36483 - RNA, 24 nt, Human
gagcaauugcuagaccgaggcauu

SEQ ID NO: 36484 - RNA, 24 nt, Human
ugugaagccuugcugcaggcaagc

SEQ ID NO: 36485 - RNA, 24 nt, Human
cuugcucauagucuucagcaagga

SEQ ID NO: 36486 - RNA, 24 nt, Human
uggaaagcagguagaguuggcuuu

SEQ ID NO: 36487 - RNA, 24 nt, Human
uaagagcaguucagaugaugauca

SEQ ID NO: 36488 - RNA, 22 nt, Human
uggaauuuucugggccgaauac

SEQ ID NO: 36489 - RNA, 24 nt, Human
uuacuuggcacaauuuauuucuac

SEQ ID NO: 36490 - RNA, 24 nt, Human
gggaaacacacaugcagagaaggc

SEQ ID NO: 36491 - RNA, 24 nt, Human
aggcaguuuuauaacuuuauuuga

SEQ ID NO: 36492 - RNA, 24 nt, Human
uuuggugaaucuucauccucauua

SEQ ID NO: 36493 - RNA, 24 nt, Human
aagaaccugccaguucaaccagcg

SEQ ID NO: 36494 - RNA, 24 nt, Human
ucuguaguuuuaagagguuagaag

SEQ ID NO: 36495 - RNA, 24 nt, Human
uggaagaaaaagacauuccucuac

SEQ ID NO: 36496 - RNA, 24 nt, Human
uucugguguuuaauugugauauaa

SEQ ID NO: 36497 - RNA, 24 nt, Human
uggaagaugcucaacaccuccucc

SEQ ID NO: 36498 - RNA, 24 nt, Human
ugaccaggaaauacaacgagcugc

SEQ ID NO: 36499 - RNA, 24 nt, Human
uggaagaugcucaacaccuccucc

SEQ ID NO: 36500 - RNA, 24 nt, Human
ugaccaggaaauacaacgagcugc

SEQ ID NO: 36501 - RNA, 24 nt, Human
ucuuaaguccuacacuguuuuaga

SEQ ID NO: 36502 - RNA, 24 nt, Human
acagugguuacaaaaaaaaaagua

SEQ ID NO: 36503 - RNA, 24 nt, Human
uggaagaugcucaacaccuccucc

SEQ ID NO: 36504 - RNA, 24 nt, Human
ugaccaggaaauacaacgagcugc

SEQ ID NO: 36505 - RNA, 24 nt, Human
ucagugcaaccagagacccuuucg

SEQ ID NO: 36506 - RNA, 24 nt, Human
aggcacucagagaagguaaagcuu

SEQ ID NO: 36507 - RNA, 24 nt, Human
cacccggggcuccacccaagcgcc

SEQ ID NO: 36508 - RNA, 23 nt, Human
uuggaagagcagcccaggugguc

SEQ ID NO: 36509 - RNA, 24 nt, Human
cggcacggucugauccggaaauau

SEQ ID NO: 36510 - RNA, 24 nt, Human
cguucuuuuccucugccgugagug

SEQ ID NO: 36511 - RNA, 24 nt, Human
agaacaccugaaucuuaucucggu

SEQ ID NO: 36512 - RNA, 17 nt, Human
ugucacuggcguccugg

SEQ ID NO: 36513 - RNA, 24 nt, Human
uucagcaaccaggagaccugugug

SEQ ID NO: 36514 - RNA, 24 nt, Human
guggagcuaagagagugaccucca

SEQ ID NO: 36515 - RNA, 24 nt, Human
ccuccgggcaccgccuugggcgcg

SEQ ID NO: 36516 - RNA, 22 nt, Human
cuuggagucacugcuacucagc

SEQ ID NO: 36517 - RNA, 24 nt, Human
uucccuggggauagagugcacccu

SEQ ID NO: 36518 - RNA, 24 nt, Human
uaaguuccucccccuuauaauccc

SEQ ID NO: 36519 - RNA, 24 nt, Human
ugagagccauggagggagccacac

SEQ ID NO: 36520 - RNA, 23 nt, Human
uuuaggaaaaagagauuaagaga

SEQ ID NO: 36521 - RNA, 24 nt, Human
gcgcguucccauuuuccacaggag

SEQ ID NO: 36522 - RNA, 24 nt, Human
uggaggcugagugccguugcggug

SEQ ID NO: 36523 - RNA, 19 nt, Human
cggcaguggagaugaacgu

SEQ ID NO: 36524 - RNA, 24 nt, Human
uuugcuguacacucaauagggcau

SEQ ID NO: 36525 - RNA, 24 nt, Human
uguggcgggccagggccgccugcg

SEQ ID NO: 36526 - RNA, 24 nt, Human
gagcagcugggagggcuccuucuc

SEQ ID NO: 36527 - RNA, 24 nt, Human
aacccaguggaaggaucuacugau

SEQ ID NO: 36528 - RNA, 24 nt, Human
uuccacagccagauuugaccaagc

SEQ ID NO: 36529 - RNA, 24 nt, Human
guuaaauuccuucucuguucaggg

SEQ ID NO: 36530 - RNA, 24 nt, Human
acucuguucuuccgccgcuccgcc

SEQ ID NO: 36531 - RNA, 24 nt, Human
uagaaacgcguccucagcggaaag

SEQ ID NO: 36532 - RNA, 24 nt, Human
ugucucgaggaaucugaagaacuu

SEQ ID NO: 36533 - RNA, 24 nt, Human
ucaaaaagaaacugauucagagac

SEQ ID NO: 36534 - RNA, 24 nt, Human
uuuuagcuguuaauuguacuaugc

SEQ ID NO: 36535 - RNA, 24 nt, Human
aagaaacuuaaagccuggaaugau

SEQ ID NO: 36536 - RNA, 24 nt, Human
ugaauuguacggcacuuggcguaa

SEQ ID NO: 36537 - RNA, 24 nt, Human
uacagaauggauuuuggaagaggg

SEQ ID NO: 36538 - RNA, 24 nt, Human
cgaccgaucuucauucacugcgga

SEQ ID NO: 36539 - RNA, 24 nt, Human
acagcggaggagcuguaccgccug

SEQ ID NO: 36540 - RNA, 24 nt, Human
ggagggacgggucugcagguucca

SEQ ID NO: 36541 - RNA, 24 nt, Human
ccuugaguaaaucccguuaccucu

SEQ ID NO: 36542 - RNA, 21 nt, Human
cuuggcacuggccgucguuuu

SEQ ID NO: 36543 - RNA, 24 nt, Human
aaguauaggcgauagaaauugaaa

SEQ ID NO: 36544 - RNA, 19 nt, Human
agggauggaaagucaccgu

SEQ ID NO: 36545 - RNA, 24 nt, Human
ucugaucuauaaaugcgguggcau

SEQ ID NO: 36546 - RNA, 24 nt, Human
gagcauuagacccaagaccauugu

SEQ ID NO: 36547 - RNA, 24 nt, Human
uuugaagacucuguccgaaaguuu

SEQ ID NO: 36548 - RNA, 24 nt, Human
acccaaauacauuaacaccuccuc

SEQ ID NO: 36549 - RNA, 24 nt, Human
ugagauguugaugcgcccacuugg

SEQ ID NO: 36550 - RNA, 24 nt, Human
uuuaagcucuuucacacuuuuucu

SEQ ID NO: 36551 - RNA, 24 nt, Human
uaucuguucucgguacuauagggc

SEQ ID NO: 36552 - RNA, 24 nt, Human
agagguucugcgguuuaauauccc

SEQ ID NO: 36553 - RNA, 24 nt, Human
ugcauuguuaucauuaaccagucu

SEQ ID NO: 36554 - RNA, 24 nt, Human
uauuagggauaauauucauuuagc

SEQ ID NO: 36555 - RNA, 24 nt, Human
uaaugggucucaaaauucugugac

SEQ ID NO: 36556 - RNA, 24 nt, Human
ugugcagaagaaauggaaggauuc

SEQ ID NO: 36557 - RNA, 24 nt, Human
uucaaauuucuuucuuuuuuaauu

SEQ ID NO: 36558 - RNA, 24 nt, Human
uagcgugggauagauuugucucuu

SEQ ID NO: 36559 - RNA, 24 nt, Human
ugguauacuacugcuuugcggaau

SEQ ID NO: 36560 - RNA, 24 nt, Human
ugagucuuggccaugagaucugug

SEQ ID NO: 36561 - RNA, 24 nt, Human
uagcugguuccagguagaagaggc

SEQ ID NO: 36562 - RNA, 24 nt, Human
uaaguggaguuagaaguggguuau

SEQ ID NO: 36563 - RNA, 24 nt, Human
uguagggauaaggcgugaccacag

SEQ ID NO: 36564 - RNA, 24 nt, Human
ucggcuccagcaccacgaguaccg

SEQ ID NO: 36565 - RNA, 24 nt, Human
uaaagcauuguuuuggagcugguu

SEQ ID NO: 36566 - RNA, 24 nt, Human
uacaaaauaucgaagacacuacca

SEQ ID NO: 36567 - RNA, 24 nt, Human
uaacauggucaaaaaggcaaucag

SEQ ID NO: 36568 - RNA, 24 nt, Human
gagccuuaaugggggcagaaaggg

SEQ ID NO: 36569 - RNA, 23 nt, Human
aacugcguggcuaucacacugac

SEQ ID NO: 36570 - RNA, 24 nt, Human
uaaguuaauuaagggccuguuacu

SEQ ID NO: 36571 - RNA, 24 nt, Human
uuccauagagggcacguagcauau

SEQ ID NO: 36572 - RNA, 24 nt, Human
uuacuuggaauuuccucuguuaua

SEQ ID NO: 36573 - RNA, 22 nt, Human
uccacgaggcaaacgggucauc

SEQ ID NO: 36574 - RNA, 24 nt, Human
uggcaagcagcuccaguccgagca

SEQ ID NO: 36575 - RNA, 24 nt, Human
uauuguagauauuuuuaaaucuuu

SEQ ID NO: 36576 - RNA, 24 nt, Human
uugaaaauacuuuaagucaaaaau

SEQ ID NO: 36577 - RNA, 24 nt, Human
uuuguugaaaaagaggcagacaga

SEQ ID NO: 36578 - RNA, 24 nt, Human
gggcggggcucucgucguacccgc

SEQ ID NO: 36579 - RNA, 24 nt, Human
ucuaaaaugguaaaaugugccacu

SEQ ID NO: 36580 - RNA, 24 nt, Human
aaauagugauccccuuaaaugcuu

SEQ ID NO: 36581 - RNA, 24 nt, Human
uggaggcccaggcugggagguguc

SEQ ID NO: 36582 - RNA, 24 nt, Human
uauuucaucuuauuuaauggugca

SEQ ID NO: 36583 - RNA, 24 nt, Human
uuucaaacaaagcacaguaacagu

SEQ ID NO: 36584 - RNA, 17 nt, Human
ucuaguguccccccagc

SEQ ID NO: 36585 - RNA, 24 nt, Human
caaucauugaauacaaaacaaaua

SEQ ID NO: 36586 - RNA, 24 nt, Human
uugcauacauggaugaggagacug

SEQ ID NO: 36587 - RNA, 24 nt, Human
uggccgggccacggggcucaugcc

SEQ ID NO: 36588 - RNA, 24 nt, Human
ugacaacauuaacgguccucaugc

SEQ ID NO: 36589 - RNA, 24 nt, Human
ucacauauucuuugucuuuauuau

SEQ ID NO: 36590 - RNA, 24 nt, Human
acauguuguggaguugagcugaau

SEQ ID NO: 36591 - RNA, 24 nt, Human
uacaggagacaaucauuuauguuu

SEQ ID NO: 36592 - RNA, 24 nt, Human
uuaggccaacauguauuaagcuga

SEQ ID NO: 36593 - RNA, 24 nt, Human
aggaagaggacucaaaagucuggc

SEQ ID NO: 36594 - RNA, 24 nt, Human
cuuccugguugagcuucugcuaaa

SEQ ID NO: 36595 - RNA, 23 nt, Human
uggcaggccccagcccugcagca

SEQ ID NO: 36596 - RNA, 24 nt, Human
uaagugggucuaggugcugggggc

SEQ ID NO: 36597 - RNA, 24 nt, Human
uguuaagaaugccuucguuauuuc

SEQ ID NO: 36598 - RNA, 24 nt, Human
uuuguggaggccuggggaguuucu

SEQ ID NO: 36599 - RNA, 24 nt, Human
uaagugaagacuuuccaaaaacuc

SEQ ID NO: 36600 - RNA, 24 nt, Human
uuaggaaaauaaggucacauaucu

SEQ ID NO: 36601 - RNA, 24 nt, Human
ugggauuacagaugugagccacca

SEQ ID NO: 36602 - RNA, 24 nt, Human
ucucucuuaauuaacucuuuuauu

SEQ ID NO: 36603 - RNA, 24 nt, Human
uauaugggccugcauacaguggaa

SEQ ID NO: 36604 - RNA, 24 nt, Human
ucacccggaaggaugcaggaaccu

SEQ ID NO: 36605 - RNA, 24 nt, Human
ucgcagaaacaguggaagcagucg

SEQ ID NO: 36606 - RNA, 24 nt, Human
acccaguggagccuggaucggagc

SEQ ID NO: 36607 - RNA, 24 nt, Human
ugaugacccguuaccuggaguccu

SEQ ID NO: 36608 - RNA, 24 nt, Human
uaucugaaaccuagcugcuuacuu

SEQ ID NO: 36609 - RNA, 24 nt, Human
uaggucugucaugaugucuagucu

SEQ ID NO: 36610 - RNA, 24 nt, Human
uggcgagcgcaaguuucaccuguu

SEQ ID NO: 36611 - RNA, 24 nt, Human
ugagucauucgggcaguuaggugg

SEQ ID NO: 36612 - RNA, 24 nt, Human
acuuggugcauguguucuuucuag

SEQ ID NO: 36613 - RNA, 24 nt, Human
ugaaacuggguaauggauacucug

SEQ ID NO: 36614 - RNA, 24 nt, Human
ugugcagcgcgcggccgggcagcu

SEQ ID NO: 36615 - RNA, 24 nt, Human
cacugugcuaagugauuuaccuuu

SEQ ID NO: 36616 - RNA, 24 nt, Human
aaacugcuuauuucuucucuuugc

SEQ ID NO: 36617 - RNA, 17 nt, Human
uauguggcuuuguugua

SEQ ID NO: 36618 - RNA, 24 nt, Human
uggcugcugugucaucuuugaagu

SEQ ID NO: 36619 - RNA, 23 nt, Human
uggguuccuggugguggguuuga

SEQ ID NO: 36620 - RNA, 24 nt, Human
ugaaguaucgggagacggguuuuc

SEQ ID NO: 36621 - RNA, 24 nt, Human
ggaccggagaggcgagacagcggc

SEQ ID NO: 36622 - RNA, 24 nt, Human
acgcugagcucauggagaugcagc

SEQ ID NO: 36623 - RNA, 24 nt, Human
cacaccaccugcugcaugcggcug

SEQ ID NO: 36624 - RNA, 24 nt, Human
ugugagcagguccaccggccccua

SEQ ID NO: 36625 - RNA, 24 nt, Human
cagcaaaugaauggauauuucugc

SEQ ID NO: 36626 - RNA, 24 nt, Human
uccaugaccacaguaaggaccaaa

SEQ ID NO: 36627 - RNA, 24 nt, Human
aaagucauauauacgcaagguaga

SEQ ID NO: 36628 - RNA, 24 nt, Human
cucucccugucaucugggcuggag

SEQ ID NO: 36629 - RNA, 24 nt, Human
uggcugggcagguggauuacaagg

SEQ ID NO: 36630 - RNA, 24 nt, Human
ugaaggcccuagaaagguggucau

SEQ ID NO: 36631 - RNA, 24 nt, Human
auaagccucuaaagugaucagugc

SEQ ID NO: 36632 - RNA, 24 nt, Human
ucuuaaauaucaaccauggcacuu

SEQ ID NO: 36633 - RNA, 24 nt, Human
uaccgggaccgaugcccucuagug

SEQ ID NO: 36634 - RNA, 24 nt, Human
uggccgcaguugcgcuggcuuccg

SEQ ID NO: 36635 - RNA, 24 nt, Human
gaggaucaggguauguuugcgagc

SEQ ID NO: 36636 - RNA, 21 nt, Human
uagcaccuggaauucccuggu

SEQ ID NO: 36637 - RNA, 24 nt, Human
ucuggaguuccaaucccaccuuua

SEQ ID NO: 36638 - RNA, 24 nt, Human
ugaagagccacccuguggcaucga

SEQ ID NO: 36639 - RNA, 24 nt, Human
uagcaagcaggccaaagaugucuc

SEQ ID NO: 36640 - RNA, 24 nt, Human
uccgcaccucuuccaaccacccuc

SEQ ID NO: 36641 - RNA, 24 nt, Human
uuggcagucuccaguugggcugug

SEQ ID NO: 36642 - RNA, 24 nt, Human
ugucaaaaagaccugcagauaccc

SEQ ID NO: 36643 - RNA, 24 nt, Human
agugugcagccauaacacaagaaa

SEQ ID NO: 36644 - RNA, 24 nt, Human
auugugcauaucagggauacccuc

SEQ ID NO: 36645 - RNA, 24 nt, Human
ucccaugaaggaagaagugggguu

SEQ ID NO: 36646 - RNA, 24 nt, Human
ucuuacgguuugguaugggacaug

SEQ ID NO: 36647 - RNA, 23 nt, Human
ugccaaggaccaggaugauggag

SEQ ID NO: 36648 - RNA, 24 nt, Human
aggcaggggguggggaaggcggug

SEQ ID NO: 36649 - RNA, 24 nt, Human
acaagccucucagcuucgcgucgg

SEQ ID NO: 36650 - RNA, 18 nt, Human
cgcgauggagccggggcg

SEQ ID NO: 36651 - RNA, 24 nt, Human
cacaggacacugccugccagucac

SEQ ID NO: 36652 - RNA, 24 nt, Human
auggcgcugcugucuggguucuuu

SEQ ID NO: 36653 - RNA, 24 nt, Human
gcuucaguaagcuagauuuacuaa

SEQ ID NO: 36654 - RNA, 21 nt, Human
uuauuuuaggggccuuaccau

SEQ ID NO: 36655 - RNA, 24 nt, Human
uaccacucuacaagccaguuccac

SEQ ID NO: 36656 - RNA, 24 nt, Human
guccuuagagaugggaaucuugac

SEQ ID NO: 36657 - RNA, 24 nt, Human
ugagugcaacggaaagggcuauca

SEQ ID NO: 36658 - RNA, 17 nt, Human
ucaguguccacagcgca

SEQ ID NO: 36659 - RNA, 24 nt, Human
ucacucgggggaagggaaagguug

SEQ ID NO: 36660 - RNA, 24 nt, Human
ugucacggcagucguugaacacac

SEQ ID NO: 36661 - RNA, 24 nt, Human
uggcagugcugauccucagaaacu

SEQ ID NO: 36662 - RNA, 24 nt, Human
ugcaucaggcgcccuuugaggcca

SEQ ID NO: 36663 - RNA, 24 nt, Human
ugcccaagcuggaguagagugaca

SEQ ID NO: 36664 - RNA, 24 nt, Human
uacuuuuuuuuagaagggggguga

SEQ ID NO: 36665 - RNA, 24 nt, Human
acuuugugauucaggcaaaggcug

SEQ ID NO: 36666 - RNA, 24 nt, Human
aucucauuuuuuuccuuucuccag

SEQ ID NO: 36667 - RNA, 21 nt, Human
gcccugcgcuggcucugccgu

SEQ ID NO: 36668 - RNA, 24 nt, Human
uauaagagucauggaaaaagacag

SEQ ID NO: 36669 - RNA, 21 nt, Human
ugauuucugucccugcaucuc

SEQ ID NO: 36670 - RNA, 24 nt, Human
agagcaagaagaaauguaggaugu

SEQ ID NO: 36671 - RNA, 24 nt, Human
uggcaaggagcugccaaaacugag

SEQ ID NO: 36672 - RNA, 24 nt, Human
aucaaguacuaugugucaggaacc

SEQ ID NO: 36673 - RNA, 24 nt, Human
aggcagcaucugauugugauuugg

SEQ ID NO: 36674 - RNA, 24 nt, Human
guuccuguaaacauccaucgcagc

SEQ ID NO: 36675 - RNA, 24 nt, Human
ggggauccgcgggcugcagguuug

SEQ ID NO: 36676 - RNA, 24 nt, Human
uugguucaagggauggacaaguca

SEQ ID NO: 36677 - RNA, 24 nt, Human
uauugggcaaaacugcaucaaucu

SEQ ID NO: 36678 - RNA, 24 nt, Human
ugaggaggcauuuuugcuaaggcu

SEQ ID NO: 36679 - RNA, 24 nt, Human
uucacuugaaggaauucuauccgg

SEQ ID NO: 36680 - RNA, 24 nt, Human
aguggcuuaaugauccugaaggga

SEQ ID NO: 36681 - RNA, 24 nt, Human
ugacauuaacuacaauuaugggaa

SEQ ID NO: 36682 - RNA, 24 nt, Human
uacuguaucuguuuuccuucaaag

SEQ ID NO: 36683 - RNA, 24 nt, Human
gcgcaaccucuaccgccucuccaa

SEQ ID NO: 36684 - RNA, 24 nt, Human
ccugccacucuaugagcuuaagaa

SEQ ID NO: 36685 - RNA, 22 nt, Human
cccgcccccacggcccagagga

SEQ ID NO: 36686 - RNA, 24 nt, Human
gaccuuuucuuccuggacuauuga

SEQ ID NO: 36687 - RNA, 24 nt, Human
uuuaaaaucugucauuugcuuauu

SEQ ID NO: 36688 - RNA, 24 nt, Human
ugagagagagagaauauaugccac

SEQ ID NO: 36689 - RNA, 24 nt, Human
uaaaugcgcuugaugggcucggcu

SEQ ID NO: 36690 - RNA, 24 nt, Human
uugaugaagucucucaucuuuaga

SEQ ID NO: 36691 - RNA, 24 nt, Human
ucagaccaacagaagauaaccaua

SEQ ID NO: 36692 - RNA, 24 nt, Human
uauguagaaggaaacaccaagaaa

SEQ ID NO: 36693 - RNA, 24 nt, Human
aauuuuuuugcuuguuugucuuuu

SEQ ID NO: 36694 - RNA, 24 nt, Human
aaggaguuaaaagcuucuucuuca

SEQ ID NO: 36695 - RNA, 24 nt, Human
cagccguggcucucuagucuucgu

SEQ ID NO: 36696 - RNA, 24 nt, Human
acgggccgcuuuccacaaugcagu

SEQ ID NO: 36697 - RNA, 24 nt, Human
aggccgagguccgcggccaggugc

SEQ ID NO: 36698 - RNA, 24 nt, Human
uggccggcacgggcagacaacgcg

SEQ ID NO: 36699 - RNA, 24 nt, Human
cagcugcacgaacaucaugugguc

SEQ ID NO: 36700 - RNA, 24 nt, Human
ccgcgcugugaccuggggccucuc

SEQ ID NO: 36701 - RNA, 24 nt, Human
ugagcaguguaugucaggacuugu

SEQ ID NO: 36702 - RNA, 24 nt, Human
ugcuguguguuucauuuuaaauug

SEQ ID NO: 36703 - RNA, 24 nt, Human
uggauuggggagaggguccggggu

SEQ ID NO: 36704 - RNA, 24 nt, Human
uagagcuagugaauuagccuauuu

SEQ ID NO: 36705 - RNA, 24 nt, Human
uucaucucuuugcucgggagguuc

SEQ ID NO: 36706 - RNA, 23 nt, Human
cuggcccuggagcugcacggaca

SEQ ID NO: 36707 - RNA, 24 nt, Human
gagguuccuucacugugcgugcug

SEQ ID NO: 36708 - RNA, 24 nt, Human
uaucccaucacccuuuauuuggag

SEQ ID NO: 36709 - RNA, 24 nt, Human
aagaagccgauuaugugguuuagc

SEQ ID NO: 36710 - RNA, 24 nt, Human
caagcgcaaaguauccuacgccuc

SEQ ID NO: 36711 - RNA, 24 nt, Human
uacacggucguggacgagauguuc

SEQ ID NO: 36712 - RNA, 24 nt, Human
cccuccuggacucgccugcucgcu

SEQ ID NO: 36713 - RNA, 22 nt, Human
ucaggccacugaauggguagga

SEQ ID NO: 36714 - RNA, 24 nt, Human
cuugcugugcucaccugggggggg

SEQ ID NO: 36715 - RNA, 24 nt, Human
accugcucuaguccuguggguccc

SEQ ID NO: 36716 - RNA, 24 nt, Human
agccuacauccuggugguggcggg

SEQ ID NO: 36717 - RNA, 24 nt, Human
gaccuggauccugcacaguugggg

SEQ ID NO: 36718 - RNA, 22 nt, Human
ugccucagagaacuucugcagc

SEQ ID NO: 36719 - RNA, 24 nt, Human
ugggggaaccccccuuuuuccuua

SEQ ID NO: 36720 - RNA, 20 nt, Human
ccccaggggggggggggggg

SEQ ID NO: 36721 - RNA, 20 nt, Human
ucccuguggaaugaaaccgc

SEQ ID NO: 36722 - RNA, 24 nt, Human
uaaugggucucaaaauucugugac

SEQ ID NO: 36723 - RNA, 24 nt, Human
uauuagggauaauauucauuuagc

SEQ ID NO: 36724 - RNA, 24 nt, Human
aggaggcuuuaaaaauagacacca

SEQ ID NO: 36725 - RNA, 24 nt, Human
uucagugucgucaauuuuccauga

SEQ ID NO: 36726 - RNA, 24 nt, Human
uggaagcugcugcugagaucccag

SEQ ID NO: 36727 - RNA, 24 nt, Human
uccaggguucuaccacuugggggg

SEQ ID NO: 36728 - RNA, 21 nt, Human
gguucugggcucccagagagg

SEQ ID NO: 36729 - RNA, 24 nt, Human
ugagaucuugggcaaaucacuuag

SEQ ID NO: 36730 - RNA, 24 nt, Human
uaccucgcccacacuggccagcag

SEQ ID NO: 36731 - RNA, 24 nt, Human
cauucaaucacucucuaugcuugg

SEQ ID NO: 36732 - RNA, 23 nt, Human
ugccccaguacuuuguggguguu

SEQ ID NO: 36733 - RNA, 24 nt, Human
cuggcagugcuccuggcgucgugg

SEQ ID NO: 36734 - RNA, 24 nt, Human
uauuuuuauaacuuguggucguac

SEQ ID NO: 36735 - RNA, 24 nt, Human
uucauauucauggcugaaacuuga

SEQ ID NO: 36736 - RNA, 24 nt, Human
uccaagcugagcuggaugggcuac

SEQ ID NO: 36737 - RNA, 24 nt, Human
cuagauggugacuguaugaccuua

SEQ ID NO: 36738 - RNA, 24 nt, Human
cuggagcagguccaccggccccua

SEQ ID NO: 36739 - RNA, 24 nt, Human
gugcagaaugagggccgaguagau

SEQ ID NO: 36740 - RNA, 24 nt, Human
ccaggccaaaaaggcucaacauuu

SEQ ID NO: 36741 - RNA, 24 nt, Human
aggugucggauggacuuuuggcuc

SEQ ID NO: 36742 - RNA, 24 nt, Human
ugaagaggugagcuccccuucgcc

SEQ ID NO: 36743 - RNA, 24 nt, Human
ugggcaaguuggugagguucugca

SEQ ID NO: 36744 - RNA, 24 nt, Human
gugcugccccuugaggaagcaaag

SEQ ID NO: 36745 - RNA, 24 nt, Human
uaagagaacaguacaauuugcagu

SEQ ID NO: 36746 - RNA, 24 nt, Human
uugaacacauucuuaaaaacacug

SEQ ID NO: 36747 - RNA, 24 nt, Human
uucaagcucuaaaauuuugguucu

SEQ ID NO: 36748 - RNA, 24 nt, Human
gguaaggcugggugcaguggcuca

SEQ ID NO: 36749 - RNA, 21 nt, Human
ugacugcagagcaaguagcug

SEQ ID NO: 36750 - RNA, 24 nt, Human
uggaugauccugagguggagcagg

SEQ ID NO: 36751 - RNA, 19 nt, Human
uuccaaguggugcuggaag

SEQ ID NO: 36752 - RNA, 24 nt, Human
ugucuguagauuuuggaaaguggu

SEQ ID NO: 36753 - RNA, 24 nt, Human
acauuccuuauugcguuggcccag

SEQ ID NO: 36754 - RNA, 24 nt, Human
acccuggugugaaugcgcacaucu

SEQ ID NO: 36755 - RNA, 22 nt, Human
uuacugaauguggcaucagggc

SEQ ID NO: 36756 - RNA, 24 nt, Human
cauggcucaccaagcccugcucca

SEQ ID NO: 36757 - RNA, 24 nt, Human
ucccucuggcugaagacugagaag

SEQ ID NO: 36758 - RNA, 21 nt, Human
uagguggugacagggccuuga

SEQ ID NO: 36759 - RNA, 24 nt, Human
cagggcacagaugaccaaaguccc

SEQ ID NO: 36760 - RNA, 24 nt, Human
ucuuuuguauaaaugacaaagugu

SEQ ID NO: 36761 - RNA, 24 nt, Human
aggcaggggguggggaaggcggug

SEQ ID NO: 36762 - RNA, 23 nt, Human
ugccaaggaccaggaugauggag

SEQ ID NO: 36763 - RNA, 22 nt, Human
aagcugccccaccagcucugcc

SEQ ID NO: 36764 - RNA, 24 nt, Human
ccucccugguggcuaacagggaau

SEQ ID NO: 36765 - RNA, 24 nt, Human
aucacaguuuagaggcacagugga

SEQ ID NO: 36766 - RNA, 24 nt, Human
ucacugagugagcagaaucuggua

SEQ ID NO: 36767 - RNA, 24 nt, Human
agugaagaauucaggcaggugaug

SEQ ID NO: 36768 - RNA, 24 nt, Human
uaccugcugcaggguugguacauu

SEQ ID NO: 36769 - RNA, 24 nt, Human
aggccucacagccgcuuagcacag

SEQ ID NO: 36770 - RNA, 24 nt, Human
ucaguccuggcuagacaaguccac

SEQ ID NO: 36771 - RNA, 24 nt, Human
ugcgaagcccggagaaugugaggc

SEQ ID NO: 36772 - RNA, 24 nt, Human
uuugccuggcagguucaggcucag

SEQ ID NO: 36773 - RNA, 18 nt, Human
cucuaaaucaugguccuc

SEQ ID NO: 36774 - RNA, 24 nt, Human
ugaauauuauucuuuaaugugacu

SEQ ID NO: 36775 - RNA, 24 nt, Human
uuaaaguuucaaaauggagacuca

SEQ ID NO: 36776 - RNA, 24 nt, Human
uguuuagagggaaauauaaauuua

SEQ ID NO: 36777 - RNA, 24 nt, Human
ugagaugggaaagggcuccuucaa

SEQ ID NO: 36778 - RNA, 21 nt, Human
uucaagggauggaaagucacc

SEQ ID NO: 36779 - RNA, 24 nt, Human
uccaggccccacccuagacuuccu

SEQ ID NO: 36780 - RNA, 24 nt, Human
ugccaggugcuuuguggauguucu

SEQ ID NO: 36781 - RNA, 24 nt, Human
ugagaaaggcggagaggcuccaaa

SEQ ID NO: 36782 - RNA, 24 nt, Human
ggccgguggcugagcagucccaga

SEQ ID NO: 36783 - RNA, 24 nt, Human
uuccuugguaugguuaugauuaua

SEQ ID NO: 36784 - RNA, 24 nt, Human
gggcauuuggcauuguuggaaaug

SEQ ID NO: 36785 - RNA, 24 nt, Human
uaucagaggauuuaguucuugcau

SEQ ID NO: 36786 - RNA, 20 nt, Human
ucaguguaguuguaaaugcu

SEQ ID NO: 36787 - RNA, 24 nt, Human
uuaauguuauuaugagguuaaugu

SEQ ID NO: 36788 - RNA, 24 nt, Human
uguuuuguuuuuucauauuuguag

SEQ ID NO: 36789 - RNA, 24 nt, Human
agaguuccagccagaagcuacagc

SEQ ID NO: 36790 - RNA, 24 nt, Human
aaaaccuucaaccucaugccagaa

SEQ ID NO: 36791 - RNA, 18 nt, Human
ucucagggcagauggaag

SEQ ID NO: 36792 - RNA, 24 nt, Human
uuaaagcaguuuuagguguacagc

SEQ ID NO: 36793 - RNA, 24 nt, Human
ucaaaaauagauaguuggugacug

SEQ ID NO: 36794 - RNA, 24 nt, Human
uucauagucgugaaacuggugucu

SEQ ID NO: 36795 - RNA, 24 nt, Human
ggccauggacuuguacagcacccc

SEQ ID NO: 36796 - RNA, 24 nt, Human
acaggaacaugucaucugcagaga

SEQ ID NO: 36797 - RNA, 24 nt, Human
gucgcagggaagcccuggagaaaa

SEQ ID NO: 36798 - RNA, 24 nt, Human
uauugcuuugcccucuuuuucacu

SEQ ID NO: 36799 - RNA, 24 nt, Human
uucauaauacauagaugauauaaa

SEQ ID NO: 36800 - RNA, 24 nt, Human
ugaguaagaagcuauauggacucc

SEQ ID NO: 36801 - RNA, 24 nt, Human
aagaaucauugagauaggaggaaa

SEQ ID NO: 36802 - RNA, 24 nt, Human
uccccaggcucaagcauccuccca

SEQ ID NO: 36803 - RNA, 24 nt, Human
cccgggcucaagugauccaccccc

SEQ ID NO: 36804 - RNA, 24 nt, Human
uaugucugugcucacuccuuuaga

SEQ ID NO: 36805 - RNA, 24 nt, Human
uuaguucauucuucuaauaagccu

SEQ ID NO: 36806 - RNA, 24 nt, Human
aagcguuaucugucaaagcaauuc

SEQ ID NO: 36807 - RNA, 24 nt, Human
ugugcucagcaaugagaauauagc

SEQ ID NO: 36808 - RNA, 17 nt, Human
uuucuuggugggucaag

SEQ ID NO: 36809 - RNA, 24 nt, Human
uguaauaggcuggcugcgcugcua

SEQ ID NO: 36810 - RNA, 24 nt, Human
ucaguuuugauggaacuuggagua

SEQ ID NO: 36811 - RNA, 24 nt, Human
ucgaugccacaucccccucaaagg

SEQ ID NO: 36812 - RNA, 24 nt, Human
ugauggauguggcgaaaugaacau

SEQ ID NO: 36813 - RNA, 24 nt, Human
ucacugagcuaaugaucuaauccu

SEQ ID NO: 36814 - RNA, 24 nt, Human
ccccccgagcugaggaggcuucgc

SEQ ID NO: 36815 - RNA, 24 nt, Human
ugugcaggacaaggagccgcaagg

SEQ ID NO: 36816 - RNA, 24 nt, Human
ccccagagccucaggcagcucaga

SEQ ID NO: 36817 - RNA, 24 nt, Human
acgcucccacgguggcacaugaac

SEQ ID NO: 36818 - RNA, 24 nt, Human
ugccuuauuguuuacaugaugguc

SEQ ID NO: 36819 - RNA, 24 nt, Human
uuaauugcaaaagaauagugauca

SEQ ID NO: 36820 - RNA, 22 nt, Human
uacgcugccugugaccuuugug

SEQ ID NO: 36821 - RNA, 24 nt, Human
uaagagcuacugucagaccuucag

SEQ ID NO: 36822 - RNA, 24 nt, Human
uaagagaaaaugucuucuuuagga

SEQ ID NO: 36823 - RNA, 22 nt, Human
uggggcaacaccagcuggugga

SEQ ID NO: 36824 - RNA, 24 nt, Human
uaaauguccuaucugugagaaaag

SEQ ID NO: 36825 - RNA, 24 nt, Human
ugcaaaaaagccuuucugcggagu

SEQ ID NO: 36826 - RNA, 24 nt, Human
agggaccaggagcuccugcaugcu

SEQ ID NO: 36827 - RNA, 18 nt, Human
uggcaggaauauaccuuc

SEQ ID NO: 36828 - RNA, 24 nt, Human
agagguaaucaggcccaggcugcg

SEQ ID NO: 36829 - RNA, 21 nt, Human
gcggacccacacgggcgagug

SEQ ID NO: 36830 - RNA, 24 nt, Human
ggacaccgccaggcccgagcccag

SEQ ID NO: 36831 - RNA, 24 nt, Human
ugaguuaacaaaauauuuuuaaua

SEQ ID NO: 36832 - RNA, 24 nt, Human
ugaguugguuggauuggcaagcau

SEQ ID NO: 36833 - RNA, 23 nt, Human
uugcucgcaguauccuagaaucu

SEQ ID NO: 36834 - RNA, 24 nt, Human
ugacuugguguuuuaucuugaccc

SEQ ID NO: 36835 - RNA, 24 nt, Human
uaagguaaaugacacaaaguugaa

SEQ ID NO: 36836 - RNA, 24 nt, Human
acuaaacuguagagaaaagacaaa

SEQ ID NO: 36837 - RNA, 24 nt, Human
ugagugcaacggaaagggcuauca

SEQ ID NO: 36838 - RNA, 24 nt, Human
uugcauagcucaaaaaguuugaaa

SEQ ID NO: 36839 - RNA, 24 nt, Human
uauuagggauaauauucauuuagc

SEQ ID NO: 36840 - RNA, 24 nt, Human
uaaugggucucaaaauucugugac

SEQ ID NO: 36841 - RNA, 24 nt, Human
uggccaaggauucuuugcuugucu

SEQ ID NO: 36842 - RNA, 20 nt, Human
uggcucggggcgagcggcgg

SEQ ID NO: 36843 - RNA, 21 nt, Human
cacccuuuuucucaagccaag

SEQ ID NO: 36844 - RNA, 17 nt, Human
uggcugggaguuccacg

SEQ ID NO: 36845 - RNA, 24 nt, Human
cuggcacuucagguguggccggca

SEQ ID NO: 36846 - RNA, 24 nt, Human
acugucuuugugguucuggcuguu

SEQ ID NO: 36847 - RNA, 24 nt, Human
agacagggugcguccaucuuccag

SEQ ID NO: 36848 - RNA, 24 nt, Human
ucagggucuucacgaagaucugca

SEQ ID NO: 36849 - RNA, 21 nt, Human
ugagcggaggagggcccgagu

SEQ ID NO: 36850 - RNA, 18 nt, Human
ugcuauuucggcuucauc

SEQ ID NO: 36851 - RNA, 24 nt, Human
caagagcaccuggcguacgccugc

SEQ ID NO: 36852 - RNA, 24 nt, Human
uagcuuauuggucaggguagauag

SEQ ID NO: 36853 - RNA, 24 nt, Human
uguuauggaauauaguuauaagca

SEQ ID NO: 36854 - RNA, 20 nt, Human
uccugggugcugggacgugc

SEQ ID NO: 36855 - RNA, 24 nt, Human
gacucugggccaccccaguuauac

SEQ ID NO: 36856 - RNA, 21 nt, Human
uguggaaaugguuauauaugg

SEQ ID NO: 36857 - RNA, 24 nt, Human
uugccuggcccugggaggcccaag

SEQ ID NO: 36858 - RNA, 24 nt, Human
uucauaguuuacagaauuuuaaug

SEQ ID NO: 36859 - RNA, 24 nt, Human
aaggagcuggccuugaacucaggg

SEQ ID NO: 36860 - RNA, 24 nt, Human
cggggccaggcuggcagcugucug

SEQ ID NO: 36861 - RNA, 24 nt, Human
uggcugccugcucagggccuggcu

SEQ ID NO: 36862 - RNA, 18 nt, Human
ugcgugcggaagcgcagg

SEQ ID NO: 36863 - RNA, 24 nt, Human
ugaguagauuuacaguugugugga

SEQ ID NO: 36864 - RNA, 24 nt, Human
cuagcauuuucaaguuugcaguaa

SEQ ID NO: 36865 - RNA, 24 nt, Human
guuuggggagagacacaggcaggc

SEQ ID NO: 36866 - RNA, 24 nt, Human
agucuguugggguggugcucaggg

SEQ ID NO: 36867 - RNA, 24 nt, Human
gggccggagcguggccggaccccc

SEQ ID NO: 36868 - RNA, 24 nt, Human
ccuggcaugccuuuuucacggcgg

SEQ ID NO: 36869 - RNA, 24 nt, Human
cucagcauccggcaagaaaacaga

SEQ ID NO: 36870 - RNA, 24 nt, Human
ucuucaauuuuuguauagaguuuu

SEQ ID NO: 36871 - RNA, 24 nt, Human
ucucaccgaagugaucuggaaugu

SEQ ID NO: 36872 - RNA, 24 nt, Human
ugggaaguuuggggccuacaugca

SEQ ID NO: 36873 - RNA, 24 nt, Human
ucgguuguuaagaacuagagcuua

SEQ ID NO: 36874 - RNA, 24 nt, Human
uuuccauguaaaaucucuguugug

SEQ ID NO: 36875 - RNA, 24 nt, Human
uaaaaugcucucaaguccuuugaa

SEQ ID NO: 36876 - RNA, 23 nt, Human
cacugcuauaaaagaugcagggg

SEQ ID NO: 36877 - RNA, 24 nt, Human
uggaauaguauuauguacaaggca

SEQ ID NO: 36878 - RNA, 24 nt, Human
uugaaagguauauuaaaauuaagg

SEQ ID NO: 36879 - RNA, 24 nt, Human
ucuacagucugugaauauaccaau

SEQ ID NO: 36880 - RNA, 24 nt, Human
uggcaauuguaaauagguuuccag

SEQ ID NO: 36881 - RNA, 22 nt, Human
uugaaguuacccaaccaaaugg

SEQ ID NO: 36882 - RNA, 23 nt, Human
caggagccaaucauuagaauuug

SEQ ID NO: 36883 - RNA, 22 nt, Human
ucccucaccaguacaguggagg

SEQ ID NO: 36884 - RNA, 24 nt, Human
ugagaaagagcccuguggcuacgu

SEQ ID NO: 36885 - RNA, 24 nt, Human
ugagaaagagcccuguggcuacgu

SEQ ID NO: 36886 - RNA, 17 nt, Human
uacaguggagguguugg

SEQ ID NO: 36887 - RNA, 21 nt, Human
ugaguuggugagugcugaugu

SEQ ID NO: 36888 - RNA, 24 nt, Human
cagcggaugaauauugggaagcuc

SEQ ID NO: 36889 - RNA, 24 nt, Human
ucuugcucugucgcccaggcugaa

SEQ ID NO: 36890 - RNA, 24 nt, Human
cccaaguagcugggauuacaggcu

SEQ ID NO: 36891 - RNA, 24 nt, Human
aggcauugcaaaaugccuuugaua

SEQ ID NO: 36892 - RNA, 24 nt, Human
cgcgcaaauccucaacugcccugc

SEQ ID NO: 36893 - RNA, 24 nt, Human
uaaugcuagcagguuaaaaucaau

SEQ ID NO: 36894 - RNA, 24 nt, Human
ugccugcacggccgcgucgcucag

SEQ ID NO: 36895 - RNA, 21 nt, Human
gcgcggcgcgagggcgcggag

SEQ ID NO: 36896 - RNA, 24 nt, Human
ugggaagggaaguuaucaagacga

SEQ ID NO: 36897 - RNA, 24 nt, Human
ucaaggcaggaauaaagagcuuuu

SEQ ID NO: 36898 - RNA, 24 nt, Human
uggcagaguuaaauugugcuuuug

SEQ ID NO: 36899 - RNA, 24 nt, Human
auuaaguauccucuaccugcaaau

SEQ ID NO: 36900 - RNA, 24 nt, Human
uccccaggcagccuggggaacgug

SEQ ID NO: 36901 - RNA, 24 nt, Human
uggaacuguguuugggagccucau

SEQ ID NO: 36902 - RNA, 24 nt, Human
uuuuucagacaauuuugcagaaag

SEQ ID NO: 36903 - RNA, 24 nt, Human
uuccauuguguuaaaggcuguaau

SEQ ID NO: 36904 - RNA, 24 nt, Human
uuccauugcacuccagccugggua

SEQ ID NO: 36905 - RNA, 21 nt, Human
ugcgacgauugugcuuugagg

SEQ ID NO: 36906 - RNA, 24 nt, Human
uaacagguguaagaguguugaaaa

SEQ ID NO: 36907 - RNA, 24 nt, Human
uaucaaggaagggcaggcgugaug

SEQ ID NO: 36908 - RNA, 24 nt, Human
uucaaauuucuuucuuuuuuaauu

SEQ ID NO: 36909 - RNA, 24 nt, Human
ccccccuucccccuuuuuuguccc

SEQ ID NO: 36910 - RNA, 24 nt, Human
uagcauugcuuucguguaaauuau

SEQ ID NO: 36911 - RNA, 24 nt, Human
uaccugugcaguugugaauaccca

SEQ ID NO: 36912 - RNA, 24 nt, Human
cuaugcuaggaggcaaauggccag

SEQ ID NO: 36913 - RNA, 24 nt, Human
ucuguaauuaugaaaaagguuguu

SEQ ID NO: 36914 - RNA, 24 nt, Human
uguuuugcaucuguaucuucuaaa

SEQ ID NO: 36915 - RNA, 18 nt, Human
uggguuugguugauugca

SEQ ID NO: 36916 - RNA, 24 nt, Human
uagcauccauaauaaaguuucauu

SEQ ID NO: 36917 - RNA, 24 nt, Human
uagccucacucuccauucucugcc

SEQ ID NO: 36918 - RNA, 24 nt, Human
uuaaagcacuuucuaaagcccuca

SEQ ID NO: 36919 - RNA, 23 nt, Human
uacacaguguuuauugugguuag

SEQ ID NO: 36920 - RNA, 24 nt, Human
ggugauugcauaguguccuuugag

SEQ ID NO: 36921 - RNA, 24 nt, Human
uucaccuuggcuugaguagggggc

SEQ ID NO: 36922 - RNA, 24 nt, Human
uuucuuggguuuuugggcagccuu

SEQ ID NO: 36923 - RNA, 24 nt, Human
uaggagaaggaauuucaggugggu

SEQ ID NO: 36924 - RNA, 24 nt, Human
uuaacauagacuugaauuauuuuu

SEQ ID NO: 36925 - RNA, 24 nt, Human
ugccacgggaggaaugacaagcag

SEQ ID NO: 36926 - RNA, 24 nt, Human
auugcaaauuccauagggcugugg

SEQ ID NO: 36927 - RNA, 24 nt, Human
cauucacugugcuaucggcaauga

SEQ ID NO: 36928 - RNA, 24 nt, Human
aagaaggcauuuucacacaaggcu

SEQ ID NO: 36929 - RNA, 24 nt, Human
uuuucaguuucauccauguauuuc

SEQ ID NO: 36930 - RNA, 24 nt, Human
ugaaauauaauucacauaccacaa

SEQ ID NO: 36931 - RNA, 20 nt, Human
gaucaugguuaucugauuug

SEQ ID NO: 36932 - RNA, 24 nt, Human
ugggaaauuuccagguuuugugaa

SEQ ID NO: 36933 - RNA, 24 nt, Human
ccccguugucuucgcgugugucug

SEQ ID NO: 36934 - RNA, 24 nt, Human
uaaacuaccagugaaaagcgaaua

SEQ ID NO: 36935 - RNA, 24 nt, Human
uuguaagaguggaauuaacugccc

SEQ ID NO: 36936 - RNA, 24 nt, Human
ucccagagcaaccauguuuuagca

SEQ ID NO: 36937 - RNA, 24 nt, Human
cuaaggcgucuuuuguaggcuuaa

SEQ ID NO: 36938 - RNA, 24 nt, Human
uauuauguggugaaauuuuguaaa

SEQ ID NO: 36939 - RNA, 24 nt, Human
uagcuuuauuggggagggggugau

SEQ ID NO: 36940 - RNA, 24 nt, Human
cucguaguguucuggcgggcaguu

SEQ ID NO: 36941 - RNA, 24 nt, Human
uauaaaacuuugauaguuacauug

SEQ ID NO: 36942 - RNA, 24 nt, Human
aacagguaaccacuugagaggaug

SEQ ID NO: 36943 - RNA, 24 nt, Human
uaacagggacgccacagguuuuua

SEQ ID NO: 36944 - RNA, 24 nt, Human
agggagccacgauaauucuccaga

SEQ ID NO: 36945 - RNA, 24 nt, Human
ugaaugacgagcauugagccauca

SEQ ID NO: 36946 - RNA, 24 nt, Human
uaaugggucucaaaauucugugac

SEQ ID NO: 36947 - RNA, 24 nt, Human
uauuagggauaauauucauuuagc

SEQ ID NO: 36948 - RNA, 24 nt, Human
uuuauaaucuauuuguggauuuug

SEQ ID NO: 36949 - RNA, 24 nt, Human
uuuauuagauaccauuuaaaaauu

SEQ ID NO: 36950 - RNA, 24 nt, Human
uuucauugcagucauuauaggauu

SEQ ID NO: 36951 - RNA, 24 nt, Human
cagcagaacauguaguuaugcuug

SEQ ID NO: 36952 - RNA, 24 nt, Human
uaaggaaacuguuguuguuaaaau

SEQ ID NO: 36953 - RNA, 24 nt, Human
uauaauauauucuaaacacaauga

SEQ ID NO: 36954 - RNA, 24 nt, Human
gugcaguuaauguugaaguuacag

SEQ ID NO: 36955 - RNA, 21 nt, Human
uaacauccaccccccaccauc

SEQ ID NO: 36956 - RNA, 24 nt, Human
aaagauggucggcugcuuuuggua

SEQ ID NO: 36957 - RNA, 24 nt, Human
ggacagguguacagacauguucuu

SEQ ID NO: 36958 - RNA, 24 nt, Human
ucgaauggacacauuaccagugaa

SEQ ID NO: 36959 - RNA, 24 nt, Human
uccaaggggauauccacagaguac

SEQ ID NO: 36960 - RNA, 24 nt, Human
ucucuuggcgaucuucuucuugcc

SEQ ID NO: 36961 - RNA, 20 nt, Human
caucacccagccuccgaguc

SEQ ID NO: 36962 - RNA, 24 nt, Human
agcuguugauuauguuuguaguug

SEQ ID NO: 36963 - RNA, 24 nt, Human
aagcggccgggggucaucuaacag

SEQ ID NO: 36964 - RNA, 24 nt, Human
uugaauguuggaaagacacugaca

SEQ ID NO: 36965 - RNA, 24 nt, Human
ugcgguggcagcucugucuggccg

SEQ ID NO: 36966 - RNA, 18 nt, Human
ugaccagaauaugggugg

SEQ ID NO: 36967 - RNA, 20 nt, Human
uccauggucucuuugggcgg

SEQ ID NO: 36968 - RNA, 24 nt, Human
uuuauaauuaaauuauauaauggg

SEQ ID NO: 36969 - RNA, 24 nt, Human
ucuauagacaucacuuaaccuaaa

SEQ ID NO: 36970 - RNA, 24 nt, Human
ugccuugggaagggaggagcagag

SEQ ID NO: 36971 - RNA, 24 nt, Human
uguagauagucuacauuaugauau

SEQ ID NO: 36972 - RNA, 24 nt, Human
agaaugcaaauauauuuuuacugu

SEQ ID NO: 36973 - RNA, 24 nt, Human
uucaacauauguaacguuauucuc

SEQ ID NO: 36974 - RNA, 24 nt, Human
uugaagcauagaauugggcaucca

SEQ ID NO: 36975 - RNA, 24 nt, Human
uggcugggcucuuaucuggaaguu

SEQ ID NO: 36976 - RNA, 24 nt, Human
ucuacaauaaccucaacccccuua

SEQ ID NO: 36977 - RNA, 24 nt, Human
aggcagaguggagagaaacaacuc

SEQ ID NO: 36978 - RNA, 24 nt, Human
ugaaguauacaaacugaaagcuga

SEQ ID NO: 36979 - RNA, 22 nt, Human
ugaaagaaggccuaaagaauua

SEQ ID NO: 36980 - RNA, 24 nt, Human
ccuuuggucgcucgcuccucuccu

SEQ ID NO: 36981 - RNA, 24 nt, Human
ugacauuugcgucugagaaacaau

SEQ ID NO: 36982 - RNA, 24 nt, Human
ucagugguugguggaacaugaaua

SEQ ID NO: 36983 - RNA, 24 nt, Human
aaagauccuggguaguucggauga

SEQ ID NO: 36984 - RNA, 21 nt, Human
ugacucguaaugguggguugc

SEQ ID NO: 36985 - RNA, 24 nt, Human
agucagucgaaguguggccauaau

SEQ ID NO: 36986 - RNA, 24 nt, Human
ccgugcgguguuggugcacugguc

SEQ ID NO: 36987 - RNA, 24 nt, Human
uaccucuagugcaauuuauaagca

SEQ ID NO: 36988 - RNA, 24 nt, Human
ucacaaggauugaaagaugagguu

SEQ ID NO: 36989 - RNA, 24 nt, Human
uaguugcagccacuaacauguuaa

SEQ ID NO: 36990 - RNA, 24 nt, Human
ugugcaacuaucauuuuucucacc

SEQ ID NO: 36991 - RNA, 24 nt, Human
uauucaguguuucccgaguaagcc

SEQ ID NO: 36992 - RNA, 24 nt, Human
uacaggagaggaaugaugauuuac

SEQ ID NO: 36993 - RNA, 19 nt, Human
uugaagcugagccccgccu

SEQ ID NO: 36994 - RNA, 24 nt, Human
ucuggugugaggcacagcgagggc

SEQ ID NO: 36995 - RNA, 24 nt, Human
uauggcaagaaguccaagcuggag

SEQ ID NO: 36996 - RNA, 24 nt, Human
uguguuuguagacuuggaacccac

SEQ ID NO: 36997 - RNA, 24 nt, Human
caccggucuucagggcuucuuggu

SEQ ID NO: 36998 - RNA, 24 nt, Human
ccccggaggucccggaaagggcgg

SEQ ID NO: 36999 - RNA, 24 nt, Human
uaccuggaagagaggcuggaagcu

SEQ ID NO: 37000 - RNA, 24 nt, Human
ucaaagcguuagguuauaggaauu

SEQ ID NO: 37001 - RNA, 24 nt, Human
uaggauaauaguggagagaagguc

SEQ ID NO: 37002 - RNA, 24 nt, Human
uuccuuacuuucuagaauaacaag

SEQ ID NO: 37003 - RNA, 24 nt, Human
uauccugccuuaauucuagaauca

SEQ ID NO: 37004 - RNA, 24 nt, Human
caccuggcugucuuuuccauuaug

SEQ ID NO: 37005 - RNA, 24 nt, Human
gucaacucugccugcauccuaaaa

SEQ ID NO: 37006 - RNA, 24 nt, Human
agucguuuuuuuacagagaaaagg

SEQ ID NO: 37007 - RNA, 24 nt, Human
ugaccagggcugugcuugagguac

SEQ ID NO: 37008 - RNA, 24 nt, Human
uaccugccgaucauagacgacguc

SEQ ID NO: 37009 - RNA, 24 nt, Human
gggcagugggcaccgucaaaguau

SEQ ID NO: 37010 - RNA, 24 nt, Human
caccuggaacaucaaccacgcccg

SEQ ID NO: 37011 - RNA, 22 nt, Human
cacucgguguacguccuggagg

SEQ ID NO: 37012 - RNA, 24 nt, Human
cuccucuagcuuauuggugucucc

SEQ ID NO: 37013 - RNA, 24 nt, Human
caccgggaggugaccccugaccag

SEQ ID NO: 37014 - RNA, 24 nt, Human
ucugaucuauaaaugcgguggcau

SEQ ID NO: 37015 - RNA, 23 nt, Human
agcaacuaucagggcagcucugc

SEQ ID NO: 37016 - RNA, 24 nt, Human
uauugcucacgggggcuccagccg

SEQ ID NO: 37017 - RNA, 24 nt, Human
ucccgugggccucacaugccaggu

SEQ ID NO: 37018 - RNA, 24 nt, Human
uggccugaugauccacagcggaga

SEQ ID NO: 37019 - RNA, 24 nt, Human
ugugugccauugcccaggcagagu

SEQ ID NO: 37020 - RNA, 24 nt, Human
uacaccacucccaagaagaauaag

SEQ ID NO: 37021 - RNA, 24 nt, Human
uauggcaagucacuuugacagaca

SEQ ID NO: 37022 - RNA, 24 nt, Human
ugagaauggcaaaauuagucgccu

SEQ ID NO: 37023 - RNA, 24 nt, Human
uacaccacucccaagaagaauaag

SEQ ID NO: 37024 - RNA, 24 nt, Human
caccuggcaagcacuguggcuggc

SEQ ID NO: 37025 - RNA, 24 nt, Human
uacacugacacgggaaagagggcg

SEQ ID NO: 37026 - RNA, 24 nt, Human
uacguccaacuucagccccagaug

SEQ ID NO: 37027 - RNA, 24 nt, Human
uuagcggugcccucaugccugcuc

SEQ ID NO: 37028 - RNA, 24 nt, Human
ucacugaguacgcggugcagcgca

SEQ ID NO: 37029 - RNA, 24 nt, Human
aagcaucugaguuugagaccaugg

SEQ ID NO: 37030 - RNA, 24 nt, Human
uaccuuugauaaagggcagaugaa

SEQ ID NO: 37031 - RNA, 23 nt, Human
caucaauugcugccaacccaggg

SEQ ID NO: 37032 - RNA, 24 nt, Human
caagaacccgagcacgaacuucca

SEQ ID NO: 37033 - RNA, 24 nt, Human
aauuguuggcuguuuucauaagca

SEQ ID NO: 37034 - RNA, 23 nt, Human
uggcagaaaucagcacgcuggcc

SEQ ID NO: 37035 - RNA, 24 nt, Human
acugcucugagauuugagggaaac

SEQ ID NO: 37036 - RNA, 24 nt, Human
ccuggacgagccccagggacaguc

SEQ ID NO: 37037 - RNA, 21 nt, Human
cugcagcagcucuucuccucc

SEQ ID NO: 37038 - RNA, 24 nt, Human
uccacauucggcuauggggaggaa

SEQ ID NO: 37039 - RNA, 24 nt, Human
ggagguggacuuuggccccuaggg

SEQ ID NO: 37040 - RNA, 24 nt, Human
uggggaggaaagccaguaggaccc

SEQ ID NO: 37041 - RNA, 24 nt, Human
ugcaggaaugagagugauuuuaug

SEQ ID NO: 37042 - RNA, 24 nt, Human
uaaaaaggaccuuuuguuuauacu

SEQ ID NO: 37043 - RNA, 24 nt, Human
ugucagagguugaaugccaucugc

SEQ ID NO: 37044 - RNA, 24 nt, Human
aaaaauuucaauaaccuuugaaau

SEQ ID NO: 37045 - RNA, 24 nt, Human
uuauauuguguuuuuugcguuggu

SEQ ID NO: 37046 - RNA, 24 nt, Human
ucagcaagcaggaguaugacgagu

SEQ ID NO: 37047 - RNA, 24 nt, Human
gacacggugcaaggugacagcagu

SEQ ID NO: 37048 - RNA, 24 nt, Human
acgcagagccggacgugacgggcu

SEQ ID NO: 37049 - RNA, 23 nt, Human
ugacagcugaaggcggggaggcu

SEQ ID NO: 37050 - RNA, 24 nt, Human
aggcuggggucaggcagagguggg

SEQ ID NO: 37051 - RNA, 24 nt, Human
gguccagucagccuugcccagugg

SEQ ID NO: 37052 - RNA, 24 nt, Human
uggccaguuagccguaaaaaaaga

SEQ ID NO: 37053 - RNA, 24 nt, Human
gcgccuuuguuggggguccgggaa

SEQ ID NO: 37054 - RNA, 24 nt, Human
uuucugggagagugcuuaauuccu

SEQ ID NO: 37055 - RNA, 24 nt, Human
ugauugaagccaggaagaaucaug

SEQ ID NO: 37056 - RNA, 24 nt, Human
guggcggcggcggcggcggcagca

SEQ ID NO: 37057 - RNA, 24 nt, Human
agucuuagaaugaguagcaauauc

SEQ ID NO: 37058 - RNA, 24 nt, Human
ccacugcgggggcaagacgaagga

SEQ ID NO: 37059 - RNA, 24 nt, Human
uaaguugcugcaaauucaaaagcu

SEQ ID NO: 37060 - RNA, 24 nt, Human
ugucuugggggaagugcaacugug

SEQ ID NO: 37061 - RNA, 23 nt, Human
uaaggcccacuuaggguccuggu

SEQ ID NO: 37062 - RNA, 24 nt, Human
uaaauugaagaaauuauuuauuac

SEQ ID NO: 37063 - RNA, 24 nt, Human
uugcuguacagauuuuaaaaaacc

SEQ ID NO: 37064 - RNA, 24 nt, Human
agaagaagaagaaauggcaaagag

SEQ ID NO: 37065 - RNA, 24 nt, Human
ucaauuuuuauuuugguuuucuua

SEQ ID NO: 37066 - RNA, 24 nt, Human
gccccgggagaaacacgccagggg

SEQ ID NO: 37067 - RNA, 24 nt, Human
uagggucuaaaaaagcucaaaggg

SEQ ID NO: 37068 - RNA, 24 nt, Human
auuauguuauacaaggcaagcauu

SEQ ID NO: 37069 - RNA, 24 nt, Human
ucacugggcagguuuaagaagaag

SEQ ID NO: 37070 - RNA, 24 nt, Human
ugacuggggcagguuguagagaaa

SEQ ID NO: 37071 - RNA, 24 nt, Human
ugacugcucugccauguugcuuug

SEQ ID NO: 37072 - RNA, 24 nt, Human
uuagaggagccuuuuucaucugac

SEQ ID NO: 37073 - RNA, 24 nt, Human
uguccuguauucuaccgaguccga

SEQ ID NO: 37074 - RNA, 24 nt, Human
uccauggcaggcggguacaagggg

SEQ ID NO: 37075 - RNA, 21 nt, Human
ugggaucgaucagcacugcca

SEQ ID NO: 37076 - RNA, 24 nt, Human
gucccuuucucuccucccuaguaa

SEQ ID NO: 37077 - RNA, 22 nt, Human
uaccggaucaggaagaccaggg

SEQ ID NO: 37078 - RNA, 17 nt, Human
ugugaaguuggggucgu

SEQ ID NO: 37079 - RNA, 24 nt, Human
uguguuguggucuggggagaaugu

SEQ ID NO: 37080 - RNA, 24 nt, Human
uucaaauaggagccgauggaucug

SEQ ID NO: 37081 - RNA, 24 nt, Human
uccaaagaaucggcaaaugagagu

SEQ ID NO: 37082 - RNA, 24 nt, Human
ucaggcucagauagcugcuggccg

SEQ ID NO: 37083 - RNA, 24 nt, Human
uccccugggauccugcagcucuag

SEQ ID NO: 37084 - RNA, 24 nt, Human
ugccuugcccccagacccaccagc

SEQ ID NO: 37085 - RNA, 24 nt, Human
uuuccggcgccgacucugaggccc

SEQ ID NO: 37086 - RNA, 24 nt, Human
ucucacuccacacggugccccgac

SEQ ID NO: 37087 - RNA, 24 nt, Human
gcagugcuggaggcagucucaugc

SEQ ID NO: 37088 - RNA, 24 nt, Human
accacguugcccaguguaaaucca

SEQ ID NO: 37089 - RNA, 24 nt, Human
gcagaauuucgugugugaucacug

SEQ ID NO: 37090 - RNA, 24 nt, Human
ggagauguguauucuuuggccuuc

SEQ ID NO: 37091 - RNA, 24 nt, Human
ucggaaccacauaauuaaagacca

SEQ ID NO: 37092 - RNA, 24 nt, Human
ugagcgguugacccuccuggcucc

SEQ ID NO: 37093 - RNA, 24 nt, Human
ugaauuggcugcagagucugaugu

SEQ ID NO: 37094 - RNA, 24 nt, Human
ucaaagacuaauacuggaauaugu

SEQ ID NO: 37095 - RNA, 24 nt, Human
ugcccagggccagcccauagcuuu

SEQ ID NO: 37096 - RNA, 24 nt, Human
uacaauuuucuauacuguuuaaaa

SEQ ID NO: 37097 - RNA, 24 nt, Human
ucauuuaucauuuauguaaucaaa

SEQ ID NO: 37098 - RNA, 24 nt, Human
agggagcugcugcaggucagccag

SEQ ID NO: 37099 - RNA, 24 nt, Human
aaggaucuuguucucuuugugaca

SEQ ID NO: 37100 - RNA, 24 nt, Human
agauggugaaggcguacagcucag

SEQ ID NO: 37101 - RNA, 24 nt, Human
uccccaugaguucagaauuauuua

SEQ ID NO: 37102 - RNA, 24 nt, Human
aacaguucuuagaccggucuucca

SEQ ID NO: 37103 - RNA, 23 nt, Human
uugguucccuuuaaaaguucugg

SEQ ID NO: 37104 - RNA, 24 nt, Human
uugagggggcaucagaauugggug

SEQ ID NO: 37105 - RNA, 24 nt, Human
uaccauaggacgaaguaaccuugc

SEQ ID NO: 37106 - RNA, 24 nt, Human
aaagguauguaaguuauuaaaugg

SEQ ID NO: 37107 - RNA, 24 nt, Human
uuacugauuuuaaaaauacagaaa

SEQ ID NO: 37108 - RNA, 24 nt, Human
ucgcuagucuccguauggcccgug

SEQ ID NO: 37109 - RNA, 24 nt, Human
uggcguaauaccgaagaggccuga

SEQ ID NO: 37110 - RNA, 23 nt, Human
cagcagacguggcaauaugugug

SEQ ID NO: 37111 - RNA, 23 nt, Human
uuugaccuggggcggaaaaaggc

SEQ ID NO: 37112 - RNA, 24 nt, Human
uaaaaaguuguggcaaagauggcu

SEQ ID NO: 37113 - RNA, 24 nt, Human
uuguccugugcuggggcugacaga

SEQ ID NO: 37114 - RNA, 24 nt, Human
ccacugcacuccagccugggcaag

SEQ ID NO: 37115 - RNA, 24 nt, Human
uuggaaggcagaggugagugaauu

SEQ ID NO: 37116 - RNA, 24 nt, Human
uaggugaugcaagcaucuaagaga

SEQ ID NO: 37117 - RNA, 23 nt, Human
uugaaaaauuugagaaggaggcu

SEQ ID NO: 37118 - RNA, 24 nt, Human
ccuuggguucaagcgauggaaguc

SEQ ID NO: 37119 - RNA, 24 nt, Human
ugagagcucuggccucuucgugag

SEQ ID NO: 37120 - RNA, 21 nt, Human
uggccagaggccaucacaggc

SEQ ID NO: 37121 - RNA, 24 nt, Human
gauugcucgaaccugggaggcgga

SEQ ID NO: 37122 - RNA, 24 nt, Human
cccccgguccagagggccuuccca

SEQ ID NO: 37123 - RNA, 24 nt, Human
ugaggaagaaugugcaucccacag

SEQ ID NO: 37124 - RNA, 24 nt, Human
uauagcaaauuuggaacaacuagg

SEQ ID NO: 37125 - RNA, 24 nt, Human
ugauuuguuucaguuuuauuuucc

SEQ ID NO: 37126 - RNA, 24 nt, Human
uuuguucaaaccaaagugaaaagg

SEQ ID NO: 37127 - RNA, 24 nt, Human
ugagaaacagucaucucaauaaau

SEQ ID NO: 37128 - RNA, 24 nt, Human
aacaguguguaagucauuaacagu

SEQ ID NO: 37129 - RNA, 23 nt, Human
uagcacaugaccaaaugaacaua

SEQ ID NO: 37130 - RNA, 24 nt, Human
ucagucugugcaaugaaauugaug

SEQ ID NO: 37131 - RNA, 24 nt, Human
ugaauugggauguacaagguuauu

SEQ ID NO: 37132 - RNA, 24 nt, Human
uaguagagacgggguuacaccaug

SEQ ID NO: 37133 - RNA, 24 nt, Human
ucacugcaaccuccaccucccggg

SEQ ID NO: 37134 - RNA, 22 nt, Human
uuggaauuucuggagacuaauu

SEQ ID NO: 37135 - RNA, 24 nt, Human
cauugcacuccagccugggugaaa

SEQ ID NO: 37136 - RNA, 24 nt, Human
ugagaccagccucaccaacaugga

SEQ ID NO: 37137 - RNA, 22 nt, Human
uucucauuuguucuccacgccc

SEQ ID NO: 37138 - RNA, 24 nt, Human
ugugcuuauuaaaaauggucaucu

SEQ ID NO: 37139 - RNA, 24 nt, Human
uaagaaauuaauuuauuugaguuc

SEQ ID NO: 37140 - RNA, 24 nt, Human
ugccagcaaacucuucucuuccca

SEQ ID NO: 37141 - RNA, 24 nt, Human
agccuggucaacauggugaaaccc

SEQ ID NO: 37142 - RNA, 24 nt, Human
ugccccagccugagcguacagugu

SEQ ID NO: 37143 - RNA, 20 nt, Human
ugaggcuggucuuuccuggc

SEQ ID NO: 37144 - RNA, 24 nt, Human
uggcaguaccgggcaccgcacuga

SEQ ID NO: 37145 - RNA, 21 nt, Human
ccauacuucgcccuaagcauc

SEQ ID NO: 37146 - RNA, 24 nt, Human
gugguucuuaagacccuccccagc

SEQ ID NO: 37147 - RNA, 24 nt, Human
uccagagagcuucuggguagcuga

SEQ ID NO: 37148 - RNA, 24 nt, Human
aagaugccgcauuuggauuggaug

SEQ ID NO: 37149 - RNA, 24 nt, Human
ugauauguuacucauuguaaagac

SEQ ID NO: 37150 - RNA, 24 nt, Human
agccuugugcuaaaggcguauaac

SEQ ID NO: 37151 - RNA, 24 nt, Human
ucagucauccaaacuagugccauu

SEQ ID NO: 37152 - RNA, 24 nt, Human
ugugugcuuuggugguguugagau

SEQ ID NO: 37153 - RNA, 24 nt, Human
aggaaggagauauagugaagagga

SEQ ID NO: 37154 - RNA, 24 nt, Human
uauggcaagucacuuugacagaca

SEQ ID NO: 37155 - RNA, 24 nt, Human
uacaccacucccaagaagaauaag

SEQ ID NO: 37156 - RNA, 24 nt, Human
uggaaagcagguagaguuggcuuu

SEQ ID NO: 37157 - RNA, 24 nt, Human
agccauugaaacagaugaucugac

SEQ ID NO: 37158 - RNA, 24 nt, Human
aagaagaaaacgaaaagaagaaac

SEQ ID NO: 37159 - RNA, 24 nt, Human
aacugugugagccugcugucccca

SEQ ID NO: 37160 - RNA, 23 nt, Human
cccacacuuccuccaggccucca

SEQ ID NO: 37161 - RNA, 24 nt, Human
gcccuggaacagaguuacagauac

SEQ ID NO: 37162 - RNA, 24 nt, Human
uauucuuccaugcaggaaucugga

SEQ ID NO: 37163 - RNA, 24 nt, Human
gucgucaccuuccagugucauguc

SEQ ID NO: 37164 - RNA, 24 nt, Human
ugacuugucguggccccugucuag

SEQ ID NO: 37165 - RNA, 24 nt, Human
cgauuugguaaccacggaguuggg

SEQ ID NO: 37166 - RNA, 24 nt, Human
ucaggucccuuucaguucuggcuc

SEQ ID NO: 37167 - RNA, 24 nt, Human
ugaaaacuaugaguccuccaauuu

SEQ ID NO: 37168 - RNA, 24 nt, Human
ggacuacaggcauaagccaucaug

SEQ ID NO: 37169 - RNA, 24 nt, Human
uuuuuuguaauucaaguaaaaaaa

SEQ ID NO: 37170 - RNA, 24 nt, Human
ggacuacaggcauaagccaucaug

SEQ ID NO: 37171 - RNA, 24 nt, Human
uuuuuuguaauucaaguaaaaaaa

SEQ ID NO: 37172 - RNA, 24 nt, Human
aacaaguuuacgaucacugucagu

SEQ ID NO: 37173 - RNA, 24 nt, Human
uguuaaaaucugcuagaaaaguaa

SEQ ID NO: 37174 - RNA, 24 nt, Human
ucaggcaugugcccugagcaucga

SEQ ID NO: 37175 - RNA, 24 nt, Human
uauuagggauaauauucauuuagc

SEQ ID NO: 37176 - RNA, 24 nt, Human
uucccagggucuauaaaacauuaa

SEQ ID NO: 37177 - RNA, 24 nt, Human
gaccuggcauuugcucgggacaua

SEQ ID NO: 37178 - RNA, 24 nt, Human
uucauggucccugaucaauuuuaa

SEQ ID NO: 37179 - RNA, 24 nt, Human
uucaaauuacguuggcuugcucaa

SEQ ID NO: 37180 - RNA, 24 nt, Human
uugcagguguaggaggugcgacaa

SEQ ID NO: 37181 - RNA, 20 nt, Human
gcccugggcugggucgaacc

SEQ ID NO: 37182 - RNA, 24 nt, Human
uagcgggucucaugccucggccuc

SEQ ID NO: 37183 - RNA, 24 nt, Human
uuugaagugucuauugggcuagca

SEQ ID NO: 37184 - RNA, 24 nt, Human
uuuaaauucaaguuaguuaaaauu

SEQ ID NO: 37185 - RNA, 24 nt, Human
uggacacugcccccgugggaccuc

SEQ ID NO: 37186 - RNA, 24 nt, Human
ggucacugcugggccuuccacguc

SEQ ID NO: 37187 - RNA, 24 nt, Human
ugagaaacgcacacguaaacugac

SEQ ID NO: 37188 - RNA, 24 nt, Human
uaugaucaaggauauggaaauuac

SEQ ID NO: 37189 - RNA, 24 nt, Human
uaaaguaacccaucuugcaggacg

SEQ ID NO: 37190 - RNA, 24 nt, Human
ucccugaacaccuggguauuggga

SEQ ID NO: 37191 - RNA, 24 nt, Human
uaagucugugaaucuacccugguc

SEQ ID NO: 37192 - RNA, 24 nt, Human
uucuugguccauauccugcccauc

SEQ ID NO: 37193 - RNA, 24 nt, Human
ucaguccaggcaaagcccagagca

SEQ ID NO: 37194 - RNA, 23 nt, Human
cauucugugucaucuagucgugc

SEQ ID NO: 37195 - RNA, 24 nt, Human
uugccgcugacuauaaaacaaacc

SEQ ID NO: 37196 - RNA, 24 nt, Human
ucgguccaauggaaggccuuuugg

SEQ ID NO: 37197 - RNA, 18 nt, Human
uuuuaagcccgggagugg

SEQ ID NO: 37198 - RNA, 24 nt, Human
uacauuaagaaaauuggcuacaac

SEQ ID NO: 37199 - RNA, 24 nt, Human
ccucccugacaacccagcaggcca

SEQ ID NO: 37200 - RNA, 24 nt, Human
uuggguuuaucugcaauuaggguu

SEQ ID NO: 37201 - RNA, 24 nt, Human
cucucugcauggcucuggccaucc

SEQ ID NO: 37202 - RNA, 24 nt, Human
cgugcacgccacaggacccguggc

SEQ ID NO: 37203 - RNA, 24 nt, Human
ucagagcagcgacagugaggccgg

SEQ ID NO: 37204 - RNA, 24 nt, Human
caagacaguaucgaaaaugcauau

SEQ ID NO: 37205 - RNA, 24 nt, Human
cauugcuccugacaucacuaagau

SEQ ID NO: 37206 - RNA, 24 nt, Human
uggggagggcaggaaagaaucggg

SEQ ID NO: 37207 - RNA, 24 nt, Human
ugggcgggcaggcgggcagcauuc

SEQ ID NO: 37208 - RNA, 24 nt, Human
ugaggcaaagaaugguggcgucug

SEQ ID NO: 37209 - RNA, 24 nt, Human
ugaaaugccuaaagaagucacagg

SEQ ID NO: 37210 - RNA, 24 nt, Human
uuuuauguguauuuuauauugcau

SEQ ID NO: 37211 - RNA, 24 nt, Human
ucucagaguacggcucaggcuugg

SEQ ID NO: 37212 - RNA, 24 nt, Human
uggcucuucucuccccagcccucc

SEQ ID NO: 37213 - RNA, 24 nt, Human
ugaauuugucuccugcuaaauauu

SEQ ID NO: 37214 - RNA, 24 nt, Human
uucauuagaaauuuagccauuaga

SEQ ID NO: 37215 - RNA, 24 nt, Human
uaacggaggcaguggaaccaaucg

SEQ ID NO: 37216 - RNA, 24 nt, Human
caagacacaaauguaacuucugag

SEQ ID NO: 37217 - RNA, 24 nt, Human
uaguauuggaaccucccaacauaa

SEQ ID NO: 37218 - RNA, 24 nt, Human
ucuaccauguuggcaugucaacag

SEQ ID NO: 37219 - RNA, 24 nt, Human
ucugugacaggcagcugaaccuac

SEQ ID NO: 37220 - RNA, 24 nt, Human
uacugauugagcuaaagaagaaaa

SEQ ID NO: 37221 - RNA, 24 nt, Human
ucacaaccacggcccuggaggagc

SEQ ID NO: 37222 - RNA, 24 nt, Human
aaaguuuauacaaauuugagggag

SEQ ID NO: 37223 - RNA, 24 nt, Human
caccccuaagggggggccgaacgu

SEQ ID NO: 37224 - RNA, 22 nt, Human
uucacggauggcaagucaccgu

SEQ ID NO: 37225 - RNA, 24 nt, Human
uauugcguugcaccacuuugcgcc

SEQ ID NO: 37226 - RNA, 24 nt, Human
uauguugcccaggcugguccugaa

SEQ ID NO: 37227 - RNA, 24 nt, Human
ucuguaacccaggcuagagugcag

SEQ ID NO: 37228 - RNA, 24 nt, Human
gcggaucaugugucugaugcugcu

SEQ ID NO: 37229 - RNA, 24 nt, Human
guccuucucgauggccaacggcau

SEQ ID NO: 37230 - RNA, 24 nt, Human
uaugacaucaccaaccgcuggucc

SEQ ID NO: 37231 - RNA, 24 nt, Human
uucagccugcaggaccucugcugc

SEQ ID NO: 37232 - RNA, 24 nt, Human
uauuauaagaaaucuagagaugau

SEQ ID NO: 37233 - RNA, 24 nt, Human
aagcagcugggaggagagggggga

SEQ ID NO: 37234 - RNA, 24 nt, Human
cgggagaaaauccaccauaauaaa

SEQ ID NO: 37235 - RNA, 24 nt, Human
ucgcgcagagaucgugccacugca

SEQ ID NO: 37236 - RNA, 24 nt, Human
ugcacagaggggcacggaacucca

SEQ ID NO: 37237 - RNA, 24 nt, Human
uguccugggcagcucgguggcaau

SEQ ID NO: 37238 - RNA, 24 nt, Human
agcacauuugccagcuguagccuu

SEQ ID NO: 37239 - RNA, 24 nt, Human
gagcauaacucgauugcccaucau

SEQ ID NO: 37240 - RNA, 24 nt, Human
uaugugcauccagaccugcagcug

SEQ ID NO: 37241 - RNA, 24 nt, Human
uggcaaacuuucuucauguccugg

SEQ ID NO: 37242 - RNA, 24 nt, Human
ucaauggaacgcaaaaaagaccag

SEQ ID NO: 37243 - RNA, 24 nt, Human
cuuugagauacuccacacugagca

SEQ ID NO: 37244 - RNA, 19 nt, Human
uauaccaccucccgaaggg

SEQ ID NO: 37245 - RNA, 24 nt, Human
gcccguaggcgucuggcagcccgg

SEQ ID NO: 37246 - RNA, 18 nt, Human
ugugaaggcuaugagucc

SEQ ID NO: 37247 - RNA, 24 nt, Human
ugggauggguaugauguaacagug

SEQ ID NO: 37248 - RNA, 24 nt, Human
gugcagcuggcgaccugggcggga

SEQ ID NO: 37249 - RNA, 24 nt, Human
gugcauggaaaguuacuaacagga

SEQ ID NO: 37250 - RNA, 24 nt, Human
uaagucaugacuguuaucacaggg

SEQ ID NO: 37251 - RNA, 24 nt, Human
ugcaaugguuuacagaauucaugg

SEQ ID NO: 37252 - RNA, 21 nt, Human
ugcauguucuuguugccuguc

SEQ ID NO: 37253 - RNA, 24 nt, Human
uaguauuuauaaucauuuacuugu

SEQ ID NO: 37254 - RNA, 24 nt, Human
uguuccugucucaguaaaauuaga

SEQ ID NO: 37255 - RNA, 24 nt, Human
uaagucauauagguaauuauuguc

SEQ ID NO: 37256 - RNA, 24 nt, Human
ucgaauggacacauuaccagugaa

SEQ ID NO: 37257 - RNA, 24 nt, Human
ggacagguguacagacauguucuu

SEQ ID NO: 37258 - RNA, 24 nt, Human
cagccgguguccgaacugaucgcg

SEQ ID NO: 37259 - RNA, 19 nt, Human
cggcgcaggcggcgcugcc

SEQ ID NO: 37260 - RNA, 24 nt, Human
uacacaguugcccgguugggaaug

SEQ ID NO: 37261 - RNA, 24 nt, Human
uaaaauacauauagaauauaagau

SEQ ID NO: 37262 - RNA, 24 nt, Human
uucaucauuuccucaagagaaaca

SEQ ID NO: 37263 - RNA, 24 nt, Human
uuagaaguaaauagcagauucaac

SEQ ID NO: 37264 - RNA, 24 nt, Human
ugcaugcacgaggugcacacguuc

SEQ ID NO: 37265 - RNA, 24 nt, Human
cugcggggugugggcccggccucc

SEQ ID NO: 37266 - RNA, 24 nt, Human
ucaggcuccugcugaggggcccga

SEQ ID NO: 37267 - RNA, 24 nt, Human
uggcgggacgugugggccgugagg

SEQ ID NO: 37268 - RNA, 24 nt, Human
cggcaccaucgacuuccgggaguu

SEQ ID NO: 37269 - RNA, 24 nt, Human
cgaccagauuacauggaggaguuc

SEQ ID NO: 37270 - RNA, 24 nt, Human
ugagauguacgaccuggacggcga

SEQ ID NO: 37271 - RNA, 24 nt, Human
uugaucuugaagaaacugggcgug

SEQ ID NO: 37272 - RNA, 24 nt, Human
aggaaggagauauagugaagagga

SEQ ID NO: 37273 - RNA, 24 nt, Human
guagaguuuucuucaggcuuaaag

SEQ ID NO: 37274 - RNA, 24 nt, Human
aagcugaagggccccugguuugga

SEQ ID NO: 37275 - RNA, 24 nt, Human
aggcaugaucugaguuauucugaa

SEQ ID NO: 37276 - RNA, 24 nt, Human
ccucuugucacagcuugacuccua

SEQ ID NO: 37277 - RNA, 24 nt, Human
uccacuguacuccagccugggcga

SEQ ID NO: 37278 - RNA, 24 nt, Human
cccccgguaacaggcccaggcggu

SEQ ID NO: 37279 - RNA, 24 nt, Human
agccgcugccugcgccccuggaug

SEQ ID NO: 37280 - RNA, 21 nt, Human
ucuaagugggcgggcuguggc

SEQ ID NO: 37281 - RNA, 24 nt, Human
ggugcacaggaccacagucucuga

SEQ ID NO: 37282 - RNA, 24 nt, Human
uguacaaaaugugcauguuucagu

SEQ ID NO: 37283 - RNA, 18 nt, Human
uacaguucaugacaaaaa

SEQ ID NO: 37284 - RNA, 24 nt, Human
acacuuggaagagggucggcuuua

SEQ ID NO: 37285 - RNA, 24 nt, Human
uauucuugggcugaagaggggggg

SEQ ID NO: 37286 - RNA, 23 nt, Human
uaacggguccugcgguggugggu

SEQ ID NO: 37287 - RNA, 24 nt, Human
ucuuacuuuauuuuaaaauuaucu

SEQ ID NO: 37288 - RNA, 24 nt, Human
aggaaggagauauagugaagagga

SEQ ID NO: 37289 - RNA, 23 nt, Human
uuacuccacagaaguuccgagua

SEQ ID NO: 37290 - RNA, 24 nt, Human
uuuauagcagugacagccguucau

SEQ ID NO: 37291 - RNA, 24 nt, Human
uagcagcaagguugaaaagguuaa

SEQ ID NO: 37292 - RNA, 24 nt, Human
cuuacugugacaagcaaaugugga

SEQ ID NO: 37293 - RNA, 24 nt, Human
ugguauaucaucuggguugccuuu

SEQ ID NO: 37294 - RNA, 24 nt, Human
gcccuggcucucugucuccuccca

SEQ ID NO: 37295 - RNA, 24 nt, Human
cucgauuuaaaauacacacaucuu

SEQ ID NO: 37296 - RNA, 24 nt, Human
aauuguccauuugaccuuagccgg

SEQ ID NO: 37297 - RNA, 24 nt, Human
uaggaucaugguuaacguuuccca

SEQ ID NO: 37298 - RNA, 24 nt, Human
ugaggauaugcuuggucggguauu

SEQ ID NO: 37299 - RNA, 24 nt, Human
gaaauggaagggauucauucaaag

SEQ ID NO: 37300 - RNA, 23 nt, Human
agacuguuuacuacuguucgauu

SEQ ID NO: 37301 - RNA, 24 nt, Human
aagagcaaucugggcacuguuacc

SEQ ID NO: 37302 - RNA, 24 nt, Human
ugucaaggacucccaagcugcucu

SEQ ID NO: 37303 - RNA, 24 nt, Human
ugcgagggguugagaacgccuagc

SEQ ID NO: 37304 - RNA, 24 nt, Human
ugugagcaacaggcaugguggcca

SEQ ID NO: 37305 - RNA, 24 nt, Human
acccuggaucugcgcauugcugga

SEQ ID NO: 37306 - RNA, 24 nt, Human
cuccggcugagcugggagaguugg

SEQ ID NO: 37307 - RNA, 18 nt, Human
ccacauguuguucccagg

SEQ ID NO: 37308 - RNA, 24 nt, Human
uaucaagaaagggcuucaccagga

SEQ ID NO: 37309 - RNA, 24 nt, Human
ucucccugcugaaucgaaaggaag

SEQ ID NO: 37310 - RNA, 24 nt, Human
aaucugccuuuggucuguugauuu

SEQ ID NO: 37311 - RNA, 24 nt, Human
guggaacuauguacagaucuuguu

SEQ ID NO: 37312 - RNA, 24 nt, Human
uacuaugcacgucuuaauaagaag

SEQ ID NO: 37313 - RNA, 24 nt, Human
uacacagaauauuccugugcccac

SEQ ID NO: 37314 - RNA, 24 nt, Human
ucuauaauuuuaaccauuuaucca

SEQ ID NO: 37315 - RNA, 24 nt, Human
acugaaagaacaagcagcaacugg

SEQ ID NO: 37316 - RNA, 24 nt, Human
uccagcuuggacgacagagcgaga

SEQ ID NO: 37317 - RNA, 24 nt, Human
agaggugcagugugauggcaggag

SEQ ID NO: 37318 - RNA, 24 nt, Human
cuugcccccugcccugaggaugcg

SEQ ID NO: 37319 - RNA, 24 nt, Human
agacaggcuggcacagccccaggc

SEQ ID NO: 37320 - RNA, 24 nt, Human
aagcagcaccaauggggaugaccc

SEQ ID NO: 37321 - RNA, 24 nt, Human
ucacuguaagcauccaguaggcag

SEQ ID NO: 37322 - RNA, 24 nt, Human
gaugaagccagugauuaggguguu

SEQ ID NO: 37323 - RNA, 17 nt, Human
cagggcuucaucaccgg

SEQ ID NO: 37324 - RNA, 24 nt, Human
cgaguucaucguguacuaugagag

SEQ ID NO: 37325 - RNA, 24 nt, Human
ucccacauccaggaugacaccuua

SEQ ID NO: 37326 - RNA, 24 nt, Human
ugccuggguaacuugcguauuuuc

SEQ ID NO: 37327 - RNA, 24 nt, Human
uaucuuuauccguucguguucaug

SEQ ID NO: 37328 - RNA, 24 nt, Human
auuagcucaucaauuucugcaaaa

SEQ ID NO: 37329 - RNA, 24 nt, Human
uauuuuguaguuuucaauguagaa

SEQ ID NO: 37330 - RNA, 24 nt, Human
gccauguuucuucugugccuacca

SEQ ID NO: 37331 - RNA, 24 nt, Human
uugcagggccauauacggguacau

SEQ ID NO: 37332 - RNA, 24 nt, Human
ugggcucaagugaucuuccugucu

SEQ ID NO: 37333 - RNA, 24 nt, Human
agaaugcuguguuccuucgcugga

SEQ ID NO: 37334 - RNA, 24 nt, Human
cagcaugaguuucugaauaauuuc

SEQ ID NO: 37335 - RNA, 18 nt, Human
uauaauguuauacaguuu

SEQ ID NO: 37336 - RNA, 24 nt, Human
uuuuugguauuuagaaauuuuuuu

SEQ ID NO: 37337 - RNA, 24 nt, Human
uaagauauccaucuuuuucuuuuu

SEQ ID NO: 37338 - RNA, 24 nt, Human
uauaguaaccuuaaaaagaacauu

SEQ ID NO: 37339 - RNA, 24 nt, Human
uucaugcacaggcaaaauguauuc

SEQ ID NO: 37340 - RNA, 24 nt, Human
uguugagauuauuauauacuguau

SEQ ID NO: 37341 - RNA, 24 nt, Human
uguaaacauguaccuuuucuuccc

SEQ ID NO: 37342 - RNA, 24 nt, Human
auaaaaccucuuuguaaacaugua

SEQ ID NO: 37343 - RNA, 24 nt, Human
gauuuuuuuuuaaccuuuauucau

SEQ ID NO: 37344 - RNA, 24 nt, Human
uggacagaagucaugaugaugggg

SEQ ID NO: 37345 - RNA, 24 nt, Human
agcaaauaugaaaauagaaagucc

SEQ ID NO: 37346 - RNA, 24 nt, Human
gccccgucgccccgcccucgccgg

SEQ ID NO: 37347 - RNA, 24 nt, Human
ccggcgcggcaguggccucgcagg

SEQ ID NO: 37348 - RNA, 23 nt, Human
uguguaguguguauagugugugc

SEQ ID NO: 37349 - RNA, 24 nt, Human
uuagugaaauucugaaauacuuga

SEQ ID NO: 37350 - RNA, 24 nt, Human
agauagaccaguucuguugagggu

SEQ ID NO: 37351 - RNA, 24 nt, Human
uucacaaucccuuuacuuuaauuu

SEQ ID NO: 37352 - RNA, 24 nt, Human
uacaggaagugccaaguucaaugc

SEQ ID NO: 37353 - RNA, 24 nt, Human
aaccuuuguacuuguuuuccuccu

SEQ ID NO: 37354 - RNA, 24 nt, Human
uaaaagcuagagauuuauuguuau

SEQ ID NO: 37355 - RNA, 24 nt, Human
aagcagaaagagcaaagacacaug

SEQ ID NO: 37356 - RNA, 24 nt, Human
acgggguuucaccauguuagcaau

SEQ ID NO: 37357 - RNA, 24 nt, Human
uggcauuuguuugaacacagucca

SEQ ID NO: 37358 - RNA, 24 nt, Human
aagaacuacaggucagaaauggaa

SEQ ID NO: 37359 - RNA, 20 nt, Human
uauguagggcaucacuuuau

SEQ ID NO: 37360 - RNA, 24 nt, Human
aauguccuagaguuggagugguac

SEQ ID NO: 37361 - RNA, 24 nt, Human
uccauaguuuacauuagaguucau

SEQ ID NO: 37362 - RNA, 24 nt, Human
gucacauugcaugcaaguuugcug

SEQ ID NO: 37363 - RNA, 24 nt, Human
augguuccuggcaagcccaugugu

SEQ ID NO: 37364 - RNA, 24 nt, Human
cuugcaccguugccagccauuugc

SEQ ID NO: 37365 - RNA, 24 nt, Human
uauaaugaggcacggcuuauugca

SEQ ID NO: 37366 - RNA, 24 nt, Human
cagccgcgaagaugccguuggaac

SEQ ID NO: 37367 - RNA, 24 nt, Human
uaugaagccagcuaccagccccuc

SEQ ID NO: 37368 - RNA, 24 nt, Human
aagaaguucuugaguggcguguaa

SEQ ID NO: 37369 - RNA, 24 nt, Human
uaaugugcaggccaugugccugug

SEQ ID NO: 37370 - RNA, 24 nt, Human
auaguuccugaaaauuaaugcauc

SEQ ID NO: 37371 - RNA, 24 nt, Human
aaugcaacacaauucuuugaaagg

SEQ ID NO: 37372 - RNA, 24 nt, Human
ucucggccuuggcaacggccgucg

SEQ ID NO: 37373 - RNA, 24 nt, Human
agcuauugcuauucaauggagacg

SEQ ID NO: 37374 - RNA, 24 nt, Human
guagagcacagcagcacugugccu

SEQ ID NO: 37375 - RNA, 24 nt, Human
ucucuacucugauuuaacuguucu

SEQ ID NO: 37376 - RNA, 24 nt, Human
cauugugugccaagagcuugaccc

SEQ ID NO: 37377 - RNA, 24 nt, Human
uugcugauggaggaauccaaaaug

SEQ ID NO: 37378 - RNA, 24 nt, Human
ucugaucuauaaaugcgguggcau

SEQ ID NO: 37379 - RNA, 24 nt, Human
caccugaagauuaucggcuauaag

SEQ ID NO: 37380 - RNA, 17 nt, Human
uugguuggggugggggg

SEQ ID NO: 37381 - RNA, 24 nt, Human
uuaaauauuuaaauguacuuauau

SEQ ID NO: 37382 - RNA, 24 nt, Human
uaacugccaaagaguaucauuucg

SEQ ID NO: 37383 - RNA, 24 nt, Human
cagcugcaacaucuuaugaaaccu

SEQ ID NO: 37384 - RNA, 24 nt, Human
ugagucaacugacaauugugacca

SEQ ID NO: 37385 - RNA, 24 nt, Human
ucccccaggugggcgaagcggugg

SEQ ID NO: 37386 - RNA, 24 nt, Human
gugugcuguuagaaggguucuggg

SEQ ID NO: 37387 - RNA, 24 nt, Human
uuccuuggggcauuucugccacug

SEQ ID NO: 37388 - RNA, 24 nt, Human
uagccaucugugccuggauaaaua

SEQ ID NO: 37389 - RNA, 24 nt, Human
uucaaguaaauggccauggaggac

SEQ ID NO: 37390 - RNA, 24 nt, Human
ucugaucuauaaaugcgguggcau

SEQ ID NO: 37391 - RNA, 24 nt, Human
ugugaaaaugccuucuuccucuuu

SEQ ID NO: 37392 - RNA, 24 nt, Human
cuuggcgugcaagugcuggaugaa

SEQ ID NO: 37393 - RNA, 24 nt, Human
uuccagggauggcaagucaccgua

SEQ ID NO: 37394 - RNA, 24 nt, Human
ucugaucuauaaaugcgguggcau

SEQ ID NO: 37395 - RNA, 24 nt, Human
ugagaacuccaggauuguccugca

SEQ ID NO: 37396 - RNA, 24 nt, Human
aaugacacauuuucucuggugguc

SEQ ID NO: 37397 - RNA, 24 nt, Human
uugcauggaggaucuuuguguuuc

SEQ ID NO: 37398 - RNA, 24 nt, Human
agaaaucauuuugccugaaauaag

SEQ ID NO: 37399 - RNA, 23 nt, Human
gguccagcaggcagguacaagcc

SEQ ID NO: 37400 - RNA, 24 nt, Human
gaucaccaagucaggaguucaaga

SEQ ID NO: 37401 - RNA, 21 nt, Human
uugguauuuuuggagaggugu

SEQ ID NO: 37402 - RNA, 24 nt, Human
uggaauuuucagaaaaagauuguc

SEQ ID NO: 37403 - RNA, 24 nt, Human
ugcacaauaaaagguucggaucgu

SEQ ID NO: 37404 - RNA, 24 nt, Human
caagacaugauuuugcuggcuuua

SEQ ID NO: 37405 - RNA, 24 nt, Human
ugagaaaaaaaaaccaccagaagu

SEQ ID NO: 37406 - RNA, 24 nt, Human
ugucaagaaacuucuuaucuucau

SEQ ID NO: 37407 - RNA, 24 nt, Human
aaaggaaacauaaagugcuucuag

SEQ ID NO: 37408 - RNA, 24 nt, Human
gcuguagaacuuuaacacaagucu

SEQ ID NO: 37409 - RNA, 24 nt, Human
uaguagagaugcgacucacggaga

SEQ ID NO: 37410 - RNA, 21 nt, Human
uacaaaguacaagaaauggug

SEQ ID NO: 37411 - RNA, 24 nt, Human
ucaggagugguggugaugcaaaag

SEQ ID NO: 37412 - RNA, 24 nt, Human
aggcaugaaaaggggaaagugagg

SEQ ID NO: 37413 - RNA, 24 nt, Human
ucaggcgcaguacaaguuggggca

SEQ ID NO: 37414 - RNA, 24 nt, Human
uugaaguuuuugcuauaaaacauu

SEQ ID NO: 37415 - RNA, 24 nt, Human
uaugacuaccugcggaagcucuuc

SEQ ID NO: 37416 - RNA, 24 nt, Human
ugggcgcgugcagcccccugaauc

SEQ ID NO: 37417 - RNA, 24 nt, Human
uaucauggcauaagugaaaauauu

SEQ ID NO: 37418 - RNA, 24 nt, Human
uggcugaauucaaaauuaauuuuu

SEQ ID NO: 37419 - RNA, 24 nt, Human
aauacucuccauuggcuuugcuug

SEQ ID NO: 37420 - RNA, 24 nt, Human
auuuacuuguggcuggauuauuug

SEQ ID NO: 37421 - RNA, 24 nt, Human
cgggggaaacccaaagcggggcgc

SEQ ID NO: 37422 - RNA, 24 nt, Human
gcggauccugcgccgagccaaugc

SEQ ID NO: 37423 - RNA, 24 nt, Human
aauaacacaaaauauuuuuuuaag

SEQ ID NO: 37424 - RNA, 22 nt, Human
ccucaaggcgggaguugccggc

SEQ ID NO: 37425 - RNA, 24 nt, Human
uaugaggcccuagagcuccgggac

SEQ ID NO: 37426 - RNA, 24 nt, Human
cauuuggguuggccugaugcagga

SEQ ID NO: 37427 - RNA, 24 nt, Human
auagucuagagccuuuaaaaaacc

SEQ ID NO: 37428 - RNA, 24 nt, Human
gccacaggguuccuacucgccccu

SEQ ID NO: 37429 - RNA, 24 nt, Human
uaucccagcaagcacacuaggcag

SEQ ID NO: 37430 - RNA, 24 nt, Human
caggaucguccuuccaaauggugu

SEQ ID NO: 37431 - RNA, 24 nt, Human
uaguauaucaacuuugguguuuaa

SEQ ID NO: 37432 - RNA, 24 nt, Human
aggcauuggcaugaccaaagcuga

SEQ ID NO: 37433 - RNA, 24 nt, Human
accauggugagcccauuggcaggg

SEQ ID NO: 37434 - RNA, 24 nt, Human
aucaugcugcccugggacccagcu

SEQ ID NO: 37435 - RNA, 22 nt, Human
ugauaguugcaggucuaucugu

SEQ ID NO: 37436 - RNA, 24 nt, Human
ugcgaccauggccgccuuccaguc

SEQ ID NO: 37437 - RNA, 24 nt, Human
caccaauggagggaaaugucagcc

SEQ ID NO: 37438 - RNA, 24 nt, Human
cuuucauucacuguccagcuugcc

SEQ ID NO: 37439 - RNA, 20 nt, Human
cgucaagggggacgagugcc

SEQ ID NO: 37440 - RNA, 24 nt, Human
uagcuucauuauuagauuguuuca

SEQ ID NO: 37441 - RNA, 23 nt, Human
uuucaagucauucuccagacccu

SEQ ID NO: 37442 - RNA, 24 nt, Human
uagacucgaucuaguucaguaaca

SEQ ID NO: 37443 - RNA, 24 nt, Human
aggcagacauccgacuucuugccc

SEQ ID NO: 37444 - RNA, 24 nt, Human
ccuuccaugagcucuccgcagcuc

SEQ ID NO: 37445 - RNA, 24 nt, Human
uuagucccaguuccauuuucauga

SEQ ID NO: 37446 - RNA, 24 nt, Human
uauuggacuuuccaucugucagaa

SEQ ID NO: 37447 - RNA, 24 nt, Human
ucacauugaucucaaagcugaaga

SEQ ID NO: 37448 - RNA, 24 nt, Human
ugacuugaggcuggauaccauccu

SEQ ID NO: 37449 - RNA, 24 nt, Human
caggugcagcugagggaccaggcu

SEQ ID NO: 37450 - RNA, 24 nt, Human
uagcucuaaauuguucuaaagcaa

SEQ ID NO: 37451 - RNA, 24 nt, Human
aggaagugccggcaagucugaucu

SEQ ID NO: 37452 - RNA, 20 nt, Human
caccauaggggaacagggag

SEQ ID NO: 37453 - RNA, 24 nt, Human
ccucacaggcucggcgucggguga

SEQ ID NO: 37454 - RNA, 24 nt, Human
guggauggagagaggccccagccu

SEQ ID NO: 37455 - RNA, 23 nt, Human
aaacacaggcucuucuggugagg

SEQ ID NO: 37456 - RNA, 24 nt, Human
uucacugucccuguuuagccaagg

SEQ ID NO: 37457 - RNA, 24 nt, Human
uguauggacagaguauguugucuc

SEQ ID NO: 37458 - RNA, 24 nt, Human
ucaguuaaaaaagaagaagaagaa

SEQ ID NO: 37459 - RNA, 24 nt, Human
ugugcagaagaaauggaaggauuc

SEQ ID NO: 37460 - RNA, 24 nt, Human
uaucaaggaagggcaggcgugaug

SEQ ID NO: 37461 - RNA, 24 nt, Human
uaacagguguaagaguguugaaaa

SEQ ID NO: 37462 - RNA, 24 nt, Human
cauuacuuugaggcagaucguugu

SEQ ID NO: 37463 - RNA, 24 nt, Human
uaacuuguucauaagaugguggga

SEQ ID NO: 37464 - RNA, 24 nt, Human
uucacagaaguaugaaaaggggau

SEQ ID NO: 37465 - RNA, 24 nt, Human
uauuauguaugguuguaaauucau

SEQ ID NO: 37466 - RNA, 24 nt, Human
uugcaguuaauuugaaaacuuugg

SEQ ID NO: 37467 - RNA, 24 nt, Human
ugauuugaauuuuauaauuguuuu

SEQ ID NO: 37468 - RNA, 20 nt, Human
uuagcucaacacuucacucc

SEQ ID NO: 37469 - RNA, 24 nt, Human
agccauggggcuggaagaagcuuc

SEQ ID NO: 37470 - RNA, 24 nt, Human
uuacaggaagggccuuggcggcca

SEQ ID NO: 37471 - RNA, 24 nt, Human
uuugcuauuucuucuagcaaauuu

SEQ ID NO: 37472 - RNA, 24 nt, Human
uacauguacaaaaacccagcaaga

SEQ ID NO: 37473 - RNA, 24 nt, Human
uguaaaacaucaacucagccaggc

SEQ ID NO: 37474 - RNA, 24 nt, Human
ccuccagcacagccuauauggagc

SEQ ID NO: 37475 - RNA, 24 nt, Human
agaggcugggugaugaccggcuuc

SEQ ID NO: 37476 - RNA, 24 nt, Human
aggaaggagauauagugaagagga

SEQ ID NO: 37477 - RNA, 18 nt, Human
aaggucccaggagaccag

SEQ ID NO: 37478 - RNA, 24 nt, Human
ugugcacugcgugacaaugaccca

SEQ ID NO: 37479 - RNA, 24 nt, Human
gaagcgguuugaauuacgccugua

SEQ ID NO: 37480 - RNA, 18 nt, Human
ugacguggacauccgcaa

SEQ ID NO: 37481 - RNA, 23 nt, Human
ucuguccuacugcucuccagagg

SEQ ID NO: 37482 - RNA, 22 nt, Human
ugauucugugaagaacauauca

SEQ ID NO: 37483 - RNA, 24 nt, Human
uaaguugaacaucaauagcacauu

SEQ ID NO: 37484 - RNA, 24 nt, Human
uaagcaaguuuuaaaauguuaauu

SEQ ID NO: 37485 - RNA, 24 nt, Human
accacacuccagccugggcuacag

SEQ ID NO: 37486 - RNA, 24 nt, Human
uagcuggacguaguggcaugugug

SEQ ID NO: 37487 - RNA, 24 nt, Human
ucaggacuuaacagaaagacuuag

SEQ ID NO: 37488 - RNA, 24 nt, Human
ccugcagccuuucuugccugagag

SEQ ID NO: 37489 - RNA, 24 nt, Human
cagcauaacuucagaguaagggua

SEQ ID NO: 37490 - RNA, 24 nt, Human
gcccuggacuucgagcaggagaug

SEQ ID NO: 37491 - RNA, 24 nt, Human
ugggauugcaggcaugagcuacgg

SEQ ID NO: 37492 - RNA, 24 nt, Human
acggagcaugagaagacguucccc

SEQ ID NO: 37493 - RNA, 24 nt, Human
ugccuuuggcuuuggagaugguuu

SEQ ID NO: 37494 - RNA, 24 nt, Human
uccacggugagcuugcuguagagg

SEQ ID NO: 37495 - RNA, 24 nt, Human
uuuaugcuucaugguugaaauuuu

SEQ ID NO: 37496 - RNA, 24 nt, Human
agacugcuuuguguaauuaaauga

SEQ ID NO: 37497 - RNA, 24 nt, Human
uguaaaauuucugccugucugccu

SEQ ID NO: 37498 - RNA, 24 nt, Human
uggaaucaucucuggguauaugau

SEQ ID NO: 37499 - RNA, 24 nt, Human
ugacuauguugauguucuuguccc

SEQ ID NO: 37500 - RNA, 24 nt, Human
uagccuacuggugauuucauauug

SEQ ID NO: 37501 - RNA, 21 nt, Human
uuugcugggaucuucucucca

SEQ ID NO: 37502 - RNA, 24 nt, Human
uaugucuuuaaacaauaagcaauu

SEQ ID NO: 37503 - RNA, 24 nt, Human
acuugauuuucauuaauccagagc

SEQ ID NO: 37504 - RNA, 24 nt, Human
gaacugguccuuucacuuugagau

SEQ ID NO: 37505 - RNA, 24 nt, Human
uaucaagucagcacacaccuuuuc

SEQ ID NO: 37506 - RNA, 24 nt, Human
ucaaugagucgcuugugaauucuc

SEQ ID NO: 37507 - RNA, 20 nt, Human
ucagaauguguccuccucau

SEQ ID NO: 37508 - RNA, 24 nt, Human
uuuucagaaacaagccacugggcu

SEQ ID NO: 37509 - RNA, 24 nt, Human
ggacagguguacagacauguucuu

SEQ ID NO: 37510 - RNA, 24 nt, Human
ucgaauggacacauuaccagugaa

SEQ ID NO: 37511 - RNA, 23 nt, Human
uaguggccccaaaugucuggcug

SEQ ID NO: 37512 - RNA, 24 nt, Human
ucuggcaacacuugaggggagaua

SEQ ID NO: 37513 - RNA, 24 nt, Human
gagcucgcuugggucccuuugaca

SEQ ID NO: 37514 - RNA, 24 nt, Human
ugacgaggcauuuggcuaccuuaa

SEQ ID NO: 37515 - RNA, 24 nt, Human
uccaaaagccuuguuacuguuucu

SEQ ID NO: 37516 - RNA, 24 nt, Human
ucugauagaccaucuuugggaaac

SEQ ID NO: 37517 - RNA, 21 nt, Human
cuuugugcugggccugcucuu

SEQ ID NO: 37518 - RNA, 23 nt, Human
aggugguuccggaauggccagga

SEQ ID NO: 37519 - RNA, 19 nt, Human
uaggaugcagauuuucccu

SEQ ID NO: 37520 - RNA, 19 nt, Human
caaugcacaaauggaucag

SEQ ID NO: 37521 - RNA, 24 nt, Human
uaggaaagacaaaauaaauacuua

SEQ ID NO: 37522 - RNA, 24 nt, Human
ugcccauuguucaauuauauucgu

SEQ ID NO: 37523 - RNA, 24 nt, Human
gagcauccggaacgucacagagga

SEQ ID NO: 37524 - RNA, 24 nt, Human
gugcaugaccaaaaguccuucuaa

SEQ ID NO: 37525 - RNA, 24 nt, Human
ucacugccucuaccugaaaaacug

SEQ ID NO: 37526 - RNA, 24 nt, Human
ugccaaggauuaaagggcaagcag

SEQ ID NO: 37527 - RNA, 22 nt, Human
uggcuuguccuucccagaaggu

SEQ ID NO: 37528 - RNA, 24 nt, Human
ucgcagagauccugagugucuacc

SEQ ID NO: 37529 - RNA, 24 nt, Human
ugcuaagucagguugccuuuacuu

SEQ ID NO: 37530 - RNA, 24 nt, Human
ugcgugagagggucgugaucgauu

SEQ ID NO: 37531 - RNA, 24 nt, Human
uucccauguggcagcaguaguggc

SEQ ID NO: 37532 - RNA, 24 nt, Human
aacacgguaucggucgucuggaca

SEQ ID NO: 37533 - RNA, 24 nt, Human
agcaagagugacuuuaguauucau

SEQ ID NO: 37534 - RNA, 24 nt, Human
uaagagaaagacacagguagauga

SEQ ID NO: 37535 - RNA, 24 nt, Human
aggaagauuugaacauagcagcug

SEQ ID NO: 37536 - RNA, 24 nt, Human
aacaauacguagccaauuuccuua

SEQ ID NO: 37537 - RNA, 24 nt, Human
ucaguuauaauguucuuuuuaagg

SEQ ID NO: 37538 - RNA, 24 nt, Human
ugacuacauacauagauggguagc

SEQ ID NO: 37539 - RNA, 24 nt, Human
aauggcaccuucaaaaggggcgau

SEQ ID NO: 37540 - RNA, 24 nt, Human
uggaugcagugucucgggacuucg

SEQ ID NO: 37541 - RNA, 21 nt, Human
uucaagggauggaaagucacc

SEQ ID NO: 37542 - RNA, 21 nt, Human
uucaagggauggaaagucacc

SEQ ID NO: 37543 - RNA, 24 nt, Human
uugcagugagccgagaucccgcac

SEQ ID NO: 37544 - RNA, 24 nt, Human
aaugguuuccacugauucgauuuu

SEQ ID NO: 37545 - RNA, 24 nt, Human
uggcauggccuuccgugucccacu

SEQ ID NO: 37546 - RNA, 24 nt, Human
ucgcugagacaccauggggaaggu

SEQ ID NO: 37547 - RNA, 24 nt, Human
ugagaagaacugugaaaagagcau

SEQ ID NO: 37548 - RNA, 24 nt, Human
uaugacacugacaaugaaaauacu

SEQ ID NO: 37549 - RNA, 22 nt, Human
ucagaaagaacuggcgggggca

SEQ ID NO: 37550 - RNA, 24 nt, Human
ugugguggcuggagguggccgaau

SEQ ID NO: 37551 - RNA, 24 nt, Human
uuaguuagguaguuuugguacauu

SEQ ID NO: 37552 - RNA, 24 nt, Human
uuuaacuaagcuauacuaacccca

SEQ ID NO: 37553 - RNA, 24 nt, Human
agcauggugcuaccauucaagaag

SEQ ID NO: 37554 - RNA, 21 nt, Human
uagccaccgcaccucgucuug

SEQ ID NO: 37555 - RNA, 24 nt, Human
uuaggagauuuuuaugacacacgg

SEQ ID NO: 37556 - RNA, 24 nt, Human
uucagggugggggagaauugagga

SEQ ID NO: 37557 - RNA, 24 nt, Human
uauauagaccucccaccgaguggu

SEQ ID NO: 37558 - RNA, 24 nt, Human
cagcagaccaaucauguucccuga

SEQ ID NO: 37559 - RNA, 24 nt, Human
agaaagacugucgcuagcauuuuu

SEQ ID NO: 37560 - RNA, 23 nt, Human
uuugugcauugccacaggagaua

SEQ ID NO: 37561 - RNA, 24 nt, Human
uaguauuuuuuuccucagauggaa

SEQ ID NO: 37562 - RNA, 24 nt, Human
uaaauucugauuuuucacuacuac

SEQ ID NO: 37563 - RNA, 24 nt, Human
uuaaaaguuucugcccauggaaua

SEQ ID NO: 37564 - RNA, 24 nt, Human
uugaagacuuuaacaguagauaaa

SEQ ID NO: 37565 - RNA, 24 nt, Human
augaaauuaauaucuucuacuuga

SEQ ID NO: 37566 - RNA, 24 nt, Human
gagcgcacgaguuaguuguagucc

SEQ ID NO: 37567 - RNA, 24 nt, Human
uguuuucuuuggucccgcaggagg

SEQ ID NO: 37568 - RNA, 24 nt, Human
uucauugucacuaacaucuggugu

SEQ ID NO: 37569 - RNA, 24 nt, Human
uaagguuuauuuucacuguguuuu

SEQ ID NO: 37570 - RNA, 24 nt, Human
ugugauacaagcacuggguucuuu

SEQ ID NO: 37571 - RNA, 21 nt, Human
uuccccagcaucuaauuucuc

SEQ ID NO: 37572 - RNA, 24 nt, Human
guuuguuuggagagggugucuuuc

SEQ ID NO: 37573 - RNA, 24 nt, Human
uuuauggccuaaaauuuguauaag

SEQ ID NO: 37574 - RNA, 24 nt, Human
ugggaagugcaagaccaagauaug

SEQ ID NO: 37575 - RNA, 24 nt, Human
auuuaucaucauaaauacauuuaa

SEQ ID NO: 37576 - RNA, 24 nt, Human
ucccgugggccucacaugccaggu

SEQ ID NO: 37577 - RNA, 17 nt, Human
uaucagggcagcucugc

SEQ ID NO: 37578 - RNA, 24 nt, Human
cguggcccucaugagcuacgccug

SEQ ID NO: 37579 - RNA, 24 nt, Human
uuaaauuuguuuugagaggagauc

SEQ ID NO: 37580 - RNA, 23 nt, Human
uugaaagguauauuaaaauuaag

SEQ ID NO: 37581 - RNA, 21 nt, Human
uuuguaagcuucugagauugc

SEQ ID NO: 37582 - RNA, 24 nt, Human
uguaugcccagggaaggaggcgcu

SEQ ID NO: 37583 - RNA, 24 nt, Human
acaaaacagcccugcugcaaagau

SEQ ID NO: 37584 - RNA, 24 nt, Human
uuagggaaaugguaagauguuaca

SEQ ID NO: 37585 - RNA, 24 nt, Human
uuuuccgcccccuaggguccaagc

SEQ ID NO: 37586 - RNA, 24 nt, Human
uggcagcaggggaacgucuucuca

SEQ ID NO: 37587 - RNA, 24 nt, Human
uuaccagaagacgaaggacugggg

SEQ ID NO: 37588 - RNA, 22 nt, Human
cgccgggacagcagacugccgg

SEQ ID NO: 37589 - RNA, 24 nt, Human
cagccuggacuuaccaccacuaaa

SEQ ID NO: 37590 - RNA, 24 nt, Human
ggcccggagcggagcgcgcccugc

SEQ ID NO: 37591 - RNA, 19 nt, Human
ccacuccaguugcuuggca

SEQ ID NO: 37592 - RNA, 24 nt, Human
uggcccagacaccuccacgcugcu

SEQ ID NO: 37593 - RNA, 24 nt, Human
ucauuuccagcauuuccaucuuua

SEQ ID NO: 37594 - RNA, 24 nt, Human
ucggcacguggcuggucccaggcc

SEQ ID NO: 37595 - RNA, 21 nt, Human
ucuuguggacgcaagcuuccu

SEQ ID NO: 37596 - RNA, 24 nt, Human
uggcagcccuaccucugagauuuu

SEQ ID NO: 37597 - RNA, 19 nt, Human
caccgggcauagccguggu

SEQ ID NO: 37598 - RNA, 24 nt, Human
cccaggacuccuucaccucguuga

SEQ ID NO: 37599 - RNA, 24 nt, Human
uggaagaggggcuccugcagguaa

SEQ ID NO: 37600 - RNA, 24 nt, Human
caagucuuaaagcauguuggauuu

SEQ ID NO: 37601 - RNA, 24 nt, Human
ucuaugacuuauuuuucuguuugg

SEQ ID NO: 37602 - RNA, 24 nt, Human
agacauagucaaaaugaaaacaua

SEQ ID NO: 37603 - RNA, 24 nt, Human
cuccugguccuauuguuuaggaag

SEQ ID NO: 37604 - RNA, 24 nt, Human
ucacucaguuuuuaauaaaggcca

SEQ ID NO: 37605 - RNA, 24 nt, Human
ucccggagcgguggggcggggccu

SEQ ID NO: 37606 - RNA, 24 nt, Human
ucaguucuucccaggugaacagca

SEQ ID NO: 37607 - RNA, 24 nt, Human
aggaagggauggaaggucuccuug

SEQ ID NO: 37608 - RNA, 24 nt, Human
uggaaugcaagcuuuaggacuuca

SEQ ID NO: 37609 - RNA, 24 nt, Human
uggcaagugggugguauagaggcu

SEQ ID NO: 37610 - RNA, 24 nt, Human
ugggaaccgcgcuggaggaaggcg

SEQ ID NO: 37611 - RNA, 24 nt, Human
uugaaugacacccgggaccugcau

SEQ ID NO: 37612 - RNA, 24 nt, Human
uaacagguguaagaguguugaaaa

SEQ ID NO: 37613 - RNA, 24 nt, Human
gaccguaauuguggcugcacugga

SEQ ID NO: 37614 - RNA, 24 nt, Human
ugucauaggcaucgacgaggggca

SEQ ID NO: 37615 - RNA, 24 nt, Human
ugaaaggaaaagcuggugcugggg

SEQ ID NO: 37616 - RNA, 24 nt, Human
uauccuguaauaaggcagggcagg

SEQ ID NO: 37617 - RNA, 24 nt, Human
gaugcaaaauguuugcaguuugac

SEQ ID NO: 37618 - RNA, 24 nt, Human
aaauggaaucuagaagcuaaauuu

SEQ ID NO: 37619 - RNA, 22 nt, Human
uuuacagaaaauucuagaacaa

SEQ ID NO: 37620 - RNA, 24 nt, Human
ugguucuugguaugucccaggaug

SEQ ID NO: 37621 - RNA, 23 nt, Human
ucucacagugcggggucugcggg

SEQ ID NO: 37622 - RNA, 24 nt, Human
cacccgguuagauggggcucugca

SEQ ID NO: 37623 - RNA, 24 nt, Human
uguaaacuagauuauguuguaaac

SEQ ID NO: 37624 - RNA, 24 nt, Human
uugguuggauacuugcuggaaaaa

SEQ ID NO: 37625 - RNA, 19 nt, Human
uaacucccugugucugcau

SEQ ID NO: 37626 - RNA, 24 nt, Human
cugcucccuggccagcccccuugu

SEQ ID NO: 37627 - RNA, 24 nt, Human
uaacagguguaagaguguugaaaa

SEQ ID NO: 37628 - RNA, 24 nt, Human
ugugcagaagaaauggaaggauuc

SEQ ID NO: 37629 - RNA, 24 nt, Human
uaucaaggaagggcaggcgugaug

SEQ ID NO: 37630 - RNA, 24 nt, Human
uuuaagaauuuguuuuauuaaauu

SEQ ID NO: 37631 - RNA, 21 nt, Human
uugcagguggguaguggguca

SEQ ID NO: 37632 - RNA, 24 nt, Human
uguggaucaggguauauagacaga

SEQ ID NO: 37633 - RNA, 23 nt, Human
gaggcccaguccugcccgggccc

SEQ ID NO: 37634 - RNA, 24 nt, Human
aaccuuuuuaaaaaauggagauga

SEQ ID NO: 37635 - RNA, 24 nt, Human
uguacagauuuuaaaaaaccaaaa

SEQ ID NO: 37636 - RNA, 24 nt, Human
uguggaauggggcuaugcuuuuga

SEQ ID NO: 37637 - RNA, 24 nt, Human
uguucaguugcugcucacaauagu

SEQ ID NO: 37638 - RNA, 24 nt, Human
auggagccacaaaguuuccagaug

SEQ ID NO: 37639 - RNA, 24 nt, Human
ggaaaagucaaauucauuguuuau

SEQ ID NO: 37640 - RNA, 24 nt, Human
aucuguuucguuaagcugaaccag

SEQ ID NO: 37641 - RNA, 24 nt, Human
uacccagccggggcccuccuggag

SEQ ID NO: 37642 - RNA, 24 nt, Human
caguguccaccacgagucugccug

SEQ ID NO: 37643 - RNA, 24 nt, Human
cagcagccucaacaguaugguauu

SEQ ID NO: 37644 - RNA, 24 nt, Human
uauggccagcaaccaacuucccag

SEQ ID NO: 37645 - RNA, 24 nt, Human
uagcugcuagcuauuggccuccca

SEQ ID NO: 37646 - RNA, 24 nt, Human
ccaaccuggaccugguuaucgaua

SEQ ID NO: 37647 - RNA, 24 nt, Human
uggaagacagcuacgggcagcagu

SEQ ID NO: 37648 - RNA, 24 nt, Human
ucccuggcuuaugagcaggcugag

SEQ ID NO: 37649 - RNA, 24 nt, Human
uauaacauguaugcuuuucagaau

SEQ ID NO: 37650 - RNA, 24 nt, Human
cucaggauugcccauguggaucac

SEQ ID NO: 37651 - RNA, 24 nt, Human
agaccagucagagaagucagacgu

SEQ ID NO: 37652 - RNA, 23 nt, Human
gaggcccaguccugcccgggccc

SEQ ID NO: 37653 - RNA, 24 nt, Human
ugagacuaguucggacuccccuuc

SEQ ID NO: 37654 - RNA, 24 nt, Human
ucuuguguugugaucaggcuggag

SEQ ID NO: 37655 - RNA, 24 nt, Human
gagugcgucauauguuguuccuag

SEQ ID NO: 37656 - RNA, 24 nt, Human
uucuucucggaaggcuuuuuuaaa

SEQ ID NO: 37657 - RNA, 24 nt, Human
cuuuaaaaaaaaaaaagcggccaa

SEQ ID NO: 37658 - RNA, 24 nt, Human
gcgcagcuucaggggccgcaaggg

SEQ ID NO: 37659 - RNA, 19 nt, Human
ucugaccggcuucaagcuc

SEQ ID NO: 37660 - RNA, 24 nt, Human
ggugaaagagaugaaccacgacua

SEQ ID NO: 37661 - RNA, 24 nt, Human
uuauguugguuaauguuaaucuau

SEQ ID NO: 37662 - RNA, 24 nt, Human
uauuauucucaguugcaucuucau

SEQ ID NO: 37663 - RNA, 24 nt, Human
ugagguuugccagccgggacacca

SEQ ID NO: 37664 - RNA, 24 nt, Human
uuugcacucagcuuauuacaggua

SEQ ID NO: 37665 - RNA, 24 nt, Human
uucaaaaugggcaaauuuuauuuu

SEQ ID NO: 37666 - RNA, 24 nt, Human
uuaauucuuuugccaaguaugccu

SEQ ID NO: 37667 - RNA, 24 nt, Human
caauccgaucgugccccaagacag

SEQ ID NO: 37668 - RNA, 24 nt, Human
cacccguguuuuugcggcgagaag

SEQ ID NO: 37669 - RNA, 24 nt, Human
ccccgguggggcuccacccgucac

SEQ ID NO: 37670 - RNA, 24 nt, Human
ucuaagucagagucuccuaaagag

SEQ ID NO: 37671 - RNA, 24 nt, Human
cggcgggaaugaccacuuccggcc

SEQ ID NO: 37672 - RNA, 23 nt, Human
uagcugcccauuaugcccuucaa

SEQ ID NO: 37673 - RNA, 24 nt, Human
uuccuggccaguguggagucucua

SEQ ID NO: 37674 - RNA, 21 nt, Human
uucaagggauggaaagucacc

SEQ ID NO: 37675 - RNA, 24 nt, Human
uggacgcaagggacaacacgcacu

SEQ ID NO: 37676 - RNA, 24 nt, Human
gagcagcaucguuggcgucuggua

SEQ ID NO: 37677 - RNA, 24 nt, Human
uuccagccagcuuuccaaaucgac

SEQ ID NO: 37678 - RNA, 20 nt, Human
ucucucagcucccgcacccc

SEQ ID NO: 37679 - RNA, 24 nt, Human
acagucuuugaguaacaucuguuc

SEQ ID NO: 37680 - RNA, 24 nt, Human
ucgaauggacacauuaccagugaa

SEQ ID NO: 37681 - RNA, 24 nt, Human
ggacagguguacagacauguucuu

SEQ ID NO: 37682 - RNA, 24 nt, Human
aggauuguauuuaaaaacccccaa

SEQ ID NO: 37683 - RNA, 24 nt, Human
uauuacaauucacuggccgucguu

SEQ ID NO: 37684 - RNA, 24 nt, Human
caccuguaaucccagcuacuuggg

SEQ ID NO: 37685 - RNA, 24 nt, Human
ucuccagggugugcucuggaagau

SEQ ID NO: 37686 - RNA, 21 nt, Human
agggagcuguguaaauggacc

SEQ ID NO: 37687 - RNA, 24 nt, Human
ggagaucacuguuucguaugcucu

SEQ ID NO: 37688 - RNA, 24 nt, Human
ugagaaagcaagauguuggcuacc

SEQ ID NO: 37689 - RNA, 24 nt, Human
uuggaucugagcauuuaaauguuu

SEQ ID NO: 37690 - RNA, 24 nt, Human
ggggagucaggugcggggagcggu

SEQ ID NO: 37691 - RNA, 24 nt, Human
cuugacaaaguggucguugagggc

SEQ ID NO: 37692 - RNA, 24 nt, Human
ugggauggaaaugaaauggccaaa

SEQ ID NO: 37693 - RNA, 23 nt, Human
ucccucuuggcccccggggggac

SEQ ID NO: 37694 - RNA, 20 nt, Human
uacaucgcccugaacgagga

SEQ ID NO: 37695 - RNA, 24 nt, Human
cgggaugaacuggccaacacgcag

SEQ ID NO: 37696 - RNA, 24 nt, Human
agagagcgcggcccucaggagcaa

SEQ ID NO: 37697 - RNA, 24 nt, Human
uacgccucgcaggggcgcuacgag

SEQ ID NO: 37698 - RNA, 24 nt, Human
uccacgggggcuucuuugcguugg

SEQ ID NO: 37699 - RNA, 24 nt, Human
ggcgcagagaccgcgucagggacg

SEQ ID NO: 37700 - RNA, 24 nt, Human
gggaagacgaaggcaugguucagg

SEQ ID NO: 37701 - RNA, 24 nt, Human
uaaaaggaacauuuaaaaaguugc

SEQ ID NO: 37702 - RNA, 24 nt, Human
cugcagcaauuuucagugagacag

SEQ ID NO: 37703 - RNA, 22 nt, Human
ucccgccacugaugaggagaga

SEQ ID NO: 37704 - RNA, 24 nt, Human
uuggccuuauaaguggcucuuugu

SEQ ID NO: 37705 - RNA, 24 nt, Human
aucaagcucagaugacuuauuugg

SEQ ID NO: 37706 - RNA, 17 nt, Human
ucacaguggaauucguc

SEQ ID NO: 37707 - RNA, 24 nt, Human
agaguuguucauccaggagacagc

SEQ ID NO: 37708 - RNA, 24 nt, Human
ggccugggcacccuuagaggggag

SEQ ID NO: 37709 - RNA, 24 nt, Human
uaccaagaaguggaagaagaccaa

SEQ ID NO: 37710 - RNA, 24 nt, Human
acacaaugagauugcaggucagau

SEQ ID NO: 37711 - RNA, 24 nt, Human
cacccgagcuacgccgugccgcac

SEQ ID NO: 37712 - RNA, 24 nt, Human
ugaggauaugcuuggucggguauu

SEQ ID NO: 37713 - RNA, 24 nt, Human
ugaggaaaagcaacuucgcggagg

SEQ ID NO: 37714 - RNA, 24 nt, Human
ugucccggcggcgccaaccgaagc

SEQ ID NO: 37715 - RNA, 19 nt, Human
ugaaaggggagggucccca

SEQ ID NO: 37716 - RNA, 24 nt, Human
uucucuggguucugaaguucuggg

SEQ ID NO: 37717 - RNA, 24 nt, Human
ugcuguagcagcucuuuagcugaa

SEQ ID NO: 37718 - RNA, 24 nt, Human
uacaugaagcucaccaaggcccug

SEQ ID NO: 37719 - RNA, 24 nt, Human
ggcauauuuuauauuagugaagag

SEQ ID NO: 37720 - RNA, 24 nt, Human
uaaaagcagguggaguugguugaa

SEQ ID NO: 37721 - RNA, 24 nt, Human
uuagaaaugagaucuagagaacac

SEQ ID NO: 37722 - RNA, 24 nt, Human
uccaccacuacguggccaucugau

SEQ ID NO: 37723 - RNA, 24 nt, Human
uugguuccaacgcgauggcaaguc

SEQ ID NO: 37724 - RNA, 24 nt, Human
aggcagcagaggcaugagcagcga

SEQ ID NO: 37725 - RNA, 18 nt, Human
caugcagggacgcgcccc

SEQ ID NO: 37726 - RNA, 24 nt, Human
cgaguacaggcacagugccacgac

SEQ ID NO: 37727 - RNA, 24 nt, Human
uaaaaaguuguggcaaagauggcu

SEQ ID NO: 37728 - RNA, 24 nt, Human
caacugaaccacugucuugacuuu

SEQ ID NO: 37729 - RNA, 24 nt, Human
uguguauauauauauauauaugua

SEQ ID NO: 37730 - RNA, 24 nt, Human
ucaacagugugaauguaucauguu

SEQ ID NO: 37731 - RNA, 24 nt, Human
ucgcgcagggggcucgguggggau

SEQ ID NO: 37732 - RNA, 24 nt, Human
ucuaagucagagucuccuaaagag

SEQ ID NO: 37733 - RNA, 24 nt, Human
aucgugcaaguggaugguaagaua

SEQ ID NO: 37734 - RNA, 24 nt, Human
augcagugugugucccgcauguug

SEQ ID NO: 37735 - RNA, 24 nt, Human
ugaggucgaggguuaugauuugaa

SEQ ID NO: 37736 - RNA, 24 nt, Human
uuccagaguucagucugcgccuca

SEQ ID NO: 37737 - RNA, 24 nt, Human
ugggauguccgcugcaaucugcuc

SEQ ID NO: 37738 - RNA, 24 nt, Human
ccugcaaugcacgcugguauucug

SEQ ID NO: 37739 - RNA, 24 nt, Human
aggcaguggcgauggcgcccuuuc

SEQ ID NO: 37740 - RNA, 21 nt, Human
ucagaacauuccacagguaua

SEQ ID NO: 37741 - RNA, 24 nt, Human
cuugcccgcuggcgggcaguagcu

SEQ ID NO: 37742 - RNA, 24 nt, Human
uacuggaagaggucaaggcgcugc

SEQ ID NO: 37743 - RNA, 24 nt, Human
ugcgagaaauuccaggcggcgcuc

SEQ ID NO: 37744 - RNA, 24 nt, Human
aggaauuuggagaccaggauguag

SEQ ID NO: 37745 - RNA, 24 nt, Human
uacucaagacaauugacgagggag

SEQ ID NO: 37746 - RNA, 17 nt, Human
ugugucugaugcuguua

SEQ ID NO: 37747 - RNA, 24 nt, Human
gcucaaucuggccucuaggcuacc

SEQ ID NO: 37748 - RNA, 24 nt, Human
ugauguuuuuauuccucuguaucc

SEQ ID NO: 37749 - RNA, 24 nt, Human
uauagcacuucucaaugccacacc

SEQ ID NO: 37750 - RNA, 24 nt, Human
agaaagacaguucuggucaggccu

SEQ ID NO: 37751 - RNA, 24 nt, Human
ucagaaaugugaauuccaggaugc

SEQ ID NO: 37752 - RNA, 24 nt, Human
aggaaggagauauagugaagagga

SEQ ID NO: 37753 - RNA, 24 nt, Human
uagcuuggugccaauuggucgugg

SEQ ID NO: 37754 - RNA, 24 nt, Human
uugaucuugaagaaacugggcgug

SEQ ID NO: 37755 - RNA, 24 nt, Human
aggaaggagauauagugaagagga

SEQ ID NO: 37756 - RNA, 24 nt, Human
aggaaggagauauagugaagagga

SEQ ID NO: 37757 - RNA, 24 nt, Human
aggaaggagauauagugaagagga

SEQ ID NO: 37758 - RNA, 24 nt, Human
aggaaggagauauagugaagagga

SEQ ID NO: 37759 - RNA, 24 nt, Human
uugaucuugaagaaacugggcgug

SEQ ID NO: 37760 - RNA, 24 nt, Human
aggaaggagauauagugaagagga

SEQ ID NO: 37761 - RNA, 24 nt, Human
guagaguuuucuucaggcuuaaag

SEQ ID NO: 37762 - RNA, 24 nt, Human
uugaucuugaagaaacugggcgug

SEQ ID NO: 37763 - RNA, 24 nt, Human
aggaaggagauauagugaagagga

SEQ ID NO: 37764 - RNA, 24 nt, Human
guagaguuuucuucaggcuuaaag

SEQ ID NO: 37765 - RNA, 18 nt, Human
ugucaaggucauggcugu

SEQ ID NO: 37766 - RNA, 24 nt, Human
uugaucuugaagaaacugggcgug

SEQ ID NO: 37767 - RNA, 24 nt, Human
aggaaggagauauagugaagagga

SEQ ID NO: 37768 - RNA, 24 nt, Human
guagaguuuucuucaggcuuaaag

SEQ ID NO: 37769 - RNA, 20 nt, Human
uugaagaaacugggcguguc

SEQ ID NO: 37770 - RNA, 24 nt, Human
guagaguuuucuucaggcuuaaag

SEQ ID NO: 37771 - RNA, 24 nt, Human
uugaucuugaagaaacugggcgug

SEQ ID NO: 37772 - RNA, 24 nt, Human
guagaguuuucuucaggcuuaaag

SEQ ID NO: 37773 - RNA, 24 nt, Human
uugaucuugaagaaacugggcgug

SEQ ID NO: 37774 - RNA, 24 nt, Human
aggaaggagauauagugaagagga

SEQ ID NO: 37775 - RNA, 24 nt, Human
guagaguuuucuucaggcuuaaag

SEQ ID NO: 37776 - RNA, 24 nt, Human
uugaucuugaagaaacugggcgug

SEQ ID NO: 37777 - RNA, 24 nt, Human
auggaucugaugaaaagaaaaagc

SEQ ID NO: 37778 - RNA, 24 nt, Human
aggaaggagauauagugaagagga

SEQ ID NO: 37779 - RNA, 24 nt, Human
guagaguuuucuucaggcuuaaag

SEQ ID NO: 37780 - RNA, 24 nt, Human
aaggaccugcccacugugcuuccu

SEQ ID NO: 37781 - RNA, 24 nt, Human
uugaucuugaagaaacugggcgug

SEQ ID NO: 37782 - RNA, 24 nt, Human
guagaguuuucuucaggcuuaaag

SEQ ID NO: 37783 - RNA, 24 nt, Human
uugaucuugaagaaacugggcgug

SEQ ID NO: 37784 - RNA, 24 nt, Human
aggaaggagauauagugaagagga

SEQ ID NO: 37785 - RNA, 24 nt, Human
uauggcaagucacuuugacagaca

SEQ ID NO: 37786 - RNA, 24 nt, Human
ugagaauggcaaaauuagucgccu

SEQ ID NO: 37787 - RNA, 24 nt, Human
uacaccacucccaagaagaauaag

SEQ ID NO: 37788 - RNA, 22 nt, Human
uccgugcgcguugcugcggccg

SEQ ID NO: 37789 - RNA, 24 nt, Human
uugaucuugaagaaacugggcgug

SEQ ID NO: 37790 - RNA, 24 nt, Human
ugcaaggaacuuccaugccucuaa

SEQ ID NO: 37791 - RNA, 24 nt, Human
aggaaggagauauagugaagagga

SEQ ID NO: 37792 - RNA, 24 nt, Human
guagaguuuucuucaggcuuaaag

SEQ ID NO: 37793 - RNA, 24 nt, Human
aggaaggagauauagugaagagga

SEQ ID NO: 37794 - RNA, 24 nt, Human
uugaucuugaagaaacugggcgug

SEQ ID NO: 37795 - RNA, 24 nt, Human
aggaaggagauauagugaagagga

SEQ ID NO: 37796 - RNA, 24 nt, Human
guagaguuuucuucaggcuuaaag

SEQ ID NO: 37797 - RNA, 22 nt, Human
uccgugcgcguugcugcggccg

SEQ ID NO: 37798 - RNA, 24 nt, Human
uugaucuugaagaaacugggcgug

SEQ ID NO: 37799 - RNA, 24 nt, Human
aggaaggagauauagugaagagga

SEQ ID NO: 37800 - RNA, 24 nt, Human
guagaguuuucuucaggcuuaaag

SEQ ID NO: 37801 - RNA, 24 nt, Human
ucucaaggccugacagacagaagg

SEQ ID NO: 37802 - RNA, 18 nt, Human
uuccagugauaucggcuc

SEQ ID NO: 37803 - RNA, 23 nt, Human
uggggauaaaauaaagauguaau

SEQ ID NO: 37804 - RNA, 24 nt, Human
aacacauuaauaacaauuuaaaau

SEQ ID NO: 37805 - RNA, 24 nt, Human
uauuauguacacauagaauguuac

SEQ ID NO: 37806 - RNA, 24 nt, Human
ucagaagaagucaacaggcccaag

SEQ ID NO: 37807 - RNA, 24 nt, Human
ugcagaaagaacuugaggugacua

SEQ ID NO: 37808 - RNA, 24 nt, Human
aaaguuacaaccaagaacugggag

SEQ ID NO: 37809 - RNA, 22 nt, Human
uccgugcgcguugcugcggccg

SEQ ID NO: 37810 - RNA, 24 nt, Human
auuugucugagcagugugggcaug

SEQ ID NO: 37811 - RNA, 24 nt, Human
ucucucugcaaaaaaaaaaaaaaa

SEQ ID NO: 37812 - RNA, 24 nt, Human
uauaguacuaccaauguuggugac

SEQ ID NO: 37813 - RNA, 24 nt, Human
uggcacugccggccccuggcccua

SEQ ID NO: 37814 - RNA, 24 nt, Human
uggcccggccugacccggucuggc

SEQ ID NO: 37815 - RNA, 24 nt, Human
cggcccagcgagcggcccugaugc

SEQ ID NO: 37816 - RNA, 24 nt, Human
aggcggcguggacagcggccccgg

SEQ ID NO: 37817 - RNA, 24 nt, Human
cagauuacgcccccuauccuauca

SEQ ID NO: 37818 - RNA, 24 nt, Human
ugaguggagcggccauuuccuguu

SEQ ID NO: 37819 - RNA, 24 nt, Human
uauuagauacuaauuuggccuauu

SEQ ID NO: 37820 - RNA, 24 nt, Human
aaggugcuggaggugccaagugaa

SEQ ID NO: 37821 - RNA, 24 nt, Human
gugcuugacuuguagucccuuuac

SEQ ID NO: 37822 - RNA, 21 nt, Human
uagcauguggaucucgagcuc

SEQ ID NO: 37823 - RNA, 22 nt, Human
ugcccuggccaguggcgugaga

SEQ ID NO: 37824 - RNA, 24 nt, Human
ugaggaccagugcacugaguacau

SEQ ID NO: 37825 - RNA, 24 nt, Human
aggcagcggcuguggcagcccggc

SEQ ID NO: 37826 - RNA, 24 nt, Human
uugaucuugaagaaacugggcgug

SEQ ID NO: 37827 - RNA, 24 nt, Human
aggaaggagauauagugaagagga

SEQ ID NO: 37828 - RNA, 24 nt, Human
guagaguuuucuucaggcuuaaag

SEQ ID NO: 37829 - RNA, 22 nt, Human
uccgugcgcguugcugcggccg

SEQ ID NO: 37830 - RNA, 24 nt, Human
uugaucuugaagaaacugggcgug

SEQ ID NO: 37831 - RNA, 24 nt, Human
aggaaggagauauagugaagagga

SEQ ID NO: 37832 - RNA, 24 nt, Human
uaucacgaacagcaaagcgaccca

SEQ ID NO: 37833 - RNA, 22 nt, Human
uccgugcgcguugcugcggccg

SEQ ID NO: 37834 - RNA, 24 nt, Human
aggaaggagauauagugaagagga

SEQ ID NO: 37835 - RNA, 22 nt, Human
uccgugcgcguugcugcggccg

SEQ ID NO: 37836 - RNA, 24 nt, Human
uugaucuugaagaaacugggcgug

SEQ ID NO: 37837 - RNA, 24 nt, Human
aggaaggagauauagugaagagga

SEQ ID NO: 37838 - RNA, 24 nt, Human
guagaguuuucuucaggcuuaaag

SEQ ID NO: 37839 - RNA, 24 nt, Human
uugaucuugaagaaacugggcgug

SEQ ID NO: 37840 - RNA, 24 nt, Human
uugaucuugaagaaacugggcgug

SEQ ID NO: 37841 - RNA, 24 nt, Human
aggaaggagauauagugaagagga

SEQ ID NO: 37842 - RNA, 24 nt, Human
guagaguuuucuucaggcuuaaag

SEQ ID NO: 37843 - RNA, 24 nt, Human
aagcagaaagggaagagaagcgag

SEQ ID NO: 37844 - RNA, 24 nt, Human
uugaucuugaagaaacugggcgug

SEQ ID NO: 37845 - RNA, 24 nt, Human
aggaaggagauauagugaagagga

SEQ ID NO: 37846 - RNA, 24 nt, Human
guagaguuuucuucaggcuuaaag

SEQ ID NO: 37847 - RNA, 22 nt, Human
uccgugcgcguugcugcggccg

SEQ ID NO: 37848 - RNA, 24 nt, Human
uugaucuugaagaaacugggcgug

SEQ ID NO: 37849 - RNA, 24 nt, Human
aggaaggagauauagugaagagga

SEQ ID NO: 37850 - RNA, 22 nt, Human
uccgugcgcguugcugcggccg

SEQ ID NO: 37851 - RNA, 24 nt, Human
uugaucuugaagaaacugggcgug

SEQ ID NO: 37852 - RNA, 24 nt, Human
aggaaggagauauagugaagagga

SEQ ID NO: 37853 - RNA, 24 nt, Human
uugaucuugaagaaacugggcgug

SEQ ID NO: 37854 - RNA, 24 nt, Human
aggaaggagauauagugaagagga

SEQ ID NO: 37855 - RNA, 24 nt, Human
guagaguuuucuucaggcuuaaag

SEQ ID NO: 37856 - RNA, 24 nt, Human
uuugacaaaccuucaagugcaauu

SEQ ID NO: 37857 - RNA, 24 nt, Human
uauuagagugguauuuuuauccaa

SEQ ID NO: 37858 - RNA, 24 nt, Human
uuuugcuuauucauggcaucuuuc

SEQ ID NO: 37859 - RNA, 24 nt, Human
cauuggaugucuauuaaccaacua

SEQ ID NO: 37860 - RNA, 24 nt, Human
cauuuuguuagcuuucuccuuacu

SEQ ID NO: 37861 - RNA, 24 nt, Human
ugcguggggcucggggaugcuggu

SEQ ID NO: 37862 - RNA, 23 nt, Human
aagcagcaagugacagaggaggg

SEQ ID NO: 37863 - RNA, 24 nt, Human
ugccugggggccuaggugaggcug

SEQ ID NO: 37864 - RNA, 24 nt, Human
ucuaaaggaucagcugauuuauaa

SEQ ID NO: 37865 - RNA, 24 nt, Human
caacauggcagccuuuuccuuaga

SEQ ID NO: 37866 - RNA, 24 nt, Human
uuggacauuugaacagacaguggg

SEQ ID NO: 37867 - RNA, 18 nt, Human
ucccgugguuccagcgcc

SEQ ID NO: 37868 - RNA, 24 nt, Human
cucaggauugcccauguggaucac

SEQ ID NO: 37869 - RNA, 23 nt, Human
gaggcccaguucuguccgggccc

SEQ ID NO: 37870 - RNA, 24 nt, Human
uccuugguuggaagggccaagcac

SEQ ID NO: 37871 - RNA, 24 nt, Human
aagaaacuuaaagccuggaaugau

SEQ ID NO: 37872 - RNA, 24 nt, Human
cgggggccucaccaaacaauuguc

SEQ ID NO: 37873 - RNA, 24 nt, Human
gggcauggaccugauaagccucgg

SEQ ID NO: 37874 - RNA, 24 nt, Human
uugaagacaccugcucaguaugac

SEQ ID NO: 37875 - RNA, 24 nt, Human
cacccguggccacuucggccaagu

SEQ ID NO: 37876 - RNA, 24 nt, Human
cagcaccaccugaagaaacuggag

SEQ ID NO: 37877 - RNA, 24 nt, Human
uguaaauuguugguagguagaagu

SEQ ID NO: 37878 - RNA, 24 nt, Human
aggaaggcuggcaccucuggcucu

SEQ ID NO: 37879 - RNA, 24 nt, Human
agccuaaucuggaagaucuggcau

SEQ ID NO: 37880 - RNA, 24 nt, Human
ucugcaggcccaggacagugggcu

SEQ ID NO: 37881 - RNA, 24 nt, Human
uaccauaugugaaauuuguuuuug

SEQ ID NO: 37882 - RNA, 24 nt, Human
uggaggcaguguuugauuucaacu

SEQ ID NO: 37883 - RNA, 24 nt, Human
uagcaucuugucaguggcacuacu

SEQ ID NO: 37884 - RNA, 24 nt, Human
ucccagugcaacacuaccuuugug

SEQ ID NO: 37885 - RNA, 24 nt, Human
uauggcaagucacuuugacagaca

SEQ ID NO: 37886 - RNA, 24 nt, Human
ugagaauggcaaaauuagucgccu

SEQ ID NO: 37887 - RNA, 24 nt, Human
uacaccacucccaagaagaauaag

SEQ ID NO: 37888 - RNA, 20 nt, Human
ugugaccacccccuucacug

SEQ ID NO: 37889 - RNA, 24 nt, Human
aagcaggagcuuguccaggaaugu

SEQ ID NO: 37890 - RNA, 24 nt, Human
uaugccagcuggagcgacugugcu

SEQ ID NO: 37891 - RNA, 24 nt, Human
ugugccucuauuuuuaccauuuug

SEQ ID NO: 37892 - RNA, 22 nt, Human
aaaguuccagauugcaacaugg

SEQ ID NO: 37893 - RNA, 24 nt, Human
uguggaauauguagauucacuuuu

SEQ ID NO: 37894 - RNA, 24 nt, Human
ugacuguccauagugguuauugau

SEQ ID NO: 37895 - RNA, 24 nt, Human
uccaguaucccaaacuuucuaguc

SEQ ID NO: 37896 - RNA, 20 nt, Human
ugggauuuggaggcaagaga

SEQ ID NO: 37897 - RNA, 24 nt, Human
uacacuuaaaaccacuuaugaaaa

SEQ ID NO: 37898 - RNA, 24 nt, Human
ucuuuugucuuaugcuuagccaua

SEQ ID NO: 37899 - RNA, 24 nt, Human
uaauauguuaaaaacauuuugcuu

SEQ ID NO: 37900 - RNA, 24 nt, Human
uauaacauguaugcuuuucagaau

SEQ ID NO: 37901 - RNA, 24 nt, Human
acccggagauacuaaugggcuucu

SEQ ID NO: 37902 - RNA, 24 nt, Human
uaguaccuuuacggcuguggcuuu

SEQ ID NO: 37903 - RNA, 24 nt, Human
ugacuuaaaaaucugguauuuucu

SEQ ID NO: 37904 - RNA, 24 nt, Human
uucauuuuauauauauauauauau

SEQ ID NO: 37905 - RNA, 24 nt, Human
ucacaaguguaccucugcuaacca

SEQ ID NO: 37906 - RNA, 24 nt, Human
aaaguaaaauaaccaaagucuuaa

SEQ ID NO: 37907 - RNA, 24 nt, Human
acuuuuauaauuaaccacugaagu

SEQ ID NO: 37908 - RNA, 24 nt, Human
ugcccagaagaaaguuaauggcaa

SEQ ID NO: 37909 - RNA, 24 nt, Human
gaucuuguuuuucuugccauccac

SEQ ID NO: 37910 - RNA, 24 nt, Human
accagguaucaagcucauagcggc

SEQ ID NO: 37911 - RNA, 21 nt, Human
caccuggacaauaggaauucg

SEQ ID NO: 37912 - RNA, 19 nt, Human
uaacucccugugucugcau

SEQ ID NO: 37913 - RNA, 24 nt, Human
cugcugcuccccagcccaccagug

SEQ ID NO: 37914 - RNA, 24 nt, Human
cugcucccuggccagcccccuugu

SEQ ID NO: 37915 - RNA, 24 nt, Human
ugcccuguugcucuacauggccuu

SEQ ID NO: 37916 - RNA, 24 nt, Human
uguggucggguguuugcuggugcc

SEQ ID NO: 37917 - RNA, 24 nt, Human
uauggcaagucacuuugacagaca

SEQ ID NO: 37918 - RNA, 24 nt, Human
uacaccacucccaagaagaauaag

SEQ ID NO: 37919 - RNA, 24 nt, Human
uuuggcccugccugcuuaagcccu

SEQ ID NO: 37920 - RNA, 17 nt, Human
ucccugaguccagagcc

SEQ ID NO: 37921 - RNA, 24 nt, Human
ugaggcccagaacccagaccccaa

SEQ ID NO: 37922 - RNA, 24 nt, Human
ccaaagcucagacuugccaggcuc

SEQ ID NO: 37923 - RNA, 24 nt, Human
ugagagcccugcugugggagagcg

SEQ ID NO: 37924 - RNA, 24 nt, Human
uaccauggcgaggggcacauuuca

SEQ ID NO: 37925 - RNA, 24 nt, Human
gacacauucacugccuggucaggc

SEQ ID NO: 37926 - RNA, 24 nt, Human
ucaguauuauuuucaaaaggcuuc

SEQ ID NO: 37927 - RNA, 24 nt, Human
uuccugcauuucugaauuugucau

SEQ ID NO: 37928 - RNA, 24 nt, Human
uucacauuugagggguucuuaucc

SEQ ID NO: 37929 - RNA, 24 nt, Human
ucuguccccaucucugaaauccuu

SEQ ID NO: 37930 - RNA, 24 nt, Human
uuaaaaguugcugcaaggcugcag

SEQ ID NO: 37931 - RNA, 24 nt, Human
ugccuuaacaagaagaugcccaca

SEQ ID NO: 37932 - RNA, 24 nt, Human
uugaucuugaagaaacugggcgug

SEQ ID NO: 37933 - RNA, 24 nt, Human
guagaguuuucuucaggcuuaaag

SEQ ID NO: 37934 - RNA, 24 nt, Human
ugacgugggugugaucgcuagcag

SEQ ID NO: 37935 - RNA, 24 nt, Human
uacccuuggaggccggcgcgcccc

SEQ ID NO: 37936 - RNA, 24 nt, Human
uguccgagugcgcccugaugcugg

SEQ ID NO: 37937 - RNA, 24 nt, Human
uggaaggacgaguuccuccggguc

SEQ ID NO: 37938 - RNA, 24 nt, Human
accaccuuccucugcucguauguc

SEQ ID NO: 37939 - RNA, 24 nt, Human
uaaaucccggggccccggccgggu

SEQ ID NO: 37940 - RNA, 24 nt, Human
agggguucucucuuuccaagcgcc

SEQ ID NO: 37941 - RNA, 24 nt, Human
gggccccccccuucaaaaaacccc

SEQ ID NO: 37942 - RNA, 24 nt, Human
cgaaggggguucucaagguucacc

SEQ ID NO: 37943 - RNA, 24 nt, Human
uugaucuugaagaaacugggcgug

SEQ ID NO: 37944 - RNA, 24 nt, Human
aggaaggagauauagugaagagga

SEQ ID NO: 37945 - RNA, 24 nt, Human
guagaguuuucuucaggcuuaaag

SEQ ID NO: 37946 - RNA, 24 nt, Human
uauggcaagucacuuugacagaca

SEQ ID NO: 37947 - RNA, 24 nt, Human
uacaccacucccaagaagaauaag

SEQ ID NO: 37948 - RNA, 24 nt, Human
cuaccggggccgcggcggggaccg

SEQ ID NO: 37949 - RNA, 24 nt, Human
uaccaugccagcaagcucagcauc

SEQ ID NO: 37950 - RNA, 24 nt, Human
ugagaaccucuuguugcuggugga

SEQ ID NO: 37951 - RNA, 21 nt, Human
aaguaugccugggucuuggau

SEQ ID NO: 37952 - RNA, 24 nt, Human
uacagggacaucucaggcugacug

SEQ ID NO: 37953 - RNA, 24 nt, Human
cguaaagauggcaaugccaguggg

SEQ ID NO: 37954 - RNA, 24 nt, Human
ucugaucuauaaaugcgguggcau

SEQ ID NO: 37955 - RNA, 24 nt, Human
ugucauugccacagccucugagcc

SEQ ID NO: 37956 - RNA, 24 nt, Human
ucagugcaacgaaggcugcagcug

SEQ ID NO: 37957 - RNA, 24 nt, Human
ugugggcagcuacugucuuauuuu

SEQ ID NO: 37958 - RNA, 24 nt, Human
ggagguugcagugagcugagauca

SEQ ID NO: 37959 - RNA, 24 nt, Human
aacaacuuccggcuccucugcaag

SEQ ID NO: 37960 - RNA, 24 nt, Human
cgaccccacuguggaggagacuaa

SEQ ID NO: 37961 - RNA, 24 nt, Human
caccagaaauguucuugcuagcag

SEQ ID NO: 37962 - RNA, 20 nt, Human
uagugcaucuuccauagggg

SEQ ID NO: 37963 - RNA, 24 nt, Human
agagauuggugaggauuuggauaa

SEQ ID NO: 37964 - RNA, 24 nt, Human
uguugugguagcacuggacuuaca

SEQ ID NO: 37965 - RNA, 24 nt, Human
ucaggaacuacggauuuugggaua

SEQ ID NO: 37966 - RNA, 24 nt, Human
gugccgccuucgccaaccacuccg

SEQ ID NO: 37967 - RNA, 24 nt, Human
uaaaugacuauaaacuauuaugug

SEQ ID NO: 37968 - RNA, 24 nt, Human
uggaaggguguaaagauucuuuug

SEQ ID NO: 37969 - RNA, 24 nt, Human
uauguguauuagugaaacauugua

SEQ ID NO: 37970 - RNA, 24 nt, Human
aggaaguugcuguguuucauuucu

SEQ ID NO: 37971 - RNA, 24 nt, Human
gggcguaguugccauugaucuggg

SEQ ID NO: 37972 - RNA, 24 nt, Human
uuggaagguggcuuaucacuguag

SEQ ID NO: 37973 - RNA, 23 nt, Human
uuaaggguuauuguggguugagu

SEQ ID NO: 37974 - RNA, 24 nt, Human
cgggcagauguuuuuuuucuugga

SEQ ID NO: 37975 - RNA, 24 nt, Human
gggaaauguuuguuuuggguuuug

SEQ ID NO: 37976 - RNA, 24 nt, Human
uacaggguugaagaguuugggagg

SEQ ID NO: 37977 - RNA, 24 nt, Human
uuggugggggugcgcugggggugu

SEQ ID NO: 37978 - RNA, 24 nt, Human
ugccugggguuguguguauuguuu

SEQ ID NO: 37979 - RNA, 24 nt, Human
uucugugucgggugggagcguuug

SEQ ID NO: 37980 - RNA, 24 nt, Human
aggaaggagauauagugaagagga

SEQ ID NO: 37981 - RNA, 24 nt, Human
guagaguuuucuucaggcuuaaag

SEQ ID NO: 37982 - RNA, 24 nt, Human
agccauaguucuuuguuaccacag

SEQ ID NO: 37983 - RNA, 24 nt, Human
ugaauaaccaauaauaauuuuuuu

SEQ ID NO: 37984 - RNA, 24 nt, Human
uaacaggccaaaauucuauuuccu

SEQ ID NO: 37985 - RNA, 24 nt, Human
ugagguguuugugguauaauuuuu

SEQ ID NO: 37986 - RNA, 20 nt, Human
uaaaauguagguguuuauug

SEQ ID NO: 37987 - RNA, 24 nt, Human
agugcaguggcgcaaucuuggcug

SEQ ID NO: 37988 - RNA, 24 nt, Human
ucuagagaguagcagaccucucau

SEQ ID NO: 37989 - RNA, 24 nt, Human
agagaagaaaagcguaauagaggg

SEQ ID NO: 37990 - RNA, 24 nt, Human
ugccguggcgagagagauccaucu

SEQ ID NO: 37991 - RNA, 24 nt, Human
uuccggguggugaaaaagcccucc

SEQ ID NO: 37992 - RNA, 24 nt, Human
cuuucauuaauguucuaaggcaga

SEQ ID NO: 37993 - RNA, 24 nt, Human
uauuagggauaauauucauuuagc

SEQ ID NO: 37994 - RNA, 24 nt, Human
uaaugggucucaaaauucugugac

SEQ ID NO: 37995 - RNA, 24 nt, Human
ucccucagccucugguuuuucagc

SEQ ID NO: 37996 - RNA, 24 nt, Human
guugccaccgggacaagaggaccc

SEQ ID NO: 37997 - RNA, 24 nt, Human
cguugcugagcucaacgggaccca

SEQ ID NO: 37998 - RNA, 24 nt, Human
ucucuggauucgauggcucugcgg

SEQ ID NO: 37999 - RNA, 24 nt, Human
uucacucagugauaccccgugugg

SEQ ID NO: 38000 - RNA, 24 nt, Human
ucucucagcccugagguauacaga

SEQ ID NO: 38001 - RNA, 24 nt, Human
uaguguguccccagcaccuucaac

SEQ ID NO: 38002 - RNA, 24 nt, Human
ucagugaacauguuuuuauugaac

SEQ ID NO: 38003 - RNA, 24 nt, Human
uaaugggucucaaaauucugugac

SEQ ID NO: 38004 - RNA, 24 nt, Human
aguucagacaucaauguuccuucc

SEQ ID NO: 38005 - RNA, 24 nt, Human
ugagaaaagacagacuugggguag

SEQ ID NO: 38006 - RNA, 24 nt, Human
gggaauucuuuauuuaguaauguc

SEQ ID NO: 38007 - RNA, 24 nt, Human
ucugcaggugccuccaaaugcugg

SEQ ID NO: 38008 - RNA, 24 nt, Human
uggugcgcgcccgcaagcagaucg

SEQ ID NO: 38009 - RNA, 24 nt, Human
uuggacaacugccccuuccaugac

SEQ ID NO: 38010 - RNA, 24 nt, Human
gcccgauaagcugacacuaagaac

SEQ ID NO: 38011 - RNA, 24 nt, Human
uuccugccccgccggcggggcgag

SEQ ID NO: 38012 - RNA, 24 nt, Human
cgugcaggcgcugaagcgcgcggg

SEQ ID NO: 38013 - RNA, 24 nt, Human
uggaagaagauacaguauuguuua

SEQ ID NO: 38014 - RNA, 24 nt, Human
aaauggaaucuagaagcuaaauuu

SEQ ID NO: 38015 - RNA, 24 nt, Human
uaagguaugcuucaaaaauuuugu

SEQ ID NO: 38016 - RNA, 24 nt, Human
ugaauggauaaguaaaggcagaaa

SEQ ID NO: 38017 - RNA, 24 nt, Human
ugcauuguuaucauuaaccagucu

SEQ ID NO: 38018 - RNA, 24 nt, Human
uauuagggauaauauucauuuagc

SEQ ID NO: 38019 - RNA, 24 nt, Human
uuuaacuuuuuuaaugggucucaa

SEQ ID NO: 38020 - RNA, 21 nt, Human
ugggaggggcugaauguggug

SEQ ID NO: 38021 - RNA, 24 nt, Human
aaggaaccauggccaacugugagc

SEQ ID NO: 38022 - RNA, 24 nt, Human
aagcguuuugagcagaaaggauuc

SEQ ID NO: 38023 - RNA, 24 nt, Human
ugagccugggaaguuguggcugca

SEQ ID NO: 38024 - RNA, 24 nt, Human
uaagugacuugcucaaugccacac

SEQ ID NO: 38025 - RNA, 24 nt, Human
auacaguaggauuuaauauaugca

SEQ ID NO: 38026 - RNA, 17 nt, Human
cucagguucucauccuc

SEQ ID NO: 38027 - RNA, 19 nt, Human
ugagugguagggagucacu

SEQ ID NO: 38028 - RNA, 24 nt, Human
ugcccaguguacaugcacagaugu

SEQ ID NO: 38029 - RNA, 24 nt, Human
cugaggcuucauccuugcucugca

SEQ ID NO: 38030 - RNA, 22 nt, Human
ccggaaauggccaucugcgggg

SEQ ID NO: 38031 - RNA, 24 nt, Human
uggcucaguccucagccucugguc

SEQ ID NO: 38032 - RNA, 24 nt, Human
cucgauuaaaauacacacaucuua

SEQ ID NO: 38033 - RNA, 24 nt, Human
gagcaugguuauggugauucgugc

SEQ ID NO: 38034 - RNA, 24 nt, Human
gggaagcuuugaaauacuugcuga

SEQ ID NO: 38035 - RNA, 24 nt, Human
uaauaucaaacaucucacaggugc

SEQ ID NO: 38036 - RNA, 24 nt, Human
ugcaggagucagaugaggaccauu

SEQ ID NO: 38037 - RNA, 24 nt, Human
uuaggauaauggccuccagcugca

SEQ ID NO: 38038 - RNA, 24 nt, Human
auauauccuacuaguucuguuccu

SEQ ID NO: 38039 - RNA, 24 nt, Human
uacaaaauccuugucaguuuugcu

SEQ ID NO: 38040 - RNA, 24 nt, Human
uaagucugugaaucuacccugguc

SEQ ID NO: 38041 - RNA, 24 nt, Human
ucccugaacaccuggguauuggga

SEQ ID NO: 38042 - RNA, 24 nt, Human
uucuugguccauauccugcccauc

SEQ ID NO: 38043 - RNA, 24 nt, Human
augcaguuucuucauuagguaguc

SEQ ID NO: 38044 - RNA, 22 nt, Human
ggugauggcuguugugugagcc

SEQ ID NO: 38045 - RNA, 24 nt, Human
uguguugugugauaaaccauauaa

SEQ ID NO: 38046 - RNA, 24 nt, Human
uagaauguuagaugacauauuauu

SEQ ID NO: 38047 - RNA, 24 nt, Human
ugggagaggaguugcugaagacug

SEQ ID NO: 38048 - RNA, 24 nt, Human
cagcacccuugggagcucccagug

SEQ ID NO: 38049 - RNA, 24 nt, Human
ugaaaugcacuuucccgugcagca

SEQ ID NO: 38050 - RNA, 24 nt, Human
uggaagccagucauuggcauuuuu

SEQ ID NO: 38051 - RNA, 24 nt, Human
ggggagccucgcugugucuugcug

SEQ ID NO: 38052 - RNA, 24 nt, Human
ugugacuguugcccuuagccagcc

SEQ ID NO: 38053 - RNA, 24 nt, Human
cauuuugccuuccuguuuuugcuc

SEQ ID NO: 38054 - RNA, 24 nt, Human
uguauccgcucaugagacaauaac

SEQ ID NO: 38055 - RNA, 24 nt, Human
agacagcuggaguucagugagcca

SEQ ID NO: 38056 - RNA, 24 nt, Human
accaccuucuaucuuugagugcca

SEQ ID NO: 38057 - RNA, 24 nt, Human
uguacauauguauagguacgagcg

SEQ ID NO: 38058 - RNA, 24 nt, Human
ucggaaccuguugcguuuugaccc

SEQ ID NO: 38059 - RNA, 24 nt, Human
gucgaucaguguccgguaacccuc

SEQ ID NO: 38060 - RNA, 24 nt, Human
gggguccguggcuggguccguggc

SEQ ID NO: 38061 - RNA, 24 nt, Human
cagccgccugccgaacugacccgg

SEQ ID NO: 38062 - RNA, 24 nt, Human
ucuagcgacuggucacccuugcaa

SEQ ID NO: 38063 - RNA, 24 nt, Human
ucuggcgccguucgguuucucuua

SEQ ID NO: 38064 - RNA, 24 nt, Human
aguuuuuuuuuuuucuuuuuauuu

SEQ ID NO: 38065 - RNA, 24 nt, Human
cacccauuguccauagccuucuca

SEQ ID NO: 38066 - RNA, 24 nt, Human
ucugaacagucagcgauuccaggu

SEQ ID NO: 38067 - RNA, 24 nt, Human
ucgcguggccgccaaaagaugagg

SEQ ID NO: 38068 - RNA, 24 nt, Human
uucguucauuuugguucucagggu

SEQ ID NO: 38069 - RNA, 21 nt, Human
aaguaugccugggucuuggau

SEQ ID NO: 38070 - RNA, 24 nt, Human
cgacacaguagcaauuggugccaa

SEQ ID NO: 38071 - RNA, 21 nt, Human
uucaagggauggaaagucacc

SEQ ID NO: 38072 - RNA, 24 nt, Human
uggcaacgggaaacagugaggguu

SEQ ID NO: 38073 - RNA, 24 nt, Human
cuccuucgcugacuacaaccugcu

SEQ ID NO: 38074 - RNA, 24 nt, Human
uacaggguaaaugacggcguggag

SEQ ID NO: 38075 - RNA, 24 nt, Human
uggcuuagauuuuaaaucacauuu

SEQ ID NO: 38076 - RNA, 24 nt, Human
uucaugcaagaacagcaacagggg

SEQ ID NO: 38077 - RNA, 24 nt, Human
ugauaacacuuagcaaacacugau

SEQ ID NO: 38078 - RNA, 24 nt, Human
uugaagguugugcguccacaccua

SEQ ID NO: 38079 - RNA, 23 nt, Human
uccagggcaggaggaucaugaga

SEQ ID NO: 38080 - RNA, 23 nt, Human
gagcaguucuacgucacaagaga

SEQ ID NO: 38081 - RNA, 22 nt, Human
uuagguauuagcaaucugugcu

SEQ ID NO: 38082 - RNA, 24 nt, Human
ggaaaggauucuuuuaauugugga

SEQ ID NO: 38083 - RNA, 24 nt, Human
uuucacucauuagcuccugaggua

SEQ ID NO: 38084 - RNA, 24 nt, Human
uuccaggggacaugucccagauau

SEQ ID NO: 38085 - RNA, 24 nt, Human
acauauuguguacacucccuagga

SEQ ID NO: 38086 - RNA, 24 nt, Human
ugaucugagucuggaacugacaag

SEQ ID NO: 38087 - RNA, 24 nt, Human
ugggguuuccaccuccugccuccg

SEQ ID NO: 38088 - RNA, 23 nt, Human
ugagaagagccauaacucgugac

SEQ ID NO: 38089 - RNA, 24 nt, Human
uguuuuaauuugcuccgccucuug

SEQ ID NO: 38090 - RNA, 24 nt, Human
ggagacccaagaaauccuggugca

SEQ ID NO: 38091 - RNA, 24 nt, Human
gucucuguuuucaauauaauucuu

SEQ ID NO: 38092 - RNA, 22 nt, Human
uacauuggagaaacuggcaggu

SEQ ID NO: 38093 - RNA, 24 nt, Human
cccccaggccucaccuucugaguc

SEQ ID NO: 38094 - RNA, 24 nt, Human
agcacaauuuuucuugcugguacu

SEQ ID NO: 38095 - RNA, 24 nt, Human
cuuugaaugauaccacuaaggccc

SEQ ID NO: 38096 - RNA, 24 nt, Human
uaccugggggccaugcuucuauug

SEQ ID NO: 38097 - RNA, 24 nt, Human
ggaggcgaggggaacuggccgcgu

SEQ ID NO: 38098 - RNA, 24 nt, Human
uccaugcauauugacgagggaucu

SEQ ID NO: 38099 - RNA, 24 nt, Human
uuuaaaggggaaaaaaaguuugua

SEQ ID NO: 38100 - RNA, 24 nt, Human
acgcgcugcccggccagaaaacgg

SEQ ID NO: 38101 - RNA, 24 nt, Human
ucagagcuacacauugagaaccug

SEQ ID NO: 38102 - RNA, 24 nt, Human
uuccugcagacccagcaccagcgg

SEQ ID NO: 38103 - RNA, 24 nt, Human
cuugugcagaacauaaucauguug

SEQ ID NO: 38104 - RNA, 24 nt, Human
ccacugugaauacugguuaaguau

SEQ ID NO: 38105 - RNA, 24 nt, Human
guucacugccgacaucccuccccc

SEQ ID NO: 38106 - RNA, 24 nt, Human
auuuggguggaaaacagggugcua

SEQ ID NO: 38107 - RNA, 24 nt, Human
uacgcacuaaaaaaaaugugugcu

SEQ ID NO: 38108 - RNA, 24 nt, Human
uuuguaaccauuuauauauauuuu

SEQ ID NO: 38109 - RNA, 18 nt, Human
ucacaguggaauucgucc

SEQ ID NO: 38110 - RNA, 24 nt, Human
ugggcagaggaaugcuuugcaagc

SEQ ID NO: 38111 - RNA, 24 nt, Human
uauggaaguucuuaugcgaguauu

SEQ ID NO: 38112 - RNA, 24 nt, Human
ggagccugcuaucaccgccaauuu

SEQ ID NO: 38113 - RNA, 24 nt, Human
ugggcagagccagcugaggggggc

SEQ ID NO: 38114 - RNA, 22 nt, Human
uaagugcuauggucugaauguu

SEQ ID NO: 38115 - RNA, 24 nt, Human
ucaccuggauggcuuucguguccc

SEQ ID NO: 38116 - RNA, 24 nt, Human
acucgcugauguuuggaaagauug

SEQ ID NO: 38117 - RNA, 22 nt, Human
uccgugcgcguugcugcggccg

SEQ ID NO: 38118 - RNA, 24 nt, Human
uugaucuugaagaaacugggcgug

SEQ ID NO: 38119 - RNA, 24 nt, Human
ucagugcgcggaaccaacuugcag

SEQ ID NO: 38120 - RNA, 24 nt, Human
uaaacuaauuaacggaaggagaua

SEQ ID NO: 38121 - RNA, 24 nt, Human
guagaguuuucuucaggcuuaaag

SEQ ID NO: 38122 - RNA, 24 nt, Human
ugaggagcugcagagccuggcugg

SEQ ID NO: 38123 - RNA, 24 nt, Human
uguggugcuguccauggacaacag

SEQ ID NO: 38124 - RNA, 17 nt, Human
ugaggagaaagcugugg

SEQ ID NO: 38125 - RNA, 21 nt, Human
uuggauccccgggaagguccg

SEQ ID NO: 38126 - RNA, 24 nt, Human
uccaacccagaucaaccaaguggu

SEQ ID NO: 38127 - RNA, 24 nt, Human
ugggaccccagcagcagcagcccg

SEQ ID NO: 38128 - RNA, 24 nt, Human
gcgcugaugcccuggcaaggucuu

SEQ ID NO: 38129 - RNA, 23 nt, Human
uggcaugcccguggacacgcugu

SEQ ID NO: 38130 - RNA, 24 nt, Human
ucugaucuauaaaugcgguggcau

SEQ ID NO: 38131 - RNA, 24 nt, Human
uggaaucuguggauagugaauauu

SEQ ID NO: 38132 - RNA, 24 nt, Human
ugacaacagcugacauuuaggagg

SEQ ID NO: 38133 - RNA, 24 nt, Human
uguauugugauuaucugaaauauu

SEQ ID NO: 38134 - RNA, 24 nt, Human
ucgccguugaccuggacagcacuu

SEQ ID NO: 38135 - RNA, 23 nt, Human
uacagcuagguaucucuggagac

SEQ ID NO: 38136 - RNA, 24 nt, Human
ugucaaguaaaacggaagagggau

SEQ ID NO: 38137 - RNA, 24 nt, Human
gagguugaguuuuggacuaggcuu

SEQ ID NO: 38138 - RNA, 24 nt, Human
ucucugggcgccuggcuggcgccg

SEQ ID NO: 38139 - RNA, 24 nt, Human
uccuacguguacgacugguccgcg

SEQ ID NO: 38140 - RNA, 24 nt, Human
cagagccuggaggacaugcuggag

SEQ ID NO: 38141 - RNA, 24 nt, Human
uauaaugaggcacggcuuauugca

SEQ ID NO: 38142 - RNA, 24 nt, Human
ugaagggcaaacaguuuaguucaa

SEQ ID NO: 38143 - RNA, 24 nt, Human
acagccuuugaggaaguauggggg

SEQ ID NO: 38144 - RNA, 24 nt, Human
uaugaaaguuggcacuucuuuuuc

SEQ ID NO: 38145 - RNA, 24 nt, Human
gggcauuggauccucccacaguug

SEQ ID NO: 38146 - RNA, 23 nt, Human
ugagggaaccggaaggaaagugc

SEQ ID NO: 38147 - RNA, 24 nt, Human
uaaugggcguuuucacaugcacau

SEQ ID NO: 38148 - RNA, 24 nt, Human
ucgucucggggugcccugcgggga

SEQ ID NO: 38149 - RNA, 24 nt, Human
gcacaauucacugacccaacugaa

SEQ ID NO: 38150 - RNA, 24 nt, Human
guggaagugagugcugggucaccc

SEQ ID NO: 38151 - RNA, 24 nt, Human
cgcgcugggccgggggcuacgugc

SEQ ID NO: 38152 - RNA, 24 nt, Human
cgagcacguggccuucgaguucgu

SEQ ID NO: 38153 - RNA, 24 nt, Human
ugagcugaguaagggcuccugggg

SEQ ID NO: 38154 - RNA, 24 nt, Human
uuaauggaacgaagaugaagaugc

SEQ ID NO: 38155 - RNA, 24 nt, Human
auugauggucagccaggugccuuc

SEQ ID NO: 38156 - RNA, 24 nt, Human
agccauuggugucugcuccgcuga

SEQ ID NO: 38157 - RNA, 24 nt, Human
gggcauuggccuagcuaucucccu

SEQ ID NO: 38158 - RNA, 24 nt, Human
uguccauucuuucauugagaucua

SEQ ID NO: 38159 - RNA, 24 nt, Human
ggaacagacaggcauugcuggauc

SEQ ID NO: 38160 - RNA, 24 nt, Human
uccccaggcagccuggggaacgug

SEQ ID NO: 38161 - RNA, 23 nt, Human
ugccaugugaaggagccgucucc

SEQ ID NO: 38162 - RNA, 24 nt, Human
uggaacuguguugggagccucauc

SEQ ID NO: 38163 - RNA, 24 nt, Human
uccgcuaucugcagggugcugaaa

SEQ ID NO: 38164 - RNA, 24 nt, Human
ugguuggggcagccuggggcaucu

SEQ ID NO: 38165 - RNA, 18 nt, Human
uggcaugguuccugacgg

SEQ ID NO: 38166 - RNA, 24 nt, Human
ggagagcggugugcggagaaggca

SEQ ID NO: 38167 - RNA, 24 nt, Human
ugagguuucgcuggauaguaggua

SEQ ID NO: 38168 - RNA, 24 nt, Human
aggcugaggcaggaggaucgcuug

SEQ ID NO: 38169 - RNA, 23 nt, Human
agccagacauggugguguaugcc

SEQ ID NO: 38170 - RNA, 22 nt, Human
uggcacggacugaggccaagaa

SEQ ID NO: 38171 - RNA, 24 nt, Human
gggcaggagccggccaagacgaau

SEQ ID NO: 38172 - RNA, 24 nt, Human
aacuguguguugauuucugguucc

SEQ ID NO: 38173 - RNA, 18 nt, Human
uggaagagaaguggaugg

SEQ ID NO: 38174 - RNA, 24 nt, Human
uaaaagcaucuuuuggaacuucaa

SEQ ID NO: 38175 - RNA, 24 nt, Human
uuaaacaguggcuuuggcucuuua

SEQ ID NO: 38176 - RNA, 20 nt, Human
guggcucuggcacuccaccc

SEQ ID NO: 38177 - RNA, 24 nt, Human
ugcccgaggggucagucugauaga

SEQ ID NO: 38178 - RNA, 24 nt, Human
uagcaaaucgagucuuaaauaauc

SEQ ID NO: 38179 - RNA, 24 nt, Human
uggaaaggaggagcgaccgccuga

SEQ ID NO: 38180 - RNA, 24 nt, Human
caagcuccucuccccccucuuuuc

SEQ ID NO: 38181 - RNA, 24 nt, Human
agccacuucccucccaacccuggu

SEQ ID NO: 38182 - RNA, 24 nt, Human
ucggaccacaugaaggugcacagc

SEQ ID NO: 38183 - RNA, 20 nt, Human
uggccggaagcugggcgggu

SEQ ID NO: 38184 - RNA, 24 nt, Human
uauaguuucuccugaacaccugcu

SEQ ID NO: 38185 - RNA, 24 nt, Human
cuuccaccauucccagaacugauc

SEQ ID NO: 38186 - RNA, 24 nt, Human
uuagucuaaagaagauacaggccc

SEQ ID NO: 38187 - RNA, 24 nt, Human
ugcuuggugaccgaauuacuaggu

SEQ ID NO: 38188 - RNA, 24 nt, Human
uauggcaagucacuuugacagaca

SEQ ID NO: 38189 - RNA, 24 nt, Human
ugagaauggcaaaauuagucgccu

SEQ ID NO: 38190 - RNA, 24 nt, Human
uccgcgggguaccaccacaaggag

SEQ ID NO: 38191 - RNA, 24 nt, Human
caagccagagagagcagagaaggc

SEQ ID NO: 38192 - RNA, 24 nt, Human
ccacgaccaguuggcagguuccga

SEQ ID NO: 38193 - RNA, 24 nt, Human
uucucaagggugucagaaccauac

SEQ ID NO: 38194 - RNA, 24 nt, Human
ugaggcuguggccuccaaaggguc

SEQ ID NO: 38195 - RNA, 24 nt, Human
ugguguggaggugcucaugggggu

SEQ ID NO: 38196 - RNA, 24 nt, Human
cagagcacucgcggcguggguggg

SEQ ID NO: 38197 - RNA, 24 nt, Human
gaagcaccugcuccggcauccagc

SEQ ID NO: 38198 - RNA, 24 nt, Human
ggccuuggcuaggacccagagcca

SEQ ID NO: 38199 - RNA, 24 nt, Human
ugugccaaucuuuggauaaagaua

SEQ ID NO: 38200 - RNA, 24 nt, Human
cucuggugaugcuccuccagcucc

SEQ ID NO: 38201 - RNA, 24 nt, Human
agagccugaguccucgccuuguug

SEQ ID NO: 38202 - RNA, 22 nt, Human
uggccugcuccggcugcuuguc

SEQ ID NO: 38203 - RNA, 24 nt, Human
ccagaccgacguggccauuguagu

SEQ ID NO: 38204 - RNA, 24 nt, Human
uacgugaaacacaaacuuugcucu

SEQ ID NO: 38205 - RNA, 24 nt, Human
ugcaggaacugggugugcacacgg

SEQ ID NO: 38206 - RNA, 24 nt, Human
caguaggcuucuauauauccugga

SEQ ID NO: 38207 - RNA, 24 nt, Human
uaggaggauguggcuguugggguu

SEQ ID NO: 38208 - RNA, 24 nt, Human
ugaaaacaaaagaacuucacugag

SEQ ID NO: 38209 - RNA, 24 nt, Human
uaaguaacugaucuaugaaguuag

SEQ ID NO: 38210 - RNA, 24 nt, Human
cacaagccugguuauuugaggaug

SEQ ID NO: 38211 - RNA, 24 nt, Human
acacuguucugaucacuuacaucu

SEQ ID NO: 38212 - RNA, 24 nt, Human
ugagaaccgcucccgagaacuugc

SEQ ID NO: 38213 - RNA, 20 nt, Human
caggagccagcgaggcagag

SEQ ID NO: 38214 - RNA, 23 nt, Human
ugccaagggcagcugcugaccgc

SEQ ID NO: 38215 - RNA, 24 nt, Human
ugagaagccugagaaagugguugu

SEQ ID NO: 38216 - RNA, 18 nt, Human
uacaaauuuacuugguga

SEQ ID NO: 38217 - RNA, 24 nt, Human
aaguuuauauagagaauucuggcu

SEQ ID NO: 38218 - RNA, 24 nt, Human
acuuauuuugcucaaugguuucug

SEQ ID NO: 38219 - RNA, 24 nt, Human
uuauuaaacaagaauauaaauuuu

SEQ ID NO: 38220 - RNA, 24 nt, Human
gaucaauccuucuuuuucucuuuu

SEQ ID NO: 38221 - RNA, 24 nt, Human
ucaguuaaaaaagaaggaaggaag

SEQ ID NO: 38222 - RNA, 24 nt, Human
ucaauuuuuauuuugguuuucuua

SEQ ID NO: 38223 - RNA, 20 nt, Human
cuugucccucucucacacuu

SEQ ID NO: 38224 - RNA, 24 nt, Human
aaggugaacuugucacuugguaug

SEQ ID NO: 38225 - RNA, 24 nt, Human
ugguggucuugagcuuuuggccug

SEQ ID NO: 38226 - RNA, 24 nt, Human
gaacacacuuggcagauggaggaa

SEQ ID NO: 38227 - RNA, 24 nt, Human
agagcgagaggagauugaagugga

SEQ ID NO: 38228 - RNA, 24 nt, Human
cgggcacagaaacacagcagcggg

SEQ ID NO: 38229 - RNA, 24 nt, Human
uucugauuccacuaggaccagacu

SEQ ID NO: 38230 - RNA, 24 nt, Human
ugcauuguuaucauuaaccagucu

SEQ ID NO: 38231 - RNA, 24 nt, Human
ugagcaccuguggcugacccgaca

SEQ ID NO: 38232 - RNA, 24 nt, Human
cuuugugcuugggguagaucuucu

SEQ ID NO: 38233 - RNA, 24 nt, Human
guagaguuuucuucaggcuuaaag

SEQ ID NO: 38234 - RNA, 24 nt, Human
agccucggagccggugggccaugu

SEQ ID NO: 38235 - RNA, 24 nt, Human
caccaaaaacccguuuuuuucccc

SEQ ID NO: 38236 - RNA, 24 nt, Human
gggcguugggaaccgacaccgccg

SEQ ID NO: 38237 - RNA, 24 nt, Human
uaugacauuuuucugcuuuucccu

SEQ ID NO: 38238 - RNA, 22 nt, Human
uuggugcuuaagagaauuacaa

SEQ ID NO: 38239 - RNA, 24 nt, Human
cgggaccaucuggggcaccugcuu

SEQ ID NO: 38240 - RNA, 24 nt, Human
caggagcuuuugugugccugguag

SEQ ID NO: 38241 - RNA, 24 nt, Human
gggcacugaagaugaugcgaccca

SEQ ID NO: 38242 - RNA, 22 nt, Human
aagaguguguaggccagccccg

SEQ ID NO: 38243 - RNA, 24 nt, Human
ucacggaggaccccgccgagcgcg

SEQ ID NO: 38244 - RNA, 24 nt, Human
uugaucuugaagaaacugggcgug

SEQ ID NO: 38245 - RNA, 24 nt, Human
guagaguuuucuucaggcuuaaag

SEQ ID NO: 38246 - RNA, 21 nt, Human
uucuaugguuuccaacagagg

SEQ ID NO: 38247 - RNA, 24 nt, Human
uagcuugacacaaaaguugguagc

SEQ ID NO: 38248 - RNA, 24 nt, Human
uggaugaaaaaaaauacaagagcu

SEQ ID NO: 38249 - RNA, 24 nt, Human
uggcuguaacaaaugcugauuuag

SEQ ID NO: 38250 - RNA, 24 nt, Human
uggcaccauggaugccuucgugaa

SEQ ID NO: 38251 - RNA, 24 nt, Human
ugagcuggugaagagcuggcucaa

SEQ ID NO: 38252 - RNA, 24 nt, Human
uggcucaggguggcuggcgcucac

SEQ ID NO: 38253 - RNA, 24 nt, Human
cuggagccucuguaccugugccca

SEQ ID NO: 38254 - RNA, 24 nt, Human
ucuuguggauuuuguagaugguuu

SEQ ID NO: 38255 - RNA, 24 nt, Human
ugaaaaaauacuuguuaauuuauu

SEQ ID NO: 38256 - RNA, 24 nt, Human
ugcaugaacuucgaagggcagaua

SEQ ID NO: 38257 - RNA, 24 nt, Human
uucaacacgauaauaccuguugcc

SEQ ID NO: 38258 - RNA, 24 nt, Human
ugaacgcgcgccggggggaugggc

SEQ ID NO: 38259 - RNA, 19 nt, Human
uacauuugaggcuuguuuu

SEQ ID NO: 38260 - RNA, 24 nt, Human
uaacuggguugacauugggcugaa

SEQ ID NO: 38261 - RNA, 24 nt, Human
uaauucuuuuaauuugguuaucug

SEQ ID NO: 38262 - RNA, 24 nt, Human
ugucuucgagaauaaccguuuggc

SEQ ID NO: 38263 - RNA, 24 nt, Human
gccaagcggcugagccaaauuggg

SEQ ID NO: 38264 - RNA, 19 nt, Human
acccugguaaauguuuugg

SEQ ID NO: 38265 - RNA, 24 nt, Human
uguuacaccagccuuuccaggguu

SEQ ID NO: 38266 - RNA, 24 nt, Human
ugauuaggacuuuuauugugaauu

SEQ ID NO: 38267 - RNA, 24 nt, Human
ugacaagaggaagcuagguugaaa

SEQ ID NO: 38268 - RNA, 24 nt, Human
ugaccagccggagcagccggagcu

SEQ ID NO: 38269 - RNA, 24 nt, Human
ucaguccccacugcgguccacggc

SEQ ID NO: 38270 - RNA, 24 nt, Human
ugaaaacccaaaacccaacuggcc

SEQ ID NO: 38271 - RNA, 23 nt, Human
uuacaacaaucgagugcuggaca

SEQ ID NO: 38272 - RNA, 24 nt, Human
uccaaauuuggauaaaauaucucu

SEQ ID NO: 38273 - RNA, 24 nt, Human
uuagacuugcaggcugcaggagug

SEQ ID NO: 38274 - RNA, 20 nt, Human
ugacacaaagguggaauaaa

SEQ ID NO: 38275 - RNA, 24 nt, Human
gcgcagcuucaggggccgcaaggg

SEQ ID NO: 38276 - RNA, 24 nt, Human
guccagggcgcggcaugggcgucc

SEQ ID NO: 38277 - RNA, 24 nt, Human
ugaaagccacucggaauuucucca

SEQ ID NO: 38278 - RNA, 24 nt, Human
ugaucucguuggacugcguggcua

SEQ ID NO: 38279 - RNA, 24 nt, Human
aggcaguucaccagccggcucagg

SEQ ID NO: 38280 - RNA, 24 nt, Human
cggcaaaggcgcgguuuucaccac

SEQ ID NO: 38281 - RNA, 24 nt, Human
aaguacgugcuguggguggacgac

SEQ ID NO: 38282 - RNA, 24 nt, Human
cggcgugguuaacuucuuccuggc

SEQ ID NO: 38283 - RNA, 24 nt, Human
acacaaguugucucaaagaugaua

SEQ ID NO: 38284 - RNA, 24 nt, Human
aaaaauccuaagauuucaguucag

SEQ ID NO: 38285 - RNA, 21 nt, Human
aguuguuuuacuccauccugu

SEQ ID NO: 38286 - RNA, 24 nt, Human
uguuauuuucugcaauucuuauuc

SEQ ID NO: 38287 - RNA, 24 nt, Human
auuacauaaaaaugguucuauaaa

SEQ ID NO: 38288 - RNA, 24 nt, Human
uauagaacaaauguuucgucuuaa

SEQ ID NO: 38289 - RNA, 24 nt, Human
uacguuaugcaaaguguuucaaau

SEQ ID NO: 38290 - RNA, 24 nt, Human
uuaaaacacacauaauacaaguuu

SEQ ID NO: 38291 - RNA, 20 nt, Human
uggcugaaggucugcagcug

SEQ ID NO: 38292 - RNA, 24 nt, Human
uggagugugaucuagcucacugua

SEQ ID NO: 38293 - RNA, 24 nt, Human
agggggugggaggugugcauaaga

SEQ ID NO: 38294 - RNA, 21 nt, Human
uguuguaaauuucuuuguugg

SEQ ID NO: 38295 - RNA, 24 nt, Human
agaaggaaggagggagggcagagc

SEQ ID NO: 38296 - RNA, 24 nt, Human
cuuuccuuuucagauguggcuggu

SEQ ID NO: 38297 - RNA, 24 nt, Human
ugaugauacccacggauaugcagu

SEQ ID NO: 38298 - RNA, 19 nt, Human
ucacuggggagucuuaugc

SEQ ID NO: 38299 - RNA, 24 nt, Human
augccaccuaagggagacucagga

SEQ ID NO: 38300 - RNA, 24 nt, Human
uggaacaugggccuuauguuguca

SEQ ID NO: 38301 - RNA, 24 nt, Human
uauggcaagucacuuugacagaca

SEQ ID NO: 38302 - RNA, 24 nt, Human
uacaccacucccaagaagaauaag

SEQ ID NO: 38303 - RNA, 24 nt, Human
uuuaaaaaccuggcuccuuacucu

SEQ ID NO: 38304 - RNA, 24 nt, Human
uccgugcgcguugcugcggccgug

SEQ ID NO: 38305 - RNA, 24 nt, Human
guagaguuuucuucaggcuuaaag

SEQ ID NO: 38306 - RNA, 24 nt, Human
aagcaucuuauuuuauaguauauc

SEQ ID NO: 38307 - RNA, 24 nt, Human
uagcaauaauugguuucuggcaag

SEQ ID NO: 38308 - RNA, 24 nt, Human
uaucaaauaugacccaagcauugg

SEQ ID NO: 38309 - RNA, 24 nt, Human
uagggggugcaggucugaacaagg

SEQ ID NO: 38310 - RNA, 24 nt, Human
cggugccauucaguuuguggacgg

SEQ ID NO: 38311 - RNA, 24 nt, Human
uuggcagucaagcacuuuucugua

SEQ ID NO: 38312 - RNA, 24 nt, Human
cagauccaagagauauauuuggca

SEQ ID NO: 38313 - RNA, 24 nt, Human
aguuuggauucugaaaacuaacug

SEQ ID NO: 38314 - RNA, 24 nt, Human
ccuuacucccucuuuaagauugcg

SEQ ID NO: 38315 - RNA, 24 nt, Human
uuagagcuggcagcagcaucucag

SEQ ID NO: 38316 - RNA, 24 nt, Human
uacccuaacagugccaaagcaaag

SEQ ID NO: 38317 - RNA, 24 nt, Human
uacccugagaacucagagcaguug

SEQ ID NO: 38318 - RNA, 24 nt, Human
ucuuguguuucaccaaaugagagg

SEQ ID NO: 38319 - RNA, 24 nt, Human
uuggcuguggcacugggcugagug

SEQ ID NO: 38320 - RNA, 24 nt, Human
ggaccacgagugcaagcucugugg

SEQ ID NO: 38321 - RNA, 24 nt, Human
uggcaaggccuuccccaaggucua

SEQ ID NO: 38322 - RNA, 24 nt, Human
uggaaagagcuuccgggagucggg

SEQ ID NO: 38323 - RNA, 24 nt, Human
uucauggugaacaccauucaacaa

SEQ ID NO: 38324 - RNA, 24 nt, Human
cauccaacguggucgcgaccucgu

SEQ ID NO: 38325 - RNA, 24 nt, Human
cuuggcacugaacacaccuccaca

SEQ ID NO: 38326 - RNA, 24 nt, Human
agagcagucaggagacaagcauaa

SEQ ID NO: 38327 - RNA, 24 nt, Human
caagagcaagaagcaguucuuugu

SEQ ID NO: 38328 - RNA, 24 nt, Human
ugcccugguggcagcccccagcac

SEQ ID NO: 38329 - RNA, 24 nt, Human
ugugaugaggugaaccugccgcug

SEQ ID NO: 38330 - RNA, 24 nt, Human
uuuguuaguguuggcaaaaagucu

SEQ ID NO: 38331 - RNA, 24 nt, Human
ucgcaaccauggcaguccugggcc

SEQ ID NO: 38332 - RNA, 24 nt, Human
caggguacggcuggacgagcacgc

SEQ ID NO: 38333 - RNA, 20 nt, Human
ugggcuggagggagaggcuu

SEQ ID NO: 38334 - RNA, 21 nt, Human
ucgaagagauacucgcccagc

SEQ ID NO: 38335 - RNA, 20 nt, Human
uaggaggccgugcaggucac

SEQ ID NO: 38336 - RNA, 24 nt, Human
ucagagcuacagccagggauagag

SEQ ID NO: 38337 - RNA, 24 nt, Human
uucgaggggaccugcuauucuucg

SEQ ID NO: 38338 - RNA, 21 nt, Human
ugugauggccacccuucucuu

SEQ ID NO: 38339 - RNA, 24 nt, Human
augaagcuaaaaaaaaggccagug

SEQ ID NO: 38340 - RNA, 23 nt, Human
ucuccaggugcucaucuccaucc

SEQ ID NO: 38341 - RNA, 24 nt, Human
acugguucaccuacaaugagacaa

SEQ ID NO: 38342 - RNA, 24 nt, Human
ucacauagguugugccaugagugg

SEQ ID NO: 38343 - RNA, 24 nt, Human
ugcccagagcuccuugcaagaagu

SEQ ID NO: 38344 - RNA, 24 nt, Human
ugucagaagcucaaagcgacucau

SEQ ID NO: 38345 - RNA, 24 nt, Human
uaaaauguuauacucauauuuguc

SEQ ID NO: 38346 - RNA, 24 nt, Human
uaaauuguuuuccaguugaccgag

SEQ ID NO: 38347 - RNA, 24 nt, Human
uucaaggagagucaccuugcucau

SEQ ID NO: 38348 - RNA, 24 nt, Human
ccgcgcccagcccaaauuauuaca

SEQ ID NO: 38349 - RNA, 19 nt, Human
ugacagaguacauugaggg

SEQ ID NO: 38350 - RNA, 24 nt, Human
agaggaaaagggcccccauggaga

SEQ ID NO: 38351 - RNA, 24 nt, Human
uggcgaaggagcuuucugaaauca

SEQ ID NO: 38352 - RNA, 24 nt, Human
ucgaagcugcacaaagguggcccc

SEQ ID NO: 38353 - RNA, 24 nt, Human
uuccgggucaggcagauugguauu

SEQ ID NO: 38354 - RNA, 23 nt, Human
uuucgcugucuuuuccucacaca

SEQ ID NO: 38355 - RNA, 24 nt, Human
uauuaggcaagaacagguaaugua

SEQ ID NO: 38356 - RNA, 24 nt, Human
aaacugguuaaaaauugagucuuu

SEQ ID NO: 38357 - RNA, 24 nt, Human
uuugauuauuagacagcaauguca

SEQ ID NO: 38358 - RNA, 24 nt, Human
uccacauuccaggagcugugcgag

SEQ ID NO: 38359 - RNA, 24 nt, Human
ugcucgggaucaaggcccaggugg

SEQ ID NO: 38360 - RNA, 24 nt, Human
cgaggucugucccacgcccgcccg

SEQ ID NO: 38361 - RNA, 24 nt, Human
aggaaccgcggggaaaggcgaaug

SEQ ID NO: 38362 - RNA, 24 nt, Human
caaguacauaugauuucagcugca

SEQ ID NO: 38363 - RNA, 24 nt, Human
uaucagagacuguuauccauuugu

SEQ ID NO: 38364 - RNA, 24 nt, Human
uauuucauaaguauggaugugcaa

SEQ ID NO: 38365 - RNA, 23 nt, Human
ccucggagagugggaagcuuugg

SEQ ID NO: 38366 - RNA, 24 nt, Human
ucaaauguaaacucaauuugccuc

SEQ ID NO: 38367 - RNA, 22 nt, Human
ugacuggagcacccccauucac

SEQ ID NO: 38368 - RNA, 18 nt, Human
uacaaggaaggcuguguu

SEQ ID NO: 38369 - RNA, 24 nt, Human
ugccauugccaccaucaaaacaag

SEQ ID NO: 38370 - RNA, 24 nt, Human
ugaguucagguguggaguuuuuca

SEQ ID NO: 38371 - RNA, 24 nt, Human
ucgaccacagaugcucugaacguu

SEQ ID NO: 38372 - RNA, 24 nt, Human
ugugaccaugucggugggaaaagu

SEQ ID NO: 38373 - RNA, 24 nt, Human
uguuauggggauaagcuggugagg

SEQ ID NO: 38374 - RNA, 22 nt, Human
ugggguauccugaacuguaucc

SEQ ID NO: 38375 - RNA, 24 nt, Human
uaaugggucucaaaauucugugac

SEQ ID NO: 38376 - RNA, 24 nt, Human
aagcacuuuuguugagugacaacc

SEQ ID NO: 38377 - RNA, 18 nt, Human
ugauacgacucugagagc

SEQ ID NO: 38378 - RNA, 24 nt, Human
uuugaucaggaaacgugguuacua

SEQ ID NO: 38379 - RNA, 24 nt, Human
ucaguggugcugccccauucggcg

SEQ ID NO: 38380 - RNA, 24 nt, Human
uggaaggcuggacuacuuccuccu

SEQ ID NO: 38381 - RNA, 24 nt, Human
uacaccaugauauacucuugucug

SEQ ID NO: 38382 - RNA, 24 nt, Human
ucucucacccuugcugugcaugua

SEQ ID NO: 38383 - RNA, 24 nt, Human
cucgagggaccaaaucuccaacuu

SEQ ID NO: 38384 - RNA, 22 nt, Human
auggagcccugaauguugaccu

SEQ ID NO: 38385 - RNA, 24 nt, Human
uggcaggccccaacaucgccgcca

SEQ ID NO: 38386 - RNA, 24 nt, Human
gagaaggagaagcucaagucccag

SEQ ID NO: 38387 - RNA, 24 nt, Human
caggagccaccaugucugccccau

SEQ ID NO: 38388 - RNA, 24 nt, Human
aacaguuugcugaugaccaaauac

SEQ ID NO: 38389 - RNA, 24 nt, Human
accaggugccauguuucauuuaug

SEQ ID NO: 38390 - RNA, 24 nt, Human
agaguugggguaaagauuccaggg

SEQ ID NO: 38391 - RNA, 24 nt, Human
ccagaacucaaccuuucacaucuu

SEQ ID NO: 38392 - RNA, 24 nt, Human
ucuauuaguuuuauuuugguguaa

SEQ ID NO: 38393 - RNA, 24 nt, Human
uuuagagaccacugguagccuaag

SEQ ID NO: 38394 - RNA, 24 nt, Human
uguaaguguuggcuuuuaacuugg

SEQ ID NO: 38395 - RNA, 24 nt, Human
cauuucaauacuuuuggcuacuuc

SEQ ID NO: 38396 - RNA, 24 nt, Human
acucuguuccuuuaauuacaaagu

SEQ ID NO: 38397 - RNA, 24 nt, Human
ucccaggcuggaguacaauggcau

SEQ ID NO: 38398 - RNA, 24 nt, Human
uagauuauuuggaaagacuguauu

SEQ ID NO: 38399 - RNA, 24 nt, Human
cagcacacacacucuucccugggc

SEQ ID NO: 38400 - RNA, 24 nt, Human
agucacuaaguccuggccugagag

SEQ ID NO: 38401 - RNA, 24 nt, Human
guccaguagucacaugggcucaau

SEQ ID NO: 38402 - RNA, 24 nt, Human
gccccgguccuggugccucuugcc

SEQ ID NO: 38403 - RNA, 24 nt, Human
ccagcacgucgaagcgcuccaugg

SEQ ID NO: 38404 - RNA, 20 nt, Human
cccaggauguagaugcggcc

SEQ ID NO: 38405 - RNA, 24 nt, Human
uggaugaaguuuuguuguagugug

SEQ ID NO: 38406 - RNA, 24 nt, Human
uucucaguuuugaggccaugaauc

SEQ ID NO: 38407 - RNA, 24 nt, Human
uggcaugcuagguuucuggguucu

SEQ ID NO: 38408 - RNA, 24 nt, Human
cuuggccuuggccuuggccuuggc

SEQ ID NO: 38409 - RNA, 24 nt, Human
cauuguuggccugcaucuucuuua

SEQ ID NO: 38410 - RNA, 24 nt, Human
uacacggucguggacgagauguuc

SEQ ID NO: 38411 - RNA, 24 nt, Human
ugacgggcggcaucuuuguggcgc

SEQ ID NO: 38412 - RNA, 24 nt, Human
uauggcaagucacuuugacagaca

SEQ ID NO: 38413 - RNA, 24 nt, Human
ugagaauggcaaaauuagucgccu

SEQ ID NO: 38414 - RNA, 24 nt, Human
uacaccacucccaagaagaauaag

SEQ ID NO: 38415 - RNA, 24 nt, Human
cagcaucuuggaccucaugccugg

SEQ ID NO: 38416 - RNA, 24 nt, Human
ugaauaaaaugucuuugcuuguaa

SEQ ID NO: 38417 - RNA, 24 nt, Human
agccauugaaacagaugaucugac

SEQ ID NO: 38418 - RNA, 20 nt, Human
ugccauaggccggggugcca

SEQ ID NO: 38419 - RNA, 19 nt, Human
gucccuuuaauugcucugg

SEQ ID NO: 38420 - RNA, 24 nt, Human
uauggcaagucacuuugacagaca

SEQ ID NO: 38421 - RNA, 24 nt, Human
cagguggaugagaauggcaaaauu

SEQ ID NO: 38422 - RNA, 24 nt, Human
uacaccacucccaagaagaauaag

SEQ ID NO: 38423 - RNA, 24 nt, Human
gagacgggguuuccccaugugggc

SEQ ID NO: 38424 - RNA, 24 nt, Human
uggucugaaaacucuuguccucag

SEQ ID NO: 38425 - RNA, 24 nt, Human
uugcaaccucugccuccgggguuc

SEQ ID NO: 38426 - RNA, 24 nt, Human
ucucgcucuguugcccaggcugga

SEQ ID NO: 38427 - RNA, 24 nt, Human
uuaguuuaaaauguugguguuuag

SEQ ID NO: 38428 - RNA, 24 nt, Human
ucaaaacccugguuauagauguac

SEQ ID NO: 38429 - RNA, 24 nt, Human
aagguccaguuuuaaaaaaugaca

SEQ ID NO: 38430 - RNA, 24 nt, Human
gggaauccaaauccaggucgcgau

SEQ ID NO: 38431 - RNA, 24 nt, Human
uuagugaggugaacgacuucagau

SEQ ID NO: 38432 - RNA, 24 nt, Human
uugaucuugaagaaacugggcgug

SEQ ID NO: 38433 - RNA, 24 nt, Human
aggaaggagauauagugaagagga

SEQ ID NO: 38434 - RNA, 24 nt, Human
guagaguuuucuucaggcuuaaag

SEQ ID NO: 38435 - RNA, 24 nt, Human
ugagaauggcaaaauuagucgccu

SEQ ID NO: 38436 - RNA, 24 nt, Human
uacaccacucccaagaagaauaag

SEQ ID NO: 38437 - RNA, 24 nt, Human
ucaaaguagguggagccgauguag

SEQ ID NO: 38438 - RNA, 24 nt, Human
guuuuuguucuggaagccauauuu

SEQ ID NO: 38439 - RNA, 24 nt, Human
uccaguggaacccaaaguccuaag

SEQ ID NO: 38440 - RNA, 24 nt, Human
uagcuuggugccaauuggucgugg

SEQ ID NO: 38441 - RNA, 24 nt, Human
uugaucuugaagaaacugggcgug

SEQ ID NO: 38442 - RNA, 24 nt, Human
aggaaggagauauagugaagagga

SEQ ID NO: 38443 - RNA, 24 nt, Human
guagaguuuucuucaggcuuaaag

SEQ ID NO: 38444 - RNA, 24 nt, Human
gagugcuucagguaucagcuucca

SEQ ID NO: 38445 - RNA, 24 nt, Human
ggacagguguacagacauguucuu

SEQ ID NO: 38446 - RNA, 24 nt, Human
acuaaggucggcuuuguuccugga

SEQ ID NO: 38447 - RNA, 24 nt, Human
uguuauggaggaauagauuugcuu

SEQ ID NO: 38448 - RNA, 24 nt, Human
uuaaaugaagccaugguauguguu

SEQ ID NO: 38449 - RNA, 24 nt, Human
ccgcugcgcgggagcuagggcugu

SEQ ID NO: 38450 - RNA, 24 nt, Human
gcccggcgaggucgccgcugccuc

SEQ ID NO: 38451 - RNA, 24 nt, Human
ugcucuggagauuuaaauuuuccc

SEQ ID NO: 38452 - RNA, 24 nt, Human
ugaggaccagaggcccuauugcuu

SEQ ID NO: 38453 - RNA, 24 nt, Human
gcgcucagugccuuggggaagaag

SEQ ID NO: 38454 - RNA, 24 nt, Human
ccuuccggcuacacauuaccauuc

SEQ ID NO: 38455 - RNA, 24 nt, Human
uccaaauaccagagacugaaauuu

SEQ ID NO: 38456 - RNA, 24 nt, Human
uuugucgugguuauaaaacaauua

SEQ ID NO: 38457 - RNA, 23 nt, Human
ugcaacaggacucgguggagugc

SEQ ID NO: 38458 - RNA, 17 nt, Human
ugcuuugguaggacguc

SEQ ID NO: 38459 - RNA, 24 nt, Human
ggacagguguacagacauguucuu

SEQ ID NO: 38460 - RNA, 24 nt, Human
ucgaauggacacauuaccagugaa

SEQ ID NO: 38461 - RNA, 24 nt, Human
aggcauaggccccucaugaccugc

SEQ ID NO: 38462 - RNA, 17 nt, Human
uaauaugucugugcagc

SEQ ID NO: 38463 - RNA, 24 nt, Human
ugugaagacugggagggaacccua

SEQ ID NO: 38464 - RNA, 24 nt, Human
ugagaaugaccccaagaccuuuga

SEQ ID NO: 38465 - RNA, 24 nt, Human
ugugaacgggaagaaggugcugca

SEQ ID NO: 38466 - RNA, 24 nt, Human
cuuccaaucugaugggcauguuug

SEQ ID NO: 38467 - RNA, 22 nt, Human
guggagggcagcuuugucuaca

SEQ ID NO: 38468 - RNA, 24 nt, Human
cauggcaccccagcaguuagggac

SEQ ID NO: 38469 - RNA, 24 nt, Human
ugagguaucguuuacugcaaagaa

SEQ ID NO: 38470 - RNA, 24 nt, Human
ccauacuguguugaauaagagugg

SEQ ID NO: 38471 - RNA, 24 nt, Human
gccccguuaauuuuuuuauauuuu

SEQ ID NO: 38472 - RNA, 24 nt, Human
uuacugcaagcuccgccuccuggg

SEQ ID NO: 38473 - RNA, 24 nt, Human
ugaaauagugauuugcaauagacu

SEQ ID NO: 38474 - RNA, 24 nt, Human
aacacuuguauuuucuccuuugca

SEQ ID NO: 38475 - RNA, 24 nt, Human
agcccguugagguuggcguagugg

SEQ ID NO: 38476 - RNA, 24 nt, Human
ucccgaggugcaucugcaggagcu

SEQ ID NO: 38477 - RNA, 20 nt, Human
ugcuggggggucgggggcag

SEQ ID NO: 38478 - RNA, 24 nt, Human
cgagggcaaggguggcccugaagg

SEQ ID NO: 38479 - RNA, 21 nt, Human
ucuuguggacgcaagcuuccu

SEQ ID NO: 38480 - RNA, 24 nt, Human
uggcagcccuaccucugagauuuu

SEQ ID NO: 38481 - RNA, 24 nt, Human
ugaggaccagugcacugaguacau

SEQ ID NO: 38482 - RNA, 21 nt, Human
ugggaggggcugaauguggug

SEQ ID NO: 38483 - RNA, 21 nt, Human
gauucuguggagagugcagag

SEQ ID NO: 38484 - RNA, 24 nt, Human
ugagaauggcaaaauuagucgccu

SEQ ID NO: 38485 - RNA, 24 nt, Human
uacaccacucccaagaagaauaag

SEQ ID NO: 38486 - RNA, 24 nt, Human
ccuccaauccuaguaaacaggggc

SEQ ID NO: 38487 - RNA, 24 nt, Human
uaugauagaggaccagcgucuagg

SEQ ID NO: 38488 - RNA, 24 nt, Human
gcgaagaucaacccaugcgcacaa

SEQ ID NO: 38489 - RNA, 24 nt, Human
uccacuggcgaaagaugccuuucu

SEQ ID NO: 38490 - RNA, 24 nt, Human
uagagugguggcucccagaauccc

SEQ ID NO: 38491 - RNA, 24 nt, Human
ugagcaaagaacugaagaagcaag

SEQ ID NO: 38492 - RNA, 24 nt, Human
uuaaauauuaagaaagcuaaaauu

SEQ ID NO: 38493 - RNA, 24 nt, Human
aaggagccacggggugaggcuggu

SEQ ID NO: 38494 - RNA, 24 nt, Human
aagggcccccggaagugugggggc

SEQ ID NO: 38495 - RNA, 22 nt, Human
ugacuuguuaagauagacaacg

SEQ ID NO: 38496 - RNA, 24 nt, Human
uauucagguauccaaagucaggaa

SEQ ID NO: 38497 - RNA, 24 nt, Human
uaccuugugggagggcgccccccc

SEQ ID NO: 38498 - RNA, 24 nt, Human
uaccaaaauaaauauaucuaacac

SEQ ID NO: 38499 - RNA, 24 nt, Human
uaccugucauccuccauagaacgg

SEQ ID NO: 38500 - RNA, 23 nt, Human
cguggacagcuaucucagagccu

SEQ ID NO: 38501 - RNA, 24 nt, Human
cagggccaaagccaccuccagcgc

SEQ ID NO: 38502 - RNA, 22 nt, Human
ugagcugggggagggggagggc

SEQ ID NO: 38503 - RNA, 24 nt, Human
gauaacauuauuauguugccuucu

SEQ ID NO: 38504 - RNA, 24 nt, Human
aaugugcugguaacugcuuugcuu

SEQ ID NO: 38505 - RNA, 24 nt, Human
aagcaucugaguuugagaccaugg

SEQ ID NO: 38506 - RNA, 24 nt, Human
ucgguuccucccauacaugauaua

SEQ ID NO: 38507 - RNA, 24 nt, Human
uccucugucucucgaggaacuagg

SEQ ID NO: 38508 - RNA, 24 nt, Human
cggcgaccgccuccgcggcgcccc

SEQ ID NO: 38509 - RNA, 24 nt, Human
agaagaagaagaaauggcaaagag

SEQ ID NO: 38510 - RNA, 24 nt, Human
agguugccagucucuucauccaug

SEQ ID NO: 38511 - RNA, 24 nt, Human
ucugaucaauccuucuuuuucucu

SEQ ID NO: 38512 - RNA, 24 nt, Human
ucaauuuuuauuuugguuuucuua

SEQ ID NO: 38513 - RNA, 24 nt, Human
agaagccgggagcggcugaucagg

SEQ ID NO: 38514 - RNA, 24 nt, Human
ucccucaaguuucauuugugaagu

SEQ ID NO: 38515 - RNA, 24 nt, Human
uaucugaaaaauaugaaauuagcu

SEQ ID NO: 38516 - RNA, 17 nt, Human
cugcucagugauugcgg

SEQ ID NO: 38517 - RNA, 24 nt, Human
uuaaucauucaaaucacuaucuga

SEQ ID NO: 38518 - RNA, 24 nt, Human
aggcaugacggcuccgagcccugc

SEQ ID NO: 38519 - RNA, 24 nt, Human
uaaguacggugcaguugacccacu

SEQ ID NO: 38520 - RNA, 24 nt, Human
ugacaggagcagccugugggcacc

SEQ ID NO: 38521 - RNA, 18 nt, Human
caccccgcuuucaccccc

SEQ ID NO: 38522 - RNA, 24 nt, Human
uggguggcugugguauaugggaaa

SEQ ID NO: 38523 - RNA, 24 nt, Human
uggaagaagaaugaaguugcugau

SEQ ID NO: 38524 - RNA, 24 nt, Human
auacaagaaugugaaauuguucuc

SEQ ID NO: 38525 - RNA, 24 nt, Human
gucguggucauuguugcuuccuuc

SEQ ID NO: 38526 - RNA, 21 nt, Human
uucaagggauggaaagucacc

SEQ ID NO: 38527 - RNA, 23 nt, Human
ugugaaaggccagaauuugagga

SEQ ID NO: 38528 - RNA, 24 nt, Human
gugguuuaagguguuccagaugac

SEQ ID NO: 38529 - RNA, 24 nt, Human
uugccgguguagggaccaggcacg

SEQ ID NO: 38530 - RNA, 19 nt, Human
uauaguagacuguucaugu

SEQ ID NO: 38531 - RNA, 24 nt, Human
uaccuuaaagacauuauacugaug

SEQ ID NO: 38532 - RNA, 24 nt, Human
gacacuggcaggcacgccgggcag

SEQ ID NO: 38533 - RNA, 24 nt, Human
uaccugguccucacaucuccuuag

SEQ ID NO: 38534 - RNA, 23 nt, Human
aggcagaggagggggcggggggc

SEQ ID NO: 38535 - RNA, 24 nt, Human
uugaucuugaagaaacugggcgug

SEQ ID NO: 38536 - RNA, 24 nt, Human
aggaaggagauauagugaagagga

SEQ ID NO: 38537 - RNA, 24 nt, Human
uguggagucaggaacugaaagcug

SEQ ID NO: 38538 - RNA, 24 nt, Human
ugaagcaagcuccggagacuucuu

SEQ ID NO: 38539 - RNA, 24 nt, Human
ucuuugggacaccugaagaaaauc

SEQ ID NO: 38540 - RNA, 24 nt, Human
uggaaggauacggugaccugguga

SEQ ID NO: 38541 - RNA, 24 nt, Human
uaucagaguaacgagaagacaaac

SEQ ID NO: 38542 - RNA, 24 nt, Human
uaccgcauuguuucucagaagcaa

SEQ ID NO: 38543 - RNA, 24 nt, Human
uauggcaagucacuuugacagaca

SEQ ID NO: 38544 - RNA, 24 nt, Human
ugagaauggcaaaauuagucgccu

SEQ ID NO: 38545 - RNA, 24 nt, Human
ucacaccacucccaagaagaauaa

SEQ ID NO: 38546 - RNA, 24 nt, Human
uccaaaagaacaagaaauuaaugc

SEQ ID NO: 38547 - RNA, 24 nt, Human
uggaucaccugaggucaggaguuc

SEQ ID NO: 38548 - RNA, 24 nt, Human
ucgaaagugaggaucuugcccccu

SEQ ID NO: 38549 - RNA, 24 nt, Human
ugucucaggcaccugaaucagacc

SEQ ID NO: 38550 - RNA, 24 nt, Human
uguugugaggaucaaauggaagga

SEQ ID NO: 38551 - RNA, 22 nt, Human
uccgugcgcguugcugcggccg

SEQ ID NO: 38552 - RNA, 24 nt, Human
uugaucuugaagaaacugggcgug

SEQ ID NO: 38553 - RNA, 24 nt, Human
aggaaggagauauagugaagagga

SEQ ID NO: 38554 - RNA, 24 nt, Human
guagaguuuucuucaggcuuaaag

SEQ ID NO: 38555 - RNA, 24 nt, Human
uucagugggccugguggagacccu

SEQ ID NO: 38556 - RNA, 18 nt, Human
uagaggguggaucugguc

SEQ ID NO: 38557 - RNA, 24 nt, Human
uugauaguuuacuuauacguugaa

SEQ ID NO: 38558 - RNA, 22 nt, Human
uccgugcgcguugcugcggccg

SEQ ID NO: 38559 - RNA, 24 nt, Human
uuccaguuggugaggagcuguugg

SEQ ID NO: 38560 - RNA, 24 nt, Human
aggaaggagauauagugaagagga

SEQ ID NO: 38561 - RNA, 24 nt, Human
uucaagaaauugucacaaaagguu

SEQ ID NO: 38562 - RNA, 22 nt, Human
uccgugcgcguugcugcggccg

SEQ ID NO: 38563 - RNA, 24 nt, Human
uugaucuugaagaaacugggcgug

SEQ ID NO: 38564 - RNA, 24 nt, Human
aggaaggagauauagugaagagga

SEQ ID NO: 38565 - RNA, 22 nt, Human
uccgugcgcguugcugcggccg

SEQ ID NO: 38566 - RNA, 24 nt, Human
uugaucuugaagaaacugggcgug

SEQ ID NO: 38567 - RNA, 24 nt, Human
aggaaggagauauagugaagagga

SEQ ID NO: 38568 - RNA, 24 nt, Human
guagaguuuucuucaggcuuaaag

SEQ ID NO: 38569 - RNA, 22 nt, Human
uccgugcgcguugcugcggccg

SEQ ID NO: 38570 - RNA, 24 nt, Human
uugaucuugaagaaacugggcgug

SEQ ID NO: 38571 - RNA, 24 nt, Human
aggaaggagauauagugaagagga

SEQ ID NO: 38572 - RNA, 24 nt, Human
guagaguuuucuucaggcuuaaag

SEQ ID NO: 38573 - RNA, 24 nt, Human
ugugaacgggaagaaggugcugca

SEQ ID NO: 38574 - RNA, 23 nt, Human
uuggcagccaugaucuuugcaug

SEQ ID NO: 38575 - RNA, 24 nt, Human
uggggucaugccgaacacccauga

SEQ ID NO: 38576 - RNA, 24 nt, Human
gucagcuuguaggccgucagugua

SEQ ID NO: 38577 - RNA, 22 nt, Human
uccgugcgcguugcugcggccg

SEQ ID NO: 38578 - RNA, 24 nt, Human
uugaucuugaagaaacugggcgug

SEQ ID NO: 38579 - RNA, 24 nt, Human
aggaaggagauauagugaagagga

SEQ ID NO: 38580 - RNA, 24 nt, Human
guagaguuuucuucaggcuuaaag

SEQ ID NO: 38581 - RNA, 24 nt, Human
uugaucuugaagaaacugggcgug

SEQ ID NO: 38582 - RNA, 24 nt, Human
guagaguuuucuucaggcuuaaag

SEQ ID NO: 38583 - RNA, 24 nt, Human
gcccugguuggccuggaaggguga

SEQ ID NO: 38584 - RNA, 19 nt, Human
gacacaguggggacaggag

SEQ ID NO: 38585 - RNA, 24 nt, Human
uggaaguggcucugggcaccagcc

SEQ ID NO: 38586 - RNA, 24 nt, Human
ucgcagguggcaugacagaggcuc

SEQ ID NO: 38587 - RNA, 24 nt, Human
uauugcucuuugguuucauaauuu

SEQ ID NO: 38588 - RNA, 24 nt, Human
uugaucuugaagaaacugggcgug

SEQ ID NO: 38589 - RNA, 24 nt, Human
aggaaggagauauagugaagagga

SEQ ID NO: 38590 - RNA, 24 nt, Human
uagcuuggugccaauuggucgugg

SEQ ID NO: 38591 - RNA, 24 nt, Human
gagcugauaccucuguugaucuug

SEQ ID NO: 38592 - RNA, 24 nt, Human
aggaaggagauauagugaagagga

SEQ ID NO: 38593 - RNA, 22 nt, Human
uccgugcgcguugcugcggccg

SEQ ID NO: 38594 - RNA, 24 nt, Human
uugaucuugaagaaacugggcgug

SEQ ID NO: 38595 - RNA, 24 nt, Human
aggaaggagauauagugaagagga

SEQ ID NO: 38596 - RNA, 24 nt, Human
uugaucuugaagaaacugggcgug

SEQ ID NO: 38597 - RNA, 24 nt, Human
aggaaggagauauagugaagagga

SEQ ID NO: 38598 - RNA, 24 nt, Human
guagaguuuucuucaggcuuaaag

SEQ ID NO: 38599 - RNA, 23 nt, Human
uaucaagucucgggagaucuuuc

SEQ ID NO: 38600 - RNA, 24 nt, Human
gcagucuuuggaaaccauuuguuu

SEQ ID NO: 38601 - RNA, 24 nt, Human
aggaaggagauauagugaagagga

SEQ ID NO: 38602 - RNA, 24 nt, Human
uugaucuugaagaaacugggcgug

SEQ ID NO: 38603 - RNA, 24 nt, Human
aggaaggagauauagugaagagga

SEQ ID NO: 38604 - RNA, 24 nt, Human
guagaguuuucuucaggcuuaaag

SEQ ID NO: 38605 - RNA, 24 nt, Human
aggaaggagauauagugaagagga

SEQ ID NO: 38606 - RNA, 24 nt, Human
ugggaacuugaagaagcaaugcgc

SEQ ID NO: 38607 - RNA, 22 nt, Human
uccgugcgcguugcugcggccg

SEQ ID NO: 38608 - RNA, 24 nt, Human
aggaaggagauauagugaagagga

SEQ ID NO: 38609 - RNA, 20 nt, Human
caucggggcugagcagagcu

SEQ ID NO: 38610 - RNA, 24 nt, Human
ugucgugacccugggugccgcggc

SEQ ID NO: 38611 - RNA, 24 nt, Human
cugcagguugucagcgaugccggc

SEQ ID NO: 38612 - RNA, 22 nt, Human
uccgugcgcguugcugcggccg

SEQ ID NO: 38613 - RNA, 24 nt, Human
guagaguuuucuucaggcuuaaag

SEQ ID NO: 38614 - RNA, 24 nt, Human
uugaucuugaagaaacugggcgug

SEQ ID NO: 38615 - RNA, 24 nt, Human
guagaguuuucuucaggcuuaaag

SEQ ID NO: 38616 - RNA, 22 nt, Human
uccgugcgcguugcugcggccg

SEQ ID NO: 38617 - RNA, 24 nt, Human
uugaucuugaagaaacugggcgug

SEQ ID NO: 38618 - RNA, 24 nt, Human
aggaaggagauauagugaagagga

SEQ ID NO: 38619 - RNA, 24 nt, Human
guagaguuuucuucaggcuuaaag

SEQ ID NO: 38620 - RNA, 24 nt, Human
uaaucaccucucggaagaaagccc

SEQ ID NO: 38621 - RNA, 24 nt, Human
uggcacaaucucagcucacuacaa

SEQ ID NO: 38622 - RNA, 24 nt, Human
uuaguagagaugggguuucaccau

SEQ ID NO: 38623 - RNA, 24 nt, Human
guagaguuuucuucaggcuuaaag

SEQ ID NO: 38624 - RNA, 24 nt, Human
ggacagguguacagacauguucuu

SEQ ID NO: 38625 - RNA, 24 nt, Human
ucgaauggacacauuaccagugaa

SEQ ID NO: 38626 - RNA, 24 nt, Human
uuuuuuuuuuuuaaaggggucuca

SEQ ID NO: 38627 - RNA, 22 nt, Human
uccgugcgcguugcugcggccg

SEQ ID NO: 38628 - RNA, 24 nt, Human
uugaucuugaagaaacugggcgug

SEQ ID NO: 38629 - RNA, 24 nt, Human
aggaaggagauauagugaagagga

SEQ ID NO: 38630 - RNA, 24 nt, Human
guagaguuuucuucaggcuuaaag

SEQ ID NO: 38631 - RNA, 24 nt, Human
uguaaaccaacaauaaagcaaaga

SEQ ID NO: 38632 - RNA, 24 nt, Human
uguugcugucaaagggcugccccc

SEQ ID NO: 38633 - RNA, 24 nt, Human
uagcaugcuuuggaaaagcaaaua

SEQ ID NO: 38634 - RNA, 24 nt, Human
guggagcgauguuuccaucucuaa

SEQ ID NO: 38635 - RNA, 24 nt, Human
aucauccuggaaagggacagaggc

SEQ ID NO: 38636 - RNA, 24 nt, Human
uauccccguuuacacacaaauuca

SEQ ID NO: 38637 - RNA, 24 nt, Human
uauuacacacggauguaagcauuu

SEQ ID NO: 38638 - RNA, 18 nt, Human
uacaaggucuggcauugg

SEQ ID NO: 38639 - RNA, 24 nt, Human
cuuggcagcauccugcagcccucu

SEQ ID NO: 38640 - RNA, 24 nt, Human
cagcaucccaacuccagguccaga

SEQ ID NO: 38641 - RNA, 24 nt, Human
aaaugugcgaaaaauaaaugcuug

SEQ ID NO: 38642 - RNA, 24 nt, Human
aggaaggagauauagugaagagga

SEQ ID NO: 38643 - RNA, 22 nt, Human
uccgugcgcguugcugcggccg

SEQ ID NO: 38644 - RNA, 24 nt, Human
uugaucuugaagaaacugggcgug

SEQ ID NO: 38645 - RNA, 24 nt, Human
aggaaggagauauagugaagagga

SEQ ID NO: 38646 - RNA, 24 nt, Human
uugaucuugaagaaacugggcgug

SEQ ID NO: 38647 - RNA, 24 nt, Human
aggaaggagauauagugaagagga

SEQ ID NO: 38648 - RNA, 24 nt, Human
guagaguuuucuucaggcuuaaag

SEQ ID NO: 38649 - RNA, 24 nt, Human
uuuucgggcugcacaaaccacggg

SEQ ID NO: 38650 - RNA, 24 nt, Human
uggaagaucuuagaauugccugcc

SEQ ID NO: 38651 - RNA, 22 nt, Human
uacugggugaauagcacuuucc

SEQ ID NO: 38652 - RNA, 24 nt, Human
ucuguuaugauuuuauuucuucaa

SEQ ID NO: 38653 - RNA, 24 nt, Human
agccaguaucauccugagcacuga

SEQ ID NO: 38654 - RNA, 24 nt, Human
ugaugagcaacuuuaaggcuaagc

SEQ ID NO: 38655 - RNA, 24 nt, Human
uucaggguugguagcagggaguac

SEQ ID NO: 38656 - RNA, 24 nt, Human
uggguugggaagaccaucaguucu

SEQ ID NO: 38657 - RNA, 24 nt, Human
ucuaugugccaggugcugguccaa

SEQ ID NO: 38658 - RNA, 24 nt, Human
aucaccuuucaccaugggcagcga

SEQ ID NO: 38659 - RNA, 24 nt, Human
ugauuuguuuccaugaaccugagu

SEQ ID NO: 38660 - RNA, 24 nt, Human
cacccggggcaguuggcugggcca

SEQ ID NO: 38661 - RNA, 24 nt, Human
ugaggaccagugcacugaguacau

SEQ ID NO: 38662 - RNA, 24 nt, Human
aggcagcggcuguggcagcccggc

SEQ ID NO: 38663 - RNA, 24 nt, Human
uugaagccaguggggcaccaaucc

SEQ ID NO: 38664 - RNA, 24 nt, Human
uaauguacagaacuaaauuuuuua

SEQ ID NO: 38665 - RNA, 24 nt, Human
uaauuuguuaaaaugacuucauuu

SEQ ID NO: 38666 - RNA, 24 nt, Human
aacacuuuuuacauauauguacau

SEQ ID NO: 38667 - RNA, 24 nt, Human
uacacggugaggcacccggagugg

SEQ ID NO: 38668 - RNA, 24 nt, Human
ugaaaggugugaacuugcaauguc

SEQ ID NO: 38669 - RNA, 24 nt, Human
uuaaaauaugggugcacauuuugc

SEQ ID NO: 38670 - RNA, 19 nt, Human
agggauguucaggacucug

SEQ ID NO: 38671 - RNA, 24 nt, Human
uucucuguuuggaggcugcaccca

SEQ ID NO: 38672 - RNA, 24 nt, Human
ccacacaggcucauucucaacugg

SEQ ID NO: 38673 - RNA, 23 nt, Human
ugaguagacgggaggggagggug

SEQ ID NO: 38674 - RNA, 24 nt, Human
ugguacagacuaaaacaaaugugg

SEQ ID NO: 38675 - RNA, 24 nt, Human
uaaagcucuaagacucaugagcca

SEQ ID NO: 38676 - RNA, 24 nt, Human
ugagugcaagagauugaagaguuc

SEQ ID NO: 38677 - RNA, 19 nt, Human
ucugaaguaauugcaaagg

SEQ ID NO: 38678 - RNA, 24 nt, Human
uugaaaguuuguugaugaauauuu

SEQ ID NO: 38679 - RNA, 24 nt, Human
uugaaugguagagaagaaacagca

SEQ ID NO: 38680 - RNA, 24 nt, Human
cagcugcaucugcgccaccugcug

SEQ ID NO: 38681 - RNA, 24 nt, Human
cagcauucuggggcuuguaacacu

SEQ ID NO: 38682 - RNA, 24 nt, Human
ucagugguggcgccugggcucagc

SEQ ID NO: 38683 - RNA, 24 nt, Human
uguagggagaggagauggcaggac

SEQ ID NO: 38684 - RNA, 24 nt, Human
uaagaaacagaccuaguuuaaaag

SEQ ID NO: 38685 - RNA, 24 nt, Human
aaaaaccauuuggaaaaaagggga

SEQ ID NO: 38686 - RNA, 24 nt, Human
ucuacauaaaagcugucaaaguuu

SEQ ID NO: 38687 - RNA, 24 nt, Human
uucuuggccugcucaggagggggc

SEQ ID NO: 38688 - RNA, 24 nt, Human
uauuggccgacuccgcgaucugcu

SEQ ID NO: 38689 - RNA, 18 nt, Human
cuugccccccgcagagcu

SEQ ID NO: 38690 - RNA, 24 nt, Human
agguagcucgggcuauggcacuuc

SEQ ID NO: 38691 - RNA, 24 nt, Human
ugcccgaggggucagucugauaga

SEQ ID NO: 38692 - RNA, 24 nt, Human
cucacauuauacuucuacuggaca

SEQ ID NO: 38693 - RNA, 24 nt, Human
uugcuagucaaguauugagggacu

SEQ ID NO: 38694 - RNA, 24 nt, Human
cucacauuauacuucuacuggaca

SEQ ID NO: 38695 - RNA, 24 nt, Human
uugcuagucaaguauugagggacu

SEQ ID NO: 38696 - RNA, 19 nt, Human
ugcugaacaucuggugguu

SEQ ID NO: 38697 - RNA, 24 nt, Human
ugccacacuuaauagcuucaucca

SEQ ID NO: 38698 - RNA, 24 nt, Human
gccccgaggaggcggcuccucuuc

SEQ ID NO: 38699 - RNA, 24 nt, Human
uuccuugacaggcaaggcuguugg

SEQ ID NO: 38700 - RNA, 24 nt, Human
ccugcagggcucggccguaggaga

SEQ ID NO: 38701 - RNA, 24 nt, Human
uccuuugaaguauacuugaggagg

SEQ ID NO: 38702 - RNA, 24 nt, Human
ugguguggcgcauagugcagagcc

SEQ ID NO: 38703 - RNA, 24 nt, Human
acagcaaaguguggugcgaucucu

SEQ ID NO: 38704 - RNA, 24 nt, Human
uggaagcaaguggguucagugaag

SEQ ID NO: 38705 - RNA, 19 nt, Human
ccgcugagggaggcacagg

SEQ ID NO: 38706 - RNA, 24 nt, Human
ggcgguugccgguggccucagaca

SEQ ID NO: 38707 - RNA, 24 nt, Human
gugcauggccggaugucucuggga

SEQ ID NO: 38708 - RNA, 24 nt, Human
uauggcaagucacuuugacagaca

SEQ ID NO: 38709 - RNA, 24 nt, Human
ugagaauggcaaaauuagucgccu

SEQ ID NO: 38710 - RNA, 24 nt, Human
uacaccacucccaagaagaauaag

SEQ ID NO: 38711 - RNA, 24 nt, Human
uccagugucaaucccaaaccccga

SEQ ID NO: 38712 - RNA, 24 nt, Human
aaauggaaucuagaagcuaaauuu

SEQ ID NO: 38713 - RNA, 24 nt, Human
uaccauggcugaaaaaaagaguca

SEQ ID NO: 38714 - RNA, 24 nt, Human
uaauuugauucuuaugucuuuugu

SEQ ID NO: 38715 - RNA, 24 nt, Human
accagcuaccccagaccuacuaca

SEQ ID NO: 38716 - RNA, 24 nt, Human
uuggaccagccugaucguuucucu

SEQ ID NO: 38717 - RNA, 24 nt, Human
uugaagaucgugacgucuuguaac

SEQ ID NO: 38718 - RNA, 24 nt, Human
uugcggcggcgggucgaacacguu

SEQ ID NO: 38719 - RNA, 24 nt, Human
uucuaggugaaagcaguaaaugga

SEQ ID NO: 38720 - RNA, 24 nt, Human
aggaagcauccccacuacugcccu

SEQ ID NO: 38721 - RNA, 24 nt, Human
ucauuauuuggagaauaacaguga

SEQ ID NO: 38722 - RNA, 24 nt, Human
aagaagacaaacagggccaggcgc

SEQ ID NO: 38723 - RNA, 24 nt, Human
uucaccauuagacucucacauuua

SEQ ID NO: 38724 - RNA, 24 nt, Human
uccaucuucuguucuuccuccauu

SEQ ID NO: 38725 - RNA, 24 nt, Human
ugacuggaaaagaaaaguagcugc

SEQ ID NO: 38726 - RNA, 24 nt, Human
uaagccacucacuuuaaaauuuuu

SEQ ID NO: 38727 - RNA, 17 nt, Human
uugauuguuaggauaga

SEQ ID NO: 38728 - RNA, 24 nt, Human
acgcagauccuucggaccgggggg

SEQ ID NO: 38729 - RNA, 24 nt, Human
uagcauguuuccgaaagugggagg

SEQ ID NO: 38730 - RNA, 24 nt, Human
ccaguccccagcagaaaauuugcc

SEQ ID NO: 38731 - RNA, 22 nt, Human
uauugugucaggccugaaauac

SEQ ID NO: 38732 - RNA, 24 nt, Human
uuggcagcuauggaccucggccug

SEQ ID NO: 38733 - RNA, 24 nt, Human
ggaguggaaccuugucgauuaagg

SEQ ID NO: 38734 - RNA, 24 nt, Human
uggaggaggaugacgaugaugagc

SEQ ID NO: 38735 - RNA, 24 nt, Human
ucacagcccgguaggccgcaaguc

SEQ ID NO: 38736 - RNA, 18 nt, Human
ugacguggacauccgcaa

SEQ ID NO: 38737 - RNA, 24 nt, Human
acuuugagaguuucccggaguccc

SEQ ID NO: 38738 - RNA, 24 nt, Human
uagcacaguugucagacaagauuc

SEQ ID NO: 38739 - RNA, 24 nt, Human
ucccugugcccgcucaccccacuc

SEQ ID NO: 38740 - RNA, 24 nt, Human
uaauggaguauauaguuuagucau

SEQ ID NO: 38741 - RNA, 21 nt, Human
aagaagaaacucaggccaccc

SEQ ID NO: 38742 - RNA, 20 nt, Human
ucccucugggaucugagccu

SEQ ID NO: 38743 - RNA, 24 nt, Human
ucggaucagcuucuugggggccuc

SEQ ID NO: 38744 - RNA, 24 nt, Human
ucacgugggugguuuccauauaga

SEQ ID NO: 38745 - RNA, 17 nt, Human
uaacaaggagauuacuu

SEQ ID NO: 38746 - RNA, 24 nt, Human
uaauaggagaugcaguuuauuuaa

SEQ ID NO: 38747 - RNA, 24 nt, Human
ugaccucaggugauccucccgccu

SEQ ID NO: 38748 - RNA, 24 nt, Human
uaaaaaauuaauauucucaacuaa

SEQ ID NO: 38749 - RNA, 24 nt, Human
agacuggcugugguuaaaugaaua

SEQ ID NO: 38750 - RNA, 24 nt, Human
uuucacucggggaaugcuccggcu

SEQ ID NO: 38751 - RNA, 22 nt, Human
aauuccucacuugucugugugu

SEQ ID NO: 38752 - RNA, 24 nt, Human
cauaccaccacgcccagcaaauuu

SEQ ID NO: 38753 - RNA, 21 nt, Human
uauuuuggcugcagauacagg

SEQ ID NO: 38754 - RNA, 17 nt, Human
ccccccgggaaaagggg

SEQ ID NO: 38755 - RNA, 24 nt, Human
aaaauuccccacaacauacaaccc

SEQ ID NO: 38756 - RNA, 24 nt, Human
aggaaaugucaaaaagggaaaaug

SEQ ID NO: 38757 - RNA, 24 nt, Human
uucuggaguugguuaacacacacu

SEQ ID NO: 38758 - RNA, 24 nt, Human
gagcuugggggcggggauguugaa

SEQ ID NO: 38759 - RNA, 24 nt, Human
ucccugcucaucccgaggagagag

SEQ ID NO: 38760 - RNA, 24 nt, Human
uuucagagccgugaucuuccuaac

SEQ ID NO: 38761 - RNA, 24 nt, Human
uucgagccgaaccgagauuuggaa

SEQ ID NO: 38762 - RNA, 24 nt, Human
uaagugcucuuccccaugguagcu

SEQ ID NO: 38763 - RNA, 24 nt, Human
uaaggcacuguccaaguaacacac

SEQ ID NO: 38764 - RNA, 24 nt, Human
aagaaacuuaaagccuggaaugau

SEQ ID NO: 38765 - RNA, 24 nt, Human
uagcagaaucuugaaaagcccaga

SEQ ID NO: 38766 - RNA, 18 nt, Human
caucguagagugaacaca

SEQ ID NO: 38767 - RNA, 23 nt, Human
uugaaaaauuugagaaggaggcu

SEQ ID NO: 38768 - RNA, 24 nt, Human
uggccugguucaagggauggaaag

SEQ ID NO: 38769 - RNA, 24 nt, Human
uccaccacuacuggccaucugauc

SEQ ID NO: 38770 - RNA, 22 nt, Human
uuccacgggaugggaaagucac

SEQ ID NO: 38771 - RNA, 24 nt, Human
aacgguuugaugauccagguuuga

SEQ ID NO: 38772 - RNA, 23 nt, Human
ugacaaagggacuccuaacccgc

SEQ ID NO: 38773 - RNA, 20 nt, Human
gcaaaggcgcguuugcccgc

SEQ ID NO: 38774 - RNA, 22 nt, Human
uaccaagugaaauuuagaagac

SEQ ID NO: 38775 - RNA, 24 nt, Human
auugauggucagccaggugccuuc

SEQ ID NO: 38776 - RNA, 24 nt, Human
ucccggguucacgcccuucuccug

SEQ ID NO: 38777 - RNA, 24 nt, Human
cacccgucuuggccguccaaagug

SEQ ID NO: 38778 - RNA, 22 nt, Human
uacugggugaauagcacuuucc

SEQ ID NO: 38779 - RNA, 24 nt, Human
ucaguuggaagacacccugaaauc

SEQ ID NO: 38780 - RNA, 24 nt, Human
agagguuggugagggagaucgcgc

SEQ ID NO: 38781 - RNA, 24 nt, Human
uccaccacuacuggccaucugauc

SEQ ID NO: 38782 - RNA, 24 nt, Human
aacgcuuuuauacuguauuuugua

SEQ ID NO: 38783 - RNA, 17 nt, Human
cagcucuuuccuagggg

SEQ ID NO: 38784 - RNA, 24 nt, Human
gcugcaguccauuggcaccgagaa

SEQ ID NO: 38785 - RNA, 24 nt, Human
aggcaccagguccaaugcaguggu

SEQ ID NO: 38786 - RNA, 24 nt, Human
ugauauugccugccgaugcugcca

SEQ ID NO: 38787 - RNA, 24 nt, Human
uagcuacauuuauuccuugucuua

SEQ ID NO: 38788 - RNA, 24 nt, Human
ucgccguguuagccaggacggccu

SEQ ID NO: 38789 - RNA, 24 nt, Human
uugaagguggcgucucaucugucu

SEQ ID NO: 38790 - RNA, 24 nt, Human
ccacggggaccucaccuuugggaa

SEQ ID NO: 38791 - RNA, 19 nt, Human
uaccaguuggcaugauguc

SEQ ID NO: 38792 - RNA, 19 nt, Human
ucccaaagcucagacuugc

SEQ ID NO: 38793 - RNA, 24 nt, Human
ugcuacagaaccaccaaaacccgc

SEQ ID NO: 38794 - RNA, 24 nt, Human
ccccccgcucguggccggccccgg

SEQ ID NO: 38795 - RNA, 19 nt, Human
uggcaugauguauuuuuau

SEQ ID NO: 38796 - RNA, 24 nt, Human
uaaauggugaucuucuaaaucugu

SEQ ID NO: 38797 - RNA, 24 nt, Human
uauuuguccuaccggguuuuuguu

SEQ ID NO: 38798 - RNA, 24 nt, Human
gucccggguccuggcgcuggcauc

SEQ ID NO: 38799 - RNA, 24 nt, Human
acagcccagaggcucgagaagcca

SEQ ID NO: 38800 - RNA, 24 nt, Human
uuuuccuccugguccuccaaaaug

SEQ ID NO: 38801 - RNA, 24 nt, Human
ugagugagggagguagaguuggaa

SEQ ID NO: 38802 - RNA, 24 nt, Human
uauuucauuaagauaaauguuuca

SEQ ID NO: 38803 - RNA, 24 nt, Human
uuggacaauauucugcuaucuaca

SEQ ID NO: 38804 - RNA, 24 nt, Human
ugcauuguuaucauuaaccagucu

SEQ ID NO: 38805 - RNA, 24 nt, Human
uaggacagcuuuauugaucucugg

SEQ ID NO: 38806 - RNA, 24 nt, Human
guuuucuucuucaacguaguggaa

SEQ ID NO: 38807 - RNA, 24 nt, Human
aaagagcuuuguuuuggaggauua

SEQ ID NO: 38808 - RNA, 24 nt, Human
ucucaucaacagaaucuggcucuc

SEQ ID NO: 38809 - RNA, 24 nt, Human
uaucuggaacaguuuacuccguua

SEQ ID NO: 38810 - RNA, 20 nt, Human
agacaggaugaauggugggg

SEQ ID NO: 38811 - RNA, 24 nt, Human
uguuugggggaucaccuggacgcc

SEQ ID NO: 38812 - RNA, 24 nt, Human
uccgcaucguauucccggaaucag

SEQ ID NO: 38813 - RNA, 24 nt, Human
cugcagcuccuuuugacaagaaau

SEQ ID NO: 38814 - RNA, 24 nt, Human
uagaauauaugcaugguaacugaa

SEQ ID NO: 38815 - RNA, 24 nt, Human
cgcacauauuaugcgaaucuauag

SEQ ID NO: 38816 - RNA, 24 nt, Human
gagcaagaaggagcugaaagagcu

SEQ ID NO: 38817 - RNA, 24 nt, Human
aggcggugcaggcccuccgggagc

SEQ ID NO: 38818 - RNA, 24 nt, Human
uggcccagccggcgccugccugag

SEQ ID NO: 38819 - RNA, 21 nt, Human
cgccgugacucuggucagcgc

SEQ ID NO: 38820 - RNA, 24 nt, Human
uccaggagcccguugggaggagac

SEQ ID NO: 38821 - RNA, 24 nt, Human
ucagucagacauuuuaauuugaac

SEQ ID NO: 38822 - RNA, 24 nt, Human
ccaguacggauaauaguuggccuc

SEQ ID NO: 38823 - RNA, 24 nt, Human
aagauuuuuauugcaaggcgcucu

SEQ ID NO: 38824 - RNA, 24 nt, Human
ugcuuuggcaaauuuccuaccguu

SEQ ID NO: 38825 - RNA, 24 nt, Human
acccggggucuggggaacacaccg

SEQ ID NO: 38826 - RNA, 24 nt, Human
uauucaguugguaagcuuccagga

SEQ ID NO: 38827 - RNA, 24 nt, Human
uuaaaaaaaaaaaaaaagucucgu

SEQ ID NO: 38828 - RNA, 24 nt, Human
uagaauguguaaggcucuugccag

SEQ ID NO: 38829 - RNA, 24 nt, Human
uggaagauaagcuuaaaggagaaa

SEQ ID NO: 38830 - RNA, 24 nt, Human
gucgaucuacugggcugauucugg

SEQ ID NO: 38831 - RNA, 24 nt, Human
augacacuaauaaacaaaaauaua

SEQ ID NO: 38832 - RNA, 24 nt, Human
uaauuuuuuguauuuuuaguagag

SEQ ID NO: 38833 - RNA, 24 nt, Human
gagaacuuaaaaaaauaaagacug

SEQ ID NO: 38834 - RNA, 24 nt, Human
caguagcaucaacaucacccugaa

SEQ ID NO: 38835 - RNA, 24 nt, Human
guugcaaaagggcauuuucuguca

SEQ ID NO: 38836 - RNA, 24 nt, Human
ucccuugauaaugcaguaagggac

SEQ ID NO: 38837 - RNA, 24 nt, Human
ucacugcacuccagccugggggaa

SEQ ID NO: 38838 - RNA, 24 nt, Human
aagaaaaugaaauaaagacauuuu

SEQ ID NO: 38839 - RNA, 24 nt, Human
auggggcugacuuuagugggacca

SEQ ID NO: 38840 - RNA, 24 nt, Human
uagagugucaaaacuucuccccag

SEQ ID NO: 38841 - RNA, 24 nt, Human
ucuuuauuuaaaauaccaaguuau

SEQ ID NO: 38842 - RNA, 24 nt, Human
cuucuguauuaccuguguuugccg

SEQ ID NO: 38843 - RNA, 24 nt, Human
ugagguuggacuuguugaaauaau

SEQ ID NO: 38844 - RNA, 24 nt, Human
uggauauggguaugggaaaaauug

SEQ ID NO: 38845 - RNA, 24 nt, Human
uccgaucucgaguggggauccagc

SEQ ID NO: 38846 - RNA, 24 nt, Human
cugcugaacaugcucaauaucucc

SEQ ID NO: 38847 - RNA, 24 nt, Human
ugaaaaccaauugaguguuaccaa

SEQ ID NO: 38848 - RNA, 24 nt, Human
uugauaugaacuuaggacauugac

SEQ ID NO: 38849 - RNA, 24 nt, Human
uuugaagucuccauucguuguaca

SEQ ID NO: 38850 - RNA, 24 nt, Human
aagccuuugguaggaaggaacagc

SEQ ID NO: 38851 - RNA, 24 nt, Human
uuucuggggcuugcgcgcaaaauc

SEQ ID NO: 38852 - RNA, 24 nt, Human
acucuuauuccuacucauuuagca

SEQ ID NO: 38853 - RNA, 24 nt, Human
agagaagcauagaagagacuuuuu

SEQ ID NO: 38854 - RNA, 24 nt, Human
acagaacuuauuaaaguggauaaa

SEQ ID NO: 38855 - RNA, 23 nt, Human
ugggaagcgccuuccccacagga

SEQ ID NO: 38856 - RNA, 24 nt, Human
uauuuugacuugccucuucaucug

SEQ ID NO: 38857 - RNA, 24 nt, Human
uugaacuuacccgcacuuuguucc

SEQ ID NO: 38858 - RNA, 24 nt, Human
uaugaggcccuagagcuccgggac

SEQ ID NO: 38859 - RNA, 23 nt, Human
uaccaggggaggaguggagcugc

SEQ ID NO: 38860 - RNA, 17 nt, Human
uaucaggaguucaugac

SEQ ID NO: 38861 - RNA, 24 nt, Human
ugacaugcucacgugacaugguua

SEQ ID NO: 38862 - RNA, 24 nt, Human
uuuuuauauugcaaacagugguug

SEQ ID NO: 38863 - RNA, 24 nt, Human
aaacaugggccuguuagaaaaaaa

SEQ ID NO: 38864 - RNA, 24 nt, Human
uucauugaagaguuguuuuuuuuu

SEQ ID NO: 38865 - RNA, 24 nt, Human
acaaguucuuccagacuaaagaaa

SEQ ID NO: 38866 - RNA, 24 nt, Human
ucagaaccucuuccucuacacuuu

SEQ ID NO: 38867 - RNA, 24 nt, Human
cagaggcccuggcacauuuuuccu

SEQ ID NO: 38868 - RNA, 24 nt, Human
agaggugggguuucaucauagugg

SEQ ID NO: 38869 - RNA, 24 nt, Human
ucucgcuguguugcccagccugga

SEQ ID NO: 38870 - RNA, 24 nt, Human
uuaguagagaugggguuucaccuu

SEQ ID NO: 38871 - RNA, 24 nt, Human
acugucucuuguuuuuggagguga

SEQ ID NO: 38872 - RNA, 22 nt, Human
ugggaauauuuucugucuucaa

SEQ ID NO: 38873 - RNA, 24 nt, Human
uaauaugggaccauaaagaugagu

SEQ ID NO: 38874 - RNA, 17 nt, Human
uauaagauuucaggaaa

SEQ ID NO: 38875 - RNA, 24 nt, Human
uugcacaggaaagacugcuggcug

SEQ ID NO: 38876 - RNA, 24 nt, Human
uggaaguggcucgcagauacugga

SEQ ID NO: 38877 - RNA, 22 nt, Human
uccgugcgcguugcugcggccg

SEQ ID NO: 38878 - RNA, 24 nt, Human
uugaucuugaagaaacugggcgug

SEQ ID NO: 38879 - RNA, 24 nt, Human
aggaaggagauauagugaagagga

SEQ ID NO: 38880 - RNA, 24 nt, Human
guagaguuuucuucaggcuuaaag

SEQ ID NO: 38881 - RNA, 24 nt, Human
uucgcaauaaccugacgacacucu

SEQ ID NO: 38882 - RNA, 20 nt, Human
gagacuguuggauggcagcu

SEQ ID NO: 38883 - RNA, 20 nt, Human
aauucagucacaaggaguug

SEQ ID NO: 38884 - RNA, 24 nt, Human
ugaguguagacaaguccuccagca

SEQ ID NO: 38885 - RNA, 24 nt, Human
ugaggcagacgccugaacagggac

SEQ ID NO: 38886 - RNA, 24 nt, Human
ugacgugauuggcagacaggguuc

SEQ ID NO: 38887 - RNA, 24 nt, Human
ccgccguggggaggcgugcggcuc

SEQ ID NO: 38888 - RNA, 24 nt, Human
uggcaagaagcugcgcugaaggcc

SEQ ID NO: 38889 - RNA, 24 nt, Human
cacgggacgaccgggcgcccacuu

SEQ ID NO: 38890 - RNA, 24 nt, Human
aguggcauucggggccggggucgc

SEQ ID NO: 38891 - RNA, 24 nt, Human
uauuaugguuucuaaaucaguuau

SEQ ID NO: 38892 - RNA, 24 nt, Human
agagucccuuaauuggguggcuaa

SEQ ID NO: 38893 - RNA, 24 nt, Human
uuaaaaauucuggugcaguggugg

SEQ ID NO: 38894 - RNA, 24 nt, Human
ugugugaaaaugugacaaacacac

SEQ ID NO: 38895 - RNA, 24 nt, Human
ugaaggaaagaggaagugcuagag

SEQ ID NO: 38896 - RNA, 24 nt, Human
uuccuugcagcaggaacccacuua

SEQ ID NO: 38897 - RNA, 24 nt, Human
uucaugauucaauacucuuaagau

SEQ ID NO: 38898 - RNA, 24 nt, Human
guguaugugguuaggaguaauagg

SEQ ID NO: 38899 - RNA, 22 nt, Human
uguccuggcuggcucauuuuuc

SEQ ID NO: 38900 - RNA, 23 nt, Human
gaauacucuagaauucuucauuc

SEQ ID NO: 38901 - RNA, 24 nt, Human
gauugcccacggcaauaaaaugag

SEQ ID NO: 38902 - RNA, 24 nt, Human
uucagugugugauuucaaaagaaa

SEQ ID NO: 38903 - RNA, 24 nt, Human
uacaaagcuuaaaauucugcauau

SEQ ID NO: 38904 - RNA, 24 nt, Human
ccgcaggcugaucccgccguccac

SEQ ID NO: 38905 - RNA, 24 nt, Human
gugauguugggcaacucugcgccg

SEQ ID NO: 38906 - RNA, 24 nt, Human
ucgcaaccuccucggcccugcgug

SEQ ID NO: 38907 - RNA, 24 nt, Human
aagaagccagcugaaucucaaaaa

SEQ ID NO: 38908 - RNA, 24 nt, Human
aggaaggagauauagugaagagga

SEQ ID NO: 38909 - RNA, 21 nt, Human
cauuggacaggacauccagcc

SEQ ID NO: 38910 - RNA, 24 nt, Human
cagcggcagagagccauccucuau

SEQ ID NO: 38911 - RNA, 17 nt, Human
ucucucucugugccucu

SEQ ID NO: 38912 - RNA, 24 nt, Human
ucucucacacauucucccccuugg

SEQ ID NO: 38913 - RNA, 24 nt, Human
guuuuuuuaaaaaaaagaaauuac

SEQ ID NO: 38914 - RNA, 24 nt, Human
uuccacgggauggaaagucaccgu

SEQ ID NO: 38915 - RNA, 23 nt, Human
uacacaguguuuauugugguuag

SEQ ID NO: 38916 - RNA, 24 nt, Human
uuuaaagacaaauuaugggacguu

SEQ ID NO: 38917 - RNA, 24 nt, Human
aagcugccugccuguugccaaagc

SEQ ID NO: 38918 - RNA, 24 nt, Human
aagcuucgucugccaaacagagac

SEQ ID NO: 38919 - RNA, 17 nt, Human
uccugugugcaaguccc

SEQ ID NO: 38920 - RNA, 24 nt, Human
cgagagggccuuaaaguacguccg

SEQ ID NO: 38921 - RNA, 19 nt, Human
uuugcuguguccaagucca

SEQ ID NO: 38922 - RNA, 24 nt, Human
uaugguuugucauugcaugcuuug

SEQ ID NO: 38923 - RNA, 24 nt, Human
auggagcucuacgagcgucuggag

SEQ ID NO: 38924 - RNA, 24 nt, Human
ugccaaagcucgacagcggcccag

SEQ ID NO: 38925 - RNA, 24 nt, Human
ugcuggucuguguucugguugcgc

SEQ ID NO: 38926 - RNA, 24 nt, Human
acagggcguaguaguuagcaacaa

SEQ ID NO: 38927 - RNA, 24 nt, Human
ucuauggguagaaugcaaagggaa

SEQ ID NO: 38928 - RNA, 24 nt, Human
cuuggaaauccaccugacagcucc

SEQ ID NO: 38929 - RNA, 24 nt, Human
ugacccugggcgguaccauggggc

SEQ ID NO: 38930 - RNA, 24 nt, Human
ugagagccaugugcaaagaggaca

SEQ ID NO: 38931 - RNA, 21 nt, Human
caaggcaaaggagauagugag

SEQ ID NO: 38932 - RNA, 24 nt, Human
cauccuggcgaggaguuucaauaa

SEQ ID NO: 38933 - RNA, 24 nt, Human
ugguaaguaauggagcugugaguu

SEQ ID NO: 38934 - RNA, 24 nt, Human
aaagugcugggauuacaggcauga

SEQ ID NO: 38935 - RNA, 24 nt, Human
acucauauugauuaaaacaguuaa

SEQ ID NO: 38936 - RNA, 24 nt, Human
ucacugcauccucugccucccggg

SEQ ID NO: 38937 - RNA, 24 nt, Human
uguggauggccccuccgggaaacu

SEQ ID NO: 38938 - RNA, 24 nt, Human
caugggccacauuggccuccaaga

SEQ ID NO: 38939 - RNA, 24 nt, Human
ucagugguggaccugaccugccgu

SEQ ID NO: 38940 - RNA, 21 nt, Human
cauccgggacuccacgguggc

SEQ ID NO: 38941 - RNA, 20 nt, Human
aagcagcuuuuucgacgugu

SEQ ID NO: 38942 - RNA, 24 nt, Human
uauugcuuaugucauuucuuaagc

SEQ ID NO: 38943 - RNA, 24 nt, Human
ccgagccaugcccgcacagaagag

SEQ ID NO: 38944 - RNA, 24 nt, Human
uaagggcaaguuggggagguccag

SEQ ID NO: 38945 - RNA, 24 nt, Human
uccaccacuacuggccaucugauc

SEQ ID NO: 38946 - RNA, 24 nt, Human
gagcgcagcauccgaccagguugu

SEQ ID NO: 38947 - RNA, 24 nt, Human
uucgcagagcugcuccgcgcgcua

SEQ ID NO: 38948 - RNA, 22 nt, Human
ucgcugccguucggugcgcagu

SEQ ID NO: 38949 - RNA, 24 nt, Human
aaagagacaggaccugaugaugag

SEQ ID NO: 38950 - RNA, 24 nt, Human
agggguacugguucugaacagaau

SEQ ID NO: 38951 - RNA, 24 nt, Human
caaugcaguccuggauggagccga

SEQ ID NO: 38952 - RNA, 24 nt, Human
uuggacggugcaaccgagcuggga

SEQ ID NO: 38953 - RNA, 24 nt, Human
uaugguguuugcgucauucauccg

SEQ ID NO: 38954 - RNA, 24 nt, Human
uggaagugggcagcaagaucuacg

SEQ ID NO: 38955 - RNA, 24 nt, Human
ugucaaggaggaguuuaaggccuu

SEQ ID NO: 38956 - RNA, 24 nt, Human
uccaaugauuggaaacucccuggc

SEQ ID NO: 38957 - RNA, 21 nt, Human
aucagcuuauuuuuuaaccca

SEQ ID NO: 38958 - RNA, 24 nt, Human
ugacacuuuuaaauucaauuuagc

SEQ ID NO: 38959 - RNA, 24 nt, Human
ugugucuccaguccucucuggagg

SEQ ID NO: 38960 - RNA, 24 nt, Human
cauggcacaucgggcuauuugaac

SEQ ID NO: 38961 - RNA, 24 nt, Human
agagguuguggugcuaguuucucu

SEQ ID NO: 38962 - RNA, 24 nt, Human
aacccuggcuaacugcaagcugaa

SEQ ID NO: 38963 - RNA, 24 nt, Human
uguggauggccccuccgggaaacu

SEQ ID NO: 38964 - RNA, 21 nt, Human
cugcccccucugcugaugccc

SEQ ID NO: 38965 - RNA, 24 nt, Human
ugagaacgggaagcuugucaucaa

SEQ ID NO: 38966 - RNA, 24 nt, Human
ugagaacgggaagcuugucaucaa

SEQ ID NO: 38967 - RNA, 24 nt, Human
ugucauaggcaucgacgaggggca

SEQ ID NO: 38968 - RNA, 24 nt, Human
guggugcggcccccaguguccgcu

SEQ ID NO: 38969 - RNA, 24 nt, Human
ccauugcugaaaaggucgaggccu

SEQ ID NO: 38970 - RNA, 21 nt, Human
ucuggagaaacugcugccuca

SEQ ID NO: 38971 - RNA, 24 nt, Human
uuuagggucgcggcuacaagugac

SEQ ID NO: 38972 - RNA, 17 nt, Human
cggcaaguacgugcccc

SEQ ID NO: 38973 - RNA, 24 nt, Human
agcuggugugaacauguccguuuc

SEQ ID NO: 38974 - RNA, 22 nt, Human
uucccguugccuuugcugaggg

SEQ ID NO: 38975 - RNA, 24 nt, Human
ucaguggaaaaccgauggggaacc

SEQ ID NO: 38976 - RNA, 23 nt, Human
ugccaugugaaggagccgucucc

SEQ ID NO: 38977 - RNA, 24 nt, Human
uggaacuguguuugggagccucau

SEQ ID NO: 38978 - RNA, 24 nt, Human
ccucacagcugcugagccguccgc

SEQ ID NO: 38979 - RNA, 24 nt, Human
uugaucuugaagaaacugggcgug

SEQ ID NO: 38980 - RNA, 24 nt, Human
aggaaggagauauagugaagagga

SEQ ID NO: 38981 - RNA, 24 nt, Human
guagaguuuucuucaggcuuaaag

SEQ ID NO: 38982 - RNA, 24 nt, Human
uggaagaggucaucacuccccgga

SEQ ID NO: 38983 - RNA, 24 nt, Human
caggagucaauccgauacgccccu

SEQ ID NO: 38984 - RNA, 24 nt, Human
aaggugccccaagaaacgagaggc

SEQ ID NO: 38985 - RNA, 24 nt, Human
ucagaacacuuaauuuacaaucaa

SEQ ID NO: 38986 - RNA, 24 nt, Human
ugagaugggaaagggcuccuucaa

SEQ ID NO: 38987 - RNA, 24 nt, Human
aggcggcgggcgcggggcgcgcuc

SEQ ID NO: 38988 - RNA, 21 nt, Human
gaggacgucaggaggcccugc

SEQ ID NO: 38989 - RNA, 24 nt, Human
caggacccgucgccaugggccgug

SEQ ID NO: 38990 - RNA, 24 nt, Human
uuggagguuuucugucucaacugg

SEQ ID NO: 38991 - RNA, 24 nt, Human
uuccuacuauaauaacgcugaauc

SEQ ID NO: 38992 - RNA, 24 nt, Human
uaauugaaauaaaauucuaggcug

SEQ ID NO: 38993 - RNA, 24 nt, Human
ugaguuggagaugaacuuuggcca

SEQ ID NO: 38994 - RNA, 24 nt, Human
uacacaggagcagacuggggcgug

SEQ ID NO: 38995 - RNA, 22 nt, Human
uaccccuauuuauauucccugu

SEQ ID NO: 38996 - RNA, 20 nt, Human
ccccaggaacagcacuacac

SEQ ID NO: 38997 - RNA, 24 nt, Human
uuuagacuugacgcaacgggaggu

SEQ ID NO: 38998 - RNA, 24 nt, Human
uaaaggcaucauucaaaaggauuu

SEQ ID NO: 38999 - RNA, 24 nt, Human
augcagcugcugcccgcgggcuug

SEQ ID NO: 39000 - RNA, 22 nt, Human
ucaagccagggcagcccucugu

SEQ ID NO: 39001 - RNA, 24 nt, Human
agcucgugugggccaccucaagcc

SEQ ID NO: 39002 - RNA, 24 nt, Human
uauaaacuccaugagggcagagac

SEQ ID NO: 39003 - RNA, 24 nt, Human
uaccuuggcaugcagcuccagucc

SEQ ID NO: 39004 - RNA, 24 nt, Human
uguauaaaaguaggugauucugua

SEQ ID NO: 39005 - RNA, 24 nt, Human
ugaaaaacagguauucaguauuau

SEQ ID NO: 39006 - RNA, 24 nt, Human
aaucugcauuguucuagcugcucc

SEQ ID NO: 39007 - RNA, 24 nt, Human
uguggcagugagagaauccuggca

SEQ ID NO: 39008 - RNA, 24 nt, Human
uagcagcauugguuuuccaaaaaa

SEQ ID NO: 39009 - RNA, 24 nt, Human
uuagcaagcgccauuuggaugucu

SEQ ID NO: 39010 - RNA, 24 nt, Human
uaacucagcacgcuuccacuucac

SEQ ID NO: 39011 - RNA, 24 nt, Human
cgugcagcugggagagcuagacua

SEQ ID NO: 39012 - RNA, 24 nt, Human
aaacagccaggacuugggucaaca

SEQ ID NO: 39013 - RNA, 24 nt, Human
caucaucgcggucgaaauagaagc

SEQ ID NO: 39014 - RNA, 24 nt, Human
ucuguuuggccgccagucuuuugu

SEQ ID NO: 39015 - RNA, 24 nt, Human
uuggaaagucgaguggcaaagcug

SEQ ID NO: 39016 - RNA, 24 nt, Human
caaucaaaucagcuucagcaaaau

SEQ ID NO: 39017 - RNA, 24 nt, Human
cguucuuggcauucuccaaaacag

SEQ ID NO: 39018 - RNA, 22 nt, Human
ugauggggagaugaacauugca

SEQ ID NO: 39019 - RNA, 24 nt, Human
uucgguguucugcgguggccaugg

SEQ ID NO: 39020 - RNA, 24 nt, Human
ugcugugacuucuccuuuucguga

SEQ ID NO: 39021 - RNA, 24 nt, Human
ucaacggcauccaucuuccuggua

SEQ ID NO: 39022 - RNA, 24 nt, Human
ugggguuggcuggcccugcuucug

SEQ ID NO: 39023 - RNA, 24 nt, Human
uucaucuguuaaauagugacggug

SEQ ID NO: 39024 - RNA, 24 nt, Human
uaagagaaguggggggaggugcca

SEQ ID NO: 39025 - RNA, 24 nt, Human
ucuaccagaaagaacagugcccug

SEQ ID NO: 39026 - RNA, 23 nt, Human
guuacagaggcucaccugguggu

SEQ ID NO: 39027 - RNA, 24 nt, Human
ugcccaggcuggggugcacgacuc

SEQ ID NO: 39028 - RNA, 20 nt, Human
aagaguuuguggggauuuug

SEQ ID NO: 39029 - RNA, 23 nt, Human
ccaggcuucuccgugcaggaaga

SEQ ID NO: 39030 - RNA, 24 nt, Human
gccacaauacaagucaggagaggg

SEQ ID NO: 39031 - RNA, 24 nt, Human
gaacugguccuuucacuuugagau

SEQ ID NO: 39032 - RNA, 24 nt, Human
uaucaagucagcacacaccuuuuc

SEQ ID NO: 39033 - RNA, 24 nt, Human
ucaaugagucgcuugugaauucuc

SEQ ID NO: 39034 - RNA, 24 nt, Human
caugagaauaauguuuuaaaacca

SEQ ID NO: 39035 - RNA, 24 nt, Human
uauaaaguuugggcacuuagagca

SEQ ID NO: 39036 - RNA, 24 nt, Human
uggguccagguccaugcucugaac

SEQ ID NO: 39037 - RNA, 24 nt, Human
uagacaauagcugaucauaauagg

SEQ ID NO: 39038 - RNA, 19 nt, Human
uaugccauuaugaaauuau

SEQ ID NO: 39039 - RNA, 24 nt, Human
caaggacuucuuugcagguaucug

SEQ ID NO: 39040 - RNA, 24 nt, Human
aaaguaaaaauuugagugguucuc

SEQ ID NO: 39041 - RNA, 24 nt, Human
gaguuuggauguguaacugaggca

SEQ ID NO: 39042 - RNA, 24 nt, Human
ugagggcagacugccaaguccugg

SEQ ID NO: 39043 - RNA, 24 nt, Human
ugggguaaugaaguauuucaguuu

SEQ ID NO: 39044 - RNA, 24 nt, Human
ugaaguauuucaguuuugugaaua

SEQ ID NO: 39045 - RNA, 24 nt, Human
uaucauggacauucaggucccgac

SEQ ID NO: 39046 - RNA, 17 nt, Human
uccccgggggcugccgg

SEQ ID NO: 39047 - RNA, 24 nt, Human
agaccagaccagcaacugggaagg

SEQ ID NO: 39048 - RNA, 24 nt, Human
aagacccuccccuuuccccugagg

SEQ ID NO: 39049 - RNA, 24 nt, Human
agguguuucucugcuucaggagug

SEQ ID NO: 39050 - RNA, 24 nt, Human
agcacggaaaucgaccugcccgug

SEQ ID NO: 39051 - RNA, 24 nt, Human
cucuuccuccuucccaaauaucug

SEQ ID NO: 39052 - RNA, 24 nt, Human
uauuuguuuucauuuucuuugccu

SEQ ID NO: 39053 - RNA, 24 nt, Human
aaguugguacgcugucuaauucuu

SEQ ID NO: 39054 - RNA, 24 nt, Human
auagcacuucugcuuuucaaauau

SEQ ID NO: 39055 - RNA, 24 nt, Human
ugccuuaacaagaagaugcccaca

SEQ ID NO: 39056 - RNA, 24 nt, Human
aaucccuucgaggccccagucccu

SEQ ID NO: 39057 - RNA, 24 nt, Human
ucccugaucucugcauugggaagg

SEQ ID NO: 39058 - RNA, 24 nt, Human
uacacuuuuaaaaauuaucccaca

SEQ ID NO: 39059 - RNA, 23 nt, Human
ccucaagcaaucgccugccucag

SEQ ID NO: 39060 - RNA, 24 nt, Human
uucaauuugggaaguuucuauuga

SEQ ID NO: 39061 - RNA, 24 nt, Human
uauagcuuacugcuuaacuaauuu

SEQ ID NO: 39062 - RNA, 24 nt, Human
uauuguuaacauuuuaguguauug

SEQ ID NO: 39063 - RNA, 24 nt, Human
ugagugauaaaggcugaguguuga

SEQ ID NO: 39064 - RNA, 24 nt, Human
uggcaaguaaaugcaguacuguuc

SEQ ID NO: 39065 - RNA, 24 nt, Human
aaaguuguguuccccaaugcuugg

SEQ ID NO: 39066 - RNA, 24 nt, Human
ugguggugggaggggacugaagcc

SEQ ID NO: 39067 - RNA, 24 nt, Human
uuccuaugugucucagcuuggggc

SEQ ID NO: 39068 - RNA, 24 nt, Human
ucuuugauuugcucuuugaggacc

SEQ ID NO: 39069 - RNA, 24 nt, Human
uugguccugagcccugcgaugcug

SEQ ID NO: 39070 - RNA, 24 nt, Human
uauuuuauugcaggaggugggggu

SEQ ID NO: 39071 - RNA, 24 nt, Human
uccgcuccaucauggaggagugcg

SEQ ID NO: 39072 - RNA, 24 nt, Human
ucccguggaagguucaggaagcga

SEQ ID NO: 39073 - RNA, 24 nt, Human
ggacaagaaacagagcugggagga

SEQ ID NO: 39074 - RNA, 24 nt, Human
uccccuuguccacugauggggggu

SEQ ID NO: 39075 - RNA, 24 nt, Human
uaagugcucauggcugcugugcuu

SEQ ID NO: 39076 - RNA, 24 nt, Human
gcgaagggcagggcgaucucaaac

SEQ ID NO: 39077 - RNA, 23 nt, Human
aggcaggucaucgggugcuggcc

SEQ ID NO: 39078 - RNA, 24 nt, Human
ucccugaacagagaagcccguggc

SEQ ID NO: 39079 - RNA, 24 nt, Human
cucugccucucccgcccccuuacc

SEQ ID NO: 39080 - RNA, 24 nt, Human
ucugcaauuugguauaaauguuag

SEQ ID NO: 39081 - RNA, 24 nt, Human
aacuguaucccguugaugcacuaa

SEQ ID NO: 39082 - RNA, 24 nt, Human
aaagcagcaauucuauguucauag

SEQ ID NO: 39083 - RNA, 24 nt, Human
uccauuuuuuuaaauucccccuuu

SEQ ID NO: 39084 - RNA, 24 nt, Human
uggcagaguuacaguucugugguu

SEQ ID NO: 39085 - RNA, 24 nt, Human
uggaucaccugaggucaggaguuc

SEQ ID NO: 39086 - RNA, 24 nt, Human
uaaauaaaauuuaauucugccuuu

SEQ ID NO: 39087 - RNA, 24 nt, Human
uagguaccaacaauuguuaaugac

SEQ ID NO: 39088 - RNA, 24 nt, Human
cacccgcgccaagccugacagcac

SEQ ID NO: 39089 - RNA, 24 nt, Human
ugcccuggggcgccuggcugaggc

SEQ ID NO: 39090 - RNA, 24 nt, Human
guaaaaccuguaugaaaguguagc

SEQ ID NO: 39091 - RNA, 24 nt, Human
ucaaaagaacuuauccaguguagc

SEQ ID NO: 39092 - RNA, 24 nt, Human
ccuggccaacauggugaaauccca

SEQ ID NO: 39093 - RNA, 24 nt, Human
acaaaaccaaauaaaagaagccau

SEQ ID NO: 39094 - RNA, 24 nt, Human
ugaggaaaacgacaagagugagca

SEQ ID NO: 39095 - RNA, 24 nt, Human
aggcauauuuacucuuugugagaa

SEQ ID NO: 39096 - RNA, 24 nt, Human
uaauacucucgaccccauucuucu

SEQ ID NO: 39097 - RNA, 24 nt, Human
uaaggaccugcucuaggaaacauu

SEQ ID NO: 39098 - RNA, 24 nt, Human
caucucaguccuauuuuugaguuu

SEQ ID NO: 39099 - RNA, 24 nt, Human
uauuaucauucagcagucucccuc

SEQ ID NO: 39100 - RNA, 24 nt, Human
ccucgaccuccugggcuccagcgu

SEQ ID NO: 39101 - RNA, 22 nt, Human
uggcaaggucucgcuuagucgc

SEQ ID NO: 39102 - RNA, 24 nt, Human
uauggcaagucacuuugacagaca

SEQ ID NO: 39103 - RNA, 24 nt, Human
ugagaauggcaaaauuagucgccu

SEQ ID NO: 39104 - RNA, 24 nt, Human
uacaccacucccaagaagaauaag

SEQ ID NO: 39105 - RNA, 24 nt, Human
aggaagcgagaaugcagaguuucc

SEQ ID NO: 39106 - RNA, 24 nt, Human
ugugguggcagcagcacaggggca

SEQ ID NO: 39107 - RNA, 24 nt, Human
auccuguucugcggcuuccuuggc

SEQ ID NO: 39108 - RNA, 24 nt, Human
uggcaucuccuauaucuaauucca

SEQ ID NO: 39109 - RNA, 24 nt, Human
uggcugagggaagcagugaugggg

SEQ ID NO: 39110 - RNA, 24 nt, Human
gagccgccgugccucagaggacug

SEQ ID NO: 39111 - RNA, 24 nt, Human
uucauuagcaacuaaugguugagg

SEQ ID NO: 39112 - RNA, 24 nt, Human
ucucacacuggcaggcgguggcuc

SEQ ID NO: 39113 - RNA, 24 nt, Human
ugggucuuugugcugaggcaggac

SEQ ID NO: 39114 - RNA, 24 nt, Human
uugcaugaaacauucuuaacguga

SEQ ID NO: 39115 - RNA, 24 nt, Human
aggcagguuaaguuccuugaugcc

SEQ ID NO: 39116 - RNA, 24 nt, Human
ugaccacagcuguaggauugccag

SEQ ID NO: 39117 - RNA, 24 nt, Human
ccucccagguucuagcgauucucc

SEQ ID NO: 39118 - RNA, 24 nt, Human
ucccugauaucuaccucaccccca

SEQ ID NO: 39119 - RNA, 24 nt, Human
ucaguccccauuaaggccagaauu

SEQ ID NO: 39120 - RNA, 24 nt, Human
uagcccgcagaagcccggucagcg

SEQ ID NO: 39121 - RNA, 24 nt, Human
aggcuuuuacaccacaagugcagu

SEQ ID NO: 39122 - RNA, 24 nt, Human
guggccuuauucugcggcuguggg

SEQ ID NO: 39123 - RNA, 18 nt, Human
uggcuggacccccccgug

SEQ ID NO: 39124 - RNA, 24 nt, Human
cuagcuugcuccgccuaucccugc

SEQ ID NO: 39125 - RNA, 24 nt, Human
caauucuauaucagaaaugaagga

SEQ ID NO: 39126 - RNA, 24 nt, Human
uggccugggcaaucuuggcccugu

SEQ ID NO: 39127 - RNA, 24 nt, Human
gugcauuguccuguuuucacuuuu

SEQ ID NO: 39128 - RNA, 24 nt, Human
cucugcccagguuaagggccacgg

SEQ ID NO: 39129 - RNA, 24 nt, Human
uauggugcggaggcccuggagagg

SEQ ID NO: 39130 - RNA, 24 nt, Human
uaagacuaggggcuugguauauau

SEQ ID NO: 39131 - RNA, 24 nt, Human
cuuugggcagcggcuggaugaaag

SEQ ID NO: 39132 - RNA, 24 nt, Human
uaagacuaggggcuugguauauau

SEQ ID NO: 39133 - RNA, 24 nt, Human
uaagacuaggggcuugguauauau

SEQ ID NO: 39134 - RNA, 24 nt, Human
ucacuguaagcauccaguaggcag

SEQ ID NO: 39135 - RNA, 24 nt, Human
uuaaugccgauauacucuagauga

SEQ ID NO: 39136 - RNA, 24 nt, Human
cauuucaucuggguauuuucaggc

SEQ ID NO: 39137 - RNA, 24 nt, Human
cucaccuugguccggcuccugcac

SEQ ID NO: 39138 - RNA, 20 nt, Human
uaggaucuguaccguccagu

SEQ ID NO: 39139 - RNA, 22 nt, Human
uugguuggagcaguaguuggca

SEQ ID NO: 39140 - RNA, 19 nt, Human
uccauuguugugccuuuga

SEQ ID NO: 39141 - RNA, 24 nt, Human
gucagugucaccgcccaaaaaccu

SEQ ID NO: 39142 - RNA, 24 nt, Human
ugggucugagguuuucucuacuga

SEQ ID NO: 39143 - RNA, 24 nt, Human
ugaggcuucuguacuucucccuuu

SEQ ID NO: 39144 - RNA, 24 nt, Human
caugggccugcuggccauguacac

SEQ ID NO: 39145 - RNA, 24 nt, Human
guagugcgauccaacuaugaagca

SEQ ID NO: 39146 - RNA, 24 nt, Human
ucugcaggauggccgggcauaugg

SEQ ID NO: 39147 - RNA, 24 nt, Human
gagcugcuaauucgcaaucauuug

SEQ ID NO: 39148 - RNA, 24 nt, Human
uugaucuugaagaaacugggcgug

SEQ ID NO: 39149 - RNA, 23 nt, Human
uccgugcgcguugcugcggccgu

SEQ ID NO: 39150 - RNA, 24 nt, Human
aggaaggagauauagugaagagga

SEQ ID NO: 39151 - RNA, 24 nt, Human
guagaguuuucuucaggcuuaaag

SEQ ID NO: 39152 - RNA, 22 nt, Human
ugccaugcacuccagccugagc

SEQ ID NO: 39153 - RNA, 24 nt, Human
uaaaggagauggaagugaauucaa

SEQ ID NO: 39154 - RNA, 24 nt, Human
uucuuggugagaagggccggauga

SEQ ID NO: 39155 - RNA, 24 nt, Human
uguaguucagaugagguuuggcuu

SEQ ID NO: 39156 - RNA, 24 nt, Human
gagaauucugcucuuugauaacaa

SEQ ID NO: 39157 - RNA, 24 nt, Human
uaagggccaaauuuuguaaaauuu

SEQ ID NO: 39158 - RNA, 24 nt, Human
uauaaagcccaaguagagggugua

SEQ ID NO: 39159 - RNA, 24 nt, Human
uccagagcuuuguuugaguucuca

SEQ ID NO: 39160 - RNA, 24 nt, Human
uaaguauagaaucuuaaugguugc

SEQ ID NO: 39161 - RNA, 24 nt, Human
uaaguaguaucauuggagcccuua

SEQ ID NO: 39162 - RNA, 24 nt, Human
uugguugaauacauaguuaagaug

SEQ ID NO: 39163 - RNA, 24 nt, Human
acagagcaagacucugucucaaaa

SEQ ID NO: 39164 - RNA, 24 nt, Human
uggcucugcccagguggggguggg

SEQ ID NO: 39165 - RNA, 23 nt, Human
ccgccgcgcccccgccgccgccc

SEQ ID NO: 39166 - RNA, 24 nt, Human
aacaucuugaccacaucacuuuuu

SEQ ID NO: 39167 - RNA, 24 nt, Human
uuuaagaauuuguuuuauuaaauu

SEQ ID NO: 39168 - RNA, 21 nt, Human
uugcagguggguaguggguca

SEQ ID NO: 39169 - RNA, 24 nt, Human
aagcagcaccaauggggaugaccc

SEQ ID NO: 39170 - RNA, 24 nt, Human
agacaggcuggcacagccccaggc

SEQ ID NO: 39171 - RNA, 24 nt, Human
uacaaugucauuguuugggacccg

SEQ ID NO: 39172 - RNA, 24 nt, Human
caucugcugccuacauuccugcuc

SEQ ID NO: 39173 - RNA, 24 nt, Human
ugaggagauguugcugaagcaucu

SEQ ID NO: 39174 - RNA, 24 nt, Human
ucaguuggaagacacccugaaauc

SEQ ID NO: 39175 - RNA, 24 nt, Human
uuuuuuggguuuacugggugaaua

SEQ ID NO: 39176 - RNA, 24 nt, Human
uaaugcagcuacaggagcaaauua

SEQ ID NO: 39177 - RNA, 24 nt, Human
uggguccaaagacgauuccaaggu

SEQ ID NO: 39178 - RNA, 24 nt, Human
uuuacuuuuauuacaauaaauaau

SEQ ID NO: 39179 - RNA, 24 nt, Human
ugauucaaugggcgcuugagugcc

SEQ ID NO: 39180 - RNA, 21 nt, Human
cgggaugggccggcgccgggc

SEQ ID NO: 39181 - RNA, 24 nt, Human
ugccuuaugggucagugguauggg

SEQ ID NO: 39182 - RNA, 24 nt, Human
uuuaagcaucuuuuacagucagca

SEQ ID NO: 39183 - RNA, 24 nt, Human
ucucgugauguuagcagcuguugc

SEQ ID NO: 39184 - RNA, 24 nt, Human
accauguuggucaggcuggucucg

SEQ ID NO: 39185 - RNA, 24 nt, Human
ucccugggagaaaguccuucccuc

SEQ ID NO: 39186 - RNA, 21 nt, Human
ucacaugagguccuuugcucc

SEQ ID NO: 39187 - RNA, 24 nt, Human
aaugaccccaagaccuuugagggc

SEQ ID NO: 39188 - RNA, 24 nt, Human
ugugaacgggaagaaggugcugca

SEQ ID NO: 39189 - RNA, 24 nt, Human
cuuccaaucugaugggcauguuug

SEQ ID NO: 39190 - RNA, 22 nt, Human
guggagggcagcuuugucuaca

SEQ ID NO: 39191 - RNA, 24 nt, Human
gagcauucaagucccuccgauuca

SEQ ID NO: 39192 - RNA, 24 nt, Human
uuuuacugcugauggugaucaagu

SEQ ID NO: 39193 - RNA, 21 nt, Human
uccgagagccuagucccugcu

SEQ ID NO: 39194 - RNA, 24 nt, Human
ggagaccuugguacaacgcaacgg

SEQ ID NO: 39195 - RNA, 23 nt, Human
uaccaauagauccaaucgaucag

SEQ ID NO: 39196 - RNA, 24 nt, Human
ggagugcucuagaggcccccccuc

SEQ ID NO: 39197 - RNA, 18 nt, Human
ucccugagaaggggagga

SEQ ID NO: 39198 - RNA, 21 nt, Human
ugugaaaauaaaccaacauga

SEQ ID NO: 39199 - RNA, 24 nt, Human
caggaguucaaggcuaugaucaug

SEQ ID NO: 39200 - RNA, 24 nt, Human
uuaaaacauuuugguacugaucaa

SEQ ID NO: 39201 - RNA, 24 nt, Human
uuaaaacauuuugguacugaucaa

SEQ ID NO: 39202 - RNA, 24 nt, Human
ucucacacuggcaggcgguggcuc

SEQ ID NO: 39203 - RNA, 24 nt, Human
ugggucuuugugcugaggcaggac

SEQ ID NO: 39204 - RNA, 24 nt, Human
ccagcucguggagcagguccaccg

SEQ ID NO: 39205 - RNA, 24 nt, Human
uuccccuuaaaguaguugucaugc

SEQ ID NO: 39206 - RNA, 21 nt, Human
ugugaaaauaaaccaacauga

SEQ ID NO: 39207 - RNA, 24 nt, Human
cggaagccggacgggcagggaugg

SEQ ID NO: 39208 - RNA, 24 nt, Human
uaacguguguuuuugccaaaaaaa

SEQ ID NO: 39209 - RNA, 24 nt, Human
uaccaucuucuucagaacugcauc

SEQ ID NO: 39210 - RNA, 24 nt, Human
uaacauacuuuuccagcguaacuc

SEQ ID NO: 39211 - RNA, 24 nt, Human
ucuacagagauccugaagcagauu

SEQ ID NO: 39212 - RNA, 24 nt, Human
uguggaacguguucggucccgagu

SEQ ID NO: 39213 - RNA, 24 nt, Human
uugguucaagcgauggcaagucac

SEQ ID NO: 39214 - RNA, 24 nt, Human
ucugaucuauaaaugcgguggcau

SEQ ID NO: 39215 - RNA, 23 nt, Human
uuugcaaaucugcggaaagugcu

SEQ ID NO: 39216 - RNA, 24 nt, Human
uaggguaugacccccaucauuuac

SEQ ID NO: 39217 - RNA, 24 nt, Human
aggcauguaccacggacccccucc

SEQ ID NO: 39218 - RNA, 17 nt, Human
agggagcccuggggagc

SEQ ID NO: 39219 - RNA, 24 nt, Human
ucccagagccaguguuuauuagca

SEQ ID NO: 39220 - RNA, 24 nt, Human
uuacuggauuuaagaaauuucccu

SEQ ID NO: 39221 - RNA, 24 nt, Human
cuguaugaaugaaugacaucaugu

SEQ ID NO: 39222 - RNA, 24 nt, Human
gaucucucggucccuuccuuaacc

SEQ ID NO: 39223 - RNA, 24 nt, Human
gcgcuuuguggucauucuaccuga

SEQ ID NO: 39224 - RNA, 24 nt, Human
uagcagaagcauagcaagugcucu

SEQ ID NO: 39225 - RNA, 24 nt, Human
ucagaaacgucuaaauacaaugca

SEQ ID NO: 39226 - RNA, 24 nt, Human
uaucaguagauccuuccacugggu

SEQ ID NO: 39227 - RNA, 24 nt, Human
aaucugcauuguucuagcugcucc

SEQ ID NO: 39228 - RNA, 24 nt, Human
uagaaacugaaaauuuacaaacua

SEQ ID NO: 39229 - RNA, 21 nt, Human
uccugggucccgggagggcuc

SEQ ID NO: 39230 - RNA, 24 nt, Human
ugggggcuguggcaagggccccuu

SEQ ID NO: 39231 - RNA, 24 nt, Human
uacauuuacuguacaaagaacggu

SEQ ID NO: 39232 - RNA, 24 nt, Human
uggggccaggacagggaagcugga

SEQ ID NO: 39233 - RNA, 24 nt, Human
uugcagucggggugauaugacaca

SEQ ID NO: 39234 - RNA, 24 nt, Human
uagcugacagcccauacuucaccu

SEQ ID NO: 39235 - RNA, 24 nt, Human
aucacauuaacauaauccgcgagu

SEQ ID NO: 39236 - RNA, 24 nt, Human
acccugguuaauaacaaguuuuac

SEQ ID NO: 39237 - RNA, 24 nt, Human
cuuuccuuuccucgacuuuuuggu

SEQ ID NO: 39238 - RNA, 24 nt, Human
guagugcaacaggguguuuugaua

SEQ ID NO: 39239 - RNA, 24 nt, Human
ucacugagcuaaugaucuaauccu

SEQ ID NO: 39240 - RNA, 22 nt, Human
ucguagccuguuacauuguuac

SEQ ID NO: 39241 - RNA, 24 nt, Human
ugaccggacaaucaugaaggcucu

SEQ ID NO: 39242 - RNA, 23 nt, Human
agcuggguguaguggugugugcc

SEQ ID NO: 39243 - RNA, 24 nt, Human
uaccugggugacagagcaagacuc

SEQ ID NO: 39244 - RNA, 24 nt, Human
gagcacgugucaucuucccugcgg

SEQ ID NO: 39245 - RNA, 23 nt, Human
uccagcagauuacucgggauuuc

SEQ ID NO: 39246 - RNA, 24 nt, Human
uugcgggagauugcugaagaguau

SEQ ID NO: 39247 - RNA, 24 nt, Human
cgagaggcacagaaggagcuggag

SEQ ID NO: 39248 - RNA, 24 nt, Human
ugccccgacguugcccccugccug

SEQ ID NO: 39249 - RNA, 18 nt, Human
gcucuuguuuugucuuga

SEQ ID NO: 39250 - RNA, 23 nt, Human
uucaagggauggaaagucaccgu

SEQ ID NO: 39251 - RNA, 21 nt, Human
aaguaugccugggucuuggau

SEQ ID NO: 39252 - RNA, 21 nt, Human
uggccgggaagugcucgacgu

SEQ ID NO: 39253 - RNA, 24 nt, Human
cguccggggcgaguggcacggggg

SEQ ID NO: 39254 - RNA, 24 nt, Human
gacacguagauucgggcaagucca

SEQ ID NO: 39255 - RNA, 24 nt, Human
uuccccaauguacauucuuggcag

SEQ ID NO: 39256 - RNA, 18 nt, Human
uaaugugauuccuccagu

SEQ ID NO: 39257 - RNA, 24 nt, Human
uaugugagagauaggaaucuaguu

SEQ ID NO: 39258 - RNA, 24 nt, Human
uacuaguuagaagcuuauuaucuu

SEQ ID NO: 39259 - RNA, 24 nt, Human
uuuuaaauguugucuuaccaauua

SEQ ID NO: 39260 - RNA, 24 nt, Human
uacgguauauuucaagagauucua

SEQ ID NO: 39261 - RNA, 24 nt, Human
uuggaguaguuucaaauacaagau

SEQ ID NO: 39262 - RNA, 24 nt, Human
auggauuguugcuugauaguguau

SEQ ID NO: 39263 - RNA, 24 nt, Human
cagcagaaagaugccaggcaaugg

SEQ ID NO: 39264 - RNA, 22 nt, Human
ucuguuggaggagcgccaaaag

SEQ ID NO: 39265 - RNA, 24 nt, Human
aaagaucuucucuccaaaccaguu

SEQ ID NO: 39266 - RNA, 24 nt, Human
uagccaugcccauucccgccccca

SEQ ID NO: 39267 - RNA, 24 nt, Human
uagcuccucuuguccacucugcuu

SEQ ID NO: 39268 - RNA, 24 nt, Human
aggugccauugugggaaugauagu

SEQ ID NO: 39269 - RNA, 24 nt, Human
gaguagccuggcuguaggugacac

SEQ ID NO: 39270 - RNA, 24 nt, Human
cauguaaccucggggucugaggcc

SEQ ID NO: 39271 - RNA, 24 nt, Human
ugagugaaaugaguuauggaucua

SEQ ID NO: 39272 - RNA, 22 nt, Human
cacugcuggaggccuucggacc

SEQ ID NO: 39273 - RNA, 24 nt, Human
uauauagauguauauauauacaca

SEQ ID NO: 39274 - RNA, 24 nt, Human
uacacagauaauuagagauauaug

SEQ ID NO: 39275 - RNA, 24 nt, Human
ucuaauuuagccaaguaauugcug

SEQ ID NO: 39276 - RNA, 24 nt, Human
aaucccacauuuuuggauuauguc

SEQ ID NO: 39277 - RNA, 24 nt, Human
ugauguggacuucucuuuucuugg

SEQ ID NO: 39278 - RNA, 24 nt, Human
ugaauugguauuaauuuaguaacg

SEQ ID NO: 39279 - RNA, 23 nt, Human
uacccaacagaguugugcuauga

SEQ ID NO: 39280 - RNA, 24 nt, Human
uauuucagccugaaaaugaaaucc

SEQ ID NO: 39281 - RNA, 24 nt, Human
aucacaauauggucugguccaauc

SEQ ID NO: 39282 - RNA, 24 nt, Human
uucaagauuggaucagagcucauc

SEQ ID NO: 39283 - RNA, 24 nt, Human
uugaucuugaagaaacugggcgug

SEQ ID NO: 39284 - RNA, 24 nt, Human
guagaguuuucuucaggcuuaaag

SEQ ID NO: 39285 - RNA, 24 nt, Human
uccacuggcgaaagaugccuuucu

SEQ ID NO: 39286 - RNA, 24 nt, Human
uaguucagauugaucuuaggucaa

SEQ ID NO: 39287 - RNA, 24 nt, Human
uagagugguggcucccagaauccc

SEQ ID NO: 39288 - RNA, 23 nt, Human
ucgaccccaaaagccaagucugu

SEQ ID NO: 39289 - RNA, 24 nt, Human
ugggggcaggguggggucucaagc

SEQ ID NO: 39290 - RNA, 24 nt, Human
aagccagcacuauccuuggggaca

SEQ ID NO: 39291 - RNA, 20 nt, Human
uaaggcgaggcggaauuaaa

SEQ ID NO: 39292 - RNA, 24 nt, Human
aguuuggauuaaauuuacacugug

SEQ ID NO: 39293 - RNA, 21 nt, Human
ucugacaguucugcgacaagc

SEQ ID NO: 39294 - RNA, 24 nt, Human
gcugaacccccugcucaccgccag

SEQ ID NO: 39295 - RNA, 20 nt, Human
ugaugaggggguggagcugg

SEQ ID NO: 39296 - RNA, 21 nt, Human
ugacaccauggggagcugcug

SEQ ID NO: 39297 - RNA, 20 nt, Human
cuugcucuuaacuuuucugu

SEQ ID NO: 39298 - RNA, 24 nt, Human
uagaaggaccggcgauuaauggag

SEQ ID NO: 39299 - RNA, 24 nt, Human
uaagugagaacaugcgguauuugg

SEQ ID NO: 39300 - RNA, 24 nt, Human
uauuuugcuaaggauaauggcuuc

SEQ ID NO: 39301 - RNA, 24 nt, Human
uauugugaaacaucagaggguaca

SEQ ID NO: 39302 - RNA, 24 nt, Human
uagaaugugacgcuuuuaauauag

SEQ ID NO: 39303 - RNA, 24 nt, Human
ugagagucugacaugcauaucaua

SEQ ID NO: 39304 - RNA, 24 nt, Human
aagggacccagcugggucugggcc

SEQ ID NO: 39305 - RNA, 24 nt, Human
uacaccaucccaagaagaauaagc

SEQ ID NO: 39306 - RNA, 24 nt, Human
gucaaggucauuggacagcugaac

SEQ ID NO: 39307 - RNA, 24 nt, Human
aacugggcauauagggagauccug

SEQ ID NO: 39308 - RNA, 24 nt, Human
gucaugcuguaaucccaucacuuu

SEQ ID NO: 39309 - RNA, 24 nt, Human
ugaaauggguuaugucuuaauuuu

SEQ ID NO: 39310 - RNA, 24 nt, Human
aggugguuuuuauucacagaaagu

SEQ ID NO: 39311 - RNA, 24 nt, Human
uugcucaacagguuuauauaaagc

SEQ ID NO: 39312 - RNA, 24 nt, Human
ccaggaaauacaagggguccaagg

SEQ ID NO: 39313 - RNA, 24 nt, Human
uugagguagagguuggggguuuau

SEQ ID NO: 39314 - RNA, 24 nt, Human
cugugccugugggucucuagaacc

SEQ ID NO: 39315 - RNA, 24 nt, Human
agugucuauuuauucuuggguggc

SEQ ID NO: 39316 - RNA, 24 nt, Human
uaucugggagcacuucgauaagga

SEQ ID NO: 39317 - RNA, 24 nt, Human
cgauauagugcccccagccaguac

SEQ ID NO: 39318 - RNA, 23 nt, Human
uucaagggauggcaagucaccgu

SEQ ID NO: 39319 - RNA, 24 nt, Human
ccagaacggcacgcuguaugugac

SEQ ID NO: 39320 - RNA, 24 nt, Human
uguccuguggccaggcggaaagca

SEQ ID NO: 39321 - RNA, 24 nt, Human
aucuuuguacugucaacuuuuugg

SEQ ID NO: 39322 - RNA, 24 nt, Human
ugccaugguggugguucucucgag

SEQ ID NO: 39323 - RNA, 24 nt, Human
cauuggguccagcaaggaccucua

SEQ ID NO: 39324 - RNA, 19 nt, Human
cugcagcggugggcagacg

SEQ ID NO: 39325 - RNA, 24 nt, Human
uucuuauuuauuuauuuauuuuug

SEQ ID NO: 39326 - RNA, 21 nt, Human
ugagcgcgacgaaaacauagu

SEQ ID NO: 39327 - RNA, 24 nt, Human
ggggaauagggcagugggcagaaa

SEQ ID NO: 39328 - RNA, 24 nt, Human
uuuguuuaauaacuuaugaaaagg

SEQ ID NO: 39329 - RNA, 24 nt, Human
uggaaaaacacuuguacaaugaaa

SEQ ID NO: 39330 - RNA, 24 nt, Human
ucacaggcuagccuuucugcacug

SEQ ID NO: 39331 - RNA, 24 nt, Human
uuccuccguuaauaaggauccuug

SEQ ID NO: 39332 - RNA, 21 nt, Human
ugauuuguggacguuuuccuu

SEQ ID NO: 39333 - RNA, 24 nt, Human
aggcagacagcgaguggcgacgau

SEQ ID NO: 39334 - RNA, 24 nt, Human
uuccgugguagaucaaacgcgagg

SEQ ID NO: 39335 - RNA, 24 nt, Human
aagcauuucggggcguuggaggcc

SEQ ID NO: 39336 - RNA, 24 nt, Human
agguuccagcacaaaggagucugu

SEQ ID NO: 39337 - RNA, 19 nt, Human
ccgcugagggaggcacagg

SEQ ID NO: 39338 - RNA, 24 nt, Human
ugagguaggcuguuuccuucuuuc

SEQ ID NO: 39339 - RNA, 24 nt, Human
uuuaaagggguuaaaaccuuuugg

SEQ ID NO: 39340 - RNA, 22 nt, Human
ucagggagacaagggauggcag

SEQ ID NO: 39341 - RNA, 24 nt, Human
ugccugggcugaggucuugggggc

SEQ ID NO: 39342 - RNA, 24 nt, Human
aggucauucauuucacaaacauuu

SEQ ID NO: 39343 - RNA, 24 nt, Human
gugcuuagagcuuuucgguggaag

SEQ ID NO: 39344 - RNA, 24 nt, Human
uauuagggauaauauucauuuagc

SEQ ID NO: 39345 - RNA, 24 nt, Human
ugguauguuguaucuuuguucucg

SEQ ID NO: 39346 - RNA, 24 nt, Human
uagugcuauaaauuucccucuaca

SEQ ID NO: 39347 - RNA, 23 nt, Human
ucucaggggcccuggcccugacc

SEQ ID NO: 39348 - RNA, 24 nt, Human
ccgaagcucugucucccacuccgu

SEQ ID NO: 39349 - RNA, 24 nt, Human
uguagauaggcaaaaccaagaacu

SEQ ID NO: 39350 - RNA, 24 nt, Human
uaaccacuuaaauagaacaguguc

SEQ ID NO: 39351 - RNA, 24 nt, Human
uagggcauuuuaaugugcaaaaaa

SEQ ID NO: 39352 - RNA, 24 nt, Human
uauuagggauaauauucauuuagc

SEQ ID NO: 39353 - RNA, 24 nt, Human
uaaugggucucaaaauucugugac

SEQ ID NO: 39354 - RNA, 24 nt, Human
uggaagacagcuacgggcagcagu

SEQ ID NO: 39355 - RNA, 18 nt, Human
guccagguguagaaugcc

SEQ ID NO: 39356 - RNA, 24 nt, Human
ucacugcaaccucugccuccuggg

SEQ ID NO: 39357 - RNA, 24 nt, Human
uucaucacucaggauggcuuguga

SEQ ID NO: 39358 - RNA, 24 nt, Human
caaaugacuuaguaaucuaauaug

SEQ ID NO: 39359 - RNA, 24 nt, Human
uuccaguaagaaguucaagaguac

SEQ ID NO: 39360 - RNA, 22 nt, Human
uucaaguaagagcaauaguaaa

SEQ ID NO: 39361 - RNA, 24 nt, Human
uugaagaauucacuggucguuuug

SEQ ID NO: 39362 - RNA, 24 nt, Human
uggcuaaugagcaggcguuucuuc

SEQ ID NO: 39363 - RNA, 24 nt, Human
uccucaguucuuuccauccuccuu

SEQ ID NO: 39364 - RNA, 22 nt, Human
cagcacagagggagggcaugga

SEQ ID NO: 39365 - RNA, 24 nt, Human
uuguccugugcuggggcugacagg

SEQ ID NO: 39366 - RNA, 24 nt, Human
uccgcagccaauuaagccgacuga

SEQ ID NO: 39367 - RNA, 24 nt, Human
uaaaaaguuguggcaaagauggcu

SEQ ID NO: 39368 - RNA, 24 nt, Human
ucagaagcuauaguccagaaauca

SEQ ID NO: 39369 - RNA, 24 nt, Human
cauaucaucgcggaauucauucgg

SEQ ID NO: 39370 - RNA, 24 nt, Human
uuagaaaaaguguuuuuccucauc

SEQ ID NO: 39371 - RNA, 24 nt, Human
ccuggcaaauauugugaaaccccg

SEQ ID NO: 39372 - RNA, 20 nt, Human
ugaggcaggagaaucaccug

SEQ ID NO: 39373 - RNA, 24 nt, Human
ggagcacacuuguaaucccaguac

SEQ ID NO: 39374 - RNA, 24 nt, Human
uggaauagcgucuuccauguggga

SEQ ID NO: 39375 - RNA, 24 nt, Human
cacaguguuauuuguuguaccuga

SEQ ID NO: 39376 - RNA, 24 nt, Human
uaaagaaagaaaauuacagccugc

SEQ ID NO: 39377 - RNA, 24 nt, Human
ugagaucauuauuuucaaaacauu

SEQ ID NO: 39378 - RNA, 24 nt, Human
agguaauuaggugaugaggguaga

SEQ ID NO: 39379 - RNA, 24 nt, Human
uauguuaauauuuugaacuaacau

SEQ ID NO: 39380 - RNA, 24 nt, Human
cacuggucuugguugcccccacau

SEQ ID NO: 39381 - RNA, 24 nt, Human
ucaauguucccuuuugugaagaug

SEQ ID NO: 39382 - RNA, 24 nt, Human
uugugcuaaagggaaaggaggauc

SEQ ID NO: 39383 - RNA, 24 nt, Human
ucagaguacauauuuggggugcgg

SEQ ID NO: 39384 - RNA, 24 nt, Human
ucccaguaucgaggggcaaacuua

SEQ ID NO: 39385 - RNA, 24 nt, Human
caccgcauaacaccccugugggca

SEQ ID NO: 39386 - RNA, 24 nt, Human
uauaaauuccggacauggcggcag

SEQ ID NO: 39387 - RNA, 24 nt, Human
cgacagcuaccgcucaccucuugc

SEQ ID NO: 39388 - RNA, 24 nt, Human
uaugaggcccuagagcuccgggac

SEQ ID NO: 39389 - RNA, 24 nt, Human
ccagcggugguuccggccuucuga

SEQ ID NO: 39390 - RNA, 24 nt, Human
gccugcugacacuucccugcaacc

SEQ ID NO: 39391 - RNA, 24 nt, Human
aagccauuuggauuggguuuagaa

SEQ ID NO: 39392 - RNA, 23 nt, Human
uguggaauuaguagauucgauga

SEQ ID NO: 39393 - RNA, 24 nt, Human
uauuaaguguccauauuucucaag

SEQ ID NO: 39394 - RNA, 24 nt, Human
gggaauucuuuauuuaguaauguc

SEQ ID NO: 39395 - RNA, 24 nt, Human
ucugcaggugccuccaaaugcugg

SEQ ID NO: 39396 - RNA, 24 nt, Human
aggaauucgagaccagccuuggcc

SEQ ID NO: 39397 - RNA, 24 nt, Human
uagcccccugcagccuugaccucc

SEQ ID NO: 39398 - RNA, 24 nt, Human
uauggcaagucacuuugacagaca

SEQ ID NO: 39399 - RNA, 24 nt, Human
uacaccacucccaagaagaauaag

SEQ ID NO: 39400 - RNA, 24 nt, Human
uacgcgcgagggagagaagcgccc

SEQ ID NO: 39401 - RNA, 24 nt, Human
ugagaauggcaaaauuagucgccu

SEQ ID NO: 39402 - RNA, 24 nt, Human
uacaccacucccaagaagaauaag

SEQ ID NO: 39403 - RNA, 24 nt, Human
ggacagguguacagacauguucuu

SEQ ID NO: 39404 - RNA, 24 nt, Human
uuuagaauaugaaaauaagagccc

SEQ ID NO: 39405 - RNA, 24 nt, Human
aggccauuaacuguuugaugcgag

SEQ ID NO: 39406 - RNA, 24 nt, Human
uaaguggaaugucucccggcccuc

SEQ ID NO: 39407 - RNA, 24 nt, Human
uuuggcacauaucuaacucuagua

SEQ ID NO: 39408 - RNA, 24 nt, Human
ucucuugugggcaggggugggggu

SEQ ID NO: 39409 - RNA, 24 nt, Human
guggcccuucuuguugccggcacu

SEQ ID NO: 39410 - RNA, 24 nt, Human
uaaauagcaucccucuccccacga

SEQ ID NO: 39411 - RNA, 24 nt, Human
agguggucggugagggucuggagc

SEQ ID NO: 39412 - RNA, 24 nt, Human
ugccguggcggcggcugcccuccu

SEQ ID NO: 39413 - RNA, 24 nt, Human
uugcaugaaacauucuuaacguga

SEQ ID NO: 39414 - RNA, 24 nt, Human
aggcagguuaaguuccuugaugcc

SEQ ID NO: 39415 - RNA, 24 nt, Human
aaguuuuucaauccuucauggaaa

SEQ ID NO: 39416 - RNA, 24 nt, Human
uucauggaguacuuggagaaaaac

SEQ ID NO: 39417 - RNA, 24 nt, Human
uucuucuauguacgucagcuuuag

SEQ ID NO: 39418 - RNA, 24 nt, Human
ucacaaccacggcccuggaggagc

SEQ ID NO: 39419 - RNA, 24 nt, Human
agguaguaaacuccccaggugggc

SEQ ID NO: 39420 - RNA, 24 nt, Human
uauguugcccaggcuggucgcaaa

SEQ ID NO: 39421 - RNA, 24 nt, Human
uucaaauguauaugaagaagaaac

SEQ ID NO: 39422 - RNA, 24 nt, Human
agacaggcuggcacagccccaggc

SEQ ID NO: 39423 - RNA, 24 nt, Human
aagcagcaccaauggggaugaccc

SEQ ID NO: 39424 - RNA, 23 nt, Human
aaggagccccgcggccuaagcgc

SEQ ID NO: 39425 - RNA, 23 nt, Human
uugaaagguauauuaaaauuaag

SEQ ID NO: 39426 - RNA, 21 nt, Human
uuuguaagcuucugagauugc

SEQ ID NO: 39427 - RNA, 24 nt, Human
cuggaaggcauacccuacaauuua

SEQ ID NO: 39428 - RNA, 24 nt, Human
aauugccaggaaagagguagaaau

SEQ ID NO: 39429 - RNA, 24 nt, Human
ucucuacaaaaugcuaacauuuaa

SEQ ID NO: 39430 - RNA, 24 nt, Human
ucccagcaggacccucuucuuguu

SEQ ID NO: 39431 - RNA, 24 nt, Human
ggacagguguacagacauguucuu

SEQ ID NO: 39432 - RNA, 24 nt, Human
ucgaauggacacauuaccagugaa

SEQ ID NO: 39433 - RNA, 24 nt, Human
uaaguacauaggucuuuauuuaaa

SEQ ID NO: 39434 - RNA, 18 nt, Human
guccagguguagaaugcc

SEQ ID NO: 39435 - RNA, 24 nt, Human
uccacuggcgaaagaugccuuucu

SEQ ID NO: 39436 - RNA, 24 nt, Human
uaguucagauugaucuuaggucaa

SEQ ID NO: 39437 - RNA, 24 nt, Human
uagagugguggcucccagaauccc

SEQ ID NO: 39438 - RNA, 24 nt, Human
ugauauguuucuuuacagaaugca

SEQ ID NO: 39439 - RNA, 24 nt, Human
caccuggaacauugggaauuguuu

SEQ ID NO: 39440 - RNA, 20 nt, Human
uguaacuuauuaaauauguu

SEQ ID NO: 39441 - RNA, 24 nt, Human
uuuuacuuuuuugguuuuuguuuu

SEQ ID NO: 39442 - RNA, 24 nt, Human
aagcugcagaccuucgccaagagg

SEQ ID NO: 39443 - RNA, 24 nt, Human
ugugacaguucuuaaagauagugu

SEQ ID NO: 39444 - RNA, 24 nt, Human
uggcugcaggugcuggggagagag

SEQ ID NO: 39445 - RNA, 24 nt, Human
aaggaggcuuggcggugguugggc

SEQ ID NO: 39446 - RNA, 24 nt, Human
auuuaauugggugcuuuguaaaua

SEQ ID NO: 39447 - RNA, 24 nt, Human
ucuacaacugaggaaacaauauag

SEQ ID NO: 39448 - RNA, 24 nt, Human
ucacugccuccugggccaaaguga

SEQ ID NO: 39449 - RNA, 24 nt, Human
uaaaugcguggauuuauaccugag

SEQ ID NO: 39450 - RNA, 24 nt, Human
augcauggugcugggcaccaaagu

SEQ ID NO: 39451 - RNA, 24 nt, Human
cucgauuaaaauacacacaucuua

SEQ ID NO: 39452 - RNA, 24 nt, Human
uaggaguugugaaugugguaaaac

SEQ ID NO: 39453 - RNA, 24 nt, Human
ucaguuggcuaugggaagcaguuc

SEQ ID NO: 39454 - RNA, 24 nt, Human
uuaauccaugaacaucauuauauc

SEQ ID NO: 39455 - RNA, 18 nt, Human
ugagugaaagaagcagcc

SEQ ID NO: 39456 - RNA, 24 nt, Human
ugagcaggacccccuuccagguga

SEQ ID NO: 39457 - RNA, 24 nt, Human
uuccccuuggaaacuuugguuggc

SEQ ID NO: 39458 - RNA, 24 nt, Human
auuucauucacuggggaggaacaa

SEQ ID NO: 39459 - RNA, 23 nt, Human
uaaggcgaggcggaauuaaaccc

SEQ ID NO: 39460 - RNA, 24 nt, Human
ugguuggggcuguggacugagguc

SEQ ID NO: 39461 - RNA, 24 nt, Human
uuuggaguggauucuuagcugcuu

SEQ ID NO: 39462 - RNA, 24 nt, Human
ugaaguaagagguacggagauccu

SEQ ID NO: 39463 - RNA, 20 nt, Human
ucaccaguuuucauuguucu

SEQ ID NO: 39464 - RNA, 24 nt, Human
ucacugaaguacucgcauguuguu

SEQ ID NO: 39465 - RNA, 24 nt, Human
uaggugcccucaauagccuccuug

SEQ ID NO: 39466 - RNA, 24 nt, Human
ucgaauggacacauuaccagugaa

SEQ ID NO: 39467 - RNA, 21 nt, Human
gucaauauccauaaaugaagg

SEQ ID NO: 39468 - RNA, 24 nt, Human
ucucgaacuccugagcucaagcag

SEQ ID NO: 39469 - RNA, 24 nt, Human
ugggaccauuggugcaugccacua

SEQ ID NO: 39470 - RNA, 24 nt, Human
aagacugaauaauauuccauugua

SEQ ID NO: 39471 - RNA, 22 nt, Human
uucacgggauggaagucaccgu

SEQ ID NO: 39472 - RNA, 24 nt, Human
agaaagaaaauaaauucuuaaugu

SEQ ID NO: 39473 - RNA, 24 nt, Human
ugaggaaguaauagucucuuuucc

SEQ ID NO: 39474 - RNA, 24 nt, Human
uuugcagugagccgagagcgugcc

SEQ ID NO: 39475 - RNA, 24 nt, Human
ucccagaagguguccagccgagac

SEQ ID NO: 39476 - RNA, 24 nt, Human
caacuggauugaugacuccgggaa

SEQ ID NO: 39477 - RNA, 24 nt, Human
ucugcagucaaagccgaugcuggg

SEQ ID NO: 39478 - RNA, 24 nt, Human
caucaaugcugccaagggcuccuc

SEQ ID NO: 39479 - RNA, 24 nt, Human
gcaacauuacgaccauugcugagu

SEQ ID NO: 39480 - RNA, 24 nt, Human
ucagacaagcaacccacuggcuug

SEQ ID NO: 39481 - RNA, 23 nt, Human
ucugcaaauuuugugcucacagc

SEQ ID NO: 39482 - RNA, 24 nt, Human
cuugcccaccuggguuuggcugca

SEQ ID NO: 39483 - RNA, 24 nt, Human
ugucauagacauaauugaucaauu

SEQ ID NO: 39484 - RNA, 23 nt, Human
gcgcguggacaucgucacagcag

SEQ ID NO: 39485 - RNA, 24 nt, Human
uucagcugcaucugcgccaccugc

SEQ ID NO: 39486 - RNA, 24 nt, Human
cagcauucuggggcuuguaacacu

SEQ ID NO: 39487 - RNA, 24 nt, Human
ugcauuuuucauucaauaaauguu

SEQ ID NO: 39488 - RNA, 19 nt, Human
uucaaugguacugcaguua

SEQ ID NO: 39489 - RNA, 24 nt, Human
cggcagccuugagaucaaaugccc

SEQ ID NO: 39490 - RNA, 24 nt, Human
ucagcaccugcucugcggaaggca

SEQ ID NO: 39491 - RNA, 24 nt, Human
uuacaucccguucacagcucgagu

SEQ ID NO: 39492 - RNA, 24 nt, Human
guucuugggccuggcacugucucc

SEQ ID NO: 39493 - RNA, 24 nt, Human
gaaagugucuuaaucaaaauuucu

SEQ ID NO: 39494 - RNA, 24 nt, Human
uauuuuguuaauuuuuuauugagu

SEQ ID NO: 39495 - RNA, 24 nt, Human
ccugccguugcccugagcugcagc

SEQ ID NO: 39496 - RNA, 24 nt, Human
ugcauuguuaucauuaaccagucu

SEQ ID NO: 39497 - RNA, 24 nt, Human
uaaugggucucaaaauuuugugac

SEQ ID NO: 39498 - RNA, 24 nt, Human
uauuagggauaauauucauuuagc

SEQ ID NO: 39499 - RNA, 24 nt, Human
uauuagggauaauauucauuuagc

SEQ ID NO: 39500 - RNA, 24 nt, Human
uucacugauguuagaaucaucaca

SEQ ID NO: 39501 - RNA, 24 nt, Human
ugguauugaguaauacuuaccuga

SEQ ID NO: 39502 - RNA, 24 nt, Human
uggcucagauuggcuccuauguuc

SEQ ID NO: 39503 - RNA, 24 nt, Human
ucuuggaugaacuaggaagaggga

SEQ ID NO: 39504 - RNA, 24 nt, Human
ugggucaaccuuggguuucuucac

SEQ ID NO: 39505 - RNA, 24 nt, Human
ugagaauggcaaaauuagucgccu

SEQ ID NO: 39506 - RNA, 24 nt, Human
ugcccugaaaacaucuacaaaugc

SEQ ID NO: 39507 - RNA, 24 nt, Human
ugugaugaucagauugucaguuca

SEQ ID NO: 39508 - RNA, 22 nt, Human
uaaagguuucacagucagugca

SEQ ID NO: 39509 - RNA, 24 nt, Human
cauggcucaccaagcccugcucca

SEQ ID NO: 39510 - RNA, 24 nt, Human
ugauuggcugcagggaugaaaguu

SEQ ID NO: 39511 - RNA, 24 nt, Human
uguucuggagcuguuggacaaaua

SEQ ID NO: 39512 - RNA, 22 nt, Human
ugagaagaagcagcagaugggc

SEQ ID NO: 39513 - RNA, 24 nt, Human
aggcagucacagaacaggggcaug

SEQ ID NO: 39514 - RNA, 24 nt, Human
aaccagaaaguaagguguucuacu

SEQ ID NO: 39515 - RNA, 24 nt, Human
uaauguugucugacuuacuguuuc

SEQ ID NO: 39516 - RNA, 24 nt, Human
ugagaauggcaaaauuagucgccu

SEQ ID NO: 39517 - RNA, 24 nt, Human
uacaccacucccaagaagaauaag

SEQ ID NO: 39518 - RNA, 24 nt, Human
uguuguggccuuuuuugauccaua

SEQ ID NO: 39519 - RNA, 24 nt, Human
gcuccagaaaaaccuguaaagaaa

SEQ ID NO: 39520 - RNA, 24 nt, Human
gagccgagcgaagcgaugccuaaa

SEQ ID NO: 39521 - RNA, 24 nt, Human
uuguauguuuggauugcagaagaa

SEQ ID NO: 39522 - RNA, 24 nt, Human
uguaaaggaugaucaaacacugga

SEQ ID NO: 39523 - RNA, 19 nt, Human
cacauuguuuuuugcuacc

SEQ ID NO: 39524 - RNA, 24 nt, Human
uugaauuuggaaagagaacuaucc

SEQ ID NO: 39525 - RNA, 24 nt, Human
uccccagaugacucugguuuuguu

SEQ ID NO: 39526 - RNA, 24 nt, Human
ucuaagcuuggguuccguguugcc

SEQ ID NO: 39527 - RNA, 24 nt, Human
cagcaaacagaaugauucuuugac

SEQ ID NO: 39528 - RNA, 24 nt, Human
ggcucuguugcgggcgcacgacgc

SEQ ID NO: 39529 - RNA, 24 nt, Human
cggugcgggucgcgggccuccgcu

SEQ ID NO: 39530 - RNA, 18 nt, Human
uccccguucugcaagggc

SEQ ID NO: 39531 - RNA, 24 nt, Human
uuucccaguaauaaaauuagguuu

SEQ ID NO: 39532 - RNA, 20 nt, Human
ugaacagcugaucgagucga

SEQ ID NO: 39533 - RNA, 24 nt, Human
uauggcaagucacuuugacagaca

SEQ ID NO: 39534 - RNA, 24 nt, Human
ugagaauggcaaaauuagucgccu

SEQ ID NO: 39535 - RNA, 24 nt, Human
uacaccacucccaagaagaauaag

SEQ ID NO: 39536 - RNA, 24 nt, Human
ugcccggcaaauucuuguuucuuc

SEQ ID NO: 39537 - RNA, 24 nt, Human
uuuaagcuaguguuaauaaauuaa

SEQ ID NO: 39538 - RNA, 24 nt, Human
gaggauccaagcuuacguacgcgu

SEQ ID NO: 39539 - RNA, 24 nt, Human
uacuuugguaccuggcccgccuuu

SEQ ID NO: 39540 - RNA, 24 nt, Human
ucagcgggcuauauacucgucggu

SEQ ID NO: 39541 - RNA, 24 nt, Human
uccgugcgcguugcugcggccgug

SEQ ID NO: 39542 - RNA, 24 nt, Human
uugaucuugaagaaacugggcgug

SEQ ID NO: 39543 - RNA, 24 nt, Human
aggaaggagauauagugaagagga

SEQ ID NO: 39544 - RNA, 24 nt, Human
uguucuggagcuguuggacaaaua

SEQ ID NO: 39545 - RNA, 24 nt, Human
aggagauuauuuagguaucuuucu

SEQ ID NO: 39546 - RNA, 24 nt, Human
uaccaggaagcauuugaaauuagu

SEQ ID NO: 39547 - RNA, 24 nt, Human
aggcagucacagaacaggggcaug

SEQ ID NO: 39548 - RNA, 24 nt, Human
aggaggaagaaauguuuucuuagg

SEQ ID NO: 39549 - RNA, 24 nt, Human
caagcuccucuccccccucuuuuc

SEQ ID NO: 39550 - RNA, 24 nt, Human
agccacuucccucccaacccuggu

SEQ ID NO: 39551 - RNA, 24 nt, Human
ucggaccacaugaaggugcacagc

SEQ ID NO: 39552 - RNA, 24 nt, Human
uucauguauuacuucgauaacccg

SEQ ID NO: 39553 - RNA, 24 nt, Human
uguggucuacugggaagugaagua

SEQ ID NO: 39554 - RNA, 24 nt, Human
aggaacuuugaugcacuggugaug

SEQ ID NO: 39555 - RNA, 24 nt, Human
uucgugaguaacuagagagcagac

SEQ ID NO: 39556 - RNA, 24 nt, Human
agaauagagcuuuaucuucguauu

SEQ ID NO: 39557 - RNA, 24 nt, Human
uugcaaaguuacguuuuguaggag

SEQ ID NO: 39558 - RNA, 24 nt, Human
uaugacagaaucaugaagacuugc

SEQ ID NO: 39559 - RNA, 24 nt, Human
auguauuuggugcugaagauaaac

SEQ ID NO: 39560 - RNA, 24 nt, Human
uccagauuuguauuugcacuguca

SEQ ID NO: 39561 - RNA, 24 nt, Human
uccagguguaucuuagcuaaaacu

SEQ ID NO: 39562 - RNA, 24 nt, Human
uggcugacaccuuacugguaaccu

SEQ ID NO: 39563 - RNA, 24 nt, Human
uacccgggcugaaaaccucaauuu

SEQ ID NO: 39564 - RNA, 24 nt, Human
uagaaaguuggcauugagaaucug

SEQ ID NO: 39565 - RNA, 24 nt, Human
uacagagaaaagcagcgugaggga

SEQ ID NO: 39566 - RNA, 24 nt, Human
caccccugcggagagcaccguggc

SEQ ID NO: 39567 - RNA, 24 nt, Human
aguggauuuugccggcugguugug

SEQ ID NO: 39568 - RNA, 24 nt, Human
uguguucacccccgacuuccagga

SEQ ID NO: 39569 - RNA, 24 nt, Human
ugaccugcccaccgucccugucca

SEQ ID NO: 39570 - RNA, 24 nt, Human
uggcagaguuaaauugugcuuuug

SEQ ID NO: 39571 - RNA, 24 nt, Human
uccgggguugggaccgccgcguuc

SEQ ID NO: 39572 - RNA, 24 nt, Human
ucggucccccaggccugccgguca

SEQ ID NO: 39573 - RNA, 24 nt, Human
ucaaacagccgaaaccugucuugc

SEQ ID NO: 39574 - RNA, 24 nt, Human
gucgcagacuucacaguguaacuu

SEQ ID NO: 39575 - RNA, 24 nt, Human
cgccauggaccucucccucgaugc

SEQ ID NO: 39576 - RNA, 24 nt, Human
acugcaccugaagcccagccaaug

SEQ ID NO: 39577 - RNA, 24 nt, Human
accauggugagcccauuggcaggg

SEQ ID NO: 39578 - RNA, 22 nt, Human
cgccgggacagcagacugccgg

SEQ ID NO: 39579 - RNA, 24 nt, Human
cagccuggacuuaccaccacuaaa

SEQ ID NO: 39580 - RNA, 24 nt, Human
ggcccggagcggagcgcgcccugc

SEQ ID NO: 39581 - RNA, 24 nt, Human
aggaagucacuaccauuuauauuc

SEQ ID NO: 39582 - RNA, 24 nt, Human
gacucuuucugcaagauaccugua

SEQ ID NO: 39583 - RNA, 24 nt, Human
uacacaucaauuugaguuguucag

SEQ ID NO: 39584 - RNA, 24 nt, Human
uacaguguuaacugccauauaugu

SEQ ID NO: 39585 - RNA, 24 nt, Human
uaggagaaggaauuucaggugggu

SEQ ID NO: 39586 - RNA, 24 nt, Human
uaaaugguaaacgugauaucauga

SEQ ID NO: 39587 - RNA, 24 nt, Human
uguuagucaagaguccucaguagg

SEQ ID NO: 39588 - RNA, 24 nt, Human
ucauggacuaaacuaggucagagu

SEQ ID NO: 39589 - RNA, 22 nt, Human
gucaauauccauaaaugaaggg

SEQ ID NO: 39590 - RNA, 24 nt, Human
uggaagggcagaaucaggcuaucu

SEQ ID NO: 39591 - RNA, 24 nt, Human
ggacugggccgucgcacacgccag

SEQ ID NO: 39592 - RNA, 24 nt, Human
ugaaaaguuggaagauuuugcauc

SEQ ID NO: 39593 - RNA, 24 nt, Human
aaauggaaucuagaagcuaaauuu

SEQ ID NO: 39594 - RNA, 24 nt, Human
agagugcugaacggcaagggugca

SEQ ID NO: 39595 - RNA, 24 nt, Human
gugguugguguaaaugagugaggc

SEQ ID NO: 39596 - RNA, 17 nt, Human
ugaguagguggccugca

SEQ ID NO: 39597 - RNA, 24 nt, Human
gccaacauggugaaacccugucuc

SEQ ID NO: 39598 - RNA, 24 nt, Human
aacucauuuuccucguaauuuggg

SEQ ID NO: 39599 - RNA, 24 nt, Human
ugguaguggccagggccugcguuc

SEQ ID NO: 39600 - RNA, 24 nt, Human
ucuugcucuucuugcccaggcugg

SEQ ID NO: 39601 - RNA, 24 nt, Human
uaauauaauaacagccaauguuug

SEQ ID NO: 39602 - RNA, 22 nt, Human
uuaauuggguauaauucuggaa

SEQ ID NO: 39603 - RNA, 24 nt, Human
ugacuugggccaauuacacgacug

SEQ ID NO: 39604 - RNA, 24 nt, Human
uagccuguggcaccccggagauga

SEQ ID NO: 39605 - RNA, 24 nt, Human
ugacacgaggggaggggucugugu

SEQ ID NO: 39606 - RNA, 24 nt, Human
cuccccagcaugcuggcauccagc

SEQ ID NO: 39607 - RNA, 24 nt, Human
ugacgaguacgucugaugcugcca

SEQ ID NO: 39608 - RNA, 21 nt, Human
accaauguuuaaaaugacauu

SEQ ID NO: 39609 - RNA, 24 nt, Human
uguaaccucauaaaguguccgaug

SEQ ID NO: 39610 - RNA, 24 nt, Human
ucagaaauuauuggucugcguuca

SEQ ID NO: 39611 - RNA, 24 nt, Human
cuaaauuggucuuccaggugcuug

SEQ ID NO: 39612 - RNA, 24 nt, Human
uaaugguuuuuacagauuauugaa

SEQ ID NO: 39613 - RNA, 24 nt, Human
uaagaagacgcuuauuuguauugg

SEQ ID NO: 39614 - RNA, 24 nt, Human
cauuccauuuuuuuuuacuuuaua

SEQ ID NO: 39615 - RNA, 24 nt, Human
ugagguuucgcuggauaguaggua

SEQ ID NO: 39616 - RNA, 24 nt, Human
uugaucuugaagaaacugggcgug

SEQ ID NO: 39617 - RNA, 24 nt, Human
uccgcgcgcagccggagcacaugg

SEQ ID NO: 39618 - RNA, 24 nt, Human
aggaaggagauauagugaagagga

SEQ ID NO: 39619 - RNA, 24 nt, Human
guagaguuuucuucaggcuuaaag

SEQ ID NO: 39620 - RNA, 24 nt, Human
aggaaggagauauagugaagagga

SEQ ID NO: 39621 - RNA, 24 nt, Human
gcgcguugcugcggccgugguccg

SEQ ID NO: 39622 - RNA, 24 nt, Human
uugaucuugaagaaacugggcgug

SEQ ID NO: 39623 - RNA, 24 nt, Human
guagaguuuucuucaggcuuaaag

SEQ ID NO: 39624 - RNA, 18 nt, Human
cagcagccggaguguggc

SEQ ID NO: 39625 - RNA, 24 nt, Human
agucgggaacaugaagggagacug

SEQ ID NO: 39626 - RNA, 24 nt, Human
uguuugggaaacauagauugucuu

SEQ ID NO: 39627 - RNA, 24 nt, Human
auagcaguccaauugaucauaagc

SEQ ID NO: 39628 - RNA, 24 nt, Human
uaaguagcaucugggaagaggaga

SEQ ID NO: 39629 - RNA, 24 nt, Human
uuaccaugaagguuguuuugcuua

SEQ ID NO: 39630 - RNA, 24 nt, Human
ggaggaacuugaaaggaggguaaa

SEQ ID NO: 39631 - RNA, 24 nt, Human
cauguuuuagacaaauacucacgu

SEQ ID NO: 39632 - RNA, 24 nt, Human
ucuuuuuuuauaccauuuuauccu

SEQ ID NO: 39633 - RNA, 24 nt, Human
aauuuccuguuguguggguggcau

SEQ ID NO: 39634 - RNA, 24 nt, Human
guggugcggcaggcgucccugcau

SEQ ID NO: 39635 - RNA, 24 nt, Human
agauaagagaacgauugcagcgag

SEQ ID NO: 39636 - RNA, 24 nt, Human
ucacugggaagaugaccacagaaa

SEQ ID NO: 39637 - RNA, 24 nt, Human
agaggaacaaaggugugcucugag

SEQ ID NO: 39638 - RNA, 24 nt, Human
uaaaugcucccugccugguguggg

SEQ ID NO: 39639 - RNA, 24 nt, Human
uuaguagacgugggguuucaccau

SEQ ID NO: 39640 - RNA, 24 nt, Human
ccaacgugcugggauuacaggcau

SEQ ID NO: 39641 - RNA, 24 nt, Human
ucuugcucugucacccaggcugga

SEQ ID NO: 39642 - RNA, 24 nt, Human
gcuugagugaugcucagauuaggg

SEQ ID NO: 39643 - RNA, 24 nt, Human
aguaaaauuaaacucugugcuucc

SEQ ID NO: 39644 - RNA, 24 nt, Human
uaaaugauaugaaucauuuaacua

SEQ ID NO: 39645 - RNA, 24 nt, Human
uuaggaaauaauuauuaaaacaug

SEQ ID NO: 39646 - RNA, 24 nt, Human
uugguugaauacauaguuaagaug

SEQ ID NO: 39647 - RNA, 24 nt, Human
uaagccauuuuaaggaguuucaug

SEQ ID NO: 39648 - RNA, 24 nt, Human
cagcuuagaaaaugcagguuaccc

SEQ ID NO: 39649 - RNA, 24 nt, Human
ugaaauacuaccuaguuacuucuu

SEQ ID NO: 39650 - RNA, 24 nt, Human
uuggaugccacuccccuguguuga

SEQ ID NO: 39651 - RNA, 24 nt, Human
cuaguucuuaggaacagacucgau

SEQ ID NO: 39652 - RNA, 24 nt, Human
aguaguuuuaagguccagcuucuu

SEQ ID NO: 39653 - RNA, 20 nt, Human
ugaguugaauacucagcucc

SEQ ID NO: 39654 - RNA, 24 nt, Human
accccaugaauaaauagcagguuc

SEQ ID NO: 39655 - RNA, 24 nt, Human
ugaaaugaccaaaguacacaaaug

SEQ ID NO: 39656 - RNA, 24 nt, Human
ugggaccacgggcaugagccacca

SEQ ID NO: 39657 - RNA, 24 nt, Human
aucaaugucaauauccuaguuuug

SEQ ID NO: 39658 - RNA, 24 nt, Human
cuuggcuuccacucagcaucagcg

SEQ ID NO: 39659 - RNA, 24 nt, Human
caccagaaaaccuucauauaaaaa

SEQ ID NO: 39660 - RNA, 24 nt, Human
ggaaagcagcgcguggauguggag

SEQ ID NO: 39661 - RNA, 24 nt, Human
ucacaaccacggcccuggaggagc

SEQ ID NO: 39662 - RNA, 24 nt, Human
uaauauuuacugaccauuuacuau

SEQ ID NO: 39663 - RNA, 24 nt, Human
uuaauuuuugucuaccgaauauga

SEQ ID NO: 39664 - RNA, 24 nt, Human
uauccuucaacaaguguacguggc

SEQ ID NO: 39665 - RNA, 18 nt, Human
uacagugugcuuuagaau

SEQ ID NO: 39666 - RNA, 24 nt, Human
ugugaaaauuuaaguagauucuua

SEQ ID NO: 39667 - RNA, 24 nt, Human
ucuggcacaggaaauggucuccaa

SEQ ID NO: 39668 - RNA, 24 nt, Human
cgcccuaggcuucacggcagauca

SEQ ID NO: 39669 - RNA, 24 nt, Human
uuucaaggucgcugggcccgaggu

SEQ ID NO: 39670 - RNA, 24 nt, Human
cagcccccucaugcugguccuuga

SEQ ID NO: 39671 - RNA, 24 nt, Human
ugagauuauuaugagcagaauggu

SEQ ID NO: 39672 - RNA, 24 nt, Human
uacaccacucccaagaagaauaag

SEQ ID NO: 39673 - RNA, 24 nt, Human
uugcugccacuuccaggugcuggc

SEQ ID NO: 39674 - RNA, 24 nt, Human
aaaaugagcagcgucccucuccac

SEQ ID NO: 39675 - RNA, 24 nt, Human
aaguauaggcgauagaaauugaga

SEQ ID NO: 39676 - RNA, 24 nt, Human
uuugcauuuuuggcugauuuaaaa

SEQ ID NO: 39677 - RNA, 24 nt, Human
gaggaugccgccauccagaauuuu

SEQ ID NO: 39678 - RNA, 24 nt, Human
uuucuaaauaucuuuuuaaaauaa

SEQ ID NO: 39679 - RNA, 24 nt, Human
uagcuuuuuaaaaggcuguuuaca

SEQ ID NO: 39680 - RNA, 24 nt, Human
cuccuaaucccagauguaccgcga

SEQ ID NO: 39681 - RNA, 24 nt, Human
cagcugcugccagguuuaagaaca

SEQ ID NO: 39682 - RNA, 24 nt, Human
aaucaaguccuggucaccuggaca

SEQ ID NO: 39683 - RNA, 24 nt, Human
uuggaaguagaauguucgcugaug

SEQ ID NO: 39684 - RNA, 24 nt, Human
uugcaaguggcguauaacgauaag

SEQ ID NO: 39685 - RNA, 24 nt, Human
uuaguaccaagaaaacagggauga

SEQ ID NO: 39686 - RNA, 24 nt, Human
ucagagggucuccugcagcccucu

SEQ ID NO: 39687 - RNA, 24 nt, Human
aaguauaggcgauagaaauugaga

SEQ ID NO: 39688 - RNA, 24 nt, Human
uggcaaaaugugggcugcucuguu

SEQ ID NO: 39689 - RNA, 24 nt, Human
gaacauauaccauauagugaaagg

SEQ ID NO: 39690 - RNA, 24 nt, Human
ucucaaaacucaaauacucuuuau

SEQ ID NO: 39691 - RNA, 22 nt, Human
acgcacagcuaggaaugaccgc

SEQ ID NO: 39692 - RNA, 19 nt, Human
uaccuugugagcaguuggu

SEQ ID NO: 39693 - RNA, 24 nt, Human
uaaauuuucuuuuuaaaaagaggc

SEQ ID NO: 39694 - RNA, 24 nt, Human
ugcgaugggucgugacacugggcc

SEQ ID NO: 39695 - RNA, 24 nt, Human
ucggggauucugcugggcaauggc

SEQ ID NO: 39696 - RNA, 24 nt, Human
aggcauuugaagaugaaaugaaaa

SEQ ID NO: 39697 - RNA, 24 nt, Human
uguguauuuacuuuagaaaaaaug

SEQ ID NO: 39698 - RNA, 24 nt, Human
uggaugauuaagagauugccauuu

SEQ ID NO: 39699 - RNA, 24 nt, Human
uggcgagauaucaaguucaaaacc

SEQ ID NO: 39700 - RNA, 22 nt, Human
ucauaaguagucauccaguaga

SEQ ID NO: 39701 - RNA, 24 nt, Human
uggcuuuagucuugaugaauguga

SEQ ID NO: 39702 - RNA, 24 nt, Human
ccgcacccaucuuugaagauagcc

SEQ ID NO: 39703 - RNA, 24 nt, Human
accuggagggcaugaugagcgagg

SEQ ID NO: 39704 - RNA, 24 nt, Human
agaguuguucauccaggagacagc

SEQ ID NO: 39705 - RNA, 24 nt, Human
ggccugggcacccuuagaggggag

SEQ ID NO: 39706 - RNA, 22 nt, Human
gcgaauggcaaauuguaagcgg

SEQ ID NO: 39707 - RNA, 24 nt, Human
uauuucaaggagacagaucaaauu

SEQ ID NO: 39708 - RNA, 24 nt, Human
uccaugcugaacgacugugacuau

SEQ ID NO: 39709 - RNA, 24 nt, Human
cacccgcaguaaccacugaacguc

SEQ ID NO: 39710 - RNA, 24 nt, Human
uagcauucaaaauguugcauagag

SEQ ID NO: 39711 - RNA, 24 nt, Human
gcagaccccugcaugcaguugugu

SEQ ID NO: 39712 - RNA, 19 nt, Human
aacacggugaaaccccauc

SEQ ID NO: 39713 - RNA, 24 nt, Human
ccacugcacuccacccugggcaac

SEQ ID NO: 39714 - RNA, 24 nt, Human
uucaaaauuuuaauguguuccaug

SEQ ID NO: 39715 - RNA, 24 nt, Human
uuccagguugaccacuuugugccc

SEQ ID NO: 39716 - RNA, 24 nt, Human
cagaagcuauaaaacuggggggca

SEQ ID NO: 39717 - RNA, 24 nt, Human
aagcagcgguaccagaugcagaaa

SEQ ID NO: 39718 - RNA, 24 nt, Human
uccacuggcgaaagaugccuuucu

SEQ ID NO: 39719 - RNA, 24 nt, Human
uaguucagauugaucuuaggucaa

SEQ ID NO: 39720 - RNA, 24 nt, Human
uagagugguggcucccagaauccc

SEQ ID NO: 39721 - RNA, 24 nt, Human
ggucauuaccuuauugaguuuaga

SEQ ID NO: 39722 - RNA, 24 nt, Human
uuuagacuugacgcaacgggaggu

SEQ ID NO: 39723 - RNA, 24 nt, Human
agagcagguguucugggccccuuc

SEQ ID NO: 39724 - RNA, 24 nt, Human
gggcucaggugagagcagguguuc

SEQ ID NO: 39725 - RNA, 24 nt, Human
ugcaugacgguguccuguccucgg

SEQ ID NO: 39726 - RNA, 24 nt, Human
uaguucagauugaucuuaggucaa

SEQ ID NO: 39727 - RNA, 19 nt, Human
ugucacagaacuacagucu

SEQ ID NO: 39728 - RNA, 24 nt, Human
acuugauggggaugguuagacaac

SEQ ID NO: 39729 - RNA, 24 nt, Human
gaccagccggaaagcauuggggau

SEQ ID NO: 39730 - RNA, 24 nt, Human
ucccgaaagucccaggcuguugga

SEQ ID NO: 39731 - RNA, 24 nt, Human
ucacuuccagguccucaguacaca

SEQ ID NO: 39732 - RNA, 24 nt, Human
uuaaaauaugggugcacauuuugc

SEQ ID NO: 39733 - RNA, 24 nt, Human
ccacacaggcucauucucaacugg

SEQ ID NO: 39734 - RNA, 23 nt, Human
agggauguucaggacucugcagc

SEQ ID NO: 39735 - RNA, 24 nt, Human
uucucuguuuggaggcugcaccca

SEQ ID NO: 39736 - RNA, 24 nt, Human
auuucauucacuggggaggaacaa

SEQ ID NO: 39737 - RNA, 23 nt, Human
uaaggcgaggcggaauuaaaccc

SEQ ID NO: 39738 - RNA, 24 nt, Human
gagcauuuguauguuauggugaau

SEQ ID NO: 39739 - RNA, 24 nt, Human
ucucacuggaauaccccaccauua

SEQ ID NO: 39740 - RNA, 24 nt, Human
cagcgugguugugcaugggagugg

SEQ ID NO: 39741 - RNA, 24 nt, Human
uggaauugguaugugguugggcaa

SEQ ID NO: 39742 - RNA, 24 nt, Human
uaacagguguaagaguguugaaaa

SEQ ID NO: 39743 - RNA, 24 nt, Human
ugugcagaagaaauggaaggauuc

SEQ ID NO: 39744 - RNA, 24 nt, Human
uccauagucuccuaccccuccugg

SEQ ID NO: 39745 - RNA, 24 nt, Human
ucacguaagcaugagguuguuggg

SEQ ID NO: 39746 - RNA, 24 nt, Human
uuccagcgacuggacaagcugagg

SEQ ID NO: 39747 - RNA, 24 nt, Human
aacaaauuucacauaugguaaacc

SEQ ID NO: 39748 - RNA, 24 nt, Human
aggaagcgagaaugcagaguuucc

SEQ ID NO: 39749 - RNA, 20 nt, Human
ugugguggcagcagccaagg

SEQ ID NO: 39750 - RNA, 21 nt, Human
ucgcuggcucccacuuugucu

SEQ ID NO: 39751 - RNA, 24 nt, Human
ugacagacagaagggcuuggagau

SEQ ID NO: 39752 - RNA, 24 nt, Human
ugacgugcuggaacucagagaggu

SEQ ID NO: 39753 - RNA, 24 nt, Human
uggcugaauuuuccuucuuuaccu

SEQ ID NO: 39754 - RNA, 24 nt, Human
uugcagcacgucagcaucaauauc

SEQ ID NO: 39755 - RNA, 24 nt, Human
ugugaugacagcuuggcggguacg

SEQ ID NO: 39756 - RNA, 24 nt, Human
aacccggaagcauagacugugcua

SEQ ID NO: 39757 - RNA, 24 nt, Human
ggacuagaaaguacaugaccaagc

SEQ ID NO: 39758 - RNA, 24 nt, Human
ucccgguaacuauuccgguuauga

SEQ ID NO: 39759 - RNA, 24 nt, Human
uaccuggaggagaagggcaccuac

SEQ ID NO: 39760 - RNA, 24 nt, Human
ggggaagugccuggacugcaucaa

SEQ ID NO: 39761 - RNA, 24 nt, Human
ugagggcuuccucaaagucugagc

SEQ ID NO: 39762 - RNA, 24 nt, Human
ucccugaaagagauggucuccaag

SEQ ID NO: 39763 - RNA, 24 nt, Human
uagcaaaaguaauauaaaaguacc

SEQ ID NO: 39764 - RNA, 24 nt, Human
cauggagagcgaugcuagugaugc

SEQ ID NO: 39765 - RNA, 24 nt, Human
cacccugugccaggucgcugcgcu

SEQ ID NO: 39766 - RNA, 24 nt, Human
aucgagcaggucucuggacucaca

SEQ ID NO: 39767 - RNA, 24 nt, Human
ucccugcagcccgggccgggccug

SEQ ID NO: 39768 - RNA, 24 nt, Human
acgcaguuacggcgugccaauacc

SEQ ID NO: 39769 - RNA, 24 nt, Human
ugagauagccaggcugaagaagca

SEQ ID NO: 39770 - RNA, 24 nt, Human
uauggcaagucacuuugacagaca

SEQ ID NO: 39771 - RNA, 24 nt, Human
uacaccacucccaagaagaauaag

SEQ ID NO: 39772 - RNA, 24 nt, Human
ucuugcucuguugcccaggcugga

SEQ ID NO: 39773 - RNA, 24 nt, Human
agcaauuuuccugcuggguauuua

SEQ ID NO: 39774 - RNA, 24 nt, Human
caggcaguuaacaaaugcuggcaa

SEQ ID NO: 39775 - RNA, 24 nt, Human
ugacuaguuuaaggagacuggcga

SEQ ID NO: 39776 - RNA, 24 nt, Human
uagaagcagccaccagcagaugac

SEQ ID NO: 39777 - RNA, 24 nt, Human
cacuacaccauuggcaaggagauc

SEQ ID NO: 39778 - RNA, 24 nt, Human
uguguuuguagacuuggaacccac

SEQ ID NO: 39779 - RNA, 24 nt, Human
ucacgaacacagagacgucaucgu

SEQ ID NO: 39780 - RNA, 24 nt, Human
ugaauccucaguggucacugcucu

SEQ ID NO: 39781 - RNA, 24 nt, Human
gauuaugugcgcuggaacguggaa

SEQ ID NO: 39782 - RNA, 24 nt, Human
cacugcauuccagccugggcagca

SEQ ID NO: 39783 - RNA, 24 nt, Human
ugcccaggacagccagcccugagc

SEQ ID NO: 39784 - RNA, 24 nt, Human
ugucacguggggcuuauaggacgg

SEQ ID NO: 39785 - RNA, 24 nt, Human
agaacagacugggacucaucuucc

SEQ ID NO: 39786 - RNA, 24 nt, Human
ugacaagaggagccccaccuuauc

SEQ ID NO: 39787 - RNA, 24 nt, Human
caugugaacgcuacuuaugugaac

SEQ ID NO: 39788 - RNA, 22 nt, Human
auaaugaauaaugaccuuauuu

SEQ ID NO: 39789 - RNA, 24 nt, Human
accgugagaaguaaauuucuguuu

SEQ ID NO: 39790 - RNA, 24 nt, Human
uaauguacagaacuaaauuuuuua

SEQ ID NO: 39791 - RNA, 24 nt, Human
uaauuuguuaaaaugacuucauuu

SEQ ID NO: 39792 - RNA, 24 nt, Human
acagugcgggcugcggugggucag

SEQ ID NO: 39793 - RNA, 24 nt, Human
ugccguagcuauggaauagaagca

SEQ ID NO: 39794 - RNA, 24 nt, Human
uuuggcaaggauggaguguccaga

SEQ ID NO: 39795 - RNA, 24 nt, Human
uggcagggcagugaaagaagggga

SEQ ID NO: 39796 - RNA, 24 nt, Human
uuuaagauuuucugaccuggauuu

SEQ ID NO: 39797 - RNA, 24 nt, Human
uucacagaccaaaccagacaucca

SEQ ID NO: 39798 - RNA, 18 nt, Human
uggcugugacauugagca

SEQ ID NO: 39799 - RNA, 24 nt, Human
augggucagcgaucuccugacuca

SEQ ID NO: 39800 - RNA, 24 nt, Human
ucaguggcccucccuggugcacug

SEQ ID NO: 39801 - RNA, 20 nt, Human
ucucccagccaccuccuccc

SEQ ID NO: 39802 - RNA, 24 nt, Human
aaccaggaagagaagaguggccca

SEQ ID NO: 39803 - RNA, 17 nt, Human
ugagagggggggcggcc

SEQ ID NO: 39804 - RNA, 24 nt, Human
cuacuggagcuggauccgccagcc

SEQ ID NO: 39805 - RNA, 24 nt, Human
ucccucuuuuggaacucugguuua

SEQ ID NO: 39806 - RNA, 24 nt, Human
ugagggaaggacugcugggauugg

SEQ ID NO: 39807 - RNA, 24 nt, Human
uaccaggacaucagugaguuggua

SEQ ID NO: 39808 - RNA, 24 nt, Human
accugggguggcacacacacgcaa

SEQ ID NO: 39809 - RNA, 24 nt, Human
uggaaugggaacgucuguugagag

SEQ ID NO: 39810 - RNA, 24 nt, Human
cuggagccaagugcuaacaugucu

SEQ ID NO: 39811 - RNA, 24 nt, Human
ggccgaggagaaggguuccaaacc

SEQ ID NO: 39812 - RNA, 24 nt, Human
uccaccacuacuggccaucugauc

SEQ ID NO: 39813 - RNA, 24 nt, Human
ccuggcuccagggauggcaaaguc

SEQ ID NO: 39814 - RNA, 24 nt, Human
caccuggaacaucaaccacgcccg

SEQ ID NO: 39815 - RNA, 22 nt, Human
cacucgguguacguccuggagg

SEQ ID NO: 39816 - RNA, 24 nt, Human
ugcugagcccgcuucggccgggac

SEQ ID NO: 39817 - RNA, 24 nt, Human
ucugaucuauaaaugcgguggcau

SEQ ID NO: 39818 - RNA, 24 nt, Human
uuagucacggggaugguggaagag

SEQ ID NO: 39819 - RNA, 24 nt, Human
acucgccccaaaggaaaacaacuu

SEQ ID NO: 39820 - RNA, 24 nt, Human
uagagcuagugaauuagccuauuu

SEQ ID NO: 39821 - RNA, 24 nt, Human
uagcagugcaaagaguuccuuuau

SEQ ID NO: 39822 - RNA, 24 nt, Human
uaacuaagauuuugccuuuauugg

SEQ ID NO: 39823 - RNA, 24 nt, Human
ucaggcucauauagcugcuggccg

SEQ ID NO: 39824 - RNA, 24 nt, Human
ugggauccugcagcucuagucucc

SEQ ID NO: 39825 - RNA, 24 nt, Human
uggaggguguuguggucuccaauc

SEQ ID NO: 39826 - RNA, 24 nt, Human
ugcuguacuuacucccugagguag

SEQ ID NO: 39827 - RNA, 24 nt, Human
ugauagggugggcuaaaaaccaug

SEQ ID NO: 39828 - RNA, 24 nt, Human
ugcugcaguacaggggagcauagg

SEQ ID NO: 39829 - RNA, 24 nt, Human
uaugaggcccuagagcuccgggac

SEQ ID NO: 39830 - RNA, 24 nt, Human
uaaaugucuacaugugccagaaug

SEQ ID NO: 39831 - RNA, 20 nt, Human
uacacaggcacauggcuuua

SEQ ID NO: 39832 - RNA, 24 nt, Human
uccacaauuaaaauagcacaucug

SEQ ID NO: 39833 - RNA, 24 nt, Human
uggugcaaaagugauugugguuug

SEQ ID NO: 39834 - RNA, 24 nt, Human
uuagaugguagcuaugcucaguga

SEQ ID NO: 39835 - RNA, 24 nt, Human
ugagguugacccuuuucguguuaa

SEQ ID NO: 39836 - RNA, 18 nt, Human
uucauuuuauuucuguuc

SEQ ID NO: 39837 - RNA, 24 nt, Human
aaccaggacccaaggugcccuucc

SEQ ID NO: 39838 - RNA, 24 nt, Human
gggccaugcucccuggcccugacu

SEQ ID NO: 39839 - RNA, 24 nt, Human
ucuaucggauuagcacucggugcc

SEQ ID NO: 39840 - RNA, 24 nt, Human
ccaacgcacucuaaauccccagau

SEQ ID NO: 39841 - RNA, 24 nt, Human
augaauuacugagcuccaaaauug

SEQ ID NO: 39842 - RNA, 24 nt, Human
ucaaggacauuuuccuaaggacag

SEQ ID NO: 39843 - RNA, 24 nt, Human
aggcaggacacagcggcuuuccga

SEQ ID NO: 39844 - RNA, 24 nt, Human
aagguucuuuuauuguggaacuuu

SEQ ID NO: 39845 - RNA, 18 nt, Human
aggcagggucugcaugug

SEQ ID NO: 39846 - RNA, 24 nt, Human
agucuuugaaaggcaccaacccuu

SEQ ID NO: 39847 - RNA, 24 nt, Human
uaguaguugggauuacaggcaugc

SEQ ID NO: 39848 - RNA, 24 nt, Human
ugaccucaagugauccgcucgcuc

SEQ ID NO: 39849 - RNA, 21 nt, Human
uaaggagggggcauggguccc

SEQ ID NO: 39850 - RNA, 24 nt, Human
aagcgugcuucuguguccagcuuu

SEQ ID NO: 39851 - RNA, 24 nt, Human
ggaaggacgggcguggucugcagg

SEQ ID NO: 39852 - RNA, 24 nt, Human
cauuuggaaaaucuacuguacagg

SEQ ID NO: 39853 - RNA, 24 nt, Human
guggggcagcaggagcuaacggag

SEQ ID NO: 39854 - RNA, 24 nt, Human
uaagccccgcaugcauuagguauu

SEQ ID NO: 39855 - RNA, 20 nt, Human
ucccugcaaaggacaggaac

SEQ ID NO: 39856 - RNA, 24 nt, Human
ugccaaaguuagccacaucuuacu

SEQ ID NO: 39857 - RNA, 24 nt, Human
uucugauuuuaaaaggauucucug

SEQ ID NO: 39858 - RNA, 24 nt, Human
acuaugacgaaucacuuuacagca

SEQ ID NO: 39859 - RNA, 24 nt, Human
cagcaaaugaauggauauuucugc

SEQ ID NO: 39860 - RNA, 24 nt, Human
ugacaaauaagucucacacagugc

SEQ ID NO: 39861 - RNA, 24 nt, Human
uauugugacucacauguccuccug

SEQ ID NO: 39862 - RNA, 24 nt, Human
uguuuuguucuuuugguaguuuua

SEQ ID NO: 39863 - RNA, 24 nt, Human
uuacuuggaauuuccucuguuaua

SEQ ID NO: 39864 - RNA, 24 nt, Human
uaaguuguauaaaaguaggugauu

SEQ ID NO: 39865 - RNA, 24 nt, Human
uugaaaguuguacugguucccugu

SEQ ID NO: 39866 - RNA, 24 nt, Human
uggcaggccugguaggcggaggcg

SEQ ID NO: 39867 - RNA, 24 nt, Human
uuacuacauuaagguacgagcagg

SEQ ID NO: 39868 - RNA, 24 nt, Human
ugaaaguauucaaaagucuucccg

SEQ ID NO: 39869 - RNA, 24 nt, Human
uaaaagaccauccauccagucugc

SEQ ID NO: 39870 - RNA, 24 nt, Human
uuaaaugugcauuaccugguuaca

SEQ ID NO: 39871 - RNA, 24 nt, Human
acaaagccaaaggccccuuguuag

SEQ ID NO: 39872 - RNA, 19 nt, Human
aacaaguuauuauacuccu

SEQ ID NO: 39873 - RNA, 24 nt, Human
acuggauuaugauaaggguuuaag

SEQ ID NO: 39874 - RNA, 24 nt, Human
gugcuuugauuaaugguuaaaacu

SEQ ID NO: 39875 - RNA, 24 nt, Human
cauucugugccuguggugaccgug

SEQ ID NO: 39876 - RNA, 24 nt, Human
cccccgggaccucgcaugcacgaa

SEQ ID NO: 39877 - RNA, 24 nt, Human
cggcgggaaggaggcgcgcggacc

SEQ ID NO: 39878 - RNA, 18 nt, Human
uagaacgcaggcggcggc

SEQ ID NO: 39879 - RNA, 24 nt, Human
acucguuuugucuucucuuccccu

SEQ ID NO: 39880 - RNA, 24 nt, Human
cuuuaucauuucauuaauucacaa

SEQ ID NO: 39881 - RNA, 24 nt, Human
acuauuauuacuauauauuaaauu

SEQ ID NO: 39882 - RNA, 24 nt, Human
uuacauaggucggcuugagcacug

SEQ ID NO: 39883 - RNA, 24 nt, Human
ucucagaagacuccguuucugggg

SEQ ID NO: 39884 - RNA, 24 nt, Human
uggaaggucuaaaguuugugaggg

SEQ ID NO: 39885 - RNA, 24 nt, Human
gagcgguccuuggggagacgcggg

SEQ ID NO: 39886 - RNA, 24 nt, Human
ucaggcccugcucaagauuccagu

SEQ ID NO: 39887 - RNA, 24 nt, Human
cacagugucugauuuguaugccca

SEQ ID NO: 39888 - RNA, 24 nt, Human
uuuagacuugacgcaacgggaggu

SEQ ID NO: 39889 - RNA, 24 nt, Human
cagcugccaccuccagacuuugga

SEQ ID NO: 39890 - RNA, 24 nt, Human
ucacagagguagcaucaagccccu

SEQ ID NO: 39891 - RNA, 24 nt, Human
uaaaacauaaacuguguuagauag

SEQ ID NO: 39892 - RNA, 24 nt, Human
uggcagggaacaaaugccaaguga

SEQ ID NO: 39893 - RNA, 24 nt, Human
uccacugggcaaaaaacaaaacaa

SEQ ID NO: 39894 - RNA, 19 nt, Human
uagaagacagguggucugc

SEQ ID NO: 39895 - RNA, 24 nt, Human
ugagggagagagagcagcuccaca

SEQ ID NO: 39896 - RNA, 24 nt, Human
uaaaacaaguuuuuguugguuacu

SEQ ID NO: 39897 - RNA, 24 nt, Human
ggccuuagccgccagcccgcgcug

SEQ ID NO: 39898 - RNA, 24 nt, Human
ucauauguuuaaccuugauuugga

SEQ ID NO: 39899 - RNA, 24 nt, Human
uucacuuuuauuauaggaucccca

SEQ ID NO: 39900 - RNA, 24 nt, Human
acgcagccucuagucucuguuucu

SEQ ID NO: 39901 - RNA, 24 nt, Human
caguaugguagugggcuacccccu

SEQ ID NO: 39902 - RNA, 24 nt, Human
guggagggcccuauggacacccca

SEQ ID NO: 39903 - RNA, 24 nt, Human
acgcaguuucaucucagggaggcc

SEQ ID NO: 39904 - RNA, 24 nt, Human
ucccugcagaagcguggcauugug

SEQ ID NO: 39905 - RNA, 24 nt, Human
ucauuguagaaaggaagccuugcu

SEQ ID NO: 39906 - RNA, 23 nt, Human
uaccggcccaaguacugcgguuc

SEQ ID NO: 39907 - RNA, 24 nt, Human
ugggaguaucggauguagcugagu

SEQ ID NO: 39908 - RNA, 24 nt, Human
ucggcucgugccgauucggcacga

SEQ ID NO: 39909 - RNA, 24 nt, Human
ugaggcaauacauuuuguguuacu

SEQ ID NO: 39910 - RNA, 24 nt, Human
ugcccguugccuagguugggcuca

SEQ ID NO: 39911 - RNA, 24 nt, Human
uagccuuggaaaaauccaucuccg

SEQ ID NO: 39912 - RNA, 24 nt, Human
guagagcuccccaucaaugaucgc

SEQ ID NO: 39913 - RNA, 24 nt, Human
agaucuguugccaucauggccccu

SEQ ID NO: 39914 - RNA, 23 nt, Human
uauguugucaaaggcuuaagggc

SEQ ID NO: 39915 - RNA, 17 nt, Human
ugagauggaucaacagu

SEQ ID NO: 39916 - RNA, 24 nt, Human
gggaauuggcacaccagcugguac

SEQ ID NO: 39917 - RNA, 24 nt, Human
ucaaucagguugcagauucuaaaa

SEQ ID NO: 39918 - RNA, 24 nt, Human
uggaaaaacuuggcuugucugcca

SEQ ID NO: 39919 - RNA, 22 nt, Human
uggggagagcuuuuccacugcc

SEQ ID NO: 39920 - RNA, 24 nt, Human
uuaguugugugucugccugaaacc

SEQ ID NO: 39921 - RNA, 24 nt, Human
uguagaaucuuuauuaucucaaca

SEQ ID NO: 39922 - RNA, 24 nt, Human
uccgugcuggcccuaugagacgga

SEQ ID NO: 39923 - RNA, 24 nt, Human
ccgaacuugaucaauguauacaau

SEQ ID NO: 39924 - RNA, 24 nt, Human
uaaaauaauaugaaaugcagacuu

SEQ ID NO: 39925 - RNA, 24 nt, Human
gugaacuugaagugcuucccauuc

SEQ ID NO: 39926 - RNA, 24 nt, Human
uuccuggcucugcaguugguacuu

SEQ ID NO: 39927 - RNA, 24 nt, Human
gagcagcagcaguggagggggcag

SEQ ID NO: 39928 - RNA, 24 nt, Human
ucccuauuuccuuugcuguguucc

SEQ ID NO: 39929 - RNA, 17 nt, Human
cagggcaggcgccggcc

SEQ ID NO: 39930 - RNA, 24 nt, Human
ugaauggacggguucaggccugau

SEQ ID NO: 39931 - RNA, 24 nt, Human
agauguugacccagaguccucugu

SEQ ID NO: 39932 - RNA, 24 nt, Human
agguggcucagggaguggcagaag

SEQ ID NO: 39933 - RNA, 24 nt, Human
uccaaauuuggauaaaauaucucu

SEQ ID NO: 39934 - RNA, 24 nt, Human
cuucccaaagcuagggccguuccc

SEQ ID NO: 39935 - RNA, 24 nt, Human
uaugugaaaagagaaggugggcug

SEQ ID NO: 39936 - RNA, 24 nt, Human
uuaaaguaagugugggucaagguc

SEQ ID NO: 39937 - RNA, 24 nt, Human
gggcaguaaagaaucuguaacugc

SEQ ID NO: 39938 - RNA, 24 nt, Human
agccugggcuucaugcccccucug

SEQ ID NO: 39939 - RNA, 24 nt, Human
ucgaauggacacauuaccagugaa

SEQ ID NO: 39940 - RNA, 24 nt, Human
uaaggaagcgguacgaacuccacg

SEQ ID NO: 39941 - RNA, 21 nt, Human
ugacacgaggggagggggucu

SEQ ID NO: 39942 - RNA, 24 nt, Human
ugaggggagaaaaacaaucacuug

SEQ ID NO: 39943 - RNA, 24 nt, Human
uggaagucauuaccucugcaguca

SEQ ID NO: 39944 - RNA, 24 nt, Human
uaauaggccuuucaaauguauguu

SEQ ID NO: 39945 - RNA, 24 nt, Human
ccgcgucgacgaaacauuuaggac

SEQ ID NO: 39946 - RNA, 18 nt, Human
cgauacgagccacaaacu

SEQ ID NO: 39947 - RNA, 24 nt, Human
ugaccucaggugauccucccgccu

SEQ ID NO: 39948 - RNA, 24 nt, Human
uaagaaaccucuuuaagcaauaga

SEQ ID NO: 39949 - RNA, 20 nt, Human
cauucauuacugggggaggu

SEQ ID NO: 39950 - RNA, 23 nt, Human
uggacugcgcauucauggguucc

SEQ ID NO: 39951 - RNA, 24 nt, Human
auagaauguggccaggccuuacaa

SEQ ID NO: 39952 - RNA, 24 nt, Human
aaggugccucguuuuuguccuaga

SEQ ID NO: 39953 - RNA, 24 nt, Human
uuacuaguuuauuauggcuugggu

SEQ ID NO: 39954 - RNA, 24 nt, Human
ucuauaguguuugaucauagaagu

SEQ ID NO: 39955 - RNA, 22 nt, Human
aacauuauaaauguaugcuacu

SEQ ID NO: 39956 - RNA, 24 nt, Human
agugguugaauuuacccacccaag

SEQ ID NO: 39957 - RNA, 24 nt, Human
uccuuuaucagucgucuuagcaga

SEQ ID NO: 39958 - RNA, 24 nt, Human
cagguuccauucaaugcaagucac

SEQ ID NO: 39959 - RNA, 24 nt, Human
cagugcacauaccuucaguuuggg

SEQ ID NO: 39960 - RNA, 24 nt, Human
uuugccaauuuggcgguggcugcc

SEQ ID NO: 39961 - RNA, 24 nt, Human
uggcggcggcgcagggccucgugg

SEQ ID NO: 39962 - RNA, 24 nt, Human
uaaaagaccauccauccagucugc

SEQ ID NO: 39963 - RNA, 24 nt, Human
ugguaaggggaagaggcagauaug

SEQ ID NO: 39964 - RNA, 24 nt, Human
ccuccagccugagaagcaugccgu

SEQ ID NO: 39965 - RNA, 24 nt, Human
caucgguaagcgggugccggauca

SEQ ID NO: 39966 - RNA, 24 nt, Human
agucauuccuuacgagaagaaagc

SEQ ID NO: 39967 - RNA, 17 nt, Human
acccugaggaagaagag

SEQ ID NO: 39968 - RNA, 24 nt, Human
ugaggugggcagugugccaggucc

SEQ ID NO: 39969 - RNA, 24 nt, Human
uaagcagaggucaccgggcaacua

SEQ ID NO: 39970 - RNA, 24 nt, Human
uaccaggagaggaaucgagccaug

SEQ ID NO: 39971 - RNA, 24 nt, Human
gggcagcaagcggccccucgcucc

SEQ ID NO: 39972 - RNA, 24 nt, Human
agccauugggauccagacaucaga

SEQ ID NO: 39973 - RNA, 24 nt, Human
acacuggucuccgcuguauccugg

SEQ ID NO: 39974 - RNA, 17 nt, Human
uaacuuggaaggcagag

SEQ ID NO: 39975 - RNA, 24 nt, Human
uucuccaaguacgagaaguaacag

SEQ ID NO: 39976 - RNA, 24 nt, Human
ugaggugggcgcaccgggcauagu

SEQ ID NO: 39977 - RNA, 24 nt, Human
ugauguugagaaccguguaccaug

SEQ ID NO: 39978 - RNA, 24 nt, Human
ccaguacaacauuauguucccgaa

SEQ ID NO: 39979 - RNA, 24 nt, Human
guccaguucacagacauuguggaa

SEQ ID NO: 39980 - RNA, 24 nt, Human
ugagggaaggacugcuggguuggc

SEQ ID NO: 39981 - RNA, 24 nt, Human
ucaccgaaggugaaaauggcauua

SEQ ID NO: 39982 - RNA, 24 nt, Human
ucggaaaggaggcgccggcugugg

SEQ ID NO: 39983 - RNA, 24 nt, Human
uucauuaagauaaagauggcuuuu

SEQ ID NO: 39984 - RNA, 24 nt, Human
ucuccagaaaugcuuuggguucau

SEQ ID NO: 39985 - RNA, 24 nt, Human
uugaucuugaagaaacugggcgug

SEQ ID NO: 39986 - RNA, 24 nt, Human
caugaaguaccacccuuugggggu

SEQ ID NO: 39987 - RNA, 24 nt, Human
aggaaggagauauagugaagagga

SEQ ID NO: 39988 - RNA, 24 nt, Human
guagaguuuucuucaggcuuaaag

SEQ ID NO: 39989 - RNA, 24 nt, Human
ccaccuggccauuaaggggaaagg

SEQ ID NO: 39990 - RNA, 24 nt, Human
ucccaguugaggggcacagggcug

SEQ ID NO: 39991 - RNA, 24 nt, Human
uguggauggccccuccgggaaacu

SEQ ID NO: 39992 - RNA, 21 nt, Human
cugcccccucugcugaugccc

SEQ ID NO: 39993 - RNA, 24 nt, Human
ccugggaggcgggggccccccucc

SEQ ID NO: 39994 - RNA, 23 nt, Human
acugaaucuccccuccucacagu

SEQ ID NO: 39995 - RNA, 24 nt, Human
aggaaggagauauagugaagagga

SEQ ID NO: 39996 - RNA, 24 nt, Human
uccgugcgcguugcugcggccgug

SEQ ID NO: 39997 - RNA, 24 nt, Human
guagaguuuucuucaggcuuaaag

SEQ ID NO: 39998 - RNA, 24 nt, Human
uucacaguggcuaaguucugcacc

SEQ ID NO: 39999 - RNA, 22 nt, Human
uggguuggcccuuaaagggggg

SEQ ID NO: 40000 - RNA, 24 nt, Human
cuuucaucuccaaccagccgggcg

SEQ ID NO: 40001 - RNA, 22 nt, Human
ucagccaagagcaaugggcggc

SEQ ID NO: 40002 - RNA, 24 nt, Human
gugcaucgcggccaacgcgggcgg

SEQ ID NO: 40003 - RNA, 24 nt, Human
ccgcagcuucagcaccucggccca

SEQ ID NO: 40004 - RNA, 24 nt, Human
aggcaucgggcagccacuuucacu

SEQ ID NO: 40005 - RNA, 24 nt, Human
gggaauuguuguaaauaaaaaccc

SEQ ID NO: 40006 - RNA, 24 nt, Human
ucccccaguacucccagcuggugc

SEQ ID NO: 40007 - RNA, 24 nt, Human
uuggacccuugacggagauccugg

SEQ ID NO: 40008 - RNA, 24 nt, Human
cuccccauccuacacaccuccuca

SEQ ID NO: 40009 - RNA, 24 nt, Human
ucugugcugcgguguguccagggg

SEQ ID NO: 40010 - RNA, 24 nt, Human
uuuaagaaauuccuacgugggaca

SEQ ID NO: 40011 - RNA, 24 nt, Human
aggguucguucccaggaagaaagu

SEQ ID NO: 40012 - RNA, 24 nt, Human
ucgagaccuggaagcuauggccag

SEQ ID NO: 40013 - RNA, 24 nt, Human
cgcccagagaucacgcacgcggua

SEQ ID NO: 40014 - RNA, 24 nt, Human
cuucugguucuccgcuccgccucg

SEQ ID NO: 40015 - RNA, 21 nt, Human
uugacaggggaggccuuggca

SEQ ID NO: 40016 - RNA, 24 nt, Human
ucacugccaccucuccgccccgga

SEQ ID NO: 40017 - RNA, 24 nt, Human
ucccuggaucuccucccuccuccc

SEQ ID NO: 40018 - RNA, 24 nt, Human
ucccagguucacccacccaggcuu

SEQ ID NO: 40019 - RNA, 23 nt, Human
accaagauggcggccguggggcg

SEQ ID NO: 40020 - RNA, 24 nt, Human
uugaccaacugaaaauuccuccug

SEQ ID NO: 40021 - RNA, 24 nt, Human
uguaguauucguggaccauguacu

SEQ ID NO: 40022 - RNA, 24 nt, Human
uagaauggcagcaugcaggacuug

SEQ ID NO: 40023 - RNA, 24 nt, Human
uggccaggcugcagcugaaugggc

SEQ ID NO: 40024 - RNA, 24 nt, Human
uucauuggaggguugagcuuugaa

SEQ ID NO: 40025 - RNA, 24 nt, Human
uuucauguuuguguuuugacugga

SEQ ID NO: 40026 - RNA, 24 nt, Human
ucugaucuauaaaugcgguggcau

SEQ ID NO: 40027 - RNA, 24 nt, Human
ucugaucuauaaaugcgguggcau

SEQ ID NO: 40028 - RNA, 19 nt, Human
ugauuugcucccagagaac

SEQ ID NO: 40029 - RNA, 24 nt, Human
uggccaggccaccugcaccaggga

SEQ ID NO: 40030 - RNA, 24 nt, Human
gcagucccgaggggucacaggcua

SEQ ID NO: 40031 - RNA, 24 nt, Human
uggcuugggucgagcucugucaca

SEQ ID NO: 40032 - RNA, 24 nt, Human
cuuugcugcugaugcuauggcccg

SEQ ID NO: 40033 - RNA, 24 nt, Human
ugcuagugaugaucugguaauaua

SEQ ID NO: 40034 - RNA, 24 nt, Human
aggaaacggguuuuugggugcuuc

SEQ ID NO: 40035 - RNA, 24 nt, Human
uuuccagaucuacgcugugccuug

SEQ ID NO: 40036 - RNA, 24 nt, Human
uaagagguuuuuaguuuuuguuuu

SEQ ID NO: 40037 - RNA, 24 nt, Human
cuggcagacggcucgcuuuucgua

SEQ ID NO: 40038 - RNA, 24 nt, Human
ucuauggucuauuccuauucuaga

SEQ ID NO: 40039 - RNA, 24 nt, Human
uugacccaggcucuuauagauagg

SEQ ID NO: 40040 - RNA, 24 nt, Human
ugaacagacuauaacuaggaaagg

SEQ ID NO: 40041 - RNA, 24 nt, Human
aaauuucuuuuuuuuuauuuaauu

SEQ ID NO: 40042 - RNA, 20 nt, Human
cacccuuugcugcugaccuc

SEQ ID NO: 40043 - RNA, 24 nt, Human
aaggaguacucgguguuccugacc

SEQ ID NO: 40044 - RNA, 18 nt, Human
uaucaaggaagggcaggc

SEQ ID NO: 40045 - RNA, 24 nt, Human
ucaguuaaaaaagaagaagaagaa

SEQ ID NO: 40046 - RNA, 24 nt, Human
ucugaucaauccuucuuuuucucu

SEQ ID NO: 40047 - RNA, 24 nt, Human
ucaauuuuuauuuugguuuucuua

SEQ ID NO: 40048 - RNA, 24 nt, Human
uggcugggcagggcaaggcugggc

SEQ ID NO: 40049 - RNA, 24 nt, Human
uagaagaugaaauugugggaagac

SEQ ID NO: 40050 - RNA, 24 nt, Human
ugacugguaaaaacuggauauuaa

SEQ ID NO: 40051 - RNA, 24 nt, Human
uuaguacgggucuagaagccaguu

SEQ ID NO: 40052 - RNA, 24 nt, Human
gugcauccuggacugaagagugag

SEQ ID NO: 40053 - RNA, 24 nt, Human
aggaagcaaaaaaggcuaagcaag

SEQ ID NO: 40054 - RNA, 19 nt, Human
uuaaugcgaaaugcgaguc

SEQ ID NO: 40055 - RNA, 17 nt, Human
uacauggauucugaaag

SEQ ID NO: 40056 - RNA, 24 nt, Human
aacaacauugguaaaucguuuucc

SEQ ID NO: 40057 - RNA, 24 nt, Human
ucccuugcaauuguucgccccucu

SEQ ID NO: 40058 - RNA, 24 nt, Human
uaaguggaauucuucauugagucg

SEQ ID NO: 40059 - RNA, 24 nt, Human
uggcuuggggcugcacuuuggcuc

SEQ ID NO: 40060 - RNA, 24 nt, Human
aggcagggccucucugcagcugcc

SEQ ID NO: 40061 - RNA, 23 nt, Human
uacccaggugcuguggcacuaac

SEQ ID NO: 40062 - RNA, 24 nt, Human
ucagaacaaucucucuuccuuggu

SEQ ID NO: 40063 - RNA, 19 nt, Human
ugcuucagugggccccugc

SEQ ID NO: 40064 - RNA, 22 nt, Human
uauccaguguaaauuguugagc

SEQ ID NO: 40065 - RNA, 24 nt, Human
uauucaguuggauuuggauauauu

SEQ ID NO: 40066 - RNA, 24 nt, Human
uauaccauuuuuccagaugcguau

SEQ ID NO: 40067 - RNA, 24 nt, Human
uuugaucuuuccccuuuaauuuga

SEQ ID NO: 40068 - RNA, 24 nt, Human
cauccagcuugggaacccgggaca

SEQ ID NO: 40069 - RNA, 24 nt, Human
uauggucccucagaaucacaguca

SEQ ID NO: 40070 - RNA, 24 nt, Human
ucaggcucagauagcugcuggccg

SEQ ID NO: 40071 - RNA, 24 nt, Human
ugggauccugcagcucuagucucc

SEQ ID NO: 40072 - RNA, 20 nt, Human
uaaaagguacauacuauucu

SEQ ID NO: 40073 - RNA, 24 nt, Human
aaagguacauacuauucugcacuu

SEQ ID NO: 40074 - RNA, 24 nt, Human
cugugccacgcguggcugcggaag

SEQ ID NO: 40075 - RNA, 24 nt, Human
augcaggcccugugggagcccacg

SEQ ID NO: 40076 - RNA, 24 nt, Human
cacgugccucuuuacucagcgcuc

SEQ ID NO: 40077 - RNA, 24 nt, Human
uacgugguccaugcgguguucucu

SEQ ID NO: 40078 - RNA, 24 nt, Human
gagcagcagccaaguccgcgggaa

SEQ ID NO: 40079 - RNA, 23 nt, Human
uucaaccuauacaaaaaggaaaa

SEQ ID NO: 40080 - RNA, 24 nt, Human
ugccggugcgagcggggcccggcu

SEQ ID NO: 40081 - RNA, 24 nt, Human
ucacaaggucaggaguucaagacc

SEQ ID NO: 40082 - RNA, 24 nt, Human
aucacgccacugcacuccagccug

SEQ ID NO: 40083 - RNA, 24 nt, Human
ucacugaauuuggcaguuauuauu

SEQ ID NO: 40084 - RNA, 22 nt, Human
ugugccugcagaggagcugcuc

SEQ ID NO: 40085 - RNA, 24 nt, Human
uaugcaaggucaagagcggagggg

SEQ ID NO: 40086 - RNA, 20 nt, Human
cauccuggugggaccuccgc

SEQ ID NO: 40087 - RNA, 24 nt, Human
gugcuccccgguccccaccccuac

SEQ ID NO: 40088 - RNA, 24 nt, Human
uaaauguaaggaguauauauuuug

SEQ ID NO: 40089 - RNA, 24 nt, Human
uaucacaucuuuuuacuuuuaaag

SEQ ID NO: 40090 - RNA, 24 nt, Human
uauuaugucaaaagcugaagcucu

SEQ ID NO: 40091 - RNA, 24 nt, Human
uaaaacauacccacaugagauucu

SEQ ID NO: 40092 - RNA, 24 nt, Human
ugagaagacauuccccuccugcca

SEQ ID NO: 40093 - RNA, 24 nt, Human
ugccagaacuuguaucaacuugag

SEQ ID NO: 40094 - RNA, 19 nt, Human
uaacauagcauuaaggugg

SEQ ID NO: 40095 - RNA, 24 nt, Human
ggauaucgucuuucaucacguucu

SEQ ID NO: 40096 - RNA, 24 nt, Human
uuaauauaguuucacuuuuuauuu

SEQ ID NO: 40097 - RNA, 24 nt, Human
uucauuuuaaagguuaaauuauga

SEQ ID NO: 40098 - RNA, 24 nt, Human
ugucuagucuugaaguccucauuu

SEQ ID NO: 40099 - RNA, 24 nt, Human
aauugcuugaacccgggaggugga

SEQ ID NO: 40100 - RNA, 24 nt, Human
ggagcaaaucccaccuuuacccca

SEQ ID NO: 40101 - RNA, 24 nt, Human
uucugccacgcuuuaugcccuugc

SEQ ID NO: 40102 - RNA, 24 nt, Human
agugguggggaggaggacgagaag

SEQ ID NO: 40103 - RNA, 24 nt, Human
ccgcagcuucagcaccucggccca

SEQ ID NO: 40104 - RNA, 24 nt, Human
uggcaauucggacgaggaggcguu

SEQ ID NO: 40105 - RNA, 24 nt, Human
uguugcugggcuugugaucuacgu

SEQ ID NO: 40106 - RNA, 23 nt, Human
uucggggaaguaguccuugacca

SEQ ID NO: 40107 - RNA, 18 nt, Human
cacagcguuuacaaaguu

SEQ ID NO: 40108 - RNA, 24 nt, Human
uaccuguacagaauggauuacaua

SEQ ID NO: 40109 - RNA, 24 nt, Human
ggccauggaaauuaguacagaacc

SEQ ID NO: 40110 - RNA, 24 nt, Human
uggccuggucuccucuccuccuca

SEQ ID NO: 40111 - RNA, 24 nt, Human
uacugggaccaacuacaacaucgg

SEQ ID NO: 40112 - RNA, 22 nt, Human
ugugcagaagaaauggaaggau

SEQ ID NO: 40113 - RNA, 24 nt, Human
accauccuggcagcccuggcccug

SEQ ID NO: 40114 - RNA, 24 nt, Human
uggggcccacaagggggggggucc

SEQ ID NO: 40115 - RNA, 24 nt, Human
ccuccaggcccccuccacucggcc

SEQ ID NO: 40116 - RNA, 24 nt, Human
cccccggggcuucaagggcgccuc

SEQ ID NO: 40117 - RNA, 24 nt, Human
aaaccccagccucagccaguccca

SEQ ID NO: 40118 - RNA, 24 nt, Human
guuucuguaaagagaaaaauuauc

SEQ ID NO: 40119 - RNA, 24 nt, Human
uugaauguaagugcaguagaaauu

SEQ ID NO: 40120 - RNA, 24 nt, Human
uugguggcuguggucggguguugc

SEQ ID NO: 40121 - RNA, 24 nt, Human
uccagguaggaggccaggcggucg

SEQ ID NO: 40122 - RNA, 24 nt, Human
cgaggacacaaagcgggcggagga

SEQ ID NO: 40123 - RNA, 24 nt, Human
uagugcaggaaaguggugauaagc

SEQ ID NO: 40124 - RNA, 24 nt, Human
uccgcgggacuucacaccaugugc

SEQ ID NO: 40125 - RNA, 24 nt, Human
uguaugcuuucacuguaaugaauc

SEQ ID NO: 40126 - RNA, 24 nt, Human
uggaagaugcucaacaccuccucc

SEQ ID NO: 40127 - RNA, 24 nt, Human
ugugcagaagaaauggaaggauuc

SEQ ID NO: 40128 - RNA, 24 nt, Human
uaucaaggaagggcaggcgugaug

SEQ ID NO: 40129 - RNA, 24 nt, Human
uucaaauuucuuucuuuuuuaauu

SEQ ID NO: 40130 - RNA, 24 nt, Human
ucaauuuuuauuuugguuuucuua

SEQ ID NO: 40131 - RNA, 24 nt, Human
ccacugcacuccagccugggagac

SEQ ID NO: 40132 - RNA, 21 nt, Human
aacacggugaaacuccgucuc

SEQ ID NO: 40133 - RNA, 23 nt, Human
uuuaucagacauauugcaccgac

SEQ ID NO: 40134 - RNA, 24 nt, Human
uaacagguguaagaguguugaaaa

SEQ ID NO: 40135 - RNA, 24 nt, Human
uaucaaggaagggcaggcgugaug

SEQ ID NO: 40136 - RNA, 24 nt, Human
ucaguuaaaaaagaagaagaagaa

SEQ ID NO: 40137 - RNA, 24 nt, Human
ucugaucaauccuucuuuuucucu

SEQ ID NO: 40138 - RNA, 24 nt, Human
ugcauuguuaucauuaaccagucu

SEQ ID NO: 40139 - RNA, 24 nt, Human
uauuagggauaauauucauuuagc

SEQ ID NO: 40140 - RNA, 24 nt, Human
uaaugggucucaaaauucugugac

SEQ ID NO: 40141 - RNA, 24 nt, Human
gaagugaaaauuguucaguccaag

SEQ ID NO: 40142 - RNA, 24 nt, Human
uagaauagagggugaugacgguaa

SEQ ID NO: 40143 - RNA, 24 nt, Human
uaacuggaguagaguuccugguug

SEQ ID NO: 40144 - RNA, 24 nt, Human
uaaugggucucaaaauucugugac

SEQ ID NO: 40145 - RNA, 24 nt, Human
ugagcaggcugagagugacaucau

SEQ ID NO: 40146 - RNA, 24 nt, Human
aggaacaaccugacucaggcucua

SEQ ID NO: 40147 - RNA, 21 nt, Human
uuucgcauagugccaagcacc

SEQ ID NO: 40148 - RNA, 24 nt, Human
aacucugcaagacuugguagaaaa

SEQ ID NO: 40149 - RNA, 24 nt, Human
gacuuguuguuucuucaaaacuuu

SEQ ID NO: 40150 - RNA, 23 nt, Human
uagaauucggcugugaauccauc

SEQ ID NO: 40151 - RNA, 24 nt, Human
augguauuucugguucuagauccu

SEQ ID NO: 40152 - RNA, 24 nt, Human
uaguacagaaggaaugguaccagu

SEQ ID NO: 40153 - RNA, 24 nt, Human
uacugugaauagugccgcaauaaa

SEQ ID NO: 40154 - RNA, 21 nt, Human
uuucugguucuagauccuugg

SEQ ID NO: 40155 - RNA, 24 nt, Human
ucuuugcuauugugaauagugccg

SEQ ID NO: 40156 - RNA, 21 nt, Human
uuucugguucuagauccuugg

SEQ ID NO: 40157 - RNA, 19 nt, Human
augcaugucaaugggaguu

SEQ ID NO: 40158 - RNA, 24 nt, Human
uguagagucaugccaguucuuagg

SEQ ID NO: 40159 - RNA, 24 nt, Human
uggaaugccgacauguggccuuuc

SEQ ID NO: 40160 - RNA, 24 nt, Human
ucgcagaaugggcugacucggagc

SEQ ID NO: 40161 - RNA, 24 nt, Human
aguggaaucauacaguauuugucu

SEQ ID NO: 40162 - RNA, 24 nt, Human
uuaauggucagcuuuucauguuua

SEQ ID NO: 40163 - RNA, 24 nt, Human
uccacgguggcugcaggcacaugc

SEQ ID NO: 40164 - RNA, 24 nt, Human
uucaugaggggccguagcuugagc

SEQ ID NO: 40165 - RNA, 24 nt, Human
ucccccugcucuaggccaaggugg

SEQ ID NO: 40166 - RNA, 24 nt, Human
agagggaagcccagggguccuguu

SEQ ID NO: 40167 - RNA, 24 nt, Human
gacugcuugcaauccuugacuagu

SEQ ID NO: 40168 - RNA, 24 nt, Human
gagcuuguuuuccugcaacuagac

SEQ ID NO: 40169 - RNA, 24 nt, Human
uaaggagcgugcaaccuacauccc

SEQ ID NO: 40170 - RNA, 24 nt, Human
agaaagacuuaagggagcagaggg

SEQ ID NO: 40171 - RNA, 24 nt, Human
uauaucucauaagagcaaagauac

SEQ ID NO: 40172 - RNA, 24 nt, Human
caggguccaauucaagauuacucu

SEQ ID NO: 40173 - RNA, 24 nt, Human
cuugcuuuaauaccugcuucuggc

SEQ ID NO: 40174 - RNA, 24 nt, Human
ucagaacgguuauacucaaaaaca

SEQ ID NO: 40175 - RNA, 24 nt, Human
gggcacugaagaugaugcgaccca

SEQ ID NO: 40176 - RNA, 24 nt, Human
uacagugcuuguaaaagguuugaa

SEQ ID NO: 40177 - RNA, 22 nt, Human
ucccuaaagaaaaagaugaaaa

SEQ ID NO: 40178 - RNA, 24 nt, Human
uaacuugauuuuuuacuauuauaa

SEQ ID NO: 40179 - RNA, 24 nt, Human
uguuguugaauucaagauggaaga

SEQ ID NO: 40180 - RNA, 18 nt, Human
ucccaugaaaugaaauua

SEQ ID NO: 40181 - RNA, 24 nt, Human
uagaucauuuauugaagacauacu

SEQ ID NO: 40182 - RNA, 24 nt, Human
uagguaaauaacucaauggacaac

SEQ ID NO: 40183 - RNA, 24 nt, Human
ucgaauggacacauuaccagugaa

SEQ ID NO: 40184 - RNA, 24 nt, Human
ggacagguguacagacauguuucu

SEQ ID NO: 40185 - RNA, 24 nt, Human
agagugaagaagagguuuucuuug

SEQ ID NO: 40186 - RNA, 24 nt, Human
uucaaauuucuuucuuuuuuaauu

SEQ ID NO: 40187 - RNA, 19 nt, Human
ucaguguccacagcgcaug

SEQ ID NO: 40188 - RNA, 24 nt, Human
ugaguacuuggccccggucacgcg

SEQ ID NO: 40189 - RNA, 24 nt, Human
acuuuuguggccuuuuuuccuuuu

SEQ ID NO: 40190 - RNA, 24 nt, Human
uuagugcccacucgcuagaugguu

SEQ ID NO: 40191 - RNA, 24 nt, Human
ugcgcgcgcacaugagcgcgugcu

SEQ ID NO: 40192 - RNA, 24 nt, Human
acgaaccgguguacacuugucagg

SEQ ID NO: 40193 - RNA, 24 nt, Human
uuggaacuaugaaaagcucuucuc

SEQ ID NO: 40194 - RNA, 24 nt, Human
uaguuugauuguagaaaucacauc

SEQ ID NO: 40195 - RNA, 24 nt, Human
uuuuacagccacuccagauuugua

SEQ ID NO: 40196 - RNA, 24 nt, Human
uccacuggcgaaagaugccuuucu

SEQ ID NO: 40197 - RNA, 24 nt, Human
uaguucagauugaucuuaggucaa

SEQ ID NO: 40198 - RNA, 24 nt, Human
acgcgcaaauucugaccaguccuc

SEQ ID NO: 40199 - RNA, 24 nt, Human
uagagccacuguugguauuuugau

SEQ ID NO: 40200 - RNA, 24 nt, Human
ugagauuuuagacagugauguuuu

SEQ ID NO: 40201 - RNA, 24 nt, Human
cagugcccacguuguuguauuccc

SEQ ID NO: 40202 - RNA, 24 nt, Human
cuuggcacaggucacuugcacaua

SEQ ID NO: 40203 - RNA, 24 nt, Human
uguggcuuucauuaauauaguucu

SEQ ID NO: 40204 - RNA, 24 nt, Human
ucucugaggagaccucacccacuc

SEQ ID NO: 40205 - RNA, 24 nt, Human
uaaaauaaagggaagacgcugcug

SEQ ID NO: 40206 - RNA, 24 nt, Human
uggaagaugcucaacaccuccucc

SEQ ID NO: 40207 - RNA, 24 nt, Human
ugggggccccccgcacccacaggg

SEQ ID NO: 40208 - RNA, 24 nt, Human
uaugaucaagguucacacaguuaa

SEQ ID NO: 40209 - RNA, 24 nt, Human
gggccauggguagggguuuggggg

SEQ ID NO: 40210 - RNA, 24 nt, Human
uaaggcacguucuuuccuuacugg

SEQ ID NO: 40211 - RNA, 24 nt, Human
ucuguccucuucucugcauaccgu

SEQ ID NO: 40212 - RNA, 24 nt, Human
agagauugaagacgggugggcaca

SEQ ID NO: 40213 - RNA, 24 nt, Human
uagcugaguucaugguugcuugaa

SEQ ID NO: 40214 - RNA, 24 nt, Human
uucaugcaaugguuguucuagaaa

SEQ ID NO: 40215 - RNA, 24 nt, Human
aaguguauuauugcauuuuuuaag

SEQ ID NO: 40216 - RNA, 24 nt, Human
cguaaagaaaauuauuugucuuuu

SEQ ID NO: 40217 - RNA, 24 nt, Human
ugccacgggaccauggaacagugc

SEQ ID NO: 40218 - RNA, 24 nt, Human
uaccaccagaguaguaauuuucca

SEQ ID NO: 40219 - RNA, 24 nt, Human
guggaucguguuuauggugaaucc

SEQ ID NO: 40220 - RNA, 21 nt, Human
uaagguaagguaaauuucaug

SEQ ID NO: 40221 - RNA, 24 nt, Human
uuuaauagagugaaaacagagcuc

SEQ ID NO: 40222 - RNA, 24 nt, Human
aaaguacuugccgcucuaccccug

SEQ ID NO: 40223 - RNA, 24 nt, Human
cuccauggccaaagcgagagcauu

SEQ ID NO: 40224 - RNA, 24 nt, Human
gucaagaagugaagacagaugguc

SEQ ID NO: 40225 - RNA, 24 nt, Human
agggagggaagcacagugggcagg

SEQ ID NO: 40226 - RNA, 24 nt, Human
guacauugagcgccaugcuuagcu

SEQ ID NO: 40227 - RNA, 24 nt, Human
uauccucgauagaaguaaggguca

SEQ ID NO: 40228 - RNA, 24 nt, Human
uaacaaaauauuucaccuuuucug

SEQ ID NO: 40229 - RNA, 24 nt, Human
ucuuuugugagcagugagugccua

SEQ ID NO: 40230 - RNA, 24 nt, Human
ugggauccuggguccugaggccuu

SEQ ID NO: 40231 - RNA, 24 nt, Human
ucuauaaucuauccugccaucagg

SEQ ID NO: 40232 - RNA, 24 nt, Human
uggaacuuuauuuuguuuaucagu

SEQ ID NO: 40233 - RNA, 24 nt, Human
uauuuggaauuuauauacaaccug

SEQ ID NO: 40234 - RNA, 24 nt, Human
caaccccacaacucuaagguucug

SEQ ID NO: 40235 - RNA, 24 nt, Human
ccugcugguuuccuccuuccacgc

SEQ ID NO: 40236 - RNA, 24 nt, Human
gugguuccuagacucacuuugugc

SEQ ID NO: 40237 - RNA, 24 nt, Human
caccugauucuauaggccaugugc

SEQ ID NO: 40238 - RNA, 24 nt, Human
ucaagguuuaauuuugcuuuaauc

SEQ ID NO: 40239 - RNA, 24 nt, Human
acgcaguagccauaaugccacacc

SEQ ID NO: 40240 - RNA, 24 nt, Human
uugguaguuggcuauggauuuucu

SEQ ID NO: 40241 - RNA, 24 nt, Human
gaucacucugcucugauuauggaa

SEQ ID NO: 40242 - RNA, 24 nt, Human
ucaguuaaaaaagaagaagaagaa

SEQ ID NO: 40243 - RNA, 24 nt, Human
ugaaucggccaacgcgcggggaga

SEQ ID NO: 40244 - RNA, 24 nt, Human
cggcugcggcgagcgguaucagcu

SEQ ID NO: 40245 - RNA, 24 nt, Human
ucaauaguuuaaguaacauuacaa

SEQ ID NO: 40246 - RNA, 20 nt, Human
ucaguaggaguuauaauacc

SEQ ID NO: 40247 - RNA, 23 nt, Human
ucuccaaguaacacaucaaguac

SEQ ID NO: 40248 - RNA, 24 nt, Human
uauaacccaaacuuuuuuuuuuuu

SEQ ID NO: 40249 - RNA, 24 nt, Human
uacuuagucacggggaugguggaa

SEQ ID NO: 40250 - RNA, 24 nt, Human
ugagcaguguaugucaggacuugu

SEQ ID NO: 40251 - RNA, 24 nt, Human
uagagcuagugaauuagccuauuu

SEQ ID NO: 40252 - RNA, 24 nt, Human
caaucauugaauacaaaacaaaua

SEQ ID NO: 40253 - RNA, 24 nt, Human
uacauggaugaggagacuggcaac

SEQ ID NO: 40254 - RNA, 24 nt, Human
cacccuacaaacaggcccccuaca

SEQ ID NO: 40255 - RNA, 24 nt, Human
uggaaaauaauggcaauuuauuaa

SEQ ID NO: 40256 - RNA, 24 nt, Human
ucucuugucuuuuuacuuagcaaa

SEQ ID NO: 40257 - RNA, 24 nt, Human
uuuaauauauuuguuggccagaga

SEQ ID NO: 40258 - RNA, 24 nt, Human
ucaaagaaguaagauggugaaaau

SEQ ID NO: 40259 - RNA, 24 nt, Human
uagguuagaauguaaauuaaagug

SEQ ID NO: 40260 - RNA, 24 nt, Human
ugacuuguaguaagcagguuucug

SEQ ID NO: 40261 - RNA, 24 nt, Human
ugcccagcugggcuggaaaaccgg

SEQ ID NO: 40262 - RNA, 24 nt, Human
ucuuuccagaaaauccaaguccgg

SEQ ID NO: 40263 - RNA, 24 nt, Human
ucucccaggcucuucuggagcugg

SEQ ID NO: 40264 - RNA, 24 nt, Human
ugcgggaaaugggggggucugaaa

SEQ ID NO: 40265 - RNA, 24 nt, Human
uaaccaaaaacauaaagcgauaau

SEQ ID NO: 40266 - RNA, 23 nt, Human
guccagagccucgucguccacug

SEQ ID NO: 40267 - RNA, 24 nt, Human
uaacacaagcauguggcucaucac

SEQ ID NO: 40268 - RNA, 24 nt, Human
aagcagccucuugucacagguuga

SEQ ID NO: 40269 - RNA, 23 nt, Human
uauucuggauguaauaucucugu

SEQ ID NO: 40270 - RNA, 24 nt, Human
acauguggcaaugggaugauucuc

SEQ ID NO: 40271 - RNA, 24 nt, Human
aagggcucacgagucgaaauauca

SEQ ID NO: 40272 - RNA, 24 nt, Human
uauugcguaauuccuuucaaauac

SEQ ID NO: 40273 - RNA, 24 nt, Human
aagcauauuuuucagcaaguacag

SEQ ID NO: 40274 - RNA, 24 nt, Human
ugguggaggaggguaaauauguca

SEQ ID NO: 40275 - RNA, 24 nt, Human
gaacaagagaaauaacugcagaaa

SEQ ID NO: 40276 - RNA, 24 nt, Human
uaaguucuguucaaggcaagaagu

SEQ ID NO: 40277 - RNA, 24 nt, Human
uauaaaacacuuauacagauaaau

SEQ ID NO: 40278 - RNA, 24 nt, Human
uugccagucugcucauccauguau

SEQ ID NO: 40279 - RNA, 24 nt, Human
uucaaauuucuuucuuuuuuaauu

SEQ ID NO: 40280 - RNA, 24 nt, Human
ucaauuuuuauuuugguuuucuua

SEQ ID NO: 40281 - RNA, 24 nt, Human
gcucauuugcaggggggagccaaa

SEQ ID NO: 40282 - RNA, 24 nt, Human
uauuagggauaauauucauuuagc

SEQ ID NO: 40283 - RNA, 24 nt, Human
uaaugggucucaaaauucugugac

SEQ ID NO: 40284 - RNA, 24 nt, Human
aucgagcauuucuggagggagcug

SEQ ID NO: 40285 - RNA, 24 nt, Human
uucagcuccaucaccauccuggag

SEQ ID NO: 40286 - RNA, 24 nt, Human
ugggaagggaugaucucugucucu

SEQ ID NO: 40287 - RNA, 24 nt, Human
uugaacagccgccuggaggagcag

SEQ ID NO: 40288 - RNA, 24 nt, Human
ugaaaguggcuguucuccugccuu

SEQ ID NO: 40289 - RNA, 17 nt, Human
ugaacagucugcaguca

SEQ ID NO: 40290 - RNA, 24 nt, Human
aagcugcaaaccauuuagggaguc

SEQ ID NO: 40291 - RNA, 24 nt, Human
uguaaauugcuuaaaucgcuuaaa

SEQ ID NO: 40292 - RNA, 24 nt, Human
uguuagucaagaguccucaguagg

SEQ ID NO: 40293 - RNA, 24 nt, Human
uaaaugguaaacgugauaucauga

SEQ ID NO: 40294 - RNA, 24 nt, Human
ucauggacuaaacuaggucaaagu

SEQ ID NO: 40295 - RNA, 22 nt, Human
gucaauauccauaaaugaaggg

SEQ ID NO: 40296 - RNA, 24 nt, Human
uacaugauuggcuugcccaauaca

SEQ ID NO: 40297 - RNA, 24 nt, Human
cuucaagugagccuccugccucug

SEQ ID NO: 40298 - RNA, 24 nt, Human
ucccaaaggccggcaagauggugu

SEQ ID NO: 40299 - RNA, 24 nt, Human
agccggugcugguggcccggcgcg

SEQ ID NO: 40300 - RNA, 24 nt, Human
ugagaucaagauggccuucgugcu

SEQ ID NO: 40301 - RNA, 24 nt, Human
uguacuggauuguuuuugcacucu

SEQ ID NO: 40302 - RNA, 24 nt, Human
uucacauuuaauacaaacuuucuu

SEQ ID NO: 40303 - RNA, 24 nt, Human
uaguaguaaggagaaucuuaaauc

SEQ ID NO: 40304 - RNA, 24 nt, Human
ugggaacugaugaggagaguaaca

SEQ ID NO: 40305 - RNA, 24 nt, Human
ggagaacaguccccugguacacug

SEQ ID NO: 40306 - RNA, 24 nt, Human
uaggagaagaaauaugggguaaaa

SEQ ID NO: 40307 - RNA, 24 nt, Human
uaggguguuaaucuuuaugugaaa

SEQ ID NO: 40308 - RNA, 24 nt, Human
aucagguuccguuuggggcccguc

SEQ ID NO: 40309 - RNA, 24 nt, Human
uggaagccacacacagcccgguug

SEQ ID NO: 40310 - RNA, 24 nt, Human
uggcaggcuggcgcuggcaggcag

SEQ ID NO: 40311 - RNA, 24 nt, Human
uauuugaaggcagaaaacacccua

SEQ ID NO: 40312 - RNA, 24 nt, Human
cguuggccgagggggccguacgga

SEQ ID NO: 40313 - RNA, 24 nt, Human
aaaggugcucauuuagagauucua

SEQ ID NO: 40314 - RNA, 24 nt, Human
acuggcaugaggacuauuggucuu

SEQ ID NO: 40315 - RNA, 18 nt, Human
uguggaggaucaaggcug

SEQ ID NO: 40316 - RNA, 24 nt, Human
acuggauucggaaugugcugauuu

SEQ ID NO: 40317 - RNA, 24 nt, Human
uccacagaaaacauccuggggucc

SEQ ID NO: 40318 - RNA, 24 nt, Human
ggccauggucucacacuagugcug

SEQ ID NO: 40319 - RNA, 24 nt, Human
ucgccaaucuggucggcauggcgg

SEQ ID NO: 40320 - RNA, 24 nt, Human
ccagcagugaguaucccuguugca

SEQ ID NO: 40321 - RNA, 24 nt, Human
aggcaguaccauacuuggaguuca

SEQ ID NO: 40322 - RNA, 24 nt, Human
acugcaguuuauuggacgugcguu

SEQ ID NO: 40323 - RNA, 24 nt, Human
ucugcacgacgcacuggcccagga

SEQ ID NO: 40324 - RNA, 24 nt, Human
ugaaggacgagcgugugcccaaga

SEQ ID NO: 40325 - RNA, 24 nt, Human
ucaguuaaaaaagaagaagaagaa

SEQ ID NO: 40326 - RNA, 24 nt, Human
uggcuuauuuguuuuguauucaau

SEQ ID NO: 40327 - RNA, 21 nt, Human
agacuagacucuauuauuauu

SEQ ID NO: 40328 - RNA, 24 nt, Human
ucucacucuguugcccagacugga

SEQ ID NO: 40329 - RNA, 24 nt, Human
ugagaacuaugcccaagguggucg

SEQ ID NO: 40330 - RNA, 24 nt, Human
uccagguuacagguagauuuaaaa

SEQ ID NO: 40331 - RNA, 24 nt, Human
uuccaggccuguguuguguggagg

SEQ ID NO: 40332 - RNA, 24 nt, Human
ugagggaucuuuacugaacgcagc

SEQ ID NO: 40333 - RNA, 24 nt, Human
ugaggacugggacagguacgugca

SEQ ID NO: 40334 - RNA, 24 nt, Human
uaugaggaguuaugccuaacaacu

SEQ ID NO: 40335 - RNA, 20 nt, Human
ucccgggguaaucacucccc

SEQ ID NO: 40336 - RNA, 24 nt, Human
uaaauuuucaguuucuacacacuu

SEQ ID NO: 40337 - RNA, 24 nt, Human
uuaguucugucaugccaggaauuu

SEQ ID NO: 40338 - RNA, 24 nt, Human
uugaugcugagauccauauuuagu

SEQ ID NO: 40339 - RNA, 21 nt, Human
cacuguauagcaggagaaaac

SEQ ID NO: 40340 - RNA, 24 nt, Human
ugggcacuccaguaaaaaugacau

SEQ ID NO: 40341 - RNA, 22 nt, Human
ucuaguguugucuugaucaaga

SEQ ID NO: 40342 - RNA, 24 nt, Human
cacacccaaacaaacccaagucaa

SEQ ID NO: 40343 - RNA, 24 nt, Human
uaauaggauggcaucuaauauuuu

SEQ ID NO: 40344 - RNA, 24 nt, Human
cgugcagacucgacagcaccugaa

SEQ ID NO: 40345 - RNA, 24 nt, Human
cuuuuccaugacugacauuuuuca

SEQ ID NO: 40346 - RNA, 24 nt, Human
cgcccgugccggagccgcccaagg

SEQ ID NO: 40347 - RNA, 24 nt, Human
uuaguccuauggagaacguccaug

SEQ ID NO: 40348 - RNA, 24 nt, Human
acccggaaguuagacuugcgacua

SEQ ID NO: 40349 - RNA, 24 nt, Human
cugcgggaggugcagacccugcgc

SEQ ID NO: 40350 - RNA, 24 nt, Human
ucuguagucaucacaggcuucccu

SEQ ID NO: 40351 - RNA, 24 nt, Human
uuaaugaagggauuaaguucauaa

SEQ ID NO: 40352 - RNA, 24 nt, Human
ugacuggucgauccucuuuauggc

SEQ ID NO: 40353 - RNA, 23 nt, Human
uaucaaagaaguuuguauggcuu

SEQ ID NO: 40354 - RNA, 24 nt, Human
uggaagguaaauauauguuaagaa

SEQ ID NO: 40355 - RNA, 24 nt, Human
uacuuuugcuuuuuauagugauua

SEQ ID NO: 40356 - RNA, 24 nt, Human
uacauagucauauacguaacaucu

SEQ ID NO: 40357 - RNA, 24 nt, Human
uauguaauauauaacuauaugacc

SEQ ID NO: 40358 - RNA, 24 nt, Human
uucaguuugaguuuagugaaaaaa

SEQ ID NO: 40359 - RNA, 24 nt, Human
caggagccacccagcugguccagc

SEQ ID NO: 40360 - RNA, 24 nt, Human
cugguccuugcaugugggcagcag

SEQ ID NO: 40361 - RNA, 24 nt, Human
gccacaauauuccuuuaagccaaa

SEQ ID NO: 40362 - RNA, 24 nt, Human
uugacuguacuucuauauccauga

SEQ ID NO: 40363 - RNA, 24 nt, Human
uggaaugugcaaaagaaaucaauu

SEQ ID NO: 40364 - RNA, 24 nt, Human
cugaagauacucaggguaaaaaga

SEQ ID NO: 40365 - RNA, 24 nt, Human
uccaguguagguggagaaacuucu

SEQ ID NO: 40366 - RNA, 24 nt, Human
uggcucucuuauauauuucuuuau

SEQ ID NO: 40367 - RNA, 24 nt, Human
ugagagcccugcagugugccugcg

SEQ ID NO: 40368 - RNA, 24 nt, Human
ugccggaggaguggucgcaugugg

SEQ ID NO: 40369 - RNA, 23 nt, Human
ugcguggaagaauacaccggggc

SEQ ID NO: 40370 - RNA, 24 nt, Human
guggagcaggcugaggcucugaag

SEQ ID NO: 40371 - RNA, 24 nt, Human
uggcauagugaaggcccugaaugu

SEQ ID NO: 40372 - RNA, 24 nt, Human
guggugcuccucauggaaccuugc

SEQ ID NO: 40373 - RNA, 24 nt, Human
ucuaccagaaagaacagugcccug

SEQ ID NO: 40374 - RNA, 23 nt, Human
guuacagaggcucaccugguggu

SEQ ID NO: 40375 - RNA, 24 nt, Human
cuuuaaguccucaucuucuuccuc

SEQ ID NO: 40376 - RNA, 24 nt, Human
uugaaacauucauuguuugcauuu

SEQ ID NO: 40377 - RNA, 24 nt, Human
uaguauagagauguggauguaguc

SEQ ID NO: 40378 - RNA, 24 nt, Human
ugagagccaugugcaagaggacag

SEQ ID NO: 40379 - RNA, 24 nt, Human
accuggguggauggagccgugcgu

SEQ ID NO: 40380 - RNA, 24 nt, Human
cuggcccgcaagggcccguggcug

SEQ ID NO: 40381 - RNA, 24 nt, Human
uugaucuugaagaaacugggcgug

SEQ ID NO: 40382 - RNA, 24 nt, Human
gcgcguugcugcggccgugguccg

SEQ ID NO: 40383 - RNA, 24 nt, Human
guagaguuuucuucaggcuuaaag

SEQ ID NO: 40384 - RNA, 24 nt, Human
ggacagguguggccagcuccagca

SEQ ID NO: 40385 - RNA, 24 nt, Human
ugggguucuugaaaacauuggaga

SEQ ID NO: 40386 - RNA, 21 nt, Human
cguuguacuuggucuugcccc

SEQ ID NO: 40387 - RNA, 24 nt, Human
aagcaggugcggcugccccaggac

SEQ ID NO: 40388 - RNA, 24 nt, Human
aagaugccgcauuuggauuggaug

SEQ ID NO: 40389 - RNA, 24 nt, Human
uauagagauuacuggcuuuaacag

SEQ ID NO: 40390 - RNA, 24 nt, Human
ugccaagggcagcugcugaccgcc

SEQ ID NO: 40391 - RNA, 24 nt, Human
ugccagaacuguaucaacuugagg

SEQ ID NO: 40392 - RNA, 19 nt, Human
uaacauagcauuaaggugg

SEQ ID NO: 40393 - RNA, 24 nt, Human
ggauaucgucuuucaucacguucu

SEQ ID NO: 40394 - RNA, 24 nt, Human
uauuuuauuuaaauaaggggaagc

SEQ ID NO: 40395 - RNA, 21 nt, Human
ugaaaggauuagagaaggauu

SEQ ID NO: 40396 - RNA, 24 nt, Human
ugaaagcccuggacaugaauucau

SEQ ID NO: 40397 - RNA, 24 nt, Human
acgggguuucaccauguugguuag

SEQ ID NO: 40398 - RNA, 24 nt, Human
uagagugcagauggcaugaucuca

SEQ ID NO: 40399 - RNA, 23 nt, Human
uucacauucauauacucccgcau

SEQ ID NO: 40400 - RNA, 18 nt, Human
ugaccaggccaggcugcu

SEQ ID NO: 40401 - RNA, 24 nt, Human
aggcauagaaggcgaagugguaga

SEQ ID NO: 40402 - RNA, 18 nt, Human
ucccuggugcagcuguac

SEQ ID NO: 40403 - RNA, 23 nt, Human
uuccugaccccugagaaagcagg

SEQ ID NO: 40404 - RNA, 24 nt, Human
uggcugucauuucacaagagcauc

SEQ ID NO: 40405 - RNA, 24 nt, Human
uccaucagacucuucacaacuauu

SEQ ID NO: 40406 - RNA, 24 nt, Human
augcuuacuuuuuguaauuguaac

SEQ ID NO: 40407 - RNA, 24 nt, Human
ugugugggagaucacugcggcgga

SEQ ID NO: 40408 - RNA, 24 nt, Human
gaggaccccgggccgcaggccccu

SEQ ID NO: 40409 - RNA, 24 nt, Human
agagugcgcugaccauccagcuga

SEQ ID NO: 40410 - RNA, 24 nt, Human
ggaguacagcgccaugcgggacca

SEQ ID NO: 40411 - RNA, 24 nt, Human
caccaguacagggagcagaucaaa

SEQ ID NO: 40412 - RNA, 24 nt, Human
uacaccaaccaagugggguggaua

SEQ ID NO: 40413 - RNA, 24 nt, Human
uggugcgagcaugugcguucagag

SEQ ID NO: 40414 - RNA, 24 nt, Human
ucacugcaaccuccgccuccuggg

SEQ ID NO: 40415 - RNA, 24 nt, Human
cuuggccuuggccuuggccuuggc

SEQ ID NO: 40416 - RNA, 24 nt, Human
cauuguuggccugcaucuucuuua

SEQ ID NO: 40417 - RNA, 24 nt, Human
gagcuugcggcugacacccuuugg

SEQ ID NO: 40418 - RNA, 24 nt, Human
cgagguuccuugggucauggugcc

SEQ ID NO: 40419 - RNA, 24 nt, Human
uacauggaugggcggggagguaac

SEQ ID NO: 40420 - RNA, 24 nt, Human
ugugugcgccgcucagugagaaca

SEQ ID NO: 40421 - RNA, 24 nt, Human
uuggucgauagcaaauauguagug

SEQ ID NO: 40422 - RNA, 17 nt, Human
ugggaaggugauacugu

SEQ ID NO: 40423 - RNA, 24 nt, Human
uuggaacuaccaagcauguggcuc

SEQ ID NO: 40424 - RNA, 24 nt, Human
uucauguguuagaacgggggcugg

SEQ ID NO: 40425 - RNA, 24 nt, Human
uuguaagaguggaauuaacugccc

SEQ ID NO: 40426 - RNA, 24 nt, Human
ccaguacagaucguuucucaucuc

SEQ ID NO: 40427 - RNA, 24 nt, Human
caugucaccuuucacccagcaaua

SEQ ID NO: 40428 - RNA, 24 nt, Human
uacccuuggaagaauuaugaauuu

SEQ ID NO: 40429 - RNA, 24 nt, Human
uucgacuuccuacagauuugacag

SEQ ID NO: 40430 - RNA, 24 nt, Human
ucagauggaacuggaagauguaug

SEQ ID NO: 40431 - RNA, 24 nt, Human
ugaagaaauuuauaguacccuacu

SEQ ID NO: 40432 - RNA, 24 nt, Human
accggaagggcagaauuuauuuuu

SEQ ID NO: 40433 - RNA, 24 nt, Human
ucagccuucauuuguucguggaug

SEQ ID NO: 40434 - RNA, 24 nt, Human
uagccagcaggauggaguccacgg

SEQ ID NO: 40435 - RNA, 19 nt, Human
uaagcuagccaccuucccc

SEQ ID NO: 40436 - RNA, 24 nt, Human
cagcagcacgugguucucguaagg

SEQ ID NO: 40437 - RNA, 24 nt, Human
ucuaauggcuuaccgagacagcuc

SEQ ID NO: 40438 - RNA, 24 nt, Human
aggaggccuuccgcacccgggaag

SEQ ID NO: 40439 - RNA, 24 nt, Human
ugaguucauaaguagugguuauag

SEQ ID NO: 40440 - RNA, 24 nt, Human
ucugcacaagcuggaaguguccuu

SEQ ID NO: 40441 - RNA, 24 nt, Human
ucuggauucgguucuuggcuggga

SEQ ID NO: 40442 - RNA, 24 nt, Human
ugguguggcgcauagugcagagcc

SEQ ID NO: 40443 - RNA, 24 nt, Human
acagcaaaguguggugcgaucucu

SEQ ID NO: 40444 - RNA, 24 nt, Human
aaugugacaugaauuauggaguag

SEQ ID NO: 40445 - RNA, 24 nt, Human
uuucucaguacaaagaauccguga

SEQ ID NO: 40446 - RNA, 24 nt, Human
uacauggaagaguauauaugggaa

SEQ ID NO: 40447 - RNA, 24 nt, Human
cacccugaagugcagaggguugcu

SEQ ID NO: 40448 - RNA, 24 nt, Human
uggcaagucacuuggugcccgggg

SEQ ID NO: 40449 - RNA, 24 nt, Human
ugaggaggaggaagaugaugauga

SEQ ID NO: 40450 - RNA, 23 nt, Human
ggugcagaccugcuuggaggccc

SEQ ID NO: 40451 - RNA, 24 nt, Human
cauugccuuauuucugcuagauca

SEQ ID NO: 40452 - RNA, 21 nt, Human
acccugagugugacgggaagg

SEQ ID NO: 40453 - RNA, 24 nt, Human
aagcagaaagggaagagaagcgag

SEQ ID NO: 40454 - RNA, 24 nt, Human
uucccaugccccaggcuccugcag

SEQ ID NO: 40455 - RNA, 24 nt, Human
auaguucuguuaauaacccacugu

SEQ ID NO: 40456 - RNA, 24 nt, Human
acugucucugccucuucccggaga

SEQ ID NO: 40457 - RNA, 24 nt, Human
uggaaggugacuuuaucaccuuaa

SEQ ID NO: 40458 - RNA, 24 nt, Human
uaaaaagcaugucgugauguacac

SEQ ID NO: 40459 - RNA, 24 nt, Human
cuacugcaaccucugccucccggg

SEQ ID NO: 40460 - RNA, 24 nt, Human
ucccuuaccuacauuguuccaaca

SEQ ID NO: 40461 - RNA, 24 nt, Human
aagcccuacgcauuauauagagga

SEQ ID NO: 40462 - RNA, 24 nt, Human
cuuugguaguuccuggaaaucauc

SEQ ID NO: 40463 - RNA, 19 nt, Human
gagcuuccagcagcugcuc

SEQ ID NO: 40464 - RNA, 20 nt, Human
uaaaaccagccugcaguaga

SEQ ID NO: 40465 - RNA, 24 nt, Human
ggguauggcucugcuccuuccugu

SEQ ID NO: 40466 - RNA, 24 nt, Human
ugucauaggcaucgacgaggggca

SEQ ID NO: 40467 - RNA, 24 nt, Human
uacacacugaacuggcaauaacau

SEQ ID NO: 40468 - RNA, 24 nt, Human
uaugugugugugugugugugugua

SEQ ID NO: 40469 - RNA, 24 nt, Human
cuagguccuuucuugaaagacucu

SEQ ID NO: 40470 - RNA, 24 nt, Human
aagguuuccuugagcuauuguuuu

SEQ ID NO: 40471 - RNA, 24 nt, Human
acuugcugccauugacuucuggcc

SEQ ID NO: 40472 - RNA, 24 nt, Human
aguugcuccagaaaaaccuguaaa

SEQ ID NO: 40473 - RNA, 24 nt, Human
uaaugggucucaaaauucugugac

SEQ ID NO: 40474 - RNA, 24 nt, Human
acuacuuccuauaaauuucuccug

SEQ ID NO: 40475 - RNA, 24 nt, Human
uaucauggaauuagaugacacuuu

SEQ ID NO: 40476 - RNA, 24 nt, Human
uucuaggucagucuaacaguuugc

SEQ ID NO: 40477 - RNA, 24 nt, Human
uaucagaguauauacacaugaggu

SEQ ID NO: 40478 - RNA, 24 nt, Human
gagcaugcaucuucucggugagcc

SEQ ID NO: 40479 - RNA, 24 nt, Human
uuccaaaauccacagauccaaaga

SEQ ID NO: 40480 - RNA, 24 nt, Human
ugaccuguguuggugggagaugac

SEQ ID NO: 40481 - RNA, 24 nt, Human
acagguacauagguaaccaaagua

SEQ ID NO: 40482 - RNA, 24 nt, Human
augcgcuugugaauguugauggug

SEQ ID NO: 40483 - RNA, 24 nt, Human
gaacccaggucacugcuggggcga

SEQ ID NO: 40484 - RNA, 24 nt, Human
ugggaaggaacacaggccuccagc

SEQ ID NO: 40485 - RNA, 24 nt, Human
acuacaggugcaugccacccauuu

SEQ ID NO: 40486 - RNA, 24 nt, Human
ucuuccucugucgcccaggcugga

SEQ ID NO: 40487 - RNA, 18 nt, Human
gauuacggaugugagcca

SEQ ID NO: 40488 - RNA, 24 nt, Human
ucuggcauauauuagcugugugac

SEQ ID NO: 40489 - RNA, 24 nt, Human
cauggaacuuggccucaguacguc

SEQ ID NO: 40490 - RNA, 24 nt, Human
ugagaggaaguuagaggggcuaga

SEQ ID NO: 40491 - RNA, 24 nt, Human
uacauggacaccggcgaggagauc

SEQ ID NO: 40492 - RNA, 19 nt, Human
ucagcagaugccaccacuu

SEQ ID NO: 40493 - RNA, 24 nt, Human
uuccuugcagugucaugggaagug

SEQ ID NO: 40494 - RNA, 24 nt, Human
uguuuuguuuuuugguaucacuua

SEQ ID NO: 40495 - RNA, 24 nt, Human
gucgccugagacccuccugagggg

SEQ ID NO: 40496 - RNA, 24 nt, Human
uuccauggggauccgcaguccaga

SEQ ID NO: 40497 - RNA, 24 nt, Human
aguggaguucgcugcgcgcuguug

SEQ ID NO: 40498 - RNA, 24 nt, Human
uucccuuuaaggggggggaaaugc

SEQ ID NO: 40499 - RNA, 24 nt, Human
acccgguggccgcccggaccugcu

SEQ ID NO: 40500 - RNA, 24 nt, Human
guuguccccucgccaaagggacgg

SEQ ID NO: 40501 - RNA, 24 nt, Human
uggcgccgccuguaccugaaaugc

SEQ ID NO: 40502 - RNA, 24 nt, Human
aagcauaguguaguggagaugauc

SEQ ID NO: 40503 - RNA, 24 nt, Human
ugagaacauauaacugggcguccc

SEQ ID NO: 40504 - RNA, 24 nt, Human
uaagcguaaauucccccguccaca

SEQ ID NO: 40505 - RNA, 24 nt, Human
uagaagaugaccucguuccggagc

SEQ ID NO: 40506 - RNA, 24 nt, Human
uugcccuuuuccuugacuauuaca

SEQ ID NO: 40507 - RNA, 18 nt, Human
gacacuuuugccaaugaa

SEQ ID NO: 40508 - RNA, 22 nt, Human
ugagcacauaguauguggcagg

SEQ ID NO: 40509 - RNA, 24 nt, Human
uacaguuuacagacaagagguuuc

SEQ ID NO: 40510 - RNA, 24 nt, Human
cggcugggcucggucgggcgcugu

SEQ ID NO: 40511 - RNA, 24 nt, Human
caccgggguuggggcgcggaggag

SEQ ID NO: 40512 - RNA, 24 nt, Human
uacgcuuccccaauggggucccca

SEQ ID NO: 40513 - RNA, 24 nt, Human
ggccagagcaccgaggagcugcgg

SEQ ID NO: 40514 - RNA, 24 nt, Human
ugacugcauuugguauugcauucc

SEQ ID NO: 40515 - RNA, 20 nt, Human
gucguuguaaagccagacuc

SEQ ID NO: 40516 - RNA, 23 nt, Human
uccgcgcgccgggagccggccgc

SEQ ID NO: 40517 - RNA, 24 nt, Human
agcuguuuugagaagccuucgggu

SEQ ID NO: 40518 - RNA, 24 nt, Human
ccagcacccuugacgucugggucc

SEQ ID NO: 40519 - RNA, 24 nt, Human
ugaguuagaauccaaaccagagcu

SEQ ID NO: 40520 - RNA, 24 nt, Human
acgcaaggcuucacagcuuuccaa

SEQ ID NO: 40521 - RNA, 24 nt, Human
ugccaacguuaggagugaaaauag

SEQ ID NO: 40522 - RNA, 24 nt, Human
aagcgcugggauuguucugaucuc

SEQ ID NO: 40523 - RNA, 24 nt, Human
uagcauacuuaugcacagagugaa

SEQ ID NO: 40524 - RNA, 24 nt, Human
uacaagaucacugacucugaggac

SEQ ID NO: 40525 - RNA, 24 nt, Human
gugggcccggccaggcuggcagau

SEQ ID NO: 40526 - RNA, 24 nt, Human
ucgcugcccucagcgcagagcuca

SEQ ID NO: 40527 - RNA, 24 nt, Human
agcuguguggggcccuggggcugg

SEQ ID NO: 40528 - RNA, 24 nt, Human
caccagcaccaagugccugguggu

SEQ ID NO: 40529 - RNA, 24 nt, Human
cgccggggccuccaggagcggugg

SEQ ID NO: 40530 - RNA, 24 nt, Human
acuccgugagcgccuccgccgguc

SEQ ID NO: 40531 - RNA, 24 nt, Human
ucacggucccggucccggucccug

SEQ ID NO: 40532 - RNA, 24 nt, Human
uuccugggugcuuugauguuaagu

SEQ ID NO: 40533 - RNA, 22 nt, Human
gccuaggggcagcuuugacucg

SEQ ID NO: 40534 - RNA, 24 nt, Human
cuggcagucauagaguucuauccg

SEQ ID NO: 40535 - RNA, 24 nt, Human
ccacaagcucugcggaccuuggcc

SEQ ID NO: 40536 - RNA, 24 nt, Human
caucaguuuagcccagagauagac

SEQ ID NO: 40537 - RNA, 22 nt, Human
aagaaaaccaaaaaaaaaggac

SEQ ID NO: 40538 - RNA, 24 nt, Human
aggaaccguggggacaaccgggau

SEQ ID NO: 40539 - RNA, 24 nt, Human
gagcaguuucugaccauccugccu

SEQ ID NO: 40540 - RNA, 24 nt, Human
acccugugggagccccaaauggcg

SEQ ID NO: 40541 - RNA, 24 nt, Human
uaugauauuaacgccugggcagcg

SEQ ID NO: 40542 - RNA, 24 nt, Human
ucacuggaaacucaccuccugggu

SEQ ID NO: 40543 - RNA, 24 nt, Human
ugucaaggaaugaagucucuagcc

SEQ ID NO: 40544 - RNA, 24 nt, Human
ugcauuguuaucauuaaccagucu

SEQ ID NO: 40545 - RNA, 24 nt, Human
ugcauuguuaucauuaaccagucu

SEQ ID NO: 40546 - RNA, 24 nt, Human
uauuagggauaauauucauuuagc

SEQ ID NO: 40547 - RNA, 24 nt, Human
uaaugggucucaaaauucugugac

SEQ ID NO: 40548 - RNA, 24 nt, Human
uguuauugcauguuuauuucuucu

SEQ ID NO: 40549 - RNA, 22 nt, Human
ugccugguaggagcggaggaca

SEQ ID NO: 40550 - RNA, 24 nt, Human
gaacugguccuuucacuuugagau

SEQ ID NO: 40551 - RNA, 18 nt, Human
ugccaggaucuggucucu

SEQ ID NO: 40552 - RNA, 24 nt, Human
ucuuaagugucaucuggcaucuuc

SEQ ID NO: 40553 - RNA, 24 nt, Human
acccaagaaauuucggauuucaac

SEQ ID NO: 40554 - RNA, 24 nt, Human
ugauauccuuguuuuuaacuguug

SEQ ID NO: 40555 - RNA, 19 nt, Human
cacccuugggcggcacggg

SEQ ID NO: 40556 - RNA, 24 nt, Human
ccccggagucacccgugggcggca

SEQ ID NO: 40557 - RNA, 24 nt, Human
acccauucagccccuuccgcuguc

SEQ ID NO: 40558 - RNA, 23 nt, Human
uuugcaccgucuauguggguaag

SEQ ID NO: 40559 - RNA, 22 nt, Human
ucgcugucggaccgcgacagcu

SEQ ID NO: 40560 - RNA, 24 nt, Human
cggcagccucagcggcucugaguc

SEQ ID NO: 40561 - RNA, 24 nt, Human
caagugguuugggauucagggcuu

SEQ ID NO: 40562 - RNA, 19 nt, Human
uguuauggccgcugaccgc

SEQ ID NO: 40563 - RNA, 24 nt, Human
ucucagauuacuucauugcucacc

SEQ ID NO: 40564 - RNA, 24 nt, Human
gucacuuaaacaagccaucuaucc

SEQ ID NO: 40565 - RNA, 24 nt, Human
caccguguuagccaggauggucuc

SEQ ID NO: 40566 - RNA, 24 nt, Human
aagcagcugaagauuucaacacau

SEQ ID NO: 40567 - RNA, 24 nt, Human
ugguaaggaauaaaaaauguacag

SEQ ID NO: 40568 - RNA, 24 nt, Human
ugagcauaauaaaguguagaaaug

SEQ ID NO: 40569 - RNA, 24 nt, Human
acgcauauuugaccuucucucgaa

SEQ ID NO: 40570 - RNA, 24 nt, Human
ugauguuccgggugugcauccccu

SEQ ID NO: 40571 - RNA, 24 nt, Human
ucgcuucgggugcucgacuccugu

SEQ ID NO: 40572 - RNA, 24 nt, Human
cccugguucgugccgaagggaccc

SEQ ID NO: 40573 - RNA, 21 nt, Human
ugguaugggugcggucuuccc

SEQ ID NO: 40574 - RNA, 24 nt, Human
uacuugguguaaagaacuuaauuu

SEQ ID NO: 40575 - RNA, 24 nt, Human
ugagauccauauuuaguuuuauaa

SEQ ID NO: 40576 - RNA, 24 nt, Human
uaaauuuucaguuucuacacacuu

SEQ ID NO: 40577 - RNA, 24 nt, Human
agcuagaacaaugcagauucaucc

SEQ ID NO: 40578 - RNA, 24 nt, Human
uaauauguuaaaaacauuuugcuu

SEQ ID NO: 40579 - RNA, 24 nt, Human
uuuaagauggauauuugguggcuc

SEQ ID NO: 40580 - RNA, 24 nt, Human
cuagaccauauuuucaagucaucu

SEQ ID NO: 40581 - RNA, 18 nt, Human
uuccucgcgcaaaaaggc

SEQ ID NO: 40582 - RNA, 24 nt, Human
cuggugcggacgccggcagauguu

SEQ ID NO: 40583 - RNA, 24 nt, Human
ugacaaggugagagggagaggagg

SEQ ID NO: 40584 - RNA, 24 nt, Human
uucaacaagugaagguuuauuacu

SEQ ID NO: 40585 - RNA, 24 nt, Human
gucccuuugugguacgugcuuucc

SEQ ID NO: 40586 - RNA, 24 nt, Human
uaagagaaaauacuuccucuguuc

SEQ ID NO: 40587 - RNA, 24 nt, Human
ucccggugcucugcgagaucuccc

SEQ ID NO: 40588 - RNA, 24 nt, Human
cauugcccagaguugcacuugcug

SEQ ID NO: 40589 - RNA, 24 nt, Human
aguuuuuuaaaccucugaauuugu

SEQ ID NO: 40590 - RNA, 24 nt, Human
uaagcuccucugagcagggucgac

SEQ ID NO: 40591 - RNA, 24 nt, Human
ugucaguauuugcauggcuuguac

SEQ ID NO: 40592 - RNA, 24 nt, Human
cagaacaugaucaaggguguuaca

SEQ ID NO: 40593 - RNA, 24 nt, Human
ccccugagggagaggaaaggugaa

SEQ ID NO: 40594 - RNA, 23 nt, Human
uuacaacaaucgagugcuggaca

SEQ ID NO: 40595 - RNA, 24 nt, Human
uguguuguuuuguuuuuauuuuua

SEQ ID NO: 40596 - RNA, 24 nt, Human
caccgguaguuucccgucuuugca

SEQ ID NO: 40597 - RNA, 24 nt, Human
gcgcaucuauaaauuuucacacaa

SEQ ID NO: 40598 - RNA, 24 nt, Human
uauuacagauuguucaaaaauguc

SEQ ID NO: 40599 - RNA, 24 nt, Human
uuccuucucggcaccaccuggauc

SEQ ID NO: 40600 - RNA, 24 nt, Human
ggauauagggucgaagccgcacuc

SEQ ID NO: 40601 - RNA, 24 nt, Human
uuuguagucacucauaggccagac

SEQ ID NO: 40602 - RNA, 24 nt, Human
uaauauguuaaaaacauuuugcuu

SEQ ID NO: 40603 - RNA, 24 nt, Human
ugauauuuaaaacauuuauguggu

SEQ ID NO: 40604 - RNA, 24 nt, Human
ugaccugaaauuuuuaguauuuac

SEQ ID NO: 40605 - RNA, 24 nt, Human
cacuguguucaauuuugaguuucc

SEQ ID NO: 40606 - RNA, 24 nt, Human
ucacucgugcucggccccagggac

SEQ ID NO: 40607 - RNA, 23 nt, Human
ugucgcggucugugaguuugucu

SEQ ID NO: 40608 - RNA, 17 nt, Human
uuauaggugugcaccac

SEQ ID NO: 40609 - RNA, 24 nt, Human
uuugcauuuaaauuuuuaucuuau

SEQ ID NO: 40610 - RNA, 24 nt, Human
uuuuuguuuuugugugugugugcu

SEQ ID NO: 40611 - RNA, 24 nt, Human
uuaaaaauauuuauccuguuagaa

SEQ ID NO: 40612 - RNA, 24 nt, Human
uggcaagauugcagcaagaucaug

SEQ ID NO: 40613 - RNA, 24 nt, Human
uuaaaaagcaaaauaaacuugguu

SEQ ID NO: 40614 - RNA, 24 nt, Human
ugaggcuguggccuccaaaggguc

SEQ ID NO: 40615 - RNA, 24 nt, Human
cagagcacucgcggcguggguggg

SEQ ID NO: 40616 - RNA, 24 nt, Human
ucagagagcaacgcgagaaggauu

SEQ ID NO: 40617 - RNA, 17 nt, Human
uaggaggccucaccugc

SEQ ID NO: 40618 - RNA, 19 nt, Human
gacacuguuucggacucgu

SEQ ID NO: 40619 - RNA, 24 nt, Human
ccaccucggccggcgagcgcgccc

SEQ ID NO: 40620 - RNA, 24 nt, Human
uaccauuucuucaaauucuacugc

SEQ ID NO: 40621 - RNA, 24 nt, Human
gaccgggauccugaggcugguaac

SEQ ID NO: 40622 - RNA, 18 nt, Human
aagcagguaucgguuuua

SEQ ID NO: 40623 - RNA, 24 nt, Human
cuuuauguacaagccuuagggaag

SEQ ID NO: 40624 - RNA, 21 nt, Human
uaggacccaggacauugccac

SEQ ID NO: 40625 - RNA, 24 nt, Human
ugucuuggucuugugcuucuccuu

SEQ ID NO: 40626 - RNA, 24 nt, Human
ugccauaugguuuuucagaaacau

SEQ ID NO: 40627 - RNA, 24 nt, Human
uacagcuuugcacacugacaggag

SEQ ID NO: 40628 - RNA, 24 nt, Human
uaucaaggaagggcaaggcgugau

SEQ ID NO: 40629 - RNA, 24 nt, Human
uugucaugaauauggacaaaaccu

SEQ ID NO: 40630 - RNA, 24 nt, Human
uuugaauuuauauuuacuagcuac

SEQ ID NO: 40631 - RNA, 24 nt, Human
uaggaggguguugauuagaggaag

SEQ ID NO: 40632 - RNA, 24 nt, Human
aagcaggaucuagguauuuaggua

SEQ ID NO: 40633 - RNA, 24 nt, Human
uagcaucaugaauuugcuuuucuc

SEQ ID NO: 40634 - RNA, 24 nt, Human
uguggaggugcucauggggugcgg

SEQ ID NO: 40635 - RNA, 22 nt, Human
uuagaacauaacuugcugaagu

SEQ ID NO: 40636 - RNA, 24 nt, Human
uuagauucuuuuauuuuuuuaauu

SEQ ID NO: 40637 - RNA, 24 nt, Human
uacugauuuuuugagaccaaggau

SEQ ID NO: 40638 - RNA, 24 nt, Human
ucuaaaacaauacuuuuuuaaaaa

SEQ ID NO: 40639 - RNA, 24 nt, Human
ugcgacugccugcagggcuuccag

SEQ ID NO: 40640 - RNA, 24 nt, Human
agcaaggugcgugaggaguaugcc

SEQ ID NO: 40641 - RNA, 24 nt, Human
ucaugauugagcgcgugguggggg

SEQ ID NO: 40642 - RNA, 24 nt, Human
ugauuagauuuacacagagcuuuu

SEQ ID NO: 40643 - RNA, 24 nt, Human
cacgcagaaaaaguauguagcgac

SEQ ID NO: 40644 - RNA, 24 nt, Human
ugacuagggcgcaguugcucauac

SEQ ID NO: 40645 - RNA, 24 nt, Human
uagaagccuuugaccaagcagguc

SEQ ID NO: 40646 - RNA, 24 nt, Human
aaggacuccuacgugggcgacgag

SEQ ID NO: 40647 - RNA, 24 nt, Human
acucuguucuuccgccgcuccgcc

SEQ ID NO: 40648 - RNA, 24 nt, Human
ugggguggugggaagcuugggagc

SEQ ID NO: 40649 - RNA, 24 nt, Human
uuuuguuugauuugcggcguuccu

SEQ ID NO: 40650 - RNA, 24 nt, Human
ugagcuuagggucuuccucugacu

SEQ ID NO: 40651 - RNA, 24 nt, Human
ugucacaccuuugcuuauggccug

SEQ ID NO: 40652 - RNA, 24 nt, Human
cuuggccucuucuuuccggcagga

SEQ ID NO: 40653 - RNA, 24 nt, Human
ugaaaucauaaagccuuuugacaa

SEQ ID NO: 40654 - RNA, 24 nt, Human
ugaaacagaaaccugugcuaaaau

SEQ ID NO: 40655 - RNA, 24 nt, Human
ugugaaagaaagggcccagggugu

SEQ ID NO: 40656 - RNA, 24 nt, Human
aauuaugugccuuuacugcagcuu

SEQ ID NO: 40657 - RNA, 24 nt, Human
uucauuauuuuauaugucauaugu

SEQ ID NO: 40658 - RNA, 24 nt, Human
ucucacugucacccaggcuggagu

SEQ ID NO: 40659 - RNA, 23 nt, Human
ugaccaagguauuaagcucagca

SEQ ID NO: 40660 - RNA, 23 nt, Human
cagcaucugcacauauuuccugc

SEQ ID NO: 40661 - RNA, 24 nt, Human
uucagugggauuucucacuccauc

SEQ ID NO: 40662 - RNA, 24 nt, Human
agauauuuuuuuaguucgagagac

SEQ ID NO: 40663 - RNA, 24 nt, Human
auaucauuuaaacgaaugagcaau

SEQ ID NO: 40664 - RNA, 24 nt, Human
uagagucuauaguuuacacuuuua

SEQ ID NO: 40665 - RNA, 24 nt, Human
uucaauaauuaacucuagcacgua

SEQ ID NO: 40666 - RNA, 24 nt, Human
caagugacagcagaacugaaaaug

SEQ ID NO: 40667 - RNA, 24 nt, Human
uacaagauuuuuaaaauuuuucuu

SEQ ID NO: 40668 - RNA, 24 nt, Human
ucaccagaaagcaaccaacuuagc

SEQ ID NO: 40669 - RNA, 24 nt, Human
cugcugcgcaccccagcuaagguu

SEQ ID NO: 40670 - RNA, 24 nt, Human
ucugccagguuuucuugggcaaug

SEQ ID NO: 40671 - RNA, 24 nt, Human
uggccagcgucuuugaccaguuua

SEQ ID NO: 40672 - RNA, 24 nt, Human
uggcauagaugacagcaucucuca

SEQ ID NO: 40673 - RNA, 24 nt, Human
uaggauaaacacauggcacaguaa

SEQ ID NO: 40674 - RNA, 24 nt, Human
cuggagcagguccaccggccccua

SEQ ID NO: 40675 - RNA, 24 nt, Human
gugcagaaugagggccgaguagau

SEQ ID NO: 40676 - RNA, 24 nt, Human
aagccccauuucuuugagaagugg

SEQ ID NO: 40677 - RNA, 24 nt, Human
acaccauccggaagaugaagaacg

SEQ ID NO: 40678 - RNA, 23 nt, Human
aagagcacugaucguacuggcuc

SEQ ID NO: 40679 - RNA, 20 nt, Human
uguccagaauuuccagaagu

SEQ ID NO: 40680 - RNA, 24 nt, Human
ugagugcccccaggaggggcuggg

SEQ ID NO: 40681 - RNA, 24 nt, Human
uguggcccuucucuuuaaguccga

SEQ ID NO: 40682 - RNA, 21 nt, Human
uacuguguaacaaaucacugc

SEQ ID NO: 40683 - RNA, 24 nt, Human
ccccauugcacuccagccugggca

SEQ ID NO: 40684 - RNA, 24 nt, Human
aaagacauagaaaaaggcuuugcc

SEQ ID NO: 40685 - RNA, 24 nt, Human
ugaggugugagugaaaugagcuuu

SEQ ID NO: 40686 - RNA, 24 nt, Human
uccguaccugcagugggugcgcca

SEQ ID NO: 40687 - RNA, 24 nt, Human
ugucuagucuugaagucccucauu

SEQ ID NO: 40688 - RNA, 24 nt, Human
uggggaaaaacauuaaaauuaaaa

SEQ ID NO: 40689 - RNA, 24 nt, Human
uucuuuguauaauaaugggaaguu

SEQ ID NO: 40690 - RNA, 24 nt, Human
ucccuaauguucuuccucuaguca

SEQ ID NO: 40691 - RNA, 24 nt, Human
uccauuguguuuugccgaucuucu

SEQ ID NO: 40692 - RNA, 24 nt, Human
uguuugcuguuuuccaucaugugu

SEQ ID NO: 40693 - RNA, 24 nt, Human
aacaagacuggaaauaguuuagaa

SEQ ID NO: 40694 - RNA, 23 nt, Human
ugucggaaugggguuaaccuuuc

SEQ ID NO: 40695 - RNA, 24 nt, Human
cgggaucucggcggucagauaaua

SEQ ID NO: 40696 - RNA, 24 nt, Human
uuguucaguuccucgucguugcgu

SEQ ID NO: 40697 - RNA, 18 nt, Human
uguugcauguuuguaguc

SEQ ID NO: 40698 - RNA, 23 nt, Human
ccagaaaaggugucacacuuuug

SEQ ID NO: 40699 - RNA, 24 nt, Human
agguaugugcaggggacuccugga

SEQ ID NO: 40700 - RNA, 24 nt, Human
uguggagacucagucugugaagcu

SEQ ID NO: 40701 - RNA, 24 nt, Human
uuaguauuauuuauuugacaacuc

SEQ ID NO: 40702 - RNA, 24 nt, Human
uguucuggagcuguuggacaaaua

SEQ ID NO: 40703 - RNA, 24 nt, Human
uggcacuaaauuucucagucuuuu

SEQ ID NO: 40704 - RNA, 24 nt, Human
ucccggagacgccgacucgcgauc

SEQ ID NO: 40705 - RNA, 24 nt, Human
uaccagcacacccuaaagagagga

SEQ ID NO: 40706 - RNA, 24 nt, Human
uagaaaguuggagucaaacacugg

SEQ ID NO: 40707 - RNA, 24 nt, Human
uaguauaguaaauacauaaaccag

SEQ ID NO: 40708 - RNA, 24 nt, Human
uauugcaauacauauggcaucacu

SEQ ID NO: 40709 - RNA, 24 nt, Human
ccucucugaccgguuggccaggga

SEQ ID NO: 40710 - RNA, 24 nt, Human
uaaacgggucuucaaggugguaga

SEQ ID NO: 40711 - RNA, 24 nt, Human
cuuugaugaggccuuuguucggga

SEQ ID NO: 40712 - RNA, 23 nt, Human
uggcucgaugguuacucggugac

SEQ ID NO: 40713 - RNA, 24 nt, Human
uaaugccaacugaagaaaauauug

SEQ ID NO: 40714 - RNA, 17 nt, Human
uuucaggggcuuuauag

SEQ ID NO: 40715 - RNA, 24 nt, Human
ugccuuggugcacucuagagacgg

SEQ ID NO: 40716 - RNA, 24 nt, Human
ugaaauagaaauaugaauagcauu

SEQ ID NO: 40717 - RNA, 24 nt, Human
gggcaggcgcccgucgacccuucg

SEQ ID NO: 40718 - RNA, 24 nt, Human
caagacagugaugaugaaaaaaug

SEQ ID NO: 40719 - RNA, 24 nt, Human
cagcccacguacaucucuccuccu

SEQ ID NO: 40720 - RNA, 24 nt, Human
ugaguaccauucugcaaaggauuc

SEQ ID NO: 40721 - RNA, 24 nt, Human
ugacaggagaaggcuuguuuggca

SEQ ID NO: 40722 - RNA, 23 nt, Human
ucccugggcgacguggguuucug

SEQ ID NO: 40723 - RNA, 24 nt, Human
aaaguuaaagcgaugccauuaguu

SEQ ID NO: 40724 - RNA, 17 nt, Human
uauguuaucaggcuaca

SEQ ID NO: 40725 - RNA, 24 nt, Human
auccauccguuuugcauuggaaau

SEQ ID NO: 40726 - RNA, 24 nt, Human
auaaacuugucucacuuuacucug

SEQ ID NO: 40727 - RNA, 21 nt, Human
cacaggaccucaaggugggcc

SEQ ID NO: 40728 - RNA, 24 nt, Human
cuuggcuacuaacaucauccagcc

SEQ ID NO: 40729 - RNA, 24 nt, Human
gauggcaagaacugcuggagacac

SEQ ID NO: 40730 - RNA, 24 nt, Human
ucgcucuccucuggggacugcaga

SEQ ID NO: 40731 - RNA, 24 nt, Human
ccgggcccugguucgugccgaagg

SEQ ID NO: 40732 - RNA, 17 nt, Human
uagaaaauaaacauguu

SEQ ID NO: 40733 - RNA, 19 nt, Human
uggaagaacacaaggaaaa

SEQ ID NO: 40734 - RNA, 24 nt, Human
uugaucuugaagaaacugggcgug

SEQ ID NO: 40735 - RNA, 23 nt, Human
uccgugcgcguugcugcggccgu

SEQ ID NO: 40736 - RNA, 24 nt, Human
aggaaggagauauagugaagagga

SEQ ID NO: 40737 - RNA, 24 nt, Human
guagaguuuucuucaggcuuaaag

SEQ ID NO: 40738 - RNA, 24 nt, Human
cagcggacuuuaggggauuacagg

SEQ ID NO: 40739 - RNA, 24 nt, Human
ugugagaaguagauaggguuacug

SEQ ID NO: 40740 - RNA, 24 nt, Human
ccagcucguggagcagguccaccg

SEQ ID NO: 40741 - RNA, 24 nt, Human
gugcagaaugagggccgaguagau

SEQ ID NO: 40742 - RNA, 24 nt, Human
ccaggccaaaaaggcucaacauuu

SEQ ID NO: 40743 - RNA, 24 nt, Human
ucacugccacccagaagacuguug

SEQ ID NO: 40744 - RNA, 24 nt, Human
ucgcucagacaccauggggaaggu

SEQ ID NO: 40745 - RNA, 24 nt, Human
gcucauuugcaggggggagccaaa

SEQ ID NO: 40746 - RNA, 24 nt, Human
ucccaacacaaggugggcagggag

SEQ ID NO: 40747 - RNA, 24 nt, Human
uucugguuagcucagccccagccc

SEQ ID NO: 40748 - RNA, 24 nt, Human
aagcguuuugagcagaaaggauuc

SEQ ID NO: 40749 - RNA, 24 nt, Human
acccugaggaacugguagauuaca

SEQ ID NO: 40750 - RNA, 24 nt, Human
ugagaaugaccccaagaccuuuga

SEQ ID NO: 40751 - RNA, 24 nt, Human
ugugaacgggaagaaggugcugca

SEQ ID NO: 40752 - RNA, 24 nt, Human
cuuccaaucugaugggcauguuug

SEQ ID NO: 40753 - RNA, 22 nt, Human
guggagggcagcuuugucuaca

SEQ ID NO: 40754 - RNA, 24 nt, Human
uggcaaguuuggggccuacaugca

SEQ ID NO: 40755 - RNA, 24 nt, Human
ugaugggccugugaccauagagcu

SEQ ID NO: 40756 - RNA, 24 nt, Human
uagaagaaugaacuaaggugucua

SEQ ID NO: 40757 - RNA, 24 nt, Human
cagcagacgcuucaugauaggaag

SEQ ID NO: 40758 - RNA, 22 nt, Human
caacacagcacccuccuccugu

SEQ ID NO: 40759 - RNA, 23 nt, Human
ucccgugugcccgagagcgccgg

SEQ ID NO: 40760 - RNA, 24 nt, Human
uuccauugacauucuuagcacagc

SEQ ID NO: 40761 - RNA, 24 nt, Human
uauaaugaggcacggcuuauugca

SEQ ID NO: 40762 - RNA, 24 nt, Human
gucccaaaggcagaaggcaguauu

SEQ ID NO: 40763 - RNA, 24 nt, Human
uucuuggucuuggaggcgaagccg

SEQ ID NO: 40764 - RNA, 24 nt, Human
gucacuugugguauugauguggac

SEQ ID NO: 40765 - RNA, 24 nt, Human
uugcuggggacgacgcuccccgag

SEQ ID NO: 40766 - RNA, 24 nt, Human
uggguugggaucagggguaggaau

SEQ ID NO: 40767 - RNA, 24 nt, Human
ugacggggcuugagguccucaggg

SEQ ID NO: 40768 - RNA, 24 nt, Human
ugauugacaacacccauuuuuccu

SEQ ID NO: 40769 - RNA, 24 nt, Human
uaaugucgggacaucaucuucacc

SEQ ID NO: 40770 - RNA, 24 nt, Human
uaagaagaugugggucuccaaaaa

SEQ ID NO: 40771 - RNA, 24 nt, Human
aggaacccaaggcgugaacgaugg

SEQ ID NO: 40772 - RNA, 24 nt, Human
ugcaauguauuuuccugcuuuuca

SEQ ID NO: 40773 - RNA, 24 nt, Human
uuggauccuagaguuguuuccagu

SEQ ID NO: 40774 - RNA, 18 nt, Human
gugcauguggauugauac

SEQ ID NO: 40775 - RNA, 24 nt, Human
uuagcauuggaauucugaaggcuu

SEQ ID NO: 40776 - RNA, 24 nt, Human
ucugcauucucgcuuccuggaggg

SEQ ID NO: 40777 - RNA, 24 nt, Human
uggccuugucuguggagacggauu

SEQ ID NO: 40778 - RNA, 24 nt, Human
gagagcacgauuuauuguggugac

SEQ ID NO: 40779 - RNA, 24 nt, Human
aguuauguuugaaugcgauaaggg

SEQ ID NO: 40780 - RNA, 24 nt, Human
uuugcacgucccuauggcagggag

SEQ ID NO: 40781 - RNA, 24 nt, Human
ggaggagacagaggcgauggugcg

SEQ ID NO: 40782 - RNA, 24 nt, Human
ccgcaaccuccaccuccagguuuc

SEQ ID NO: 40783 - RNA, 24 nt, Human
uccacaacuguaguaucauacaga

SEQ ID NO: 40784 - RNA, 24 nt, Human
ucuauaguuuacauuagaguucac

SEQ ID NO: 40785 - RNA, 24 nt, Human
ucuuagugugauagacuaccacgc

SEQ ID NO: 40786 - RNA, 21 nt, Human
ugugauagugucgacggugag

SEQ ID NO: 40787 - RNA, 24 nt, Human
uccugcagcguccacacagaggca

SEQ ID NO: 40788 - RNA, 24 nt, Human
uaugguguuugcgucauucauccg

SEQ ID NO: 40789 - RNA, 24 nt, Human
ucuuccuugcucagaagaugauga

SEQ ID NO: 40790 - RNA, 24 nt, Human
ugccguggaggccucuucaagugc

SEQ ID NO: 40791 - RNA, 24 nt, Human
uagcaguaggaacgggggccgccg

SEQ ID NO: 40792 - RNA, 24 nt, Human
cgugcaguaccaguucgagaugga

SEQ ID NO: 40793 - RNA, 24 nt, Human
agaauggagggccagucccggaau

SEQ ID NO: 40794 - RNA, 24 nt, Human
uggcaccauggaugccuucgugaa

SEQ ID NO: 40795 - RNA, 24 nt, Human
uggaagacagcuacgggcagcagu

SEQ ID NO: 40796 - RNA, 24 nt, Human
uagcacgccccgccagaacuacca

SEQ ID NO: 40797 - RNA, 24 nt, Human
gcugcagcauauuguacuggccug

SEQ ID NO: 40798 - RNA, 20 nt, Human
uaaaauuucaggcucgacac

SEQ ID NO: 40799 - RNA, 24 nt, Human
uagccuguggccaccccggagaug

SEQ ID NO: 40800 - RNA, 24 nt, Human
agcagcucuuuuugcccuucuucu

SEQ ID NO: 40801 - RNA, 24 nt, Human
uugaagccaauuguuuuccaaaua

SEQ ID NO: 40802 - RNA, 24 nt, Human
uccaaagacaagguuucccuggaa

SEQ ID NO: 40803 - RNA, 24 nt, Human
acagaaaguuugagccuauaagcc

SEQ ID NO: 40804 - RNA, 23 nt, Human
uaaccagacaaagucaaauucac

SEQ ID NO: 40805 - RNA, 22 nt, Human
uagcaugccucuuaauuuuucu

SEQ ID NO: 40806 - RNA, 24 nt, Human
uauaaaacuuugauaguuacauug

SEQ ID NO: 40807 - RNA, 24 nt, Human
caccugaaagaaacuucauacuug

SEQ ID NO: 40808 - RNA, 24 nt, Human
aacagguaaccacuugagaggaug

SEQ ID NO: 40809 - RNA, 24 nt, Human
uaaggccccuaacucuugcuggcu

SEQ ID NO: 40810 - RNA, 24 nt, Human
ugaaaagauaauuuauccuauguu

SEQ ID NO: 40811 - RNA, 24 nt, Human
cuuaccuacaaauuugaaacaugu

SEQ ID NO: 40812 - RNA, 24 nt, Human
uucuacuucaccagcagcagcguu

SEQ ID NO: 40813 - RNA, 24 nt, Human
cuugcggaccuuccucgagcgcca

SEQ ID NO: 40814 - RNA, 24 nt, Human
ugauuugauccuggaaguaacugc

SEQ ID NO: 40815 - RNA, 24 nt, Human
uggcaggaaugggaggcauccaga

SEQ ID NO: 40816 - RNA, 24 nt, Human
ugcuugacgggcacccacggccag

SEQ ID NO: 40817 - RNA, 24 nt, Human
uauuuuuuaaauuuuuaaaauuug

SEQ ID NO: 40818 - RNA, 24 nt, Human
uaccucaagggcuuuugacuugag

SEQ ID NO: 40819 - RNA, 24 nt, Human
auggauuuucugagaaaccugacu

SEQ ID NO: 40820 - RNA, 24 nt, Human
uuccaauaaguaucuuaggaacuu

SEQ ID NO: 40821 - RNA, 23 nt, Human
ugccaggguggcgaucucccccc

SEQ ID NO: 40822 - RNA, 22 nt, Human
uuccuggaauauuucuugguuu

SEQ ID NO: 40823 - RNA, 24 nt, Human
ugcauuguuaucauuaaccagucu

SEQ ID NO: 40824 - RNA, 24 nt, Human
uauuagggauaauauucauuuagc

SEQ ID NO: 40825 - RNA, 24 nt, Human
uagcuuuaacugugacgggugucg

SEQ ID NO: 40826 - RNA, 24 nt, Human
uggggcccaacgaggcgcuggugg

SEQ ID NO: 40827 - RNA, 24 nt, Human
gggaagcugaguugaaaaagggaa

SEQ ID NO: 40828 - RNA, 24 nt, Human
uucaucuaugguuaccccaagaag

SEQ ID NO: 40829 - RNA, 24 nt, Human
agaaaagcaauuauucaggauggc

SEQ ID NO: 40830 - RNA, 24 nt, Human
ugcauuguuaucauuaaccagucu

SEQ ID NO: 40831 - RNA, 24 nt, Human
uauuagggauaauauucauuuagc

SEQ ID NO: 40832 - RNA, 24 nt, Human
uaaugggucucaaaauucugugac

SEQ ID NO: 40833 - RNA, 24 nt, Human
uuuccuguccccugcugcuccuuc

SEQ ID NO: 40834 - RNA, 24 nt, Human
ugaagcaagcuccggagacuucuu

SEQ ID NO: 40835 - RNA, 24 nt, Human
uucuucacgggcagcaagcuggug

SEQ ID NO: 40836 - RNA, 24 nt, Human
ccggaccccaccucuucccugccg

SEQ ID NO: 40837 - RNA, 24 nt, Human
cagcgcgcaccccggcggggcuuu

SEQ ID NO: 40838 - RNA, 24 nt, Human
ugagcuaaaagcuuccaugaaggg

SEQ ID NO: 40839 - RNA, 24 nt, Human
uacguugcuuaacccuuuuggcgu

SEQ ID NO: 40840 - RNA, 24 nt, Human
ucggaucucaugacgcugagugac

SEQ ID NO: 40841 - RNA, 24 nt, Human
aggaagcgagcacucagcagguua

SEQ ID NO: 40842 - RNA, 24 nt, Human
aacgguuugaugauccagguuuga

SEQ ID NO: 40843 - RNA, 24 nt, Human
ugugggcauuuauaaucuggucca

SEQ ID NO: 40844 - RNA, 19 nt, Human
uuccacacggaguuggagc

SEQ ID NO: 40845 - RNA, 24 nt, Human
ggggaagagcugggucgacucaag

SEQ ID NO: 40846 - RNA, 24 nt, Human
ugacuggcagaguacggcugcugu

SEQ ID NO: 40847 - RNA, 24 nt, Human
uacaauuuggugaauggagugacc

SEQ ID NO: 40848 - RNA, 23 nt, Human
cuggccaccaaagagggccuucc

SEQ ID NO: 40849 - RNA, 24 nt, Human
accccuuugccugaacgccuuacu

SEQ ID NO: 40850 - RNA, 24 nt, Human
uccagaaccugacgacccggcgac

SEQ ID NO: 40851 - RNA, 24 nt, Human
ucagcaguccuagcccccaacagc

SEQ ID NO: 40852 - RNA, 24 nt, Human
ugccaugacgaccgccaucuugga

SEQ ID NO: 40853 - RNA, 24 nt, Human
ccuuauuguuuggggcaaagggcc

SEQ ID NO: 40854 - RNA, 24 nt, Human
caggacccgucgucaugggccgug

SEQ ID NO: 40855 - RNA, 24 nt, Human
uccaugcugguccuggagucccug

SEQ ID NO: 40856 - RNA, 24 nt, Human
uggcuaaaguguucagccugaugg

SEQ ID NO: 40857 - RNA, 24 nt, Human
uccuugugggaugcguccggcaua

SEQ ID NO: 40858 - RNA, 24 nt, Human
uguaaaauauuuccuggauaacuu

SEQ ID NO: 40859 - RNA, 24 nt, Human
cugccgucgcgguccgugcugucc

SEQ ID NO: 40860 - RNA, 24 nt, Human
ccagcacuuugaaugaaaauuugu

SEQ ID NO: 40861 - RNA, 24 nt, Human
ggggggccgaaaccaacagggguu

SEQ ID NO: 40862 - RNA, 24 nt, Human
ugggcuuugccaucuacugguuca

SEQ ID NO: 40863 - RNA, 18 nt, Human
ggggaugggguuggggaa

SEQ ID NO: 40864 - RNA, 24 nt, Human
uuccuugcagcaggaacccacuua

SEQ ID NO: 40865 - RNA, 24 nt, Human
cuccugaguucacugcuacucaac

SEQ ID NO: 40866 - RNA, 24 nt, Human
caccaugccugacccauuuggcag

SEQ ID NO: 40867 - RNA, 24 nt, Human
ugggaagaugggccuuaaauucuu

SEQ ID NO: 40868 - RNA, 21 nt, Human
uucaagggauggaaagucacc

SEQ ID NO: 40869 - RNA, 24 nt, Human
ucccggaggguugcuccuuuugcc

SEQ ID NO: 40870 - RNA, 23 nt, Human
uccagcagauuacucgggauuuc

SEQ ID NO: 40871 - RNA, 24 nt, Human
ucacuguagaccccaaauaccauc

SEQ ID NO: 40872 - RNA, 24 nt, Human
acucucugccuccgccaaaauuua

SEQ ID NO: 40873 - RNA, 24 nt, Human
gcuugcuugagggcucuggaacug

SEQ ID NO: 40874 - RNA, 24 nt, Human
uacauuaagaaaauuggcuacaac

SEQ ID NO: 40875 - RNA, 24 nt, Human
ucugaucuauaaaugcgguggcau

SEQ ID NO: 40876 - RNA, 24 nt, Human
ucagcaagauccgugaggaguucc

SEQ ID NO: 40877 - RNA, 24 nt, Human
ucggugcaccagcugguggagaau

SEQ ID NO: 40878 - RNA, 24 nt, Human
uaaccgggggcccugaaccguggc

SEQ ID NO: 40879 - RNA, 24 nt, Human
uagaagaacucggugccccugcga

SEQ ID NO: 40880 - RNA, 24 nt, Human
gcgcagcuucaggggccgcaaggg

SEQ ID NO: 40881 - RNA, 19 nt, Human
ucugaccggcuucaagcuc

SEQ ID NO: 40882 - RNA, 24 nt, Human
aaccagaaaguaaggcguucuacu

SEQ ID NO: 40883 - RNA, 24 nt, Human
uuuuccccgcccccccuggaaucu

SEQ ID NO: 40884 - RNA, 24 nt, Human
aagcguucaaagugaaggccgugc

SEQ ID NO: 40885 - RNA, 24 nt, Human
ucccgguccggggguggcgguggu

SEQ ID NO: 40886 - RNA, 24 nt, Human
acucgcugcgaacacccucguggu

SEQ ID NO: 40887 - RNA, 24 nt, Human
cccccccccacccauggagcccac

SEQ ID NO: 40888 - RNA, 24 nt, Human
uuggcaucuucuaccaggccugaa

SEQ ID NO: 40889 - RNA, 22 nt, Human
uuccugagccuugaggaguuga

SEQ ID NO: 40890 - RNA, 24 nt, Human
cguacguaagcuuggauccucuag

SEQ ID NO: 40891 - RNA, 24 nt, Human
acagugcugcaggcugagcugaca

SEQ ID NO: 40892 - RNA, 24 nt, Human
uggccaguguuggcuagggacacu

SEQ ID NO: 40893 - RNA, 24 nt, Human
ucccugugcacaggugggcugacc

SEQ ID NO: 40894 - RNA, 24 nt, Human
uccuugguuaaagaaauccacuug

SEQ ID NO: 40895 - RNA, 24 nt, Human
ugaccaacguggugaaacccuguc

SEQ ID NO: 40896 - RNA, 24 nt, Human
ucuuuucuuuauucuacuaguuga

SEQ ID NO: 40897 - RNA, 24 nt, Human
uuggcagaaggcacuuaaacugug

SEQ ID NO: 40898 - RNA, 22 nt, Human
gcccaugggaaggacagagugu

SEQ ID NO: 40899 - RNA, 24 nt, Human
cagcucccucccucagcccugccc

SEQ ID NO: 40900 - RNA, 24 nt, Human
aggaggaggcggguuuggacagaa

SEQ ID NO: 40901 - RNA, 24 nt, Human
cgaggccuccgcgcucuacggccg

SEQ ID NO: 40902 - RNA, 24 nt, Human
gccacgggauggcccccaaauucc

SEQ ID NO: 40903 - RNA, 21 nt, Human
cauggaaacugcagagacugc

SEQ ID NO: 40904 - RNA, 24 nt, Human
uggcaagccuagcccccaucccug

SEQ ID NO: 40905 - RNA, 24 nt, Human
uaucaaggaagggcaggcgugaug

SEQ ID NO: 40906 - RNA, 24 nt, Human
ucaauuuuuauuuugguuuucuua

SEQ ID NO: 40907 - RNA, 24 nt, Human
ucagugguaggcugauucugauuu

SEQ ID NO: 40908 - RNA, 24 nt, Human
uuuugcucucagaaccccuucccc

SEQ ID NO: 40909 - RNA, 24 nt, Human
acuggcugccugcggguggcuccu

SEQ ID NO: 40910 - RNA, 20 nt, Human
cuuggcccaguaccuaugca

SEQ ID NO: 40911 - RNA, 24 nt, Human
cuugcccccugcccugaggaugcg

SEQ ID NO: 40912 - RNA, 24 nt, Human
cacaaccacggccgucuuguuuuc

SEQ ID NO: 40913 - RNA, 24 nt, Human
uacaaaguuucaucauugccccca

SEQ ID NO: 40914 - RNA, 24 nt, Human
uugcuuugucccuuuucucagagc

SEQ ID NO: 40915 - RNA, 24 nt, Human
guccauuguguggcuugagaccua

SEQ ID NO: 40916 - RNA, 24 nt, Human
acugcuguucuagacugugggggu

SEQ ID NO: 40917 - RNA, 24 nt, Human
ugcccagauaaaguccaagugauu

SEQ ID NO: 40918 - RNA, 24 nt, Human
ugagagaauaaaguauuuuggaaa

SEQ ID NO: 40919 - RNA, 24 nt, Human
ugagaauggcaaaauuagucgccu

SEQ ID NO: 40920 - RNA, 24 nt, Human
gagaauauuugauuuuuguuguca

SEQ ID NO: 40921 - RNA, 24 nt, Human
acacuggaaaguaggaauuugguu

SEQ ID NO: 40922 - RNA, 24 nt, Human
uggaauggaaauguaagcuauaaa

SEQ ID NO: 40923 - RNA, 24 nt, Human
aaagagcuauuuuaaaauauaaag

SEQ ID NO: 40924 - RNA, 24 nt, Human
ucaggcgcaguacaaguuggggca

SEQ ID NO: 40925 - RNA, 24 nt, Human
uuuaugaaaaaaauuuaaaguaca

SEQ ID NO: 40926 - RNA, 20 nt, Human
ucccgggguaaucacucccc

SEQ ID NO: 40927 - RNA, 24 nt, Human
gcagcaacccaggcaucugugccc

SEQ ID NO: 40928 - RNA, 24 nt, Human
uaggacccucaggcuggccgacga

SEQ ID NO: 40929 - RNA, 22 nt, Human
uaggagaugcuguagugaccau

SEQ ID NO: 40930 - RNA, 24 nt, Human
ucuguaguggauguacuacagcuc

SEQ ID NO: 40931 - RNA, 24 nt, Human
uugaaaauggaggcuaugcagacc

SEQ ID NO: 40932 - RNA, 17 nt, Human
ugacaaggaccaugaug

SEQ ID NO: 40933 - RNA, 20 nt, Human
uagcuggcauugauaaggca

SEQ ID NO: 40934 - RNA, 24 nt, Human
cuuuccuucuucuuggcuuucucu

SEQ ID NO: 40935 - RNA, 19 nt, Human
gauucuggacagguugcuc

SEQ ID NO: 40936 - RNA, 24 nt, Human
uguugugcagcauguugcacuucu

SEQ ID NO: 40937 - RNA, 24 nt, Human
ugaaaucaggaccgcagcucgggc

SEQ ID NO: 40938 - RNA, 24 nt, Human
ucugcaauuugguauaaauguuag

SEQ ID NO: 40939 - RNA, 24 nt, Human
aaagcagcaauucuauguucauag

SEQ ID NO: 40940 - RNA, 24 nt, Human
ugggaagucuggggaagggauaca

SEQ ID NO: 40941 - RNA, 24 nt, Human
acccuugugacccuguaugaaggu

SEQ ID NO: 40942 - RNA, 24 nt, Human
aagcacgacuaagagccuucugag

SEQ ID NO: 40943 - RNA, 24 nt, Human
uuaaccaggcccuuuuggauuuuc

SEQ ID NO: 40944 - RNA, 24 nt, Human
auaguaggaaugcauguuaagauu

SEQ ID NO: 40945 - RNA, 24 nt, Human
uccaugaugauacggggucucuau

SEQ ID NO: 40946 - RNA, 24 nt, Human
agagggagaagacaggcgcaguca

SEQ ID NO: 40947 - RNA, 24 nt, Human
uaagcaagcugaagggaaaagggg

SEQ ID NO: 40948 - RNA, 24 nt, Human
acgaaggugcaugcgcugaaugau

SEQ ID NO: 40949 - RNA, 24 nt, Human
agggguccggugcugucgcgggaa

SEQ ID NO: 40950 - RNA, 24 nt, Human
uuaguauuauuuauuugacaacuc

SEQ ID NO: 40951 - RNA, 24 nt, Human
acacacuuuccucuucuugacugu

SEQ ID NO: 40952 - RNA, 24 nt, Human
ucacugccuccugggccaaaguga

SEQ ID NO: 40953 - RNA, 22 nt, Human
ccgcagccgcuggcccaggugc

SEQ ID NO: 40954 - RNA, 24 nt, Human
cgccguggagcaggggguggcgcu

SEQ ID NO: 40955 - RNA, 24 nt, Human
uacaugagugggugugucuaggug

SEQ ID NO: 40956 - RNA, 24 nt, Human
gugcauuggugauuuugaucaucc

SEQ ID NO: 40957 - RNA, 24 nt, Human
uuuaaaaauuucuugaauuugugg

SEQ ID NO: 40958 - RNA, 24 nt, Human
auccuguaaucacugaaggguaca

SEQ ID NO: 40959 - RNA, 24 nt, Human
ucccagguucaagcaauucuccug

SEQ ID NO: 40960 - RNA, 24 nt, Human
uagaaucuugcuauucaaagugua

SEQ ID NO: 40961 - RNA, 24 nt, Human
aguuugugagaaaugcagaaaccu

SEQ ID NO: 40962 - RNA, 24 nt, Human
caaaauauuuggccuaaauuuuca

SEQ ID NO: 40963 - RNA, 24 nt, Human
uccguagucuauucuuucccucau

SEQ ID NO: 40964 - RNA, 24 nt, Human
gaaucccaggccacggugcuucua

SEQ ID NO: 40965 - RNA, 24 nt, Human
gggaaggaaaggggccugagcugg

SEQ ID NO: 40966 - RNA, 24 nt, Human
uggccuggggcugcucccugcccg

SEQ ID NO: 40967 - RNA, 24 nt, Human
ccggagcacauuccugagcgcuga

SEQ ID NO: 40968 - RNA, 24 nt, Human
aagcagaaagagcaaagacacaug

SEQ ID NO: 40969 - RNA, 24 nt, Human
uccgagaucugcuuauguucccaa

SEQ ID NO: 40970 - RNA, 24 nt, Human
cacuuugugagcucaucaucaguc

SEQ ID NO: 40971 - RNA, 24 nt, Human
uggcagccucaucaagaugacuga

SEQ ID NO: 40972 - RNA, 24 nt, Human
uguauagacccaguuggcaaucau

SEQ ID NO: 40973 - RNA, 24 nt, Human
aggaaggcacuaaggaaagaccac

SEQ ID NO: 40974 - RNA, 24 nt, Human
uauguguauauauauguauguaac

SEQ ID NO: 40975 - RNA, 24 nt, Human
gcacuggggugggcagcuggccag

SEQ ID NO: 40976 - RNA, 24 nt, Human
cagccuuuuccucuuuccaggccc

SEQ ID NO: 40977 - RNA, 24 nt, Human
uucagagucuuauugggguggggc

SEQ ID NO: 40978 - RNA, 24 nt, Human
ugcagaaaacacaucuuaaaauca

SEQ ID NO: 40979 - RNA, 24 nt, Human
uauggcaacaggccauucugggcc

SEQ ID NO: 40980 - RNA, 17 nt, Human
cauuccccaaggcgggg

SEQ ID NO: 40981 - RNA, 24 nt, Human
uauuuuggaggauuggguucucag

SEQ ID NO: 40982 - RNA, 24 nt, Human
ugaggugggaggauggcuugaaca

SEQ ID NO: 40983 - RNA, 24 nt, Human
aggcaggagugcaguggcaaaucu

SEQ ID NO: 40984 - RNA, 24 nt, Human
uuaguagagacgggguuucaccau

SEQ ID NO: 40985 - RNA, 24 nt, Human
ccucaaucucuccaaaaacggaga

SEQ ID NO: 40986 - RNA, 24 nt, Human
agucaagaucagaauagcuccucu

SEQ ID NO: 40987 - RNA, 24 nt, Human
uaaauggauuaaucccauuauugc

SEQ ID NO: 40988 - RNA, 24 nt, Human
uccaaaguucauguguuggaaacu

SEQ ID NO: 40989 - RNA, 24 nt, Human
gauaugaucagauuuaccauuuuu

SEQ ID NO: 40990 - RNA, 24 nt, Human
uauaugcaaagcccgugugacugg

SEQ ID NO: 40991 - RNA, 24 nt, Human
uggaauguucuguaacugccuguu

SEQ ID NO: 40992 - RNA, 24 nt, Human
uguugagaagaauauguauucugc

SEQ ID NO: 40993 - RNA, 24 nt, Human
gggcuuguggccuuagacgccagu

SEQ ID NO: 40994 - RNA, 24 nt, Human
uuuucaguuucauccauguauuuc

SEQ ID NO: 40995 - RNA, 24 nt, Human
ucuaaagauuugucuauuuugaac

SEQ ID NO: 40996 - RNA, 24 nt, Human
ugaaauauaauucacauaccacaa

SEQ ID NO: 40997 - RNA, 24 nt, Human
agacaggcuggcacagccccaggc

SEQ ID NO: 40998 - RNA, 24 nt, Human
aagcagcaccaauggggaugaccc

SEQ ID NO: 40999 - RNA, 24 nt, Human
ugguaguucaugcaggccacggcc

SEQ ID NO: 41000 - RNA, 21 nt, Human
uaaccagcaauacuauggggc

SEQ ID NO: 41001 - RNA, 24 nt, Human
ugccaagggacgcugcugaccgcc

SEQ ID NO: 41002 - RNA, 24 nt, Human
uaagaaaacugauucaguuguguu

SEQ ID NO: 41003 - RNA, 24 nt, Human
cuagcaccuuugauuuuucucagu

SEQ ID NO: 41004 - RNA, 24 nt, Human
agacaggcuggcacagccccaugc

SEQ ID NO: 41005 - RNA, 24 nt, Human
aagcagcaccaauggggaugaccc

SEQ ID NO: 41006 - RNA, 24 nt, Human
cuggagcacaagguucagcaaggg

SEQ ID NO: 41007 - RNA, 24 nt, Human
cgaguccagcucuccucaugcucc

SEQ ID NO: 41008 - RNA, 24 nt, Human
uagugucaacccaaccaaaaacua

SEQ ID NO: 41009 - RNA, 24 nt, Human
uucgcagagcugcuccgcgcgcua

SEQ ID NO: 41010 - RNA, 22 nt, Human
ucgcugccguucggugcgcagu

SEQ ID NO: 41011 - RNA, 24 nt, Human
ggaacgagggcgacgugugggccu

SEQ ID NO: 41012 - RNA, 24 nt, Human
ucucuuguucccgucccacggucc

SEQ ID NO: 41013 - RNA, 24 nt, Human
ucaguaaugcguucaggaguccac

SEQ ID NO: 41014 - RNA, 24 nt, Human
acgcuuugucaugcuucuucagua

SEQ ID NO: 41015 - RNA, 24 nt, Human
gcaguggagcuggcgguuuccucu

SEQ ID NO: 41016 - RNA, 24 nt, Human
ugauuaccuucaugacgggaaccu

SEQ ID NO: 41017 - RNA, 24 nt, Human
uacaauaugguugguaguaacaga

SEQ ID NO: 41018 - RNA, 24 nt, Human
ugaggaaucuugagccaaguccua

SEQ ID NO: 41019 - RNA, 24 nt, Human
ucuuuuguuuauuuauauucuuua

SEQ ID NO: 41020 - RNA, 24 nt, Human
uagcuccauuuaacaccagccaug

SEQ ID NO: 41021 - RNA, 24 nt, Human
cuacagguugcaacauaaaacgga

SEQ ID NO: 41022 - RNA, 24 nt, Human
gagcuggggccaagugacuucucc

SEQ ID NO: 41023 - RNA, 24 nt, Human
cagcacaggaaccugggcaggcag

SEQ ID NO: 41024 - RNA, 24 nt, Human
uagaaaaugcucagcacguggccu

SEQ ID NO: 41025 - RNA, 24 nt, Human
uaucauuggagauugugccaccca

SEQ ID NO: 41026 - RNA, 24 nt, Human
gugaacuugcuuuaccccgaaacc

SEQ ID NO: 41027 - RNA, 24 nt, Human
uauaauauuuucauuagcacaagg

SEQ ID NO: 41028 - RNA, 24 nt, Human
acuuaauuuuuacagaaaauucuu

SEQ ID NO: 41029 - RNA, 19 nt, Human
ugggaugggugcacaacuc

SEQ ID NO: 41030 - RNA, 24 nt, Human
ugaguacuuaaauaaaucuaugaa

SEQ ID NO: 41031 - RNA, 24 nt, Human
aggcuguagaaccugccagacugu

SEQ ID NO: 41032 - RNA, 24 nt, Human
aauuuuauuucaaugucugauuua

SEQ ID NO: 41033 - RNA, 24 nt, Human
uccaaaaucuccuuuaucacucga

SEQ ID NO: 41034 - RNA, 24 nt, Human
ucuuugauugagccguauaaacca

SEQ ID NO: 41035 - RNA, 24 nt, Human
ucaaauauuuggaaauuuuuaaau

SEQ ID NO: 41036 - RNA, 24 nt, Human
agacaaggagggggcuugggagug

SEQ ID NO: 41037 - RNA, 24 nt, Human
uuacaagugagaacaugugguguu

SEQ ID NO: 41038 - RNA, 24 nt, Human
uagcuaguuauccugaugcucucc

SEQ ID NO: 41039 - RNA, 24 nt, Human
uaucaaccuaucaccuagguauua

SEQ ID NO: 41040 - RNA, 24 nt, Human
uguuauauagcuuuucccaaugcu

SEQ ID NO: 41041 - RNA, 24 nt, Human
uggcaagcaguuccaguccgagca

SEQ ID NO: 41042 - RNA, 24 nt, Human
ugccugaacagcuuuaccgccggg

SEQ ID NO: 41043 - RNA, 24 nt, Human
uugcuuugaaugcucaaacuaugg

SEQ ID NO: 41044 - RNA, 24 nt, Human
uggaaagcucccucaccagagugc

SEQ ID NO: 41045 - RNA, 24 nt, Human
ugacaccagacccuucauucaagc

SEQ ID NO: 41046 - RNA, 24 nt, Human
uguggcgguuacacggccgggcgc

SEQ ID NO: 41047 - RNA, 24 nt, Human
ugagguaucguuuacugcaaagaa

SEQ ID NO: 41048 - RNA, 24 nt, Human
ugaaaacaaaagaacuucacugag

SEQ ID NO: 41049 - RNA, 24 nt, Human
uaaguaacugaucuaugaaguuag

SEQ ID NO: 41050 - RNA, 24 nt, Human
agggguccggugcugucgcgggaa

SEQ ID NO: 41051 - RNA, 24 nt, Human
uuaguauuauuuauuugacaacuc

SEQ ID NO: 41052 - RNA, 24 nt, Human
ucauggacuaaacuaggucagagu

SEQ ID NO: 41053 - RNA, 24 nt, Human
uaaccaaaaacauaaagcgauaau

SEQ ID NO: 41054 - RNA, 24 nt, Human
uauaguguccaauguagcauuauu

SEQ ID NO: 41055 - RNA, 24 nt, Human
gacacuugcaguaacauuugggaa

SEQ ID NO: 41056 - RNA, 24 nt, Human
uucaaguaucagugccuccaucaa

SEQ ID NO: 41057 - RNA, 24 nt, Human
cacaguuucagaacugaguaagga

SEQ ID NO: 41058 - RNA, 24 nt, Human
uauggcaagucacuuugacagaca

SEQ ID NO: 41059 - RNA, 24 nt, Human
ugagaauggcaaaauuagucgccu

SEQ ID NO: 41060 - RNA, 24 nt, Human
uacaccacucccaagaagaauaag

SEQ ID NO: 41061 - RNA, 24 nt, Human
uuugauugaaagucuucaauuugu

SEQ ID NO: 41062 - RNA, 24 nt, Human
ucuuucuuuuuaauguguccagcu

SEQ ID NO: 41063 - RNA, 24 nt, Human
guggaaugacucuuugaccacgcg

SEQ ID NO: 41064 - RNA, 24 nt, Human
ucacugcacucuagccuaggugac

SEQ ID NO: 41065 - RNA, 17 nt, Human
uugcucucccuugggcc

SEQ ID NO: 41066 - RNA, 24 nt, Human
gagcgcgcacggcucgcuggagcc

SEQ ID NO: 41067 - RNA, 24 nt, Human
uguaucugcuguguagcaucugau

SEQ ID NO: 41068 - RNA, 24 nt, Human
uauguuggguaucacuucagaguc

SEQ ID NO: 41069 - RNA, 24 nt, Human
ugaccacggguuccacacucuggu

SEQ ID NO: 41070 - RNA, 24 nt, Human
cauuacuuuuaaccaaaacauuca

SEQ ID NO: 41071 - RNA, 24 nt, Human
ucaugguaaagaccacauauuuuu

SEQ ID NO: 41072 - RNA, 24 nt, Human
acgguccuggucaugugccacacg

SEQ ID NO: 41073 - RNA, 24 nt, Human
aggaaguucagccggaauccagga

SEQ ID NO: 41074 - RNA, 20 nt, Human
ugugcuggaacgaguguuga

SEQ ID NO: 41075 - RNA, 24 nt, Human
gugcagccgcagacguccaaagcu

SEQ ID NO: 41076 - RNA, 24 nt, Human
uaucaaccuaucaccuagguauua

SEQ ID NO: 41077 - RNA, 24 nt, Human
uaagaacgggcuuggacuuggucu

SEQ ID NO: 41078 - RNA, 24 nt, Human
ugagaauguauuggcaauucaucu

SEQ ID NO: 41079 - RNA, 24 nt, Human
uaccuauaaugacucacauguaug

SEQ ID NO: 41080 - RNA, 24 nt, Human
ucagcuaguauuugcagccacguu

SEQ ID NO: 41081 - RNA, 24 nt, Human
ugcagaaaaacccagaguuagauu

SEQ ID NO: 41082 - RNA, 24 nt, Human
ugcuguuuguuauccugagguaug

SEQ ID NO: 41083 - RNA, 23 nt, Human
uucaagugauuccugugccucag

SEQ ID NO: 41084 - RNA, 24 nt, Human
ccccggagucacccgugggcggca

SEQ ID NO: 41085 - RNA, 21 nt, Human
uaccaaggcucaugggacgcu

SEQ ID NO: 41086 - RNA, 24 nt, Human
aagcaacuagaacaugauucagaa

SEQ ID NO: 41087 - RNA, 20 nt, Human
cauuucacugccaugaaaca

SEQ ID NO: 41088 - RNA, 24 nt, Human
ugaguaaaacgcugccuuagguga

SEQ ID NO: 41089 - RNA, 24 nt, Human
acacaaaccauccugugcaucuau

SEQ ID NO: 41090 - RNA, 24 nt, Human
aaaccagguauccaaaggcgaaag

SEQ ID NO: 41091 - RNA, 24 nt, Human
agcuguguguaaugaaaaggguug

SEQ ID NO: 41092 - RNA, 22 nt, Human
cgccgggacagcagacugccgg

SEQ ID NO: 41093 - RNA, 24 nt, Human
cagccuggacuuaccaccacuaaa

SEQ ID NO: 41094 - RNA, 24 nt, Human
ggcccggagcggagcgcgcccugc

SEQ ID NO: 41095 - RNA, 24 nt, Human
ggacugggccgucgacacgccagc

SEQ ID NO: 41096 - RNA, 24 nt, Human
uggggcacccaggaagccugaggg

SEQ ID NO: 41097 - RNA, 24 nt, Human
uauuucacuggaaaauucuguaaa

SEQ ID NO: 41098 - RNA, 24 nt, Human
ugaaaagcagguauccaaaagaac

SEQ ID NO: 41099 - RNA, 24 nt, Human
uucgcagacacucuccauggcggg

SEQ ID NO: 41100 - RNA, 24 nt, Human
aacccuuuauacaucuggggcauc

SEQ ID NO: 41101 - RNA, 24 nt, Human
cugaagccugguuccuggggucgc

SEQ ID NO: 41102 - RNA, 24 nt, Human
ugagcuguucugucucgaaaaguu

SEQ ID NO: 41103 - RNA, 24 nt, Human
ucggaagcggagcaaggucgaggc

SEQ ID NO: 41104 - RNA, 24 nt, Human
gcgcagcuucaggggccgcaaggg

SEQ ID NO: 41105 - RNA, 19 nt, Human
ucugaccggcuucaagcuc

SEQ ID NO: 41106 - RNA, 24 nt, Human
uccagaacaggcaaauuuguagag

SEQ ID NO: 41107 - RNA, 24 nt, Human
gcagagcugguccggcugcgcgag

SEQ ID NO: 41108 - RNA, 24 nt, Human
uggcagagagcaccuuagcaggcc

SEQ ID NO: 41109 - RNA, 24 nt, Human
gucguugugccggccuuaguucca

SEQ ID NO: 41110 - RNA, 22 nt, Human
agccccaauuacgcgaucuugc

SEQ ID NO: 41111 - RNA, 24 nt, Human
cauuccaugcagccuugcggaacu

SEQ ID NO: 41112 - RNA, 24 nt, Human
uguggacgagcaggaggaggcggc

SEQ ID NO: 41113 - RNA, 23 nt, Human
uaggauccacuauuauucacagu

SEQ ID NO: 41114 - RNA, 24 nt, Human
uagguuguguucugaaucucaggu

SEQ ID NO: 41115 - RNA, 21 nt, Human
uaauaagugcuuuccuuaguu

SEQ ID NO: 41116 - RNA, 24 nt, Human
uugcagcuuuauaguuuuuaaaau

SEQ ID NO: 41117 - RNA, 24 nt, Human
auagaaccccuucugacugagcaa

SEQ ID NO: 41118 - RNA, 24 nt, Human
uagugugucuucuugaguaggcca

SEQ ID NO: 41119 - RNA, 24 nt, Human
uauauuguuaagaguaguacauau

SEQ ID NO: 41120 - RNA, 24 nt, Human
uacaggaugauuuucauauuuuga

SEQ ID NO: 41121 - RNA, 24 nt, Human
acccagugccggaguuggucuucu

SEQ ID NO: 41122 - RNA, 24 nt, Human
uuuaacuuuuuuaaugggucucaa

SEQ ID NO: 41123 - RNA, 24 nt, Human
ggggagggcagcccagagacacgu

SEQ ID NO: 41124 - RNA, 24 nt, Human
ugggagaugcgugugagcgagaca

SEQ ID NO: 41125 - RNA, 24 nt, Human
uacccggcugcgcaggucugauau

SEQ ID NO: 41126 - RNA, 24 nt, Human
aaccucuucuguggagucugcgug

SEQ ID NO: 41127 - RNA, 24 nt, Human
acgcugcggggcgggcggacagac

SEQ ID NO: 41128 - RNA, 24 nt, Human
uauggcaagucacuuugacagaca

SEQ ID NO: 41129 - RNA, 24 nt, Human
ugagaauggcaaaauuagucgccu

SEQ ID NO: 41130 - RNA, 24 nt, Human
uacaccacucccaagaagaauaag

SEQ ID NO: 41131 - RNA, 24 nt, Human
uacagugcugcaaauuacaccaau

SEQ ID NO: 41132 - RNA, 24 nt, Human
uauggcaagucacuuugacagaca

SEQ ID NO: 41133 - RNA, 24 nt, Human
uacaccacucccaagaagaauaag

SEQ ID NO: 41134 - RNA, 24 nt, Human
agugguucacgccuguaaucccag

SEQ ID NO: 41135 - RNA, 24 nt, Human
ggcccggagcggagcgcgcccugc

SEQ ID NO: 41136 - RNA, 24 nt, Human
ccccuggggaacaggccgucgcgg

SEQ ID NO: 41137 - RNA, 24 nt, Human
ucgaagagcuggagaccaaggccg

SEQ ID NO: 41138 - RNA, 18 nt, Human
ugguguggcagagcuggg

SEQ ID NO: 41139 - RNA, 24 nt, Human
agcugguaccaggcgggcagugcc

SEQ ID NO: 41140 - RNA, 24 nt, Human
aacucuuugggaaugcagccuagu

SEQ ID NO: 41141 - RNA, 24 nt, Human
uuuaaaaguuucuguaccaauauc

SEQ ID NO: 41142 - RNA, 24 nt, Human
uggugucgaugggccggaaguagg

SEQ ID NO: 41143 - RNA, 22 nt, Human
ucguacauguggaacagaaauc

SEQ ID NO: 41144 - RNA, 24 nt, Human
uuucccgacagcagcuccucgacc

SEQ ID NO: 41145 - RNA, 24 nt, Human
uauggcaagucacuuugacagaca

SEQ ID NO: 41146 - RNA, 24 nt, Human
ugagaauggcaaaauuagucgccu

SEQ ID NO: 41147 - RNA, 24 nt, Human
uacaccacucccaagaagaauaag

SEQ ID NO: 41148 - RNA, 22 nt, Human
cgccgggacagcagacugccgg

SEQ ID NO: 41149 - RNA, 24 nt, Human
cagccuggacuuaccaccacuaaa

SEQ ID NO: 41150 - RNA, 24 nt, Human
cucgauuaaaauacacacaucuua

SEQ ID NO: 41151 - RNA, 24 nt, Human
uccuugggaugggcgucugcucug

SEQ ID NO: 41152 - RNA, 24 nt, Human
uguuuuggucucuugggcaacauu

SEQ ID NO: 41153 - RNA, 24 nt, Human
cagcggccgcgguguuuguuuugu

SEQ ID NO: 41154 - RNA, 24 nt, Human
gagcuuuugcauccucuggaugua

SEQ ID NO: 41155 - RNA, 24 nt, Human
uuccuggguaaccuccccaggugu

SEQ ID NO: 41156 - RNA, 24 nt, Human
aaccuuuguacuuguuuuccuccu

SEQ ID NO: 41157 - RNA, 24 nt, Human
uacacuguuaaauauuccaagaaa

SEQ ID NO: 41158 - RNA, 24 nt, Human
ucaacgaaguuauuccaucauccc

SEQ ID NO: 41159 - RNA, 18 nt, Human
ggacuuggaaggcuggug

SEQ ID NO: 41160 - RNA, 24 nt, Human
ucaaagauuccacugauugacauu

SEQ ID NO: 41161 - RNA, 24 nt, Human
uaugccaguguaaugaaacugccc

SEQ ID NO: 41162 - RNA, 24 nt, Human
aaggaccauccauucuuugccggc

SEQ ID NO: 41163 - RNA, 24 nt, Human
aaggaaccauggccaacugugagc

SEQ ID NO: 41164 - RNA, 24 nt, Human
aagcguuuugagcagaaaggauuc

SEQ ID NO: 41165 - RNA, 24 nt, Human
gcgcggccuggugggcgagaucau

SEQ ID NO: 41166 - RNA, 24 nt, Human
aggaaggagauauagugaagagga

SEQ ID NO: 41167 - RNA, 24 nt, Human
guagaguauucuucaggcuuaaag

SEQ ID NO: 41168 - RNA, 24 nt, Human
uuaguucauucuucuaauaagccu

SEQ ID NO: 41169 - RNA, 24 nt, Human
uggccaggccucagcgcgaccucg

SEQ ID NO: 41170 - RNA, 24 nt, Human
ucacucaguuuuuaauaaaggcca

SEQ ID NO: 41171 - RNA, 24 nt, Human
ugacaauaggucuuaaugcaaguu

SEQ ID NO: 41172 - RNA, 24 nt, Human
ugcauuguuaucauuaaccagucu

SEQ ID NO: 41173 - RNA, 24 nt, Human
uauuagggauaauauucauuuggc

SEQ ID NO: 41174 - RNA, 24 nt, Human
ucacugaggcgucuuggcuacugg

SEQ ID NO: 41175 - RNA, 24 nt, Human
acuggcugccugcggguggcuccu

SEQ ID NO: 41176 - RNA, 24 nt, Human
aucgagcuguccgacaacccuggc

SEQ ID NO: 41177 - RNA, 24 nt, Human
cuuggcccaguaccuaugcaacga

SEQ ID NO: 41178 - RNA, 17 nt, Human
uacagugguuucucuuu

SEQ ID NO: 41179 - RNA, 24 nt, Human
uuggcaaacguuucccgaagagga

SEQ ID NO: 41180 - RNA, 24 nt, Human
ugaauuugcaggaugggagggcuc

SEQ ID NO: 41181 - RNA, 24 nt, Human
cuucuuggucucggcgugccccau

SEQ ID NO: 41182 - RNA, 24 nt, Human
agguauauuuguauauguaaccaa

SEQ ID NO: 41183 - RNA, 24 nt, Human
aggcagggaguggggacugcagga

SEQ ID NO: 41184 - RNA, 24 nt, Human
ucuaugaacauaucaguuggggga

SEQ ID NO: 41185 - RNA, 24 nt, Human
ugccuggggauccugaagauaaaa

SEQ ID NO: 41186 - RNA, 24 nt, Human
cauugcuggauggccgggacugca

SEQ ID NO: 41187 - RNA, 24 nt, Human
uggaagcugagcccauauuaagag

SEQ ID NO: 41188 - RNA, 24 nt, Human
ccccugaaaaagcagcuuaaaaua

SEQ ID NO: 41189 - RNA, 19 nt, Human
agggauguucaggacucug

SEQ ID NO: 41190 - RNA, 24 nt, Human
uucucuguuuggaggcugcaccca

SEQ ID NO: 41191 - RNA, 24 nt, Human
ucuggcacaggaaauggucuccaa

SEQ ID NO: 41192 - RNA, 24 nt, Human
gaaugggguugggggccccaccuc

SEQ ID NO: 41193 - RNA, 24 nt, Human
uaggucccgagguggagucggggg

SEQ ID NO: 41194 - RNA, 24 nt, Human
uguauauauuuaacacacacaucu

SEQ ID NO: 41195 - RNA, 24 nt, Human
uugaagcuugaaaauuuuauuuaa

SEQ ID NO: 41196 - RNA, 24 nt, Human
uauaaaaguauuacacaauucugu

SEQ ID NO: 41197 - RNA, 24 nt, Human
accacauguaugaggacacauaua

SEQ ID NO: 41198 - RNA, 24 nt, Human
aagcagcaccaauggggaugaccc

SEQ ID NO: 41199 - RNA, 24 nt, Human
guccaguagucacaugggcucaau

SEQ ID NO: 41200 - RNA, 24 nt, Human
aaggguauuuauuucuuauucaug

SEQ ID NO: 41201 - RNA, 20 nt, Human
uccacauguggaaguggggu

SEQ ID NO: 41202 - RNA, 24 nt, Human
aaaccaucucaaguccaaacaugu

SEQ ID NO: 41203 - RNA, 21 nt, Human
agagcucaggucucugagggc

SEQ ID NO: 41204 - RNA, 19 nt, Human
agcugccuggggccagccc

SEQ ID NO: 41205 - RNA, 22 nt, Human
agggccguucuacccccuggga

SEQ ID NO: 41206 - RNA, 21 nt, Human
cacagggccguucuacccccu

SEQ ID NO: 41207 - RNA, 19 nt, Human
cagcaggagugucuuaagc

SEQ ID NO: 41208 - RNA, 23 nt, Human
cagguuccccauccuagcucccc

SEQ ID NO: 41209 - RNA, 18 nt, Human
ccacagcggcgccggcca

SEQ ID NO: 41210 - RNA, 22 nt, Human
ccagccccucaguucuggcugu

SEQ ID NO: 41211 - RNA, 23 nt, Human
ccagccccucaguucuggcugug

SEQ ID NO: 41212 - RNA, 23 nt, Human
ccagggccacuucugcaggagcu

SEQ ID NO: 41213 - RNA, 21 nt, Human
cccacagcggcgccggccacg

SEQ ID NO: 41214 - RNA, 22 nt, Human
ccccauccuagcuccccggauc

SEQ ID NO: 41215 - RNA, 22 nt, Human
ccccugggagcugccuggggcc

SEQ ID NO: 41216 - RNA, 18 nt, Human
cccucaguucuggcugug

SEQ ID NO: 41217 - RNA, 20 nt, Human
cgcccagggcugagugacgg

SEQ ID NO: 41218 - RNA, 19 nt, Human
cggcgccggccacgcgcug

SEQ ID NO: 41219 - RNA, 26 nt, Human
cugagugacggugguggcaagugcuu

SEQ ID NO: 41220 - RNA, 19 nt, Human
gccagccccucaguucugg

SEQ ID NO: 41221 - RNA, 22 nt, Human
gcucggguucgagguuccacgu

SEQ ID NO: 41222 - RNA, 19 nt, Human
gcuggugugcccggguacc

SEQ ID NO: 41223 - RNA, 24 nt, Human
ggcugagugacggugguggcaagu

SEQ ID NO: 41224 - RNA, 25 nt, Human
ggggcagcaggagugucuuaagcac

SEQ ID NO: 41225 - RNA, 21 nt, Human
uccacguggccagaagagcuc

SEQ ID NO: 41226 - RNA, 24 nt, Human
uccagggccacuucugcaggagcu

SEQ ID NO: 41227 - RNA, 20 nt, Human
uccccacagcggcgccggcc

SEQ ID NO: 41228 - RNA, 21 nt, Human
uccuagcuccccggaucucca

SEQ ID NO: 41229 - RNA, 24 nt, Human
ucuccauagggaguguccccucgg

SEQ ID NO: 41230 - RNA, 23 nt, Human
ucugcaggagcucggguucgagg

SEQ ID NO: 41231 - RNA, 23 nt, Human
ucuggcuguggcagguuccccau

SEQ ID NO: 41232 - RNA, 23 nt, Human
ugccuggggccagccccucaguu

SEQ ID NO: 41233 - RNA, 26 nt, Human
ugccuggggccagccccucaguucug

SEQ ID NO: 41234 - RNA, 19 nt, Human
uggcuguggcagguucccc

SEQ ID NO: 41235 - RNA, 20 nt, Human
uggggccagccccucaguuc

SEQ ID NO: 41236 - RNA, 21 nt, Human
uggggccagccccucaguucu

SEQ ID NO: 41237 - RNA, 24 nt, Human
uguccagaccgcucucuuaucccu

SEQ ID NO: 41238 - RNA, 18 nt, Human
ugugcccggguacccauc

SEQ ID NO: 41239 - RNA, 21 nt, Human
aaaaaagaaaaaagaaaagaa

SEQ ID NO: 41240 - RNA, 20 nt, Human
aaacuaagcuggggcugggc

SEQ ID NO: 41241 - RNA, 23 nt, Human
aaacucggcagugguugggaagg

SEQ ID NO: 41242 - RNA, 21 nt, Human
aaagaggcccugagaaguguu

SEQ ID NO: 41243 - RNA, 19 nt, Human
aacaaggugaaaccccauc

SEQ ID NO: 41244 - RNA, 20 nt, Human
aacaaggugaaaccccaucu

SEQ ID NO: 41245 - RNA, 21 nt, Human
aacaaggugaaaccccaucuc

SEQ ID NO: 41246 - RNA, 19 nt, Human
aacacagugagacccuguc

SEQ ID NO: 41247 - RNA, 20 nt, Human
aacacagugagacccugucu

SEQ ID NO: 41248 - RNA, 18 nt, Human
aacacuuugggaggcuga

SEQ ID NO: 41249 - RNA, 24 nt, Human
aacacuuugggaggcugaggcggg

SEQ ID NO: 41250 - RNA, 19 nt, Human
aacauagugagacucaucu

SEQ ID NO: 41251 - RNA, 21 nt, Human
aagaacacagaggaauccagc

SEQ ID NO: 41252 - RNA, 21 nt, Human
aagacauuuuaaacagagcuc

SEQ ID NO: 41253 - RNA, 23 nt, Human
aagagcaaaauucugucucaaaa

SEQ ID NO: 41254 - RNA, 26 nt, Human
aagagcaaaauucugucucaaaaaca

SEQ ID NO: 41255 - RNA, 23 nt, Human
aagaguucaagaccagccugggc

SEQ ID NO: 41256 - RNA, 23 nt, Human
aagaucacgccauugcacuccag

SEQ ID NO: 41257 - RNA, 19 nt, Human
aauaaauaauagaaagaaa

SEQ ID NO: 41258 - RNA, 24 nt, Human
aaucacuugaacccaggagguaga

SEQ ID NO: 41259 - RNA, 19 nt, Human
acaaaaaauaauaauuagc

SEQ ID NO: 41260 - RNA, 18 nt, Human
acacugcacuccagccug

SEQ ID NO: 41261 - RNA, 20 nt, Human
acacugcacuccagccuggg

SEQ ID NO: 41262 - RNA, 21 nt, Human
acacugcacuccagccugggu

SEQ ID NO: 41263 - RNA, 24 nt, Human
acacugcacuccagccugggugac

SEQ ID NO: 41264 - RNA, 20 nt, Human
acagugagacccugucuaca

SEQ ID NO: 41265 - RNA, 20 nt, Human
acagugugagacccugucuc

SEQ ID NO: 41266 - RNA, 24 nt, Human
acagugugagacccugucucaaaa

SEQ ID NO: 41267 - RNA, 21 nt, Human
accccaucucuacuaaaaaca

SEQ ID NO: 41268 - RNA, 23 nt, Human
accuauuagaauggcuaaaauaa

SEQ ID NO: 41269 - RNA, 18 nt, Human
acuaagcuggggcugggc

SEQ ID NO: 41270 - RNA, 24 nt, Human
acugcaacacugcacuccagccug

SEQ ID NO: 41271 - RNA, 18 nt, Human
acugcacuccagccuggg

SEQ ID NO: 41272 - RNA, 21 nt, Human
acugcacuccagccuggguga

SEQ ID NO: 41273 - RNA, 24 nt, Human
acugcacuccagccugggugacag

SEQ ID NO: 41274 - RNA, 21 nt, Human
agaaaaaagaaaagaaaacug

SEQ ID NO: 41275 - RNA, 18 nt, Human
agaaagagagagaggaca

SEQ ID NO: 41276 - RNA, 22 nt, Human
agaaucacuugaacccaggagg

SEQ ID NO: 41277 - RNA, 24 nt, Human
agacugugcagacauuaguuaaaa

SEQ ID NO: 41278 - RNA, 20 nt, Human
agagguugcugugagccaag

SEQ ID NO: 41279 - RNA, 24 nt, Human
agcacuuugggaggcugaggcggg

SEQ ID NO: 41280 - RNA, 26 nt, Human
agccaguccagaauccccggcacuuc

SEQ ID NO: 41281 - RNA, 18 nt, Human
agccggacugcaacacug

SEQ ID NO: 41282 - RNA, 22 nt, Human
agccugggcaacauagugagac

SEQ ID NO: 41283 - RNA, 23 nt, Human
agccugggcaacauagugagacu

SEQ ID NO: 41284 - RNA, 24 nt, Human
agccugggcaacauagugagacuc

SEQ ID NO: 41285 - RNA, 24 nt, Human
agcuacucaggaggcugagguggg

SEQ ID NO: 41286 - RNA, 23 nt, Human
agcuggggcugggcgugguggcu

SEQ ID NO: 41287 - RNA, 20 nt, Human
agcugggugugguggugggu

SEQ ID NO: 41288 - RNA, 23 nt, Human
agcugggugugguggugggugcc

SEQ ID NO: 41289 - RNA, 22 nt, Human
agcuugggcaacacagugagac

SEQ ID NO: 41290 - RNA, 24 nt, Human
agcuugggcaacacagugagaccc

SEQ ID NO: 41291 - RNA, 19 nt, Human
aggacucagagcugaggga

SEQ ID NO: 41292 - RNA, 19 nt, Human
aggagccaccccagaaccc

SEQ ID NO: 41293 - RNA, 22 nt, Human
aggagccaccccagaacccauc

SEQ ID NO: 41294 - RNA, 21 nt, Human
aggaguuggagaccagccugg

SEQ ID NO: 41295 - RNA, 24 nt, Human
aggaucacuugagcccaagaguuc

SEQ ID NO: 41296 - RNA, 22 nt, Human
aggaucgcuugagccugggagg

SEQ ID NO: 41297 - RNA, 18 nt, Human
aggcacgagaaucacuug

SEQ ID NO: 41298 - RNA, 22 nt, Human
aggcaggaggaucgcuugagcc

SEQ ID NO: 41299 - RNA, 24 nt, Human
aggcaggaggaucgcuugagccug

SEQ ID NO: 41300 - RNA, 24 nt, Human
aggcaugguggcucaugccuguag

SEQ ID NO: 41301 - RNA, 18 nt, Human
aggcgggaggaucacuug

SEQ ID NO: 41302 - RNA, 23 nt, Human
aggcgggaggaucacuugagccc

SEQ ID NO: 41303 - RNA, 20 nt, Human
aggcggguggaucaccugag

SEQ ID NO: 41304 - RNA, 24 nt, Human
aggcugaggcacgagaaucacuug

SEQ ID NO: 41305 - RNA, 20 nt, Human
aggcugaggcaggaggaucg

SEQ ID NO: 41306 - RNA, 24 nt, Human
aggcugaggcaggaggaucgcuug

SEQ ID NO: 41307 - RNA, 24 nt, Human
aggcugaggcgggaggaucacuug

SEQ ID NO: 41308 - RNA, 21 nt, Human
aggcugaggcggguggaucac

SEQ ID NO: 41309 - RNA, 24 nt, Human
aggcugaggcggguggaucaccug

SEQ ID NO: 41310 - RNA, 19 nt, Human
aggcugaggugggaggauc

SEQ ID NO: 41311 - RNA, 18 nt, Human
agggccuugaggcccugc

SEQ ID NO: 41312 - RNA, 24 nt, Human
agguagagguugcugugagccaag

SEQ ID NO: 41313 - RNA, 22 nt, Human
aggugcccagggaguaagaggc

SEQ ID NO: 41314 - RNA, 24 nt, Human
aggugcuguggcucacaccuguaa

SEQ ID NO: 41315 - RNA, 20 nt, Human
aggugggaggaucacuuaag

SEQ ID NO: 41316 - RNA, 22 nt, Human
agguuuuaaaaauugauaaacc

SEQ ID NO: 41317 - RNA, 21 nt, Human
aguaagaggcagcauccugga

SEQ ID NO: 41318 - RNA, 24 nt, Human
aucacgccauugcacuccagccug

SEQ ID NO: 41319 - RNA, 20 nt, Human
auuagcuggguguggugguc

SEQ ID NO: 41320 - RNA, 24 nt, Human
auugcacuccagccugggcaacaa

SEQ ID NO: 41321 - RNA, 24 nt, Human
caaaaugcagcuucccugaaccuc

SEQ ID NO: 41322 - RNA, 22 nt, Human
caacacuuugggaggcugaggc

SEQ ID NO: 41323 - RNA, 24 nt, Human
caacacuuugggaggcugaggcgg

SEQ ID NO: 41324 - RNA, 23 nt, Human
caacagcacccugggcccgcggc

SEQ ID NO: 41325 - RNA, 21 nt, Human
cacaaaaugcagcuucccuga

SEQ ID NO: 41326 - RNA, 24 nt, Human
cacaccuguaaucccaacacuuug

SEQ ID NO: 41327 - RNA, 24 nt, Human
cacagaggaauccagccauuucca

SEQ ID NO: 41328 - RNA, 19 nt, Human
caccaacagcacccugggc

SEQ ID NO: 41329 - RNA, 24 nt, Human
caccccuguaaucccagcacuuug

SEQ ID NO: 41330 - RNA, 21 nt, Human
cacccuggacugggaggacaa

SEQ ID NO: 41331 - RNA, 24 nt, Human
caccugagcucaggaguuggagac

SEQ ID NO: 41332 - RNA, 19 nt, Human
caccuguaaucccaacacu

SEQ ID NO: 41333 - RNA, 24 nt, Human
caccuguaaucccaacacuuuggg

SEQ ID NO: 41334 - RNA, 24 nt, Human
cacuccagccugggcaacaagagc

SEQ ID NO: 41335 - RNA, 20 nt, Human
cacuccagccugggugacag

SEQ ID NO: 41336 - RNA, 20 nt, Human
cacuccagccugggugacag

SEQ ID NO: 41337 - RNA, 22 nt, Human
cacuccagccugggugacagug

SEQ ID NO: 41338 - RNA, 19 nt, Human
cacugcacuccagccuggg

SEQ ID NO: 41339 - RNA, 19 nt, Human
cacugcacuccagccuggg

SEQ ID NO: 41340 - RNA, 19 nt, Human
cacugcacuccagccuggg

SEQ ID NO: 41341 - RNA, 20 nt, Human
cacugcacuccagccugggu

SEQ ID NO: 41342 - RNA, 22 nt, Human
cacugcacuccagccuggguga

SEQ ID NO: 41343 - RNA, 23 nt, Human
cacugcacuccagccugggugac

SEQ ID NO: 41344 - RNA, 24 nt, Human
cacugcacuccagccugggugaca

SEQ ID NO: 41345 - RNA, 25 nt, Human
cacugcacuccagccugggugacag

SEQ ID NO: 41346 - RNA, 18 nt, Human
cagaauccccggcacuuc

SEQ ID NO: 41347 - RNA, 26 nt, Human
cagcacccugggcccgcggggagguc

SEQ ID NO: 41348 - RNA, 24 nt, Human
cagcacuuugggaggcugaggcgg

SEQ ID NO: 41349 - RNA, 19 nt, Human
cagccccccagagaccccg

SEQ ID NO: 41350 - RNA, 20 nt, Human
cagccugggcaacauaguga

SEQ ID NO: 41351 - RNA, 24 nt, Human
cagcuacucaggaggcugaggugg

SEQ ID NO: 41352 - RNA, 24 nt, Human
cagcuacuugggaggcugaggcag

SEQ ID NO: 41353 - RNA, 24 nt, Human
caggaggcugaggcacgagaauca

SEQ ID NO: 41354 - RNA, 23 nt, Human
cagggccuugaggcccugcucca

SEQ ID NO: 41355 - RNA, 19 nt, Human
cauugcacuccagccuggg

SEQ ID NO: 41356 - RNA, 21 nt, Human
cauugcacuccagccugggca

SEQ ID NO: 41357 - RNA, 22 nt, Human
cauugcacuccagccugggcaa

SEQ ID NO: 41358 - RNA, 24 nt, Human
cauugcacuccagccugggcaaca

SEQ ID NO: 41359 - RNA, 19 nt, Human
ccaacaaggugaaacccca

SEQ ID NO: 41360 - RNA, 18 nt, Human
ccacuccucuaccucagg

SEQ ID NO: 41361 - RNA, 20 nt, Human
ccauugcacuccagccuggg

SEQ ID NO: 41362 - RNA, 21 nt, Human
ccauugcacuccagccugggc

SEQ ID NO: 41363 - RNA, 23 nt, Human
ccauugcacuccagccugggcaa

SEQ ID NO: 41364 - RNA, 24 nt, Human
ccauugcacuccagccugggcaac

SEQ ID NO: 41365 - RNA, 22 nt, Human
cccagcccacucagcccuggga

SEQ ID NO: 41366 - RNA, 23 nt, Human
cccagcccacucagcccugggag

SEQ ID NO: 41367 - RNA, 21 nt, Human
cccccagagaccccggccuug

SEQ ID NO: 41368 - RNA, 22 nt, Human
ccccggcacuucugaggacacc

SEQ ID NO: 41369 - RNA, 19 nt, Human
ccccuguaaucccagcacu

SEQ ID NO: 41370 - RNA, 23 nt, Human
ccccuguaaucccagcacuuugg

SEQ ID NO: 41371 - RNA, 23 nt, Human
ccucaggagccaccccagaaccc

SEQ ID NO: 41372 - RNA, 21 nt, Human
ccuggacugggaggacaagac

SEQ ID NO: 41373 - RNA, 19 nt, Human
ccuggccacccaacaaggu

SEQ ID NO: 41374 - RNA, 28 nt, Human
ccuggccacccaacaaggugaaacccca

SEQ ID NO: 41375 - RNA, 22 nt, Human
ccuguaaucccagcacuuuggg

SEQ ID NO: 41376 - RNA, 19 nt, Human
ccuguagucccagcuacuc

SEQ ID NO: 41377 - RNA, 21 nt, Human
ccuguagucccagcuacucag

SEQ ID NO: 41378 - RNA, 22 nt, Human
ccugucucaaaaaagaaaaaag

SEQ ID NO: 41379 - RNA, 24 nt, Human
cgccauugcacuccagccugggca

SEQ ID NO: 41380 - RNA, 24 nt, Human
cggguggaucaccugagcucagga

SEQ ID NO: 41381 - RNA, 24 nt, Human
cucaaaaacaaauaaacaagaaaa

SEQ ID NO: 41382 - RNA, 21 nt, Human
cucaagcaaccugcccauacc

SEQ ID NO: 41383 - RNA, 24 nt, Human
cucaagcaaccugcccauaccugc

SEQ ID NO: 41384 - RNA, 22 nt, Human
cucacaccuguaaucccaacac

SEQ ID NO: 41385 - RNA, 24 nt, Human
cucacaccuguaaucccaacacuu

SEQ ID NO: 41386 - RNA, 24 nt, Human
cucaccccuguaaucccagcacuu

SEQ ID NO: 41387 - RNA, 18 nt, Human
cucaggaggcugaggugg

SEQ ID NO: 41388 - RNA, 24 nt, Human
cucaugccuguagucccagcuacu

SEQ ID NO: 41389 - RNA, 24 nt, Human
cuccagccccccagagaccccggc

SEQ ID NO: 41390 - RNA, 21 nt, Human
cugcccauaccugcugggacc

SEQ ID NO: 41391 - RNA, 21 nt, Human
cuggaagagcacagaugaaag

SEQ ID NO: 41392 - RNA, 23 nt, Human
cuuaagagccaguucuccacucc

SEQ ID NO: 41393 - RNA, 21 nt, Human
cuugugcugcaacaggagggg

SEQ ID NO: 41394 - RNA, 19 nt, Human
gaagugacaucaucacaga

SEQ ID NO: 41395 - RNA, 21 nt, Human
gagccaguccagaauccccgg

SEQ ID NO: 41396 - RNA, 21 nt, Human
gaggcccugagaaguguuggu

SEQ ID NO: 41397 - RNA, 25 nt, Human
gauaaugggaaagaacacagaggaa

SEQ ID NO: 41398 - RNA, 23 nt, Human
gaucaccugagcucaggaguugg

SEQ ID NO: 41399 - RNA, 24 nt, Human
gaucaccugagcucaggaguugga

SEQ ID NO: 41400 - RNA, 24 nt, Human
gaucacuuaaggccaggaguucaa

SEQ ID NO: 41401 - RNA, 24 nt, Human
gaucacuugagcccaagaguucaa

SEQ ID NO: 41402 - RNA, 26 nt, Human
gaucacuugagcccaagaguucaaga

SEQ ID NO: 41403 - RNA, 23 nt, Human
gaucgcuugagccugggagguca

SEQ ID NO: 41404 - RNA, 18 nt, Human
gcaacacugcacuccagc

SEQ ID NO: 41405 - RNA, 22 nt, Human
gcacgagaaucacuugaaccca

SEQ ID NO: 41406 - RNA, 22 nt, Human
gccaggcaugguggcucaugcc

SEQ ID NO: 41407 - RNA, 22 nt, Human
gccauugcacuccagccugggc

SEQ ID NO: 41408 - RNA, 24 nt, Human
gccauugcacuccagccugggcaa

SEQ ID NO: 41409 - RNA, 24 nt, Human
gccugggaggucaaaacugcagug

SEQ ID NO: 41410 - RNA, 22 nt, Human
gcuucuccagccccccagagac

SEQ ID NO: 41411 - RNA, 19 nt, Human
ggaggcuucuccagccccc

SEQ ID NO: 41412 - RNA, 23 nt, Human
ggaucacuuaaggccaggaguuc

SEQ ID NO: 41413 - RNA, 23 nt, Human
ggaucacuugagcccaagaguuc

SEQ ID NO: 41414 - RNA, 24 nt, Human
ggcaacuaagcacuuggggaaaaa

SEQ ID NO: 41415 - RNA, 23 nt, Human
ggcgugguggcucaccccuguaa

SEQ ID NO: 41416 - RNA, 21 nt, Human
ggcucaccccuguaaucccag

SEQ ID NO: 41417 - RNA, 21 nt, Human
ggcucaugccuguagucccag

SEQ ID NO: 41418 - RNA, 21 nt, Human
gggaacagcccagcacuacca

SEQ ID NO: 41419 - RNA, 22 nt, Human
gggaggucaaaacugcagugag

SEQ ID NO: 41420 - RNA, 21 nt, Human
ggggcugggcgugguggcuca

SEQ ID NO: 41421 - RNA, 21 nt, Human
gguggaucaccugagcucagg

SEQ ID NO: 41422 - RNA, 24 nt, Human
gguggcucaccccuguaaucccag

SEQ ID NO: 41423 - RNA, 24 nt, Human
gguggcucaugccuguagucccag

SEQ ID NO: 41424 - RNA, 28 nt, Human
gugaguuggccaggcaugguggcucaug

SEQ ID NO: 41425 - RNA, 22 nt, Human
guggcucacaccuguaauccca

SEQ ID NO: 41426 - RNA, 19 nt, Human
uaaaaaacuaagcuggggc

SEQ ID NO: 41427 - RNA, 26 nt, Human
uaaaaauuagcugggugugguggugg

SEQ ID NO: 41428 - RNA, 21 nt, Human
uagcaaauucguugaaaaaca

SEQ ID NO: 41429 - RNA, 18 nt, Human
uagcaagaaagagagaga

SEQ ID NO: 41430 - RNA, 18 nt, Human
ucacagacugugcagaca

SEQ ID NO: 41431 - RNA, 23 nt, Human
ucacgccauugcacuccagccug

SEQ ID NO: 41432 - RNA, 23 nt, Human
ucacuuaaggccaggaguucaag

SEQ ID NO: 41433 - RNA, 23 nt, Human
ucacuugagcccaagaguucaag

SEQ ID NO: 41434 - RNA, 21 nt, Human
ucagagcugagggauaauggg

SEQ ID NO: 41435 - RNA, 20 nt, Human
ucaggaguuggagaccagcc

SEQ ID NO: 41436 - RNA, 20 nt, Human
uccagaauccccggcacuuc

SEQ ID NO: 41437 - RNA, 23 nt, Human
uccagccugggugacagugugag

SEQ ID NO: 41438 - RNA, 24 nt, Human
uccagccugggugacagugugaga

SEQ ID NO: 41439 - RNA, 18 nt, Human
ucgcuugagccugggagg

SEQ ID NO: 41440 - RNA, 18 nt, Human
ucucaaaaaagaaaaaag

SEQ ID NO: 41441 - RNA, 21 nt, Human
ucuccagccccccagagaccc

SEQ ID NO: 41442 - RNA, 21 nt, Human
ucuccagccccccagagaccc

SEQ ID NO: 41443 - RNA, 21 nt, Human
ucucuacuaaaaacauaaaaa

SEQ ID NO: 41444 - RNA, 20 nt, Human
ucuuaagagccaguucucca

SEQ ID NO: 41445 - RNA, 19 nt, Human
ugaaaccccaucucuacua

SEQ ID NO: 41446 - RNA, 20 nt, Human
ugacagugugagacccuguc

SEQ ID NO: 41447 - RNA, 22 nt, Human
ugacagugugagacccugucuc

SEQ ID NO: 41448 - RNA, 22 nt, Human
ugagacucaucucuacaaaaaa

SEQ ID NO: 41449 - RNA, 23 nt, Human
ugagcccaagaguucaagaccag

SEQ ID NO: 41450 - RNA, 21 nt, Human
ugagccggacugcaacacugg

SEQ ID NO: 41451 - RNA, 18 nt, Human
ugagccugggaggucaaa

SEQ ID NO: 41452 - RNA, 24 nt, Human
ugagccugggaggucaaaacugca

SEQ ID NO: 41453 - RNA, 25 nt, Human
ugaggacaccaacagcacccugggc

SEQ ID NO: 41454 - RNA, 23 nt, Human
ugaggacacgagaucccagccca

SEQ ID NO: 41455 - RNA, 20 nt, Human
ugaggcacgagaaucacuug

SEQ ID NO: 41456 - RNA, 24 nt, Human
ugaggcacgagaaucacuugaacc

SEQ ID NO: 41457 - RNA, 20 nt, Human
ugaggcaggaggaucgcuug

SEQ ID NO: 41458 - RNA, 24 nt, Human
ugaggcaggaggaucgcuugagcc

SEQ ID NO: 41459 - RNA, 24 nt, Human
ugaggcaggaggaucgcuugagcc

SEQ ID NO: 41460 - RNA, 19 nt, Human
ugaggcgggaggaucacuu

SEQ ID NO: 41461 - RNA, 24 nt, Human
ugaggcgggaggaucacuugagcc

SEQ ID NO: 41462 - RNA, 19 nt, Human
ugaggcggguggaucaccu

SEQ ID NO: 41463 - RNA, 20 nt, Human
ugaggcggguggaucaccug

SEQ ID NO: 41464 - RNA, 22 nt, Human
ugaggcggguggaucaccugag

SEQ ID NO: 41465 - RNA, 22 nt, Human
ugaggcggguggaucaccugag

SEQ ID NO: 41466 - RNA, 26 nt, Human
ugaggcggguggaucaccugagcuca

SEQ ID NO: 41467 - RNA, 18 nt, Human
ugaggugggaggaucacu

SEQ ID NO: 41468 - RNA, 20 nt, Human
ugaggugggaggaucacuua

SEQ ID NO: 41469 - RNA, 24 nt, Human
ugaggugggaggaucacuuaaggc

SEQ ID NO: 41470 - RNA, 26 nt, Human
ugaggugggaggaucacuuaaggcca

SEQ ID NO: 41471 - RNA, 19 nt, Human
ugcacuccagccugggcaa

SEQ ID NO: 41472 - RNA, 22 nt, Human
ugcacuccagccugggcaacaa

SEQ ID NO: 41473 - RNA, 19 nt, Human
ugccagggccuugaggccc

SEQ ID NO: 41474 - RNA, 24 nt, Human
ugcccaggcucccagcuacuuggg

SEQ ID NO: 41475 - RNA, 24 nt, Human
ugccuguagucccagcuacucagg

SEQ ID NO: 41476 - RNA, 24 nt, Human
ugccugucagcccagcuacucagg

SEQ ID NO: 41477 - RNA, 22 nt, Human
uggacugggaggacaagaccac

SEQ ID NO: 41478 - RNA, 23 nt, Human
uggaucaccugagcucaggaguu

SEQ ID NO: 41479 - RNA, 27 nt, Human
uggaucaccugagcucaggaguuggag

SEQ ID NO: 41480 - RNA, 24 nt, Human
uggccaggcaugguggcucaugcc

SEQ ID NO: 41481 - RNA, 24 nt, Human
uggccaggugcuguggcucacacc

SEQ ID NO: 41482 - RNA, 21 nt, Human
uggcucacaccuguaauccca

SEQ ID NO: 41483 - RNA, 21 nt, Human
uggcucaccccuguaauccca

SEQ ID NO: 41484 - RNA, 24 nt, Human
uggcucaccccuguaaucccagca

SEQ ID NO: 41485 - RNA, 26 nt, Human
ugggaaagaacacagaggaauccagc

SEQ ID NO: 41486 - RNA, 21 nt, Human
ugggaggaucacuuaaggcca

SEQ ID NO: 41487 - RNA, 20 nt, Human
ugggaggcugaggcaggagg

SEQ ID NO: 41488 - RNA, 23 nt, Human
ugggaggcugaggcaggaggauc

SEQ ID NO: 41489 - RNA, 19 nt, Human
ugggaggcugaggcgggag

SEQ ID NO: 41490 - RNA, 24 nt, Human
ugggaggcugaggcgggaggauca

SEQ ID NO: 41491 - RNA, 20 nt, Human
ugggaggcugaggcgggugg

SEQ ID NO: 41492 - RNA, 23 nt, Human
ugggaggcugaggcggguggauc

SEQ ID NO: 41493 - RNA, 24 nt, Human
ugggaggcugaggcggguggauca

SEQ ID NO: 41494 - RNA, 23 nt, Human
ugggaggcugggaacagcccagc

SEQ ID NO: 41495 - RNA, 20 nt, Human
ugggcaacacagugagaccc

SEQ ID NO: 41496 - RNA, 24 nt, Human
ugggcaacacagugagacccuguc

SEQ ID NO: 41497 - RNA, 24 nt, Human
ugguggcucaccccuguaauccca

SEQ ID NO: 41498 - RNA, 24 nt, Human
ugguggcucaugccuguaguccca

SEQ ID NO: 41499 - RNA, 22 nt, Human
uggugggugccugucagcccag

SEQ ID NO: 41500 - RNA, 21 nt, Human
ugucuggggugagcgucugca

SEQ ID NO: 41501 - RNA, 19 nt, Human
ugugcugcaacaggagggg

SEQ ID NO: 41502 - RNA, 19 nt, Human
uguggcucacaccuguaau

SEQ ID NO: 41503 - RNA, 19 nt, Human
ugugugccagggccuugag

SEQ ID NO: 41504 - RNA, 18 nt, Human
uuagcugggugugguggu

SEQ ID NO: 41505 - RNA, 24 nt, Human
uuagcugggugugguggugggugc

SEQ ID NO: 41506 - RNA, 22 nt, Human
uucaucaacuauugguugauaa

SEQ ID NO: 41507 - RNA, 22 nt, Human
uugagcccaagaguucaagacc

SEQ ID NO: 41508 - RNA, 24 nt, Human
uugggaggcugaggcaggaggauc

SEQ ID NO: 41509 - RNA, 25 nt, Human
uugggaggcugaggcgggaggauca

SEQ ID NO: 41510 - RNA, 25 nt, Human
uugggaggcugaggcggguggauca

SEQ ID NO: 41511 - RNA, 26 nt, Human
uuuccacagcguccagcucugcugug

SEQ ID NO: 41512 - RNA, 21 nt, Human
aaagcacuuuucagccuugug

SEQ ID NO: 41513 - RNA, 22 nt, Human
cagcaaagcacuuuucagccuu

SEQ ID NO: 41514 - RNA, 20 nt, Human
gcagaaagaaggagcuggag

SEQ ID NO: 41515 - RNA, 21 nt, Human
ugcagaaagaaggagcuggag

SEQ ID NO: 41516 - RNA, 24 nt, Human
uggagcucagagaacaggacucca

SEQ ID NO: 41517 - RNA, 26 nt, Human
uguuuauucaucaagucuuuaaagau

SEQ ID NO: 41518 - RNA, 19 nt, Human
aacucgguucccgggcuag

SEQ ID NO: 41519 - RNA, 22 nt, Human
acggcacagaccgcacucccgc

SEQ ID NO: 41520 - RNA, 25 nt, Human
caaacuccuggccggaacggcacaa

SEQ ID NO: 41521 - RNA, 18 nt, Human
ucugcagucggcaaacuc

SEQ ID NO: 41522 - RNA, 18 nt, Human
uggaaaacaaaaggaaaa

SEQ ID NO: 41523 - RNA, 22 nt, Human
uggaaaacaaaaggaaaacuua

SEQ ID NO: 41524 - RNA, 21 nt, Human
aagaaggaaaaucuccgaaaa

SEQ ID NO: 41525 - RNA, 23 nt, Human
aagcagauagacaauguagaaaa

SEQ ID NO: 41526 - RNA, 18 nt, Human
aguaagaaaaaaaaaaca

SEQ ID NO: 41527 - RNA, 20 nt, Human
aguagccaacucacaaaaau

SEQ ID NO: 41528 - RNA, 21 nt, Human
auacaagaauguaauauuuuu

SEQ ID NO: 41529 - RNA, 25 nt, Human
cacaguaagaaaaaaaaaacagaaa

SEQ ID NO: 41530 - RNA, 25 nt, Human
ccacaguaagaaaaaaaaaacagaa

SEQ ID NO: 41531 - RNA, 19 nt, Human
ccuacaugauaugccugaa

SEQ ID NO: 41532 - RNA, 21 nt, Human
cgucccgcuucuuggucucua

SEQ ID NO: 41533 - RNA, 22 nt, Human
cucacaaaaauaaaguauacaa

SEQ ID NO: 41534 - RNA, 21 nt, Human
cucacauuuauucucuugcau

SEQ ID NO: 41535 - RNA, 23 nt, Human
guaagaaggaaaaucuccgaaaa

SEQ ID NO: 41536 - RNA, 22 nt, Human
guagccaacucacaaaaauaaa

SEQ ID NO: 41537 - RNA, 19 nt, Human
uaacaguguaagaaggaaa

SEQ ID NO: 41538 - RNA, 22 nt, Human
uaaucgaaauuuucugagguuu

SEQ ID NO: 41539 - RNA, 24 nt, Human
ucuagaaacacagaaaguaaaccu

SEQ ID NO: 41540 - RNA, 21 nt, Human
uugcaucguaaauaguagcca

SEQ ID NO: 41541 - RNA, 25 nt, Human
uuggucucuagaaacacagggucac

SEQ ID NO: 41542 - RNA, 25 nt, Human
aaguguccuccuaagccaaggaggg

SEQ ID NO: 41543 - RNA, 20 nt, Human
agccaccuuaucuccucuuu

SEQ ID NO: 41544 - RNA, 21 nt, Human
agcugagcuaagaggagccca

SEQ ID NO: 41545 - RNA, 18 nt, Human
aucauguuggcagccagg

SEQ ID NO: 41546 - RNA, 21 nt, Human
ccgcuagcccugggggccugu

SEQ ID NO: 41547 - RNA, 18 nt, Human
ccuccuaagccaaggagg

SEQ ID NO: 41548 - RNA, 20 nt, Human
ccuccuuggggcgccccagc

SEQ ID NO: 41549 - RNA, 22 nt, Human
cgccccagcuuuggaagugucc

SEQ ID NO: 41550 - RNA, 21 nt, Human
cuguaguagcagauguucccc

SEQ ID NO: 41551 - RNA, 19 nt, Human
gagcccagggcagagacgg

SEQ ID NO: 41552 - RNA, 18 nt, Human
gaggagcccagggcagag

SEQ ID NO: 41553 - RNA, 23 nt, Human
gauguuccccgggcagccugugg

SEQ ID NO: 41554 - RNA, 21 nt, Human
gcucagcugagcuaagaggag

SEQ ID NO: 41555 - RNA, 24 nt, Human
ggagcccagggcagagacggggau

SEQ ID NO: 41556 - RNA, 18 nt, Human
uaagaggagcccagggca

SEQ ID NO: 41557 - RNA, 22 nt, Human
uacccaguguucccuccacaaa

SEQ ID NO: 41558 - RNA, 23 nt, Human
uauuuagcccugcucucuccacu

SEQ ID NO: 41559 - RNA, 20 nt, Human
ucaggccgugagaagccacc

SEQ ID NO: 41560 - RNA, 18 nt, Human
uccccgggcagccugugg

SEQ ID NO: 41561 - RNA, 18 nt, Human
uccccgggcagccugugg

SEQ ID NO: 41562 - RNA, 19 nt, Human
uccccgggcagccuguggu

SEQ ID NO: 41563 - RNA, 20 nt, Human
uccccgggcagccuguggug

SEQ ID NO: 41564 - RNA, 22 nt, Human
ugccuccuuggggcgccccagc

SEQ ID NO: 41565 - RNA, 24 nt, Human
ugggggccuguccgcaggcacggg

SEQ ID NO: 41566 - RNA, 22 nt, Human
aaaaacgauuccuacuugcuga

SEQ ID NO: 41567 - RNA, 24 nt, Human
aagucaccccaaagaacucuccua

SEQ ID NO: 41568 - RNA, 18 nt, Human
caagggcccgcugcaccu

SEQ ID NO: 41569 - RNA, 22 nt, Human
caccccaaagaacucuccuagg

SEQ ID NO: 41570 - RNA, 19 nt, Human
cacgugguccuuuuauucu

SEQ ID NO: 41571 - RNA, 18 nt, Human
cacugacguggagggcuc

SEQ ID NO: 41572 - RNA, 20 nt, Human
cagagucccccgccaagggc

SEQ ID NO: 41573 - RNA, 20 nt, Human
cagcuccucccucagagucc

SEQ ID NO: 41574 - RNA, 24 nt, Human
ccagcuccucccucagaguccccc

SEQ ID NO: 41575 - RNA, 22 nt, Human
cccagcuccucccucagagucc

SEQ ID NO: 41576 - RNA, 26 nt, Human
ccccaaagaacucuccuagggucgcc

SEQ ID NO: 41577 - RNA, 18 nt, Human
ccccgccaagggcccgcu

SEQ ID NO: 41578 - RNA, 19 nt, Human
ccucagagucccccgccaa

SEQ ID NO: 41579 - RNA, 22 nt, Human
ccucccucagagucccccgcca

SEQ ID NO: 41580 - RNA, 18 nt, Human
gacggauggauccagugg

SEQ ID NO: 41581 - RNA, 21 nt, Human
gacugcucccaaguguguucc

SEQ ID NO: 41582 - RNA, 23 nt, Human
ggcacugacguggagggcucagg

SEQ ID NO: 41583 - RNA, 22 nt, Human
gugggagccuccuccuucccca

SEQ ID NO: 41584 - RNA, 21 nt, Human
ucccucagagucccccgccaa

SEQ ID NO: 41585 - RNA, 18 nt, Human
ugcugacgcggaaagcuc

SEQ ID NO: 41586 - RNA, 19 nt, Human
ugcuggguuaggaggggcu

SEQ ID NO: 41587 - RNA, 24 nt, Human
uuuaaggggcacugagacauagga

SEQ ID NO: 41588 - RNA, 27 nt, Human
aaaaaaacaaaagaaaaaaaguggcac

SEQ ID NO: 41589 - RNA, 19 nt, Human
aaaacaaaauauaauuccc

SEQ ID NO: 41590 - RNA, 21 nt, Human
aaaagaaaaaaaguggcacaa

SEQ ID NO: 41591 - RNA, 28 nt, Human
aaacaacaacaacaaaaaaaaaacaaaa

SEQ ID NO: 41592 - RNA, 19 nt, Human
aaacagcacauuagcaaac

SEQ ID NO: 41593 - RNA, 20 nt, Human
aaacagcacauuagcaaacc

SEQ ID NO: 41594 - RNA, 21 nt, Human
aacagcacauuagcaaaccca

SEQ ID NO: 41595 - RNA, 24 nt, Human
acaacaacaaaaaaaaaacaaaag

SEQ ID NO: 41596 - RNA, 25 nt, Human
acaacaacaaaaaaaaaacaaaaga

SEQ ID NO: 41597 - RNA, 26 nt, Human
acaacaacaacaaaaaaaaaacaaaa

SEQ ID NO: 41598 - RNA, 24 nt, Human
acagagcgagacuccaucucaaaa

SEQ ID NO: 41599 - RNA, 21 nt, Human
acugcacuccagccuggguga

SEQ ID NO: 41600 - RNA, 24 nt, Human
acugcacuccagccugggugacag

SEQ ID NO: 41601 - RNA, 26 nt, Human
acugcacuccagccugggugacagag

SEQ ID NO: 41602 - RNA, 18 nt, Human
agagcagagcaacaaaag

SEQ ID NO: 41603 - RNA, 24 nt, Human
agccugggugacagagcgagacuc

SEQ ID NO: 41604 - RNA, 21 nt, Human
caaaagaaaaaaaguggcaca

SEQ ID NO: 41605 - RNA, 24 nt, Human
caaaaggcagcaaggcuggcagau

SEQ ID NO: 41606 - RNA, 24 nt, Human
caacaaaaaaaaaacaaaagaaaa

SEQ ID NO: 41607 - RNA, 22 nt, Human
caccuggugacuguaaagacaa

SEQ ID NO: 41608 - RNA, 22 nt, Human
cacuccagccugggugacagag

SEQ ID NO: 41609 - RNA, 24 nt, Human
cacuccagccugggugacagagcg

SEQ ID NO: 41610 - RNA, 19 nt, Human
cacugcacuccagccuggg

SEQ ID NO: 41611 - RNA, 19 nt, Human
cacugcacuccagccuggg

SEQ ID NO: 41612 - RNA, 20 nt, Human
cacugcacuccagccugggu

SEQ ID NO: 41613 - RNA, 20 nt, Human
cacugcacuccagccugggu

SEQ ID NO: 41614 - RNA, 21 nt, Human
cacugcacuccagccugggug

SEQ ID NO: 41615 - RNA, 22 nt, Human
cacugcacuccagccuggguga

SEQ ID NO: 41616 - RNA, 23 nt, Human
cacugcacuccagccugggugac

SEQ ID NO: 41617 - RNA, 24 nt, Human
cacugcacuccagccugggugaca

SEQ ID NO: 41618 - RNA, 25 nt, Human
cacugcacuccagccugggugacag

SEQ ID NO: 41619 - RNA, 22 nt, Human
caucucaaaaaacaacaacaac

SEQ ID NO: 41620 - RNA, 22 nt, Human
ccugggugacagagcgagacuc

SEQ ID NO: 41621 - RNA, 24 nt, Human
cucaaaaaacaacaacaacaaaaa

SEQ ID NO: 41622 - RNA, 20 nt, Human
cugggaagaaaaaaacaaaa

SEQ ID NO: 41623 - RNA, 24 nt, Human
gcacuccagccugggugacagagc

SEQ ID NO: 41624 - RNA, 23 nt, Human
gcagagcaacaaaaggcagcaag

SEQ ID NO: 41625 - RNA, 21 nt, Human
uauugccugggaagaaaaaaa

SEQ ID NO: 41626 - RNA, 20 nt, Human
ucacacacauguucagaggu

SEQ ID NO: 41627 - RNA, 23 nt, Human
uccagccugggugacagagcgag

SEQ ID NO: 41628 - RNA, 24 nt, Human
uccagccugggugacagagcgaga

SEQ ID NO: 41629 - RNA, 28 nt, Human
ucucaaaaaacaacaacaacaaaaaaaa

SEQ ID NO: 41630 - RNA, 18 nt, Human
ugccugggaagaaaaaaa

SEQ ID NO: 41631 - RNA, 23 nt, Human
uggcuugcaucuccuguuccaaa

SEQ ID NO: 41632 - RNA, 22 nt, Human
ugggaagaaaaaaacaaaauau

SEQ ID NO: 41633 - RNA, 25 nt, Human
uuuaaaacagcacauuagcaaaccc

SEQ ID NO: 41634 - RNA, 18 nt, Human
aauagugaaccaaaacua

SEQ ID NO: 41635 - RNA, 25 nt, Human
aaucacacacuggcaaguuuaugag

SEQ ID NO: 41636 - RNA, 20 nt, Human
acccuuucuuuuugacuccu

SEQ ID NO: 41637 - RNA, 24 nt, Human
aggaagaauccuccuggaauccug

SEQ ID NO: 41638 - RNA, 18 nt, Human
augaacacacuucuuaga

SEQ ID NO: 41639 - RNA, 21 nt, Human
augcauuucuguugaauauau

SEQ ID NO: 41640 - RNA, 21 nt, Human
caagggaccagcgggucaggc

SEQ ID NO: 41641 - RNA, 27 nt, Human
ccucccgccagcaagggaccagcgggu

SEQ ID NO: 41642 - RNA, 20 nt, Human
cuccauguugauguuuuugu

SEQ ID NO: 41643 - RNA, 24 nt, Human
cuccuauuaaaaacacucagcaaa

SEQ ID NO: 41644 - RNA, 26 nt, Human
cucuauggcuguugcaugaacacacu

SEQ ID NO: 41645 - RNA, 21 nt, Human
gaaccaaaacuacuuggaaaa

SEQ ID NO: 41646 - RNA, 23 nt, Human
gacccuuucuuuuugacuccuau

SEQ ID NO: 41647 - RNA, 28 nt, Human
gauugccuuucaauagcaccaucucuau

SEQ ID NO: 41648 - RNA, 23 nt, Human
gcgggucaggccuggcuacugcg

SEQ ID NO: 41649 - RNA, 24 nt, Human
ggaauuauuuaugaugauucguac

SEQ ID NO: 41650 - RNA, 21 nt, Human
gggucaggccuggcuacugcg

SEQ ID NO: 41651 - RNA, 22 nt, Human
gucauggaauaugcacauuuuc

SEQ ID NO: 41652 - RNA, 22 nt, Human
gugaacaccacuacuauaaaua

SEQ ID NO: 41653 - RNA, 21 nt, Human
uaacaaaauauugaaaugaga

SEQ ID NO: 41654 - RNA, 18 nt, Human
uagaagacacugaagaga

SEQ ID NO: 41655 - RNA, 18 nt, Human
uagaagacacugaagaga

SEQ ID NO: 41656 - RNA, 22 nt, Human
uaguuaacaaaauauugaaaug

SEQ ID NO: 41657 - RNA, 19 nt, Human
ucaggccuggcuacugcgu

SEQ ID NO: 41658 - RNA, 21 nt, Human
ucguacagcuucuuuuacaaa

SEQ ID NO: 41659 - RNA, 22 nt, Human
ucuguuauuauuuccuacuuca

SEQ ID NO: 41660 - RNA, 22 nt, Human
ugaauauauaucuaggagauaa

SEQ ID NO: 41661 - RNA, 23 nt, Human
ugauucguacagcuucuuuuaca

SEQ ID NO: 41662 - RNA, 19 nt, Human
uggaauccugaugcuuguc

SEQ ID NO: 41663 - RNA, 23 nt, Human
ugggacuauugugaacaccacua

SEQ ID NO: 41664 - RNA, 21 nt, Human
uguucauuuacuguuuucuuu

SEQ ID NO: 41665 - RNA, 20 nt, Human
uugaauauauaucuaggaga

SEQ ID NO: 41666 - RNA, 21 nt, Human
accccuugagggacagggacu

SEQ ID NO: 41667 - RNA, 27 nt, Human
ccacccuccaggccccgucuccgaucu

SEQ ID NO: 41668 - RNA, 20 nt, Human
ccuccaggccccgucucccc

SEQ ID NO: 41669 - RNA, 22 nt, Human
ccuuugcgugcugccacccucc

SEQ ID NO: 41670 - RNA, 21 nt, Human
cgacuugcgggaugcgcgccc

SEQ ID NO: 41671 - RNA, 20 nt, Human
cuucccccagcgacucgccg

SEQ ID NO: 41672 - RNA, 21 nt, Human
cuuugcgugcugccacccucc

SEQ ID NO: 41673 - RNA, 18 nt, Human
gacuucccccagcgacuc

SEQ ID NO: 41674 - RNA, 21 nt, Human
gaguuccggcagcgcugggug

SEQ ID NO: 41675 - RNA, 21 nt, Human
gauccgccggguuccgacuug

SEQ ID NO: 41676 - RNA, 20 nt, Human
gaucugcgggauccgauccg

SEQ ID NO: 41677 - RNA, 18 nt, Human
gccccgaguuccggcagc

SEQ ID NO: 41678 - RNA, 24 nt, Human
ugaaaacaugaauuaggcaaacua

SEQ ID NO: 41679 - RNA, 19 nt, Human
ugaauuaggcaaacuaauc

SEQ ID NO: 41680 - RNA, 25 nt, Human
aaaaaaaaaaaaaaaggcugcccag

SEQ ID NO: 41681 - RNA, 24 nt, Human
aaaaaagugugaguucaaacccau

SEQ ID NO: 41682 - RNA, 21 nt, Human
aaaacagaaccggggaaaaaa

SEQ ID NO: 41683 - RNA, 23 nt, Human
aaaauacaacuccaucuuuucau

SEQ ID NO: 41684 - RNA, 20 nt, Human
aaaauagaucccauuacaga

SEQ ID NO: 41685 - RNA, 23 nt, Human
aaauguaaaaaauuacuauuuua

SEQ ID NO: 41686 - RNA, 19 nt, Human
aacagcuuaucagagggaa

SEQ ID NO: 41687 - RNA, 24 nt, Human
aaccacaagaagaaaacacagaca

SEQ ID NO: 41688 - RNA, 23 nt, Human
aagaagaaaacacagacaaaugg

SEQ ID NO: 41689 - RNA, 22 nt, Human
aagagucucauaaggaugaccc

SEQ ID NO: 41690 - RNA, 24 nt, Human
aagcagaaauuuuugaacacguag

SEQ ID NO: 41691 - RNA, 21 nt, Human
aagcaggauguuagccacgca

SEQ ID NO: 41692 - RNA, 21 nt, Human
aagcgcccugagaaccggcuc

SEQ ID NO: 41693 - RNA, 18 nt, Human
aaggaugacccuguagac

SEQ ID NO: 41694 - RNA, 24 nt, Human
aaggggagaaaacagaaccgggga

SEQ ID NO: 41695 - RNA, 20 nt, Human
aaucauuuuuuucuuuuuca

SEQ ID NO: 41696 - RNA, 20 nt, Human
aaugcuccauauggaaguau

SEQ ID NO: 41697 - RNA, 21 nt, Human
acaaucucuuuaaucccaugc

SEQ ID NO: 41698 - RNA, 19 nt, Human
acacagacaaauggcuuua

SEQ ID NO: 41699 - RNA, 23 nt, Human
acuauacagugaaugaaugaugu

SEQ ID NO: 41700 - RNA, 21 nt, Human
acuccaucuuuucauuuucua

SEQ ID NO: 41701 - RNA, 23 nt, Human
agaaauaugcauuuuaauacuuc

SEQ ID NO: 41702 - RNA, 24 nt, Human
agaaauuauucuauaaauucugua

SEQ ID NO: 41703 - RNA, 24 nt, Human
agaagucacugauagaacuuaaaa

SEQ ID NO: 41704 - RNA, 23 nt, Human
agaguugguaaaaauuucuacca

SEQ ID NO: 41705 - RNA, 19 nt, Human
agucaggacaaaugggcac

SEQ ID NO: 41706 - RNA, 19 nt, Human
aguggccauacuccucuau

SEQ ID NO: 41707 - RNA, 22 nt, Human
auaguucucucauauuuuucuu

SEQ ID NO: 41708 - RNA, 22 nt, Human
auuuugagaauuucugaaacuc

SEQ ID NO: 41709 - RNA, 23 nt, Human
caaaauacaacuccaucuuuuca

SEQ ID NO: 41710 - RNA, 18 nt, Human
caaaauaguucacagugc

SEQ ID NO: 41711 - RNA, 18 nt, Human
caaacuuacauaagaaaa

SEQ ID NO: 41712 - RNA, 26 nt, Human
caagaagaaaacacagacaaauggcu

SEQ ID NO: 41713 - RNA, 21 nt, Human
cacauagguacauuccacagg

SEQ ID NO: 41714 - RNA, 19 nt, Human
caccccguaugaacaggau

SEQ ID NO: 41715 - RNA, 28 nt, Human
cagaaccggggaaaaaacaaggagcaaa

SEQ ID NO: 41716 - RNA, 22 nt, Human
cagacagucaggacaaaugggc

SEQ ID NO: 41717 - RNA, 24 nt, Human
cagacagucaggacaaaugggcac

SEQ ID NO: 41718 - RNA, 19 nt, Human
cagcguguggcucgggagc

SEQ ID NO: 41719 - RNA, 21 nt, Human
cauagguacauuccacaggga

SEQ ID NO: 41720 - RNA, 18 nt, Human
ccccuugacaagccuucc

SEQ ID NO: 41721 - RNA, 20 nt, Human
ccccuugacaagccuuccgg

SEQ ID NO: 41722 - RNA, 24 nt, Human
cccugcccugccgcagcccgggag

SEQ ID NO: 41723 - RNA, 22 nt, Human
cccugccgcagcccgggagaga

SEQ ID NO: 41724 - RNA, 19 nt, Human
ccggccccacucacucucg

SEQ ID NO: 41725 - RNA, 22 nt, Human
ccugcccugccgcagcccggga

SEQ ID NO: 41726 - RNA, 28 nt, Human
ccuggcuucagcagcuugcagccccagc

SEQ ID NO: 41727 - RNA, 21 nt, Human
cguguggcucgggagcccugg

SEQ ID NO: 41728 - RNA, 22 nt, Human
cuccccgcccugcccugccgca

SEQ ID NO: 41729 - RNA, 18 nt, Human
cugaaacucacauaggua

SEQ ID NO: 41730 - RNA, 20 nt, Human
cugccaccagaacagcuuau

SEQ ID NO: 41731 - RNA, 18 nt, Human
cuggcuucagcagcuugc

SEQ ID NO: 41732 - RNA, 21 nt, Human
gagaauuucugaaacucacau

SEQ ID NO: 41733 - RNA, 22 nt, Human
gcggagcuccccgcccugcccu

SEQ ID NO: 41734 - RNA, 20 nt, Human
ggaaaaaacaaggagcaaag

SEQ ID NO: 41735 - RNA, 23 nt, Human
ggacaaaugggcacaggcuuccc

SEQ ID NO: 41736 - RNA, 22 nt, Human
gugaaacuuuugucuaguuuuu

SEQ ID NO: 41737 - RNA, 18 nt, Human
gugacccuuauacuuucu

SEQ ID NO: 41738 - RNA, 23 nt, Human
gugcaacauuuaauagucacaaa

SEQ ID NO: 41739 - RNA, 24 nt, Human
uaaaacaaucauuuuuuucuuuuu

SEQ ID NO: 41740 - RNA, 23 nt, Human
uaaaccagugagcugaauaacau

SEQ ID NO: 41741 - RNA, 21 nt, Human
uaauacacuugugucagauaa

SEQ ID NO: 41742 - RNA, 18 nt, Human
uacacaggaacaaaaaaa

SEQ ID NO: 41743 - RNA, 22 nt, Human
uacuaaaugccauaaacacaag

SEQ ID NO: 41744 - RNA, 19 nt, Human
uagcagacagucaggacaa

SEQ ID NO: 41745 - RNA, 23 nt, Human
uaggacaauauaacaauggaacc

SEQ ID NO: 41746 - RNA, 18 nt, Human
uagucaaugauuacuaua

SEQ ID NO: 41747 - RNA, 19 nt, Human
uauauuuguaaaccaguga

SEQ ID NO: 41748 - RNA, 21 nt, Human
ucaaagcaggauguuagccac

SEQ ID NO: 41749 - RNA, 22 nt, Human
ucacauagguacauuccacagg

SEQ ID NO: 41750 - RNA, 18 nt, Human
ucagaggaaccgaaguaa

SEQ ID NO: 41751 - RNA, 24 nt, Human
ucagcagcuugcagccccagcagu

SEQ ID NO: 41752 - RNA, 23 nt, Human
ucauuuuuuucuuuuucagcagu

SEQ ID NO: 41753 - RNA, 21 nt, Human
uccacagggaauauacagaaa

SEQ ID NO: 41754 - RNA, 18 nt, Human
ucccggccccacucacuc

SEQ ID NO: 41755 - RNA, 18 nt, Human
ucccucagccagcacccc

SEQ ID NO: 41756 - RNA, 23 nt, Human
uccucuauaccacaggguucuac

SEQ ID NO: 41757 - RNA, 20 nt, Human
ucuaaaacaaucauuuuuuu

SEQ ID NO: 41758 - RNA, 25 nt, Human
ucuauaccacaggguucuacaaaga

SEQ ID NO: 41759 - RNA, 24 nt, Human
ugaaaaaugcuccauauggaagua

SEQ ID NO: 41760 - RNA, 18 nt, Human
ugaaagaaacucaaauau

SEQ ID NO: 41761 - RNA, 22 nt, Human
ugaaagaucacuugaacuuccc

SEQ ID NO: 41762 - RNA, 22 nt, Human
ugaagagaugaaaaauuugaga

SEQ ID NO: 41763 - RNA, 20 nt, Human
ugaagguacuaaaugccaua

SEQ ID NO: 41764 - RNA, 19 nt, Human
ugagcugaauaacauggca

SEQ ID NO: 41765 - RNA, 24 nt, Human
ugcaauuaaaaaaaaaaaaaaaaa

SEQ ID NO: 41766 - RNA, 19 nt, Human
ugcgcggagcuccccgccc

SEQ ID NO: 41767 - RNA, 22 nt, Human
ugcgcggagcuccccgcccugc

SEQ ID NO: 41768 - RNA, 18 nt, Human
ugcgggucccggccccac

SEQ ID NO: 41769 - RNA, 19 nt, Human
uggcacacucauugccagc

SEQ ID NO: 41770 - RNA, 18 nt, Human
uggcacuaauaacucugg

SEQ ID NO: 41771 - RNA, 20 nt, Human
uggcucgaagcauaggacaa

SEQ ID NO: 41772 - RNA, 20 nt, Human
uggucauuaacuguuuucca

SEQ ID NO: 41773 - RNA, 19 nt, Human
ugucaaaauacaacuccau

SEQ ID NO: 41774 - RNA, 19 nt, Human
ugugcugggcauuuauguu

SEQ ID NO: 41775 - RNA, 22 nt, Human
uguugaagaauucauuguuuag

SEQ ID NO: 41776 - RNA, 24 nt, Human
uuagaaaacucugaaaaaugcucc

SEQ ID NO: 41777 - RNA, 24 nt, Human
uuccagugcaaaaauagaucccau

SEQ ID NO: 41778 - RNA, 21 nt, Human
uugaaaucagaggaaccgaag

SEQ ID NO: 41779 - RNA, 18 nt, Human
uugaagaauucauuguuu

SEQ ID NO: 41780 - RNA, 23 nt, Human
uuguguuugcgucucuuucuccu

SEQ ID NO: 41781 - RNA, 23 nt, Human
uuguguuuucuucaaaauaguuc

SEQ ID NO: 41782 - RNA, 24 nt, Human
uuuuuuaacaaugaauugugcugg

SEQ ID NO: 41783 - RNA, 23 nt, Human
uuuuuucuuuuuuccuuuuaaug

SEQ ID NO: 41784 - RNA, 21 nt, Human
aggcaggggcgaggggccggg

SEQ ID NO: 41785 - RNA, 18 nt, Human
agggaggugggcgggcag

SEQ ID NO: 41786 - RNA, 18 nt, Human
aggugggcgggcaggggg

SEQ ID NO: 41787 - RNA, 29 nt, Human
auggcagcuggggguuggggggggucugg

SEQ ID NO: 41788 - RNA, 22 nt, Human
caaaauaaauacgggacugacc

SEQ ID NO: 41789 - RNA, 24 nt, Human
caagacgcacacccaggcacaggc

SEQ ID NO: 41790 - RNA, 24 nt, Human
cagaccccgaggcuuuaaggcaaa

SEQ ID NO: 41791 - RNA, 18 nt, Human
cagcagggucagcuucuc

SEQ ID NO: 41792 - RNA, 18 nt, Human
cagcccgggccgggucag

SEQ ID NO: 41793 - RNA, 18 nt, Human
cagcuccgcccacagccc

SEQ ID NO: 41794 - RNA, 20 nt, Human
caggagaaaggccagcagug

SEQ ID NO: 41795 - RNA, 20 nt, Human
cagugccaggcaggggcgag

SEQ ID NO: 41796 - RNA, 18 nt, Human
ccacuccaggcccuggca

SEQ ID NO: 41797 - RNA, 20 nt, Human
cccacagcccgcucucggca

SEQ ID NO: 41798 - RNA, 23 nt, Human
cccacagcccgcucucggcaucu

SEQ ID NO: 41799 - RNA, 21 nt, Human
ccccuugguccugaaccucca

SEQ ID NO: 41800 - RNA, 21 nt, Human
cccgcaccguugacgcccagg

SEQ ID NO: 41801 - RNA, 18 nt, Human
cccgccgcgccgcugggc

SEQ ID NO: 41802 - RNA, 19 nt, Human
cccgccgcgccgcugggca

SEQ ID NO: 41803 - RNA, 24 nt, Human
ccgccgcgccgcugggcaucgccc

SEQ ID NO: 41804 - RNA, 24 nt, Human
ccgcgcgggggcggggcgcucggg

SEQ ID NO: 41805 - RNA, 19 nt, Human
ccucagcgccgcggcccgc

SEQ ID NO: 41806 - RNA, 21 nt, Human
ccucccuggcccagcucuggg

SEQ ID NO: 41807 - RNA, 20 nt, Human
ccuugccuggccagcagggu

SEQ ID NO: 41808 - RNA, 25 nt, Human
cgaggccgggcaggagaaaggccag

SEQ ID NO: 41809 - RNA, 19 nt, Human
cgccaagacgcacacccag

SEQ ID NO: 41810 - RNA, 18 nt, Human
cgccgggccccgcagccc

SEQ ID NO: 41811 - RNA, 19 nt, Human
cggcaaccgcagugaccac

SEQ ID NO: 41812 - RNA, 18 nt, Human
cggcgucgccuugggcgg

SEQ ID NO: 41813 - RNA, 23 nt, Human
cgggcagggggccaagcugggug

SEQ ID NO: 41814 - RNA, 23 nt, Human
cucaaagcaaaauaaauacggga

SEQ ID NO: 41815 - RNA, 19 nt, Human
cucccuggcccagcucugg

SEQ ID NO: 41816 - RNA, 22 nt, Human
cugacccagcuccgcccacagc

SEQ ID NO: 41817 - RNA, 18 nt, Human
cuggccagcagggucagc

SEQ ID NO: 41818 - RNA, 21 nt, Human
gagagcagggccagaggagcc

SEQ ID NO: 41819 - RNA, 21 nt, Human
gagcagugccaggcaggggcg

SEQ ID NO: 41820 - RNA, 20 nt, Human
gagcccgaagcacucgccaa

SEQ ID NO: 41821 - RNA, 19 nt, Human
gaggccgggcaggagaaag

SEQ ID NO: 41822 - RNA, 20 nt, Human
gcagcuggggguuggggggg

SEQ ID NO: 41823 - RNA, 18 nt, Human
gccccgccgggccccgca

SEQ ID NO: 41824 - RNA, 24 nt, Human
gcccgcaccguugacgcccaggag

SEQ ID NO: 41825 - RNA, 20 nt, Human
gcuggggguugggggggguc

SEQ ID NO: 41826 - RNA, 22 nt, Human
ggagagcagggccagaggagcc

SEQ ID NO: 41827 - RNA, 18 nt, Human
ggccagcagggucagcuu

SEQ ID NO: 41828 - RNA, 19 nt, Human
ggcccggcucccagggagg

SEQ ID NO: 41829 - RNA, 22 nt, Human
ggccgggcagaccccgaggcuu

SEQ ID NO: 41830 - RNA, 19 nt, Human
gggcaggagaaaggccagc

SEQ ID NO: 41831 - RNA, 21 nt, Human
gggccgggcagaccccgaggc

SEQ ID NO: 41832 - RNA, 24 nt, Human
gggcggggcgcucgggcguccggg

SEQ ID NO: 41833 - RNA, 19 nt, Human
gggggcggggcgcucgggc

SEQ ID NO: 41834 - RNA, 18 nt, Human
guacaggggcuggaggac

SEQ ID NO: 41835 - RNA, 19 nt, Human
gucgccuugggcggugagc

SEQ ID NO: 41836 - RNA, 20 nt, Human
gugggagagcgauggcagcu

SEQ ID NO: 41837 - RNA, 19 nt, Human
ucaaagcaaaauaaauacg

SEQ ID NO: 41838 - RNA, 23 nt, Human
ucccgcaggacagccaccucccu

SEQ ID NO: 41839 - RNA, 23 nt, Human
ucccgcgggacagccaccucccu

SEQ ID NO: 41840 - RNA, 23 nt, Human
uccugaaccuccacuccaggccc

SEQ ID NO: 41841 - RNA, 24 nt, Human
uccugaaccuccacuccaggcccu

SEQ ID NO: 41842 - RNA, 19 nt, Human
ugacccagcuccgcccaca

SEQ ID NO: 41843 - RNA, 23 nt, Human
ugcccgcaccguugacgcccagg

SEQ ID NO: 41844 - RNA, 21 nt, Human
uggcagcuggggguugggggg

SEQ ID NO: 41845 - RNA, 26 nt, Human
uggcccagcucuggguggucaguggg

SEQ ID NO: 41846 - RNA, 20 nt, Human
ugggagagcgauggcagcug

SEQ ID NO: 41847 - RNA, 27 nt, Human
ugggagagcgauggcagcuggggguug

SEQ ID NO: 41848 - RNA, 18 nt, Human
uggggguugggggggguc

SEQ ID NO: 41849 - RNA, 23 nt, Human
ugguccagccggcgucgccuugg

SEQ ID NO: 41850 - RNA, 21 nt, Human
uuuaaaacaaacaucugugcg

SEQ ID NO: 41851 - RNA, 22 nt, Human
uuuaaaacaaacaucugugcgc

SEQ ID NO: 41852 - RNA, 21 nt, Human
aaaagccuccuugacucacag

SEQ ID NO: 41853 - RNA, 23 nt, Human
aaacagagacugcuucgagccug

SEQ ID NO: 41854 - RNA, 18 nt, Human
aacugcaggcagagagga

SEQ ID NO: 41855 - RNA, 18 nt, Human
acagagggcuccggggug

SEQ ID NO: 41856 - RNA, 20 nt, Human
acccugagguuugggaacac

SEQ ID NO: 41857 - RNA, 21 nt, Human
accucgcaggacaucaggagg

SEQ ID NO: 41858 - RNA, 23 nt, Human
acgcuaagaccccagcaccuaau

SEQ ID NO: 41859 - RNA, 20 nt, Human
agagaggaguccuucccgcu

SEQ ID NO: 41860 - RNA, 19 nt, Human
aggaggaggcggcuccgca

SEQ ID NO: 41861 - RNA, 21 nt, Human
aggauguaagaugggcccugc

SEQ ID NO: 41862 - RNA, 19 nt, Human
aggcagggaaggcgaugga

SEQ ID NO: 41863 - RNA, 21 nt, Human
augggcccugcuugcccgucc

SEQ ID NO: 41864 - RNA, 20 nt, Human
cacccagagaccccggagcu

SEQ ID NO: 41865 - RNA, 25 nt, Human
cacccagagaccccggagcuugccc

SEQ ID NO: 41866 - RNA, 24 nt, Human
caccuucccuccugugccggcugc

SEQ ID NO: 41867 - RNA, 28 nt, Human
cacuggguccucucuccagggagugccu

SEQ ID NO: 41868 - RNA, 21 nt, Human
cagaagaggcuccacacagca

SEQ ID NO: 41869 - RNA, 21 nt, Human
cagagccuccaggaugccccc

SEQ ID NO: 41870 - RNA, 21 nt, Human
cagcaggucucccuucaggac

SEQ ID NO: 41871 - RNA, 19 nt, Human
cagcccuuagggugguccc

SEQ ID NO: 41872 - RNA, 20 nt, Human
cagcucagcugcagcccuuc

SEQ ID NO: 41873 - RNA, 18 nt, Human
caggaggugcccagggcu

SEQ ID NO: 41874 - RNA, 25 nt, Human
caggaugcccccgggcugcgcugga

SEQ ID NO: 41875 - RNA, 21 nt, Human
ccacccagagaccccggagcu

SEQ ID NO: 41876 - RNA, 24 nt, Human
ccacccagagaccccggagcuugc

SEQ ID NO: 41877 - RNA, 20 nt, Human
cccccgggcugcgcuggacg

SEQ ID NO: 41878 - RNA, 25 nt, Human
ccccggagcuugcccgcagacugcc

SEQ ID NO: 41879 - RNA, 24 nt, Human
cccggccugccccagcucugggaa

SEQ ID NO: 41880 - RNA, 22 nt, Human
cccuuaggguggucccugcgug

SEQ ID NO: 41881 - RNA, 18 nt, Human
ccgggguggggccugaga

SEQ ID NO: 41882 - RNA, 21 nt, Human
ccuggagaaauucaaccccca

SEQ ID NO: 41883 - RNA, 18 nt, Human
cguguguaaacuuggaca

SEQ ID NO: 41884 - RNA, 20 nt, Human
cguguguaaacuuggacaag

SEQ ID NO: 41885 - RNA, 24 nt, Human
cuccagcaccgagccugggguacc

SEQ ID NO: 41886 - RNA, 20 nt, Human
cucuccagcaccgagccugg

SEQ ID NO: 41887 - RNA, 27 nt, Human
cugcagcccuuccugggucagcucucc

SEQ ID NO: 41888 - RNA, 22 nt, Human
cuucccgcuuccuccccagggg

SEQ ID NO: 41889 - RNA, 23 nt, Human
gagaggcagggaaggcgauggag

SEQ ID NO: 41890 - RNA, 19 nt, Human
gagccugggcgccggggcg

SEQ ID NO: 41891 - RNA, 19 nt, Human
gagcuugcccgcagacugc

SEQ ID NO: 41892 - RNA, 18 nt, Human
gagggcuccggggugggg

SEQ ID NO: 41893 - RNA, 21 nt, Human
gcacagagggcuccggggugg

SEQ ID NO: 41894 - RNA, 24 nt, Human
gcagcccuuccugggucagcucuc

SEQ ID NO: 41895 - RNA, 21 nt, Human
gcagugcuggaaacagagacu

SEQ ID NO: 41896 - RNA, 23 nt, Human
gcagugcuggaaacagagacugc

SEQ ID NO: 41897 - RNA, 20 nt, Human
gcaugguccauuccuggcgg

SEQ ID NO: 41898 - RNA, 21 nt, Human
gcguguccuggggcgggcgac

SEQ ID NO: 41899 - RNA, 19 nt, Human
gcuacaguucaaccuggcu

SEQ ID NO: 41900 - RNA, 22 nt, Human
gcuggaaacagagacugcuucg

SEQ ID NO: 41901 - RNA, 19 nt, Human
gcugggucccagaagaggc

SEQ ID NO: 41902 - RNA, 21 nt, Human
gcuugcccguccugucccugc

SEQ ID NO: 41903 - RNA, 19 nt, Human
ggacaagucacuggguccu

SEQ ID NO: 41904 - RNA, 20 nt, Human
ggagaugcgcaugcugaucc

SEQ ID NO: 41905 - RNA, 18 nt, Human
ggaggugcccagggcuca

SEQ ID NO: 41906 - RNA, 19 nt, Human
ggcagggcaacccugaggu

SEQ ID NO: 41907 - RNA, 18 nt, Human
ggcuggcuucccgcuucc

SEQ ID NO: 41908 - RNA, 22 nt, Human
gggccugagagccucuggagug

SEQ ID NO: 41909 - RNA, 24 nt, Human
gggguggggccugagagccucugg

SEQ ID NO: 41910 - RNA, 23 nt, Human
ggguggggccugagagccucugg

SEQ ID NO: 41911 - RNA, 20 nt, Human
gucacuggguccucucucca

SEQ ID NO: 41912 - RNA, 23 nt, Human
gucagcucuccacccagagaccc

SEQ ID NO: 41913 - RNA, 24 nt, Human
gucagcucuccacccagagacccc

SEQ ID NO: 41914 - RNA, 24 nt, Human
uaagaugggcccugcuugcccguc

SEQ ID NO: 41915 - RNA, 18 nt, Human
uaggagaugcugugggac

SEQ ID NO: 41916 - RNA, 19 nt, Human
uaggagaugcugugggacg

SEQ ID NO: 41917 - RNA, 24 nt, Human
uaugcagacauggagaugcgcaug

SEQ ID NO: 41918 - RNA, 21 nt, Human
ucagcauuuauuuucuggaug

SEQ ID NO: 41919 - RNA, 21 nt, Human
ucagcugcagcccuuccuggg

SEQ ID NO: 41920 - RNA, 21 nt, Human
ucaggaggugcccagggcuca

SEQ ID NO: 41921 - RNA, 23 nt, Human
uccgcacagagggcuccggggug

SEQ ID NO: 41922 - RNA, 24 nt, Human
uccuggcggccugggggccucgcu

SEQ ID NO: 41923 - RNA, 23 nt, Human
uccuugagacagccacccagccc

SEQ ID NO: 41924 - RNA, 22 nt, Human
ucgcggugacuaccaugcccua

SEQ ID NO: 41925 - RNA, 24 nt, Human
ucuccagcaccgagccugggcgcc

SEQ ID NO: 41926 - RNA, 22 nt, Human
ugagguuugggaacaccgugac

SEQ ID NO: 41927 - RNA, 25 nt, Human
ugcccagggcucacaggcaugacuc

SEQ ID NO: 41928 - RNA, 18 nt, Human
ugcccggccugccccagc

SEQ ID NO: 41929 - RNA, 21 nt, Human
uggaaacagagacugcuucga

SEQ ID NO: 41930 - RNA, 26 nt, Human
uggacgcuaagaccccagcaccuaau

SEQ ID NO: 41931 - RNA, 19 nt, Human
uggagaggcagggaaggcg

SEQ ID NO: 41932 - RNA, 19 nt, Human
uggcuucccgcuuccuccc

SEQ ID NO: 41933 - RNA, 21 nt, Human
uguaaacuuggacaagucacu

SEQ ID NO: 41934 - RNA, 24 nt, Human
uguaaacuuggacaagucacuggg

SEQ ID NO: 41935 - RNA, 19 nt, Human
ugugcagacguggcugcuc

SEQ ID NO: 41936 - RNA, 18 nt, Human
uguguaaacuuggacaag

SEQ ID NO: 41937 - RNA, 19 nt, Human
uuuuuuuuuuuuuuugugu

SEQ ID NO: 41938 - RNA, 18 nt, Human
uuuuuuuuuuuuuuuuug

SEQ ID NO: 41939 - RNA, 19 nt, Human
uuuuuuuuuuuuuuuuugu

SEQ ID NO: 41940 - RNA, 22 nt, Human
aagucaguuucgguuuccuucc

SEQ ID NO: 41941 - RNA, 23 nt, Human
acaacgcagacacacagacaaac

SEQ ID NO: 41942 - RNA, 27 nt, Human
acaacgcagacacacagacaaacaugc

SEQ ID NO: 41943 - RNA, 21 nt, Human
agaaaagcagaucugcuugaa

SEQ ID NO: 41944 - RNA, 25 nt, Human
agacaaacaugcagaaaagcagauc

SEQ ID NO: 41945 - RNA, 23 nt, Human
agaccagauuggucagagcugag

SEQ ID NO: 41946 - RNA, 19 nt, Human
agcaaaggacauaaacgcc

SEQ ID NO: 41947 - RNA, 20 nt, Human
aguccauuuggaugaccaua

SEQ ID NO: 41948 - RNA, 19 nt, Human
augaaaaucacacacaacg

SEQ ID NO: 41949 - RNA, 20 nt, Human
auggaggccaaagcugcuag

SEQ ID NO: 41950 - RNA, 20 nt, Human
cacaacgcagacacacagac

SEQ ID NO: 41951 - RNA, 24 nt, Human
cacagacaaacaugcagaaaagca

SEQ ID NO: 41952 - RNA, 21 nt, Human
ccuccagcugcccagaguucc

SEQ ID NO: 41953 - RNA, 24 nt, Human
cgcagacacacagacaaacaugca

SEQ ID NO: 41954 - RNA, 24 nt, Human
cuagugggauggcccgggguuucu

SEQ ID NO: 41955 - RNA, 19 nt, Human
cuccugcgccuccagcugc

SEQ ID NO: 41956 - RNA, 18 nt, Human
cugcaugcuccucgugug

SEQ ID NO: 41957 - RNA, 25 nt, Human
cugcccagaguuccuuucuggcugc

SEQ ID NO: 41958 - RNA, 20 nt, Human
gaauucgcugcaugcuccuc

SEQ ID NO: 41959 - RNA, 23 nt, Human
gaggccccucagacagcaaagga

SEQ ID NO: 41960 - RNA, 23 nt, Human
gauuuuguauuuguuugguuuca

SEQ ID NO: 41961 - RNA, 26 nt, Human
gccuccagcugcccagaguuccuuuc

SEQ ID NO: 41962 - RNA, 24 nt, Human
uccaugaaaaucacacacaacgca

SEQ ID NO: 41963 - RNA, 24 nt, Human
uccuucugaaagaccucuuucuga

SEQ ID NO: 41964 - RNA, 18 nt, Human
ucgcugcaugcuccucgu

SEQ ID NO: 41965 - RNA, 24 nt, Human
ucuaguucuggggucuggagaagg

SEQ ID NO: 41966 - RNA, 24 nt, Human
ucugaaagaccucuuucugaauuc

SEQ ID NO: 41967 - RNA, 18 nt, Human
ucugcuugaaaugagagc

SEQ ID NO: 41968 - RNA, 23 nt, Human
ugaaaaucacacacaacgcagac

SEQ ID NO: 41969 - RNA, 18 nt, Human
ugagugcauuugcauuuu

SEQ ID NO: 41970 - RNA, 25 nt, Human
ugcagaaaagcagaucugcuugaaa

SEQ ID NO: 41971 - RNA, 22 nt, Human
ugcaugcuccucguguguuugu

SEQ ID NO: 41972 - RNA, 19 nt, Human
ugcgccuccagcugcccag

SEQ ID NO: 41973 - RNA, 19 nt, Human
ugcuagugggauggcccgg

SEQ ID NO: 41974 - RNA, 18 nt, Human
ugggcacaggcuccugcg

SEQ ID NO: 41975 - RNA, 23 nt, Human
uuuguauuuguuugguuucacca

SEQ ID NO: 41976 - RNA, 22 nt, Human
uuuguuuucugcugcagugggg

SEQ ID NO: 41977 - RNA, 22 nt, Human
accacggcuucucuccagccuu

SEQ ID NO: 41978 - RNA, 23 nt, Human
aggcacucuaccuugcccuugcc

SEQ ID NO: 41979 - RNA, 21 nt, Human
caccaccacggcuucucucca

SEQ ID NO: 41980 - RNA, 18 nt, Human
ccccgcggccccgcaggg

SEQ ID NO: 41981 - RNA, 24 nt, Human
ccgcggccccgcaggggagggagg

SEQ ID NO: 41982 - RNA, 18 nt, Human
ccuccccgcggccccgca

SEQ ID NO: 41983 - RNA, 18 nt, Human
ggcaccagccccucugcc

SEQ ID NO: 41984 - RNA, 19 nt, Human
ucccagggccuccccgcgg

SEQ ID NO: 41985 - RNA, 24 nt, Human
ucugccagccugaguccagggcuc

SEQ ID NO: 41986 - RNA, 19 nt, Human
aaugcaguuuaaacuauga

SEQ ID NO: 41987 - RNA, 24 nt, Human
acaaauauuaaaaaguauuuaaca

SEQ ID NO: 41988 - RNA, 24 nt, Human
accuaaaggaaacgaacagcggcc

SEQ ID NO: 41989 - RNA, 24 nt, Human
acucuguuccuuuaauuacgaagu

SEQ ID NO: 41990 - RNA, 23 nt, Human
acuuuaugcaaacauuucaauac

SEQ ID NO: 41991 - RNA, 22 nt, Human
aggaggaauguucuggcuuccg

SEQ ID NO: 41992 - RNA, 21 nt, Human
cagccaaucagccucaccaca

SEQ ID NO: 41993 - RNA, 18 nt, Human
cagcccacgccccggcgc

SEQ ID NO: 41994 - RNA, 18 nt, Human
cagccucaccacagauga

SEQ ID NO: 41995 - RNA, 18 nt, Human
caggcuuccuguggcaaa

SEQ ID NO: 41996 - RNA, 24 nt, Human
cauuucaauacuuuuugcuacuuc

SEQ ID NO: 41997 - RNA, 23 nt, Human
ccagccaaucagccucaccacag

SEQ ID NO: 41998 - RNA, 22 nt, Human
ccucgagaaacugcgaaacagg

SEQ ID NO: 41999 - RNA, 23 nt, Human
cgaacagcggccucugcuucuuu

SEQ ID NO: 42000 - RNA, 18 nt, Human
cuggagaauaucugaaua

SEQ ID NO: 42001 - RNA, 25 nt, Human
cuucauaauucuguaaguguuugcu

SEQ ID NO: 42002 - RNA, 26 nt, Human
gaccucgcgcuccuuggaacggccac

SEQ ID NO: 42003 - RNA, 22 nt, Human
gagaaacugcgaaacagguuga

SEQ ID NO: 42004 - RNA, 22 nt, Human
ggagaaugagaaaugaucucua

SEQ ID NO: 42005 - RNA, 18 nt, Human
ggcgcuguuccugcccag

SEQ ID NO: 42006 - RNA, 20 nt, Human
ucacucuguuccuuuaauua

SEQ ID NO: 42007 - RNA, 24 nt, Human
ucaguuacaguccaaaugggaaaa

SEQ ID NO: 42008 - RNA, 18 nt, Human
uccuaggagaaugagaaa

SEQ ID NO: 42009 - RNA, 25 nt, Human
uccuuggaacggccaccaagacgug

SEQ ID NO: 42010 - RNA, 21 nt, Human
ucugaacuugacugaggaaau

SEQ ID NO: 42011 - RNA, 20 nt, Human
ugaagacucugaacuugacu

SEQ ID NO: 42012 - RNA, 21 nt, Human
ugagcucaggcuuccuguggc

SEQ ID NO: 42013 - RNA, 21 nt, Human
ugaugucucucacucuguucc

SEQ ID NO: 42014 - RNA, 24 nt, Human
ugaugucucucacucuguuccuuu

SEQ ID NO: 42015 - RNA, 24 nt, Human
ugcuuuuaacuuugaauaaauguc

SEQ ID NO: 42016 - RNA, 20 nt, Human
uggaagaagauacuccgacu

SEQ ID NO: 42017 - RNA, 24 nt, Human
uggagaauaucugaauagaguagg

SEQ ID NO: 42018 - RNA, 22 nt, Human
uguaaguguuugcuuuuaacuu

SEQ ID NO: 42019 - RNA, 24 nt, Human
uuuaggaaucuggagaauaucuga

SEQ ID NO: 42020 - RNA, 24 nt, Human
aaaagaaaauacaaaaccugaaaa

SEQ ID NO: 42021 - RNA, 21 nt, Human
aaaauguugaaaacugcacau

SEQ ID NO: 42022 - RNA, 19 nt, Human
aaauaaagcuucugcccuu

SEQ ID NO: 42023 - RNA, 20 nt, Human
aaauacaugccuucaaacaa

SEQ ID NO: 42024 - RNA, 26 nt, Human
aaauacaugccuucaaacaacuuaaa

SEQ ID NO: 42025 - RNA, 22 nt, Human
aaauguugaaaacugcacauau

SEQ ID NO: 42026 - RNA, 20 nt, Human
aaauuaacagcacugauaca

SEQ ID NO: 42027 - RNA, 19 nt, Human
acaaaaccugaaaauaacu

SEQ ID NO: 42028 - RNA, 18 nt, Human
acaaggauuauuuuccuc

SEQ ID NO: 42029 - RNA, 20 nt, Human
acaugccuucaaacaacuuu

SEQ ID NO: 42030 - RNA, 27 nt, Human
agaaaagaaaauacaaaaccugaaaaa

SEQ ID NO: 42031 - RNA, 18 nt, Human
agacuauaaauaaaacua

SEQ ID NO: 42032 - RNA, 23 nt, Human
agacuauaaauaaaacuauaacc

SEQ ID NO: 42033 - RNA, 24 nt, Human
auuuuagccuuauuaaugaaauuc

SEQ ID NO: 42034 - RNA, 27 nt, Human
caaaaaauaaagcuucugcccuuuuaa

SEQ ID NO: 42035 - RNA, 27 nt, Human
caaaaccugaaaauaacuucagugcua

SEQ ID NO: 42036 - RNA, 22 nt, Human
caaaauguugaaaacugcacag

SEQ ID NO: 42037 - RNA, 23 nt, Human
caacuuaaaugcaaaaaucauuc

SEQ ID NO: 42038 - RNA, 22 nt, Human
caagaaaagaaaauacaaaacc

SEQ ID NO: 42039 - RNA, 23 nt, Human
cacaaggauuauuuuccucagau

SEQ ID NO: 42040 - RNA, 20 nt, Human
caccuuugaagacacaggag

SEQ ID NO: 42041 - RNA, 21 nt, Human
cagggaacuaauaaauucuua

SEQ ID NO: 42042 - RNA, 24 nt, Human
ccacaagaaaagaaaauacaaaac

SEQ ID NO: 42043 - RNA, 25 nt, Human
cccguacgccucagcccgccggcca

SEQ ID NO: 42044 - RNA, 24 nt, Human
ccucagcucucaacaccuuugaag

SEQ ID NO: 42045 - RNA, 18 nt, Human
gaaaagaaaauacaaaac

SEQ ID NO: 42046 - RNA, 21 nt, Human
gaaaaucacacuuuauaaaga

SEQ ID NO: 42047 - RNA, 19 nt, Human
gcaaggacuuccaaacuua

SEQ ID NO: 42048 - RNA, 23 nt, Human
ggaacacauauuccucagcucuc

SEQ ID NO: 42049 - RNA, 25 nt, Human
ggaacacauauuccucagcucucaa

SEQ ID NO: 42050 - RNA, 20 nt, Human
ggagaaaaagcacuuuuucu

SEQ ID NO: 42051 - RNA, 24 nt, Human
ggagaugggcaauauaaauguucc

SEQ ID NO: 42052 - RNA, 23 nt, Human
uaaaaaugauugucacagaugua

SEQ ID NO: 42053 - RNA, 23 nt, Human
uaaaaguagguagaauacuacca

SEQ ID NO: 42054 - RNA, 24 nt, Human
uaaaugcaaaaaucauucauucuu

SEQ ID NO: 42055 - RNA, 18 nt, Human
uaacagcacugauacaaa

SEQ ID NO: 42056 - RNA, 21 nt, Human
uacaugccuucaaacaacuuu

SEQ ID NO: 42057 - RNA, 18 nt, Human
uagccuuauuaaugaaau

SEQ ID NO: 42058 - RNA, 21 nt, Human
uagguagaauacuaccagaag

SEQ ID NO: 42059 - RNA, 23 nt, Human
uaguucaugggaaaacuuccauu

SEQ ID NO: 42060 - RNA, 20 nt, Human
uaucagaaaauaaaacauaa

SEQ ID NO: 42061 - RNA, 22 nt, Human
ucauguaucagaaaauaaaaca

SEQ ID NO: 42062 - RNA, 22 nt, Human
uccacaagaaaagaaaauacaa

SEQ ID NO: 42063 - RNA, 20 nt, Human
uccucagcucucaacaccuu

SEQ ID NO: 42064 - RNA, 24 nt, Human
ucucauauuguuuaccaguaauug

SEQ ID NO: 42065 - RNA, 22 nt, Human
ugaaauagugguuucuucuucc

SEQ ID NO: 42066 - RNA, 21 nt, Human
ugaggcaacagcaaauuaaca

SEQ ID NO: 42067 - RNA, 23 nt, Human
ugcacauauucaaacauaguucc

SEQ ID NO: 42068 - RNA, 19 nt, Human
uguaucagaaaauaaaaca

SEQ ID NO: 42069 - RNA, 19 nt, Human
uguguuguuugcuuucuga

SEQ ID NO: 42070 - RNA, 25 nt, Human
uuaaaaaacauguuuuccuguucaa

SEQ ID NO: 42071 - RNA, 21 nt, Human
uuaaagucucauauuguuuac

SEQ ID NO: 42072 - RNA, 20 nt, Human
uuccucagcucucaacaccu

SEQ ID NO: 42073 - RNA, 21 nt, Human
uuccucagcucucaacaccuu

SEQ ID NO: 42074 - RNA, 19 nt, Human
uucgcaaaaguacucauac

SEQ ID NO: 42075 - RNA, 22 nt, Human
aaagcucaugcuaauacuuucc

SEQ ID NO: 42076 - RNA, 21 nt, Human
aagaaaaaacaaucccagcaa

SEQ ID NO: 42077 - RNA, 19 nt, Human
aagacaguucucugcccuu

SEQ ID NO: 42078 - RNA, 23 nt, Human
aagcacugagugguggcugagcu

SEQ ID NO: 42079 - RNA, 23 nt, Human
aaucccagcaaucccuccugcug

SEQ ID NO: 42080 - RNA, 27 nt, Human
acccugugaauaugaauuugaggaagc

SEQ ID NO: 42081 - RNA, 27 nt, Human
agcauccacccuuucccuauccuuagc

SEQ ID NO: 42082 - RNA, 19 nt, Human
agcugccacuugacauugg

SEQ ID NO: 42083 - RNA, 21 nt, Human
aggccauuagaaauuagcuuc

SEQ ID NO: 42084 - RNA, 22 nt, Human
cacugagugguggcugagcugc

SEQ ID NO: 42085 - RNA, 20 nt, Human
cagagaagcacugaguggug

SEQ ID NO: 42086 - RNA, 26 nt, Human
cauuggguuuucccucauauggaccc

SEQ ID NO: 42087 - RNA, 18 nt, Human
ccaccccuacacucacuc

SEQ ID NO: 42088 - RNA, 21 nt, Human
cccucagccugagagcaucca

SEQ ID NO: 42089 - RNA, 18 nt, Human
cgacccugugaauaugaa

SEQ ID NO: 42090 - RNA, 19 nt, Human
cugagcugccacuugacau

SEQ ID NO: 42091 - RNA, 21 nt, Human
cuguaaaaguaaaauauuaac

SEQ ID NO: 42092 - RNA, 21 nt, Human
cugugaauaugaauuugagga

SEQ ID NO: 42093 - RNA, 20 nt, Human
ggagaguuaaaagguuucaa

SEQ ID NO: 42094 - RNA, 20 nt, Human
uaaaagguuucacaaccuuu

SEQ ID NO: 42095 - RNA, 20 nt, Human
uaauugcaacccacagccaa

SEQ ID NO: 42096 - RNA, 27 nt, Human
uauccuuagccuuagagaugaaggaag

SEQ ID NO: 42097 - RNA, 27 nt, Human
ucaggacuggcuccugcacagagaaaa

SEQ ID NO: 42098 - RNA, 24 nt, Human
ucccugaugucucacuaauuccca

SEQ ID NO: 42099 - RNA, 23 nt, Human
ugaaagacaguucucugcccuug

SEQ ID NO: 42100 - RNA, 18 nt, Human
ugacauuggguuuucccu

SEQ ID NO: 42101 - RNA, 23 nt, Human
ugacuguaaaaguaaaauauuaa

SEQ ID NO: 42102 - RNA, 19 nt, Human
ugagagcauccacccuuuc

SEQ ID NO: 42103 - RNA, 19 nt, Human
ugcugggauuguuuuuuuc

SEQ ID NO: 42104 - RNA, 22 nt, Human
ugggauuguuuuuuucuuuaaa

SEQ ID NO: 42105 - RNA, 23 nt, Human
uguauacacaucuaaagcagaau

SEQ ID NO: 42106 - RNA, 18 nt, Human
uuugaggaagccagagga

SEQ ID NO: 42107 - RNA, 19 nt, Human
uuugaggaagccagaggaa

SEQ ID NO: 42108 - RNA, 23 nt, Human
aaaaacacuggaaucauccugca

SEQ ID NO: 42109 - RNA, 22 nt, Human
aaaacacuggaaucauccugca

SEQ ID NO: 42110 - RNA, 20 nt, Human
aaaauucccucuugcauucc

SEQ ID NO: 42111 - RNA, 21 nt, Human
aaaauucccucuugcauuccu

SEQ ID NO: 42112 - RNA, 22 nt, Human
aagccacuaucaucuccaccug

SEQ ID NO: 42113 - RNA, 21 nt, Human
aagguggaacuugacuugaaa

SEQ ID NO: 42114 - RNA, 23 nt, Human
aaguuugaucuuuccacacuacc

SEQ ID NO: 42115 - RNA, 20 nt, Human
acacuggaaucauccugcaa

SEQ ID NO: 42116 - RNA, 20 nt, Human
acaguuucuucagucucugc

SEQ ID NO: 42117 - RNA, 22 nt, Human
acccaaauuccuucccuucacu

SEQ ID NO: 42118 - RNA, 23 nt, Human
acuuaccagcaucuguaccaaca

SEQ ID NO: 42119 - RNA, 19 nt, Human
agcacuuucccauguacca

SEQ ID NO: 42120 - RNA, 21 nt, Human
aggaacgcuguuggugcccuc

SEQ ID NO: 42121 - RNA, 22 nt, Human
agucuaccaugaccaugaggau

SEQ ID NO: 42122 - RNA, 19 nt, Human
aucuuuuucauauagauuc

SEQ ID NO: 42123 - RNA, 18 nt, Human
auucuguucuuuuacauc

SEQ ID NO: 42124 - RNA, 23 nt, Human
auuucuuccaucuugaaaaacaa

SEQ ID NO: 42125 - RNA, 22 nt, Human
caacaaaaacacuggaaucauc

SEQ ID NO: 42126 - RNA, 18 nt, Human
cacauuaugcuccuuggg

SEQ ID NO: 42127 - RNA, 23 nt, Human
cacucugucuuucugaauauauc

SEQ ID NO: 42128 - RNA, 18 nt, Human
cagaaucugaccuuugcc

SEQ ID NO: 42129 - RNA, 23 nt, Human
cagcaucuguaccaacacucugc

SEQ ID NO: 42130 - RNA, 24 nt, Human
cagguggcacugaacccaauuauc

SEQ ID NO: 42131 - RNA, 21 nt, Human
cagucacacagcuuuaaauac

SEQ ID NO: 42132 - RNA, 24 nt, Human
caucuugaaaaacaaacaaaaaac

SEQ ID NO: 42133 - RNA, 19 nt, Human
ccaugccugcuggaucccu

SEQ ID NO: 42134 - RNA, 21 nt, Human
ccaugccugcuggaucccucc

SEQ ID NO: 42135 - RNA, 20 nt, Human
ccauucuucccuuucugucc

SEQ ID NO: 42136 - RNA, 25 nt, Human
cccaaauuccuucccuucacugguc

SEQ ID NO: 42137 - RNA, 23 nt, Human
ccccaugccugcuggaucccucc

SEQ ID NO: 42138 - RNA, 20 nt, Human
cccugcaccuccagcucuac

SEQ ID NO: 42139 - RNA, 18 nt, Human
ccgugcuuauuucacuga

SEQ ID NO: 42140 - RNA, 22 nt, Human
ccuccagcucuaccaccaucau

SEQ ID NO: 42141 - RNA, 22 nt, Human
ccucgaaccucgcgcgugucug

SEQ ID NO: 42142 - RNA, 23 nt, Human
ccucugcauccugcucugccugc

SEQ ID NO: 42143 - RNA, 28 nt, Human
ccucugcauccugcucugccugccaccu

SEQ ID NO: 42144 - RNA, 19 nt, Human
ccucuugcauuccugacuc

SEQ ID NO: 42145 - RNA, 27 nt, Human
cucagccucgaaccucgcgccgguucc

SEQ ID NO: 42146 - RNA, 23 nt, Human
cucauuagcacauaaggagauga

SEQ ID NO: 42147 - RNA, 19 nt, Human
cuccagcucuaccaccauc

SEQ ID NO: 42148 - RNA, 22 nt, Human
cucuccauaucagucuaccaug

SEQ ID NO: 42149 - RNA, 23 nt, Human
cucuugaccacacuuccccugcc

SEQ ID NO: 42150 - RNA, 18 nt, Human
gaccacacuuccccugcc

SEQ ID NO: 42151 - RNA, 20 nt, Human
gaggaggaacgcuguuggug

SEQ ID NO: 42152 - RNA, 23 nt, Human
gccucgaaccucgcgcgugucug

SEQ ID NO: 42153 - RNA, 21 nt, Human
ggugcccucuuagcacuuucc

SEQ ID NO: 42154 - RNA, 22 nt, Human
uaaaauauacuguagcaaaagu

SEQ ID NO: 42155 - RNA, 25 nt, Human
uaaaugaacuauucaugccucucuu

SEQ ID NO: 42156 - RNA, 18 nt, Human
uacaucuucacauucugc

SEQ ID NO: 42157 - RNA, 19 nt, Human
uacaucuucacauucugcu

SEQ ID NO: 42158 - RNA, 20 nt, Human
uaccaucuguaucgaauaau

SEQ ID NO: 42159 - RNA, 22 nt, Human
uacucugagacggaagcaguug

SEQ ID NO: 42160 - RNA, 26 nt, Human
uagaauggaacuccauaaccuccuac

SEQ ID NO: 42161 - RNA, 23 nt, Human
uaggaaggaccagaagaaggaua

SEQ ID NO: 42162 - RNA, 20 nt, Human
ucaacaaaaacacuggaauc

SEQ ID NO: 42163 - RNA, 23 nt, Human
ucaacuacuuaccuaacacugga

SEQ ID NO: 42164 - RNA, 23 nt, Human
ucaagcuuaacaugccuaaccug

SEQ ID NO: 42165 - RNA, 22 nt, Human
ucacacagcuuuaaauaccauc

SEQ ID NO: 42166 - RNA, 19 nt, Human
ucacuggucuaacaggcgg

SEQ ID NO: 42167 - RNA, 19 nt, Human
ucagucagucacacagcuu

SEQ ID NO: 42168 - RNA, 23 nt, Human
uccacuuaccagcaucuguacca

SEQ ID NO: 42169 - RNA, 22 nt, Human
uccagguggcacugaacccaau

SEQ ID NO: 42170 - RNA, 19 nt, Human
uccccaggcugggcccucc

SEQ ID NO: 42171 - RNA, 20 nt, Human
ucccucuuuuccuuuggagc

SEQ ID NO: 42172 - RNA, 23 nt, Human
ucccuuucuguccuauaucauca

SEQ ID NO: 42173 - RNA, 19 nt, Human
uccuuugaugccuucucuc

SEQ ID NO: 42174 - RNA, 19 nt, Human
uccuuuggagcuaaacugg

SEQ ID NO: 42175 - RNA, 18 nt, Human
ucuaacaggcggucagau

SEQ ID NO: 42176 - RNA, 24 nt, Human
ucucaagcuuaacaugccuaaccu

SEQ ID NO: 42177 - RNA, 21 nt, Human
ucuccauaucagucuaccaug

SEQ ID NO: 42178 - RNA, 24 nt, Human
ucucuucuuaaaucaacccaaauu

SEQ ID NO: 42179 - RNA, 19 nt, Human
ugaaagaaggcuuguggug

SEQ ID NO: 42180 - RNA, 21 nt, Human
ugaaagaaggcuuguggugac

SEQ ID NO: 42181 - RNA, 19 nt, Human
ugaaguguuuagaauggaa

SEQ ID NO: 42182 - RNA, 18 nt, Human
ugaccacacuuccccugc

SEQ ID NO: 42183 - RNA, 20 nt, Human
ugaccuuugcccugcaccuc

SEQ ID NO: 42184 - RNA, 23 nt, Human
ugcauguucauccuguagauccc

SEQ ID NO: 42185 - RNA, 20 nt, Human
ugcuguuucuguaaaugaac

SEQ ID NO: 42186 - RNA, 19 nt, Human
ugcuuugcuaaguccaaag

SEQ ID NO: 42187 - RNA, 23 nt, Human
uggaacuccauaaccuccuacca

SEQ ID NO: 42188 - RNA, 22 nt, Human
uggggaggaggaacgcuguugg

SEQ ID NO: 42189 - RNA, 20 nt, Human
uggugcccucuuagcacuuu

SEQ ID NO: 42190 - RNA, 22 nt, Human
uggugcccucuuagcacuuucc

SEQ ID NO: 42191 - RNA, 19 nt, Human
uguguaguuugaaagaagg

SEQ ID NO: 42192 - RNA, 19 nt, Human
uguucucucugaaacccac

SEQ ID NO: 42193 - RNA, 19 nt, Human
uuaccuaacacuggagugg

SEQ ID NO: 42194 - RNA, 24 nt, Human
uucaagauacucugagacggaagc

SEQ ID NO: 42195 - RNA, 23 nt, Human
uucacauucugcuaaauuaccgg

SEQ ID NO: 42196 - RNA, 18 nt, Human
uuccuuggacuucucagu

SEQ ID NO: 42197 - RNA, 22 nt, Human
uuccuuggacuucucagucuau

SEQ ID NO: 42198 - RNA, 24 nt, Human
uugcauguucauccuguagauccc

SEQ ID NO: 42199 - RNA, 21 nt, Human
uugcuguuucuguaaaugaac

SEQ ID NO: 42200 - RNA, 22 nt, Human
uugcuuccgcauccccaguucu

SEQ ID NO: 42201 - RNA, 22 nt, Human
uugugcugugccucugcauccu

SEQ ID NO: 42202 - RNA, 19 nt, Human
uuguuugcauguucauccu

SEQ ID NO: 42203 - RNA, 20 nt, Human
uuuguuugcauguucauccu

SEQ ID NO: 42204 - RNA, 18 nt, Human
aaugcguggacgccggcc

SEQ ID NO: 42205 - RNA, 19 nt, Human
acaucuuauucccuucugg

SEQ ID NO: 42206 - RNA, 19 nt, Human
accccaagaccaggaugaa

SEQ ID NO: 42207 - RNA, 19 nt, Human
agcgcacgcgccgccgcca

SEQ ID NO: 42208 - RNA, 20 nt, Human
agggaaguggccaaacuuuu

SEQ ID NO: 42209 - RNA, 25 nt, Human
cagcacggccccgcuggcucugggc

SEQ ID NO: 42210 - RNA, 21 nt, Human
caggccucaccgcccacuccc

SEQ ID NO: 42211 - RNA, 19 nt, Human
cagggaaaggagacacauc

SEQ ID NO: 42212 - RNA, 21 nt, Human
ccacgcacucacgcagggcac

SEQ ID NO: 42213 - RNA, 25 nt, Human
ccccaaaagauguuuuucggaaagg

SEQ ID NO: 42214 - RNA, 21 nt, Human
ccccaagaccaggaugaaaua

SEQ ID NO: 42215 - RNA, 27 nt, Human
ccccaagaccaggaugaaauaagccag

SEQ ID NO: 42216 - RNA, 23 nt, Human
cccgcuggcucugggcccgggac

SEQ ID NO: 42217 - RNA, 22 nt, Human
ccgcuggcucugggcccgggac

SEQ ID NO: 42218 - RNA, 21 nt, Human
cgcacucacgcagggcacgua

SEQ ID NO: 42219 - RNA, 20 nt, Human
cggaaaggucccuuucccuu

SEQ ID NO: 42220 - RNA, 21 nt, Human
cggccgaggcugcgggcacug

SEQ ID NO: 42221 - RNA, 21 nt, Human
cgggggucccgggaagggacg

SEQ ID NO: 42222 - RNA, 20 nt, Human
cucugggcccgggacccuuc

SEQ ID NO: 42223 - RNA, 21 nt, Human
gggcgcggacauccgggugcc

SEQ ID NO: 42224 - RNA, 24 nt, Human
uagcaccauaccccaagaccagga

SEQ ID NO: 42225 - RNA, 19 nt, Human
ucuuugagagggaaguggc

SEQ ID NO: 42226 - RNA, 21 nt, Human
uggcucugggcccgggacccu

SEQ ID NO: 42227 - RNA, 20 nt, Human
uggguuagucuuugagaggg

SEQ ID NO: 42228 - RNA, 23 nt, Human
uuagucuuugagagggaaguggc

SEQ ID NO: 42229 - RNA, 22 nt, Human
uuuuuuuuuuuuuuuuucacag

SEQ ID NO: 42230 - RNA, 23 nt, Human
uuuuuuuuuuuuuuuuucacagu

SEQ ID NO: 42231 - RNA, 19 nt, Human
aacaaaaaaagaaaauguc

SEQ ID NO: 42232 - RNA, 26 nt, Human
acaauucugcuucagugcaaauaugu

SEQ ID NO: 42233 - RNA, 27 nt, Human
guaguccaaaacaacaaaaaaagaaaa

SEQ ID NO: 42234 - RNA, 19 nt, Human
uccaaaacaacaaaaaaag

SEQ ID NO: 42235 - RNA, 22 nt, Human
ugagcgaggaaagaggaaccga

SEQ ID NO: 42236 - RNA, 19 nt, Human
agggagggauuggccuccc

SEQ ID NO: 42237 - RNA, 21 nt, Human
augcuuggcagcgaccacacc

SEQ ID NO: 42238 - RNA, 22 nt, Human
cacccucaucccacugagggcu

SEQ ID NO: 42239 - RNA, 18 nt, Human
caggagccgccggcaaua

SEQ ID NO: 42240 - RNA, 19 nt, Human
caggagccgccggcaauag

SEQ ID NO: 42241 - RNA, 25 nt, Human
caguaggcucccccaggcugagccc

SEQ ID NO: 42242 - RNA, 25 nt, Human
cccagcccuaacacugaugcuuggc

SEQ ID NO: 42243 - RNA, 24 nt, Human
cccaggcugagccccagcccuaac

SEQ ID NO: 42244 - RNA, 21 nt, Human
ccccaggcugagccccagccc

SEQ ID NO: 42245 - RNA, 18 nt, Human
cccccaggcugagcccca

SEQ ID NO: 42246 - RNA, 23 nt, Human
cccccaggcugagccccagcccu

SEQ ID NO: 42247 - RNA, 23 nt, Human
ccucaucccacugagggcucuau

SEQ ID NO: 42248 - RNA, 23 nt, Human
ccugccagcugcucggccccggc

SEQ ID NO: 42249 - RNA, 21 nt, Human
cgaccacaccucagggggccc

SEQ ID NO: 42250 - RNA, 19 nt, Human
cgccggcaauagcaguuuc

SEQ ID NO: 42251 - RNA, 20 nt, Human
cugagccccagcccuaacac

SEQ ID NO: 42252 - RNA, 18 nt, Human
gacgcgguaaaacaggag

SEQ ID NO: 42253 - RNA, 20 nt, Human
ggaggggagggagggauugg

SEQ ID NO: 42254 - RNA, 21 nt, Human
ggaggggagggagggauuggc

SEQ ID NO: 42255 - RNA, 21 nt, Human
gggagggaggcagccggcagg

SEQ ID NO: 42256 - RNA, 21 nt, Human
gggauuggccuccccugccag

SEQ ID NO: 42257 - RNA, 23 nt, Human
ucaguccccaguaggcuccccca

SEQ ID NO: 42258 - RNA, 18 nt, Human
ucccccaggcugagcccc

SEQ ID NO: 42259 - RNA, 26 nt, Human
ucccccaggcugagccccagcccuaa

SEQ ID NO: 42260 - RNA, 24 nt, Human
uccccugccagcugcucggccccc

SEQ ID NO: 42261 - RNA, 18 nt, Human
ugggagggaggcagccgg

SEQ ID NO: 42262 - RNA, 18 nt, Human
uggggaggggagggaggg

SEQ ID NO: 42263 - RNA, 23 nt, Human
uggggaggggagggagggauugg

SEQ ID NO: 42264 - RNA, 22 nt, Human
aaaaacccugguaagaccuagg

SEQ ID NO: 42265 - RNA, 20 nt, Human
aaaaaggcagcucuaccuuu

SEQ ID NO: 42266 - RNA, 19 nt, Human
aaaccaaacaguaaaaacc

SEQ ID NO: 42267 - RNA, 26 nt, Human
aaagugcccgccauuacucccaauua

SEQ ID NO: 42268 - RNA, 18 nt, Human
aacaguaaaaacccuggu

SEQ ID NO: 42269 - RNA, 21 nt, Human
aaguuucuagaacaucuuggu

SEQ ID NO: 42270 - RNA, 21 nt, Human
accaggggcaagaugcaggaa

SEQ ID NO: 42271 - RNA, 24 nt, Human
accucuggcaaagccagauccugg

SEQ ID NO: 42272 - RNA, 23 nt, Human
accuuugcuuaggaggcuaggga

SEQ ID NO: 42273 - RNA, 18 nt, Human
acucccaauuagaaaaag

SEQ ID NO: 42274 - RNA, 23 nt, Human
agacagaugcccuccacgcuccc

SEQ ID NO: 42275 - RNA, 22 nt, Human
agacaggcugaccugcccgggc

SEQ ID NO: 42276 - RNA, 24 nt, Human
agaugcccuccacgcucccuaccc

SEQ ID NO: 42277 - RNA, 24 nt, Human
agccagggguggguggacgagggg

SEQ ID NO: 42278 - RNA, 21 nt, Human
aggccaggccuguuaccuggc

SEQ ID NO: 42279 - RNA, 18 nt, Human
aggcguuggcucagggca

SEQ ID NO: 42280 - RNA, 20 nt, Human
aggcguuggcucagggcagc

SEQ ID NO: 42281 - RNA, 21 nt, Human
agguuuaaaaaggcagcucua

SEQ ID NO: 42282 - RNA, 27 nt, Human
aucccauccaccaaagacagaagagaa

SEQ ID NO: 42283 - RNA, 23 nt, Human
aucccguuccccgugucccuccg

SEQ ID NO: 42284 - RNA, 19 nt, Human
augaacauccacguggccu

SEQ ID NO: 42285 - RNA, 20 nt, Human
cacccgcgcugcgccgcugc

SEQ ID NO: 42286 - RNA, 24 nt, Human
cagacagaugcccuccacgcuccc

SEQ ID NO: 42287 - RNA, 21 nt, Human
caggcuacuaaggaagggcca

SEQ ID NO: 42288 - RNA, 18 nt, Human
cagugcugcaggccuggg

SEQ ID NO: 42289 - RNA, 26 nt, Human
ccaauuagaaaaagguuuuugaaauc

SEQ ID NO: 42290 - RNA, 18 nt, Human
ccacccgcgcugcgccgc

SEQ ID NO: 42291 - RNA, 23 nt, Human
ccagggguggguggacgaggggc

SEQ ID NO: 42292 - RNA, 22 nt, Human
ccccaccgggagaagcaggggc

SEQ ID NO: 42293 - RNA, 22 nt, Human
cccgcgcugcgccgcugcaagg

SEQ ID NO: 42294 - RNA, 24 nt, Human
cccgcgcugcgccgcugcaagguc

SEQ ID NO: 42295 - RNA, 25 nt, Human
cccgcgcugcgccgcugcaaggucg

SEQ ID NO: 42296 - RNA, 27 nt, Human
cccuacccgcccuggccagacucacag

SEQ ID NO: 42297 - RNA, 22 nt, Human
cccuccacgcucccuacccgcc

SEQ ID NO: 42298 - RNA, 21 nt, Human
cccuggccagacucacagagc

SEQ ID NO: 42299 - RNA, 22 nt, Human
ccgcucuucccgcugcuccucc

SEQ ID NO: 42300 - RNA, 21 nt, Human
ccgggcugggcaccccugagg

SEQ ID NO: 42301 - RNA, 19 nt, Human
ccugcugguuggagguggg

SEQ ID NO: 42302 - RNA, 20 nt, Human
cgcgcugcucauugaagacu

SEQ ID NO: 42303 - RNA, 19 nt, Human
cgugggcacaucugccagg

SEQ ID NO: 42304 - RNA, 18 nt, Human
cuccagacagcagagcac

SEQ ID NO: 42305 - RNA, 23 nt, Human
cuccgcucuucccgcugcuccuc

SEQ ID NO: 42306 - RNA, 23 nt, Human
cuggacaucccccaggcuacuaa

SEQ ID NO: 42307 - RNA, 21 nt, Human
cuggccagccccucacucccc

SEQ ID NO: 42308 - RNA, 20 nt, Human
cugguuggaggugggcgggu

SEQ ID NO: 42309 - RNA, 18 nt, Human
gaacauccacguggccuc

SEQ ID NO: 42310 - RNA, 19 nt, Human
gaccuagguuuaaaaaggc

SEQ ID NO: 42311 - RNA, 21 nt, Human
gagcacaggggcggguguggg

SEQ ID NO: 42312 - RNA, 19 nt, Human
gcaccggguccucugcccc

SEQ ID NO: 42313 - RNA, 22 nt, Human
gccggaccggguccuccccccg

SEQ ID NO: 42314 - RNA, 24 nt, Human
gcgcgcagcaggcucgggucuggg

SEQ ID NO: 42315 - RNA, 23 nt, Human
ggaccaggggcaagaugcaggaa

SEQ ID NO: 42316 - RNA, 18 nt, Human
ggagggcagcugggggcc

SEQ ID NO: 42317 - RNA, 18 nt, Human
ggcaccggguccucugcc

SEQ ID NO: 42318 - RNA, 19 nt, Human
ggcagacagaugcccucca

SEQ ID NO: 42319 - RNA, 21 nt, Human
ggcgggugcugaaggccaggu

SEQ ID NO: 42320 - RNA, 21 nt, Human
gggaagccccuucucuggagg

SEQ ID NO: 42321 - RNA, 22 nt, Human
gggagggaggcugccagccagg

SEQ ID NO: 42322 - RNA, 18 nt, Human
gggcacaucugccaggca

SEQ ID NO: 42323 - RNA, 18 nt, Human
gggcggguguggggaggg

SEQ ID NO: 42324 - RNA, 26 nt, Human
ggguaaggagugcccugggaaugggg

SEQ ID NO: 42325 - RNA, 24 nt, Human
ggguguggggagggaggcugccag

SEQ ID NO: 42326 - RNA, 24 nt, Human
ggugcugaaggccagguuguagcu

SEQ ID NO: 42327 - RNA, 21 nt, Human
uagcucacgggggcaaggcca

SEQ ID NO: 42328 - RNA, 21 nt, Human
uaguacacuuuauugaccggg

SEQ ID NO: 42329 - RNA, 19 nt, Human
uagucucuggacauccccc

SEQ ID NO: 42330 - RNA, 22 nt, Human
ucaaaccaaacaguaaaaaccc

SEQ ID NO: 42331 - RNA, 20 nt, Human
ucccgcugcuccuccccgcc

SEQ ID NO: 42332 - RNA, 25 nt, Human
ucccuacccgcccuggccagacuca

SEQ ID NO: 42333 - RNA, 19 nt, Human
uccuccccgccucccaccc

SEQ ID NO: 42334 - RNA, 18 nt, Human
ucgcuccgcucuucccgc

SEQ ID NO: 42335 - RNA, 19 nt, Human
ucuucccgcugcuccuccc

SEQ ID NO: 42336 - RNA, 22 nt, Human
ugcaggaagcggugauccaugg

SEQ ID NO: 42337 - RNA, 19 nt, Human
ugcccugggaauggggcag

SEQ ID NO: 42338 - RNA, 19 nt, Human
uggcaagagggagagacgg

SEQ ID NO: 42339 - RNA, 20 nt, Human
uggcucagggcagcaggggu

SEQ ID NO: 42340 - RNA, 19 nt, Human
ugggagggggcgcgcagca

SEQ ID NO: 42341 - RNA, 23 nt, Human
ugggagggggcgcgcagcaggcu

SEQ ID NO: 42342 - RNA, 19 nt, Human
ugggcgggugcugaaggcc

SEQ ID NO: 42343 - RNA, 23 nt, Human
uggggagggaggcugccagccag

SEQ ID NO: 42344 - RNA, 19 nt, Human
ugguuggaggugggcgggu

SEQ ID NO: 42345 - RNA, 22 nt, Human
ugguuggaggugggcgggugcu

SEQ ID NO: 42346 - RNA, 22 nt, Human
uuagaaaaagguuuuugaaauc

SEQ ID NO: 42347 - RNA, 20 nt, Human
uucccgcugcuccuccccgc

SEQ ID NO: 42348 - RNA, 21 nt, Human
uucgugugguucacagugaga

SEQ ID NO: 42349 - RNA, 22 nt, Human
uuugccaccaucccauccacca

SEQ ID NO: 42350 - RNA, 18 nt, Human
aaaagaaaaaagggaaag

SEQ ID NO: 42351 - RNA, 22 nt, Human
aaagaaaaaagggaaagccugg

SEQ ID NO: 42352 - RNA, 30 nt, Human
aaagaacaaaaucaaucaacacuguaagcc

SEQ ID NO: 42353 - RNA, 20 nt, Human
aaagacuugcaguccacaga

SEQ ID NO: 42354 - RNA, 21 nt, Human
aacaaaagaaaaaagggaaag

SEQ ID NO: 42355 - RNA, 22 nt, Human
aaccaauuccuccagaagucug

SEQ ID NO: 42356 - RNA, 18 nt, Human
aaccacaaaacugcagcc

SEQ ID NO: 42357 - RNA, 21 nt, Human
aagaaaaaagggaaagccugg

SEQ ID NO: 42358 - RNA, 19 nt, Human
aaggucaaauucccaugag

SEQ ID NO: 42359 - RNA, 21 nt, Human
agaaaagaggugguaagaaaa

SEQ ID NO: 42360 - RNA, 23 nt, Human
agaggcugccucuggcccaaaac

SEQ ID NO: 42361 - RNA, 21 nt, Human
agccccagguggaacgucggc

SEQ ID NO: 42362 - RNA, 19 nt, Human
agccggggccggggccgca

SEQ ID NO: 42363 - RNA, 25 nt, Human
aggaggacaggcgugggagugcaga

SEQ ID NO: 42364 - RNA, 20 nt, Human
aggcugccucuggcccaaaa

SEQ ID NO: 42365 - RNA, 21 nt, Human
aggcugccucuggcccaaaac

SEQ ID NO: 42366 - RNA, 19 nt, Human
agguaccaugagagggaaa

SEQ ID NO: 42367 - RNA, 21 nt, Human
aguuccagguccagguuagcc

SEQ ID NO: 42368 - RNA, 23 nt, Human
auuuucuccaggccccucaacca

SEQ ID NO: 42369 - RNA, 25 nt, Human
caaaacuccuccgugggaagcacca

SEQ ID NO: 42370 - RNA, 23 nt, Human
caaaaucaaucaacacuguaagc

SEQ ID NO: 42371 - RNA, 21 nt, Human
caaagacuugcaguccacaga

SEQ ID NO: 42372 - RNA, 18 nt, Human
caacacuguaagcaacca

SEQ ID NO: 42373 - RNA, 23 nt, Human
caaccaacacugcuuugggccag

SEQ ID NO: 42374 - RNA, 20 nt, Human
caaccaauuccuccagaagu

SEQ ID NO: 42375 - RNA, 23 nt, Human
caaccacaaaacugcagccccaa

SEQ ID NO: 42376 - RNA, 23 nt, Human
cacugccaaggggagaaaaugau

SEQ ID NO: 42377 - RNA, 20 nt, Human
cagguaccaugagagggaaa

SEQ ID NO: 42378 - RNA, 21 nt, Human
caguuccaggcaggggaccgg

SEQ ID NO: 42379 - RNA, 22 nt, Human
caguuccagguccagguuagcc

SEQ ID NO: 42380 - RNA, 21 nt, Human
ccccagguggaacgucggccc

SEQ ID NO: 42381 - RNA, 21 nt, Human
ccccucaaccacaaaacugca

SEQ ID NO: 42382 - RNA, 18 nt, Human
ccccuggcccuacaguuc

SEQ ID NO: 42383 - RNA, 21 nt, Human
ccccuggcccuacaguuccag

SEQ ID NO: 42384 - RNA, 25 nt, Human
cccugggcgcuggcauauaggcccu

SEQ ID NO: 42385 - RNA, 19 nt, Human
ccuacaguuccagguccag

SEQ ID NO: 42386 - RNA, 24 nt, Human
ccuacaguuccagguccagguuag

SEQ ID NO: 42387 - RNA, 21 nt, Human
ccucuggcccaaaacgagaac

SEQ ID NO: 42388 - RNA, 22 nt, Human
cggcggcggcgcagggagccgg

SEQ ID NO: 42389 - RNA, 21 nt, Human
cuaggaucuucuauacaacca

SEQ ID NO: 42390 - RNA, 23 nt, Human
cucaaagacuugcaguccacaga

SEQ ID NO: 42391 - RNA, 19 nt, Human
cuccugggucuucacagcc

SEQ ID NO: 42392 - RNA, 18 nt, Human
cuggcgcugagaugcugg

SEQ ID NO: 42393 - RNA, 19 nt, Human
cuggcgcugagaugcuggu

SEQ ID NO: 42394 - RNA, 18 nt, Human
gaacugguagagcuggcg

SEQ ID NO: 42395 - RNA, 18 nt, Human
gagagggaaagaaaagag

SEQ ID NO: 42396 - RNA, 19 nt, Human
gagauccgaggcaguaggc

SEQ ID NO: 42397 - RNA, 19 nt, Human
gaggcuugguuuaccaggg

SEQ ID NO: 42398 - RNA, 19 nt, Human
gagucggggugggugggga

SEQ ID NO: 42399 - RNA, 22 nt, Human
gauguuagaggugaugggagcc

SEQ ID NO: 42400 - RNA, 19 nt, Human
gccaaggggagaaaaugau

SEQ ID NO: 42401 - RNA, 18 nt, Human
gcggcggcgcagggagcc

SEQ ID NO: 42402 - RNA, 19 nt, Human
gcggcggcggcggcggcgc

SEQ ID NO: 42403 - RNA, 20 nt, Human
gcggcggcggcggcggcggc

SEQ ID NO: 42404 - RNA, 20 nt, Human
gcggcggcggcggcggcggc

SEQ ID NO: 42405 - RNA, 20 nt, Human
gcggcggcggcggcggcggc

SEQ ID NO: 42406 - RNA, 20 nt, Human
gcggcggcggcggcggcggc

SEQ ID NO: 42407 - RNA, 20 nt, Human
gcggcggcggcggcggcggc

SEQ ID NO: 42408 - RNA, 20 nt, Human
gcggcggcggcggcggcggc

SEQ ID NO: 42409 - RNA, 20 nt, Human
gcggcggcggcggcggcggc

SEQ ID NO: 42410 - RNA, 20 nt, Human
gcggcggcggcggcggcggc

SEQ ID NO: 42411 - RNA, 23 nt, Human
gcggcggcggcggcggcggcggc

SEQ ID NO: 42412 - RNA, 23 nt, Human
gcggcggcggcggcggcggcggc

SEQ ID NO: 42413 - RNA, 23 nt, Human
gcggcggcggcggcggcggcggc

SEQ ID NO: 42414 - RNA, 23 nt, Human
gcggcggcggcggcggcggcggc

SEQ ID NO: 42415 - RNA, 23 nt, Human
gcggcggcggcggcggcggcggc

SEQ ID NO: 42416 - RNA, 23 nt, Human
gcggcggcggcggcggcggcggc

SEQ ID NO: 42417 - RNA, 24 nt, Human
gcggcggcggcggcggcggcggcg

SEQ ID NO: 42418 - RNA, 24 nt, Human
gcggcggcggcggcggcggcggcg

SEQ ID NO: 42419 - RNA, 24 nt, Human
gcggcggcggcggcggcggcggcg

SEQ ID NO: 42420 - RNA, 24 nt, Human
gcggcggcggcggcggcggcggcg

SEQ ID NO: 42421 - RNA, 21 nt, Human
gcuggcggcggcggcggcggc

SEQ ID NO: 42422 - RNA, 19 nt, Human
ggaggcuugguuuaccagg

SEQ ID NO: 42423 - RNA, 24 nt, Human
ggagucgggguggguggggaggga

SEQ ID NO: 42424 - RNA, 23 nt, Human
ggauguuagaggugaugggagcc

SEQ ID NO: 42425 - RNA, 26 nt, Human
ggccccucaaccacaaaacugcagcc

SEQ ID NO: 42426 - RNA, 20 nt, Human
ggcggcggcggcggcggcgg

SEQ ID NO: 42427 - RNA, 23 nt, Human
ggcggcggcggcggcggcggcgg

SEQ ID NO: 42428 - RNA, 23 nt, Human
ggcggcggcggcggcggcggcgg

SEQ ID NO: 42429 - RNA, 23 nt, Human
ggcggcggcggcggcggcggcgg

SEQ ID NO: 42430 - RNA, 23 nt, Human
ggcggcggcggcggcggcggcgg

SEQ ID NO: 42431 - RNA, 23 nt, Human
ggcggcggcggcggcggcggcgg

SEQ ID NO: 42432 - RNA, 23 nt, Human
ggcggcggcggcggcggcggcgg

SEQ ID NO: 42433 - RNA, 23 nt, Human
ggcggcggcggcggcggcggcgg

SEQ ID NO: 42434 - RNA, 23 nt, Human
ggcggcggcgggcaccgggcggc

SEQ ID NO: 42435 - RNA, 23 nt, Human
ggcggcggcgggcaccgggcggc

SEQ ID NO: 42436 - RNA, 23 nt, Human
ggcggcgggugaucgggcccggc

SEQ ID NO: 42437 - RNA, 21 nt, Human
gggaggcuugguuuaccaggg

SEQ ID NO: 42438 - RNA, 19 nt, Human
gggcagggugugcguguuu

SEQ ID NO: 42439 - RNA, 22 nt, Human
gggcggcggcgggcaccgggcg

SEQ ID NO: 42440 - RNA, 22 nt, Human
gggcggcggcgggcaccgggcg

SEQ ID NO: 42441 - RNA, 26 nt, Human
gggcggcggcgggcaccgggcggcga

SEQ ID NO: 42442 - RNA, 26 nt, Human
gggcggcggcgggcaccgggcggcga

SEQ ID NO: 42443 - RNA, 26 nt, Human
gggcggcggcgggcaccgggcggcgg

SEQ ID NO: 42444 - RNA, 26 nt, Human
gggcggcggcgggcaccgggcggcgg

SEQ ID NO: 42445 - RNA, 24 nt, Human
gggcggcgggugaucgggcccggc

SEQ ID NO: 42446 - RNA, 22 nt, Human
gucaaggucaaauucccaugag

SEQ ID NO: 42447 - RNA, 25 nt, Human
gucacuaggaucuucuauacaacca

SEQ ID NO: 42448 - RNA, 18 nt, Human
guggcgcgggcggcggcg

SEQ ID NO: 42449 - RNA, 22 nt, Human
guugcuggcgcgggcggcggcg

SEQ ID NO: 42450 - RNA, 29 nt, Human
uagcgcuggcggcggcggcggcggcggcg

SEQ ID NO: 42451 - RNA, 22 nt, Human
uauacaaccaauuccuccagaa

SEQ ID NO: 42452 - RNA, 22 nt, Human
ucaaccacaaaacugcagcccc

SEQ ID NO: 42453 - RNA, 20 nt, Human
ucccaugaggccaucuccuu

SEQ ID NO: 42454 - RNA, 23 nt, Human
ucccugggcgcuggcauauaggc

SEQ ID NO: 42455 - RNA, 19 nt, Human
uccuccagaagucuggcug

SEQ ID NO: 42456 - RNA, 23 nt, Human
uccuccagaagucuggcugccaa

SEQ ID NO: 42457 - RNA, 18 nt, Human
uccuuaauauuuacccca

SEQ ID NO: 42458 - RNA, 23 nt, Human
ucgggcccgguugcuggcgcggg

SEQ ID NO: 42459 - RNA, 18 nt, Human
ucgggguggguggggagg

SEQ ID NO: 42460 - RNA, 21 nt, Human
ugaacaaaagaaaaaagggaa

SEQ ID NO: 42461 - RNA, 18 nt, Human
ugaggccaucuccuuaau

SEQ ID NO: 42462 - RNA, 20 nt, Human
ugcagccccaaggaaaugaa

SEQ ID NO: 42463 - RNA, 19 nt, Human
ugcuggcgcuagcgcuggc

SEQ ID NO: 42464 - RNA, 23 nt, Human
uggcauauaggcccugcaguucu

SEQ ID NO: 42465 - RNA, 19 nt, Human
uggcccaaaacgagaacug

SEQ ID NO: 42466 - RNA, 20 nt, Human
uggcccaaaacgagaacugg

SEQ ID NO: 42467 - RNA, 18 nt, Human
uggcggcggcggcggcgg

SEQ ID NO: 42468 - RNA, 22 nt, Human
uggcggcggcggcggcggcggc

SEQ ID NO: 42469 - RNA, 21 nt, Human
uggggagggaagccccaggug

SEQ ID NO: 42470 - RNA, 23 nt, Human
uggguggggagggaagccccagg

SEQ ID NO: 42471 - RNA, 24 nt, Human
ugggugguucgcaucucugucucu

SEQ ID NO: 42472 - RNA, 19 nt, Human
uucccagcuuuugagugcc

SEQ ID NO: 42473 - RNA, 21 nt, Human
uucccaugaggccaucuccuu

SEQ ID NO: 42474 - RNA, 19 nt, Human
uuucagugugggaggcuug

SEQ ID NO: 42475 - RNA, 21 nt, Human
aaaagacagcaggaguuagaa

SEQ ID NO: 42476 - RNA, 25 nt, Human
aaacaucuucucaggccucaggccc

SEQ ID NO: 42477 - RNA, 21 nt, Human
aacccacccccaacaccgcac

SEQ ID NO: 42478 - RNA, 22 nt, Human
acccccccuacauuuaccccug

SEQ ID NO: 42479 - RNA, 23 nt, Human
agugaaaccuucucuaaccaccc

SEQ ID NO: 42480 - RNA, 23 nt, Human
caacccacccccaacaccgcacc

SEQ ID NO: 42481 - RNA, 25 nt, Human
cacagaucagaaaacuauaagcuuu

SEQ ID NO: 42482 - RNA, 26 nt, Human
cacccccaacaccgcacccuugaucc

SEQ ID NO: 42483 - RNA, 21 nt, Human
cacccccccuacauuuacccc

SEQ ID NO: 42484 - RNA, 19 nt, Human
cacccuccccaacccaccc

SEQ ID NO: 42485 - RNA, 21 nt, Human
cacccuccccaacccaccccc

SEQ ID NO: 42486 - RNA, 22 nt, Human
cacccuugauccugggcaaucu

SEQ ID NO: 42487 - RNA, 19 nt, Human
caccgcacccuugauccug

SEQ ID NO: 42488 - RNA, 20 nt, Human
cagcaauccccacccccccu

SEQ ID NO: 42489 - RNA, 23 nt, Human
caguacagcauuugcaacacuuc

SEQ ID NO: 42490 - RNA, 23 nt, Human
cauccagcaauccccaccccccc

SEQ ID NO: 42491 - RNA, 24 nt, Human
cauccagcaauccccacccccccu

SEQ ID NO: 42492 - RNA, 21 nt, Human
ccaauucuucguuucccagaa

SEQ ID NO: 42493 - RNA, 22 nt, Human
ccagaaucagagaauaugaaaa

SEQ ID NO: 42494 - RNA, 21 nt, Human
ccagcaauccccacccccccu

SEQ ID NO: 42495 - RNA, 21 nt, Human
ccaugaagucuccacaucucc

SEQ ID NO: 42496 - RNA, 22 nt, Human
cccaacccacccccaacaccgc

SEQ ID NO: 42497 - RNA, 21 nt, Human
cccacccccaacaccgcaccc

SEQ ID NO: 42498 - RNA, 23 nt, Human
cccacccccccuacauuuacccc

SEQ ID NO: 42499 - RNA, 18 nt, Human
ccccaacaccgcacccuu

SEQ ID NO: 42500 - RNA, 21 nt, Human
ccccaacaccgcacccuugau

SEQ ID NO: 42501 - RNA, 25 nt, Human
ccccaacaccgcacccuugauccug

SEQ ID NO: 42502 - RNA, 27 nt, Human
ccccacccccccuacauuuaccccuuc

SEQ ID NO: 42503 - RNA, 24 nt, Human
cccccaacaccgcacccuugaucc

SEQ ID NO: 42504 - RNA, 23 nt, Human
cccccccuacauuuaccccugcu

SEQ ID NO: 42505 - RNA, 26 nt, Human
cccccccuacauuuaccccugcuucc

SEQ ID NO: 42506 - RNA, 21 nt, Human
cccuccccaacccacccccaa

SEQ ID NO: 42507 - RNA, 25 nt, Human
cccuccccaacccacccccaacacc

SEQ ID NO: 42508 - RNA, 24 nt, Human
cccugcucauaaaaucagucuucu

SEQ ID NO: 42509 - RNA, 22 nt, Human
ccuacauuuaccccugcuucca

SEQ ID NO: 42510 - RNA, 22 nt, Human
ccuucucuaaccacccucccca

SEQ ID NO: 42511 - RNA, 20 nt, Human
cgcagacugugggccucgaa

SEQ ID NO: 42512 - RNA, 19 nt, Human
cuccccaacccacccccaa

SEQ ID NO: 42513 - RNA, 24 nt, Human
cugggguucuaaggucuugagagc

SEQ ID NO: 42514 - RNA, 21 nt, Human
cugugggccucgaagcugcac

SEQ ID NO: 42515 - RNA, 23 nt, Human
cuuagugaaaccuucucuaacca

SEQ ID NO: 42516 - RNA, 19 nt, Human
cuugagcagccagaagagg

SEQ ID NO: 42517 - RNA, 23 nt, Human
cuugauccugggcaaucuccuuu

SEQ ID NO: 42518 - RNA, 19 nt, Human
gccucgaagcugcaccugu

SEQ ID NO: 42519 - RNA, 20 nt, Human
ggguuuccauccagcaaucc

SEQ ID NO: 42520 - RNA, 23 nt, Human
uaaaaggagaaccacaugaucac

SEQ ID NO: 42521 - RNA, 18 nt, Human
uaaccacccuccccaacc

SEQ ID NO: 42522 - RNA, 22 nt, Human
uaaccacccuccccaacccacc

SEQ ID NO: 42523 - RNA, 23 nt, Human
uagugaaaccuucucuaaccacc

SEQ ID NO: 42524 - RNA, 25 nt, Human
uauuauaaaauuauucagcauguaa

SEQ ID NO: 42525 - RNA, 24 nt, Human
uccagcaauccccacccccccuac

SEQ ID NO: 42526 - RNA, 21 nt, Human
uccauccagcaauccccaccc

SEQ ID NO: 42527 - RNA, 24 nt, Human
uccccaacccacccccaacaccgc

SEQ ID NO: 42528 - RNA, 25 nt, Human
uccccacccccccuacauuuacccc

SEQ ID NO: 42529 - RNA, 19 nt, Human
ucucuaaccacccucccca

SEQ ID NO: 42530 - RNA, 25 nt, Human
ugaaaagacagcaggaguuagaaga

SEQ ID NO: 42531 - RNA, 19 nt, Human
ugagagccaucaaguagcc

SEQ ID NO: 42532 - RNA, 19 nt, Human
ugauccugggcaaucuccu

SEQ ID NO: 42533 - RNA, 23 nt, Human
ugccugcucuuuccucuccuuag

SEQ ID NO: 42534 - RNA, 20 nt, Human
ugggguucuaaggucuugag

SEQ ID NO: 42535 - RNA, 19 nt, Human
ugguucugggguucuaagg

SEQ ID NO: 42536 - RNA, 18 nt, Human
uguaucaaaccccugcuc

SEQ ID NO: 42537 - RNA, 20 nt, Human
ugugaaccucugagcucagc

SEQ ID NO: 42538 - RNA, 21 nt, Human
uuagaagaagcuuagaucucg

SEQ ID NO: 42539 - RNA, 21 nt, Human
uuccaggagaaguucucaucu

SEQ ID NO: 42540 - RNA, 19 nt, Human
uuccaggguuuccauccag

SEQ ID NO: 42541 - RNA, 24 nt, Human
uuccaggguuuccauccagcaauc

SEQ ID NO: 42542 - RNA, 19 nt, Human
uuccugccaauucuucguu

SEQ ID NO: 42543 - RNA, 20 nt, Human
uucucuaaccacccucccca

SEQ ID NO: 42544 - RNA, 21 nt, Human
aaagugucauuuauagagaaa

SEQ ID NO: 42545 - RNA, 19 nt, Human
aaccuugcaaacuccaucc

SEQ ID NO: 42546 - RNA, 25 nt, Human
aagacuccuccuauucaucucacag

SEQ ID NO: 42547 - RNA, 21 nt, Human
acaugaggaacccuuggggau

SEQ ID NO: 42548 - RNA, 22 nt, Human
agaaccaaccccaagcccacca

SEQ ID NO: 42549 - RNA, 18 nt, Human
agcauuuuguuuucuugg

SEQ ID NO: 42550 - RNA, 18 nt, Human
agccucuacuuuacccag

SEQ ID NO: 42551 - RNA, 23 nt, Human
agugagugggguuaaacgagaag

SEQ ID NO: 42552 - RNA, 20 nt, Human
aguggggacaacuucagccc

SEQ ID NO: 42553 - RNA, 22 nt, Human
auaguauggaaauuggaauauc

SEQ ID NO: 42554 - RNA, 23 nt, Human
auucugcucuuuuuccuucugau

SEQ ID NO: 42555 - RNA, 18 nt, Human
auuguggcugauuucuaa

SEQ ID NO: 42556 - RNA, 22 nt, Human
caagcccaccaaguggggugac

SEQ ID NO: 42557 - RNA, 21 nt, Human
caccacccagaaccaacccca

SEQ ID NO: 42558 - RNA, 26 nt, Human
caccacccagaaccaaccccaagccc

SEQ ID NO: 42559 - RNA, 21 nt, Human
cacccagaaccaaccccaagc

SEQ ID NO: 42560 - RNA, 24 nt, Human
cauuuuguuuucuugguuauucua

SEQ ID NO: 42561 - RNA, 19 nt, Human
ccagucaagauggaaguga

SEQ ID NO: 42562 - RNA, 21 nt, Human
ccccugagaacuguuuucacc

SEQ ID NO: 42563 - RNA, 22 nt, Human
ccugggcuuuuggccuggggac

SEQ ID NO: 42564 - RNA, 21 nt, Human
cuuucacucuauggcagagaa

SEQ ID NO: 42565 - RNA, 18 nt, Human
gaaaccuugcaaacucca

SEQ ID NO: 42566 - RNA, 19 nt, Human
gagaggacagccccuccuc

SEQ ID NO: 42567 - RNA, 18 nt, Human
gcacuggggugguuuugg

SEQ ID NO: 42568 - RNA, 20 nt, Human
gcccaccaaguggggugaca

SEQ ID NO: 42569 - RNA, 21 nt, Human
ggauuugggaggugaagggca

SEQ ID NO: 42570 - RNA, 19 nt, Human
gggcugaagaccagggcug

SEQ ID NO: 42571 - RNA, 21 nt, Human
ggggauuugggaggugaaggg

SEQ ID NO: 42572 - RNA, 21 nt, Human
guggggacaacuucagcccca

SEQ ID NO: 42573 - RNA, 20 nt, Human
uagaaucagccgccaggacc

SEQ ID NO: 42574 - RNA, 23 nt, Human
uauagagaaacuccagcauuuug

SEQ ID NO: 42575 - RNA, 20 nt, Human
ucagugaaauaauugcaagg

SEQ ID NO: 42576 - RNA, 24 nt, Human
uccacauuuguaggggaguguggc

SEQ ID NO: 42577 - RNA, 25 nt, Human
uccugaagacuccuccuauucaucu

SEQ ID NO: 42578 - RNA, 20 nt, Human
ucucauguuggguuggccaa

SEQ ID NO: 42579 - RNA, 21 nt, Human
ugccugcggagaggacagccc

SEQ ID NO: 42580 - RNA, 21 nt, Human
ugcggagaggacagccccucc

SEQ ID NO: 42581 - RNA, 18 nt, Human
uggaaauuggaauaucuu

SEQ ID NO: 42582 - RNA, 23 nt, Human
uggaagugagugggguuaaacga

SEQ ID NO: 42583 - RNA, 19 nt, Human
uggaauaucuucagugaaa

SEQ ID NO: 42584 - RNA, 23 nt, Human
uggagcccugggcuuuuggccug

SEQ ID NO: 42585 - RNA, 19 nt, Human
uggcagagaaauggcaaag

SEQ ID NO: 42586 - RNA, 21 nt, Human
uggcagagaaauggcaaaggu

SEQ ID NO: 42587 - RNA, 21 nt, Human
uggcaguggggacaacuucag

SEQ ID NO: 42588 - RNA, 18 nt, Human
uggccaaacacuguauuc

SEQ ID NO: 42589 - RNA, 22 nt, Human
uggccaagagcagaaaacccua

SEQ ID NO: 42590 - RNA, 21 nt, Human
uggccagaagaccugcuacgu

SEQ ID NO: 42591 - RNA, 25 nt, Human
ugggaggggcugaagaccagggcug

SEQ ID NO: 42592 - RNA, 21 nt, Human
ugggaggugaagggcaguuuc

SEQ ID NO: 42593 - RNA, 24 nt, Human
ugggcuuuuggccuggggacacuu

SEQ ID NO: 42594 - RNA, 22 nt, Human
uggggauuugggaggugaaggg

SEQ ID NO: 42595 - RNA, 19 nt, Human
ugguugggagccgguccaa

SEQ ID NO: 42596 - RNA, 18 nt, Human
ugugguuuugguugggag

SEQ ID NO: 42597 - RNA, 24 nt, Human
uucaccacccagaaccaaccccaa

SEQ ID NO: 42598 - RNA, 22 nt, Human
uuggaggaaauaguauggaaau

SEQ ID NO: 42599 - RNA, 23 nt, Human
uuguggcugauuucuaacugaaa

SEQ ID NO: 42600 - RNA, 25 nt, Human
uuguuuauuguggcugauuucuaac

SEQ ID NO: 42601 - RNA, 22 nt, Human
uuuauacacacuuuuguaugua

SEQ ID NO: 42602 - RNA, 19 nt, Human
aaaaucuuaaggugccccc

SEQ ID NO: 42603 - RNA, 31 nt, Human
aaacaaggacacagacacaaaggccuucucu

SEQ ID NO: 42604 - RNA, 22 nt, Human
aaacagaaacgaaacuuuagga

SEQ ID NO: 42605 - RNA, 22 nt, Human
aaacagaaacgaaacuuuagga

SEQ ID NO: 42606 - RNA, 22 nt, Human
aaacagaaacgaaacuuuagga

SEQ ID NO: 42607 - RNA, 21 nt, Human
aaacagcucgagccagacuga

SEQ ID NO: 42608 - RNA, 19 nt, Human
aacugcuucuggaccacau

SEQ ID NO: 42609 - RNA, 20 nt, Human
aagcagcauagacgcccagc

SEQ ID NO: 42610 - RNA, 23 nt, Human
aagcauucagcacaguuacccug

SEQ ID NO: 42611 - RNA, 23 nt, Human
aagcauucagcacaguuacccug

SEQ ID NO: 42612 - RNA, 19 nt, Human
aaggacacagacacaaagg

SEQ ID NO: 42613 - RNA, 24 nt, Human
aaggcacaggccuccagagucugc

SEQ ID NO: 42614 - RNA, 19 nt, Human
aaggcccaccagccccggg

SEQ ID NO: 42615 - RNA, 19 nt, Human
aaggcccaccagccccggg

SEQ ID NO: 42616 - RNA, 22 nt, Human
aaggcccaccagccccggguuc

SEQ ID NO: 42617 - RNA, 22 nt, Human
aaggcccaccagccccggguuc

SEQ ID NO: 42618 - RNA, 19 nt, Human
aauguccuccucugaguag

SEQ ID NO: 42619 - RNA, 19 nt, Human
aauguccuccucugaguag

SEQ ID NO: 42620 - RNA, 23 nt, Human
acacugagcuccacagugccaau

SEQ ID NO: 42621 - RNA, 23 nt, Human
acccagcagcugucuucuguucc

SEQ ID NO: 42622 - RNA, 23 nt, Human
acccagcagcugucuucuguucc

SEQ ID NO: 42623 - RNA, 23 nt, Human
acccagcagcugucuucuguucc

SEQ ID NO: 42624 - RNA, 22 nt, Human
accccagaguacaggacugagu

SEQ ID NO: 42625 - RNA, 22 nt, Human
accccagaguacaggacugagu

SEQ ID NO: 42626 - RNA, 22 nt, Human
acccgcugccgcuggcccccag

SEQ ID NO: 42627 - RNA, 24 nt, Human
acccucuccacagccacgauguua

SEQ ID NO: 42628 - RNA, 20 nt, Human
accgcggacagugggucauc

SEQ ID NO: 42629 - RNA, 20 nt, Human
agagcaccacgcaguucccc

SEQ ID NO: 42630 - RNA, 20 nt, Human
agagcaccacgcaguucccc

SEQ ID NO: 42631 - RNA, 23 nt, Human
agagcggcgugcuggccaugaug

SEQ ID NO: 42632 - RNA, 22 nt, Human
agcacaguuacccuguaaggca

SEQ ID NO: 42633 - RNA, 19 nt, Human
agcagcugucuucuguucc

SEQ ID NO: 42634 - RNA, 19 nt, Human
agcagcugucuucuguucc

SEQ ID NO: 42635 - RNA, 19 nt, Human
agcagcugucuucuguucc

SEQ ID NO: 42636 - RNA, 18 nt, Human
agccagacugacccgcug

SEQ ID NO: 42637 - RNA, 19 nt, Human
agcccaccaaauguccucc

SEQ ID NO: 42638 - RNA, 21 nt, Human
agcgcuugggguucagggcuu

SEQ ID NO: 42639 - RNA, 27 nt, Human
agcugccucuggcccacgcugagauuc

SEQ ID NO: 42640 - RNA, 27 nt, Human
agcugccucuggcccacgcugagauuc

SEQ ID NO: 42641 - RNA, 24 nt, Human
aggaggaaaaagcuuuuuauuaaa

SEQ ID NO: 42642 - RNA, 18 nt, Human
aggaggaaauggggcagg

SEQ ID NO: 42643 - RNA, 18 nt, Human
aggaggaaauggggcagg

SEQ ID NO: 42644 - RNA, 23 nt, Human
aggcacaggccuccagagucugc

SEQ ID NO: 42645 - RNA, 21 nt, Human
aggcagcaccccagaguacag

SEQ ID NO: 42646 - RNA, 21 nt, Human
aggcagcaccccagaguacag

SEQ ID NO: 42647 - RNA, 21 nt, Human
aggcagcaccccagaguacag

SEQ ID NO: 42648 - RNA, 24 nt, Human
aggcagcaucuccaggucagcuag

SEQ ID NO: 42649 - RNA, 19 nt, Human
agggacaaggacccugaac

SEQ ID NO: 42650 - RNA, 24 nt, Human
agggguggccugacccagcagcug

SEQ ID NO: 42651 - RNA, 24 nt, Human
agggguggccugacccagcagcug

SEQ ID NO: 42652 - RNA, 24 nt, Human
agggguggccugacccagcagcug

SEQ ID NO: 42653 - RNA, 24 nt, Human
aggugguugugguguggagguagg

SEQ ID NO: 42654 - RNA, 22 nt, Human
agucugcugguagcgcuugggg

SEQ ID NO: 42655 - RNA, 20 nt, Human
agugccuccuuauccucugc

SEQ ID NO: 42656 - RNA, 22 nt, Human
augacaggggccagaaccucau

SEQ ID NO: 42657 - RNA, 20 nt, Human
caaaaucuuaaggugccccc

SEQ ID NO: 42658 - RNA, 20 nt, Human
caaaaucuuaaggugccccc

SEQ ID NO: 42659 - RNA, 22 nt, Human
caaacuagcugugaccuuaggc

SEQ ID NO: 42660 - RNA, 22 nt, Human
caaacuagcugugaccuuaggc

SEQ ID NO: 42661 - RNA, 22 nt, Human
caaacuagcugugaccuuaggc

SEQ ID NO: 42662 - RNA, 22 nt, Human
caaagcccaccaaauguccucc

SEQ ID NO: 42663 - RNA, 22 nt, Human
caaagcccaccaaauguccucc

SEQ ID NO: 42664 - RNA, 23 nt, Human
caaagcccaccaaauguccuccu

SEQ ID NO: 42665 - RNA, 21 nt, Human
caaggacacagacacaaaggc

SEQ ID NO: 42666 - RNA, 23 nt, Human
cacagaaaggcccaccagccccg

SEQ ID NO: 42667 - RNA, 23 nt, Human
cacagaaaggcccaccagccccg

SEQ ID NO: 42668 - RNA, 22 nt, Human
caccacgcaguuccccacgaac

SEQ ID NO: 42669 - RNA, 22 nt, Human
caccacgcaguuccccacgaac

SEQ ID NO: 42670 - RNA, 24 nt, Human
caccagggaggacuucccacagcc

SEQ ID NO: 42671 - RNA, 18 nt, Human
caccaggucuaggcccgg

SEQ ID NO: 42672 - RNA, 18 nt, Human
caccaggucuaggcccgg

SEQ ID NO: 42673 - RNA, 22 nt, Human
caccagugccccuuucgggacc

SEQ ID NO: 42674 - RNA, 18 nt, Human
cacccuuugccgccucca

SEQ ID NO: 42675 - RNA, 18 nt, Human
cacccuuugccgccucca

SEQ ID NO: 42676 - RNA, 18 nt, Human
caccuucucugauggacc

SEQ ID NO: 42677 - RNA, 23 nt, Human
cacguacacccagagggugauca

SEQ ID NO: 42678 - RNA, 18 nt, Human
cacguuuuccugaagagu

SEQ ID NO: 42679 - RNA, 18 nt, Human
cagaauaauuccggaacu

SEQ ID NO: 42680 - RNA, 21 nt, Human
cagaauaauuccggaacucca

SEQ ID NO: 42681 - RNA, 22 nt, Human
cagaauuccuaaagcagcauag

SEQ ID NO: 42682 - RNA, 18 nt, Human
cagagggugaucaggguc

SEQ ID NO: 42683 - RNA, 20 nt, Human
cagcaccccagaguacagga

SEQ ID NO: 42684 - RNA, 20 nt, Human
cagcaccccagaguacagga

SEQ ID NO: 42685 - RNA, 23 nt, Human
cagcccacaggccccaccacggc

SEQ ID NO: 42686 - RNA, 24 nt, Human
cagccccggguucaggcugcuccu

SEQ ID NO: 42687 - RNA, 24 nt, Human
cagccccggguucaggcugcuccu

SEQ ID NO: 42688 - RNA, 24 nt, Human
cagccgcuucaguugccgugaugu

SEQ ID NO: 42689 - RNA, 19 nt, Human
cagcgugguacagagcccc

SEQ ID NO: 42690 - RNA, 25 nt, Human
caggaaaggccaggaggaaaucuca

SEQ ID NO: 42691 - RNA, 25 nt, Human
caggaaaggccaggaggaaaucuca

SEQ ID NO: 42692 - RNA, 21 nt, Human
caggaggaaaaagcuuuuuau

SEQ ID NO: 42693 - RNA, 21 nt, Human
caggaggaaaaagcuuuuuau

SEQ ID NO: 42694 - RNA, 21 nt, Human
caggaggaaaaagcuuuuuau

SEQ ID NO: 42695 - RNA, 18 nt, Human
cagggcagacaccaggga

SEQ ID NO: 42696 - RNA, 18 nt, Human
cagggcuggguacgggcc

SEQ ID NO: 42697 - RNA, 20 nt, Human
caggucagcuagcaaggcac

SEQ ID NO: 42698 - RNA, 18 nt, Human
caggugaaggugguugug

SEQ ID NO: 42699 - RNA, 27 nt, Human
caggugccuccgggguaacuuagagga

SEQ ID NO: 42700 - RNA, 19 nt, Human
caguucuggauccaugccu

SEQ ID NO: 42701 - RNA, 18 nt, Human
cauaggccacggagcccu

SEQ ID NO: 42702 - RNA, 21 nt, Human
caucaacgacauagauguccu

SEQ ID NO: 42703 - RNA, 24 nt, Human
caucacuguaaacagcucgagcca

SEQ ID NO: 42704 - RNA, 23 nt, Human
ccaaagcccaccaaauguccucc

SEQ ID NO: 42705 - RNA, 20 nt, Human
ccacaagaguggagauggcg

SEQ ID NO: 42706 - RNA, 18 nt, Human
ccaccaaauguccuccuc

SEQ ID NO: 42707 - RNA, 18 nt, Human
ccaccaaauguccuccuc

SEQ ID NO: 42708 - RNA, 24 nt, Human
ccacuccgaugcucagccaccuau

SEQ ID NO: 42709 - RNA, 24 nt, Human
ccacuccgaugcucagccgccuau

SEQ ID NO: 42710 - RNA, 20 nt, Human
ccagaacacacugagcucca

SEQ ID NO: 42711 - RNA, 22 nt, Human
ccagccccggguucaggcugcu

SEQ ID NO: 42712 - RNA, 22 nt, Human
ccagccccggguucaggcugcu

SEQ ID NO: 42713 - RNA, 19 nt, Human
ccauggccauggcugccag

SEQ ID NO: 42714 - RNA, 22 nt, Human
cccacgaacuccacuccgaugc

SEQ ID NO: 42715 - RNA, 22 nt, Human
cccacgaacuccacuccgaugc

SEQ ID NO: 42716 - RNA, 22 nt, Human
cccacgauccccaccuucucgc

SEQ ID NO: 42717 - RNA, 22 nt, Human
cccacgauccccaccuucucgc

SEQ ID NO: 42718 - RNA, 19 nt, Human
cccagcggcgggcagagcg

SEQ ID NO: 42719 - RNA, 26 nt, Human
cccccaguguuugcuaucaaguccau

SEQ ID NO: 42720 - RNA, 26 nt, Human
cccccaguguuugcuaucaaguccau

SEQ ID NO: 42721 - RNA, 21 nt, Human
ccccgcccucugagcacugga

SEQ ID NO: 42722 - RNA, 21 nt, Human
ccccgcccucugagcacugga

SEQ ID NO: 42723 - RNA, 19 nt, Human
ccccggguucaggcugcuc

SEQ ID NO: 42724 - RNA, 19 nt, Human
ccccggguucaggcugcuc

SEQ ID NO: 42725 - RNA, 23 nt, Human
cccgcugccgcuggcccccagac

SEQ ID NO: 42726 - RNA, 24 nt, Human
cccgcugccgcuggcccccagaca

SEQ ID NO: 42727 - RNA, 19 nt, Human
cccugaacaccagagagcc

SEQ ID NO: 42728 - RNA, 19 nt, Human
ccgcggacagugggucauc

SEQ ID NO: 42729 - RNA, 18 nt, Human
ccucugucaccugcaccu

SEQ ID NO: 42730 - RNA, 23 nt, Human
ccugacccagcagcugucuucug

SEQ ID NO: 42731 - RNA, 23 nt, Human
ccugacccagcagcugucuucug

SEQ ID NO: 42732 - RNA, 23 nt, Human
ccugacccagcagcugucuucug

SEQ ID NO: 42733 - RNA, 24 nt, Human
ccugggcccaggugaaggugccac

SEQ ID NO: 42734 - RNA, 22 nt, Human
cgagcugccucuggcccacgcu

SEQ ID NO: 42735 - RNA, 18 nt, Human
cgccuccaggaugcggaa

SEQ ID NO: 42736 - RNA, 23 nt, Human
cggcccacgauccccaccuucuc

SEQ ID NO: 42737 - RNA, 19 nt, Human
cggucggacccagcggcgg

SEQ ID NO: 42738 - RNA, 19 nt, Human
cgugcgcagcagcuggggc

SEQ ID NO: 42739 - RNA, 19 nt, Human
cucacaaacgugugcaggu

SEQ ID NO: 42740 - RNA, 19 nt, Human
cucacaaacgugugcaggu

SEQ ID NO: 42741 - RNA, 19 nt, Human
cucaggaauugcuggaucc

SEQ ID NO: 42742 - RNA, 23 nt, Human
cucaucaacgacauagauguccu

SEQ ID NO: 42743 - RNA, 25 nt, Human
cuccaaagcccaccaaauguccucc

SEQ ID NO: 42744 - RNA, 25 nt, Human
cuccaaagcccaccaaauguccucc

SEQ ID NO: 42745 - RNA, 24 nt, Human
cuccacagccacgauguuagauuc

SEQ ID NO: 42746 - RNA, 18 nt, Human
cuccacagugccaauggc

SEQ ID NO: 42747 - RNA, 19 nt, Human
cuccacuccgaugcucagc

SEQ ID NO: 42748 - RNA, 22 nt, Human
cuccacuccgaugcucagccac

SEQ ID NO: 42749 - RNA, 23 nt, Human
cugaguagcugccgaaggggucc

SEQ ID NO: 42750 - RNA, 23 nt, Human
cugaguagcugccgaaggggucc

SEQ ID NO: 42751 - RNA, 24 nt, Human
cugccuuccaccacccagggcgcc

SEQ ID NO: 42752 - RNA, 24 nt, Human
cugccuuccaccacccagggcgcc

SEQ ID NO: 42753 - RNA, 23 nt, Human
cuucgggagggcggcugccuucc

SEQ ID NO: 42754 - RNA, 23 nt, Human
cuucgggagggcggcugccuucc

SEQ ID NO: 42755 - RNA, 21 nt, Human
cuugcagaauuccuaaagcag

SEQ ID NO: 42756 - RNA, 21 nt, Human
cuuugacccacauacaggaga

SEQ ID NO: 42757 - RNA, 26 nt, Human
gaacaggaugggguccugcgggauga

SEQ ID NO: 42758 - RNA, 26 nt, Human
gaacaggaugggguccugcgggauga

SEQ ID NO: 42759 - RNA, 20 nt, Human
gaagacuugccagccccagu

SEQ ID NO: 42760 - RNA, 20 nt, Human
gaagacuugccagccccagu

SEQ ID NO: 42761 - RNA, 24 nt, Human
gagcaccacgcaguuccccacgaa

SEQ ID NO: 42762 - RNA, 24 nt, Human
gagcaccacgcaguuccccacgaa

SEQ ID NO: 42763 - RNA, 21 nt, Human
gaugcccuccaccugcuucag

SEQ ID NO: 42764 - RNA, 24 nt, Human
gaugcucagccaccuaugggggau

SEQ ID NO: 42765 - RNA, 21 nt, Human
gcaaggcacaggccuccagag

SEQ ID NO: 42766 - RNA, 23 nt, Human
gcaguuccccacgaacuccacuc

SEQ ID NO: 42767 - RNA, 23 nt, Human
gcaguuccccacgaacuccacuc

SEQ ID NO: 42768 - RNA, 20 nt, Human
gcaucauuuguccaggcacu

SEQ ID NO: 42769 - RNA, 19 nt, Human
gcaugaggaugacaggggc

SEQ ID NO: 42770 - RNA, 19 nt, Human
gccagaaccucaucaacga

SEQ ID NO: 42771 - RNA, 21 nt, Human
gcccacgcugagauucucccc

SEQ ID NO: 42772 - RNA, 21 nt, Human
gcccacgcugagauucucccc

SEQ ID NO: 42773 - RNA, 21 nt, Human
gccccaccacggccaccagug

SEQ ID NO: 42774 - RNA, 19 nt, Human
gccccggguucaggcugcu

SEQ ID NO: 42775 - RNA, 19 nt, Human
gccccggguucaggcugcu

SEQ ID NO: 42776 - RNA, 19 nt, Human
gccgugcgcagcagcuggg

SEQ ID NO: 42777 - RNA, 19 nt, Human
gccucugucucugucuugg

SEQ ID NO: 42778 - RNA, 19 nt, Human
gccucugucucugucuugg

SEQ ID NO: 42779 - RNA, 24 nt, Human
gcggcugcaaggaaggcgagcgcg

SEQ ID NO: 42780 - RNA, 19 nt, Human
ggaaggcgagcgcggucgg

SEQ ID NO: 42781 - RNA, 20 nt, Human
ggagcccuucaugugcacuu

SEQ ID NO: 42782 - RNA, 18 nt, Human
ggaggaaauggggcaggg

SEQ ID NO: 42783 - RNA, 24 nt, Human
ggaggacuucccacagcccacagg

SEQ ID NO: 42784 - RNA, 18 nt, Human
ggcaggggcagggcaggg

SEQ ID NO: 42785 - RNA, 20 nt, Human
ggccauggcugccagcauca

SEQ ID NO: 42786 - RNA, 22 nt, Human
ggcccacgauccccaccuucuc

SEQ ID NO: 42787 - RNA, 23 nt, Human
gggacagcuccaaagcccaccaa

SEQ ID NO: 42788 - RNA, 23 nt, Human
gggacagcuccaaagcccaccaa

SEQ ID NO: 42789 - RNA, 18 nt, Human
gggaucagaugaggagga

SEQ ID NO: 42790 - RNA, 24 nt, Human
gggccgaggcgcggcugcaaggaa

SEQ ID NO: 42791 - RNA, 18 nt, Human
ggggcaggggcagggcag

SEQ ID NO: 42792 - RNA, 21 nt, Human
gggguccugcgggaugauggu

SEQ ID NO: 42793 - RNA, 21 nt, Human
gggguccugcgggaugauggu

SEQ ID NO: 42794 - RNA, 19 nt, Human
ggguccugcgggaugaugg

SEQ ID NO: 42795 - RNA, 19 nt, Human
ggguccugcgggaugaugg

SEQ ID NO: 42796 - RNA, 22 nt, Human
gggugaucagggucaccaggaa

SEQ ID NO: 42797 - RNA, 20 nt, Human
ggguggccugacccagcagc

SEQ ID NO: 42798 - RNA, 20 nt, Human
ggguggccugacccagcagc

SEQ ID NO: 42799 - RNA, 20 nt, Human
ggguggccugacccagcagc

SEQ ID NO: 42800 - RNA, 19 nt, Human
ggugcccccaguguuugcu

SEQ ID NO: 42801 - RNA, 19 nt, Human
ggugcccccaguguuugcu

SEQ ID NO: 42802 - RNA, 19 nt, Human
ggugcccccaguguuugcu

SEQ ID NO: 42803 - RNA, 23 nt, Human
guccaggccugccggcugggagc

SEQ ID NO: 42804 - RNA, 23 nt, Human
guccaggccugccggcugggagc

SEQ ID NO: 42805 - RNA, 20 nt, Human
uaauggauucaggcagcacc

SEQ ID NO: 42806 - RNA, 20 nt, Human
uaauggauucaggcagcacc

SEQ ID NO: 42807 - RNA, 20 nt, Human
uaauggauucaggcagcacc

SEQ ID NO: 42808 - RNA, 21 nt, Human
uacaggccgacccugucccuc

SEQ ID NO: 42809 - RNA, 25 nt, Human
uagcacaaugaugaagucugucugg

SEQ ID NO: 42810 - RNA, 21 nt, Human
uagcagcuucucugguuggca

SEQ ID NO: 42811 - RNA, 24 nt, Human
uaggcgugucauucaccacuuggg

SEQ ID NO: 42812 - RNA, 24 nt, Human
uaggcgugucauucaccacuuggg

SEQ ID NO: 42813 - RNA, 24 nt, Human
uaggcgugucauucaccacuuggg

SEQ ID NO: 42814 - RNA, 18 nt, Human
ucaaacugggugcggaug

SEQ ID NO: 42815 - RNA, 18 nt, Human
ucaaacugggugcggaug

SEQ ID NO: 42816 - RNA, 21 nt, Human
ucacccuuugccgccuccagg

SEQ ID NO: 42817 - RNA, 23 nt, Human
ucagcaccuugaugccguccagg

SEQ ID NO: 42818 - RNA, 19 nt, Human
ucagcuagcaaggcacagg

SEQ ID NO: 42819 - RNA, 23 nt, Human
ucaggcagcaccccagaguacag

SEQ ID NO: 42820 - RNA, 23 nt, Human
ucaggcagcaccccagaguacag

SEQ ID NO: 42821 - RNA, 19 nt, Human
ucaucaguacucccauuuu

SEQ ID NO: 42822 - RNA, 19 nt, Human
ucaucaguacucccauuuu

SEQ ID NO: 42823 - RNA, 19 nt, Human
ucaucaguacucccauuuu

SEQ ID NO: 42824 - RNA, 25 nt, Human
ucauucaccacuuggggaucauuuc

SEQ ID NO: 42825 - RNA, 25 nt, Human
ucauucaccacuuggggaucauuuc

SEQ ID NO: 42826 - RNA, 25 nt, Human
ucauucaccacuuggggaucauuuc

SEQ ID NO: 42827 - RNA, 19 nt, Human
uccacacucugggggucaa

SEQ ID NO: 42828 - RNA, 19 nt, Human
uccaccacccagggcgccu

SEQ ID NO: 42829 - RNA, 19 nt, Human
uccaccacccagggcgccu

SEQ ID NO: 42830 - RNA, 24 nt, Human
uccaccacccagggcgccucuguc

SEQ ID NO: 42831 - RNA, 24 nt, Human
uccaccacccagggcgccucuguc

SEQ ID NO: 42832 - RNA, 23 nt, Human
uccaccuccccacgugggggcca

SEQ ID NO: 42833 - RNA, 23 nt, Human
uccaccuccccacgugggggcca

SEQ ID NO: 42834 - RNA, 24 nt, Human
uccacguacacguacacccagagg

SEQ ID NO: 42835 - RNA, 21 nt, Human
uccagcaagaaaauaucggca

SEQ ID NO: 42836 - RNA, 23 nt, Human
uccaucagcuagcacaaugauga

SEQ ID NO: 42837 - RNA, 19 nt, Human
ucccacagcccacaggccc

SEQ ID NO: 42838 - RNA, 22 nt, Human
ucccguagaagaugccucuagc

SEQ ID NO: 42839 - RNA, 19 nt, Human
uccuuggagaagcaguuca

SEQ ID NO: 42840 - RNA, 21 nt, Human
ucuccaggucgauggcagcug

SEQ ID NO: 42841 - RNA, 21 nt, Human
ucuccaggucgauggcagcug

SEQ ID NO: 42842 - RNA, 22 nt, Human
ucugauccccaccaggcagcau

SEQ ID NO: 42843 - RNA, 18 nt, Human
ugaaaaccaggaaaggcc

SEQ ID NO: 42844 - RNA, 19 nt, Human
ugaccacaagaguggagau

SEQ ID NO: 42845 - RNA, 23 nt, Human
ugacggcaaauagugcagcaaag

SEQ ID NO: 42846 - RNA, 23 nt, Human
ugacggcaaauagugcagcaaag

SEQ ID NO: 42847 - RNA, 18 nt, Human
ugaggacagggcacucag

SEQ ID NO: 42848 - RNA, 20 nt, Human
ugaucucaaaaucccggcug

SEQ ID NO: 42849 - RNA, 20 nt, Human
ugcaacacacgggcagccug

SEQ ID NO: 42850 - RNA, 18 nt, Human
ugccauggcaucauuugu

SEQ ID NO: 42851 - RNA, 19 nt, Human
ugccccuuucgggaccugg

SEQ ID NO: 42852 - RNA, 19 nt, Human
ugcccuccaccugcuucag

SEQ ID NO: 42853 - RNA, 24 nt, Human
ugccucuggcccacgcugagauuc

SEQ ID NO: 42854 - RNA, 23 nt, Human
ugccuggugcaacacacgggcag

SEQ ID NO: 42855 - RNA, 24 nt, Human
ugcugggaauuccuggaggagcag

SEQ ID NO: 42856 - RNA, 28 nt, Human
uggaccacauaggugacugguuaaagag

SEQ ID NO: 42857 - RNA, 20 nt, Human
uggaguacuccuugacccuc

SEQ ID NO: 42858 - RNA, 20 nt, Human
uggaguacuccuugacccuc

SEQ ID NO: 42859 - RNA, 20 nt, Human
uggaugccacccgcugccau

SEQ ID NO: 42860 - RNA, 20 nt, Human
uggcaccagucacugucucc

SEQ ID NO: 42861 - RNA, 21 nt, Human
uggcauagccuggggagaugg

SEQ ID NO: 42862 - RNA, 20 nt, Human
uggcccgaugacguggucaa

SEQ ID NO: 42863 - RNA, 23 nt, Human
uggcccgaugacguggucaaaga

SEQ ID NO: 42864 - RNA, 21 nt, Human
uggccucgucuaaaaccagga

SEQ ID NO: 42865 - RNA, 21 nt, Human
uggccucgucuaaaaccagga

SEQ ID NO: 42866 - RNA, 19 nt, Human
uggcugcuuucuccuccug

SEQ ID NO: 42867 - RNA, 21 nt, Human
ugggguccugcgggaugaugg

SEQ ID NO: 42868 - RNA, 21 nt, Human
ugggguccugcgggaugaugg

SEQ ID NO: 42869 - RNA, 21 nt, Human
ugggucagugccccaucugcc

SEQ ID NO: 42870 - RNA, 21 nt, Human
uggugcaacacacgggcagcc

SEQ ID NO: 42871 - RNA, 21 nt, Human
ugguguggagguaggccgccg

SEQ ID NO: 42872 - RNA, 18 nt, Human
ugguguggugucaaagaa

SEQ ID NO: 42873 - RNA, 21 nt, Human
uguccaggaccaggacccugg

SEQ ID NO: 42874 - RNA, 21 nt, Human
uguccaggaccaggacccugg

SEQ ID NO: 42875 - RNA, 22 nt, Human
uucacccuuugccgccuccagg

SEQ ID NO: 42876 - RNA, 22 nt, Human
uucagagacacacuggccugag

SEQ ID NO: 42877 - RNA, 21 nt, Human
uuccagccgcuucaguugccg

SEQ ID NO: 42878 - RNA, 20 nt, Human
uucccacagcccacaggccc

SEQ ID NO: 42879 - RNA, 21 nt, Human
uuccugaagagugcaguucug

SEQ ID NO: 42880 - RNA, 23 nt, Human
uucuggauccaugccugcugggg

SEQ ID NO: 42881 - RNA, 20 nt, Human
uugacccucuccacagccac

SEQ ID NO: 42882 - RNA, 21 nt, Human
uugacccucuccacagccacu

SEQ ID NO: 42883 - RNA, 18 nt, Human
uuucuccuccugggucag

SEQ ID NO: 42884 - RNA, 26 nt, Human
uuuuuuuuuuuuuuuuuuacuguuga

SEQ ID NO: 42885 - RNA, 26 nt, Human
uuuuuuuuuuuuuuuuuuacuguuga

SEQ ID NO: 42886 - RNA, 19 nt, Human
aagcagggaugcuggggcu

SEQ ID NO: 42887 - RNA, 18 nt, Human
aggcggcgguggccgcgg

SEQ ID NO: 42888 - RNA, 19 nt, Human
ccgggcggggcgggcgcgg

SEQ ID NO: 42889 - RNA, 18 nt, Human
cggggucgcgcugaucag

SEQ ID NO: 42890 - RNA, 23 nt, Human
gcggggcgggcgcgggccggggu

SEQ ID NO: 42891 - RNA, 24 nt, Human
ggaccucaagcagggaugcugggg

SEQ ID NO: 42892 - RNA, 18 nt, Human
ggaugcuggggcuccggc

SEQ ID NO: 42893 - RNA, 19 nt, Human
ggcggcgguggccgcgggc

SEQ ID NO: 42894 - RNA, 22 nt, Human
ggcgggcgcgggccggggucgc

SEQ ID NO: 42895 - RNA, 21 nt, Human
ggggcgggcgcgggccggggu

SEQ ID NO: 42896 - RNA, 21 nt, Human
ggucgcgcugaucaggcggcg

SEQ ID NO: 42897 - RNA, 21 nt, Human
uccaaaaacuaguggaaaaug

SEQ ID NO: 42898 - RNA, 18 nt, Human
ugaucaggcggcgguggc

SEQ ID NO: 42899 - RNA, 18 nt, Human
ugccaaaguaaaaaaaag

SEQ ID NO: 42900 - RNA, 21 nt, Human
uguugccaaaguaaaaaaaag

SEQ ID NO: 42901 - RNA, 23 nt, Human
aaaaaugauagaaaggaauaugc

SEQ ID NO: 42902 - RNA, 20 nt, Human
aaacaguaagugacaccagg

SEQ ID NO: 42903 - RNA, 21 nt, Human
aaacaguaagugacaccagga

SEQ ID NO: 42904 - RNA, 20 nt, Human
aaaccacacagcaaccagca

SEQ ID NO: 42905 - RNA, 19 nt, Human
aacaacagcaaaaagaaga

SEQ ID NO: 42906 - RNA, 20 nt, Human
aacaugcuaaggcgacagaa

SEQ ID NO: 42907 - RNA, 18 nt, Human
aagaagaaggcaggaaag

SEQ ID NO: 42908 - RNA, 20 nt, Human
aagaagaaggcaggaaagaa

SEQ ID NO: 42909 - RNA, 22 nt, Human
aagaagaaggcaggaaagaaac

SEQ ID NO: 42910 - RNA, 21 nt, Human
aagcagcaguuggcuccaggg

SEQ ID NO: 42911 - RNA, 24 nt, Human
aaugaaaugcuacucuuccuacag

SEQ ID NO: 42912 - RNA, 21 nt, Human
acacaccaaaccacacagcaa

SEQ ID NO: 42913 - RNA, 22 nt, Human
acacgucuuccuuuggacaccc

SEQ ID NO: 42914 - RNA, 19 nt, Human
acagacccacgaaauccug

SEQ ID NO: 42915 - RNA, 23 nt, Human
acagacccacgaaauccugagcc

SEQ ID NO: 42916 - RNA, 18 nt, Human
accacacagcaaccagca

SEQ ID NO: 42917 - RNA, 21 nt, Human
accagccccacagcacaaagg

SEQ ID NO: 42918 - RNA, 19 nt, Human
agaaaaccuggcaccguga

SEQ ID NO: 42919 - RNA, 20 nt, Human
agaaacaacagcaaaaagaa

SEQ ID NO: 42920 - RNA, 19 nt, Human
agaaaggaaaacagaccca

SEQ ID NO: 42921 - RNA, 20 nt, Human
agaaaggaaaacagacccac

SEQ ID NO: 42922 - RNA, 23 nt, Human
agaaugaaaugcuacucuuccua

SEQ ID NO: 42923 - RNA, 24 nt, Human
agacugauucuuguuuagaaacaa

SEQ ID NO: 42924 - RNA, 21 nt, Human
agagagagagacugugcgacg

SEQ ID NO: 42925 - RNA, 25 nt, Human
agcaaaaagaagaaggcaggaaaga

SEQ ID NO: 42926 - RNA, 19 nt, Human
agcaaaaccagaucucuag

SEQ ID NO: 42927 - RNA, 22 nt, Human
agccaauccggaacugcugugc

SEQ ID NO: 42928 - RNA, 18 nt, Human
aggaaccugaggcagugg

SEQ ID NO: 42929 - RNA, 19 nt, Human
aggcaggaaagaaacuccc

SEQ ID NO: 42930 - RNA, 22 nt, Human
aggcaggaaagaaacuccccgg

SEQ ID NO: 42931 - RNA, 20 nt, Human
aggcggcagagggggcuguc

SEQ ID NO: 42932 - RNA, 25 nt, Human
aggcggcagagggggcugucggagg

SEQ ID NO: 42933 - RNA, 22 nt, Human
caaaaacuucuacgccagugug

SEQ ID NO: 42934 - RNA, 20 nt, Human
caacaggucuuggagcugga

SEQ ID NO: 42935 - RNA, 21 nt, Human
cacaccaaaccacacagcaac

SEQ ID NO: 42936 - RNA, 23 nt, Human
caccaaaccacacagcaaccagg

SEQ ID NO: 42937 - RNA, 21 nt, Human
caccccuggagcggcuguggg

SEQ ID NO: 42938 - RNA, 18 nt, Human
caccucaaaaagcagcag

SEQ ID NO: 42939 - RNA, 23 nt, Human
caccucaaaaagcagcaguuggc

SEQ ID NO: 42940 - RNA, 24 nt, Human
cagcaaaaagaagaaggcaggaaa

SEQ ID NO: 42941 - RNA, 22 nt, Human
cagcacaaaggggguuugcggg

SEQ ID NO: 42942 - RNA, 23 nt, Human
caggacagaaggcaggagcccug

SEQ ID NO: 42943 - RNA, 21 nt, Human
cagucuaauagcaaaaccaga

SEQ ID NO: 42944 - RNA, 23 nt, Human
cagucuaauagcaaaaccagauc

SEQ ID NO: 42945 - RNA, 18 nt, Human
ccaggacaaccgcgccag

SEQ ID NO: 42946 - RNA, 18 nt, Human
ccagggcucacagacugu

SEQ ID NO: 42947 - RNA, 21 nt, Human
cccacgaaauccugagcccug

SEQ ID NO: 42948 - RNA, 22 nt, Human
cccugccacugaacuguggagg

SEQ ID NO: 42949 - RNA, 21 nt, Human
ccugaaccuuuuagagugcaa

SEQ ID NO: 42950 - RNA, 28 nt, Human
ccugccacugaacuguggaagguuuucc

SEQ ID NO: 42951 - RNA, 23 nt, Human
cgcucaaccacgcucccgagcau

SEQ ID NO: 42952 - RNA, 23 nt, Human
cggcagagggggcugucggaggg

SEQ ID NO: 42953 - RNA, 27 nt, Human
cgggaacacaccaaaccacacagcaac

SEQ ID NO: 42954 - RNA, 18 nt, Human
cugcgccccugcuccagg

SEQ ID NO: 42955 - RNA, 18 nt, Human
cugcugugcgaaagauaa

SEQ ID NO: 42956 - RNA, 18 nt, Human
cuguggggaggcggcaga

SEQ ID NO: 42957 - RNA, 19 nt, Human
cuucgccccgcugcucucc

SEQ ID NO: 42958 - RNA, 20 nt, Human
cuucgccccgcugcucuccc

SEQ ID NO: 42959 - RNA, 18 nt, Human
gaaauccugagcccugcc

SEQ ID NO: 42960 - RNA, 23 nt, Human
gaacacaccaaaccacacagcaa

SEQ ID NO: 42961 - RNA, 23 nt, Human
gaaccaacaggucuuggagcugg

SEQ ID NO: 42962 - RNA, 18 nt, Human
gaaccuuuuagagugcaa

SEQ ID NO: 42963 - RNA, 22 nt, Human
gaaugaaaugcuacucuuccua

SEQ ID NO: 42964 - RNA, 19 nt, Human
gagggcccacuauugccac

SEQ ID NO: 42965 - RNA, 20 nt, Human
gcgaaagauaaaaucgagaa

SEQ ID NO: 42966 - RNA, 23 nt, Human
ggaaagaaacuccccggcucgga

SEQ ID NO: 42967 - RNA, 21 nt, Human
gggagugaaaaggggccuggg

SEQ ID NO: 42968 - RNA, 22 nt, Human
gggagugaaaaggggccugggc

SEQ ID NO: 42969 - RNA, 25 nt, Human
gugaaacacacaagccaauccggaa

SEQ ID NO: 42970 - RNA, 23 nt, Human
uaaaauaaacagcuuacauuuuc

SEQ ID NO: 42971 - RNA, 21 nt, Human
uagaaacaacagcaaaaagaa

SEQ ID NO: 42972 - RNA, 19 nt, Human
uaggaaccugaggcagugg

SEQ ID NO: 42973 - RNA, 25 nt, Human
uauaaagcuucauuauaggccucug

SEQ ID NO: 42974 - RNA, 19 nt, Human
uauauagauauagcuacac

SEQ ID NO: 42975 - RNA, 21 nt, Human
uauugccacacgucuuccuuu

SEQ ID NO: 42976 - RNA, 21 nt, Human
ucaaccacgcucccgagcaug

SEQ ID NO: 42977 - RNA, 19 nt, Human
ucagcaaacaugcuaaggc

SEQ ID NO: 42978 - RNA, 19 nt, Human
ucuccagccaccccuggag

SEQ ID NO: 42979 - RNA, 18 nt, Human
ucucuguggauagacuga

SEQ ID NO: 42980 - RNA, 18 nt, Human
ucucuguggauagacuga

SEQ ID NO: 42981 - RNA, 19 nt, Human
ucuuggagcuggagagcuc

SEQ ID NO: 42982 - RNA, 20 nt, Human
ugaaacacacaagccaaucc

SEQ ID NO: 42983 - RNA, 20 nt, Human
ugacagaaacaguaagugaa

SEQ ID NO: 42984 - RNA, 22 nt, Human
ugacagaaacaguaagugacac

SEQ ID NO: 42985 - RNA, 22 nt, Human
ugagaacucacggcgcucugca

SEQ ID NO: 42986 - RNA, 20 nt, Human
ugaggcagugggacucucug

SEQ ID NO: 42987 - RNA, 19 nt, Human
ugcaauuaagaacaaaaac

SEQ ID NO: 42988 - RNA, 25 nt, Human
uggaauaaauacaauaaucaaaaua

SEQ ID NO: 42989 - RNA, 21 nt, Human
uggacacccagaaaaccuggc

SEQ ID NO: 42990 - RNA, 23 nt, Human
uggagggagugaaaaggggccug

SEQ ID NO: 42991 - RNA, 24 nt, Human
uggagggagugaaaaggggccugg

SEQ ID NO: 42992 - RNA, 19 nt, Human
uggggaggcggcagagggg

SEQ ID NO: 42993 - RNA, 23 nt, Human
uguacagaauuauauauagauau

SEQ ID NO: 42994 - RNA, 22 nt, Human
uuagaaacaacagcaaaaagaa

SEQ ID NO: 42995 - RNA, 21 nt, Human
uuauaauaacgguucccugaa

SEQ ID NO: 42996 - RNA, 18 nt, Human
uugccacacgucuuccuu

SEQ ID NO: 42997 - RNA, 21 nt, Human
uuggacacccagaaaaccugg

SEQ ID NO: 42998 - RNA, 23 nt, Human
uuggagcuggagagcucugugca

SEQ ID NO: 42999 - RNA, 19 nt, Human
agggguaugggcagggucc

SEQ ID NO: 43000 - RNA, 20 nt, Human
caagugauuuacaguuagaa

SEQ ID NO: 43001 - RNA, 25 nt, Human
caagugauuuacaguuagaaaaccc

SEQ ID NO: 43002 - RNA, 19 nt, Human
caggcccccgccccccggg

SEQ ID NO: 43003 - RNA, 21 nt, Human
caguuagaaaacccaggcagg

SEQ ID NO: 43004 - RNA, 23 nt, Human
ccggcccggccgucaggcccccg

SEQ ID NO: 43005 - RNA, 19 nt, Human
ccucugucccuugcagcuc

SEQ ID NO: 43006 - RNA, 22 nt, Human
cgggcucagcuggcuccgcugg

SEQ ID NO: 43007 - RNA, 18 nt, Human
gccgcgccucugucccuu

SEQ ID NO: 43008 - RNA, 18 nt, Human
gcgcgggcgcgggcuggg

SEQ ID NO: 43009 - RNA, 18 nt, Human
gggcaggguccgaaugug

SEQ ID NO: 43010 - RNA, 20 nt, Human
uacaagugauuuacaguuag

SEQ ID NO: 43011 - RNA, 21 nt, Human
uacaguuagaaaacccaggca

SEQ ID NO: 43012 - RNA, 21 nt, Human
ucccuugcagcuccgccgccc

SEQ ID NO: 43013 - RNA, 22 nt, Human
uccgccgcccggcccggccguc

SEQ ID NO: 43014 - RNA, 20 nt, Human
uccgcgcgccugccgcgccu

SEQ ID NO: 43015 - RNA, 21 nt, Human
uccgcgcgccugccgcgccuc

SEQ ID NO: 43016 - RNA, 22 nt, Human
ugggauggcacuugggcucugg

SEQ ID NO: 43017 - RNA, 20 nt, Human
ugggcucgggcucagcuggc

SEQ ID NO: 43018 - RNA, 24 nt, Human
ugucccuugcagcuccgccgcccc

SEQ ID NO: 43019 - RNA, 21 nt, Human
aagcagaggcccgugugcccc

SEQ ID NO: 43020 - RNA, 24 nt, Human
accacccucaggggauggaccaug

SEQ ID NO: 43021 - RNA, 24 nt, Human
accccagcuuccuccgcggagcaa

SEQ ID NO: 43022 - RNA, 18 nt, Human
accugggcuggcugccgc

SEQ ID NO: 43023 - RNA, 19 nt, Human
acugagcugggaacauggu

SEQ ID NO: 43024 - RNA, 21 nt, Human
acuggggcuggugccuggggc

SEQ ID NO: 43025 - RNA, 24 nt, Human
agagguggugaggggccgaggggg

SEQ ID NO: 43026 - RNA, 20 nt, Human
agguggugaggggccgaggg

SEQ ID NO: 43027 - RNA, 19 nt, Human
caagcagaggcccgugugc

SEQ ID NO: 43028 - RNA, 25 nt, Human
caagcagaggcccguguuguaauga

SEQ ID NO: 43029 - RNA, 22 nt, Human
caaguggaggaacuuggcucuc

SEQ ID NO: 43030 - RNA, 23 nt, Human
cacggaacgggagccuuggcuga

SEQ ID NO: 43031 - RNA, 18 nt, Human
cacugcccuggacagggc

SEQ ID NO: 43032 - RNA, 19 nt, Human
cacuguggaacagcgcccc

SEQ ID NO: 43033 - RNA, 19 nt, Human
cagcgcccccagggagugg

SEQ ID NO: 43034 - RNA, 23 nt, Human
cagcucccccuggugaccccucu

SEQ ID NO: 43035 - RNA, 20 nt, Human
caggggcggggugcgugcau

SEQ ID NO: 43036 - RNA, 22 nt, Human
caucuacuuucccgagggcggg

SEQ ID NO: 43037 - RNA, 19 nt, Human
ccaccuucuccuccuccuc

SEQ ID NO: 43038 - RNA, 18 nt, Human
ccccgggguggugcuggg

SEQ ID NO: 43039 - RNA, 23 nt, Human
ccccugagacugucgcuuuaggg

SEQ ID NO: 43040 - RNA, 18 nt, Human
ccccugaggucagggccu

SEQ ID NO: 43041 - RNA, 21 nt, Human
cccuccacaucuacuuucccg

SEQ ID NO: 43042 - RNA, 21 nt, Human
ccucaggggauggaccauggg

SEQ ID NO: 43043 - RNA, 20 nt, Human
ccugcagugccaggggcugu

SEQ ID NO: 43044 - RNA, 22 nt, Human
cgcacuccuggcuggcaagcag

SEQ ID NO: 43045 - RNA, 23 nt, Human
cgcggccucuucgggcagcccaa

SEQ ID NO: 43046 - RNA, 18 nt, Human
cgggaaaggcacacggug

SEQ ID NO: 43047 - RNA, 18 nt, Human
cuccagggucgcggccuc

SEQ ID NO: 43048 - RNA, 23 nt, Human
cucugugugacugugggucccac

SEQ ID NO: 43049 - RNA, 19 nt, Human
cucuuuggcacugagcugg

SEQ ID NO: 43050 - RNA, 19 nt, Human
cugaggucagggccuugag

SEQ ID NO: 43051 - RNA, 24 nt, Human
cugcagugccaggggcuguggccu

SEQ ID NO: 43052 - RNA, 21 nt, Human
cugcuggcacgguagucacau

SEQ ID NO: 43053 - RNA, 20 nt, Human
cugggccuguugucuaggca

SEQ ID NO: 43054 - RNA, 20 nt, Human
cuucgggcagcccaagugga

SEQ ID NO: 43055 - RNA, 19 nt, Human
cuucuccuccuccuccucc

SEQ ID NO: 43056 - RNA, 18 nt, Human
cuuggcucuccuguccug

SEQ ID NO: 43057 - RNA, 26 nt, Human
cuugugggggagaggaugcaggugag

SEQ ID NO: 43058 - RNA, 21 nt, Human
gaacuuggcucuccuguccug

SEQ ID NO: 43059 - RNA, 28 nt, Human
gaggccaccugcagugccaggggccagg

SEQ ID NO: 43060 - RNA, 19 nt, Human
gaggggccgagggggcggg

SEQ ID NO: 43061 - RNA, 22 nt, Human
gcacugggccccuuguacccca

SEQ ID NO: 43062 - RNA, 19 nt, Human
gcagaggcccgugugcccc

SEQ ID NO: 43063 - RNA, 18 nt, Human
gcagggcgccacccucca

SEQ ID NO: 43064 - RNA, 19 nt, Human
gcagggcgccacccuccac

SEQ ID NO: 43065 - RNA, 21 nt, Human
gcagugccaggggcuguggcc

SEQ ID NO: 43066 - RNA, 19 nt, Human
gcaguguaggcuggcgggg

SEQ ID NO: 43067 - RNA, 21 nt, Human
gcaguugaggcagguggcugg

SEQ ID NO: 43068 - RNA, 21 nt, Human
gcggggcaggggccggggacg

SEQ ID NO: 43069 - RNA, 21 nt, Human
gcggggugacggccgcagggg

SEQ ID NO: 43070 - RNA, 18 nt, Human
gcuggcaagcagaggccc

SEQ ID NO: 43071 - RNA, 23 nt, Human
gcuggcaagcagaggcccguguu

SEQ ID NO: 43072 - RNA, 18 nt, Human
ggacucgagucucuggag

SEQ ID NO: 43073 - RNA, 24 nt, Human
ggccaggcaugcaggggcggggug

SEQ ID NO: 43074 - RNA, 19 nt, Human
ggcuguggccugacgggcu

SEQ ID NO: 43075 - RNA, 18 nt, Human
gggccgagggggcggggc

SEQ ID NO: 43076 - RNA, 21 nt, Human
ggggcggggugcgugcauggg

SEQ ID NO: 43077 - RNA, 19 nt, Human
ggggcuggguuuggcaccg

SEQ ID NO: 43078 - RNA, 20 nt, Human
gggguggugcccggcccgag

SEQ ID NO: 43079 - RNA, 18 nt, Human
gguggugaggggccgagg

SEQ ID NO: 43080 - RNA, 24 nt, Human
guaccccagcuuccuccgcggagc

SEQ ID NO: 43081 - RNA, 23 nt, Human
uaccccagcuuccuccgcggagc

SEQ ID NO: 43082 - RNA, 18 nt, Human
uacuggggggacuggggg

SEQ ID NO: 43083 - RNA, 18 nt, Human
ucccacggaacgggagcc

SEQ ID NO: 43084 - RNA, 21 nt, Human
uccgcagacagcucccccugg

SEQ ID NO: 43085 - RNA, 28 nt, Human
ucggcugcgcugcuguguggcguugucg

SEQ ID NO: 43086 - RNA, 20 nt, Human
ucuaggaggaggggccaggc

SEQ ID NO: 43087 - RNA, 22 nt, Human
ucucccgugggaucuuuggggc

SEQ ID NO: 43088 - RNA, 19 nt, Human
ucuccuccuccuccucccc

SEQ ID NO: 43089 - RNA, 21 nt, Human
ucucucucgggcaggcgcugg

SEQ ID NO: 43090 - RNA, 23 nt, Human
ucucuggagggaggccaccugca

SEQ ID NO: 43091 - RNA, 18 nt, Human
ucucuuccucuccaccuu

SEQ ID NO: 43092 - RNA, 25 nt, Human
ugagagacugacgaggagggaauca

SEQ ID NO: 43093 - RNA, 18 nt, Human
ugaggcagguggcuggaa

SEQ ID NO: 43094 - RNA, 21 nt, Human
ugaggcagguggcuggaagga

SEQ ID NO: 43095 - RNA, 26 nt, Human
ugagggcccgggaaaggcacacgguu

SEQ ID NO: 43096 - RNA, 18 nt, Human
ugaggggccgagggggcg

SEQ ID NO: 43097 - RNA, 24 nt, Human
ugcaggggcggggugcgugcaugg

SEQ ID NO: 43098 - RNA, 24 nt, Human
ugccccgguggcggcuggcagugu

SEQ ID NO: 43099 - RNA, 23 nt, Human
ugcccggcccgagggcugagggc

SEQ ID NO: 43100 - RNA, 21 nt, Human
ugccuggggcagcaguugagg

SEQ ID NO: 43101 - RNA, 22 nt, Human
ugccuggggcagcaguugaggc

SEQ ID NO: 43102 - RNA, 24 nt, Human
ugccuggggcagcaguugaggcag

SEQ ID NO: 43103 - RNA, 26 nt, Human
ugcgucccucuccccucucccguggg

SEQ ID NO: 43104 - RNA, 19 nt, Human
uggaggaacuuggcucucc

SEQ ID NO: 43105 - RNA, 21 nt, Human
uggaggaacuuggcucuccug

SEQ ID NO: 43106 - RNA, 21 nt, Human
uggccccugaggucagggccu

SEQ ID NO: 43107 - RNA, 21 nt, Human
uggccugacgggcuccugggg

SEQ ID NO: 43108 - RNA, 22 nt, Human
uggcugccgcguagggacuggg

SEQ ID NO: 43109 - RNA, 21 nt, Human
ugggagggacagggcgagggu

SEQ ID NO: 43110 - RNA, 19 nt, Human
ugggccccuuguaccccag

SEQ ID NO: 43111 - RNA, 21 nt, Human
ugggcucagggcccuccaggg

SEQ ID NO: 43112 - RNA, 21 nt, Human
ugggggagaggaugcagguga

SEQ ID NO: 43113 - RNA, 19 nt, Human
uggugaggggccgaggggg

SEQ ID NO: 43114 - RNA, 21 nt, Human
uggugaggggccgagggggcg

SEQ ID NO: 43115 - RNA, 22 nt, Human
uguggccagcacugggccccuu

SEQ ID NO: 43116 - RNA, 20 nt, Human
uguugcucugacccugggcc

SEQ ID NO: 43117 - RNA, 23 nt, Human
uuaggcccccgggguggugcugg

SEQ ID NO: 43118 - RNA, 19 nt, Human
uugaggcagguggcuggaa

SEQ ID NO: 43119 - RNA, 23 nt, Human
aaaauaguauuuguuucaaaaca

SEQ ID NO: 43120 - RNA, 18 nt, Human
aaaguacuauuccaaugu

SEQ ID NO: 43121 - RNA, 20 nt, Human
aagcagaaagggagauuucc

SEQ ID NO: 43122 - RNA, 22 nt, Human
aagcagaaagggagauuuccaa

SEQ ID NO: 43123 - RNA, 23 nt, Human
aagcagaaagggagauuuccaag

SEQ ID NO: 43124 - RNA, 24 nt, Human
aaugaaaggauuuauuaaaaauau

SEQ ID NO: 43125 - RNA, 24 nt, Human
acagcgucccauagucugcagcgu

SEQ ID NO: 43126 - RNA, 20 nt, Human
accuugaaaaugaggagaga

SEQ ID NO: 43127 - RNA, 22 nt, Human
accuugaaaaugaggagagagc

SEQ ID NO: 43128 - RNA, 21 nt, Human
agaagagcaagcagaaaggga

SEQ ID NO: 43129 - RNA, 23 nt, Human
agaagcucaagcugcaccaagcu

SEQ ID NO: 43130 - RNA, 20 nt, Human
agaggucgaaucaggccauc

SEQ ID NO: 43131 - RNA, 23 nt, Human
aguaggaaaaauaguauuuguuu

SEQ ID NO: 43132 - RNA, 23 nt, Human
aucaauuugaauucuagguauua

SEQ ID NO: 43133 - RNA, 18 nt, Human
auuacuaugauucucaga

SEQ ID NO: 43134 - RNA, 22 nt, Human
caaaagagcacuaaaccagaga

SEQ ID NO: 43135 - RNA, 20 nt, Human
caagcuccucccucccaggc

SEQ ID NO: 43136 - RNA, 23 nt, Human
caagcuccucccucccaggcccc

SEQ ID NO: 43137 - RNA, 25 nt, Human
caccaagcuccucccucccaggccc

SEQ ID NO: 43138 - RNA, 25 nt, Human
caccuagaaaauccuguuuuacaag

SEQ ID NO: 43139 - RNA, 24 nt, Human
cacuaaaccagagagucaggagaa

SEQ ID NO: 43140 - RNA, 18 nt, Human
cacuuagaaacccacaga

SEQ ID NO: 43141 - RNA, 21 nt, Human
cagaaagggagauuuccaagc

SEQ ID NO: 43142 - RNA, 21 nt, Human
cagacacaccacauauacaua

SEQ ID NO: 43143 - RNA, 22 nt, Human
cagcaaauguuuuagaaagucc

SEQ ID NO: 43144 - RNA, 20 nt, Human
caggccccucauuggcugug

SEQ ID NO: 43145 - RNA, 18 nt, Human
cccaggccccucauuggc

SEQ ID NO: 43146 - RNA, 21 nt, Human
ccccucauuggcugugagggc

SEQ ID NO: 43147 - RNA, 20 nt, Human
ccuagaaaauccuguuuuac

SEQ ID NO: 43148 - RNA, 21 nt, Human
ccuuugaaccuugaaaaugag

SEQ ID NO: 43149 - RNA, 21 nt, Human
cgcaaacagaagagcaagcag

SEQ ID NO: 43150 - RNA, 18 nt, Human
cucuuccacuguuguguu

SEQ ID NO: 43151 - RNA, 24 nt, Human
cugcagcguuucucuuccacuguu

SEQ ID NO: 43152 - RNA, 21 nt, Human
cuuagaaacccacagaaguuu

SEQ ID NO: 43153 - RNA, 18 nt, Human
cuugaaaaugaggagaga

SEQ ID NO: 43154 - RNA, 18 nt, Human
gagcaaagcgaauuacau

SEQ ID NO: 43155 - RNA, 20 nt, Human
gagugucaauuuucucaaaa

SEQ ID NO: 43156 - RNA, 25 nt, Human
guauaacagaaugucuuugagccuu

SEQ ID NO: 43157 - RNA, 21 nt, Human
gugacagaugcagcagagcuc

SEQ ID NO: 43158 - RNA, 22 nt, Human
guuacccaaaccggcuuccaaa

SEQ ID NO: 43159 - RNA, 23 nt, Human
uaacaaaagagcacuaaaccaga

SEQ ID NO: 43160 - RNA, 21 nt, Human
uaauaacaaaagagcacuaaa

SEQ ID NO: 43161 - RNA, 20 nt, Human
uaauuuguuauaugcccuca

SEQ ID NO: 43162 - RNA, 25 nt, Human
uacagcgucccauagucugcagcgu

SEQ ID NO: 43163 - RNA, 22 nt, Human
uauaacagaaugucuuugagcc

SEQ ID NO: 43164 - RNA, 18 nt, Human
ucacagaaauccccagca

SEQ ID NO: 43165 - RNA, 25 nt, Human
ucaugcaguauaacagaaugucuuu

SEQ ID NO: 43166 - RNA, 21 nt, Human
uccaaaagaauucguuuuaaa

SEQ ID NO: 43167 - RNA, 23 nt, Human
uccccagcaaauguuuuagaaag

SEQ ID NO: 43168 - RNA, 19 nt, Human
ucccuuugaaccuugaaaa

SEQ ID NO: 43169 - RNA, 20 nt, Human
ucugcagcguuucucuucca

SEQ ID NO: 43170 - RNA, 22 nt, Human
ucuugcugccuuuuuuucucug

SEQ ID NO: 43171 - RNA, 19 nt, Human
ugacugaccuuacauaaug

SEQ ID NO: 43172 - RNA, 24 nt, Human
ugauacauuuuagccaugcuuuuu

SEQ ID NO: 43173 - RNA, 23 nt, Human
ugcaccaagcuccucccucccag

SEQ ID NO: 43174 - RNA, 20 nt, Human
ugcuaaaaucuuauaaaaca

SEQ ID NO: 43175 - RNA, 25 nt, Human
ugcuuuuuucuuucaacaaaugcca

SEQ ID NO: 43176 - RNA, 21 nt, Human
uggaauccucgcagcuucccc

SEQ ID NO: 43177 - RNA, 18 nt, Human
uggagaggucgaaucagg

SEQ ID NO: 43178 - RNA, 19 nt, Human
uguuguguuuuuaauuuug

SEQ ID NO: 43179 - RNA, 21 nt, Human
uuaaaagaucaugcuucacag

SEQ ID NO: 43180 - RNA, 18 nt, Human
uuacauaaugcauuuguu

SEQ ID NO: 43181 - RNA, 20 nt, Human
uucauuuccagaauauugcc

SEQ ID NO: 43182 - RNA, 26 nt, Human
aaacaaaaccaguuaugcaaaaacaa

SEQ ID NO: 43183 - RNA, 20 nt, Human
aaacaagaguacaaaaugcc

SEQ ID NO: 43184 - RNA, 23 nt, Human
aaacaagaguacaaaaugccccu

SEQ ID NO: 43185 - RNA, 21 nt, Human
aaauaaccaccacacuucuaa

SEQ ID NO: 43186 - RNA, 19 nt, Human
aaaugcacuccaagacaca

SEQ ID NO: 43187 - RNA, 22 nt, Human
aacauacuuuuuaaacauaaaa

SEQ ID NO: 43188 - RNA, 19 nt, Human
aacccaaauauaaaaaagu

SEQ ID NO: 43189 - RNA, 20 nt, Human
aacuaccacagggcacagga

SEQ ID NO: 43190 - RNA, 21 nt, Human
aacuuguucuccauuauucug

SEQ ID NO: 43191 - RNA, 19 nt, Human
aagacacacacaaggaaug

SEQ ID NO: 43192 - RNA, 21 nt, Human
aagauucacagagauaaaaca

SEQ ID NO: 43193 - RNA, 22 nt, Human
aauucucuuaaaaaucuagaac

SEQ ID NO: 43194 - RNA, 20 nt, Human
aauucugcaaaaaaacaaaa

SEQ ID NO: 43195 - RNA, 23 nt, Human
acauaaaaucacagucaaagaca

SEQ ID NO: 43196 - RNA, 20 nt, Human
acuaccacagggcacaggaa

SEQ ID NO: 43197 - RNA, 21 nt, Human
acuuugccuuucuaaguauau

SEQ ID NO: 43198 - RNA, 24 nt, Human
agagauaaaacagugccucggaaa

SEQ ID NO: 43199 - RNA, 21 nt, Human
agguauaguucuccagauuuc

SEQ ID NO: 43200 - RNA, 20 nt, Human
agguuuuuaaccacaagaau

SEQ ID NO: 43201 - RNA, 19 nt, Human
caaaaaaacaaaaccaguu

SEQ ID NO: 43202 - RNA, 20 nt, Human
caaauaaccaccacacuucu

SEQ ID NO: 43203 - RNA, 24 nt, Human
caaauaaccaccacacuucuaaug

SEQ ID NO: 43204 - RNA, 23 nt, Human
caagaguacaaaaugccccuuuc

SEQ ID NO: 43205 - RNA, 19 nt, Human
cagcuaaagaaaucugcca

SEQ ID NO: 43206 - RNA, 22 nt, Human
cauaaaaucacagucaaagaca

SEQ ID NO: 43207 - RNA, 23 nt, Human
cauauacuuuaaacaacucaaua

SEQ ID NO: 43208 - RNA, 23 nt, Human
cuaacacacacaaauuugucuaa

SEQ ID NO: 43209 - RNA, 20 nt, Human
gaguuuuuuuuuuuuuuuuu

SEQ ID NO: 43210 - RNA, 22 nt, Human
gaguuuuuuuuuuuuuuuuuuu

SEQ ID NO: 43211 - RNA, 23 nt, Human
gcaaaaacaagaguacaaaaugc

SEQ ID NO: 43212 - RNA, 19 nt, Human
gcacuccaagacacacaca

SEQ ID NO: 43213 - RNA, 19 nt, Human
uaaacaacucaauacugca

SEQ ID NO: 43214 - RNA, 23 nt, Human
uagaacaggacaaaugaugaccc

SEQ ID NO: 43215 - RNA, 19 nt, Human
uagcaauauccuauauaau

SEQ ID NO: 43216 - RNA, 20 nt, Human
uagcaauauccuauauaaua

SEQ ID NO: 43217 - RNA, 24 nt, Human
uagcugacuucgaaugguuuacau

SEQ ID NO: 43218 - RNA, 21 nt, Human
uaggugugauacaugguaacc

SEQ ID NO: 43219 - RNA, 21 nt, Human
uaguuaaggaaaaccaaaaug

SEQ ID NO: 43220 - RNA, 18 nt, Human
uauaaaaaaguuauucaa

SEQ ID NO: 43221 - RNA, 20 nt, Human
uccaagacacacacaaggaa

SEQ ID NO: 43222 - RNA, 22 nt, Human
uccaagacacacacaaggaaug

SEQ ID NO: 43223 - RNA, 18 nt, Human
uccuuguaagcaagacug

SEQ ID NO: 43224 - RNA, 18 nt, Human
ucuaaguauauucuguaa

SEQ ID NO: 43225 - RNA, 18 nt, Human
ucugcaaaaaaacaaaac

SEQ ID NO: 43226 - RNA, 22 nt, Human
ucuguaauuauuucacugaagc

SEQ ID NO: 43227 - RNA, 21 nt, Human
ugaguauuacuguggcagcua

SEQ ID NO: 43228 - RNA, 19 nt, Human
ugcaaaaaaacaaaaccag

SEQ ID NO: 43229 - RNA, 22 nt, Human
ugcauuauuucauguagugccu

SEQ ID NO: 43230 - RNA, 20 nt, Human
ugggaagauuaggugugaua

SEQ ID NO: 43231 - RNA, 21 nt, Human
ugggaagauuaggugugauac

SEQ ID NO: 43232 - RNA, 23 nt, Human
ugggcuucuaacacacacaaauu

SEQ ID NO: 43233 - RNA, 23 nt, Human
ugggcuucuaacacacacaaauu

SEQ ID NO: 43234 - RNA, 23 nt, Human
ugucuaauucucuuaaaaaucua

SEQ ID NO: 43235 - RNA, 23 nt, Human
uguggcagcuaaagaaaucugcc

SEQ ID NO: 43236 - RNA, 22 nt, Human
uuaaaaaaaacuaagcucaacu

SEQ ID NO: 43237 - RNA, 21 nt, Human
uucaagauucacagagauaaa

SEQ ID NO: 43238 - RNA, 20 nt, Human
uucgguagccagugauuguu

SEQ ID NO: 43239 - RNA, 21 nt, Human
uuuguugcuuuguuuuuuuuu

SEQ ID NO: 43240 - RNA, 21 nt, Human
uuuguugcuuuguuuuuuuuu

SEQ ID NO: 43241 - RNA, 22 nt, Human
uuuuuaaacauaaaaucacagu

SEQ ID NO: 43242 - RNA, 24 nt, Human
uuuuuuuuuuuuuuuuuuaaucug

SEQ ID NO: 43243 - RNA, 20 nt, Human
aaaaccuucaguaucugcag

SEQ ID NO: 43244 - RNA, 22 nt, Human
aaaauauuaaguaacucaagua

SEQ ID NO: 43245 - RNA, 22 nt, Human
aaaauauuaaguaacucaagua

SEQ ID NO: 43246 - RNA, 20 nt, Human
aaaggccccuggaaguuagu

SEQ ID NO: 43247 - RNA, 20 nt, Human
aaauacaaaucuggagauuc

SEQ ID NO: 43248 - RNA, 20 nt, Human
aaauacaaaucuggagauuc

SEQ ID NO: 43249 - RNA, 20 nt, Human
aaauacaaaucuggagauuc

SEQ ID NO: 43250 - RNA, 18 nt, Human
aacuacacaacacuggca

SEQ ID NO: 43251 - RNA, 18 nt, Human
aacuacacaacacuggca

SEQ ID NO: 43252 - RNA, 18 nt, Human
aacuacacaacacuggca

SEQ ID NO: 43253 - RNA, 21 nt, Human
aagaaccucaagauccucuca

SEQ ID NO: 43254 - RNA, 21 nt, Human
aagagaccaccaccacaugga

SEQ ID NO: 43255 - RNA, 22 nt, Human
aaguacuagaaguacagaagcc

SEQ ID NO: 43256 - RNA, 22 nt, Human
aaguacuagaaguacagaagcc

SEQ ID NO: 43257 - RNA, 22 nt, Human
aaguacuagaaguacagaagcc

SEQ ID NO: 43258 - RNA, 21 nt, Human
aaugaaacuacaagagaccac

SEQ ID NO: 43259 - RNA, 18 nt, Human
acacagcccacccucccu

SEQ ID NO: 43260 - RNA, 18 nt, Human
acagaucucacacuucca

SEQ ID NO: 43261 - RNA, 18 nt, Human
acagaucucacacuucca

SEQ ID NO: 43262 - RNA, 18 nt, Human
acagaucucacacuucca

SEQ ID NO: 43263 - RNA, 25 nt, Human
acagcccacccucccuccagaaccc

SEQ ID NO: 43264 - RNA, 22 nt, Human
acagccuccugagggcaggggc

SEQ ID NO: 43265 - RNA, 19 nt, Human
acccucccuccagaaccca

SEQ ID NO: 43266 - RNA, 21 nt, Human
accugggcucagcccaccacu

SEQ ID NO: 43267 - RNA, 21 nt, Human
accugggcucagcccaccacu

SEQ ID NO: 43268 - RNA, 21 nt, Human
accugggcucagcccaccacu

SEQ ID NO: 43269 - RNA, 26 nt, Human
accuuggguguuugacauacgcgugu

SEQ ID NO: 43270 - RNA, 21 nt, Human
acuacaagagaccaccaccac

SEQ ID NO: 43271 - RNA, 20 nt, Human
acuagaaguacagaagccug

SEQ ID NO: 43272 - RNA, 20 nt, Human
acuagaaguacagaagccug

SEQ ID NO: 43273 - RNA, 22 nt, Human
agaaucgcuccacguccuggcu

SEQ ID NO: 43274 - RNA, 26 nt, Human
agacagaaagcuguaauucuuuuuaa

SEQ ID NO: 43275 - RNA, 27 nt, Human
agacagaaagcuguaauucuuuuuaau

SEQ ID NO: 43276 - RNA, 27 nt, Human
agacagaaagcuguaauucuuuuuaau

SEQ ID NO: 43277 - RNA, 20 nt, Human
agcaugacagccaggaaugu

SEQ ID NO: 43278 - RNA, 22 nt, Human
agcucccaucuuccuccuccac

SEQ ID NO: 43279 - RNA, 22 nt, Human
aggagaggugggaacgccuggc

SEQ ID NO: 43280 - RNA, 20 nt, Human
aggcacaaaagggucaggaa

SEQ ID NO: 43281 - RNA, 22 nt, Human
aggggcacuggucugagugagg

SEQ ID NO: 43282 - RNA, 22 nt, Human
aggggcacuggucugagugagg

SEQ ID NO: 43283 - RNA, 22 nt, Human
aggggcacuggucugagugagg

SEQ ID NO: 43284 - RNA, 18 nt, Human
aguagugggcccaaucca

SEQ ID NO: 43285 - RNA, 24 nt, Human
aucuuccuccuccacagaguuuca

SEQ ID NO: 43286 - RNA, 24 nt, Human
caaaagggucaggaacaucaaggc

SEQ ID NO: 43287 - RNA, 23 nt, Human
caaggcucugccgaugucccaca

SEQ ID NO: 43288 - RNA, 19 nt, Human
caaguggaaagggagaugu

SEQ ID NO: 43289 - RNA, 19 nt, Human
caaguggaaagggagaugu

SEQ ID NO: 43290 - RNA, 19 nt, Human
caaguggaaagggagaugu

SEQ ID NO: 43291 - RNA, 18 nt, Human
cacagcccacccucccuc

SEQ ID NO: 43292 - RNA, 20 nt, Human
cacagcccacccucccucca

SEQ ID NO: 43293 - RNA, 22 nt, Human
cacagcccacccucccuccaga

SEQ ID NO: 43294 - RNA, 21 nt, Human
cacaguaacuccaccucaugc

SEQ ID NO: 43295 - RNA, 21 nt, Human
cacaguaacuccaccucaugc

SEQ ID NO: 43296 - RNA, 21 nt, Human
cacaguaacuccaccucaugc

SEQ ID NO: 43297 - RNA, 20 nt, Human
cacccucccuccagaaccca

SEQ ID NO: 43298 - RNA, 22 nt, Human
cacccucccuccagaacccacu

SEQ ID NO: 43299 - RNA, 21 nt, Human
caccugagaaaagaaaaaaac

SEQ ID NO: 43300 - RNA, 24 nt, Human
caccugagaaaagaaaaaaaccac

SEQ ID NO: 43301 - RNA, 18 nt, Human
caccuuuugcccugacuc

SEQ ID NO: 43302 - RNA, 24 nt, Human
cagaacccacuggaaccucccaag

SEQ ID NO: 43303 - RNA, 18 nt, Human
cagaguuucagaaccaag

SEQ ID NO: 43304 - RNA, 20 nt, Human
cagaguuucagaaccaagga

SEQ ID NO: 43305 - RNA, 20 nt, Human
cagaguuucagaaccaagga

SEQ ID NO: 43306 - RNA, 19 nt, Human
cagccuccugagggcaggg

SEQ ID NO: 43307 - RNA, 21 nt, Human
caucaaggcauuuugugauga

SEQ ID NO: 43308 - RNA, 18 nt, Human
ccaaccuuauuuuggcua

SEQ ID NO: 43309 - RNA, 18 nt, Human
ccaaguuggacaggccug

SEQ ID NO: 43310 - RNA, 22 nt, Human
ccacagaguuucagaaccaagg

SEQ ID NO: 43311 - RNA, 24 nt, Human
ccaccucaccuuuugcccugacuc

SEQ ID NO: 43312 - RNA, 26 nt, Human
ccacuggaaccucccaaggggcccuc

SEQ ID NO: 43313 - RNA, 19 nt, Human
cccaucuuccuccuccaca

SEQ ID NO: 43314 - RNA, 21 nt, Human
cccaucuuccuccuccacaga

SEQ ID NO: 43315 - RNA, 21 nt, Human
cccaucuuccuccuccacaga

SEQ ID NO: 43316 - RNA, 19 nt, Human
ccccguuuugaggggccuc

SEQ ID NO: 43317 - RNA, 22 nt, Human
cccgagggacucuggagcccag

SEQ ID NO: 43318 - RNA, 24 nt, Human
cccgcgaccgccaugaccugagac

SEQ ID NO: 43319 - RNA, 22 nt, Human
cccuccagaacccacuggaacc

SEQ ID NO: 43320 - RNA, 24 nt, Human
ccgagggacucuggagcccagcug

SEQ ID NO: 43321 - RNA, 25 nt, Human
ccuccagaacccacuggaaccuccc

SEQ ID NO: 43322 - RNA, 20 nt, Human
ccucccuccagaacccacug

SEQ ID NO: 43323 - RNA, 24 nt, Human
ccugagaccgagggacucuggagc

SEQ ID NO: 43324 - RNA, 21 nt, Human
ccugagggcaggggccccaga

SEQ ID NO: 43325 - RNA, 25 nt, Human
ccugcacaggacccauguggcuccu

SEQ ID NO: 43326 - RNA, 19 nt, Human
ccuucaguaucugcaggaa

SEQ ID NO: 43327 - RNA, 18 nt, Human
cgagggacucuggagccc

SEQ ID NO: 43328 - RNA, 21 nt, Human
cggcagaaccugagucggggu

SEQ ID NO: 43329 - RNA, 24 nt, Human
cuccacagaguuucagaaccaagg

SEQ ID NO: 43330 - RNA, 23 nt, Human
cuccagaacccacuggaaccucc

SEQ ID NO: 43331 - RNA, 21 nt, Human
cucccaucuuccuccuccaca

SEQ ID NO: 43332 - RNA, 22 nt, Human
cucccaucuuccuccuccacag

SEQ ID NO: 43333 - RNA, 22 nt, Human
cucgcucuccacuuccucuguc

SEQ ID NO: 43334 - RNA, 22 nt, Human
cucucugcuacugcuacucccc

SEQ ID NO: 43335 - RNA, 22 nt, Human
cucuuuagcaaacaugaucuga

SEQ ID NO: 43336 - RNA, 22 nt, Human
cucuuuagcaaacaugaucuga

SEQ ID NO: 43337 - RNA, 22 nt, Human
cucuuuagcaaacaugaucuga

SEQ ID NO: 43338 - RNA, 22 nt, Human
cuguccuugccaccaaguugga

SEQ ID NO: 43339 - RNA, 23 nt, Human
cuuuguuucccaggaccccauag

SEQ ID NO: 43340 - RNA, 23 nt, Human
gaaaaaaaccacaccaaccuagg

SEQ ID NO: 43341 - RNA, 19 nt, Human
gaacccacuggaaccuccc

SEQ ID NO: 43342 - RNA, 18 nt, Human
gaauagaagguucuuaga

SEQ ID NO: 43343 - RNA, 18 nt, Human
gagaagacagaaagcugu

SEQ ID NO: 43344 - RNA, 18 nt, Human
gagaagacagaaagcugu

SEQ ID NO: 43345 - RNA, 18 nt, Human
gagaggcucuggccggca

SEQ ID NO: 43346 - RNA, 21 nt, Human
gagauucaaugucccccacag

SEQ ID NO: 43347 - RNA, 21 nt, Human
gagauucaaugucccccacag

SEQ ID NO: 43348 - RNA, 21 nt, Human
gagauucagugucccccacag

SEQ ID NO: 43349 - RNA, 18 nt, Human
gagcaaaagacggagcug

SEQ ID NO: 43350 - RNA, 18 nt, Human
gagcucgaucuucgcugu

SEQ ID NO: 43351 - RNA, 18 nt, Human
gagcucgaucuucgcugu

SEQ ID NO: 43352 - RNA, 18 nt, Human
gagcucgaucuucgcugu

SEQ ID NO: 43353 - RNA, 19 nt, Human
gaggaggccacucgguucu

SEQ ID NO: 43354 - RNA, 21 nt, Human
gaggcagcagaguccugggag

SEQ ID NO: 43355 - RNA, 21 nt, Human
gaggcagcagaguccugggag

SEQ ID NO: 43356 - RNA, 21 nt, Human
gaggcagcagaguccugggag

SEQ ID NO: 43357 - RNA, 20 nt, Human
gccccauuuaccugccucag

SEQ ID NO: 43358 - RNA, 18 nt, Human
gccuuuggguucuuucuc

SEQ ID NO: 43359 - RNA, 18 nt, Human
gcgugaguccuugcccca

SEQ ID NO: 43360 - RNA, 24 nt, Human
gcuaugaguagugggcccaaucca

SEQ ID NO: 43361 - RNA, 21 nt, Human
gcucccaucuuccuccuccac

SEQ ID NO: 43362 - RNA, 19 nt, Human
gcuuugugcuuucuggguu

SEQ ID NO: 43363 - RNA, 19 nt, Human
gcuuugugcuuucuggguu

SEQ ID NO: 43364 - RNA, 19 nt, Human
gcuuugugcuuucuggguu

SEQ ID NO: 43365 - RNA, 21 nt, Human
ggcacaaaagggucaggaaca

SEQ ID NO: 43366 - RNA, 20 nt, Human
ggccaggcugagccuuuggg

SEQ ID NO: 43367 - RNA, 23 nt, Human
ggcccuggccaggcugagccuuu

SEQ ID NO: 43368 - RNA, 20 nt, Human
gggccucuggcccuggccag

SEQ ID NO: 43369 - RNA, 18 nt, Human
gggcgcgggccccgcgac

SEQ ID NO: 43370 - RNA, 26 nt, Human
guucuccuuccaaaagccagagcuuc

SEQ ID NO: 43371 - RNA, 26 nt, Human
uaaaaaaaaucauuccaugauagaga

SEQ ID NO: 43372 - RNA, 26 nt, Human
uaaaaaaaaucauuccaugauagaga

SEQ ID NO: 43373 - RNA, 24 nt, Human
uaaaaauauuaaguaacucaagua

SEQ ID NO: 43374 - RNA, 24 nt, Human
uaaaaauauuaaguaacucaagua

SEQ ID NO: 43375 - RNA, 24 nt, Human
uaagguagggcagaccaaaggccc

SEQ ID NO: 43376 - RNA, 24 nt, Human
uaagguagggcagaccaaaggccc

SEQ ID NO: 43377 - RNA, 24 nt, Human
uaagguagggcagaccaaaggccc

SEQ ID NO: 43378 - RNA, 19 nt, Human
uacuagaaguacagaagcc

SEQ ID NO: 43379 - RNA, 19 nt, Human
uacuagaaguacagaagcc

SEQ ID NO: 43380 - RNA, 19 nt, Human
uacuagaaguacagaagcc

SEQ ID NO: 43381 - RNA, 21 nt, Human
uacuagaaguacagaagccug

SEQ ID NO: 43382 - RNA, 21 nt, Human
uacuagaaguacagaagccug

SEQ ID NO: 43383 - RNA, 22 nt, Human
uagaagguucuuagagccagca

SEQ ID NO: 43384 - RNA, 30 nt, Human
uagaccugggcucagcccaccacugcuagg

SEQ ID NO: 43385 - RNA, 30 nt, Human; identical to SEQ ID NO: 43384

SEQ ID NO: 43386 - RNA, 30 nt, Human; identical to SEQ ID NO: 43384

SEQ ID NO: 43387 - RNA, 24 nt, Human
uagugguucagguucuaacuacac

SEQ ID NO: 43388 - RNA, 24 nt, Human
uagugguucagguucuaacuacac

SEQ ID NO: 43389 - RNA, 18 nt, Human
uaucaccugagaaaagaa

SEQ ID NO: 43390 - RNA, 22 nt, Human
uauugcugcacaauuuaacuga

SEQ ID NO: 43391 - RNA, 22 nt, Human
uauugcugcacaauuuaacuga

SEQ ID NO: 43392 - RNA, 22 nt, Human
uauugcugcacaauuuaacuga

SEQ ID NO: 43393 - RNA, 23 nt, Human
ucaccaccucaccuuuugcccug

SEQ ID NO: 43394 - RNA, 24 nt, Human
ucagaacaaugagcaugacagcca

SEQ ID NO: 43395 - RNA, 20 nt, Human
ucauuccaugauagagaagg

SEQ ID NO: 43396 - RNA, 20 nt, Human
ucauuccaugauagagaagg

SEQ ID NO: 43397 - RNA, 20 nt, Human
ucauuccaugauagagaagg

SEQ ID NO: 43398 - RNA, 20 nt, Human
uccaguccaccugcuggucc

SEQ ID NO: 43399 - RNA, 21 nt, Human
uccaugauagagaagacagaa

SEQ ID NO: 43400 - RNA, 21 nt, Human
ucccaucuuccuccuccacag

SEQ ID NO: 43401 - RNA, 22 nt, Human
ucucaucagcucccaucuuccu

SEQ ID NO: 43402 - RNA, 22 nt, Human
ucucaucagcucccaucuuccu

SEQ ID NO: 43403 - RNA, 21 nt, Human
ugaaacuacaagagaccacca

SEQ ID NO: 43404 - RNA, 22 nt, Human
ugaacgucauccccagcugcug

SEQ ID NO: 43405 - RNA, 24 nt, Human
ugacuggggaucaagccaaccugg

SEQ ID NO: 43406 - RNA, 25 nt, Human
ugagaaaagaaaaaaaccacaccaa

SEQ ID NO: 43407 - RNA, 18 nt, Human
ugaggcagcagaguccug

SEQ ID NO: 43408 - RNA, 18 nt, Human
ugaggcagcagaguccug

SEQ ID NO: 43409 - RNA, 18 nt, Human
ugaggcagcagaguccug

SEQ ID NO: 43410 - RNA, 20 nt, Human
ugagggccgccgacccgcca

SEQ ID NO: 43411 - RNA, 20 nt, Human
ugagggccgccgacccgcca

SEQ ID NO: 43412 - RNA, 20 nt, Human
ugagggccgccgacccgcca

SEQ ID NO: 43413 - RNA, 21 nt, Human
ugauucucaucagcucccauc

SEQ ID NO: 43414 - RNA, 19 nt, Human
ugccccauuuaccugccuc

SEQ ID NO: 43415 - RNA, 21 nt, Human
ugccccauuuaccugccucag

SEQ ID NO: 43416 - RNA, 22 nt, Human
ugccccauuuaccugccucagg

SEQ ID NO: 43417 - RNA, 19 nt, Human
ugcccugacucuaggaccu

SEQ ID NO: 43418 - RNA, 18 nt, Human
ugcuuugugcuuucuggg

SEQ ID NO: 43419 - RNA, 18 nt, Human
ugcuuugugcuuucuggg

SEQ ID NO: 43420 - RNA, 21 nt, Human
uggcaaguggaaagggagaug

SEQ ID NO: 43421 - RNA, 21 nt, Human
uggcaaguggaaagggagaug

SEQ ID NO: 43422 - RNA, 21 nt, Human
uggcaaguggaaagggagaug

SEQ ID NO: 43423 - RNA, 21 nt, Human
uggccaggcugagccuuuggg

SEQ ID NO: 43424 - RNA, 21 nt, Human
uggccaggcugagccuuuggg

SEQ ID NO: 43425 - RNA, 26 nt, Human
uggccaggcugagccuuuggguucuu

SEQ ID NO: 43426 - RNA, 22 nt, Human
uggccugggucagaugggagag

SEQ ID NO: 43427 - RNA, 20 nt, Human
ugggcucagcccaccacugc

SEQ ID NO: 43428 - RNA, 20 nt, Human
ugggcucagcccaccacugc

SEQ ID NO: 43429 - RNA, 20 nt, Human
ugggcucagcccaccacugc

SEQ ID NO: 43430 - RNA, 22 nt, Human
uggggagaagugaaaaacccug

SEQ ID NO: 43431 - RNA, 22 nt, Human
uggggagaagugaaaaacccug

SEQ ID NO: 43432 - RNA, 23 nt, Human
uggggagaagugaaaaacccugg

SEQ ID NO: 43433 - RNA, 23 nt, Human
uggggagaagugaaaaacccugg

SEQ ID NO: 43434 - RNA, 21 nt, Human
ugguucagguucuaacuacac

SEQ ID NO: 43435 - RNA, 24 nt, Human
ugucaaauacaaaucuggagauuc

SEQ ID NO: 43436 - RNA, 24 nt, Human
ugucaaauacaaaucuggagauuc

SEQ ID NO: 43437 - RNA, 25 nt, Human
ugucaaauacaaaucuggagauuca

SEQ ID NO: 43438 - RNA, 25 nt, Human
ugucaaauacaaaucuggagauuca

SEQ ID NO: 43439 - RNA, 25 nt, Human
uguccuugccaccaaguuggacagg

SEQ ID NO: 43440 - RNA, 22 nt, Human
uuauuuuggcuaaggggaaagg

SEQ ID NO: 43441 - RNA, 22 nt, Human
uuauuuuggcuaaggggaaagg

SEQ ID NO: 43442 - RNA, 22 nt, Human
uuauuuuggcuaaggggaaagg

SEQ ID NO: 43443 - RNA, 18 nt, Human
uucccuucccaccaagcu

SEQ ID NO: 43444 - RNA, 18 nt, Human
uucccuucccaccaagcu

SEQ ID NO: 43445 - RNA, 18 nt, Human
uucccuucccaccaagcu

SEQ ID NO: 43446 - RNA, 24 nt, Human
uugauucucaucagcucccauccc

SEQ ID NO: 43447 - RNA, 21 nt, Human
uuggcuaaggggaaagggauu

SEQ ID NO: 43448 - RNA, 21 nt, Human
uuggcuaaggggaaagggauu

SEQ ID NO: 43449 - RNA, 21 nt, Human
uuggcuaaggggaaagggauu

SEQ ID NO: 43450 - RNA, 18 nt, Human
uuuggcuaaggggaaagg

SEQ ID NO: 43451 - RNA, 18 nt, Human
uuuuuuuuuuuuuuuuug

SEQ ID NO: 43452 - RNA, 18 nt, Human
uuuuuuuuuuuuuuuuug

SEQ ID NO: 43453 - RNA, 18 nt, Human
uuuuuuuuuuuuuuuuug

SEQ ID NO: 43454 - RNA, 21 nt, Human
uuuuuuuuuuuuuuuuuuugg

SEQ ID NO: 43455 - RNA, 25 nt, Human
uuuuuuuuuuuuuuuuuuuguuuuu

SEQ ID NO: 43456 - RNA, 25 nt, Human
uuuuuuuuuuuuuuuuuuuguuuuu

SEQ ID NO: 43457 - RNA, 19 nt, Human
aaaacaaaaaaaguucaga

SEQ ID NO: 43458 - RNA, 21 nt, Human
aaaauaccuauuuuuccaaca

SEQ ID NO: 43459 - RNA, 20 nt, Human
aaaaucuucccauacaucau

SEQ ID NO: 43460 - RNA, 24 nt, Human
aaacauguuuaaaagcaccaaaaa

SEQ ID NO: 43461 - RNA, 20 nt, Human
aaaugcuuuuuccuaaaucu

SEQ ID NO: 43462 - RNA, 22 nt, Human
aaugcaaaaacaaaaaaaguuc

SEQ ID NO: 43463 - RNA, 25 nt, Human
aaugcaaaaacaaaaaaaguucaga

SEQ ID NO: 43464 - RNA, 25 nt, Human
acaaacaauaaacauaauccugaug

SEQ ID NO: 43465 - RNA, 24 nt, Human
acagaaaaaagcaugaaagaauau

SEQ ID NO: 43466 - RNA, 21 nt, Human
acucaagaaauuuagaugggu

SEQ ID NO: 43467 - RNA, 20 nt, Human
agaaaaaagcaugaaagaau

SEQ ID NO: 43468 - RNA, 22 nt, Human
agaaaaaucuguggaacuuaaa

SEQ ID NO: 43469 - RNA, 24 nt, Human
agcaccaaaaaagauuaaaaacaa

SEQ ID NO: 43470 - RNA, 24 nt, Human
aggaacagaaaaguggccgguacc

SEQ ID NO: 43471 - RNA, 19 nt, Human
aggcauuacuuauuuuagu

SEQ ID NO: 43472 - RNA, 18 nt, Human
agggguuuuuugcgggga

SEQ ID NO: 43473 - RNA, 20 nt, Human
auuuuuuuauuccauucugu

SEQ ID NO: 43474 - RNA, 25 nt, Human
caaaaaaaguucagaguaaaguuag

SEQ ID NO: 43475 - RNA, 23 nt, Human
caaaaacaaaaaaaguucagagu

SEQ ID NO: 43476 - RNA, 22 nt, Human
cagcucuucuggagaaaacgau

SEQ ID NO: 43477 - RNA, 19 nt, Human
caggaacagaaaaguggca

SEQ ID NO: 43478 - RNA, 21 nt, Human
caggaucaguaaauaacaaua

SEQ ID NO: 43479 - RNA, 23 nt, Human
caggaucaguaaauaacaauagc

SEQ ID NO: 43480 - RNA, 19 nt, Human
cagguaaguacagaaaccc

SEQ ID NO: 43481 - RNA, 22 nt, Human
cauaauaggguccaguuaaacc

SEQ ID NO: 43482 - RNA, 21 nt, Human
ccaggcuccagguaauccugu

SEQ ID NO: 43483 - RNA, 22 nt, Human
ccauacaucaugaaaacuugga

SEQ ID NO: 43484 - RNA, 20 nt, Human
cuucccauacaucaugaaaa

SEQ ID NO: 43485 - RNA, 21 nt, Human
cuucuggagaaaacgaucccc

SEQ ID NO: 43486 - RNA, 21 nt, Human
cuuggcugcccaacagaaaaa

SEQ ID NO: 43487 - RNA, 24 nt, Human
gaaaacaaacaauaaacauaaucc

SEQ ID NO: 43488 - RNA, 23 nt, Human
gcuaaacauguuuaaaagcacca

SEQ ID NO: 43489 - RNA, 22 nt, Human
gugcucuauauccaaacucaca

SEQ ID NO: 43490 - RNA, 25 nt, Human
uaaaaggcauaauaggguccaguua

SEQ ID NO: 43491 - RNA, 24 nt, Human
uaggguccaguuaaaccauacuuu

SEQ ID NO: 43492 - RNA, 19 nt, Human
uauuaugcacaaaagagcc

SEQ ID NO: 43493 - RNA, 24 nt, Human
ucacaaauuuaaccuauccuuaaa

SEQ ID NO: 43494 - RNA, 28 nt, Human
uccaggcuccagguaauccuguucaaaa

SEQ ID NO: 43495 - RNA, 19 nt, Human
ucuggagaaaacgaucccc

SEQ ID NO: 43496 - RNA, 21 nt, Human
ucuggagaaaacgauccccuu

SEQ ID NO: 43497 - RNA, 19 nt, Human
ucuguaguucuaagggaag

SEQ ID NO: 43498 - RNA, 19 nt, Human
ugaaaugucuucauuuuag

SEQ ID NO: 43499 - RNA, 19 nt, Human
ugacaaaaaauucuaguaa

SEQ ID NO: 43500 - RNA, 25 nt, Human
ugacaaaaaauucuaguaaauacuc

SEQ ID NO: 43501 - RNA, 22 nt, Human
ugacugaauacagaaccucaug

SEQ ID NO: 43502 - RNA, 23 nt, Human
ugcaaaaacaaaaaaaguucaga

SEQ ID NO: 43503 - RNA, 22 nt, Human
ugcaaagacugaaaacaaacaa

SEQ ID NO: 43504 - RNA, 20 nt, Human
ugcccaacagaaaaaucugu

SEQ ID NO: 43505 - RNA, 22 nt, Human
ugcccaacagaaaaaucugugg

SEQ ID NO: 43506 - RNA, 23 nt, Human
ugcccaacagaaaaaucugugga

SEQ ID NO: 43507 - RNA, 18 nt, Human
ugccuuuagggaaguggu

SEQ ID NO: 43508 - RNA, 18 nt, Human
ugcuugccccagucauuu

SEQ ID NO: 43509 - RNA, 22 nt, Human
uggagaaaacgauccccuugcg

SEQ ID NO: 43510 - RNA, 24 nt, Human
uggcuccaggcuccagguaauccu

SEQ ID NO: 43511 - RNA, 22 nt, Human
uggggcauaaaauccugauuca

SEQ ID NO: 43512 - RNA, 21 nt, Human
ugguaauauagugcaaagacu

SEQ ID NO: 43513 - RNA, 24 nt, Human
uguauacaaaacaaacccuuuaca

SEQ ID NO: 43514 - RNA, 24 nt, Human
uguuuauuuaucaaaugucaauca

SEQ ID NO: 43515 - RNA, 25 nt, Human
uuaaaaaaaauacauagaugcuuag

SEQ ID NO: 43516 - RNA, 19 nt, Human
uuaaaguggcuccaggcuc

SEQ ID NO: 43517 - RNA, 22 nt, Human
uuaauaaauggcuuaucaauau

SEQ ID NO: 43518 - RNA, 19 nt, Human
uuagaaaugcuuuuuccua

SEQ ID NO: 43519 - RNA, 20 nt, Human
uucaggaacagaaaaguggc

SEQ ID NO: 43520 - RNA, 20 nt, Human
uucuaauuuccuccucaauu

SEQ ID NO: 43521 - RNA, 21 nt, Human
uuucaacuacaauuuagaacc

SEQ ID NO: 43522 - RNA, 21 nt, Human
uuuguauacaaaacaaacccu

SEQ ID NO: 43523 - RNA, 27 nt, Human
uuuuacaacauguauuuauggguuacu

SEQ ID NO: 43524 - RNA, 24 nt, Human
uuuucagccacacagcguguucuc

SEQ ID NO: 43525 - RNA, 22 nt, Human
aacagcaccacccaaagacugg

SEQ ID NO: 43526 - RNA, 21 nt, Human
aacagcuguuuguaccaguga

SEQ ID NO: 43527 - RNA, 20 nt, Human
aagagaagcagaacaaacaa

SEQ ID NO: 43528 - RNA, 22 nt, Human
accuccagcucugagcuucaac

SEQ ID NO: 43529 - RNA, 20 nt, Human
agaaaagaacagcaccaccc

SEQ ID NO: 43530 - RNA, 25 nt, Human
agaaaagaacagcaccacccaaaga

SEQ ID NO: 43531 - RNA, 21 nt, Human
agagaaauggaugcaaucaga

SEQ ID NO: 43532 - RNA, 23 nt, Human
agcauuaaauccaccagaaaaga

SEQ ID NO: 43533 - RNA, 22 nt, Human
aggccagaggcagucuucagag

SEQ ID NO: 43534 - RNA, 24 nt, Human
aggccagaggcagucuucagagga

SEQ ID NO: 43535 - RNA, 18 nt, Human
aguucagcagcauuccuu

SEQ ID NO: 43536 - RNA, 19 nt, Human
auggggcuggcucuccaag

SEQ ID NO: 43537 - RNA, 22 nt, Human
auggggcuggcucuccaagucg

SEQ ID NO: 43538 - RNA, 24 nt, Human
caccagaaaagaacagcaccaccc

SEQ ID NO: 43539 - RNA, 26 nt, Human
caccuccagcucugagcuucaacagc

SEQ ID NO: 43540 - RNA, 24 nt, Human
cagaggacuucuaggccacacaaa

SEQ ID NO: 43541 - RNA, 20 nt, Human
cagcaccacccaaagacugg

SEQ ID NO: 43542 - RNA, 30 nt, Human
cagcagcauuccuuuccugccccaaguccu

SEQ ID NO: 43543 - RNA, 23 nt, Human
cagugagucagcauuaaauccac

SEQ ID NO: 43544 - RNA, 21 nt, Human
caguuacagcuacuguggcgg

SEQ ID NO: 43545 - RNA, 19 nt, Human
ccucagaagcucaccucca

SEQ ID NO: 43546 - RNA, 22 nt, Human
cuccaccuucaugugccugaau

SEQ ID NO: 43547 - RNA, 18 nt, Human
cucgggagacuucuggga

SEQ ID NO: 43548 - RNA, 24 nt, Human
cuuuccuuuauuucuuccccuuuu

SEQ ID NO: 43549 - RNA, 21 nt, Human
gagucagcauuaaauccaccg

SEQ ID NO: 43550 - RNA, 21 nt, Human
gcaaaggccucagaagcucac

SEQ ID NO: 43551 - RNA, 24 nt, Human
gcagaacaaacaagucuuucagag

SEQ ID NO: 43552 - RNA, 20 nt, Human
gcaggccagaggcagucuuc

SEQ ID NO: 43553 - RNA, 18 nt, Human
uccuuuccugccccaagu

SEQ ID NO: 43554 - RNA, 19 nt, Human
ucucucgggagacuucugg

SEQ ID NO: 43555 - RNA, 19 nt, Human
ugagcuucaacagcuguuu

SEQ ID NO: 43556 - RNA, 21 nt, Human
uggaaccucacaauaaggugg

SEQ ID NO: 43557 - RNA, 23 nt, Human
uggaaccucacaauaaggugguc

SEQ ID NO: 43558 - RNA, 21 nt, Human
uucaaguucagcagcauuccu

SEQ ID NO: 43559 - RNA, 26 nt, Human
uucagaggaggggagaccacagagga

SEQ ID NO: 43560 - RNA, 21 nt, Human
uucugagugaugagaguccug

SEQ ID NO: 43561 - RNA, 24 nt, Human
uuuuuuucggcagcaacuccuuuc

SEQ ID NO: 43562 - RNA, 21 nt, Human
aaaaaaaaaaaaaaccaccaa

SEQ ID NO: 43563 - RNA, 22 nt, Human
acccacaaacccaacgcgguuc

SEQ ID NO: 43564 - RNA, 20 nt, Human
acgcgguucuagggguugga

SEQ ID NO: 43565 - RNA, 18 nt, Human
acuucucauuggaaaaga

SEQ ID NO: 43566 - RNA, 22 nt, Human
auucuagacgugcccucggcca

SEQ ID NO: 43567 - RNA, 18 nt, Human
caaguacuaaaaagguau

SEQ ID NO: 43568 - RNA, 25 nt, Human
caccuuagaaagaugaaaaugugaa

SEQ ID NO: 43569 - RNA, 20 nt, Human
cacguggaaaaagaaagacu

SEQ ID NO: 43570 - RNA, 24 nt, Human
caggacccacggugccuggugcua

SEQ ID NO: 43571 - RNA, 20 nt, Human
cauccaggacccacggugcc

SEQ ID NO: 43572 - RNA, 24 nt, Human
ccagacaucugacugugcagccau

SEQ ID NO: 43573 - RNA, 23 nt, Human
ccucucuaaacaaaguaugugau

SEQ ID NO: 43574 - RNA, 22 nt, Human
cguggaaaaagaaagacuuuga

SEQ ID NO: 43575 - RNA, 18 nt, Human
cuccaugcucggacucuc

SEQ ID NO: 43576 - RNA, 23 nt, Human
cuuagaaagaugaaaaugugaaa

SEQ ID NO: 43577 - RNA, 21 nt, Human
gaaaagagacacaccuuagaa

SEQ ID NO: 43578 - RNA, 20 nt, Human
gagacacccacaaacccaac

SEQ ID NO: 43579 - RNA, 25 nt, Human
gagacacccacaaacccaacgcggg

SEQ ID NO: 43580 - RNA, 20 nt, Human
gcuugcaaaaaugacuucuc

SEQ ID NO: 43581 - RNA, 22 nt, Human
ggaaaagagacacaccuuagaa

SEQ ID NO: 43582 - RNA, 23 nt, Human
ggaaucgcuccaugcucggacuc

SEQ ID NO: 43583 - RNA, 19 nt, Human
ggugacucggguuaaaccc

SEQ ID NO: 43584 - RNA, 21 nt, Human
guccacgucuucccuccaccu

SEQ ID NO: 43585 - RNA, 21 nt, Human
gugaaaaacaacagucauaaa

SEQ ID NO: 43586 - RNA, 24 nt, Human
uaaaaaaaaaaaaaaaaccaccaa

SEQ ID NO: 43587 - RNA, 23 nt, Human
uaagaagcacguggaaaaagaaa

SEQ ID NO: 43588 - RNA, 21 nt, Human
ucaccagcuguguugcagcuu

SEQ ID NO: 43589 - RNA, 18 nt, Human
ucagcaaguacuaaaaag

SEQ ID NO: 43590 - RNA, 18 nt, Human
uccaggacccacggugcc

SEQ ID NO: 43591 - RNA, 25 nt, Human
ucuguauguuaaaaaaaaaaaaaaa

SEQ ID NO: 43592 - RNA, 26 nt, Human
ucuguauguuaaaaaaaaaaaaaaaa

SEQ ID NO: 43593 - RNA, 21 nt, Human
ucuucccuccaccuggaaccu

SEQ ID NO: 43594 - RNA, 23 nt, Human
ugagcacgagacacccacaaacc

SEQ ID NO: 43595 - RNA, 24 nt, Human
ugagcacgagacacccacaaaccc

SEQ ID NO: 43596 - RNA, 25 nt, Human
ugcccucggccacagugucuaaucu

SEQ ID NO: 43597 - RNA, 18 nt, Human
ugcgauugaucgacuuug

SEQ ID NO: 43598 - RNA, 21 nt, Human
ugggugacucggguuaaaccc

SEQ ID NO: 43599 - RNA, 18 nt, Human
uuagaaagaugaaaaugu

SEQ ID NO: 43600 - RNA, 19 nt, Human
uuuaggaagaaacaaacaa

SEQ ID NO: 43601 - RNA, 20 nt, Human
uuuccuggcauucagguguu

SEQ ID NO: 43602 - RNA, 24 nt, Human
uuuuuuuuuuuuuuuuuuuuuagg

SEQ ID NO: 43603 - RNA, 19 nt, Human
aaaaaacuugauugaauac

SEQ ID NO: 43604 - RNA, 21 nt, Human
aaaaauguaucucuuuaaaac

SEQ ID NO: 43605 - RNA, 20 nt, Human
aaacaaacucuaaagcagca

SEQ ID NO: 43606 - RNA, 19 nt, Human
aagaccaccaagcaugugc

SEQ ID NO: 43607 - RNA, 24 nt, Human
acaaaugccagagacaguaauaac

SEQ ID NO: 43608 - RNA, 21 nt, Human
agaaaacaacaaaaaaacuug

SEQ ID NO: 43609 - RNA, 22 nt, Human
agaaaacaacaaaaaaacuuga

SEQ ID NO: 43610 - RNA, 23 nt, Human
agaaaacaacaaaaaaacuugau

SEQ ID NO: 43611 - RNA, 23 nt, Human
gaugaggaaacaaaugccagaga

SEQ ID NO: 43612 - RNA, 24 nt, Human
gcaagggaacagaaaacaacaaaa

SEQ ID NO: 43613 - RNA, 21 nt, Human
ggaacagaaaacaacaaaaaa

SEQ ID NO: 43614 - RNA, 18 nt, Human
uaacaagaccaccaagca

SEQ ID NO: 43615 - RNA, 21 nt, Human
uaacuugucaggaguuuccag

SEQ ID NO: 43616 - RNA, 19 nt, Human
uaagacagaaucuuuuuuc

SEQ ID NO: 43617 - RNA, 26 nt, Human
uaauaaauuagaccagauuucuuccc

SEQ ID NO: 43618 - RNA, 18 nt, Human
uacccuauaagacagaau

SEQ ID NO: 43619 - RNA, 22 nt, Human
uccccaugguuacugucugagg

SEQ ID NO: 43620 - RNA, 25 nt, Human
ucuaaaaauguaucucuuuaaaaca

SEQ ID NO: 43621 - RNA, 24 nt, Human
ucucaggaugcgugcgcucggagg

SEQ ID NO: 43622 - RNA, 21 nt, Human
ugaggaaacaaaugccagaga

SEQ ID NO: 43623 - RNA, 18 nt, Human
uggcaagggaacagaaaa

SEQ ID NO: 43624 - RNA, 18 nt, Human
ugucaggaguuuccagaa

SEQ ID NO: 43625 - RNA, 19 nt, Human
ugucaggaguuuccagaau

SEQ ID NO: 43626 - RNA, 22 nt, Human
ugugauggcaagggaacagaaa

SEQ ID NO: 43627 - RNA, 18 nt, Human
ugugcuuaucaaaaagau

SEQ ID NO: 43628 - RNA, 20 nt, Human
ugugcuuaucaaaaagauuu

SEQ ID NO: 43629 - RNA, 23 nt, Human
aaccuugcuucaucuaaacccac

SEQ ID NO: 43630 - RNA, 19 nt, Human
aagaaagaaauacauggca

SEQ ID NO: 43631 - RNA, 21 nt, Human
accccggagucccuugggaca

SEQ ID NO: 43632 - RNA, 18 nt, Human
acuauaaaccacuuccau

SEQ ID NO: 43633 - RNA, 24 nt, Human
agcccauuccuacgguuuuuuauu

SEQ ID NO: 43634 - RNA, 23 nt, Human
aggaacagaagcauucuuaccca

SEQ ID NO: 43635 - RNA, 18 nt, Human
aggcagcaaagcugggca

SEQ ID NO: 43636 - RNA, 19 nt, Human
cacgagucucccauagguu

SEQ ID NO: 43637 - RNA, 24 nt, Human
cacucucauuucagacguucagag

SEQ ID NO: 43638 - RNA, 19 nt, Human
ccuagaacaaggaaaaaaa

SEQ ID NO: 43639 - RNA, 28 nt, Human
ccuagaacaaggaaaaaaaauagucaca

SEQ ID NO: 43640 - RNA, 23 nt, Human
ccugaccccggagucccuuggga

SEQ ID NO: 43641 - RNA, 21 nt, Human
ccugcaaguuguaagagcaag

SEQ ID NO: 43642 - RNA, 19 nt, Human
cuccccagaguggcuucag

SEQ ID NO: 43643 - RNA, 18 nt, Human
cucuguagcaguggugcu

SEQ ID NO: 43644 - RNA, 19 nt, Human
cugcuuggauccaagaggc

SEQ ID NO: 43645 - RNA, 21 nt, Human
cuucaucuaaacccacaacuc

SEQ ID NO: 43646 - RNA, 18 nt, Human
ggagcccguggcagacug

SEQ ID NO: 43647 - RNA, 24 nt, Human
gggcaaauuuucugguggccggac

SEQ ID NO: 43648 - RNA, 21 nt, Human
gguuuuuuauuuuaauccuca

SEQ ID NO: 43649 - RNA, 19 nt, Human
uaaaagacuugagaugucc

SEQ ID NO: 43650 - RNA, 24 nt, Human
uaaacccacaacucucuuucucug

SEQ ID NO: 43651 - RNA, 22 nt, Human
uauggucaggaauccuugaaac

SEQ ID NO: 43652 - RNA, 20 nt, Human
ucacuuccauuuucccagcc

SEQ ID NO: 43653 - RNA, 23 nt, Human
ucagagcagucaugcacagucgg

SEQ ID NO: 43654 - RNA, 19 nt, Human
ucaguuggggagcccgugg

SEQ ID NO: 43655 - RNA, 19 nt, Human
ucaucuaaacccacaacuc

SEQ ID NO: 43656 - RNA, 19 nt, Human
uccaaauaaccacaugucc

SEQ ID NO: 43657 - RNA, 23 nt, Human
uccaaauaaccacaugucccugc

SEQ ID NO: 43658 - RNA, 22 nt, Human
uccccagaguggcuucaguugg

SEQ ID NO: 43659 - RNA, 21 nt, Human
ucugcauuuaacucugggucu

SEQ ID NO: 43660 - RNA, 20 nt, Human
ucuuucucugucacuuaugg

SEQ ID NO: 43661 - RNA, 18 nt, Human
ugaccuauuuuuuucugu

SEQ ID NO: 43662 - RNA, 20 nt, Human
ugagauguccugucaagaaa

SEQ ID NO: 43663 - RNA, 22 nt, Human
uggccggacccuccccagagug

SEQ ID NO: 43664 - RNA, 26 nt, Human
ugucaagaaagaaauacauggcacuc

SEQ ID NO: 43665 - RNA, 21 nt, Human
ugugaucagguaacuccgacc

SEQ ID NO: 43666 - RNA, 20 nt, Human
uuaaaagacuugagaugucc

SEQ ID NO: 43667 - RNA, 21 nt, Human
uuccauugcauucaaggccug

SEQ ID NO: 43668 - RNA, 21 nt, Human
aaaacacccuugggacuuuuu

SEQ ID NO: 43669 - RNA, 23 nt, Human
aaauagcagaggcugagaaggcu

SEQ ID NO: 43670 - RNA, 22 nt, Human
agaaaacaguaacaaaacaccc

SEQ ID NO: 43671 - RNA, 24 nt, Human
agagagguggaagagaagaucaaa

SEQ ID NO: 43672 - RNA, 21 nt, Human
aggaacagaccaugucaaaca

SEQ ID NO: 43673 - RNA, 23 nt, Human
aggcaagagagauaguugugauu

SEQ ID NO: 43674 - RNA, 18 nt, Human
caacauguaacuaggaac

SEQ ID NO: 43675 - RNA, 21 nt, Human
caauacacaauaacaugauca

SEQ ID NO: 43676 - RNA, 26 nt, Human
caaugaguucuucccugucucuguuu

SEQ ID NO: 43677 - RNA, 24 nt, Human
cagaggcugagaaggcuguugugg

SEQ ID NO: 43678 - RNA, 18 nt, Human
cauuaauaaaaucugagg

SEQ ID NO: 43679 - RNA, 18 nt, Human
cucacuucuaccuuccuc

SEQ ID NO: 43680 - RNA, 23 nt, Human
cugagcaaaguggcugaguuuac

SEQ ID NO: 43681 - RNA, 22 nt, Human
gaaauagcagaggcugagaagg

SEQ ID NO: 43682 - RNA, 24 nt, Human
gagagguggaagagaagaucaaag

SEQ ID NO: 43683 - RNA, 23 nt, Human
gaguaaaaaggaugggaucucca

SEQ ID NO: 43684 - RNA, 18 nt, Human
ggagaaaacaguaacaaa

SEQ ID NO: 43685 - RNA, 20 nt, Human
ggaguuuggagaccgaaaug

SEQ ID NO: 43686 - RNA, 27 nt, Human
uaacuaggaacagaccaugucaaacac

SEQ ID NO: 43687 - RNA, 20 nt, Human
uccacggcaauacacaauaa

SEQ ID NO: 43688 - RNA, 26 nt, Human
ucugcaaacauggaaacucacuucua

SEQ ID NO: 43689 - RNA, 24 nt, Human
ugacauguagagaaacuaaauucc

SEQ ID NO: 43690 - RNA, 19 nt, Human
ugagaaggcuguuguggaa

SEQ ID NO: 43691 - RNA, 19 nt, Human
ugcauuaaaaagccaacag

SEQ ID NO: 43692 - RNA, 22 nt, Human
ugccugagggaguuaagaagau

SEQ ID NO: 43693 - RNA, 18 nt, Human
uggaagagaagaucaaag

SEQ ID NO: 43694 - RNA, 25 nt, Human
uuaaaaagccaacagggaguuugga

SEQ ID NO: 43695 - RNA, 18 nt, Human
uucacagaaccacaauuu

SEQ ID NO: 43696 - RNA, 24 nt, Human
uucacagaaccacaauuuuaccau

SEQ ID NO: 43697 - RNA, 19 nt, Human
uuccuuggguuuaccuaua

SEQ ID NO: 43698 - RNA, 19 nt, Human
aaaaagacaguccacaucg

SEQ ID NO: 43699 - RNA, 24 nt, Human
aaacaaaaugcacuggaccccgag

SEQ ID NO: 43700 - RNA, 25 nt, Human
aaacaaaaugcacuggaccccgaga

SEQ ID NO: 43701 - RNA, 24 nt, Human
aagaacucagaaaagugaaggcug

SEQ ID NO: 43702 - RNA, 23 nt, Human
aagccaccgccgcuuuccaaagc

SEQ ID NO: 43703 - RNA, 23 nt, Human
aagguccaggagaccccgggucc

SEQ ID NO: 43704 - RNA, 25 nt, Human
acagcccgccgguaucugggcuccg

SEQ ID NO: 43705 - RNA, 20 nt, Human
acagggcccucagcucugcc

SEQ ID NO: 43706 - RNA, 21 nt, Human
accaggacugcgcaggcccuu

SEQ ID NO: 43707 - RNA, 23 nt, Human
accccgagaagcagagggggagc

SEQ ID NO: 43708 - RNA, 21 nt, Human
acggagcggggaggaggaagg

SEQ ID NO: 43709 - RNA, 24 nt, Human
acgugaggcuuucaggggcuccgu

SEQ ID NO: 43710 - RNA, 25 nt, Human
agaaaaaaaugaaaaagacagucca

SEQ ID NO: 43711 - RNA, 21 nt, Human
agaccccgggucccugcccag

SEQ ID NO: 43712 - RNA, 20 nt, Human
agagacggagcggggaggag

SEQ ID NO: 43713 - RNA, 21 nt, Human
agagagaaaaaaaugaaaaag

SEQ ID NO: 43714 - RNA, 22 nt, Human
agagagaaaaaaaugaaaaaga

SEQ ID NO: 43715 - RNA, 25 nt, Human
agcaagagcugggcucuggggaugu

SEQ ID NO: 43716 - RNA, 18 nt, Human
agccaccacaggcccccg

SEQ ID NO: 43717 - RNA, 18 nt, Human
agcggggaggaggaaggu

SEQ ID NO: 43718 - RNA, 21 nt, Human
aggaaggugcgggagggcagg

SEQ ID NO: 43719 - RNA, 21 nt, Human
aggcagagggccugacacaca

SEQ ID NO: 43720 - RNA, 19 nt, Human
aggcccuuuccucccaccu

SEQ ID NO: 43721 - RNA, 22 nt, Human
agggagugcaggcagagggccu

SEQ ID NO: 43722 - RNA, 22 nt, Human
agggcacccagaugugugaaag

SEQ ID NO: 43723 - RNA, 21 nt, Human
aggggcuccagagagaaaaaa

SEQ ID NO: 43724 - RNA, 22 nt, Human
agugcaccccaccccgggcagc

SEQ ID NO: 43725 - RNA, 21 nt, Human
aucacguuaacaaaaggaagg

SEQ ID NO: 43726 - RNA, 20 nt, Human
aucagccguucccaccuggc

SEQ ID NO: 43727 - RNA, 18 nt, Human
auggaaaggacaugcccc

SEQ ID NO: 43728 - RNA, 19 nt, Human
auggcccgugcaugcccuu

SEQ ID NO: 43729 - RNA, 22 nt, Human
caaagccaacccgggccaacgg

SEQ ID NO: 43730 - RNA, 20 nt, Human
caaagccaccgccgcuuucc

SEQ ID NO: 43731 - RNA, 18 nt, Human
caccccgggcagcagcag

SEQ ID NO: 43732 - RNA, 18 nt, Human
caccugcccacugcucuc

SEQ ID NO: 43733 - RNA, 22 nt, Human
cacugccucccuuguccccugc

SEQ ID NO: 43734 - RNA, 21 nt, Human
cagagacggagcggggaggag

SEQ ID NO: 43735 - RNA, 18 nt, Human
cagauuuggauucaaaaa

SEQ ID NO: 43736 - RNA, 22 nt, Human
cagcacacgacgggcaaggcca

SEQ ID NO: 43737 - RNA, 25 nt, Human
cagcagcagagggcagagugaccag

SEQ ID NO: 43738 - RNA, 21 nt, Human
cagcccgccgguaucugggcu

SEQ ID NO: 43739 - RNA, 19 nt, Human
cagccgggggaggaggggc

SEQ ID NO: 43740 - RNA, 22 nt, Human
cagccgugugcauggcccgugc

SEQ ID NO: 43741 - RNA, 23 nt, Human
caggaccaggacugcgcaggcug

SEQ ID NO: 43742 - RNA, 19 nt, Human
caggcccgcccccgccccg

SEQ ID NO: 43743 - RNA, 22 nt, Human
cagggcacccagaugugugaaa

SEQ ID NO: 43744 - RNA, 23 nt, Human
cagggcacccagaugugugaaag

SEQ ID NO: 43745 - RNA, 24 nt, Human
cagggcacccagaugugugaaagg

SEQ ID NO: 43746 - RNA, 19 nt, Human
cagggcccucagcucugcc

SEQ ID NO: 43747 - RNA, 18 nt, Human
cagugcacgucacaagag

SEQ ID NO: 43748 - RNA, 21 nt, Human
caucacguuaacaaaaggaag

SEQ ID NO: 43749 - RNA, 20 nt, Human
ccaacccgggccaacggcga

SEQ ID NO: 43750 - RNA, 27 nt, Human
ccaggagaccccgggucccugcccaga

SEQ ID NO: 43751 - RNA, 24 nt, Human
ccaggggccccuggcguucccgag

SEQ ID NO: 43752 - RNA, 21 nt, Human
ccaguaccucauggagacagg

SEQ ID NO: 43753 - RNA, 22 nt, Human
ccccacuagccacugccucccu

SEQ ID NO: 43754 - RNA, 24 nt, Human
ccccacuagccacugccucccuug

SEQ ID NO: 43755 - RNA, 19 nt, Human
ccccgccgccgccugcgcc

SEQ ID NO: 43756 - RNA, 24 nt, Human
ccccgccgccgccugcgccuuaac

SEQ ID NO: 43757 - RNA, 19 nt, Human
ccccgggucccugcccaga

SEQ ID NO: 43758 - RNA, 24 nt, Human
cccgaaauggcgguucuugaaaca

SEQ ID NO: 43759 - RNA, 22 nt, Human
cccgccaggcccgcccccgccc

SEQ ID NO: 43760 - RNA, 24 nt, Human
cccgcccccgccccgccgccgccu

SEQ ID NO: 43761 - RNA, 21 nt, Human
cccgugcaugcccuucccgaa

SEQ ID NO: 43762 - RNA, 25 nt, Human
ccgcacccaggggccccuggcguuc

SEQ ID NO: 43763 - RNA, 22 nt, Human
ccgcccccgccccgccgccgcc

SEQ ID NO: 43764 - RNA, 18 nt, Human
ccgccccgcaggccgccc

SEQ ID NO: 43765 - RNA, 19 nt, Human
ccgccccgccgccgccugc

SEQ ID NO: 43766 - RNA, 19 nt, Human
ccgccgcccgccgcccgcg

SEQ ID NO: 43767 - RNA, 25 nt, Human
ccgccgcccgccgcccgcgcccgcc

SEQ ID NO: 43768 - RNA, 21 nt, Human
ccgccgccugcgccuuaaccc

SEQ ID NO: 43769 - RNA, 21 nt, Human
ccggcgugaagccucaggggc

SEQ ID NO: 43770 - RNA, 19 nt, Human
ccgggcccggcucaggccc

SEQ ID NO: 43771 - RNA, 20 nt, Human
ccgugcaugcccuucccgaa

SEQ ID NO: 43772 - RNA, 22 nt, Human
ccgugugcauggcccgugcaug

SEQ ID NO: 43773 - RNA, 21 nt, Human
ccucaccgccgcccgccgccc

SEQ ID NO: 43774 - RNA, 22 nt, Human
ccucaggggcggccaccugccc

SEQ ID NO: 43775 - RNA, 18 nt, Human
ccucccugaugaccccca

SEQ ID NO: 43776 - RNA, 20 nt, Human
ccugacaccugaccccugac

SEQ ID NO: 43777 - RNA, 21 nt, Human
ccugacaccugaccccugacc

SEQ ID NO: 43778 - RNA, 24 nt, Human
ccugcgccuuaacccccuccuggc

SEQ ID NO: 43779 - RNA, 19 nt, Human
cgagcccggcccaaagcca

SEQ ID NO: 43780 - RNA, 25 nt, Human
cgaggccgagcccggcccaaagcca

SEQ ID NO: 43781 - RNA, 21 nt, Human
cgaggcgguaugaaggggcgg

SEQ ID NO: 43782 - RNA, 20 nt, Human
cgaggugcccaguggcagcu

SEQ ID NO: 43783 - RNA, 21 nt, Human
cgccaggcccgcccccgcccc

SEQ ID NO: 43784 - RNA, 23 nt, Human
cgcccaguucaagagugcagcca

SEQ ID NO: 43785 - RNA, 18 nt, Human
cgcccgcgcccgcccagg

SEQ ID NO: 43786 - RNA, 18 nt, Human
cgcccgcgcccgcccagg

SEQ ID NO: 43787 - RNA, 20 nt, Human
cggcccccgggcgccgcccc

SEQ ID NO: 43788 - RNA, 20 nt, Human
cggcucggcccggcccccgg

SEQ ID NO: 43789 - RNA, 22 nt, Human
cgggcagcagcagagggcagag

SEQ ID NO: 43790 - RNA, 21 nt, Human
cgggccggagccccucucccg

SEQ ID NO: 43791 - RNA, 20 nt, Human
cggggaggaggaaggugcgg

SEQ ID NO: 43792 - RNA, 21 nt, Human
cgugugcauggcccgugcaug

SEQ ID NO: 43793 - RNA, 24 nt, Human
cucacuagucccuucucagccacu

SEQ ID NO: 43794 - RNA, 18 nt, Human
cucauggagacaggcagu

SEQ ID NO: 43795 - RNA, 19 nt, Human
cucccugaugacccccaca

SEQ ID NO: 43796 - RNA, 23 nt, Human
cuccggcgugaagccucaggggc

SEQ ID NO: 43797 - RNA, 21 nt, Human
cuccugggccaaggugcugac

SEQ ID NO: 43798 - RNA, 18 nt, Human
cucggcccggcccccggg

SEQ ID NO: 43799 - RNA, 20 nt, Human
cugccugggcccagucuggg

SEQ ID NO: 43800 - RNA, 20 nt, Human
cuuaacccccuccuggccgc

SEQ ID NO: 43801 - RNA, 24 nt, Human
gaaaaauaaaguacaaguuuaggu

SEQ ID NO: 43802 - RNA, 20 nt, Human
gaaaagagcgucuauaaaag

SEQ ID NO: 43803 - RNA, 21 nt, Human
gaaacaaaaugcacuggaccc

SEQ ID NO: 43804 - RNA, 22 nt, Human
gaaacaaaaugcacuggacccc

SEQ ID NO: 43805 - RNA, 20 nt, Human
gaaaugcuucaagaacucag

SEQ ID NO: 43806 - RNA, 18 nt, Human
gaaggugcgggagggcag

SEQ ID NO: 43807 - RNA, 18 nt, Human
gacagugaccugccaccc

SEQ ID NO: 43808 - RNA, 24 nt, Human
gaccaggacugcgcaggcccuuuc

SEQ ID NO: 43809 - RNA, 21 nt, Human
gagacaggcagucgggggacc

SEQ ID NO: 43810 - RNA, 26 nt, Human
gagcaagagcugggcucuggggaugu

SEQ ID NO: 43811 - RNA, 22 nt, Human
gagcccggcccaaagccaccgc

SEQ ID NO: 43812 - RNA, 18 nt, Human
gagcggggaggaggaagg

SEQ ID NO: 43813 - RNA, 19 nt, Human
gaggagugggggaggggaa

SEQ ID NO: 43814 - RNA, 22 nt, Human
gaggccgagcccggcccaaagc

SEQ ID NO: 43815 - RNA, 25 nt, Human
gaggggcuccagagagaaaaaaaug

SEQ ID NO: 43816 - RNA, 19 nt, Human
gaggugcccaguggcagcu

SEQ ID NO: 43817 - RNA, 21 nt, Human
gagugcagccaggaccaggac

SEQ ID NO: 43818 - RNA, 23 nt, Human
gagugggggaggggaagggcccu

SEQ ID NO: 43819 - RNA, 19 nt, Human
gauggaaaggacaugcccc

SEQ ID NO: 43820 - RNA, 19 nt, Human
gcagcagagggcagaguga

SEQ ID NO: 43821 - RNA, 22 nt, Human
gcccaguucaagagugcagcca

SEQ ID NO: 43822 - RNA, 18 nt, Human
gcccgcaugugcugcagg

SEQ ID NO: 43823 - RNA, 24 nt, Human
gccgcgcccguccgcacccagggg

SEQ ID NO: 43824 - RNA, 20 nt, Human
gccgugugcauggcccgugc

SEQ ID NO: 43825 - RNA, 20 nt, Human
gccuggcgcagagcuccugg

SEQ ID NO: 43826 - RNA, 19 nt, Human
gcgcccgccaggcccgccc

SEQ ID NO: 43827 - RNA, 19 nt, Human
gcuccguuugugguuuucc

SEQ ID NO: 43828 - RNA, 22 nt, Human
ggaggaggaaggugcgggaggg

SEQ ID NO: 43829 - RNA, 19 nt, Human
ggcggccaccugcccacug

SEQ ID NO: 43830 - RNA, 22 nt, Human
gggaggggaagggcccuucagg

SEQ ID NO: 43831 - RNA, 20 nt, Human
gggauguggacagauggaaa

SEQ ID NO: 43832 - RNA, 18 nt, Human
gggcaaggccagggagug

SEQ ID NO: 43833 - RNA, 18 nt, Human
gggcagcagcagagggca

SEQ ID NO: 43834 - RNA, 23 nt, Human
ggggaggggaagggcccuucagg

SEQ ID NO: 43835 - RNA, 18 nt, Human
ggggauguggacagaugg

SEQ ID NO: 43836 - RNA, 21 nt, Human
ggggcuauuuggcaccagcug

SEQ ID NO: 43837 - RNA, 19 nt, Human
gggggaccugggugggggc

SEQ ID NO: 43838 - RNA, 20 nt, Human
uaaaaaauacuacagaggac

SEQ ID NO: 43839 - RNA, 18 nt, Human
uaacaaaaggaagggacc

SEQ ID NO: 43840 - RNA, 19 nt, Human
uacacagaggcagggcuuu

SEQ ID NO: 43841 - RNA, 20 nt, Human
uacacagaggcagggcuuug

SEQ ID NO: 43842 - RNA, 18 nt, Human
uagccacugccucccuug

SEQ ID NO: 43843 - RNA, 20 nt, Human
uaguagagcuggacuccaca

SEQ ID NO: 43844 - RNA, 25 nt, Human
uauacagaaacaaaaugcacuggac

SEQ ID NO: 43845 - RNA, 26 nt, Human
uauacagaaacaaaaugcacuggacc

SEQ ID NO: 43846 - RNA, 21 nt, Human
ucaaaaaaaaccacagagaau

SEQ ID NO: 43847 - RNA, 28 nt, Human
ucagcacacgacgggcaaggccagggag

SEQ ID NO: 43848 - RNA, 23 nt, Human
uccacagggcccucagcucugcc

SEQ ID NO: 43849 - RNA, 27 nt, Human
uccacaucagccguucccaccuggccu

SEQ ID NO: 43850 - RNA, 22 nt, Human
uccagagagaaaaaaaugaaaa

SEQ ID NO: 43851 - RNA, 19 nt, Human
ucccaccugcccaggaccc

SEQ ID NO: 43852 - RNA, 21 nt, Human
ucccgaggccgagcccggccc

SEQ ID NO: 43853 - RNA, 23 nt, Human
ucccugaugacccccacagaaca

SEQ ID NO: 43854 - RNA, 25 nt, Human
ucccugcccagagucacagcccgcc

SEQ ID NO: 43855 - RNA, 23 nt, Human
uccgcacccaggggccccuggcg

SEQ ID NO: 43856 - RNA, 20 nt, Human
ucggcagugacagugaccug

SEQ ID NO: 43857 - RNA, 21 nt, Human
ucgggggaccugggugggggc

SEQ ID NO: 43858 - RNA, 18 nt, Human
ugaaaaagacaguccaca

SEQ ID NO: 43859 - RNA, 18 nt, Human
ugaaaaagacaguccaca

SEQ ID NO: 43860 - RNA, 22 nt, Human
ugacucacuagucccuucucag

SEQ ID NO: 43861 - RNA, 20 nt, Human
ugcacuggaccccgagaagc

SEQ ID NO: 43862 - RNA, 21 nt, Human
ugcagccaggaccaggacugc

SEQ ID NO: 43863 - RNA, 19 nt, Human
ugcauggcccgugcaugcc

SEQ ID NO: 43864 - RNA, 19 nt, Human
ugccucgauccuuuucagc

SEQ ID NO: 43865 - RNA, 21 nt, Human
ugcgccaagcgaacgaucggg

SEQ ID NO: 43866 - RNA, 18 nt, Human
ugcucugucuucaaggcc

SEQ ID NO: 43867 - RNA, 20 nt, Human
uggagaaguggaagaaggag

SEQ ID NO: 43868 - RNA, 19 nt, Human
uggcaccagcuguucaccc

SEQ ID NO: 43869 - RNA, 22 nt, Human
uggcagcucuauucucucucag

SEQ ID NO: 43870 - RNA, 22 nt, Human
uggccgcgcccguccgcaccca

SEQ ID NO: 43871 - RNA, 19 nt, Human
uggcgagugcaccccaccc

SEQ ID NO: 43872 - RNA, 22 nt, Human
uggcuuuagcacccuguuuucc

SEQ ID NO: 43873 - RNA, 20 nt, Human
ugggcuccggccuggggcag

SEQ ID NO: 43874 - RNA, 18 nt, Human
ugggcucuggggaugugg

SEQ ID NO: 43875 - RNA, 24 nt, Human
ugggggaggggaagggcccuucag

SEQ ID NO: 43876 - RNA, 22 nt, Human
uuccaaaggaaagggccuugua

SEQ ID NO: 43877 - RNA, 22 nt, Human
uuggagaaguggaagaaggagg

SEQ ID NO: 43878 - RNA, 19 nt, Human
aaaacaagaacacaggaaa

SEQ ID NO: 43879 - RNA, 22 nt, Human
aagaacacaggaaaacaagucc

SEQ ID NO: 43880 - RNA, 20 nt, Human
acucccgcgcccccgccgac

SEQ ID NO: 43881 - RNA, 23 nt, Human
caagaacacaggaaaacaagucc

SEQ ID NO: 43882 - RNA, 18 nt, Human
caaguccuuuucccucuc

SEQ ID NO: 43883 - RNA, 22 nt, Human
cagccgccgcgcugccuccagg

SEQ ID NO: 43884 - RNA, 22 nt, Human
ccaggcccuggcccugagcggc

SEQ ID NO: 43885 - RNA, 20 nt, Human
cccagcccaggcccuggccc

SEQ ID NO: 43886 - RNA, 25 nt, Human
cccagcccaggcccuggcccugagc

SEQ ID NO: 43887 - RNA, 19 nt, Human
ccgcgcccccgccgacccc

SEQ ID NO: 43888 - RNA, 20 nt, Human
ccgcgcccccgccgaccccu

SEQ ID NO: 43889 - RNA, 21 nt, Human
ccgcgcccccgccgaccccug

SEQ ID NO: 43890 - RNA, 24 nt, Human
ccucacggcagccgccgcgcugcc

SEQ ID NO: 43891 - RNA, 25 nt, Human
ccucacggcagccgccgcgcugccu

SEQ ID NO: 43892 - RNA, 22 nt, Human
ccuccaggcgacucacagauuc

SEQ ID NO: 43893 - RNA, 18 nt, Human
ccucccagcccaggcccu

SEQ ID NO: 43894 - RNA, 21 nt, Human
ccugagcggcugggccaccgg

SEQ ID NO: 43895 - RNA, 19 nt, Human
cggcagccgccgcgcugcc

SEQ ID NO: 43896 - RNA, 21 nt, Human
cucagaaaugugugcauuuuc

SEQ ID NO: 43897 - RNA, 22 nt, Human
cucccagcccaggcccuggccc

SEQ ID NO: 43898 - RNA, 19 nt, Human
cuccgcacccggccuccuc

SEQ ID NO: 43899 - RNA, 18 nt, Human
cuccuggcgcugcuccgg

SEQ ID NO: 43900 - RNA, 20 nt, Human
cucgcguacucccgcgcccc

SEQ ID NO: 43901 - RNA, 26 nt, Human
cucggcuccggccucgggcuccuggc

SEQ ID NO: 43902 - RNA, 23 nt, Human
cuggcgcugcuccggucucuccc

SEQ ID NO: 43903 - RNA, 19 nt, Human
gaaaacaagaacacaggaa

SEQ ID NO: 43904 - RNA, 21 nt, Human
gcccaggcccuggcccugagc

SEQ ID NO: 43905 - RNA, 19 nt, Human
gcccugagcggcugggccc

SEQ ID NO: 43906 - RNA, 21 nt, Human
gccgcgcugccuccaggcgac

SEQ ID NO: 43907 - RNA, 18 nt, Human
gccucgggcuccuggcgc

SEQ ID NO: 43908 - RNA, 19 nt, Human
gccucgggcuccuggcgcu

SEQ ID NO: 43909 - RNA, 24 nt, Human
gcgcccccgccgaccccuggucac

SEQ ID NO: 43910 - RNA, 19 nt, Human
guccuuuucccucuccccu

SEQ ID NO: 43911 - RNA, 18 nt, Human
ucacggcagccgccgcgc

SEQ ID NO: 43912 - RNA, 24 nt, Human
ucacggcagccgccgcgcugccuc

SEQ ID NO: 43913 - RNA, 18 nt, Human
uccucggcuccggccucg

SEQ ID NO: 43914 - RNA, 21 nt, Human
ugcuccggucucucccuccca

SEQ ID NO: 43915 - RNA, 22 nt, Human
agggauccagcgcuggacguag

SEQ ID NO: 43916 - RNA, 23 nt, Human
agggguucuccugggggcuggua

SEQ ID NO: 43917 - RNA, 18 nt, Human
aggucccauuguagcuaa

SEQ ID NO: 43918 - RNA, 26 nt, Human
caccagguccucauuuucaauguucu

SEQ ID NO: 43919 - RNA, 20 nt, Human
cagcgcuggacguaguuggg

SEQ ID NO: 43920 - RNA, 20 nt, Human
caggugauggccugcucccc

SEQ ID NO: 43921 - RNA, 18 nt, Human
ccagggguuggugauguu

SEQ ID NO: 43922 - RNA, 21 nt, Human
cccaccgucacccaggccacc

SEQ ID NO: 43923 - RNA, 23 nt, Human
cccaccgucacccaggccaccag

SEQ ID NO: 43924 - RNA, 22 nt, Human
cccaggugauggccugcuccuc

SEQ ID NO: 43925 - RNA, 19 nt, Human
ccguugucccgaggccaca

SEQ ID NO: 43926 - RNA, 19 nt, Human
ccuccugccagccuggggg

SEQ ID NO: 43927 - RNA, 18 nt, Human
ccugggaggaacuggggg

SEQ ID NO: 43928 - RNA, 23 nt, Human
ccugggggcugguaaagagcagg

SEQ ID NO: 43929 - RNA, 23 nt, Human
cgaucacagugucucuggaugcc

SEQ ID NO: 43930 - RNA, 24 nt, Human
cuccacggcucugugugcucugcu

SEQ ID NO: 43931 - RNA, 22 nt, Human
cucugcucccaguucgcucugc

SEQ ID NO: 43932 - RNA, 19 nt, Human
cucugcuuccagccuuugc

SEQ ID NO: 43933 - RNA, 18 nt, Human
cugcacagcuccgacucc

SEQ ID NO: 43934 - RNA, 18 nt, Human
cugcuccuccugccagcc

SEQ ID NO: 43935 - RNA, 23 nt, Human
cuggugguagaugcugcugcugc

SEQ ID NO: 43936 - RNA, 22 nt, Human
cuuguggccccagggguucucc

SEQ ID NO: 43937 - RNA, 21 nt, Human
gaagcccacggaguucccagg

SEQ ID NO: 43938 - RNA, 19 nt, Human
gagugggggaugugcagga

SEQ ID NO: 43939 - RNA, 25 nt, Human
gcagcaccuggucggccauggagug

SEQ ID NO: 43940 - RNA, 18 nt, Human
gcgcuuguggccccaggg

SEQ ID NO: 43941 - RNA, 21 nt, Human
gcggugucuugggcuccaggg

SEQ ID NO: 43942 - RNA, 20 nt, Human
gcucccaguucgcucugcuu

SEQ ID NO: 43943 - RNA, 19 nt, Human
gggcgggugccaggggucg

SEQ ID NO: 43944 - RNA, 25 nt, Human
guagaugcugcugcugcacagcucc

SEQ ID NO: 43945 - RNA, 23 nt, Human
uaaaagggggaggcaucgagcag

SEQ ID NO: 43946 - RNA, 19 nt, Human
uacgugcgcuuguggcccc

SEQ ID NO: 43947 - RNA, 18 nt, Human
ucguucuggugguagaug

SEQ ID NO: 43948 - RNA, 23 nt, Human
ucucuggaugccagggagggguc

SEQ ID NO: 43949 - RNA, 18 nt, Human
ucugaggguuuauugucu

SEQ ID NO: 43950 - RNA, 21 nt, Human
ugccacauccaggucuacgcg

SEQ ID NO: 43951 - RNA, 19 nt, Human
ugccaggggguaccuugcc

SEQ ID NO: 43952 - RNA, 22 nt, Human
ugcugcacagcuccgacucccg

SEQ ID NO: 43953 - RNA, 23 nt, Human
uggccggagcaggaagcccacgg

SEQ ID NO: 43954 - RNA, 20 nt, Human
uggcuggaccacgcgguguc

SEQ ID NO: 43955 - RNA, 22 nt, Human
uggcuggaccacgcggugucuu

SEQ ID NO: 43956 - RNA, 25 nt, Human
uggcuggaccacgcggugucuuggg

SEQ ID NO: 43957 - RNA, 19 nt, Human
uggcuguguugggaauguc

SEQ ID NO: 43958 - RNA, 21 nt, Human
ugggggaggaacugggggcug

SEQ ID NO: 43959 - RNA, 21 nt, Human
ugggggaggaacugggggcug

SEQ ID NO: 43960 - RNA, 22 nt, Human
ugggggaggaacugggggcugg

SEQ ID NO: 43961 - RNA, 18 nt, Human
ugucccgaggccacacga

SEQ ID NO: 43962 - RNA, 18 nt, Human
uucccagguguggcugug

SEQ ID NO: 43963 - RNA, 19 nt, Human
uuggugccugccacaucca

SEQ ID NO: 43964 - RNA, 19 nt, Human
aaacaauucccgaacagca

SEQ ID NO: 43965 - RNA, 25 nt, Human
aaacagaacauagacaaaagggacc

SEQ ID NO: 43966 - RNA, 26 nt, Human
aaacagaacauagacaaaagggaccc

SEQ ID NO: 43967 - RNA, 22 nt, Human
aaacggcagcaucaaacagacc

SEQ ID NO: 43968 - RNA, 18 nt, Human
aaaggagggagggcgggc

SEQ ID NO: 43969 - RNA, 21 nt, Human
aacaggcucaaaaagggccuc

SEQ ID NO: 43970 - RNA, 25 nt, Human
aaccccagaaguggagauucccaaa

SEQ ID NO: 43971 - RNA, 22 nt, Human
aacgacgcucugccacacagaa

SEQ ID NO: 43972 - RNA, 18 nt, Human
aagaacaggcagaccugg

SEQ ID NO: 43973 - RNA, 19 nt, Human
aagaacaggcagaccuggc

SEQ ID NO: 43974 - RNA, 20 nt, Human
aagagcugagcugccucccc

SEQ ID NO: 43975 - RNA, 19 nt, Human
aaggagggagggcgggcgg

SEQ ID NO: 43976 - RNA, 21 nt, Human
aaggcgauggagcgaagacca

SEQ ID NO: 43977 - RNA, 19 nt, Human
aaguguacauaaaacaauu

SEQ ID NO: 43978 - RNA, 18 nt, Human
acagaacauagacaaaaa

SEQ ID NO: 43979 - RNA, 18 nt, Human
acagaccacugcugccgc

SEQ ID NO: 43980 - RNA, 23 nt, Human
acagaccacugcugccgcgacaa

SEQ ID NO: 43981 - RNA, 19 nt, Human
acagcacggagcaucagac

SEQ ID NO: 43982 - RNA, 19 nt, Human
acagcagggaagggaacug

SEQ ID NO: 43983 - RNA, 20 nt, Human
acagcagggaagggaacuga

SEQ ID NO: 43984 - RNA, 22 nt, Human
acaggaguaaacaggcucaaaa

SEQ ID NO: 43985 - RNA, 20 nt, Human
acccagggccucuucagagc

SEQ ID NO: 43986 - RNA, 24 nt, Human
accccagaaguggagauucccaaa

SEQ ID NO: 43987 - RNA, 21 nt, Human
accuuaggaagggccaggcac

SEQ ID NO: 43988 - RNA, 20 nt, Human
acggugggaacacaccucac

SEQ ID NO: 43989 - RNA, 23 nt, Human
acucacucugccccuuccugucc

SEQ ID NO: 43990 - RNA, 19 nt, Human
agagguauggagggcagga

SEQ ID NO: 43991 - RNA, 20 nt, Human
agagguauggagggcaggag

SEQ ID NO: 43992 - RNA, 21 nt, Human
agccaucagccauugcccagc

SEQ ID NO: 43993 - RNA, 21 nt, Human
aggaagaggcggguggaggaa

SEQ ID NO: 43994 - RNA, 25 nt, Human
aggaggccccagcagaacccagccc

SEQ ID NO: 43995 - RNA, 22 nt, Human
aggagggagggcgggcgggagc

SEQ ID NO: 43996 - RNA, 21 nt, Human
aggaguaaacaggcucaaaaa

SEQ ID NO: 43997 - RNA, 33 nt, Human
aggcaggaggccgaacagguaaaccccagaagg

SEQ ID NO: 43998 - RNA, 22 nt, Human
aggcgauggagcgaagaccaag

SEQ ID NO: 43999 - RNA, 19 nt, Human
aggcggaaagaaagugcug

SEQ ID NO: 44000 - RNA, 21 nt, Human
aggcuggggcugggcagccgg

SEQ ID NO: 44001 - RNA, 18 nt, Human
agggagggcgggcgggag

SEQ ID NO: 44002 - RNA, 23 nt, Human
agguauggagggcaggagguggg

SEQ ID NO: 44003 - RNA, 21 nt, Human
auagaacagcagggaagggaa

SEQ ID NO: 44004 - RNA, 20 nt, Human
aucagucacccuccaggaag

SEQ ID NO: 44005 - RNA, 19 nt, Human
caaagcaggugugcuccca

SEQ ID NO: 44006 - RNA, 24 nt, Human
caaagcaggugugcucccaaaggc

SEQ ID NO: 44007 - RNA, 23 nt, Human
caacccagggccucuucagagcu

SEQ ID NO: 44008 - RNA, 18 nt, Human
caagguggcacaaaagac

SEQ ID NO: 44009 - RNA, 19 nt, Human
cacaugcaugcaggcaggc

SEQ ID NO: 44010 - RNA, 19 nt, Human
caccaacaaggaggcccca

SEQ ID NO: 44011 - RNA, 23 nt, Human
caccgccuuucccagggagcaag

SEQ ID NO: 44012 - RNA, 21 nt, Human
caccucacuccuuccuaguac

SEQ ID NO: 44013 - RNA, 24 nt, Human
cacucaaaggaaauagaacagcag

SEQ ID NO: 44014 - RNA, 18 nt, Human
cagcaagaacaggcagac

SEQ ID NO: 44015 - RNA, 19 nt, Human
cagcaucaaacagaccacu

SEQ ID NO: 44016 - RNA, 20 nt, Human
cagcgcaaaauaaaaggccu

SEQ ID NO: 44017 - RNA, 21 nt, Human
cagcgcaaaauaaaaggccuu

SEQ ID NO: 44018 - RNA, 23 nt, Human
caggaguaaacaggcucaaaaag

SEQ ID NO: 44019 - RNA, 20 nt, Human
caggcagaccuggcguuucu

SEQ ID NO: 44020 - RNA, 18 nt, Human
ccacaggaguaaacaggc

SEQ ID NO: 44021 - RNA, 22 nt, Human
ccaccacccgcccgcagccacc

SEQ ID NO: 44022 - RNA, 19 nt, Human
ccaggagaccgccaucugg

SEQ ID NO: 44023 - RNA, 20 nt, Human
cccaaaaggcuguauccaga

SEQ ID NO: 44024 - RNA, 19 nt, Human
cccaaaggcggagucugag

SEQ ID NO: 44025 - RNA, 18 nt, Human
cccacaacuugcuccuaa

SEQ ID NO: 44026 - RNA, 19 nt, Human
cccagcaagaacaggcaga

SEQ ID NO: 44027 - RNA, 23 nt, Human
ccccacucuccccacaacuucug

SEQ ID NO: 44028 - RNA, 19 nt, Human
ccccagcagaacccagccc

SEQ ID NO: 44029 - RNA, 23 nt, Human
ccccucuugaaaagcccccacaa

SEQ ID NO: 44030 - RNA, 24 nt, Human
ccccuggagcugcaucugcucucc

SEQ ID NO: 44031 - RNA, 21 nt, Human
cccgcgacccgggacacccag

SEQ ID NO: 44032 - RNA, 22 nt, Human
ccgaaacccgacccucaucgcg

SEQ ID NO: 44033 - RNA, 23 nt, Human
ccgaaacccgacccucaucgcgc

SEQ ID NO: 44034 - RNA, 19 nt, Human
ccgcagccacccugccucg

SEQ ID NO: 44035 - RNA, 20 nt, Human
ccgcccgcagccacccugcc

SEQ ID NO: 44036 - RNA, 21 nt, Human
ccggcagcggcaaacggcagc

SEQ ID NO: 44037 - RNA, 20 nt, Human
ccguggcagugcuuggcugu

SEQ ID NO: 44038 - RNA, 24 nt, Human
ccuacagcaccaacaaggaggccc

SEQ ID NO: 44039 - RNA, 21 nt, Human
ccuaggcugauggcccgaggc

SEQ ID NO: 44040 - RNA, 24 nt, Human
ccucagcagccugaccgccuccuc

SEQ ID NO: 44041 - RNA, 19 nt, Human
ccugaccgccuccuccccc

SEQ ID NO: 44042 - RNA, 19 nt, Human
ccuuccucuugggcauguc

SEQ ID NO: 44043 - RNA, 19 nt, Human
cgauggagcgaagaccaag

SEQ ID NO: 44044 - RNA, 23 nt, Human
cggaugccaggcagggaccuuag

SEQ ID NO: 44045 - RNA, 21 nt, Human
cggcaccacaauggcuggcca

SEQ ID NO: 44046 - RNA, 21 nt, Human
cggcugucugauuccccacuc

SEQ ID NO: 44047 - RNA, 24 nt, Human
cgggggaggccgaaguugcgagcg

SEQ ID NO: 44048 - RNA, 20 nt, Human
cgguggugaggcuggggcuc

SEQ ID NO: 44049 - RNA, 23 nt, Human
cgugaaggucgcagucugggccg

SEQ ID NO: 44050 - RNA, 19 nt, Human
cgugacucacucugccccu

SEQ ID NO: 44051 - RNA, 22 nt, Human
cuagagguauggagggcaggag

SEQ ID NO: 44052 - RNA, 22 nt, Human
cucagcagccugaccgccuccu

SEQ ID NO: 44053 - RNA, 20 nt, Human
cucugccacacagaagagcc

SEQ ID NO: 44054 - RNA, 20 nt, Human
cucugugcuaagcuggggac

SEQ ID NO: 44055 - RNA, 22 nt, Human
cugaaaagcaguagaaggaaca

SEQ ID NO: 44056 - RNA, 19 nt, Human
cugcccaaggccacaggag

SEQ ID NO: 44057 - RNA, 24 nt, Human
cuggacaccugcuucggccacauc

SEQ ID NO: 44058 - RNA, 23 nt, Human
gaacaggcagaccuggcguuucu

SEQ ID NO: 44059 - RNA, 26 nt, Human
gaccuggcguuucuuagccugacucc

SEQ ID NO: 44060 - RNA, 18 nt, Human
gaguaaacaggcucaaaa

SEQ ID NO: 44061 - RNA, 23 nt, Human
gcaaacccuucuuuaagacucag

SEQ ID NO: 44062 - RNA, 24 nt, Human
gcagaccuggcguuucuuagccug

SEQ ID NO: 44063 - RNA, 18 nt, Human
gcagggaagggaacugaa

SEQ ID NO: 44064 - RNA, 21 nt, Human
gcaguagaaggaacagucaga

SEQ ID NO: 44065 - RNA, 22 nt, Human
gcagugacuggagguuucgggc

SEQ ID NO: 44066 - RNA, 23 nt, Human
gccaggagaccgccaucugggag

SEQ ID NO: 44067 - RNA, 20 nt, Human
gccaucagccauugcccagc

SEQ ID NO: 44068 - RNA, 20 nt, Human
gccauugcccagcaagaaca

SEQ ID NO: 44069 - RNA, 19 nt, Human
gccuggacaccugcuucgg

SEQ ID NO: 44070 - RNA, 21 nt, Human
gccuggacaccugcuucggcc

SEQ ID NO: 44071 - RNA, 21 nt, Human
gcggaaagaaagugcuggagg

SEQ ID NO: 44072 - RNA, 21 nt, Human
gcucggucagauccgaaaccc

SEQ ID NO: 44073 - RNA, 18 nt, Human
gcugcagccuaccugccu

SEQ ID NO: 44074 - RNA, 23 nt, Human
ggaaauagaacagcagggaaggg

SEQ ID NO: 44075 - RNA, 25 nt, Human
ggacaccugcuucggccacaucagu

SEQ ID NO: 44076 - RNA, 22 nt, Human
ggaggaagacugaggggaggcu

SEQ ID NO: 44077 - RNA, 20 nt, Human
ggcaccacaauggcuggcca

SEQ ID NO: 44078 - RNA, 25 nt, Human
ggcaggaggugggaugcgggggacc

SEQ ID NO: 44079 - RNA, 21 nt, Human
ggcaggaggugggaugcggug

SEQ ID NO: 44080 - RNA, 22 nt, Human
ggccggcagcggcaaacggcag

SEQ ID NO: 44081 - RNA, 22 nt, Human
ggcggagucugaggaggggccg

SEQ ID NO: 44082 - RNA, 23 nt, Human
gggcaaugcgucugcaagucggg

SEQ ID NO: 44083 - RNA, 23 nt, Human
gggcaggaggugggaugcggugg

SEQ ID NO: 44084 - RNA, 23 nt, Human
gggccggcagcggcaaacggcag

SEQ ID NO: 44085 - RNA, 20 nt, Human
ggugcacaugcaugcaggca

SEQ ID NO: 44086 - RNA, 18 nt, Human
gguggugaggcuggggcu

SEQ ID NO: 44087 - RNA, 19 nt, Human
gucagauauucaugaaggg

SEQ ID NO: 44088 - RNA, 19 nt, Human
gugagucuuuacacucaaa

SEQ ID NO: 44089 - RNA, 19 nt, Human
gugcacaugcaugcaggca

SEQ ID NO: 44090 - RNA, 18 nt, Human
gugggccugugccuuugc

SEQ ID NO: 44091 - RNA, 22 nt, Human
guuccaggcugcacagucccug

SEQ ID NO: 44092 - RNA, 25 nt, Human
uaaaacaauucccgaacagcacgga

SEQ ID NO: 44093 - RNA, 22 nt, Human
uaaaaucuaaggcaagaguacc

SEQ ID NO: 44094 - RNA, 21 nt, Human
uaaacaggcucaaaaagggcu

SEQ ID NO: 44095 - RNA, 27 nt, Human
uaaaccccagaaguggagauucccaaa

SEQ ID NO: 44096 - RNA, 24 nt, Human
uaaggcaagaguaccacgaggucc

SEQ ID NO: 44097 - RNA, 26 nt, Human
uacccaaaaggcuguauccagaagcu

SEQ ID NO: 44098 - RNA, 19 nt, Human
uauuaacauuuuccucuca

SEQ ID NO: 44099 - RNA, 22 nt, Human
ucaggcggaaagaaagugcugg

SEQ ID NO: 44100 - RNA, 22 nt, Human
ucagucacccuccaggaagccu

SEQ ID NO: 44101 - RNA, 21 nt, Human
uccaccacccgcccgcagcca

SEQ ID NO: 44102 - RNA, 23 nt, Human
uccaccacccgcccgcagccacc

SEQ ID NO: 44103 - RNA, 21 nt, Human
uccagaagcuggggcggcacc

SEQ ID NO: 44104 - RNA, 21 nt, Human
ucccaaaggcggagucugagg

SEQ ID NO: 44105 - RNA, 19 nt, Human
ucccagguccuggaggacc

SEQ ID NO: 44106 - RNA, 18 nt, Human
ucccaguguuuacccaaa

SEQ ID NO: 44107 - RNA, 24 nt, Human
uccccacaacuucuggaguuccca

SEQ ID NO: 44108 - RNA, 19 nt, Human
uccccagcccugagggccc

SEQ ID NO: 44109 - RNA, 22 nt, Human
uccucagcagccugaccgccuc

SEQ ID NO: 44110 - RNA, 18 nt, Human
ucgcagucugggccguga

SEQ ID NO: 44111 - RNA, 21 nt, Human
ucggucagauccgaaacccga

SEQ ID NO: 44112 - RNA, 22 nt, Human
ucugaguuggaccccaggcugg

SEQ ID NO: 44113 - RNA, 24 nt, Human
ucugauuccccacucuccccacaa

SEQ ID NO: 44114 - RNA, 20 nt, Human
ucugcccaaggccacaggag

SEQ ID NO: 44115 - RNA, 21 nt, Human
ucuggcaccugacccucccca

SEQ ID NO: 44116 - RNA, 22 nt, Human
ucuggcaccugacccuccccac

SEQ ID NO: 44117 - RNA, 20 nt, Human
ugaaaagcaguagaaggaac

SEQ ID NO: 44118 - RNA, 21 nt, Human
ugacucacucugccccuuccu

SEQ ID NO: 44119 - RNA, 21 nt, Human
ugagggcccggaaacgacgcu

SEQ ID NO: 44120 - RNA, 20 nt, Human
ugcacaggcagcaaggcaag

SEQ ID NO: 44121 - RNA, 19 nt, Human
ugccucagcgagcuugggg

SEQ ID NO: 44122 - RNA, 20 nt, Human
ugccucagcgagcuuggggc

SEQ ID NO: 44123 - RNA, 22 nt, Human
ugccucagcgagcuuggggcug

SEQ ID NO: 44124 - RNA, 27 nt, Human
ugccucagcgagcuuggggcugugggg

SEQ ID NO: 44125 - RNA, 23 nt, Human
ugcuaagcuggggacgaguguga

SEQ ID NO: 44126 - RNA, 22 nt, Human
ugcugccgcgacaacccagggc

SEQ ID NO: 44127 - RNA, 24 nt, Human
ugcugggcacagccacccugcugg

SEQ ID NO: 44128 - RNA, 22 nt, Human
uggaagcaagcaggagccuucu

SEQ ID NO: 44129 - RNA, 21 nt, Human
uggaggaagacugaggggagg

SEQ ID NO: 44130 - RNA, 18 nt, Human
uggcagcaguuacacagc

SEQ ID NO: 44131 - RNA, 24 nt, Human
uggcagcaguuacacagcgcaaaa

SEQ ID NO: 44132 - RNA, 19 nt, Human
uggcugcagccuaccugcc

SEQ ID NO: 44133 - RNA, 25 nt, Human
ugggcuggacucaggcggaaagaaa

SEQ ID NO: 44134 - RNA, 20 nt, Human
uggggcugggcagccggcuu

SEQ ID NO: 44135 - RNA, 20 nt, Human
uggggcuguggggcucccug

SEQ ID NO: 44136 - RNA, 18 nt, Human
uggguuugggaguuuucu

SEQ ID NO: 44137 - RNA, 21 nt, Human
uggugaggcuggggcugggca

SEQ ID NO: 44138 - RNA, 20 nt, Human
uuaacauuuuccucucacgu

SEQ ID NO: 44139 - RNA, 20 nt, Human
uucuggaguucccaguguuu

SEQ ID NO: 44140 - RNA, 19 nt, Human
uugcagccuucccauagcc

SEQ ID NO: 44141 - RNA, 20 nt, Human
uugcagccuucccauagccu

SEQ ID NO: 44142 - RNA, 21 nt, Human
uuggggcuguggggcucccug

SEQ ID NO: 44143 - RNA, 18 nt, Human
uuuccucagcagccugac

SEQ ID NO: 44144 - RNA, 19 nt, Human
uuucucagccuuugcagcc

SEQ ID NO: 44145 - RNA, 21 nt, Human
uuugcuucccagguccuggag

SEQ ID NO: 44146 - RNA, 25 nt, Human
uuugggaguuuucuauugcagucuu

SEQ ID NO: 44147 - RNA, 18 nt, Human
uuuuuuuuuuuuuuuuug

SEQ ID NO: 44148 - RNA, 27 nt, Human
uuuuuuuuuuuuuuuuuuuuuuugggg

SEQ ID NO: 44149 - RNA, 20 nt, Human
aaugaguugaagugccuuga

SEQ ID NO: 44150 - RNA, 18 nt, Human
caacccugcagaccagcc

SEQ ID NO: 44151 - RNA, 21 nt, Human
caccccacccacuccuauacc

SEQ ID NO: 44152 - RNA, 19 nt, Human
cagccaccaguccgggaac

SEQ ID NO: 44153 - RNA, 21 nt, Human
caggucaacccugcagaccag

SEQ ID NO: 44154 - RNA, 21 nt, Human
caucaguguucacauuuucca

SEQ ID NO: 44155 - RNA, 24 nt, Human
caugcacuuuuacuaugcccauug

SEQ ID NO: 44156 - RNA, 19 nt, Human
ccacugccaccaccaccag

SEQ ID NO: 44157 - RNA, 24 nt, Human
ccauggccuuguggccugggugac

SEQ ID NO: 44158 - RNA, 20 nt, Human
ccguccgcacacgcgcagaa

SEQ ID NO: 44159 - RNA, 19 nt, Human
cguccgcacacgcgcagaa

SEQ ID NO: 44160 - RNA, 22 nt, Human
cucaacaccccacccacuccua

SEQ ID NO: 44161 - RNA, 19 nt, Human
cugcguagcgccuccagcc

SEQ ID NO: 44162 - RNA, 21 nt, Human
gagggucugauggguggcuca

SEQ ID NO: 44163 - RNA, 22 nt, Human
gcuagagcagcaggacugucug

SEQ ID NO: 44164 - RNA, 21 nt, Human
guagcgccuccagccugggac

SEQ ID NO: 44165 - RNA, 22 nt, Human
gugcugaguuuucccauguggu

SEQ ID NO: 44166 - RNA, 20 nt, Human
ucaacccugcagaccagcca

SEQ ID NO: 44167 - RNA, 20 nt, Human
uccgcacacgcgcagaacca

SEQ ID NO: 44168 - RNA, 21 nt, Human
uccgcacacgcgcagaaccac

SEQ ID NO: 44169 - RNA, 19 nt, Human
ucuguccacugccaccacc

SEQ ID NO: 44170 - RNA, 21 nt, Human
ugaccgcggaguuaacagaca

SEQ ID NO: 44171 - RNA, 28 nt, Human
ugaccgcggaguuaacagacagccgucc

SEQ ID NO: 44172 - RNA, 19 nt, Human
ugaguugaagugccuugau

SEQ ID NO: 44173 - RNA, 24 nt, Human
ugcccauugcacuucucauccaug

SEQ ID NO: 44174 - RNA, 23 nt, Human
ugcugaguuuucccaugugguuu

SEQ ID NO: 44175 - RNA, 21 nt, Human
aaaaacacaaaaaaauauuca

SEQ ID NO: 44176 - RNA, 22 nt, Human
aaaaggaaacaaaaacacaaaa

SEQ ID NO: 44177 - RNA, 26 nt, Human
aaaaucaacuauaguagaaccagagg

SEQ ID NO: 44178 - RNA, 24 nt, Human
aaacaaaaacacaaaaaaauauuc

SEQ ID NO: 44179 - RNA, 21 nt, Human
aaaucaacuauaguagaaccg

SEQ ID NO: 44180 - RNA, 20 nt, Human
aaggaaacaaaaacacaagg

SEQ ID NO: 44181 - RNA, 23 nt, Human
acagacaggagggcauuccucca

SEQ ID NO: 44182 - RNA, 26 nt, Human
acugcagucgcacugaacaccaggcc

SEQ ID NO: 44183 - RNA, 18 nt, Human
agcuguggcacagagaac

SEQ ID NO: 44184 - RNA, 22 nt, Human
aggcaguccagaaguagaaaua

SEQ ID NO: 44185 - RNA, 19 nt, Human
aggcgucuuaacaugaaac

SEQ ID NO: 44186 - RNA, 23 nt, Human
caacgaauauucaacauucaaaa

SEQ ID NO: 44187 - RNA, 19 nt, Human
cacaccuuugcucuagaau

SEQ ID NO: 44188 - RNA, 22 nt, Human
cacaggcgucuuaacaugaaac

SEQ ID NO: 44189 - RNA, 23 nt, Human
caccuuugcucuagaaucaggaa

SEQ ID NO: 44190 - RNA, 19 nt, Human
cagaaacacugaauagcac

SEQ ID NO: 44191 - RNA, 18 nt, Human
cagaaguagaaauacacc

SEQ ID NO: 44192 - RNA, 21 nt, Human
caggaagagcaucagugaaag

SEQ ID NO: 44193 - RNA, 19 nt, Human
cagguccugcccuagagga

SEQ ID NO: 44194 - RNA, 24 nt, Human
caucagugaaaguccccaggcccc

SEQ ID NO: 44195 - RNA, 23 nt, Human
ccaaauauccauuuuaucaugau

SEQ ID NO: 44196 - RNA, 24 nt, Human
ccccaggccccuagaggagggauc

SEQ ID NO: 44197 - RNA, 19 nt, Human
ccccuucccacaccuuugc

SEQ ID NO: 44198 - RNA, 19 nt, Human
ccuccauuuccccuuccca

SEQ ID NO: 44199 - RNA, 21 nt, Human
ccuccauuuccccuucccaca

SEQ ID NO: 44200 - RNA, 22 nt, Human
ccuucccacaccuuugcucuag

SEQ ID NO: 44201 - RNA, 24 nt, Human
cgacacagacaggagggcauuccc

SEQ ID NO: 44202 - RNA, 23 nt, Human
cgccuucgaccuccguugcgcuc

SEQ ID NO: 44203 - RNA, 24 nt, Human
cuccguugcgcucgcacuggcggg

SEQ ID NO: 44204 - RNA, 19 nt, Human
gaggagcucagcccuuggg

SEQ ID NO: 44205 - RNA, 18 nt, Human
gcucgcacuggcgggacc

SEQ ID NO: 44206 - RNA, 24 nt, Human
ggaaacaaaaacacaaaaaaauau

SEQ ID NO: 44207 - RNA, 22 nt, Human
ggcacagagaacgacacagaca

SEQ ID NO: 44208 - RNA, 20 nt, Human
gugccaacacacagggugca

SEQ ID NO: 44209 - RNA, 23 nt, Human
uaaaguggauccaagaaaggacu

SEQ ID NO: 44210 - RNA, 23 nt, Human
uaacaugaaacccaacgaauauu

SEQ ID NO: 44211 - RNA, 22 nt, Human
uagcacuccuggaccacaggcg

SEQ ID NO: 44212 - RNA, 23 nt, Human
uaguaaaaugcagacuaaucaag

SEQ ID NO: 44213 - RNA, 19 nt, Human
uauaguagaaccagaggug

SEQ ID NO: 44214 - RNA, 19 nt, Human
uaucaggaacagaaacacu

SEQ ID NO: 44215 - RNA, 23 nt, Human
ucaagauaaaguggauccaagaa

SEQ ID NO: 44216 - RNA, 20 nt, Human
ucagaaaaggaaacaaaaac

SEQ ID NO: 44217 - RNA, 21 nt, Human
ucagaaaaggaaacaaaaaca

SEQ ID NO: 44218 - RNA, 18 nt, Human
uccaaaauccaguuaagu

SEQ ID NO: 44219 - RNA, 21 nt, Human
uccacuggggauucugcccca

SEQ ID NO: 44220 - RNA, 22 nt, Human
uccccaggccccuagaggaggg

SEQ ID NO: 44221 - RNA, 23 nt, Human
ucuguagcuguggcacagagaac

SEQ ID NO: 44222 - RNA, 27 nt, Human
ugaaacccaacgaauauucaacauuca

SEQ ID NO: 44223 - RNA, 21 nt, Human
ugacggugaaucuucacuggu

SEQ ID NO: 44224 - RNA, 21 nt, Human
ugacugcagucgcacugaaca

SEQ ID NO: 44225 - RNA, 19 nt, Human
ugccccaguccaagacccg

SEQ ID NO: 44226 - RNA, 22 nt, Human
ugcgcucgcacuggcgggaccu

SEQ ID NO: 44227 - RNA, 20 nt, Human
uggaauagagcggcccacau

SEQ ID NO: 44228 - RNA, 25 nt, Human
uuaacaugaaacccaacgaauauuc

SEQ ID NO: 44229 - RNA, 22 nt, Human
uucaaaguguuuaucaggaaca

SEQ ID NO: 44230 - RNA, 22 nt, Human
uuucaugguuugacggugaauc

SEQ ID NO: 44231 - RNA, 22 nt, Human
uuuuuuuaaaagccaaauugga

SEQ ID NO: 44232 - RNA, 21 nt, Human
aaagaguuccauugcuuaaaa

SEQ ID NO: 44233 - RNA, 18 nt, Human
aagaaagaguuccauugc

SEQ ID NO: 44234 - RNA, 18 nt, Human
agaaccaaggcauucccu

SEQ ID NO: 44235 - RNA, 19 nt, Human
agagagcagguaaaaacau

SEQ ID NO: 44236 - RNA, 19 nt, Human
agaguuccauugcuuaaaa

SEQ ID NO: 44237 - RNA, 22 nt, Human
agaugucagcaauugacagaac

SEQ ID NO: 44238 - RNA, 23 nt, Human
agaugucagcaauugacagaacc

SEQ ID NO: 44239 - RNA, 23 nt, Human
agguaugauggcuuccagcuuca

SEQ ID NO: 44240 - RNA, 25 nt, Human
auuuggagcaaaugguagccgaaau

SEQ ID NO: 44241 - RNA, 21 nt, Human
caaauacuuagcugaguccua

SEQ ID NO: 44242 - RNA, 22 nt, Human
caccuaggcaagauucagaaaa

SEQ ID NO: 44243 - RNA, 21 nt, Human
cagcagcguuucacagagaug

SEQ ID NO: 44244 - RNA, 20 nt, Human
caucauuguauuaacagccu

SEQ ID NO: 44245 - RNA, 23 nt, Human
cauugcuuaaaaacgggguugga

SEQ ID NO: 44246 - RNA, 20 nt, Human
ccauugcuuaaaaacggggu

SEQ ID NO: 44247 - RNA, 22 nt, Human
cuacauaaaaaacuguaaguua

SEQ ID NO: 44248 - RNA, 21 nt, Human
ggaauuuggagcaaaugguag

SEQ ID NO: 44249 - RNA, 20 nt, Human
uaaaacgagauuagcuguaa

SEQ ID NO: 44250 - RNA, 18 nt, Human
uaaaugaaacaccuaggc

SEQ ID NO: 44251 - RNA, 19 nt, Human
uacauuaacuguugcaaaa

SEQ ID NO: 44252 - RNA, 23 nt, Human
uaggcaaauacuuagcugagucc

SEQ ID NO: 44253 - RNA, 20 nt, Human
uauucuguguucucagaugu

SEQ ID NO: 44254 - RNA, 19 nt, Human
ucaaagauuuguccuucca

SEQ ID NO: 44255 - RNA, 21 nt, Human
ucaaagauuuguccuuccacu

SEQ ID NO: 44256 - RNA, 19 nt, Human
ucacucagcagcguuucac

SEQ ID NO: 44257 - RNA, 21 nt, Human
ucagcaauugacagaaccaag

SEQ ID NO: 44258 - RNA, 24 nt, Human
ucagcagcguuucacagagauguu

SEQ ID NO: 44259 - RNA, 22 nt, Human
ucucuauagagagagcagguaa

SEQ ID NO: 44260 - RNA, 23 nt, Human
ucuuaccuuauuuuacuacuuau

SEQ ID NO: 44261 - RNA, 22 nt, Human
ugaaagcaguucucacucagca

SEQ ID NO: 44262 - RNA, 22 nt, Human
uggaguacagugguaaaaacca

SEQ ID NO: 44263 - RNA, 25 nt, Human
ugguagccgaaaugaguuuacaugc

SEQ ID NO: 44264 - RNA, 20 nt, Human
uguucugcauaagcuuuugu

SEQ ID NO: 44265 - RNA, 22 nt, Human
uucaaagauuuguccuuccacu

SEQ ID NO: 44266 - RNA, 24 nt, Human
uuuguuugucaucauuguauuaac

SEQ ID NO: 44267 - RNA, 21 nt, Human
aaaguuucacaaaugcuuucc

SEQ ID NO: 44268 - RNA, 21 nt, Human
aagagaucaaaauaaccuaug

SEQ ID NO: 44269 - RNA, 18 nt, Human
aagcaaaaguauaaacua

SEQ ID NO: 44270 - RNA, 26 nt, Human
aauuaaauaagauuuucaagaaaguu

SEQ ID NO: 44271 - RNA, 24 nt, Human
agaccaacagucauauaaaaauaa

SEQ ID NO: 44272 - RNA, 19 nt, Human
agcccgugggcgggauggg

SEQ ID NO: 44273 - RNA, 23 nt, Human
agcccuuucuuuuuucuggagcu

SEQ ID NO: 44274 - RNA, 20 nt, Human
auaaaaaccaaaccugcuua

SEQ ID NO: 44275 - RNA, 22 nt, Human
auaaaaaccaaaccugcuuaag

SEQ ID NO: 44276 - RNA, 18 nt, Human
augcaaacauaugaaaug

SEQ ID NO: 44277 - RNA, 26 nt, Human
auggggcggggcgggaagaggcgguu

SEQ ID NO: 44278 - RNA, 24 nt, Human
caaaaugcaaacauaugaaaugag

SEQ ID NO: 44279 - RNA, 23 nt, Human
cacuggaaaaaacguuaaagccc

SEQ ID NO: 44280 - RNA, 19 nt, Human
cuggagcugaaacaguggc

SEQ ID NO: 44281 - RNA, 21 nt, Human
ggaagaggcgguugggcugcg

SEQ ID NO: 44282 - RNA, 28 nt, Human
uaagcaaaaguauaaacuaaucaacggg

SEQ ID NO: 44283 - RNA, 23 nt, Human
uaauaccauuaagucuacaaagu

SEQ ID NO: 44284 - RNA, 19 nt, Human
uacacgggucacggccuug

SEQ ID NO: 44285 - RNA, 20 nt, Human
uccccgaacgcgggacuccu

SEQ ID NO: 44286 - RNA, 20 nt, Human
ucuggagcugaaacaguggc

SEQ ID NO: 44287 - RNA, 21 nt, Human
ugcggaaggacggggcgcugc

SEQ ID NO: 44288 - RNA, 19 nt, Human
ugggcgggauggggcgggg

SEQ ID NO: 44289 - RNA, 23 nt, Human
uucaaguaaagugguacuaaaga

SEQ ID NO: 44290 - RNA, 18 nt, Human
uuucacuggaaaaaacgu

SEQ ID NO: 44291 - RNA, 22 nt, Human
uuuucacuggaaaaaacguuaa

SEQ ID NO: 44292 - RNA, 22 nt, Human
acagucagucacacagcaugaa

SEQ ID NO: 44293 - RNA, 22 nt, Human
acaguggugaggaggcggaaag

SEQ ID NO: 44294 - RNA, 26 nt, Human
accaccugcccaacaccaggacccca

SEQ ID NO: 44295 - RNA, 20 nt, Human
accccgcccccaggagccag

SEQ ID NO: 44296 - RNA, 23 nt, Human
accucaaggaaaagacagacccc

SEQ ID NO: 44297 - RNA, 23 nt, Human
agacagaccccaccaagggccug

SEQ ID NO: 44298 - RNA, 19 nt, Human
agccccaccaccugcccaa

SEQ ID NO: 44299 - RNA, 22 nt, Human
aggaaaagacagaccccaccaa

SEQ ID NO: 44300 - RNA, 24 nt, Human
aggaaaagacagaccccaccaagg

SEQ ID NO: 44301 - RNA, 19 nt, Human
auggcccagccccaccacc

SEQ ID NO: 44302 - RNA, 23 nt, Human
cacaaccccgcccccaggagccu

SEQ ID NO: 44303 - RNA, 19 nt, Human
cacacagcaugaaucacca

SEQ ID NO: 44304 - RNA, 21 nt, Human
cacacagcaugaaucaccacc

SEQ ID NO: 44305 - RNA, 22 nt, Human
cacacagcaugaaucaccaccc

SEQ ID NO: 44306 - RNA, 20 nt, Human
cacagucccaggcccgaauc

SEQ ID NO: 44307 - RNA, 25 nt, Human
caccaccugcccaacaccaggaccc

SEQ ID NO: 44308 - RNA, 22 nt, Human
caccccugccuucaucagacuu

SEQ ID NO: 44309 - RNA, 18 nt, Human
cagcacugagcccaucug

SEQ ID NO: 44310 - RNA, 23 nt, Human
caucugggguccccagggagccc

SEQ ID NO: 44311 - RNA, 26 nt, Human
ccaggccucgucauccugaccccagc

SEQ ID NO: 44312 - RNA, 22 nt, Human
cccagccccaccaccugcccaa

SEQ ID NO: 44313 - RNA, 21 nt, Human
ccccacaaccccgcccccagg

SEQ ID NO: 44314 - RNA, 18 nt, Human
cccccacaaccccgcccc

SEQ ID NO: 44315 - RNA, 21 nt, Human
ccccccacaaccccgccccca

SEQ ID NO: 44316 - RNA, 21 nt, Human
ccccccacaaccccgcccccg

SEQ ID NO: 44317 - RNA, 20 nt, Human
ccccgcccccaggagccagg

SEQ ID NO: 44318 - RNA, 23 nt, Human
ccccuggcucccgcgccuucccg

SEQ ID NO: 44319 - RNA, 20 nt, Human
cccgcccccaggagccaggg

SEQ ID NO: 44320 - RNA, 24 nt, Human
cccugccuucaucagacuuuacaa

SEQ ID NO: 44321 - RNA, 18 nt, Human
ccgccgggccgcccaguc

SEQ ID NO: 44322 - RNA, 22 nt, Human
ccucugggccagcuccauggcc

SEQ ID NO: 44323 - RNA, 28 nt, Human
ccucugggccagcuccauggcccagccc

SEQ ID NO: 44324 - RNA, 24 nt, Human
ccugaccccagcccugcuccugac

SEQ ID NO: 44325 - RNA, 20 nt, Human
ccugaccucugaccucaagg

SEQ ID NO: 44326 - RNA, 20 nt, Human
ccugcccaacaccaggaccc

SEQ ID NO: 44327 - RNA, 24 nt, Human
cucaaggaaaagacagaccccacc

SEQ ID NO: 44328 - RNA, 20 nt, Human
cuccauggcccagccccacc

SEQ ID NO: 44329 - RNA, 24 nt, Human
cuccauggcccagccccaccaccu

SEQ ID NO: 44330 - RNA, 21 nt, Human
cuccugaccucugaccucaag

SEQ ID NO: 44331 - RNA, 22 nt, Human
cuccugaccucugaccucaagg

SEQ ID NO: 44332 - RNA, 20 nt, Human
cugaccucaaggaaaagaca

SEQ ID NO: 44333 - RNA, 24 nt, Human
cuggcucccgcgccuucccgcagu

SEQ ID NO: 44334 - RNA, 23 nt, Human
cugucgcacugggccuucaugcc

SEQ ID NO: 44335 - RNA, 18 nt, Human
gaaaagacagaccccacc

SEQ ID NO: 44336 - RNA, 19 nt, Human
gaaaagacagaccccacca

SEQ ID NO: 44337 - RNA, 22 nt, Human
gagcccccgccgggccgcccag

SEQ ID NO: 44338 - RNA, 22 nt, Human
gaggaacuugaggcacaguggu

SEQ ID NO: 44339 - RNA, 18 nt, Human
gcaccagggcccgcggga

SEQ ID NO: 44340 - RNA, 19 nt, Human
gcacugggccuucaugcca

SEQ ID NO: 44341 - RNA, 18 nt, Human
ggaaaagacagaccccac

SEQ ID NO: 44342 - RNA, 20 nt, Human
ggaggacaacugaggugucc

SEQ ID NO: 44343 - RNA, 21 nt, Human
ggaggccccuggcucccgcgc

SEQ ID NO: 44344 - RNA, 21 nt, Human
uagaugaggaacuugaggcac

SEQ ID NO: 44345 - RNA, 19 nt, Human
ucagcccccccacaacccc

SEQ ID NO: 44346 - RNA, 19 nt, Human
uccccagggagcccccgcc

SEQ ID NO: 44347 - RNA, 21 nt, Human
ucccugagugucgcucagccc

SEQ ID NO: 44348 - RNA, 20 nt, Human
ugaccccagcccugcuccug

SEQ ID NO: 44349 - RNA, 24 nt, Human
ugaccccagcccugcuccugaccu

SEQ ID NO: 44350 - RNA, 26 nt, Human
ugaggaacuugaggcacaguggugag

SEQ ID NO: 44351 - RNA, 24 nt, Human
ugaggaggcggaaaggcccagagg

SEQ ID NO: 44352 - RNA, 18 nt, Human
uggcucccgcgccuuccc

SEQ ID NO: 44353 - RNA, 19 nt, Human
ugggguggaggccccuggc

SEQ ID NO: 44354 - RNA, 26 nt, Human
aaaaacacaaaaaugaaccaggcaug

SEQ ID NO: 44355 - RNA, 21 nt, Human
aaaugaccuacugaaaccacc

SEQ ID NO: 44356 - RNA, 22 nt, Human
aaccaaaaaggccaacaccagg

SEQ ID NO: 44357 - RNA, 18 nt, Human
aaccaggcaugguggugc

SEQ ID NO: 44358 - RNA, 25 nt, Human
aacuguacagcccccuucucucccu

SEQ ID NO: 44359 - RNA, 24 nt, Human
aaggcugcagugagcugagaucgg

SEQ ID NO: 44360 - RNA, 24 nt, Human
aaucaccggaacccaggaggucaa

SEQ ID NO: 44361 - RNA, 24 nt, Human
acccaggaggucaaggcugcagug

SEQ ID NO: 44362 - RNA, 24 nt, Human
accccaucucuacuaaaaacacaa

SEQ ID NO: 44363 - RNA, 23 nt, Human
accuguaguuccagcuacuuggg

SEQ ID NO: 44364 - RNA, 24 nt, Human
acugcacucuagccugggugacag

SEQ ID NO: 44365 - RNA, 26 nt, Human
acugcacucuagccugggugacagag

SEQ ID NO: 44366 - RNA, 21 nt, Human
acuucuguauacucugaaacu

SEQ ID NO: 44367 - RNA, 24 nt, Human
agauauccaacacuguauugaaua

SEQ ID NO: 44368 - RNA, 24 nt, Human
agcacuuugggaggccaagguggg

SEQ ID NO: 44369 - RNA, 22 nt, Human
agccaggcaugguggcucaucc

SEQ ID NO: 44370 - RNA, 22 nt, Human
agccugggcaauaugguaaaac

SEQ ID NO: 44371 - RNA, 24 nt, Human
agccugggcaauaugguaaaaccc

SEQ ID NO: 44372 - RNA, 22 nt, Human
agccugggugacagaguaagac

SEQ ID NO: 44373 - RNA, 24 nt, Human
aggcaugguggcucaucccuguaa

SEQ ID NO: 44374 - RNA, 21 nt, Human
aggcaugguggugcacaccug

SEQ ID NO: 44375 - RNA, 24 nt, Human
aggcaugguggugcacaccuguag

SEQ ID NO: 44376 - RNA, 19 nt, Human
aggccaaggugggcgauau

SEQ ID NO: 44377 - RNA, 24 nt, Human
aggucaaggcugcagugagcugag

SEQ ID NO: 44378 - RNA, 20 nt, Human
auauguaugcguauacagcu

SEQ ID NO: 44379 - RNA, 22 nt, Human
aucccagcacuuugggaggcca

SEQ ID NO: 44380 - RNA, 24 nt, Human
aucgcgccacugcacucuagccug

SEQ ID NO: 44381 - RNA, 22 nt, Human
caaaacccaauuucugaacuau

SEQ ID NO: 44382 - RNA, 25 nt, Human
caaggugggcgauauccagaagcca

SEQ ID NO: 44383 - RNA, 24 nt, Human
cacaccuguaguuccagcuacuug

SEQ ID NO: 44384 - RNA, 22 nt, Human
caccaggacccugacuaagggc

SEQ ID NO: 44385 - RNA, 23 nt, Human
caccuguaguuccagcuacuugg

SEQ ID NO: 44386 - RNA, 24 nt, Human
caccuguaguuccagcuacuuggg

SEQ ID NO: 44387 - RNA, 22 nt, Human
cacucuagccugggugacagag

SEQ ID NO: 44388 - RNA, 22 nt, Human
cacucuagccugggugacagag

SEQ ID NO: 44389 - RNA, 19 nt, Human
cacugcacucuagccuggg

SEQ ID NO: 44390 - RNA, 21 nt, Human
cacugcacucuagccugggug

SEQ ID NO: 44391 - RNA, 22 nt, Human
cacugcacucuagccuggguga

SEQ ID NO: 44392 - RNA, 23 nt, Human
cacugcacucuagccugggugac

SEQ ID NO: 44393 - RNA, 24 nt, Human
cacugcacucuagccugggugaca

SEQ ID NO: 44394 - RNA, 25 nt, Human
cacugcacucuagccugggugacag

SEQ ID NO: 44395 - RNA, 18 nt, Human
cagaagccagaagaccag

SEQ ID NO: 44396 - RNA, 21 nt, Human
cagcacuuugggaggccaagg

SEQ ID NO: 44397 - RNA, 24 nt, Human
cagcacuuugggaggccaaggugg

SEQ ID NO: 44398 - RNA, 22 nt, Human
cagccugaaaagagaaaaccaa

SEQ ID NO: 44399 - RNA, 23 nt, Human
cagccugaaaagagaaaaccaaa

SEQ ID NO: 44400 - RNA, 19 nt, Human
caggacccugacuaagggc

SEQ ID NO: 44401 - RNA, 23 nt, Human
caggacccugacuaagggcuuca

SEQ ID NO: 44402 - RNA, 25 nt, Human
caggauaaagugcaauaauaaccau

SEQ ID NO: 44403 - RNA, 23 nt, Human
cauaugaccuacaaaauuauacc

SEQ ID NO: 44404 - RNA, 24 nt, Human
caucccuguaaucccagcacuuug

SEQ ID NO: 44405 - RNA, 22 nt, Human
ccaacaccaggacccugacuaa

SEQ ID NO: 44406 - RNA, 20 nt, Human
ccacugcacucuagccuggg

SEQ ID NO: 44407 - RNA, 20 nt, Human
ccacugcacucuagccuggg

SEQ ID NO: 44408 - RNA, 21 nt, Human
ccacugcacucuagccugggu

SEQ ID NO: 44409 - RNA, 21 nt, Human
ccacugcacucuagccugggu

SEQ ID NO: 44410 - RNA, 24 nt, Human
ccacugcacucuagccugggugac

SEQ ID NO: 44411 - RNA, 21 nt, Human
ccagggaggggucccacuccu

SEQ ID NO: 44412 - RNA, 21 nt, Human
cccccuucucucccucauucc

SEQ ID NO: 44413 - RNA, 21 nt, Human
cccugacuaagggcuucauua

SEQ ID NO: 44414 - RNA, 24 nt, Human
ccugggcaauaugguaaaacccca

SEQ ID NO: 44415 - RNA, 20 nt, Human
ccugggugacagaguaagac

SEQ ID NO: 44416 - RNA, 21 nt, Human
ccuguaguuccagcuacuugg

SEQ ID NO: 44417 - RNA, 24 nt, Human
ccuguauaaccuauauugcaaaac

SEQ ID NO: 44418 - RNA, 24 nt, Human
cguauacagcuuuaaaaacaguuu

SEQ ID NO: 44419 - RNA, 24 nt, Human
cucaucccuguaaucccagcacuu

SEQ ID NO: 44420 - RNA, 19 nt, Human
cugcagugagcugagaucg

SEQ ID NO: 44421 - RNA, 20 nt, Human
cugcagugagcugagaucgc

SEQ ID NO: 44422 - RNA, 22 nt, Human
cugcagugagcugagaucgcgc

SEQ ID NO: 44423 - RNA, 20 nt, Human
gacacaaccguuuaaaauuu

SEQ ID NO: 44424 - RNA, 20 nt, Human
gagaaucaccggaacccagg

SEQ ID NO: 44425 - RNA, 20 nt, Human
gagaucgcgccacugcacuc

SEQ ID NO: 44426 - RNA, 24 nt, Human
gcacucuagccugggugacagagu

SEQ ID NO: 44427 - RNA, 20 nt, Human
gcacuuugggaggccaaggu

SEQ ID NO: 44428 - RNA, 21 nt, Human
gccaacaccaggacccugacu

SEQ ID NO: 44429 - RNA, 24 nt, Human
gccacugcacucuagccuggguga

SEQ ID NO: 44430 - RNA, 20 nt, Human
gcugagaucgcgccacugca

SEQ ID NO: 44431 - RNA, 30 nt, Human
ggaggucaaggcugcagugagcugagaucg

SEQ ID NO: 44432 - RNA, 21 nt, Human
ggcucaucccuguaaucccag

SEQ ID NO: 44433 - RNA, 18 nt, Human
gggaggaugaggcaugag

SEQ ID NO: 44434 - RNA, 24 nt, Human
gguggcucaucccuguaaucccag

SEQ ID NO: 44435 - RNA, 24 nt, Human
gguggugcacaccuguaguuccag

SEQ ID NO: 44436 - RNA, 24 nt, Human
uaaaaacacaaaaaugaaccaggc

SEQ ID NO: 44437 - RNA, 24 nt, Human
uaaaauacagaaauugucaacuga

SEQ ID NO: 44438 - RNA, 23 nt, Human
uaaaccuuauacuugaaaacuaa

SEQ ID NO: 44439 - RNA, 20 nt, Human
uacagcuuuaaaaacaguuu

SEQ ID NO: 44440 - RNA, 24 nt, Human
uacuuaaaccuuauacuugaaaac

SEQ ID NO: 44441 - RNA, 20 nt, Human
uauauauauguaugcguaua

SEQ ID NO: 44442 - RNA, 21 nt, Human
uauccagaagccagaagacca

SEQ ID NO: 44443 - RNA, 25 nt, Human
uaugguaaaaccccaucucuacuaa

SEQ ID NO: 44444 - RNA, 22 nt, Human
ucacugaaccaaaacccaauuu

SEQ ID NO: 44445 - RNA, 22 nt, Human
ucccaacaagacacaaccguuu

SEQ ID NO: 44446 - RNA, 22 nt, Human
ucccacgcaaggcacuuacucc

SEQ ID NO: 44447 - RNA, 22 nt, Human
ucccuguaaucccagcacuuug

SEQ ID NO: 44448 - RNA, 23 nt, Human
ucccuguaaucccagcacuuugg

SEQ ID NO: 44449 - RNA, 24 nt, Human
ucccuguaaucccagcacuuuggg

SEQ ID NO: 44450 - RNA, 24 nt, Human
ucuagccugggugacagaguaaga

SEQ ID NO: 44451 - RNA, 25 nt, Human
ugaaaagagaaaaccaaaaaggcca

SEQ ID NO: 44452 - RNA, 22 nt, Human
ugagcugagaucgcgccacugc

SEQ ID NO: 44453 - RNA, 19 nt, Human
ugaggcaugagaaucaccg

SEQ ID NO: 44454 - RNA, 24 nt, Human
ugaggcaugagaaucaccggaacc

SEQ ID NO: 44455 - RNA, 18 nt, Human
ugcaaaacaauagauuca

SEQ ID NO: 44456 - RNA, 18 nt, Human
uggcucaucccuguaauc

SEQ ID NO: 44457 - RNA, 21 nt, Human
uggcucaucccuguaauccca

SEQ ID NO: 44458 - RNA, 22 nt, Human
uggcucaucccuguaaucccag

SEQ ID NO: 44459 - RNA, 24 nt, Human
uggcucaucccuguaaucccagca

SEQ ID NO: 44460 - RNA, 19 nt, Human
ugggaggccaaggugggcg

SEQ ID NO: 44461 - RNA, 22 nt, Human
ugggcaauaugguaaaacccca

SEQ ID NO: 44462 - RNA, 19 nt, Human
uggugcacaccuguaguuc

SEQ ID NO: 44463 - RNA, 22 nt, Human
uggugcacaccuguaguuccag

SEQ ID NO: 44464 - RNA, 24 nt, Human
ugguggcucaucccuguaauccca

SEQ ID NO: 44465 - RNA, 23 nt, Human
ugguggugcacaccuguaguucc

SEQ ID NO: 44466 - RNA, 24 nt, Human
ugguggugcacaccuguaguucca

SEQ ID NO: 44467 - RNA, 24 nt, Human
uguaacaaauauuucccugaugcc

SEQ ID NO: 44468 - RNA, 22 nt, Human
uuacagcagugacaccagggag

SEQ ID NO: 44469 - RNA, 22 nt, Human
uuggaaaaaaauacaggugcuu

SEQ ID NO: 44470 - RNA, 23 nt, Human
uuuaaaaugaccuacugaaacca

SEQ ID NO: 44471 - RNA, 20 nt, Human
uuucccugaugccacaagau

SEQ ID NO: 44472 - RNA, 18 nt, Human
acgcccgcguccugcacg

SEQ ID NO: 44473 - RNA, 19 nt, Human
aggcacagugcugggaaca

SEQ ID NO: 44474 - RNA, 23 nt, Human
cgggacaaaccagggccuuaagg

SEQ ID NO: 44475 - RNA, 19 nt, Human
uaaggaaaggggcuucggc

SEQ ID NO: 44476 - RNA, 23 nt, Human
uaagugcucuugagagcaggcac

SEQ ID NO: 44477 - RNA, 21 nt, Human
ugacccagcucuggcguccug

SEQ ID NO: 44478 - RNA, 18 nt, Human
ugagagcaggcacagugc

SEQ ID NO: 44479 - RNA, 18 nt, Human
ugagagcaggcacagugc

SEQ ID NO: 44480 - RNA, 20 nt, Human
aaaaaaugaaacagcuuauc

SEQ ID NO: 44481 - RNA, 25 nt, Human
agaaaauaauaaaaaaugaaacagc

SEQ ID NO: 44482 - RNA, 21 nt, Human
agcggccuccuccccaacccc

SEQ ID NO: 44483 - RNA, 24 nt, Human
cauagaaaauaauaaaaaaugaaa

SEQ ID NO: 44484 - RNA, 19 nt, Human
ccccaaccccgcacccuag

SEQ ID NO: 44485 - RNA, 18 nt, Human
ccuccccaaccccgcacc

SEQ ID NO: 44486 - RNA, 18 nt, Human
ccuccuccccaaccccgc

SEQ ID NO: 44487 - RNA, 21 nt, Human
cguagacuagcggccuccucc

SEQ ID NO: 44488 - RNA, 18 nt, Human
cuagcggccuccucccca

SEQ ID NO: 44489 - RNA, 23 nt, Human
cuagcggccuccuccccaacccc

SEQ ID NO: 44490 - RNA, 21 nt, Human
cuccccaaccccgcacccuag

SEQ ID NO: 44491 - RNA, 21 nt, Human
gccuccuccccaaccccgcac

SEQ ID NO: 44492 - RNA, 20 nt, Human
gcggccuccuccccaacccc

SEQ ID NO: 44493 - RNA, 18 nt, Human
ggccuccuccccaacccc

SEQ ID NO: 44494 - RNA, 26 nt, Human
uaagcugacccacaguagucacacuu

SEQ ID NO: 44495 - RNA, 23 nt, Human
uagacuagcggccuccuccccaa

SEQ ID NO: 44496 - RNA, 19 nt, Human
ucacauaggguugucuccu

SEQ ID NO: 44497 - RNA, 20 nt, Human
uccuccccaaccccgcaccc

SEQ ID NO: 44498 - RNA, 20 nt, Human
ucuccuuaaauagcagaggu

SEQ ID NO: 44499 - RNA, 18 nt, Human
ugggauuucaucauuuug

SEQ ID NO: 44500 - RNA, 19 nt, Human
uucuggucacauaggguug

SEQ ID NO: 44501 - RNA, 21 nt, Human
cugccgccgucugcccugcgc

SEQ ID NO: 44502 - RNA, 20 nt, Human
cuucuccugccgccgucugc

SEQ ID NO: 44503 - RNA, 22 nt, Human
uaaaguaaaguacaagcuguaa

SEQ ID NO: 44504 - RNA, 24 nt, Human
uaaaugcaauugucuuguaccuug

SEQ ID NO: 44505 - RNA, 18 nt, Human
uacacauuaaaguaaagu

SEQ ID NO: 44506 - RNA, 23 nt, Human
ucuccugccgccgucugcccugc

SEQ ID NO: 44507 - RNA, 24 nt, Human
uuacacauuaaaguaaaguacaag

SEQ ID NO: 44508 - RNA, 22 nt, Human
uuaguuuaaaaagaaauugagg

SEQ ID NO: 44509 - RNA, 23 nt, Human
uugguccucugauuucacauauu

SEQ ID NO: 44510 - RNA, 19 nt, Human
aaauaacaaggccagaaaa

SEQ ID NO: 44511 - RNA, 21 nt, Human
aagcaggaaauacauuuaaaa

SEQ ID NO: 44512 - RNA, 29 nt, Human
aagcaggaaauacauuuaaaagggacccc

SEQ ID NO: 44513 - RNA, 24 nt, Human
aaggcaaaaaaaaaauaugaucaa

SEQ ID NO: 44514 - RNA, 18 nt, Human
aauaacuaaaaugacauu

SEQ ID NO: 44515 - RNA, 22 nt, Human
acaaggcaaaaaaaaaauauga

SEQ ID NO: 44516 - RNA, 19 nt, Human
acugcauugcagcuuaaaa

SEQ ID NO: 44517 - RNA, 25 nt, Human
agccaguccucuggcuagaggccca

SEQ ID NO: 44518 - RNA, 19 nt, Human
aggcaaaaaaaaaauauga

SEQ ID NO: 44519 - RNA, 22 nt, Human
aguccucuggcuagaggcccag

SEQ ID NO: 44520 - RNA, 20 nt, Human
auaagauuuuaacugccaac

SEQ ID NO: 44521 - RNA, 22 nt, Human
caggauggaaaccagcuccuac

SEQ ID NO: 44522 - RNA, 18 nt, Human
ccccgggcagcagcgccg

SEQ ID NO: 44523 - RNA, 18 nt, Human
cgugacuacugcauugca

SEQ ID NO: 44524 - RNA, 19 nt, Human
cugaagccgggagccaguc

SEQ ID NO: 44525 - RNA, 22 nt, Human
gacccaacaccuccagcucucg

SEQ ID NO: 44526 - RNA, 19 nt, Human
gauggaaaccagcuccuac

SEQ ID NO: 44527 - RNA, 20 nt, Human
ggcuggaggugugugccgug

SEQ ID NO: 44528 - RNA, 24 nt, Human
gggcagcagcgccgggcucgaggc

SEQ ID NO: 44529 - RNA, 23 nt, Human
gggccgaggcugagcguuuugga

SEQ ID NO: 44530 - RNA, 18 nt, Human
ggggggccgaggcugagc

SEQ ID NO: 44531 - RNA, 25 nt, Human
uaaaacaugcuuuggucaguaaauu

SEQ ID NO: 44532 - RNA, 27 nt, Human
uaaaauaauauuuuauacuccugugca

SEQ ID NO: 44533 - RNA, 22 nt, Human
uaacaauaccugacuacauggu

SEQ ID NO: 44534 - RNA, 24 nt, Human
uaacaauaccugacuacaugguua

SEQ ID NO: 44535 - RNA, 18 nt, Human
uaacacagauucauuugu

SEQ ID NO: 44536 - RNA, 23 nt, Human
uaaguaaacuuuaaauacauuga

SEQ ID NO: 44537 - RNA, 22 nt, Human
uacugcauugcagcuuaaaaca

SEQ ID NO: 44538 - RNA, 18 nt, Human
uagaauguccaguagcau

SEQ ID NO: 44539 - RNA, 20 nt, Human
uagucuauauucuuuucuca

SEQ ID NO: 44540 - RNA, 23 nt, Human
uaucauugcucuccgaauuaaaa

SEQ ID NO: 44541 - RNA, 22 nt, Human
ucaguagucuauauucuuuucu

SEQ ID NO: 44542 - RNA, 18 nt, Human
ucccagguccaaggcugu

SEQ ID NO: 44543 - RNA, 19 nt, Human
ucccagguccaaggcuguc

SEQ ID NO: 44544 - RNA, 21 nt, Human
ucccgacccaacaccuccagc

SEQ ID NO: 44545 - RNA, 23 nt, Human
uccgaauuaaaacuaaacuacaa

SEQ ID NO: 44546 - RNA, 19 nt, Human
ucuggcuagaggcccagag

SEQ ID NO: 44547 - RNA, 19 nt, Human
ugacaaggcaaaaaaaaaa

SEQ ID NO: 44548 - RNA, 24 nt, Human
ugacaaggcaaaaaaaaaauauga

SEQ ID NO: 44549 - RNA, 18 nt, Human
ugcacugauuaucauugc

SEQ ID NO: 44550 - RNA, 22 nt, Human
ugccaggauggaaaccagcucc

SEQ ID NO: 44551 - RNA, 18 nt, Human
ugcuagaauguccaguag

SEQ ID NO: 44552 - RNA, 23 nt, Human
uggcagggcucagagcgauaagg

SEQ ID NO: 44553 - RNA, 21 nt, Human
ugucagacuaguugugguuag

SEQ ID NO: 44554 - RNA, 20 nt, Human
uguggggggccgaggcugag

SEQ ID NO: 44555 - RNA, 23 nt, Human
uguggggggccgaggcugagcgu

SEQ ID NO: 44556 - RNA, 20 nt, Human
uguggucauaagaaaaauaa

SEQ ID NO: 44557 - RNA, 27 nt, Human
uuuagaauuuccugaccuuaaguaaac

SEQ ID NO: 44558 - RNA, 24 nt, Human
aaaaaccaaagcaaaccucagaac

SEQ ID NO: 44559 - RNA, 24 nt, Human
aaaacaaaacaaaucuccaucgga

SEQ ID NO: 44560 - RNA, 19 nt, Human
aaaagcauaaaaugaagca

SEQ ID NO: 44561 - RNA, 21 nt, Human
aaaaggggguuuuugggcagg

SEQ ID NO: 44562 - RNA, 22 nt, Human
aaacaaaacaaaucuccaucgg

SEQ ID NO: 44563 - RNA, 22 nt, Human
aaacauaaaagccccccuaccc

SEQ ID NO: 44564 - RNA, 21 nt, Human
aaaccaaagcaaaccucagaa

SEQ ID NO: 44565 - RNA, 28 nt, Human
aaaugccaaagaaaauggaaaaaccaaa

SEQ ID NO: 44566 - RNA, 20 nt, Human
aacacaggcgucccccaccc

SEQ ID NO: 44567 - RNA, 22 nt, Human
aagaaaauggaaaaaccaaagc

SEQ ID NO: 44568 - RNA, 23 nt, Human
aagcaaaccucagaacaucaaaa

SEQ ID NO: 44569 - RNA, 27 nt, Human
aagcaaaccucagaacaucaaaacuaa

SEQ ID NO: 44570 - RNA, 27 nt, Human
aagcauaaaaugaagcaaaagggaccc

SEQ ID NO: 44571 - RNA, 22 nt, Human
aaggcaagcaucgcgccagaug

SEQ ID NO: 44572 - RNA, 24 nt, Human
acaaaacaaaucuccaucggacaa

SEQ ID NO: 44573 - RNA, 21 nt, Human
acacaagaacugaauguagca

SEQ ID NO: 44574 - RNA, 19 nt, Human
acagggagagaagaacgac

SEQ ID NO: 44575 - RNA, 22 nt, Human
acagggagagaagaacgacaug

SEQ ID NO: 44576 - RNA, 23 nt, Human
agagaacgcaaggcaagcaucgc

SEQ ID NO: 44577 - RNA, 22 nt, Human
agcuugcuguuccuuguccugg

SEQ ID NO: 44578 - RNA, 20 nt, Human
aggcgucccccacccgcugg

SEQ ID NO: 44579 - RNA, 24 nt, Human
agguuggcgcgggucaccuuuggc

SEQ ID NO: 44580 - RNA, 19 nt, Human
aguguggacacuggaaacc

SEQ ID NO: 44581 - RNA, 20 nt, Human
auaaaaagaaucagacugua

SEQ ID NO: 44582 - RNA, 18 nt, Human
aucggacaaacauaaaag

SEQ ID NO: 44583 - RNA, 18 nt, Human
caaacauaaaagcccccc

SEQ ID NO: 44584 - RNA, 20 nt, Human
caccuuuggcgccgaagccc

SEQ ID NO: 44585 - RNA, 21 nt, Human
caccuuuggcgccgaagcccc

SEQ ID NO: 44586 - RNA, 24 nt, Human
cacggcggggcccaaggaugcguc

SEQ ID NO: 44587 - RNA, 19 nt, Human
cagagugugacucaucucu

SEQ ID NO: 44588 - RNA, 18 nt, Human
cagccgcacgcugacagg

SEQ ID NO: 44589 - RNA, 18 nt, Human
cagcuuggggaaaagggg

SEQ ID NO: 44590 - RNA, 23 nt, Human
cauaaaagccccccuaccccaga

SEQ ID NO: 44591 - RNA, 18 nt, Human
ccauucaaacucuagcuc

SEQ ID NO: 44592 - RNA, 18 nt, Human
cccaugggcagcuugggg

SEQ ID NO: 44593 - RNA, 18 nt, Human
ccccaugggcagcuuggg

SEQ ID NO: 44594 - RNA, 21 nt, Human
ccccccuaccccagauaaaaa

SEQ ID NO: 44595 - RNA, 19 nt, Human
ccccuaccccagauaaaaa

SEQ ID NO: 44596 - RNA, 18 nt, Human
cgccgaagccccaugggc

SEQ ID NO: 44597 - RNA, 20 nt, Human
cgccgaagccccaugggcag

SEQ ID NO: 44598 - RNA, 21 nt, Human
cggagcgaggucuaggcagcu

SEQ ID NO: 44599 - RNA, 19 nt, Human
cuggucccacugcacggca

SEQ ID NO: 44600 - RNA, 30 nt, Human
gacaugggcaccaugggugaacacaggcgu

SEQ ID NO: 44601 - RNA, 20 nt, Human
gaccuggaaucuggucccac

SEQ ID NO: 44602 - RNA, 22 nt, Human
gcaaaccucagaacaucaaaac

SEQ ID NO: 44603 - RNA, 19 nt, Human
gcagcuuggggaaaagggg

SEQ ID NO: 44604 - RNA, 20 nt, Human
gcagcuuggggaaaaggggg

SEQ ID NO: 44605 - RNA, 23 nt, Human
gccagaugcugugaguuuauccu

SEQ ID NO: 44606 - RNA, 20 nt, Human
gcugugaguuuauccugaga

SEQ ID NO: 44607 - RNA, 25 nt, Human
ggagggagugcugggugacucgagg

SEQ ID NO: 44608 - RNA, 22 nt, Human
ggagugcugggugacucgaggg

SEQ ID NO: 44609 - RNA, 20 nt, Human
ggagugucauguacaagaca

SEQ ID NO: 44610 - RNA, 19 nt, Human
gggaaaaggggguuuuugg

SEQ ID NO: 44611 - RNA, 20 nt, Human
ggguuuuugggcagguuaag

SEQ ID NO: 44612 - RNA, 21 nt, Human
guuccuuguccugggucuugg

SEQ ID NO: 44613 - RNA, 22 nt, Human
uaaaaaagcauaaaaugaagca

SEQ ID NO: 44614 - RNA, 21 nt, Human
uaaauaaaugccaaagaaaau

SEQ ID NO: 44615 - RNA, 18 nt, Human
uaagagggacgcacggcg

SEQ ID NO: 44616 - RNA, 22 nt, Human
uacaagacagacguggaggugg

SEQ ID NO: 44617 - RNA, 18 nt, Human
ucccaguccucgggcucu

SEQ ID NO: 44618 - RNA, 24 nt, Human
uccucgggcucugcuuaaaccuug

SEQ ID NO: 44619 - RNA, 20 nt, Human
ucgggcucugcuuaaaccuu

SEQ ID NO: 44620 - RNA, 21 nt, Human
ugaacacaggcgucccccacc

SEQ ID NO: 44621 - RNA, 18 nt, Human
ugaagcaaaacaaaacaa

SEQ ID NO: 44622 - RNA, 20 nt, Human
ugcaggugcuuuauacaucu

SEQ ID NO: 44623 - RNA, 24 nt, Human
ugcuuuauacaucuggcagugaga

SEQ ID NO: 44624 - RNA, 19 nt, Human
ugggccucaaggucuguuu

SEQ ID NO: 44625 - RNA, 20 nt, Human
uguacaagacagacguggag

SEQ ID NO: 44626 - RNA, 24 nt, Human
ugugacucaucucuccuaagaggg

SEQ ID NO: 44627 - RNA, 18 nt, Human
uguuggacguggccggag

SEQ ID NO: 44628 - RNA, 22 nt, Human
uguuuggagggagugcugggug

SEQ ID NO: 44629 - RNA, 18 nt, Human
uuggcgccgaagccccau

SEQ ID NO: 44630 - RNA, 23 nt, Human
uuuuuuuuuuuuuuuuccacaag

SEQ ID NO: 44631 - RNA, 24 nt, Human
aaagauccuacagccuuacucucc

SEQ ID NO: 44632 - RNA, 25 nt, Human
aacucuuuauacaggcgaaggcauu

SEQ ID NO: 44633 - RNA, 21 nt, Human
aagacuccuuccuuaccacag

SEQ ID NO: 44634 - RNA, 21 nt, Human
aagccggcagccggcggcggg

SEQ ID NO: 44635 - RNA, 20 nt, Human
aauguaaaaagaaugggaua

SEQ ID NO: 44636 - RNA, 20 nt, Human
aauuuauggacguggcccuc

SEQ ID NO: 44637 - RNA, 22 nt, Human
acacagcuagggaaggaaggcc

SEQ ID NO: 44638 - RNA, 22 nt, Human
acaguacagacaccaggggaga

SEQ ID NO: 44639 - RNA, 22 nt, Human
acagugcaaagguuacaaugcg

SEQ ID NO: 44640 - RNA, 21 nt, Human
acccaguuuauuagaccagag

SEQ ID NO: 44641 - RNA, 20 nt, Human
accuccauccccuggguggg

SEQ ID NO: 44642 - RNA, 21 nt, Human
agaaagaggcagagcuuguga

SEQ ID NO: 44643 - RNA, 21 nt, Human
agaccaagacacagcuaggga

SEQ ID NO: 44644 - RNA, 24 nt, Human
agagcccugcagggagcgccccgc

SEQ ID NO: 44645 - RNA, 21 nt, Human
agaggcagagagaggacucua

SEQ ID NO: 44646 - RNA, 22 nt, Human
agaggcagagagaggacucuau

SEQ ID NO: 44647 - RNA, 22 nt, Human
agaggcaugcgucacccagagc

SEQ ID NO: 44648 - RNA, 24 nt, Human
agaggcaugcgucacccagagccc

SEQ ID NO: 44649 - RNA, 26 nt, Human
agagggcaaugggauaggaggagcag

SEQ ID NO: 44650 - RNA, 22 nt, Human
agagggguuggggcucaggccu

SEQ ID NO: 44651 - RNA, 19 nt, Human
agaguuccauaagaaaauu

SEQ ID NO: 44652 - RNA, 22 nt, Human
agauuccaaagauccuacagcc

SEQ ID NO: 44653 - RNA, 20 nt, Human
agcuaggggaggcagcaugg

SEQ ID NO: 44654 - RNA, 23 nt, Human
agcugggggcccccucgcucucc

SEQ ID NO: 44655 - RNA, 20 nt, Human
aggcauucagagaccaggga

SEQ ID NO: 44656 - RNA, 18 nt, Human
aggccagaaagaggcaga

SEQ ID NO: 44657 - RNA, 20 nt, Human
aggggaugggguggagacag

SEQ ID NO: 44658 - RNA, 18 nt, Human
aggggcagccugaggucc

SEQ ID NO: 44659 - RNA, 20 nt, Human
aggggcucauggcccggggc

SEQ ID NO: 44660 - RNA, 18 nt, Human
agggggcugggcacccag

SEQ ID NO: 44661 - RNA, 21 nt, Human
agggugagacaacagcagagc

SEQ ID NO: 44662 - RNA, 21 nt, Human
aggugaggaaagggggcuggg

SEQ ID NO: 44663 - RNA, 18 nt, Human
aguacagacaccagggga

SEQ ID NO: 44664 - RNA, 22 nt, Human
auagcaauauagagucuguauc

SEQ ID NO: 44665 - RNA, 21 nt, Human
aucaggugaggaaagggggcu

SEQ ID NO: 44666 - RNA, 19 nt, Human
auggaggagagaggggcag

SEQ ID NO: 44667 - RNA, 18 nt, Human
augggauaggaggagcag

SEQ ID NO: 44668 - RNA, 19 nt, Human
caccaggggagagagucca

SEQ ID NO: 44669 - RNA, 18 nt, Human
cacccagagcccugccug

SEQ ID NO: 44670 - RNA, 24 nt, Human
cacccagagcccugccugcuguuc

SEQ ID NO: 44671 - RNA, 28 nt, Human
cagaccccagagaucccuuccaccccuu

SEQ ID NO: 44672 - RNA, 21 nt, Human
cagagaucccuuccaccccuc

SEQ ID NO: 44673 - RNA, 20 nt, Human
cagagcccugccugcuguuc

SEQ ID NO: 44674 - RNA, 23 nt, Human
cagcaucccacugccccaacuuc

SEQ ID NO: 44675 - RNA, 23 nt, Human
cagccggcggcggguccuggggc

SEQ ID NO: 44676 - RNA, 23 nt, Human
cagcuguggggugggggugaacu

SEQ ID NO: 44677 - RNA, 23 nt, Human
cagcuuccuuugucgccacugag

SEQ ID NO: 44678 - RNA, 21 nt, Human
caggagucgccaauccccagc

SEQ ID NO: 44679 - RNA, 22 nt, Human
caggagucgccaauccccagcu

SEQ ID NO: 44680 - RNA, 21 nt, Human
caggguagaccuccauccccu

SEQ ID NO: 44681 - RNA, 23 nt, Human
ccaaacccaccucaccagaaaau

SEQ ID NO: 44682 - RNA, 22 nt, Human
ccaagagauuccaaagauccua

SEQ ID NO: 44683 - RNA, 18 nt, Human
ccagaccccagagauccc

SEQ ID NO: 44684 - RNA, 23 nt, Human
ccaggccaaugcagcugcucaca

SEQ ID NO: 44685 - RNA, 19 nt, Human
ccagggccgcaucuugucc

SEQ ID NO: 44686 - RNA, 21 nt, Human
cccaaacccaccucaccagaa

SEQ ID NO: 44687 - RNA, 22 nt, Human
cccaaacccaccucaccagaaa

SEQ ID NO: 44688 - RNA, 22 nt, Human
cccagagaucccuuccaccccc

SEQ ID NO: 44689 - RNA, 25 nt, Human
cccagagaucccuuccaccccucac

SEQ ID NO: 44690 - RNA, 18 nt, Human
cccagggcagaugugagg

SEQ ID NO: 44691 - RNA, 19 nt, Human
ccccacacuagcccucccc

SEQ ID NO: 44692 - RNA, 22 nt, Human
ccccacacuagcccucccccuu

SEQ ID NO: 44693 - RNA, 20 nt, Human
ccccagagaucccuuccacc

SEQ ID NO: 44694 - RNA, 18 nt, Human
cccgcgcgcgcuggcucg

SEQ ID NO: 44695 - RNA, 18 nt, Human
cccggccccgcucggcuc

SEQ ID NO: 44696 - RNA, 23 nt, Human
ccggccccgcucggcuccgaucu

SEQ ID NO: 44697 - RNA, 26 nt, Human
ccucaccagaaaauaaaagugguggg

SEQ ID NO: 44698 - RNA, 20 nt, Human
ccucccaaacccaccucacc

SEQ ID NO: 44699 - RNA, 21 nt, Human
cgcggaggggcucauggcccg

SEQ ID NO: 44700 - RNA, 23 nt, Human
cuaguccuccccaucuaggccuu

SEQ ID NO: 44701 - RNA, 20 nt, Human
cuccaggccaaugcagcugc

SEQ ID NO: 44702 - RNA, 22 nt, Human
cuccauccccugggugggggcu

SEQ ID NO: 44703 - RNA, 21 nt, Human
cucccucccccacacuagccc

SEQ ID NO: 44704 - RNA, 21 nt, Human
cugaggaccucagcuucugcc

SEQ ID NO: 44705 - RNA, 24 nt, Human
cugggagcuaggggaggcagcaug

SEQ ID NO: 44706 - RNA, 18 nt, Human
cugguggagggagggggg

SEQ ID NO: 44707 - RNA, 18 nt, Human
cuguggggugggggugaa

SEQ ID NO: 44708 - RNA, 21 nt, Human
cuucaggagucgccaaucccc

SEQ ID NO: 44709 - RNA, 20 nt, Human
cuucugccugucagcauccc

SEQ ID NO: 44710 - RNA, 18 nt, Human
cuuggcuuaguguccagg

SEQ ID NO: 44711 - RNA, 20 nt, Human
cuuguccccauuaccacuuc

SEQ ID NO: 44712 - RNA, 21 nt, Human
cuuuccucccaaacccaccuc

SEQ ID NO: 44713 - RNA, 21 nt, Human
gaagagggguuggggcucagg

SEQ ID NO: 44714 - RNA, 21 nt, Human
gaaggcauucagagaccaggg

SEQ ID NO: 44715 - RNA, 24 nt, Human
gaaugggauagaggcagagagagg

SEQ ID NO: 44716 - RNA, 24 nt, Human
gagaucccuuccaccccucacugg

SEQ ID NO: 44717 - RNA, 18 nt, Human
gagcccgcggccgccgcg

SEQ ID NO: 44718 - RNA, 23 nt, Human
gauccuacagccuuacucuccag

SEQ ID NO: 44719 - RNA, 18 nt, Human
gccaauccccagcucccu

SEQ ID NO: 44720 - RNA, 22 nt, Human
gccuggaaggagugucuggugg

SEQ ID NO: 44721 - RNA, 20 nt, Human
ggaaggaaggccugaagagg

SEQ ID NO: 44722 - RNA, 24 nt, Human
ggaaggaaggccugaagagggguu

SEQ ID NO: 44723 - RNA, 21 nt, Human
ggacgcuaaccagccaggucu

SEQ ID NO: 44724 - RNA, 23 nt, Human
ggcccccucgcucuccuaguccu

SEQ ID NO: 44725 - RNA, 23 nt, Human
ggccuggaaggagugucuggugg

SEQ ID NO: 44726 - RNA, 21 nt, Human
gggaaggaaggccugaagagg

SEQ ID NO: 44727 - RNA, 18 nt, Human
gggagaaugguucucaga

SEQ ID NO: 44728 - RNA, 20 nt, Human
ggggaugggguggagacaga

SEQ ID NO: 44729 - RNA, 23 nt, Human
ggggcucaggccuggaaggagug

SEQ ID NO: 44730 - RNA, 23 nt, Human
gggguggagacagacagggcugg

SEQ ID NO: 44731 - RNA, 18 nt, Human
gguggaacuugggguggg

SEQ ID NO: 44732 - RNA, 19 nt, Human
gucugguggagggaggggg

SEQ ID NO: 44733 - RNA, 18 nt, Human
uaaaaguggugggcuugg

SEQ ID NO: 44734 - RNA, 18 nt, Human
uacagcaccagggccgca

SEQ ID NO: 44735 - RNA, 25 nt, Human
uagaagguggaacuuggggugggag

SEQ ID NO: 44736 - RNA, 23 nt, Human
uagaggcagagagaggacucuau

SEQ ID NO: 44737 - RNA, 18 nt, Human
uagauagacagaauucag

SEQ ID NO: 44738 - RNA, 19 nt, Human
ucaacuccuccucuaggcc

SEQ ID NO: 44739 - RNA, 24 nt, Human
ucagagaccagggagggaguagaa

SEQ ID NO: 44740 - RNA, 26 nt, Human
uccacauggugugagagaguggggcu

SEQ ID NO: 44741 - RNA, 23 nt, Human
ucccaaacccaccucaccagaaa

SEQ ID NO: 44742 - RNA, 22 nt, Human
uccgggagagggaccagugagg

SEQ ID NO: 44743 - RNA, 22 nt, Human
uccuggggcgcuggaccggugg

SEQ ID NO: 44744 - RNA, 21 nt, Human
ucucuacagcaaccccuuccc

SEQ ID NO: 44745 - RNA, 18 nt, Human
ugaaguuggggaagagga

SEQ ID NO: 44746 - RNA, 19 nt, Human
ugagacaacagcagagcuu

SEQ ID NO: 44747 - RNA, 22 nt, Human
ugagagaagcaaaugaaguugg

SEQ ID NO: 44748 - RNA, 20 nt, Human
ugaggaagggcugccucuug

SEQ ID NO: 44749 - RNA, 24 nt, Human
ugaggaggcagcugggggcccccu

SEQ ID NO: 44750 - RNA, 20 nt, Human
ugcccggguugggggagagg

SEQ ID NO: 44751 - RNA, 21 nt, Human
ugcccggguugggggagaggg

SEQ ID NO: 44752 - RNA, 19 nt, Human
uggaacuuggggugggaga

SEQ ID NO: 44753 - RNA, 18 nt, Human
uggaggagagaggggcag

SEQ ID NO: 44754 - RNA, 18 nt, Human
ugggaagggccuuuggug

SEQ ID NO: 44755 - RNA, 21 nt, Human
ugggagaaugguucucagaga

SEQ ID NO: 44756 - RNA, 18 nt, Human
ugggauagaggcagagag

SEQ ID NO: 44757 - RNA, 20 nt, Human
ugggauagaggcagagagag

SEQ ID NO: 44758 - RNA, 21 nt, Human
uggggaagccucccuccccca

SEQ ID NO: 44759 - RNA, 18 nt, Human
uggggagguaugaucucu

SEQ ID NO: 44760 - RNA, 22 nt, Human
uggggccaaauuccagacccca

SEQ ID NO: 44761 - RNA, 26 nt, Human
ugggggcccccucgcucugggacacc

SEQ ID NO: 44762 - RNA, 22 nt, Human
uggggugggagaaugguucuca

SEQ ID NO: 44763 - RNA, 21 nt, Human
uggggugggagaaugguucuu

SEQ ID NO: 44764 - RNA, 22 nt, Human
uggguaucaggugaggaaaggg

SEQ ID NO: 44765 - RNA, 21 nt, Human
ugggugggggcuaucucuaca

SEQ ID NO: 44766 - RNA, 24 nt, Human
uggguuuggggacagucacugggc

SEQ ID NO: 44767 - RNA, 21 nt, Human
ugguggagggagggggggcag

SEQ ID NO: 44768 - RNA, 24 nt, Human
ugguggagggagggggggcaggcc

SEQ ID NO: 44769 - RNA, 23 nt, Human
ugucagcaucccacugccccaac

SEQ ID NO: 44770 - RNA, 19 nt, Human
ugucagcugggcagagggc

SEQ ID NO: 44771 - RNA, 22 nt, Human
uuaaugggauggugaggaaggg

SEQ ID NO: 44772 - RNA, 20 nt, Human
uuccagaccccagagauccc

SEQ ID NO: 44773 - RNA, 18 nt, Human
uucccuggggaugccacu

SEQ ID NO: 44774 - RNA, 25 nt, Human
uuggggaagaggaugugggagaguu

SEQ ID NO: 44775 - RNA, 19 nt, Human
uuuuuugguugaaacccag

SEQ ID NO: 44776 - RNA, 21 nt, Human
cagcugcccaccaguguuccc

SEQ ID NO: 44777 - RNA, 21 nt, Human
caucccagucucuggugggag

SEQ ID NO: 44778 - RNA, 20 nt, Human
ccaccaguguucccauccca

SEQ ID NO: 44779 - RNA, 23 nt, Human
cccaucccagucucuggugggag

SEQ ID NO: 44780 - RNA, 23 nt, Human
cuggugggaggcccuugggcagg

SEQ ID NO: 44781 - RNA, 20 nt, Human
gggaggcccuugggcagggc

SEQ ID NO: 44782 - RNA, 18 nt, Human
uguucccaucccagucuc

SEQ ID NO: 44783 - RNA, 23 nt, Human
aaacagaacagaagucaaaucca

SEQ ID NO: 44784 - RNA, 24 nt, Human
aaacagaacagaagucaaauccag

SEQ ID NO: 44785 - RNA, 22 nt, Human
aaauaaauacugaaagcaaugu

SEQ ID NO: 44786 - RNA, 19 nt, Human
aaauacugaaagcaauguc

SEQ ID NO: 44787 - RNA, 22 nt, Human
aagaaacagaacagaagucaaa

SEQ ID NO: 44788 - RNA, 21 nt, Human
aagaugcucucuccuuggcca

SEQ ID NO: 44789 - RNA, 19 nt, Human
aauccuuauuaagaaacag

SEQ ID NO: 44790 - RNA, 23 nt, Human
aauccuuauuaagaaacagaaca

SEQ ID NO: 44791 - RNA, 22 nt, Human
acaauuuuuuuucugaacagag

SEQ ID NO: 44792 - RNA, 18 nt, Human
accuuggaagugaaaaag

SEQ ID NO: 44793 - RNA, 18 nt, Human
agaaauaaauacugaaag

SEQ ID NO: 44794 - RNA, 23 nt, Human
agacagaaauaaauacugaaagc

SEQ ID NO: 44795 - RNA, 21 nt, Human
aggcaugcucugggaguucac

SEQ ID NO: 44796 - RNA, 20 nt, Human
auccauccauauuccauaca

SEQ ID NO: 44797 - RNA, 21 nt, Human
augcaugccauucucaauccu

SEQ ID NO: 44798 - RNA, 19 nt, Human
caccucaagaggaaaaaca

SEQ ID NO: 44799 - RNA, 21 nt, Human
cacugugagcaaauacaaaag

SEQ ID NO: 44800 - RNA, 18 nt, Human
cagaaauaaauacugaaa

SEQ ID NO: 44801 - RNA, 19 nt, Human
caguagaaaugaguuucua

SEQ ID NO: 44802 - RNA, 23 nt, Human
cauacaagauccaacacuugcuc

SEQ ID NO: 44803 - RNA, 18 nt, Human
ccacugaaugacuuuccc

SEQ ID NO: 44804 - RNA, 18 nt, Human
ccugugagccaagaucac

SEQ ID NO: 44805 - RNA, 19 nt, Human
cucaagaggaaaaacauag

SEQ ID NO: 44806 - RNA, 20 nt, Human
cucagcacugcucaaacacu

SEQ ID NO: 44807 - RNA, 19 nt, Human
cuuucccuagacuaaaacc

SEQ ID NO: 44808 - RNA, 20 nt, Human
cuuugugcucagcacugcuc

SEQ ID NO: 44809 - RNA, 20 nt, Human
gaggccccuggcucuaguuu

SEQ ID NO: 44810 - RNA, 23 nt, Human
gugagaccaaauacacacuuucc

SEQ ID NO: 44811 - RNA, 21 nt, Human
guuagagaacaguagaaauga

SEQ ID NO: 44812 - RNA, 20 nt, Human
guugucuuuggacaauuuuu

SEQ ID NO: 44813 - RNA, 22 nt, Human
uaagaaacagaacagaagucaa

SEQ ID NO: 44814 - RNA, 21 nt, Human
uaauauacucuaauacaaaau

SEQ ID NO: 44815 - RNA, 25 nt, Human
uacaacaaaaucaccucaagaggaa

SEQ ID NO: 44816 - RNA, 28 nt, Human
uacaacaaaaucaccucaagaggaaaaa

SEQ ID NO: 44817 - RNA, 21 nt, Human
uacauacaacaaaaucaccuc

SEQ ID NO: 44818 - RNA, 21 nt, Human
ucacuguaggcaaaucaccau

SEQ ID NO: 44819 - RNA, 24 nt, Human
uccauccauauuccauacaagauc

SEQ ID NO: 44820 - RNA, 18 nt, Human
uccccugugagccaagau

SEQ ID NO: 44821 - RNA, 18 nt, Human
ucccuggauucuucucuc

SEQ ID NO: 44822 - RNA, 20 nt, Human
ucucuuuagaccugucaccu

SEQ ID NO: 44823 - RNA, 18 nt, Human
ugaaaaagcaauguccuc

SEQ ID NO: 44824 - RNA, 18 nt, Human
ugacaauggauuaaauga

SEQ ID NO: 44825 - RNA, 21 nt, Human
ugagugucugcuuugugcuca

SEQ ID NO: 44826 - RNA, 23 nt, Human
uggauucuucucucuuuagaccu

SEQ ID NO: 44827 - RNA, 22 nt, Human
uggcucuaguuuuguguuguca

SEQ ID NO: 44828 - RNA, 19 nt, Human
uuaacauuuacauacaaca

SEQ ID NO: 44829 - RNA, 23 nt, Human
uucccuaauauacucuaauacaa

SEQ ID NO: 44830 - RNA, 26 nt, Human
uuuagaccugucaccuugaagaaagc

SEQ ID NO: 44831 - RNA, 19 nt, Human
uuucaacuucagaaauuca

SEQ ID NO: 44832 - RNA, 24 nt, Human
aagaagagacagaaaugggggacc

SEQ ID NO: 44833 - RNA, 23 nt, Human
accggaagacgggaacagagggg

SEQ ID NO: 44834 - RNA, 18 nt, Human
agaggaccgggagccccg

SEQ ID NO: 44835 - RNA, 18 nt, Human
agaggaccgggagccccg

SEQ ID NO: 44836 - RNA, 19 nt, Human
aggaggaagggagcacuag

SEQ ID NO: 44837 - RNA, 25 nt, Human
aggaggaagggagcacuaggucuga

SEQ ID NO: 44838 - RNA, 20 nt, Human
aggcggcgucugaggcgggg

SEQ ID NO: 44839 - RNA, 20 nt, Human
aggggacaggagggggaggu

SEQ ID NO: 44840 - RNA, 26 nt, Human
aggggacaggagggggagguuggggg

SEQ ID NO: 44841 - RNA, 19 nt, Human
aguggucgaacugguucuu

SEQ ID NO: 44842 - RNA, 19 nt, Human
cagccugaagacaugccag

SEQ ID NO: 44843 - RNA, 19 nt, Human
cagccugaagacaugccag

SEQ ID NO: 44844 - RNA, 20 nt, Human
cccagcccugaaauaaauag

SEQ ID NO: 44845 - RNA, 20 nt, Human
cccagcccugaaauaaauag

SEQ ID NO: 44846 - RNA, 18 nt, Human
ccccgggggacgucgggg

SEQ ID NO: 44847 - RNA, 20 nt, Human
ccccgggggacgucgggggg

SEQ ID NO: 44848 - RNA, 21 nt, Human
ccccgggggacgucggggugg

SEQ ID NO: 44849 - RNA, 19 nt, Human
ccgggccgggccgggccgc

SEQ ID NO: 44850 - RNA, 20 nt, Human
ccgggccgggccgggccgcg

SEQ ID NO: 44851 - RNA, 23 nt, Human
ccuguggccguaggggaagaggc

SEQ ID NO: 44852 - RNA, 19 nt, Human
cggccagggcgcccagcga

SEQ ID NO: 44853 - RNA, 18 nt, Human
cggcccccuccuccugcc

SEQ ID NO: 44854 - RNA, 18 nt, Human
cgggaggggaggacggca

SEQ ID NO: 44855 - RNA, 20 nt, Human
cuccagcgguggaacucggc

SEQ ID NO: 44856 - RNA, 22 nt, Human
cuccugcccuguccagugugag

SEQ ID NO: 44857 - RNA, 21 nt, Human
gaacucggccuuccacuggcg

SEQ ID NO: 44858 - RNA, 23 nt, Human
gacgggaacagaggggacaggag

SEQ ID NO: 44859 - RNA, 19 nt, Human
gaggcacggcccccuccuc

SEQ ID NO: 44860 - RNA, 23 nt, Human
gcagccagagggcgaaggcacgc

SEQ ID NO: 44861 - RNA, 18 nt, Human
gccccgggggacgucggg

SEQ ID NO: 44862 - RNA, 18 nt, Human
gccccgggggacgucggg

SEQ ID NO: 44863 - RNA, 19 nt, Human
gccccgggggacgucgggg

SEQ ID NO: 44864 - RNA, 20 nt, Human
gccgggcggagcggaggaca

SEQ ID NO: 44865 - RNA, 20 nt, Human
gccgggcggagcggaggaca

SEQ ID NO: 44866 - RNA, 21 nt, Human
gcggagcggaggacauggggg

SEQ ID NO: 44867 - RNA, 21 nt, Human
gcggagcggaggacauggggg

SEQ ID NO: 44868 - RNA, 18 nt, Human
ggaacagaggggacagga

SEQ ID NO: 44869 - RNA, 19 nt, Human
ggaccgggagccccggggg

SEQ ID NO: 44870 - RNA, 19 nt, Human
ggaccgggagccccggggg

SEQ ID NO: 44871 - RNA, 24 nt, Human
ggagagaggaggagaaaagaauga

SEQ ID NO: 44872 - RNA, 19 nt, Human
ggagggggagguuggggga

SEQ ID NO: 44873 - RNA, 19 nt, Human
ggccgggccgggccgcgcc

SEQ ID NO: 44874 - RNA, 21 nt, Human
ggccgggcggagcggaggaca

SEQ ID NO: 44875 - RNA, 21 nt, Human
ggccgggcggagcggaggaca

SEQ ID NO: 44876 - RNA, 21 nt, Human
gggaaaaagaagagacagaaa

SEQ ID NO: 44877 - RNA, 20 nt, Human
gggaggaugagggcagaggc

SEQ ID NO: 44878 - RNA, 24 nt, Human
gggcaggcggcgucugaggcggcc

SEQ ID NO: 44879 - RNA, 21 nt, Human
gggccgggccgggccgcgccg

SEQ ID NO: 44880 - RNA, 24 nt, Human
gggccgggccgggccgcgccggga

SEQ ID NO: 44881 - RNA, 19 nt, Human
gggccgggcggagcggagg

SEQ ID NO: 44882 - RNA, 19 nt, Human
gggccgggcggagcggagg

SEQ ID NO: 44883 - RNA, 22 nt, Human
ggggacaggagggggagguugg

SEQ ID NO: 44884 - RNA, 20 nt, Human
ggggguuucagugcagggag

SEQ ID NO: 44885 - RNA, 19 nt, Human
ggguggggaugggcagagu

SEQ ID NO: 44886 - RNA, 19 nt, Human
ggguggggaugggcagagu

SEQ ID NO: 44887 - RNA, 18 nt, Human
gggugggguggggauggg

SEQ ID NO: 44888 - RNA, 18 nt, Human
gggugggguggggauggg

SEQ ID NO: 44889 - RNA, 24 nt, Human
gguugggggaaaaagaagagacag

SEQ ID NO: 44890 - RNA, 21 nt, Human
guccggggccucccacuuccc

SEQ ID NO: 44891 - RNA, 22 nt, Human
ucccacuuccccccaaugucag

SEQ ID NO: 44892 - RNA, 18 nt, Human
ucccugagaaggguggga

SEQ ID NO: 44893 - RNA, 26 nt, Human
ucugcggccagggcgcccagcgaggc

SEQ ID NO: 44894 - RNA, 18 nt, Human
ugagaagggugggaggca

SEQ ID NO: 44895 - RNA, 19 nt, Human
ugagggcagaggcggggcc

SEQ ID NO: 44896 - RNA, 18 nt, Human
ugcagggaggacgcacgg

SEQ ID NO: 44897 - RNA, 19 nt, Human
ugcuguaguggucgaacug

SEQ ID NO: 44898 - RNA, 18 nt, Human
uggaacucggccuuccac

SEQ ID NO: 44899 - RNA, 23 nt, Human
uggggcccuuccccacgguccga

SEQ ID NO: 44900 - RNA, 23 nt, Human
ugggguggggaugggcagagucu

SEQ ID NO: 44901 - RNA, 23 nt, Human
ugggguggggaugggcagagucu

SEQ ID NO: 44902 - RNA, 20 nt, Human
uguuauagcccagcccugaa

SEQ ID NO: 44903 - RNA, 20 nt, Human
uguuauagcccagcccugaa

SEQ ID NO: 44904 - RNA, 18 nt, Human
uuccccccaaugucaggc

SEQ ID NO: 44905 - RNA, 25 nt, Human
uugcagccagagggcgaaggcacgc

SEQ ID NO: 44906 - RNA, 18 nt, Human
uuugggcggguugaaggg

SEQ ID NO: 44907 - RNA, 22 nt, Human
aaggcccaguccuaggaggucc

SEQ ID NO: 44908 - RNA, 23 nt, Human
acacagcuucagcgacgcccagg

SEQ ID NO: 44909 - RNA, 25 nt, Human
acccagagccugcuggggcggcccu

SEQ ID NO: 44910 - RNA, 19 nt, Human
agcacugauguccuccagg

SEQ ID NO: 44911 - RNA, 21 nt, Human
agccugucuucacccggcccc

SEQ ID NO: 44912 - RNA, 18 nt, Human
aggcaggcccucuggcuc

SEQ ID NO: 44913 - RNA, 19 nt, Human
aggcaguggcucccagagc

SEQ ID NO: 44914 - RNA, 22 nt, Human
aggcaguggcucccagagcuca

SEQ ID NO: 44915 - RNA, 24 nt, Human
aggcgccccucccccgccagcccg

SEQ ID NO: 44916 - RNA, 21 nt, Human
agguucccgccggccgcggcc

SEQ ID NO: 44917 - RNA, 18 nt, Human
caccccagcugcugccag

SEQ ID NO: 44918 - RNA, 22 nt, Human
caccccagcugcugccaggggc

SEQ ID NO: 44919 - RNA, 23 nt, Human
caccuccuccuccgccaccacgg

SEQ ID NO: 44920 - RNA, 19 nt, Human
caccuccuccuccgccggc

SEQ ID NO: 44921 - RNA, 22 nt, Human
caccugucccuccugcaccccg

SEQ ID NO: 44922 - RNA, 21 nt, Human
cagccaagucccauucaaguc

SEQ ID NO: 44923 - RNA, 22 nt, Human
cagcccgcaccaccugucccuc

SEQ ID NO: 44924 - RNA, 21 nt, Human
cagcggguccuccaggacugg

SEQ ID NO: 44925 - RNA, 20 nt, Human
cagcguuccccgcacucuuc

SEQ ID NO: 44926 - RNA, 19 nt, Human
cagcucggggcggcuucgg

SEQ ID NO: 44927 - RNA, 20 nt, Human
caggcaguggcucccagagc

SEQ ID NO: 44928 - RNA, 27 nt, Human
caggccccgcccaggaccagggccaga

SEQ ID NO: 44929 - RNA, 21 nt, Human
caggcgccccucccccgccag

SEQ ID NO: 44930 - RNA, 24 nt, Human
caggcgccccucccccgccagccc

SEQ ID NO: 44931 - RNA, 24 nt, Human
caggcuggugggaaaacauggaac

SEQ ID NO: 44932 - RNA, 20 nt, Human
cagggccagaggcaggucau

SEQ ID NO: 44933 - RNA, 22 nt, Human
cagguagguuuccugacagccc

SEQ ID NO: 44934 - RNA, 19 nt, Human
ccacugccgcucccccagu

SEQ ID NO: 44935 - RNA, 23 nt, Human
ccagagcucagcguuccccgcac

SEQ ID NO: 44936 - RNA, 19 nt, Human
cccacaggccccgcccagg

SEQ ID NO: 44937 - RNA, 19 nt, Human
cccacaggccccgcccagg

SEQ ID NO: 44938 - RNA, 22 nt, Human
cccacaggccccgcccaggacc

SEQ ID NO: 44939 - RNA, 20 nt, Human
cccaccggccgggacccucc

SEQ ID NO: 44940 - RNA, 22 nt, Human
cccagccucccgcagccuuggc

SEQ ID NO: 44941 - RNA, 21 nt, Human
cccaggaccagggccagaggc

SEQ ID NO: 44942 - RNA, 22 nt, Human
ccccaccggccgggacccuccc

SEQ ID NO: 44943 - RNA, 25 nt, Human
ccccaccggccgggacccuccccaa

SEQ ID NO: 44944 - RNA, 18 nt, Human
ccccaggcgccccucccc

SEQ ID NO: 44945 - RNA, 20 nt, Human
ccccaugccccuacauccug

SEQ ID NO: 44946 - RNA, 24 nt, Human
ccccaugccccuacauccugcguc

SEQ ID NO: 44947 - RNA, 20 nt, Human
cccccaggcgccccuccccc

SEQ ID NO: 44948 - RNA, 22 nt, Human
cccccaggcgccccucccccgc

SEQ ID NO: 44949 - RNA, 25 nt, Human
cccccaggcgccccucccccgccag

SEQ ID NO: 44950 - RNA, 19 nt, Human
cccccgccagcccggcccc

SEQ ID NO: 44951 - RNA, 18 nt, Human
cccccuggaagaaggccc

SEQ ID NO: 44952 - RNA, 18 nt, Human
ccccgccagcccggcccc

SEQ ID NO: 44953 - RNA, 21 nt, Human
ccccgccagcccggccccacc

SEQ ID NO: 44954 - RNA, 18 nt, Human
ccccggagguaccguggg

SEQ ID NO: 44955 - RNA, 19 nt, Human
ccccggagguaccgugggg

SEQ ID NO: 44956 - RNA, 24 nt, Human
ccccgggagcagcaggagcagcgg

SEQ ID NO: 44957 - RNA, 22 nt, Human
ccccgggcagccaauucgccuc

SEQ ID NO: 44958 - RNA, 24 nt, Human
ccccuacauccugcguccccuuca

SEQ ID NO: 44959 - RNA, 18 nt, Human
ccccucccccgccagccc

SEQ ID NO: 44960 - RNA, 22 nt, Human
ccccuggaagaaggcccagucc

SEQ ID NO: 44961 - RNA, 23 nt, Human
ccccuggaagaaggcccaguccu

SEQ ID NO: 44962 - RNA, 20 nt, Human
cccgcaccaccugucccucc

SEQ ID NO: 44963 - RNA, 20 nt, Human
cccgccugcccagguccagc

SEQ ID NO: 44964 - RNA, 19 nt, Human
cccggccccuuccacaucu

SEQ ID NO: 44965 - RNA, 20 nt, Human
cccucaagccugucuucacc

SEQ ID NO: 44966 - RNA, 20 nt, Human
cccucaggcaguggcuccca

SEQ ID NO: 44967 - RNA, 20 nt, Human
cccucgccgggucccucucc

SEQ ID NO: 44968 - RNA, 21 nt, Human
cccucuggcucuccagacgca

SEQ ID NO: 44969 - RNA, 18 nt, Human
ccgcagccuuggccuugc

SEQ ID NO: 44970 - RNA, 19 nt, Human
ccgccugcccagguccagc

SEQ ID NO: 44971 - RNA, 22 nt, Human
ccggccgggacccuccccacca

SEQ ID NO: 44972 - RNA, 18 nt, Human
ccgguucgggcugcugca

SEQ ID NO: 44973 - RNA, 24 nt, Human
ccuccaggggcugccccuuggucu

SEQ ID NO: 44974 - RNA, 19 nt, Human
ccucccagccucugccgcc

SEQ ID NO: 44975 - RNA, 20 nt, Human
ccucccgcccgacgcucucc

SEQ ID NO: 44976 - RNA, 23 nt, Human
ccucgccgggucccucucccucc

SEQ ID NO: 44977 - RNA, 22 nt, Human
ccucugccgccuuccgcugccu

SEQ ID NO: 44978 - RNA, 18 nt, Human
ccuggccuugggcccugg

SEQ ID NO: 44979 - RNA, 19 nt, Human
ccuuccgcugccuccccgc

SEQ ID NO: 44980 - RNA, 23 nt, Human
cgcccaggaccagggccagaggc

SEQ ID NO: 44981 - RNA, 21 nt, Human
cgccccucccccgccagcccg

SEQ ID NO: 44982 - RNA, 21 nt, Human
cgccuccggguccugagcccu

SEQ ID NO: 44983 - RNA, 21 nt, Human
cggaacuuuccggccccuccc

SEQ ID NO: 44984 - RNA, 23 nt, Human
cgggcagccaauucgccucuugc

SEQ ID NO: 44985 - RNA, 21 nt, Human
cgggucccucucccuccuggg

SEQ ID NO: 44986 - RNA, 21 nt, Human
cgguucgggcugcugcagcag

SEQ ID NO: 44987 - RNA, 25 nt, Human
cuccaggggcugccccuuggucucc

SEQ ID NO: 44988 - RNA, 20 nt, Human
cucccaggaccaccgccucc

SEQ ID NO: 44989 - RNA, 24 nt, Human
cucccaggaccaccgccucccgcc

SEQ ID NO: 44990 - RNA, 18 nt, Human
cucccgcccgacgcucuc

SEQ ID NO: 44991 - RNA, 18 nt, Human
cuccggguccugagcccu

SEQ ID NO: 44992 - RNA, 20 nt, Human
cucgccgggucccucucccu

SEQ ID NO: 44993 - RNA, 18 nt, Human
cucgcgggggccuucccc

SEQ ID NO: 44994 - RNA, 20 nt, Human
cucucccuccuggggcuccu

SEQ ID NO: 44995 - RNA, 19 nt, Human
cucugccgccuuccgcugc

SEQ ID NO: 44996 - RNA, 23 nt, Human
cugcagcagccuccgcgggcucc

SEQ ID NO: 44997 - RNA, 18 nt, Human
cugccgccuuccgcugcc

SEQ ID NO: 44998 - RNA, 18 nt, Human
cugccgccuuccgcugcc

SEQ ID NO: 44999 - RNA, 21 nt, Human
cuggggcuccuucccguucag

SEQ ID NO: 45000 - RNA, 18 nt, Human
cugucccuccugcacccc

SEQ ID NO: 45001 - RNA, 20 nt, Human
cugucccuccugcaccccgg

SEQ ID NO: 45002 - RNA, 23 nt, Human
cuuggucuccuuccagcccuggc

SEQ ID NO: 45003 - RNA, 24 nt, Human
gagcagcaacuucgcccaacaggg

SEQ ID NO: 45004 - RNA, 18 nt, Human
gagcagcaggagcagcgg

SEQ ID NO: 45005 - RNA, 20 nt, Human
gagcagcggguccuccagga

SEQ ID NO: 45006 - RNA, 24 nt, Human
gagcagcggguccuccaggacugg

SEQ ID NO: 45007 - RNA, 23 nt, Human
gagguaccguggggcccgggccu

SEQ ID NO: 45008 - RNA, 19 nt, Human
gcagggcagggcucccagc

SEQ ID NO: 45009 - RNA, 19 nt, Human
gccacaagucacauucugc

SEQ ID NO: 45010 - RNA, 20 nt, Human
gccagcccggccccaccggc

SEQ ID NO: 45011 - RNA, 24 nt, Human
gccccuuggucuccuuccagcccu

SEQ ID NO: 45012 - RNA, 22 nt, Human
gcccgacaccccagcugcugcc

SEQ ID NO: 45013 - RNA, 23 nt, Human
gcccuggccuugggcccuggucc

SEQ ID NO: 45014 - RNA, 20 nt, Human
gccuuggccuugcuccaucc

SEQ ID NO: 45015 - RNA, 21 nt, Human
gccuuggccuugcuccaucuu

SEQ ID NO: 45016 - RNA, 24 nt, Human
gcgggagggaugggcagggcaggg

SEQ ID NO: 45017 - RNA, 21 nt, Human
gcuuccugagccaccucaggc

SEQ ID NO: 45018 - RNA, 23 nt, Human
ggaccagggccagaggcagguca

SEQ ID NO: 45019 - RNA, 22 nt, Human
ggaugggggcaucuccccacuc

SEQ ID NO: 45020 - RNA, 18 nt, Human
ggcagggcucccagccuc

SEQ ID NO: 45021 - RNA, 18 nt, Human
ggccuggggguacuacuc

SEQ ID NO: 45022 - RNA, 22 nt, Human
gggaauuggguggaagaggaag

SEQ ID NO: 45023 - RNA, 18 nt, Human
ggggaauuggguggaaga

SEQ ID NO: 45024 - RNA, 22 nt, Human
ggggcccgggccugccagucac

SEQ ID NO: 45025 - RNA, 24 nt, Human
ggguacuacuccacccacaggccc

SEQ ID NO: 45026 - RNA, 20 nt, Human
guaccguggggcccgggccu

SEQ ID NO: 45027 - RNA, 23 nt, Human
gucccucucccuccuggggcucc

SEQ ID NO: 45028 - RNA, 20 nt, Human
ucaccaccuccuccuccgcc

SEQ ID NO: 45029 - RNA, 22 nt, Human
ucagguagguuuccugacagcc

SEQ ID NO: 45030 - RNA, 22 nt, Human
uccaggggcugccccuuggucu

SEQ ID NO: 45031 - RNA, 18 nt, Human
uccaugguaaggccacaa

SEQ ID NO: 45032 - RNA, 18 nt, Human
ucccacugccgcuccccc

SEQ ID NO: 45033 - RNA, 24 nt, Human
ucccagagcucagcguuccccgca

SEQ ID NO: 45034 - RNA, 21 nt, Human
ucccagucugucacccagggc

SEQ ID NO: 45035 - RNA, 22 nt, Human
ucccagucugucacccagggca

SEQ ID NO: 45036 - RNA, 22 nt, Human
uccccaugccccuacauccugc

SEQ ID NO: 45037 - RNA, 25 nt, Human
ucccuguggccaacacaucccgccu

SEQ ID NO: 45038 - RNA, 24 nt, Human
uccgccggcgccuccggguccuga

SEQ ID NO: 45039 - RNA, 19 nt, Human
uccugcaccccgggcagcc

SEQ ID NO: 45040 - RNA, 18 nt, Human
uccugcguccccuucagc

SEQ ID NO: 45041 - RNA, 21 nt, Human
uccuucaggcaggcccucugg

SEQ ID NO: 45042 - RNA, 21 nt, Human
ucgccucuugcacccccaggc

SEQ ID NO: 45043 - RNA, 22 nt, Human
ucgggcugcugcagcagccucc

SEQ ID NO: 45044 - RNA, 23 nt, Human
ucucccacugccgcucccccagu

SEQ ID NO: 45045 - RNA, 21 nt, Human
ucugcccgacaccccagcugc

SEQ ID NO: 45046 - RNA, 21 nt, Human
ucuugcacccccaggcgcccc

SEQ ID NO: 45047 - RNA, 23 nt, Human
ugauguccuccaggggcugcccc

SEQ ID NO: 45048 - RNA, 20 nt, Human
ugcagggacagcacuggugc

SEQ ID NO: 45049 - RNA, 18 nt, Human
ugcgggagggaugggcag

SEQ ID NO: 45050 - RNA, 22 nt, Human
uggaagaagcaggacugaaugg

SEQ ID NO: 45051 - RNA, 19 nt, Human
uggacggacaggcucaggu

SEQ ID NO: 45052 - RNA, 24 nt, Human
uggcucccagagcucagcguuccc

SEQ ID NO: 45053 - RNA, 20 nt, Human
ugggcccugguccccgccag

SEQ ID NO: 45054 - RNA, 21 nt, Human
uguccuccaggggcugccccu

SEQ ID NO: 45055 - RNA, 22 nt, Human
ugucuucacccggccccuucca

SEQ ID NO: 45056 - RNA, 20 nt, Human
uguggccaacacaucccgcc

SEQ ID NO: 45057 - RNA, 18 nt, Human
uuuccugacagcccgcac

SEQ ID NO: 45058 - RNA, 18 nt, Human
aaccccauacuccuuccc

SEQ ID NO: 45059 - RNA, 18 nt, Human
aaccccgcaaaauccgga

SEQ ID NO: 45060 - RNA, 23 nt, Human
aagaaagcaacauccuaacgccc

SEQ ID NO: 45061 - RNA, 22 nt, Human
aagcccuuaacacguaacauac

SEQ ID NO: 45062 - RNA, 21 nt, Human
aagggaaguaaaaaaaaaaaa

SEQ ID NO: 45063 - RNA, 21 nt, Human
aaugaaccccauacuccuucc

SEQ ID NO: 45064 - RNA, 21 nt, Human
acacuucaguuacagacagac

SEQ ID NO: 45065 - RNA, 19 nt, Human
accccauacuccuucccag

SEQ ID NO: 45066 - RNA, 21 nt, Human
accccauacuccuucccagca

SEQ ID NO: 45067 - RNA, 18 nt, Human
acugcaguaggguuccug

SEQ ID NO: 45068 - RNA, 22 nt, Human
agcagguagcagagcaaaguca

SEQ ID NO: 45069 - RNA, 27 nt, Human
aggaagaagaaagggaaguaaaaaaaa

SEQ ID NO: 45070 - RNA, 19 nt, Human
auaagacacaagacauuuc

SEQ ID NO: 45071 - RNA, 18 nt, Human
auauucaucagcuuccuc

SEQ ID NO: 45072 - RNA, 18 nt, Human
aucuuguucacaaacucc

SEQ ID NO: 45073 - RNA, 21 nt, Human
caagauaguguccaaugaacc

SEQ ID NO: 45074 - RNA, 23 nt, Human
caagauaguguccaaugaacccc

SEQ ID NO: 45075 - RNA, 22 nt, Human
caagcccuuaacacguaacaua

SEQ ID NO: 45076 - RNA, 18 nt, Human
cacagaacauuucagugg

SEQ ID NO: 45077 - RNA, 20 nt, Human
cacagaacauuucaguggga

SEQ ID NO: 45078 - RNA, 21 nt, Human
cacucggugaccaaugcccau

SEQ ID NO: 45079 - RNA, 20 nt, Human
cagacaaaucagcugcauaa

SEQ ID NO: 45080 - RNA, 21 nt, Human
cagacaaaucagcugcauaaa

SEQ ID NO: 45081 - RNA, 22 nt, Human
cagcacaaagaugccauugagg

SEQ ID NO: 45082 - RNA, 22 nt, Human
cagcuuccucccgaguaaagga

SEQ ID NO: 45083 - RNA, 21 nt, Human
cauguuauauaaggaagaaga

SEQ ID NO: 45084 - RNA, 20 nt, Human
ccagcagccgguagcuuccc

SEQ ID NO: 45085 - RNA, 25 nt, Human
ccaucccccugacauaaacagacuc

SEQ ID NO: 45086 - RNA, 18 nt, Human
ccauugagggcuccaaug

SEQ ID NO: 45087 - RNA, 21 nt, Human
cccacaguuucuaagcauguc

SEQ ID NO: 45088 - RNA, 22 nt, Human
cccacggaugacgauacagccc

SEQ ID NO: 45089 - RNA, 20 nt, Human
ccccagcagccgguagcuuc

SEQ ID NO: 45090 - RNA, 18 nt, Human
ccccauacuccuucccag

SEQ ID NO: 45091 - RNA, 18 nt, Human
cccccugacauaaacaga

SEQ ID NO: 45092 - RNA, 24 nt, Human
cccccugacauaaacagacucugg

SEQ ID NO: 45093 - RNA, 23 nt, Human
ccccgcaaaauccggagcacccc

SEQ ID NO: 45094 - RNA, 26 nt, Human
cccgcaaaauccggagcaccccagca

SEQ ID NO: 45095 - RNA, 19 nt, Human
cgacuccgaugagaccauc

SEQ ID NO: 45096 - RNA, 22 nt, Human
cgacuccgaugagaccaucuac

SEQ ID NO: 45097 - RNA, 23 nt, Human
cgagcagaggaguggcagggaag

SEQ ID NO: 45098 - RNA, 26 nt, Human
cgaguaaaggacccacaguuucuaag

SEQ ID NO: 45099 - RNA, 21 nt, Human
cgguagcuucccgggauccgg

SEQ ID NO: 45100 - RNA, 19 nt, Human
cgugcgcggcgcuucuucc

SEQ ID NO: 45101 - RNA, 18 nt, Human
cuacaaaugcgacuccga

SEQ ID NO: 45102 - RNA, 24 nt, Human
cuauauaguuuauuuaaaccagac

SEQ ID NO: 45103 - RNA, 22 nt, Human
cugcuucagccucuucugauca

SEQ ID NO: 45104 - RNA, 19 nt, Human
cuucccuuccuucuucauc

SEQ ID NO: 45105 - RNA, 21 nt, Human
cuuuacauauuaaguuacuac

SEQ ID NO: 45106 - RNA, 18 nt, Human
cuuuguguggacugaagg

SEQ ID NO: 45107 - RNA, 20 nt, Human
gagaagagacugagguggca

SEQ ID NO: 45108 - RNA, 18 nt, Human
gagacugagguggcagcu

SEQ ID NO: 45109 - RNA, 18 nt, Human
gagcaaagucacaaauau

SEQ ID NO: 45110 - RNA, 21 nt, Human
gagcagaggaguggcagggaa

SEQ ID NO: 45111 - RNA, 22 nt, Human
gagguggcagcugcccagaauc

SEQ ID NO: 45112 - RNA, 21 nt, Human
gauccggcuuuugucccggcc

SEQ ID NO: 45113 - RNA, 19 nt, Human
gcagggaagugcugccuga

SEQ ID NO: 45114 - RNA, 21 nt, Human
gcccuacaaugaggaagaccc

SEQ ID NO: 45115 - RNA, 20 nt, Human
ggagcaccccagcagccggu

SEQ ID NO: 45116 - RNA, 20 nt, Human
gggaaguaaaaaaaaaaaaa

SEQ ID NO: 45117 - RNA, 21 nt, Human
ggggugcuuuaaauguauagu

SEQ ID NO: 45118 - RNA, 19 nt, Human
guaaucuuugaggaucugc

SEQ ID NO: 45119 - RNA, 22 nt, Human
uaaaaaaaaaaaaagagagaca

SEQ ID NO: 45120 - RNA, 24 nt, Human
uaacuaauggaaaaagaaagcaac

SEQ ID NO: 45121 - RNA, 19 nt, Human
uacaaugaggaagacccca

SEQ ID NO: 45122 - RNA, 18 nt, Human
uacauuccaggccccugc

SEQ ID NO: 45123 - RNA, 23 nt, Human
uacuuccagugcauaaucgagca

SEQ ID NO: 45124 - RNA, 18 nt, Human
uagcagagcaaagucaca

SEQ ID NO: 45125 - RNA, 18 nt, Human
uauaaaaaaaauaugaag

SEQ ID NO: 45126 - RNA, 21 nt, Human
uccacaggcccgacgaacccc

SEQ ID NO: 45127 - RNA, 19 nt, Human
uccacauauuuugugacaa

SEQ ID NO: 45128 - RNA, 25 nt, Human
uccacauauuuugugacaauggcua

SEQ ID NO: 45129 - RNA, 21 nt, Human
ucccgggauccggcuuuuguc

SEQ ID NO: 45130 - RNA, 22 nt, Human
uccgugcgcggcgcuucuucca

SEQ ID NO: 45131 - RNA, 23 nt, Human
uccgugcgcggcgcuucuuccac

SEQ ID NO: 45132 - RNA, 24 nt, Human
uccgugcgcggcgcuucuuccaca

SEQ ID NO: 45133 - RNA, 23 nt, Human
ugacaauggcuaaggaugcaaug

SEQ ID NO: 45134 - RNA, 21 nt, Human
ugauaauacagagaagagacu

SEQ ID NO: 45135 - RNA, 21 nt, Human
ugcccaugaucagcuucccuu

SEQ ID NO: 45136 - RNA, 24 nt, Human
ugcccaugaucagcuucccuuccu

SEQ ID NO: 45137 - RNA, 18 nt, Human
ugccgaaguccgugcgcg

SEQ ID NO: 45138 - RNA, 20 nt, Human
uggauuacagaugcaaagua

SEQ ID NO: 45139 - RNA, 24 nt, Human
uggcagggaagugcugccugacgu

SEQ ID NO: 45140 - RNA, 22 nt, Human
uggcuguuuacauuccaggccc

SEQ ID NO: 45141 - RNA, 19 nt, Human
uguuucauucccuuccucc

SEQ ID NO: 45142 - RNA, 23 nt, Human
uuaacuaauggaaaaagaaagca

SEQ ID NO: 45143 - RNA, 26 nt, Human
uuacuacuccacauauuuugugacaa

SEQ ID NO: 45144 - RNA, 20 nt, Human
uuccaggccccugcuaaaua

SEQ ID NO: 45145 - RNA, 21 nt, Human
uuggcuugguuuuuauuucua

SEQ ID NO: 45146 - RNA, 23 nt, Human
uuucuaagcaugucuacaaaugc

SEQ ID NO: 45147 - RNA, 21 nt, Human
aaccaccuccuugccuaaccu

SEQ ID NO: 45148 - RNA, 24 nt, Human
aagcaggauggaggaaaaaucaga

SEQ ID NO: 45149 - RNA, 18 nt, Human
aagguggauauaaagugg

SEQ ID NO: 45150 - RNA, 20 nt, Human
accuccuugccuaaccuagc

SEQ ID NO: 45151 - RNA, 20 nt, Human
agaagagacugggaacugca

SEQ ID NO: 45152 - RNA, 22 nt, Human
agagacugggaacugcaggggc

SEQ ID NO: 45153 - RNA, 23 nt, Human
agaggcaagggcugcaggacagg

SEQ ID NO: 45154 - RNA, 19 nt, Human
agggcugcaggacagaaga

SEQ ID NO: 45155 - RNA, 21 nt, Human
aggugacccaguccuggcccc

SEQ ID NO: 45156 - RNA, 19 nt, Human
ccagggaggugguaagcag

SEQ ID NO: 45157 - RNA, 23 nt, Human
cccaguccuggccccggcuguuc

SEQ ID NO: 45158 - RNA, 18 nt, Human
ccccaucucuggccaacc

SEQ ID NO: 45159 - RNA, 20 nt, Human
ccccuggggccgaguggcug

SEQ ID NO: 45160 - RNA, 22 nt, Human
cccugcagcgccccuuuucucg

SEQ ID NO: 45161 - RNA, 19 nt, Human
cccuggggccgaguggcug

SEQ ID NO: 45162 - RNA, 18 nt, Human
cucagacuuaaugggaaa

SEQ ID NO: 45163 - RNA, 22 nt, Human
cucuggccaaccaccuccuugc

SEQ ID NO: 45164 - RNA, 22 nt, Human
gcaggacagaagagacugggaa

SEQ ID NO: 45165 - RNA, 23 nt, Human
gcccugggacucaggaggagaug

SEQ ID NO: 45166 - RNA, 19 nt, Human
gcgugggcugccgggcugg

SEQ ID NO: 45167 - RNA, 22 nt, Human
gcugguaccugcagcucuagug

SEQ ID NO: 45168 - RNA, 22 nt, Human
ggccggaagugcgugggcugcc

SEQ ID NO: 45169 - RNA, 21 nt, Human
ggcgcuggggcgcuugggugu

SEQ ID NO: 45170 - RNA, 19 nt, Human
gggaggugguaagcaggau

SEQ ID NO: 45171 - RNA, 19 nt, Human
gggccgaguggcugguacc

SEQ ID NO: 45172 - RNA, 18 nt, Human
gggugguggagacugugc

SEQ ID NO: 45173 - RNA, 19 nt, Human
gguaagcaggauggaggaa

SEQ ID NO: 45174 - RNA, 19 nt, Human
uaaccuagcucuugccucu

SEQ ID NO: 45175 - RNA, 19 nt, Human
uaaggggguguguuugggg

SEQ ID NO: 45176 - RNA, 20 nt, Human
uaagucccaagagauagggg

SEQ ID NO: 45177 - RNA, 23 nt, Human
uaccugcagcucuaguguuuucc

SEQ ID NO: 45178 - RNA, 21 nt, Human
ucccucuguggccauaacccc

SEQ ID NO: 45179 - RNA, 20 nt, Human
uccuggccccggcuguuccc

SEQ ID NO: 45180 - RNA, 19 nt, Human
ucggaaacccucgacccug

SEQ ID NO: 45181 - RNA, 23 nt, Human
ucuggccaaccaccuccuugccu

SEQ ID NO: 45182 - RNA, 24 nt, Human
ucuguggccauaacccccuggggc

SEQ ID NO: 45183 - RNA, 20 nt, Human
ugacccaguccuggccccgg

SEQ ID NO: 45184 - RNA, 24 nt, Human
ugauucagcucauaggugacccag

SEQ ID NO: 45185 - RNA, 19 nt, Human
uggcuccagggugguggag

SEQ ID NO: 45186 - RNA, 25 nt, Human
uggcuccagggugguggagacugug

SEQ ID NO: 45187 - RNA, 20 nt, Human
ugggaacugcaggggcccug

SEQ ID NO: 45188 - RNA, 21 nt, Human
uggggggaaaaggauggccac

SEQ ID NO: 45189 - RNA, 21 nt, Human
ugugaaagacccuuggcucca

SEQ ID NO: 45190 - RNA, 29 nt, Human
uuccccaucucuggccaaccaccuccuug

SEQ ID NO: 45191 - RNA, 28 nt, Human
uuggcuccagggugguggagacugugcc

SEQ ID NO: 45192 - RNA, 18 nt, Human
aaaugacccucaagagga

SEQ ID NO: 45193 - RNA, 20 nt, Human
aaccgccucccaacaaaggu

SEQ ID NO: 45194 - RNA, 19 nt, Human
aaccugacccaagcagcgg

SEQ ID NO: 45195 - RNA, 21 nt, Human
aagagaagaugauuaacaaaa

SEQ ID NO: 45196 - RNA, 24 nt, Human
aagcagcgggaccgguucccgugc

SEQ ID NO: 45197 - RNA, 18 nt, Human
aaucacugcucugauuug

SEQ ID NO: 45198 - RNA, 21 nt, Human
accauucuagcuuccaaauuc

SEQ ID NO: 45199 - RNA, 25 nt, Human
acucugaaggaaaaggggagagaag

SEQ ID NO: 45200 - RNA, 27 nt, Human
agaaauguguucucccaaaccgccucc

SEQ ID NO: 45201 - RNA, 22 nt, Human
aggaaaaugacccucaagagga

SEQ ID NO: 45202 - RNA, 26 nt, Human
caaauucuggaaaaagagaagaugau

SEQ ID NO: 45203 - RNA, 23 nt, Human
cacugguauaauuaauacagaaa

SEQ ID NO: 45204 - RNA, 20 nt, Human
cagaaaggaaaaugacccuc

SEQ ID NO: 45205 - RNA, 19 nt, Human
cccagaggcagccagggag

SEQ ID NO: 45206 - RNA, 21 nt, Human
cccucaagaggaagguuucau

SEQ ID NO: 45207 - RNA, 24 nt, Human
ccucccagaggcagccagggaggc

SEQ ID NO: 45208 - RNA, 24 nt, Human
cuacaaggcagcaccccucccaga

SEQ ID NO: 45209 - RNA, 22 nt, Human
cuacaggauuggcaccagaccc

SEQ ID NO: 45210 - RNA, 18 nt, Human
cugacccaagcagcggga

SEQ ID NO: 45211 - RNA, 21 nt, Human
cugauggccacguguuccucc

SEQ ID NO: 45212 - RNA, 20 nt, Human
gaacaauaagaggguaggag

SEQ ID NO: 45213 - RNA, 19 nt, Human
gaccggcgaaccugaccca

SEQ ID NO: 45214 - RNA, 25 nt, Human
gaggaacaauaagaggguaggagac

SEQ ID NO: 45215 - RNA, 24 nt, Human
gauucacucugaaggaaaagggga

SEQ ID NO: 45216 - RNA, 25 nt, Human
ggggagagaagagagaaucacuggu

SEQ ID NO: 45217 - RNA, 24 nt, Human
guagaaacuucugguuuugugccu

SEQ ID NO: 45218 - RNA, 21 nt, Human
uaaaagaaaacuucacauuuc

SEQ ID NO: 45219 - RNA, 20 nt, Human
uaagaggguaggagacaccu

SEQ ID NO: 45220 - RNA, 21 nt, Human
uacagaaaggaaaaugacccu

SEQ ID NO: 45221 - RNA, 24 nt, Human
uacagaaaggaaaaugacccucaa

SEQ ID NO: 45222 - RNA, 18 nt, Human
uccaucuacaaggcagca

SEQ ID NO: 45223 - RNA, 22 nt, Human
ucucccaaaccgccucccaaca

SEQ ID NO: 45224 - RNA, 20 nt, Human
ucugaaggaaaaggggagag

SEQ ID NO: 45225 - RNA, 19 nt, Human
ugaaaagauaguaaaagaa

SEQ ID NO: 45226 - RNA, 23 nt, Human
ugaaggaaaaggggagagaagag

SEQ ID NO: 45227 - RNA, 24 nt, Human
ugaucaguaacuuuaaagacaagc

SEQ ID NO: 45228 - RNA, 23 nt, Human
uggcacuacugacauucccacca

SEQ ID NO: 45229 - RNA, 20 nt, Human
ugguggugcggcuuccuccc

SEQ ID NO: 45230 - RNA, 23 nt, Human
uuaacaaaaauagagaauguaga

SEQ ID NO: 45231 - RNA, 25 nt, Human
uuauguggaucuaucaaaagguaca

SEQ ID NO: 45232 - RNA, 22 nt, Human
uucaaauuagaaauguguucuc

SEQ ID NO: 45233 - RNA, 22 nt, Human
uucucccaaaccgccucccaac

SEQ ID NO: 45234 - RNA, 22 nt, Human
cacacguggagcugaacuugac

SEQ ID NO: 45235 - RNA, 18 nt, Human
ucggauccacugauggca

SEQ ID NO: 45236 - RNA, 18 nt, Human
uggaauaggaagccaugg

SEQ ID NO: 45237 - RNA, 18 nt, Human
aggcaguggccaggagug

SEQ ID NO: 45238 - RNA, 24 nt, Human
cacaaaauuugaguugcacacagg

SEQ ID NO: 45239 - RNA, 23 nt, Human
cacacaggcgcuuucugaagcag

SEQ ID NO: 45240 - RNA, 22 nt, Human
cccacaaacuggaaggcauagg

SEQ ID NO: 45241 - RNA, 23 nt, Human
cuggaaggcauaggcaguggcca

SEQ ID NO: 45242 - RNA, 23 nt, Human
gaaaauccaaaaucugugguucu

SEQ ID NO: 45243 - RNA, 26 nt, Human
uaggcaguggccaggaguggaaagag

SEQ ID NO: 45244 - RNA, 19 nt, Human
uccacaaaauuugaguugc

SEQ ID NO: 45245 - RNA, 18 nt, Human
ugaagcagauuaaacuug

SEQ ID NO: 45246 - RNA, 22 nt, Human
ugaagcagauuaaacuuguccu

SEQ ID NO: 45247 - RNA, 18 nt, Human
ugcgcccacaaacuggaa

SEQ ID NO: 45248 - RNA, 21 nt, Human
ugcgcccacaaacuggaaggc

SEQ ID NO: 45249 - RNA, 19 nt, Human
auuaucacaugauggugcu

SEQ ID NO: 45250 - RNA, 22 nt, Human
cccggcugcuccgagggucugc

SEQ ID NO: 45251 - RNA, 19 nt, Human
uaugccauaguaccauuau

SEQ ID NO: 45252 - RNA, 22 nt, Human
ucacaugauggugcugguugcu

SEQ ID NO: 45253 - RNA, 25 nt, Human
ugacuguggagagacacuuccaacc

SEQ ID NO: 45254 - RNA, 23 nt, Human
uggagagacacuuccaacccggc

SEQ ID NO: 45255 - RNA, 19 nt, Human
ugucuggugacuguggaga

SEQ ID NO: 45256 - RNA, 24 nt, Human
aaucaccgcgaucccagauuaggu

SEQ ID NO: 45257 - RNA, 18 nt, Human
aucuccggcguguucugg

SEQ ID NO: 45258 - RNA, 20 nt, Human
cacacuccacaguucaaccc

SEQ ID NO: 45259 - RNA, 18 nt, Human
cacaguucaaccccugcc

SEQ ID NO: 45260 - RNA, 27 nt, Human
caccgcgaucccagauuagguccagcc

SEQ ID NO: 45261 - RNA, 20 nt, Human
ccagggaaaccaaaagcagg

SEQ ID NO: 45262 - RNA, 25 nt, Human
cccacacacuccacaguucaacccc

SEQ ID NO: 45263 - RNA, 18 nt, Human
cgccugggcaaguugagg

SEQ ID NO: 45264 - RNA, 20 nt, Human
cgggcucagaaagcagcagc

SEQ ID NO: 45265 - RNA, 18 nt, Human
gcccacacacuccacagu

SEQ ID NO: 45266 - RNA, 21 nt, Human
uagacuuggcugaaugugcca

SEQ ID NO: 45267 - RNA, 18 nt, Human
uccacggugcaaaucacc

SEQ ID NO: 45268 - RNA, 20 nt, Human
uccacggugcaaaucaccgc

SEQ ID NO: 45269 - RNA, 21 nt, Human
uccggcguguucuggaaucag

SEQ ID NO: 45270 - RNA, 19 nt, Human
uucuggaaucagaaguuga

SEQ ID NO: 45271 - RNA, 23 nt, Human
aaagagcuggcuuugggcccugg

SEQ ID NO: 45272 - RNA, 20 nt, Human
aacacaacugauuuccaucu

SEQ ID NO: 45273 - RNA, 25 nt, Human
aacauuuuuauugauucuccugcca

SEQ ID NO: 45274 - RNA, 22 nt, Human
aaggagccgcgggagguaaagg

SEQ ID NO: 45275 - RNA, 23 nt, Human
aaguauugaaggugccaacgacu

SEQ ID NO: 45276 - RNA, 19 nt, Human
aagugugcacuaugggugu

SEQ ID NO: 45277 - RNA, 23 nt, Human
aauuacuuuuuaagguaagaaac

SEQ ID NO: 45278 - RNA, 23 nt, Human
accaacgccaacagggcagcgcg

SEQ ID NO: 45279 - RNA, 21 nt, Human
accuccucaugaaguaaacuc

SEQ ID NO: 45280 - RNA, 18 nt, Human
accuggaggaggaagggc

SEQ ID NO: 45281 - RNA, 20 nt, Human
acggaggggacuacugucaa

SEQ ID NO: 45282 - RNA, 24 nt, Human
agaaacaguaagucaacugaacaa

SEQ ID NO: 45283 - RNA, 22 nt, Human
agacuagcauacaaguguccuu

SEQ ID NO: 45284 - RNA, 19 nt, Human
aggaggagcugcgggggug

SEQ ID NO: 45285 - RNA, 21 nt, Human
aggaggaggagcugcgggggu

SEQ ID NO: 45286 - RNA, 27 nt, Human
aggaggaggagcugcgggggugggguc

SEQ ID NO: 45287 - RNA, 22 nt, Human
aggcaaagugguucagauggga

SEQ ID NO: 45288 - RNA, 24 nt, Human
aggcaaagugguucagaugggagc

SEQ ID NO: 45289 - RNA, 23 nt, Human
aggggcugggcgggucaccgggg

SEQ ID NO: 45290 - RNA, 19 nt, Human
auaaaaacagucauauucc

SEQ ID NO: 45291 - RNA, 27 nt, Human
caaaccuacugaagagguagacucgau

SEQ ID NO: 45292 - RNA, 22 nt, Human
caacugaacaaagagcuggcuu

SEQ ID NO: 45293 - RNA, 25 nt, Human
caacugaacaaagagcuggcuuuuu

SEQ ID NO: 45294 - RNA, 22 nt, Human
cacaacugauuuccaucuacaa

SEQ ID NO: 45295 - RNA, 18 nt, Human
caccuggagggaguaggg

SEQ ID NO: 45296 - RNA, 21 nt, Human
caccuggagggcccgggcgcu

SEQ ID NO: 45297 - RNA, 21 nt, Human
caccuggguuggggcacagcg

SEQ ID NO: 45298 - RNA, 26 nt, Human
cagaggcaaagugguucagauggggc

SEQ ID NO: 45299 - RNA, 20 nt, Human
caggccauccacacaaaccu

SEQ ID NO: 45300 - RNA, 24 nt, Human
caggguggggucuagucaggcuuu

SEQ ID NO: 45301 - RNA, 20 nt, Human
cauagaggggcugggcgggu

SEQ ID NO: 45302 - RNA, 19 nt, Human
ccaccuggguuggggcaca

SEQ ID NO: 45303 - RNA, 23 nt, Human
ccacgccgacaggggcgccuugc

SEQ ID NO: 45304 - RNA, 21 nt, Human
ccaggccauccacacaaaccu

SEQ ID NO: 45305 - RNA, 27 nt, Human
ccaucuacaauuacuuuuuaaggggaa

SEQ ID NO: 45306 - RNA, 23 nt, Human
ccccauaagcugucugaaucaaa

SEQ ID NO: 45307 - RNA, 22 nt, Human
cccgcaccaacgccaacagggc

SEQ ID NO: 45308 - RNA, 20 nt, Human
cccgcgcgccugcgcagucc

SEQ ID NO: 45309 - RNA, 24 nt, Human
cccgcgcgccugcgcagucccgca

SEQ ID NO: 45310 - RNA, 20 nt, Human
cccgcggguccacgccgaca

SEQ ID NO: 45311 - RNA, 21 nt, Human
ccgcaccaacgccaacagggc

SEQ ID NO: 45312 - RNA, 21 nt, Human
ccggaggaggaggagcugcgg

SEQ ID NO: 45313 - RNA, 21 nt, Human
ccugcagggacugggccgccg

SEQ ID NO: 45314 - RNA, 19 nt, Human
ccugcaggggcggggcugc

SEQ ID NO: 45315 - RNA, 23 nt, Human
ccugcaggggcggggcugcaggu

SEQ ID NO: 45316 - RNA, 20 nt, Human
ccugcgcaaucggcuccugc

SEQ ID NO: 45317 - RNA, 21 nt, Human
ccugcgcaaucggcuccugcg

SEQ ID NO: 45318 - RNA, 25 nt, Human
ccuggguuggggcacagccgggguc

SEQ ID NO: 45319 - RNA, 18 nt, Human
ccuucauuguuuuauguu

SEQ ID NO: 45320 - RNA, 18 nt, Human
cgcacgccgacgcgcgca

SEQ ID NO: 45321 - RNA, 22 nt, Human
cgcagcagggcacgaaccugcc

SEQ ID NO: 45322 - RNA, 21 nt, Human
cgccgacgcgcgcaggcgcac

SEQ ID NO: 45323 - RNA, 22 nt, Human
cgccgagacaccgcggcguucc

SEQ ID NO: 45324 - RNA, 19 nt, Human
cgcgcgcaggcgcacugcc

SEQ ID NO: 45325 - RNA, 21 nt, Human
cgcuccugagaccccaccccc

SEQ ID NO: 45326 - RNA, 20 nt, Human
cggaagaaggcgagggggug

SEQ ID NO: 45327 - RNA, 23 nt, Human
cggggguuggcgggggcgcaguc

SEQ ID NO: 45328 - RNA, 21 nt, Human
cucaugaaguaaacucgacaa

SEQ ID NO: 45329 - RNA, 24 nt, Human
cuccaggccauccacacaaaccua

SEQ ID NO: 45330 - RNA, 25 nt, Human
cuccaggccauccacacaaaccuac

SEQ ID NO: 45331 - RNA, 20 nt, Human
cuccugagaccccaccccca

SEQ ID NO: 45332 - RNA, 26 nt, Human
cuccugagaccccacccccaacaccu

SEQ ID NO: 45333 - RNA, 18 nt, Human
gagcaagcaccugccucc

SEQ ID NO: 45334 - RNA, 20 nt, Human
gaggaggagcugcgggggug

SEQ ID NO: 45335 - RNA, 23 nt, Human
gagggaguagggcggaagaaggc

SEQ ID NO: 45336 - RNA, 23 nt, Human
gcaccaacgccaacagggcagcg

SEQ ID NO: 45337 - RNA, 18 nt, Human
gccugcgcaaucggcucc

SEQ ID NO: 45338 - RNA, 21 nt, Human
gccugcgcaaucggcuccugc

SEQ ID NO: 45339 - RNA, 21 nt, Human
gcgcagucaccuggagggccc

SEQ ID NO: 45340 - RNA, 21 nt, Human
gcgcagucccgcaccaacgcc

SEQ ID NO: 45341 - RNA, 18 nt, Human
gcggggguuggcgggggc

SEQ ID NO: 45342 - RNA, 20 nt, Human
gcuggcgggcuguggugcug

SEQ ID NO: 45343 - RNA, 18 nt, Human
ggaaggagccgcgggagg

SEQ ID NO: 45344 - RNA, 20 nt, Human
ggaaggagccgcgggaggua

SEQ ID NO: 45345 - RNA, 21 nt, Human
ggagaagggguaccuggagga

SEQ ID NO: 45346 - RNA, 18 nt, Human
ggagggcccgggcgcugc

SEQ ID NO: 45347 - RNA, 19 nt, Human
ggcugggcgggucaccggg

SEQ ID NO: 45348 - RNA, 18 nt, Human
gggaagagagagguagca

SEQ ID NO: 45349 - RNA, 21 nt, Human
gggaaggagccgcgggaggua

SEQ ID NO: 45350 - RNA, 18 nt, Human
gggacggggccgcaggag

SEQ ID NO: 45351 - RNA, 19 nt, Human
gggcggaagaaggcgaggg

SEQ ID NO: 45352 - RNA, 20 nt, Human
gggcggggguuggcgggggc

SEQ ID NO: 45353 - RNA, 23 nt, Human
gggcgggucaccggggaacugcc

SEQ ID NO: 45354 - RNA, 20 nt, Human
gggcugggcgggucaccggg

SEQ ID NO: 45355 - RNA, 20 nt, Human
gggcuguggugcugucguuc

SEQ ID NO: 45356 - RNA, 18 nt, Human
ggggacggggccgcagga

SEQ ID NO: 45357 - RNA, 19 nt, Human
ggggacggggccgcaggag

SEQ ID NO: 45358 - RNA, 19 nt, Human
ggggcggggguuggcgggg

SEQ ID NO: 45359 - RNA, 25 nt, Human
ggggcugcagguuguccggaggagg

SEQ ID NO: 45360 - RNA, 19 nt, Human
ggggguggggucaccugga

SEQ ID NO: 45361 - RNA, 20 nt, Human
ggggguggggucaccuggag

SEQ ID NO: 45362 - RNA, 19 nt, Human
gggguggggucaccuggag

SEQ ID NO: 45363 - RNA, 19 nt, Human
gggguguguguguguggug

SEQ ID NO: 45364 - RNA, 18 nt, Human
ggguguguguguguggug

SEQ ID NO: 45365 - RNA, 21 nt, Human
ggguguguguguguggugggg

SEQ ID NO: 45366 - RNA, 18 nt, Human
gguggggucaccuggagg

SEQ ID NO: 45367 - RNA, 24 nt, Human
uaaaacacuucuaaucuagacugu

SEQ ID NO: 45368 - RNA, 22 nt, Human
uaagguaagaaacaguaaguca

SEQ ID NO: 45369 - RNA, 20 nt, Human
uaccccauaagcugucugaa

SEQ ID NO: 45370 - RNA, 21 nt, Human
uaccccauaagcugucugaau

SEQ ID NO: 45371 - RNA, 19 nt, Human
uaccuggaggaggaagggc

SEQ ID NO: 45372 - RNA, 20 nt, Human
uaccuggaggaggaagggcc

SEQ ID NO: 45373 - RNA, 18 nt, Human
uagaggggcugggcgggu

SEQ ID NO: 45374 - RNA, 19 nt, Human
ucaccuggagggaguaggg

SEQ ID NO: 45375 - RNA, 23 nt, Human
uccacacaaaccuacugaagagg

SEQ ID NO: 45376 - RNA, 21 nt, Human
ucccgcgcgcagaggcgccga

SEQ ID NO: 45377 - RNA, 21 nt, Human
uccgcgggucaccugcaggga

SEQ ID NO: 45378 - RNA, 20 nt, Human
uccugagaccccacccccaa

SEQ ID NO: 45379 - RNA, 20 nt, Human
ugaacaaagagcuggcuuug

SEQ ID NO: 45380 - RNA, 22 nt, Human
ugagcccgcggguccacgccga

SEQ ID NO: 45381 - RNA, 22 nt, Human
ugagcgcgcggcucugggcuuu

SEQ ID NO: 45382 - RNA, 19 nt, Human
ugcaggggcggggcugcag

SEQ ID NO: 45383 - RNA, 24 nt, Human
ugccaaauaauaacacuuuuccca

SEQ ID NO: 45384 - RNA, 22 nt, Human
ugccuuugagcccgcggguccu

SEQ ID NO: 45385 - RNA, 18 nt, Human
uggaggaggaagggccgc

SEQ ID NO: 45386 - RNA, 23 nt, Human
uggggucaccuggagggaguagg

SEQ ID NO: 45387 - RNA, 23 nt, Human
uguagaaauuaaaacacuucuaa

SEQ ID NO: 45388 - RNA, 23 nt, Human
uucaccugcaggggcggggcugc

SEQ ID NO: 45389 - RNA, 18 nt, Human
uucagaugggagccaaug

SEQ ID NO: 45390 - RNA, 20 nt, Human
uucaugauuuugacauuauc

SEQ ID NO: 45391 - RNA, 23 nt, Human
uugagcccgcggguccacgccga

SEQ ID NO: 45392 - RNA, 19 nt, Human
uuuuguaacuggggcaaag

SEQ ID NO: 45393 - RNA, 18 nt, Human
aacacagcacuugguaaa

SEQ ID NO: 45394 - RNA, 21 nt, Human
aacucccuucccaccacuccc

SEQ ID NO: 45395 - RNA, 22 nt, Human
aacucugccauuuucuaauccu

SEQ ID NO: 45396 - RNA, 27 nt, Human
aagcaacucccuucccaccacucccca

SEQ ID NO: 45397 - RNA, 18 nt, Human
acagcacuauucauucuc

SEQ ID NO: 45398 - RNA, 20 nt, Human
accaugggccacgcugagcc

SEQ ID NO: 45399 - RNA, 23 nt, Human
acucccuucccaccacuccccac

SEQ ID NO: 45400 - RNA, 21 nt, Human
acucugccauuuucuaauccu

SEQ ID NO: 45401 - RNA, 22 nt, Human
acuucaggcuggaggaaaaaga

SEQ ID NO: 45402 - RNA, 18 nt, Human
agcaccaacucugccauu

SEQ ID NO: 45403 - RNA, 23 nt, Human
agcacuauucauucucugggagc

SEQ ID NO: 45404 - RNA, 21 nt, Human
agccaauguuuguaccccugg

SEQ ID NO: 45405 - RNA, 18 nt, Human
aggaggcaaauccuguuu

SEQ ID NO: 45406 - RNA, 20 nt, Human
aggcccaacccaggaucucc

SEQ ID NO: 45407 - RNA, 22 nt, Human
aggucccuggagaccccagccc

SEQ ID NO: 45408 - RNA, 21 nt, Human
aucagagggaggcccaaccca

SEQ ID NO: 45409 - RNA, 23 nt, Human
caacacagcacuugguaaacauc

SEQ ID NO: 45410 - RNA, 22 nt, Human
caacucccuucccaccacuccc

SEQ ID NO: 45411 - RNA, 18 nt, Human
caagguggauccagcacc

SEQ ID NO: 45412 - RNA, 22 nt, Human
caccacuccccacucccuccca

SEQ ID NO: 45413 - RNA, 23 nt, Human
caucagagggaggcccaacccag

SEQ ID NO: 45414 - RNA, 21 nt, Human
caucucagguguguagggagc

SEQ ID NO: 45415 - RNA, 18 nt, Human
ccaccacuccccacuccc

SEQ ID NO: 45416 - RNA, 26 nt, Human
ccaccacuccccacucccucccaagu

SEQ ID NO: 45417 - RNA, 25 nt, Human
ccaggaucuccuguccaugggcugg

SEQ ID NO: 45418 - RNA, 21 nt, Human
ccaugggccacgcugagcccc

SEQ ID NO: 45419 - RNA, 20 nt, Human
ccaugggcuggggagcagca

SEQ ID NO: 45420 - RNA, 19 nt, Human
cccacucccucccaaguac

SEQ ID NO: 45421 - RNA, 22 nt, Human
cccagcccaccuccccuaggag

SEQ ID NO: 45422 - RNA, 22 nt, Human
ccccacucccucccaaguacag

SEQ ID NO: 45423 - RNA, 19 nt, Human
ccccagcccuauucugggc

SEQ ID NO: 45424 - RNA, 24 nt, Human
ccccagcccuauucugggccacag

SEQ ID NO: 45425 - RNA, 23 nt, Human
cccuucccaccacuccccacucc

SEQ ID NO: 45426 - RNA, 21 nt, Human
ccucccaaguacagacaaccu

SEQ ID NO: 45427 - RNA, 27 nt, Human
ccuucccaccacuccccacucccuccc

SEQ ID NO: 45428 - RNA, 18 nt, Human
ccuuccguccugcuccag

SEQ ID NO: 45429 - RNA, 23 nt, Human
cgagggcccagcccaccuccccu

SEQ ID NO: 45430 - RNA, 27 nt, Human
cuaaaauaagcacugagaggcaagacc

SEQ ID NO: 45431 - RNA, 20 nt, Human
cucugggagcugccccagcc

SEQ ID NO: 45432 - RNA, 22 nt, Human
gagggaggcccaacccaggauc

SEQ ID NO: 45433 - RNA, 22 nt, Human
gauccaguuccuugggagccaa

SEQ ID NO: 45434 - RNA, 20 nt, Human
gcuccaguugaaggggugac

SEQ ID NO: 45435 - RNA, 23 nt, Human
gcugagugacaggcaccaugggc

SEQ ID NO: 45436 - RNA, 18 nt, Human
ggagggaagggggcugag

SEQ ID NO: 45437 - RNA, 24 nt, Human
ggcuggggucaucagagggaggcc

SEQ ID NO: 45438 - RNA, 18 nt, Human
uaaaauaagcacugagag

SEQ ID NO: 45439 - RNA, 20 nt, Human
uaaaauaagcacugagaggc

SEQ ID NO: 45440 - RNA, 21 nt, Human
uagcucaggucccuggagacc

SEQ ID NO: 45441 - RNA, 20 nt, Human
ucaggcuggaggaaaaagaa

SEQ ID NO: 45442 - RNA, 22 nt, Human
uccaacacagcacuugguaaac

SEQ ID NO: 45443 - RNA, 19 nt, Human
ucccuggagaccccagccc

SEQ ID NO: 45444 - RNA, 22 nt, Human
ucucugggagcugccccagccc

SEQ ID NO: 45445 - RNA, 20 nt, Human
ugacugccaguuuacaucuc

SEQ ID NO: 45446 - RNA, 26 nt, Human
ugauucgugugacaagcaacucccuu

SEQ ID NO: 45447 - RNA, 18 nt, Human
uggcuggggucaucagag

SEQ ID NO: 45448 - RNA, 22 nt, Human
uguagcucaggucccuggagac

SEQ ID NO: 45449 - RNA, 22 nt, Human
uguggcuggcuggcuguugggu

SEQ ID NO: 45450 - RNA, 18 nt, Human
uguguagggagcguggag

SEQ ID NO: 45451 - RNA, 23 nt, Human
uguugggugauccaguuccuugg

SEQ ID NO: 45452 - RNA, 21 nt, Human
uucaggcuggaggaaaaagaa

SEQ ID NO: 45453 - RNA, 22 nt, Human
uuucccacuaaaauaagcacug

SEQ ID NO: 45454 - RNA, 21 nt, Human
aacacuguggcugggacacau

SEQ ID NO: 45455 - RNA, 18 nt, Human
agcauaacacuguggcug

SEQ ID NO: 45456 - RNA, 22 nt, Human
agcuguguuuccccuuccugcc

SEQ ID NO: 45457 - RNA, 18 nt, Human
aggaaaagccugccugug

SEQ ID NO: 45458 - RNA, 18 nt, Human
aggcucugagaggcuggu

SEQ ID NO: 45459 - RNA, 19 nt, Human
cagccacagagcauaacac

SEQ ID NO: 45460 - RNA, 23 nt, Human
cagcgccacagguuggaggaaaa

SEQ ID NO: 45461 - RNA, 22 nt, Human
cauacgugggcaucugugccac

SEQ ID NO: 45462 - RNA, 18 nt, Human
cauguguguuucacauac

SEQ ID NO: 45463 - RNA, 22 nt, Human
ccaacaguggagaucgggccuc

SEQ ID NO: 45464 - RNA, 18 nt, Human
cccauugcaccccggaac

SEQ ID NO: 45465 - RNA, 25 nt, Human
ccccauugcaccccggaacucagca

SEQ ID NO: 45466 - RNA, 23 nt, Human
ccccggaacucagcaaaggugag

SEQ ID NO: 45467 - RNA, 20 nt, Human
cccugcugcagcgccacagg

SEQ ID NO: 45468 - RNA, 21 nt, Human
ccucccccauugcaccccgga

SEQ ID NO: 45469 - RNA, 24 nt, Human
ccugccugugagcagggucccggc

SEQ ID NO: 45470 - RNA, 24 nt, Human
cggaggcucugagaggcugguggg

SEQ ID NO: 45471 - RNA, 20 nt, Human
cucccucccccauugcaccc

SEQ ID NO: 45472 - RNA, 18 nt, Human
gcaccccggaacucagca

SEQ ID NO: 45473 - RNA, 20 nt, Human
gccucagagcugggcaguca

SEQ ID NO: 45474 - RNA, 23 nt, Human
gcuuucccucccucccuccccca

SEQ ID NO: 45475 - RNA, 19 nt, Human
ggaaaagccugccugugag

SEQ ID NO: 45476 - RNA, 18 nt, Human
uaggaggaagcuuucccu

SEQ ID NO: 45477 - RNA, 18 nt, Human
ucccggcaggccacccac

SEQ ID NO: 45478 - RNA, 24 nt, Human
ucccucccucccccauugcacccc

SEQ ID NO: 45479 - RNA, 22 nt, Human
ucccucccucccucccccauug

SEQ ID NO: 45480 - RNA, 19 nt, Human
uccugcccugcugcagcgc

SEQ ID NO: 45481 - RNA, 18 nt, Human
ucgggccucagagcuggg

SEQ ID NO: 45482 - RNA, 23 nt, Human
uggagaucgggccucagagcugg

SEQ ID NO: 45483 - RNA, 21 nt, Human
uuucccucccucccuccccca

SEQ ID NO: 45484 - RNA, 20 nt, Human
aacagccucuuucuagcuga

SEQ ID NO: 45485 - RNA, 22 nt, Human
acuucaaaagccuguagagggg

SEQ ID NO: 45486 - RNA, 21 nt, Human
aggcagggugugaggauggca

SEQ ID NO: 45487 - RNA, 23 nt, Human
caaugcccacauggcaaaagccu

SEQ ID NO: 45488 - RNA, 21 nt, Human
cagcagcagccugugggucac

SEQ ID NO: 45489 - RNA, 22 nt, Human
cagcagccugugggucacugug

SEQ ID NO: 45490 - RNA, 20 nt, Human
ccaguauuuuucuaaucuau

SEQ ID NO: 45491 - RNA, 20 nt, Human
cugcuaccacuucaaaagcc

SEQ ID NO: 45492 - RNA, 24 nt, Human
cugcucugggcagauucaaaaggc

SEQ ID NO: 45493 - RNA, 21 nt, Human
cuguggcagagaauacaacca

SEQ ID NO: 45494 - RNA, 24 nt, Human
cuuuguccaccuucucacccuuca

SEQ ID NO: 45495 - RNA, 25 nt, Human
gagguuggccuggcuuauccagcug

SEQ ID NO: 45496 - RNA, 18 nt, Human
gaguguucauccagcagc

SEQ ID NO: 45497 - RNA, 18 nt, Human
ggcaaaagccuguccuuu

SEQ ID NO: 45498 - RNA, 24 nt, Human
gugaggauggcaaugcccacaugg

SEQ ID NO: 45499 - RNA, 20 nt, Human
uauccaguauuuuucuaauc

SEQ ID NO: 45500 - RNA, 21 nt, Human
ucaaaagccuguagaggggaa

SEQ ID NO: 45501 - RNA, 22 nt, Human
ugaacaagcagccugcacuacc

SEQ ID NO: 45502 - RNA, 27 nt, Human
ugaacaagcagccugcacuaccacucc

SEQ ID NO: 45503 - RNA, 23 nt, Human
ugaggagagcuguuucuggcagg

SEQ ID NO: 45504 - RNA, 24 nt, Human
ugaguguucauccagcagcagccu

SEQ ID NO: 45505 - RNA, 21 nt, Human
ugcccacauggcaaaagccug

SEQ ID NO: 45506 - RNA, 19 nt, Human
uguggcagagaauacaacc

SEQ ID NO: 45507 - RNA, 22 nt, Human
uguggcagagaauacaaccauc

SEQ ID NO: 45508 - RNA, 18 nt, Human
aagccgaggcaggcagca

SEQ ID NO: 45509 - RNA, 20 nt, Human
aagccgaggcaggcagcaua

SEQ ID NO: 45510 - RNA, 21 nt, Human
acaccuccucccgccgguacu

SEQ ID NO: 45511 - RNA, 18 nt, Human
agaggcaggggcaggugg

SEQ ID NO: 45512 - RNA, 18 nt, Human
agaggcaggggcaggugg

SEQ ID NO: 45513 - RNA, 18 nt, Human
agcaggcccagccccaag

SEQ ID NO: 45514 - RNA, 18 nt, Human
agcaggcccagccccaag

SEQ ID NO: 45515 - RNA, 22 nt, Human
agcuggggggauggcagccuca

SEQ ID NO: 45516 - RNA, 22 nt, Human
agcuggggggauggcagccuca

SEQ ID NO: 45517 - RNA, 18 nt, Human
aggcacccuggucuccag

SEQ ID NO: 45518 - RNA, 18 nt, Human
aggcacccuggucuccag

SEQ ID NO: 45519 - RNA, 22 nt, Human
aggccagcaggcccagccccaa

SEQ ID NO: 45520 - RNA, 22 nt, Human
aggccagcaggcccagccccaa

SEQ ID NO: 45521 - RNA, 20 nt, Human
aggggcaccacuggagcugg

SEQ ID NO: 45522 - RNA, 20 nt, Human
aggggcaccacuggagcugg

SEQ ID NO: 45523 - RNA, 19 nt, Human
agggggccgggcacccggg

SEQ ID NO: 45524 - RNA, 19 nt, Human
agggggccgggcacccggg

SEQ ID NO: 45525 - RNA, 22 nt, Human
aucauagaggcccagggccccc

SEQ ID NO: 45526 - RNA, 18 nt, Human
cagcacagcuacagcucc

SEQ ID NO: 45527 - RNA, 18 nt, Human
cagcacagcuacagcucc

SEQ ID NO: 45528 - RNA, 18 nt, Human
cagcagcucgugguaucg

SEQ ID NO: 45529 - RNA, 21 nt, Human
cagcaggaucccuggcacaug

SEQ ID NO: 45530 - RNA, 18 nt, Human
cagcaggggcaccacugg

SEQ ID NO: 45531 - RNA, 21 nt, Human
cagcaggggcaccacuggagc

SEQ ID NO: 45532 - RNA, 21 nt, Human
cagcagggugcugucaugagc

SEQ ID NO: 45533 - RNA, 21 nt, Human
cagcagggugcugucaugagc

SEQ ID NO: 45534 - RNA, 18 nt, Human
cagccucgggaaacagcc

SEQ ID NO: 45535 - RNA, 21 nt, Human
cagcgggccucggggcucccu

SEQ ID NO: 45536 - RNA, 23 nt, Human
cagcugggccuucucugcugccc

SEQ ID NO: 45537 - RNA, 18 nt, Human
caggaaggccucguagcg

SEQ ID NO: 45538 - RNA, 19 nt, Human
caggggcaccacuggagcu

SEQ ID NO: 45539 - RNA, 19 nt, Human
caggggcaccacuggagcu

SEQ ID NO: 45540 - RNA, 23 nt, Human
caggggcaccacuggagcugggg

SEQ ID NO: 45541 - RNA, 23 nt, Human
caggggcaccacuggagcugggg

SEQ ID NO: 45542 - RNA, 18 nt, Human
cauguugggguccagugu

SEQ ID NO: 45543 - RNA, 18 nt, Human
cauguugggguccagugu

SEQ ID NO: 45544 - RNA, 18 nt, Human
cauguugggguccagugu

SEQ ID NO: 45545 - RNA, 24 nt, Human
ccaccagcacagcuacagcuccgg

SEQ ID NO: 45546 - RNA, 24 nt, Human
ccaccagcacagcuacagcuccgg

SEQ ID NO: 45547 - RNA, 22 nt, Human
ccagcaggcccagccccaagcu

SEQ ID NO: 45548 - RNA, 22 nt, Human
ccagcaggcccagccccaagcu

SEQ ID NO: 45549 - RNA, 22 nt, Human
ccagcgggccucggggcucccu

SEQ ID NO: 45550 - RNA, 18 nt, Human
ccagcuccagcugcuggc

SEQ ID NO: 45551 - RNA, 24 nt, Human
cccagccccaagcugagugccacc

SEQ ID NO: 45552 - RNA, 24 nt, Human
cccagccccaagcugagugccacc

SEQ ID NO: 45553 - RNA, 19 nt, Human
cccagcuccagcugcuggc

SEQ ID NO: 45554 - RNA, 19 nt, Human
ccccaagcugagugccacc

SEQ ID NO: 45555 - RNA, 19 nt, Human
ccccaagcugagugccacc

SEQ ID NO: 45556 - RNA, 19 nt, Human
ccccaaggcccgcaggcac

SEQ ID NO: 45557 - RNA, 19 nt, Human
ccccaaggcccgcaggcac

SEQ ID NO: 45558 - RNA, 20 nt, Human
ccccaaggcccgcaggcacc

SEQ ID NO: 45559 - RNA, 21 nt, Human
cccccaaggcccgcaggcacc

SEQ ID NO: 45560 - RNA, 22 nt, Human
cccccuggagggccagcagggu

SEQ ID NO: 45561 - RNA, 22 nt, Human
cccccuggagggccagcagggu

SEQ ID NO: 45562 - RNA, 19 nt, Human
ccccuggagggccagcagg

SEQ ID NO: 45563 - RNA, 19 nt, Human
ccccuggagggccagcagg

SEQ ID NO: 45564 - RNA, 22 nt, Human
cccgcaggcacccuggucucca

SEQ ID NO: 45565 - RNA, 22 nt, Human
cccgcaggcacccuggucucca

SEQ ID NO: 45566 - RNA, 20 nt, Human
cccggcaagguuggccuggg

SEQ ID NO: 45567 - RNA, 19 nt, Human
cccugcgcaguggcucucc

SEQ ID NO: 45568 - RNA, 20 nt, Human
cccuggagggccagcagggu

SEQ ID NO: 45569 - RNA, 20 nt, Human
cccuggagggccagcagggu

SEQ ID NO: 45570 - RNA, 19 nt, Human
ccgcagcagcucgugguau

SEQ ID NO: 45571 - RNA, 18 nt, Human
ccgggccggggcagucag

SEQ ID NO: 45572 - RNA, 20 nt, Human
ccgggccggggcagucagcu

SEQ ID NO: 45573 - RNA, 21 nt, Human
ccggggugggcccacgugggc

SEQ ID NO: 45574 - RNA, 21 nt, Human
ccucagcagcuuauccucagc

SEQ ID NO: 45575 - RNA, 20 nt, Human
ccucaggaagcggcccagcu

SEQ ID NO: 45576 - RNA, 19 nt, Human
ccuccagcgggccucgggg

SEQ ID NO: 45577 - RNA, 23 nt, Human
ccucccgccgguacuccggacuc

SEQ ID NO: 45578 - RNA, 18 nt, Human
cgacucaggaagcccguc

SEQ ID NO: 45579 - RNA, 18 nt, Human
cgcagcagcucgugguau

SEQ ID NO: 45580 - RNA, 23 nt, Human
cgcaggacaucuggggaggccca

SEQ ID NO: 45581 - RNA, 19 nt, Human
cgcuggacccgggagaagu

SEQ ID NO: 45582 - RNA, 24 nt, Human
cggccagcaggggcaccacuggag

SEQ ID NO: 45583 - RNA, 24 nt, Human
cggccagcaggggcaccacuggag

SEQ ID NO: 45584 - RNA, 21 nt, Human
cggcggccucgguggccuccc

SEQ ID NO: 45585 - RNA, 21 nt, Human
cgggaucggccuccagcgggc

SEQ ID NO: 45586 - RNA, 18 nt, Human
cggggaggcugagaggca

SEQ ID NO: 45587 - RNA, 19 nt, Human
gaacucaaagccgaggcag

SEQ ID NO: 45588 - RNA, 19 nt, Human
gaacucaaagccgaggcag

SEQ ID NO: 45589 - RNA, 22 nt, Human
gaagcccguccagcccuccagg

SEQ ID NO: 45590 - RNA, 19 nt, Human
gaagcggccuaguggacag

SEQ ID NO: 45591 - RNA, 19 nt, Human
gaagcggccuaguggacag

SEQ ID NO: 45592 - RNA, 20 nt, Human
gcaggacaucuggggaggcc

SEQ ID NO: 45593 - RNA, 20 nt, Human
gcaguggcucuccaaccagc

SEQ ID NO: 45594 - RNA, 22 nt, Human
gcccagggcccccuggagggcc

SEQ ID NO: 45595 - RNA, 22 nt, Human
gcccagggcccccuggagggcc

SEQ ID NO: 45596 - RNA, 19 nt, Human
gcuacagcuccggccagca

SEQ ID NO: 45597 - RNA, 19 nt, Human
gcuacagcuccggccagca

SEQ ID NO: 45598 - RNA, 20 nt, Human
gcuccaauauccaaagccga

SEQ ID NO: 45599 - RNA, 18 nt, Human
gcuggacccgggagaagu

SEQ ID NO: 45600 - RNA, 18 nt, Human
ggcaagguuggccugggc

SEQ ID NO: 45601 - RNA, 22 nt, Human
ggcaccacuggagcugggggga

SEQ ID NO: 45602 - RNA, 21 nt, Human
gggcaccgugugcaccgggau

SEQ ID NO: 45603 - RNA, 19 nt, Human
ggggacagcugcgcauggg

SEQ ID NO: 45604 - RNA, 24 nt, Human
ggggcaccacuggagcugggggga

SEQ ID NO: 45605 - RNA, 19 nt, Human
gguccagugucagcugggg

SEQ ID NO: 45606 - RNA, 19 nt, Human
gguccagugucagcugggg

SEQ ID NO: 45607 - RNA, 19 nt, Human
gguccagugucagcugggg

SEQ ID NO: 45608 - RNA, 18 nt, Human
uagaagagggagacggug

SEQ ID NO: 45609 - RNA, 18 nt, Human
uagaagagggagacggug

SEQ ID NO: 45610 - RNA, 23 nt, Human
uaucggggacagcugcgcauggg

SEQ ID NO: 45611 - RNA, 18 nt, Human
ucagcuggggguagggaa

SEQ ID NO: 45612 - RNA, 18 nt, Human
ucagcuggggguagggaa

SEQ ID NO: 45613 - RNA, 18 nt, Human
ucagcuggggguagggaa

SEQ ID NO: 45614 - RNA, 21 nt, Human
ucauagaggcccagggccccc

SEQ ID NO: 45615 - RNA, 22 nt, Human
uccaauauccaaagccgagauc

SEQ ID NO: 45616 - RNA, 18 nt, Human
uccccaggugcuuccgga

SEQ ID NO: 45617 - RNA, 18 nt, Human
uccccaggugcuuccgga

SEQ ID NO: 45618 - RNA, 19 nt, Human
uccgugcugcggauguaca

SEQ ID NO: 45619 - RNA, 22 nt, Human
ucggcggccucgguggccuccc

SEQ ID NO: 45620 - RNA, 19 nt, Human
ucgguggccucccgcagca

SEQ ID NO: 45621 - RNA, 24 nt, Human
ucuccaggccagcaggcccagccc

SEQ ID NO: 45622 - RNA, 24 nt, Human
ucuccaggccagcaggcccagccc

SEQ ID NO: 45623 - RNA, 25 nt, Human
ucuccaggcgacucaggaagcccuu

SEQ ID NO: 45624 - RNA, 20 nt, Human
ugcaccgggaucggccucca

SEQ ID NO: 45625 - RNA, 21 nt, Human
ugccaccagcacagcuacagc

SEQ ID NO: 45626 - RNA, 21 nt, Human
ugccaccagcacagcuacagc

SEQ ID NO: 45627 - RNA, 18 nt, Human
uggacagggggccgggca

SEQ ID NO: 45628 - RNA, 18 nt, Human
uggacagggggccgggca

SEQ ID NO: 45629 - RNA, 20 nt, Human
uggagcuggggggauggcag

SEQ ID NO: 45630 - RNA, 20 nt, Human
uggagcuggggggauggcag

SEQ ID NO: 45631 - RNA, 20 nt, Human
uggccugggcacucuccagc

SEQ ID NO: 45632 - RNA, 21 nt, Human
uggccugggcacucuccagcg

SEQ ID NO: 45633 - RNA, 18 nt, Human
uggcggacccccuccgug

SEQ ID NO: 45634 - RNA, 18 nt, Human
uggcucacacggggcccc

SEQ ID NO: 45635 - RNA, 18 nt, Human
uggcucacacggggcccc

SEQ ID NO: 45636 - RNA, 24 nt, Human
uggcucuccaaccagcgacagucc

SEQ ID NO: 45637 - RNA, 19 nt, Human
ugggcgggaggccgggccg

SEQ ID NO: 45638 - RNA, 19 nt, Human
ugggcgggaggccgggccg

SEQ ID NO: 45639 - RNA, 21 nt, Human
ugguaguggaagaccgugggc

SEQ ID NO: 45640 - RNA, 19 nt, Human
ucaucuuuccuuuuucuca

SEQ ID NO: 45641 - RNA, 20 nt, Human
uuuuauaucuauauauauau

SEQ ID NO: 45642 - RNA, 22 nt, Human
uuuuauaucuauauauauaugu

SEQ ID NO: 45643 - RNA, 19 nt, Human
aaauacccugucaagggca

SEQ ID NO: 45644 - RNA, 18 nt, Human
augccacaguagcccuag

SEQ ID NO: 45645 - RNA, 18 nt, Human
ccaguaaaggauauagcu

SEQ ID NO: 45646 - RNA, 23 nt, Human
cguuugucuuuccugucuacaua

SEQ ID NO: 45647 - RNA, 25 nt, Human
cuaacauuacuuacuuaacaguacc

SEQ ID NO: 45648 - RNA, 19 nt, Human
cuacaugugaaaaauaugg

SEQ ID NO: 45649 - RNA, 22 nt, Human
cucaaguaagacccaagguaga

SEQ ID NO: 45650 - RNA, 19 nt, Human
cucuaagauaaccuuaaga

SEQ ID NO: 45651 - RNA, 28 nt, Human
cuugaaaacucacuuuucuuuugcauuu

SEQ ID NO: 45652 - RNA, 18 nt, Human
cuuguccucuuuccagca

SEQ ID NO: 45653 - RNA, 19 nt, Human
cuuguccucuuuccagcau

SEQ ID NO: 45654 - RNA, 19 nt, Human
gaaaaauauggaacucaag

SEQ ID NO: 45655 - RNA, 21 nt, Human
gaaauacccugucaagggcca

SEQ ID NO: 45656 - RNA, 23 nt, Human
gacccaagguagaucccaagggc

SEQ ID NO: 45657 - RNA, 19 nt, Human
gcccuaguguuuaaguguu

SEQ ID NO: 45658 - RNA, 21 nt, Human
uaacaguaccuaaauucuaau

SEQ ID NO: 45659 - RNA, 25 nt, Human
uaagacccaagguagaucccaaggg

SEQ ID NO: 45660 - RNA, 23 nt, Human
uaauauuccuaacuucacaaaac

SEQ ID NO: 45661 - RNA, 21 nt, Human
uagaucccaagggcuucagaa

SEQ ID NO: 45662 - RNA, 22 nt, Human
uagaucccaagggcuucagaaa

SEQ ID NO: 45663 - RNA, 22 nt, Human
ucaauaccaucaacaacgaauu

SEQ ID NO: 45664 - RNA, 23 nt, Human
ucuacaugugaaaaauauggaac

SEQ ID NO: 45665 - RNA, 22 nt, Human
ucucaaacuuguccucuuucca

SEQ ID NO: 45666 - RNA, 23 nt, Human
ucuccucucucaaccugccacuc

SEQ ID NO: 45667 - RNA, 24 nt, Human
ugccaaguguuuucaucacauccc

SEQ ID NO: 45668 - RNA, 20 nt, Human
ugccacaguagcccuagugu

SEQ ID NO: 45669 - RNA, 18 nt, Human
uggaacucaaguaagacc

SEQ ID NO: 45670 - RNA, 18 nt, Human
uuaaguguugccucucaa

SEQ ID NO: 45671 - RNA, 21 nt, Human
uucaucacauccccaaggcua

SEQ ID NO: 45672 - RNA, 22 nt, Human
uucuaaaacuucuuaccaguaa

SEQ ID NO: 45673 - RNA, 23 nt, Human
uuuuuuuuuuuuuuuugaugcag

SEQ ID NO: 45674 - RNA, 19 nt, Human
aaaacaagcaagggcccag

SEQ ID NO: 45675 - RNA, 18 nt, Human
aaaacaagcaagggcccg

SEQ ID NO: 45676 - RNA, 23 nt, Human
aagaauggauaaaagcaugaaua

SEQ ID NO: 45677 - RNA, 21 nt, Human
aauagagugauggaggcuuuu

SEQ ID NO: 45678 - RNA, 26 nt, Human
aauggauaaaagcaugaauagaagaa

SEQ ID NO: 45679 - RNA, 22 nt, Human
agaauggauaaaagcaugaaua

SEQ ID NO: 45680 - RNA, 23 nt, Human
agcuaugaagcaaacugcgagca

SEQ ID NO: 45681 - RNA, 23 nt, Human
cccagugugggccacaggguacc

SEQ ID NO: 45682 - RNA, 23 nt, Human
ccccagugugggccacagcugcu

SEQ ID NO: 45683 - RNA, 23 nt, Human
ccugagucaaaacaagcaagggc

SEQ ID NO: 45684 - RNA, 19 nt, Human
gaagacaggacagagaaga

SEQ ID NO: 45685 - RNA, 22 nt, Human
gauaaaagcaugaauagaagaa

SEQ ID NO: 45686 - RNA, 20 nt, Human
gcugcuucacagagcuauga

SEQ ID NO: 45687 - RNA, 27 nt, Human
gcugcuucacagagcuaugaagcaaac

SEQ ID NO: 45688 - RNA, 24 nt, Human
gcuucacagagcuaugaagcaaac

SEQ ID NO: 45689 - RNA, 20 nt, Human
ggaaggaacuaaauauaaaa

SEQ ID NO: 45690 - RNA, 22 nt, Human
gggaaggaacuaaauauaaaau

SEQ ID NO: 45691 - RNA, 23 nt, Human
uaaaaugagccaaauagagugau

SEQ ID NO: 45692 - RNA, 18 nt, Human
ucaaaacaagcaagggcc

SEQ ID NO: 45693 - RNA, 26 nt, Human
ugaaaaaaaaaucaggaauauugaga

SEQ ID NO: 45694 - RNA, 18 nt, Human
ugacuggggaaggaacua

SEQ ID NO: 45695 - RNA, 23 nt, Human
ugacuggggaaggaacuaaauau

SEQ ID NO: 45696 - RNA, 25 nt, Human
ugagucaaaacaagcaagggcccag

SEQ ID NO: 45697 - RNA, 25 nt, Human
ugccugagucaaaacaagcaagggc

SEQ ID NO: 45698 - RNA, 22 nt, Human
uggauaaaagcaugaauagaag

SEQ ID NO: 45699 - RNA, 22 nt, Human
uucacagagcuaugaagcaaac

SEQ ID NO: 45700 - RNA, 20 nt, Human
uugaaaaaaaaaucaggaau

SEQ ID NO: 45701 - RNA, 19 nt, Human
uuuuuuuuuuuuuugcuuu

SEQ ID NO: 45702 - RNA, 20 nt, Human
uuuuuuuuuuuuuuugcuuu

SEQ ID NO: 45703 - RNA, 22 nt, Human
uuuuuuuuuuuuuuugcuuuaa

SEQ ID NO: 45704 - RNA, 26 nt, Human
aaaaacuuuuccacucuaaggcacuc

SEQ ID NO: 45705 - RNA, 21 nt, Human
aacguguugaaacccaugcuu

SEQ ID NO: 45706 - RNA, 21 nt, Human
aagaccgcaacugaguucugg

SEQ ID NO: 45707 - RNA, 25 nt, Human
accuuaagagauggcccccuggagg

SEQ ID NO: 45708 - RNA, 19 nt, Human
acuccaaaaggaacagaaa

SEQ ID NO: 45709 - RNA, 20 nt, Human
acugugcuuuuugugugcuu

SEQ ID NO: 45710 - RNA, 20 nt, Human
agaauagacuuuuauuucau

SEQ ID NO: 45711 - RNA, 20 nt, Human
aucugaagaucccuuccaac

SEQ ID NO: 45712 - RNA, 20 nt, Human
augugugaaaaaaaggauga

SEQ ID NO: 45713 - RNA, 21 nt, Human
caaaaauaagaccgcaacuga

SEQ ID NO: 45714 - RNA, 24 nt, Human
caaaaggaacagaaagucaccagc

SEQ ID NO: 45715 - RNA, 22 nt, Human
cacaugcaugucaacuccaaaa

SEQ ID NO: 45716 - RNA, 21 nt, Human
caccagcaccaucugaagauc

SEQ ID NO: 45717 - RNA, 22 nt, Human
caccaucugaagaucccuucca

SEQ ID NO: 45718 - RNA, 23 nt, Human
caguuuuguucuuuuaccauuca

SEQ ID NO: 45719 - RNA, 21 nt, Human
cauauuccauugaguaaacac

SEQ ID NO: 45720 - RNA, 22 nt, Human
caucugaagaucccuuccaacu

SEQ ID NO: 45721 - RNA, 21 nt, Human
caugucaacuccaaaaggaac

SEQ ID NO: 45722 - RNA, 25 nt, Human
ccaucugaagaucccuuccaacugc

SEQ ID NO: 45723 - RNA, 21 nt, Human
cccaugcuuuggcuaucccua

SEQ ID NO: 45724 - RNA, 22 nt, Human
ccugcauuuccuccaagucuua

SEQ ID NO: 45725 - RNA, 19 nt, Human
ccuucuugggaaauugggg

SEQ ID NO: 45726 - RNA, 21 nt, Human
cugugauuuaaacaguacgaa

SEQ ID NO: 45727 - RNA, 27 nt, Human
cuucuugggaaauuggggaacucugag

SEQ ID NO: 45728 - RNA, 21 nt, Human
gaauauuuucuaaaacuuaag

SEQ ID NO: 45729 - RNA, 18 nt, Human
gagagccauaauguccuc

SEQ ID NO: 45730 - RNA, 18 nt, Human
gauauuuuccucugcuuc

SEQ ID NO: 45731 - RNA, 22 nt, Human
gauuuuuaaaugauaacaauuc

SEQ ID NO: 45732 - RNA, 19 nt, Human
gggcugcaaaauuauuggu

SEQ ID NO: 45733 - RNA, 18 nt, Human
uaaacacagaacuagcaa

SEQ ID NO: 45734 - RNA, 24 nt, Human
uaaugaauuuacucugaucaguuu

SEQ ID NO: 45735 - RNA, 22 nt, Human
uagaauacucaagguaguuccc

SEQ ID NO: 45736 - RNA, 22 nt, Human
uaucccuagguagaaaugaucc

SEQ ID NO: 45737 - RNA, 20 nt, Human
uauucauuucuguucuacug

SEQ ID NO: 45738 - RNA, 22 nt, Human
ucacauuacauauaaccaggaa

SEQ ID NO: 45739 - RNA, 23 nt, Human
uccaaaaggaacagaaagucacc

SEQ ID NO: 45740 - RNA, 21 nt, Human
uccacagcuccuagguauaug

SEQ ID NO: 45741 - RNA, 23 nt, Human
uccucaguucucauauuccauug

SEQ ID NO: 45742 - RNA, 24 nt, Human
ucucuuaguuuuucuuuuacucuu

SEQ ID NO: 45743 - RNA, 23 nt, Human
ucuggcuuuagugacaacgaagg

SEQ ID NO: 45744 - RNA, 24 nt, Human
ucuguaagcguuuagaaaaaucac

SEQ ID NO: 45745 - RNA, 26 nt, Human
ucuuauaccguguacaugacuccuac

SEQ ID NO: 45746 - RNA, 19 nt, Human
ucuucaguaauuacaucca

SEQ ID NO: 45747 - RNA, 19 nt, Human
ugacaacgaaggcaaaaug

SEQ ID NO: 45748 - RNA, 18 nt, Human
ugagggcaaauuguagcu

SEQ ID NO: 45749 - RNA, 24 nt, Human
ugagggcaaauuguagcuuuguuu

SEQ ID NO: 45750 - RNA, 21 nt, Human
ugaguaaacacagaacuagca

SEQ ID NO: 45751 - RNA, 22 nt, Human
ugauuaugaagagauauuuucc

SEQ ID NO: 45752 - RNA, 25 nt, Human
ugauuuaaacaguacgaaaggagaa

SEQ ID NO: 45753 - RNA, 20 nt, Human
ugcaaggagaguugucuuug

SEQ ID NO: 45754 - RNA, 19 nt, Human
ugcaggagaaaacagaagg

SEQ ID NO: 45755 - RNA, 21 nt, Human
uggcccccuggauuguggccu

SEQ ID NO: 45756 - RNA, 21 nt, Human
ugugauaauugcuaaugaauu

SEQ ID NO: 45757 - RNA, 20 nt, Human
uguggacucagccuuccccg

SEQ ID NO: 45758 - RNA, 19 nt, Human
uguuuuuuaauucuacagu

SEQ ID NO: 45759 - RNA, 19 nt, Human
uuagugacaacgaaggcaa

SEQ ID NO: 45760 - RNA, 18 nt, Human
uuccuccaagucuuauac

SEQ ID NO: 45761 - RNA, 22 nt, Human
uugcaggagaaaacagaagggu

SEQ ID NO: 45762 - RNA, 19 nt, Human
uuguggccucuaucucucc

SEQ ID NO: 45763 - RNA, 18 nt, Human
uuuccacucuaaacuaca

SEQ ID NO: 45764 - RNA, 24 nt, Human
uuugcaggagaaaacagaaggguc

SEQ ID NO: 45765 - RNA, 23 nt, Human
uuuuguucuuuuaccauucauag

SEQ ID NO: 45766 - RNA, 19 nt, Human
aacagaaugacuuuaaugc

SEQ ID NO: 45767 - RNA, 19 nt, Human
ccuggucgccgcggagggg

SEQ ID NO: 45768 - RNA, 19 nt, Human
cucucggcucgggcccugg

SEQ ID NO: 45769 - RNA, 22 nt, Human
cugcgggguggcuggagcucag

SEQ ID NO: 45770 - RNA, 22 nt, Human
cuucaaguuuuccauuuucuuc

SEQ ID NO: 45771 - RNA, 19 nt, Human
gacugcgggguggcuggag

SEQ ID NO: 45772 - RNA, 24 nt, Human
gccgcccccccauugagaagauuc

SEQ ID NO: 45773 - RNA, 18 nt, Human
uacgauggcagcaacgga

SEQ ID NO: 45774 - RNA, 24 nt, Human
ucgaaaaauaacaaaaugagguaa

SEQ ID NO: 45775 - RNA, 23 nt, Human
ucgggcccuggucgccgcggagg

SEQ ID NO: 45776 - RNA, 19 nt, Human
ugacugcgggguggcugga

SEQ ID NO: 45777 - RNA, 26 nt, Human
uggcagcaacggaaguuguuacaaag

SEQ ID NO: 45778 - RNA, 18 nt, Human
uuaacagaaugacuuuaa

SEQ ID NO: 45779 - RNA, 20 nt, Human
uuacaaagaaagugacugcg

SEQ ID NO: 45780 - RNA, 22 nt, Human
agcugcuucacaggauuccuga

SEQ ID NO: 45781 - RNA, 20 nt, Human
cacaguugugugcuagagac

SEQ ID NO: 45782 - RNA, 28 nt, Human
cagauuuauuaaaaaacacauagguaac

SEQ ID NO: 45783 - RNA, 22 nt, Human
gaaugauuuggaaaagaacuga

SEQ ID NO: 45784 - RNA, 21 nt, Human
gagacagagaggagcaggaaa

SEQ ID NO: 45785 - RNA, 19 nt, Human
gcuucacaggauuccugac

SEQ ID NO: 45786 - RNA, 24 nt, Human
uaccaguagccuauuucagauuua

SEQ ID NO: 45787 - RNA, 21 nt, Human
ucacaggauuccugacagugc

SEQ ID NO: 45788 - RNA, 21 nt, Human
ucagagcuuuggcuaggaaug

SEQ ID NO: 45789 - RNA, 24 nt, Human
ucagagcuuuggcuaggaaugauu

SEQ ID NO: 45790 - RNA, 20 nt, Human
uggaaaagaacugaaggcag

SEQ ID NO: 45791 - RNA, 20 nt, Human
uggaaaagaacugaaggcau

SEQ ID NO: 45792 - RNA, 23 nt, Human
ugugcuagagacagagaggagca

SEQ ID NO: 45793 - RNA, 23 nt, Human
uucacaggauuccugacagugcu

SEQ ID NO: 45794 - RNA, 23 nt, Human
aaaaaaaaccaaaacaaaacaaa

SEQ ID NO: 45795 - RNA, 23 nt, Human
aaaaaacaaauaaagccaugcca

SEQ ID NO: 45796 - RNA, 23 nt, Human
aaaaaacaaauaaagccaugcca

SEQ ID NO: 45797 - RNA, 26 nt, Human
aaaaaaccaaaacaaaacaaaaaaaa

SEQ ID NO: 45798 - RNA, 30 nt, Human
aaaaaaccaaaacaaaacaaaaaaaacaaa

SEQ ID NO: 45799 - RNA, 19 nt, Human
aaaacaaaacaaaaaaaac

SEQ ID NO: 45800 - RNA, 20 nt, Human
aaaacaaauaaagccaugcc

SEQ ID NO: 45801 - RNA, 19 nt, Human
aaaagccuucauacaucuc

SEQ ID NO: 45802 - RNA, 20 nt, Human
aaaccaaaacaaaacaaaaa

SEQ ID NO: 45803 - RNA, 23 nt, Human
aaaccaaaacaaaacaaaaaaaa

SEQ ID NO: 45804 - RNA, 26 nt, Human
aaaccaaaacaaaacaaaaaaaacaa

SEQ ID NO: 45805 - RNA, 21 nt, Human
aacaaugugcaaucaaagucc

SEQ ID NO: 45806 - RNA, 19 nt, Human
aacuggucucaagucagug

SEQ ID NO: 45807 - RNA, 18 nt, Human
aagccaaaaaaaaaaaaa

SEQ ID NO: 45808 - RNA, 22 nt, Human
aaguugggggacaaaaaggggg

SEQ ID NO: 45809 - RNA, 18 nt, Human
acaaaaagggggaagggg

SEQ ID NO: 45810 - RNA, 18 nt, Human
acaaaacaaaaaaaacaa

SEQ ID NO: 45811 - RNA, 20 nt, Human
acaaaacaaaaaaaacaaau

SEQ ID NO: 45812 - RNA, 21 nt, Human
acaaaacaaaaaaaacaaaua

SEQ ID NO: 45813 - RNA, 19 nt, Human
acccacucccagggagacc

SEQ ID NO: 45814 - RNA, 21 nt, Human
agcaaugcuaucaccuccccu

SEQ ID NO: 45815 - RNA, 22 nt, Human
agggggaagggggggcacgaag

SEQ ID NO: 45816 - RNA, 25 nt, Human
agggggaagggggggcacgaaggcu

SEQ ID NO: 45817 - RNA, 27 nt, Human
agggggaagggggggcacgaaggcuca

SEQ ID NO: 45818 - RNA, 18 nt, Human
agucaagccaaaaaaaaa

SEQ ID NO: 45819 - RNA, 25 nt, Human
auuuacacgaaagcaaugcuaucac

SEQ ID NO: 45820 - RNA, 21 nt, Human
caaaaaaaacaaauaaagcca

SEQ ID NO: 45821 - RNA, 27 nt, Human
caaaaaaaacaaauaaagccaugccaa

SEQ ID NO: 45822 - RNA, 23 nt, Human
caaaauaaaaaaguauuaaggcg

SEQ ID NO: 45823 - RNA, 23 nt, Human
caacaaugugcaaucaaaguccu

SEQ ID NO: 45824 - RNA, 29 nt, Human
caaguugggggacaaaaagggggaagggg

SEQ ID NO: 45825 - RNA, 24 nt, Human
caucucaaguugggggacaaaaag

SEQ ID NO: 45826 - RNA, 24 nt, Human
ccaaaaaaaaaaaaaaaaccaaaa

SEQ ID NO: 45827 - RNA, 27 nt, Human
ccaaaaaaaaaaaaaaaaccaaaacaa

SEQ ID NO: 45828 - RNA, 22 nt, Human
ccaaaacaaaacaaaaaaaaca

SEQ ID NO: 45829 - RNA, 21 nt, Human
ccaaaagccuucauacaucuc

SEQ ID NO: 45830 - RNA, 24 nt, Human
ccaaaagccuucauacaucucaag

SEQ ID NO: 45831 - RNA, 23 nt, Human
ccuccccuguguggacuugggag

SEQ ID NO: 45832 - RNA, 22 nt, Human
ccugagucaagccaaaaaaaaa

SEQ ID NO: 45833 - RNA, 19 nt, Human
cgcuccaaccgacugcugu

SEQ ID NO: 45834 - RNA, 22 nt, Human
cgcuccaaccgacugcugucac

SEQ ID NO: 45835 - RNA, 18 nt, Human
cggcaaaggcgaggcucu

SEQ ID NO: 45836 - RNA, 19 nt, Human
cuggcggcggguguggacg

SEQ ID NO: 45837 - RNA, 26 nt, Human
cuggucucaagucaguguacagguaa

SEQ ID NO: 45838 - RNA, 22 nt, Human
gaaagcaaugcuaucaccuccc

SEQ ID NO: 45839 - RNA, 20 nt, Human
gccaaaaaaaaaaaaaaaac

SEQ ID NO: 45840 - RNA, 24 nt, Human
gccaaaaaaaaaaaaaaaaccaaa

SEQ ID NO: 45841 - RNA, 22 nt, Human
gcccuggcugccuccacccacu

SEQ ID NO: 45842 - RNA, 18 nt, Human
gggacaaaaagggggaag

SEQ ID NO: 45843 - RNA, 26 nt, Human
gggcacgaaggcucaucauucaaaau

SEQ ID NO: 45844 - RNA, 20 nt, Human
ggggaagggggggcacgaag

SEQ ID NO: 45845 - RNA, 20 nt, Human
guugggggacaaaaaggggg

SEQ ID NO: 45846 - RNA, 20 nt, Human
uaaaaaaacaacaaugugca

SEQ ID NO: 45847 - RNA, 23 nt, Human
uaaauccugagucaagccaaaaa

SEQ ID NO: 45848 - RNA, 24 nt, Human
uaaauccugagucaagccaaaaaa

SEQ ID NO: 45849 - RNA, 23 nt, Human
uacacgaaagcaaugcuaucacc

SEQ ID NO: 45850 - RNA, 24 nt, Human
uacagguaagcccuggcugccucc

SEQ ID NO: 45851 - RNA, 18 nt, Human
ucaacuggucucaaguca

SEQ ID NO: 45852 - RNA, 22 nt, Human
ucaagccaaaaaaaaaaaaaaa

SEQ ID NO: 45853 - RNA, 23 nt, Human
ucaagccaaaaaaaaaaaaaaaa

SEQ ID NO: 45854 - RNA, 27 nt, Human
ucaagccaaaaaaaaaaaaaaaaccaa

SEQ ID NO: 45855 - RNA, 23 nt, Human
uccacccacucccagggagacca

SEQ ID NO: 45856 - RNA, 23 nt, Human
uccuuagagagaagugggguggc

SEQ ID NO: 45857 - RNA, 24 nt, Human
ugagucaagccaaaaaaaaaaaaa

SEQ ID NO: 45858 - RNA, 20 nt, Human
ugcaaucaaaguccucggcc

SEQ ID NO: 45859 - RNA, 21 nt, Human
uggcugccuccacccacuccc

SEQ ID NO: 45860 - RNA, 19 nt, Human
ugucaagaaaggguguaac

SEQ ID NO: 45861 - RNA, 24 nt, Human
ugucaagaaaggguguaacgcaac

SEQ ID NO: 45862 - RNA, 20 nt, Human
uguggacgggcggcggaucg

SEQ ID NO: 45863 - RNA, 22 nt, Human
uguggacgggcggcggaucggc

SEQ ID NO: 45864 - RNA, 22 nt, Human
uuaaaaaaacaacaaugugcaa

SEQ ID NO: 45865 - RNA, 19 nt, Human
uuaaggcgaagauuaaaaa

SEQ ID NO: 45866 - RNA, 22 nt, Human
uuaggauggcaagggacuuccu

SEQ ID NO: 45867 - RNA, 26 nt, Human
uucaaaauaaaacaaaauaaaaaagu

SEQ ID NO: 45868 - RNA, 25 nt, Human
aacaaauugcacguguguaaacaaa

SEQ ID NO: 45869 - RNA, 23 nt, Human
aagaugagggaaggugguuugga

SEQ ID NO: 45870 - RNA, 22 nt, Human
acaaacaaauugcacgugugua

SEQ ID NO: 45871 - RNA, 18 nt, Human
agguagauggagagagaa

SEQ ID NO: 45872 - RNA, 20 nt, Human
gguagauggagagagaaggc

SEQ ID NO: 45873 - RNA, 22 nt, Human
uaaagcaauaaauauuagaagc

SEQ ID NO: 45874 - RNA, 20 nt, Human
ugaaagaugagggaaggugg

SEQ ID NO: 45875 - RNA, 22 nt, Human
ugaugaaagaugagggaaggug

SEQ ID NO: 45876 - RNA, 19 nt, Human
cugguaacagaguagucuc

SEQ ID NO: 45877 - RNA, 24 nt, Human
cuucucccagugacugagggcugg

SEQ ID NO: 45878 - RNA, 23 nt, Human
gaggggauccuuggagaaccugu

SEQ ID NO: 45879 - RNA, 20 nt, Human
uaacagaguagucucgaggg

SEQ ID NO: 45880 - RNA, 22 nt, Human
uaacagaguagucucgagggga

SEQ ID NO: 45881 - RNA, 21 nt, Human
ucucccagugacugagggcug

SEQ ID NO: 45882 - RNA, 18 nt, Human
ugagugagcuggggacug

SEQ ID NO: 45883 - RNA, 22 nt, Human
uggagcaccgaggguaugagag

SEQ ID NO: 45884 - RNA, 19 nt, Human
uuggagaaccuguucugac

SEQ ID NO: 45885 - RNA, 19 nt, Human
aaacacacacgcaccaaug

SEQ ID NO: 45886 - RNA, 19 nt, Human
aacacacacgcaccaaugu

SEQ ID NO: 45887 - RNA, 24 nt, Human
aagacgagggcggccgggcggggu

SEQ ID NO: 45888 - RNA, 21 nt, Human
acagcagauggaacagauaga

SEQ ID NO: 45889 - RNA, 21 nt, Human
acccggguggaggcugggagc

SEQ ID NO: 45890 - RNA, 19 nt, Human
acuuuuuuuucuuuuuugc

SEQ ID NO: 45891 - RNA, 25 nt, Human
agaagaaaaaaaaaucaguaaaaag

SEQ ID NO: 45892 - RNA, 28 nt, Human
agaagaaaaaaaaaucaguaaaaaggaa

SEQ ID NO: 45893 - RNA, 24 nt, Human
agcagauggaacagauagaagaaa

SEQ ID NO: 45894 - RNA, 19 nt, Human
aggcaggagaugggcgacg

SEQ ID NO: 45895 - RNA, 20 nt, Human
agggcugggcugggcugggc

SEQ ID NO: 45896 - RNA, 30 nt, Human
auagaagaaaaaaaaaucaguaaaaaggaa

SEQ ID NO: 45897 - RNA, 20 nt, Human
caagacgagggcggccgggc

SEQ ID NO: 45898 - RNA, 22 nt, Human
caagaguacccccuaccccgac

SEQ ID NO: 45899 - RNA, 24 nt, Human
cccacaccaaaauggacaugagau

SEQ ID NO: 45900 - RNA, 23 nt, Human
gaacccaggcaggagaugggcga

SEQ ID NO: 45901 - RNA, 27 nt, Human
gagcugaaaccgaacccaggcaggaga

SEQ ID NO: 45902 - RNA, 25 nt, Human
gaguacccccuaccccgacucccac

SEQ ID NO: 45903 - RNA, 21 nt, Human
gcgcgcgugcuagggucugga

SEQ ID NO: 45904 - RNA, 20 nt, Human
gcggaggugcaaggcagggc

SEQ ID NO: 45905 - RNA, 21 nt, Human
ggagaugggcgacggcggagg

SEQ ID NO: 45906 - RNA, 26 nt, Human
ggaguagggcugggcugggcugggcc

SEQ ID NO: 45907 - RNA, 18 nt, Human
ggcagggaggaucgaugc

SEQ ID NO: 45908 - RNA, 24 nt, Human
ggcuggcggggccgggcucgcucc

SEQ ID NO: 45909 - RNA, 23 nt, Human
ggcugggcugggcuggcggggcc

SEQ ID NO: 45910 - RNA, 18 nt, Human
ggcugggcugggcugggc

SEQ ID NO: 45911 - RNA, 22 nt, Human
gggagggaguagggcugggcug

SEQ ID NO: 45912 - RNA, 25 nt, Human
gggagggaguagggcugggcugggc

SEQ ID NO: 45913 - RNA, 18 nt, Human
gggcugggcugggcuggg

SEQ ID NO: 45914 - RNA, 19 nt, Human
gggcugggcugggcugggc

SEQ ID NO: 45915 - RNA, 24 nt, Human
ggggagggaguagggcugggcugg

SEQ ID NO: 45916 - RNA, 26 nt, Human
ggggagggaguagggcugggcugggc

SEQ ID NO: 45917 - RNA, 21 nt, Human
guggggagggaguagggcugg

SEQ ID NO: 45918 - RNA, 26 nt, Human
uaacuuuuuuuucuuuuuugcagaaa

SEQ ID NO: 45919 - RNA, 21 nt, Human
uacccccuaccccgacuccca

SEQ ID NO: 45920 - RNA, 20 nt, Human
uaguuaaucuuuccucuuuu

SEQ ID NO: 45921 - RNA, 23 nt, Human
ucucugagcaacggcugcugccc

SEQ ID NO: 45922 - RNA, 19 nt, Human
ucuuccuccaccuucucuc

SEQ ID NO: 45923 - RNA, 22 nt, Human
ugcccuggcguggggagggagu

SEQ ID NO: 45924 - RNA, 24 nt, Human
ugcgcgcgugcuagggucuggauu

SEQ ID NO: 45925 - RNA, 23 nt, Human
uggauuucuuccuccaccuucuc

SEQ ID NO: 45926 - RNA, 25 nt, Human
uggcguggggagggaguagggcugg

SEQ ID NO: 45927 - RNA, 20 nt, Human
ugggcugggcuggcggggcc

SEQ ID NO: 45928 - RNA, 19 nt, Human
ugggcugggcugggcuggc

SEQ ID NO: 45929 - RNA, 20 nt, Human
uggggagggaguagggcugg

SEQ ID NO: 45930 - RNA, 21 nt, Human
uggggagggaguagggcuggg

SEQ ID NO: 45931 - RNA, 22 nt, Human
uuccgccgcggcgcugcuggcg

SEQ ID NO: 45932 - RNA, 22 nt, Human
uucgcgggcagggaggaucgau

SEQ ID NO: 45933 - RNA, 20 nt, Human
uugguuuuuaacguaacuuu

SEQ ID NO: 45934 - RNA, 20 nt, Human
aaacagagcacuuuuaugug

SEQ ID NO: 45935 - RNA, 22 nt, Human
aagcaucaaaaaaucacugacu

SEQ ID NO: 45936 - RNA, 21 nt, Human
aagcugucaacaagauggaaa

SEQ ID NO: 45937 - RNA, 24 nt, Human
aagcuuccgcaaaagaaagaacuc

SEQ ID NO: 45938 - RNA, 21 nt, Human
aauauacuccccuagggccaa

SEQ ID NO: 45939 - RNA, 18 nt, Human
aauaucuaguuauuccua

SEQ ID NO: 45940 - RNA, 24 nt, Human
aauccccggcaguuccaucucaca

SEQ ID NO: 45941 - RNA, 19 nt, Human
aauuugugguuuuuucccc

SEQ ID NO: 45942 - RNA, 22 nt, Human
acaaaaagcaugggaaccugga

SEQ ID NO: 45943 - RNA, 22 nt, Human
acuguccaaucccaggggugaa

SEQ ID NO: 45944 - RNA, 19 nt, Human
aggccuuuagacacagaac

SEQ ID NO: 45945 - RNA, 23 nt, Human
auaaauaauccuaaaaaccucau

SEQ ID NO: 45946 - RNA, 18 nt, Human
aucccaggggugaacaca

SEQ ID NO: 45947 - RNA, 24 nt, Human
aucuaguuauuccuacuacacaaa

SEQ ID NO: 45948 - RNA, 22 nt, Human
caaaagaaagaacucaccucca

SEQ ID NO: 45949 - RNA, 23 nt, Human
caaaagaaagaacucaccuccac

SEQ ID NO: 45950 - RNA, 22 nt, Human
caauuacugaacuacgaaaggc

SEQ ID NO: 45951 - RNA, 22 nt, Human
cagcaguaugagcaaaaagaaa

SEQ ID NO: 45952 - RNA, 22 nt, Human
ccuaaaaaccucauuucaccuu

SEQ ID NO: 45953 - RNA, 21 nt, Human
ccuccuaauuuccuauuacuc

SEQ ID NO: 45954 - RNA, 23 nt, Human
cgccugggcgcugggucucgggc

SEQ ID NO: 45955 - RNA, 21 nt, Human
cggacgcacgggcugacuggc

SEQ ID NO: 45956 - RNA, 20 nt, Human
cuacagcaguaugagcaaaa

SEQ ID NO: 45957 - RNA, 20 nt, Human
cucucuggcaauuaaacuga

SEQ ID NO: 45958 - RNA, 18 nt, Human
gagcacuuuuaugugguc

SEQ ID NO: 45959 - RNA, 22 nt, Human
gaggcggcgggcggcgggcggc

SEQ ID NO: 45960 - RNA, 19 nt, Human
gauacugguuucugacuug

SEQ ID NO: 45961 - RNA, 22 nt, Human
gcaaaagaaagaacucaccucc

SEQ ID NO: 45962 - RNA, 20 nt, Human
gcucgguuggccggggcugc

SEQ ID NO: 45963 - RNA, 22 nt, Human
gcugcggcggggcgcgaggggc

SEQ ID NO: 45964 - RNA, 24 nt, Human
ggaaaaacaggggggaauuauagc

SEQ ID NO: 45965 - RNA, 21 nt, Human
ggcggcgggcgcggggugacc

SEQ ID NO: 45966 - RNA, 20 nt, Human
ggcgggcggcgggcgcgggg

SEQ ID NO: 45967 - RNA, 19 nt, Human
ggcgggcggcgggcggcgg

SEQ ID NO: 45968 - RNA, 21 nt, Human
gggcgcgaggggcucggacgc

SEQ ID NO: 45969 - RNA, 25 nt, Human
gggcugcggcggggcgcgaggggcu

SEQ ID NO: 45970 - RNA, 20 nt, Human
guaugagcaaaaagaaagaa

SEQ ID NO: 45971 - RNA, 18 nt, Human
uaaaacuagaggcauaag

SEQ ID NO: 45972 - RNA, 27 nt, Human
uaaaacuagaggcauaaggaaguccug

SEQ ID NO: 45973 - RNA, 22 nt, Human
uaaaauaucuaguuauuccuac

SEQ ID NO: 45974 - RNA, 23 nt, Human
uaaagcuugucaaaguuuccagg

SEQ ID NO: 45975 - RNA, 19 nt, Human
uaagcauauuagagauaaa

SEQ ID NO: 45976 - RNA, 24 nt, Human
uacagcaguaugagcaaaaagaaa

SEQ ID NO: 45977 - RNA, 20 nt, Human
uacuacacaaaacauaugua

SEQ ID NO: 45978 - RNA, 22 nt, Human
uagaaucccaaauauacucccc

SEQ ID NO: 45979 - RNA, 20 nt, Human
uagcaggagugcauguagca

SEQ ID NO: 45980 - RNA, 25 nt, Human
uaugagcaaaaagaaagaaugaaca

SEQ ID NO: 45981 - RNA, 23 nt, Human
uauuacucaaguaauuuguucug

SEQ ID NO: 45982 - RNA, 21 nt, Human
uccuucugucccuagauccuc

SEQ ID NO: 45983 - RNA, 23 nt, Human
uccuucugucccuagauccuccu

SEQ ID NO: 45984 - RNA, 21 nt, Human
ucuuggguauuuuguauuuuc

SEQ ID NO: 45985 - RNA, 24 nt, Human
ucuuuuuaauccccggcaguucca

SEQ ID NO: 45986 - RNA, 22 nt, Human
ugacugaguugaccauccagcc

SEQ ID NO: 45987 - RNA, 23 nt, Human
ugagugauuacagaagcucagca

SEQ ID NO: 45988 - RNA, 19 nt, Human
ugccuugugaugaaccagu

SEQ ID NO: 45989 - RNA, 24 nt, Human
ugcuuuauucucuacaagcuguca

SEQ ID NO: 45990 - RNA, 21 nt, Human
uggaaucaauaaauaauccua

SEQ ID NO: 45991 - RNA, 30 nt, Human
uggaaucaauaaauaauccuaaaaaccucc

SEQ ID NO: 45992 - RNA, 22 nt, Human
uggccggggcugcggcggggcg

SEQ ID NO: 45993 - RNA, 27 nt, Human
ugggcgcugggucucgggcgaagcgga

SEQ ID NO: 45994 - RNA, 21 nt, Human
uguuaggauacacuguccaau

SEQ ID NO: 45995 - RNA, 23 nt, Human
uucccccucucucucucucaacu

SEQ ID NO: 45996 - RNA, 20 nt, Human
uugcauccuucucucuggca

SEQ ID NO: 45997 - RNA, 22 nt, Human
uugccuugugaugaaccaguca

SEQ ID NO: 45998 - RNA, 25 nt, Human
uuugugguuuuuuccccccggucuu

SEQ ID NO: 45999 - RNA, 22 nt, Human
uuuucccccucucucucucuca

SEQ ID NO: 46000 - RNA, 27 nt, Human
uuuuuucccccucucucucucucaacu

SEQ ID NO: 46001 - RNA, 22 nt, Human
cacagggugcauccucucucca

SEQ ID NO: 46002 - RNA, 21 nt, Human
cauagagaaccucagugguug

SEQ ID NO: 46003 - RNA, 24 nt, Human
ucagccacagggugcauccucucu

SEQ ID NO: 46004 - RNA, 20 nt, Human
uccgagggacggaugggauc

SEQ ID NO: 46005 - RNA, 18 nt, Human
uucagaagcacuuggcug

SEQ ID NO: 46006 - RNA, 19 nt, Human
accccggaggacugcagag

SEQ ID NO: 46007 - RNA, 18 nt, Human
aggaaugggacugugggg

SEQ ID NO: 46008 - RNA, 22 nt, Human
cacccacccaccccggaggacu

SEQ ID NO: 46009 - RNA, 26 nt, Human
cacccacccaccccggaggacugcag

SEQ ID NO: 46010 - RNA, 25 nt, Human
ccgcucccgccucagcucccgcccc

SEQ ID NO: 46011 - RNA, 20 nt, Human
cgucggggguguugggucag

SEQ ID NO: 46012 - RNA, 26 nt, Human
cuccuggaggccgucggggguguugg

SEQ ID NO: 46013 - RNA, 21 nt, Human
cugcccaggccccuccuggag

SEQ ID NO: 46014 - RNA, 22 nt, Human
gcccaggccccuccuggaggcc

SEQ ID NO: 46015 - RNA, 19 nt, Human
ugcauagauacagagugga

SEQ ID NO: 46016 - RNA, 21 nt, Human
ugcccaggccccuccuggagg

SEQ ID NO: 46017 - RNA, 22 nt, Human
ugcccaggccccuccuggaggc

SEQ ID NO: 46018 - RNA, 19 nt, Human
uggaggccgucgggggugu

SEQ ID NO: 46019 - RNA, 23 nt, Human
aaaaugucccccacccccuuuua

SEQ ID NO: 46020 - RNA, 19 nt, Human
aacaugccccgcccuccuu

SEQ ID NO: 46021 - RNA, 21 nt, Human
aaccacaggccuagcuggccc

SEQ ID NO: 46022 - RNA, 18 nt, Human
acccccuugcuggggaug

SEQ ID NO: 46023 - RNA, 20 nt, Human
acccccuugcuggggauggg

SEQ ID NO: 46024 - RNA, 28 nt, Human
acccccuuuuaggucugacuccuuauua

SEQ ID NO: 46025 - RNA, 20 nt, Human
acgaacaggagguggcaaug

SEQ ID NO: 46026 - RNA, 21 nt, Human
agagagggagguggggcccug

SEQ ID NO: 46027 - RNA, 21 nt, Human
agcucaauguuacuugugugu

SEQ ID NO: 46028 - RNA, 21 nt, Human
aggagcaaguggaugaagugc

SEQ ID NO: 46029 - RNA, 23 nt, Human
aggcauucuggcccuggagcuca

SEQ ID NO: 46030 - RNA, 24 nt, Human
aggcugcaggggggcacugcugug

SEQ ID NO: 46031 - RNA, 21 nt, Human
agggguucagggcaugcaggg

SEQ ID NO: 46032 - RNA, 21 nt, Human
aguauacgagccaagaccaaa

SEQ ID NO: 46033 - RNA, 20 nt, Human
caccagggcaucuacccagg

SEQ ID NO: 46034 - RNA, 22 nt, Human
caccagugggagcugcuggcug

SEQ ID NO: 46035 - RNA, 21 nt, Human
cacccccuuuuaggucugacu

SEQ ID NO: 46036 - RNA, 24 nt, Human
cagcccacuccccaaacuggcuac

SEQ ID NO: 46037 - RNA, 22 nt, Human
cagcccugagagucggagcagg

SEQ ID NO: 46038 - RNA, 20 nt, Human
cauccucugcccuggcucug

SEQ ID NO: 46039 - RNA, 22 nt, Human
ccacaacagccugacauggcgc

SEQ ID NO: 46040 - RNA, 22 nt, Human
ccagggggauacccacaacagc

SEQ ID NO: 46041 - RNA, 20 nt, Human
cccaacaugccccgcccucc

SEQ ID NO: 46042 - RNA, 23 nt, Human
cccaacaugccccgcccuccuug

SEQ ID NO: 46043 - RNA, 24 nt, Human
cccacaacagccugacauggcgcu

SEQ ID NO: 46044 - RNA, 20 nt, Human
cccacacgccagcucaaggc

SEQ ID NO: 46045 - RNA, 20 nt, Human
cccccucucccaacaugccc

SEQ ID NO: 46046 - RNA, 21 nt, Human
cccccucucccaacaugcccc

SEQ ID NO: 46047 - RNA, 21 nt, Human
cccccuuuuaggucugacucc

SEQ ID NO: 46048 - RNA, 19 nt, Human
ccccucccucccccucucc

SEQ ID NO: 46049 - RNA, 21 nt, Human
ccccucccucccccucuccca

SEQ ID NO: 46050 - RNA, 18 nt, Human
ccccuugcuggggaugga

SEQ ID NO: 46051 - RNA, 22 nt, Human
cccuacaccagggcaucuaccc

SEQ ID NO: 46052 - RNA, 21 nt, Human
cccucaauaaaugaugagcau

SEQ ID NO: 46053 - RNA, 20 nt, Human
cccuuucccacccagggugc

SEQ ID NO: 46054 - RNA, 22 nt, Human
ccuacaccagggcaucuaccca

SEQ ID NO: 46055 - RNA, 26 nt, Human
ccuacaccagggcaucuacccaggaa

SEQ ID NO: 46056 - RNA, 21 nt, Human
ccuguccaugcagcucaaugu

SEQ ID NO: 46057 - RNA, 22 nt, Human
cucccccucucccaacaugccc

SEQ ID NO: 46058 - RNA, 18 nt, Human
cugcacccccuugcuggg

SEQ ID NO: 46059 - RNA, 20 nt, Human
cugugccacccacccagggg

SEQ ID NO: 46060 - RNA, 21 nt, Human
cuugcagcccacuccccaaac

SEQ ID NO: 46061 - RNA, 18 nt, Human
gaagauaggaggacagag

SEQ ID NO: 46062 - RNA, 20 nt, Human
gagccaagaccaaaaagggu

SEQ ID NO: 46063 - RNA, 23 nt, Human
gaggguagagggaggagcaagug

SEQ ID NO: 46064 - RNA, 21 nt, Human
gccccuugcagcccacucccc

SEQ ID NO: 46065 - RNA, 20 nt, Human
gcccugagagucggagcagg

SEQ ID NO: 46066 - RNA, 21 nt, Human
ggccgcgccggcccugcccag

SEQ ID NO: 46067 - RNA, 23 nt, Human
ggcgcucaauucccacacgccag

SEQ ID NO: 46068 - RNA, 22 nt, Human
ggcugccccuugcagcccacuc

SEQ ID NO: 46069 - RNA, 22 nt, Human
gggagguggggcccuggccaca

SEQ ID NO: 46070 - RNA, 18 nt, Human
gguagagggaggagcaag

SEQ ID NO: 46071 - RNA, 22 nt, Human
gugacacaccagugggagcugc

SEQ ID NO: 46072 - RNA, 23 nt, Human
uaagaaaaugucccccacccccu

SEQ ID NO: 46073 - RNA, 19 nt, Human
uaaugauuuacaaaaguuu

SEQ ID NO: 46074 - RNA, 23 nt, Human
ucagggaggcagcccugagaguc

SEQ ID NO: 46075 - RNA, 22 nt, Human
uccaugcagcucaauguuacuu

SEQ ID NO: 46076 - RNA, 22 nt, Human
ucccaacaugccccgcccuccu

SEQ ID NO: 46077 - RNA, 24 nt, Human
ucccaacaugccccgcccuccuug

SEQ ID NO: 46078 - RNA, 19 nt, Human
ucugucuccccucccuccc

SEQ ID NO: 46079 - RNA, 19 nt, Human
ugacccugggcugcacccc

SEQ ID NO: 46080 - RNA, 20 nt, Human
ugacccugggcugcaccccc

SEQ ID NO: 46081 - RNA, 22 nt, Human
ugagagagggagguggggcccu

SEQ ID NO: 46082 - RNA, 19 nt, Human
ugccacccacccagggguu

SEQ ID NO: 46083 - RNA, 23 nt, Human
ugccacccacccagggguucagg

SEQ ID NO: 46084 - RNA, 20 nt, Human
ugccccgcccuccuugggca

SEQ ID NO: 46085 - RNA, 19 nt, Human
ugccccuugcagcccacuc

SEQ ID NO: 46086 - RNA, 21 nt, Human
ugccccuugcagcccacuccc

SEQ ID NO: 46087 - RNA, 20 nt, Human
ugcccuggcucugaagggcc

SEQ ID NO: 46088 - RNA, 22 nt, Human
ugcccuggcucugaagggccug

SEQ ID NO: 46089 - RNA, 21 nt, Human
ugcugugccacccacccaggg

SEQ ID NO: 46090 - RNA, 23 nt, Human
uggagcucagggaggcagcccug

SEQ ID NO: 46091 - RNA, 21 nt, Human
uguagaggggaaggcugcagg

SEQ ID NO: 46092 - RNA, 24 nt, Human
ugucuccccucccucccccucucc

SEQ ID NO: 46093 - RNA, 18 nt, Human
ugugugcauguccugugu

SEQ ID NO: 46094 - RNA, 19 nt, Human
ugugugcauguccugugua

SEQ ID NO: 46095 - RNA, 21 nt, Human
uucaguacucagcccuacacc

SEQ ID NO: 46096 - RNA, 21 nt, Human
uucuugggugagguaagaaaa

SEQ ID NO: 46097 - RNA, 22 nt, Human
uuucuugggugagguaagaaaa

SEQ ID NO: 46098 - RNA, 18 nt, Human
aaaaaguagauuaaaaca

SEQ ID NO: 46099 - RNA, 22 nt, Human
acucuggucacugggguacucg

SEQ ID NO: 46100 - RNA, 20 nt, Human
acugcauuacagacugggcg

SEQ ID NO: 46101 - RNA, 24 nt, Human
acugcauuacagacugggcgacag

SEQ ID NO: 46102 - RNA, 23 nt, Human
acugcuugagccugggaggugga

SEQ ID NO: 46103 - RNA, 19 nt, Human
agacccuugagccgcccaa

SEQ ID NO: 46104 - RNA, 20 nt, Human
agcacauguguaaaaugcag

SEQ ID NO: 46105 - RNA, 24 nt, Human
aggcguuccugggauuaugaguuc

SEQ ID NO: 46106 - RNA, 30 nt, Human
aggcucuuggucacaucugcccacaguccu

SEQ ID NO: 46107 - RNA, 19 nt, Human
agguggaggcugcaguggg

SEQ ID NO: 46108 - RNA, 25 nt, Human
agguggaggcugcagugggcuaugg

SEQ ID NO: 46109 - RNA, 19 nt, Human
aguaaggaaugcaaagaau

SEQ ID NO: 46110 - RNA, 20 nt, Human
auaaagaagagaagcacagg

SEQ ID NO: 46111 - RNA, 20 nt, Human
caauaaagaagagaagcaca

SEQ ID NO: 46112 - RNA, 20 nt, Human
cacaguccuucaagccgcgu

SEQ ID NO: 46113 - RNA, 24 nt, Human
cacugcauuacagacugggcgaca

SEQ ID NO: 46114 - RNA, 19 nt, Human
caggacuaaaauucuacug

SEQ ID NO: 46115 - RNA, 22 nt, Human
cagugugacgcuuaccaaugcu

SEQ ID NO: 46116 - RNA, 24 nt, Human
ccauucugacaaccagucaggcca

SEQ ID NO: 46117 - RNA, 21 nt, Human
cccguagcguucaggacuaaa

SEQ ID NO: 46118 - RNA, 23 nt, Human
ccgcccaauaucucugaaaacgc

SEQ ID NO: 46119 - RNA, 19 nt, Human
ccugggagguggaggcugc

SEQ ID NO: 46120 - RNA, 25 nt, Human
cgcccaauaucucugaaaacgcuau

SEQ ID NO: 46121 - RNA, 19 nt, Human
cgcgugcccucguucagag

SEQ ID NO: 46122 - RNA, 24 nt, Human
cgguggugucacguggguaauggc

SEQ ID NO: 46123 - RNA, 22 nt, Human
cuccagcagcucucacuuuggc

SEQ ID NO: 46124 - RNA, 19 nt, Human
cucuuggucacaucugccu

SEQ ID NO: 46125 - RNA, 24 nt, Human
cugaagaaaaugcauuuuccccgu

SEQ ID NO: 46126 - RNA, 24 nt, Human
cugcuugagccugggagguggagg

SEQ ID NO: 46127 - RNA, 20 nt, Human
cuguaauaaaaucauaagac

SEQ ID NO: 46128 - RNA, 19 nt, Human
cuugagccugggaggugga

SEQ ID NO: 46129 - RNA, 26 nt, Human
gaaaaugcauuuuccccguagcguuc

SEQ ID NO: 46130 - RNA, 24 nt, Human
gacugcuugagccugggaggugga

SEQ ID NO: 46131 - RNA, 19 nt, Human
gaguucuccagcagcucuc

SEQ ID NO: 46132 - RNA, 20 nt, Human
gcaauaaagaagagaagcac

SEQ ID NO: 46133 - RNA, 24 nt, Human
gccugggagguggaggcugcagug

SEQ ID NO: 46134 - RNA, 18 nt, Human
gcgugcccucguucagag

SEQ ID NO: 46135 - RNA, 20 nt, Human
ggacugcuugagccugggag

SEQ ID NO: 46136 - RNA, 21 nt, Human
ggaggcugcagugggcuaugg

SEQ ID NO: 46137 - RNA, 26 nt, Human
ggaggcugcagugggcuauggcuagg

SEQ ID NO: 46138 - RNA, 24 nt, Human
ggaggcugcagugggcuaugguca

SEQ ID NO: 46139 - RNA, 21 nt, Human
ggcgaggggggaaggacugcu

SEQ ID NO: 46140 - RNA, 21 nt, Human
ggggggaaggacugcuugagc

SEQ ID NO: 46141 - RNA, 20 nt, Human
gugaaagcuaugcaaagcca

SEQ ID NO: 46142 - RNA, 19 nt, Human
uaaaaugcagcaaagucug

SEQ ID NO: 46143 - RNA, 22 nt, Human
uaaaaugcagcaaagucugaca

SEQ ID NO: 46144 - RNA, 23 nt, Human
uaaagaagagaagcacaggcaau

SEQ ID NO: 46145 - RNA, 30 nt, Human
uaagcuuuaacauaugcacaaagcaguuuu

SEQ ID NO: 46146 - RNA, 18 nt, Human
uacacacauacaaaugug

SEQ ID NO: 46147 - RNA, 22 nt, Human
uacacacauacaaaugugaagc

SEQ ID NO: 46148 - RNA, 30 nt, Human
uaugaacugaaaaaaaguuacagucuacaa

SEQ ID NO: 46149 - RNA, 21 nt, Human
uaugcacaaagcaguuuugua

SEQ ID NO: 46150 - RNA, 22 nt, Human
uauugcugauuaaaaauucacc

SEQ ID NO: 46151 - RNA, 21 nt, Human
uccugggauuaugaguucucc

SEQ ID NO: 46152 - RNA, 18 nt, Human
ucguucagagcuucucuc

SEQ ID NO: 46153 - RNA, 19 nt, Human
ucucacucuggucacuggg

SEQ ID NO: 46154 - RNA, 23 nt, Human
ucugacaaccagucaggccagca

SEQ ID NO: 46155 - RNA, 20 nt, Human
ucugcccacaguccuucaag

SEQ ID NO: 46156 - RNA, 24 nt, Human
ucuguaauaaaaucauaagaccac

SEQ ID NO: 46157 - RNA, 20 nt, Human
ucuuuuaggauuucucuguu

SEQ ID NO: 46158 - RNA, 22 nt, Human
ugaaaugcccaguucacaguca

SEQ ID NO: 46159 - RNA, 22 nt, Human
ugaacaguucgugaaaugccca

SEQ ID NO: 46160 - RNA, 22 nt, Human
ugaagcacuuaaaaugugauuu

SEQ ID NO: 46161 - RNA, 22 nt, Human
ugacgcuuaccaaugcuccagg

SEQ ID NO: 46162 - RNA, 18 nt, Human
ugagccugggagguggag

SEQ ID NO: 46163 - RNA, 24 nt, Human
ugagccugggagguggaggcugca

SEQ ID NO: 46164 - RNA, 22 nt, Human
ugcaaagaauuccuagugcaau

SEQ ID NO: 46165 - RNA, 22 nt, Human
uggcagaguuuaaaugcacgua

SEQ ID NO: 46166 - RNA, 18 nt, Human
ugggagguggaggcugca

SEQ ID NO: 46167 - RNA, 24 nt, Human
ugggagguggaggcugcagugggc

SEQ ID NO: 46168 - RNA, 21 nt, Human
uggggagggagacagauggau

SEQ ID NO: 46169 - RNA, 23 nt, Human
uggggagggagacagauggauuc

SEQ ID NO: 46170 - RNA, 22 nt, Human
uguaaaaugcagcaaagucuga

SEQ ID NO: 46171 - RNA, 22 nt, Human
uguaaacaucagcacaugugua

SEQ ID NO: 46172 - RNA, 19 nt, Human
uguuccuccagucccuacc

SEQ ID NO: 46173 - RNA, 23 nt, Human
uuaaaaauucaccaccuccuuga

SEQ ID NO: 46174 - RNA, 21 nt, Human
uuaugaguucuccagcagcuc

SEQ ID NO: 46175 - RNA, 22 nt, Human
uuccuucuugacacuaugaaaa

SEQ ID NO: 46176 - RNA, 18 nt, Human
uucucuguguuccuccag

SEQ ID NO: 46177 - RNA, 21 nt, Human
uugagccugggagguggaggc

SEQ ID NO: 46178 - RNA, 20 nt, Human
uuuguaaaaacuacuaagug

SEQ ID NO: 46179 - RNA, 22 nt, Human
aagcacggacagcaugacgacc

SEQ ID NO: 46180 - RNA, 21 nt, Human
acacggcuggacagacaaagc

SEQ ID NO: 46181 - RNA, 24 nt, Human
accacacccccgaccugcacaugc

SEQ ID NO: 46182 - RNA, 19 nt, Human
accaccgccgccgccgccg

SEQ ID NO: 46183 - RNA, 18 nt, Human
accacuguggcaugaggg

SEQ ID NO: 46184 - RNA, 18 nt, Human
agcaugacgaccacaccc

SEQ ID NO: 46185 - RNA, 19 nt, Human
agcgcggcucagagcugcc

SEQ ID NO: 46186 - RNA, 24 nt, Human
agcuccguguggagagagggagca

SEQ ID NO: 46187 - RNA, 21 nt, Human
agggaggaggggaaagcgcgg

SEQ ID NO: 46188 - RNA, 22 nt, Human
agggcugggcagaaacgagagg

SEQ ID NO: 46189 - RNA, 19 nt, Human
aucuuccugccucagccuc

SEQ ID NO: 46190 - RNA, 24 nt, Human
caaagcgcuacgauuacaggccua

SEQ ID NO: 46191 - RNA, 22 nt, Human
caagcuaucuuccugccucagc

SEQ ID NO: 46192 - RNA, 21 nt, Human
cacacacacacucacacgcac

SEQ ID NO: 46193 - RNA, 25 nt, Human
cacacacucacacgcacguguaagg

SEQ ID NO: 46194 - RNA, 19 nt, Human
cacacgcacguguaagggc

SEQ ID NO: 46195 - RNA, 24 nt, Human
cacauugcccagguuugucucgaa

SEQ ID NO: 46196 - RNA, 19 nt, Human
caccacaccaggcccaaag

SEQ ID NO: 46197 - RNA, 20 nt, Human
caccacaccaggcccaaagc

SEQ ID NO: 46198 - RNA, 20 nt, Human
caccgccgccgccgccgccg

SEQ ID NO: 46199 - RNA, 20 nt, Human
caccuacagacacacacaca

SEQ ID NO: 46200 - RNA, 26 nt, Human
caccuuggugugcugugggcuggucc

SEQ ID NO: 46201 - RNA, 33 nt, Human
cagacacacacacacacucacacgcacguggug

SEQ ID NO: 46202 - RNA, 23 nt, Human
cagcaugacgaccacacccccga

SEQ ID NO: 46203 - RNA, 25 nt, Human
cagcaugacgaccacacccccgacc

SEQ ID NO: 46204 - RNA, 20 nt, Human
cagcguccaucccagggagg

SEQ ID NO: 46205 - RNA, 24 nt, Human
caggcacaacgggggacgcaccuc

SEQ ID NO: 46206 - RNA, 25 nt, Human
caggcacaacgggggacgcaccucg

SEQ ID NO: 46207 - RNA, 23 nt, Human
cagggcuccuggccacagagggc

SEQ ID NO: 46208 - RNA, 21 nt, Human
cagggggcuccucuggggccu

SEQ ID NO: 46209 - RNA, 23 nt, Human
cauggcuccuggccacgugccag

SEQ ID NO: 46210 - RNA, 19 nt, Human
ccaccacaccaggcccaaa

SEQ ID NO: 46211 - RNA, 20 nt, Human
ccaccacaccaggcccaaaa

SEQ ID NO: 46212 - RNA, 19 nt, Human
ccaccgccgccgccgccgc

SEQ ID NO: 46213 - RNA, 18 nt, Human
ccagggcuccuggccaca

SEQ ID NO: 46214 - RNA, 24 nt, Human
cccacauugcccagguuugucucg

SEQ ID NO: 46215 - RNA, 24 nt, Human
ccccacauugcccagguuugucuc

SEQ ID NO: 46216 - RNA, 23 nt, Human
cccccgaccugcacaugcacaga

SEQ ID NO: 46217 - RNA, 23 nt, Human
ccgccgccgccgccgcagcccag

SEQ ID NO: 46218 - RNA, 24 nt, Human
ccgccgccgccgccgcagcccagc

SEQ ID NO: 46219 - RNA, 18 nt, Human
ccgccgccgccgccgccg

SEQ ID NO: 46220 - RNA, 21 nt, Human
ccggccccucccaagcgcccc

SEQ ID NO: 46221 - RNA, 22 nt, Human
ccuacagacacacacacacacu

SEQ ID NO: 46222 - RNA, 18 nt, Human
ccuccggccccucccaag

SEQ ID NO: 46223 - RNA, 21 nt, Human
ccucuggggccugaccccauu

SEQ ID NO: 46224 - RNA, 25 nt, Human
ccucuugcgggccagggcuccuggc

SEQ ID NO: 46225 - RNA, 18 nt, Human
ccuuuucuucuucuaggc

SEQ ID NO: 46226 - RNA, 21 nt, Human
cgaaccaggcacaacggggga

SEQ ID NO: 46227 - RNA, 26 nt, Human
cgcuacgauuacaggccuaugccacc

SEQ ID NO: 46228 - RNA, 23 nt, Human
cggcacaugcacacacggcugga

SEQ ID NO: 46229 - RNA, 18 nt, Human
cggcuggacagacaaagc

SEQ ID NO: 46230 - RNA, 22 nt, Human
cguuagaauauacugcuucuga

SEQ ID NO: 46231 - RNA, 18 nt, Human
cucaagcuaucuuccugc

SEQ ID NO: 46232 - RNA, 21 nt, Human
cucaagcuaucuuccugccuc

SEQ ID NO: 46233 - RNA, 21 nt, Human
cucccaagcgccccugucaug

SEQ ID NO: 46234 - RNA, 25 nt, Human
cucccgggcucugucccucuugcgg

SEQ ID NO: 46235 - RNA, 20 nt, Human
cuccucuggggccugacccc

SEQ ID NO: 46236 - RNA, 18 nt, Human
cucuggggccugacccca

SEQ ID NO: 46237 - RNA, 21 nt, Human
cugaccccauugucaagaaac

SEQ ID NO: 46238 - RNA, 23 nt, Human
cugccucagccucucaaagcgcu

SEQ ID NO: 46239 - RNA, 22 nt, Human
cuguagcccuaaagggcuuggg

SEQ ID NO: 46240 - RNA, 22 nt, Human
cuuccugccucagccucucaaa

SEQ ID NO: 46241 - RNA, 24 nt, Human
cuuccugccucagccucucaaagc

SEQ ID NO: 46242 - RNA, 23 nt, Human
cuucugguucuuccgggccaccu

SEQ ID NO: 46243 - RNA, 23 nt, Human
cuugcgggccagggcuccuggcc

SEQ ID NO: 46244 - RNA, 18 nt, Human
cuuuucuucuucuaggcu

SEQ ID NO: 46245 - RNA, 31 nt, Human
gacacacacacacacucacacgcacguguag

SEQ ID NO: 46246 - RNA, 18 nt, Human
gaccacacccccgaccug

SEQ ID NO: 46247 - RNA, 23 nt, Human
gagauggggucuccccacauugc

SEQ ID NO: 46248 - RNA, 23 nt, Human
gcacggacagcaugacgaccaca

SEQ ID NO: 46249 - RNA, 23 nt, Human
gggaggaggggaaagcgcggcuc

SEQ ID NO: 46250 - RNA, 20 nt, Human
ggggcacuccccgccacgga

SEQ ID NO: 46251 - RNA, 21 nt, Human
ggggcuccucuggggccugac

SEQ ID NO: 46252 - RNA, 27 nt, Human
gugcgcaccuacagacacacacacaca

SEQ ID NO: 46253 - RNA, 31 nt, Human
uacagacacacacacacacucacacgcacgg

SEQ ID NO: 46254 - RNA, 21 nt, Human
uacaggccuaugccaccacac

SEQ ID NO: 46255 - RNA, 24 nt, Human
uacgauuacaggccuaugccacca

SEQ ID NO: 46256 - RNA, 19 nt, Human
uacugaaaagaggcaccag

SEQ ID NO: 46257 - RNA, 19 nt, Human
ucaagaaacccuuuucucc

SEQ ID NO: 46258 - RNA, 18 nt, Human
uccacuggcagucucccg

SEQ ID NO: 46259 - RNA, 21 nt, Human
uccacuggcagucucccggca

SEQ ID NO: 46260 - RNA, 19 nt, Human
uccaggacaagagacugua

SEQ ID NO: 46261 - RNA, 24 nt, Human
ucccacuacaaccaguucgaggug

SEQ ID NO: 46262 - RNA, 25 nt, Human
uccccgccacggacuaauaaaacaa

SEQ ID NO: 46263 - RNA, 19 nt, Human
ucccgggcucugucccucu

SEQ ID NO: 46264 - RNA, 24 nt, Human
ucucaaagcgcuacgauuacaggc

SEQ ID NO: 46265 - RNA, 21 nt, Human
ucucagggggcuccucugggg

SEQ ID NO: 46266 - RNA, 23 nt, Human
ucucccggcagcguccaucccag

SEQ ID NO: 46267 - RNA, 24 nt, Human
ucucgaacucucugagcucaagcu

SEQ ID NO: 46268 - RNA, 18 nt, Human
ucuuccgggccaccuugg

SEQ ID NO: 46269 - RNA, 22 nt, Human
ucuucuaggcugugaacuccaa

SEQ ID NO: 46270 - RNA, 22 nt, Human
ugagaggggcugcacuucuggu

SEQ ID NO: 46271 - RNA, 18 nt, Human
ugaguucuccacacaauu

SEQ ID NO: 46272 - RNA, 23 nt, Human
ugcacacacggcuggacagacaa

SEQ ID NO: 46273 - RNA, 19 nt, Human
ugcacagaaagcucaagca

SEQ ID NO: 46274 - RNA, 18 nt, Human
ugccaccacaccaggccc

SEQ ID NO: 46275 - RNA, 21 nt, Human
ugccaggagcuccguguggag

SEQ ID NO: 46276 - RNA, 25 nt, Human
ugccucagccucucaaagcgcuacg

SEQ ID NO: 46277 - RNA, 24 nt, Human
uggcaacaccucgguuccuccggc

SEQ ID NO: 46278 - RNA, 22 nt, Human
uggcacccuacaggguccagga

SEQ ID NO: 46279 - RNA, 19 nt, Human
uggcacugaguucuccaca

SEQ ID NO: 46280 - RNA, 18 nt, Human
uggcaugaggggcucugg

SEQ ID NO: 46281 - RNA, 24 nt, Human
uggggucuccccacauugcccagg

SEQ ID NO: 46282 - RNA, 23 nt, Human
uguagagauggggucuccccaca

SEQ ID NO: 46283 - RNA, 21 nt, Human
ugucucaaacccaacauggga

SEQ ID NO: 46284 - RNA, 23 nt, Human
uucuucuaggcugugaacuccaa

SEQ ID NO: 46285 - RNA, 21 nt, Human
uccacugagucuggagagaca

SEQ ID NO: 46286 - RNA, 20 nt, Human
acacuaccucuacccagaua

SEQ ID NO: 46287 - RNA, 21 nt, Human
accggggccaccuccccucca

SEQ ID NO: 46288 - RNA, 22 nt, Human
accuccccuccaccgcgcggcc

SEQ ID NO: 46289 - RNA, 18 nt, Human
acugccccccaccccccc

SEQ ID NO: 46290 - RNA, 18 nt, Human
acugccccccaccccccc

SEQ ID NO: 46291 - RNA, 24 nt, Human
agcacacaccacacucacacuacc

SEQ ID NO: 46292 - RNA, 27 nt, Human
aggcagaaaggaaucaggugcuccugg

SEQ ID NO: 46293 - RNA, 22 nt, Human
agggcaccauccacugcccccc

SEQ ID NO: 46294 - RNA, 24 nt, Human
auccacugccccccacccccccag

SEQ ID NO: 46295 - RNA, 21 nt, Human
cacacaccacacucacacuac

SEQ ID NO: 46296 - RNA, 22 nt, Human
cacacucacacuaccucuaccc

SEQ ID NO: 46297 - RNA, 20 nt, Human
caccacucccuccuaauaaa

SEQ ID NO: 46298 - RNA, 21 nt, Human
caccauccacugccccccacc

SEQ ID NO: 46299 - RNA, 19 nt, Human
caccgcgcggccgcaguug

SEQ ID NO: 46300 - RNA, 23 nt, Human
caccgcgcggccgcaguugcacc

SEQ ID NO: 46301 - RNA, 21 nt, Human
cacucccuccuaauaaaccgu

SEQ ID NO: 46302 - RNA, 18 nt, Human
cacugccccccacccccc

SEQ ID NO: 46303 - RNA, 23 nt, Human
cagaaaggaaucaggugcuccug

SEQ ID NO: 46304 - RNA, 22 nt, Human
cagcgcuggacggcgggcuggg

SEQ ID NO: 46305 - RNA, 18 nt, Human
caguugcaccgccagcgc

SEQ ID NO: 46306 - RNA, 18 nt, Human
ccacugccccccaccccc

SEQ ID NO: 46307 - RNA, 21 nt, Human
ccacugccccccaccccccca

SEQ ID NO: 46308 - RNA, 21 nt, Human
ccagauagggcaccauccacu

SEQ ID NO: 46309 - RNA, 19 nt, Human
ccccacccccccagccccc

SEQ ID NO: 46310 - RNA, 24 nt, Human
ccccacccccccagcccccugcag

SEQ ID NO: 46311 - RNA, 18 nt, Human
ccccagcacacaccacac

SEQ ID NO: 46312 - RNA, 18 nt, Human
ccccagcccccugcaggc

SEQ ID NO: 46313 - RNA, 21 nt, Human
cccccacccccccagcccccu

SEQ ID NO: 46314 - RNA, 25 nt, Human
ccccccacccccccagcccccugca

SEQ ID NO: 46315 - RNA, 22 nt, Human
cccccugcaggcagaaaggaau

SEQ ID NO: 46316 - RNA, 27 nt, Human
cccccugcaggcagaaaggaaucaggu

SEQ ID NO: 46317 - RNA, 19 nt, Human
cccgggacugggauggggg

SEQ ID NO: 46318 - RNA, 18 nt, Human
ccgcgcggccgcaguugc

SEQ ID NO: 46319 - RNA, 23 nt, Human
ccucccgggacugggaugggggc

SEQ ID NO: 46320 - RNA, 18 nt, Human
ccugccuggcccagcucc

SEQ ID NO: 46321 - RNA, 22 nt, Human
cgcucggcgcagcuggcgcggc

SEQ ID NO: 46322 - RNA, 22 nt, Human
cggaccgggcuggagccgggga

SEQ ID NO: 46323 - RNA, 22 nt, Human
cucugggcccgcucugcgggug

SEQ ID NO: 46324 - RNA, 19 nt, Human
cuggagccggggaggggcu

SEQ ID NO: 46325 - RNA, 18 nt, Human
cuggcgcggcagccuccc

SEQ ID NO: 46326 - RNA, 18 nt, Human
gcacacaccacacucaca

SEQ ID NO: 46327 - RNA, 24 nt, Human
gcacacaccacacucacacuaccu

SEQ ID NO: 46328 - RNA, 24 nt, Human
gcaccgccagcgcuggacggcggg

SEQ ID NO: 46329 - RNA, 18 nt, Human
ggacugggaugggggcug

SEQ ID NO: 46330 - RNA, 21 nt, Human
gggcuggagccggggaggggc

SEQ ID NO: 46331 - RNA, 19 nt, Human
gggcugggguccggcgcgg

SEQ ID NO: 46332 - RNA, 20 nt, Human
ggggaggggcucgcucggcg

SEQ ID NO: 46333 - RNA, 20 nt, Human
ucacacuaccucuacccaga

SEQ ID NO: 46334 - RNA, 18 nt, Human
uccaccacucccuccuaa

SEQ ID NO: 46335 - RNA, 22 nt, Human
uccaccacucccuccuaauaaa

SEQ ID NO: 46336 - RNA, 19 nt, Human
uccccagcacacaccacac

SEQ ID NO: 46337 - RNA, 25 nt, Human
ucugcggguggcggggcgcuagccu

SEQ ID NO: 46338 - RNA, 19 nt, Human
ugcaggcagaaaggaauca

SEQ ID NO: 46339 - RNA, 21 nt, Human
ugccccccacccccccagccc

SEQ ID NO: 46340 - RNA, 22 nt, Human
ugccccccacccccccagcccc

SEQ ID NO: 46341 - RNA, 18 nt, Human
uggcugggugggcugggg

SEQ ID NO: 46342 - RNA, 19 nt, Human
uggcugggugggcuggggg

SEQ ID NO: 46343 - RNA, 21 nt, Human
ugggaugggggcuggagcaaa

SEQ ID NO: 46344 - RNA, 21 nt, Human
uuuggcugggugggcuggggg

SEQ ID NO: 46345 - RNA, 24 nt, Human
ccccaggggcaaagguuuaggagu

SEQ ID NO: 46346 - RNA, 21 nt, Human
ggcucacgcucgccucucagc

SEQ ID NO: 46347 - RNA, 22 nt, Human
gguugggauggaagccccaggg

SEQ ID NO: 46348 - RNA, 19 nt, Human
uacuucagagacagcccug

SEQ ID NO: 46349 - RNA, 24 nt, Human
uacuucagagacagcccuguccau

SEQ ID NO: 46350 - RNA, 18 nt, Human
cauacagguaauauauaa

SEQ ID NO: 46351 - RNA, 19 nt, Human
cuaauauuaacacacaaua

SEQ ID NO: 46352 - RNA, 25 nt, Human
cuaauauuaacacacaauaguucua

SEQ ID NO: 46353 - RNA, 24 nt, Human
cucaaaccucuugucuuccacgcu

SEQ ID NO: 46354 - RNA, 19 nt, Human
uaauaauaaaaaccaaacc

SEQ ID NO: 46355 - RNA, 21 nt, Human
uccacgcugcaggucaucgga

SEQ ID NO: 46356 - RNA, 23 nt, Human
agaguuggggugacuccacaggg

SEQ ID NO: 46357 - RNA, 25 nt, Human
agaguuggggugacuccacagggug

SEQ ID NO: 46358 - RNA, 19 nt, Human
auacgugugugcagaaaug

SEQ ID NO: 46359 - RNA, 23 nt, Human
augccgagguauacgugugugca

SEQ ID NO: 46360 - RNA, 20 nt, Human
caaccaugcccaugugcaag

SEQ ID NO: 46361 - RNA, 23 nt, Human
cagccccacagaguuggggugac

SEQ ID NO: 46362 - RNA, 27 nt, Human
caggagcaucaguaacugacuauugag

SEQ ID NO: 46363 - RNA, 20 nt, Human
cagggugaaggcuuggagga

SEQ ID NO: 46364 - RNA, 19 nt, Human
ccacagaaggaggguuuca

SEQ ID NO: 46365 - RNA, 19 nt, Human
ccagcgguggccgcggccg

SEQ ID NO: 46366 - RNA, 22 nt, Human
ccagcgguggccgcggccggcc

SEQ ID NO: 46367 - RNA, 22 nt, Human
ccccggcgcugcucccuccgcc

SEQ ID NO: 46368 - RNA, 24 nt, Human
cccuccgccgccgcucgguggguc

SEQ ID NO: 46369 - RNA, 21 nt, Human
ccgccgcucggugggucucug

SEQ ID NO: 46370 - RNA, 21 nt, Human
cgcugcucccuccgccgccgc

SEQ ID NO: 46371 - RNA, 19 nt, Human
cggcucgguggccgcucgg

SEQ ID NO: 46372 - RNA, 22 nt, Human
cgguggccgcggccggccacgc

SEQ ID NO: 46373 - RNA, 18 nt, Human
cgugcgccccggcgcugc

SEQ ID NO: 46374 - RNA, 18 nt, Human
cgugcgccccggcgcugc

SEQ ID NO: 46375 - RNA, 19 nt, Human
cgugcgccccggcgcugcu

SEQ ID NO: 46376 - RNA, 21 nt, Human
cucgugcgccccggcgcugcu

SEQ ID NO: 46377 - RNA, 22 nt, Human
cugccggcucgguggccgcucg

SEQ ID NO: 46378 - RNA, 21 nt, Human
cugcucccuccgccgccgcuc

SEQ ID NO: 46379 - RNA, 21 nt, Human
gagaucauggucuucuuggaa

SEQ ID NO: 46380 - RNA, 24 nt, Human
gcgcugcucccuccgccgccgcuc

SEQ ID NO: 46381 - RNA, 25 nt, Human
gugugugcagaaauggacacauagg

SEQ ID NO: 46382 - RNA, 23 nt, Human
ucgguggccgcucggcuuucccu

SEQ ID NO: 46383 - RNA, 23 nt, Human
ucggugggucucugccggcucgg

SEQ ID NO: 46384 - RNA, 19 nt, Human
ucgugcgccccggcgcugc

SEQ ID NO: 46385 - RNA, 21 nt, Human
uggaaggaauaaauguaaaaa

SEQ ID NO: 46386 - RNA, 22 nt, Human
uggaaggaauaaauguaaaaau

SEQ ID NO: 46387 - RNA, 22 nt, Human
aagaaaaugcagcaacgaagaa

SEQ ID NO: 46388 - RNA, 19 nt, Human
aaggggcuugguccggagc

SEQ ID NO: 46389 - RNA, 24 nt, Human
aaggggcuugguccggagccucca

SEQ ID NO: 46390 - RNA, 19 nt, Human
accacugaauaccaccauu

SEQ ID NO: 46391 - RNA, 24 nt, Human
acuggcacgcggagccgcgccccu

SEQ ID NO: 46392 - RNA, 19 nt, Human
agcaacgaagaacagggaa

SEQ ID NO: 46393 - RNA, 21 nt, Human
agggagaagcugaaggggcuu

SEQ ID NO: 46394 - RNA, 24 nt, Human
aucucuugccauuuuuucuucaac

SEQ ID NO: 46395 - RNA, 21 nt, Human
augggguaaauugauuuucau

SEQ ID NO: 46396 - RNA, 20 nt, Human
caaaacagggaccucccucc

SEQ ID NO: 46397 - RNA, 24 nt, Human
caagugaagaaaaugcagcaacga

SEQ ID NO: 46398 - RNA, 24 nt, Human
caauguugagguggucgagccucc

SEQ ID NO: 46399 - RNA, 19 nt, Human
caccacgugacgcgcgggc

SEQ ID NO: 46400 - RNA, 19 nt, Human
caccacgugacgcgcgggc

SEQ ID NO: 46401 - RNA, 18 nt, Human
cacgcggagccgcgcccc

SEQ ID NO: 46402 - RNA, 19 nt, Human
cacgugacgcgcgggcacc

SEQ ID NO: 46403 - RNA, 18 nt, Human
cacugaauaccaccauuc

SEQ ID NO: 46404 - RNA, 23 nt, Human
cagcaacgaagaacagggaacac

SEQ ID NO: 46405 - RNA, 24 nt, Human
cagggaccucccucccccucguuc

SEQ ID NO: 46406 - RNA, 24 nt, Human
cauacccgucccccaggcgcuuca

SEQ ID NO: 46407 - RNA, 24 nt, Human
ccaaaacagggaccucccuccccc

SEQ ID NO: 46408 - RNA, 18 nt, Human
ccaaggcaaaagcugcag

SEQ ID NO: 46409 - RNA, 19 nt, Human
ccauacccgucccccaggc

SEQ ID NO: 46410 - RNA, 24 nt, Human
cccccucguucguuuccuuccucc

SEQ ID NO: 46411 - RNA, 27 nt, Human
ccccuaccucccgcccauacccguccc

SEQ ID NO: 46412 - RNA, 27 nt, Human
ccccucguucguuuccuuccuccuuuc

SEQ ID NO: 46413 - RNA, 22 nt, Human
cccucucgcuccacuucagggg

SEQ ID NO: 46414 - RNA, 18 nt, Human
ccgcugccgcugccgccg

SEQ ID NO: 46415 - RNA, 21 nt, Human
ccgcugccgcugccgccgccg

SEQ ID NO: 46416 - RNA, 24 nt, Human
ccgcugccgcugccgccgccgccg

SEQ ID NO: 46417 - RNA, 27 nt, Human
ccgcugccgcugccgccgccgccgccu

SEQ ID NO: 46418 - RNA, 19 nt, Human
ccucacggguuaacagcag

SEQ ID NO: 46419 - RNA, 27 nt, Human
ccucccgcccauacccgucccccaggc

SEQ ID NO: 46420 - RNA, 19 nt, Human
ccuccuuuccccgcuuucc

SEQ ID NO: 46421 - RNA, 20 nt, Human
ccuccuuuccccgcuuuccc

SEQ ID NO: 46422 - RNA, 22 nt, Human
ccuguguaaagcauuacagaau

SEQ ID NO: 46423 - RNA, 19 nt, Human
ccuuccuccuuuccccgcu

SEQ ID NO: 46424 - RNA, 21 nt, Human
ccuugcucguucccucuucuc

SEQ ID NO: 46425 - RNA, 21 nt, Human
cgauccggagggagaagcuga

SEQ ID NO: 46426 - RNA, 23 nt, Human
cgccccuaccucccgcccauacc

SEQ ID NO: 46427 - RNA, 22 nt, Human
cgcgcgcaugcgcgcgggggac

SEQ ID NO: 46428 - RNA, 24 nt, Human
cgcggagccgcgccccuaccuccc

SEQ ID NO: 46429 - RNA, 19 nt, Human
cguucccucuucucucccc

SEQ ID NO: 46430 - RNA, 23 nt, Human
cucguucccucuucucucccccc

SEQ ID NO: 46431 - RNA, 21 nt, Human
cugccgcugccgccgccgccg

SEQ ID NO: 46432 - RNA, 22 nt, Human
cuucaggggccggcaacgcucc

SEQ ID NO: 46433 - RNA, 19 nt, Human
cuuccgcugccgcugccgc

SEQ ID NO: 46434 - RNA, 24 nt, Human
cuugccauuuuuucuucaacuguu

SEQ ID NO: 46435 - RNA, 20 nt, Human
gaaacucagaccuccgccuc

SEQ ID NO: 46436 - RNA, 27 nt, Human
gaagccgggaccuccccuggcaggaga

SEQ ID NO: 46437 - RNA, 21 nt, Human
gagggagaagcugaaggggcu

SEQ ID NO: 46438 - RNA, 22 nt, Human
gauaugaucucuugccauuuuu

SEQ ID NO: 46439 - RNA, 21 nt, Human
gccgcugccgccgccgccgcc

SEQ ID NO: 46440 - RNA, 20 nt, Human
gccgggaccuccccuggcag

SEQ ID NO: 46441 - RNA, 22 nt, Human
gcugcuaggccugccgccgccc

SEQ ID NO: 46442 - RNA, 18 nt, Human
ggcgcgcgcaugcgcgcg

SEQ ID NO: 46443 - RNA, 23 nt, Human
guaggcacuaggaagaaccaagg

SEQ ID NO: 46444 - RNA, 24 nt, Human
uaacagcagcacaucgauccggag

SEQ ID NO: 46445 - RNA, 28 nt, Human
uaauagguuucucuuuggagugaaguuu

SEQ ID NO: 46446 - RNA, 24 nt, Human
uaccaugggguaaauugauuuuca

SEQ ID NO: 46447 - RNA, 18 nt, Human
uccaccucccacccccaa

SEQ ID NO: 46448 - RNA, 22 nt, Human
ucccucgaaacucagaccuccg

SEQ ID NO: 46449 - RNA, 20 nt, Human
uccuccaaaacagggaccuc

SEQ ID NO: 46450 - RNA, 19 nt, Human
uccuuuuccaccucccacc

SEQ ID NO: 46451 - RNA, 19 nt, Human
ucucuguuauccugaguau

SEQ ID NO: 46452 - RNA, 19 nt, Human
ugaaggggcuugguccgga

SEQ ID NO: 46453 - RNA, 25 nt, Human
ugcagcaacgaagaacagggaacac

SEQ ID NO: 46454 - RNA, 18 nt, Human
ugcgcgcgggggacgguu

SEQ ID NO: 46455 - RNA, 23 nt, Human
ugcugcuaggccugccgccgccc

SEQ ID NO: 46456 - RNA, 19 nt, Human
uggcaggagaaacggcgaa

SEQ ID NO: 46457 - RNA, 21 nt, Human
uggguuccuuuuccaccuccc

SEQ ID NO: 46458 - RNA, 18 nt, Human
ugguccggagccuccacg

SEQ ID NO: 46459 - RNA, 21 nt, Human
uucaggcuuuaaaauuuaagu

SEQ ID NO: 46460 - RNA, 22 nt, Human
uuccaccucccacccccaaauu

SEQ ID NO: 46461 - RNA, 20 nt, Human
uuccgcugccgcugccgccg

SEQ ID NO: 46462 - RNA, 19 nt, Human
uuuccuucccuugcucguu

SEQ ID NO: 46463 - RNA, 24 nt, Human
uuucuucaacuguuacuugugagg

SEQ ID NO: 46464 - RNA, 21 nt, Human
aaaacauccccacaucugccc

SEQ ID NO: 46465 - RNA, 23 nt, Human
aaacauccccacaucugcccugg

SEQ ID NO: 46466 - RNA, 23 nt, Human
aaacauccccacaucugcccugg

SEQ ID NO: 46467 - RNA, 19 nt, Human
aacccccccccgcccugcc

SEQ ID NO: 46468 - RNA, 19 nt, Human
aacccccccccgcccugcc

SEQ ID NO: 46469 - RNA, 22 nt, Human
aacccccccccgcccugccaaa

SEQ ID NO: 46470 - RNA, 22 nt, Human
aacccccccccgcccugccaaa

SEQ ID NO: 46471 - RNA, 19 nt, Human
aaccccugcggagccagga

SEQ ID NO: 46472 - RNA, 19 nt, Human
aaccccugcggagccagga

SEQ ID NO: 46473 - RNA, 21 nt, Human
aagauucaguuuuaaaaaaug

SEQ ID NO: 46474 - RNA, 21 nt, Human
aagauucaguuuuaaaaaaug

SEQ ID NO: 46475 - RNA, 22 nt, Human
aagugcccuccaggccuggucc

SEQ ID NO: 46476 - RNA, 22 nt, Human
aagugcccuccaggccuggucc

SEQ ID NO: 46477 - RNA, 26 nt, Human
aagugcccuccaggccugguccaccc

SEQ ID NO: 46478 - RNA, 26 nt, Human
aagugcccuccaggccugguccaccc

SEQ ID NO: 46479 - RNA, 21 nt, Human
accccugcggagccaggaguu

SEQ ID NO: 46480 - RNA, 21 nt, Human
accccugcggagccaggaguu

SEQ ID NO: 46481 - RNA, 21 nt, Human
agaacccccccccgcccugcc

SEQ ID NO: 46482 - RNA, 21 nt, Human
agaacccccccccgcccugcc

SEQ ID NO: 46483 - RNA, 22 nt, Human
agcugggaugcccagccccuga

SEQ ID NO: 46484 - RNA, 22 nt, Human
agcugggaugcccagccccuga

SEQ ID NO: 46485 - RNA, 19 nt, Human
aggcagaagcuggcaggca

SEQ ID NO: 46486 - RNA, 21 nt, Human
aggcagaagcuggcaggcagc

SEQ ID NO: 46487 - RNA, 19 nt, Human
aggcuagguccacuggugg

SEQ ID NO: 46488 - RNA, 22 nt, Human
aguugaaggguuuggaccugga

SEQ ID NO: 46489 - RNA, 22 nt, Human
aguugaaggguuuggaccugga

SEQ ID NO: 46490 - RNA, 24 nt, Human
aguuucuccggggccuccuguaaa

SEQ ID NO: 46491 - RNA, 24 nt, Human
aguuucuccggggccuccuguaaa

SEQ ID NO: 46492 - RNA, 21 nt, Human
augauguuggugccgcuggga

SEQ ID NO: 46493 - RNA, 20 nt, Human
auuugcauggugccucccuc

SEQ ID NO: 46494 - RNA, 20 nt, Human
auuugcauggugccucccuc

SEQ ID NO: 46495 - RNA, 23 nt, Human
caaaacauccccacaucugcccu

SEQ ID NO: 46496 - RNA, 23 nt, Human
caaaacauccccacaucugcccu

SEQ ID NO: 46497 - RNA, 22 nt, Human
caaaccccugcggagccaggag

SEQ ID NO: 46498 - RNA, 21 nt, Human
caaccaggacagccccagcga

SEQ ID NO: 46499 - RNA, 23 nt, Human
caagcugggaugcccagccccug

SEQ ID NO: 46500 - RNA, 23 nt, Human
caagcugggaugcccagccccug

SEQ ID NO: 46501 - RNA, 19 nt, Human
caaugaugauguuggugcc

SEQ ID NO: 46502 - RNA, 23 nt, Human
cacccaaaccccugcggagccag

SEQ ID NO: 46503 - RNA, 23 nt, Human
cacccaaaccccugcggagccag

SEQ ID NO: 46504 - RNA, 27 nt, Human
cacccugguggugccaagggcagggcc

SEQ ID NO: 46505 - RNA, 27 nt, Human
cacccugguggugccaagggcagggcc

SEQ ID NO: 46506 - RNA, 24 nt, Human
cagccccgucccccuaggucccag

SEQ ID NO: 46507 - RNA, 24 nt, Human
cagccccgucccccuaggucccag

SEQ ID NO: 46508 - RNA, 18 nt, Human
cagccccugacugugcuc

SEQ ID NO: 46509 - RNA, 18 nt, Human
cagccccugacugugcuc

SEQ ID NO: 46510 - RNA, 21 nt, Human
cagcugccugguugcaaggag

SEQ ID NO: 46511 - RNA, 21 nt, Human
cagcugccugguugcaaggag

SEQ ID NO: 46512 - RNA, 20 nt, Human
caggucagagccguccgccg

SEQ ID NO: 46513 - RNA, 22 nt, Human
cauggccauaccucaguuucuc

SEQ ID NO: 46514 - RNA, 22 nt, Human
cauggccauaccucaguuucuc

SEQ ID NO: 46515 - RNA, 23 nt, Human
ccaaaccccugcggagccaggag

SEQ ID NO: 46516 - RNA, 20 nt, Human
ccaagggcagggccacagcc

SEQ ID NO: 46517 - RNA, 20 nt, Human
ccaagggcagggccacagcc

SEQ ID NO: 46518 - RNA, 24 nt, Human
ccacagcccccacccaaaccccug

SEQ ID NO: 46519 - RNA, 24 nt, Human
ccacagcccccacccaaaccccug

SEQ ID NO: 46520 - RNA, 22 nt, Human
ccacccaaaccccugcggagcc

SEQ ID NO: 46521 - RNA, 22 nt, Human
ccacccaaaccccugcggagcc

SEQ ID NO: 46522 - RNA, 22 nt, Human
cccacccaaaccccugcggagc

SEQ ID NO: 46523 - RNA, 22 nt, Human
cccacccaaaccccugcggagc

SEQ ID NO: 46524 - RNA, 28 nt, Human
cccacugccggggcaggugccggggucc

SEQ ID NO: 46525 - RNA, 24 nt, Human
ccccacaucugcccuggccccagc

SEQ ID NO: 46526 - RNA, 24 nt, Human
ccccacaucugcccuggccccagc

SEQ ID NO: 46527 - RNA, 24 nt, Human
cccccccccgcccugccaaaaucc

SEQ ID NO: 46528 - RNA, 24 nt, Human
cccccccccgcccugccaaaaucc

SEQ ID NO: 46529 - RNA, 22 nt, Human
ccccugcaguccagcuccuugc

SEQ ID NO: 46530 - RNA, 23 nt, Human
cccguggugggagcaaauccggc

SEQ ID NO: 46531 - RNA, 27 nt, Human
cccuaggucccagagagauaagacccc

SEQ ID NO: 46532 - RNA, 27 nt, Human
cccuaggucccagagagauaagacccc

SEQ ID NO: 46533 - RNA, 22 nt, Human
cccugcaguccagcuccuugcc

SEQ ID NO: 46534 - RNA, 19 nt, Human
ccgcccaggacgauggcug

SEQ ID NO: 46535 - RNA, 18 nt, Human
ccuaggccuugggcaugg

SEQ ID NO: 46536 - RNA, 18 nt, Human
ccuaggccuugggcaugg

SEQ ID NO: 46537 - RNA, 18 nt, Human
ccugguugcaaggagggg

SEQ ID NO: 46538 - RNA, 18 nt, Human
ccugguugcaaggagggg

SEQ ID NO: 46539 - RNA, 23 nt, Human
cgaauuggagacgaucugggaca

SEQ ID NO: 46540 - RNA, 23 nt, Human
cgaauuggagacgaucugggaca

SEQ ID NO: 46541 - RNA, 21 nt, Human
cgcccugccaaaauccaugug

SEQ ID NO: 46542 - RNA, 21 nt, Human
cgcccugccaaaauccaugug

SEQ ID NO: 46543 - RNA, 20 nt, Human
cgggggcaagcugggaugcc

SEQ ID NO: 46544 - RNA, 20 nt, Human
cgggggcaagcugggaugcc

SEQ ID NO: 46545 - RNA, 18 nt, Human
cggguguggucauccuug

SEQ ID NO: 46546 - RNA, 18 nt, Human
cggguguggucauccuug

SEQ ID NO: 46547 - RNA, 21 nt, Human
cucauacuuccuccaagcuca

SEQ ID NO: 46548 - RNA, 21 nt, Human
cucauacuuccuccaagcuca

SEQ ID NO: 46549 - RNA, 20 nt, Human
cuccccugcaguccagcucc

SEQ ID NO: 46550 - RNA, 22 nt, Human
cugcaaccaggacagccccagc

SEQ ID NO: 46551 - RNA, 25 nt, Human
cugcacguggccuccccugcagucc

SEQ ID NO: 46552 - RNA, 22 nt, Human
cugccggggcaggugcugaagu

SEQ ID NO: 46553 - RNA, 22 nt, Human
cugccugguugcaaggaggggc

SEQ ID NO: 46554 - RNA, 22 nt, Human
cugccugguugcaaggaggggc

SEQ ID NO: 46555 - RNA, 23 nt, Human
cuugggcauggcacaggcagcuu

SEQ ID NO: 46556 - RNA, 23 nt, Human
cuugggcauggcacaggcagcuu

SEQ ID NO: 46557 - RNA, 19 nt, Human
gagccaaugaugauguugg

SEQ ID NO: 46558 - RNA, 21 nt, Human
gcaggcugugccauccuccac

SEQ ID NO: 46559 - RNA, 18 nt, Human
ggaccuggaagacauuug

SEQ ID NO: 46560 - RNA, 18 nt, Human
ggaccuggaagacauuug

SEQ ID NO: 46561 - RNA, 22 nt, Human
ggagcaaauccggcgcucccca

SEQ ID NO: 46562 - RNA, 21 nt, Human
ggcaagcugggaugcccagcc

SEQ ID NO: 46563 - RNA, 21 nt, Human
ggcaagcugggaugcccagcc

SEQ ID NO: 46564 - RNA, 22 nt, Human
ggcuuggagggaggagggugga

SEQ ID NO: 46565 - RNA, 22 nt, Human
ggcuuggagggaggagggugga

SEQ ID NO: 46566 - RNA, 20 nt, Human
gggccacagcccccacccaa

SEQ ID NO: 46567 - RNA, 20 nt, Human
gggccacagcccccacccaa

SEQ ID NO: 46568 - RNA, 18 nt, Human
ggguggggacgugggcag

SEQ ID NO: 46569 - RNA, 23 nt, Human
gguugcaaggaggggccauccag

SEQ ID NO: 46570 - RNA, 23 nt, Human
gguugcaaggaggggccauccag

SEQ ID NO: 46571 - RNA, 19 nt, Human
gguugccguacccauaacc

SEQ ID NO: 46572 - RNA, 19 nt, Human
gguugccguacccauaacc

SEQ ID NO: 46573 - RNA, 22 nt, Human
gucuuugccuguccagucuggc

SEQ ID NO: 46574 - RNA, 20 nt, Human
gugggggacuguggaggaag

SEQ ID NO: 46575 - RNA, 20 nt, Human
gugggggacuguggaggaag

SEQ ID NO: 46576 - RNA, 21 nt, Human
guguggucauccuuggggagg

SEQ ID NO: 46577 - RNA, 21 nt, Human
guguggucauccuuggggagg

SEQ ID NO: 46578 - RNA, 18 nt, Human
uaaaaaauguagauguca

SEQ ID NO: 46579 - RNA, 18 nt, Human
uaaaaaauguagauguca

SEQ ID NO: 46580 - RNA, 23 nt, Human
uaaauccccagcccgugccgccc

SEQ ID NO: 46581 - RNA, 24 nt, Human
uaaauccccagcccgugccgccca

SEQ ID NO: 46582 - RNA, 28 nt, Human
uaggccuugggcauggcacaggcagcuu

SEQ ID NO: 46583 - RNA, 28 nt, Human
uaggccuugggcauggcacaggcagcuu

SEQ ID NO: 46584 - RNA, 23 nt, Human
uaucucuccgucucccccguggg

SEQ ID NO: 46585 - RNA, 23 nt, Human
ucaaaacauccccacaucugccc

SEQ ID NO: 46586 - RNA, 23 nt, Human
ucccuccguggcuggaugggggc

SEQ ID NO: 46587 - RNA, 23 nt, Human
ucccuccguggcuggaugggggc

SEQ ID NO: 46588 - RNA, 19 nt, Human
uccgucucccccgugggug

SEQ ID NO: 46589 - RNA, 18 nt, Human
uccguggcuggauggggg

SEQ ID NO: 46590 - RNA, 18 nt, Human
uccguggcuggauggggg

SEQ ID NO: 46591 - RNA, 18 nt, Human
uccuccaagcucagcggg

SEQ ID NO: 46592 - RNA, 18 nt, Human
uccuccaagcucagcggg

SEQ ID NO: 46593 - RNA, 19 nt, Human
ucugcccuggccccagcac

SEQ ID NO: 46594 - RNA, 19 nt, Human
ucugcccuggccccagcac

SEQ ID NO: 46595 - RNA, 23 nt, Human
ugaaggcagaagcuggcaggcag

SEQ ID NO: 46596 - RNA, 21 nt, Human
ugagguggaagcuacauucac

SEQ ID NO: 46597 - RNA, 21 nt, Human
ugagguggaagcuacauucac

SEQ ID NO: 46598 - RNA, 23 nt, Human
ugcaaccaggacagccccagcug

SEQ ID NO: 46599 - RNA, 21 nt, Human
ugcaaggaggggccauccagg

SEQ ID NO: 46600 - RNA, 21 nt, Human
ugcaaggaggggccauccagg

SEQ ID NO: 46601 - RNA, 25 nt, Human
ugcaaggcugagccgcaggaggugg

SEQ ID NO: 46602 - RNA, 25 nt, Human
ugcaaggcugagccgcaggaggugg

SEQ ID NO: 46603 - RNA, 20 nt, Human
ugccaagggcagggccacag

SEQ ID NO: 46604 - RNA, 20 nt, Human
ugccaagggcagggccacag

SEQ ID NO: 46605 - RNA, 19 nt, Human
ugcucagugacaggacuuc

SEQ ID NO: 46606 - RNA, 19 nt, Human
ugcucagugacaggacuuc

SEQ ID NO: 46607 - RNA, 18 nt, Human
uggaggaagugcccucca

SEQ ID NO: 46608 - RNA, 18 nt, Human
uggaggaagugcccucca

SEQ ID NO: 46609 - RNA, 21 nt, Human
uggcugacagaugcacuuccc

SEQ ID NO: 46610 - RNA, 19 nt, Human
uggggacgugggcaggggg

SEQ ID NO: 46611 - RNA, 23 nt, Human
uggguggggacgugggcaggggg

SEQ ID NO: 46612 - RNA, 21 nt, Human
uguaaaugucaaaacaucccc

SEQ ID NO: 46613 - RNA, 21 nt, Human
uguaaaugucaaaacaucccc

SEQ ID NO: 46614 - RNA, 22 nt, Human
ugugcaaggcugagccgcagga

SEQ ID NO: 46615 - RNA, 22 nt, Human
ugugcaaggcugagccgcagga

SEQ ID NO: 46616 - RNA, 19 nt, Human
uguggaggaagugcccucc

SEQ ID NO: 46617 - RNA, 19 nt, Human
uguggaggaagugcccucc

SEQ ID NO: 46618 - RNA, 18 nt, Human
uguggcaauccaugaggu

SEQ ID NO: 46619 - RNA, 18 nt, Human
uguggcaauccaugaggu

SEQ ID NO: 46620 - RNA, 19 nt, Human
uguggucauccuuggggag

SEQ ID NO: 46621 - RNA, 19 nt, Human
uguggucauccuuggggag

SEQ ID NO: 46622 - RNA, 20 nt, Human
uguuaggcccgcaggcugug

SEQ ID NO: 46623 - RNA, 21 nt, Human
uuaggccccuccggaccuucc

SEQ ID NO: 46624 - RNA, 20 nt, Human
uuaggcccgcaggcugugcc

SEQ ID NO: 46625 - RNA, 20 nt, Human
uuuucuagaacccccccccg

SEQ ID NO: 46626 - RNA, 20 nt, Human
uuuucuagaacccccccccg

SEQ ID NO: 46627 - RNA, 22 nt, Human
aaaaaacuccaacuggagcuga

SEQ ID NO: 46628 - RNA, 18 nt, Human
aaaaagacaaugcccacg

SEQ ID NO: 46629 - RNA, 23 nt, Human
aaauacuaaaagcacaacaagcc

SEQ ID NO: 46630 - RNA, 20 nt, Human
aacaccaccuuucccaagcu

SEQ ID NO: 46631 - RNA, 20 nt, Human
aacaugcucacggcugguca

SEQ ID NO: 46632 - RNA, 20 nt, Human
aacuccaacuggagcugaaa

SEQ ID NO: 46633 - RNA, 22 nt, Human
aagcaaacacauccuguccaga

SEQ ID NO: 46634 - RNA, 20 nt, Human
aagccagccuugaccguugc

SEQ ID NO: 46635 - RNA, 24 nt, Human
acacuacagaccccuuccaaacau

SEQ ID NO: 46636 - RNA, 22 nt, Human
acagaccccuuccaaacaugcu

SEQ ID NO: 46637 - RNA, 18 nt, Human
accauagcacagcacagc

SEQ ID NO: 46638 - RNA, 21 nt, Human
accauagcacagcacagcacu

SEQ ID NO: 46639 - RNA, 22 nt, Human
accuuaagauuccugucugcaa

SEQ ID NO: 46640 - RNA, 20 nt, Human
acuaaaauacuaaaagcaca

SEQ ID NO: 46641 - RNA, 18 nt, Human
acuacagcgcacugcacu

SEQ ID NO: 46642 - RNA, 19 nt, Human
acuacagcgcacugcacug

SEQ ID NO: 46643 - RNA, 19 nt, Human
acuauguugccuagauaca

SEQ ID NO: 46644 - RNA, 22 nt, Human
agaaaaagaagugcuuggcauu

SEQ ID NO: 46645 - RNA, 22 nt, Human
agaaaggacagcgagaaaaaga

SEQ ID NO: 46646 - RNA, 20 nt, Human
agacagagcaccauagcaca

SEQ ID NO: 46647 - RNA, 22 nt, Human
agcagacaugaacuauacccau

SEQ ID NO: 46648 - RNA, 19 nt, Human
agcaguauuauuuuccagc

SEQ ID NO: 46649 - RNA, 18 nt, Human
aggcauuugaagagugaa

SEQ ID NO: 46650 - RNA, 20 nt, Human
aggcauuugaagagugaaga

SEQ ID NO: 46651 - RNA, 19 nt, Human
agucucuauccuggugugg

SEQ ID NO: 46652 - RNA, 27 nt, Human
auccauagucaugaauacuauguugcc

SEQ ID NO: 46653 - RNA, 18 nt, Human
augcaugcuauacgaguu

SEQ ID NO: 46654 - RNA, 23 nt, Human
caaaaaacuccaacuggagcuga

SEQ ID NO: 46655 - RNA, 18 nt, Human
caaguucuggcuugucua

SEQ ID NO: 46656 - RNA, 27 nt, Human
caauuaccaaguguaaucaguuacagu

SEQ ID NO: 46657 - RNA, 20 nt, Human
cacagccuggaccugaagcc

SEQ ID NO: 46658 - RNA, 24 nt, Human
caccaaagcuuccuggccagaagc

SEQ ID NO: 46659 - RNA, 21 nt, Human
caccaccuuucccaagcuaaa

SEQ ID NO: 46660 - RNA, 24 nt, Human
caccauagcacagcacagcacuga

SEQ ID NO: 46661 - RNA, 24 nt, Human
cacuguugaaaaaaggugucggcu

SEQ ID NO: 46662 - RNA, 19 nt, Human
cagaagacagaggcaucaa

SEQ ID NO: 46663 - RNA, 26 nt, Human
cagaccccuuccaaacaugcucacgg

SEQ ID NO: 46664 - RNA, 19 nt, Human
cauggaaaacucagugaug

SEQ ID NO: 46665 - RNA, 20 nt, Human
ccaaaagaaggcuuucucau

SEQ ID NO: 46666 - RNA, 19 nt, Human
ccaccuuucccaagcuaaa

SEQ ID NO: 46667 - RNA, 20 nt, Human
ccaguccagaagacagaggc

SEQ ID NO: 46668 - RNA, 22 nt, Human
ccauggaaaacucagugauggu

SEQ ID NO: 46669 - RNA, 23 nt, Human
cccuuggcucuggccugagaugg

SEQ ID NO: 46670 - RNA, 19 nt, Human
ccuaaaaguugguacaaaa

SEQ ID NO: 46671 - RNA, 18 nt, Human
ccugaagccccuuggcuc

SEQ ID NO: 46672 - RNA, 23 nt, Human
ccuggaccugaagccccuuggcu

SEQ ID NO: 46673 - RNA, 23 nt, Human
ccuugagugacacuacagacccc

SEQ ID NO: 46674 - RNA, 24 nt, Human
cuauacccaugaacaucacauucc

SEQ ID NO: 46675 - RNA, 18 nt, Human
cucauaaaacacucagag

SEQ ID NO: 46676 - RNA, 20 nt, Human
cucauaauauuuaggaaguu

SEQ ID NO: 46677 - RNA, 21 nt, Human
cucccaggugucccugggagc

SEQ ID NO: 46678 - RNA, 19 nt, Human
cugccugccaguugucaag

SEQ ID NO: 46679 - RNA, 26 nt, Human
cuuaagauuccugucugcaacccuuu

SEQ ID NO: 46680 - RNA, 19 nt, Human
gaagccagauuucucccag

SEQ ID NO: 46681 - RNA, 19 nt, Human
gacugcuuuccaauaaggc

SEQ ID NO: 46682 - RNA, 18 nt, Human
gaggaugccccauagaga

SEQ ID NO: 46683 - RNA, 21 nt, Human
gauacaguggggaacaccggg

SEQ ID NO: 46684 - RNA, 18 nt, Human
gcacaacaagccuuccug

SEQ ID NO: 46685 - RNA, 20 nt, Human
ggccuucagugcagcagcuc

SEQ ID NO: 46686 - RNA, 18 nt, Human
gguaguugggggacugcu

SEQ ID NO: 46687 - RNA, 18 nt, Human
gucaaggggcacagggcc

SEQ ID NO: 46688 - RNA, 19 nt, Human
guccgaguuggcccgggga

SEQ ID NO: 46689 - RNA, 19 nt, Human
gugcaaguagacagagcag

SEQ ID NO: 46690 - RNA, 19 nt, Human
gugcagcagcucucgggcc

SEQ ID NO: 46691 - RNA, 26 nt, Human
uaaaaaugccuacuacagcgcacugc

SEQ ID NO: 46692 - RNA, 19 nt, Human
uaacaugccagaucuaagg

SEQ ID NO: 46693 - RNA, 21 nt, Human
uaaugauagcagacaugaacu

SEQ ID NO: 46694 - RNA, 23 nt, Human
uaauucuguauguaucucagcag

SEQ ID NO: 46695 - RNA, 24 nt, Human
uacaaaaaacuccaacuggagcug

SEQ ID NO: 46696 - RNA, 19 nt, Human
uaccaaguguaaucaguua

SEQ ID NO: 46697 - RNA, 18 nt, Human
uaccauaagcacagcugg

SEQ ID NO: 46698 - RNA, 22 nt, Human
uacccaugaacaucacauucca

SEQ ID NO: 46699 - RNA, 27 nt, Human
uacuacagcgcacugcacuguaaucaa

SEQ ID NO: 46700 - RNA, 22 nt, Human
uagguuucuuacagaaacacca

SEQ ID NO: 46701 - RNA, 21 nt, Human
uauagggagguggcgguuugc

SEQ ID NO: 46702 - RNA, 19 nt, Human
uauguugccuagauacagu

SEQ ID NO: 46703 - RNA, 22 nt, Human
uauguugccuagauacaguggg

SEQ ID NO: 46704 - RNA, 19 nt, Human
ucaaguucuggcuuguccu

SEQ ID NO: 46705 - RNA, 18 nt, Human
ucaccaaagcuuccuggc

SEQ ID NO: 46706 - RNA, 21 nt, Human
ucagaaagcaaacacauccug

SEQ ID NO: 46707 - RNA, 19 nt, Human
ucagggucaaguucuggcu

SEQ ID NO: 46708 - RNA, 22 nt, Human
uccagaaaaucaacugagauuc

SEQ ID NO: 46709 - RNA, 24 nt, Human
ucccaggugucccugggagccugc

SEQ ID NO: 46710 - RNA, 23 nt, Human
ucccugaaagccaaacacagccu

SEQ ID NO: 46711 - RNA, 26 nt, Human
ucugcaacccagguucucaccaaagc

SEQ ID NO: 46712 - RNA, 21 nt, Human
ugaauacaggaucauuguauu

SEQ ID NO: 46713 - RNA, 20 nt, Human
ugacuagaucugguuaaugg

SEQ ID NO: 46714 - RNA, 24 nt, Human
ugagauggggaauccagaaaauca

SEQ ID NO: 46715 - RNA, 22 nt, Human
ugcagcagcucucgggcccggc

SEQ ID NO: 46716 - RNA, 22 nt, Human
ugcagccaaguuggaaaaagag

SEQ ID NO: 46717 - RNA, 21 nt, Human
uggaaaaagaggaugccccau

SEQ ID NO: 46718 - RNA, 25 nt, Human
uggaaaacucagugaugguaaaaau

SEQ ID NO: 46719 - RNA, 18 nt, Human
uguaguuuuugcaagcau

SEQ ID NO: 46720 - RNA, 20 nt, Human
uguccagaaucccaucaagc

SEQ ID NO: 46721 - RNA, 19 nt, Human
ugucugaauacaggaucau

SEQ ID NO: 46722 - RNA, 19 nt, Human
uguggcuacaccuuaagau

SEQ ID NO: 46723 - RNA, 22 nt, Human
uguggugauuugcucagcucca

SEQ ID NO: 46724 - RNA, 23 nt, Human
ugugugcgugcgucgcgcgcgcg

SEQ ID NO: 46725 - RNA, 21 nt, Human
uguguguguuugugucacgug

SEQ ID NO: 46726 - RNA, 24 nt, Human
uguuuuaaacauuaaaaaaaaucc

SEQ ID NO: 46727 - RNA, 24 nt, Human
uucuugguacauauuuuucuguuc

SEQ ID NO: 46728 - RNA, 23 nt, Human
uuggaggaagggcuaacaugcca

SEQ ID NO: 46729 - RNA, 20 nt, Human
uuguccaauaucuacgaaua

SEQ ID NO: 46730 - RNA, 18 nt, Human
uuuuuuuuuuuuuuuuug

SEQ ID NO: 46731 - RNA, 20 nt, Human
aacccccagccccuccccaa

SEQ ID NO: 46732 - RNA, 18 nt, Human
acccccagccccucccca

SEQ ID NO: 46733 - RNA, 21 nt, Human
acccccagccccuccccaagc

SEQ ID NO: 46734 - RNA, 23 nt, Human
acccccagccccuccccaagccc

SEQ ID NO: 46735 - RNA, 23 nt, Human
agccccuccccaagcccccgcug

SEQ ID NO: 46736 - RNA, 19 nt, Human
aggcugugcggaccuuccu

SEQ ID NO: 46737 - RNA, 18 nt, Human
caacccccagccccuccc

SEQ ID NO: 46738 - RNA, 21 nt, Human
caagcccccgcugcaacuacg

SEQ ID NO: 46739 - RNA, 20 nt, Human
cagccccuccccaagccccc

SEQ ID NO: 46740 - RNA, 25 nt, Human
cagccccuccccaagcccccgcugc

SEQ ID NO: 46741 - RNA, 21 nt, Human
cccccagccccuccccaagcc

SEQ ID NO: 46742 - RNA, 19 nt, Human
cccccgcugcaacuacgcc

SEQ ID NO: 46743 - RNA, 23 nt, Human
cccuccccaagcccccgcugcaa

SEQ ID NO: 46744 - RNA, 21 nt, Human
ccuccccaagcccccgcugca

SEQ ID NO: 46745 - RNA, 26 nt, Human
cgcugcaacuacgccggcagguccgc

SEQ ID NO: 46746 - RNA, 25 nt, Human
cguccaacccccagccccuccccaa

SEQ ID NO: 46747 - RNA, 19 nt, Human
cucaaucccguccaacccc

SEQ ID NO: 46748 - RNA, 22 nt, Human
cuccccaagcccccgcugcaac

SEQ ID NO: 46749 - RNA, 21 nt, Human
uccaacccccagccccucccc

SEQ ID NO: 46750 - RNA, 24 nt, Human
uccccaagcccccgcugcaacuac

SEQ ID NO: 46751 - RNA, 21 nt, Human
ucccguccaacccccagcccc

SEQ ID NO: 46752 - RNA, 23 nt, Human
ugagcagagacaggcugugcgga

SEQ ID NO: 46753 - RNA, 20 nt, Human
ugcccggagucuuaagacac

SEQ ID NO: 46754 - RNA, 23 nt, Human
ugugcggaccuuccucaaucccg

SEQ ID NO: 46755 - RNA, 22 nt, Human
uugacagcgcguggcggugccc

SEQ ID NO: 46756 - RNA, 18 nt, Human
aaacuaaaaccugaaagc

SEQ ID NO: 46757 - RNA, 18 nt, Human
aaacuaaaaccugaaagc

SEQ ID NO: 46758 - RNA, 19 nt, Human
aaauaaaugccaaaugcuu

SEQ ID NO: 46759 - RNA, 21 nt, Human
aacccauccucguccauaugu

SEQ ID NO: 46760 - RNA, 20 nt, Human
aaggcaaaaaaaaaaaaaaa

SEQ ID NO: 46761 - RNA, 18 nt, Human
aagugcugggauuacagg

SEQ ID NO: 46762 - RNA, 18 nt, Human
aagugcugggauuacagg

SEQ ID NO: 46763 - RNA, 19 nt, Human
aagugcugggauuacaggc

SEQ ID NO: 46764 - RNA, 19 nt, Human
aagugcugggauuacaggc

SEQ ID NO: 46765 - RNA, 21 nt, Human
aagugcugggauuacaggcau

SEQ ID NO: 46766 - RNA, 21 nt, Human
aagugcugggauuacaggcau

SEQ ID NO: 46767 - RNA, 22 nt, Human
aagugcugggauuacaggcaug

SEQ ID NO: 46768 - RNA, 23 nt, Human
aagugcugggauuacaggcauga

SEQ ID NO: 46769 - RNA, 23 nt, Human
aagugcugggauuacaggcauga

SEQ ID NO: 46770 - RNA, 26 nt, Human
aagugcugggauuacaggcaugagcc

SEQ ID NO: 46771 - RNA, 26 nt, Human
aagugcugggauuacaggcaugagcc

SEQ ID NO: 46772 - RNA, 24 nt, Human
aaugccaaaugcuucauauucagc

SEQ ID NO: 46773 - RNA, 21 nt, Human
acuagaaauagacccacaauu

SEQ ID NO: 46774 - RNA, 21 nt, Human
acuagaaauagacccacaauu

SEQ ID NO: 46775 - RNA, 18 nt, Human
acucugucacccaggcug

SEQ ID NO: 46776 - RNA, 18 nt, Human
acucugucacccaggcug

SEQ ID NO: 46777 - RNA, 25 nt, Human
acucugucacccaggcuggagugua

SEQ ID NO: 46778 - RNA, 25 nt, Human
acucugucacccaggcuggagugua

SEQ ID NO: 46779 - RNA, 22 nt, Human
agcccucacuguaagguagugg

SEQ ID NO: 46780 - RNA, 22 nt, Human
agcccucacuguaagguagugg

SEQ ID NO: 46781 - RNA, 22 nt, Human
aggaaguucaaacacaugacca

SEQ ID NO: 46782 - RNA, 22 nt, Human
aggaaguucaaacacaugacca

SEQ ID NO: 46783 - RNA, 23 nt, Human
aggaggcagccuuuucacuucug

SEQ ID NO: 46784 - RNA, 18 nt, Human
aggcaaaaaaaaaaaaaa

SEQ ID NO: 46785 - RNA, 18 nt, Human
aggcaaaaaaaaaaaaaa

SEQ ID NO: 46786 - RNA, 22 nt, Human
aggcggccuggagucuggggcg

SEQ ID NO: 46787 - RNA, 23 nt, Human
aggcugcaggcggccuggagucu

SEQ ID NO: 46788 - RNA, 18 nt, Human
agugcugggauuacaggc

SEQ ID NO: 46789 - RNA, 18 nt, Human
agugcugggauuacaggc

SEQ ID NO: 46790 - RNA, 21 nt, Human
aguguaguggcgcaaccucag

SEQ ID NO: 46791 - RNA, 21 nt, Human
aguguaguggcgcaaccucag

SEQ ID NO: 46792 - RNA, 26 nt, Human
auaaaaaaaaacugaucauuucccua

SEQ ID NO: 46793 - RNA, 20 nt, Human
auaaaauacagaaaaacugc

SEQ ID NO: 46794 - RNA, 25 nt, Human
auaaaauacagaaaaacugcccagu

SEQ ID NO: 46795 - RNA, 25 nt, Human
auaaaauacagaaaaacugcccagu

SEQ ID NO: 46796 - RNA, 18 nt, Human
aucucacucugucaccca

SEQ ID NO: 46797 - RNA, 18 nt, Human
aucucacucugucaccca

SEQ ID NO: 46798 - RNA, 18 nt, Human
augagccaccacucccag

SEQ ID NO: 46799 - RNA, 21 nt, Human
auucauaacccaauccagcug

SEQ ID NO: 46800 - RNA, 23 nt, Human
caaaauaaguagauucacuuuca

SEQ ID NO: 46801 - RNA, 21 nt, Human
caaauaaaugccaaaugcuuc

SEQ ID NO: 46802 - RNA, 21 nt, Human
caaauaaaugccaaaugcuuc

SEQ ID NO: 46803 - RNA, 21 nt, Human
caaauaaaugccaaaugcuuc

SEQ ID NO: 46804 - RNA, 22 nt, Human
caaaucagggcccuaaacaguu

SEQ ID NO: 46805 - RNA, 22 nt, Human
caaaucagggcccuaaacaguu

SEQ ID NO: 46806 - RNA, 24 nt, Human
caagugcugggauuacaggcauga

SEQ ID NO: 46807 - RNA, 24 nt, Human
caagugcugggauuacaggcauga

SEQ ID NO: 46808 - RNA, 24 nt, Human
caauguauacuaaauuuaucuccu

SEQ ID NO: 46809 - RNA, 26 nt, Human
cacacuuaagucagaagagcugagaa

SEQ ID NO: 46810 - RNA, 24 nt, Human
cacccaggcuggaguguaguggcg

SEQ ID NO: 46811 - RNA, 24 nt, Human
cacccaggcuggaguguaguggcg

SEQ ID NO: 46812 - RNA, 22 nt, Human
cacucugucacccaggcuggag

SEQ ID NO: 46813 - RNA, 23 nt, Human
cacucugucacccaggcuggagu

SEQ ID NO: 46814 - RNA, 23 nt, Human
cacucugucacccaggcuggagu

SEQ ID NO: 46815 - RNA, 24 nt, Human
cacucugucacccaggcuggagug

SEQ ID NO: 46816 - RNA, 24 nt, Human
cacuuaagucagaagagcugagaa

SEQ ID NO: 46817 - RNA, 19 nt, Human
cagcugugcugcuauuugg

SEQ ID NO: 46818 - RNA, 22 nt, Human
cagugccuguuaucaauauaaa

SEQ ID NO: 46819 - RNA, 21 nt, Human
cagugcuguuaucaauauaaa

SEQ ID NO: 46820 - RNA, 22 nt, Human
caugaccagcaucugcuaaguc

SEQ ID NO: 46821 - RNA, 22 nt, Human
caugaccagcaucugcuaaguc

SEQ ID NO: 46822 - RNA, 19 nt, Human
caugagccaccacucccag

SEQ ID NO: 46823 - RNA, 19 nt, Human
caugagccaccacucccag

SEQ ID NO: 46824 - RNA, 22 nt, Human
ccaaaugcuucauauucagcgg

SEQ ID NO: 46825 - RNA, 22 nt, Human
ccaaaugcuucauauucagcgg

SEQ ID NO: 46826 - RNA, 18 nt, Human
ccaagugcugggauuaca

SEQ ID NO: 46827 - RNA, 18 nt, Human
ccaagugcugggauuaca

SEQ ID NO: 46828 - RNA, 21 nt, Human
ccaagugcugggauuacaggc

SEQ ID NO: 46829 - RNA, 23 nt, Human
ccaagugcugggauuacaggcau

SEQ ID NO: 46830 - RNA, 23 nt, Human
ccaagugcugggauuacaggcau

SEQ ID NO: 46831 - RNA, 24 nt, Human
ccaagugcugggauuacaggcaug

SEQ ID NO: 46832 - RNA, 19 nt, Human
ccagcaaaucagggcccua

SEQ ID NO: 46833 - RNA, 19 nt, Human
ccagcaaaucagggcccua

SEQ ID NO: 46834 - RNA, 22 nt, Human
ccauaaauucaacuggcuacca

SEQ ID NO: 46835 - RNA, 22 nt, Human
ccauaaauucaacuggcuacca

SEQ ID NO: 46836 - RNA, 22 nt, Human
ccccucaauccucuuuucccuc

SEQ ID NO: 46837 - RNA, 23 nt, Human
ccuagccccucaauccucuuuuc

SEQ ID NO: 46838 - RNA, 23 nt, Human
ccuagccccucaauccucuuuuc

SEQ ID NO: 46839 - RNA, 29 nt, Human
ccuagccccucaauccucuuuucccuccc

SEQ ID NO: 46840 - RNA, 27 nt, Human
ccuagccccucaauccucuuuuccucc

SEQ ID NO: 46841 - RNA, 22 nt, Human
ccucaaaauaagcuagauucac

SEQ ID NO: 46842 - RNA, 24 nt, Human
ccucagccucuccaagugcuggga

SEQ ID NO: 46843 - RNA, 24 nt, Human
ccucagccucuccaagugcuggga

SEQ ID NO: 46844 - RNA, 20 nt, Human
ccuuuguuuuuaguugaagg

SEQ ID NO: 46845 - RNA, 21 nt, Human
ccuuuguuuuuaguugaaggc

SEQ ID NO: 46846 - RNA, 21 nt, Human
ccuuuguuuuuaguugaaggc

SEQ ID NO: 46847 - RNA, 23 nt, Human
ccuuuucaaaaggagaagggcca

SEQ ID NO: 46848 - RNA, 23 nt, Human
ccuuuucaaaaggagaagggcca

SEQ ID NO: 46849 - RNA, 18 nt, Human
cgaagggaucacaggggc

SEQ ID NO: 46850 - RNA, 22 nt, Human
cuagaaauagacccacaauuua

SEQ ID NO: 46851 - RNA, 22 nt, Human
cuagaaauagacccacaauuua

SEQ ID NO: 46852 - RNA, 24 nt, Human
cucacucugucacccaggcuggag

SEQ ID NO: 46853 - RNA, 24 nt, Human
cucacucugucacccaggcuggag

SEQ ID NO: 46854 - RNA, 20 nt, Human
cucauaacccaauccagcug

SEQ ID NO: 46855 - RNA, 24 nt, Human
cuccaagugcugggauuacaggca

SEQ ID NO: 46856 - RNA, 22 nt, Human
cuccuuuguuuuuaguugaagg

SEQ ID NO: 46857 - RNA, 22 nt, Human
cugaaagccucaaaauaaguag

SEQ ID NO: 46858 - RNA, 19 nt, Human
cugcaggaaguucaaacac

SEQ ID NO: 46859 - RNA, 19 nt, Human
cugcaggaaguucaaacac

SEQ ID NO: 46860 - RNA, 20 nt, Human
cugcuaagucacuucccagu

SEQ ID NO: 46861 - RNA, 20 nt, Human
cugcuaagucacuucccagu

SEQ ID NO: 46862 - RNA, 21 nt, Human
gaaccgaugcagaauccaugc

SEQ ID NO: 46863 - RNA, 21 nt, Human
gaagagccauauuaacccaaa

SEQ ID NO: 46864 - RNA, 21 nt, Human
gaagagccauauuaacccaaa

SEQ ID NO: 46865 - RNA, 18 nt, Human
gauuacaggcaugagcca

SEQ ID NO: 46866 - RNA, 18 nt, Human
gauuacaggcaugagcca

SEQ ID NO: 46867 - RNA, 21 nt, Human
gauuacaggcaugagccacca

SEQ ID NO: 46868 - RNA, 21 nt, Human
gauuacaggcaugagccacca

SEQ ID NO: 46869 - RNA, 22 nt, Human
gauuacaggcaugagccaccac

SEQ ID NO: 46870 - RNA, 22 nt, Human
gauuacaggcaugagccaccac

SEQ ID NO: 46871 - RNA, 23 nt, Human
gcaaaaaaaaaaaaaaaaaaaaa

SEQ ID NO: 46872 - RNA, 23 nt, Human
gcaaaaaaaaaaaaaaaaaaaaa

SEQ ID NO: 46873 - RNA, 21 nt, Human
gcgcaaccucagccucuccaa

SEQ ID NO: 46874 - RNA, 21 nt, Human
gcgcaaccucagccucuccaa

SEQ ID NO: 46875 - RNA, 19 nt, Human
ggauuacaggcaugagcca

SEQ ID NO: 46876 - RNA, 19 nt, Human
ggauuacaggcaugagcca

SEQ ID NO: 46877 - RNA, 23 nt, Human
gggauccgcccggccuagccccc

SEQ ID NO: 46878 - RNA, 23 nt, Human
gggauccgcccggccuagccccc

SEQ ID NO: 46879 - RNA, 20 nt, Human
gggcaggcugcaggcggccu

SEQ ID NO: 46880 - RNA, 20 nt, Human
guauacuaaauuuaucuccu

SEQ ID NO: 46881 - RNA, 20 nt, Human
guggcgcaaccucagccucu

SEQ ID NO: 46882 - RNA, 20 nt, Human
guggcgcaaccucagccucu

SEQ ID NO: 46883 - RNA, 24 nt, Human
uaaaaaaaaacugaucauuucccu

SEQ ID NO: 46884 - RNA, 26 nt, Human
uaaaugccaaaugcuucauauucagc

SEQ ID NO: 46885 - RNA, 21 nt, Human
uaacagggauacaugaagaua

SEQ ID NO: 46886 - RNA, 21 nt, Human
uaacagggauacaugaagaua

SEQ ID NO: 46887 - RNA, 20 nt, Human
uaacuagaaauagacccaca

SEQ ID NO: 46888 - RNA, 20 nt, Human
uaacuagaaauagacccaca

SEQ ID NO: 46889 - RNA, 21 nt, Human
uaacuagaaauagacccacaa

SEQ ID NO: 46890 - RNA, 21 nt, Human
uaacuagaaauagacccacaa

SEQ ID NO: 46891 - RNA, 24 nt, Human
uaagcuagauucaccuucaccuua

SEQ ID NO: 46892 - RNA, 28 nt, Human
uaagucacuucccagucuucacaaaaua

SEQ ID NO: 46893 - RNA, 28 nt, Human
uaagucacuucccagucuucacaaaaua

SEQ ID NO: 46894 - RNA, 24 nt, Human
uacaggcaugagccaccacuccca

SEQ ID NO: 46895 - RNA, 24 nt, Human
uacaggcaugagccaccacuccca

SEQ ID NO: 46896 - RNA, 23 nt, Human
uaccugcaggaaguucaaacaca

SEQ ID NO: 46897 - RNA, 23 nt, Human
uaccugcaggaaguucaaacaca

SEQ ID NO: 46898 - RNA, 23 nt, Human
uagccccucaauccucuuuuccc

SEQ ID NO: 46899 - RNA, 23 nt, Human
uagccccucaauccucuuuuccu

SEQ ID NO: 46900 - RNA, 18 nt, Human
uaguugaaggcaaaaaaa

SEQ ID NO: 46901 - RNA, 18 nt, Human
uaguugaaggcaaaaaaa

SEQ ID NO: 46902 - RNA, 20 nt, Human
uauaaaaaaaaacugaucau

SEQ ID NO: 46903 - RNA, 21 nt, Human
uauaaaauacagaaaaacugc

SEQ ID NO: 46904 - RNA, 26 nt, Human
uauaaaauacagaaaaacugcccagc

SEQ ID NO: 46905 - RNA, 26 nt, Human
uauaaaauacagaaaaacugcccagc

SEQ ID NO: 46906 - RNA, 25 nt, Human
ucaaaaggagaagggccaaaccaca

SEQ ID NO: 46907 - RNA, 25 nt, Human
ucaaaaggagaagggccaaaccaca

SEQ ID NO: 46908 - RNA, 19 nt, Human
ucaaaauaagcuagauuca

SEQ ID NO: 46909 - RNA, 22 nt, Human
ucacccaggcuggaguguagug

SEQ ID NO: 46910 - RNA, 22 nt, Human
ucacccaggcuggaguguagug

SEQ ID NO: 46911 - RNA, 24 nt, Human
ucacucugucacccaggcuggagu

SEQ ID NO: 46912 - RNA, 24 nt, Human
ucacucugucacccaggcuggagu

SEQ ID NO: 46913 - RNA, 21 nt, Human
ucauuacaguguauaaaaaaa

SEQ ID NO: 46914 - RNA, 21 nt, Human
ucauuacaguguauaaaaaaa

SEQ ID NO: 46915 - RNA, 22 nt, Human
uccaagugcugggauuacaggc

SEQ ID NO: 46916 - RNA, 23 nt, Human
uccaagugcugggauuacaggca

SEQ ID NO: 46917 - RNA, 23 nt, Human
uccaagugcugggauuacaggca

SEQ ID NO: 46918 - RNA, 24 nt, Human
uccaagugcugggauuacaggcau

SEQ ID NO: 46919 - RNA, 24 nt, Human
uccaagugcugggauuacaggcau

SEQ ID NO: 46920 - RNA, 26 nt, Human
uccacuuuucucacaaauaaaugcca

SEQ ID NO: 46921 - RNA, 26 nt, Human
uccacuuuucucacaaauaaaugcca

SEQ ID NO: 46922 - RNA, 23 nt, Human
ucucacucugucacccaggcugg

SEQ ID NO: 46923 - RNA, 23 nt, Human
ucucacucugucacccaggcugg

SEQ ID NO: 46924 - RNA, 24 nt, Human
ucucacucugucacccaggcugga

SEQ ID NO: 46925 - RNA, 24 nt, Human
ucucacucugucacccaggcugga

SEQ ID NO: 46926 - RNA, 26 nt, Human
ucucacucugucacccaggcuggagu

SEQ ID NO: 46927 - RNA, 26 nt, Human
ucucacucugucacccaggcuggagu

SEQ ID NO: 46928 - RNA, 27 nt, Human
ucucacucugucacccaggcuggagug

SEQ ID NO: 46929 - RNA, 27 nt, Human
ucucacucugucacccaggcuggagug

SEQ ID NO: 46930 - RNA, 24 nt, Human
ucuccaagugcugggauuacaggc

SEQ ID NO: 46931 - RNA, 24 nt, Human
ucuccaagugcugggauuacaggc

SEQ ID NO: 46932 - RNA, 20 nt, Human
ucucugggcagccuucgccu

SEQ ID NO: 46933 - RNA, 20 nt, Human
ucucugggcagccuucgccu

SEQ ID NO: 46934 - RNA, 21 nt, Human
ucucuggugguccaguuuugg

SEQ ID NO: 46935 - RNA, 19 nt, Human
ucugcuaagucacuuccca

SEQ ID NO: 46936 - RNA, 19 nt, Human
ucugcuaagucacuuccca

SEQ ID NO: 46937 - RNA, 24 nt, Human
ucugucacccaggcuggaguguag

SEQ ID NO: 46938 - RNA, 24 nt, Human
ucugucacccaggcuggaguguag

SEQ ID NO: 46939 - RNA, 22 nt, Human
ugaaagccucaaaauaagcuag

SEQ ID NO: 46940 - RNA, 19 nt, Human
ugaaggcaaaaaaaaaaaa

SEQ ID NO: 46941 - RNA, 19 nt, Human
ugaaggcaaaaaaaaaaaa

SEQ ID NO: 46942 - RNA, 23 nt, Human
ugagauccucaaaugacuuggca

SEQ ID NO: 46943 - RNA, 22 nt, Human
ugcaggaaguucaaacacauga

SEQ ID NO: 46944 - RNA, 22 nt, Human
ugcaggaaguucaaacacauga

SEQ ID NO: 46945 - RNA, 20 nt, Human
ugcuggggucuuccuggaug

SEQ ID NO: 46946 - RNA, 18 nt, Human
uggaguguaguggcgcaa

SEQ ID NO: 46947 - RNA, 18 nt, Human
uggaguguaguggcgcaa

SEQ ID NO: 46948 - RNA, 19 nt, Human
uggaguguaguggcgcaac

SEQ ID NO: 46949 - RNA, 19 nt, Human
uggaguguaguggcgcaac

SEQ ID NO: 46950 - RNA, 23 nt, Human
uggaguguaguggcgcaaccuca

SEQ ID NO: 46951 - RNA, 23 nt, Human
uggaguguaguggcgcaaccuca

SEQ ID NO: 46952 - RNA, 18 nt, Human
ugggauuacaggcaugag

SEQ ID NO: 46953 - RNA, 18 nt, Human
ugggauuacaggcaugag

SEQ ID NO: 46954 - RNA, 19 nt, Human
ugggauuacaggcaugagc

SEQ ID NO: 46955 - RNA, 19 nt, Human
ugggauuacaggcaugagc

SEQ ID NO: 46956 - RNA, 22 nt, Human
ugggauuacaggcaugagccac

SEQ ID NO: 46957 - RNA, 22 nt, Human
ugggauuacaggcaugagccac

SEQ ID NO: 46958 - RNA, 23 nt, Human
ugggauuacaggcaugagccacc

SEQ ID NO: 46959 - RNA, 23 nt, Human
ugggauuacaggcaugagccacc

SEQ ID NO: 46960 - RNA, 24 nt, Human
ugggauuacaggcaugagccacca

SEQ ID NO: 46961 - RNA, 24 nt, Human
ugggauuacaggcaugagccacca

SEQ ID NO: 46962 - RNA, 23 nt, Human
uguauaaaaaaaaacugaucauu

SEQ ID NO: 46963 - RNA, 23 nt, Human
uguauaaaaaaaaacugaucauu

SEQ ID NO: 46964 - RNA, 31 nt, Human
uuaguugaaggcaaaaaaaaaaaaaaaaaaa

SEQ ID NO: 46965 - RNA, 31 nt, Human; identical to SEQ ID NO: 46964

SEQ ID NO: 46966 - RNA, 21 nt, Human
uucaaaaggagaagggccaaa

SEQ ID NO: 46967 - RNA, 19 nt, Human
uucacaaaauacaagcugu

SEQ ID NO: 46968 - RNA, 19 nt, Human
uucauauucagcgguucau

SEQ ID NO: 46969 - RNA, 19 nt, Human
uucauauucagcgguucau

SEQ ID NO: 46970 - RNA, 19 nt, Human
uuuugcaccacaggucaaa

SEQ ID NO: 46971 - RNA, 19 nt, Human
uuuugcaccacaggucaaa

SEQ ID NO: 46972 - RNA, 20 nt, Human
aaaaaacacuccaaccagaa

SEQ ID NO: 46973 - RNA, 24 nt, Human
aaaaagcaagaaaacgacaaccca

SEQ ID NO: 46974 - RNA, 24 nt, Human
aaaaagcuggguugaggaagaggc

SEQ ID NO: 46975 - RNA, 21 nt, Human
aaaacaaaacaaaacaaaaag

SEQ ID NO: 46976 - RNA, 24 nt, Human
aaaacaacaccuagaggccaucag

SEQ ID NO: 46977 - RNA, 21 nt, Human
aaaagcaagaaaacgacaacc

SEQ ID NO: 46978 - RNA, 23 nt, Human
aaaaggaagugaaugacaaaaag

SEQ ID NO: 46979 - RNA, 22 nt, Human
aaacaaaaagcaagaaaacgag

SEQ ID NO: 46980 - RNA, 19 nt, Human
aaacaaaacaaaacaaaaa

SEQ ID NO: 46981 - RNA, 23 nt, Human
aaacaaaacaaaacaaaaagcaa

SEQ ID NO: 46982 - RNA, 18 nt, Human
aaacacuccaaccagaaa

SEQ ID NO: 46983 - RNA, 21 nt, Human
aaacacuccaaccagaaaauc

SEQ ID NO: 46984 - RNA, 23 nt, Human
aaacagccccuccccuggagaca

SEQ ID NO: 46985 - RNA, 19 nt, Human
aaacgacaacccaggucuc

SEQ ID NO: 46986 - RNA, 20 nt, Human
aaagagcaacuaaaaauuau

SEQ ID NO: 46987 - RNA, 19 nt, Human
aaagcaccacacggcccuc

SEQ ID NO: 46988 - RNA, 23 nt, Human
aacaaggaaaaaaggcaccaugg

SEQ ID NO: 46989 - RNA, 22 nt, Human
aaccaagcccugggcagggcca

SEQ ID NO: 46990 - RNA, 21 nt, Human
aagagcuugcuaacucacuaa

SEQ ID NO: 46991 - RNA, 23 nt, Human
aagaucugcaagugucucagagc

SEQ ID NO: 46992 - RNA, 21 nt, Human
aagcaagaaaacgacaaccca

SEQ ID NO: 46993 - RNA, 21 nt, Human
aaggggaccuuuccaguuggu

SEQ ID NO: 46994 - RNA, 21 nt, Human
aaguaccaccuccauccagcc

SEQ ID NO: 46995 - RNA, 24 nt, Human
aauacagggaugcagggguuuggg

SEQ ID NO: 46996 - RNA, 22 nt, Human
aaucccuaaaagcuaaaagggg

SEQ ID NO: 46997 - RNA, 25 nt, Human
aaugaggaaacagacucaagaggga

SEQ ID NO: 46998 - RNA, 23 nt, Human
acaaaaaaaaaaaaaaaaaaaaa

SEQ ID NO: 46999 - RNA, 20 nt, Human
acaaaacaacaccuagaggc

SEQ ID NO: 47000 - RNA, 22 nt, Human
acaaaacaacaccuagaggcca

SEQ ID NO: 47001 - RNA, 23 nt, Human
acaaaacacaaugaaaaauaaac

SEQ ID NO: 47002 - RNA, 18 nt, Human
acacgcccucagccauac

SEQ ID NO: 47003 - RNA, 22 nt, Human
agacaaaaaaaaaaaaaaaaaa

SEQ ID NO: 47004 - RNA, 18 nt, Human
agacaugcuucuucaggg

SEQ ID NO: 47005 - RNA, 22 nt, Human
agacccccucaccugcucagag

SEQ ID NO: 47006 - RNA, 19 nt, Human
agcaaacagccccuccccu

SEQ ID NO: 47007 - RNA, 18 nt, Human
agccaccgcagacccccu

SEQ ID NO: 47008 - RNA, 26 nt, Human
agccaggugcccaggcuaaggcuucu

SEQ ID NO: 47009 - RNA, 20 nt, Human
agccgaggaggcacugaguc

SEQ ID NO: 47010 - RNA, 23 nt, Human
agccugagccagcaaacagcccc

SEQ ID NO: 47011 - RNA, 20 nt, Human
agcugcugcuggcugccuuc

SEQ ID NO: 47012 - RNA, 20 nt, Human
aggaaagggagaagccccuu

SEQ ID NO: 47013 - RNA, 22 nt, Human
aggaagacccccacccugcuga

SEQ ID NO: 47014 - RNA, 19 nt, Human
aggagaagcugccagucac

SEQ ID NO: 47015 - RNA, 23 nt, Human
aggagggugggaggagcucagag

SEQ ID NO: 47016 - RNA, 21 nt, Human
aggcaccauggcccauucaag

SEQ ID NO: 47017 - RNA, 25 nt, Human
aggcaugggguuggguuuugaggau

SEQ ID NO: 47018 - RNA, 24 nt, Human
aggcccugggguggugaaucagaa

SEQ ID NO: 47019 - RNA, 21 nt, Human
aggggaccuuuccaguuggug

SEQ ID NO: 47020 - RNA, 21 nt, Human
aggucaggacugcugaggguu

SEQ ID NO: 47021 - RNA, 23 nt, Human
agugcagcugcugcuggcugccu

SEQ ID NO: 47022 - RNA, 23 nt, Human
aucaugcuuuggaauaaggucuc

SEQ ID NO: 47023 - RNA, 22 nt, Human
augcagggguuuggggagaggu

SEQ ID NO: 47024 - RNA, 21 nt, Human
caaaaagcaagaaaacgacaa

SEQ ID NO: 47025 - RNA, 21 nt, Human
caaaacaaaaagcaagaaaac

SEQ ID NO: 47026 - RNA, 21 nt, Human
caaaacacaaugaaaaauaaa

SEQ ID NO: 47027 - RNA, 18 nt, Human
caaaugaggaaacagacu

SEQ ID NO: 47028 - RNA, 22 nt, Human
caaccaagcccugggcagggcc

SEQ ID NO: 47029 - RNA, 20 nt, Human
caaggaaaaaaggcaccaug

SEQ ID NO: 47030 - RNA, 23 nt, Human
caaggaaaaaaggcaccauggcc

SEQ ID NO: 47031 - RNA, 21 nt, Human
cacagccacccugagggaaga

SEQ ID NO: 47032 - RNA, 27 nt, Human
cacagcucaggauucuaagaaucaccu

SEQ ID NO: 47033 - RNA, 19 nt, Human
cacaguacaacuuuauggg

SEQ ID NO: 47034 - RNA, 19 nt, Human
cacaugcagccauacagcc

SEQ ID NO: 47035 - RNA, 22 nt, Human
caccagacccuggacuuugggc

SEQ ID NO: 47036 - RNA, 23 nt, Human
cacccagcaccuuuguggagugg

SEQ ID NO: 47037 - RNA, 23 nt, Human
caccucaaaaacagcauacuggg

SEQ ID NO: 47038 - RNA, 18 nt, Human
cacgcccucagccauacc

SEQ ID NO: 47039 - RNA, 18 nt, Human
cacugagucaacagggag

SEQ ID NO: 47040 - RNA, 19 nt, Human
cacuggaaagaaaagggga

SEQ ID NO: 47041 - RNA, 22 nt, Human
cagaaaaucagcaagucucaga

SEQ ID NO: 47042 - RNA, 22 nt, Human
cagacacauacaaacgcacagu

SEQ ID NO: 47043 - RNA, 19 nt, Human
cagaggggugaaaggggau

SEQ ID NO: 47044 - RNA, 22 nt, Human
cagccagaagccguucccucaa

SEQ ID NO: 47045 - RNA, 21 nt, Human
cagcccgaagucaaugaccag

SEQ ID NO: 47046 - RNA, 24 nt, Human
caggaaccaagccuugaggcagag

SEQ ID NO: 47047 - RNA, 21 nt, Human
caggacugaagccaccacagc

SEQ ID NO: 47048 - RNA, 24 nt, Human
caggagugaauggauggcuucugc

SEQ ID NO: 47049 - RNA, 20 nt, Human
cagggccacagcaguggcug

SEQ ID NO: 47050 - RNA, 18 nt, Human
ccaauggccaugccccga

SEQ ID NO: 47051 - RNA, 20 nt, Human
ccagaaaaucagcaagucuc

SEQ ID NO: 47052 - RNA, 20 nt, Human
ccagcccgaagucaaugacc

SEQ ID NO: 47053 - RNA, 22 nt, Human
cccaagaacauccaagaagcac

SEQ ID NO: 47054 - RNA, 21 nt, Human
cccacggcaaggacaugggga

SEQ ID NO: 47055 - RNA, 22 nt, Human
cccaggcuaaggcuucuagaga

SEQ ID NO: 47056 - RNA, 18 nt, Human
ccccuggagacaaaaaaa

SEQ ID NO: 47057 - RNA, 24 nt, Human
cccgggaccucugaggagagcaga

SEQ ID NO: 47058 - RNA, 20 nt, Human
cccuggagacaaaaaaaaaa

SEQ ID NO: 47059 - RNA, 20 nt, Human
cccuuuccccuucugcaauc

SEQ ID NO: 47060 - RNA, 22 nt, Human
ccgaagucaaugaccagccugc

SEQ ID NO: 47061 - RNA, 21 nt, Human
ccgagucuacucuggucacac

SEQ ID NO: 47062 - RNA, 21 nt, Human
ccgcaggccagguggcuucua

SEQ ID NO: 47063 - RNA, 25 nt, Human
ccucagccauaccugcccacugccc

SEQ ID NO: 47064 - RNA, 20 nt, Human
ccucccgcaggccagguggc

SEQ ID NO: 47065 - RNA, 24 nt, Human
ccuccuccccaccagacccuggac

SEQ ID NO: 47066 - RNA, 18 nt, Human
cuauggcuagcaggcagu

SEQ ID NO: 47067 - RNA, 24 nt, Human
cucagccugagccagcaaacagcc

SEQ ID NO: 47068 - RNA, 27 nt, Human
cuccaggugcuuugcaaaaaccguccu

SEQ ID NO: 47069 - RNA, 21 nt, Human
cuccagugaucucgggcagcu

SEQ ID NO: 47070 - RNA, 21 nt, Human
cuccuucgcaggcuccccugg

SEQ ID NO: 47071 - RNA, 20 nt, Human
cucugcucagagggcaacgg

SEQ ID NO: 47072 - RNA, 20 nt, Human
cucuguacaaaugaggaaac

SEQ ID NO: 47073 - RNA, 21 nt, Human
cugagacugucagccacacag

SEQ ID NO: 47074 - RNA, 18 nt, Human
cugcucagagggcaacgg

SEQ ID NO: 47075 - RNA, 18 nt, Human
cugcugcuggcugccuuc

SEQ ID NO: 47076 - RNA, 22 nt, Human
cuuguaggucacaagcaccugg

SEQ ID NO: 47077 - RNA, 20 nt, Human
cuuuggaaaugugggcuugg

SEQ ID NO: 47078 - RNA, 18 nt, Human
cuuuggaacuggucccca

SEQ ID NO: 47079 - RNA, 22 nt, Human
gaaaauaauaaaacaaaacaaa

SEQ ID NO: 47080 - RNA, 18 nt, Human
gaaguacgaggaggggcc

SEQ ID NO: 47081 - RNA, 24 nt, Human
gaaucaccuuucacaugaagccaa

SEQ ID NO: 47082 - RNA, 19 nt, Human
gacccuggacuuugggccc

SEQ ID NO: 47083 - RNA, 20 nt, Human
gacuuugggccauccucagc

SEQ ID NO: 47084 - RNA, 20 nt, Human
gagaggggaaggaagagaga

SEQ ID NO: 47085 - RNA, 22 nt, Human
gagauuuuuggagauguggagg

SEQ ID NO: 47086 - RNA, 20 nt, Human
gagcuggggcagaaaaaggc

SEQ ID NO: 47087 - RNA, 18 nt, Human
gagggugggaggagcuca

SEQ ID NO: 47088 - RNA, 20 nt, Human
gaugggaggaggccccagga

SEQ ID NO: 47089 - RNA, 18 nt, Human
gcacuaaaucccuugagg

SEQ ID NO: 47090 - RNA, 24 nt, Human
gcagcacaguccauaguuuucuca

SEQ ID NO: 47091 - RNA, 18 nt, Human
gccauccucagccugagc

SEQ ID NO: 47092 - RNA, 24 nt, Human
gccuugaggcagaggguagcacau

SEQ ID NO: 47093 - RNA, 21 nt, Human
gcucaaggaaagggagaaaag

SEQ ID NO: 47094 - RNA, 20 nt, Human
gcucaugcagucacuauggc

SEQ ID NO: 47095 - RNA, 22 nt, Human
ggaagacaggagccaccgcaga

SEQ ID NO: 47096 - RNA, 18 nt, Human
ggacugaagccaccacag

SEQ ID NO: 47097 - RNA, 19 nt, Human
ggacugcugaggguuugcu

SEQ ID NO: 47098 - RNA, 22 nt, Human
ggaggagggugggaggagcuca

SEQ ID NO: 47099 - RNA, 20 nt, Human
ggagguuccuggaggagggu

SEQ ID NO: 47100 - RNA, 22 nt, Human
ggaucccagacacauacaaacg

SEQ ID NO: 47101 - RNA, 23 nt, Human
ggcaaggacauggggaaccugua

SEQ ID NO: 47102 - RNA, 19 nt, Human
ggcacaacgucauucccug

SEQ ID NO: 47103 - RNA, 22 nt, Human
ggccaaguguacacagccuccc

SEQ ID NO: 47104 - RNA, 23 nt, Human
ggccugaggggcuugcuggccuu

SEQ ID NO: 47105 - RNA, 24 nt, Human
ggccugaggggcuugcuggccuug

SEQ ID NO: 47106 - RNA, 19 nt, Human
ggcuuggauucuacagaac

SEQ ID NO: 47107 - RNA, 22 nt, Human
gggauguuuucaccuuuacuuu

SEQ ID NO: 47108 - RNA, 24 nt, Human
gggcuaggagucuggaggagaagc

SEQ ID NO: 47109 - RNA, 19 nt, Human
ggugugguuccagggaggg

SEQ ID NO: 47110 - RNA, 20 nt, Human
gugaagcauuaguagaacug

SEQ ID NO: 47111 - RNA, 21 nt, Human
gugaggcaugggguuggguuu

SEQ ID NO: 47112 - RNA, 23 nt, Human
gugagggagaaaggcuggagaag

SEQ ID NO: 47113 - RNA, 19 nt, Human
guuccuggaggaggguggg

SEQ ID NO: 47114 - RNA, 22 nt, Human
uaaaacaaaacaaaacaaaaag

SEQ ID NO: 47115 - RNA, 23 nt, Human
uaaaacaaaacaaaacaaaaagc

SEQ ID NO: 47116 - RNA, 19 nt, Human
uaaaagguugggccacagg

SEQ ID NO: 47117 - RNA, 22 nt, Human
uaacauugcaaaugacaaacaa

SEQ ID NO: 47118 - RNA, 25 nt, Human
uaacauugcaaaugacaaacaauuc

SEQ ID NO: 47119 - RNA, 19 nt, Human
uaagcuucccuccuccccc

SEQ ID NO: 47120 - RNA, 18 nt, Human
uaaggcagcagcacaguc

SEQ ID NO: 47121 - RNA, 23 nt, Human
uaaggcuucuagagacagggaga

SEQ ID NO: 47122 - RNA, 22 nt, Human
uacacagccucccgcaggccag

SEQ ID NO: 47123 - RNA, 21 nt, Human
uacuaacaaggaaaaaaggca

SEQ ID NO: 47124 - RNA, 25 nt, Human
uagcugggcucccuaaggggaaacc

SEQ ID NO: 47125 - RNA, 23 nt, Human
uagucccucugggcuuccaagga

SEQ ID NO: 47126 - RNA, 23 nt, Human
ucaaguauuuugcauagauguac

SEQ ID NO: 47127 - RNA, 23 nt, Human
ucacaagcaccuggucacccgaa

SEQ ID NO: 47128 - RNA, 20 nt, Human
ucacaugaagccaaaacucc

SEQ ID NO: 47129 - RNA, 21 nt, Human
ucagaggcggccagacaugcu

SEQ ID NO: 47130 - RNA, 21 nt, Human
ucaugcagucacuauggcugu

SEQ ID NO: 47131 - RNA, 26 nt, Human
uccaaacccaagaacauccaagaagc

SEQ ID NO: 47132 - RNA, 18 nt, Human
uccaaccagaaaaucagc

SEQ ID NO: 47133 - RNA, 19 nt, Human
uccagugcagcugcugcug

SEQ ID NO: 47134 - RNA, 21 nt, Human
uccauaguuuucucaaugccu

SEQ ID NO: 47135 - RNA, 18 nt, Human
ucccauggcuuucuuggg

SEQ ID NO: 47136 - RNA, 20 nt, Human
ucccugcucugacuguucca

SEQ ID NO: 47137 - RNA, 21 nt, Human
uccucauacucuccccucccu

SEQ ID NO: 47138 - RNA, 22 nt, Human
uccuuaaucccuaaaagcuaaa

SEQ ID NO: 47139 - RNA, 27 nt, Human
ucuccaggugcuuugcaaaaaccgucc

SEQ ID NO: 47140 - RNA, 22 nt, Human
ucuccuucgcaggcuccccugg

SEQ ID NO: 47141 - RNA, 19 nt, Human
ucugcaagcgaagugcugg

SEQ ID NO: 47142 - RNA, 22 nt, Human
ucugcaagcgaagugcuggccu

SEQ ID NO: 47143 - RNA, 22 nt, Human
ucugcaagugucucagagcugg

SEQ ID NO: 47144 - RNA, 19 nt, Human
ucugugaggcaugggguug

SEQ ID NO: 47145 - RNA, 18 nt, Human
ugaaaaauaaacauauga

SEQ ID NO: 47146 - RNA, 18 nt, Human
ugaacagagccaggagug

SEQ ID NO: 47147 - RNA, 28 nt, Human
ugaagccaccacagcucaggauucuaag

SEQ ID NO: 47148 - RNA, 20 nt, Human
ugaaucagaagucagcuuca

SEQ ID NO: 47149 - RNA, 19 nt, Human
ugacaaaaagcuggguuga

SEQ ID NO: 47150 - RNA, 21 nt, Human
ugaccugauugcaagacuggc

SEQ ID NO: 47151 - RNA, 20 nt, Human
ugagaggacgcguugggggu

SEQ ID NO: 47152 - RNA, 21 nt, Human
ugaggaaacagacucaagagg

SEQ ID NO: 47153 - RNA, 21 nt, Human
ugaggaagaggcucccugcuc

SEQ ID NO: 47154 - RNA, 19 nt, Human
ugagucagagugacccgug

SEQ ID NO: 47155 - RNA, 19 nt, Human
ugcaagugucucagagcug

SEQ ID NO: 47156 - RNA, 20 nt, Human
ugcagaucuugccaucgguc

SEQ ID NO: 47157 - RNA, 19 nt, Human
ugcagcugcugcuggcugc

SEQ ID NO: 47158 - RNA, 19 nt, Human
ugcaggagguggggagggg

SEQ ID NO: 47159 - RNA, 19 nt, Human
ugcccuggaucccagacac

SEQ ID NO: 47160 - RNA, 20 nt, Human
ugccugggcuuugagacgcu

SEQ ID NO: 47161 - RNA, 18 nt, Human
uggcaggaugggaggagg

SEQ ID NO: 47162 - RNA, 20 nt, Human
uggcugccuucuccagugaa

SEQ ID NO: 47163 - RNA, 19 nt, Human
ugggauggaggugauauga

SEQ ID NO: 47164 - RNA, 21 nt, Human
ugggauggaggugauaugaaa

SEQ ID NO: 47165 - RNA, 21 nt, Human
uggggcaccaggaaagugcgg

SEQ ID NO: 47166 - RNA, 18 nt, Human
uggguugaggaagaggcu

SEQ ID NO: 47167 - RNA, 22 nt, Human
uggguugaggaagaggcucccu

SEQ ID NO: 47168 - RNA, 23 nt, Human
uggguuguaaaauuggcaggagg

SEQ ID NO: 47169 - RNA, 22 nt, Human
ugguucuuucuagccauguuua

SEQ ID NO: 47170 - RNA, 19 nt, Human
ugucucagagcuggggcag

SEQ ID NO: 47171 - RNA, 19 nt, Human
ugugagggagaaaggcugg

SEQ ID NO: 47172 - RNA, 23 nt, Human
uguggagugggagucuaucuccc

SEQ ID NO: 47173 - RNA, 24 nt, Human
uguuuucaccuuuacuuuccagga

SEQ ID NO: 47174 - RNA, 22 nt, Human
uuaaggcagcagcacaguccau

SEQ ID NO: 47175 - RNA, 20 nt, Human
uuaggaaguaggcagggaga

SEQ ID NO: 47176 - RNA, 23 nt, Human
uucacaugaagccaaaacuccac

SEQ ID NO: 47177 - RNA, 22 nt, Human
uucacuuuuaaaaagauuuacc

SEQ ID NO: 47178 - RNA, 25 nt, Human
uuccauggucauggguccucugcag

SEQ ID NO: 47179 - RNA, 18 nt, Human
uucccauggcuuucuugg

SEQ ID NO: 47180 - RNA, 22 nt, Human
uucccuuuccccuucugcaauc

SEQ ID NO: 47181 - RNA, 20 nt, Human
uucuggugugguuccaggga

SEQ ID NO: 47182 - RNA, 21 nt, Human
uugcagaggggugaaagggga

SEQ ID NO: 47183 - RNA, 20 nt, Human
uuguaaaauuggcaggaggu

SEQ ID NO: 47184 - RNA, 21 nt, Human
uuucagagcuaucuaccuccu

SEQ ID NO: 47185 - RNA, 24 nt, Human
uuuccugagaucuuucuaaaccca

SEQ ID NO: 47186 - RNA, 24 nt, Human
uuugcauagauguacaaauauugu

SEQ ID NO: 47187 - RNA, 27 nt, Human
agaaauagcguaagauaaccgguaccc

SEQ ID NO: 47188 - RNA, 22 nt, Human
agggcaguuggugguuacaggg

SEQ ID NO: 47189 - RNA, 26 nt, Human
agugucuacuaaccaacagaaauagc

SEQ ID NO: 47190 - RNA, 21 nt, Human
aguuggugguuacagggcagu

SEQ ID NO: 47191 - RNA, 20 nt, Human
aucacaauaugcagguuuga

SEQ ID NO: 47192 - RNA, 22 nt, Human
ccagguaauguacauucuuuuc

SEQ ID NO: 47193 - RNA, 23 nt, Human
ccauccaucacagauaauuacuc

SEQ ID NO: 47194 - RNA, 19 nt, Human
cuaaccaacagaaauagcu

SEQ ID NO: 47195 - RNA, 23 nt, Human
cuugaaguccugggucccagccg

SEQ ID NO: 47196 - RNA, 23 nt, Human
gguaauguacauucuuuucuuuc

SEQ ID NO: 47197 - RNA, 19 nt, Human
guaaaacucauuaucaugc

SEQ ID NO: 47198 - RNA, 19 nt, Human
uaaguaaauuaucugugaa

SEQ ID NO: 47199 - RNA, 19 nt, Human
uacauucuuuucuuuccau

SEQ ID NO: 47200 - RNA, 21 nt, Human
uaccaugccccuacugacaga

SEQ ID NO: 47201 - RNA, 18 nt, Human
uagaagaagugauaucau

SEQ ID NO: 47202 - RNA, 22 nt, Human
uagaagaagugauaucauggca

SEQ ID NO: 47203 - RNA, 24 nt, Human
uagcguaagauaacuuuaaaaaaa

SEQ ID NO: 47204 - RNA, 22 nt, Human
uaucauggcaucucuguugucc

SEQ ID NO: 47205 - RNA, 23 nt, Human
uaugauauuuccuuauaccaugg

SEQ ID NO: 47206 - RNA, 18 nt, Human
ucccagccggaauaaggg

SEQ ID NO: 47207 - RNA, 19 nt, Human
ucuacuaaccaacagaaau

SEQ ID NO: 47208 - RNA, 18 nt, Human
ugaaucccaggaaaccag

SEQ ID NO: 47209 - RNA, 23 nt, Human
uguccauccaucacagauaauua

SEQ ID NO: 47210 - RNA, 18 nt, Human
uuacucuagaagaaguga

SEQ ID NO: 47211 - RNA, 18 nt, Human
uuuuuuuuuuuuuuuuug

SEQ ID NO: 47212 - RNA, 18 nt, Human
aaguaagaauaggcuagg

SEQ ID NO: 47213 - RNA, 18 nt, Human
agugcugaaaauaaaaac

SEQ ID NO: 47214 - RNA, 23 nt, Human
caucagagcugcagugcugaaaa

SEQ ID NO: 47215 - RNA, 24 nt, Human
cauuauggagccaucugucuagag

SEQ ID NO: 47216 - RNA, 22 nt, Human
ccaucagagcugcagugcugaa

SEQ ID NO: 47217 - RNA, 22 nt, Human
ccugguggagcuggaccaucag

SEQ ID NO: 47218 - RNA, 22 nt, Human
cugcagugcugaaaauaaaaac

SEQ ID NO: 47219 - RNA, 19 nt, Human
cugcuggucuggcuccucc

SEQ ID NO: 47220 - RNA, 21 nt, Human
gggaaaaggaaccuuuaauau

SEQ ID NO: 47221 - RNA, 22 nt, Human
ggggaucuguguccugguggag

SEQ ID NO: 47222 - RNA, 22 nt, Human
gucuccuucuuuuucccauuuc

SEQ ID NO: 47223 - RNA, 26 nt, Human
guuuagucuccuucuuuuucccauuu

SEQ ID NO: 47224 - RNA, 19 nt, Human
uaaacagugagacauggcu

SEQ ID NO: 47225 - RNA, 19 nt, Human
ucuccuucuuuuucccauu

SEQ ID NO: 47226 - RNA, 20 nt, Human
ucuguguccugguggagcug

SEQ ID NO: 47227 - RNA, 22 nt, Human
ugacaugaaauguccaugaagu

SEQ ID NO: 47228 - RNA, 19 nt, Human
ugcugugauagcuaaugcu

SEQ ID NO: 47229 - RNA, 23 nt, Human
ugucauuauggagccaucugucu

SEQ ID NO: 47230 - RNA, 22 nt, Human
uguccugguggagcuggaccau

SEQ ID NO: 47231 - RNA, 20 nt, Human
agggagggaaggauguagcu

SEQ ID NO: 47232 - RNA, 22 nt, Human
cuuuauuugcugcuuaaaacaa

SEQ ID NO: 47233 - RNA, 20 nt, Human
gaauauuaaguuagagacau

SEQ ID NO: 47234 - RNA, 20 nt, Human
gacaauguuugugguacuaa

SEQ ID NO: 47235 - RNA, 23 nt, Human
uggaauauuaaguuagagacauu

SEQ ID NO: 47236 - RNA, 22 nt, Human
aaaaauccuauaugccuuagcc

SEQ ID NO: 47237 - RNA, 22 nt, Human
aaaaauccuauaugccuuagcc

SEQ ID NO: 47238 - RNA, 22 nt, Human
aaacagaagcuucaugcauaua

SEQ ID NO: 47239 - RNA, 22 nt, Human
aaacagaagcuucaugcauaua

SEQ ID NO: 47240 - RNA, 23 nt, Human
acagugaggaugugccucagaac

SEQ ID NO: 47241 - RNA, 19 nt, Human
cacaggaccuuggagugcc

SEQ ID NO: 47242 - RNA, 25 nt, Human
ccggcgccgccgaguccguuucccu

SEQ ID NO: 47243 - RNA, 23 nt, Human
ccucaugccggcgccgccgaguc

SEQ ID NO: 47244 - RNA, 21 nt, Human
ccuuagcccugcaugcucauu

SEQ ID NO: 47245 - RNA, 23 nt, Human
cuuggagugccuuuuuccauuag

SEQ ID NO: 47246 - RNA, 27 nt, Human
gaaaacaauaaacagaagccgguaccc

SEQ ID NO: 47247 - RNA, 27 nt, Human
gaaaacaauaaacagaagccgguaccc

SEQ ID NO: 47248 - RNA, 19 nt, Human
gaaguaaaaguugaaguaa

SEQ ID NO: 47249 - RNA, 23 nt, Human
gacaaaaagaaaaugguaaccag

SEQ ID NO: 47250 - RNA, 23 nt, Human
gacaaaaagaaaaugguaaccag

SEQ ID NO: 47251 - RNA, 22 nt, Human
gccuuagcccugcaugcucauu

SEQ ID NO: 47252 - RNA, 23 nt, Human
gcuacauuugggucaugugaguu

SEQ ID NO: 47253 - RNA, 24 nt, Human
gcuacauuugggucaugugaguua

SEQ ID NO: 47254 - RNA, 20 nt, Human
ggagugccuuuuuccauuag

SEQ ID NO: 47255 - RNA, 21 nt, Human
guuaguuaaauccuaagccaa

SEQ ID NO: 47256 - RNA, 21 nt, Human
guuaguuaaauccuaagccaa

SEQ ID NO: 47257 - RNA, 27 nt, Human
uaaaaauacauguuuaaaguuagccua

SEQ ID NO: 47258 - RNA, 27 nt, Human
uaaaaauacauguuuaaaguuagccua

SEQ ID NO: 47259 - RNA, 19 nt, Human
uacagugaggaugugccuc

SEQ ID NO: 47260 - RNA, 19 nt, Human
uacagugaggaugugccuc

SEQ ID NO: 47261 - RNA, 21 nt, Human
uaccaguaccuuuauuguucc

SEQ ID NO: 47262 - RNA, 21 nt, Human
uaccaguaccuuuauuguucc

SEQ ID NO: 47263 - RNA, 25 nt, Human
uaugaaaaguaaaaaacaaaacaaa

SEQ ID NO: 47264 - RNA, 25 nt, Human
uaugaaaaguaaaaaacaaaacaaa

SEQ ID NO: 47265 - RNA, 19 nt, Human
uaugccuuagcccugcaug

SEQ ID NO: 47266 - RNA, 19 nt, Human
uaugccuuagcccugcaug

SEQ ID NO: 47267 - RNA, 20 nt, Human
uccaugagccuggguuucua

SEQ ID NO: 47268 - RNA, 19 nt, Human
ucgcccgagacgcucagcu

SEQ ID NO: 47269 - RNA, 24 nt, Human
ucugaaguaaaaguugaaguaaac

SEQ ID NO: 47270 - RNA, 22 nt, Human
ugaaaaguaaaaaacaaaacaa

SEQ ID NO: 47271 - RNA, 22 nt, Human
ugaaaaguaaaaaacaaaacaa

SEQ ID NO: 47272 - RNA, 19 nt, Human
ugaagagcagauagauuug

SEQ ID NO: 47273 - RNA, 23 nt, Human
ugaagagcagauagauuugcagu

SEQ ID NO: 47274 - RNA, 22 nt, Human
ugacaaaaagaaaaugguaacc

SEQ ID NO: 47275 - RNA, 22 nt, Human
ugacaaaaagaaaaugguaacc

SEQ ID NO: 47276 - RNA, 25 nt, Human
ugacaaaaagaaaaugguaaccaga

SEQ ID NO: 47277 - RNA, 25 nt, Human
ugacaaaaagaaaaugguaaccaga

SEQ ID NO: 47278 - RNA, 20 nt, Human
ugcacaggaccuuggagugc

SEQ ID NO: 47279 - RNA, 24 nt, Human
ugcagugauuccaugagccugggu

SEQ ID NO: 47280 - RNA, 27 nt, Human
ugccggcgccgccgaguccguuucccu

SEQ ID NO: 47281 - RNA, 20 nt, Human
ugccuuagcccugcaugcuc

SEQ ID NO: 47282 - RNA, 20 nt, Human
ugccuuagcccugcaugcuc

SEQ ID NO: 47283 - RNA, 19 nt, Human
uggaaaacaauaaacagaa

SEQ ID NO: 47284 - RNA, 19 nt, Human
uggaaaacaauaaacagaa

SEQ ID NO: 47285 - RNA, 24 nt, Human
uguaauauuucaguaguucuuuuc

SEQ ID NO: 47286 - RNA, 23 nt, Human
uuaaauauggaaaacaauaaaca

SEQ ID NO: 47287 - RNA, 23 nt, Human
uuaaauauggaaaacaauaaaca

SEQ ID NO: 47288 - RNA, 22 nt, Human
uuuaaaguccugcagaaaaauc

SEQ ID NO: 47289 - RNA, 22 nt, Human
uuuaaaguccugcagaaaaauc

SEQ ID NO: 47290 - RNA, 20 nt, Human
uuuacagugaggaugugccu

SEQ ID NO: 47291 - RNA, 20 nt, Human
uuuacagugaggaugugccu

SEQ ID NO: 47292 - RNA, 23 nt, Human
uuuacagugaggaugugccucag

SEQ ID NO: 47293 - RNA, 23 nt, Human
uuuacagugaggaugugccucag

SEQ ID NO: 47294 - RNA, 21 nt, Human
accccauccuugucaccccaa

SEQ ID NO: 47295 - RNA, 18 nt, Human
agcucccgggcgccgcuc

SEQ ID NO: 47296 - RNA, 22 nt, Human
agcuccguagucauuaccaccc

SEQ ID NO: 47297 - RNA, 21 nt, Human
agggggcuccgggcucggggc

SEQ ID NO: 47298 - RNA, 22 nt, Human
aguaugucauacccagaaucca

SEQ ID NO: 47299 - RNA, 22 nt, Human
auagcauggucuuuugcccccu

SEQ ID NO: 47300 - RNA, 19 nt, Human
caacuuuagcuccguaguc

SEQ ID NO: 47301 - RNA, 23 nt, Human
cacgccggcucggcgcgcauggu

SEQ ID NO: 47302 - RNA, 21 nt, Human
cagugcaaggcgguguccauc

SEQ ID NO: 47303 - RNA, 21 nt, Human
ccccauccuugucaccccaac

SEQ ID NO: 47304 - RNA, 21 nt, Human
cgaguaugucauacccagaau

SEQ ID NO: 47305 - RNA, 22 nt, Human
cgccgcuccguguggccggcga

SEQ ID NO: 47306 - RNA, 19 nt, Human
cgccggcucggcgcgcaug

SEQ ID NO: 47307 - RNA, 23 nt, Human
cgcgcauggugccgccgcgggca

SEQ ID NO: 47308 - RNA, 20 nt, Human
cuagccucgcagccacuccc

SEQ ID NO: 47309 - RNA, 21 nt, Human
cuccguguggccggcgagagc

SEQ ID NO: 47310 - RNA, 21 nt, Human
gacagguggugaaagguguuc

SEQ ID NO: 47311 - RNA, 19 nt, Human
gcagggggcuccgggcucg

SEQ ID NO: 47312 - RNA, 22 nt, Human
gcucggggcacggggcgcgggg

SEQ ID NO: 47313 - RNA, 18 nt, Human
gcugcggggcggccgcgg

SEQ ID NO: 47314 - RNA, 18 nt, Human
ggcucggggcugggcggc

SEQ ID NO: 47315 - RNA, 24 nt, Human
ggcugggcggcgcccccuuucccg

SEQ ID NO: 47316 - RNA, 22 nt, Human
gggcagggggcuccgggcucgg

SEQ ID NO: 47317 - RNA, 18 nt, Human
gggcucggggcugggcgg

SEQ ID NO: 47318 - RNA, 28 nt, Human
gguuuuguuuacaaacuuaauaguucca

SEQ ID NO: 47319 - RNA, 23 nt, Human
uaccccauccuugucaccccaac

SEQ ID NO: 47320 - RNA, 18 nt, Human
uagcucccgggcgccgcu

SEQ ID NO: 47321 - RNA, 25 nt, Human
uagcugcggggcggccgcgggcgga

SEQ ID NO: 47322 - RNA, 24 nt, Human
uccguagucauuaccacccaaagg

SEQ ID NO: 47323 - RNA, 22 nt, Human
ucggggcugggcggcgcccccu

SEQ ID NO: 47324 - RNA, 21 nt, Human
ucuuuugcccccucccccguu

SEQ ID NO: 47325 - RNA, 21 nt, Human
ugacagguggugaaagguguu

SEQ ID NO: 47326 - RNA, 19 nt, Human
ugccgccgcgggcaggggg

SEQ ID NO: 47327 - RNA, 22 nt, Human
uggccggcgagagcgccgggcu

SEQ ID NO: 47328 - RNA, 18 nt, Human
uguggccggcgagagcgc

SEQ ID NO: 47329 - RNA, 19 nt, Human
uguguguguguuguuccuu

SEQ ID NO: 47330 - RNA, 21 nt, Human
uuccaaaagagacaguuuucu

SEQ ID NO: 47331 - RNA, 19 nt, Human
uuguguguguguuguuccu

SEQ ID NO: 47332 - RNA, 24 nt, Human
uuuaaugauuccuuuauugcauuu

SEQ ID NO: 47333 - RNA, 24 nt, Human
aaaaaacaaaaaauuaacaaaaaa

SEQ ID NO: 47334 - RNA, 22 nt, Human
aaaauuuucuuuagucucuuca

SEQ ID NO: 47335 - RNA, 19 nt, Human
aagaaggauaggacagaau

SEQ ID NO: 47336 - RNA, 25 nt, Human
acacacacacacacccgcacacaca

SEQ ID NO: 47337 - RNA, 25 nt, Human
acacacacacacccgcacacacaca

SEQ ID NO: 47338 - RNA, 19 nt, Human
acacacccgcacacacaca

SEQ ID NO: 47339 - RNA, 19 nt, Human
acauggccuacaggucacc

SEQ ID NO: 47340 - RNA, 25 nt, Human
agaaaaccucaaaugauauagcuaa

SEQ ID NO: 47341 - RNA, 22 nt, Human
agacaaaaaacaaaaaauuaac

SEQ ID NO: 47342 - RNA, 19 nt, Human
aggaaagagauccacaaaa

SEQ ID NO: 47343 - RNA, 28 nt, Human
auauacugaugcugagacaaaaaacaaa

SEQ ID NO: 47344 - RNA, 18 nt, Human
cacacacacacacacaca

SEQ ID NO: 47345 - RNA, 20 nt, Human
cacacacacacacacacaca

SEQ ID NO: 47346 - RNA, 29 nt, Human
cacacacacacacacacacacccgcacac

SEQ ID NO: 47347 - RNA, 27 nt, Human
cacacacacacacacacacccgcacac

SEQ ID NO: 47348 - RNA, 22 nt, Human
cacacacacccgcacacacaca

SEQ ID NO: 47349 - RNA, 21 nt, Human
caggucaccaguucgcaaccu

SEQ ID NO: 47350 - RNA, 22 nt, Human
cccgcacacacacagauuucca

SEQ ID NO: 47351 - RNA, 19 nt, Human
ccuaaaaccaaccucaaau

SEQ ID NO: 47352 - RNA, 21 nt, Human
ccucaaaugauauagcuaaua

SEQ ID NO: 47353 - RNA, 25 nt, Human
ccugcacacacacacacacacacag

SEQ ID NO: 47354 - RNA, 24 nt, Human
ccugcacacacacacacacacagg

SEQ ID NO: 47355 - RNA, 23 nt, Human
cuaaaucuagcaacccuaaaacc

SEQ ID NO: 47356 - RNA, 22 nt, Human
cuucuugagucgagagcaaaua

SEQ ID NO: 47357 - RNA, 23 nt, Human
gaaaauguuaaccuucuugaguc

SEQ ID NO: 47358 - RNA, 23 nt, Human
gacaaaaaacaaaaaauuaacaa

SEQ ID NO: 47359 - RNA, 24 nt, Human
gguugccagaugaaaagaaaaaga

SEQ ID NO: 47360 - RNA, 25 nt, Human
uaaaacaaucaagauguugcaauca

SEQ ID NO: 47361 - RNA, 26 nt, Human
uaaaacaaucaagauguugcaaucaa

SEQ ID NO: 47362 - RNA, 20 nt, Human
uacacaaauaauuuuaguau

SEQ ID NO: 47363 - RNA, 18 nt, Human
uacuucugccaccccugc

SEQ ID NO: 47364 - RNA, 22 nt, Human
uagcaacccuaaaaccaaccuc

SEQ ID NO: 47365 - RNA, 18 nt, Human
uaggaaagagauccacag

SEQ ID NO: 47366 - RNA, 25 nt, Human
uauguuuuguuuucauuagagaaug

SEQ ID NO: 47367 - RNA, 21 nt, Human
ucaauuccuauuacagauuuu

SEQ ID NO: 47368 - RNA, 20 nt, Human
ucaccaguucgcaaccuggu

SEQ ID NO: 47369 - RNA, 18 nt, Human
ucuuuacaaucaucuucc

SEQ ID NO: 47370 - RNA, 24 nt, Human
ugagacaaaaaacaaaaaauuaac

SEQ ID NO: 47371 - RNA, 26 nt, Human
ugagacaaaaaacaaaaaauuaacaa

SEQ ID NO: 47372 - RNA, 25 nt, Human
ugcacacacacacacacacacaccc

SEQ ID NO: 47373 - RNA, 26 nt, Human
ugcacacacacacacacacacacccg

SEQ ID NO: 47374 - RNA, 27 nt, Human
ugcacacacacacacacacacacccgc

SEQ ID NO: 47375 - RNA, 21 nt, Human
ugccagaugaaaagaaaaaga

SEQ ID NO: 47376 - RNA, 19 nt, Human
ugggauauacugaugcuga

SEQ ID NO: 47377 - RNA, 27 nt, Human
uguagaaaaccucaaaugauauagcua

SEQ ID NO: 47378 - RNA, 19 nt, Human
ugucugcucuucucgcuca

SEQ ID NO: 47379 - RNA, 22 nt, Human
uuauaccaaauuguagaaaacc

SEQ ID NO: 47380 - RNA, 18 nt, Human
uuccucuugaaaauuuuc

SEQ ID NO: 47381 - RNA, 21 nt, Human
uugcaugggauauacugaugc

SEQ ID NO: 47382 - RNA, 21 nt, Human
uuuuuuuuuuuuuuuuuauuu

SEQ ID NO: 47383 - RNA, 23 nt, Human
acacugguccagagcagaaguca

SEQ ID NO: 47384 - RNA, 22 nt, Human
agggagaauguuuuguacucua

SEQ ID NO: 47385 - RNA, 26 nt, Human
agggcgucacaggagguugggacuac

SEQ ID NO: 47386 - RNA, 19 nt, Human
aggugguguggcuccuucu

SEQ ID NO: 47387 - RNA, 20 nt, Human
cgguaaggugucacaugagg

SEQ ID NO: 47388 - RNA, 22 nt, Human
gaaccaucagagcugcagcacu

SEQ ID NO: 47389 - RNA, 22 nt, Human
gagcagaagucagggcuggagu

SEQ ID NO: 47390 - RNA, 21 nt, Human
gcacugcuccuuuccacugca

SEQ ID NO: 47391 - RNA, 21 nt, Human
uaaggugucacaugagguuga

SEQ ID NO: 47392 - RNA, 19 nt, Human
ucaaaaaggcuucaaauca

SEQ ID NO: 47393 - RNA, 24 nt, Human
ucaaaaaggcuucaaaucacagug

SEQ ID NO: 47394 - RNA, 23 nt, Human
ucacaggugguguggcuccuucu

SEQ ID NO: 47395 - RNA, 25 nt, Human
ugacucugggagggugucacccgag

SEQ ID NO: 47396 - RNA, 21 nt, Human
uggaaacacugguccagagca

SEQ ID NO: 47397 - RNA, 21 nt, Human
ugggaaggcaucaacugaggu

SEQ ID NO: 47398 - RNA, 20 nt, Human
uucacaguucgugagacugc

SEQ ID NO: 47399 - RNA, 19 nt, Human
acuccggcuccgcccaggc

SEQ ID NO: 47400 - RNA, 23 nt, Human
aggcagcggcucgcaacuccggc

SEQ ID NO: 47401 - RNA, 21 nt, Human
ccucuaggcagcggcucgcaa

SEQ ID NO: 47402 - RNA, 18 nt, Human
gcccaggcuggauugcgg

SEQ ID NO: 47403 - RNA, 21 nt, Human
uccggcuccgcccaggcugga

SEQ ID NO: 47404 - RNA, 21 nt, Human
aaacacacacaaagcuggggc

SEQ ID NO: 47405 - RNA, 21 nt, Human
aacuucuccaaauuuccacac

SEQ ID NO: 47406 - RNA, 25 nt, Human
acacagcucaucccagccuggugcc

SEQ ID NO: 47407 - RNA, 19 nt, Human
acacaggcgcaggugcccc

SEQ ID NO: 47408 - RNA, 29 nt, Human
acacguacacacacacgcacccgcaagca

SEQ ID NO: 47409 - RNA, 18 nt, Human
acccgcaagcacacagcu

SEQ ID NO: 47410 - RNA, 22 nt, Human
accuggagucgggagcuugggg

SEQ ID NO: 47411 - RNA, 27 nt, Human
acguacacacacacgcacccgcaagca

SEQ ID NO: 47412 - RNA, 25 nt, Human
agacagcuggggcuacacguggcca

SEQ ID NO: 47413 - RNA, 18 nt, Human
agcacacagcucauccca

SEQ ID NO: 47414 - RNA, 18 nt, Human
agcaggggcagguguggc

SEQ ID NO: 47415 - RNA, 23 nt, Human
aggccccagagcaggggcaggug

SEQ ID NO: 47416 - RNA, 18 nt, Human
aggucucaagaaaaccag

SEQ ID NO: 47417 - RNA, 24 nt, Human
caagaaaaccagacaagauagcug

SEQ ID NO: 47418 - RNA, 22 nt, Human
cacgcacccgcaagcacacagc

SEQ ID NO: 47419 - RNA, 21 nt, Human
cagacaagauagcugacucuc

SEQ ID NO: 47420 - RNA, 18 nt, Human
cagcugagccugcaaagu

SEQ ID NO: 47421 - RNA, 22 nt, Human
caggcccaagaucaggggaccu

SEQ ID NO: 47422 - RNA, 19 nt, Human
ccagccuggugccugcaga

SEQ ID NO: 47423 - RNA, 23 nt, Human
cccacgucugugcugccuggaac

SEQ ID NO: 47424 - RNA, 18 nt, Human
ccccagagcaggggcagg

SEQ ID NO: 47425 - RNA, 19 nt, Human
cccugcugaacacacaucu

SEQ ID NO: 47426 - RNA, 19 nt, Human
ccgcaacuucuccaaauuu

SEQ ID NO: 47427 - RNA, 22 nt, Human
ccuggaaccgggugcccagggc

SEQ ID NO: 47428 - RNA, 20 nt, Human
cgaagagcacggaggggaac

SEQ ID NO: 47429 - RNA, 19 nt, Human
cucacugacacccucucga

SEQ ID NO: 47430 - RNA, 20 nt, Human
cuccaaauuuccacacaggc

SEQ ID NO: 47431 - RNA, 20 nt, Human
cugguccugggauggagucu

SEQ ID NO: 47432 - RNA, 24 nt, Human
cuucucugccgcaacuucuccaaa

SEQ ID NO: 47433 - RNA, 18 nt, Human
gacucucccacauagccc

SEQ ID NO: 47434 - RNA, 18 nt, Human
gcccaagaucaggggacc

SEQ ID NO: 47435 - RNA, 23 nt, Human
gccuggugccugcagacagcugg

SEQ ID NO: 47436 - RNA, 21 nt, Human
gcgggagaccagcggccaccu

SEQ ID NO: 47437 - RNA, 22 nt, Human
gcuggaacgcauggcuucucug

SEQ ID NO: 47438 - RNA, 20 nt, Human
ggccccagagcaggggcagg

SEQ ID NO: 47439 - RNA, 22 nt, Human
gggagaccagcggccaccugga

SEQ ID NO: 47440 - RNA, 18 nt, Human
gggcguggacagcaggag

SEQ ID NO: 47441 - RNA, 19 nt, Human
gguguggcugggaggggcu

SEQ ID NO: 47442 - RNA, 18 nt, Human
gucagggucuagggcuga

SEQ ID NO: 47443 - RNA, 22 nt, Human
guggacagcaggagccucucag

SEQ ID NO: 47444 - RNA, 25 nt, Human
uaaacacacacaaagcuggggcugu

SEQ ID NO: 47445 - RNA, 24 nt, Human
uaaagggcauuccuaagcuuaaac

SEQ ID NO: 47446 - RNA, 18 nt, Human
uccaaauuuccacacagg

SEQ ID NO: 47447 - RNA, 26 nt, Human
ucucccacauagcccuuuccauaaag

SEQ ID NO: 47448 - RNA, 20 nt, Human
ucucugccgcaacuucucca

SEQ ID NO: 47449 - RNA, 18 nt, Human
ugaacacagcgggagacc

SEQ ID NO: 47450 - RNA, 21 nt, Human
ugcagucugcucacugacacc

SEQ ID NO: 47451 - RNA, 22 nt, Human
ugcccagggcagccggcucagc

SEQ ID NO: 47452 - RNA, 23 nt, Human
ugcccagggcagccggcucagca

SEQ ID NO: 47453 - RNA, 24 nt, Human
uggaaccgggugcccagggcagcc

SEQ ID NO: 47454 - RNA, 18 nt, Human
ugggaggggcuguauaug

SEQ ID NO: 47455 - RNA, 20 nt, Human
ugggaggggcuguauaugug

SEQ ID NO: 47456 - RNA, 18 nt, Human
ugggauggagucuuucug

SEQ ID NO: 47457 - RNA, 21 nt, Human
uggggcugucccucuugaauc

SEQ ID NO: 47458 - RNA, 18 nt, Human
uuaaacacacacaaagcu

SEQ ID NO: 47459 - RNA, 21 nt, Human
uuagaacagcagcugagccug

SEQ ID NO: 47460 - RNA, 24 nt, Human
uucucauuauuaaagaauaaaagc

SEQ ID NO: 47461 - RNA, 24 nt, Human
uuuccacacaggcgcaggugcccc

SEQ ID NO: 47462 - RNA, 24 nt, Human
aacuccuuuucuaucuacccccau

SEQ ID NO: 47463 - RNA, 20 nt, Human
aagccucguuggccugcucu

SEQ ID NO: 47464 - RNA, 18 nt, Human
aaucccaccuuacugaua

SEQ ID NO: 47465 - RNA, 19 nt, Human
accucauuuuuguuccggc

SEQ ID NO: 47466 - RNA, 18 nt, Human
acgcuggaucccuccagc

SEQ ID NO: 47467 - RNA, 21 nt, Human
acgcuggaucccuccagccuu

SEQ ID NO: 47468 - RNA, 23 nt, Human
agacaagugaucucaaugucccc

SEQ ID NO: 47469 - RNA, 23 nt, Human
agcugaacagacauucaccagga

SEQ ID NO: 47470 - RNA, 18 nt, Human
agggagcuuuaguucggg

SEQ ID NO: 47471 - RNA, 22 nt, Human
aucucacuuuucuccuacuuuu

SEQ ID NO: 47472 - RNA, 21 nt, Human
auuucuauuauucguuggaag

SEQ ID NO: 47473 - RNA, 20 nt, Human
auuugcguuauuucacguug

SEQ ID NO: 47474 - RNA, 22 nt, Human
caaagccucguuggccugcucu

SEQ ID NO: 47475 - RNA, 22 nt, Human
caaagcuaacaccacuuaaacc

SEQ ID NO: 47476 - RNA, 28 nt, Human
caagauacgcuggaucccuccagccuuc

SEQ ID NO: 47477 - RNA, 22 nt, Human
cacagaagagcugaacagacau

SEQ ID NO: 47478 - RNA, 22 nt, Human
caccacaagacaagugaucuca

SEQ ID NO: 47479 - RNA, 19 nt, Human
cacugguuacuggcaagau

SEQ ID NO: 47480 - RNA, 20 nt, Human
cagcccuuccucacuuugcc

SEQ ID NO: 47481 - RNA, 27 nt, Human
cauaaucccaccuuacugauacacugu

SEQ ID NO: 47482 - RNA, 19 nt, Human
cauguaauuuauaguaaca

SEQ ID NO: 47483 - RNA, 23 nt, Human
cauuucccaacccccaugauacu

SEQ ID NO: 47484 - RNA, 20 nt, Human
ccaggauacgacuguuggac

SEQ ID NO: 47485 - RNA, 21 nt, Human
ccccauaaucccaccuuacug

SEQ ID NO: 47486 - RNA, 22 nt, Human
cccccaugauacuaaguuauuu

SEQ ID NO: 47487 - RNA, 23 nt, Human
cccccaugauacuaaguuauuug

SEQ ID NO: 47488 - RNA, 21 nt, Human
ccccccauuguuagugaaggu

SEQ ID NO: 47489 - RNA, 22 nt, Human
ccccucagcagccuccccacca

SEQ ID NO: 47490 - RNA, 20 nt, Human
cccucagcagccuccccacc

SEQ ID NO: 47491 - RNA, 19 nt, Human
cccugcaccagcccuuccu

SEQ ID NO: 47492 - RNA, 18 nt, Human
ccucaaagcuaacaccac

SEQ ID NO: 47493 - RNA, 20 nt, Human
ccucacuuugccuugcccuu

SEQ ID NO: 47494 - RNA, 18 nt, Human
cgggcacagcucgcugca

SEQ ID NO: 47495 - RNA, 21 nt, Human
cguuucauccuccuuguguga

SEQ ID NO: 47496 - RNA, 20 nt, Human
cuacccccauaaucccaccu

SEQ ID NO: 47497 - RNA, 20 nt, Human
cucacagaagagcugaacag

SEQ ID NO: 47498 - RNA, 24 nt, Human
cucagagguuaauaauccucacua

SEQ ID NO: 47499 - RNA, 19 nt, Human
cucauguugaacaaucuga

SEQ ID NO: 47500 - RNA, 19 nt, Human
gaaaccauagcagccauaa

SEQ ID NO: 47501 - RNA, 18 nt, Human
gaaagaaaggaaguugga

SEQ ID NO: 47502 - RNA, 21 nt, Human
gaccugcuaccccucagcagc

SEQ ID NO: 47503 - RNA, 24 nt, Human
gaccugcuaccccucagcagccuc

SEQ ID NO: 47504 - RNA, 18 nt, Human
gccccaggagacaccgcu

SEQ ID NO: 47505 - RNA, 21 nt, Human
gcucgcugcauuggagcccca

SEQ ID NO: 47506 - RNA, 23 nt, Human
uaacauauauuguauaaauacuc

SEQ ID NO: 47507 - RNA, 23 nt, Human
uaauguauaaacauucucugaaa

SEQ ID NO: 47508 - RNA, 25 nt, Human
uacgcuggaucccuccagccuucuu

SEQ ID NO: 47509 - RNA, 22 nt, Human
uauucccaaagcaggguuacau

SEQ ID NO: 47510 - RNA, 24 nt, Human
uauuuuacuauauacauauggaaa

SEQ ID NO: 47511 - RNA, 21 nt, Human
uccaaaaaaggaaagaggaag

SEQ ID NO: 47512 - RNA, 24 nt, Human
ucccaacccccaugauacuaaguu

SEQ ID NO: 47513 - RNA, 22 nt, Human
uccccaaaccugugggacccug

SEQ ID NO: 47514 - RNA, 23 nt, Human
ucccugcaccagcccuuccucac

SEQ ID NO: 47515 - RNA, 24 nt, Human
ucccugcaccagcccuuccucacu

SEQ ID NO: 47516 - RNA, 24 nt, Human
ucucauguugaacaaucugaaguu

SEQ ID NO: 47517 - RNA, 19 nt, Human
ugaacagacauucaccagg

SEQ ID NO: 47518 - RNA, 19 nt, Human
ugagacacaaguuacuucu

SEQ ID NO: 47519 - RNA, 22 nt, Human
ugaugauucaacuccuuuucua

SEQ ID NO: 47520 - RNA, 20 nt, Human
ugcuuucccugcaccagccc

SEQ ID NO: 47521 - RNA, 20 nt, Human
ugcuuuguuuuuucuaaacu

SEQ ID NO: 47522 - RNA, 23 nt, Human
uggauuguuaaaauuaacaauuu

SEQ ID NO: 47523 - RNA, 18 nt, Human
uggccugcucuggauugu

SEQ ID NO: 47524 - RNA, 26 nt, Human
ugugauuguacugauuuucaugagac

SEQ ID NO: 47525 - RNA, 24 nt, Human
uuaauaauccucacuaacuauccu

SEQ ID NO: 47526 - RNA, 19 nt, Human
uuauaugcacuuccacaaa

SEQ ID NO: 47527 - RNA, 21 nt, Human
uuccggcguuucauccuccuu

SEQ ID NO: 47528 - RNA, 24 nt, Human
uugcugagccuuucucuuggaccc

SEQ ID NO: 47529 - RNA, 20 nt, Human
uugcuuuguuuuuucuaaac

SEQ ID NO: 47530 - RNA, 24 nt, Human
uuggagccccaggagacaccgcuc

SEQ ID NO: 47531 - RNA, 18 nt, Human
aaaaaaguuuuagcccuc

SEQ ID NO: 47532 - RNA, 24 nt, Human
aagaaaagugaaaaaaguuuuagc

SEQ ID NO: 47533 - RNA, 20 nt, Human
aagugaaaaaaguuuuagcc

SEQ ID NO: 47534 - RNA, 24 nt, Human
accccuccgccucccgcaugcccc

SEQ ID NO: 47535 - RNA, 23 nt, Human
accuuuucccccucccuccuccu

SEQ ID NO: 47536 - RNA, 18 nt, Human
agaagaaaagugaaaaaa

SEQ ID NO: 47537 - RNA, 25 nt, Human
caccuuuucccccucccuccuccua

SEQ ID NO: 47538 - RNA, 21 nt, Human
cagccacccggucccaccccu

SEQ ID NO: 47539 - RNA, 21 nt, Human
ccacccggucccaccccuccg

SEQ ID NO: 47540 - RNA, 23 nt, Human
ccacccggucccaccccuccgcc

SEQ ID NO: 47541 - RNA, 20 nt, Human
ccagcaggaagaugcagggg

SEQ ID NO: 47542 - RNA, 18 nt, Human
cccccucccuccuccuaa

SEQ ID NO: 47543 - RNA, 20 nt, Human
cccccucccuccuccuaaaa

SEQ ID NO: 47544 - RNA, 20 nt, Human
cccucagcuccagaaauaaa

SEQ ID NO: 47545 - RNA, 24 nt, Human
gaagaugcaggggugcauggucag

SEQ ID NO: 47546 - RNA, 21 nt, Human
gagaagaaaagugaaaaaagu

SEQ ID NO: 47547 - RNA, 21 nt, Human
gccacccggucccaccccucc

SEQ ID NO: 47548 - RNA, 18 nt, Human
gcgcagccacccgguccc

SEQ ID NO: 47549 - RNA, 28 nt, Human
uagcccucagcuccagaaauaaagcgcu

SEQ ID NO: 47550 - RNA, 19 nt, Human
ugcauggucaggcgcgaga

SEQ ID NO: 47551 - RNA, 19 nt, Human
uggaaugggcgcagccacc

SEQ ID NO: 47552 - RNA, 19 nt, Human
uuagcccucagcuccagaa

SEQ ID NO: 47553 - RNA, 24 nt, Human
aaaggcaggucugggguuguugca

SEQ ID NO: 47554 - RNA, 24 nt, Human
acagccaaauguccugcagcugcc

SEQ ID NO: 47555 - RNA, 22 nt, Human
acccacagacggggguucacaa

SEQ ID NO: 47556 - RNA, 21 nt, Human
accucccgccggcucccaggc

SEQ ID NO: 47557 - RNA, 19 nt, Human
acgcugcaggccgccagcu

SEQ ID NO: 47558 - RNA, 22 nt, Human
acgggacagccuggcagaccuc

SEQ ID NO: 47559 - RNA, 25 nt, Human
acuucggggaccccagcuagaccag

SEQ ID NO: 47560 - RNA, 19 nt, Human
agaaggaggcgccgccagg

SEQ ID NO: 47561 - RNA, 21 nt, Human
agaccucccgccggcucccag

SEQ ID NO: 47562 - RNA, 23 nt, Human
agagcccuuccgugggcugcacu

SEQ ID NO: 47563 - RNA, 21 nt, Human
agauuggaaaaaguucgaauu

SEQ ID NO: 47564 - RNA, 21 nt, Human
agccacgacauagcgcccucc

SEQ ID NO: 47565 - RNA, 19 nt, Human
agcccgaggaguggagcgg

SEQ ID NO: 47566 - RNA, 25 nt, Human
agcuccuccugcugcaagcugggcc

SEQ ID NO: 47567 - RNA, 24 nt, Human
agcucucgccaauggcccggcaca

SEQ ID NO: 47568 - RNA, 19 nt, Human
aggaggcggcugcagcugc

SEQ ID NO: 47569 - RNA, 20 nt, Human
aggaucuccucaccaucguc

SEQ ID NO: 47570 - RNA, 18 nt, Human
aggcagccccuggcacug

SEQ ID NO: 47571 - RNA, 24 nt, Human
agggcucaggggcaggcagcuucu

SEQ ID NO: 47572 - RNA, 25 nt, Human
aggggagaugcucaucuucccaggg

SEQ ID NO: 47573 - RNA, 22 nt, Human
aggucugggguuguugcacugc

SEQ ID NO: 47574 - RNA, 18 nt, Human
augcacugcugcuauggg

SEQ ID NO: 47575 - RNA, 21 nt, Human
caccaacacaugcacgccccc

SEQ ID NO: 47576 - RNA, 18 nt, Human
caccaggugcucccuggc

SEQ ID NO: 47577 - RNA, 22 nt, Human
caccaucguccuccccaugggc

SEQ ID NO: 47578 - RNA, 22 nt, Human
cacccccuuagaggaggccuaa

SEQ ID NO: 47579 - RNA, 18 nt, Human
cacgccccccaaaggcag

SEQ ID NO: 47580 - RNA, 23 nt, Human
cacgccccccaaaggcaggucug

SEQ ID NO: 47581 - RNA, 21 nt, Human
cacggaacaaauguucaauga

SEQ ID NO: 47582 - RNA, 20 nt, Human
cacugagaccaggggucaac

SEQ ID NO: 47583 - RNA, 23 nt, Human
cacuggaccagaaacccacagac

SEQ ID NO: 47584 - RNA, 20 nt, Human
cacuggguguccaacaggau

SEQ ID NO: 47585 - RNA, 23 nt, Human
cagaguccccaccuccaaccccc

SEQ ID NO: 47586 - RNA, 24 nt, Human
cagcaccccagugguagaaggagg

SEQ ID NO: 47587 - RNA, 24 nt, Human
cagcaucuuccuggaggggucccc

SEQ ID NO: 47588 - RNA, 21 nt, Human
cagccacgacauagcgcccuc

SEQ ID NO: 47589 - RNA, 20 nt, Human
cagcccgaggaguggagcgg

SEQ ID NO: 47590 - RNA, 18 nt, Human
cagccuggaggacaugac

SEQ ID NO: 47591 - RNA, 20 nt, Human
cagcggcuggccgucggucc

SEQ ID NO: 47592 - RNA, 23 nt, Human
cagcuccuccugcugcaagcugg

SEQ ID NO: 47593 - RNA, 21 nt, Human
cagcugaugugcaugagcugg

SEQ ID NO: 47594 - RNA, 23 nt, Human
caggauccuccgcacgaccccuc

SEQ ID NO: 47595 - RNA, 21 nt, Human
caguauggaaugggacaggcc

SEQ ID NO: 47596 - RNA, 27 nt, Human
cauccagauggccccagccuggaggac

SEQ ID NO: 47597 - RNA, 22 nt, Human
ccaacacaugcacgccccccaa

SEQ ID NO: 47598 - RNA, 21 nt, Human
ccacacagcucuuccuggaca

SEQ ID NO: 47599 - RNA, 23 nt, Human
ccaucugacagaugagaggcugu

SEQ ID NO: 47600 - RNA, 19 nt, Human
cccacacgcagcgcgcccg

SEQ ID NO: 47601 - RNA, 25 nt, Human
cccacagcucacgcugcaggccgcc

SEQ ID NO: 47602 - RNA, 19 nt, Human
cccaugcacugcugcuaug

SEQ ID NO: 47603 - RNA, 18 nt, Human
ccccaaaggcaggucugg

SEQ ID NO: 47604 - RNA, 20 nt, Human
ccccagcuagaccagcgccc

SEQ ID NO: 47605 - RNA, 18 nt, Human
ccccauggggagggagcc

SEQ ID NO: 47606 - RNA, 22 nt, Human
ccccuuagaggaggccuaagcc

SEQ ID NO: 47607 - RNA, 23 nt, Human
ccccuuagaggaggccuaagccc

SEQ ID NO: 47608 - RNA, 21 nt, Human
cccgcucccaucugacagaug

SEQ ID NO: 47609 - RNA, 19 nt, Human
ccgccggcagacucaccag

SEQ ID NO: 47610 - RNA, 20 nt, Human
ccgcucccaucugacagaug

SEQ ID NO: 47611 - RNA, 18 nt, Human
ccucaccaucguccuccc

SEQ ID NO: 47612 - RNA, 20 nt, Human
ccucaccaucguccucccca

SEQ ID NO: 47613 - RNA, 23 nt, Human
ccuccaggcggggcagccggucc

SEQ ID NO: 47614 - RNA, 19 nt, Human
ccuccuggugaccacaccu

SEQ ID NO: 47615 - RNA, 20 nt, Human
ccucggcugacucccucucc

SEQ ID NO: 47616 - RNA, 19 nt, Human
ccugcagcuccuccugcug

SEQ ID NO: 47617 - RNA, 21 nt, Human
ccugcagcuccuccugcugca

SEQ ID NO: 47618 - RNA, 22 nt, Human
ccugcgcugcgacaaggcccgg

SEQ ID NO: 47619 - RNA, 21 nt, Human
ccugcugcaagcugggccuug

SEQ ID NO: 47620 - RNA, 20 nt, Human
ccuggacaggcacccugagg

SEQ ID NO: 47621 - RNA, 23 nt, Human
ccuggcaccugucccauaccugc

SEQ ID NO: 47622 - RNA, 18 nt, Human
ccuggcaccugucccauc

SEQ ID NO: 47623 - RNA, 22 nt, Human
ccugucccauaccugcugggag

SEQ ID NO: 47624 - RNA, 21 nt, Human
cgaccccucucccacagcuca

SEQ ID NO: 47625 - RNA, 24 nt, Human
cgaggaguggagcggagugagagg

SEQ ID NO: 47626 - RNA, 19 nt, Human
cgcacgaccccucucccac

SEQ ID NO: 47627 - RNA, 21 nt, Human
cgcccaugcacugcugcuaug

SEQ ID NO: 47628 - RNA, 19 nt, Human
cgcccgcaggagacggagc

SEQ ID NO: 47629 - RNA, 18 nt, Human
cggcacaugugucugcac

SEQ ID NO: 47630 - RNA, 21 nt, Human
cggcugcagcugcuuuggucc

SEQ ID NO: 47631 - RNA, 21 nt, Human
cucaggggcaggcagcuucuc

SEQ ID NO: 47632 - RNA, 22 nt, Human
cucagucacuggagccuccagg

SEQ ID NO: 47633 - RNA, 19 nt, Human
cuccaggccaucugccccu

SEQ ID NO: 47634 - RNA, 21 nt, Human
cuccgcacgaccccucuccca

SEQ ID NO: 47635 - RNA, 19 nt, Human
cuccgcaggagcgggagca

SEQ ID NO: 47636 - RNA, 26 nt, Human
cuccugcugcaagcugggccuugcuc

SEQ ID NO: 47637 - RNA, 23 nt, Human
cugcaggccuccugggguuccgg

SEQ ID NO: 47638 - RNA, 22 nt, Human
cugcgcauccggcgggugcccc

SEQ ID NO: 47639 - RNA, 21 nt, Human
cuuccugccagggcaggggcu

SEQ ID NO: 47640 - RNA, 19 nt, Human
gacaugacaucccgacaca

SEQ ID NO: 47641 - RNA, 19 nt, Human
gacauuggagaagacucua

SEQ ID NO: 47642 - RNA, 19 nt, Human
gaccccucucccacagcuc

SEQ ID NO: 47643 - RNA, 22 nt, Human
gagagccagcccgaggagugga

SEQ ID NO: 47644 - RNA, 23 nt, Human
gagccuccaggccaucugccccu

SEQ ID NO: 47645 - RNA, 21 nt, Human
gcacgaccccucucccacagc

SEQ ID NO: 47646 - RNA, 20 nt, Human
gcagcgcgcccguccugcgc

SEQ ID NO: 47647 - RNA, 20 nt, Human
gccagacacggaacaaaugu

SEQ ID NO: 47648 - RNA, 19 nt, Human
gcccgggcacaauacagga

SEQ ID NO: 47649 - RNA, 18 nt, Human
gcggagugagagggggcc

SEQ ID NO: 47650 - RNA, 18 nt, Human
gcugcaggccuccugggg

SEQ ID NO: 47651 - RNA, 20 nt, Human
gcuguaguagaggccaggcu

SEQ ID NO: 47652 - RNA, 20 nt, Human
gcuuugguccagcgggucug

SEQ ID NO: 47653 - RNA, 23 nt, Human
ggagagccagcccgaggagugga

SEQ ID NO: 47654 - RNA, 21 nt, Human
ggagggagggguagguggugu

SEQ ID NO: 47655 - RNA, 19 nt, Human
ggaugugcacgcccacccc

SEQ ID NO: 47656 - RNA, 19 nt, Human
ggcgaggcagccccuggca

SEQ ID NO: 47657 - RNA, 24 nt, Human
ggcugugugguacagcagcacccc

SEQ ID NO: 47658 - RNA, 19 nt, Human
gggccguggcuaggguggg

SEQ ID NO: 47659 - RNA, 24 nt, Human
ggggguucacaaggaaugccagga

SEQ ID NO: 47660 - RNA, 18 nt, Human
gggguuccgggcgaggca

SEQ ID NO: 47661 - RNA, 24 nt, Human
ggucccguccucccgggggccacc

SEQ ID NO: 47662 - RNA, 24 nt, Human
guccccaccacacaccuggcaccu

SEQ ID NO: 47663 - RNA, 23 nt, Human
guccccaccuccaacccccuagc

SEQ ID NO: 47664 - RNA, 18 nt, Human
gugagagggggccuuggu

SEQ ID NO: 47665 - RNA, 22 nt, Human
gugaugcggagggaccucacag

SEQ ID NO: 47666 - RNA, 23 nt, Human
uagauaccuaagauuggaaaaag

SEQ ID NO: 47667 - RNA, 18 nt, Human
uagcgcccuccgauccuc

SEQ ID NO: 47668 - RNA, 18 nt, Human
ucacgcugcaggccgcca

SEQ ID NO: 47669 - RNA, 22 nt, Human
ucagcaccaacacaugcacggu

SEQ ID NO: 47670 - RNA, 19 nt, Human
uccaacaggaucuccucac

SEQ ID NO: 47671 - RNA, 30 nt, Human
uccacgccacauucugucccauccaggagg

SEQ ID NO: 47672 - RNA, 20 nt, Human
uccagaguccccaccuccaa

SEQ ID NO: 47673 - RNA, 21 nt, Human
uccagaguccccaccuccaac

SEQ ID NO: 47674 - RNA, 18 nt, Human
uccaugcacguuuugggg

SEQ ID NO: 47675 - RNA, 21 nt, Human
uccaugcacguuuugggggac

SEQ ID NO: 47676 - RNA, 24 nt, Human
ucccaggccaccgccggcagacuc

SEQ ID NO: 47677 - RNA, 21 nt, Human
uccuccgcaggagcgggagca

SEQ ID NO: 47678 - RNA, 18 nt, Human
ucucgcucugccagcugu

SEQ ID NO: 47679 - RNA, 24 nt, Human
ugaaagagcccuuccgugggcugc

SEQ ID NO: 47680 - RNA, 22 nt, Human
ugacucccucuccggggucccc

SEQ ID NO: 47681 - RNA, 20 nt, Human
ugagaggcugugccaaagac

SEQ ID NO: 47682 - RNA, 21 nt, Human
ugagaggcugugccaaagaca

SEQ ID NO: 47683 - RNA, 18 nt, Human
ugagagggggccuuggug

SEQ ID NO: 47684 - RNA, 18 nt, Human
ugaugugcaugagcuggg

SEQ ID NO: 47685 - RNA, 24 nt, Human
ugcacagggguccacacgugugca

SEQ ID NO: 47686 - RNA, 25 nt, Human
ugcaggccgccagcuuguacugcca

SEQ ID NO: 47687 - RNA, 21 nt, Human
ugcaggccuccugggguuccg

SEQ ID NO: 47688 - RNA, 23 nt, Human
ugccaggaccucggcugacuccc

SEQ ID NO: 47689 - RNA, 25 nt, Human
ugccaggaccucggcugacucccuc

SEQ ID NO: 47690 - RNA, 21 nt, Human
ugcggagggaccucacagcca

SEQ ID NO: 47691 - RNA, 19 nt, Human
ugcucaucuucccagccac

SEQ ID NO: 47692 - RNA, 18 nt, Human
uggacauuggagaagacu

SEQ ID NO: 47693 - RNA, 22 nt, Human
uggagggguccccagaugcgga

SEQ ID NO: 47694 - RNA, 19 nt, Human
uggcacacaggucucguuc

SEQ ID NO: 47695 - RNA, 22 nt, Human
ugggcggccugcagcuccuccu

SEQ ID NO: 47696 - RNA, 25 nt, Human
ugggcgggacgauuaggcaguguuu

SEQ ID NO: 47697 - RNA, 19 nt, Human
ugugaaagagcccuuccgu

SEQ ID NO: 47698 - RNA, 22 nt, Human
uguggcaggagagggccuggca

SEQ ID NO: 47699 - RNA, 22 nt, Human
uuccuggacaggcacccugagg

SEQ ID NO: 47700 - RNA, 24 nt, Human
uuccuggacaggcacccugagggc

SEQ ID NO: 47701 - RNA, 19 nt, Human
uucgaauuggaaagcacug

SEQ ID NO: 47702 - RNA, 18 nt, Human
uuggugacugggaaucug

SEQ ID NO: 47703 - RNA, 23 nt, Human
uuuuuuuuuuuuuuuuucagccu

SEQ ID NO: 47704 - RNA, 23 nt, Human
aaaaaaaagacuuaaggcuuagg

SEQ ID NO: 47705 - RNA, 23 nt, Human
aaaaaaagacuuaaggcuuaaag

SEQ ID NO: 47706 - RNA, 21 nt, Human
aaaaagacuuaaggcuuaggg

SEQ ID NO: 47707 - RNA, 18 nt, Human
aaacaagcauaugcacca

SEQ ID NO: 47708 - RNA, 23 nt, Human
aaacaagcauaugcaccauggga

SEQ ID NO: 47709 - RNA, 24 nt, Human
aaaguucuugcacauucugugcuu

SEQ ID NO: 47710 - RNA, 19 nt, Human
aaaugagucaaugcagaac

SEQ ID NO: 47711 - RNA, 24 nt, Human
aacauuuuuauugguacgugcucu

SEQ ID NO: 47712 - RNA, 21 nt, Human
aaccugccuucaaagccccaa

SEQ ID NO: 47713 - RNA, 20 nt, Human
aacuuaauaucaacuacuaa

SEQ ID NO: 47714 - RNA, 19 nt, Human
aauacuaucaagaaaaaaa

SEQ ID NO: 47715 - RNA, 23 nt, Human
aaucauuugagaacacaucucuu

SEQ ID NO: 47716 - RNA, 24 nt, Human
aaucuuagcaacauauuuuucuuu

SEQ ID NO: 47717 - RNA, 18 nt, Human
aaugcaagauguuugcau

SEQ ID NO: 47718 - RNA, 24 nt, Human
acaaaaagucagcugauaugcaca

SEQ ID NO: 47719 - RNA, 22 nt, Human
acaaacagcaucaguaguguac

SEQ ID NO: 47720 - RNA, 18 nt, Human
acacaaaaacaaaggaca

SEQ ID NO: 47721 - RNA, 23 nt, Human
acacacaaaaacaaaggacaccu

SEQ ID NO: 47722 - RNA, 24 nt, Human
acaucuacucccuggagagagcau

SEQ ID NO: 47723 - RNA, 19 nt, Human
agaaaagaaagcccaaagg

SEQ ID NO: 47724 - RNA, 20 nt, Human
agaaagcccaaaggucagaa

SEQ ID NO: 47725 - RNA, 22 nt, Human
agaacaaaaggaggaugaaagc

SEQ ID NO: 47726 - RNA, 22 nt, Human
agacagcucagguacugaccuc

SEQ ID NO: 47727 - RNA, 20 nt, Human
agaggguuucaguuuugucu

SEQ ID NO: 47728 - RNA, 19 nt, Human
agagguuaauucaucuaca

SEQ ID NO: 47729 - RNA, 18 nt, Human
agcaaggugacuacugac

SEQ ID NO: 47730 - RNA, 21 nt, Human
agcaucaguaguguacacuuu

SEQ ID NO: 47731 - RNA, 20 nt, Human
aggaugaaagcaacuagaaa

SEQ ID NO: 47732 - RNA, 24 nt, Human
aggcaccuagaacauccagaaaug

SEQ ID NO: 47733 - RNA, 21 nt, Human
aguuggcuguaguaguuugcu

SEQ ID NO: 47734 - RNA, 24 nt, Human
auacaauauuucuaauauagauaa

SEQ ID NO: 47735 - RNA, 22 nt, Human
auccaaaauuucuuguuaaagu

SEQ ID NO: 47736 - RNA, 18 nt, Human
auuuacacaacagcugca

SEQ ID NO: 47737 - RNA, 21 nt, Human
auuucuuccaaugaauucugg

SEQ ID NO: 47738 - RNA, 23 nt, Human
caaaaucauuaugcugauaucac

SEQ ID NO: 47739 - RNA, 23 nt, Human
caacaaaacccuuuauauuguca

SEQ ID NO: 47740 - RNA, 21 nt, Human
caaguacuuuacaucuacucc

SEQ ID NO: 47741 - RNA, 21 nt, Human
caagucaucaacuuaauauca

SEQ ID NO: 47742 - RNA, 20 nt, Human
caaguguacuaagacaccag

SEQ ID NO: 47743 - RNA, 18 nt, Human
cacaaguguacuaagaca

SEQ ID NO: 47744 - RNA, 22 nt, Human
cacacacaaaaacaaaggacac

SEQ ID NO: 47745 - RNA, 24 nt, Human
cacacacaaaaacaaaggacaccu

SEQ ID NO: 47746 - RNA, 23 nt, Human
cacacacacacaaaaacaaagga

SEQ ID NO: 47747 - RNA, 25 nt, Human
cacagaacaaagcaugcaucucuaa

SEQ ID NO: 47748 - RNA, 22 nt, Human
caucuacauuuuaguuuguaua

SEQ ID NO: 47749 - RNA, 21 nt, Human
cauugugguugugaacauuug

SEQ ID NO: 47750 - RNA, 18 nt, Human
ccaaagcucuacuauacu

SEQ ID NO: 47751 - RNA, 18 nt, Human
ccuagaacauccagaaau

SEQ ID NO: 47752 - RNA, 25 nt, Human
ccugugaccacaaguguacuaagac

SEQ ID NO: 47753 - RNA, 20 nt, Human
ccuucaaagccccaaagcuc

SEQ ID NO: 47754 - RNA, 21 nt, Human
ccuuuauauugucaguagcug

SEQ ID NO: 47755 - RNA, 24 nt, Human
cgacaggcaccuagaacauccaga

SEQ ID NO: 47756 - RNA, 21 nt, Human
cuaaaacaaacaaaaagucag

SEQ ID NO: 47757 - RNA, 24 nt, Human
cuauagcuuuuguguuucuuuucu

SEQ ID NO: 47758 - RNA, 20 nt, Human
cucuaugcacagaacaaagc

SEQ ID NO: 47759 - RNA, 22 nt, Human
cucucauguacauguaauucau

SEQ ID NO: 47760 - RNA, 23 nt, Human
gaacaugaaccauauggaaaaua

SEQ ID NO: 47761 - RNA, 22 nt, Human
gagaacacaucucuuaaaauaa

SEQ ID NO: 47762 - RNA, 22 nt, Human
gagagagcauuucuggcuuugc

SEQ ID NO: 47763 - RNA, 21 nt, Human
gaucuauagagauuuccacuu

SEQ ID NO: 47764 - RNA, 25 nt, Human
gggaagagagagguuguccagguuu

SEQ ID NO: 47765 - RNA, 25 nt, Human
uaaaaaagaacacacacacacaaaa

SEQ ID NO: 47766 - RNA, 28 nt, Human
uaaaaaagaacacacacacacaaaaaca

SEQ ID NO: 47767 - RNA, 19 nt, Human
uaaaacaaacaaaaaguca

SEQ ID NO: 47768 - RNA, 19 nt, Human
uaaacaagcauaugcacca

SEQ ID NO: 47769 - RNA, 18 nt, Human
uaacaucaaauuuguuca

SEQ ID NO: 47770 - RNA, 20 nt, Human
uacuuuacaucuacucccug

SEQ ID NO: 47771 - RNA, 23 nt, Human
uagaaagugagccagcacuuucu

SEQ ID NO: 47772 - RNA, 20 nt, Human
uagagucaauaguuuaagcu

SEQ ID NO: 47773 - RNA, 19 nt, Human
uaucaagaaaaaaaaucaa

SEQ ID NO: 47774 - RNA, 18 nt, Human
uaucucaaccaucgacau

SEQ ID NO: 47775 - RNA, 22 nt, Human
uaugcacagaacaaagcaugca

SEQ ID NO: 47776 - RNA, 19 nt, Human
uauuacaguacauugagua

SEQ ID NO: 47777 - RNA, 27 nt, Human
ucaauaguuuaagcuguuaguuuacaa

SEQ ID NO: 47778 - RNA, 22 nt, Human
ucaguacaacaaacagcaucag

SEQ ID NO: 47779 - RNA, 22 nt, Human
uccauauccaaaauuucuuguu

SEQ ID NO: 47780 - RNA, 21 nt, Human
ucccaaaacuuuuuccuuugc

SEQ ID NO: 47781 - RNA, 21 nt, Human
ucccuggagagagcauuucug

SEQ ID NO: 47782 - RNA, 20 nt, Human
ucccuuuucugcuucagaga

SEQ ID NO: 47783 - RNA, 18 nt, Human
ucucuaauuaugucucuc

SEQ ID NO: 47784 - RNA, 19 nt, Human
ucuggaauuugccuaauuu

SEQ ID NO: 47785 - RNA, 24 nt, Human
ucuugaaccugccuucaaagcccc

SEQ ID NO: 47786 - RNA, 21 nt, Human
ucuugcacaaaguagcagcaa

SEQ ID NO: 47787 - RNA, 19 nt, Human
ugaacagcuagcugagucc

SEQ ID NO: 47788 - RNA, 20 nt, Human
ugaacauuugaacaugaacc

SEQ ID NO: 47789 - RNA, 19 nt, Human
ugaaccauauggaaaauaa

SEQ ID NO: 47790 - RNA, 23 nt, Human
ugagaacacaucucuuaaaauaa

SEQ ID NO: 47791 - RNA, 21 nt, Human
ugagcugacgaucuauagaga

SEQ ID NO: 47792 - RNA, 26 nt, Human
ugcacacacaaguaaacuagagagaa

SEQ ID NO: 47793 - RNA, 22 nt, Human
ugcacagaacaaagcaugcauc

SEQ ID NO: 47794 - RNA, 18 nt, Human
ugcagaacaaaaggagga

SEQ ID NO: 47795 - RNA, 25 nt, Human
ugcagaacaaaaggaggaugaaagc

SEQ ID NO: 47796 - RNA, 22 nt, Human
ugcgaaaauuaaaaaagaacac

SEQ ID NO: 47797 - RNA, 19 nt, Human
uggagagagcauuucuggc

SEQ ID NO: 47798 - RNA, 26 nt, Human
ugggaauuuuuaggaaaaaaaaaaga

SEQ ID NO: 47799 - RNA, 18 nt, Human
ugguaaaugagucaaugc

SEQ ID NO: 47800 - RNA, 23 nt, Human
uguaugcacacacaaguaaacua

SEQ ID NO: 47801 - RNA, 22 nt, Human
ugucaaacaaggcaauacucaa

SEQ ID NO: 47802 - RNA, 18 nt, Human
uucaaagccccaaagcuc

SEQ ID NO: 47803 - RNA, 18 nt, Human
uucugcuucagagagcga

SEQ ID NO: 47804 - RNA, 23 nt, Human
uuuacuguaacuuuucuaaaaca

SEQ ID NO: 47805 - RNA, 25 nt, Human
aaaaaaaaaagaaagaaagaaagaa

SEQ ID NO: 47806 - RNA, 20 nt, Human
aaaaaaaaagauaaucccuc

SEQ ID NO: 47807 - RNA, 24 nt, Human
aaaaaauaaaauucaggaagagga

SEQ ID NO: 47808 - RNA, 23 nt, Human
aaaaauaaaauucaggaagagga

SEQ ID NO: 47809 - RNA, 19 nt, Human
aaacaaaacaaaacaaaaa

SEQ ID NO: 47810 - RNA, 24 nt, Human
aaauaaauacaacuggggcccagg

SEQ ID NO: 47811 - RNA, 19 nt, Human
aacauggugaaaccccguc

SEQ ID NO: 47812 - RNA, 20 nt, Human
aacauggugaaaccccgucu

SEQ ID NO: 47813 - RNA, 21 nt, Human
aacauggugaaaccccgucuc

SEQ ID NO: 47814 - RNA, 20 nt, Human
aacauggugaaacccugucu

SEQ ID NO: 47815 - RNA, 21 nt, Human
aacauggugaaacccugucuc

SEQ ID NO: 47816 - RNA, 21 nt, Human
aacucuccuccugagcccucc

SEQ ID NO: 47817 - RNA, 20 nt, Human
aacuggggcccaggcccucc

SEQ ID NO: 47818 - RNA, 22 nt, Human
aagcacacacacauuuucacac

SEQ ID NO: 47819 - RNA, 21 nt, Human
aagggcagccgggauagugag

SEQ ID NO: 47820 - RNA, 19 nt, Human
aaguccuccacacccuagc

SEQ ID NO: 47821 - RNA, 23 nt, Human
aauagcgagacucugucuccaaa

SEQ ID NO: 47822 - RNA, 25 nt, Human
aaucacuugaacccgggaggcggag

SEQ ID NO: 47823 - RNA, 20 nt, Human
acaaaacaaaacaaaaauua

SEQ ID NO: 47824 - RNA, 23 nt, Human
acacacacacacacgcauacaca

SEQ ID NO: 47825 - RNA, 23 nt, Human
acacacacacacgcauacacaca

SEQ ID NO: 47826 - RNA, 33 nt, Human
acacauuuucacacacacacacacacgcauagu

SEQ ID NO: 47827 - RNA, 24 nt, Human
acagagcgagauucugucucaaaa

SEQ ID NO: 47828 - RNA, 24 nt, Human
accccgucucuacuaaaaauacaa

SEQ ID NO: 47829 - RNA, 24 nt, Human
acccugucucuacuaaaaauacaa

SEQ ID NO: 47830 - RNA, 24 nt, Human
accuaaggucaggaguucgagacc

SEQ ID NO: 47831 - RNA, 24 nt, Human
accucauacauaagcacacacaca

SEQ ID NO: 47832 - RNA, 22 nt, Human
acucugucuccaaacaaaacaa

SEQ ID NO: 47833 - RNA, 21 nt, Human
acugcagcugggagggacuga

SEQ ID NO: 47834 - RNA, 18 nt, Human
agauaaucccucacuccc

SEQ ID NO: 47835 - RNA, 26 nt, Human
agcacacacacauuuucacacacaca

SEQ ID NO: 47836 - RNA, 24 nt, Human
agcacuuugggaggccgaggcagg

SEQ ID NO: 47837 - RNA, 23 nt, Human
agccgggcguggugguaggugcc

SEQ ID NO: 47838 - RNA, 22 nt, Human
agccuggccaacauggugaaac

SEQ ID NO: 47839 - RNA, 22 nt, Human
agccuggccaacauggugaaac

SEQ ID NO: 47840 - RNA, 24 nt, Human
agccuggccaacauggugaaaccc

SEQ ID NO: 47841 - RNA, 24 nt, Human
agccuggccaacauggugaaaccc

SEQ ID NO: 47842 - RNA, 24 nt, Human
agccugggcgacagagcgagauuc

SEQ ID NO: 47843 - RNA, 24 nt, Human
agccuguaaucccagcuacucagg

SEQ ID NO: 47844 - RNA, 23 nt, Human
agcugggcgugguggcaggagcc

SEQ ID NO: 47845 - RNA, 18 nt, Human
aggaagaggaaagcagaa

SEQ ID NO: 47846 - RNA, 20 nt, Human
aggaugcagugagccgagau

SEQ ID NO: 47847 - RNA, 24 nt, Human
aggcacgguggcucacgccuguaa

SEQ ID NO: 47848 - RNA, 23 nt, Human
aggcaggagaauugcuggaaccc

SEQ ID NO: 47849 - RNA, 22 nt, Human
aggcaggucgauuaccugaggu

SEQ ID NO: 47850 - RNA, 26 nt, Human
aggcaggucgauuaccugaggucagg

SEQ ID NO: 47851 - RNA, 18 nt, Human
aggcaugagaaucacuug

SEQ ID NO: 47852 - RNA, 24 nt, Human
aggcaugagaaucacuugaacccg

SEQ ID NO: 47853 - RNA, 18 nt, Human
aggccgaggcaggucgau

SEQ ID NO: 47854 - RNA, 26 nt, Human
aggcgaguggaucaccuaaggucagg

SEQ ID NO: 47855 - RNA, 24 nt, Human
aggcggaggaugcagugagccgag

SEQ ID NO: 47856 - RNA, 20 nt, Human
aggcugaggcaggagaauug

SEQ ID NO: 47857 - RNA, 21 nt, Human
aggcugaggcaggagaauugc

SEQ ID NO: 47858 - RNA, 24 nt, Human
aggcugaggcaugagaaucacuug

SEQ ID NO: 47859 - RNA, 20 nt, Human
aggucgauuaccugagguca

SEQ ID NO: 47860 - RNA, 24 nt, Human
agguggcgaagguugcagugagcu

SEQ ID NO: 47861 - RNA, 24 nt, Human
auccacuaacccaucacugccucc

SEQ ID NO: 47862 - RNA, 24 nt, Human
aucccucacucccugaaggcccac

SEQ ID NO: 47863 - RNA, 22 nt, Human
augcagugagccgagauugugc

SEQ ID NO: 47864 - RNA, 24 nt, Human
auguaccgggcgugguggcucaca

SEQ ID NO: 47865 - RNA, 24 nt, Human
auuaccugaggucaggaguucaag

SEQ ID NO: 47866 - RNA, 24 nt, Human
auugcacuccagccugggcgacag

SEQ ID NO: 47867 - RNA, 24 nt, Human
auugugccauugcacuccagccug

SEQ ID NO: 47868 - RNA, 24 nt, Human
caacauggugaaaccccgucucua

SEQ ID NO: 47869 - RNA, 24 nt, Human
caacauggugaaacccugucucua

SEQ ID NO: 47870 - RNA, 18 nt, Human
caagagcagccuggccaa

SEQ ID NO: 47871 - RNA, 24 nt, Human
caagagcagccuggccaacauggu

SEQ ID NO: 47872 - RNA, 26 nt, Human
cacacacacacacgcauacacacacc

SEQ ID NO: 47873 - RNA, 24 nt, Human
cacacacauuuucacacacacaca

SEQ ID NO: 47874 - RNA, 24 nt, Human
cacaccuguaaucccagcacuuug

SEQ ID NO: 47875 - RNA, 18 nt, Human
cacacgcauacacacacc

SEQ ID NO: 47876 - RNA, 24 nt, Human
caccaccacccuggauuuccuagc

SEQ ID NO: 47877 - RNA, 23 nt, Human
caccuaaggucaggaguucgaga

SEQ ID NO: 47878 - RNA, 19 nt, Human
caccuguaaucccagcacu

SEQ ID NO: 47879 - RNA, 24 nt, Human
caccuguaaucccagcacuuuggg

SEQ ID NO: 47880 - RNA, 22 nt, Human
cacgcccacagccccuccccac

SEQ ID NO: 47881 - RNA, 23 nt, Human
cacgcccacagccccuccccacu

SEQ ID NO: 47882 - RNA, 24 nt, Human
cacgccuguaaucccagcacuuug

SEQ ID NO: 47883 - RNA, 22 nt, Human
cacuaacccaucacugccuccc

SEQ ID NO: 47884 - RNA, 23 nt, Human
cacuccagccugggcgacagagc

SEQ ID NO: 47885 - RNA, 24 nt, Human
cacuccagccugggcgacagagcg

SEQ ID NO: 47886 - RNA, 23 nt, Human
cagaaagggcagccgggauagug

SEQ ID NO: 47887 - RNA, 20 nt, Human
cagcacuuugggagaugaag

SEQ ID NO: 47888 - RNA, 21 nt, Human
cagcacuuugggagaugaagg

SEQ ID NO: 47889 - RNA, 24 nt, Human
cagcacuuugggaggccgaggcag

SEQ ID NO: 47890 - RNA, 25 nt, Human
cagcacuuugggaggccgaggcagg

SEQ ID NO: 47891 - RNA, 24 nt, Human
cagcuacucgggaggcugaggcag

SEQ ID NO: 47892 - RNA, 24 nt, Human
caggaggcugaggcaugagaauca

SEQ ID NO: 47893 - RNA, 19 nt, Human
caggcccucccugccuucc

SEQ ID NO: 47894 - RNA, 20 nt, Human
cagggcagggccagccugcg

SEQ ID NO: 47895 - RNA, 21 nt, Human
caggucgauuaccugagguca

SEQ ID NO: 47896 - RNA, 24 nt, Human
caggucgauuaccugaggucagga

SEQ ID NO: 47897 - RNA, 27 nt, Human
cauaagcacacacacauuuucacacac

SEQ ID NO: 47898 - RNA, 22 nt, Human
caugaggcagcaacagaagcuc

SEQ ID NO: 47899 - RNA, 19 nt, Human
cauuccagcccuggugaca

SEQ ID NO: 47900 - RNA, 19 nt, Human
cauugcacuccagccuggg

SEQ ID NO: 47901 - RNA, 21 nt, Human
cauugcacuccagccugggcg

SEQ ID NO: 47902 - RNA, 22 nt, Human
cauugcacuccagccugggcga

SEQ ID NO: 47903 - RNA, 24 nt, Human
cauugcacuccagccugggcgaca

SEQ ID NO: 47904 - RNA, 30 nt, Human
cauuuucacacacacacacacacgcauaca

SEQ ID NO: 47905 - RNA, 21 nt, Human
ccagggugagggcuaugaggg

SEQ ID NO: 47906 - RNA, 20 nt, Human
ccauugcacuccagccuggg

SEQ ID NO: 47907 - RNA, 21 nt, Human
ccauugcacuccagccugggc

SEQ ID NO: 47908 - RNA, 22 nt, Human
ccauugcacuccagccugggcg

SEQ ID NO: 47909 - RNA, 23 nt, Human
ccauugcacuccagccugggcga

SEQ ID NO: 47910 - RNA, 24 nt, Human
ccauugcacuccagccugggcgac

SEQ ID NO: 47911 - RNA, 18 nt, Human
cccacagccccuccccac

SEQ ID NO: 47912 - RNA, 19 nt, Human
cccaggacccuaguccuug

SEQ ID NO: 47913 - RNA, 19 nt, Human
cccuagcuuuggaaagcuc

SEQ ID NO: 47914 - RNA, 23 nt, Human
cccuccuuuccuggaucuuuguc

SEQ ID NO: 47915 - RNA, 19 nt, Human
cccugccuucccccucccu

SEQ ID NO: 47916 - RNA, 22 nt, Human
cccugccuucccccucccuccu

SEQ ID NO: 47917 - RNA, 23 nt, Human
ccgcagggcagagggggcaguuu

SEQ ID NO: 47918 - RNA, 22 nt, Human
ccgcuucugugccugcccuguc

SEQ ID NO: 47919 - RNA, 22 nt, Human
ccuaaggucaggaguucgagac

SEQ ID NO: 47920 - RNA, 21 nt, Human
ccuauaaucucagcuacucgg

SEQ ID NO: 47921 - RNA, 20 nt, Human
ccuaucaccaccacccugga

SEQ ID NO: 47922 - RNA, 23 nt, Human
ccucauacauaagcacacacaca

SEQ ID NO: 47923 - RNA, 24 nt, Human
ccucccagggcaggaaaccagggc

SEQ ID NO: 47924 - RNA, 21 nt, Human
ccugccaaggucagaggcaaa

SEQ ID NO: 47925 - RNA, 22 nt, Human
ccuggccaacauggugaaaccc

SEQ ID NO: 47926 - RNA, 23 nt, Human
ccuggccaacauggugaaacccc

SEQ ID NO: 47927 - RNA, 24 nt, Human
ccuggccaacauggugaaaccccg

SEQ ID NO: 47928 - RNA, 24 nt, Human
ccuggccaacauggugaaacccug

SEQ ID NO: 47929 - RNA, 22 nt, Human
ccugggcgacagagcgagauuc

SEQ ID NO: 47930 - RNA, 21 nt, Human
ccuguaaucccagcuacucag

SEQ ID NO: 47931 - RNA, 24 nt, Human
cgagaccagccuggccaacauggu

SEQ ID NO: 47932 - RNA, 20 nt, Human
cgaggcaggucgauuaccug

SEQ ID NO: 47933 - RNA, 24 nt, Human
cgaguggaucaccuaaggucagga

SEQ ID NO: 47934 - RNA, 18 nt, Human
cgcagggcagagggggca

SEQ ID NO: 47935 - RNA, 21 nt, Human
cgcauacacacaccacuuaua

SEQ ID NO: 47936 - RNA, 20 nt, Human
cgcccacagccccuccccac

SEQ ID NO: 47937 - RNA, 24 nt, Human
cgccuguaaucccagcacuuuggg

SEQ ID NO: 47938 - RNA, 21 nt, Human
cgggaggcggaggaugcagug

SEQ ID NO: 47939 - RNA, 18 nt, Human
cuagccccagggugaggg

SEQ ID NO: 47940 - RNA, 22 nt, Human
cucacaccuguaaucccagcac

SEQ ID NO: 47941 - RNA, 24 nt, Human
cucacaccuguaaucccagcacuu

SEQ ID NO: 47942 - RNA, 22 nt, Human
cucacgccuguaaucccagcac

SEQ ID NO: 47943 - RNA, 24 nt, Human
cucacgccuguaaucccagcacuu

SEQ ID NO: 47944 - RNA, 22 nt, Human
cuccaaacucuccuccugagcc

SEQ ID NO: 47945 - RNA, 22 nt, Human
cucccagcuaaguccgaggccc

SEQ ID NO: 47946 - RNA, 18 nt, Human
cugcagcugggagggacu

SEQ ID NO: 47947 - RNA, 23 nt, Human
cugcagcugggagggacugaggc

SEQ ID NO: 47948 - RNA, 24 nt, Human
cuggccaacauggugaaacccugu

SEQ ID NO: 47949 - RNA, 21 nt, Human
cugucuccaaacaaaacaaaa

SEQ ID NO: 47950 - RNA, 19 nt, Human
gaaacccugucucuacuaa

SEQ ID NO: 47951 - RNA, 18 nt, Human
gaacccgggaggcggagg

SEQ ID NO: 47952 - RNA, 18 nt, Human
gaagguugcagugagcug

SEQ ID NO: 47953 - RNA, 24 nt, Human
gaagguugcagugagcugaaauca

SEQ ID NO: 47954 - RNA, 20 nt, Human
gaagguugcagugagcuggc

SEQ ID NO: 47955 - RNA, 24 nt, Human
gacagagcgagauucugucucaaa

SEQ ID NO: 47956 - RNA, 21 nt, Human
gacuccugccaaggucagagg

SEQ ID NO: 47957 - RNA, 23 nt, Human
gagaaucacuugaacccgggagg

SEQ ID NO: 47958 - RNA, 23 nt, Human
gagauugugccauugcacuccag

SEQ ID NO: 47959 - RNA, 23 nt, Human
gaggaugcagugagccgagauug

SEQ ID NO: 47960 - RNA, 24 nt, Human
gaggcaaaguuuucagaagggcug

SEQ ID NO: 47961 - RNA, 25 nt, Human
gaggcaggucgauuaccugagguca

SEQ ID NO: 47962 - RNA, 18 nt, Human
gaucaccuaaggucagga

SEQ ID NO: 47963 - RNA, 24 nt, Human
gaucaccuaaggucaggaguucga

SEQ ID NO: 47964 - RNA, 22 nt, Human
gauuaccugaggucaggaguuc

SEQ ID NO: 47965 - RNA, 23 nt, Human
gauuaccugaggucaggaguuca

SEQ ID NO: 47966 - RNA, 24 nt, Human
gauuaccugaggucaggaguucaa

SEQ ID NO: 47967 - RNA, 21 nt, Human
gcaccaaguccuccacacccu

SEQ ID NO: 47968 - RNA, 24 nt, Human
gcacuccagccugggcgacagagc

SEQ ID NO: 47969 - RNA, 21 nt, Human
gcaggaaaccagggcagggcc

SEQ ID NO: 47970 - RNA, 22 nt, Human
gcaggagaauugcuggaaccca

SEQ ID NO: 47971 - RNA, 24 nt, Human
gccaacauggugaaaccccgucuc

SEQ ID NO: 47972 - RNA, 24 nt, Human
gccaacauggugaaacccugucuc

SEQ ID NO: 47973 - RNA, 22 nt, Human
gccauugcacuccagccugggc

SEQ ID NO: 47974 - RNA, 24 nt, Human
gccauugcacuccagccugggcga

SEQ ID NO: 47975 - RNA, 20 nt, Human
gcccucccugccuucccccu

SEQ ID NO: 47976 - RNA, 21 nt, Human
gcccucccugccuucccccuc

SEQ ID NO: 47977 - RNA, 21 nt, Human
gcccugucucugccuucuucc

SEQ ID NO: 47978 - RNA, 23 nt, Human
gccuguaaucccagcuacucagg

SEQ ID NO: 47979 - RNA, 24 nt, Human
gcgacagagcgagauucugucuca

SEQ ID NO: 47980 - RNA, 24 nt, Human
gcgagacucugucuccaaacaaaa

SEQ ID NO: 47981 - RNA, 21 nt, Human
ggagaauugcuggaacccagg

SEQ ID NO: 47982 - RNA, 22 nt, Human
ggaggaugcagugagccgagau

SEQ ID NO: 47983 - RNA, 24 nt, Human
ggaggaugcagugagccgagauug

SEQ ID NO: 47984 - RNA, 18 nt, Human
ggaggccgaggcaggucg

SEQ ID NO: 47985 - RNA, 19 nt, Human
ggagguauuauuauuggca

SEQ ID NO: 47986 - RNA, 22 nt, Human
ggaucaccuaaggucaggaguu

SEQ ID NO: 47987 - RNA, 20 nt, Human
ggcagagaggaggggcaggu

SEQ ID NO: 47988 - RNA, 20 nt, Human
ggcaggaaaccagggcaggg

SEQ ID NO: 47989 - RNA, 23 nt, Human
ggcaggaaaccagggcagggcca

SEQ ID NO: 47990 - RNA, 21 nt, Human
ggcaggagccuguaaucccag

SEQ ID NO: 47991 - RNA, 18 nt, Human
ggcgaagguugcagugag

SEQ ID NO: 47992 - RNA, 19 nt, Human
ggcgaagguugcagugagc

SEQ ID NO: 47993 - RNA, 21 nt, Human
ggcggaggaugcagugagccg

SEQ ID NO: 47994 - RNA, 23 nt, Human
ggcgugguggcucacaccuguaa

SEQ ID NO: 47995 - RNA, 21 nt, Human
ggcucacgccuguaaucccag

SEQ ID NO: 47996 - RNA, 20 nt, Human
gggcagagaggaggggcagg

SEQ ID NO: 47997 - RNA, 24 nt, Human
gggcgugguggcaggagccuguaa

SEQ ID NO: 47998 - RNA, 21 nt, Human
gguaggugccuauaaucucag

SEQ ID NO: 47999 - RNA, 24 nt, Human
gguggcaggagccuguaaucccag

SEQ ID NO: 48000 - RNA, 24 nt, Human
gguggcucacaccuguaaucccag

SEQ ID NO: 48001 - RNA, 23 nt, Human
gguggcucacgccuguaauccca

SEQ ID NO: 48002 - RNA, 24 nt, Human
gguggcucacgccuguaaucccag

SEQ ID NO: 48003 - RNA, 19 nt, Human
guaccgggcgugguggcuc

SEQ ID NO: 48004 - RNA, 19 nt, Human
guacugcagcugggaggga

SEQ ID NO: 48005 - RNA, 19 nt, Human
guccgaggccccggugccc

SEQ ID NO: 48006 - RNA, 20 nt, Human
guccuuguccccuucccugg

SEQ ID NO: 48007 - RNA, 23 nt, Human
guggcucacaccuguaaucccag

SEQ ID NO: 48008 - RNA, 24 nt, Human
uaaauaguagaauucaauuuaaaa

SEQ ID NO: 48009 - RNA, 18 nt, Human
uaccuaucaccaccaccc

SEQ ID NO: 48010 - RNA, 23 nt, Human
uaccugaggucaggaguucaaga

SEQ ID NO: 48011 - RNA, 21 nt, Human
uaggaugcaaccacaucuguc

SEQ ID NO: 48012 - RNA, 21 nt, Human
ucaaaaaaaaaaaagaaagaa

SEQ ID NO: 48013 - RNA, 20 nt, Human
ucaagagcagccuggccaac

SEQ ID NO: 48014 - RNA, 22 nt, Human
ucaagagcagccuggccaacau

SEQ ID NO: 48015 - RNA, 28 nt, Human
ucaauuuaaaaaauauguaccgggcgug

SEQ ID NO: 48016 - RNA, 20 nt, Human
ucaccuaaggucaggaguuc

SEQ ID NO: 48017 - RNA, 24 nt, Human
ucacuugaacccgggaggcggagg

SEQ ID NO: 48018 - RNA, 22 nt, Human
ucaggaagaggaaagcagaaca

SEQ ID NO: 48019 - RNA, 23 nt, Human
uccagccugggcgacagagcgag

SEQ ID NO: 48020 - RNA, 24 nt, Human
uccagccugggcgacagagcgaga

SEQ ID NO: 48021 - RNA, 18 nt, Human
ucccagcuaaguccgagg

SEQ ID NO: 48022 - RNA, 21 nt, Human
ucccugaaggcccacccuacc

SEQ ID NO: 48023 - RNA, 21 nt, Human
ucccuggugcuaaauaaaagu

SEQ ID NO: 48024 - RNA, 18 nt, Human
uccgaggccccggugccc

SEQ ID NO: 48025 - RNA, 24 nt, Human
ucgauuaccugaggucaggaguuc

SEQ ID NO: 48026 - RNA, 23 nt, Human
ucgggaggcugaggcaggagaau

SEQ ID NO: 48027 - RNA, 25 nt, Human
ucucaaaaaaaaaaaagaaagaaag

SEQ ID NO: 48028 - RNA, 24 nt, Human
ucucacgcccacagccccucccca

SEQ ID NO: 48029 - RNA, 20 nt, Human
ucuccaaacaaaacaaaaca

SEQ ID NO: 48030 - RNA, 20 nt, Human
ucuccaaacaaaacaaaacu

SEQ ID NO: 48031 - RNA, 23 nt, Human
ucucuacuaaaaauacaaaaauu

SEQ ID NO: 48032 - RNA, 23 nt, Human
ucucuacuaaaaauacaaaaauu

SEQ ID NO: 48033 - RNA, 22 nt, Human
ucucuuuccuccucugucucuc

SEQ ID NO: 48034 - RNA, 20 nt, Human
ucugcagcuucucuggccuc

SEQ ID NO: 48035 - RNA, 20 nt, Human
ucugucucaaaaaaaaaaaa

SEQ ID NO: 48036 - RNA, 23 nt, Human
ucugucucaaaaaaaaaaaagaa

SEQ ID NO: 48037 - RNA, 25 nt, Human
ucugucucaaaaaaaaaaaagaaag

SEQ ID NO: 48038 - RNA, 19 nt, Human
ucugucucuuuccuccucu

SEQ ID NO: 48039 - RNA, 25 nt, Human
ucugucucuuuccuccucugucucu

SEQ ID NO: 48040 - RNA, 21 nt, Human
ucuuagcaugaggcagcaaca

SEQ ID NO: 48041 - RNA, 26 nt, Human
ucuuuucccaaaaaauaaaauucagg

SEQ ID NO: 48042 - RNA, 27 nt, Human
ugaaggcgaguggaucaccuaagguca

SEQ ID NO: 48043 - RNA, 25 nt, Human
ugacuccaaaaggaucacauaaaua

SEQ ID NO: 48044 - RNA, 22 nt, Human
ugagccgagauugugccauugc

SEQ ID NO: 48045 - RNA, 20 nt, Human
ugaggcagcaacagaagcuc

SEQ ID NO: 48046 - RNA, 19 nt, Human
ugaggcaggagaauugcug

SEQ ID NO: 48047 - RNA, 24 nt, Human
ugaggcaggagaauugcuggaacc

SEQ ID NO: 48048 - RNA, 25 nt, Human
ugaggcaggagaauugcuggaaccc

SEQ ID NO: 48049 - RNA, 20 nt, Human
ugaggcaugagaaucacuug

SEQ ID NO: 48050 - RNA, 24 nt, Human
ugaggcaugagaaucacuugaacc

SEQ ID NO: 48051 - RNA, 21 nt, Human
ugagucuuagcaugaggcagc

SEQ ID NO: 48052 - RNA, 19 nt, Human
ugcaaccacaucugucuga

SEQ ID NO: 48053 - RNA, 22 nt, Human
ugcacuccagccugggcgacag

SEQ ID NO: 48054 - RNA, 24 nt, Human
ugcacuccagccugggcgacagag

SEQ ID NO: 48055 - RNA, 22 nt, Human
ugcccagaaagggcagccggga

SEQ ID NO: 48056 - RNA, 23 nt, Human
ugcccagaaagggcagccgggau

SEQ ID NO: 48057 - RNA, 23 nt, Human
ugccuauaaucucagcuacucgg

SEQ ID NO: 48058 - RNA, 24 nt, Human
ugccuauaaucucagcuacucggg

SEQ ID NO: 48059 - RNA, 27 nt, Human
ugccugcccugucucugccuucuuccg

SEQ ID NO: 48060 - RNA, 18 nt, Human
ugccugugucuucugcag

SEQ ID NO: 48061 - RNA, 19 nt, Human
ugccugugucuucugcagc

SEQ ID NO: 48062 - RNA, 24 nt, Human
uggaucaccuaaggucaggaguuc

SEQ ID NO: 48063 - RNA, 27 nt, Human
uggaucaccuaaggucaggaguucgag

SEQ ID NO: 48064 - RNA, 22 nt, Human
uggcaggagccuguaaucccag

SEQ ID NO: 48065 - RNA, 24 nt, Human
uggccaacauggugaaaccccguc

SEQ ID NO: 48066 - RNA, 24 nt, Human
uggccaacauggugaaacccuguc

SEQ ID NO: 48067 - RNA, 21 nt, Human
uggcucacaccuguaauccca

SEQ ID NO: 48068 - RNA, 24 nt, Human
uggcucacaccuguaaucccagca

SEQ ID NO: 48069 - RNA, 24 nt, Human
uggcucacgccuguaaucccagca

SEQ ID NO: 48070 - RNA, 19 nt, Human
ugggaggccgaggcagguc

SEQ ID NO: 48071 - RNA, 20 nt, Human
ugggaggccgaggcaggucg

SEQ ID NO: 48072 - RNA, 25 nt, Human
ugggcuugggagaggugcccagggg

SEQ ID NO: 48073 - RNA, 24 nt, Human
ugguggcaggagccuguaauccca

SEQ ID NO: 48074 - RNA, 24 nt, Human
ugguggcucacaccuguaauccca

SEQ ID NO: 48075 - RNA, 18 nt, Human
ugucugucagccccuucc

SEQ ID NO: 48076 - RNA, 19 nt, Human
uuagccgggcgugguggua

SEQ ID NO: 48077 - RNA, 24 nt, Human
uuagccgggcguggugguaggugc

SEQ ID NO: 48078 - RNA, 18 nt, Human
uuagcugggcgugguggc

SEQ ID NO: 48079 - RNA, 27 nt, Human
uucacacacacacacacacgcauacac

SEQ ID NO: 48080 - RNA, 27 nt, Human
uucccuggugcuaaauaaaagugaaua

SEQ ID NO: 48081 - RNA, 24 nt, Human
uucucuggccucucccucuguagg

SEQ ID NO: 48082 - RNA, 19 nt, Human
uugcagugagcugaaauca

SEQ ID NO: 48083 - RNA, 30 nt, Human
uugggcguggccaggcacgguggcucacgg

SEQ ID NO: 48084 - RNA, 21 nt, Human
uugucucucccugccuguguc

SEQ ID NO: 48085 - RNA, 23 nt, Human
uugugccauugcacuccagccug

SEQ ID NO: 48086 - RNA, 23 nt, Human
uuuccuagccccagggugagggc

SEQ ID NO: 48087 - RNA, 26 nt, Human
aaaauaaacucucaugagcuuguaga

SEQ ID NO: 48088 - RNA, 22 nt, Human
aaaauacugaaaacagcaagac

SEQ ID NO: 48089 - RNA, 23 nt, Human
aaacaaaaacaacaacuuucuga

SEQ ID NO: 48090 - RNA, 27 nt, Human
aaacaaaaacaacaacuuucugaaaau

SEQ ID NO: 48091 - RNA, 22 nt, Human
aaacacuuacggguacaaucaa

SEQ ID NO: 48092 - RNA, 22 nt, Human
aaacaugaaucauugauaaacc

SEQ ID NO: 48093 - RNA, 24 nt, Human
aaacauuguaggucuuacugaacc

SEQ ID NO: 48094 - RNA, 26 nt, Human
aaccacuucucaauguggcuaacuac

SEQ ID NO: 48095 - RNA, 21 nt, Human
aacuaccaagugaucuuuaau

SEQ ID NO: 48096 - RNA, 26 nt, Human
aagaaaaagguggagaaaagggaccc

SEQ ID NO: 48097 - RNA, 23 nt, Human
aagagaagcagaguaggagacaa

SEQ ID NO: 48098 - RNA, 19 nt, Human
aauacugaaaacagcaaga

SEQ ID NO: 48099 - RNA, 22 nt, Human
aauuuagacauacauuccucag

SEQ ID NO: 48100 - RNA, 24 nt, Human
acaaaaacaacaacuuucugaaaa

SEQ ID NO: 48101 - RNA, 25 nt, Human
acaaaacaaauaagcaaacacaaac

SEQ ID NO: 48102 - RNA, 19 nt, Human
acaaacaguaagaagaagc

SEQ ID NO: 48103 - RNA, 19 nt, Human
acaacaaaagaaaucccaa

SEQ ID NO: 48104 - RNA, 21 nt, Human
acagagagcagauucugccca

SEQ ID NO: 48105 - RNA, 21 nt, Human
acaugucaucacucaaacacu

SEQ ID NO: 48106 - RNA, 20 nt, Human
accacgacugcaucggugcu

SEQ ID NO: 48107 - RNA, 20 nt, Human
accaggggauauaaagugac

SEQ ID NO: 48108 - RNA, 22 nt, Human
acccuugaacaaaacaaauaag

SEQ ID NO: 48109 - RNA, 21 nt, Human
acuuuuuggcauuaaccacau

SEQ ID NO: 48110 - RNA, 21 nt, Human
agaccuccuguucaccacgac

SEQ ID NO: 48111 - RNA, 21 nt, Human
agagagaaaguaguugugaaa

SEQ ID NO: 48112 - RNA, 21 nt, Human
aguaagagaagcagaguagga

SEQ ID NO: 48113 - RNA, 19 nt, Human
aguguuucuuguaauccca

SEQ ID NO: 48114 - RNA, 19 nt, Human
cacacacacacuugcuugc

SEQ ID NO: 48115 - RNA, 23 nt, Human
cacacgcaaacccuacuucuaca

SEQ ID NO: 48116 - RNA, 19 nt, Human
cacauccucuuuuggucac

SEQ ID NO: 48117 - RNA, 18 nt, Human
cauccugaauucuagaca

SEQ ID NO: 48118 - RNA, 20 nt, Human
caucuuauuaaaacagcagc

SEQ ID NO: 48119 - RNA, 22 nt, Human
cccaaugaaaucaaacaacuuu

SEQ ID NO: 48120 - RNA, 28 nt, Human
ccuguagucagaaaauauaccggggucc

SEQ ID NO: 48121 - RNA, 21 nt, Human
cuccuaauucucuuugcacag

SEQ ID NO: 48122 - RNA, 22 nt, Human
gaagcagaguaggagacaacua

SEQ ID NO: 48123 - RNA, 23 nt, Human
gccccuagcauccugaauucuag

SEQ ID NO: 48124 - RNA, 22 nt, Human
ggagagagaaaguaguugugaa

SEQ ID NO: 48125 - RNA, 23 nt, Human
ggguacaaucaagugcuuuccag

SEQ ID NO: 48126 - RNA, 23 nt, Human
guaugaucacacacacacacgca

SEQ ID NO: 48127 - RNA, 18 nt, Human
gucaagaaauacaaaaca

SEQ ID NO: 48128 - RNA, 23 nt, Human
guugugagguuggugaugggggg

SEQ ID NO: 48129 - RNA, 26 nt, Human
uaaaauaagucaagaaauacaaaaca

SEQ ID NO: 48130 - RNA, 21 nt, Human
uaaaauauccacagcucuuuc

SEQ ID NO: 48131 - RNA, 18 nt, Human
uaaacaggcuauggaaac

SEQ ID NO: 48132 - RNA, 26 nt, Human
uaaacaggcuauggaaacaaaaacaa

SEQ ID NO: 48133 - RNA, 26 nt, Human
uaaauugaaaacacagugaaauacga

SEQ ID NO: 48134 - RNA, 21 nt, Human
uaacaauaggcacauuuggca

SEQ ID NO: 48135 - RNA, 20 nt, Human
uaaccucucuccuaauucuc

SEQ ID NO: 48136 - RNA, 24 nt, Human
uaacucccaaguuuuucuauauug

SEQ ID NO: 48137 - RNA, 23 nt, Human
uaagcaaacacaaacgcauuuua

SEQ ID NO: 48138 - RNA, 23 nt, Human
uaaguaaaugaacccguguaugu

SEQ ID NO: 48139 - RNA, 21 nt, Human
uaauaaaaauaaacucucaug

SEQ ID NO: 48140 - RNA, 22 nt, Human
uacaaucaagugcuuuccaguu

SEQ ID NO: 48141 - RNA, 23 nt, Human
uacaucuuauuaaaacagcagca

SEQ ID NO: 48142 - RNA, 21 nt, Human
uaccaguguugaauguguugg

SEQ ID NO: 48143 - RNA, 24 nt, Human
uaccugaaaaaaauacaggcaguc

SEQ ID NO: 48144 - RNA, 22 nt, Human
uagaacucaaacagugguuccc

SEQ ID NO: 48145 - RNA, 23 nt, Human
uauuuacuuuucaaaauuucuca

SEQ ID NO: 48146 - RNA, 21 nt, Human
ucacagagagcagauucugcc

SEQ ID NO: 48147 - RNA, 18 nt, Human
ucagaugaaagcucugga

SEQ ID NO: 48148 - RNA, 22 nt, Human
ucagucaaucuagugagacuca

SEQ ID NO: 48149 - RNA, 21 nt, Human
uccaauccauaucaucuucuc

SEQ ID NO: 48150 - RNA, 21 nt, Human
uccauuucucugaauuucagu

SEQ ID NO: 48151 - RNA, 28 nt, Human
ucggugcugaauccuccaggaccacggu

SEQ ID NO: 48152 - RNA, 21 nt, Human
ucugccaucuucaaauguccc

SEQ ID NO: 48153 - RNA, 21 nt, Human
ucuucaaauguccccugauuu

SEQ ID NO: 48154 - RNA, 21 nt, Human
ugaaaaugauuaugauaccau

SEQ ID NO: 48155 - RNA, 18 nt, Human
ugaacaaaacaaauaagc

SEQ ID NO: 48156 - RNA, 22 nt, Human
ugacaagggggagacaguucug

SEQ ID NO: 48157 - RNA, 24 nt, Human
ugacaaugucacugaagcaugacu

SEQ ID NO: 48158 - RNA, 22 nt, Human
ugagggaaacaugaaucauuga

SEQ ID NO: 48159 - RNA, 20 nt, Human
ugauagaaaacuugcugugu

SEQ ID NO: 48160 - RNA, 18 nt, Human
ugcccgcggggaggggcu

SEQ ID NO: 48161 - RNA, 21 nt, Human
ugcccuuggcauugggugauc

SEQ ID NO: 48162 - RNA, 18 nt, Human
ugcuaugaaguuaacggg

SEQ ID NO: 48163 - RNA, 19 nt, Human
uggaaacaaaaacaacaac

SEQ ID NO: 48164 - RNA, 28 nt, Human
uggcuaacuaccaagugaucuuuaaugu

SEQ ID NO: 48165 - RNA, 19 nt, Human
ugguuuuguaaaacaauua

SEQ ID NO: 48166 - RNA, 27 nt, Human
uguaaaacaauuauuuguuuuaaaagc

SEQ ID NO: 48167 - RNA, 19 nt, Human
ugugcuuauaaaauaauuu

SEQ ID NO: 48168 - RNA, 22 nt, Human
uguuguugggaauauaaccaca

SEQ ID NO: 48169 - RNA, 22 nt, Human
uucacaacaaaagaaaucccaa

SEQ ID NO: 48170 - RNA, 20 nt, Human
uuccaguaaaauauccacag

SEQ ID NO: 48171 - RNA, 19 nt, Human
uugacaaugucacugaagc

SEQ ID NO: 48172 - RNA, 20 nt, Human
uuggagaaguagccccuagc

SEQ ID NO: 48173 - RNA, 19 nt, Human
uuuguuauuugcuaugaag

SEQ ID NO: 48174 - RNA, 20 nt, Human
uuuuuggcauuaaccacauu

SEQ ID NO: 48175 - RNA, 18 nt, Human
uuuuuuuuuuuuuuuuug

SEQ ID NO: 48176 - RNA, 19 nt, Human
aagaaguugcaucugugau

SEQ ID NO: 48177 - RNA, 22 nt, Human
aggcaaacagcccaccuucaag

SEQ ID NO: 48178 - RNA, 18 nt, Human
augucugauucuugcuca

SEQ ID NO: 48179 - RNA, 19 nt, Human
caccagcagagacacucau

SEQ ID NO: 48180 - RNA, 22 nt, Human
cuucaagauagucuugggagaa

SEQ ID NO: 48181 - RNA, 19 nt, Human
cuugcucauuuucuuuuuu

SEQ ID NO: 48182 - RNA, 23 nt, Human
ugccaagauguauuuuaccaaca

SEQ ID NO: 48183 - RNA, 22 nt, Human
ugggagaagcaccagcagagac

SEQ ID NO: 48184 - RNA, 18 nt, Human
ugucugauucuugcucau

SEQ ID NO: 48185 - RNA, 22 nt, Human
uucacgaaaggcaaacagccca

SEQ ID NO: 48186 - RNA, 24 nt, Human
uucuugcucauuuucuuuuuuaaa

SEQ ID NO: 48187 - RNA, 21 nt, Human
auaguuuagggaaauaaguca

SEQ ID NO: 48188 - RNA, 23 nt, Human
cuggagcacacugaacaugcgcc

SEQ ID NO: 48189 - RNA, 18 nt, Human
gccaagagcuggagcaca

SEQ ID NO: 48190 - RNA, 22 nt, Human
uccccuggagggagaacgccaa

SEQ ID NO: 48191 - RNA, 18 nt, Human
ugcgccgcgagccagcac

SEQ ID NO: 48192 - RNA, 22 nt, Human
aaaagagggagagagaguggag

SEQ ID NO: 48193 - RNA, 22 nt, Human
acaagacuggccccugcccccc

SEQ ID NO: 48194 - RNA, 22 nt, Human
accccgggaagcaccgaguggg

SEQ ID NO: 48195 - RNA, 22 nt, Human
acccguccgccacccgcccccc

SEQ ID NO: 48196 - RNA, 23 nt, Human
acuauucccguuuccccuccccu

SEQ ID NO: 48197 - RNA, 21 nt, Human
agaaaaaaaaauugggaugaa

SEQ ID NO: 48198 - RNA, 19 nt, Human
agagggagagagaguggag

SEQ ID NO: 48199 - RNA, 25 nt, Human
agcacaagacuggccccugcccccc

SEQ ID NO: 48200 - RNA, 23 nt, Human
agcuggccccggcccgcgugcgc

SEQ ID NO: 48201 - RNA, 24 nt, Human
aggaaaagcggaaucaaucgggug

SEQ ID NO: 48202 - RNA, 23 nt, Human
auacccucuccucuucccccuua

SEQ ID NO: 48203 - RNA, 20 nt, Human
caaaaccaaucaggcagcga

SEQ ID NO: 48204 - RNA, 26 nt, Human
caggagagggaagaagcccgccaggc

SEQ ID NO: 48205 - RNA, 23 nt, Human
caggagcacaagacuggccccug

SEQ ID NO: 48206 - RNA, 23 nt, Human
caguccacuggacaguugaugau

SEQ ID NO: 48207 - RNA, 18 nt, Human
ccaagggacccagucacc

SEQ ID NO: 48208 - RNA, 20 nt, Human
ccacaguggagacccuuguc

SEQ ID NO: 48209 - RNA, 21 nt, Human
ccacaguggagacccuugucu

SEQ ID NO: 48210 - RNA, 21 nt, Human
cccacguuaaccccuaccaug

SEQ ID NO: 48211 - RNA, 21 nt, Human
ccccaccccgggaagcaccga

SEQ ID NO: 48212 - RNA, 24 nt, Human
ccccauacccucuccucuuccccc

SEQ ID NO: 48213 - RNA, 22 nt, Human
cccgagccgagcgcgagcagcu

SEQ ID NO: 48214 - RNA, 24 nt, Human
cccgccccccugaagucggggccg

SEQ ID NO: 48215 - RNA, 24 nt, Human
cccgccccccugaagugucaacua

SEQ ID NO: 48216 - RNA, 18 nt, Human
cccgcgccagccccgcgc

SEQ ID NO: 48217 - RNA, 23 nt, Human
cccgcgccgccgcccccgagccg

SEQ ID NO: 48218 - RNA, 21 nt, Human
cccggccgcucucuccaggaa

SEQ ID NO: 48219 - RNA, 19 nt, Human
cccguccgccacccgcccc

SEQ ID NO: 48220 - RNA, 22 nt, Human
cccguccgccacccgccccccu

SEQ ID NO: 48221 - RNA, 18 nt, Human
cccugggaucagagagag

SEQ ID NO: 48222 - RNA, 22 nt, Human
cccuuuagaaagagucccuggg

SEQ ID NO: 48223 - RNA, 21 nt, Human
ccgagcaagguccaguccacu

SEQ ID NO: 48224 - RNA, 19 nt, Human
ccgcccccgagccgagcgc

SEQ ID NO: 48225 - RNA, 19 nt, Human
ccgcgcagccgccuccugc

SEQ ID NO: 48226 - RNA, 23 nt, Human
ccgcgcagccgccuccugccucc

SEQ ID NO: 48227 - RNA, 21 nt, Human
ccguccuccgccccugcccgc

SEQ ID NO: 48228 - RNA, 24 nt, Human
ccucaguaccgcauguccaggagc

SEQ ID NO: 48229 - RNA, 24 nt, Human
ccucccgcgccgccgcccccgagc

SEQ ID NO: 48230 - RNA, 26 nt, Human
cgagacccguccgccacccgcccccc

SEQ ID NO: 48231 - RNA, 21 nt, Human
cgcagccgccuccugccuccu

SEQ ID NO: 48232 - RNA, 18 nt, Human
cgcccccgagccgagcgc

SEQ ID NO: 48233 - RNA, 20 nt, Human
cgccuccugccuccucccca

SEQ ID NO: 48234 - RNA, 20 nt, Human
cgcuuucuccucugcggcca

SEQ ID NO: 48235 - RNA, 19 nt, Human
cggcccgagcgcggcccgg

SEQ ID NO: 48236 - RNA, 19 nt, Human
cggcccgcggggcccggcg

SEQ ID NO: 48237 - RNA, 23 nt, Human
cggcccgcggggcccggcggcgg

SEQ ID NO: 48238 - RNA, 23 nt, Human
cguccuccgccccugcccgcgcc

SEQ ID NO: 48239 - RNA, 21 nt, Human
cguggacccacguuaaccccu

SEQ ID NO: 48240 - RNA, 21 nt, Human
cucccgcgccgccgcccccga

SEQ ID NO: 48241 - RNA, 20 nt, Human
cuccuccccaccccgggaag

SEQ ID NO: 48242 - RNA, 25 nt, Human
cucuacgcguggacccacguuaacc

SEQ ID NO: 48243 - RNA, 20 nt, Human
cuggacaguugaugauaggg

SEQ ID NO: 48244 - RNA, 20 nt, Human
cuuccuucccggcuugacau

SEQ ID NO: 48245 - RNA, 18 nt, Human
gacccuugucugcaccuc

SEQ ID NO: 48246 - RNA, 19 nt, Human
gagcagcuggccccggccc

SEQ ID NO: 48247 - RNA, 19 nt, Human
gccaagggacccagucacc

SEQ ID NO: 48248 - RNA, 18 nt, Human
gccccauacccucuccuc

SEQ ID NO: 48249 - RNA, 21 nt, Human
gcccgcuccucccgcgccgcc

SEQ ID NO: 48250 - RNA, 20 nt, Human
gcgcaggagagggaagaagc

SEQ ID NO: 48251 - RNA, 19 nt, Human
ggagaccccaaccgcuuuc

SEQ ID NO: 48252 - RNA, 19 nt, Human
ggcccggccgcucucucca

SEQ ID NO: 48253 - RNA, 23 nt, Human
gggagaccccaaccgcuuucucc

SEQ ID NO: 48254 - RNA, 19 nt, Human
gggcaggugcuggcggccc

SEQ ID NO: 48255 - RNA, 22 nt, Human
guacuggagggguugcggcaau

SEQ ID NO: 48256 - RNA, 23 nt, Human
gugcgcccguccuccgccccugc

SEQ ID NO: 48257 - RNA, 19 nt, Human
guggagacccuugucugca

SEQ ID NO: 48258 - RNA, 24 nt, Human
uacccucuccucuucccccuuagg

SEQ ID NO: 48259 - RNA, 24 nt, Human
uacgcguggacccacguuaacccc

SEQ ID NO: 48260 - RNA, 18 nt, Human
ucaggcagcgagacccgu

SEQ ID NO: 48261 - RNA, 22 nt, Human
uccaggaugcaucuuccgaaga

SEQ ID NO: 48262 - RNA, 20 nt, Human
ucccccggcggccccucugg

SEQ ID NO: 48263 - RNA, 22 nt, Human
ucccccuuaggaauuugugcag

SEQ ID NO: 48264 - RNA, 23 nt, Human
ucccguuuccccuccccugggau

SEQ ID NO: 48265 - RNA, 21 nt, Human
ucccugggagaccccaaccgc

SEQ ID NO: 48266 - RNA, 23 nt, Human
uccuccccaccccgggaagcacc

SEQ ID NO: 48267 - RNA, 19 nt, Human
ucuccaggaaaagcggaau

SEQ ID NO: 48268 - RNA, 21 nt, Human
ucuccaggaaaagcggaauca

SEQ ID NO: 48269 - RNA, 23 nt, Human
ucucucacuauucccguuucccc

SEQ ID NO: 48270 - RNA, 30 nt, Human
ucugcaccucaguaccgcauguccaggagg

SEQ ID NO: 48271 - RNA, 20 nt, Human
ugaaaagagggagagagagu

SEQ ID NO: 48272 - RNA, 21 nt, Human
ugauagggucugccgccccau

SEQ ID NO: 48273 - RNA, 18 nt, Human
ugcccgcgccagccccgc

SEQ ID NO: 48274 - RNA, 23 nt, Human
ugggaugaaaugcaaaaccaauc

SEQ ID NO: 48275 - RNA, 25 nt, Human
uucuuuccuuucccucuacgcgugg

SEQ ID NO: 48276 - RNA, 23 nt, Human
uugugcaguacuggagggguugc

SEQ ID NO: 48277 - RNA, 26 nt, Human
aaacagauagagagcaccagaacuag

SEQ ID NO: 48278 - RNA, 19 nt, Human
acaaggguuugucuuaaac

SEQ ID NO: 48279 - RNA, 23 nt, Human
aggcagagaacuggaguuguuuu

SEQ ID NO: 48280 - RNA, 22 nt, Human
agggagacaagggagaaaggga

SEQ ID NO: 48281 - RNA, 21 nt, Human
agggagaggugggagaaagga

SEQ ID NO: 48282 - RNA, 21 nt, Human
caagcccaaagugcccugagg

SEQ ID NO: 48283 - RNA, 21 nt, Human
caaggaaguaggaaacuucau

SEQ ID NO: 48284 - RNA, 21 nt, Human
cagugagugaucuagccaagc

SEQ ID NO: 48285 - RNA, 19 nt, Human
cccaaagugcccugagguc

SEQ ID NO: 48286 - RNA, 24 nt, Human
cccaaagugcccugaggucacugg

SEQ ID NO: 48287 - RNA, 23 nt, Human
cugcaacuucaaaaucacaacag

SEQ ID NO: 48288 - RNA, 18 nt, Human
gacuucagaugugagcua

SEQ ID NO: 48289 - RNA, 21 nt, Human
gaugugagcuaguauagcuuu

SEQ ID NO: 48290 - RNA, 20 nt, Human
ggagaaagggagagguggga

SEQ ID NO: 48291 - RNA, 21 nt, Human
gugcaggcagagaacuggagu

SEQ ID NO: 48292 - RNA, 19 nt, Human
ucaaagacaaggaaguagg

SEQ ID NO: 48293 - RNA, 20 nt, Human
ucacaacagaagcuacaacc

SEQ ID NO: 48294 - RNA, 21 nt, Human
ucacugguagacuaguuacau

SEQ ID NO: 48295 - RNA, 23 nt, Human
ugacuucagaugugagcuaguau

SEQ ID NO: 48296 - RNA, 22 nt, Human
ugcccugaggucacugguagac

SEQ ID NO: 48297 - RNA, 19 nt, Human
uuuuuuuuuuuuugggcag

SEQ ID NO: 48298 - RNA, 24 nt, Human
uuuuuuuuuuuuuuuuuuuuuggg

SEQ ID NO: 48299 - RNA, 20 nt, Human
aaaaaaaaaaggagaaaaaa

SEQ ID NO: 48300 - RNA, 20 nt, Human
aaaaaaaaauccccugacca

SEQ ID NO: 48301 - RNA, 19 nt, Human
aaaaaaauccccugaccau

SEQ ID NO: 48302 - RNA, 23 nt, Human
aaaaacaaaagacuggacaaaga

SEQ ID NO: 48303 - RNA, 24 nt, Human
aaaaacaaaagacuggacaaagaa

SEQ ID NO: 48304 - RNA, 20 nt, Human
aaaaaccaacgaagucccuu

SEQ ID NO: 48305 - RNA, 18 nt, Human
aaaaagaaaaaaaaaagg

SEQ ID NO: 48306 - RNA, 22 nt, Human
aaaaagaaaaaaaaaaggagaa

SEQ ID NO: 48307 - RNA, 22 nt, Human
aaaaaugaaagcacuuggauaa

SEQ ID NO: 48308 - RNA, 22 nt, Human
aaaacaaaagacuggacaaaga

SEQ ID NO: 48309 - RNA, 21 nt, Human
aaaagaaaaaaaaaaggagaa

SEQ ID NO: 48310 - RNA, 25 nt, Human
aaaagaaaaaaaaaaggagaaaaaa

SEQ ID NO: 48311 - RNA, 27 nt, Human
aaacaaaagacuggacaaaggggaccc

SEQ ID NO: 48312 - RNA, 20 nt, Human
aaaccaacgaagucccuuca

SEQ ID NO: 48313 - RNA, 21 nt, Human
aaaccaacgaagucccuucaa

SEQ ID NO: 48314 - RNA, 23 nt, Human
aaagaagaggcagcuggccagag

SEQ ID NO: 48315 - RNA, 28 nt, Human
aaagacuggacaaagaaagugaagauaa

SEQ ID NO: 48316 - RNA, 25 nt, Human
aaagugcaggaugggaggauggcug

SEQ ID NO: 48317 - RNA, 24 nt, Human
aaauggaaacaaaucaaaacaaaa

SEQ ID NO: 48318 - RNA, 21 nt, Human
aacaaagucccuucaacauga

SEQ ID NO: 48319 - RNA, 20 nt, Human
aacagaaacugaauacuaca

SEQ ID NO: 48320 - RNA, 19 nt, Human
aacagcuucaagcacugac

SEQ ID NO: 48321 - RNA, 23 nt, Human
aaccaagacuccaaaaaaccaac

SEQ ID NO: 48322 - RNA, 24 nt, Human
aaccaagacuccaaaaaaccaacg

SEQ ID NO: 48323 - RNA, 18 nt, Human
aaccugcccuuucaccca

SEQ ID NO: 48324 - RNA, 18 nt, Human
aaccugcccuuucaccca

SEQ ID NO: 48325 - RNA, 21 nt, Human
aaccugcccuuucacccacaa

SEQ ID NO: 48326 - RNA, 22 nt, Human
aagaagaggcagcuggccagag

SEQ ID NO: 48327 - RNA, 18 nt, Human
aagacuccaaaaaaccaa

SEQ ID NO: 48328 - RNA, 22 nt, Human
aagcaggauaaaugggaaccca

SEQ ID NO: 48329 - RNA, 23 nt, Human
aagcaggauaaaugggaacccaa

SEQ ID NO: 48330 - RNA, 19 nt, Human
aaggcaugcccgugcuccc

SEQ ID NO: 48331 - RNA, 21 nt, Human
aagucacuguuaucaagggac

SEQ ID NO: 48332 - RNA, 20 nt, Human
aauggaaaaguaugccugaa

SEQ ID NO: 48333 - RNA, 22 nt, Human
acaaaggauucuaccucacaga

SEQ ID NO: 48334 - RNA, 23 nt, Human
acaacagaaacugaauacuacag

SEQ ID NO: 48335 - RNA, 20 nt, Human
acaaccaagacuccaaaaaa

SEQ ID NO: 48336 - RNA, 23 nt, Human
acaaccaagacuccaaaaaacca

SEQ ID NO: 48337 - RNA, 18 nt, Human
acagaaacugaauacuac

SEQ ID NO: 48338 - RNA, 24 nt, Human
accaaauccuuuauguucaccucu

SEQ ID NO: 48339 - RNA, 21 nt, Human
accaagacuccaaaaaaccaa

SEQ ID NO: 48340 - RNA, 23 nt, Human
accacagaccucucugcccugga

SEQ ID NO: 48341 - RNA, 21 nt, Human
accucucucacacccuaguau

SEQ ID NO: 48342 - RNA, 22 nt, Human
acuccgcacuggaaguggcccc

SEQ ID NO: 48343 - RNA, 24 nt, Human
acugaaaccuaaucaagaccgcaa

SEQ ID NO: 48344 - RNA, 25 nt, Human
acugcagccaucaucacaguacccg

SEQ ID NO: 48345 - RNA, 22 nt, Human
acugcaguuuucaacuccuacc

SEQ ID NO: 48346 - RNA, 22 nt, Human
acuuccguggcacugggaacuu

SEQ ID NO: 48347 - RNA, 22 nt, Human
agacugauuuacugugccccca

SEQ ID NO: 48348 - RNA, 21 nt, Human
agagaggccaaacaaccugag

SEQ ID NO: 48349 - RNA, 24 nt, Human
agaggcaggcucagcuccccaagg

SEQ ID NO: 48350 - RNA, 25 nt, Human
agaggcaggcucagcuccccaaggg

SEQ ID NO: 48351 - RNA, 24 nt, Human
agaggggucugcguaauccacaaa

SEQ ID NO: 48352 - RNA, 18 nt, Human
agcaaucccaaagaaagc

SEQ ID NO: 48353 - RNA, 26 nt, Human
agcaucacaaaacuggacugcagcca

SEQ ID NO: 48354 - RNA, 22 nt, Human
agccugaagaggagaggggcug

SEQ ID NO: 48355 - RNA, 24 nt, Human
agcuggaagcuuggcaauauucca

SEQ ID NO: 48356 - RNA, 27 nt, Human
aggagagaggcaggcucagcuccugaa

SEQ ID NO: 48357 - RNA, 18 nt, Human
agguauagacaaaggauu

SEQ ID NO: 48358 - RNA, 24 nt, Human
aguaaaggaaacagcuucaagcac

SEQ ID NO: 48359 - RNA, 28 nt, Human
agucacaaccaagacuccaaaaaaccaa

SEQ ID NO: 48360 - RNA, 24 nt, Human
agucuaugcuugggcucuucccug

SEQ ID NO: 48361 - RNA, 26 nt, Human
auagaauaaaagcaaagaugugaaug

SEQ ID NO: 48362 - RNA, 21 nt, Human
aucugcaggcuccaaucacac

SEQ ID NO: 48363 - RNA, 20 nt, Human
augcccaagauggaccagag

SEQ ID NO: 48364 - RNA, 23 nt, Human
auggaaacaaaucaaaacaaaac

SEQ ID NO: 48365 - RNA, 19 nt, Human
caaagaaugcacaggagcc

SEQ ID NO: 48366 - RNA, 23 nt, Human
caacacucuaaaagccaacaaag

SEQ ID NO: 48367 - RNA, 24 nt, Human
caacacucuaaaagccaacaaagu

SEQ ID NO: 48368 - RNA, 20 nt, Human
caacagaaacugaauacuac

SEQ ID NO: 48369 - RNA, 22 nt, Human
caaccaagacuccaaaaaacca

SEQ ID NO: 48370 - RNA, 24 nt, Human
caaccaagacuccaaaaaaccaac

SEQ ID NO: 48371 - RNA, 24 nt, Human
caagacuccaaaaaaccaacgaag

SEQ ID NO: 48372 - RNA, 21 nt, Human
caagauggaccagagaggcca

SEQ ID NO: 48373 - RNA, 22 nt, Human
caaggcaugcccgugcucccuu

SEQ ID NO: 48374 - RNA, 24 nt, Human
cacaacuacugcuuucuaugucaa

SEQ ID NO: 48375 - RNA, 19 nt, Human
cacagaccucucugcccug

SEQ ID NO: 48376 - RNA, 25 nt, Human
caccaaauccuuuauguucaccucu

SEQ ID NO: 48377 - RNA, 21 nt, Human
cacucuaaaagccaacaaagu

SEQ ID NO: 48378 - RNA, 21 nt, Human
cacuugggggaaaaaaggggg

SEQ ID NO: 48379 - RNA, 22 nt, Human
cagagagccagacuccacagag

SEQ ID NO: 48380 - RNA, 20 nt, Human
cagcaggugacaacccugua

SEQ ID NO: 48381 - RNA, 21 nt, Human
cagcaggugacaacccuguag

SEQ ID NO: 48382 - RNA, 27 nt, Human
cagcaucacaaaacuggacugcagcca

SEQ ID NO: 48383 - RNA, 19 nt, Human
cagcuggcuaaagugcagg

SEQ ID NO: 48384 - RNA, 22 nt, Human
caggagacaggcgccacuuccc

SEQ ID NO: 48385 - RNA, 20 nt, Human
caggaugggaggauggcugg

SEQ ID NO: 48386 - RNA, 22 nt, Human
caggaugggaggauggcugggc

SEQ ID NO: 48387 - RNA, 19 nt, Human
cagggaagcagcuuuccuu

SEQ ID NO: 48388 - RNA, 23 nt, Human
caguucagacaaaucaacuacaa

SEQ ID NO: 48389 - RNA, 27 nt, Human
caguucagacaaaucaacuacaaaaau

SEQ ID NO: 48390 - RNA, 23 nt, Human
caguuccuugggaugcuuuggug

SEQ ID NO: 48391 - RNA, 23 nt, Human
caucacaaaacuggacugcagcc

SEQ ID NO: 48392 - RNA, 18 nt, Human
caucacaguacccgaguc

SEQ ID NO: 48393 - RNA, 21 nt, Human
ccacggcaccaagucuaugcu

SEQ ID NO: 48394 - RNA, 19 nt, Human
ccaguuaaagaagaggcag

SEQ ID NO: 48395 - RNA, 21 nt, Human
ccccacgccuccgcuacuccg

SEQ ID NO: 48396 - RNA, 19 nt, Human
cccccacgccuccgcuacu

SEQ ID NO: 48397 - RNA, 23 nt, Human
cccccacgccuccgcuacuccgc

SEQ ID NO: 48398 - RNA, 18 nt, Human
cccgacccgccggcggca

SEQ ID NO: 48399 - RNA, 21 nt, Human
ccgcgaggcauugcccggccc

SEQ ID NO: 48400 - RNA, 22 nt, Human
ccugcagcuggcuaaagugcag

SEQ ID NO: 48401 - RNA, 25 nt, Human
ccuggcccgaccgcugguccccugg

SEQ ID NO: 48402 - RNA, 21 nt, Human
cgccagccccucgaggccccc

SEQ ID NO: 48403 - RNA, 19 nt, Human
cggcccgacccgccggcgg

SEQ ID NO: 48404 - RNA, 18 nt, Human
cggggcgucggcacggga

SEQ ID NO: 48405 - RNA, 18 nt, Human
cgggucugcgcgccgggc

SEQ ID NO: 48406 - RNA, 25 nt, Human
cuacaacagaaacugaauacuacag

SEQ ID NO: 48407 - RNA, 22 nt, Human
cuccaaaaaaccaacgaagucc

SEQ ID NO: 48408 - RNA, 21 nt, Human
cuccgcacuggaaguggcccc

SEQ ID NO: 48409 - RNA, 22 nt, Human
cugaaaccuaaucaagaccgca

SEQ ID NO: 48410 - RNA, 18 nt, Human
cugaagaggagaggggcu

SEQ ID NO: 48411 - RNA, 19 nt, Human
cugaugcugagaaccacag

SEQ ID NO: 48412 - RNA, 21 nt, Human
cugaugcugagaaccacagac

SEQ ID NO: 48413 - RNA, 27 nt, Human
cugcgcgccgggcccaagauggcuccc

SEQ ID NO: 48414 - RNA, 19 nt, Human
cuugggggaaaaaaggggg

SEQ ID NO: 48415 - RNA, 24 nt, Human
gaaugcuacgaccuaccucucuca

SEQ ID NO: 48416 - RNA, 25 nt, Human
gacugcagccaucaccacggcacca

SEQ ID NO: 48417 - RNA, 18 nt, Human
gagaagaggcagcuggaa

SEQ ID NO: 48418 - RNA, 21 nt, Human
gagcaggccucuuccacucca

SEQ ID NO: 48419 - RNA, 21 nt, Human
gagggggaaaaggagacauuc

SEQ ID NO: 48420 - RNA, 20 nt, Human
gccuugcccgcccugcagcu

SEQ ID NO: 48421 - RNA, 24 nt, Human
gcuuuaggagaagaggcagcugga

SEQ ID NO: 48422 - RNA, 20 nt, Human
ggaaagaggggaaguagagg

SEQ ID NO: 48423 - RNA, 20 nt, Human
ggagaaccuaaugcccaaga

SEQ ID NO: 48424 - RNA, 19 nt, Human
ggagaagaggcagcuggaa

SEQ ID NO: 48425 - RNA, 22 nt, Human
ggagccagagagccagacucca

SEQ ID NO: 48426 - RNA, 18 nt, Human
ggcccgacccgccggcgg

SEQ ID NO: 48427 - RNA, 24 nt, Human
gggaaaaggagacauucagaucac

SEQ ID NO: 48428 - RNA, 21 nt, Human
gggaaagaggggaaguagagg

SEQ ID NO: 48429 - RNA, 20 nt, Human
gggacacauaaaagcagaau

SEQ ID NO: 48430 - RNA, 21 nt, Human
gggcucuucccugcucugcuc

SEQ ID NO: 48431 - RNA, 21 nt, Human
ggggggccuggccagaccuug

SEQ ID NO: 48432 - RNA, 19 nt, Human
gggggugaguggggguucu

SEQ ID NO: 48433 - RNA, 24 nt, Human
gggggugaguggggguucugaucu

SEQ ID NO: 48434 - RNA, 19 nt, Human
gucacuguuaucaagggac

SEQ ID NO: 48435 - RNA, 19 nt, Human
gucuaugcuugggcucuuc

SEQ ID NO: 48436 - RNA, 23 nt, Human
gugaaugucucuaccagacagag

SEQ ID NO: 48437 - RNA, 18 nt, Human
guucugcaaaggcauccu

SEQ ID NO: 48438 - RNA, 18 nt, Human
uaaaaacaaaagacugga

SEQ ID NO: 48439 - RNA, 19 nt, Human
uaaaaacaaaagacuggac

SEQ ID NO: 48440 - RNA, 22 nt, Human
uaaaaacaaaagacuggacaaa

SEQ ID NO: 48441 - RNA, 19 nt, Human
uaaaaagaaaaaaaaaagg

SEQ ID NO: 48442 - RNA, 21 nt, Human
uaacuucuuagguuucugccu

SEQ ID NO: 48443 - RNA, 22 nt, Human
uaagaucuugggggugaguggg

SEQ ID NO: 48444 - RNA, 19 nt, Human
uaagucacuguuaucaagg

SEQ ID NO: 48445 - RNA, 19 nt, Human
uaagucacuguuaucaagg

SEQ ID NO: 48446 - RNA, 24 nt, Human
uacagagagcauagaauaaaagca

SEQ ID NO: 48447 - RNA, 19 nt, Human
uagcaaucccaaagaaagc

SEQ ID NO: 48448 - RNA, 18 nt, Human
uagccugaagaggagagg

SEQ ID NO: 48449 - RNA, 22 nt, Human
uaggagaagaggcagcuggaaa

SEQ ID NO: 48450 - RNA, 22 nt, Human
uaucugcaggcuccaaucacac

SEQ ID NO: 48451 - RNA, 19 nt, Human
ucagcaguuuggagggaaa

SEQ ID NO: 48452 - RNA, 24 nt, Human
ucagggaugccucgcucucuuccu

SEQ ID NO: 48453 - RNA, 24 nt, Human
ucaguaguccuccugagugugucu

SEQ ID NO: 48454 - RNA, 21 nt, Human
uccacaaaugaaauuaucagu

SEQ ID NO: 48455 - RNA, 19 nt, Human
uccagggaagcagcuuucc

SEQ ID NO: 48456 - RNA, 21 nt, Human
uccagggaagcagcuuuccuu

SEQ ID NO: 48457 - RNA, 20 nt, Human
ucugacacggcucguuucca

SEQ ID NO: 48458 - RNA, 26 nt, Human
ucugacacggcucguuuccagcagau

SEQ ID NO: 48459 - RNA, 18 nt, Human
ucugccucuucacuuggg

SEQ ID NO: 48460 - RNA, 22 nt, Human
ucuguccugugugacucagagg

SEQ ID NO: 48461 - RNA, 27 nt, Human
ucuuagguuucugccucuucacuuggg

SEQ ID NO: 48462 - RNA, 19 nt, Human
ugaacacacgagucaaugu

SEQ ID NO: 48463 - RNA, 21 nt, Human
ugaacacacgagucaauguuc

SEQ ID NO: 48464 - RNA, 19 nt, Human
ugaagauaacagugggcag

SEQ ID NO: 48465 - RNA, 19 nt, Human
ugaagauaacagugggcag

SEQ ID NO: 48466 - RNA, 22 nt, Human
ugacacggcucguuuccagcag

SEQ ID NO: 48467 - RNA, 19 nt, Human
ugaccaacacucuaaaagc

SEQ ID NO: 48468 - RNA, 20 nt, Human
ugacuuagucaacuucccuu

SEQ ID NO: 48469 - RNA, 22 nt, Human
ugacuuagucaacuucccuugg

SEQ ID NO: 48470 - RNA, 20 nt, Human
ugagagccuguguucccagu

SEQ ID NO: 48471 - RNA, 19 nt, Human
ugagcagcucccuuaaccc

SEQ ID NO: 48472 - RNA, 21 nt, Human
ugagcagcucccuuaacccag

SEQ ID NO: 48473 - RNA, 22 nt, Human
ugagggugcuggcucagcacgu

SEQ ID NO: 48474 - RNA, 21 nt, Human
ugcagccaucaucacaguacc

SEQ ID NO: 48475 - RNA, 21 nt, Human
ugcagcuggcuaaagugcagg

SEQ ID NO: 48476 - RNA, 18 nt, Human
ugcccggcccgacccgcc

SEQ ID NO: 48477 - RNA, 22 nt, Human
ugccucgcucucuuccuacaac

SEQ ID NO: 48478 - RNA, 20 nt, Human
ugccuugcccgcccugcagc

SEQ ID NO: 48479 - RNA, 23 nt, Human
ugcuacgaccuaccucucucaca

SEQ ID NO: 48480 - RNA, 18 nt, Human
ugcuugggggucuuccuc

SEQ ID NO: 48481 - RNA, 21 nt, Human
ugcuuugguguucugcaaagg

SEQ ID NO: 48482 - RNA, 18 nt, Human
uggaaaaaugaaagcacu

SEQ ID NO: 48483 - RNA, 23 nt, Human
uggaaacaaaucaaaacaaaacu

SEQ ID NO: 48484 - RNA, 19 nt, Human
uggacugcagccaucacca

SEQ ID NO: 48485 - RNA, 21 nt, Human
uggagaaccuaaugcccaaga

SEQ ID NO: 48486 - RNA, 20 nt, Human
uggcuaaagugcaggauggg

SEQ ID NO: 48487 - RNA, 18 nt, Human
uggcuuaaaaagaaaaaa

SEQ ID NO: 48488 - RNA, 19 nt, Human
ugggaacccaaaguuuuca

SEQ ID NO: 48489 - RNA, 19 nt, Human
ugggggugaguggggguuc

SEQ ID NO: 48490 - RNA, 19 nt, Human
ugugucuagcugacuguua

SEQ ID NO: 48491 - RNA, 20 nt, Human
uguucugcaaaggcauccuu

SEQ ID NO: 48492 - RNA, 21 nt, Human
uucaaagaaugcacaggagcc

SEQ ID NO: 48493 - RNA, 19 nt, Human
uuccagggaagcagcuuuc

SEQ ID NO: 48494 - RNA, 20 nt, Human
uuccagggaagcagcuuucc

SEQ ID NO: 48495 - RNA, 24 nt, Human
uuccuugccuugcccgcccugcag

SEQ ID NO: 48496 - RNA, 22 nt, Human
uuccuugggaugcuuugguguu

SEQ ID NO: 48497 - RNA, 19 nt, Human
uuugcccucugagggggaa

SEQ ID NO: 48498 - RNA, 24 nt, Human
aaagagaccuaaguuuagacagac

SEQ ID NO: 48499 - RNA, 24 nt, Human
aaagcauguaauccaaagccugaa

SEQ ID NO: 48500 - RNA, 21 nt, Human
aagaauuucacacaaaguaau

SEQ ID NO: 48501 - RNA, 24 nt, Human
aagagaccuaaguuuagacagacg

SEQ ID NO: 48502 - RNA, 24 nt, Human
acaaaacacgcuagggggcagaga

SEQ ID NO: 48503 - RNA, 18 nt, Human
acauacagagaacacuga

SEQ ID NO: 48504 - RNA, 23 nt, Human
accugguggucccccgugucccc

SEQ ID NO: 48505 - RNA, 22 nt, Human
acgcaccccauccccuccccac

SEQ ID NO: 48506 - RNA, 22 nt, Human
agaaaagagaccuaaguuuaga

SEQ ID NO: 48507 - RNA, 22 nt, Human
agacggagccguccccuccuca

SEQ ID NO: 48508 - RNA, 23 nt, Human
agagcacuucucucagcuccucu

SEQ ID NO: 48509 - RNA, 19 nt, Human
agauuuacauacagagaac

SEQ ID NO: 48510 - RNA, 21 nt, Human
agccgaauuacauucauagaa

SEQ ID NO: 48511 - RNA, 22 nt, Human
agcguggggaugauaaaaagga

SEQ ID NO: 48512 - RNA, 22 nt, Human
aggaaaaagagccacuguacau

SEQ ID NO: 48513 - RNA, 21 nt, Human
aggaacagagggaacuuaggc

SEQ ID NO: 48514 - RNA, 21 nt, Human
aggcagagcacuucucucagc

SEQ ID NO: 48515 - RNA, 22 nt, Human
aguacagaagcuucuagaggaa

SEQ ID NO: 48516 - RNA, 22 nt, Human
aguugccccuuaagcucuccau

SEQ ID NO: 48517 - RNA, 19 nt, Human
aucugugcacaaugugaag

SEQ ID NO: 48518 - RNA, 19 nt, Human
auguguuuguuuugagaca

SEQ ID NO: 48519 - RNA, 21 nt, Human
caaaucucugagcuuggugga

SEQ ID NO: 48520 - RNA, 23 nt, Human
caaauuaaaagcauguaauccaa

SEQ ID NO: 48521 - RNA, 20 nt, Human
caagugaacacuagaacuca

SEQ ID NO: 48522 - RNA, 18 nt, Human
cacagcccccugcacccc

SEQ ID NO: 48523 - RNA, 19 nt, Human
cacagcccccugcaccccc

SEQ ID NO: 48524 - RNA, 25 nt, Human
cacagcuucgcuaaucccauccuca

SEQ ID NO: 48525 - RNA, 24 nt, Human
caccaugcugggagucugcuccuc

SEQ ID NO: 48526 - RNA, 18 nt, Human
caccccauccccucccca

SEQ ID NO: 48527 - RNA, 19 nt, Human
caccccccaucaugucugc

SEQ ID NO: 48528 - RNA, 19 nt, Human
cacccucuagagccuugga

SEQ ID NO: 48529 - RNA, 20 nt, Human
caccugccccaggucugaug

SEQ ID NO: 48530 - RNA, 23 nt, Human
caccugguggucccccguguccc

SEQ ID NO: 48531 - RNA, 20 nt, Human
cacggaaggccccgagcaac

SEQ ID NO: 48532 - RNA, 26 nt, Human
cacuagaacucacacggaaggccccg

SEQ ID NO: 48533 - RNA, 21 nt, Human
cacugcacuggcaggcagagc

SEQ ID NO: 48534 - RNA, 22 nt, Human
cagaaggggaaaugcugcggca

SEQ ID NO: 48535 - RNA, 18 nt, Human
cagaccaccugcuucugg

SEQ ID NO: 48536 - RNA, 22 nt, Human
cagagacaggaggauuuucaca

SEQ ID NO: 48537 - RNA, 23 nt, Human
cagagacgcuguaaacuggacac

SEQ ID NO: 48538 - RNA, 22 nt, Human
cagcagcacguggucucaccag

SEQ ID NO: 48539 - RNA, 19 nt, Human
cagcaggacugaaguaagc

SEQ ID NO: 48540 - RNA, 28 nt, Human
cagccugaaaggcuccacucucagccgc

SEQ ID NO: 48541 - RNA, 23 nt, Human
caggacacacagucacugcugcg

SEQ ID NO: 48542 - RNA, 22 nt, Human
caguagaacucaauuucuaaac

SEQ ID NO: 48543 - RNA, 18 nt, Human
cauaaaagugaccugaca

SEQ ID NO: 48544 - RNA, 24 nt, Human
cauccccuccccacacugcgcacc

SEQ ID NO: 48545 - RNA, 21 nt, Human
caugcaguuguaacguguggu

SEQ ID NO: 48546 - RNA, 21 nt, Human
caugugcaugacagggccacg

SEQ ID NO: 48547 - RNA, 19 nt, Human
ccacacagggcccucgccu

SEQ ID NO: 48548 - RNA, 19 nt, Human
ccacagcccccugcacccc

SEQ ID NO: 48549 - RNA, 20 nt, Human
ccacagcccccugcaccccc

SEQ ID NO: 48550 - RNA, 23 nt, Human
ccacuguacauguguuuguuuug

SEQ ID NO: 48551 - RNA, 22 nt, Human
ccaugcugggagucugcuccuc

SEQ ID NO: 48552 - RNA, 18 nt, Human
ccaugugcaugacagggc

SEQ ID NO: 48553 - RNA, 22 nt, Human
ccccacacugcgcaccugcccc

SEQ ID NO: 48554 - RNA, 20 nt, Human
ccccaugugcaugacagggc

SEQ ID NO: 48555 - RNA, 21 nt, Human
cccccugcaccccccaucaug

SEQ ID NO: 48556 - RNA, 26 nt, Human
cccccugcaccccccaucaugucugc

SEQ ID NO: 48557 - RNA, 20 nt, Human
ccccgagcaaccacuggccu

SEQ ID NO: 48558 - RNA, 21 nt, Human
ccccgagcaaccacuggccuc

SEQ ID NO: 48559 - RNA, 18 nt, Human
ccccgugucccccuacuc

SEQ ID NO: 48560 - RNA, 26 nt, Human
cccggccgccaaccuggccgcuuggc

SEQ ID NO: 48561 - RNA, 19 nt, Human
ccgccaaccuggccgcuug

SEQ ID NO: 48562 - RNA, 18 nt, Human
ccgccgccgccgccgccg

SEQ ID NO: 48563 - RNA, 18 nt, Human
ccgccgccgccgccgccg

SEQ ID NO: 48564 - RNA, 18 nt, Human
ccgccgcugccgccgccg

SEQ ID NO: 48565 - RNA, 24 nt, Human
ccgccgcugccgccgccgccgccg

SEQ ID NO: 48566 - RNA, 18 nt, Human
ccgcugccgccgccgccg

SEQ ID NO: 48567 - RNA, 24 nt, Human
ccgcugccgccgccgccgccgccg

SEQ ID NO: 48568 - RNA, 27 nt, Human
ccgcuuggccgccgcugccgccgccgg

SEQ ID NO: 48569 - RNA, 22 nt, Human
ccuccaccagucccuggaaccc

SEQ ID NO: 48570 - RNA, 20 nt, Human
ccuccucaguguaccugaac

SEQ ID NO: 48571 - RNA, 24 nt, Human
ccugaaugaauggccagccuggga

SEQ ID NO: 48572 - RNA, 18 nt, Human
ccugcccccaguucagau

SEQ ID NO: 48573 - RNA, 21 nt, Human
ccuggaacccggcaggucaga

SEQ ID NO: 48574 - RNA, 22 nt, Human
cgcaccccauccccuccccaca

SEQ ID NO: 48575 - RNA, 23 nt, Human
cggcagagagaugccaggcggcg

SEQ ID NO: 48576 - RNA, 22 nt, Human
cgggcggcgcucugccucguug

SEQ ID NO: 48577 - RNA, 19 nt, Human
cuacacuacgccagcagca

SEQ ID NO: 48578 - RNA, 22 nt, Human
cuagaggaggcugagggcuaca

SEQ ID NO: 48579 - RNA, 20 nt, Human
cucaaauccuuugucuguau

SEQ ID NO: 48580 - RNA, 19 nt, Human
cucaguguaccugaacacc

SEQ ID NO: 48581 - RNA, 24 nt, Human
cuccaugccagccugaaaggcucc

SEQ ID NO: 48582 - RNA, 22 nt, Human
cucccgggcugacucccucugu

SEQ ID NO: 48583 - RNA, 25 nt, Human
cuccgcgcuuggccagugugucucc

SEQ ID NO: 48584 - RNA, 26 nt, Human
cuccgcgcuuggccagugugucuccc

SEQ ID NO: 48585 - RNA, 19 nt, Human
cucgcgccgggcggcgcuc

SEQ ID NO: 48586 - RNA, 23 nt, Human
cugaucccaaggcagcuuccuuc

SEQ ID NO: 48587 - RNA, 18 nt, Human
cugaugugagaugcuggg

SEQ ID NO: 48588 - RNA, 18 nt, Human
cugcgcaccugccccagg

SEQ ID NO: 48589 - RNA, 22 nt, Human
cugguggucccccguguccccc

SEQ ID NO: 48590 - RNA, 21 nt, Human
cuucucucagcuccucuuuca

SEQ ID NO: 48591 - RNA, 22 nt, Human
gaaggaacagagggaacuuagg

SEQ ID NO: 48592 - RNA, 22 nt, Human
gaccugccauccaccuccaccu

SEQ ID NO: 48593 - RNA, 22 nt, Human
gagguucuggaggaugacgcug

SEQ ID NO: 48594 - RNA, 22 nt, Human
gagguucuggaggaugacgcug

SEQ ID NO: 48595 - RNA, 21 nt, Human
gaugcuggggacaaccgugga

SEQ ID NO: 48596 - RNA, 19 nt, Human
gcaccccauccccucccca

SEQ ID NO: 48597 - RNA, 24 nt, Human
gcaggacacacagucacugcugcg

SEQ ID NO: 48598 - RNA, 20 nt, Human
gccgccaaccuggccgcuug

SEQ ID NO: 48599 - RNA, 22 nt, Human
gccgccgccgccgccgccgccg

SEQ ID NO: 48600 - RNA, 26 nt, Human
gccugaaaggcuccacucucagccgc

SEQ ID NO: 48601 - RNA, 28 nt, Human
ggaaggccccgagcaaccacuggccccu

SEQ ID NO: 48602 - RNA, 25 nt, Human
ggaggugguccacacagggcccucg

SEQ ID NO: 48603 - RNA, 24 nt, Human
ggaguacagaagcuucuagaggag

SEQ ID NO: 48604 - RNA, 23 nt, Human
ggcacugcacuggcaggcagagc

SEQ ID NO: 48605 - RNA, 18 nt, Human
ggccucggggcugggugc

SEQ ID NO: 48606 - RNA, 24 nt, Human
gggcagaccaccugcuucuggggu

SEQ ID NO: 48607 - RNA, 18 nt, Human
guccagauucuaaaauca

SEQ ID NO: 48608 - RNA, 27 nt, Human
guguuccuuguggcuugggaguuccuu

SEQ ID NO: 48609 - RNA, 20 nt, Human
uaaaaaggaaucuuuugagc

SEQ ID NO: 48610 - RNA, 22 nt, Human
uaaaacuauggcauuuuccaag

SEQ ID NO: 48611 - RNA, 24 nt, Human
uaaacugagaaaaguuuuccauga

SEQ ID NO: 48612 - RNA, 19 nt, Human
uaauggcccaucgguuccu

SEQ ID NO: 48613 - RNA, 20 nt, Human
uacccagggagguaccuacg

SEQ ID NO: 48614 - RNA, 22 nt, Human
uaccuacggagaaaagagaccu

SEQ ID NO: 48615 - RNA, 23 nt, Human
uaccuacggagaaaagagaccua

SEQ ID NO: 48616 - RNA, 25 nt, Human
uaccucuauuuucccacccuccucc

SEQ ID NO: 48617 - RNA, 23 nt, Human
uagaacucaauuucuaaacguaa

SEQ ID NO: 48618 - RNA, 21 nt, Human
uagaggaggcugagggcuaca

SEQ ID NO: 48619 - RNA, 27 nt, Human
uagaggaggcugagggcuacagggggg

SEQ ID NO: 48620 - RNA, 19 nt, Human
uaucucagcaggacugaag

SEQ ID NO: 48621 - RNA, 19 nt, Human
uauuuucccacccuccucc

SEQ ID NO: 48622 - RNA, 20 nt, Human
ucaaauccuuugucuguauu

SEQ ID NO: 48623 - RNA, 21 nt, Human
ucacccacauccauucgauuc

SEQ ID NO: 48624 - RNA, 19 nt, Human
ucacuggacgguucagaag

SEQ ID NO: 48625 - RNA, 20 nt, Human
ucacuggacgguucagaagg

SEQ ID NO: 48626 - RNA, 22 nt, Human
ucaguugccccuuaagcucucc

SEQ ID NO: 48627 - RNA, 20 nt, Human
ucauggucgagucggaccug

SEQ ID NO: 48628 - RNA, 18 nt, Human
uccaaagccugaaaaagc

SEQ ID NO: 48629 - RNA, 24 nt, Human
uccaaagccugaaaaagcaaacag

SEQ ID NO: 48630 - RNA, 20 nt, Human
uccacucucagccgcagccg

SEQ ID NO: 48631 - RNA, 22 nt, Human
uccacucucagccgcagccgcg

SEQ ID NO: 48632 - RNA, 23 nt, Human
uccucaguguaccugaacacccu

SEQ ID NO: 48633 - RNA, 20 nt, Human
uccugaccucccgggcugac

SEQ ID NO: 48634 - RNA, 18 nt, Human
ucgcgccgggcggcgcuc

SEQ ID NO: 48635 - RNA, 20 nt, Human
ucgcgccgggcggcgcucug

SEQ ID NO: 48636 - RNA, 24 nt, Human
ucuacugaaaucauucuacuucca

SEQ ID NO: 48637 - RNA, 21 nt, Human
ucuagaggaggcugagggcua

SEQ ID NO: 48638 - RNA, 22 nt, Human
ucucagcuccucuuucauccug

SEQ ID NO: 48639 - RNA, 20 nt, Human
ucucgcgccgggcggcgcuc

SEQ ID NO: 48640 - RNA, 22 nt, Human
ugaaaaagccgacacacccuua

SEQ ID NO: 48641 - RNA, 22 nt, Human
ugaaugaauggccagccuggga

SEQ ID NO: 48642 - RNA, 23 nt, Human
ugaaugaauggccagccugggau

SEQ ID NO: 48643 - RNA, 21 nt, Human
ugaccucccgggcugacuccc

SEQ ID NO: 48644 - RNA, 19 nt, Human
ugagggcuacaggggccug

SEQ ID NO: 48645 - RNA, 19 nt, Human
ugaugugagaugcugggga

SEQ ID NO: 48646 - RNA, 19 nt, Human
ugccaggcggcgaugcugg

SEQ ID NO: 48647 - RNA, 25 nt, Human
ugcccccaguucagaugugagguuc

SEQ ID NO: 48648 - RNA, 26 nt, Human
ugcgcaccugccccaggucugaugac

SEQ ID NO: 48649 - RNA, 22 nt, Human
uggaggugguccacacagggcc

SEQ ID NO: 48650 - RNA, 18 nt, Human
uggaugcccacagccccc

SEQ ID NO: 48651 - RNA, 18 nt, Human
uggcaggcagagcacuuc

SEQ ID NO: 48652 - RNA, 21 nt, Human
uggccagugugucuccuucag

SEQ ID NO: 48653 - RNA, 23 nt, Human
uggccagugugucuccuucaguu

SEQ ID NO: 48654 - RNA, 24 nt, Human
uggccuacacuacgccagcagcac

SEQ ID NO: 48655 - RNA, 23 nt, Human
ugggcagguccggaugugcaguc

SEQ ID NO: 48656 - RNA, 20 nt, Human
uguauacacagauuuacaua

SEQ ID NO: 48657 - RNA, 26 nt, Human
uguauacacagauuuacauacagugu

SEQ ID NO: 48658 - RNA, 21 nt, Human
ugucuuugauaaagcuggaaa

SEQ ID NO: 48659 - RNA, 23 nt, Human
uguuuguuuugagacaugggcag

SEQ ID NO: 48660 - RNA, 19 nt, Human
uuaauggcccaucgguucc

SEQ ID NO: 48661 - RNA, 19 nt, Human
uuagaggugggaaagaugg

SEQ ID NO: 48662 - RNA, 23 nt, Human
uucaaacaguaaacaagaaagug

SEQ ID NO: 48663 - RNA, 24 nt, Human
uuccuaccucuauuuucccacccu

SEQ ID NO: 48664 - RNA, 22 nt, Human
uuccuuguggcuugguacucgu

SEQ ID NO: 48665 - RNA, 22 nt, Human
uucuagaggaggcugagggcua

SEQ ID NO: 48666 - RNA, 21 nt, Human
uucugggguaaaguguuugag

SEQ ID NO: 48667 - RNA, 19 nt, Human
uuggccagugugucuccuu

SEQ ID NO: 48668 - RNA, 25 nt, Human
uuuaaaaaaccugaaugaauggcca

SEQ ID NO: 48669 - RNA, 19 nt, Human
uuuacagaauuuagaggug

SEQ ID NO: 48670 - RNA, 24 nt, Human
uuuccuucuuuaugccuggggcag

SEQ ID NO: 48671 - RNA, 20 nt, Human
aaacaguguuacuagaucuu

SEQ ID NO: 48672 - RNA, 19 nt, Human
aaagugcugggauuacagg

SEQ ID NO: 48673 - RNA, 24 nt, Human
aaagugcugggauuacaggccuga

SEQ ID NO: 48674 - RNA, 21 nt, Human
aacuaccaaaaaagcuaagac

SEQ ID NO: 48675 - RNA, 19 nt, Human
aagugcugggauuacaggc

SEQ ID NO: 48676 - RNA, 19 nt, Human
aagugcugggauuacaggc

SEQ ID NO: 48677 - RNA, 26 nt, Human
aagugcugggauuacaggccugagcc

SEQ ID NO: 48678 - RNA, 20 nt, Human
acagagaugcaaagcucaga

SEQ ID NO: 48679 - RNA, 20 nt, Human
acaggguuucaccagguugg

SEQ ID NO: 48680 - RNA, 24 nt, Human
acaggguuucaccagguuggccag

SEQ ID NO: 48681 - RNA, 24 nt, Human
accagguuggccaggcuggucuug

SEQ ID NO: 48682 - RNA, 22 nt, Human
acccaggcuggagugcagcggu

SEQ ID NO: 48683 - RNA, 21 nt, Human
agaaaaccaacacaaacaggc

SEQ ID NO: 48684 - RNA, 19 nt, Human
agacaggguuucaccaggu

SEQ ID NO: 48685 - RNA, 22 nt, Human
agagaagcaauaaaacacaaug

SEQ ID NO: 48686 - RNA, 18 nt, Human
agagcaggaccacugaag

SEQ ID NO: 48687 - RNA, 18 nt, Human
agccucccgaguagcuag

SEQ ID NO: 48688 - RNA, 21 nt, Human
aggaacccauaaaacagagcu

SEQ ID NO: 48689 - RNA, 18 nt, Human
aguagcuaggauuacagg

SEQ ID NO: 48690 - RNA, 24 nt, Human
agugcugggauuacaggccugagc

SEQ ID NO: 48691 - RNA, 21 nt, Human
auaaaacagagcugcugcaga

SEQ ID NO: 48692 - RNA, 18 nt, Human
auaauugagacaucuaaa

SEQ ID NO: 48693 - RNA, 22 nt, Human
auuacaggccugagccaccaag

SEQ ID NO: 48694 - RNA, 21 nt, Human
auuacaggugugcgccaccau

SEQ ID NO: 48695 - RNA, 24 nt, Human
caaagugcugggauuacaggccug

SEQ ID NO: 48696 - RNA, 22 nt, Human
caagcaauucuccugccucagc

SEQ ID NO: 48697 - RNA, 18 nt, Human
cacaacagagaugcaaag

SEQ ID NO: 48698 - RNA, 21 nt, Human
caccacuaccuccgccuccug

SEQ ID NO: 48699 - RNA, 23 nt, Human
caccacuaccuccgccuccuggg

SEQ ID NO: 48700 - RNA, 21 nt, Human
caccagguuggccaggcuggu

SEQ ID NO: 48701 - RNA, 24 nt, Human
caccagguuggccaggcuggucuu

SEQ ID NO: 48702 - RNA, 20 nt, Human
cagagcaggaccacugaaga

SEQ ID NO: 48703 - RNA, 23 nt, Human
caggcuauuccuagagccaggga

SEQ ID NO: 48704 - RNA, 24 nt, Human
caggguuucaccagguuggccagg

SEQ ID NO: 48705 - RNA, 21 nt, Human
cauuucagcucaauaaauauu

SEQ ID NO: 48706 - RNA, 19 nt, Human
ccaaagugcugggauuaca

SEQ ID NO: 48707 - RNA, 22 nt, Human
ccaaagugcugggauuacaggc

SEQ ID NO: 48708 - RNA, 24 nt, Human
ccaaagugcugggauuacaggccu

SEQ ID NO: 48709 - RNA, 23 nt, Human
ccaccuggccaucgaccuucagg

SEQ ID NO: 48710 - RNA, 19 nt, Human
ccagaucaaaacagaaagc

SEQ ID NO: 48711 - RNA, 23 nt, Human
cccgaguagcuaggauuacaggu

SEQ ID NO: 48712 - RNA, 24 nt, Human
cccgaguagcuaggauuacaggug

SEQ ID NO: 48713 - RNA, 24 nt, Human
ccgaguagcuaggauuacaggugu

SEQ ID NO: 48714 - RNA, 27 nt, Human
ccgccuccuggguucaagcaauucuuu

SEQ ID NO: 48715 - RNA, 19 nt, Human
ccuccgccuccuggguuca

SEQ ID NO: 48716 - RNA, 24 nt, Human
ccuccuggguucaagcaauucucc

SEQ ID NO: 48717 - RNA, 21 nt, Human
ccugaccucaagugaucugcc

SEQ ID NO: 48718 - RNA, 23 nt, Human
ccugaccucaagugaucugccug

SEQ ID NO: 48719 - RNA, 24 nt, Human
ccugccucagccucccgaguagcu

SEQ ID NO: 48720 - RNA, 19 nt, Human
ccuggccaucgaccuucag

SEQ ID NO: 48721 - RNA, 23 nt, Human
ccuggguucaagcaauucuccug

SEQ ID NO: 48722 - RNA, 18 nt, Human
cucaagugaucugccugc

SEQ ID NO: 48723 - RNA, 24 nt, Human
cucccgaguagcuaggauuacagg

SEQ ID NO: 48724 - RNA, 26 nt, Human
cuccugaccucaagugaucugccugc

SEQ ID NO: 48725 - RNA, 21 nt, Human
cuccuggguucaagcaauucu

SEQ ID NO: 48726 - RNA, 23 nt, Human
cucuaucacccaggcuggagugc

SEQ ID NO: 48727 - RNA, 24 nt, Human
gaccacugaagaaugggaaaagaa

SEQ ID NO: 48728 - RNA, 22 nt, Human
gaccucaagugaucugccugcc

SEQ ID NO: 48729 - RNA, 21 nt, Human
gagauagggucuugcucuauc

SEQ ID NO: 48730 - RNA, 24 nt, Human
gaguagcuaggauuacaggugugc

SEQ ID NO: 48731 - RNA, 27 nt, Human
gaucugccugccugggcuucccaaagu

SEQ ID NO: 48732 - RNA, 19 nt, Human
gaugcaaagcucagaaaga

SEQ ID NO: 48733 - RNA, 18 nt, Human
gauuacaggccugagcca

SEQ ID NO: 48734 - RNA, 21 nt, Human
gauuacaggccugagccacca

SEQ ID NO: 48735 - RNA, 18 nt, Human
gauuacaggugugcgcca

SEQ ID NO: 48736 - RNA, 24 nt, Human
gauuacaggugugcgccaccaugc

SEQ ID NO: 48737 - RNA, 20 nt, Human
gcagagagcuacuucaauca

SEQ ID NO: 48738 - RNA, 20 nt, Human
gccucagccucccgaguagc

SEQ ID NO: 48739 - RNA, 20 nt, Human
gccuucauucuuugcuggcu

SEQ ID NO: 48740 - RNA, 23 nt, Human
gcuggucuugaacuccugaccuc

SEQ ID NO: 48741 - RNA, 27 nt, Human
ggacagaacucuuucaauuguaaguca

SEQ ID NO: 48742 - RNA, 19 nt, Human
ggauuacaggccugagcca

SEQ ID NO: 48743 - RNA, 22 nt, Human
ggauuacaggugugcgccacca

SEQ ID NO: 48744 - RNA, 24 nt, Human
ggauuacaggugugcgccaccaug

SEQ ID NO: 48745 - RNA, 24 nt, Human
ggcuggucuugaacuccugaccuc

SEQ ID NO: 48746 - RNA, 22 nt, Human
gguaguaggaaaagauggccac

SEQ ID NO: 48747 - RNA, 19 nt, Human
ggucuugaacuccugaccu

SEQ ID NO: 48748 - RNA, 22 nt, Human
gguuggccaggcuggucuugaa

SEQ ID NO: 48749 - RNA, 24 nt, Human
gucuugcucuaucacccaggcugg

SEQ ID NO: 48750 - RNA, 24 nt, Human
guuuuugcauuuuuaguagagaca

SEQ ID NO: 48751 - RNA, 21 nt, Human
uaaaacacaauggaagucaga

SEQ ID NO: 48752 - RNA, 24 nt, Human
uaaaacacaauggaagucagauag

SEQ ID NO: 48753 - RNA, 22 nt, Human
uacagcuccagaucaaaacaga

SEQ ID NO: 48754 - RNA, 19 nt, Human
uaccuccgccuccuggguu

SEQ ID NO: 48755 - RNA, 20 nt, Human
uagagacaggguuucaccag

SEQ ID NO: 48756 - RNA, 22 nt, Human
uagagacaggguuucaccaggu

SEQ ID NO: 48757 - RNA, 18 nt, Human
uaggauuacaggugugcg

SEQ ID NO: 48758 - RNA, 21 nt, Human
uaggauuacaggugugcgcca

SEQ ID NO: 48759 - RNA, 22 nt, Human
uaggauuacaggugugcgccac

SEQ ID NO: 48760 - RNA, 24 nt, Human
uaggauuacaggugugcgccacca

SEQ ID NO: 48761 - RNA, 25 nt, Human
uaggauuacaggugugcgccaccau

SEQ ID NO: 48762 - RNA, 19 nt, Human
uaguagagacaggguuuca

SEQ ID NO: 48763 - RNA, 25 nt, Human
uaguagagacaggguuucaccaggu

SEQ ID NO: 48764 - RNA, 21 nt, Human
uaguaggaaaagauggccacc

SEQ ID NO: 48765 - RNA, 24 nt, Human
uaguuuuugcauuuuuaguagaga

SEQ ID NO: 48766 - RNA, 21 nt, Human
uaucacccaggcuggagugca

SEQ ID NO: 48767 - RNA, 21 nt, Human
uaugugacccuuacagcucca

SEQ ID NO: 48768 - RNA, 19 nt, Human
ucaagcaauucuccugccu

SEQ ID NO: 48769 - RNA, 24 nt, Human
ucacaaggcaguauaguuuaugaa

SEQ ID NO: 48770 - RNA, 24 nt, Human
ucaccacuaccuccgccuccuggg

SEQ ID NO: 48771 - RNA, 27 nt, Human
ucaccacuaccuccgccuccuggguuc

SEQ ID NO: 48772 - RNA, 18 nt, Human
ucacccaggcuggagugc

SEQ ID NO: 48773 - RNA, 19 nt, Human
uccagaucaaaacagaaag

SEQ ID NO: 48774 - RNA, 24 nt, Human
ucccaaagugcugggauuacaggc

SEQ ID NO: 48775 - RNA, 19 nt, Human
ucccgaguagcuaggauua

SEQ ID NO: 48776 - RNA, 23 nt, Human
ucccgaguagcuaggauuacagg

SEQ ID NO: 48777 - RNA, 24 nt, Human
ucccgaguagcuaggauuacaggu

SEQ ID NO: 48778 - RNA, 24 nt, Human
uccgccuccuggguucaagcaauu

SEQ ID NO: 48779 - RNA, 21 nt, Human
uccuggguucaagcaauucuc

SEQ ID NO: 48780 - RNA, 24 nt, Human
uccuggguucaagcaauucuccug

SEQ ID NO: 48781 - RNA, 19 nt, Human
ucuaucacccaggcuggag

SEQ ID NO: 48782 - RNA, 24 nt, Human
ucuaucacccaggcuggagugcag

SEQ ID NO: 48783 - RNA, 24 nt, Human
ucuccugccucagccucccgagua

SEQ ID NO: 48784 - RNA, 20 nt, Human
ucucuuggcuguuuccuuug

SEQ ID NO: 48785 - RNA, 22 nt, Human
ucucuuggcuguuuccuuuguu

SEQ ID NO: 48786 - RNA, 21 nt, Human
ucuugaacuccugaccucaag

SEQ ID NO: 48787 - RNA, 19 nt, Human
ucuugcucuaucacccagg

SEQ ID NO: 48788 - RNA, 23 nt, Human
ucuugcucuaucacccaggcugg

SEQ ID NO: 48789 - RNA, 24 nt, Human
ucuugcucuaucacccaggcugga

SEQ ID NO: 48790 - RNA, 22 nt, Human
ugaagaaugggaaaagaauggc

SEQ ID NO: 48791 - RNA, 18 nt, Human
ugaccucaagugaucugc

SEQ ID NO: 48792 - RNA, 24 nt, Human
ugaccucaagugaucugccugccu

SEQ ID NO: 48793 - RNA, 23 nt, Human
ugcaaagcucagaaagaauguuc

SEQ ID NO: 48794 - RNA, 23 nt, Human
ugccucagccucccgaguagcua

SEQ ID NO: 48795 - RNA, 24 nt, Human
ugccucagccucccgaguagcuag

SEQ ID NO: 48796 - RNA, 22 nt, Human
ugcucuaucacccaggcuggag

SEQ ID NO: 48797 - RNA, 24 nt, Human
ugcucuaucacccaggcuggagug

SEQ ID NO: 48798 - RNA, 18 nt, Human
ugcugaaucaauguagga

SEQ ID NO: 48799 - RNA, 19 nt, Human
uggagugcagcgguacgau

SEQ ID NO: 48800 - RNA, 24 nt, Human
uggccaggcuggucuugaacuccu

SEQ ID NO: 48801 - RNA, 18 nt, Human
ugggauuacaggccugag

SEQ ID NO: 48802 - RNA, 19 nt, Human
ugggauuacaggccugagc

SEQ ID NO: 48803 - RNA, 21 nt, Human
ugggauuacaggccugagcca

SEQ ID NO: 48804 - RNA, 22 nt, Human
ugggauuacaggccugagccac

SEQ ID NO: 48805 - RNA, 24 nt, Human
ugggauuacaggccugagccacca

SEQ ID NO: 48806 - RNA, 21 nt, Human
uggguucaagcaauucuccug

SEQ ID NO: 48807 - RNA, 23 nt, Human
uggguucaagcaauucuccugcc

SEQ ID NO: 48808 - RNA, 24 nt, Human
uggguucaagcaauucuccugccu

SEQ ID NO: 48809 - RNA, 22 nt, Human
uguaaaacuugcagagcgucaa

SEQ ID NO: 48810 - RNA, 22 nt, Human
uguauuacacaacagagaugca

SEQ ID NO: 48811 - RNA, 18 nt, Human
uuaguagagacaggguuu

SEQ ID NO: 48812 - RNA, 21 nt, Human
uucaagcaauucuccugccuc

SEQ ID NO: 48813 - RNA, 24 nt, Human
uucaagcaauucuccugccucagc

SEQ ID NO: 48814 - RNA, 19 nt, Human
uucuuugcuggcuuucucu

SEQ ID NO: 48815 - RNA, 24 nt, Human
uugcucuaucacccaggcuggagu

SEQ ID NO: 48816 - RNA, 24 nt, Human
uugcuggcuuucucuagguaguag

SEQ ID NO: 48817 - RNA, 20 nt, Human
uuuaugaagaccaccuggcc

SEQ ID NO: 48818 - RNA, 21 nt, Human
uuucaccagguuggccaggcu

SEQ ID NO: 48819 - RNA, 25 nt, Human
uuugauucucuuggcuguuuccuuu

SEQ ID NO: 48820 - RNA, 24 nt, Human
uuuuuaguagagacaggguuucac

SEQ ID NO: 48821 - RNA, 20 nt, Human
uuuuugcauuuuuaguagag

SEQ ID NO: 48822 - RNA, 21 nt, Human
uuuuugcauuuuuaguagaga

SEQ ID NO: 48823 - RNA, 18 nt, Human
aaacccacgaugucagca

SEQ ID NO: 48824 - RNA, 21 nt, Human
accagcuccugggcugugcac

SEQ ID NO: 48825 - RNA, 23 nt, Human
accccaugugcaccccagaggcc

SEQ ID NO: 48826 - RNA, 19 nt, Human
aggaguuucaccagcuccu

SEQ ID NO: 48827 - RNA, 21 nt, Human
aggaguuucaccagcuccugg

SEQ ID NO: 48828 - RNA, 22 nt, Human
auucccaccccaugugcacccc

SEQ ID NO: 48829 - RNA, 23 nt, Human
cacacagcagugggcauggucag

SEQ ID NO: 48830 - RNA, 18 nt, Human
cacagcagugggcauggu

SEQ ID NO: 48831 - RNA, 19 nt, Human
cacccccggagcauuccca

SEQ ID NO: 48832 - RNA, 19 nt, Human
cagcaaacaggaugcucac

SEQ ID NO: 48833 - RNA, 18 nt, Human
cagcagugggcaugguca

SEQ ID NO: 48834 - RNA, 18 nt, Human
caggaugcucacauuguc

SEQ ID NO: 48835 - RNA, 19 nt, Human
cagggggcuucaggaaguc

SEQ ID NO: 48836 - RNA, 20 nt, Human
caguaguagcaguccccgag

SEQ ID NO: 48837 - RNA, 23 nt, Human
caugccuggacaaugcuccuccu

SEQ ID NO: 48838 - RNA, 21 nt, Human
ccaccguggccugugucaccc

SEQ ID NO: 48839 - RNA, 20 nt, Human
ccagcuccugggcugugcac

SEQ ID NO: 48840 - RNA, 18 nt, Human
cccaugugcaccccagag

SEQ ID NO: 48841 - RNA, 18 nt, Human
ccccggagcauucccacc

SEQ ID NO: 48842 - RNA, 18 nt, Human
cccugcucugcuggucug

SEQ ID NO: 48843 - RNA, 18 nt, Human
ccggagcauucccacccc

SEQ ID NO: 48844 - RNA, 18 nt, Human
ccugugucacccccggag

SEQ ID NO: 48845 - RNA, 19 nt, Human
cgagaaucuugaugcggcg

SEQ ID NO: 48846 - RNA, 24 nt, Human
cucacauugucgugccucuggaug

SEQ ID NO: 48847 - RNA, 22 nt, Human
cugggugaggcccgacacgcag

SEQ ID NO: 48848 - RNA, 19 nt, Human
cugugcugugccugcucgg

SEQ ID NO: 48849 - RNA, 18 nt, Human
gggcauggucagucuugg

SEQ ID NO: 48850 - RNA, 20 nt, Human
gguuggcccucgggccacag

SEQ ID NO: 48851 - RNA, 21 nt, Human
uccacccuggcaaguggcucc

SEQ ID NO: 48852 - RNA, 23 nt, Human
ucccaccccaugugcaccccaga

SEQ ID NO: 48853 - RNA, 19 nt, Human
ucuggcugguccuggcugg

SEQ ID NO: 48854 - RNA, 23 nt, Human
uggcucccugcucugcuggucug

SEQ ID NO: 48855 - RNA, 19 nt, Human
ugggcauggucagucuugg

SEQ ID NO: 48856 - RNA, 23 nt, Human
ugugcugugccugcucggugguu

SEQ ID NO: 48857 - RNA, 18 nt, Human
uugaggaguuucaccagc

SEQ ID NO: 48858 - RNA, 24 nt, Human
uugaugcggcgacagugguucucc

SEQ ID NO: 48859 - RNA, 23 nt, Human
aaacagcaguugugcugggcccc

SEQ ID NO: 48860 - RNA, 19 nt, Human
aacuguggaacucugaaca

SEQ ID NO: 48861 - RNA, 19 nt, Human
aagaacccacgaggcacgc

SEQ ID NO: 48862 - RNA, 25 nt, Human
aagugauccucccaccucagccucc

SEQ ID NO: 48863 - RNA, 20 nt, Human
acaaaagacaaauggcauca

SEQ ID NO: 48864 - RNA, 23 nt, Human
acaaaagacaaauggcaucaaaa

SEQ ID NO: 48865 - RNA, 19 nt, Human
acacacggagcagagggac

SEQ ID NO: 48866 - RNA, 20 nt, Human
acacauuuuacaccaaggcc

SEQ ID NO: 48867 - RNA, 22 nt, Human
acacugggguuuuugggaaacu

SEQ ID NO: 48868 - RNA, 24 nt, Human
acagacagcacgcacaucaaaaac

SEQ ID NO: 48869 - RNA, 21 nt, Human
acagcacgcacaucaaaaaca

SEQ ID NO: 48870 - RNA, 22 nt, Human
acaggcacuguaaaucaaagua

SEQ ID NO: 48871 - RNA, 24 nt, Human
acccaggcuggagugcagugguau

SEQ ID NO: 48872 - RNA, 20 nt, Human
accucagccucccauguagc

SEQ ID NO: 48873 - RNA, 23 nt, Human
accucagccucccauguagcugg

SEQ ID NO: 48874 - RNA, 20 nt, Human
acgagaacgagucugcagag

SEQ ID NO: 48875 - RNA, 23 nt, Human
acguuggcugugugucuucuuua

SEQ ID NO: 48876 - RNA, 21 nt, Human
acuguguguuugaauaucaga

SEQ ID NO: 48877 - RNA, 21 nt, Human
agaacaaauucuucaaggccu

SEQ ID NO: 48878 - RNA, 25 nt, Human
agacaaauggcaucaaaacaucaga

SEQ ID NO: 48879 - RNA, 24 nt, Human
agacaggaaaauaaaagauacagg

SEQ ID NO: 48880 - RNA, 22 nt, Human
agagaugggggucuugcuaugu

SEQ ID NO: 48881 - RNA, 21 nt, Human
agauaauauacacccccuagu

SEQ ID NO: 48882 - RNA, 20 nt, Human
agcacagaguccacgugggg

SEQ ID NO: 48883 - RNA, 24 nt, Human
agcacagaguccacgugggggaca

SEQ ID NO: 48884 - RNA, 19 nt, Human
agcugcccagaacuuuaag

SEQ ID NO: 48885 - RNA, 19 nt, Human
aggagccacugcacccggc

SEQ ID NO: 48886 - RNA, 20 nt, Human
aggcagaauacuaaauaagu

SEQ ID NO: 48887 - RNA, 27 nt, Human
agguuggggccugagaauuugcauuuu

SEQ ID NO: 48888 - RNA, 23 nt, Human
auaauauacacccccuaguuuua

SEQ ID NO: 48889 - RNA, 19 nt, Human
auacagucuucuugccaaa

SEQ ID NO: 48890 - RNA, 23 nt, Human
augcccaaauuaaaaucagacca

SEQ ID NO: 48891 - RNA, 20 nt, Human
auguguguguguuucaccuu

SEQ ID NO: 48892 - RNA, 20 nt, Human
auguugcccaggcuggucuc

SEQ ID NO: 48893 - RNA, 21 nt, Human
auucuuuugcagucuaugucu

SEQ ID NO: 48894 - RNA, 22 nt, Human
caaaagacaaauggcaucaaaa

SEQ ID NO: 48895 - RNA, 18 nt, Human
caaaauauugggauuaua

SEQ ID NO: 48896 - RNA, 23 nt, Human
caaaguacauaaaacuuuuaaug

SEQ ID NO: 48897 - RNA, 27 nt, Human
caagugauccucccaccucagccuccc

SEQ ID NO: 48898 - RNA, 27 nt, Human
caagugauccucccaccucagccuccc

SEQ ID NO: 48899 - RNA, 19 nt, Human
cacacaucagacaccaaac

SEQ ID NO: 48900 - RNA, 21 nt, Human
cacggggcaccugccaggcuc

SEQ ID NO: 48901 - RNA, 25 nt, Human
cacuccuaaacagauauguaaaaca

SEQ ID NO: 48902 - RNA, 23 nt, Human
cagaaaagaacaugcaccagaag

SEQ ID NO: 48903 - RNA, 21 nt, Human
caggcacuguaaaucaaagua

SEQ ID NO: 48904 - RNA, 21 nt, Human
caguugugcugggccccagcc

SEQ ID NO: 48905 - RNA, 18 nt, Human
ccacugcacccggccuga

SEQ ID NO: 48906 - RNA, 19 nt, Human
ccacugcacccggccugau

SEQ ID NO: 48907 - RNA, 21 nt, Human
ccacugcacccggccugauga

SEQ ID NO: 48908 - RNA, 19 nt, Human
ccaguuuucugccuggcau

SEQ ID NO: 48909 - RNA, 19 nt, Human
ccauguagcugggacuaca

SEQ ID NO: 48910 - RNA, 24 nt, Human
cccacgaauaaaaggcuuccuaag

SEQ ID NO: 48911 - RNA, 19 nt, Human
ccccagccccggggaucuc

SEQ ID NO: 48912 - RNA, 20 nt, Human
ccccagccccggggaucuca

SEQ ID NO: 48913 - RNA, 22 nt, Human
ccgugggucccaacgggggccc

SEQ ID NO: 48914 - RNA, 24 nt, Human
ccgugggucccaacgggggcccuu

SEQ ID NO: 48915 - RNA, 26 nt, Human
ccucccaccucagccucccauguagc

SEQ ID NO: 48916 - RNA, 20 nt, Human
ccucucuccucggccuccca

SEQ ID NO: 48917 - RNA, 22 nt, Human
ccugggcucaagugauccuccc

SEQ ID NO: 48918 - RNA, 18 nt, Human
ccugggcuuaagugaucc

SEQ ID NO: 48919 - RNA, 22 nt, Human
ccugggcuuaagugauccucuc

SEQ ID NO: 48920 - RNA, 19 nt, Human
ccuuggacaccacuggcaa

SEQ ID NO: 48921 - RNA, 24 nt, Human
cgcucugucacccaggcuggagug

SEQ ID NO: 48922 - RNA, 21 nt, Human
cgggggcccuuggacaccacu

SEQ ID NO: 48923 - RNA, 22 nt, Human
cguuggcugugugucuucuuua

SEQ ID NO: 48924 - RNA, 20 nt, Human
cuagauacauucaacaugcu

SEQ ID NO: 48925 - RNA, 24 nt, Human
cucaagugauccucccaccucagc

SEQ ID NO: 48926 - RNA, 24 nt, Human
cucagccucccauguagcugggac

SEQ ID NO: 48927 - RNA, 23 nt, Human
cucccauguagcugggacuacag

SEQ ID NO: 48928 - RNA, 24 nt, Human
cucgcucugucacccaggcuggag

SEQ ID NO: 48929 - RNA, 20 nt, Human
cugccaggcucgcucacagu

SEQ ID NO: 48930 - RNA, 20 nt, Human
cuggacuuccugggcucaag

SEQ ID NO: 48931 - RNA, 20 nt, Human
cugggccccagccccgggga

SEQ ID NO: 48932 - RNA, 22 nt, Human
cugggguuuuugggaaacugga

SEQ ID NO: 48933 - RNA, 23 nt, Human
cuugaucagggaucagaaucacc

SEQ ID NO: 48934 - RNA, 18 nt, Human
gacagaaguugcagucag

SEQ ID NO: 48935 - RNA, 22 nt, Human
gacagcacgcacaucaaaaaca

SEQ ID NO: 48936 - RNA, 18 nt, Human
gagggagggaggucugaa

SEQ ID NO: 48937 - RNA, 20 nt, Human
gaguuugauacaaaacuggu

SEQ ID NO: 48938 - RNA, 21 nt, Human
gauacaaaacugguccuaggc

SEQ ID NO: 48939 - RNA, 21 nt, Human
gaugagcagaugcgguuggcg

SEQ ID NO: 48940 - RNA, 19 nt, Human
gauuauaggagccacugca

SEQ ID NO: 48941 - RNA, 18 nt, Human
gauugaugacaaaacuua

SEQ ID NO: 48942 - RNA, 21 nt, Human
gcacagcagcugugcccgugc

SEQ ID NO: 48943 - RNA, 18 nt, Human
gcccagaacuuuaaggag

SEQ ID NO: 48944 - RNA, 18 nt, Human
gcuccuuuucccuuuugc

SEQ ID NO: 48945 - RNA, 25 nt, Human
gcucugucacccaggcuggagugca

SEQ ID NO: 48946 - RNA, 22 nt, Human
gcuggggguguucacucagggu

SEQ ID NO: 48947 - RNA, 19 nt, Human
ggaaagaugaaugguugcu

SEQ ID NO: 48948 - RNA, 20 nt, Human
ggcugugugucuucuuuagc

SEQ ID NO: 48949 - RNA, 21 nt, Human
gggcucaagugauccucccac

SEQ ID NO: 48950 - RNA, 22 nt, Human
gggcucaagugauccucccacc

SEQ ID NO: 48951 - RNA, 20 nt, Human
gggcuuaagugauccucucu

SEQ ID NO: 48952 - RNA, 24 nt, Human
gggggucuugcuauguugcccagg

SEQ ID NO: 48953 - RNA, 19 nt, Human
gggguuuuugggaaacugg

SEQ ID NO: 48954 - RNA, 22 nt, Human
gggucuugcuauguugcccagg

SEQ ID NO: 48955 - RNA, 27 nt, Human
gguaagacuggugauauggcuuuggga

SEQ ID NO: 48956 - RNA, 24 nt, Human
gugauccucccaccucagccuccc

SEQ ID NO: 48957 - RNA, 18 nt, Human
uaaaaaaucagagccagg

SEQ ID NO: 48958 - RNA, 19 nt, Human
uaaggagagcauuggggag

SEQ ID NO: 48959 - RNA, 27 nt, Human
uaagugauccucucuccucggccuccc

SEQ ID NO: 48960 - RNA, 20 nt, Human
uacaaaagacaaauggcauc

SEQ ID NO: 48961 - RNA, 23 nt, Human
uacagucuucuugccaaaaugaa

SEQ ID NO: 48962 - RNA, 18 nt, Human
uaccauauuuuccagaaa

SEQ ID NO: 48963 - RNA, 19 nt, Human
uauaaucaaggcucacuac

SEQ ID NO: 48964 - RNA, 22 nt, Human
uauguugcccaggcuggucuca

SEQ ID NO: 48965 - RNA, 23 nt, Human
uauguugcccaggcuggucucag

SEQ ID NO: 48966 - RNA, 24 nt, Human
uauguugcccaggcuggucucaga

SEQ ID NO: 48967 - RNA, 24 nt, Human
uauuggcuucuggagagcucuuuc

SEQ ID NO: 48968 - RNA, 23 nt, Human
uauuuuuuugcagagaugggggu

SEQ ID NO: 48969 - RNA, 24 nt, Human
ucaaaagggagaauggauggaaaa

SEQ ID NO: 48970 - RNA, 24 nt, Human
ucacacacuguguccuaaucugaa

SEQ ID NO: 48971 - RNA, 21 nt, Human
ucacaguccuggcacagcagc

SEQ ID NO: 48972 - RNA, 24 nt, Human
ucacccaggcuggagugcaguggu

SEQ ID NO: 48973 - RNA, 20 nt, Human
ucacuaaacagcaguugugc

SEQ ID NO: 48974 - RNA, 18 nt, Human
ucacuacguucuggacuu

SEQ ID NO: 48975 - RNA, 20 nt, Human
ucagggaucagaaucaccug

SEQ ID NO: 48976 - RNA, 26 nt, Human
ucagggaucagaaucaccuggagaag

SEQ ID NO: 48977 - RNA, 18 nt, Human
ucaguuagcucacgcuau

SEQ ID NO: 48978 - RNA, 21 nt, Human
ucauugccucguuuaaucacu

SEQ ID NO: 48979 - RNA, 20 nt, Human
uccagaaaagaacaugcacc

SEQ ID NO: 48980 - RNA, 24 nt, Human
ucccauguagcugggacuacaggc

SEQ ID NO: 48981 - RNA, 21 nt, Human
uccugggcucaagugauccuc

SEQ ID NO: 48982 - RNA, 22 nt, Human
uccugggcucaagugauccucc

SEQ ID NO: 48983 - RNA, 24 nt, Human
uccugggcucaagugauccuccca

SEQ ID NO: 48984 - RNA, 21 nt, Human
uccugggcuuaagugauccuc

SEQ ID NO: 48985 - RNA, 20 nt, Human
uccuuacacauuuuacacca

SEQ ID NO: 48986 - RNA, 24 nt, Human
ucgcucugucacccaggcuggagu

SEQ ID NO: 48987 - RNA, 19 nt, Human
ucucgcucugucacccagg

SEQ ID NO: 48988 - RNA, 23 nt, Human
ucucgcucugucacccaggcugg

SEQ ID NO: 48989 - RNA, 24 nt, Human
ucucgcucugucacccaggcugga

SEQ ID NO: 48990 - RNA, 26 nt, Human
ucucgcucugucacccaggcuggagu

SEQ ID NO: 48991 - RNA, 27 nt, Human
ucucgcucugucacccaggcuggagug

SEQ ID NO: 48992 - RNA, 21 nt, Human
ucugaagcuugaucagggauc

SEQ ID NO: 48993 - RNA, 21 nt, Human
ucugcagaggcuccauaggac

SEQ ID NO: 48994 - RNA, 21 nt, Human
ucugccccuguuuccucaccu

SEQ ID NO: 48995 - RNA, 23 nt, Human
ucuggagagcucuuucugaaaca

SEQ ID NO: 48996 - RNA, 24 nt, Human
ucugucacccaggcuggagugcag

SEQ ID NO: 48997 - RNA, 18 nt, Human
ucuugcuauguugcccag

SEQ ID NO: 48998 - RNA, 19 nt, Human
ucuugcuauguugcccagg

SEQ ID NO: 48999 - RNA, 23 nt, Human
ucuugcuauguugcccaggcugg

SEQ ID NO: 49000 - RNA, 24 nt, Human
ucuugcuauguugcccaggcuggu

SEQ ID NO: 49001 - RNA, 26 nt, Human
ucuuuuuagcgcaaacccaaguucgg

SEQ ID NO: 49002 - RNA, 21 nt, Human
ugaaacaacugugucaaaagg

SEQ ID NO: 49003 - RNA, 22 nt, Human
ugaauaucagaugagcagaugc

SEQ ID NO: 49004 - RNA, 20 nt, Human
ugagcacagaguccacgugg

SEQ ID NO: 49005 - RNA, 18 nt, Human
ugagcucacggaaacgcu

SEQ ID NO: 49006 - RNA, 18 nt, Human
ugaguuagaggaaagaga

SEQ ID NO: 49007 - RNA, 20 nt, Human
ugauauggcuuugggagagc

SEQ ID NO: 49008 - RNA, 22 nt, Human
ugauccucucuccucggccucc

SEQ ID NO: 49009 - RNA, 23 nt, Human
ugauuccaaauuauucuuuugca

SEQ ID NO: 49010 - RNA, 25 nt, Human
ugcagagaugggggucuugcuaugu

SEQ ID NO: 49011 - RNA, 24 nt, Human
ugcagucagaaagugugugauacc

SEQ ID NO: 49012 - RNA, 23 nt, Human
ugcagucuaugucuguuagcucu

SEQ ID NO: 49013 - RNA, 19 nt, Human
ugccaggcucgcucacagu

SEQ ID NO: 49014 - RNA, 21 nt, Human
ugcccaaauuaaaaucagacc

SEQ ID NO: 49015 - RNA, 20 nt, Human
ugcccagaacuuuaaggagc

SEQ ID NO: 49016 - RNA, 22 nt, Human
ugcccaggcuggucucagacuc

SEQ ID NO: 49017 - RNA, 24 nt, Human
ugcccaggcuggucucagacuccu

SEQ ID NO: 49018 - RNA, 28 nt, Human
ugcccaggcuggucucagacuccugggc

SEQ ID NO: 49019 - RNA, 27 nt, Human
ugcuauguugcccaggcuggucucaga

SEQ ID NO: 49020 - RNA, 19 nt, Human
ugcugggccccagccccgg

SEQ ID NO: 49021 - RNA, 18 nt, Human
uggagugcagugguauaa

SEQ ID NO: 49022 - RNA, 25 nt, Human
uggagugcagugguauaaggcucug

SEQ ID NO: 49023 - RNA, 21 nt, Human
uggagugcagugguauaauca

SEQ ID NO: 49024 - RNA, 24 nt, Human
uggagugcagugguauaaucaagg

SEQ ID NO: 49025 - RNA, 21 nt, Human
uggcaucaaaacaucagacga

SEQ ID NO: 49026 - RNA, 19 nt, Human
uggcauuuuugcucacagg

SEQ ID NO: 49027 - RNA, 21 nt, Human
ugggaaugagucacaguccug

SEQ ID NO: 49028 - RNA, 21 nt, Human
ugggacuacaggcacgugcca

SEQ ID NO: 49029 - RNA, 22 nt, Human
ugggacuacaggcacgugccac

SEQ ID NO: 49030 - RNA, 24 nt, Human
ugggacuacaggcacgugccacca

SEQ ID NO: 49031 - RNA, 18 nt, Human
ugggauuauaggagccac

SEQ ID NO: 49032 - RNA, 19 nt, Human
ugggcacacaucagacacc

SEQ ID NO: 49033 - RNA, 24 nt, Human
ugggcucaagugauccucccaccu

SEQ ID NO: 49034 - RNA, 19 nt, Human
ugggcuuaagugauccucu

SEQ ID NO: 49035 - RNA, 19 nt, Human
ugggggaaugggagggacu

SEQ ID NO: 49036 - RNA, 23 nt, Human
ugggugagcacagaguccacgug

SEQ ID NO: 49037 - RNA, 18 nt, Human
uguaagacuuaaagguua

SEQ ID NO: 49038 - RNA, 19 nt, Human
uguagcugggacuacaggc

SEQ ID NO: 49039 - RNA, 19 nt, Human
uguagcugggacuacaggc

SEQ ID NO: 49040 - RNA, 24 nt, Human
uguagcugggacuacaggcacgug

SEQ ID NO: 49041 - RNA, 20 nt, Human
ugugauaccuuccugaaaau

SEQ ID NO: 49042 - RNA, 25 nt, Human
uuaccuggucauucgguguauccag

SEQ ID NO: 49043 - RNA, 26 nt, Human
uucaggguccuccuucagguuggggc

SEQ ID NO: 49044 - RNA, 27 nt, Human
uucccugaaagcguucucuagagaugc

SEQ ID NO: 49045 - RNA, 24 nt, Human
uugaagccaauggcacugggaccc

SEQ ID NO: 49046 - RNA, 25 nt, Human
uugaagccaauggcacugggacccc

SEQ ID NO: 49047 - RNA, 21 nt, Human
uugggauuauaggagccacug

SEQ ID NO: 49048 - RNA, 25 nt, Human
aagcaguagcaaaggcgacuguagc

SEQ ID NO: 49049 - RNA, 21 nt, Human
aagcuuuuaauaaaacagucu

SEQ ID NO: 49050 - RNA, 23 nt, Human
aaggcagcuuugucccagcucug

SEQ ID NO: 49051 - RNA, 20 nt, Human
aauccccccuccccugccag

SEQ ID NO: 49052 - RNA, 22 nt, Human
acucggaccacauggagaccuc

SEQ ID NO: 49053 - RNA, 21 nt, Human
agaggaauagcagggccaccc

SEQ ID NO: 49054 - RNA, 20 nt, Human
agcaagagcucaaaaggcaa

SEQ ID NO: 49055 - RNA, 19 nt, Human
agcuuccccgccugugcuc

SEQ ID NO: 49056 - RNA, 18 nt, Human
agggauuggaacgagggc

SEQ ID NO: 49057 - RNA, 18 nt, Human
aggggacaggaguuccag

SEQ ID NO: 49058 - RNA, 21 nt, Human
caaaaaauaaauucucccuuc

SEQ ID NO: 49059 - RNA, 23 nt, Human
caaaaugggagccauguccugcc

SEQ ID NO: 49060 - RNA, 23 nt, Human
caaggcaauaucggaaaguguau

SEQ ID NO: 49061 - RNA, 19 nt, Human
cacacauccacgaacaaau

SEQ ID NO: 49062 - RNA, 21 nt, Human
caccaggacgagggccgucuc

SEQ ID NO: 49063 - RNA, 21 nt, Human
cagaaauaaauccccccuccc

SEQ ID NO: 49064 - RNA, 18 nt, Human
ccccccuccccugccagg

SEQ ID NO: 49065 - RNA, 27 nt, Human
ccccucaggggcaaggacggcagggau

SEQ ID NO: 49066 - RNA, 19 nt, Human
cccgccugugcucccucca

SEQ ID NO: 49067 - RNA, 25 nt, Human
cccggaaagcccagcggcaaaggca

SEQ ID NO: 49068 - RNA, 19 nt, Human
cccuaugccuaagaccccc

SEQ ID NO: 49069 - RNA, 19 nt, Human
cccuaugccuaagaccccu

SEQ ID NO: 49070 - RNA, 19 nt, Human
cccuccacagucccggaaa

SEQ ID NO: 49071 - RNA, 25 nt, Human
ccucagagcucacacauccacgaac

SEQ ID NO: 49072 - RNA, 19 nt, Human
ccucccuucaaaaugggag

SEQ ID NO: 49073 - RNA, 18 nt, Human
ccucuucuugucuggggc

SEQ ID NO: 49074 - RNA, 19 nt, Human
ccugccccaccaagcccug

SEQ ID NO: 49075 - RNA, 20 nt, Human
cgaacaaaugaaggcugagg

SEQ ID NO: 49076 - RNA, 21 nt, Human
cgaacaaaugaaggcugagga

SEQ ID NO: 49077 - RNA, 23 nt, Human
cgagggccgucucaccucacucg

SEQ ID NO: 49078 - RNA, 21 nt, Human
cggaaagcccagcggcaaagg

SEQ ID NO: 49079 - RNA, 18 nt, Human
cuaugccuaagaccccua

SEQ ID NO: 49080 - RNA, 19 nt, Human
cucaccucacucggaccac

SEQ ID NO: 49081 - RNA, 19 nt, Human
cucuggacugggccuccuc

SEQ ID NO: 49082 - RNA, 23 nt, Human
cuuucuguucucaugacuaaggg

SEQ ID NO: 49083 - RNA, 20 nt, Human
gaccucccuucaaaauggga

SEQ ID NO: 49084 - RNA, 18 nt, Human
gaucaggaacaccaggac

SEQ ID NO: 49085 - RNA, 22 nt, Human
gcagggauuggaacgagggcuc

SEQ ID NO: 49086 - RNA, 23 nt, Human
gcucuggacugggccuccucuca

SEQ ID NO: 49087 - RNA, 21 nt, Human
ggaacgagggcucuggaagga

SEQ ID NO: 49088 - RNA, 21 nt, Human
ggagguuucuaaaccuaaagu

SEQ ID NO: 49089 - RNA, 18 nt, Human
ggccuccucucagggcuc

SEQ ID NO: 49090 - RNA, 21 nt, Human
gggacaggaguuccagaagaa

SEQ ID NO: 49091 - RNA, 21 nt, Human
gggcggaggggaggccaccuc

SEQ ID NO: 49092 - RNA, 20 nt, Human
uaaauccccccuccccugcc

SEQ ID NO: 49093 - RNA, 20 nt, Human
uagaagaucuguuuauauau

SEQ ID NO: 49094 - RNA, 21 nt, Human
ucagagcucacacauccacga

SEQ ID NO: 49095 - RNA, 19 nt, Human
ucagggcucucugagaccg

SEQ ID NO: 49096 - RNA, 19 nt, Human
uccaggaaggucgggacuu

SEQ ID NO: 49097 - RNA, 24 nt, Human
uccaggaaggucgggacuuccuuc

SEQ ID NO: 49098 - RNA, 21 nt, Human
ucccagcucugccacccuccu

SEQ ID NO: 49099 - RNA, 22 nt, Human
uccccgccugugcucccuccac

SEQ ID NO: 49100 - RNA, 19 nt, Human
ucccuccacagucccggaa

SEQ ID NO: 49101 - RNA, 23 nt, Human
ucucuuaaagcaguagcaaaggc

SEQ ID NO: 49102 - RNA, 20 nt, Human
ucuuucagaaauaaaucccc

SEQ ID NO: 49103 - RNA, 24 nt, Human
ugaaaggaaauauugcacuuucug

SEQ ID NO: 49104 - RNA, 19 nt, Human
ugaaguggagcuuccccgc

SEQ ID NO: 49105 - RNA, 19 nt, Human
ugagggccucuucuugucu

SEQ ID NO: 49106 - RNA, 18 nt, Human
ugccuaagaccccuaugc

SEQ ID NO: 49107 - RNA, 19 nt, Human
ugcuggggacacuacaggc

SEQ ID NO: 49108 - RNA, 19 nt, Human
uggaacgagggcucuggaa

SEQ ID NO: 49109 - RNA, 24 nt, Human
ugucccagcucugccacccuccug

SEQ ID NO: 49110 - RNA, 20 nt, Human
uuccagaagaaccuuucaag

SEQ ID NO: 49111 - RNA, 25 nt, Human
uucucaugacuaaggggacaggagu

SEQ ID NO: 49112 - RNA, 28 nt, Human
caguggguugaaguccuuccccccuggg

SEQ ID NO: 49113 - RNA, 23 nt, Human
uggguugaaguccuucgacugcu

SEQ ID NO: 49114 - RNA, 18 nt, Human
aaaaggaaggcaaagaca

SEQ ID NO: 49115 - RNA, 22 nt, Human
aaacagauaugcacacaaagac

SEQ ID NO: 49116 - RNA, 25 nt, Human
aaaccaaagcccacggccucccacc

SEQ ID NO: 49117 - RNA, 24 nt, Human
aaagaucgcgccauugcacuccag

SEQ ID NO: 49118 - RNA, 22 nt, Human
aaagcauaccaugucccaggac

SEQ ID NO: 49119 - RNA, 23 nt, Human
aacauucuccugaaauauggcca

SEQ ID NO: 49120 - RNA, 18 nt, Human
aaccaaagcccacggccu

SEQ ID NO: 49121 - RNA, 22 nt, Human
aaccugcugcccagacagacag

SEQ ID NO: 49122 - RNA, 20 nt, Human
aaccugggguggagagcuga

SEQ ID NO: 49123 - RNA, 20 nt, Human
aagaaacuugcccaaaacca

SEQ ID NO: 49124 - RNA, 23 nt, Human
aagaaacuugcccaaaaccaggc

SEQ ID NO: 49125 - RNA, 19 nt, Human
aagaaagaaagucacuugc

SEQ ID NO: 49126 - RNA, 22 nt, Human
aagaagcagagacaagccaccc

SEQ ID NO: 49127 - RNA, 19 nt, Human
aagagaugcuccaugcccc

SEQ ID NO: 49128 - RNA, 21 nt, Human
aagauuuggcacauggaaaca

SEQ ID NO: 49129 - RNA, 19 nt, Human
aagcagagacaagccaccc

SEQ ID NO: 49130 - RNA, 23 nt, Human
aagcagagacaagccacccaagg

SEQ ID NO: 49131 - RNA, 21 nt, Human
aagcauggaauaggcacuccu

SEQ ID NO: 49132 - RNA, 19 nt, Human
aagguuccucuuccccacc

SEQ ID NO: 49133 - RNA, 20 nt, Human
aauugcuugaacccgggugg

SEQ ID NO: 49134 - RNA, 20 nt, Human
acaaaauauucccaggaaaa

SEQ ID NO: 49135 - RNA, 24 nt, Human
acaaaauauucccaggaaaaaaga

SEQ ID NO: 49136 - RNA, 23 nt, Human
acaaagaccaacaugcacacaca

SEQ ID NO: 49137 - RNA, 18 nt, Human
acaagaaacuugcccaaa

SEQ ID NO: 49138 - RNA, 21 nt, Human
acaccuguaaucccagcacuu

SEQ ID NO: 49139 - RNA, 23 nt, Human
acaccuguaaucccagcacuuug

SEQ ID NO: 49140 - RNA, 20 nt, Human
acagagugagacuccgucuc

SEQ ID NO: 49141 - RNA, 23 nt, Human
acagagugagacuccgucucaaa

SEQ ID NO: 49142 - RNA, 24 nt, Human
acagagugagacuccgucucaaaa

SEQ ID NO: 49143 - RNA, 19 nt, Human
accaacaaauucaggccag

SEQ ID NO: 49144 - RNA, 21 nt, Human
accaacugggugaggaaaggg

SEQ ID NO: 49145 - RNA, 23 nt, Human
accaaguagucucuuccuauccc

SEQ ID NO: 49146 - RNA, 19 nt, Human
acccagaaaccaggccucc

SEQ ID NO: 49147 - RNA, 23 nt, Human
acccagaaaccaggccuccacag

SEQ ID NO: 49148 - RNA, 18 nt, Human
acccagugagcacagagu

SEQ ID NO: 49149 - RNA, 20 nt, Human
acccagugagcacagagucc

SEQ ID NO: 49150 - RNA, 23 nt, Human
accccagccccaaagcauaccau

SEQ ID NO: 49151 - RNA, 21 nt, Human
accccauggcaccaaguaguc

SEQ ID NO: 49152 - RNA, 18 nt, Human
accccuccccugcuccca

SEQ ID NO: 49153 - RNA, 22 nt, Human
accccuccccugcucccaaagg

SEQ ID NO: 49154 - RNA, 19 nt, Human
acccucaccccuaccccau

SEQ ID NO: 49155 - RNA, 24 nt, Human
accucgucucuacuaaaaauacaa

SEQ ID NO: 49156 - RNA, 24 nt, Human
accugggcaucucucuacaucccc

SEQ ID NO: 49157 - RNA, 24 nt, Human
acuccagccugggugacagaguga

SEQ ID NO: 49158 - RNA, 23 nt, Human
acucccaaaccuagcaacucuuu

SEQ ID NO: 49159 - RNA, 23 nt, Human
acuugggagggcagguuugggau

SEQ ID NO: 49160 - RNA, 21 nt, Human
agaaagucacuugcauaaucc

SEQ ID NO: 49161 - RNA, 18 nt, Human
agaagacagaggcccaca

SEQ ID NO: 49162 - RNA, 19 nt, Human
agaagacagaggcccacag

SEQ ID NO: 49163 - RNA, 19 nt, Human
agacagaggcccacaggag

SEQ ID NO: 49164 - RNA, 18 nt, Human
agacagcaagagagcacu

SEQ ID NO: 49165 - RNA, 19 nt, Human
agacaggaagggaaucuag

SEQ ID NO: 49166 - RNA, 21 nt, Human
agacaggaagggaaucuagag

SEQ ID NO: 49167 - RNA, 18 nt, Human
agaccuggaaaacagaua

SEQ ID NO: 49168 - RNA, 19 nt, Human
agacgagcaugauccaagc

SEQ ID NO: 49169 - RNA, 21 nt, Human
agacgagcaugauccaagcaa

SEQ ID NO: 49170 - RNA, 18 nt, Human
agagaaacugaggcacca

SEQ ID NO: 49171 - RNA, 18 nt, Human
agagaugcuccaugcccc

SEQ ID NO: 49172 - RNA, 22 nt, Human
agagcuucucccuccucugcuc

SEQ ID NO: 49173 - RNA, 20 nt, Human
agagguugcagugagcaaag

SEQ ID NO: 49174 - RNA, 24 nt, Human
agagguugcagugagcaaagaucg

SEQ ID NO: 49175 - RNA, 21 nt, Human
agauaggaggauggcuuaagg

SEQ ID NO: 49176 - RNA, 20 nt, Human
agauaugcacacaaagacca

SEQ ID NO: 49177 - RNA, 20 nt, Human
agcauggaauaggcacuccu

SEQ ID NO: 49178 - RNA, 21 nt, Human
agccacccaaggcugaggucu

SEQ ID NO: 49179 - RNA, 19 nt, Human
agcccacggccucccaccu

SEQ ID NO: 49180 - RNA, 19 nt, Human
agcccuggccggccugcuc

SEQ ID NO: 49181 - RNA, 21 nt, Human
agcccuggccggccugcucuu

SEQ ID NO: 49182 - RNA, 23 nt, Human
agccuggccaagauggugaaacc

SEQ ID NO: 49183 - RNA, 24 nt, Human
agccugggugacagagugagacuc

SEQ ID NO: 49184 - RNA, 24 nt, Human
agcuccugaccugacauccccaca

SEQ ID NO: 49185 - RNA, 18 nt, Human
agcugaggagcaggagca

SEQ ID NO: 49186 - RNA, 21 nt, Human
aggaaaaaagagggaaaagaa

SEQ ID NO: 49187 - RNA, 20 nt, Human
aggaagagaugcuccaugcc

SEQ ID NO: 49188 - RNA, 19 nt, Human
aggagagaggcaaccuggg

SEQ ID NO: 49189 - RNA, 23 nt, Human
aggagcacaaggacucacauaga

SEQ ID NO: 49190 - RNA, 24 nt, Human
aggcacaguggcuuacaccuguaa

SEQ ID NO: 49191 - RNA, 24 nt, Human
aggcaggagaauugcuugaacccg

SEQ ID NO: 49192 - RNA, 28 nt, Human
aggccagagucaaggagguugcagggaa

SEQ ID NO: 49193 - RNA, 24 nt, Human
aggcgugguggcucacguccguaa

SEQ ID NO: 49194 - RNA, 22 nt, Human
agggagcuggugucagaagggg

SEQ ID NO: 49195 - RNA, 19 nt, Human
agggguaaaaggaaggcaa

SEQ ID NO: 49196 - RNA, 24 nt, Human
agguagaucacaaggucaggaguu

SEQ ID NO: 49197 - RNA, 25 nt, Human
aggugaacuuccagcuccugaccug

SEQ ID NO: 49198 - RNA, 24 nt, Human
aguggcuuacaccuguaaucccag

SEQ ID NO: 49199 - RNA, 23 nt, Human
auaaaaccaaagcccacggccuc

SEQ ID NO: 49200 - RNA, 22 nt, Human
aucacaaggucaggaguucaag

SEQ ID NO: 49201 - RNA, 19 nt, Human
aucacagccacugccacca

SEQ ID NO: 49202 - RNA, 24 nt, Human
aucgcgccauugcacuccagccug

SEQ ID NO: 49203 - RNA, 18 nt, Human
aucuggaccccgacgggg

SEQ ID NO: 49204 - RNA, 19 nt, Human
augaaguaccugauggccc

SEQ ID NO: 49205 - RNA, 19 nt, Human
augauccaagcacagccug

SEQ ID NO: 49206 - RNA, 21 nt, Human
auugcacuccagccuggguga

SEQ ID NO: 49207 - RNA, 24 nt, Human
auugcacuccagccugggugacag

SEQ ID NO: 49208 - RNA, 24 nt, Human
caaaaccaggcacaguggcuuaca

SEQ ID NO: 49209 - RNA, 25 nt, Human
caaaaccaggcacaguggcuuacac

SEQ ID NO: 49210 - RNA, 20 nt, Human
caaaccccagacaguucaag

SEQ ID NO: 49211 - RNA, 21 nt, Human
caacaggugagaacccaagac

SEQ ID NO: 49212 - RNA, 23 nt, Human
caacaggugagaacccaagacac

SEQ ID NO: 49213 - RNA, 21 nt, Human
caaccugggguggagagcuga

SEQ ID NO: 49214 - RNA, 19 nt, Human
caagaaacuugcccaaaac

SEQ ID NO: 49215 - RNA, 22 nt, Human
caagacaaagugaucuucaagc

SEQ ID NO: 49216 - RNA, 21 nt, Human
caagagagcacuggggcagag

SEQ ID NO: 49217 - RNA, 24 nt, Human
caagauggugaaaccucgucucua

SEQ ID NO: 49218 - RNA, 23 nt, Human
caagccacccaaggcugaggucu

SEQ ID NO: 49219 - RNA, 25 nt, Human
caaguagucucuuccuaucccuucc

SEQ ID NO: 49220 - RNA, 20 nt, Human
caagucuuuuccccuccuuc

SEQ ID NO: 49221 - RNA, 23 nt, Human
caagugcacugccugccccuucc

SEQ ID NO: 49222 - RNA, 20 nt, Human
caauacagcaagacccugcc

SEQ ID NO: 49223 - RNA, 20 nt, Human
cacacaaagaccaacaugca

SEQ ID NO: 49224 - RNA, 20 nt, Human
cacaguaccagugaggccag

SEQ ID NO: 49225 - RNA, 18 nt, Human
cacauagaccuggaaaac

SEQ ID NO: 49226 - RNA, 24 nt, Human
cacccaaggcugaggucuucccac

SEQ ID NO: 49227 - RNA, 18 nt, Human
cacccccacagugguuac

SEQ ID NO: 49228 - RNA, 20 nt, Human
caccugcaggugaacuucca

SEQ ID NO: 49229 - RNA, 23 nt, Human
caccuggcaagaagcagagacaa

SEQ ID NO: 49230 - RNA, 18 nt, Human
caccuguaaucccagcac

SEQ ID NO: 49231 - RNA, 19 nt, Human
caccuguaaucccagcacu

SEQ ID NO: 49232 - RNA, 18 nt, Human
caccuuggucccuucagc

SEQ ID NO: 49233 - RNA, 24 nt, Human
cacguccguaaucccagcacuuug

SEQ ID NO: 49234 - RNA, 22 nt, Human
cacuccagccugggugacagag

SEQ ID NO: 49235 - RNA, 24 nt, Human
cacuccagccugggugacagagug

SEQ ID NO: 49236 - RNA, 19 nt, Human
cacugccaccacuaguagc

SEQ ID NO: 49237 - RNA, 19 nt, Human
cacugccugccccuuccac

SEQ ID NO: 49238 - RNA, 18 nt, Human
cacuuuggaaggcccugg

SEQ ID NO: 49239 - RNA, 19 nt, Human
cagacagacagggaagggu

SEQ ID NO: 49240 - RNA, 23 nt, Human
cagacaguucaagugcuggcaug

SEQ ID NO: 49241 - RNA, 23 nt, Human
cagagacaagccacccaaggcug

SEQ ID NO: 49242 - RNA, 20 nt, Human
cagaggucccuuuguucccc

SEQ ID NO: 49243 - RNA, 21 nt, Human
cagcacuuuggaaggcccugg

SEQ ID NO: 49244 - RNA, 24 nt, Human
cagcacuuuggaaggcccuggcag

SEQ ID NO: 49245 - RNA, 18 nt, Human
cagcacuuugugaggccg

SEQ ID NO: 49246 - RNA, 24 nt, Human
cagcacuuugugaggccgagauag

SEQ ID NO: 49247 - RNA, 21 nt, Human
cagcuccugaccugacauccc

SEQ ID NO: 49248 - RNA, 19 nt, Human
caggacaagaaacuugccc

SEQ ID NO: 49249 - RNA, 19 nt, Human
caggguguggacaggcccu

SEQ ID NO: 49250 - RNA, 18 nt, Human
caguaccagugaggccag

SEQ ID NO: 49251 - RNA, 20 nt, Human
caugcuaccccagccccaaa

SEQ ID NO: 49252 - RNA, 19 nt, Human
cauugcacuccagccuggg

SEQ ID NO: 49253 - RNA, 21 nt, Human
cauugcacuccagccugggug

SEQ ID NO: 49254 - RNA, 22 nt, Human
cauugcacuccagccuggguga

SEQ ID NO: 49255 - RNA, 24 nt, Human
cauugcacuccagccugggugaca

SEQ ID NO: 49256 - RNA, 24 nt, Human
cauugcacuccagccugggugaca

SEQ ID NO: 49257 - RNA, 23 nt, Human
ccaaaccuagcaacucuggaaac

SEQ ID NO: 49258 - RNA, 19 nt, Human
ccaaagcauaccauguccc

SEQ ID NO: 49259 - RNA, 19 nt, Human
ccaaagcccacggccuccc

SEQ ID NO: 49260 - RNA, 20 nt, Human
ccaacaugcacacacaguua

SEQ ID NO: 49261 - RNA, 23 nt, Human
ccaccacuaguagcucauuaccu

SEQ ID NO: 49262 - RNA, 19 nt, Human
ccacccagugagcacagag

SEQ ID NO: 49263 - RNA, 26 nt, Human
ccacucccaaaccuagcaacucuuuu

SEQ ID NO: 49264 - RNA, 21 nt, Human
ccacugccaccacuaguagcu

SEQ ID NO: 49265 - RNA, 18 nt, Human
ccagcccucaaggcuuca

SEQ ID NO: 49266 - RNA, 26 nt, Human
ccagcuccugaccugacauccccaca

SEQ ID NO: 49267 - RNA, 20 nt, Human
ccauugcacuccagccuggg

SEQ ID NO: 49268 - RNA, 21 nt, Human
ccauugcacuccagccugggu

SEQ ID NO: 49269 - RNA, 21 nt, Human
ccauugcacuccagccugggu

SEQ ID NO: 49270 - RNA, 22 nt, Human
ccauugcacuccagccugggug

SEQ ID NO: 49271 - RNA, 24 nt, Human
ccauugcacuccagccugggugac

SEQ ID NO: 49272 - RNA, 24 nt, Human
cccaaaccuagcaacucuggaaac

SEQ ID NO: 49273 - RNA, 27 nt, Human
cccacacacaggcuugcucucugagca

SEQ ID NO: 49274 - RNA, 22 nt, Human
cccacucugaucuacuuauacc

SEQ ID NO: 49275 - RNA, 19 nt, Human
cccagaaaccaggccucca

SEQ ID NO: 49276 - RNA, 21 nt, Human
cccagacaguucaagugcugg

SEQ ID NO: 49277 - RNA, 24 nt, Human
cccagcacuuuggaaggcccuggc

SEQ ID NO: 49278 - RNA, 19 nt, Human
ccccaaagcauaccauguc

SEQ ID NO: 49279 - RNA, 20 nt, Human
ccccacacacaggcuugcuc

SEQ ID NO: 49280 - RNA, 30 nt, Human
ccccaucccacuccugugcaaccugggcaa

SEQ ID NO: 49281 - RNA, 20 nt, Human
cccccgaacggcacuuaggg

SEQ ID NO: 49282 - RNA, 23 nt, Human
ccccgccgcccccgcgggcuccg

SEQ ID NO: 49283 - RNA, 18 nt, Human
cccgccgcccccgcgggc

SEQ ID NO: 49284 - RNA, 19 nt, Human
cccgcgcguccuggccguc

SEQ ID NO: 49285 - RNA, 22 nt, Human
cccuuguuuuccagcuugaggg

SEQ ID NO: 49286 - RNA, 22 nt, Human
ccgccgcccccgcgggcuccgg

SEQ ID NO: 49287 - RNA, 18 nt, Human
ccgcgccugcccugggcc

SEQ ID NO: 49288 - RNA, 22 nt, Human
ccuaucccuuccuauccaggga

SEQ ID NO: 49289 - RNA, 23 nt, Human
ccucccaccuccugacuccucua

SEQ ID NO: 49290 - RNA, 24 nt, Human
ccuccccugcucccaaaggcugga

SEQ ID NO: 49291 - RNA, 23 nt, Human
ccucuguccaucaaaccccagac

SEQ ID NO: 49292 - RNA, 18 nt, Human
ccugauggcccauuuggu

SEQ ID NO: 49293 - RNA, 20 nt, Human
ccugccccuuccacucccaa

SEQ ID NO: 49294 - RNA, 23 nt, Human
ccugcccugggcccccgccccgc

SEQ ID NO: 49295 - RNA, 19 nt, Human
ccugcugggauguucccuu

SEQ ID NO: 49296 - RNA, 21 nt, Human
ccuggccaagauggugaaacc

SEQ ID NO: 49297 - RNA, 24 nt, Human
ccuggccaagauggugaaaccucg

SEQ ID NO: 49298 - RNA, 22 nt, Human
ccugggugacagagugagacuc

SEQ ID NO: 49299 - RNA, 19 nt, Human
ccuguaaucccagcuacuc

SEQ ID NO: 49300 - RNA, 21 nt, Human
ccuguaaucccagcuacucag

SEQ ID NO: 49301 - RNA, 22 nt, Human
ccuguaaucccagcuacucagg

SEQ ID NO: 49302 - RNA, 24 nt, Human
cgagcccgcgcguccuggccgucc

SEQ ID NO: 49303 - RNA, 26 nt, Human
cgccauugcacuccagccugggugac

SEQ ID NO: 49304 - RNA, 22 nt, Human
cggcuccgcgccugcccugggc

SEQ ID NO: 49305 - RNA, 23 nt, Human
cgguagguagccccuuguuuucc

SEQ ID NO: 49306 - RNA, 23 nt, Human
cguccguaaucccagcacuuugg

SEQ ID NO: 49307 - RNA, 23 nt, Human
cuacugaccccuccccugcuccc

SEQ ID NO: 49308 - RNA, 21 nt, Human
cuagaaacaugcuagacucag

SEQ ID NO: 49309 - RNA, 20 nt, Human
cuagaguucaaccuccuaac

SEQ ID NO: 49310 - RNA, 24 nt, Human
cuagcaacucuggaaacccuucuc

SEQ ID NO: 49311 - RNA, 24 nt, Human
cucacguccguaaucccagcacuu

SEQ ID NO: 49312 - RNA, 27 nt, Human
cucagcccugaaccugcugccgguucc

SEQ ID NO: 49313 - RNA, 26 nt, Human
cucauaaaauuacuuggagguaggca

SEQ ID NO: 49314 - RNA, 19 nt, Human
cucccaccuccugacuccu

SEQ ID NO: 49315 - RNA, 26 nt, Human
cuccgucucaaaaaaaaaaaauuagc

SEQ ID NO: 49316 - RNA, 21 nt, Human
cucuggaaacccuucuccucu

SEQ ID NO: 49317 - RNA, 18 nt, Human
cucuguccaucaaacccc

SEQ ID NO: 49318 - RNA, 18 nt, Human
cugaaauauggccaaagc

SEQ ID NO: 49319 - RNA, 19 nt, Human
cugaccccuccccugcucc

SEQ ID NO: 49320 - RNA, 18 nt, Human
cuggaaacccuucuccuc

SEQ ID NO: 49321 - RNA, 20 nt, Human
cuggccggccugcucuuugg

SEQ ID NO: 49322 - RNA, 22 nt, Human
cuuacaccuguaaucccagcac

SEQ ID NO: 49323 - RNA, 25 nt, Human
cuuccagcuccugaccugacauccc

SEQ ID NO: 49324 - RNA, 27 nt, Human
cuuccagcuccugaccugacaucuuac

SEQ ID NO: 49325 - RNA, 24 nt, Human
cuucugccagcccucaaggcuuca

SEQ ID NO: 49326 - RNA, 20 nt, Human
cuugaacccggguggcagag

SEQ ID NO: 49327 - RNA, 19 nt, Human
gaaaccucgucucuacuaa

SEQ ID NO: 49328 - RNA, 24 nt, Human
gaagacagaggcccacaggagaga

SEQ ID NO: 49329 - RNA, 21 nt, Human
gaagagaugcuccaugccccc

SEQ ID NO: 49330 - RNA, 21 nt, Human
gacagaggcccacaggagaga

SEQ ID NO: 49331 - RNA, 24 nt, Human
gagacuugggagggcagguuuggg

SEQ ID NO: 49332 - RNA, 21 nt, Human
gagagcagccugggcaauaca

SEQ ID NO: 49333 - RNA, 24 nt, Human
gagcugaggcaggagaauugcuug

SEQ ID NO: 49334 - RNA, 20 nt, Human
gaggauggcuuaaggcuagg

SEQ ID NO: 49335 - RNA, 18 nt, Human
gagguaggcaacaagggu

SEQ ID NO: 49336 - RNA, 22 nt, Human
gagguaggcaacaaggguaucc

SEQ ID NO: 49337 - RNA, 22 nt, Human
gaucacaaggucaggaguucaa

SEQ ID NO: 49338 - RNA, 24 nt, Human
gaucacaaggucaggaguucaaga

SEQ ID NO: 49339 - RNA, 21 nt, Human
gcaacaaggguauccccaauc

SEQ ID NO: 49340 - RNA, 19 nt, Human
gcaauacagcaagacccug

SEQ ID NO: 49341 - RNA, 23 nt, Human
gcacuccagccugggugacagag

SEQ ID NO: 49342 - RNA, 24 nt, Human
gcacuccagccugggugacagagu

SEQ ID NO: 49343 - RNA, 30 nt, Human
gcaggagcacaaggacucacauagaccugg

SEQ ID NO: 49344 - RNA, 19 nt, Human
gccauugcacuccagccug

SEQ ID NO: 49345 - RNA, 24 nt, Human
gccauugcacuccagccuggguga

SEQ ID NO: 49346 - RNA, 18 nt, Human
gccccaaagcauaccaug

SEQ ID NO: 49347 - RNA, 23 nt, Human
gccuguaaucccagcuacucagg

SEQ ID NO: 49348 - RNA, 20 nt, Human
gcgggcgccuguaaucccag

SEQ ID NO: 49349 - RNA, 19 nt, Human
gcuaccacaccccauccca

SEQ ID NO: 49350 - RNA, 21 nt, Human
ggaaaaaagagggaaaagaag

SEQ ID NO: 49351 - RNA, 21 nt, Human
ggaaacccuucuccucugccu

SEQ ID NO: 49352 - RNA, 21 nt, Human
ggaaauuccucagccucuguc

SEQ ID NO: 49353 - RNA, 24 nt, Human
ggaauaggcacuccucaugccugu

SEQ ID NO: 49354 - RNA, 21 nt, Human
ggacaagaaacuugcccaaaa

SEQ ID NO: 49355 - RNA, 20 nt, Human
ggcaacagaagaggaagaga

SEQ ID NO: 49356 - RNA, 22 nt, Human
ggcaagugcacugccugccccu

SEQ ID NO: 49357 - RNA, 19 nt, Human
ggcagacgagcaugaucca

SEQ ID NO: 49358 - RNA, 23 nt, Human
ggcagagguugcagugagcaaag

SEQ ID NO: 49359 - RNA, 18 nt, Human
ggcagagugaccugaucu

SEQ ID NO: 49360 - RNA, 21 nt, Human
ggcagguagaucacaagguca

SEQ ID NO: 49361 - RNA, 23 nt, Human
ggcagguagaucacaaggucagg

SEQ ID NO: 49362 - RNA, 20 nt, Human
ggccaagauggugaaaccuc

SEQ ID NO: 49363 - RNA, 21 nt, Human
ggccaggcgugguggcucacg

SEQ ID NO: 49364 - RNA, 18 nt, Human
ggcgugguggcgggcgcc

SEQ ID NO: 49365 - RNA, 23 nt, Human
ggcgugguggcgggcgccuguaa

SEQ ID NO: 49366 - RNA, 19 nt, Human
gggauauggcuggggacag

SEQ ID NO: 49367 - RNA, 23 nt, Human
gggcaagugcacugccugccccu

SEQ ID NO: 49368 - RNA, 20 nt, Human
gggcauggcuggcacugugg

SEQ ID NO: 49369 - RNA, 24 nt, Human
gggccaggcgugguggcucacguc

SEQ ID NO: 49370 - RNA, 24 nt, Human
gguggcgggcgccuguaaucccag

SEQ ID NO: 49371 - RNA, 24 nt, Human
gguggcucacguccguaaucccag

SEQ ID NO: 49372 - RNA, 21 nt, Human
guggcagagguugcagugagc

SEQ ID NO: 49373 - RNA, 25 nt, Human
guucaccauccucccccacccccac

SEQ ID NO: 49374 - RNA, 24 nt, Human
uaaaaccaaagcccacggccuccc

SEQ ID NO: 49375 - RNA, 27 nt, Human
uaaaaccaaagcccacggccucccacc

SEQ ID NO: 49376 - RNA, 20 nt, Human
uaagaaagaaagucacuugc

SEQ ID NO: 49377 - RNA, 24 nt, Human
uaagauuuggcacauggaaacauu

SEQ ID NO: 49378 - RNA, 24 nt, Human
uacaaaauauuguacaaaauauuc

SEQ ID NO: 49379 - RNA, 23 nt, Human
uacagacagagaaacugaggcac

SEQ ID NO: 49380 - RNA, 22 nt, Human
uaccagugaggccagacacccc

SEQ ID NO: 49381 - RNA, 21 nt, Human
uacccagaaaccaggccucca

SEQ ID NO: 49382 - RNA, 21 nt, Human
uaccugauggcccauuugguu

SEQ ID NO: 49383 - RNA, 24 nt, Human
uacugaccccuccccugcucccaa

SEQ ID NO: 49384 - RNA, 22 nt, Human
uagaucacaaggucaggaguuc

SEQ ID NO: 49385 - RNA, 19 nt, Human
uaugcacacaaagaccaac

SEQ ID NO: 49386 - RNA, 24 nt, Human
uaugcacacaaagaccaacaugca

SEQ ID NO: 49387 - RNA, 31 nt, Human
uaugcacacaaagaccaacaugcacacagug

SEQ ID NO: 49388 - RNA, 23 nt, Human
uauggccaaagcuggcuccccag

SEQ ID NO: 49389 - RNA, 24 nt, Human
ucacaaggucaggaguucaagacc

SEQ ID NO: 49390 - RNA, 21 nt, Human
ucagaggucccuuuguucccc

SEQ ID NO: 49391 - RNA, 23 nt, Human
uccagccugggugacagagugag

SEQ ID NO: 49392 - RNA, 24 nt, Human
uccagccugggugacagagugaga

SEQ ID NO: 49393 - RNA, 18 nt, Human
ucccaaaggcuggaagau

SEQ ID NO: 49394 - RNA, 19 nt, Human
ucccagaagacagaggccu

SEQ ID NO: 49395 - RNA, 21 nt, Human
uccccacacacaggcuugcuc

SEQ ID NO: 49396 - RNA, 19 nt, Human
ucccucugcuucugcuacu

SEQ ID NO: 49397 - RNA, 20 nt, Human
uccggccggccggccggccg

SEQ ID NO: 49398 - RNA, 21 nt, Human
uccuaucccuuccuauccagg

SEQ ID NO: 49399 - RNA, 23 nt, Human
ucgcgccauugcacuccagccug

SEQ ID NO: 49400 - RNA, 23 nt, Human
ucucuacuaaaaauacaaaaauu

SEQ ID NO: 49401 - RNA, 20 nt, Human
ucugagcauuuuucacagua

SEQ ID NO: 49402 - RNA, 23 nt, Human
ucuggcacugccccagcccuggc

SEQ ID NO: 49403 - RNA, 22 nt, Human
ugagaacccaagacacagucag

SEQ ID NO: 49404 - RNA, 20 nt, Human
ugaggaaagggacaauggua

SEQ ID NO: 49405 - RNA, 19 nt, Human
ugaggagcaggagcacaag

SEQ ID NO: 49406 - RNA, 22 nt, Human
ugaggcaccaacaaauucaggc

SEQ ID NO: 49407 - RNA, 24 nt, Human
ugaggcaggagaauugcuugaacc

SEQ ID NO: 49408 - RNA, 25 nt, Human
ugaggcaggagaauugcuugaaccc

SEQ ID NO: 49409 - RNA, 21 nt, Human
ugagggcagacgagcaugauc

SEQ ID NO: 49410 - RNA, 23 nt, Human
ugaucuacuuauacccucacccc

SEQ ID NO: 49411 - RNA, 19 nt, Human
ugcaaccugggcaucucuc

SEQ ID NO: 49412 - RNA, 22 nt, Human
ugcacuccagccugggugacag

SEQ ID NO: 49413 - RNA, 24 nt, Human
ugcacuccagccugggugacagag

SEQ ID NO: 49414 - RNA, 19 nt, Human
ugcacugccugccccuucc

SEQ ID NO: 49415 - RNA, 24 nt, Human
ugcaugaagaugcccaagggaggc

SEQ ID NO: 49416 - RNA, 19 nt, Human
ugcccaggaccagugcugg

SEQ ID NO: 49417 - RNA, 19 nt, Human
ugcccaggaccagugcugg

SEQ ID NO: 49418 - RNA, 20 nt, Human
ugcccaggaccagugcuggg

SEQ ID NO: 49419 - RNA, 18 nt, Human
ugcccugggcccccgccc

SEQ ID NO: 49420 - RNA, 21 nt, Human
ugcccugggcccccgccccgc

SEQ ID NO: 49421 - RNA, 22 nt, Human
ugcccugggcccccgccccgcc

SEQ ID NO: 49422 - RNA, 23 nt, Human
ugcuaccacaccccaucccacuc

SEQ ID NO: 49423 - RNA, 24 nt, Human
ugcucuuuggcaccugcaggugaa

SEQ ID NO: 49424 - RNA, 18 nt, Human
ugcugggauguucccuuu

SEQ ID NO: 49425 - RNA, 22 nt, Human
uggaaaacagauaugcacacaa

SEQ ID NO: 49426 - RNA, 19 nt, Human
uggaauaggcacuccucau

SEQ ID NO: 49427 - RNA, 18 nt, Human
uggagguaggcaacaagg

SEQ ID NO: 49428 - RNA, 21 nt, Human
uggcaacagaagaggaagaga

SEQ ID NO: 49429 - RNA, 22 nt, Human
uggcaacagaagaggaagagau

SEQ ID NO: 49430 - RNA, 23 nt, Human
uggcacugugguacggggaucca

SEQ ID NO: 49431 - RNA, 24 nt, Human
uggcagagguugcagugagcaaag

SEQ ID NO: 49432 - RNA, 24 nt, Human
uggcagguagaucacaaggucagg

SEQ ID NO: 49433 - RNA, 19 nt, Human
uggcauggagcacuggggc

SEQ ID NO: 49434 - RNA, 22 nt, Human
uggcgggcgccuguaaucccag

SEQ ID NO: 49435 - RNA, 22 nt, Human
uggcucacguccguaaucccag

SEQ ID NO: 49436 - RNA, 24 nt, Human
uggcucacguccguaaucccagca

SEQ ID NO: 49437 - RNA, 21 nt, Human
uggcuccccagagcuucuccc

SEQ ID NO: 49438 - RNA, 21 nt, Human
uggcuuacaccuguaauccca

SEQ ID NO: 49439 - RNA, 22 nt, Human
uggcuuacaccuguaaucccag

SEQ ID NO: 49440 - RNA, 24 nt, Human
uggcuuacaccuguaaucccagca

SEQ ID NO: 49441 - RNA, 20 nt, Human
ugggauguucccuuuugugg

SEQ ID NO: 49442 - RNA, 18 nt, Human
ugggccaggcgugguggc

SEQ ID NO: 49443 - RNA, 21 nt, Human
ugggccaggcgugguggcuca

SEQ ID NO: 49444 - RNA, 23 nt, Human
uggggacaggggaguagauuuuc

SEQ ID NO: 49445 - RNA, 23 nt, Human
uggggcagagugaccugaucugg

SEQ ID NO: 49446 - RNA, 20 nt, Human
ugguagggaaggaaggagau

SEQ ID NO: 49447 - RNA, 24 nt, Human
ugguggcgggcgccuguaauccca

SEQ ID NO: 49448 - RNA, 24 nt, Human
ugguggcucacguccguaauccca

SEQ ID NO: 49449 - RNA, 20 nt, Human
ugguugaugcaugaagaugc

SEQ ID NO: 49450 - RNA, 19 nt, Human
ugucagaaggggcaugagg

SEQ ID NO: 49451 - RNA, 18 nt, Human
ugucccaggacacuaucu

SEQ ID NO: 49452 - RNA, 18 nt, Human
uuagccgggcgugguggc

SEQ ID NO: 49453 - RNA, 22 nt, Human
uuagccgggcgugguggcgggc

SEQ ID NO: 49454 - RNA, 24 nt, Human
uuagccgggcgugguggcgggcgc

SEQ ID NO: 49455 - RNA, 24 nt, Human
uucacaguaccagugaggccagac

SEQ ID NO: 49456 - RNA, 24 nt, Human
uucaccauccucccccacccccac

SEQ ID NO: 49457 - RNA, 23 nt, Human
uugcaaaggcaagcauggaauag

SEQ ID NO: 49458 - RNA, 18 nt, Human
uugcuugaacccgggugg

SEQ ID NO: 49459 - RNA, 25 nt, Human
uuggucccuucagcugaauuugugg

SEQ ID NO: 49460 - RNA, 19 nt, Human
uugguugaugcaugaagau

SEQ ID NO: 49461 - RNA, 21 nt, Human
uugguugaugcaugaagaugc

SEQ ID NO: 49462 - RNA, 24 nt, Human
uuuguacaaaauauuguacaaaau

SEQ ID NO: 49463 - RNA, 22 nt, Human
uuuuccccuccuucugccauga

SEQ ID NO: 49464 - RNA, 18 nt, Human
aaaaagaaaauaccugca

SEQ ID NO: 49465 - RNA, 19 nt, Human
aaaaagaaaauaccugcag

SEQ ID NO: 49466 - RNA, 18 nt, Human
aaaaaguuuuggugugua

SEQ ID NO: 49467 - RNA, 18 nt, Human
aaaccuuccugacuugcc

SEQ ID NO: 49468 - RNA, 18 nt, Human
aagacacauccccaaaac

SEQ ID NO: 49469 - RNA, 19 nt, Human
aagcugccucauucaaagg

SEQ ID NO: 49470 - RNA, 24 nt, Human
aauaagccagaaaaccuuagguau

SEQ ID NO: 49471 - RNA, 21 nt, Human
acagagcuucuggccuccccu

SEQ ID NO: 49472 - RNA, 20 nt, Human
acagauuucaguauaguauu

SEQ ID NO: 49473 - RNA, 20 nt, Human
acagauuucaguauaguauu

SEQ ID NO: 49474 - RNA, 20 nt, Human
acagcucagcuuacuccccc

SEQ ID NO: 49475 - RNA, 20 nt, Human
acccuguuguuacaguuagg

SEQ ID NO: 49476 - RNA, 23 nt, Human
agacagguucaauuuucguuccc

SEQ ID NO: 49477 - RNA, 20 nt, Human
agagcauacacuggagggaa

SEQ ID NO: 49478 - RNA, 20 nt, Human
agauacgugugucugucaua

SEQ ID NO: 49479 - RNA, 19 nt, Human
agcacaguaagacacaucc

SEQ ID NO: 49480 - RNA, 21 nt, Human
agcacaguaagacacaucccc

SEQ ID NO: 49481 - RNA, 22 nt, Human
agcugaccccauaagcugaugc

SEQ ID NO: 49482 - RNA, 21 nt, Human
aggaaagaagagaugcacuca

SEQ ID NO: 49483 - RNA, 22 nt, Human
aggcccaccagggagagggagu

SEQ ID NO: 49484 - RNA, 20 nt, Human
agggcuggggagagggccuc

SEQ ID NO: 49485 - RNA, 26 nt, Human
agggcuggggagagggccucugggau

SEQ ID NO: 49486 - RNA, 22 nt, Human
aguaagacacauccccaaaacc

SEQ ID NO: 49487 - RNA, 20 nt, Human
auaaaacaaaaugacaccag

SEQ ID NO: 49488 - RNA, 25 nt, Human
auaaaacaaaaugacaccaguaauu

SEQ ID NO: 49489 - RNA, 24 nt, Human
caaaaugacaccaguaauuacuug

SEQ ID NO: 49490 - RNA, 21 nt, Human
caacaagucuggucagucacc

SEQ ID NO: 49491 - RNA, 21 nt, Human
caacaugcacagccaucugca

SEQ ID NO: 49492 - RNA, 21 nt, Human
caacucaucccaggaccccaa

SEQ ID NO: 49493 - RNA, 20 nt, Human
cacgacacagcacaggcaga

SEQ ID NO: 49494 - RNA, 19 nt, Human
cacugcuagaucuugagag

SEQ ID NO: 49495 - RNA, 24 nt, Human
cacugugccgccagcauccuccug

SEQ ID NO: 49496 - RNA, 19 nt, Human
cagcauccuccugugcauc

SEQ ID NO: 49497 - RNA, 18 nt, Human
cagcccggggcaacucau

SEQ ID NO: 49498 - RNA, 25 nt, Human
cagcccuucauguaaaaaguuuugg

SEQ ID NO: 49499 - RNA, 25 nt, Human
cagcccuucauguaaaaaguuuugg

SEQ ID NO: 49500 - RNA, 20 nt, Human
cagggccuggagggcaucug

SEQ ID NO: 49501 - RNA, 19 nt, Human
cauccagacugggcugacu

SEQ ID NO: 49502 - RNA, 19 nt, Human
caugcacagccaucugcau

SEQ ID NO: 49503 - RNA, 20 nt, Human
caugcacagccaucugcaug

SEQ ID NO: 49504 - RNA, 22 nt, Human
ccaccgccacccccgcacuuag

SEQ ID NO: 49505 - RNA, 25 nt, Human
ccaccgccacccccgcacuuagcug

SEQ ID NO: 49506 - RNA, 18 nt, Human
cccacagccagcugaccu

SEQ ID NO: 49507 - RNA, 22 nt, Human
cccccgugggccuaggccucug

SEQ ID NO: 49508 - RNA, 20 nt, Human
ccccgcacuuagcuguacuc

SEQ ID NO: 49509 - RNA, 23 nt, Human
ccccuuggugucuagaaaaacag

SEQ ID NO: 49510 - RNA, 20 nt, Human
cccuccaccgccacccccgc

SEQ ID NO: 49511 - RNA, 21 nt, Human
ccugacuugccaggagagccc

SEQ ID NO: 49512 - RNA, 24 nt, Human
ccugugcauccagacugggcugac

SEQ ID NO: 49513 - RNA, 23 nt, Human
cggggcaacucaucccaggaccc

SEQ ID NO: 49514 - RNA, 21 nt, Human
cguucccuccaccgccacccc

SEQ ID NO: 49515 - RNA, 21 nt, Human
cugagcacagcacagugcuuu

SEQ ID NO: 49516 - RNA, 24 nt, Human
cugagcacagcacagugcuuugcu

SEQ ID NO: 49517 - RNA, 18 nt, Human
cugauuccacuuaugugc

SEQ ID NO: 49518 - RNA, 25 nt, Human
cugauuccacuuaugugcagcacau

SEQ ID NO: 49519 - RNA, 21 nt, Human
cugcugcuccccgccuucuug

SEQ ID NO: 49520 - RNA, 21 nt, Human
gagcacagcacagugcuuugc

SEQ ID NO: 49521 - RNA, 25 nt, Human
gaugaggccaccgguuaagucuucc

SEQ ID NO: 49522 - RNA, 20 nt, Human
gcacaguaagacacaucccc

SEQ ID NO: 49523 - RNA, 19 nt, Human
gcagcccggggcaacucau

SEQ ID NO: 49524 - RNA, 18 nt, Human
gccaggcccaccagggag

SEQ ID NO: 49525 - RNA, 26 nt, Human
gccaugaaauuccuuuauacagcaag

SEQ ID NO: 49526 - RNA, 23 nt, Human
gcuugcuucagggaaggagacug

SEQ ID NO: 49527 - RNA, 21 nt, Human
ggaaagaagagaugcacucac

SEQ ID NO: 49528 - RNA, 20 nt, Human
ggagccucugcaugcaccca

SEQ ID NO: 49529 - RNA, 19 nt, Human
ggaggccccagggccugga

SEQ ID NO: 49530 - RNA, 22 nt, Human
ggccguuaaggaggccccaggg

SEQ ID NO: 49531 - RNA, 21 nt, Human
ggcguggggcggagagucuuc

SEQ ID NO: 49532 - RNA, 18 nt, Human
ggcuucccggccuuuucg

SEQ ID NO: 49533 - RNA, 18 nt, Human
gggagagggccucugggc

SEQ ID NO: 49534 - RNA, 18 nt, Human
gggcuggggagagggccu

SEQ ID NO: 49535 - RNA, 20 nt, Human
ggggagagggccucugggcc

SEQ ID NO: 49536 - RNA, 21 nt, Human
ggggccguuaaggaggcccca

SEQ ID NO: 49537 - RNA, 21 nt, Human
guaagacacauccccaaaacc

SEQ ID NO: 49538 - RNA, 20 nt, Human
guccgcacagcucuggcacc

SEQ ID NO: 49539 - RNA, 22 nt, Human
gugcaugugucugagaaauccu

SEQ ID NO: 49540 - RNA, 23 nt, Human
uaaaaaggcagagcauacacugg

SEQ ID NO: 49541 - RNA, 23 nt, Human
uaaaaaguuuugguguggccggu

SEQ ID NO: 49542 - RNA, 22 nt, Human
uaaaaaugaaacagcauuuuga

SEQ ID NO: 49543 - RNA, 24 nt, Human
uaaaacaaacaugccagacaaggc

SEQ ID NO: 49544 - RNA, 25 nt, Human
uaaaacaaacaugccagacaaggca

SEQ ID NO: 49545 - RNA, 22 nt, Human
uaagacacauccccaaaaccug

SEQ ID NO: 49546 - RNA, 18 nt, Human
uaaugaucuucucuucug

SEQ ID NO: 49547 - RNA, 19 nt, Human
uacugauuccacuuaugug

SEQ ID NO: 49548 - RNA, 19 nt, Human
uagaauacaccugcccuuc

SEQ ID NO: 49549 - RNA, 18 nt, Human
uaggccucuguccucucc

SEQ ID NO: 49550 - RNA, 19 nt, Human
uaggccucuguccucuccg

SEQ ID NO: 49551 - RNA, 24 nt, Human
uauaaccugaacacugaaaacuaa

SEQ ID NO: 49552 - RNA, 24 nt, Human
uauguuauauuagcaacagaaacc

SEQ ID NO: 49553 - RNA, 21 nt, Human
ucaaaaggauaaaaaccccau

SEQ ID NO: 49554 - RNA, 21 nt, Human
ucaauuuucguucccuccacc

SEQ ID NO: 49555 - RNA, 20 nt, Human
ucaucuuguaaaggcuccug

SEQ ID NO: 49556 - RNA, 19 nt, Human
ucccagauccaggagccuc

SEQ ID NO: 49557 - RNA, 21 nt, Human
ucccagauccaggagccucug

SEQ ID NO: 49558 - RNA, 20 nt, Human
uccgcacagcucuggcacca

SEQ ID NO: 49559 - RNA, 21 nt, Human
uccgcacagcucuggcaccag

SEQ ID NO: 49560 - RNA, 20 nt, Human
uccucaggacucuaucccca

SEQ ID NO: 49561 - RNA, 22 nt, Human
uccuccagugcagguccaaaga

SEQ ID NO: 49562 - RNA, 24 nt, Human
ucuaaacagacuccauuccuuucu

SEQ ID NO: 49563 - RNA, 18 nt, Human
ucuagaaaaacagaccuc

SEQ ID NO: 49564 - RNA, 21 nt, Human
ucuauaaccugaacacugaaa

SEQ ID NO: 49565 - RNA, 23 nt, Human
ucucaaagucagccccgaaccag

SEQ ID NO: 49566 - RNA, 19 nt, Human
ucuccagaaugcuugccuc

SEQ ID NO: 49567 - RNA, 21 nt, Human
ucuccagaaugcuugccucac

SEQ ID NO: 49568 - RNA, 21 nt, Human
ucugcaugccuuugggauugg

SEQ ID NO: 49569 - RNA, 21 nt, Human
ucugccaacacccucccccgu

SEQ ID NO: 49570 - RNA, 21 nt, Human
ucugggccugcugcuccaugg

SEQ ID NO: 49571 - RNA, 21 nt, Human
ucuuaauuugcagcccggggc

SEQ ID NO: 49572 - RNA, 23 nt, Human
ugaaacaaauguuacagaucuau

SEQ ID NO: 49573 - RNA, 20 nt, Human
ugaaacagcauuuugaaaca

SEQ ID NO: 49574 - RNA, 18 nt, Human
ugaaggacggcaggggag

SEQ ID NO: 49575 - RNA, 21 nt, Human
ugacuugccaggagagccccc

SEQ ID NO: 49576 - RNA, 21 nt, Human
ugcaugcacccaugcggagua

SEQ ID NO: 49577 - RNA, 22 nt, Human
uggaagucuguuuucaucaugu

SEQ ID NO: 49578 - RNA, 23 nt, Human
uggagaaggucacuguuuguuug

SEQ ID NO: 49579 - RNA, 19 nt, Human
uggagggcaucugucugcc

SEQ ID NO: 49580 - RNA, 25 nt, Human
uggagggcaucugucugccaacacc

SEQ ID NO: 49581 - RNA, 20 nt, Human
uggcucaguggcugcuucga

SEQ ID NO: 49582 - RNA, 20 nt, Human
ugggaaguugaagcacagua

SEQ ID NO: 49583 - RNA, 21 nt, Human
uggggagagggccucugggcc

SEQ ID NO: 49584 - RNA, 21 nt, Human
ugguguuuuucucucuaccug

SEQ ID NO: 49585 - RNA, 22 nt, Human
ugguguuuuucucucuaccugu

SEQ ID NO: 49586 - RNA, 18 nt, Human
ugguuaaaaaggcagagc

SEQ ID NO: 49587 - RNA, 22 nt, Human
uguaaaaaaggcaacuuaagcg

SEQ ID NO: 49588 - RNA, 25 nt, Human
ugucauaaaacaaaaugacaccagu

SEQ ID NO: 49589 - RNA, 20 nt, Human
ugucuagaaaaacagaccuc

SEQ ID NO: 49590 - RNA, 20 nt, Human
ugucugccaacacccucccc

SEQ ID NO: 49591 - RNA, 18 nt, Human
ugugcgugcccacaggcc

SEQ ID NO: 49592 - RNA, 24 nt, Human
ugugucugucauaaaacaaaauga

SEQ ID NO: 49593 - RNA, 21 nt, Human
uguuacagaccaggcacagag

SEQ ID NO: 49594 - RNA, 23 nt, Human
uguuaggaaauuuccucaauaag

SEQ ID NO: 49595 - RNA, 19 nt, Human
uguugccaugaaauuccuu

SEQ ID NO: 49596 - RNA, 18 nt, Human
uucaaaaggauaaaaacc

SEQ ID NO: 49597 - RNA, 19 nt, Human
uucaaauugcuaauuuaau

SEQ ID NO: 49598 - RNA, 22 nt, Human
uucccuccaccgccacccccgc

SEQ ID NO: 49599 - RNA, 19 nt, Human
uuccuugggaaguugaagc

SEQ ID NO: 49600 - RNA, 19 nt, Human
uuccuuucugguaagaaaa

SEQ ID NO: 49601 - RNA, 20 nt, Human
uuguugccaugaaauuccuu

SEQ ID NO: 49602 - RNA, 21 nt, Human
uuuuucucucuaccuguuuga

SEQ ID NO: 49603 - RNA, 22 nt, Human
aaaaaaaaaaaaaaacagaaag

SEQ ID NO: 49604 - RNA, 21 nt, Human
aaaaaaaaaaaaacagaaaga

SEQ ID NO: 49605 - RNA, 20 nt, Human
aaaaaaaaacagaaagaaaa

SEQ ID NO: 49606 - RNA, 21 nt, Human
aaaagaaauacaaaaaaaaaa

SEQ ID NO: 49607 - RNA, 25 nt, Human
aagcgccugggcgccgugcuucugc

SEQ ID NO: 49608 - RNA, 24 nt, Human
aauacaaaaaaaaaaaaaaacaga

SEQ ID NO: 49609 - RNA, 23 nt, Human
acaaaaaaaaaaaaaaacagaaa

SEQ ID NO: 49610 - RNA, 22 nt, Human
acccuggagcucugaaacgcac

SEQ ID NO: 49611 - RNA, 22 nt, Human
accucggcguccuugcgugcug

SEQ ID NO: 49612 - RNA, 23 nt, Human
agaaaggcauguccaggggcccc

SEQ ID NO: 49613 - RNA, 21 nt, Human
agacucagccgagcgcuagcg

SEQ ID NO: 49614 - RNA, 20 nt, Human
agcaggggcggagcuggggg

SEQ ID NO: 49615 - RNA, 20 nt, Human
agccacgcagccccuuccug

SEQ ID NO: 49616 - RNA, 23 nt, Human
agccggcgcagcuuggguacgca

SEQ ID NO: 49617 - RNA, 20 nt, Human
agcugggggcgguggcaaag

SEQ ID NO: 49618 - RNA, 18 nt, Human
agcugugcuuucgaaggg

SEQ ID NO: 49619 - RNA, 18 nt, Human
aggagaagggaggcccga

SEQ ID NO: 49620 - RNA, 21 nt, Human
aggagccgcagcgcugugagc

SEQ ID NO: 49621 - RNA, 21 nt, Human
aggaggaggagggggucacgg

SEQ ID NO: 49622 - RNA, 22 nt, Human
aggaggaggagggggucacggu

SEQ ID NO: 49623 - RNA, 24 nt, Human
aggaggaggagggggucacgguga

SEQ ID NO: 49624 - RNA, 24 nt, Human
aggaucaggagaggcgggggaagg

SEQ ID NO: 49625 - RNA, 18 nt, Human
aggcacgcgcgggccggc

SEQ ID NO: 49626 - RNA, 20 nt, Human
aggcauguccaggggccccg

SEQ ID NO: 49627 - RNA, 19 nt, Human
aggcgaagguuuggaggag

SEQ ID NO: 49628 - RNA, 23 nt, Human
aggcggacguggagaaaggcaug

SEQ ID NO: 49629 - RNA, 20 nt, Human
aggggguggaggguacggga

SEQ ID NO: 49630 - RNA, 19 nt, Human
agucgcugagcggugggag

SEQ ID NO: 49631 - RNA, 20 nt, Human
aguggugagggcuccaaagc

SEQ ID NO: 49632 - RNA, 23 nt, Human
auaaaagaaauacaaaaaaaaaa

SEQ ID NO: 49633 - RNA, 19 nt, Human
caaaaucccccaagaggcc

SEQ ID NO: 49634 - RNA, 24 nt, Human
caccaagacugcggcugcagccag

SEQ ID NO: 49635 - RNA, 20 nt, Human
cacccgcggugacuuaaacc

SEQ ID NO: 49636 - RNA, 22 nt, Human
cacugcuccgcggcugcagggg

SEQ ID NO: 49637 - RNA, 20 nt, Human
caggagcccugcgcuagggc

SEQ ID NO: 49638 - RNA, 19 nt, Human
caggagccgcagcgcugug

SEQ ID NO: 49639 - RNA, 22 nt, Human
caggagccgcagcgcugugagc

SEQ ID NO: 49640 - RNA, 21 nt, Human
ccaccuccuccaccaagacug

SEQ ID NO: 49641 - RNA, 22 nt, Human
ccccagggucccagccugaucu

SEQ ID NO: 49642 - RNA, 18 nt, Human
cccccggccuucccuggg

SEQ ID NO: 49643 - RNA, 21 nt, Human
ccccgcgccaagccacgcccc

SEQ ID NO: 49644 - RNA, 26 nt, Human
ccccgcgccaagccacgcccccggaa

SEQ ID NO: 49645 - RNA, 27 nt, Human
cccgcagccggaugcagguggaggagc

SEQ ID NO: 49646 - RNA, 21 nt, Human
cccgcccccgcgccaagccac

SEQ ID NO: 49647 - RNA, 22 nt, Human
cccgcccccgcgccaagccacg

SEQ ID NO: 49648 - RNA, 19 nt, Human
cccgcgccaagccacgccc

SEQ ID NO: 49649 - RNA, 18 nt, Human
cccggagggggugugggg

SEQ ID NO: 49650 - RNA, 25 nt, Human
ccgcagcgcugugagccacgcagcc

SEQ ID NO: 49651 - RNA, 23 nt, Human
ccuaggcugacccguugcaggag

SEQ ID NO: 49652 - RNA, 24 nt, Human
ccucaggagccgcagcgcugugag

SEQ ID NO: 49653 - RNA, 22 nt, Human
ccucugcaggugcggagccagg

SEQ ID NO: 49654 - RNA, 19 nt, Human
cgcaccgcgggcgccaggc

SEQ ID NO: 49655 - RNA, 21 nt, Human
cgccugggcgccgugcuucug

SEQ ID NO: 49656 - RNA, 21 nt, Human
cgcugugagccacgcagcccc

SEQ ID NO: 49657 - RNA, 18 nt, Human
cggcgcuaacaauucacc

SEQ ID NO: 49658 - RNA, 23 nt, Human
cggcggcagcgaugggugcgaag

SEQ ID NO: 49659 - RNA, 18 nt, Human
cggcugcagggggccugg

SEQ ID NO: 49660 - RNA, 18 nt, Human
cgggccggggguggcgga

SEQ ID NO: 49661 - RNA, 22 nt, Human
cggugguggucaccaccuccuu

SEQ ID NO: 49662 - RNA, 22 nt, Human
cuggccagaagcaucccucccg

SEQ ID NO: 49663 - RNA, 24 nt, Human
cuggccagaagcaucccucccgga

SEQ ID NO: 49664 - RNA, 22 nt, Human
cugggggcgguggcaaagaagg

SEQ ID NO: 49665 - RNA, 21 nt, Human
gaaggaggaggagggggucac

SEQ ID NO: 49666 - RNA, 20 nt, Human
gaagggucgcagcacacagu

SEQ ID NO: 49667 - RNA, 21 nt, Human
gacucagccgagcgcuagcgg

SEQ ID NO: 49668 - RNA, 21 nt, Human
gagaccugucagaguggucag

SEQ ID NO: 49669 - RNA, 20 nt, Human
gagcuugcggcggaccaagu

SEQ ID NO: 49670 - RNA, 22 nt, Human
gaggagaagggaggcccgaggc

SEQ ID NO: 49671 - RNA, 23 nt, Human
gaguccauuuggcucggagcuag

SEQ ID NO: 49672 - RNA, 21 nt, Human
gaugcagguggaggagcggug

SEQ ID NO: 49673 - RNA, 20 nt, Human
gcaccuggaagaucgcggcg

SEQ ID NO: 49674 - RNA, 18 nt, Human
gcagcgcugugagccacg

SEQ ID NO: 49675 - RNA, 23 nt, Human
gcccccggccuucccugggcgca

SEQ ID NO: 49676 - RNA, 18 nt, Human
gcccgaggccgcguggaa

SEQ ID NO: 49677 - RNA, 18 nt, Human
gcccugcgcuagggcucc

SEQ ID NO: 49678 - RNA, 18 nt, Human
gccgagcgcuagcggaca

SEQ ID NO: 49679 - RNA, 19 nt, Human
gccugguaggagcuuggca

SEQ ID NO: 49680 - RNA, 21 nt, Human
gcgaaguuagcagauguggcu

SEQ ID NO: 49681 - RNA, 20 nt, Human
gcgcacugcgauccagcguu

SEQ ID NO: 49682 - RNA, 19 nt, Human
gcgcagccuuugcucucca

SEQ ID NO: 49683 - RNA, 22 nt, Human
gcgcccccggccuucccugggc

SEQ ID NO: 49684 - RNA, 20 nt, Human
gcgccugggcgccgugcuuc

SEQ ID NO: 49685 - RNA, 18 nt, Human
gcgcgggccggcguggga

SEQ ID NO: 49686 - RNA, 19 nt, Human
gcggcugcagggggccugg

SEQ ID NO: 49687 - RNA, 20 nt, Human
gcuaaacgcaaaauccccca

SEQ ID NO: 49688 - RNA, 18 nt, Human
ggagaggcgggggaagga

SEQ ID NO: 49689 - RNA, 23 nt, Human
ggaggaggagggggucacgguga

SEQ ID NO: 49690 - RNA, 20 nt, Human
ggaggcagccggaggagggg

SEQ ID NO: 49691 - RNA, 18 nt, Human
ggcagcgaugggugcgaa

SEQ ID NO: 49692 - RNA, 21 nt, Human
ggccgccgcagucccgcagcc

SEQ ID NO: 49693 - RNA, 18 nt, Human
ggcgcacugcgauccagc

SEQ ID NO: 49694 - RNA, 21 nt, Human
ggcgcagccuuugcucuccaa

SEQ ID NO: 49695 - RNA, 18 nt, Human
ggcggcgcgccccgcgac

SEQ ID NO: 49696 - RNA, 18 nt, Human
gggaaggaaaaaguggug

SEQ ID NO: 49697 - RNA, 18 nt, Human
gggauggggagcaggggc

SEQ ID NO: 49698 - RNA, 22 nt, Human
gggccggcgggcgcccccggcc

SEQ ID NO: 49699 - RNA, 20 nt, Human
gggcgguggcaaagaaggag

SEQ ID NO: 49700 - RNA, 19 nt, Human
ggggaggcagccggaggag

SEQ ID NO: 49701 - RNA, 22 nt, Human
ggggaggcagccggaggagggg

SEQ ID NO: 49702 - RNA, 20 nt, Human
ggggcaaagggcaccuggaa

SEQ ID NO: 49703 - RNA, 22 nt, Human
ggguacgcagcggcaguggcuu

SEQ ID NO: 49704 - RNA, 21 nt, Human
uaguuaauuuggaggaagggg

SEQ ID NO: 49705 - RNA, 22 nt, Human
ucauagaggcagucaguuuccu

SEQ ID NO: 49706 - RNA, 22 nt, Human
ucccugggcgcacugcgaucca

SEQ ID NO: 49707 - RNA, 21 nt, Human
uccgcuguucuuuuuuaggca

SEQ ID NO: 49708 - RNA, 18 nt, Human
uccugggcucaggcuccu

SEQ ID NO: 49709 - RNA, 20 nt, Human
ucgggcggguccuggcugcu

SEQ ID NO: 49710 - RNA, 19 nt, Human
ugacagaugagccgcgucc

SEQ ID NO: 49711 - RNA, 20 nt, Human
ugagggcuccaaagccaaga

SEQ ID NO: 49712 - RNA, 24 nt, Human
ugagggcuccaaagccaagagcuc

SEQ ID NO: 49713 - RNA, 19 nt, Human
ugaucuauaagacgagguc

SEQ ID NO: 49714 - RNA, 21 nt, Human
ugcccaggggcaaagggcacc

SEQ ID NO: 49715 - RNA, 21 nt, Human
ugcgcuagggcucccuguagg

SEQ ID NO: 49716 - RNA, 18 nt, Human
ugcggauaucugaggcug

SEQ ID NO: 49717 - RNA, 20 nt, Human
uggagaggugguagccucgg

SEQ ID NO: 49718 - RNA, 19 nt, Human
uggcaaagaaggaggagga

SEQ ID NO: 49719 - RNA, 20 nt, Human
uggcuauuuguccucaggag

SEQ ID NO: 49720 - RNA, 20 nt, Human
uggggaggcagccggaggag

SEQ ID NO: 49721 - RNA, 21 nt, Human
ugggguuuuuuuuuuuuuuuu

SEQ ID NO: 49722 - RNA, 22 nt, Human
uuagcagauguggcuggaauca

SEQ ID NO: 49723 - RNA, 24 nt, Human
uuccagcuggccgcgccagccggu

SEQ ID NO: 49724 - RNA, 23 nt, Human
uuggaggagaagggaggcccgag

SEQ ID NO: 49725 - RNA, 21 nt, Human
uuuuuuguucuaaaaaaaauu

SEQ ID NO: 49726 - RNA, 23 nt, Human
uuuuuuuuuuuuuuuuguucuaa

SEQ ID NO: 49727 - RNA, 18 nt, Human
uuuuuuuuuuuuuuuuug

SEQ ID NO: 49728 - RNA, 23 nt, Human
uuuuuuuuuuuuuuuuuuguucu

SEQ ID NO: 49729 - RNA, 20 nt, Human
aaacaaaauaaacucaaaaa

SEQ ID NO: 49730 - RNA, 18 nt, Human
aacguugagcuuggugag

SEQ ID NO: 49731 - RNA, 23 nt, Human
aagcaauaaaaaugagaucuuaa

SEQ ID NO: 49732 - RNA, 21 nt, Human
aagcacaacagccaaauacaa

SEQ ID NO: 49733 - RNA, 18 nt, Human
aagucaaauaauacccaa

SEQ ID NO: 49734 - RNA, 19 nt, Human
aaugcaagugugugugcgc

SEQ ID NO: 49735 - RNA, 24 nt, Human
agaaacaaaauaaacucaaaaaca

SEQ ID NO: 49736 - RNA, 23 nt, Human
agacagaaacaaaauaaacucaa

SEQ ID NO: 49737 - RNA, 20 nt, Human
agagaggucgggucguaggg

SEQ ID NO: 49738 - RNA, 19 nt, Human
aggcagcgggguuuccagg

SEQ ID NO: 49739 - RNA, 20 nt, Human
aggcgucgugcccggcuggc

SEQ ID NO: 49740 - RNA, 18 nt, Human
agucagcuuccaggacca

SEQ ID NO: 49741 - RNA, 25 nt, Human
caauaaaaaugagaucuuaaccaca

SEQ ID NO: 49742 - RNA, 21 nt, Human
cagcuuccaggaccaacgccu

SEQ ID NO: 49743 - RNA, 24 nt, Human
caggaccaacgccuccacucccga

SEQ ID NO: 49744 - RNA, 19 nt, Human
ccccgaggccugggcacac

SEQ ID NO: 49745 - RNA, 20 nt, Human
ccccuggguggagggucggg

SEQ ID NO: 49746 - RNA, 18 nt, Human
cccgcucagugcagggag

SEQ ID NO: 49747 - RNA, 18 nt, Human
ccucacacacucuuugaa

SEQ ID NO: 49748 - RNA, 21 nt, Human
ccugcaugcaugugggcgagc

SEQ ID NO: 49749 - RNA, 24 nt, Human
cgaggccgaggccagcccugaagg

SEQ ID NO: 49750 - RNA, 19 nt, Human
cgggcuccuuccacggucu

SEQ ID NO: 49751 - RNA, 24 nt, Human
cugaaggcacuuguucuccaccac

SEQ ID NO: 49752 - RNA, 23 nt, Human
cuuccaggaccaacgccuccacu

SEQ ID NO: 49753 - RNA, 18 nt, Human
cuuggaaagcacaacagc

SEQ ID NO: 49754 - RNA, 18 nt, Human
gagacccccgaggccugg

SEQ ID NO: 49755 - RNA, 20 nt, Human
gagccccuaaacccgcucag

SEQ ID NO: 49756 - RNA, 19 nt, Human
gagcgaaagggaagaaugg

SEQ ID NO: 49757 - RNA, 25 nt, Human
ggacacugugacauagacagaaaca

SEQ ID NO: 49758 - RNA, 20 nt, Human
ggagaccccuggguggaggg

SEQ ID NO: 49759 - RNA, 21 nt, Human
gggcagcgggugggcgccgcc

SEQ ID NO: 49760 - RNA, 18 nt, Human
gucucgugggacguggga

SEQ ID NO: 49761 - RNA, 23 nt, Human
gucucuugggggacaggugggca

SEQ ID NO: 49762 - RNA, 18 nt, Human
gugcuuacauagagaggu

SEQ ID NO: 49763 - RNA, 19 nt, Human
gugugugugcgcaugugug

SEQ ID NO: 49764 - RNA, 21 nt, Human
ucacccacagcccacggggcg

SEQ ID NO: 49765 - RNA, 19 nt, Human
uccacacagaaguuagggc

SEQ ID NO: 49766 - RNA, 20 nt, Human
uccaggaccaacgccuccac

SEQ ID NO: 49767 - RNA, 23 nt, Human
uccaggaccaacgccuccacucc

SEQ ID NO: 49768 - RNA, 25 nt, Human
ucgugacaugcccccuucgcacccc

SEQ ID NO: 49769 - RNA, 22 nt, Human
ucuucggcuuugacgggcuccu

SEQ ID NO: 49770 - RNA, 18 nt, Human
ucuuugaaacguugagcu

SEQ ID NO: 49771 - RNA, 24 nt, Human
ugacauagacagaaacaaaauaaa

SEQ ID NO: 49772 - RNA, 23 nt, Human
ugacaugcccccuucgcaccccc

SEQ ID NO: 49773 - RNA, 21 nt, Human
ugaccacauaacaccacgucc

SEQ ID NO: 49774 - RNA, 22 nt, Human
ugacgggcuccuuccacggucu

SEQ ID NO: 49775 - RNA, 25 nt, Human
ugagacccccgaggccugggcacac

SEQ ID NO: 49776 - RNA, 20 nt, Human
ugcgggugggcaaugggggg

SEQ ID NO: 49777 - RNA, 18 nt, Human
ugcugucuuggccugcau

SEQ ID NO: 49778 - RNA, 21 nt, Human
ugggaaaaagcaauaaaaaug

SEQ ID NO: 49779 - RNA, 19 nt, Human
ugucucgugggacguggga

SEQ ID NO: 49780 - RNA, 22 nt, Human
ugugcgcaugugugcuuacaua

SEQ ID NO: 49781 - RNA, 21 nt, Human
ugugugcuuacauagagaggu

SEQ ID NO: 49782 - RNA, 21 nt, Human
uuugacgggcuccuuccacgg

SEQ ID NO: 49783 - RNA, 25 nt, Human
uuuuuuuuuuuuuugcaaccucgga

SEQ ID NO: 49784 - RNA, 18 nt, Human
uuuuuuuuuuuuuuuuug

SEQ ID NO: 49785 - RNA, 23 nt, Human
uuuuuuuuuuuuuuuuugcaacc

SEQ ID NO: 49786 - RNA, 26 nt, Human
cggcaggucagccccaaugugucucu

SEQ ID NO: 49787 - RNA, 21 nt, Human
gacagcagcggcaggucagcc

SEQ ID NO: 49788 - RNA, 20 nt, Human
ugacagcagcggcaggucag

SEQ ID NO: 49789 - RNA, 21 nt, Human
aaaaagaaacugagcuccuga

SEQ ID NO: 49790 - RNA, 22 nt, Human
aaaaagaaacugagcuccugaa

SEQ ID NO: 49791 - RNA, 21 nt, Human
aaagaaaauucuagaaaggcc

SEQ ID NO: 49792 - RNA, 21 nt, Human
aaagaaaauucuagaaaggcc

SEQ ID NO: 49793 - RNA, 22 nt, Human
aacaacaacagcaucugccgag

SEQ ID NO: 49794 - RNA, 22 nt, Human
aacaacaacagcaucugccgag

SEQ ID NO: 49795 - RNA, 24 nt, Human
aagaaagcaaaaagcagccuauuc

SEQ ID NO: 49796 - RNA, 24 nt, Human
aagaaagcaaaaagcagccuauuc

SEQ ID NO: 49797 - RNA, 18 nt, Human
aagaagaaagcaaaaagc

SEQ ID NO: 49798 - RNA, 18 nt, Human
aagaagaaagcaaaaagc

SEQ ID NO: 49799 - RNA, 23 nt, Human
aagcggcggucagugccaugcag

SEQ ID NO: 49800 - RNA, 23 nt, Human
aagcggcggucagugccaugcag

SEQ ID NO: 49801 - RNA, 23 nt, Human
aauccagagacccaagugaaaaa

SEQ ID NO: 49802 - RNA, 23 nt, Human
aauccagagacccaagugaaaaa

SEQ ID NO: 49803 - RNA, 21 nt, Human
aaugccacaugaagccaggag

SEQ ID NO: 49804 - RNA, 21 nt, Human
aaugccacaugaagccaggag

SEQ ID NO: 49805 - RNA, 19 nt, Human
acagaagagaggcagcacg

SEQ ID NO: 49806 - RNA, 19 nt, Human
acagaagagaggcagcacg

SEQ ID NO: 49807 - RNA, 21 nt, Human
accaagggccuguugggccca

SEQ ID NO: 49808 - RNA, 21 nt, Human
accaagggccuguugggccca

SEQ ID NO: 49809 - RNA, 23 nt, Human
agaaagcaaaaagcagccuauuc

SEQ ID NO: 49810 - RNA, 23 nt, Human
agaaagcaaaaagcagccuauuc

SEQ ID NO: 49811 - RNA, 19 nt, Human
agccaaagcugcagaagcc

SEQ ID NO: 49812 - RNA, 19 nt, Human
agccaaagcugcagaagcc

SEQ ID NO: 49813 - RNA, 24 nt, Human
agcucugagcccuuuuccagccuc

SEQ ID NO: 49814 - RNA, 24 nt, Human
agcucugagcccuuuuccagccuc

SEQ ID NO: 49815 - RNA, 23 nt, Human
agcuggaagcggcggucagugcc

SEQ ID NO: 49816 - RNA, 23 nt, Human
agcuggaagcggcggucagugcc

SEQ ID NO: 49817 - RNA, 20 nt, Human
aggcagcacgcuugcccgcg

SEQ ID NO: 49818 - RNA, 20 nt, Human
aggcagcacgcuugcccgcg

SEQ ID NO: 49819 - RNA, 19 nt, Human
agggaaguaacaacaacag

SEQ ID NO: 49820 - RNA, 19 nt, Human
agggaaguaacaacaacag

SEQ ID NO: 49821 - RNA, 20 nt, Human
aggggcaggguggggugggg

SEQ ID NO: 49822 - RNA, 20 nt, Human
aggggcaggguggggugggg

SEQ ID NO: 49823 - RNA, 23 nt, Human
aguaggggccucaguggggcuug

SEQ ID NO: 49824 - RNA, 18 nt, Human
agucauugcauauguggg

SEQ ID NO: 49825 - RNA, 18 nt, Human
agucauugcauauguggg

SEQ ID NO: 49826 - RNA, 21 nt, Human
agugggauccgagguggcucg

SEQ ID NO: 49827 - RNA, 21 nt, Human
agugggauccgagguggcucg

SEQ ID NO: 49828 - RNA, 22 nt, Human
aucacaacuagggcaucuuucu

SEQ ID NO: 49829 - RNA, 22 nt, Human
aucacaacuagggcaucuuucu

SEQ ID NO: 49830 - RNA, 20 nt, Human
augccacaugaagccaggag

SEQ ID NO: 49831 - RNA, 23 nt, Human
caaaacgacacagaagagaggca

SEQ ID NO: 49832 - RNA, 23 nt, Human
caaaacgacacagaagagaggca

SEQ ID NO: 49833 - RNA, 20 nt, Human
caacaaaacgacacagaaga

SEQ ID NO: 49834 - RNA, 20 nt, Human
caacaaaacgacacagaaga

SEQ ID NO: 49835 - RNA, 19 nt, Human
caacaggagggacggcagg

SEQ ID NO: 49836 - RNA, 19 nt, Human
caacaggagggacggcagg

SEQ ID NO: 49837 - RNA, 22 nt, Human
caagcagagacagaauguggug

SEQ ID NO: 49838 - RNA, 22 nt, Human
caagcagagacagaauguggug

SEQ ID NO: 49839 - RNA, 21 nt, Human
cagaagccuucaguaccuucc

SEQ ID NO: 49840 - RNA, 21 nt, Human
cagaagccuucaguaccuucc

SEQ ID NO: 49841 - RNA, 18 nt, Human
cagagcacagacguggcc

SEQ ID NO: 49842 - RNA, 18 nt, Human
cagagcacagacguggcc

SEQ ID NO: 49843 - RNA, 22 nt, Human
cagcaucacugucaucuccagu

SEQ ID NO: 49844 - RNA, 21 nt, Human
cagcaucuggcccagaccugc

SEQ ID NO: 49845 - RNA, 21 nt, Human
cagcaucuggcccagaccugc

SEQ ID NO: 49846 - RNA, 19 nt, Human
cagcucugagcccuuuucc

SEQ ID NO: 49847 - RNA, 19 nt, Human
cagcucugagcccuuuucc

SEQ ID NO: 49848 - RNA, 20 nt, Human
caucaggggacagaucgggg

SEQ ID NO: 49849 - RNA, 18 nt, Human
caucuuucuggcugaguu

SEQ ID NO: 49850 - RNA, 18 nt, Human
caucuuucuggcugaguu

SEQ ID NO: 49851 - RNA, 19 nt, Human
ccacaugaagccaggaguc

SEQ ID NO: 49852 - RNA, 19 nt, Human
ccacaugaagccaggaguc

SEQ ID NO: 49853 - RNA, 24 nt, Human
ccaccggggcugggucuggggcug

SEQ ID NO: 49854 - RNA, 24 nt, Human
ccaccucgaguuaccuuugaucac

SEQ ID NO: 49855 - RNA, 24 nt, Human
ccaccucgaguuaccuuugaucac

SEQ ID NO: 49856 - RNA, 23 nt, Human
ccaccucggccggcgagcgcgcc

SEQ ID NO: 49857 - RNA, 25 nt, Human
ccagccucuuggagggaaguaacaa

SEQ ID NO: 49858 - RNA, 25 nt, Human
ccagccucuuggagggaaguaacaa

SEQ ID NO: 49859 - RNA, 20 nt, Human
ccagggucgcuccggacagg

SEQ ID NO: 49860 - RNA, 20 nt, Human
ccagggucgcuccggacagg

SEQ ID NO: 49861 - RNA, 23 nt, Human
ccaucaaugacggugaugucgag

SEQ ID NO: 49862 - RNA, 23 nt, Human
ccaucaaugacggugaugucgag

SEQ ID NO: 49863 - RNA, 18 nt, Human
cccacaucuggcaccagc

SEQ ID NO: 49864 - RNA, 18 nt, Human
cccacaucuggcaccagc

SEQ ID NO: 49865 - RNA, 23 nt, Human
cccagcaucuggcccagaccugc

SEQ ID NO: 49866 - RNA, 19 nt, Human
ccccagggcuacccuccac

SEQ ID NO: 49867 - RNA, 19 nt, Human
ccccagggcuacccuccac

SEQ ID NO: 49868 - RNA, 23 nt, Human
ccccugaagccucccccaaauaa

SEQ ID NO: 49869 - RNA, 23 nt, Human
ccccugaagccucccccaaauaa

SEQ ID NO: 49870 - RNA, 22 nt, Human
cccuccugauauaccuucccua

SEQ ID NO: 49871 - RNA, 22 nt, Human
cccuccugauauaccuucccua

SEQ ID NO: 49872 - RNA, 19 nt, Human
ccgcggcggcccccuccuc

SEQ ID NO: 49873 - RNA, 22 nt, Human
ccggcgcggcgggcgagacggg

SEQ ID NO: 49874 - RNA, 24 nt, Human
ccuagucaggcugguaccggcacc

SEQ ID NO: 49875 - RNA, 24 nt, Human
ccuagucaggcugguaccggcacc

SEQ ID NO: 49876 - RNA, 21 nt, Human
ccuaugacaggaauccagaga

SEQ ID NO: 49877 - RNA, 21 nt, Human
ccuaugacaggaauccagaga

SEQ ID NO: 49878 - RNA, 22 nt, Human
ccuaugacaggaauccagagac

SEQ ID NO: 49879 - RNA, 22 nt, Human
ccuaugacaggaauccagagac

SEQ ID NO: 49880 - RNA, 18 nt, Human
ccuccuccuucucuaaca

SEQ ID NO: 49881 - RNA, 23 nt, Human
ccucuaggcggagggcuuggcuu

SEQ ID NO: 49882 - RNA, 23 nt, Human
ccucuaggcggagggcuuggcuu

SEQ ID NO: 49883 - RNA, 19 nt, Human
ccugcggcucagaggaagc

SEQ ID NO: 49884 - RNA, 19 nt, Human
ccugcggcucagaggaagc

SEQ ID NO: 49885 - RNA, 19 nt, Human
cgacacagaagagaggcag

SEQ ID NO: 49886 - RNA, 19 nt, Human
cgacacagaagagaggcag

SEQ ID NO: 49887 - RNA, 24 nt, Human
cggcucagaggaagcuggaagcgg

SEQ ID NO: 49888 - RNA, 24 nt, Human
cggcucagaggaagcuggaagcgg

SEQ ID NO: 49889 - RNA, 22 nt, Human
cggggacgcuggcagagccagg

SEQ ID NO: 49890 - RNA, 22 nt, Human
cggggacgcuggcagagccagg

SEQ ID NO: 49891 - RNA, 24 nt, Human
cuccaccucgaguuaccuuugauc

SEQ ID NO: 49892 - RNA, 24 nt, Human
cuccaccucgaguuaccuuugauc

SEQ ID NO: 49893 - RNA, 22 nt, Human
cuccaguagucggcuccggcac

SEQ ID NO: 49894 - RNA, 19 nt, Human
cuccccccuguggggagag

SEQ ID NO: 49895 - RNA, 19 nt, Human
cuccccccuguggggagag

SEQ ID NO: 49896 - RNA, 18 nt, Human
cuccugaaucugauucug

SEQ ID NO: 49897 - RNA, 18 nt, Human
cuccugaaucugauucug

SEQ ID NO: 49898 - RNA, 20 nt, Human
cugcagaagccuucaguacc

SEQ ID NO: 49899 - RNA, 19 nt, Human
cuggcccagaccugccucu

SEQ ID NO: 49900 - RNA, 19 nt, Human
cuggcccagaccugccucu

SEQ ID NO: 49901 - RNA, 22 nt, Human
cuggcccagaccugccucuuca

SEQ ID NO: 49902 - RNA, 22 nt, Human
cuggcccagaccugccucuuca

SEQ ID NO: 49903 - RNA, 25 nt, Human
cugggguuuccugcccagcaucugg

SEQ ID NO: 49904 - RNA, 25 nt, Human
cugggguuuccugcccagcaucugg

SEQ ID NO: 49905 - RNA, 20 nt, Human
cuguugggcccacacaagcu

SEQ ID NO: 49906 - RNA, 20 nt, Human
cuguugggcccacacaagcu

SEQ ID NO: 49907 - RNA, 20 nt, Human
gaccugccucuucaaggccg

SEQ ID NO: 49908 - RNA, 20 nt, Human
gaccugccucuucaaggccg

SEQ ID NO: 49909 - RNA, 19 nt, Human
gacuuagugccuccccccu

SEQ ID NO: 49910 - RNA, 19 nt, Human
gacuuagugccuccccccu

SEQ ID NO: 49911 - RNA, 21 nt, Human
gaggggaccucuaggcggagg

SEQ ID NO: 49912 - RNA, 21 nt, Human
gaggggaccucuaggcggagg

SEQ ID NO: 49913 - RNA, 19 nt, Human
gagguggcucggcccauca

SEQ ID NO: 49914 - RNA, 19 nt, Human
gagguggcucggcccauca

SEQ ID NO: 49915 - RNA, 22 nt, Human
gccaaagcugcagaagccuuca

SEQ ID NO: 49916 - RNA, 22 nt, Human
gccaaagcugcagaagccuuca

SEQ ID NO: 49917 - RNA, 19 nt, Human
gccucaguggggcuugggg

SEQ ID NO: 49918 - RNA, 21 nt, Human
gcugcagaagccuucaguacc

SEQ ID NO: 49919 - RNA, 20 nt, Human
gcuggcucggggcuggccuc

SEQ ID NO: 49920 - RNA, 21 nt, Human
ggacaaggggcaggguggggu

SEQ ID NO: 49921 - RNA, 21 nt, Human
ggacaaggggcaggguggggu

SEQ ID NO: 49922 - RNA, 21 nt, Human
ggacagagcacagacguggcc

SEQ ID NO: 49923 - RNA, 21 nt, Human
ggacagagcacagacguggcc

SEQ ID NO: 49924 - RNA, 18 nt, Human
ggaggggaagccaagcag

SEQ ID NO: 49925 - RNA, 18 nt, Human
ggaggggaagccaagcag

SEQ ID NO: 49926 - RNA, 24 nt, Human
ggcaacaaaacgacacagaagaga

SEQ ID NO: 49927 - RNA, 24 nt, Human
ggcaacaaaacgacacagaagaga

SEQ ID NO: 49928 - RNA, 19 nt, Human
gggcagggugggguggggc

SEQ ID NO: 49929 - RNA, 24 nt, Human
gggccccagggcuacccuccaccu

SEQ ID NO: 49930 - RNA, 24 nt, Human
gggccccagggcuacccuccaccu

SEQ ID NO: 49931 - RNA, 24 nt, Human
gggccuguugggcccacacaagcu

SEQ ID NO: 49932 - RNA, 24 nt, Human
gggccuguugggcccacacaagcu

SEQ ID NO: 49933 - RNA, 19 nt, Human
ggggcaggguggggugggg

SEQ ID NO: 49934 - RNA, 19 nt, Human
ggggcaggguggggugggg

SEQ ID NO: 49935 - RNA, 22 nt, Human
gggguaaaggaggggauaaagg

SEQ ID NO: 49936 - RNA, 22 nt, Human
ggucagugccaugcagcagccu

SEQ ID NO: 49937 - RNA, 19 nt, Human
gguuccugcucagcagcuc

SEQ ID NO: 49938 - RNA, 25 nt, Human
guaccggcaccuccugaaauggguc

SEQ ID NO: 49939 - RNA, 26 nt, Human
guaccggcaccuccugaaauggguca

SEQ ID NO: 49940 - RNA, 19 nt, Human
gucaccugagacuuuaggg

SEQ ID NO: 49941 - RNA, 19 nt, Human
gucaccugagacuuuaggg

SEQ ID NO: 49942 - RNA, 19 nt, Human
gugcgcucgugcuccaccu

SEQ ID NO: 49943 - RNA, 21 nt, Human
guggugcgcccucggcggacu

SEQ ID NO: 49944 - RNA, 19 nt, Human
uaaaggaggggauaaagga

SEQ ID NO: 49945 - RNA, 19 nt, Human
uaaaggaggggauaaagga

SEQ ID NO: 49946 - RNA, 18 nt, Human
uaagcuaaauuguaaacc

SEQ ID NO: 49947 - RNA, 18 nt, Human
uaagcuaaauuguaaacc

SEQ ID NO: 49948 - RNA, 24 nt, Human
uacaaaagugaaaauuaaaaguca

SEQ ID NO: 49949 - RNA, 24 nt, Human
uacaaaagugaaaauuaaaaguca

SEQ ID NO: 49950 - RNA, 20 nt, Human
uacaaaggauuaaacuacaa

SEQ ID NO: 49951 - RNA, 20 nt, Human
uacaaaggauuaaacuacaa

SEQ ID NO: 49952 - RNA, 19 nt, Human
uaccaagggccuguugggc

SEQ ID NO: 49953 - RNA, 19 nt, Human
uaccaagggccuguugggc

SEQ ID NO: 49954 - RNA, 23 nt, Human
uagguuccuaacacgugcgcucg

SEQ ID NO: 49955 - RNA, 22 nt, Human
uauauagauuuaagugagauca

SEQ ID NO: 49956 - RNA, 22 nt, Human
uauauagauuuaagugagauca

SEQ ID NO: 49957 - RNA, 20 nt, Human
uauaugcaacuauauuucau

SEQ ID NO: 49958 - RNA, 20 nt, Human
uauaugcaacuauauuucau

SEQ ID NO: 49959 - RNA, 19 nt, Human
ucagaaaggacgggguacg

SEQ ID NO: 49960 - RNA, 18 nt, Human
ucagugggauccgaggug

SEQ ID NO: 49961 - RNA, 18 nt, Human
ucagugggauccgaggug

SEQ ID NO: 49962 - RNA, 20 nt, Human
ucuagaaaggccucuucccc

SEQ ID NO: 49963 - RNA, 20 nt, Human
ucuagaaaggccucuucccc

SEQ ID NO: 49964 - RNA, 19 nt, Human
ucuaugggcuuccuccucc

SEQ ID NO: 49965 - RNA, 19 nt, Human
ucuuucuggcugaguuaag

SEQ ID NO: 49966 - RNA, 19 nt, Human
ucuuucuggcugaguuaag

SEQ ID NO: 49967 - RNA, 22 nt, Human
ugaaaaagaaacugagcuccug

SEQ ID NO: 49968 - RNA, 19 nt, Human
ugacgugcagccaaagcug

SEQ ID NO: 49969 - RNA, 19 nt, Human
ugacgugcagccaaagcug

SEQ ID NO: 49970 - RNA, 24 nt, Human
ugagaacaguccccugaagccucc

SEQ ID NO: 49971 - RNA, 24 nt, Human
ugagaacaguccccugaagccucc

SEQ ID NO: 49972 - RNA, 18 nt, Human
ugagcccacaucuggcac

SEQ ID NO: 49973 - RNA, 18 nt, Human
ugagcccacaucuggcac

SEQ ID NO: 49974 - RNA, 19 nt, Human
ugaggcucaggagggugac

SEQ ID NO: 49975 - RNA, 19 nt, Human
ugaggcucaggagggugac

SEQ ID NO: 49976 - RNA, 22 nt, Human
ugaguaaaacauguuacacugg

SEQ ID NO: 49977 - RNA, 22 nt, Human
ugaguaaaacauguuacacugg

SEQ ID NO: 49978 - RNA, 21 nt, Human
ugcagccaaagcugcagaagc

SEQ ID NO: 49979 - RNA, 21 nt, Human
ugcagccaaagcugcagaagc

SEQ ID NO: 49980 - RNA, 25 nt, Human
ugcccagcaucuggcccagaccugc

SEQ ID NO: 49981 - RNA, 23 nt, Human
ugcccgcguagcaggcccugcgg

SEQ ID NO: 49982 - RNA, 23 nt, Human
ugcccgcguagcaggcccugcgg

SEQ ID NO: 49983 - RNA, 19 nt, Human
ugccucuucaaggccgcug

SEQ ID NO: 49984 - RNA, 19 nt, Human
ugccucuucaaggccgcug

SEQ ID NO: 49985 - RNA, 20 nt, Human
ugccuuggcaacaaaacgac

SEQ ID NO: 49986 - RNA, 20 nt, Human
ugccuuggcaacaaaacgac

SEQ ID NO: 49987 - RNA, 20 nt, Human
uggcagagccagggucgcuc

SEQ ID NO: 49988 - RNA, 20 nt, Human
uggcagagccagggucgcuc

SEQ ID NO: 49989 - RNA, 25 nt, Human
uggcagcaucacugucaucuccagu

SEQ ID NO: 49990 - RNA, 18 nt, Human
uggcccagaccugccucu

SEQ ID NO: 49991 - RNA, 18 nt, Human
uggcccagaccugccucu

SEQ ID NO: 49992 - RNA, 22 nt, Human
uggcucggcccaucaugcccag

SEQ ID NO: 49993 - RNA, 22 nt, Human
uggcucggcccaucaugcccag

SEQ ID NO: 49994 - RNA, 20 nt, Human
uggcucggggcuggccucag

SEQ ID NO: 49995 - RNA, 21 nt, Human
uggggcugcugagcacacacu

SEQ ID NO: 49996 - RNA, 21 nt, Human
uggggcugcugagcacacacu

SEQ ID NO: 49997 - RNA, 23 nt, Human
ugggggucuaugggcuuccuccu

SEQ ID NO: 49998 - RNA, 19 nt, Human
ugggguggggcugcugagc

SEQ ID NO: 49999 - RNA, 19 nt, Human
ugggguggggcugcugagc

SEQ ID NO: 50000 - RNA, 20 nt, Human
ugggucuggggcuggcucgg

SEQ ID NO: 50001 - RNA, 20 nt, Human
uggugauuucacaacaggag

SEQ ID NO: 50002 - RNA, 20 nt, Human
uggugauuucacaacaggag

SEQ ID NO: 50003 - RNA, 22 nt, Human
uguaaaccugcucaaagaaaau

SEQ ID NO: 50004 - RNA, 22 nt, Human
uguaaaccugcucaaagaaaau

SEQ ID NO: 50005 - RNA, 18 nt, Human
ugucgaggggccccaggg

SEQ ID NO: 50006 - RNA, 18 nt, Human
ugucgaggggccccaggg

SEQ ID NO: 50007 - RNA, 19 nt, Human
uguugggcccacacaagcu

SEQ ID NO: 50008 - RNA, 19 nt, Human
uguugggcccacacaagcu

SEQ ID NO: 50009 - RNA, 21 nt, Human
uucaggaccuguccucccaag

SEQ ID NO: 50010 - RNA, 21 nt, Human
uucaggaccuguccucccaag

SEQ ID NO: 50011 - RNA, 21 nt, Human
uugggaagccgagugcuucug

SEQ ID NO: 50012 - RNA, 18 nt, Human
uuuuuuuuuuuuuuuuug

SEQ ID NO: 50013 - RNA, 18 nt, Human
uuuuuuuuuuuuuuuuug

SEQ ID NO: 50014 - RNA, 20 nt, Human
uuuuuuuuuuuuuuuuugcu

SEQ ID NO: 50015 - RNA, 23 nt, Human
uuuuuuuuuuuuuuuuuugcuga

SEQ ID NO: 50016 - RNA, 23 nt, Human
uuuuuuuuuuuuuuuuuugcuga

SEQ ID NO: 50017 - RNA, 21 nt, Human
aaaccauccccaauccucagc

SEQ ID NO: 50018 - RNA, 21 nt, Human
aaaccauccccaauccucagc

SEQ ID NO: 50019 - RNA, 21 nt, Human
aacaaaggcagcccacaacua

SEQ ID NO: 50020 - RNA, 21 nt, Human
aacaaaggcagcccacaacua

SEQ ID NO: 50021 - RNA, 18 nt, Human
aagaacaugagaagacag

SEQ ID NO: 50022 - RNA, 18 nt, Human
aagaacaugagaagacag

SEQ ID NO: 50023 - RNA, 25 nt, Human
aagaacaugagaagacaguguuggc

SEQ ID NO: 50024 - RNA, 25 nt, Human
aagaacaugagaagacaguguuggc

SEQ ID NO: 50025 - RNA, 22 nt, Human
aagggaaggggaggagagagag

SEQ ID NO: 50026 - RNA, 22 nt, Human
aagggaaggggaggagagagag

SEQ ID NO: 50027 - RNA, 18 nt, Human
aaguggaaagagaagaga

SEQ ID NO: 50028 - RNA, 19 nt, Human
aaguggaaagagaagagau

SEQ ID NO: 50029 - RNA, 19 nt, Human
aaguggaaagagaagagau

SEQ ID NO: 50030 - RNA, 30 nt, Human
acacaaccucaaacauccagguggaaacuu

SEQ ID NO: 50031 - RNA, 23 nt, Human
accaccucuuauagcucuuccau

SEQ ID NO: 50032 - RNA, 23 nt, Human
accaccucuuauagcucuuccau

SEQ ID NO: 50033 - RNA, 18 nt, Human
acccaaaguggaaagaga

SEQ ID NO: 50034 - RNA, 18 nt, Human
acccaaaguggaaagaga

SEQ ID NO: 50035 - RNA, 24 nt, Human
accuuacucaggggaagccuugac

SEQ ID NO: 50036 - RNA, 24 nt, Human
accuuacucaggggaagccuugac

SEQ ID NO: 50037 - RNA, 20 nt, Human
acucaggggaagccuugacc

SEQ ID NO: 50038 - RNA, 21 nt, Human
acuccugcaggcaggcugggc

SEQ ID NO: 50039 - RNA, 25 nt, Human
acuuucuccuucuuuuugcucuuuu

SEQ ID NO: 50040 - RNA, 20 nt, Human
agaaauggaccuuacucagg

SEQ ID NO: 50041 - RNA, 20 nt, Human
agaaauggaccuuacucagg

SEQ ID NO: 50042 - RNA, 19 nt, Human
agaagacaguguuggcauu

SEQ ID NO: 50043 - RNA, 19 nt, Human
agaagacaguguuggcauu

SEQ ID NO: 50044 - RNA, 19 nt, Human
agagaagagauuuuuaaau

SEQ ID NO: 50045 - RNA, 19 nt, Human
agagaagagauuuuuaaau

SEQ ID NO: 50046 - RNA, 19 nt, Human
agagaggaggcaggaggga

SEQ ID NO: 50047 - RNA, 19 nt, Human
agagaggaggcaggaggga

SEQ ID NO: 50048 - RNA, 18 nt, Human
agcaagagcaaaggcacc

SEQ ID NO: 50049 - RNA, 22 nt, Human
agccuaugaguccccacuucac

SEQ ID NO: 50050 - RNA, 19 nt, Human
aggcaggagggagcccaag

SEQ ID NO: 50051 - RNA, 19 nt, Human
aggcaggagggagcccaag

SEQ ID NO: 50052 - RNA, 19 nt, Human
aggcaggagggagcccaag

SEQ ID NO: 50053 - RNA, 19 nt, Human
aggcaggagggagcccaag

SEQ ID NO: 50054 - RNA, 18 nt, Human
aggggucaaguuccuggc

SEQ ID NO: 50055 - RNA, 18 nt, Human
aggggucaaguuccuggc

SEQ ID NO: 50056 - RNA, 23 nt, Human
aggguccuacucuaucccuccuu

SEQ ID NO: 50057 - RNA, 23 nt, Human
aggguccuacucuaucccuccuu

SEQ ID NO: 50058 - RNA, 21 nt, Human
agguggaaacuccugcgcggc

SEQ ID NO: 50059 - RNA, 18 nt, Human
aguagaaggagcacugga

SEQ ID NO: 50060 - RNA, 18 nt, Human
aguagaaggagcacugga

SEQ ID NO: 50061 - RNA, 19 nt, Human
agugguuccaugaagaaag

SEQ ID NO: 50062 - RNA, 19 nt, Human
agugguuccaugaagaaag

SEQ ID NO: 50063 - RNA, 22 nt, Human
auacaacccaaagccaacagag

SEQ ID NO: 50064 - RNA, 22 nt, Human
auacaacccaaagccaacagag

SEQ ID NO: 50065 - RNA, 21 nt, Human
aucuacacaaccucaaacauc

SEQ ID NO: 50066 - RNA, 22 nt, Human
augggagaagggaaggggagga

SEQ ID NO: 50067 - RNA, 22 nt, Human
augggagaagggaaggggagga

SEQ ID NO: 50068 - RNA, 23 nt, Human
caaacaaaggcagcccacaacua

SEQ ID NO: 50069 - RNA, 23 nt, Human
caaacaaaggcagcccacaacua

SEQ ID NO: 50070 - RNA, 23 nt, Human
caaaggcacccaagaucacaggg

SEQ ID NO: 50071 - RNA, 21 nt, Human
caaaggcagcccacaacuagg

SEQ ID NO: 50072 - RNA, 21 nt, Human
caaaggcagcccacaacuagg

SEQ ID NO: 50073 - RNA, 18 nt, Human
caaauuucugcccugagc

SEQ ID NO: 50074 - RNA, 19 nt, Human
caaauuucugcccugagca

SEQ ID NO: 50075 - RNA, 19 nt, Human
caaauuucugcccugagca

SEQ ID NO: 50076 - RNA, 19 nt, Human
caacccaaagccaacagag

SEQ ID NO: 50077 - RNA, 19 nt, Human
caacccaaagccaacagag

SEQ ID NO: 50078 - RNA, 19 nt, Human
caacuguaaaacgaagggu

SEQ ID NO: 50079 - RNA, 19 nt, Human
caacuguaaaacgaagggu

SEQ ID NO: 50080 - RNA, 18 nt, Human
caagagcaaaggcaccca

SEQ ID NO: 50081 - RNA, 22 nt, Human
caagcuaagccaucagcccuug

SEQ ID NO: 50082 - RNA, 22 nt, Human
caagcuaagccaucagcccuug

SEQ ID NO: 50083 - RNA, 26 nt, Human
cacccaagaucacaggggaagguggg

SEQ ID NO: 50084 - RNA, 21 nt, Human
cacugcucagucugcaccccc

SEQ ID NO: 50085 - RNA, 23 nt, Human
cagagaugggagaagggaagggg

SEQ ID NO: 50086 - RNA, 23 nt, Human
cagagaugggagaagggaagggg

SEQ ID NO: 50087 - RNA, 24 nt, Human
cagcaagagcaaaggcacccaaga

SEQ ID NO: 50088 - RNA, 23 nt, Human
cagcagugauuucaaacacaugc

SEQ ID NO: 50089 - RNA, 23 nt, Human
cagcauuuccucuguuguuuuga

SEQ ID NO: 50090 - RNA, 24 nt, Human
cagcauuucucugagagcuggugc

SEQ ID NO: 50091 - RNA, 24 nt, Human
cagcauuucucugagagcuggugc

SEQ ID NO: 50092 - RNA, 22 nt, Human
caggagggagcccaaggguguc

SEQ ID NO: 50093 - RNA, 22 nt, Human
caggagggagcccaaggguguc

SEQ ID NO: 50094 - RNA, 25 nt, Human
caggauggacagauagggacggaca

SEQ ID NO: 50095 - RNA, 25 nt, Human
caggauggacagauagggacggaca

SEQ ID NO: 50096 - RNA, 26 nt, Human
caggccccaggauggacagauaggga

SEQ ID NO: 50097 - RNA, 26 nt, Human
caggccccaggauggacagauaggga

SEQ ID NO: 50098 - RNA, 21 nt, Human
cagggacagagaugggagaag

SEQ ID NO: 50099 - RNA, 21 nt, Human
cagggacagagaugggagaag

SEQ ID NO: 50100 - RNA, 22 nt, Human
cagggcugggcacaccuggggc

SEQ ID NO: 50101 - RNA, 18 nt, Human
cauugcuaccuugcaagg

SEQ ID NO: 50102 - RNA, 20 nt, Human
cauuuccucuguuguuuuga

SEQ ID NO: 50103 - RNA, 18 nt, Human
ccaagaucacaggggaag

SEQ ID NO: 50104 - RNA, 19 nt, Human
ccaagaucacaggggaagg

SEQ ID NO: 50105 - RNA, 19 nt, Human
ccaccaccccuuccggcug

SEQ ID NO: 50106 - RNA, 20 nt, Human
ccagcauuucucugagagcu

SEQ ID NO: 50107 - RNA, 20 nt, Human
ccagcauuucucugagagcu

SEQ ID NO: 50108 - RNA, 23 nt, Human
ccagcauuucucugagagcuggu

SEQ ID NO: 50109 - RNA, 21 nt, Human
ccaugaagaaagcucaggguu

SEQ ID NO: 50110 - RNA, 21 nt, Human
ccaugaagaaagcucaggguu

SEQ ID NO: 50111 - RNA, 24 nt, Human
cccaagaucacaggggaagguggg

SEQ ID NO: 50112 - RNA, 20 nt, Human
cccagcauuucucugagagc

SEQ ID NO: 50113 - RNA, 20 nt, Human
cccagcauuucucugagagc

SEQ ID NO: 50114 - RNA, 18 nt, Human
cccaugcugcagcccgcg

SEQ ID NO: 50115 - RNA, 25 nt, Human
ccccaagccuaugaguccccacuuc

SEQ ID NO: 50116 - RNA, 19 nt, Human
ccccacggaagaacaugag

SEQ ID NO: 50117 - RNA, 20 nt, Human
cccccuagcuccacucucaa

SEQ ID NO: 50118 - RNA, 24 nt, Human
cccugugcuugcagggacagagau

SEQ ID NO: 50119 - RNA, 20 nt, Human
ccuaugaguccccacuucac

SEQ ID NO: 50120 - RNA, 26 nt, Human
ccuccauuugcagcaagagcaaaggc

SEQ ID NO: 50121 - RNA, 20 nt, Human
ccucccguugaccaccaccc

SEQ ID NO: 50122 - RNA, 20 nt, Human
ccucugccgucugcuccucc

SEQ ID NO: 50123 - RNA, 18 nt, Human
ccugguccucacagcacc

SEQ ID NO: 50124 - RNA, 22 nt, Human
ccugugcuugcagggacagaga

SEQ ID NO: 50125 - RNA, 22 nt, Human
ccugugcuugcagggacagaga

SEQ ID NO: 50126 - RNA, 20 nt, Human
ccuugacaaaaggcucgggu

SEQ ID NO: 50127 - RNA, 22 nt, Human
ccuugggcaagucaccugauuu

SEQ ID NO: 50128 - RNA, 22 nt, Human
ccuugggcaagucaccugauuu

SEQ ID NO: 50129 - RNA, 22 nt, Human
cgggguaguaaggaggacagag

SEQ ID NO: 50130 - RNA, 21 nt, Human
cuaagcacuagacaaaacacu

SEQ ID NO: 50131 - RNA, 23 nt, Human
cucaagcacaaaaacaauuacaa

SEQ ID NO: 50132 - RNA, 23 nt, Human
cucacagcccugccgucagaauu

SEQ ID NO: 50133 - RNA, 19 nt, Human
cucaggggaagccuugacc

SEQ ID NO: 50134 - RNA, 19 nt, Human
cucaggggaagccuugacc

SEQ ID NO: 50135 - RNA, 18 nt, Human
cuccagcccagugcccac

SEQ ID NO: 50136 - RNA, 19 nt, Human
cuccagcccagugcccacc

SEQ ID NO: 50137 - RNA, 23 nt, Human
cuccagccccaagccuaugaguc

SEQ ID NO: 50138 - RNA, 19 nt, Human
cuccugcaggcaggcuggg

SEQ ID NO: 50139 - RNA, 19 nt, Human
cucuaucccuccuuagccc

SEQ ID NO: 50140 - RNA, 19 nt, Human
cucuaucccuccuuagccc

SEQ ID NO: 50141 - RNA, 20 nt, Human
cucugauuuagucugagccu

SEQ ID NO: 50142 - RNA, 20 nt, Human
cucugauuuagucugagccu

SEQ ID NO: 50143 - RNA, 18 nt, Human
cucugccgucugcuccuc

SEQ ID NO: 50144 - RNA, 18 nt, Human
cugagccugugagagcuc

SEQ ID NO: 50145 - RNA, 22 nt, Human
cuuagcuaucuccggucggcca

SEQ ID NO: 50146 - RNA, 21 nt, Human
cuuauagcucuuccauccauc

SEQ ID NO: 50147 - RNA, 21 nt, Human
cuuauagcucuuccauccauc

SEQ ID NO: 50148 - RNA, 23 nt, Human
cuuggaaggugagcccucugggg

SEQ ID NO: 50149 - RNA, 18 nt, Human
gaaggggaggagagagag

SEQ ID NO: 50150 - RNA, 18 nt, Human
gaaggggaggagagagag

SEQ ID NO: 50151 - RNA, 22 nt, Human
gacauuguccucccugguccuc

SEQ ID NO: 50152 - RNA, 21 nt, Human
gagggaaggucgggggaaacc

SEQ ID NO: 50153 - RNA, 21 nt, Human
gagggaaggucgggggaaacc

SEQ ID NO: 50154 - RNA, 21 nt, Human
gcacaauucaaaggggucaag

SEQ ID NO: 50155 - RNA, 21 nt, Human
gcacaauucaaaggggucaag

SEQ ID NO: 50156 - RNA, 22 nt, Human
gcaccugggagucuccagcccc

SEQ ID NO: 50157 - RNA, 22 nt, Human
gccccaagccuaugagucccca

SEQ ID NO: 50158 - RNA, 25 nt, Human
gcccugugcuugcagggacagagau

SEQ ID NO: 50159 - RNA, 18 nt, Human
gcccuugggaacaaagau

SEQ ID NO: 50160 - RNA, 27 nt, Human
gccuccauuugcagcaagagcaaaggc

SEQ ID NO: 50161 - RNA, 24 nt, Human
gcggcggcggggaugacuggccac

SEQ ID NO: 50162 - RNA, 19 nt, Human
gcugcugggagauccccca

SEQ ID NO: 50163 - RNA, 19 nt, Human
ggacagcauccaaacaaag

SEQ ID NO: 50164 - RNA, 20 nt, Human
ggacagcauccaaacaaagg

SEQ ID NO: 50165 - RNA, 20 nt, Human
ggacagcauccaaacaaagg

SEQ ID NO: 50166 - RNA, 25 nt, Human
ggaggagagagaggaggcaggaggg

SEQ ID NO: 50167 - RNA, 25 nt, Human
ggaggagagagaggaggcaggaggg

SEQ ID NO: 50168 - RNA, 23 nt, Human
ggauggacagauagggacggaca

SEQ ID NO: 50169 - RNA, 18 nt, Human
ggccacaucuacacaacc

SEQ ID NO: 50170 - RNA, 21 nt, Human
guagagauagcuccauccaca

SEQ ID NO: 50171 - RNA, 21 nt, Human
guagagauagcuccauccaca

SEQ ID NO: 50172 - RNA, 21 nt, Human
guccaggguccuacucuaucc

SEQ ID NO: 50173 - RNA, 21 nt, Human
guccaggguccuacucuaucc

SEQ ID NO: 50174 - RNA, 20 nt, Human
gucgggugaucucuaaguuc

SEQ ID NO: 50175 - RNA, 20 nt, Human
gucgggugaucucuaaguuc

SEQ ID NO: 50176 - RNA, 21 nt, Human
guggacagcauccaaacaaag

SEQ ID NO: 50177 - RNA, 21 nt, Human
guucggaauuucuuuuucuuc

SEQ ID NO: 50178 - RNA, 25 nt, Human
uaaaaaauccacccagcuaaucugc

SEQ ID NO: 50179 - RNA, 24 nt, Human
uaagaugccaguuucggucuguaa

SEQ ID NO: 50180 - RNA, 24 nt, Human
uaagaugccaguuucggucuguaa

SEQ ID NO: 50181 - RNA, 19 nt, Human
uacaacccaaagccaacag

SEQ ID NO: 50182 - RNA, 19 nt, Human
uacaacccaaagccaacag

SEQ ID NO: 50183 - RNA, 24 nt, Human
uaccaccucuuauagcucuuccau

SEQ ID NO: 50184 - RNA, 20 nt, Human
uaccaggccccaggauggac

SEQ ID NO: 50185 - RNA, 20 nt, Human
uaccaggccccaggauggac

SEQ ID NO: 50186 - RNA, 23 nt, Human
uaccaggcuagaggcucagagac

SEQ ID NO: 50187 - RNA, 22 nt, Human
uagaaagucagcauuuccucug

SEQ ID NO: 50188 - RNA, 22 nt, Human
uagaaagucagcauuuccucug

SEQ ID NO: 50189 - RNA, 18 nt, Human
uagaaggagcacuggacu

SEQ ID NO: 50190 - RNA, 18 nt, Human
uagaaggagcacuggacu

SEQ ID NO: 50191 - RNA, 23 nt, Human
uagaaggagcacuggacuggaag

SEQ ID NO: 50192 - RNA, 23 nt, Human
uagaaggagcacuggacuggaag

SEQ ID NO: 50193 - RNA, 22 nt, Human
uagcuccacucucaagggugcc

SEQ ID NO: 50194 - RNA, 22 nt, Human
ucaaacauccagguggaaacuc

SEQ ID NO: 50195 - RNA, 19 nt, Human
ucaaugccccacggaagaa

SEQ ID NO: 50196 - RNA, 23 nt, Human
ucaaugccccacggaagaacaug

SEQ ID NO: 50197 - RNA, 23 nt, Human
ucaaugccccacggaagaacaug

SEQ ID NO: 50198 - RNA, 18 nt, Human
ucacaggggaaggugggu

SEQ ID NO: 50199 - RNA, 22 nt, Human
ucagagacucucagggcugggc

SEQ ID NO: 50200 - RNA, 18 nt, Human
ucaggccuuugcugagga

SEQ ID NO: 50201 - RNA, 23 nt, Human
ucagggcugggcacaccuggggc

SEQ ID NO: 50202 - RNA, 22 nt, Human
uccacaggagauuggauuccug

SEQ ID NO: 50203 - RNA, 22 nt, Human
uccacaggagauuggauuccug

SEQ ID NO: 50204 - RNA, 21 nt, Human
uccaggguccuacucuauccc

SEQ ID NO: 50205 - RNA, 21 nt, Human
uccaggguccuacucuauccc

SEQ ID NO: 50206 - RNA, 23 nt, Human
uccagguggaaacuccugcgcgg

SEQ ID NO: 50207 - RNA, 21 nt, Human
uccauccaucauucaaguggu

SEQ ID NO: 50208 - RNA, 21 nt, Human
uccauccaucauucaaguggu

SEQ ID NO: 50209 - RNA, 20 nt, Human
uccauggcaggagguacgga

SEQ ID NO: 50210 - RNA, 19 nt, Human
ucccccagcagugcagcgg

SEQ ID NO: 50211 - RNA, 20 nt, Human
ucccccagcagugcagcggc

SEQ ID NO: 50212 - RNA, 22 nt, Human
ucccccagcagugcagcggcuc

SEQ ID NO: 50213 - RNA, 23 nt, Human
ucccucccguugaccaccacccc

SEQ ID NO: 50214 - RNA, 19 nt, Human
ucccuccuuagcccugugc

SEQ ID NO: 50215 - RNA, 19 nt, Human
ucccuccuuagcccugugc

SEQ ID NO: 50216 - RNA, 22 nt, Human
ucccuccuuagcccugugcuug

SEQ ID NO: 50217 - RNA, 20 nt, Human
ucccugguccucacagcacc

SEQ ID NO: 50218 - RNA, 23 nt, Human
uccucccugguccucacagcacc

SEQ ID NO: 50219 - RNA, 22 nt, Human
ucggguucccgcuagucccuca

SEQ ID NO: 50220 - RNA, 23 nt, Human
ucucagggcugggcacaccuggg

SEQ ID NO: 50221 - RNA, 18 nt, Human
ucuccuucuuuuugcucu

SEQ ID NO: 50222 - RNA, 18 nt, Human
ucucuugggcaacuguaa

SEQ ID NO: 50223 - RNA, 18 nt, Human
ucucuugggcaacuguaa

SEQ ID NO: 50224 - RNA, 19 nt, Human
ucugagccugugagagcuc

SEQ ID NO: 50225 - RNA, 19 nt, Human
ucugagccugugagagcuc

SEQ ID NO: 50226 - RNA, 20 nt, Human
ucugccgcuaacuagcugug

SEQ ID NO: 50227 - RNA, 20 nt, Human
ucugccgcuaacuagcugug

SEQ ID NO: 50228 - RNA, 24 nt, Human
ucugccgcuaacuagcugugugac

SEQ ID NO: 50229 - RNA, 24 nt, Human
ucugccgcuaacuagcugugugac

SEQ ID NO: 50230 - RNA, 19 nt, Human
ucugcuccuccucccuccc

SEQ ID NO: 50231 - RNA, 22 nt, Human
ucuuauagcucuuccauccauc

SEQ ID NO: 50232 - RNA, 26 nt, Human
ucuuugagggagacuuggaaggugag

SEQ ID NO: 50233 - RNA, 21 nt, Human
ugacaaaaggcucggguuccc

SEQ ID NO: 50234 - RNA, 20 nt, Human
ugagagcuggugcaagagga

SEQ ID NO: 50235 - RNA, 20 nt, Human
ugagagcuggugcaagagga

SEQ ID NO: 50236 - RNA, 21 nt, Human
ugagggagacuuggaagguga

SEQ ID NO: 50237 - RNA, 18 nt, Human
ugaucucuaaguuccccu

SEQ ID NO: 50238 - RNA, 18 nt, Human
ugaucucuaaguuccccu

SEQ ID NO: 50239 - RNA, 19 nt, Human
ugaucucuaaguuccccuu

SEQ ID NO: 50240 - RNA, 19 nt, Human
ugaucucuaaguuccccuu

SEQ ID NO: 50241 - RNA, 18 nt, Human
ugcccugagcauuaaaca

SEQ ID NO: 50242 - RNA, 18 nt, Human
ugcccugagcauuaaaca

SEQ ID NO: 50243 - RNA, 22 nt, Human
ugcccugagcauuaaacaacuu

SEQ ID NO: 50244 - RNA, 22 nt, Human
ugcccugagcauuaaacaacuu

SEQ ID NO: 50245 - RNA, 19 nt, Human
ugcugggagaucccccagc

SEQ ID NO: 50246 - RNA, 20 nt, Human
uggaaggugagcccucuggg

SEQ ID NO: 50247 - RNA, 21 nt, Human
uggacagcauccaaacaaagg

SEQ ID NO: 50248 - RNA, 21 nt, Human
uggcccagcccuguccaaggg

SEQ ID NO: 50249 - RNA, 19 nt, Human
uggcuagucacuuugacga

SEQ ID NO: 50250 - RNA, 19 nt, Human
uggcuagucacuuugacga

SEQ ID NO: 50251 - RNA, 22 nt, Human
ugggaacaaagauuacuuucug

SEQ ID NO: 50252 - RNA, 22 nt, Human
ugggaacaaagauuacuuucug

SEQ ID NO: 50253 - RNA, 19 nt, Human
ugggaagaaauggaccuua

SEQ ID NO: 50254 - RNA, 23 nt, Human
ugggagaagggaaggggaggaga

SEQ ID NO: 50255 - RNA, 23 nt, Human
ugggagaagggaaggggaggaga

SEQ ID NO: 50256 - RNA, 23 nt, Human
ugggguaguacaagcuaagccau

SEQ ID NO: 50257 - RNA, 23 nt, Human
ugggguaguacaagcuaagccau

SEQ ID NO: 50258 - RNA, 24 nt, Human
uggggugcgcuuaaaaaauccacc

SEQ ID NO: 50259 - RNA, 22 nt, Human
uggugcaagaggauuaauccug

SEQ ID NO: 50260 - RNA, 22 nt, Human
uggugcaagaggauuaauccug

SEQ ID NO: 50261 - RNA, 25 nt, Human
ugguggucaucuggcucaggccuuu

SEQ ID NO: 50262 - RNA, 21 nt, Human
ugugaccuugggcaagucacc

SEQ ID NO: 50263 - RNA, 21 nt, Human
ugugaccuugggcaagucacc

SEQ ID NO: 50264 - RNA, 22 nt, Human
uucaacuucccaaauuucugcc

SEQ ID NO: 50265 - RNA, 22 nt, Human
uucaacuucccaaauuucugcc

SEQ ID NO: 50266 - RNA, 19 nt, Human
uucaagugguuccaugaag

SEQ ID NO: 50267 - RNA, 19 nt, Human
uucaagugguuccaugaag

SEQ ID NO: 50268 - RNA, 22 nt, Human
uuccugggaagaaauggaccuu

SEQ ID NO: 50269 - RNA, 22 nt, Human
uuccugggaagaaauggaccuu

SEQ ID NO: 50270 - RNA, 22 nt, Human
uuccuugacaaaaggcucgggu

SEQ ID NO: 50271 - RNA, 21 nt, Human
uuuucugcccaugcugcagcc

SEQ ID NO: 50272 - RNA, 23 nt, Human
aauuucuuucuaacagauauuau

SEQ ID NO: 50273 - RNA, 22 nt, Human
cucacuggcaauuucuuucuaa

SEQ ID NO: 50274 - RNA, 18 nt, Human
cugaaacaaugggacucc

SEQ ID NO: 50275 - RNA, 26 nt, Human
guaaaaccucuuuccaguucuuaaag

SEQ ID NO: 50276 - RNA, 22 nt, Human
uauaauaauaauuauaaaaaga

SEQ ID NO: 50277 - RNA, 18 nt, Human
ucuaaacuaauaaaaaag

SEQ ID NO: 50278 - RNA, 21 nt, Human
uggcaaacaaaguuacuucag

SEQ ID NO: 50279 - RNA, 24 nt, Human
ugugguauuuagaugugcaauguc

SEQ ID NO: 50280 - RNA, 20 nt, Human
uuaaaacuaguaauugcuua

SEQ ID NO: 50281 - RNA, 23 nt, Human
uuaaaauucaaagccauuucugg

SEQ ID NO: 50282 - RNA, 19 nt, Human
uuaaaguccaguuugcuac

SEQ ID NO: 50283 - RNA, 18 nt, Human
uuagaugugcaaugucac

SEQ ID NO: 50284 - RNA, 19 nt, Human
uuuguaaaaccucuuucca

SEQ ID NO: 50285 - RNA, 22 nt, Human
uuuguaaaaccucuuuccaguu

SEQ ID NO: 50286 - RNA, 20 nt, Human
aagcccccaaauguaauuua

SEQ ID NO: 50287 - RNA, 18 nt, Human
acaagggaaaacaucugu

SEQ ID NO: 50288 - RNA, 22 nt, Human
aggaagguuuauuggcuucaau

SEQ ID NO: 50289 - RNA, 22 nt, Human
ccagcuguugcuccagaucaug

SEQ ID NO: 50290 - RNA, 23 nt, Human
guccuuguggauuucuucccugg

SEQ ID NO: 50291 - RNA, 18 nt, Human
guugcuccagaucaugua

SEQ ID NO: 50292 - RNA, 21 nt, Human
ucaacacuuuauuuaguucuc

SEQ ID NO: 50293 - RNA, 18 nt, Human
uggauuucuucccugcuc

SEQ ID NO: 50294 - RNA, 18 nt, Human
uuuggaaagcccccaaau

SEQ ID NO: 50295 - RNA, 20 nt, Human
aaagauuaugaagauaccaa

SEQ ID NO: 50296 - RNA, 19 nt, Human
aaugcuaggauuauagacu

SEQ ID NO: 50297 - RNA, 22 nt, Human
aggaagguuuguuggcuucaau

SEQ ID NO: 50298 - RNA, 20 nt, Human
aggaggcugaagacugcuac

SEQ ID NO: 50299 - RNA, 18 nt, Human
augaagcaagaaaucugc

SEQ ID NO: 50300 - RNA, 28 nt, Human
auguauguguauauauauaucuacuagg

SEQ ID NO: 50301 - RNA, 18 nt, Human
auugaaaacaauuuugca

SEQ ID NO: 50302 - RNA, 24 nt, Human
caauuguauaucgaccauaaagaa

SEQ ID NO: 50303 - RNA, 19 nt, Human
cacuuuauuuacuucucac

SEQ ID NO: 50304 - RNA, 22 nt, Human
cgacagugaaaacugagacaga

SEQ ID NO: 50305 - RNA, 18 nt, Human
cgaccauaaagaaauagu

SEQ ID NO: 50306 - RNA, 22 nt, Human
cuagcuguugcuccagaucuug

SEQ ID NO: 50307 - RNA, 23 nt, Human
cugaagacugcuacaggggaagg

SEQ ID NO: 50308 - RNA, 18 nt, Human
guugcuccagaucuugua

SEQ ID NO: 50309 - RNA, 22 nt, Human
uaaaaacacugccauuuacugu

SEQ ID NO: 50310 - RNA, 18 nt, Human
uaaagcucaaaaugcaaa

SEQ ID NO: 50311 - RNA, 19 nt, Human
uaacaaagcauuaacacag

SEQ ID NO: 50312 - RNA, 20 nt, Human
uaacaaagcauuaacacagg

SEQ ID NO: 50313 - RNA, 26 nt, Human
uacauuuguauauguguauauaugua

SEQ ID NO: 50314 - RNA, 24 nt, Human
uaccaaaaaugcaagaagucacag

SEQ ID NO: 50315 - RNA, 18 nt, Human
uaccaggaauaaucuuug

SEQ ID NO: 50316 - RNA, 23 nt, Human
uaguuaauagaaaaguucuagau

SEQ ID NO: 50317 - RNA, 28 nt, Human
uauacauuuguauauguguauauuacau

SEQ ID NO: 50318 - RNA, 20 nt, Human
uauauauguauguguauaua

SEQ ID NO: 50319 - RNA, 21 nt, Human
uauauguguauauauguaugu

SEQ ID NO: 50320 - RNA, 21 nt, Human
uauauguguauauauguaugu

SEQ ID NO: 50321 - RNA, 23 nt, Human
uauauguguauauauguaugugu

SEQ ID NO: 50322 - RNA, 21 nt, Human
uauguauguguauauauauau

SEQ ID NO: 50323 - RNA, 18 nt, Human
uauguguauauauauauc

SEQ ID NO: 50324 - RNA, 19 nt, Human
uauguguauauauguaugu

SEQ ID NO: 50325 - RNA, 22 nt, Human
uauguguauauauguaugugua

SEQ ID NO: 50326 - RNA, 23 nt, Human
uauguguauauauguauguguau

SEQ ID NO: 50327 - RNA, 21 nt, Human
uauuagaaaaaggaaaauguc

SEQ ID NO: 50328 - RNA, 19 nt, Human
ucacagcauuugccauccc

SEQ ID NO: 50329 - RNA, 19 nt, Human
uccuuccccugagaguggg

SEQ ID NO: 50330 - RNA, 24 nt, Human
ucgacagugaaaacugagacagaa

SEQ ID NO: 50331 - RNA, 18 nt, Human
ucgaccauaaagaaauag

SEQ ID NO: 50332 - RNA, 20 nt, Human
ucgaccauaaagaaauagua

SEQ ID NO: 50333 - RNA, 18 nt, Human
ucuagauugaaaacaauu

SEQ ID NO: 50334 - RNA, 22 nt, Human
ucucuacacuuaaagccaccau

SEQ ID NO: 50335 - RNA, 20 nt, Human
ugacacaguagaaugguuaa

SEQ ID NO: 50336 - RNA, 22 nt, Human
ugaggcuuugucauaugaagca

SEQ ID NO: 50337 - RNA, 19 nt, Human
ugcaaauccuuccccugag

SEQ ID NO: 50338 - RNA, 19 nt, Human
ugcaagaagucacaggaau

SEQ ID NO: 50339 - RNA, 21 nt, Human
ugcuaggauuauagacuugau

SEQ ID NO: 50340 - RNA, 19 nt, Human
uggcaaaggugacacagua

SEQ ID NO: 50341 - RNA, 23 nt, Human
ugggaaagcauuaacaaaugaga

SEQ ID NO: 50342 - RNA, 19 nt, Human
uguauauauguauguguau

SEQ ID NO: 50343 - RNA, 23 nt, Human
uguauauauguauguguauauau

SEQ ID NO: 50344 - RNA, 24 nt, Human
uguauauguguauauauguaugug

SEQ ID NO: 50345 - RNA, 24 nt, Human
uguguauauauguauguguauaua

SEQ ID NO: 50346 - RNA, 20 nt, Human
uguugcuccagaucuuguag

SEQ ID NO: 50347 - RNA, 19 nt, Human
uuacuguaguaaaaugugg

SEQ ID NO: 50348 - RNA, 23 nt, Human
uucauaauaugaaauagaaugua

SEQ ID NO: 50349 - RNA, 19 nt, Human
uuccccugagagugggaaa

SEQ ID NO: 50350 - RNA, 23 nt, Human
uugcaacaauagcauuuuuggag

SEQ ID NO: 50351 - RNA, 21 nt, Human
uuguggauuucuucucugcuu

SEQ ID NO: 50352 - RNA, 19 nt, Human
uuuacauucugcauucaca

SEQ ID NO: 50353 - RNA, 19 nt, Human
uuuacuguaguaaaaugug

SEQ ID NO: 50354 - RNA, 20 nt, Human
uuuuuugaacaugauucugg

SEQ ID NO: 50355 - RNA, 22 nt, Human
aggaagguuuauuggcuucaau

SEQ ID NO: 50356 - RNA, 21 nt, Human
gaggaggcugaaaacugcuac

SEQ ID NO: 50357 - RNA, 18 nt, Human
gcuacaagggaaggcauc

SEQ ID NO: 50358 - RNA, 18 nt, Human
guugcuccagaucaugua

SEQ ID NO: 50359 - RNA, 22 nt, Human
ucaacacuuuauuuaguucuca

SEQ ID NO: 50360 - RNA, 19 nt, Human
uuggcuucaauuccccagu

SEQ ID NO: 50361 - RNA, 20 nt, Human
uuucuuuggaaagcucccac

SEQ ID NO: 50362 - RNA, 24 nt, Human
aaaaaaauuauaaacauauggcca

SEQ ID NO: 50363 - RNA, 19 nt, Human
aaagcucuuuuauguuccc

SEQ ID NO: 50364 - RNA, 19 nt, Human
aaauaauagagaaaagccc

SEQ ID NO: 50365 - RNA, 19 nt, Human
aacaauccauuauacucuu

SEQ ID NO: 50366 - RNA, 22 nt, Human
aacuaauuuuaaacaauuucua

SEQ ID NO: 50367 - RNA, 19 nt, Human
aaguuuuguggguauuagg

SEQ ID NO: 50368 - RNA, 27 nt, Human
aaucuaguuuuauuuauuaucucuuca

SEQ ID NO: 50369 - RNA, 26 nt, Human
accccauugcucccagugagcuccaa

SEQ ID NO: 50370 - RNA, 19 nt, Human
acccugauaaucacuuccu

SEQ ID NO: 50371 - RNA, 26 nt, Human
agacaaaacguggagagaagggaccc

SEQ ID NO: 50372 - RNA, 18 nt, Human
agggaugggguacaugag

SEQ ID NO: 50373 - RNA, 18 nt, Human
agguacaaagucuauaau

SEQ ID NO: 50374 - RNA, 22 nt, Human
auagagaaaagcccauuaaaca

SEQ ID NO: 50375 - RNA, 20 nt, Human
augagcugucuuugaauaau

SEQ ID NO: 50376 - RNA, 27 nt, Human
auuuaacuuaccuguucuucuccuuca

SEQ ID NO: 50377 - RNA, 19 nt, Human
cacagcccugccggccucu

SEQ ID NO: 50378 - RNA, 25 nt, Human
cagugagcuccaagauuuuuuaaau

SEQ ID NO: 50379 - RNA, 20 nt, Human
caucacccagguaugaagcc

SEQ ID NO: 50380 - RNA, 18 nt, Human
caugugcaggaugugcag

SEQ ID NO: 50381 - RNA, 19 nt, Human
ccagaaaauuuucaacaua

SEQ ID NO: 50382 - RNA, 24 nt, Human
ccagguaugaagcccagcauccau

SEQ ID NO: 50383 - RNA, 20 nt, Human
cccacuuucaacuucccaga

SEQ ID NO: 50384 - RNA, 18 nt, Human
ccggccucuuaccacauc

SEQ ID NO: 50385 - RNA, 21 nt, Human
cguggagagaaaaguauaaug

SEQ ID NO: 50386 - RNA, 21 nt, Human
cucccuguugugcuaucaaau

SEQ ID NO: 50387 - RNA, 26 nt, Human
cucucugccgacucccugcccucaac

SEQ ID NO: 50388 - RNA, 24 nt, Human
cugcaaccccauugcucccaguga

SEQ ID NO: 50389 - RNA, 18 nt, Human
cuuugaauaauaccauuc

SEQ ID NO: 50390 - RNA, 23 nt, Human
gaaaauuuucaacauagacaaaa

SEQ ID NO: 50391 - RNA, 20 nt, Human
ggccaaucuaguuuuauuua

SEQ ID NO: 50392 - RNA, 19 nt, Human
gugcaggaugugcagguuu

SEQ ID NO: 50393 - RNA, 20 nt, Human
guugugcuaucaaauaccag

SEQ ID NO: 50394 - RNA, 20 nt, Human
uaauagagaaaagcccauua

SEQ ID NO: 50395 - RNA, 19 nt, Human
uaaugugauuuuuuccagu

SEQ ID NO: 50396 - RNA, 22 nt, Human
uacaauuaaauugcuguugacu

SEQ ID NO: 50397 - RNA, 19 nt, Human
uaccaggucuuauucauuc

SEQ ID NO: 50398 - RNA, 27 nt, Human
uaccuguucuucuccuucacaacccug

SEQ ID NO: 50399 - RNA, 23 nt, Human
uagcuauucuuccugaugcucuc

SEQ ID NO: 50400 - RNA, 24 nt, Human
uagcuauucuuccugaugcucucu

SEQ ID NO: 50401 - RNA, 19 nt, Human
ucacuuccuuuucuccuuu

SEQ ID NO: 50402 - RNA, 20 nt, Human
ucauguguccauguguucuc

SEQ ID NO: 50403 - RNA, 20 nt, Human
ucccugcccucaacaggccc

SEQ ID NO: 50404 - RNA, 19 nt, Human
uccuuuguugcuguaauuc

SEQ ID NO: 50405 - RNA, 18 nt, Human
ucucucucugccgacucc

SEQ ID NO: 50406 - RNA, 24 nt, Human
ucugccgacucccugcccucaaca

SEQ ID NO: 50407 - RNA, 19 nt, Human
ucuuugggaaacuguguug

SEQ ID NO: 50408 - RNA, 22 nt, Human
ugcacagaucaucucaucaccc

SEQ ID NO: 50409 - RNA, 21 nt, Human
uggggucuccaucuccucaag

SEQ ID NO: 50410 - RNA, 21 nt, Human
uguggguauuagguguauaua

SEQ ID NO: 50411 - RNA, 24 nt, Human
uguguguuguuccccaucaugugu

SEQ ID NO: 50412 - RNA, 19 nt, Human
uuaaacauauaaagaugaa

SEQ ID NO: 50413 - RNA, 24 nt, Human
uuacauagguaaacauguaccaug

SEQ ID NO: 50414 - RNA, 24 nt, Human
uucaacauagacaaaacguggaga

SEQ ID NO: 50415 - RNA, 19 nt, Human
uuccaggguacaugugcag

SEQ ID NO: 50416 - RNA, 19 nt, Human
uuccaguaaaaaucuuuuu

SEQ ID NO: 50417 - RNA, 20 nt, Human
uuuaagcuuguguaucaaua

SEQ ID NO: 50418 - RNA, 23 nt, Human
uuuauugaaaaauauaaaauaau

SEQ ID NO: 50419 - RNA, 22 nt, Human
aacaaggcacaguaccucccuu

SEQ ID NO: 50420 - RNA, 18 nt, Human
aacguuauguuucugagg

SEQ ID NO: 50421 - RNA, 20 nt, Human
aagagcaauuuggcaauguc

SEQ ID NO: 50422 - RNA, 20 nt, Human
aagcugcuccuaucacauca

SEQ ID NO: 50423 - RNA, 18 nt, Human
acagaaacuggcaacaac

SEQ ID NO: 50424 - RNA, 20 nt, Human
acagaagcagacuugggucc

SEQ ID NO: 50425 - RNA, 19 nt, Human
acauacaccuauuuaagcc

SEQ ID NO: 50426 - RNA, 24 nt, Human
acugaauuauccuuguccuugauu

SEQ ID NO: 50427 - RNA, 18 nt, Human
agaaacuggcaacaacuu

SEQ ID NO: 50428 - RNA, 18 nt, Human
agaacagauaaauuaugg

SEQ ID NO: 50429 - RNA, 19 nt, Human
aggggggcggggcgugggg

SEQ ID NO: 50430 - RNA, 18 nt, Human
auaaugggcagacaaacc

SEQ ID NO: 50431 - RNA, 21 nt, Human
augaaugacacacauaacccu

SEQ ID NO: 50432 - RNA, 21 nt, Human
augagugaaaaaagcuguaga

SEQ ID NO: 50433 - RNA, 25 nt, Human
auuccauacucauguaauucacaaa

SEQ ID NO: 50434 - RNA, 22 nt, Human
caaaaguaggugcugagaacuu

SEQ ID NO: 50435 - RNA, 20 nt, Human
caaggcacaguaccucccuu

SEQ ID NO: 50436 - RNA, 23 nt, Human
caaugaugacagcauaaaacaag

SEQ ID NO: 50437 - RNA, 19 nt, Human
caccuauuuaagcccagaa

SEQ ID NO: 50438 - RNA, 19 nt, Human
cagacacccaccacugccc

SEQ ID NO: 50439 - RNA, 24 nt, Human
caguacuaaagaguagaugguuua

SEQ ID NO: 50440 - RNA, 21 nt, Human
cagugaaaguacaacaacaca

SEQ ID NO: 50441 - RNA, 18 nt, Human
cauguaauucacaaaaac

SEQ ID NO: 50442 - RNA, 23 nt, Human
ccucuuggaggggaggaauggca

SEQ ID NO: 50443 - RNA, 21 nt, Human
ccugcuuccuuucccuuuccc

SEQ ID NO: 50444 - RNA, 24 nt, Human
ccuuaaagauaauaucacagaagc

SEQ ID NO: 50445 - RNA, 20 nt, Human
ccuucaacuggacuggagaa

SEQ ID NO: 50446 - RNA, 18 nt, Human
cgaaguggcaaaauguua

SEQ ID NO: 50447 - RNA, 28 nt, Human
cggcgcggggggcugacauccggggugg

SEQ ID NO: 50448 - RNA, 19 nt, Human
cugcuuccuuucccuuucc

SEQ ID NO: 50449 - RNA, 21 nt, Human
gaacaaggcacaguaccuccc

SEQ ID NO: 50450 - RNA, 23 nt, Human
gaagcagacuuggguccugauua

SEQ ID NO: 50451 - RNA, 22 nt, Human
gaaguggcaaaauguuaagauu

SEQ ID NO: 50452 - RNA, 19 nt, Human
gagcaauuuggcaaugucu

SEQ ID NO: 50453 - RNA, 19 nt, Human
gaggggggcggggcguggg

SEQ ID NO: 50454 - RNA, 23 nt, Human
gcaacaacuucaugccuucaacu

SEQ ID NO: 50455 - RNA, 18 nt, Human
gcaaguaugaggcuuaaa

SEQ ID NO: 50456 - RNA, 22 nt, Human
gcugugagguuggaggcgcuuc

SEQ ID NO: 50457 - RNA, 20 nt, Human
ggcgagcgccuagcgagggg

SEQ ID NO: 50458 - RNA, 19 nt, Human
ggcggggcguggggggggc

SEQ ID NO: 50459 - RNA, 26 nt, Human
ggcggugcucgagcuguggggcagcc

SEQ ID NO: 50460 - RNA, 20 nt, Human
gggcggggcguggggggggc

SEQ ID NO: 50461 - RNA, 23 nt, Human
gggcggggcguggggggggcuug

SEQ ID NO: 50462 - RNA, 21 nt, Human
ggggcggggcguggggggggc

SEQ ID NO: 50463 - RNA, 21 nt, Human
gugaaaaaagcuguagaauga

SEQ ID NO: 50464 - RNA, 20 nt, Human
uaaaacaguacuaaagagua

SEQ ID NO: 50465 - RNA, 22 nt, Human
uaccucuuggaggggaggaaug

SEQ ID NO: 50466 - RNA, 18 nt, Human
ucagauauaauuauacaa

SEQ ID NO: 50467 - RNA, 21 nt, Human
uccacacaaauguagaaauug

SEQ ID NO: 50468 - RNA, 21 nt, Human
uccauacucauguaauucaca

SEQ ID NO: 50469 - RNA, 20 nt, Human
ugaacgagagcuucagauau

SEQ ID NO: 50470 - RNA, 20 nt, Human
ugacugaauuauccuugucc

SEQ ID NO: 50471 - RNA, 24 nt, Human
ugacugaauuauccuuguccuuga

SEQ ID NO: 50472 - RNA, 19 nt, Human
ugagugaaaaaagcuguag

SEQ ID NO: 50473 - RNA, 20 nt, Human
ugagugaaaaaagcuguaga

SEQ ID NO: 50474 - RNA, 19 nt, Human
ugcaauggcuccaaccgga

SEQ ID NO: 50475 - RNA, 20 nt, Human
ugccauccuaggaauuuggg

SEQ ID NO: 50476 - RNA, 25 nt, Human
ugcccugcuuccuuucccuuucccu

SEQ ID NO: 50477 - RNA, 24 nt, Human
uggcaacaacuucaugccuucaac

SEQ ID NO: 50478 - RNA, 20 nt, Human
uguagaaugagcaaguauga

SEQ ID NO: 50479 - RNA, 20 nt, Human
uguggauaauuguuaccucu

SEQ ID NO: 50480 - RNA, 22 nt, Human
uuaaagauaauaucacagaagc

SEQ ID NO: 50481 - RNA, 19 nt, Human
uucaugccuucaacuggac

SEQ ID NO: 50482 - RNA, 19 nt, Human
uuggaggggaggaauggca

SEQ ID NO: 50483 - RNA, 23 nt, Human
aagccaauacacccuuucucuug

SEQ ID NO: 50484 - RNA, 19 nt, Human
agacauaaaauuuaugugg

SEQ ID NO: 50485 - RNA, 27 nt, Human
caaacacacagacauaaaauuuaugug

SEQ ID NO: 50486 - RNA, 25 nt, Human
caaauuccugaaagccucuucaauu

SEQ ID NO: 50487 - RNA, 23 nt, Human
caauacacccuuucucuuggucu

SEQ ID NO: 50488 - RNA, 19 nt, Human
cacccuuucucuuggucuc

SEQ ID NO: 50489 - RNA, 23 nt, Human
cuacucccaagccaauacacccu

SEQ ID NO: 50490 - RNA, 19 nt, Human
cucaaacacacagacauaa

SEQ ID NO: 50491 - RNA, 21 nt, Human
cuguagcaacuuucacuguag

SEQ ID NO: 50492 - RNA, 20 nt, Human
gaaauaaaacaaaaugcaga

SEQ ID NO: 50493 - RNA, 21 nt, Human
gacccuucuucuacucccaag

SEQ ID NO: 50494 - RNA, 27 nt, Human
uacaaauuccugaaagccucuucaauu

SEQ ID NO: 50495 - RNA, 20 nt, Human
uauugagaaagggagauccu

SEQ ID NO: 50496 - RNA, 19 nt, Human
ucaggauuauguauuuuau

SEQ ID NO: 50497 - RNA, 18 nt, Human
ucccaagccaauacaccc

SEQ ID NO: 50498 - RNA, 18 nt, Human
ugagaaagggagauccug

SEQ ID NO: 50499 - RNA, 23 nt, Human
ugagaaagggagauccuguagca

SEQ ID NO: 50500 - RNA, 21 nt, Human
uuggucucaaacacacagaca

SEQ ID NO: 50501 - RNA, 23 nt, Human
uuggucucaaacacacagacaua

SEQ ID NO: 50502 - RNA, 18 nt, Human
uuuauugagaaagggaga

SEQ ID NO: 50503 - RNA, 18 nt, Human
aaauagccuuguguaccc

SEQ ID NO: 50504 - RNA, 25 nt, Human
aaauagccuuguguacccauaugau

SEQ ID NO: 50505 - RNA, 21 nt, Human
aacacagaccuccugccacuu

SEQ ID NO: 50506 - RNA, 20 nt, Human
agccuuguguacccauauga

SEQ ID NO: 50507 - RNA, 19 nt, Human
auagacuuuuucugacuga

SEQ ID NO: 50508 - RNA, 23 nt, Human
caacauagaaauccaaguguaug

SEQ ID NO: 50509 - RNA, 24 nt, Human
caagagaaacuccaguucaccaug

SEQ ID NO: 50510 - RNA, 18 nt, Human
ccuccugccacuuuggau

SEQ ID NO: 50511 - RNA, 19 nt, Human
ccuuguguacccauaugau

SEQ ID NO: 50512 - RNA, 18 nt, Human
cucacaagagaaacucca

SEQ ID NO: 50513 - RNA, 18 nt, Human
gaaaaaugugcccguccc

SEQ ID NO: 50514 - RNA, 19 nt, Human
gacaacacagaccuccugc

SEQ ID NO: 50515 - RNA, 22 nt, Human
gacaacacagaccuccugccac

SEQ ID NO: 50516 - RNA, 24 nt, Human
gaugagggaacucucacaagagaa

SEQ ID NO: 50517 - RNA, 19 nt, Human
uaaaacucuuaaaaaucuc

SEQ ID NO: 50518 - RNA, 19 nt, Human
uauauaacagcagcuugug

SEQ ID NO: 50519 - RNA, 21 nt, Human
ucaccaugacaacacagaccu

SEQ ID NO: 50520 - RNA, 24 nt, Human
ucguugaaaaaugugcccgucccu

SEQ ID NO: 50521 - RNA, 19 nt, Human
ucugacugaugcucaguuc

SEQ ID NO: 50522 - RNA, 22 nt, Human
ucuguauuucugcaaacauaga

SEQ ID NO: 50523 - RNA, 22 nt, Human
ugacaacacagaccuccugcca

SEQ ID NO: 50524 - RNA, 18 nt, Human
uguaaaucaaaaauauua

SEQ ID NO: 50525 - RNA, 24 nt, Human
uguuaagugaauauuacucuggga

SEQ ID NO: 50526 - RNA, 20 nt, Human
uuaaaaaucuccauuucaac

SEQ ID NO: 50527 - RNA, 20 nt, Human
uuaaauggagucacuacuaa

SEQ ID NO: 50528 - RNA, 26 nt, Human
uugcaauucuacuguaucaaauugaa

SEQ ID NO: 50529 - RNA, 18 nt, Human
uuuucaguuucaccaagu

SEQ ID NO: 50530 - RNA, 20 nt, Human
aaacaaaucaguguacuaaa

SEQ ID NO: 50531 - RNA, 19 nt, Human
aagauucagcauuauuaua

SEQ ID NO: 50532 - RNA, 21 nt, Human
aagcagaaauguaaaaaacaa

SEQ ID NO: 50533 - RNA, 22 nt, Human
aagcagaaauguaaaaaacaaa

SEQ ID NO: 50534 - RNA, 24 nt, Human
aagcagaaauguaaaaaacaaauc

SEQ ID NO: 50535 - RNA, 22 nt, Human
aagcauuaccauacccuuguac

SEQ ID NO: 50536 - RNA, 19 nt, Human
accacagcaacugcuuccc

SEQ ID NO: 50537 - RNA, 21 nt, Human
acuuuggcucuacagcccacc

SEQ ID NO: 50538 - RNA, 18 nt, Human
aggaaaaaauggcagaua

SEQ ID NO: 50539 - RNA, 24 nt, Human
auagacacacauauacuccuaaau

SEQ ID NO: 50540 - RNA, 20 nt, Human
auaguaggaaaaaauggcag

SEQ ID NO: 50541 - RNA, 21 nt, Human
auuaaauugcaucugcauuca

SEQ ID NO: 50542 - RNA, 23 nt, Human
caaagcagaaauguaaaaaacaa

SEQ ID NO: 50543 - RNA, 21 nt, Human
caacugcuucccggcucaggc

SEQ ID NO: 50544 - RNA, 19 nt, Human
cacacaccccgcgcggccg

SEQ ID NO: 50545 - RNA, 24 nt, Human
cacacaccccgcgcggccggcccc

SEQ ID NO: 50546 - RNA, 18 nt, Human
cagugucugcacuccugg

SEQ ID NO: 50547 - RNA, 19 nt, Human
ccaccucugccauccacuc

SEQ ID NO: 50548 - RNA, 22 nt, Human
ccccgcgcggccggccccuggc

SEQ ID NO: 50549 - RNA, 21 nt, Human
ccccuggcuagccggccccgg

SEQ ID NO: 50550 - RNA, 20 nt, Human
ccggccccuggcuagccggc

SEQ ID NO: 50551 - RNA, 23 nt, Human
ccucacacaccccgcgcggccgg

SEQ ID NO: 50552 - RNA, 22 nt, Human
cggccccuggcuagccggcccc

SEQ ID NO: 50553 - RNA, 19 nt, Human
cggcucaggcacucagcga

SEQ ID NO: 50554 - RNA, 20 nt, Human
cuacagcccaccucugccau

SEQ ID NO: 50555 - RNA, 19 nt, Human
cucccaccccacuuuggcu

SEQ ID NO: 50556 - RNA, 28 nt, Human
cucccaccccacuuuggcucuacagccc

SEQ ID NO: 50557 - RNA, 22 nt, Human
gaaaaugaaauaaaaauuucua

SEQ ID NO: 50558 - RNA, 18 nt, Human
gcucuacagcccaccucu

SEQ ID NO: 50559 - RNA, 19 nt, Human
ggaaauaaacaucauuuuu

SEQ ID NO: 50560 - RNA, 24 nt, Human
ggagcgcguccucacacaccccgc

SEQ ID NO: 50561 - RNA, 24 nt, Human
ggcacuaucaaacuauggaaauaa

SEQ ID NO: 50562 - RNA, 18 nt, Human
ggcucaggcacucagcga

SEQ ID NO: 50563 - RNA, 23 nt, Human
gggagcgcguccucacacacccc

SEQ ID NO: 50564 - RNA, 23 nt, Human
gggcagugucugcacuccugggc

SEQ ID NO: 50565 - RNA, 18 nt, Human
uaaaaaacaaaucagugu

SEQ ID NO: 50566 - RNA, 19 nt, Human
uaaaaaacaaaucagugua

SEQ ID NO: 50567 - RNA, 20 nt, Human
uaaaaaacaaaucaguguac

SEQ ID NO: 50568 - RNA, 21 nt, Human
uaauuggcauuuaaguggcac

SEQ ID NO: 50569 - RNA, 22 nt, Human
uacagcccaccucugccaucca

SEQ ID NO: 50570 - RNA, 21 nt, Human
uaccacagcaacugcuucccg

SEQ ID NO: 50571 - RNA, 24 nt, Human
uaccauacccuuguacccucuaaa

SEQ ID NO: 50572 - RNA, 19 nt, Human
uacccuuguacccucuaaa

SEQ ID NO: 50573 - RNA, 19 nt, Human
uagggcagugucugcacuc

SEQ ID NO: 50574 - RNA, 23 nt, Human
uauagacacacauauacuccuaa

SEQ ID NO: 50575 - RNA, 24 nt, Human
uauauuaaauugcaucugcauuca

SEQ ID NO: 50576 - RNA, 18 nt, Human
uauguauguguguguaua

SEQ ID NO: 50577 - RNA, 22 nt, Human
uauuauaguaggaaaaaauggc

SEQ ID NO: 50578 - RNA, 24 nt, Human
ucccaccccacuuuggcucuacag

SEQ ID NO: 50579 - RNA, 23 nt, Human
uccucacacaccccgcgcggccg

SEQ ID NO: 50580 - RNA, 22 nt, Human
ucuacaagcauuaccauacccu

SEQ ID NO: 50581 - RNA, 25 nt, Human
ugguauauuuauguauguguguguu

SEQ ID NO: 50582 - RNA, 19 nt, Human
uguauagacacacauauac

SEQ ID NO: 50583 - RNA, 20 nt, Human
ugugguauauuuauguaugu

SEQ ID NO: 50584 - RNA, 20 nt, Human
uguguauagacacacauaua

SEQ ID NO: 50585 - RNA, 22 nt, Human
uguguguauagacacacauaua

SEQ ID NO: 50586 - RNA, 27 nt, Human
uguguguauagacacacauauacuuca

SEQ ID NO: 50587 - RNA, 22 nt, Human
uguguguguauagacacacaua

SEQ ID NO: 50588 - RNA, 22 nt, Human
uuauaguaggaaaaaauggcag

SEQ ID NO: 50589 - RNA, 25 nt, Human
uucaaagcagaaauguaaaaaacaa

SEQ ID NO: 50590 - RNA, 23 nt, Human
uucuacaagcauuaccauacccu

SEQ ID NO: 50591 - RNA, 24 nt, Human
uugaaaaugaaauaaaaauuucua

SEQ ID NO: 50592 - RNA, 19 nt, Human
uuggcucuacagcccaccu

SEQ ID NO: 50593 - RNA, 18 nt, Human
aaaaaucuugacagcaac

SEQ ID NO: 50594 - RNA, 18 nt, Human
aaauauugauaguuaccu

SEQ ID NO: 50595 - RNA, 18 nt, Human
aacuuuacaccucgcuga

SEQ ID NO: 50596 - RNA, 18 nt, Human
aagcccccagaaggaggg

SEQ ID NO: 50597 - RNA, 21 nt, Human
acccauuuuauguaaauagau

SEQ ID NO: 50598 - RNA, 18 nt, Human
agauuauacagagacucg

SEQ ID NO: 50599 - RNA, 22 nt, Human
auugcacuuuuccucuuuaggu

SEQ ID NO: 50600 - RNA, 22 nt, Human
caauggcaaaacuccgaagucc

SEQ ID NO: 50601 - RNA, 24 nt, Human
cacacaaacacacucacauuccac

SEQ ID NO: 50602 - RNA, 26 nt, Human
caccgcucgggaaguccuucgucccg

SEQ ID NO: 50603 - RNA, 23 nt, Human
caccugagcaaggcuaaggaagc

SEQ ID NO: 50604 - RNA, 22 nt, Human
cacgucuuaaaauaggggagga

SEQ ID NO: 50605 - RNA, 20 nt, Human
cacuugcaccugagcaaggc

SEQ ID NO: 50606 - RNA, 22 nt, Human
cauucacgucuuaaaauagggg

SEQ ID NO: 50607 - RNA, 25 nt, Human
ccacuggcaauggcaaaacuccgaa

SEQ ID NO: 50608 - RNA, 25 nt, Human
cccacuggcaauggcaaaacuccga

SEQ ID NO: 50609 - RNA, 18 nt, Human
cccggacucagggucucc

SEQ ID NO: 50610 - RNA, 19 nt, Human
ccgcagggcugucagagcc

SEQ ID NO: 50611 - RNA, 22 nt, Human
ccucccggacucagggucuccg

SEQ ID NO: 50612 - RNA, 21 nt, Human
cggcgaacaacuuuacaccuc

SEQ ID NO: 50613 - RNA, 25 nt, Human
cucacauuccacgcggcgaacaacu

SEQ ID NO: 50614 - RNA, 20 nt, Human
cuccuuaagccuggcaaaca

SEQ ID NO: 50615 - RNA, 20 nt, Human
gcaaaacuccgaaguccaag

SEQ ID NO: 50616 - RNA, 20 nt, Human
gccgugagaaaucaguuugu

SEQ ID NO: 50617 - RNA, 20 nt, Human
gcuaaggaagcgaagccccc

SEQ ID NO: 50618 - RNA, 21 nt, Human
ggauucuucugcaccccgccc

SEQ ID NO: 50619 - RNA, 20 nt, Human
uaaauagauuauacagagaa

SEQ ID NO: 50620 - RNA, 20 nt, Human
uaagccuggcaaacacucgg

SEQ ID NO: 50621 - RNA, 21 nt, Human
uacaaaaaaaaucuugacagc

SEQ ID NO: 50622 - RNA, 24 nt, Human
uauguacaacacgcauugcacuuu

SEQ ID NO: 50623 - RNA, 19 nt, Human
ucagaccccugcuccgggg

SEQ ID NO: 50624 - RNA, 23 nt, Human
ucagagcccgguccccacaccgc

SEQ ID NO: 50625 - RNA, 20 nt, Human
ugagcaaggcuaaggaagcg

SEQ ID NO: 50626 - RNA, 21 nt, Human
ugcacacaaacacacucacau

SEQ ID NO: 50627 - RNA, 19 nt, Human
uggcucagaccccugcucc

SEQ ID NO: 50628 - RNA, 20 nt, Human
aaccgacggccaccuccccu

SEQ ID NO: 50629 - RNA, 24 nt, Human
aaccuacccuuucugccucuccca

SEQ ID NO: 50630 - RNA, 18 nt, Human
aagacaagcagacucccc

SEQ ID NO: 50631 - RNA, 18 nt, Human
aagccccugaaaacccag

SEQ ID NO: 50632 - RNA, 18 nt, Human
aaggucaaccgacggcca

SEQ ID NO: 50633 - RNA, 25 nt, Human
aaucaucagaaaugauuacugaacc

SEQ ID NO: 50634 - RNA, 20 nt, Human
acaagcagacuccccugccu

SEQ ID NO: 50635 - RNA, 23 nt, Human
acagacacucccucguccacccc

SEQ ID NO: 50636 - RNA, 21 nt, Human
accccguucccaggcaggcag

SEQ ID NO: 50637 - RNA, 20 nt, Human
accucgacgccuucagcagc

SEQ ID NO: 50638 - RNA, 21 nt, Human
acgaggcaagcaccauccugc

SEQ ID NO: 50639 - RNA, 22 nt, Human
acuguucuguccaagugccccc

SEQ ID NO: 50640 - RNA, 20 nt, Human
agagggagaggaggcucugg

SEQ ID NO: 50641 - RNA, 22 nt, Human
agaucccuaaaguccuagaccc

SEQ ID NO: 50642 - RNA, 19 nt, Human
agcaccauccugccugcug

SEQ ID NO: 50643 - RNA, 26 nt, Human
agcacuccagcaaaucaucagaaaug

SEQ ID NO: 50644 - RNA, 23 nt, Human
aggacccuugcccucccaggccu

SEQ ID NO: 50645 - RNA, 20 nt, Human
aggccuccugcagggcccag

SEQ ID NO: 50646 - RNA, 18 nt, Human
aggcucccccaccuugcc

SEQ ID NO: 50647 - RNA, 18 nt, Human
aggcucccccgccucgcc

SEQ ID NO: 50648 - RNA, 18 nt, Human
agggcguggagccagcaa

SEQ ID NO: 50649 - RNA, 19 nt, Human
agggcucagagcuaccacc

SEQ ID NO: 50650 - RNA, 23 nt, Human
aucccuaaaguccuagacccccg

SEQ ID NO: 50651 - RNA, 22 nt, Human
caaagccccugaaaacccagcc

SEQ ID NO: 50652 - RNA, 21 nt, Human
caaccgacggccaccuccccu

SEQ ID NO: 50653 - RNA, 21 nt, Human
caagcaccuucucccagccca

SEQ ID NO: 50654 - RNA, 26 nt, Human
caagugcccccacaccucgacgccuu

SEQ ID NO: 50655 - RNA, 22 nt, Human
cacaugggccucccuugggagc

SEQ ID NO: 50656 - RNA, 18 nt, Human
caccaaagcuggcagagc

SEQ ID NO: 50657 - RNA, 22 nt, Human
caccaacaucuaagacaagcag

SEQ ID NO: 50658 - RNA, 22 nt, Human
caccuccccucccucgcccccc

SEQ ID NO: 50659 - RNA, 19 nt, Human
caccugguauggccugggg

SEQ ID NO: 50660 - RNA, 23 nt, Human
cagaagcccaagcaccuucuccc

SEQ ID NO: 50661 - RNA, 21 nt, Human
cagagccucccccaugccccc

SEQ ID NO: 50662 - RNA, 24 nt, Human
cagaucccagaucccuaaaguccu

SEQ ID NO: 50663 - RNA, 23 nt, Human
cagcaaggccuucccccacaugg

SEQ ID NO: 50664 - RNA, 25 nt, Human
cagcacuccagcaaaucaucagaaa

SEQ ID NO: 50665 - RNA, 23 nt, Human
cagcagagauggggucaccuagg

SEQ ID NO: 50666 - RNA, 23 nt, Human
cagcccggcccaaggucaccaaa

SEQ ID NO: 50667 - RNA, 20 nt, Human
cagccugcuaaacccacccc

SEQ ID NO: 50668 - RNA, 18 nt, Human
cagcuggggcaggcucag

SEQ ID NO: 50669 - RNA, 23 nt, Human
caggaucccccgccucgcccucc

SEQ ID NO: 50670 - RNA, 19 nt, Human
caggcccagaagcagcaga

SEQ ID NO: 50671 - RNA, 25 nt, Human
caucagcagacgggcaccaaggggc

SEQ ID NO: 50672 - RNA, 23 nt, Human
ccaacaucuaagacaagcagacu

SEQ ID NO: 50673 - RNA, 18 nt, Human
ccaagcaccuucucccag

SEQ ID NO: 50674 - RNA, 19 nt, Human
ccagcaccuaccgcaccaa

SEQ ID NO: 50675 - RNA, 18 nt, Human
ccagcccagguggcuccu

SEQ ID NO: 50676 - RNA, 24 nt, Human
ccagcccugaagcgcuggacugcu

SEQ ID NO: 50677 - RNA, 24 nt, Human
ccaggaucccccgccucgcccucc

SEQ ID NO: 50678 - RNA, 25 nt, Human
ccaggcccggcaacgggggccagug

SEQ ID NO: 50679 - RNA, 20 nt, Human
ccaguggagcugguggccca

SEQ ID NO: 50680 - RNA, 21 nt, Human
ccaucaggcccagaagcagca

SEQ ID NO: 50681 - RNA, 22 nt, Human
ccaucaggcccagaagcagcag

SEQ ID NO: 50682 - RNA, 20 nt, Human
cccacaccucgacgccuuca

SEQ ID NO: 50683 - RNA, 20 nt, Human
cccagcccugaagcgcugga

SEQ ID NO: 50684 - RNA, 18 nt, Human
ccccaggaccugcccagc

SEQ ID NO: 50685 - RNA, 20 nt, Human
ccccaggaccugcccagccc

SEQ ID NO: 50686 - RNA, 20 nt, Human
ccccccgacacaggggcucc

SEQ ID NO: 50687 - RNA, 19 nt, Human
cccccgccucgcccucccc

SEQ ID NO: 50688 - RNA, 19 nt, Human
cccccgccucgcccucccc

SEQ ID NO: 50689 - RNA, 21 nt, Human
cccccggacaccugcaacaga

SEQ ID NO: 50690 - RNA, 19 nt, Human
ccccgccucgcccucccac

SEQ ID NO: 50691 - RNA, 18 nt, Human
cccuuucugccucuccca

SEQ ID NO: 50692 - RNA, 20 nt, Human
ccgcaccaagcucacucccc

SEQ ID NO: 50693 - RNA, 18 nt, Human
ccgcagaagcccaagcac

SEQ ID NO: 50694 - RNA, 18 nt, Human
ccuaaaguccuagacccc

SEQ ID NO: 50695 - RNA, 20 nt, Human
ccuacagucaacacugaguc

SEQ ID NO: 50696 - RNA, 22 nt, Human
ccuacccuuucugccucuccca

SEQ ID NO: 50697 - RNA, 22 nt, Human
ccucaccgcagaagcccaagca

SEQ ID NO: 50698 - RNA, 21 nt, Human
ccucccacacaggggcuccag

SEQ ID NO: 50699 - RNA, 21 nt, Human
ccucccacacaggggcuccag

SEQ ID NO: 50700 - RNA, 23 nt, Human
ccuccugcagggcccagagguug

SEQ ID NO: 50701 - RNA, 19 nt, Human
ccucguccaccccguuccc

SEQ ID NO: 50702 - RNA, 20 nt, Human
ccugaagcgcuggacugcuc

SEQ ID NO: 50703 - RNA, 22 nt, Human
ccugcaacagagcuuccaaagc

SEQ ID NO: 50704 - RNA, 24 nt, Human
ccugcaacagagcuuccaaagccc

SEQ ID NO: 50705 - RNA, 19 nt, Human
ccugccccuuagcugccuc

SEQ ID NO: 50706 - RNA, 18 nt, Human
ccugcuaaacccacccca

SEQ ID NO: 50707 - RNA, 25 nt, Human
ccugcugcagccugcuaaacccacc

SEQ ID NO: 50708 - RNA, 25 nt, Human
ccuucccccacaugcucucaggggg

SEQ ID NO: 50709 - RNA, 19 nt, Human
cgccccccgacacaggggc

SEQ ID NO: 50710 - RNA, 18 nt, Human
cgccucgcccucccacac

SEQ ID NO: 50711 - RNA, 18 nt, Human
cgccucgcccucccacac

SEQ ID NO: 50712 - RNA, 28 nt, Human
cgccucgcccucccacacaggggcucca

SEQ ID NO: 50713 - RNA, 28 nt, Human
cgccucgcccucccacacaggggcucca

SEQ ID NO: 50714 - RNA, 20 nt, Human
cuagcaccugguauggccug

SEQ ID NO: 50715 - RNA, 18 nt, Human
cucaaccucucuccuucc

SEQ ID NO: 50716 - RNA, 23 nt, Human
cucauaguccuccggcucccgcc

SEQ ID NO: 50717 - RNA, 19 nt, Human
cuccaggcuuggcagggca

SEQ ID NO: 50718 - RNA, 18 nt, Human
cucccacguacaauccug

SEQ ID NO: 50719 - RNA, 22 nt, Human
cucccaggccuccugcagggcc

SEQ ID NO: 50720 - RNA, 22 nt, Human
cucccccaccuugccccccaac

SEQ ID NO: 50721 - RNA, 25 nt, Human
cuccuccccggaaagcucagggcaa

SEQ ID NO: 50722 - RNA, 18 nt, Human
cucgccccccgacacagg

SEQ ID NO: 50723 - RNA, 19 nt, Human
cucuggacaacgcgcggca

SEQ ID NO: 50724 - RNA, 19 nt, Human
cucuggccagucucuccua

SEQ ID NO: 50725 - RNA, 19 nt, Human
cugcagccugcuaaaccca

SEQ ID NO: 50726 - RNA, 24 nt, Human
cugcuaaacccaccccaggggcgc

SEQ ID NO: 50727 - RNA, 19 nt, Human
cugggcacaucagcagacg

SEQ ID NO: 50728 - RNA, 20 nt, Human
cuucagcagccgcuagcucc

SEQ ID NO: 50729 - RNA, 20 nt, Human
cuuccaaagccccugaaaac

SEQ ID NO: 50730 - RNA, 22 nt, Human
cuuccaaagccccugaaaaccc

SEQ ID NO: 50731 - RNA, 24 nt, Human
cuuccaaagccccugaaaacccag

SEQ ID NO: 50732 - RNA, 20 nt, Human
gaacaggccagugcauccuc

SEQ ID NO: 50733 - RNA, 20 nt, Human
gaggcaagcaccauccugcc

SEQ ID NO: 50734 - RNA, 22 nt, Human
gcaagaaggagggcucagagcu

SEQ ID NO: 50735 - RNA, 18 nt, Human
gcccccagccaacagccc

SEQ ID NO: 50736 - RNA, 18 nt, Human
gccccccaacacaggggc

SEQ ID NO: 50737 - RNA, 18 nt, Human
gcccggcaacgggggccg

SEQ ID NO: 50738 - RNA, 19 nt, Human
gccgcagcgcucccagccc

SEQ ID NO: 50739 - RNA, 25 nt, Human
gcugcaccaccaacaucuaagacag

SEQ ID NO: 50740 - RNA, 21 nt, Human
ggcugggcucuggacaacgcg

SEQ ID NO: 50741 - RNA, 21 nt, Human
gggcuccaggcucccccaccu

SEQ ID NO: 50742 - RNA, 21 nt, Human
gggcuccaggcucccccgccu

SEQ ID NO: 50743 - RNA, 19 nt, Human
gggcugcaccaccaacauc

SEQ ID NO: 50744 - RNA, 19 nt, Human
gggcugggcugggcucugg

SEQ ID NO: 50745 - RNA, 21 nt, Human
gggcuggugggagcggaaggc

SEQ ID NO: 50746 - RNA, 22 nt, Human
ggggcuccaggaucccccgccu

SEQ ID NO: 50747 - RNA, 18 nt, Human
guccucagaggugggaac

SEQ ID NO: 50748 - RNA, 21 nt, Human
guggguaucucuucagagccu

SEQ ID NO: 50749 - RNA, 19 nt, Human
uaagacaagcagacucccc

SEQ ID NO: 50750 - RNA, 26 nt, Human
uacagaacaggccagugcauccucaa

SEQ ID NO: 50751 - RNA, 20 nt, Human
uagacaccuggucccuccgu

SEQ ID NO: 50752 - RNA, 21 nt, Human
uagacccccggacaccugcaa

SEQ ID NO: 50753 - RNA, 21 nt, Human
uaggacccuugcccucccagg

SEQ ID NO: 50754 - RNA, 22 nt, Human
ucagagccucccccaugccccc

SEQ ID NO: 50755 - RNA, 23 nt, Human
ucagcagacgggcaccaaggggc

SEQ ID NO: 50756 - RNA, 24 nt, Human
ucaugggauggucaggcagguggg

SEQ ID NO: 50757 - RNA, 20 nt, Human
uccaaagccccugaaaaccc

SEQ ID NO: 50758 - RNA, 22 nt, Human
uccaggaucccccgccucgccc

SEQ ID NO: 50759 - RNA, 19 nt, Human
uccaggcuccuccccggaa

SEQ ID NO: 50760 - RNA, 22 nt, Human
ucccagaggcagugcccaaagu

SEQ ID NO: 50761 - RNA, 24 nt, Human
ucccagaggcagugcccaaaguuc

SEQ ID NO: 50762 - RNA, 27 nt, Human
ucccagaucccuaaaguccuagacccc

SEQ ID NO: 50763 - RNA, 22 nt, Human
ucccaggcaggcagaaugcucc

SEQ ID NO: 50764 - RNA, 22 nt, Human
ucccaggccuccugcagggccc

SEQ ID NO: 50765 - RNA, 21 nt, Human
uccccaggaccugcccagccc

SEQ ID NO: 50766 - RNA, 22 nt, Human
ucccccaccuugccccccaaca

SEQ ID NO: 50767 - RNA, 18 nt, Human
ucccccgccucgcccucc

SEQ ID NO: 50768 - RNA, 18 nt, Human
ucccccgccucgcccucc

SEQ ID NO: 50769 - RNA, 21 nt, Human
uccccugccucaccgcagaag

SEQ ID NO: 50770 - RNA, 21 nt, Human
uccggcucccgccgcagcgcu

SEQ ID NO: 50771 - RNA, 23 nt, Human
uccguaggacccuugcccuccca

SEQ ID NO: 50772 - RNA, 21 nt, Human
uccucaccugccagccucaca

SEQ ID NO: 50773 - RNA, 18 nt, Human
uccugcagggcccagagg

SEQ ID NO: 50774 - RNA, 19 nt, Human
ucuaguguucuccucucca

SEQ ID NO: 50775 - RNA, 21 nt, Human
ucucccagcccagguggcucc

SEQ ID NO: 50776 - RNA, 20 nt, Human
ucuccuacagaacaggccag

SEQ ID NO: 50777 - RNA, 18 nt, Human
ugacacucauguucagaa

SEQ ID NO: 50778 - RNA, 26 nt, Human
ugagguuaaacccuuccucaccugcc

SEQ ID NO: 50779 - RNA, 19 nt, Human
ugaguccuuacagacacuc

SEQ ID NO: 50780 - RNA, 24 nt, Human
ugauuccugccccuuagcugccuc

SEQ ID NO: 50781 - RNA, 28 nt, Human
ugcaacagagcuuccaaagccccugaaa

SEQ ID NO: 50782 - RNA, 25 nt, Human
ugcagggcccagagguguaggguag

SEQ ID NO: 50783 - RNA, 24 nt, Human
ugccugcugcagccugcuaaaccc

SEQ ID NO: 50784 - RNA, 21 nt, Human
ugcuaaacccaccccaggggc

SEQ ID NO: 50785 - RNA, 21 nt, Human
uggagccagcacuccagcaaa

SEQ ID NO: 50786 - RNA, 21 nt, Human
uggagggaccacacucugugg

SEQ ID NO: 50787 - RNA, 22 nt, Human
uggcccagggcaaggagagcag

SEQ ID NO: 50788 - RNA, 23 nt, Human
uggccggcaggggucccagaggc

SEQ ID NO: 50789 - RNA, 23 nt, Human
ugggcugggcucuggacaacgcg

SEQ ID NO: 50790 - RNA, 24 nt, Human
ugggcuggugggagcggaaggcgg

SEQ ID NO: 50791 - RNA, 23 nt, Human
ugggguccagaguccucagaggu

SEQ ID NO: 50792 - RNA, 21 nt, Human
uggguaucucuucagagccuc

SEQ ID NO: 50793 - RNA, 22 nt, Human
uuacugaaccuacccuuucugc

SEQ ID NO: 50794 - RNA, 19 nt, Human
uuagucacaugggccuccc

SEQ ID NO: 50795 - RNA, 28 nt, Human
uucacaugacagcaaggccuucccccac

SEQ ID NO: 50796 - RNA, 26 nt, Human
uuuauuagucacaugggccucccuug

SEQ ID NO: 50797 - RNA, 21 nt, Human
aaacaucugcuuccucagaac

SEQ ID NO: 50798 - RNA, 18 nt, Human
aaccucuccccugggacc

SEQ ID NO: 50799 - RNA, 18 nt, Human
aacgugacuggucaagcc

SEQ ID NO: 50800 - RNA, 20 nt, Human
aagcugcucuguggagacaa

SEQ ID NO: 50801 - RNA, 23 nt, Human
aaggccucucacuggguagcucu

SEQ ID NO: 50802 - RNA, 19 nt, Human
accccugagccccuuccuc

SEQ ID NO: 50803 - RNA, 26 nt, Human
accuggugcaaggccucacagcauga

SEQ ID NO: 50804 - RNA, 23 nt, Human
acucagcacaugccaguggccug

SEQ ID NO: 50805 - RNA, 22 nt, Human
acuccaagagauggcccuggga

SEQ ID NO: 50806 - RNA, 23 nt, Human
agaaggaaaggcaguuagacaag

SEQ ID NO: 50807 - RNA, 18 nt, Human
agacccagcagccagaga

SEQ ID NO: 50808 - RNA, 19 nt, Human
agcagcaucauggcucagc

SEQ ID NO: 50809 - RNA, 19 nt, Human
agccaaccagaaagauaaa

SEQ ID NO: 50810 - RNA, 20 nt, Human
agccacuccccagucucagg

SEQ ID NO: 50811 - RNA, 24 nt, Human
agcucacgguccauugcugcagcc

SEQ ID NO: 50812 - RNA, 22 nt, Human
aggaggcuauuggagccacucc

SEQ ID NO: 50813 - RNA, 18 nt, Human
aggcaggcucagcacgga

SEQ ID NO: 50814 - RNA, 24 nt, Human
agucugcugugcccaagcugcucu

SEQ ID NO: 50815 - RNA, 23 nt, Human
aguggccugccagccccaaccuc

SEQ ID NO: 50816 - RNA, 22 nt, Human
agugguguguggguggcaggag

SEQ ID NO: 50817 - RNA, 21 nt, Human
caaagaugcugcuggugcugu

SEQ ID NO: 50818 - RNA, 19 nt, Human
caaaguaggaaccggcugc

SEQ ID NO: 50819 - RNA, 21 nt, Human
caaccagaaagauaaagaucu

SEQ ID NO: 50820 - RNA, 21 nt, Human
cacacuuacauuuuuccugga

SEQ ID NO: 50821 - RNA, 21 nt, Human
caccucugggcccagcagcuc

SEQ ID NO: 50822 - RNA, 25 nt, Human
cagaaaaaaacauucccuuuagaag

SEQ ID NO: 50823 - RNA, 24 nt, Human
cagaacccaagcccuucuugcugg

SEQ ID NO: 50824 - RNA, 21 nt, Human
cagaccccugagccccuuccu

SEQ ID NO: 50825 - RNA, 23 nt, Human
cagcagcuccugaacccuaggag

SEQ ID NO: 50826 - RNA, 27 nt, Human
ccacagacgacaggcaggcucagcacg

SEQ ID NO: 50827 - RNA, 26 nt, Human
ccagucugcugugcccaagcugcucu

SEQ ID NO: 50828 - RNA, 21 nt, Human
ccccagucucagggccaggcc

SEQ ID NO: 50829 - RNA, 24 nt, Human
cccccaccuggugcaaggccucac

SEQ ID NO: 50830 - RNA, 20 nt, Human
ccccugagccccuuccucac

SEQ ID NO: 50831 - RNA, 23 nt, Human
ccccugagccccuuccucacagg

SEQ ID NO: 50832 - RNA, 22 nt, Human
ccccuuccucacaggagccaag

SEQ ID NO: 50833 - RNA, 19 nt, Human
cccgccuggcucccagccc

SEQ ID NO: 50834 - RNA, 18 nt, Human
ccgcccgccuggcuccca

SEQ ID NO: 50835 - RNA, 19 nt, Human
ccucagggucuccuggcac

SEQ ID NO: 50836 - RNA, 22 nt, Human
ccucugggcccagcagcuccug

SEQ ID NO: 50837 - RNA, 21 nt, Human
ccugaaaccaggcccucugca

SEQ ID NO: 50838 - RNA, 19 nt, Human
ccugcuggggcgcucucca

SEQ ID NO: 50839 - RNA, 22 nt, Human
cucacagcaugaaacaucugcu

SEQ ID NO: 50840 - RNA, 22 nt, Human
cucagaacccaagcccuucuug

SEQ ID NO: 50841 - RNA, 18 nt, Human
cucugggcccagcagcuc

SEQ ID NO: 50842 - RNA, 23 nt, Human
cucuguggagacaagguggugcu

SEQ ID NO: 50843 - RNA, 24 nt, Human
cugcaguggagggcugggccugcc

SEQ ID NO: 50844 - RNA, 22 nt, Human
cuggcagcagcaucauggcucu

SEQ ID NO: 50845 - RNA, 24 nt, Human
cuugcugggccucaugcugcucca

SEQ ID NO: 50846 - RNA, 18 nt, Human
gaggcuauuggagccacu

SEQ ID NO: 50847 - RNA, 22 nt, Human
gauggcagcugugacagcagga

SEQ ID NO: 50848 - RNA, 21 nt, Human
gcagcagcaucauggcucagc

SEQ ID NO: 50849 - RNA, 24 nt, Human
gcccucagggucuccuggcacucu

SEQ ID NO: 50850 - RNA, 20 nt, Human
gcccugggacugagaagugg

SEQ ID NO: 50851 - RNA, 21 nt, Human
gcugugacagcaggagaggac

SEQ ID NO: 50852 - RNA, 23 nt, Human
gcuucaggguuccugaggcaccu

SEQ ID NO: 50853 - RNA, 19 nt, Human
ggaaggggcaaacuccaug

SEQ ID NO: 50854 - RNA, 19 nt, Human
gggcugggccagcucacgg

SEQ ID NO: 50855 - RNA, 21 nt, Human
gguuuccucacacuuacauuu

SEQ ID NO: 50856 - RNA, 21 nt, Human
gugcaaggccucacagcauga

SEQ ID NO: 50857 - RNA, 23 nt, Human
guuacaacucccuauccuugauc

SEQ ID NO: 50858 - RNA, 21 nt, Human
uaggaaccggcugcccucagg

SEQ ID NO: 50859 - RNA, 24 nt, Human
uaggagagucuagggagaguggug

SEQ ID NO: 50860 - RNA, 18 nt, Human
uaucucagaaaaaaacau

SEQ ID NO: 50861 - RNA, 24 nt, Human
ucaccucugggcccagcagcuccu

SEQ ID NO: 50862 - RNA, 24 nt, Human
ucagaacccaagcccuucuugcug

SEQ ID NO: 50863 - RNA, 22 nt, Human
ucagggucuccuggcacucucu

SEQ ID NO: 50864 - RNA, 19 nt, Human
ucaugcugcuccagccugg

SEQ ID NO: 50865 - RNA, 22 nt, Human
ucaugcugcuccagccuggggc

SEQ ID NO: 50866 - RNA, 19 nt, Human
uccaagggcuuuuucacag

SEQ ID NO: 50867 - RNA, 23 nt, Human
uccauugcugcagcccagccgcc

SEQ ID NO: 50868 - RNA, 20 nt, Human
uccccgggcagaggcucugg

SEQ ID NO: 50869 - RNA, 20 nt, Human
uccccugggaccugggccca

SEQ ID NO: 50870 - RNA, 21 nt, Human
uccccugggaccugggcccau

SEQ ID NO: 50871 - RNA, 20 nt, Human
uccugaaaccaggcccucug

SEQ ID NO: 50872 - RNA, 22 nt, Human
ucucucaguccaaaguaggaac

SEQ ID NO: 50873 - RNA, 18 nt, Human
ucugcaguggagggcugg

SEQ ID NO: 50874 - RNA, 21 nt, Human
ucugcugugcccaagcugcuc

SEQ ID NO: 50875 - RNA, 18 nt, Human
ugacagcaggagaggacu

SEQ ID NO: 50876 - RNA, 18 nt, Human
ugagaaguggauggcagc

SEQ ID NO: 50877 - RNA, 19 nt, Human
ugagaaguggauggcagcu

SEQ ID NO: 50878 - RNA, 19 nt, Human
ugccaguggccugccagcc

SEQ ID NO: 50879 - RNA, 23 nt, Human
ugcccaagcugcucuguggagac

SEQ ID NO: 50880 - RNA, 20 nt, Human
ugcucuggcacugcucuguu

SEQ ID NO: 50881 - RNA, 28 nt, Human
ugcucuguuacaacucccuauccuugau

SEQ ID NO: 50882 - RNA, 22 nt, Human
ugcugggccucaugcugcucca

SEQ ID NO: 50883 - RNA, 26 nt, Human
ugcugugcccaagcugcucuguggag

SEQ ID NO: 50884 - RNA, 22 nt, Human
ugcuuccagaugcuucugcagu

SEQ ID NO: 50885 - RNA, 20 nt, Human
uggugcuguggcccccaccu

SEQ ID NO: 50886 - RNA, 23 nt, Human
ugguguguggguggcaggaggcu

SEQ ID NO: 50887 - RNA, 21 nt, Human
ugugacagcaggagaggacug

SEQ ID NO: 50888 - RNA, 23 nt, Human
uguggguggcaggaggcuauugg

SEQ ID NO: 50889 - RNA, 28 nt, Human
uuccucagaacccaagcccuucuugcug

SEQ ID NO: 50890 - RNA, 25 nt, Human
uugcugggccucaugcugcuccagc

SEQ ID NO: 50891 - RNA, 18 nt, Human
uuuagaaggaaaggcagu

SEQ ID NO: 50892 - RNA, 24 nt, Human
uuuccucacacuuacauuuuuccu

SEQ ID NO: 50893 - RNA, 22 nt, Human
uuuuuuuuuuuuuuuuucauuu

SEQ ID NO: 50894 - RNA, 19 nt, Human
aaacaaggcagacuuuuaa

SEQ ID NO: 50895 - RNA, 18 nt, Human
aaccagccguguccucuu

SEQ ID NO: 50896 - RNA, 21 nt, Human
aaggcgcgccgggcgaggggc

SEQ ID NO: 50897 - RNA, 23 nt, Human
acaaggcagacuuuuaaaaacaa

SEQ ID NO: 50898 - RNA, 22 nt, Human
acaguaaaauaguuucaguaau

SEQ ID NO: 50899 - RNA, 22 nt, Human
agcaccacccacucgcccgagc

SEQ ID NO: 50900 - RNA, 27 nt, Human
agcaccacccacucgcccgagcccaaa

SEQ ID NO: 50901 - RNA, 19 nt, Human
agccucggggcuggggcgc

SEQ ID NO: 50902 - RNA, 20 nt, Human
agcugaauagaucauaaaua

SEQ ID NO: 50903 - RNA, 19 nt, Human
aggcgcgccgggcgagggg

SEQ ID NO: 50904 - RNA, 19 nt, Human
aggcggcacccauuggccc

SEQ ID NO: 50905 - RNA, 25 nt, Human
auggccauagcgcccggaccgcgcc

SEQ ID NO: 50906 - RNA, 21 nt, Human
caccacccacucgcccgagcc

SEQ ID NO: 50907 - RNA, 24 nt, Human
cacccacucgcccgagcccaaagu

SEQ ID NO: 50908 - RNA, 26 nt, Human
cauggccauagcgcccggaccgcgcc

SEQ ID NO: 50909 - RNA, 20 nt, Human
cccacucgcccgagcccaaa

SEQ ID NO: 50910 - RNA, 21 nt, Human
ccccccgcggccaagaggcgg

SEQ ID NO: 50911 - RNA, 25 nt, Human
cgggacccacgggucggggcccccc

SEQ ID NO: 50912 - RNA, 23 nt, Human
cuccgccugccgcuucugagccu

SEQ ID NO: 50913 - RNA, 18 nt, Human
gaagaggcgagagccuag

SEQ ID NO: 50914 - RNA, 20 nt, Human
gagccuacuacugacacagg

SEQ ID NO: 50915 - RNA, 21 nt, Human
ggcggauaacuaacaaauugc

SEQ ID NO: 50916 - RNA, 18 nt, Human
gggcauggccauagcgcc

SEQ ID NO: 50917 - RNA, 28 nt, Human
gggcauggccauagcgcccggaccgcgc

SEQ ID NO: 50918 - RNA, 19 nt, Human
gggcuggggcgcugguggc

SEQ ID NO: 50919 - RNA, 18 nt, Human
uaaaagcagcugaauaga

SEQ ID NO: 50920 - RNA, 21 nt, Human
uaaaagcagcugaauagauca

SEQ ID NO: 50921 - RNA, 19 nt, Human
uagcgcccggaccgcgccu

SEQ ID NO: 50922 - RNA, 23 nt, Human
ucauaaauauauuugucaauccu

SEQ ID NO: 50923 - RNA, 23 nt, Human
uccacacaguaaaagcagcugaa

SEQ ID NO: 50924 - RNA, 21 nt, Human
uccaccauaaacaaggcagac

SEQ ID NO: 50925 - RNA, 18 nt, Human
uccauuuccuugugaggu

SEQ ID NO: 50926 - RNA, 20 nt, Human
uccuuggagccuacuacuga

SEQ ID NO: 50927 - RNA, 21 nt, Human
ucggggcuggggcgcuggugg

SEQ ID NO: 50928 - RNA, 19 nt, Human
ucuuguggauuuguaucuu

SEQ ID NO: 50929 - RNA, 20 nt, Human
ucuuucacaaugaaaaccag

SEQ ID NO: 50930 - RNA, 18 nt, Human
ugacacauacauauuagc

SEQ ID NO: 50931 - RNA, 19 nt, Human
uggcccgcgcgcccgcccg

SEQ ID NO: 50932 - RNA, 18 nt, Human
uucacaaugaaaaccagc

SEQ ID NO: 50933 - RNA, 22 nt, Human
uucuccuggaagaggcgagagc

SEQ ID NO: 50934 - RNA, 21 nt, Human
uuuccaccauaaacaaggcag

SEQ ID NO: 50935 - RNA, 20 nt, Human
aaaaagagacuuugguggca

SEQ ID NO: 50936 - RNA, 22 nt, Human
aaacucaguuuauuucuucugu

SEQ ID NO: 50937 - RNA, 19 nt, Human
aaaugagucaccaccacac

SEQ ID NO: 50938 - RNA, 19 nt, Human
aagaggaaguacagagcuc

SEQ ID NO: 50939 - RNA, 20 nt, Human
aagaggagccaugaguggca

SEQ ID NO: 50940 - RNA, 29 nt, Human
aaguuuccagaaugcuguaggacagcucu

SEQ ID NO: 50941 - RNA, 19 nt, Human
aaugaaguggaggaagaga

SEQ ID NO: 50942 - RNA, 19 nt, Human
acagagucaucucugaugg

SEQ ID NO: 50943 - RNA, 24 nt, Human
accaccacacacauguucagccca

SEQ ID NO: 50944 - RNA, 19 nt, Human
agaaaggacaaaggaaaaa

SEQ ID NO: 50945 - RNA, 23 nt, Human
agaagcagaggaacaaaaaagag

SEQ ID NO: 50946 - RNA, 19 nt, Human
agacgucuucccagagguc

SEQ ID NO: 50947 - RNA, 24 nt, Human
agagcagaagaggagccaugagug

SEQ ID NO: 50948 - RNA, 21 nt, Human
agaggaaguacagagcucaga

SEQ ID NO: 50949 - RNA, 23 nt, Human
agagguccaugugcagugacagu

SEQ ID NO: 50950 - RNA, 23 nt, Human
agauguccucaacgccucugccu

SEQ ID NO: 50951 - RNA, 26 nt, Human
aggaacaaaaaagagacuuugguggc

SEQ ID NO: 50952 - RNA, 21 nt, Human
agugagaugggccaagaggaa

SEQ ID NO: 50953 - RNA, 22 nt, Human
augcaaucuuucugccagcuua

SEQ ID NO: 50954 - RNA, 19 nt, Human
auuggguaucagaguucau

SEQ ID NO: 50955 - RNA, 19 nt, Human
caaaaagauggaaagagca

SEQ ID NO: 50956 - RNA, 23 nt, Human
caauggcauggaaaugagucacc

SEQ ID NO: 50957 - RNA, 22 nt, Human
caccacacacauguucagccca

SEQ ID NO: 50958 - RNA, 18 nt, Human
cagauguccucaacgccu

SEQ ID NO: 50959 - RNA, 18 nt, Human
cagcaagauccgucugua

SEQ ID NO: 50960 - RNA, 19 nt, Human
cagcccaacuagagccuuu

SEQ ID NO: 50961 - RNA, 22 nt, Human
cagggaccagaggacagugcag

SEQ ID NO: 50962 - RNA, 25 nt, Human
cauacaggcccucaaguguuuguug

SEQ ID NO: 50963 - RNA, 19 nt, Human
cauggaaaugagucaccac

SEQ ID NO: 50964 - RNA, 18 nt, Human
ccaccacacacauguuca

SEQ ID NO: 50965 - RNA, 19 nt, Human
ccaucaagauaagcaaccc

SEQ ID NO: 50966 - RNA, 22 nt, Human
cccaacaucuucuaggcauccu

SEQ ID NO: 50967 - RNA, 19 nt, Human
cccaagucaggccuccaaa

SEQ ID NO: 50968 - RNA, 23 nt, Human
cccaagucaggccuccaaaacac

SEQ ID NO: 50969 - RNA, 20 nt, Human
cccaggggaaccuccacagg

SEQ ID NO: 50970 - RNA, 20 nt, Human
ccccaaacagauguccucaa

SEQ ID NO: 50971 - RNA, 23 nt, Human
ccccaagucaggccuccaaaaca

SEQ ID NO: 50972 - RNA, 24 nt, Human
ccgcacauccucaaguuuccagaa

SEQ ID NO: 50973 - RNA, 19 nt, Human
ccucaacgccucugccugc

SEQ ID NO: 50974 - RNA, 21 nt, Human
ccuccaaaacacugaauuaga

SEQ ID NO: 50975 - RNA, 21 nt, Human
ccuccuaaccuuagccagaac

SEQ ID NO: 50976 - RNA, 24 nt, Human
ccuuggcccaggcauacaggcccu

SEQ ID NO: 50977 - RNA, 26 nt, Human
cuccaaaacacugaauuagagagaaa

SEQ ID NO: 50978 - RNA, 20 nt, Human
cugaaucugaaagugcugcu

SEQ ID NO: 50979 - RNA, 24 nt, Human
cuggagaugcucccaccucagugg

SEQ ID NO: 50980 - RNA, 20 nt, Human
gacaggugagccagcaagau

SEQ ID NO: 50981 - RNA, 19 nt, Human
gagcacuggagaugcuccc

SEQ ID NO: 50982 - RNA, 22 nt, Human
gagcagaagaggagccaugagu

SEQ ID NO: 50983 - RNA, 20 nt, Human
gagcucagaacucucagcaa

SEQ ID NO: 50984 - RNA, 19 nt, Human
gauaaggaggcaaacggga

SEQ ID NO: 50985 - RNA, 19 nt, Human
gcaaacgggagaagcagag

SEQ ID NO: 50986 - RNA, 19 nt, Human
gcaaacgggagaagcagag

SEQ ID NO: 50987 - RNA, 18 nt, Human
gcagaggaacaaaaaaga

SEQ ID NO: 50988 - RNA, 22 nt, Human
ggaaagagcagaagaggagccg

SEQ ID NO: 50989 - RNA, 18 nt, Human
ggagauauaauuggggag

SEQ ID NO: 50990 - RNA, 24 nt, Human
ggaggcaaacgggagaagcagagg

SEQ ID NO: 50991 - RNA, 23 nt, Human
ggcaaacgggagaagcagaggaa

SEQ ID NO: 50992 - RNA, 26 nt, Human
gggagaagcagaggaacaaaaaagag

SEQ ID NO: 50993 - RNA, 20 nt, Human
gggggagauauaauugggga

SEQ ID NO: 50994 - RNA, 20 nt, Human
guccccaagucaggccucca

SEQ ID NO: 50995 - RNA, 22 nt, Human
gugggggagauauaauugggga

SEQ ID NO: 50996 - RNA, 19 nt, Human
guggggugaucucuuggaa

SEQ ID NO: 50997 - RNA, 19 nt, Human
uaaaauucccaacuugcuc

SEQ ID NO: 50998 - RNA, 23 nt, Human
uaagucaacuaggcacccuucag

SEQ ID NO: 50999 - RNA, 22 nt, Human
uagaaagggcucaucacaggug

SEQ ID NO: 51000 - RNA, 24 nt, Human
uagcuuuuauuuacucaaaaacau

SEQ ID NO: 51001 - RNA, 24 nt, Human
uaggacagcucuauauggacugaa

SEQ ID NO: 51002 - RNA, 20 nt, Human
ucaaggauguaaaaaucccu

SEQ ID NO: 51003 - RNA, 24 nt, Human
ucaaguguuuguugauggggaauc

SEQ ID NO: 51004 - RNA, 22 nt, Human
ucaauaauacguuguccccaag

SEQ ID NO: 51005 - RNA, 18 nt, Human
ucagcccaacuagagccu

SEQ ID NO: 51006 - RNA, 22 nt, Human
uccacagggacaggugagccag

SEQ ID NO: 51007 - RNA, 21 nt, Human
uccgagagcagguucucugcu

SEQ ID NO: 51008 - RNA, 30 nt, Human
ucgagacaagauuggguaucagaguucauu

SEQ ID NO: 51009 - RNA, 18 nt, Human
ucucugcucaauuccaca

SEQ ID NO: 51010 - RNA, 23 nt, Human
ucugcucaauuccacaauggcau

SEQ ID NO: 51011 - RNA, 19 nt, Human
ugaaagugcugcugcucuu

SEQ ID NO: 51012 - RNA, 19 nt, Human
ugccugcagcuuuuuggcu

SEQ ID NO: 51013 - RNA, 18 nt, Human
uggaaagagcagaagagg

SEQ ID NO: 51014 - RNA, 18 nt, Human
uggaggaagagaguagug

SEQ ID NO: 51015 - RNA, 21 nt, Human
uggcagccuccuaaccuuagc

SEQ ID NO: 51016 - RNA, 20 nt, Human
uggcauggaaaugagucacc

SEQ ID NO: 51017 - RNA, 24 nt, Human
ugggagcagagcuggaagcacuga

SEQ ID NO: 51018 - RNA, 18 nt, Human
ugguggggugaucucuug

SEQ ID NO: 51019 - RNA, 23 nt, Human
uuagagagaaaggacaaaggaaa

SEQ ID NO: 51020 - RNA, 21 nt, Human
uuggcccaggcauacaggccc

SEQ ID NO: 51021 - RNA, 22 nt, Human
uuggcccaggcauacaggcccu

SEQ ID NO: 51022 - RNA, 20 nt, Human
uuuggcuuuuugaguuccau

SEQ ID NO: 51023 - RNA, 21 nt, Human
aaaaaaaacuaaaaaggggac

SEQ ID NO: 51024 - RNA, 25 nt, Human
aaaaaacaaaaacaaccccaaaaca

SEQ ID NO: 51025 - RNA, 19 nt, Human
aaaaacuaaaaaggggaca

SEQ ID NO: 51026 - RNA, 25 nt, Human
aaaacaaccccaaaacaaccccucc

SEQ ID NO: 51027 - RNA, 21 nt, Human
aaacaaaaacaaccccaaaac

SEQ ID NO: 51028 - RNA, 19 nt, Human
aaacaaccccaaaacaacc

SEQ ID NO: 51029 - RNA, 26 nt, Human
aaacaaccccaaaacaaccccucccc

SEQ ID NO: 51030 - RNA, 19 nt, Human
aaacaaccccuccccacag

SEQ ID NO: 51031 - RNA, 24 nt, Human
aaacaaccccuccccacagacaca

SEQ ID NO: 51032 - RNA, 21 nt, Human
aaacuaaaaaggggacaauaa

SEQ ID NO: 51033 - RNA, 23 nt, Human
aacaaaaacaaccccaaaacaac

SEQ ID NO: 51034 - RNA, 24 nt, Human
aacaucuuuccaaaaucaaaacua

SEQ ID NO: 51035 - RNA, 26 nt, Human
aagaaaaaacaaaaacaaccccaaaa

SEQ ID NO: 51036 - RNA, 30 nt, Human
aagaaaaaacaaaaacaaccccaaaacaaa

SEQ ID NO: 51037 - RNA, 18 nt, Human
aagcgcuucgggugaauu

SEQ ID NO: 51038 - RNA, 24 nt, Human
aaucuaaauaguaugaaauuaguu

SEQ ID NO: 51039 - RNA, 26 nt, Human
acaaaaaaaacuaaaaaggggacaau

SEQ ID NO: 51040 - RNA, 22 nt, Human
acaaaaacaaccccaaaacaac

SEQ ID NO: 51041 - RNA, 22 nt, Human
acaaaacaagggacuugagaag

SEQ ID NO: 51042 - RNA, 23 nt, Human
acaaaacaagggacuugagaagu

SEQ ID NO: 51043 - RNA, 18 nt, Human
acaaccccuccccacaga

SEQ ID NO: 51044 - RNA, 18 nt, Human
accacaagaggcaaacaa

SEQ ID NO: 51045 - RNA, 24 nt, Human
accacaagaggcaaacaaaaaaaa

SEQ ID NO: 51046 - RNA, 22 nt, Human
accacagccaccgggugugacu

SEQ ID NO: 51047 - RNA, 25 nt, Human
accacagccaccgggugugacucgg

SEQ ID NO: 51048 - RNA, 21 nt, Human
accccaaaacaaccccucccc

SEQ ID NO: 51049 - RNA, 25 nt, Human
agaaaaaacaaaaacaaccccaaaa

SEQ ID NO: 51050 - RNA, 18 nt, Human
agaaggaaagcucuuuuu

SEQ ID NO: 51051 - RNA, 21 nt, Human
aggcagacauucuaacgaagc

SEQ ID NO: 51052 - RNA, 23 nt, Human
caaaaaaaacuaaaaaggggaca

SEQ ID NO: 51053 - RNA, 21 nt, Human
caaaacaaccccuccccacag

SEQ ID NO: 51054 - RNA, 20 nt, Human
caaaacaagggacuugagaa

SEQ ID NO: 51055 - RNA, 22 nt, Human
caagaaaaaacaaaaacaaccc

SEQ ID NO: 51056 - RNA, 26 nt, Human
caagaaaaaacaaaaacaaccccaaa

SEQ ID NO: 51057 - RNA, 24 nt, Human
caagaggcaaacaaaaaaaacuaa

SEQ ID NO: 51058 - RNA, 24 nt, Human
cacaacacaaaacaagggacuuga

SEQ ID NO: 51059 - RNA, 23 nt, Human
cacagacacaacacaaaacaagg

SEQ ID NO: 51060 - RNA, 18 nt, Human
caccacaagaggcaaaca

SEQ ID NO: 51061 - RNA, 21 nt, Human
caccacaagaggcaaacaaaa

SEQ ID NO: 51062 - RNA, 24 nt, Human
caccacaagaggcaaacaaaaaaa

SEQ ID NO: 51063 - RNA, 24 nt, Human
caccccucaccacaagaggcaaac

SEQ ID NO: 51064 - RNA, 21 nt, Human
cccacagacacaacacaaaac

SEQ ID NO: 51065 - RNA, 23 nt, Human
cccacagacacaacacaaaacaa

SEQ ID NO: 51066 - RNA, 20 nt, Human
ccccaaaacaaccccucccc

SEQ ID NO: 51067 - RNA, 20 nt, Human
ccccacagacacaacacaaa

SEQ ID NO: 51068 - RNA, 23 nt, Human
ccccucaccacaagaggcaaaca

SEQ ID NO: 51069 - RNA, 19 nt, Human
cccgacgccacgaccuaga

SEQ ID NO: 51070 - RNA, 18 nt, Human
ccucgccgccucgcgugc

SEQ ID NO: 51071 - RNA, 20 nt, Human
cgaccuagaaacacgcuugc

SEQ ID NO: 51072 - RNA, 23 nt, Human
cgaccuagaaacacgcuugccgc

SEQ ID NO: 51073 - RNA, 25 nt, Human
cgccucgccgccucgcgugcgcuca

SEQ ID NO: 51074 - RNA, 23 nt, Human
cguuccuuccuuuggucuuccca

SEQ ID NO: 51075 - RNA, 19 nt, Human
cuaaagacgaacacuuaga

SEQ ID NO: 51076 - RNA, 23 nt, Human
cuaccuggcaagaaaaaacaaaa

SEQ ID NO: 51077 - RNA, 21 nt, Human
cuccccacagacacaacacaa

SEQ ID NO: 51078 - RNA, 23 nt, Human
cuccggaagcccgacgccacgac

SEQ ID NO: 51079 - RNA, 21 nt, Human
cuggagaaggaaagcucuuuu

SEQ ID NO: 51080 - RNA, 19 nt, Human
cuucccacaccccucacca

SEQ ID NO: 51081 - RNA, 25 nt, Human
gacaauaagugcaagauaaaaaaga

SEQ ID NO: 51082 - RNA, 20 nt, Human
gcaagaaaaaacaaaaacac

SEQ ID NO: 51083 - RNA, 22 nt, Human
gccucgcgugcgcucacccagc

SEQ ID NO: 51084 - RNA, 20 nt, Human
ggaagcccgacgccacgacc

SEQ ID NO: 51085 - RNA, 23 nt, Human
guaaggcagacauucuaacgaag

SEQ ID NO: 51086 - RNA, 18 nt, Human
ucacccagccgcacggcc

SEQ ID NO: 51087 - RNA, 19 nt, Human
ucagcaacuuagcggccag

SEQ ID NO: 51088 - RNA, 22 nt, Human
ucagcaacuuagcggccaggug

SEQ ID NO: 51089 - RNA, 19 nt, Human
ucaguuuuaucuaccuggc

SEQ ID NO: 51090 - RNA, 21 nt, Human
ucauaccacagccaccgggug

SEQ ID NO: 51091 - RNA, 21 nt, Human
ucccuggggaaaccaguaagg

SEQ ID NO: 51092 - RNA, 27 nt, Human
ucuccagccuuuucucuauggggccgc

SEQ ID NO: 51093 - RNA, 24 nt, Human
ucucuaugucaguuuuaucuaccu

SEQ ID NO: 51094 - RNA, 25 nt, Human
ucucucuccagccuuuucucuaugu

SEQ ID NO: 51095 - RNA, 21 nt, Human
ucugaggugguuuaguacagg

SEQ ID NO: 51096 - RNA, 18 nt, Human
ugacucggcuaccucucc

SEQ ID NO: 51097 - RNA, 24 nt, Human
ugagaaguuagagaaaaccuuuaa

SEQ ID NO: 51098 - RNA, 19 nt, Human
ugcaagauaaaaaagaaaa

SEQ ID NO: 51099 - RNA, 21 nt, Human
uuccaaaaucaaaacuaaaga

SEQ ID NO: 51100 - RNA, 20 nt, Human
uuccuggagaaggaaagcuc

SEQ ID NO: 51101 - RNA, 20 nt, Human
uuucugaggugguuuaguac

SEQ ID NO: 51102 - RNA, 20 nt, Human
aaaauccccucacuuccauc

SEQ ID NO: 51103 - RNA, 21 nt, Human
aaaauccccucacuuccauca

SEQ ID NO: 51104 - RNA, 22 nt, Human
aaccaugaaaccuacuggucca

SEQ ID NO: 51105 - RNA, 18 nt, Human
aagaagagcuggccuucc

SEQ ID NO: 51106 - RNA, 19 nt, Human
aagaagagcuggccuuccg

SEQ ID NO: 51107 - RNA, 23 nt, Human
aagaaguaaauccaagugucagg

SEQ ID NO: 51108 - RNA, 19 nt, Human
aaguaaauccaagugucag

SEQ ID NO: 51109 - RNA, 18 nt, Human
aauggcuaugggcugggu

SEQ ID NO: 51110 - RNA, 19 nt, Human
acacguggcugaugauucu

SEQ ID NO: 51111 - RNA, 27 nt, Human
acccaccccauucccagcagguccccu

SEQ ID NO: 51112 - RNA, 19 nt, Human
acuuaggaacaagcgaugu

SEQ ID NO: 51113 - RNA, 18 nt, Human
agaaggaagugggguggg

SEQ ID NO: 51114 - RNA, 22 nt, Human
agaauguguguguguguugggg

SEQ ID NO: 51115 - RNA, 24 nt, Human
agcacuuugggaggcugaggcagg

SEQ ID NO: 51116 - RNA, 21 nt, Human
aggaagugggguggguaccua

SEQ ID NO: 51117 - RNA, 26 nt, Human
agggagcccugccagguggguuuggc

SEQ ID NO: 51118 - RNA, 26 nt, Human
agggagcccugccagguggguuuggc

SEQ ID NO: 51119 - RNA, 18 nt, Human
auggagagaaugugugug

SEQ ID NO: 51120 - RNA, 18 nt, Human
auugguccugucuugucc

SEQ ID NO: 51121 - RNA, 23 nt, Human
auuucauccacagaaaggauugc

SEQ ID NO: 51122 - RNA, 23 nt, Human
auuugcagacugccuaggucucc

SEQ ID NO: 51123 - RNA, 21 nt, Human
cacagagugaccaagaaagca

SEQ ID NO: 51124 - RNA, 18 nt, Human
cacaugaaggggcagggc

SEQ ID NO: 51125 - RNA, 24 nt, Human
cacgccuguaaucccagcacuuug

SEQ ID NO: 51126 - RNA, 24 nt, Human
cagcacuuugggaggcugaggcag

SEQ ID NO: 51127 - RNA, 24 nt, Human
cagcacuuugggaggcugaggcag

SEQ ID NO: 51128 - RNA, 26 nt, Human
cagcagguccccucuuugauuggucc

SEQ ID NO: 51129 - RNA, 22 nt, Human
caguggugcuuaaaccgugcuc

SEQ ID NO: 51130 - RNA, 19 nt, Human
ccaagaagagcuggccuuc

SEQ ID NO: 51131 - RNA, 18 nt, Human
ccacagaaaggauugcac

SEQ ID NO: 51132 - RNA, 19 nt, Human
ccacccaccccauucccag

SEQ ID NO: 51133 - RNA, 19 nt, Human
ccagggccaccucccgggc

SEQ ID NO: 51134 - RNA, 19 nt, Human
ccagggccaccucccgggc

SEQ ID NO: 51135 - RNA, 26 nt, Human
ccagugguggguuucaugcuccccuu

SEQ ID NO: 51136 - RNA, 22 nt, Human
cccagccggggccggggagguc

SEQ ID NO: 51137 - RNA, 22 nt, Human
cccagccggggccggggagguc

SEQ ID NO: 51138 - RNA, 22 nt, Human
ccccuuuccucugcaucuuucc

SEQ ID NO: 51139 - RNA, 19 nt, Human
ccgcugccugaugaguugg

SEQ ID NO: 51140 - RNA, 21 nt, Human
ccucuccaccugccgggcugg

SEQ ID NO: 51141 - RNA, 22 nt, Human
ccugccgggcuggccuagcccu

SEQ ID NO: 51142 - RNA, 20 nt, Human
ccuggccagcccugggaacc

SEQ ID NO: 51143 - RNA, 20 nt, Human
ccuggccagcccugggaacc

SEQ ID NO: 51144 - RNA, 20 nt, Human
ccuuccgagaaggaaguggg

SEQ ID NO: 51145 - RNA, 24 nt, Human
cgccuguaaucccagcacuuuggg

SEQ ID NO: 51146 - RNA, 18 nt, Human
cgggagcgcgggagccgg

SEQ ID NO: 51147 - RNA, 18 nt, Human
cgggagcgcgggagccgg

SEQ ID NO: 51148 - RNA, 19 nt, Human
cucaccagucaccauggag

SEQ ID NO: 51149 - RNA, 22 nt, Human
cucacgccuguaaucccagcac

SEQ ID NO: 51150 - RNA, 24 nt, Human
cucacgccuguaaucccagcacuu

SEQ ID NO: 51151 - RNA, 26 nt, Human
cucacuuccaucaagaaauagcucca

SEQ ID NO: 51152 - RNA, 21 nt, Human
cuccaugguguacuauguacc

SEQ ID NO: 51153 - RNA, 21 nt, Human
cucccgggcuggcgcggaggc

SEQ ID NO: 51154 - RNA, 21 nt, Human
cucccgggcuggcgcggaggc

SEQ ID NO: 51155 - RNA, 19 nt, Human
cugccggggacccucucca

SEQ ID NO: 51156 - RNA, 19 nt, Human
gaaaauaaaauccccucac

SEQ ID NO: 51157 - RNA, 20 nt, Human
gagaauguguguguguguug

SEQ ID NO: 51158 - RNA, 21 nt, Human
gagacacccucccucuucccu

SEQ ID NO: 51159 - RNA, 19 nt, Human
gcagggaaaugcuguuccg

SEQ ID NO: 51160 - RNA, 24 nt, Human
gcccugggaacccucagaaggcca

SEQ ID NO: 51161 - RNA, 24 nt, Human
gcccugggaacccucagaaggcca

SEQ ID NO: 51162 - RNA, 20 nt, Human
gcugccggggacccucucca

SEQ ID NO: 51163 - RNA, 23 nt, Human
ggcacgguggcucacgccuguaa

SEQ ID NO: 51164 - RNA, 19 nt, Human
ggccaggggcgcgcggggc

SEQ ID NO: 51165 - RNA, 21 nt, Human
ggccgggcacgguggcucacg

SEQ ID NO: 51166 - RNA, 21 nt, Human
gggacccucuccaccugccgg

SEQ ID NO: 51167 - RNA, 20 nt, Human
gguccggcuguccagggcca

SEQ ID NO: 51168 - RNA, 20 nt, Human
gguccggcuguccagggcca

SEQ ID NO: 51169 - RNA, 23 nt, Human
gguggcucacgccuguaauccca

SEQ ID NO: 51170 - RNA, 24 nt, Human
gguggcucacgccuguaaucccag

SEQ ID NO: 51171 - RNA, 21 nt, Human
gguugugagacacccucccuc

SEQ ID NO: 51172 - RNA, 21 nt, Human
gucaguagguugagccugaaa

SEQ ID NO: 51173 - RNA, 24 nt, Human
guccagcccugcuguuuuucuuuc

SEQ ID NO: 51174 - RNA, 20 nt, Human
gugggaaacaacccuggcca

SEQ ID NO: 51175 - RNA, 20 nt, Human
gugggaaacaacccuggcca

SEQ ID NO: 51176 - RNA, 18 nt, Human
guggguuuggcugggggu

SEQ ID NO: 51177 - RNA, 18 nt, Human
guggguuuggcugggggu

SEQ ID NO: 51178 - RNA, 23 nt, Human
uaaagaaguaaauccaaguguca

SEQ ID NO: 51179 - RNA, 23 nt, Human
uaaagaaguaaauccaaguguca

SEQ ID NO: 51180 - RNA, 19 nt, Human
uaaagacauggccaggggc

SEQ ID NO: 51181 - RNA, 21 nt, Human
uaagaaugaaaugggggaggg

SEQ ID NO: 51182 - RNA, 21 nt, Human
uacccgaagcugggugcgaag

SEQ ID NO: 51183 - RNA, 18 nt, Human
uaggucuccagcuaccug

SEQ ID NO: 51184 - RNA, 21 nt, Human
uaugggaagguaagauaacug

SEQ ID NO: 51185 - RNA, 18 nt, Human
ucccagcagguccccucu

SEQ ID NO: 51186 - RNA, 24 nt, Human
ucccagccggggccggggaggucc

SEQ ID NO: 51187 - RNA, 20 nt, Human
ucccugaaggcucuuuuccu

SEQ ID NO: 51188 - RNA, 19 nt, Human
ucccugugcccuacccgcu

SEQ ID NO: 51189 - RNA, 23 nt, Human
ucccugugcccuacccgcugccu

SEQ ID NO: 51190 - RNA, 23 nt, Human
uccugucuuguccuccaagaaga

SEQ ID NO: 51191 - RNA, 24 nt, Human
ugaaaauaaaauccccucacuucc

SEQ ID NO: 51192 - RNA, 24 nt, Human
ugaagugggcacagagugaccaag

SEQ ID NO: 51193 - RNA, 22 nt, Human
ugaccaagaaagcauuagcugc

SEQ ID NO: 51194 - RNA, 20 nt, Human
ugagacacccucccucuucc

SEQ ID NO: 51195 - RNA, 24 nt, Human
ugcuuaaaccgugcuccauggugu

SEQ ID NO: 51196 - RNA, 22 nt, Human
uggagagaaugugugugugugu

SEQ ID NO: 51197 - RNA, 18 nt, Human
uggccaggggcgcgcggg

SEQ ID NO: 51198 - RNA, 24 nt, Human
uggcucacgccuguaaucccagca

SEQ ID NO: 51199 - RNA, 21 nt, Human
ugggaaacaacccuggccagc

SEQ ID NO: 51200 - RNA, 21 nt, Human
ugggaaacaacccuggccagc

SEQ ID NO: 51201 - RNA, 19 nt, Human
ugggaggcugaggcaggca

SEQ ID NO: 51202 - RNA, 20 nt, Human
ugggaggcugaggcaggcag

SEQ ID NO: 51203 - RNA, 24 nt, Human
ugggucgcaggaccaguggugggu

SEQ ID NO: 51204 - RNA, 21 nt, Human
ugggugcgaagauccaggaga

SEQ ID NO: 51205 - RNA, 27 nt, Human
ugucuuauucguccuggcugggggaag

SEQ ID NO: 51206 - RNA, 19 nt, Human
ugugcccuacccgcugccu

SEQ ID NO: 51207 - RNA, 21 nt, Human
ugugcucaaaauauucaugau

SEQ ID NO: 51208 - RNA, 22 nt, Human
uugguugugagacacccucccu

SEQ ID NO: 51209 - RNA, 18 nt, Human
uugugagacacccucccu

SEQ ID NO: 51210 - RNA, 20 nt, Human
uuugcauucaugaucauucc

SEQ ID NO: 51211 - RNA, 22 nt, Human
agccugggggaugauugggcuc

SEQ ID NO: 51212 - RNA, 25 nt, Human
agcugcccugaaacuuugcuucccc

SEQ ID NO: 51213 - RNA, 18 nt, Human
agggaaagaaagcugcgc

SEQ ID NO: 51214 - RNA, 21 nt, Human
cagcugcccugaaacuuugcu

SEQ ID NO: 51215 - RNA, 24 nt, Human
ccagcccgcagcacgucuccugcc

SEQ ID NO: 51216 - RNA, 21 nt, Human
cccacgauguuuuccucccca

SEQ ID NO: 51217 - RNA, 23 nt, Human
cccacgauguuuuccuccccagg

SEQ ID NO: 51218 - RNA, 21 nt, Human
ccccacgauguuuuccucccc

SEQ ID NO: 51219 - RNA, 19 nt, Human
cccccgggcagcccagccc

SEQ ID NO: 51220 - RNA, 21 nt, Human
cuggcaggagucaucuccccc

SEQ ID NO: 51221 - RNA, 18 nt, Human
cuucccccguggucuucu

SEQ ID NO: 51222 - RNA, 20 nt, Human
gcccugaaacuuugcuuccc

SEQ ID NO: 51223 - RNA, 20 nt, Human
ggcucggaagggcugcggcg

SEQ ID NO: 51224 - RNA, 19 nt, Human
gggaaagaaagcugcgcac

SEQ ID NO: 51225 - RNA, 22 nt, Human
gggcucggaagggcugcggcga

SEQ ID NO: 51226 - RNA, 18 nt, Human
aaaaggccccacggagcc

SEQ ID NO: 51227 - RNA, 21 nt, Human
aaggccccacggagcccgcag

SEQ ID NO: 51228 - RNA, 25 nt, Human
accagcccgccucucuggucccccu

SEQ ID NO: 51229 - RNA, 24 nt, Human
agcucugcccaguuccucagggau

SEQ ID NO: 51230 - RNA, 20 nt, Human
cacggagcccgcagccucuc

SEQ ID NO: 51231 - RNA, 24 nt, Human
ccccacggagcccgcagccucucc

SEQ ID NO: 51232 - RNA, 21 nt, Human
ccccuuacccccaagcccagc

SEQ ID NO: 51233 - RNA, 18 nt, Human
cgguggccgggccggggg

SEQ ID NO: 51234 - RNA, 21 nt, Human
cuuacccccaagcccagcaca

SEQ ID NO: 51235 - RNA, 18 nt, Human
gcauggaggauggggcag

SEQ ID NO: 51236 - RNA, 22 nt, Human
gcccagcacacuccgcggccua

SEQ ID NO: 51237 - RNA, 19 nt, Human
gguggccgggccgggggca

SEQ ID NO: 51238 - RNA, 21 nt, Human
ucagggaugucacagagcagc

SEQ ID NO: 51239 - RNA, 18 nt, Human
ugucacagagcagcugcc

SEQ ID NO: 51240 - RNA, 18 nt, Human
uucaccuuucaagggcuc

SEQ ID NO: 51241 - RNA, 18 nt, Human
aaaccaaggccaagagaa

SEQ ID NO: 51242 - RNA, 24 nt, Human
aacagcagcuaaaagauuuccccc

SEQ ID NO: 51243 - RNA, 19 nt, Human
aagcacggaggggggaaag

SEQ ID NO: 51244 - RNA, 21 nt, Human
aagcugcccucggccaacggc

SEQ ID NO: 51245 - RNA, 22 nt, Human
aaggcacccccguccucaggcg

SEQ ID NO: 51246 - RNA, 20 nt, Human
acacaaagucucugcccucc

SEQ ID NO: 51247 - RNA, 22 nt, Human
acacagacauacaagauagaaa

SEQ ID NO: 51248 - RNA, 20 nt, Human
acuuggaaggaugacaggaa

SEQ ID NO: 51249 - RNA, 22 nt, Human
acuuggaaggaugacaggaaau

SEQ ID NO: 51250 - RNA, 21 nt, Human
agaaagggcuugcauugcaaa

SEQ ID NO: 51251 - RNA, 21 nt, Human
agacgcugcgguucuggcccg

SEQ ID NO: 51252 - RNA, 19 nt, Human
agcaagaagcuucccuugu

SEQ ID NO: 51253 - RNA, 19 nt, Human
agcacggaggggggaaagg

SEQ ID NO: 51254 - RNA, 18 nt, Human
aggaaaaaaauggacaga

SEQ ID NO: 51255 - RNA, 26 nt, Human
aggaaaaaaauggacagaagggaccc

SEQ ID NO: 51256 - RNA, 22 nt, Human
aggaagauggcuccaggucaag

SEQ ID NO: 51257 - RNA, 22 nt, Human
aggccgggcccgaacuggagga

SEQ ID NO: 51258 - RNA, 20 nt, Human
agggaggccgggcccgaacu

SEQ ID NO: 51259 - RNA, 18 nt, Human
agggagggggccgcaggg

SEQ ID NO: 51260 - RNA, 24 nt, Human
aguugugcgcccugcuggggcugg

SEQ ID NO: 51261 - RNA, 18 nt, Human
aucaaugacaugaucuca

SEQ ID NO: 51262 - RNA, 18 nt, Human
cacaggaaaaaaauggac

SEQ ID NO: 51263 - RNA, 19 nt, Human
caccagaaagggcuugcau

SEQ ID NO: 51264 - RNA, 20 nt, Human
cacccccguccucaggcggg

SEQ ID NO: 51265 - RNA, 21 nt, Human
caccccucgaugccccccgcu

SEQ ID NO: 51266 - RNA, 20 nt, Human
cagacgaggaaacgcagagc

SEQ ID NO: 51267 - RNA, 23 nt, Human
cagcagcuaaaagauuuccccau

SEQ ID NO: 51268 - RNA, 21 nt, Human
caggagccgcgacggaggcag

SEQ ID NO: 51269 - RNA, 18 nt, Human
cagggguucuccugggcg

SEQ ID NO: 51270 - RNA, 21 nt, Human
caucauaauauuuacauagga

SEQ ID NO: 51271 - RNA, 21 nt, Human
ccaggagccgcgacggaggca

SEQ ID NO: 51272 - RNA, 20 nt, Human
cccaaggccaggauuucaac

SEQ ID NO: 51273 - RNA, 23 nt, Human
cccauagucagcacuuucggggc

SEQ ID NO: 51274 - RNA, 18 nt, Human
cccccagacgcugcgguu

SEQ ID NO: 51275 - RNA, 18 nt, Human
ccccccgcugccugcagu

SEQ ID NO: 51276 - RNA, 20 nt, Human
cccgcucgccuggcugcggc

SEQ ID NO: 51277 - RNA, 23 nt, Human
cccggguuucugagugcccuggg

SEQ ID NO: 51278 - RNA, 18 nt, Human
cccugcuggggcuggggc

SEQ ID NO: 51279 - RNA, 19 nt, Human
ccgcaugaaggcacccccg

SEQ ID NO: 51280 - RNA, 21 nt, Human
ccucgaugccccccgcugccu

SEQ ID NO: 51281 - RNA, 20 nt, Human
ccuuccggcccggcgcccgu

SEQ ID NO: 51282 - RNA, 22 nt, Human
cgacauagagggacuucauaac

SEQ ID NO: 51283 - RNA, 25 nt, Human
cgccccgcucgccuggcugcggcuc

SEQ ID NO: 51284 - RNA, 19 nt, Human
cgcggacucugccgccucu

SEQ ID NO: 51285 - RNA, 21 nt, Human
cggcccggggcuggggcgcgg

SEQ ID NO: 51286 - RNA, 20 nt, Human
cucaaccagaaaagcacgga

SEQ ID NO: 51287 - RNA, 21 nt, Human
cuccuuggagucuaaaaacag

SEQ ID NO: 51288 - RNA, 18 nt, Human
cugaagagcugugagggc

SEQ ID NO: 51289 - RNA, 24 nt, Human
cuuggagucuaaaaacagcagcua

SEQ ID NO: 51290 - RNA, 20 nt, Human
gacgcucucggugggcgccu

SEQ ID NO: 51291 - RNA, 22 nt, Human
gagacuuccaaaguugugcgcc

SEQ ID NO: 51292 - RNA, 22 nt, Human
gagagccgauggguaaagagag

SEQ ID NO: 51293 - RNA, 19 nt, Human
gagccaugcccuuguaguc

SEQ ID NO: 51294 - RNA, 23 nt, Human
gagcuccuaauacagccaaguuu

SEQ ID NO: 51295 - RNA, 19 nt, Human
gagggcaggcagggcugcc

SEQ ID NO: 51296 - RNA, 21 nt, Human
gagugcccuggggcuaagcac

SEQ ID NO: 51297 - RNA, 21 nt, Human
gauggggagggcaggcagggc

SEQ ID NO: 51298 - RNA, 18 nt, Human
gccaacggcugcuccugg

SEQ ID NO: 51299 - RNA, 18 nt, Human
gcccuggagggagagagg

SEQ ID NO: 51300 - RNA, 18 nt, Human
gccgggcccgaacuggag

SEQ ID NO: 51301 - RNA, 20 nt, Human
gccuggcagcaagaagcuuc

SEQ ID NO: 51302 - RNA, 19 nt, Human
gcgcccgcuggccugggcc

SEQ ID NO: 51303 - RNA, 23 nt, Human
gcgcggacucugccgccucucgg

SEQ ID NO: 51304 - RNA, 19 nt, Human
gcggcggcggggugaggag

SEQ ID NO: 51305 - RNA, 21 nt, Human
gcggggugaggaguguggggg

SEQ ID NO: 51306 - RNA, 22 nt, Human
gcggggugaggagugugggggc

SEQ ID NO: 51307 - RNA, 21 nt, Human
gcugaugugaggcagaaaggc

SEQ ID NO: 51308 - RNA, 24 nt, Human
ggaaacgcagagcaggcagcgccc

SEQ ID NO: 51309 - RNA, 20 nt, Human
ggaggcagccgaagggugcu

SEQ ID NO: 51310 - RNA, 24 nt, Human
ggcagggcugcccuuagcauuuuu

SEQ ID NO: 51311 - RNA, 21 nt, Human
ggccgcagggaggccgggccc

SEQ ID NO: 51312 - RNA, 19 nt, Human
ggccggggcaggugaacga

SEQ ID NO: 51313 - RNA, 24 nt, Human
ggcugaugugaggcagaaaggcuc

SEQ ID NO: 51314 - RNA, 24 nt, Human
ggcuggggcgcacugugcggagcu

SEQ ID NO: 51315 - RNA, 23 nt, Human
gggaaaggacaacauuuugauac

SEQ ID NO: 51316 - RNA, 24 nt, Human
gggcaggugaacgaucagcucucc

SEQ ID NO: 51317 - RNA, 20 nt, Human
ggggacggcggcggcggcgg

SEQ ID NO: 51318 - RNA, 23 nt, Human
ggggcccgcccccaccccgggag

SEQ ID NO: 51319 - RNA, 19 nt, Human
ggggccgcagggaggccgg

SEQ ID NO: 51320 - RNA, 23 nt, Human
ggggccgcagggaggccgggccc

SEQ ID NO: 51321 - RNA, 22 nt, Human
gggggauggggagggcaggcag

SEQ ID NO: 51322 - RNA, 26 nt, Human
guuugcuucuuccacauaauuuccac

SEQ ID NO: 51323 - RNA, 21 nt, Human
uaaaaacagcagcuaaaagau

SEQ ID NO: 51324 - RNA, 27 nt, Human
uaaacacaaagucucugcccuccuccc

SEQ ID NO: 51325 - RNA, 18 nt, Human
uacaguuuggcaggccca

SEQ ID NO: 51326 - RNA, 19 nt, Human
uagcaacaugugcugacau

SEQ ID NO: 51327 - RNA, 21 nt, Human
uagguaacccccauccauuaa

SEQ ID NO: 51328 - RNA, 18 nt, Human
uaucagguuugcuucuuc

SEQ ID NO: 51329 - RNA, 19 nt, Human
ucaacaucaaaaccaaggc

SEQ ID NO: 51330 - RNA, 20 nt, Human
uccaggagccgcgacggagg

SEQ ID NO: 51331 - RNA, 18 nt, Human
uccccauagucagcacuu

SEQ ID NO: 51332 - RNA, 22 nt, Human
ucccgcgaacugcgccuggcuc

SEQ ID NO: 51333 - RNA, 24 nt, Human
ucccugucaggaaaucucaaagca

SEQ ID NO: 51334 - RNA, 21 nt, Human
uccugggcguccgccuggugg

SEQ ID NO: 51335 - RNA, 19 nt, Human
ucggggcaggaggggcaca

SEQ ID NO: 51336 - RNA, 21 nt, Human
ucuucaaaaagagagagagag

SEQ ID NO: 51337 - RNA, 21 nt, Human
ucuucaagcaguggcccugga

SEQ ID NO: 51338 - RNA, 22 nt, Human
ugaacgcgggcgcccgcuggcc

SEQ ID NO: 51339 - RNA, 23 nt, Human
ugagcgaaagcaagaggucuuaa

SEQ ID NO: 51340 - RNA, 19 nt, Human
ugaggcagaaaggcucauu

SEQ ID NO: 51341 - RNA, 20 nt, Human
ugcaaaggggcuuggccuga

SEQ ID NO: 51342 - RNA, 27 nt, Human
ugcccuccuccccugacuuuggcaauu

SEQ ID NO: 51343 - RNA, 18 nt, Human
ugcugccagcugccuucc

SEQ ID NO: 51344 - RNA, 22 nt, Human
ugcuggggcuggggcgcacugu

SEQ ID NO: 51345 - RNA, 23 nt, Human
ugcuguuaggcacaggaaaaaaa

SEQ ID NO: 51346 - RNA, 24 nt, Human
uggaaggcaucucucccaaggcca

SEQ ID NO: 51347 - RNA, 25 nt, Human
uggacagaaaucuuuucccugucag

SEQ ID NO: 51348 - RNA, 18 nt, Human
uggcccacuaggaagaug

SEQ ID NO: 51349 - RNA, 20 nt, Human
uggcccggcccggcccgggg

SEQ ID NO: 51350 - RNA, 21 nt, Human
uggcccggcccggcccggggc

SEQ ID NO: 51351 - RNA, 18 nt, Human
uggccugggccugcugcc

SEQ ID NO: 51352 - RNA, 22 nt, Human
uggccugggccugcugccagcu

SEQ ID NO: 51353 - RNA, 25 nt, Human
uggcucgcgcuucagacgcucucgg

SEQ ID NO: 51354 - RNA, 23 nt, Human
uggcugcggcucacauagggagg

SEQ ID NO: 51355 - RNA, 18 nt, Human
uguaguccagugcuugcu

SEQ ID NO: 51356 - RNA, 19 nt, Human
uguaguccagugcuugcuc

SEQ ID NO: 51357 - RNA, 18 nt, Human
ugucaggaaaucucaaag

SEQ ID NO: 51358 - RNA, 20 nt, Human
ugucaggaaaucucaaagca

SEQ ID NO: 51359 - RNA, 18 nt, Human
ugucuaaaacauguagaa

SEQ ID NO: 51360 - RNA, 21 nt, Human
uucaagaagggagaacaaaaa

SEQ ID NO: 51361 - RNA, 23 nt, Human
uucacauuugaucuguaaacuuu

SEQ ID NO: 51362 - RNA, 22 nt, Human
uuccaaaguugugcgcccugcu

SEQ ID NO: 51363 - RNA, 24 nt, Human
uucggggcaggaggggcacacaga

SEQ ID NO: 51364 - RNA, 22 nt, Human
uugcuucuuccacauaauuucc

SEQ ID NO: 51365 - RNA, 21 nt, Human
uugugcgcccugcuggggcug

SEQ ID NO: 51366 - RNA, 22 nt, Human
uuuauucuucaagaagggagaa

SEQ ID NO: 51367 - RNA, 22 nt, Human
aaaaaaaaaaaaaaacaccacc

SEQ ID NO: 51368 - RNA, 20 nt, Human
aaaacaccacaagcaaguga

SEQ ID NO: 51369 - RNA, 21 nt, Human
aaaacucccucggugcccuuc

SEQ ID NO: 51370 - RNA, 18 nt, Human
aaccacagauccgaaaca

SEQ ID NO: 51371 - RNA, 22 nt, Human
aaccaggaagcagggguccuca

SEQ ID NO: 51372 - RNA, 21 nt, Human
aacucccucggugcccuucca

SEQ ID NO: 51373 - RNA, 21 nt, Human
aagaaacgaaaacaccacaag

SEQ ID NO: 51374 - RNA, 23 nt, Human
aagaaacgaaaacaccacaagca

SEQ ID NO: 51375 - RNA, 18 nt, Human
aagaagcagggugacccc

SEQ ID NO: 51376 - RNA, 22 nt, Human
aagaagcagggugaccccggcg

SEQ ID NO: 51377 - RNA, 23 nt, Human
aagaccuccccagcgaggcaucc

SEQ ID NO: 51378 - RNA, 18 nt, Human
aagcaagugaccugccag

SEQ ID NO: 51379 - RNA, 20 nt, Human
aagcagggguccucaaugca

SEQ ID NO: 51380 - RNA, 22 nt, Human
aagccaggcccucuccaaggga

SEQ ID NO: 51381 - RNA, 25 nt, Human
aaggaaccacagauccgaaacaggc

SEQ ID NO: 51382 - RNA, 21 nt, Human
aaggacucauuuggggcuugg

SEQ ID NO: 51383 - RNA, 18 nt, Human
aagugaccugccaggaac

SEQ ID NO: 51384 - RNA, 19 nt, Human
aagugaccugccaggaaca

SEQ ID NO: 51385 - RNA, 26 nt, Human
acaagcaagugaccugccaggaacac

SEQ ID NO: 51386 - RNA, 22 nt, Human
acacaccccagggacagaacaa

SEQ ID NO: 51387 - RNA, 25 nt, Human
acacaccccagggacagaacaaaag

SEQ ID NO: 51388 - RNA, 23 nt, Human
acacagcagggcaagaagcaggg

SEQ ID NO: 51389 - RNA, 18 nt, Human
acaccacaagcaagugac

SEQ ID NO: 51390 - RNA, 20 nt, Human
accccauaagcccccauccc

SEQ ID NO: 51391 - RNA, 18 nt, Human
acccucuugguguugccg

SEQ ID NO: 51392 - RNA, 23 nt, Human
agaagaacacauucucaaagaga

SEQ ID NO: 51393 - RNA, 21 nt, Human
agaggguggagaagggguccc

SEQ ID NO: 51394 - RNA, 20 nt, Human
agaugaaaaagaaacgaaaa

SEQ ID NO: 51395 - RNA, 24 nt, Human
agcagaaagcccaggggaggcagc

SEQ ID NO: 51396 - RNA, 21 nt, Human
agcauggggcucugggaagaa

SEQ ID NO: 51397 - RNA, 19 nt, Human
agccccccugcccaccccu

SEQ ID NO: 51398 - RNA, 19 nt, Human
agccggcaaggggaagcuu

SEQ ID NO: 51399 - RNA, 25 nt, Human
agcucagaguuuaaaaaaaaaaaaa

SEQ ID NO: 51400 - RNA, 20 nt, Human
aggaagcagggguccucaau

SEQ ID NO: 51401 - RNA, 18 nt, Human
aggcaagaacacuggggg

SEQ ID NO: 51402 - RNA, 18 nt, Human
aggcaagaacacuggggg

SEQ ID NO: 51403 - RNA, 19 nt, Human
aggcagagaccaggccucc

SEQ ID NO: 51404 - RNA, 23 nt, Human
aggcagagaccaggccuccaaga

SEQ ID NO: 51405 - RNA, 25 nt, Human
aggcuggcuccgugcucuuuguggg

SEQ ID NO: 51406 - RNA, 19 nt, Human
agggagaggguggagaagg

SEQ ID NO: 51407 - RNA, 19 nt, Human
caaagccuuucaucucccu

SEQ ID NO: 51408 - RNA, 22 nt, Human
cacaagguccucaagaaaggga

SEQ ID NO: 51409 - RNA, 25 nt, Human
cacacacagcagggcaagaagcagg

SEQ ID NO: 51410 - RNA, 18 nt, Human
cacagccccaucagcauu

SEQ ID NO: 51411 - RNA, 23 nt, Human
caccacaagcaagugaccugcca

SEQ ID NO: 51412 - RNA, 21 nt, Human
caccccauaagcccccauccc

SEQ ID NO: 51413 - RNA, 22 nt, Human
caccccauaagcccccauccca

SEQ ID NO: 51414 - RNA, 27 nt, Human
caccccauaagcccccaucccagcgcc

SEQ ID NO: 51415 - RNA, 21 nt, Human
caccuccaucggccugugcuc

SEQ ID NO: 51416 - RNA, 20 nt, Human
caccugggggcgcugccacc

SEQ ID NO: 51417 - RNA, 23 nt, Human
caccugucacaggcucucaucuu

SEQ ID NO: 51418 - RNA, 21 nt, Human
cacugggacccuugcuagcag

SEQ ID NO: 51419 - RNA, 24 nt, Human
cagaacaaaagucuacaggaagac

SEQ ID NO: 51420 - RNA, 21 nt, Human
cagauccgaaacaggcaaagg

SEQ ID NO: 51421 - RNA, 21 nt, Human
cagcaaguaggcagugagcua

SEQ ID NO: 51422 - RNA, 23 nt, Human
cagccagaagaacacauucucaa

SEQ ID NO: 51423 - RNA, 18 nt, Human
cagccccccugcccaccc

SEQ ID NO: 51424 - RNA, 22 nt, Human
cagccccccugcccaccccucc

SEQ ID NO: 51425 - RNA, 24 nt, Human
cagcgaggcauccacguggccacc

SEQ ID NO: 51426 - RNA, 21 nt, Human
cauaagcccccaucccagcgc

SEQ ID NO: 51427 - RNA, 23 nt, Human
cauuuggggcuuggagaccuggc

SEQ ID NO: 51428 - RNA, 20 nt, Human
ccaaccccacaggggcagcg

SEQ ID NO: 51429 - RNA, 18 nt, Human
ccaagaccuccccagcga

SEQ ID NO: 51430 - RNA, 24 nt, Human
ccaccccauaagcccccaucccag

SEQ ID NO: 51431 - RNA, 26 nt, Human
ccaccccucccaagggguuccuaaga

SEQ ID NO: 51432 - RNA, 22 nt, Human
ccagaagaacacauucucaaag

SEQ ID NO: 51433 - RNA, 20 nt, Human
ccagcgccugccgggaccgc

SEQ ID NO: 51434 - RNA, 18 nt, Human
ccaggggaggcagccaca

SEQ ID NO: 51435 - RNA, 25 nt, Human
cccacagagcucaaagcuuucugca

SEQ ID NO: 51436 - RNA, 21 nt, Human
ccccacagagcucaaagcuuu

SEQ ID NO: 51437 - RNA, 21 nt, Human
ccccccugcccaccccuccca

SEQ ID NO: 51438 - RNA, 20 nt, Human
cccccgacaccugccaagcu

SEQ ID NO: 51439 - RNA, 19 nt, Human
ccccuaggggcgcaccagg

SEQ ID NO: 51440 - RNA, 24 nt, Human
ccccuccauucucucuacacccag

SEQ ID NO: 51441 - RNA, 18 nt, Human
ccccugcccaccccuccc

SEQ ID NO: 51442 - RNA, 23 nt, Human
ccgcaccaaccccacaggggcag

SEQ ID NO: 51443 - RNA, 22 nt, Human
ccggccagcagagggucacagu

SEQ ID NO: 51444 - RNA, 23 nt, Human
ccggcgccaccgcaccaacccca

SEQ ID NO: 51445 - RNA, 24 nt, Human
ccucaacaacccacugaggaccaa

SEQ ID NO: 51446 - RNA, 21 nt, Human
ccucaagaaagggaagcccag

SEQ ID NO: 51447 - RNA, 21 nt, Human
ccugcccaccccucccaaggg

SEQ ID NO: 51448 - RNA, 19 nt, Human
ccuugcuagcagccccccu

SEQ ID NO: 51449 - RNA, 20 nt, Human
ccuugcuagcagccccccug

SEQ ID NO: 51450 - RNA, 25 nt, Human
cuagcagccccccugcccaccccuc

SEQ ID NO: 51451 - RNA, 25 nt, Human
cucagaguuuaaaaaaaaaaaaaaa

SEQ ID NO: 51452 - RNA, 21 nt, Human
cucccucggugcccuuccaaa

SEQ ID NO: 51453 - RNA, 23 nt, Human
cucuacacccagaaaacucccuc

SEQ ID NO: 51454 - RNA, 21 nt, Human
cucuaguguguucccccacag

SEQ ID NO: 51455 - RNA, 18 nt, Human
cucuccuggcccagcucc

SEQ ID NO: 51456 - RNA, 18 nt, Human
cucuggccucaacaaccc

SEQ ID NO: 51457 - RNA, 21 nt, Human
cucuggccucaacaacccacu

SEQ ID NO: 51458 - RNA, 22 nt, Human
cucuuuuugguccccuccauuc

SEQ ID NO: 51459 - RNA, 23 nt, Human
cugccgggaccgcgagugccuag

SEQ ID NO: 51460 - RNA, 22 nt, Human
cuggcccauucccccgacaccu

SEQ ID NO: 51461 - RNA, 19 nt, Human
cuucguuucuuccuccccc

SEQ ID NO: 51462 - RNA, 21 nt, Human
gaaacaggcaaagggggaaag

SEQ ID NO: 51463 - RNA, 22 nt, Human
gaagcccagacauuggucugga

SEQ ID NO: 51464 - RNA, 18 nt, Human
gacccaagccacuaaaaa

SEQ ID NO: 51465 - RNA, 20 nt, Human
gagaccuggccgggcacucc

SEQ ID NO: 51466 - RNA, 19 nt, Human
gagauccuuuaacuugaaa

SEQ ID NO: 51467 - RNA, 24 nt, Human
gagcagcguggcuggguccgaggc

SEQ ID NO: 51468 - RNA, 21 nt, Human
gagcauggggcucugggaaga

SEQ ID NO: 51469 - RNA, 23 nt, Human
gcagccccccugcccaccccucc

SEQ ID NO: 51470 - RNA, 20 nt, Human
gcccagacauuggucuggag

SEQ ID NO: 51471 - RNA, 21 nt, Human
gcccagcuccccaccacaucc

SEQ ID NO: 51472 - RNA, 18 nt, Human
gccgggaccgcgagugcc

SEQ ID NO: 51473 - RNA, 18 nt, Human
gccuccaagaccucccca

SEQ ID NO: 51474 - RNA, 19 nt, Human
ggaagccucccacacccca

SEQ ID NO: 51475 - RNA, 22 nt, Human
ggacagaacaaaagucuacagg

SEQ ID NO: 51476 - RNA, 23 nt, Human
ggacccuugcuagcagccccccu

SEQ ID NO: 51477 - RNA, 19 nt, Human
ggaggggugcuggguaagg

SEQ ID NO: 51478 - RNA, 23 nt, Human
ggcagggagcagaaagcccaggg

SEQ ID NO: 51479 - RNA, 19 nt, Human
ggccagcagagggucacag

SEQ ID NO: 51480 - RNA, 25 nt, Human
gggagacccaagccacuaaaaaccc

SEQ ID NO: 51481 - RNA, 26 nt, Human
gggagacccaagccacuaaaaacccu

SEQ ID NO: 51482 - RNA, 21 nt, Human
gggauuuuuauaucaccauau

SEQ ID NO: 51483 - RNA, 18 nt, Human
gggcucugggaagaaagu

SEQ ID NO: 51484 - RNA, 21 nt, Human
ggggaaaggagggcccagaga

SEQ ID NO: 51485 - RNA, 24 nt, Human
uaagaugccuacuggcccaauguu

SEQ ID NO: 51486 - RNA, 24 nt, Human
uacaggaucugggcagggagcaga

SEQ ID NO: 51487 - RNA, 24 nt, Human
uauccuuuauugauaaaauagcuc

SEQ ID NO: 51488 - RNA, 19 nt, Human
uauguuccagaggauuuga

SEQ ID NO: 51489 - RNA, 19 nt, Human
ucaagaaagggaagcccag

SEQ ID NO: 51490 - RNA, 20 nt, Human
ucacaaggacucauuugggg

SEQ ID NO: 51491 - RNA, 24 nt, Human
ucagaguuuaaaaaaaaaaaaaaa

SEQ ID NO: 51492 - RNA, 20 nt, Human
ucagggagaggguggagaag

SEQ ID NO: 51493 - RNA, 24 nt, Human
uccacaagcacccaccugggggga

SEQ ID NO: 51494 - RNA, 20 nt, Human
uccacguggccacccaccua

SEQ ID NO: 51495 - RNA, 23 nt, Human
uccauucucucuacacccagaaa

SEQ ID NO: 51496 - RNA, 22 nt, Human
ucccacaccccaggaaggacuc

SEQ ID NO: 51497 - RNA, 21 nt, Human
ucccagggcgauacucuggcc

SEQ ID NO: 51498 - RNA, 22 nt, Human
uccuggcccagcuccccaccac

SEQ ID NO: 51499 - RNA, 24 nt, Human
ucgaggcagagaccaggccuccaa

SEQ ID NO: 51500 - RNA, 19 nt, Human
ucugggugccagguuuugg

SEQ ID NO: 51501 - RNA, 25 nt, Human
ugaaaaagaaacgaaaacaccacaa

SEQ ID NO: 51502 - RNA, 21 nt, Human
ugaaauagugauucugucugc

SEQ ID NO: 51503 - RNA, 21 nt, Human
ugaagccaggcccucuccaag

SEQ ID NO: 51504 - RNA, 21 nt, Human
ugacaaaagacuuauccccca

SEQ ID NO: 51505 - RNA, 18 nt, Human
ugaggccuacaggaucug

SEQ ID NO: 51506 - RNA, 20 nt, Human
ugauucugucugccacuccc

SEQ ID NO: 51507 - RNA, 20 nt, Human
ugcacagccccaucagcauu

SEQ ID NO: 51508 - RNA, 19 nt, Human
ugccaguaccccaccuggg

SEQ ID NO: 51509 - RNA, 18 nt, Human
ugccagugaucggggauc

SEQ ID NO: 51510 - RNA, 21 nt, Human
uggaaggcuggcuccgugcuc

SEQ ID NO: 51511 - RNA, 19 nt, Human
ugggaaaaguggaaggcug

SEQ ID NO: 51512 - RNA, 20 nt, Human
ugggaaaaguggaaggcugg

SEQ ID NO: 51513 - RNA, 23 nt, Human
ugggacccuugcuagcagccccc

SEQ ID NO: 51514 - RNA, 21 nt, Human
ugucacaggcucucaucuuag

SEQ ID NO: 51515 - RNA, 22 nt, Human
ugucacaggcucucaucuuaga

SEQ ID NO: 51516 - RNA, 25 nt, Human
uguggauauuuugagcugucuuggg

SEQ ID NO: 51517 - RNA, 23 nt, Human
uguucugggugccagguuuuggg

SEQ ID NO: 51518 - RNA, 24 nt, Human
uguucugggugccagguuuugggg

SEQ ID NO: 51519 - RNA, 18 nt, Human
uugaagccaggcccucuc

SEQ ID NO: 51520 - RNA, 21 nt, Human
uuuugagcugucuuggggaga

SEQ ID NO: 51521 - RNA, 22 nt, Human
uuuuggggugggacugagaacc

SEQ ID NO: 51522 - RNA, 23 nt, Human
uuuuggggugggacugagaacca

SEQ ID NO: 51523 - RNA, 21 nt, Human
aaacacagaucuccucguucc

SEQ ID NO: 51524 - RNA, 19 nt, Human
aggccgggggcggggggug

SEQ ID NO: 51525 - RNA, 19 nt, Human
cccagaagcccgggcgcgg

SEQ ID NO: 51526 - RNA, 19 nt, Human
ccccugggaagccgugccc

SEQ ID NO: 51527 - RNA, 18 nt, Human
cgggggguguggcagggc

SEQ ID NO: 51528 - RNA, 23 nt, Human
cguggcuuuucucuuugccucgg

SEQ ID NO: 51529 - RNA, 21 nt, Human
cucucccaucccuucccaaac

SEQ ID NO: 51530 - RNA, 18 nt, Human
gagcugcggaggccgggg

SEQ ID NO: 51531 - RNA, 18 nt, Human
gaggccgggggcgggggg

SEQ ID NO: 51532 - RNA, 21 nt, Human
gccacucucccaucccuuccc

SEQ ID NO: 51533 - RNA, 18 nt, Human
gccgagcugcggaggccg

SEQ ID NO: 51534 - RNA, 18 nt, Human
ggcagggcugggccgugg

SEQ ID NO: 51535 - RNA, 19 nt, Human
gggcgggggguguggcagg

SEQ ID NO: 51536 - RNA, 24 nt, Human
gggcgggggguguggcagggcugg

SEQ ID NO: 51537 - RNA, 18 nt, Human
ggguguggcagggcuggg

SEQ ID NO: 51538 - RNA, 21 nt, Human
guggcuuuucucuuugccucg

SEQ ID NO: 51539 - RNA, 20 nt, Human
uaaguaaacacagaucuccu

SEQ ID NO: 51540 - RNA, 19 nt, Human
ucagcaagccacucuccca

SEQ ID NO: 51541 - RNA, 22 nt, Human
ucccuucccaaacuuuccuuuu

SEQ ID NO: 51542 - RNA, 21 nt, Human
ucggucuuaaguaaacacaga

SEQ ID NO: 51543 - RNA, 23 nt, Human
ugcggaggccgggggcggggggu

SEQ ID NO: 51544 - RNA, 18 nt, Human
ugggccgugguuggggaa

SEQ ID NO: 51545 - RNA, 22 nt, Human
uggggaacaccccagaagcccg

SEQ ID NO: 51546 - RNA, 24 nt, Human
uuccuuuuugugcaacgguccgug

SEQ ID NO: 51547 - RNA, 26 nt, Human
uugugcaacgguccguggcuuuucuc

SEQ ID NO: 51548 - RNA, 23 nt, Human
aaacaucagaauauauuuaugac

SEQ ID NO: 51549 - RNA, 25 nt, Human
aagaaaacaaacggagggaaagugg

SEQ ID NO: 51550 - RNA, 24 nt, Human
aagaguuucaggaaggguggggga

SEQ ID NO: 51551 - RNA, 21 nt, Human
acacacacacacacacacaca

SEQ ID NO: 51552 - RNA, 25 nt, Human
acacacacacacacacacacacggu

SEQ ID NO: 51553 - RNA, 23 nt, Human
acacacacacacacacacgcaca

SEQ ID NO: 51554 - RNA, 23 nt, Human
acacacacacacaccauguaagg

SEQ ID NO: 51555 - RNA, 23 nt, Human
acacacacacacacgcacacaca

SEQ ID NO: 51556 - RNA, 23 nt, Human
acacacacacacgcacacacaca

SEQ ID NO: 51557 - RNA, 23 nt, Human
acacacacgcacacacacacaca

SEQ ID NO: 51558 - RNA, 18 nt, Human
acagagccuggagaacac

SEQ ID NO: 51559 - RNA, 19 nt, Human
accccaacucccucggugc

SEQ ID NO: 51560 - RNA, 23 nt, Human
acccuggagcucccaaaacccuu

SEQ ID NO: 51561 - RNA, 23 nt, Human
acccuggcgaaguccuucugaca

SEQ ID NO: 51562 - RNA, 21 nt, Human
acgcacacacacacacacaca

SEQ ID NO: 51563 - RNA, 20 nt, Human
agaaaacaaacggagggaaa

SEQ ID NO: 51564 - RNA, 24 nt, Human
agaaaagagugaggauuaggccua

SEQ ID NO: 51565 - RNA, 18 nt, Human
agagcgcucagccucccc

SEQ ID NO: 51566 - RNA, 24 nt, Human
agagcgcucagccuccccccaccc

SEQ ID NO: 51567 - RNA, 18 nt, Human
agcaagauaucaaaggcu

SEQ ID NO: 51568 - RNA, 23 nt, Human
agccagagcgcucagccuccccc

SEQ ID NO: 51569 - RNA, 20 nt, Human
aggaagaaaagagugaggau

SEQ ID NO: 51570 - RNA, 23 nt, Human
aguaauaagggaaccagagauaa

SEQ ID NO: 51571 - RNA, 18 nt, Human
augaacccuggagcuccc

SEQ ID NO: 51572 - RNA, 21 nt, Human
auggaaccaggggagcucucu

SEQ ID NO: 51573 - RNA, 19 nt, Human
caaagccagccugcugcuc

SEQ ID NO: 51574 - RNA, 23 nt, Human
caagaggauggugaaaacccacu

SEQ ID NO: 51575 - RNA, 19 nt, Human
caagccgggugaugggugc

SEQ ID NO: 51576 - RNA, 20 nt, Human
cacacacacacacacacaca

SEQ ID NO: 51577 - RNA, 25 nt, Human
cacacacacacacacacacgcacac

SEQ ID NO: 51578 - RNA, 24 nt, Human
cacacacacacacgcacacacaca

SEQ ID NO: 51579 - RNA, 28 nt, Human
cacacacacacacgcacacacacacaca

SEQ ID NO: 51580 - RNA, 28 nt, Human
cacacacacgcacacacacacacacaca

SEQ ID NO: 51581 - RNA, 29 nt, Human
cacacgcacacacacacacacacaccaug

SEQ ID NO: 51582 - RNA, 18 nt, Human
cacagagccuggagaaca

SEQ ID NO: 51583 - RNA, 21 nt, Human
caccuggacacuaccacugag

SEQ ID NO: 51584 - RNA, 20 nt, Human
caccuggcucaggggagggg

SEQ ID NO: 51585 - RNA, 30 nt, Human
cacgcacacacacacacacacaccauguag

SEQ ID NO: 51586 - RNA, 23 nt, Human
cacuaaggucucaucaggguuug

SEQ ID NO: 51587 - RNA, 21 nt, Human
cagagccuggagaacacuaag

SEQ ID NO: 51588 - RNA, 21 nt, Human
cagucgucagguucuggaggg

SEQ ID NO: 51589 - RNA, 23 nt, Human
caguuuuacuuuaagaggauaau

SEQ ID NO: 51590 - RNA, 18 nt, Human
ccaacccaagcaaugcuu

SEQ ID NO: 51591 - RNA, 27 nt, Human
ccacagagccuggagaacagcggaccg

SEQ ID NO: 51592 - RNA, 23 nt, Human
ccacagccagcccaucccccugu

SEQ ID NO: 51593 - RNA, 19 nt, Human
ccacugagggaggagugaa

SEQ ID NO: 51594 - RNA, 18 nt, Human
ccagagauaaaaccccaa

SEQ ID NO: 51595 - RNA, 24 nt, Human
ccagagguuuuccacagguucuga

SEQ ID NO: 51596 - RNA, 23 nt, Human
ccagcccaucccccugugggccc

SEQ ID NO: 51597 - RNA, 21 nt, Human
ccagcgcagaguagaagggaa

SEQ ID NO: 51598 - RNA, 19 nt, Human
cccaaaacccuggcgaagu

SEQ ID NO: 51599 - RNA, 20 nt, Human
cccaagcaaugcuuugugcc

SEQ ID NO: 51600 - RNA, 22 nt, Human
cccaccccaacucccucggugc

SEQ ID NO: 51601 - RNA, 19 nt, Human
ccccaacucccucggugcc

SEQ ID NO: 51602 - RNA, 22 nt, Human
ccccagccugggccaucuucuc

SEQ ID NO: 51603 - RNA, 24 nt, Human
ccccccaccccaacucccucggug

SEQ ID NO: 51604 - RNA, 19 nt, Human
cccccugcccuaaaccugg

SEQ ID NO: 51605 - RNA, 24 nt, Human
ccccugcccuaaaccuggccacag

SEQ ID NO: 51606 - RNA, 18 nt, Human
cccgggucgcgcgugggg

SEQ ID NO: 51607 - RNA, 19 nt, Human
cccucggugccaccgcucu

SEQ ID NO: 51608 - RNA, 19 nt, Human
cccugcccuaaaccuggcc

SEQ ID NO: 51609 - RNA, 23 nt, Human
cccuggagcucccaaaacccugg

SEQ ID NO: 51610 - RNA, 18 nt, Human
ccuccccccaccccaacu

SEQ ID NO: 51611 - RNA, 20 nt, Human
ccugcccuaaaccuggccac

SEQ ID NO: 51612 - RNA, 18 nt, Human
ccuggcucaggggagggg

SEQ ID NO: 51613 - RNA, 22 nt, Human
ccugugccuccagacacacaca

SEQ ID NO: 51614 - RNA, 21 nt, Human
ccuugggucacauggcccagu

SEQ ID NO: 51615 - RNA, 20 nt, Human
cgcacacacacacacacaca

SEQ ID NO: 51616 - RNA, 21 nt, Human
cgcucagccuccccccacccc

SEQ ID NO: 51617 - RNA, 22 nt, Human
cgcucagccuccccccacccca

SEQ ID NO: 51618 - RNA, 24 nt, Human
cucagccuccccccaccccaacuc

SEQ ID NO: 51619 - RNA, 22 nt, Human
cuccccccaccccaacucccuc

SEQ ID NO: 51620 - RNA, 18 nt, Human
cugcucucagccugggcc

SEQ ID NO: 51621 - RNA, 19 nt, Human
cugcugcucucagccuggu

SEQ ID NO: 51622 - RNA, 24 nt, Human
cuuaugaacccuggagcucccaaa

SEQ ID NO: 51623 - RNA, 18 nt, Human
gaaagaaggaaggagggg

SEQ ID NO: 51624 - RNA, 24 nt, Human
gagcgcucagccuccccccacccc

SEQ ID NO: 51625 - RNA, 22 nt, Human
gccagcccaucccccugugggc

SEQ ID NO: 51626 - RNA, 20 nt, Human
gccuccccccaccccaacuc

SEQ ID NO: 51627 - RNA, 20 nt, Human
gcuaaagugagagaggccag

SEQ ID NO: 51628 - RNA, 25 nt, Human
gcucccaaaacccuggcgaaguccu

SEQ ID NO: 51629 - RNA, 18 nt, Human
ggacaaaugcccccugcc

SEQ ID NO: 51630 - RNA, 24 nt, Human
ggagggaaagugggccgaggauga

SEQ ID NO: 51631 - RNA, 20 nt, Human
ggccagagguuuuccacagg

SEQ ID NO: 51632 - RNA, 20 nt, Human
ggugagugggaagguagagg

SEQ ID NO: 51633 - RNA, 19 nt, Human
gugccugugccuccagaca

SEQ ID NO: 51634 - RNA, 18 nt, Human
guggcagaaggaauggaa

SEQ ID NO: 51635 - RNA, 19 nt, Human
uaaaccuggccacagccag

SEQ ID NO: 51636 - RNA, 20 nt, Human
uaaggcaccacuggauuaua

SEQ ID NO: 51637 - RNA, 21 nt, Human
ucaccuggcucaggggagggg

SEQ ID NO: 51638 - RNA, 24 nt, Human
ucagccuccccccaccccaacucc

SEQ ID NO: 51639 - RNA, 19 nt, Human
uccaaguccuguggggagc

SEQ ID NO: 51640 - RNA, 20 nt, Human
uccagacacacacacacaca

SEQ ID NO: 51641 - RNA, 33 nt, Human
uccagacacacacacacacacacacacgcagug

SEQ ID NO: 51642 - RNA, 18 nt, Human
uccauggcuaaagugaga

SEQ ID NO: 51643 - RNA, 23 nt, Human
uccauggcuaaagugagagaggc

SEQ ID NO: 51644 - RNA, 18 nt, Human
ucccaaaacccuggcgaa

SEQ ID NO: 51645 - RNA, 18 nt, Human
uccccccaccccaacucc

SEQ ID NO: 51646 - RNA, 23 nt, Human
ucccccugugggcccucugucca

SEQ ID NO: 51647 - RNA, 20 nt, Human
ucccucggugccaccgcucu

SEQ ID NO: 51648 - RNA, 24 nt, Human
ucccucggugccaccgcucuuggg

SEQ ID NO: 51649 - RNA, 18 nt, Human
uccuucugacacugcugu

SEQ ID NO: 51650 - RNA, 21 nt, Human
ugaaaagaaaacaaacggagg

SEQ ID NO: 51651 - RNA, 18 nt, Human
ugcaaaaggaaaagaagg

SEQ ID NO: 51652 - RNA, 18 nt, Human
ugcaaaaggaaaagaagg

SEQ ID NO: 51653 - RNA, 21 nt, Human
ugcccuaaaccuggccacagc

SEQ ID NO: 51654 - RNA, 20 nt, Human
uggaaccaggggagcucucu

SEQ ID NO: 51655 - RNA, 22 nt, Human
uggaggggacaaaugcccccug

SEQ ID NO: 51656 - RNA, 18 nt, Human
uggcagaaggaauggaac

SEQ ID NO: 51657 - RNA, 28 nt, Human
uggggcgguagggaaagaaggaaggagg

SEQ ID NO: 51658 - RNA, 19 nt, Human
ugguaaggaucccuccuug

SEQ ID NO: 51659 - RNA, 24 nt, Human
ugguucaccuucuuaugaacccug

SEQ ID NO: 51660 - RNA, 18 nt, Human
ugucacagccggggaauc

SEQ ID NO: 51661 - RNA, 19 nt, Human
uuccauggcuaaagugaga

SEQ ID NO: 51662 - RNA, 19 nt, Human
aagcggggccucccggggg

SEQ ID NO: 51663 - RNA, 22 nt, Human
aagcugaaaaggggucaccaga

SEQ ID NO: 51664 - RNA, 20 nt, Human
aagcugaaaaggggucaccg

SEQ ID NO: 51665 - RNA, 19 nt, Human
aaguggcagaagcugcucu

SEQ ID NO: 51666 - RNA, 20 nt, Human
aagugggaguggaggcagcc

SEQ ID NO: 51667 - RNA, 21 nt, Human
acagcuugguguggcaucauc

SEQ ID NO: 51668 - RNA, 21 nt, Human
accagguacaaaaagagucug

SEQ ID NO: 51669 - RNA, 22 nt, Human
acccacugccucaccccaccug

SEQ ID NO: 51670 - RNA, 22 nt, Human
agccauggcgguggaggagacc

SEQ ID NO: 51671 - RNA, 28 nt, Human
agccgaaucaggcaccauuuuuuauaaa

SEQ ID NO: 51672 - RNA, 18 nt, Human
aggcagagcacuggcaca

SEQ ID NO: 51673 - RNA, 20 nt, Human
aggcagccagugacacagag

SEQ ID NO: 51674 - RNA, 18 nt, Human
aggccccagccagccucc

SEQ ID NO: 51675 - RNA, 18 nt, Human
agggaagugggaguggag

SEQ ID NO: 51676 - RNA, 18 nt, Human
agggguaggaggggaagu

SEQ ID NO: 51677 - RNA, 22 nt, Human
agggugcgccaacccagccccg

SEQ ID NO: 51678 - RNA, 21 nt, Human
caagccccgcagugucaggga

SEQ ID NO: 51679 - RNA, 27 nt, Human
cacacacacaggcagagcacuggcaca

SEQ ID NO: 51680 - RNA, 22 nt, Human
cacagcuugguguggcaucauc

SEQ ID NO: 51681 - RNA, 23 nt, Human
cacagcuugguguggcaucaucc

SEQ ID NO: 51682 - RNA, 19 nt, Human
cacagucccauggcacaag

SEQ ID NO: 51683 - RNA, 22 nt, Human
caccccaccuggaagauggccu

SEQ ID NO: 51684 - RNA, 23 nt, Human
caccccaccuggaagauggccug

SEQ ID NO: 51685 - RNA, 20 nt, Human
caccgagacccuccccauca

SEQ ID NO: 51686 - RNA, 21 nt, Human
cagaccaccuuggaagccaug

SEQ ID NO: 51687 - RNA, 23 nt, Human
cagauggggucgcacccagccca

SEQ ID NO: 51688 - RNA, 21 nt, Human
cagcaccugcugccaaugcca

SEQ ID NO: 51689 - RNA, 20 nt, Human
cagcagggaggguagcagca

SEQ ID NO: 51690 - RNA, 20 nt, Human
caggagcccgagucacugug

SEQ ID NO: 51691 - RNA, 18 nt, Human
caggagccgaggcaagcg

SEQ ID NO: 51692 - RNA, 21 nt, Human
cagggagacaacgggccccuc

SEQ ID NO: 51693 - RNA, 20 nt, Human
cagguacaaaaagagucuga

SEQ ID NO: 51694 - RNA, 23 nt, Human
caggugccuugcuguggucccug

SEQ ID NO: 51695 - RNA, 18 nt, Human
ccaaugccacucucucag

SEQ ID NO: 51696 - RNA, 21 nt, Human
ccaccgagacccuccccauca

SEQ ID NO: 51697 - RNA, 19 nt, Human
ccacugccucaccccaccu

SEQ ID NO: 51698 - RNA, 22 nt, Human
ccaggccuaacacuguuggcac

SEQ ID NO: 51699 - RNA, 19 nt, Human
ccagggagacaacgggccc

SEQ ID NO: 51700 - RNA, 20 nt, Human
ccaucaggccccagcccagc

SEQ ID NO: 51701 - RNA, 21 nt, Human
cccacagagcccaggguggca

SEQ ID NO: 51702 - RNA, 18 nt, Human
ccccagcccagcagaagc

SEQ ID NO: 51703 - RNA, 19 nt, Human
ccccuccucucgccaacac

SEQ ID NO: 51704 - RNA, 20 nt, Human
ccccugaagucaggacagag

SEQ ID NO: 51705 - RNA, 22 nt, Human
cccgagcagaccaccuuggaag

SEQ ID NO: 51706 - RNA, 22 nt, Human
cccugugcugugccugccccug

SEQ ID NO: 51707 - RNA, 21 nt, Human
ccgaucacccagacacugugc

SEQ ID NO: 51708 - RNA, 18 nt, Human
ccgccgccgccgccgccg

SEQ ID NO: 51709 - RNA, 23 nt, Human
ccgccgccgccgccgccgccgcc

SEQ ID NO: 51710 - RNA, 26 nt, Human
ccgccgccgccgccgccgccgccgcu

SEQ ID NO: 51711 - RNA, 25 nt, Human
ccgccgccgccgccgccgccgccgg

SEQ ID NO: 51712 - RNA, 23 nt, Human
ccgccgccgccgccgccgccgcu

SEQ ID NO: 51713 - RNA, 22 nt, Human
ccgggugcuggggguuggggca

SEQ ID NO: 51714 - RNA, 23 nt, Human
ccuaacacuguuggcaccuccuc

SEQ ID NO: 51715 - RNA, 23 nt, Human
ccucccgccgccgccgccgccgc

SEQ ID NO: 51716 - RNA, 22 nt, Human
ccuccucccgccgccgccgcua

SEQ ID NO: 51717 - RNA, 21 nt, Human
ccucucgccaacacuguggag

SEQ ID NO: 51718 - RNA, 20 nt, Human
cgagugcacacacacaggca

SEQ ID NO: 51719 - RNA, 21 nt, Human
cgccgccgccgccgccgcucc

SEQ ID NO: 51720 - RNA, 20 nt, Human
cgccgggcagcggcuggguu

SEQ ID NO: 51721 - RNA, 22 nt, Human
cggcaaagaaacgccccgggga

SEQ ID NO: 51722 - RNA, 21 nt, Human
cggcacugacaggacgugggc

SEQ ID NO: 51723 - RNA, 22 nt, Human
cgggcagccccugaagucagga

SEQ ID NO: 51724 - RNA, 22 nt, Human
cgggggagcugggccaggcugg

SEQ ID NO: 51725 - RNA, 19 nt, Human
cucccgggggagcugggcc

SEQ ID NO: 51726 - RNA, 23 nt, Human
cugguaccaccgagacccucccc

SEQ ID NO: 51727 - RNA, 22 nt, Human
cugugcucuucccccacaggaa

SEQ ID NO: 51728 - RNA, 22 nt, Human
gacagugcagggccugccccuc

SEQ ID NO: 51729 - RNA, 22 nt, Human
gacccacugccucaccccaccu

SEQ ID NO: 51730 - RNA, 21 nt, Human
gagaggacugucagcugggag

SEQ ID NO: 51731 - RNA, 18 nt, Human
gagcccgagucacugugg

SEQ ID NO: 51732 - RNA, 20 nt, Human
gagggccagggagacaacgg

SEQ ID NO: 51733 - RNA, 24 nt, Human
gccagggagacaacgggccccucc

SEQ ID NO: 51734 - RNA, 21 nt, Human
gccccuccucucgccaacacu

SEQ ID NO: 51735 - RNA, 24 nt, Human
gcccgagcagaccaccuuggaagc

SEQ ID NO: 51736 - RNA, 23 nt, Human
gccuccucccgccgccgccgccg

SEQ ID NO: 51737 - RNA, 23 nt, Human
gccuccucccgccgccgccgccg

SEQ ID NO: 51738 - RNA, 23 nt, Human
ggaagauggccugggcccgagca

SEQ ID NO: 51739 - RNA, 18 nt, Human
ggaagugggacccacugc

SEQ ID NO: 51740 - RNA, 19 nt, Human
ggagcugggccaggcuggg

SEQ ID NO: 51741 - RNA, 22 nt, Human
ggagggguaggaggggaagugg

SEQ ID NO: 51742 - RNA, 20 nt, Human
ggcacagcuugguguggcau

SEQ ID NO: 51743 - RNA, 20 nt, Human
gggaaugaguagacgggagg

SEQ ID NO: 51744 - RNA, 20 nt, Human
gggagcugggccaggcuggg

SEQ ID NO: 51745 - RNA, 18 nt, Human
gggaugggccacccacag

SEQ ID NO: 51746 - RNA, 18 nt, Human
gggcuggccagucugggc

SEQ ID NO: 51747 - RNA, 21 nt, Human
ggggacagcagggaggguagc

SEQ ID NO: 51748 - RNA, 21 nt, Human
ggggugcagugggaaaauuca

SEQ ID NO: 51749 - RNA, 21 nt, Human
ggucaccagguacaaaaagag

SEQ ID NO: 51750 - RNA, 23 nt, Human
gucucauuuuucacucuuuaaaa

SEQ ID NO: 51751 - RNA, 21 nt, Human
guggaggcagccagugacaca

SEQ ID NO: 51752 - RNA, 21 nt, Human
guuggcaccuccuccugcuua

SEQ ID NO: 51753 - RNA, 21 nt, Human
uacaaaaagagucugagacag

SEQ ID NO: 51754 - RNA, 22 nt, Human
uacaaaaagagucugagacagc

SEQ ID NO: 51755 - RNA, 24 nt, Human
uacaaaaagagucugagacagccg

SEQ ID NO: 51756 - RNA, 19 nt, Human
uacacugaugggccaggau

SEQ ID NO: 51757 - RNA, 20 nt, Human
uacacugaugggccaggaug

SEQ ID NO: 51758 - RNA, 23 nt, Human
uaccaccgagacccuccccauca

SEQ ID NO: 51759 - RNA, 21 nt, Human
ucacugugggagccuugaggg

SEQ ID NO: 51760 - RNA, 23 nt, Human
ucaggccaggcgaggccaguaug

SEQ ID NO: 51761 - RNA, 18 nt, Human
ucagggaagugggagugg

SEQ ID NO: 51762 - RNA, 21 nt, Human
ucccauggcacaagugcagcc

SEQ ID NO: 51763 - RNA, 25 nt, Human
ucccccacaggaagacacugggagc

SEQ ID NO: 51764 - RNA, 24 nt, Human
ucccgccgccgccgccgccgccgg

SEQ ID NO: 51765 - RNA, 19 nt, Human
ucccgggggagcugggcca

SEQ ID NO: 51766 - RNA, 21 nt, Human
ucccugagcccgggugcuggg

SEQ ID NO: 51767 - RNA, 23 nt, Human
ucccugugcugugccugccccug

SEQ ID NO: 51768 - RNA, 21 nt, Human
uccucccgccgccgccgccgc

SEQ ID NO: 51769 - RNA, 19 nt, Human
uccugaauaagggcacagg

SEQ ID NO: 51770 - RNA, 23 nt, Human
ucgcacccagcccagcaucagcg

SEQ ID NO: 51771 - RNA, 18 nt, Human
ugacacagaggcuuuucc

SEQ ID NO: 51772 - RNA, 21 nt, Human
ugagacagccgaaucaggcac

SEQ ID NO: 51773 - RNA, 22 nt, Human
ugagacagccgaaucaggcacc

SEQ ID NO: 51774 - RNA, 19 nt, Human
ugaguagacgggaggggag

SEQ ID NO: 51775 - RNA, 23 nt, Human
ugaguagacgggaggggagggug

SEQ ID NO: 51776 - RNA, 19 nt, Human
ugcacacacacaggcagag

SEQ ID NO: 51777 - RNA, 21 nt, Human
ugcagcaggagccgaggcaag

SEQ ID NO: 51778 - RNA, 21 nt, Human
ugcagcaggagggggugcagu

SEQ ID NO: 51779 - RNA, 23 nt, Human
ugcaggugccuugcugugguccc

SEQ ID NO: 51780 - RNA, 18 nt, Human
ugcuggggguuggggcaa

SEQ ID NO: 51781 - RNA, 20 nt, Human
uggagaggacugucagcugg

SEQ ID NO: 51782 - RNA, 18 nt, Human
uggccugggcccgagcag

SEQ ID NO: 51783 - RNA, 20 nt, Human
ugggagcgggcagccccuga

SEQ ID NO: 51784 - RNA, 24 nt, Human
ugggcagauggggucgcacccagc

SEQ ID NO: 51785 - RNA, 21 nt, Human
uggggcuggccagucugggcg

SEQ ID NO: 51786 - RNA, 18 nt, Human
uggggguuggggcaagag

SEQ ID NO: 51787 - RNA, 19 nt, Human
uggggguuggggcaagagg

SEQ ID NO: 51788 - RNA, 18 nt, Human
ugguaccaccgagacccu

SEQ ID NO: 51789 - RNA, 24 nt, Human
uggucccugagcccgggugcuggg

SEQ ID NO: 51790 - RNA, 21 nt, Human
uguggggcuggccagucuggg

SEQ ID NO: 51791 - RNA, 28 nt, Human
uugcuguggucccugagcccgggugcug

SEQ ID NO: 51792 - RNA, 18 nt, Human
aaaaaggcuucaugcccu

SEQ ID NO: 51793 - RNA, 19 nt, Human
aaaauaucaaggacaggau

SEQ ID NO: 51794 - RNA, 22 nt, Human
aaacaaauacaaaaacaaagau

SEQ ID NO: 51795 - RNA, 25 nt, Human
aaacaaauacaaaaacaaagauuug

SEQ ID NO: 51796 - RNA, 26 nt, Human
aaacugcucuugccccugaaaccuag

SEQ ID NO: 51797 - RNA, 23 nt, Human
aacuuuuauuucuucaguaguuu

SEQ ID NO: 51798 - RNA, 23 nt, Human
aagauuuggaacugcuaaaaaua

SEQ ID NO: 51799 - RNA, 24 nt, Human
aaggaaccagaaugacugucacag

SEQ ID NO: 51800 - RNA, 22 nt, Human
aauacaaaaacaaagauuugga

SEQ ID NO: 51801 - RNA, 18 nt, Human
acaaauacaaaaacaaag

SEQ ID NO: 51802 - RNA, 24 nt, Human
agaaggaaccagaaugacugucac

SEQ ID NO: 51803 - RNA, 24 nt, Human
agacauagaaaaucagcagugacu

SEQ ID NO: 51804 - RNA, 18 nt, Human
agcaaacaaauacaaaaa

SEQ ID NO: 51805 - RNA, 18 nt, Human
agcugaccccaagccgaa

SEQ ID NO: 51806 - RNA, 23 nt, Human
aggaaaaaggcuucaugcccuaa

SEQ ID NO: 51807 - RNA, 19 nt, Human
aguuaaucccauacacuug

SEQ ID NO: 51808 - RNA, 21 nt, Human
auagaaaaucagcagugacua

SEQ ID NO: 51809 - RNA, 24 nt, Human
aucagaaaauaucuucaacuuuua

SEQ ID NO: 51810 - RNA, 23 nt, Human
caaaaggcugagacccuggugug

SEQ ID NO: 51811 - RNA, 23 nt, Human
caaaauaacugcauuaaaaagua

SEQ ID NO: 51812 - RNA, 19 nt, Human
caacuuuuaaccccaggac

SEQ ID NO: 51813 - RNA, 27 nt, Human
cacacaacugcuaauugucgagaccug

SEQ ID NO: 51814 - RNA, 22 nt, Human
cacagcaaacaaauacaaaaac

SEQ ID NO: 51815 - RNA, 24 nt, Human
cagaugccucauccucguucaccc

SEQ ID NO: 51816 - RNA, 23 nt, Human
caggaaaaaggcuucaugcccua

SEQ ID NO: 51817 - RNA, 22 nt, Human
caggaugcagacaauuacgaug

SEQ ID NO: 51818 - RNA, 21 nt, Human
cagugggagaaaacaaacuuc

SEQ ID NO: 51819 - RNA, 20 nt, Human
cauucccaccuggcugaggg

SEQ ID NO: 51820 - RNA, 21 nt, Human
ccagaaugacugucacacaac

SEQ ID NO: 51821 - RNA, 19 nt, Human
ccagguacugcuugucgac

SEQ ID NO: 51822 - RNA, 18 nt, Human
ccccaaaaggcugagacc

SEQ ID NO: 51823 - RNA, 21 nt, Human
ccuaaaacuccacggccuguc

SEQ ID NO: 51824 - RNA, 20 nt, Human
cgacaugaaagucaauauac

SEQ ID NO: 51825 - RNA, 20 nt, Human
cuggggagucuaagaugugu

SEQ ID NO: 51826 - RNA, 19 nt, Human
gaagugcacaaaagaaaca

SEQ ID NO: 51827 - RNA, 23 nt, Human
gacaagaagucaguugcgaagug

SEQ ID NO: 51828 - RNA, 18 nt, Human
gacacauucauuccucag

SEQ ID NO: 51829 - RNA, 21 nt, Human
gaggcagggcagucauguggg

SEQ ID NO: 51830 - RNA, 19 nt, Human
gcaaacaaauacaaaaaca

SEQ ID NO: 51831 - RNA, 26 nt, Human
gcgagcuuuggcggcggcggcggcgg

SEQ ID NO: 51832 - RNA, 28 nt, Human
gcugagacccugguguguccuccucgag

SEQ ID NO: 51833 - RNA, 21 nt, Human
ggaacagacuggucagaggca

SEQ ID NO: 51834 - RNA, 18 nt, Human
ggagcugagcugacccca

SEQ ID NO: 51835 - RNA, 24 nt, Human
gggggccccggaacagacugguca

SEQ ID NO: 51836 - RNA, 21 nt, Human
guaucaguggggccuggaggc

SEQ ID NO: 51837 - RNA, 22 nt, Human
uaaaaaguacuuacuuugcccc

SEQ ID NO: 51838 - RNA, 25 nt, Human
uagguaccaaaguguguagcaaaga

SEQ ID NO: 51839 - RNA, 23 nt, Human
uaguaguuaauguaaagacauac

SEQ ID NO: 51840 - RNA, 20 nt, Human
uauggagcaaagacauagaa

SEQ ID NO: 51841 - RNA, 19 nt, Human
ucaauacaauucaucugaa

SEQ ID NO: 51842 - RNA, 24 nt, Human
ucacuguaaaucuuuccaaugauu

SEQ ID NO: 51843 - RNA, 18 nt, Human
ucagaugccucauccucg

SEQ ID NO: 51844 - RNA, 21 nt, Human
ucaguaguuucuaaugcagac

SEQ ID NO: 51845 - RNA, 23 nt, Human
ucaguaguuucuaaugcagacaa

SEQ ID NO: 51846 - RNA, 25 nt, Human
ucaucagaaaauaucuucaacuuuu

SEQ ID NO: 51847 - RNA, 21 nt, Human
ucccccagcaguauggagcaa

SEQ ID NO: 51848 - RNA, 19 nt, Human
uccucagcauuuuuucaau

SEQ ID NO: 51849 - RNA, 25 nt, Human
ucguucaccccaaaaggcugagacc

SEQ ID NO: 51850 - RNA, 27 nt, Human
ugaacacagcaaacaaauacaaaaaca

SEQ ID NO: 51851 - RNA, 21 nt, Human
ugacacauucauuccucagca

SEQ ID NO: 51852 - RNA, 20 nt, Human
ugagugcuccugcaugccaa

SEQ ID NO: 51853 - RNA, 18 nt, Human
ugauaaguaggagucacu

SEQ ID NO: 51854 - RNA, 23 nt, Human
ugcagacaaaugugacaaggcag

SEQ ID NO: 51855 - RNA, 20 nt, Human
ugcuaaaaauaucaaggaca

SEQ ID NO: 51856 - RNA, 23 nt, Human
ugcugcugggaccaggaaaaagg

SEQ ID NO: 51857 - RNA, 18 nt, Human
uggcggcggcggcggcgg

SEQ ID NO: 51858 - RNA, 18 nt, Human
uggcggcggcggcggcgg

SEQ ID NO: 51859 - RNA, 23 nt, Human
uggcugagggggccccggaacag

SEQ ID NO: 51860 - RNA, 21 nt, Human
ugggaccaggaaaaaggcuuc

SEQ ID NO: 51861 - RNA, 23 nt, Human
uggggguaucaguggggccugga

SEQ ID NO: 51862 - RNA, 21 nt, Human
ugucguacagcccagugcagc

SEQ ID NO: 51863 - RNA, 21 nt, Human
uucaugacagaugcaugacga

SEQ ID NO: 51864 - RNA, 25 nt, Human
uugacacauucauuccucagcauuu

SEQ ID NO: 51865 - RNA, 23 nt, Human
uuggggguaucaguggggccugg

SEQ ID NO: 51866 - RNA, 21 nt, Human
uuuugguaauuaucuuccaaa

SEQ ID NO: 51867 - RNA, 22 nt, Human
agacugagaaacaggaaagcac

SEQ ID NO: 51868 - RNA, 25 nt, Human
cucuuuguuuuugccuuguugagaa

SEQ ID NO: 51869 - RNA, 20 nt, Human
gaacuacauuuacuaugcaa

SEQ ID NO: 51870 - RNA, 21 nt, Human
gagcagagucaacuucaacgc

SEQ ID NO: 51871 - RNA, 19 nt, Human
uacuaugcaagagcagagu

SEQ ID NO: 51872 - RNA, 26 nt, Human
ucagcaauuaacaaugauuuucguuu

SEQ ID NO: 51873 - RNA, 21 nt, Human
ugagaaacaggaaagcaccau

SEQ ID NO: 51874 - RNA, 20 nt, Human
uuucguuuaauucucuucca

SEQ ID NO: 51875 - RNA, 21 nt, Human
aacauaaagauuguuguuuug

SEQ ID NO: 51876 - RNA, 23 nt, Human
aacccccucccagccccaccaaa

SEQ ID NO: 51877 - RNA, 20 nt, Human
aagaaaggagaaauaaaggc

SEQ ID NO: 51878 - RNA, 24 nt, Human
aauacauaacccccucccagcccc

SEQ ID NO: 51879 - RNA, 19 nt, Human
acagcccgcucaagggggu

SEQ ID NO: 51880 - RNA, 20 nt, Human
acaguaggcauccaucugaa

SEQ ID NO: 51881 - RNA, 21 nt, Human
acauaacccccucccagcccc

SEQ ID NO: 51882 - RNA, 23 nt, Human
accaugagagcagcaggagcaac

SEQ ID NO: 51883 - RNA, 33 nt, Human
agaaaauagacagcccaaaauuuaaacagaaaa

SEQ ID NO: 51884 - RNA, 19 nt, Human
agaggaagaaggagccaga

SEQ ID NO: 51885 - RNA, 23 nt, Human
agaggaagaaggagccagaggcc

SEQ ID NO: 51886 - RNA, 23 nt, Human
agagguaauguuugaaauuaaag

SEQ ID NO: 51887 - RNA, 26 nt, Human
agcccaaaauuuaaacagaauucaua

SEQ ID NO: 51888 - RNA, 22 nt, Human
aggcggccggcgaggagugagc

SEQ ID NO: 51889 - RNA, 19 nt, Human
agugagcgaacugaacugc

SEQ ID NO: 51890 - RNA, 18 nt, Human
augacaauaaugaagaaa

SEQ ID NO: 51891 - RNA, 25 nt, Human
cacaugcagaggaagaaggagccag

SEQ ID NO: 51892 - RNA, 26 nt, Human
caccaugagagcagcaggagcaacaa

SEQ ID NO: 51893 - RNA, 19 nt, Human
cagcagaaaauagacagcc

SEQ ID NO: 51894 - RNA, 20 nt, Human
cagcagaaaauagacagccc

SEQ ID NO: 51895 - RNA, 23 nt, Human
cagcagaaaauagacagcccaaa

SEQ ID NO: 51896 - RNA, 24 nt, Human
cagcagaaaauagacagcccaaaa

SEQ ID NO: 51897 - RNA, 18 nt, Human
cagcaggagcaacaaaug

SEQ ID NO: 51898 - RNA, 19 nt, Human
cagcaggagcaacaaauga

SEQ ID NO: 51899 - RNA, 18 nt, Human
cagccaguccccgccccg

SEQ ID NO: 51900 - RNA, 24 nt, Human
cagccaguccccgccccgcucucc

SEQ ID NO: 51901 - RNA, 21 nt, Human
caggaagaggcccugguggcg

SEQ ID NO: 51902 - RNA, 20 nt, Human
caggagcaacaaaugauuug

SEQ ID NO: 51903 - RNA, 22 nt, Human
cauaacccccucccagccccac

SEQ ID NO: 51904 - RNA, 24 nt, Human
caucugaaaagacuggaaacaacu

SEQ ID NO: 51905 - RNA, 24 nt, Human
ccaaagcucaauuuugcaugguuu

SEQ ID NO: 51906 - RNA, 19 nt, Human
ccaaaguuaaucuccacag

SEQ ID NO: 51907 - RNA, 20 nt, Human
ccagccaguccccgccccgc

SEQ ID NO: 51908 - RNA, 23 nt, Human
ccaucugaaaagacuggaaacaa

SEQ ID NO: 51909 - RNA, 18 nt, Human
cccaccaaagcucaauuu

SEQ ID NO: 51910 - RNA, 20 nt, Human
cccccgccccgccgggccgc

SEQ ID NO: 51911 - RNA, 20 nt, Human
cccccucccagccccaccaa

SEQ ID NO: 51912 - RNA, 22 nt, Human
ccccgccgggccgccacccucc

SEQ ID NO: 51913 - RNA, 19 nt, Human
ccccgcgcaggccggccuc

SEQ ID NO: 51914 - RNA, 22 nt, Human
cccgccgggccgccacccucca

SEQ ID NO: 51915 - RNA, 21 nt, Human
cccuccagccaguccccgccc

SEQ ID NO: 51916 - RNA, 22 nt, Human
cccucccagccccaccaaagcu

SEQ ID NO: 51917 - RNA, 21 nt, Human
ccggccccgcccccgccccgc

SEQ ID NO: 51918 - RNA, 18 nt, Human
ccuccagccaguccccgc

SEQ ID NO: 51919 - RNA, 22 nt, Human
cgaacugaacugcucugcggcc

SEQ ID NO: 51920 - RNA, 23 nt, Human
cgauguugaaaaccaauccacuu

SEQ ID NO: 51921 - RNA, 26 nt, Human
cgcucaaggggguaccaugacugccc

SEQ ID NO: 51922 - RNA, 22 nt, Human
cuccagccaguccccgccccgc

SEQ ID NO: 51923 - RNA, 19 nt, Human
cucccagccccaccaaagc

SEQ ID NO: 51924 - RNA, 24 nt, Human
cugccccgcgcaggccggccucgg

SEQ ID NO: 51925 - RNA, 25 nt, Human
cugguggcggcaacggccgccaccc

SEQ ID NO: 51926 - RNA, 19 nt, Human
cuguagggcuucaaacuua

SEQ ID NO: 51927 - RNA, 22 nt, Human
gaaggagccagaggccggcccc

SEQ ID NO: 51928 - RNA, 22 nt, Human
gaaugaucagaauguaaaaaua

SEQ ID NO: 51929 - RNA, 27 nt, Human
gacaauaaugaagaaaaaccgguaccc

SEQ ID NO: 51930 - RNA, 19 nt, Human
gagcccgaaggagaggcgg

SEQ ID NO: 51931 - RNA, 21 nt, Human
gccggccucggcagcaccgcc

SEQ ID NO: 51932 - RNA, 23 nt, Human
ggaaacaucuauucucuuugaac

SEQ ID NO: 51933 - RNA, 22 nt, Human
ggcggccggcgaggagugagcg

SEQ ID NO: 51934 - RNA, 21 nt, Human
guaaaacuuaagaacacgcaa

SEQ ID NO: 51935 - RNA, 18 nt, Human
gucuuuuccccucccucu

SEQ ID NO: 51936 - RNA, 20 nt, Human
gucuuuuccccucccucuca

SEQ ID NO: 51937 - RNA, 22 nt, Human
uaaacagaauucauagcauuac

SEQ ID NO: 51938 - RNA, 27 nt, Human
uaaagaaaaauauccaccauauauuac

SEQ ID NO: 51939 - RNA, 26 nt, Human
uaaaggucccaugaauacauaacccc

SEQ ID NO: 51940 - RNA, 21 nt, Human
uaacccccucccagccccacc

SEQ ID NO: 51941 - RNA, 22 nt, Human
uaagaaagucuuuuccccuccc

SEQ ID NO: 51942 - RNA, 22 nt, Human
uacauaacccccucccagcccc

SEQ ID NO: 51943 - RNA, 24 nt, Human
uagacagcccaaaauuuaaacaga

SEQ ID NO: 51944 - RNA, 24 nt, Human
uauuacuaaacauugaaaaaaaaa

SEQ ID NO: 51945 - RNA, 27 nt, Human
uauuugguucuuuuaaucagcuauuca

SEQ ID NO: 51946 - RNA, 24 nt, Human
uccaccauauauuacaacagaucu

SEQ ID NO: 51947 - RNA, 18 nt, Human
ucccagccccaccaaagc

SEQ ID NO: 51948 - RNA, 23 nt, Human
uccccgccccgcucuccgccaca

SEQ ID NO: 51949 - RNA, 21 nt, Human
ucuccgccacagcccgcucaa

SEQ ID NO: 51950 - RNA, 24 nt, Human
ucuccgccacagcccgcucaaggg

SEQ ID NO: 51951 - RNA, 23 nt, Human
ugacacuuacagaugauucugua

SEQ ID NO: 51952 - RNA, 22 nt, Human
ugacagaaauaaguucuguguu

SEQ ID NO: 51953 - RNA, 18 nt, Human
ugagagcagcaggagcaa

SEQ ID NO: 51954 - RNA, 18 nt, Human
ugauucuguaggcauauc

SEQ ID NO: 51955 - RNA, 22 nt, Human
ugccuaauugucaaaauaacac

SEQ ID NO: 51956 - RNA, 20 nt, Human
uggcaccaugagagcagcag

SEQ ID NO: 51957 - RNA, 21 nt, Human
uuaaacagaauucauagcauu

SEQ ID NO: 51958 - RNA, 20 nt, Human
uucauuuugacacuuacaga

SEQ ID NO: 51959 - RNA, 24 nt, Human
uucuguacaaauuaaaggucccau

SEQ ID NO: 51960 - RNA, 20 nt, Human
uugaaaaaaaaaacguggca

SEQ ID NO: 51961 - RNA, 26 nt, Human
uugaaaaaaaaaacguggcaccauga

SEQ ID NO: 51962 - RNA, 30 nt, Human
uuucaagaaaggagaaauaaaggcauaauu

SEQ ID NO: 51963 - RNA, 22 nt, Human
aaaagugaagaauuauuacugg

SEQ ID NO: 51964 - RNA, 23 nt, Human
acaugaauccaacagacaucucc

SEQ ID NO: 51965 - RNA, 20 nt, Human
acuaagaaaguuuaaaacag

SEQ ID NO: 51966 - RNA, 21 nt, Human
acuaagaaaguuuaaaacagu

SEQ ID NO: 51967 - RNA, 19 nt, Human
agacaugaauccaacagac

SEQ ID NO: 51968 - RNA, 18 nt, Human
cagacaucuccuccucau

SEQ ID NO: 51969 - RNA, 23 nt, Human
caugaauccaacagacaucuccu

SEQ ID NO: 51970 - RNA, 21 nt, Human
cuguugagggacccaguuaua

SEQ ID NO: 51971 - RNA, 18 nt, Human
ggaagauaaucagagugg

SEQ ID NO: 51972 - RNA, 19 nt, Human
uaagaaccaagccuuucuc

SEQ ID NO: 51973 - RNA, 19 nt, Human
uagcaaaagacaugaaucc

SEQ ID NO: 51974 - RNA, 25 nt, Human
uagcagaagcuacugaacuauagca

SEQ ID NO: 51975 - RNA, 24 nt, Human
uaucaggaugggaguuaaggucuc

SEQ ID NO: 51976 - RNA, 26 nt, Human
uauggggaaggcgggggucggaaacc

SEQ ID NO: 51977 - RNA, 18 nt, Human
ucagugaaauuuagcaga

SEQ ID NO: 51978 - RNA, 27 nt, Human
ugaaccacauaagaccuauuuuagccc

SEQ ID NO: 51979 - RNA, 19 nt, Human
ugaacuauagcaaaagaca

SEQ ID NO: 51980 - RNA, 23 nt, Human
uggggaaggcgggggugggaguu

SEQ ID NO: 51981 - RNA, 23 nt, Human
uguugagggacccaguuauacca

SEQ ID NO: 51982 - RNA, 25 nt, Human
uuaaaaucagugaaauuuagcagaa

SEQ ID NO: 51983 - RNA, 20 nt, Human
uuacuggauguuaguugugc

SEQ ID NO: 51984 - RNA, 26 nt, Human
uugaaaauauggggaaggcgggggug

SEQ ID NO: 51985 - RNA, 24 nt, Human
uugagggacccaguuauaccauaa

SEQ ID NO: 51986 - RNA, 23 nt, Human
uuuaaaagugaagaauuauuacu

SEQ ID NO: 51987 - RNA, 24 nt, Human
acauuccuuucucuccgugccucu

SEQ ID NO: 51988 - RNA, 22 nt, Human
acccggggucgggggagacucg

SEQ ID NO: 51989 - RNA, 21 nt, Human
acccucacccugcuccuccca

SEQ ID NO: 51990 - RNA, 22 nt, Human
acccugcuccucccagcucagc

SEQ ID NO: 51991 - RNA, 19 nt, Human
aggaggagggaagccggga

SEQ ID NO: 51992 - RNA, 21 nt, Human
aggcugcaggggaggaggagg

SEQ ID NO: 51993 - RNA, 22 nt, Human
aggcugcaggggaggaggaggg

SEQ ID NO: 51994 - RNA, 20 nt, Human
agguggugaguggggcaggu

SEQ ID NO: 51995 - RNA, 19 nt, Human
auuugggaaggggaggggg

SEQ ID NO: 51996 - RNA, 21 nt, Human
caagcugggcuggggcccccg

SEQ ID NO: 51997 - RNA, 19 nt, Human
cacccugcuccucccagcu

SEQ ID NO: 51998 - RNA, 23 nt, Human
cagcucagcuaagcucgucccuc

SEQ ID NO: 51999 - RNA, 24 nt, Human
cccacccucacccugcuccuccca

SEQ ID NO: 52000 - RNA, 18 nt, Human
ccccccucccaaccuccc

SEQ ID NO: 52001 - RNA, 27 nt, Human
ccccccucccaaccucccugucccggc

SEQ ID NO: 52002 - RNA, 25 nt, Human
ccccucuguccccccucccaaccuc

SEQ ID NO: 52003 - RNA, 23 nt, Human
cccuugggaccuggucucccauc

SEQ ID NO: 52004 - RNA, 22 nt, Human
ccuccaggccuuagcuugccuc

SEQ ID NO: 52005 - RNA, 22 nt, Human
ccugcuccucccagcucagcua

SEQ ID NO: 52006 - RNA, 18 nt, Human
ccugggacccggggucgg

SEQ ID NO: 52007 - RNA, 22 nt, Human
cucuguccccccucccaaccuc

SEQ ID NO: 52008 - RNA, 20 nt, Human
cugacccuccaggccuuagc

SEQ ID NO: 52009 - RNA, 21 nt, Human
cuugcucccuugggaccuggu

SEQ ID NO: 52010 - RNA, 20 nt, Human
gaagccgggaaugggguagg

SEQ ID NO: 52011 - RNA, 18 nt, Human
gcccaggcagacugucgg

SEQ ID NO: 52012 - RNA, 20 nt, Human
gccccggcugugcgccccgg

SEQ ID NO: 52013 - RNA, 21 nt, Human
gcgaugggagaggaccaggug

SEQ ID NO: 52014 - RNA, 18 nt, Human
gcggggggcgcgggcugc

SEQ ID NO: 52015 - RNA, 20 nt, Human
gcugcaggggaggaggaggg

SEQ ID NO: 52016 - RNA, 21 nt, Human
gcugcgccccggcugugcgcc

SEQ ID NO: 52017 - RNA, 20 nt, Human
ggcagguggaggugggagca

SEQ ID NO: 52018 - RNA, 20 nt, Human
ggccggggcugcugcgcuuc

SEQ ID NO: 52019 - RNA, 18 nt, Human
gggaaugggguaggaaga

SEQ ID NO: 52020 - RNA, 22 nt, Human
gggagcauaccugggacccggg

SEQ ID NO: 52021 - RNA, 21 nt, Human
gggaggaggagggaagccggg

SEQ ID NO: 52022 - RNA, 18 nt, Human
gucccucgugcccccccu

SEQ ID NO: 52023 - RNA, 21 nt, Human
guggggcagguggagguggga

SEQ ID NO: 52024 - RNA, 19 nt, Human
uaccagggugagagggcug

SEQ ID NO: 52025 - RNA, 22 nt, Human
ucacccugcuccucccagcuca

SEQ ID NO: 52026 - RNA, 22 nt, Human
ucagggcagguauccaccuaac

SEQ ID NO: 52027 - RNA, 18 nt, Human
uccaggccuuagcuugcc

SEQ ID NO: 52028 - RNA, 18 nt, Human
ucccaaccucccuguccc

SEQ ID NO: 52029 - RNA, 25 nt, Human
ucccucgugcccccccuuuuguggg

SEQ ID NO: 52030 - RNA, 18 nt, Human
ucugucuccccucugucc

SEQ ID NO: 52031 - RNA, 19 nt, Human
ugaguggggcagguggagg

SEQ ID NO: 52032 - RNA, 19 nt, Human
ugcaggggaggaggaggga

SEQ ID NO: 52033 - RNA, 23 nt, Human
ugcgugcaugcaguaccagggug

SEQ ID NO: 52034 - RNA, 19 nt, Human
ugcugggggcgccgggcgg

SEQ ID NO: 52035 - RNA, 20 nt, Human
ugcugggggcgccgggcggc

SEQ ID NO: 52036 - RNA, 23 nt, Human
ugggaaggggagggggaauccug

SEQ ID NO: 52037 - RNA, 25 nt, Human
ugggaaggggagggggaauccuggg

SEQ ID NO: 52038 - RNA, 24 nt, Human
ugucagggcagguauccaccuaac

SEQ ID NO: 52039 - RNA, 25 nt, Human
ugucuccccucuguccccccuccca

SEQ ID NO: 52040 - RNA, 22 nt, Human
uguggcccaggcagacugucgg

SEQ ID NO: 52041 - RNA, 24 nt, Human
aaaaaaaagaauauaagagcagga

SEQ ID NO: 52042 - RNA, 24 nt, Human
aaaaugauucaauuauuuucccua

SEQ ID NO: 52043 - RNA, 20 nt, Human
aaauaaauacauagaacuca

SEQ ID NO: 52044 - RNA, 23 nt, Human
aaaugauucaauuauuuucccua

SEQ ID NO: 52045 - RNA, 25 nt, Human
aagcaucucccuaggcucauugguc

SEQ ID NO: 52046 - RNA, 19 nt, Human
acaguagggagagaacaag

SEQ ID NO: 52047 - RNA, 19 nt, Human
agauucaucagcaccacca

SEQ ID NO: 52048 - RNA, 20 nt, Human
agcuguuggggcuuugacgg

SEQ ID NO: 52049 - RNA, 22 nt, Human
aggaaaaaaaagaauauaagag

SEQ ID NO: 52050 - RNA, 25 nt, Human
aggaaaaaaaagaauauaagagcag

SEQ ID NO: 52051 - RNA, 19 nt, Human
aggaguggaaaggaagggg

SEQ ID NO: 52052 - RNA, 20 nt, Human
agggcuuuugagagaaaugg

SEQ ID NO: 52053 - RNA, 19 nt, Human
agguguccccagucaggcc

SEQ ID NO: 52054 - RNA, 22 nt, Human
auaagagcaggaucaaaaaaaa

SEQ ID NO: 52055 - RNA, 24 nt, Human
auaguaggaaugcauguuaagauu

SEQ ID NO: 52056 - RNA, 20 nt, Human
aucaaaaaaaagcaagagac

SEQ ID NO: 52057 - RNA, 28 nt, Human
auuauuuucccuauuuucaaccuucagg

SEQ ID NO: 52058 - RNA, 21 nt, Human
caaaaaaaagcaagagacuua

SEQ ID NO: 52059 - RNA, 22 nt, Human
caacccacaguuaggagcaaag

SEQ ID NO: 52060 - RNA, 18 nt, Human
caaugcagccccuccuaa

SEQ ID NO: 52061 - RNA, 21 nt, Human
cacaguagggagagaacaaga

SEQ ID NO: 52062 - RNA, 18 nt, Human
cacaguuaggagcaaagu

SEQ ID NO: 52063 - RNA, 19 nt, Human
cacuccuuuucccucuuca

SEQ ID NO: 52064 - RNA, 19 nt, Human
ccagaacacuugagggaag

SEQ ID NO: 52065 - RNA, 20 nt, Human
ccccugcaaugcagccccuc

SEQ ID NO: 52066 - RNA, 20 nt, Human
cccugugacccaguacucca

SEQ ID NO: 52067 - RNA, 23 nt, Human
ccugauuucucugaggaaaaaaa

SEQ ID NO: 52068 - RNA, 22 nt, Human
cggcuaauucaaaugauagguu

SEQ ID NO: 52069 - RNA, 21 nt, Human
cuaggcucauuggucugcgcu

SEQ ID NO: 52070 - RNA, 21 nt, Human
cucucccccugcaaugcagcc

SEQ ID NO: 52071 - RNA, 24 nt, Human
cugauuucucugaggaaaaaaaag

SEQ ID NO: 52072 - RNA, 20 nt, Human
gaaaaaaaagaauauaagag

SEQ ID NO: 52073 - RNA, 19 nt, Human
gaaagcaucucccuaggcu

SEQ ID NO: 52074 - RNA, 20 nt, Human
gacaagaugucgagucagaa

SEQ ID NO: 52075 - RNA, 29 nt, Human
gacaaugagggcaaggugaugggagagaa

SEQ ID NO: 52076 - RNA, 18 nt, Human
gaucucuuccagcacccc

SEQ ID NO: 52077 - RNA, 21 nt, Human
gcgccgggcuggagaaauaca

SEQ ID NO: 52078 - RNA, 23 nt, Human
gcuauuauucccgaucucuucca

SEQ ID NO: 52079 - RNA, 20 nt, Human
gcuugaaccauuuacuuugu

SEQ ID NO: 52080 - RNA, 23 nt, Human
ggaaaaaaaagaauauaagagca

SEQ ID NO: 52081 - RNA, 18 nt, Human
ggaaaggaguggaaagga

SEQ ID NO: 52082 - RNA, 21 nt, Human
ggacaagaugucgagucagaa

SEQ ID NO: 52083 - RNA, 22 nt, Human
ggauuccccgcccccuccugcc

SEQ ID NO: 52084 - RNA, 23 nt, Human
ggcaaggugaugggagagagaag

SEQ ID NO: 52085 - RNA, 21 nt, Human
ggggacaagaugucgagucag

SEQ ID NO: 52086 - RNA, 22 nt, Human
gucaaaaaucagucuuccauuu

SEQ ID NO: 52087 - RNA, 22 nt, Human
gucugcgcuauuauucccgauc

SEQ ID NO: 52088 - RNA, 20 nt, Human
gugaagaagggacacucuuu

SEQ ID NO: 52089 - RNA, 24 nt, Human
uaccucuaacuacccuccugauuu

SEQ ID NO: 52090 - RNA, 22 nt, Human
uagacagauagauaaauaaaua

SEQ ID NO: 52091 - RNA, 23 nt, Human
uagcuagaguuuucaacccacag

SEQ ID NO: 52092 - RNA, 24 nt, Human
ucacuccuuuucccucuucaguga

SEQ ID NO: 52093 - RNA, 20 nt, Human
ucccccugcaaugcagcccc

SEQ ID NO: 52094 - RNA, 24 nt, Human
uccccgcccccuccugccugacuc

SEQ ID NO: 52095 - RNA, 20 nt, Human
ucccugugacccaguacucc

SEQ ID NO: 52096 - RNA, 18 nt, Human
ucugaggaaaaaaaagaa

SEQ ID NO: 52097 - RNA, 20 nt, Human
ucugcgcuauuauucccgau

SEQ ID NO: 52098 - RNA, 22 nt, Human
ucuggaguuaauauuugggggg

SEQ ID NO: 52099 - RNA, 19 nt, Human
ucuggcagauucaucagca

SEQ ID NO: 52100 - RNA, 21 nt, Human
ugacucggcuaauucaaauga

SEQ ID NO: 52101 - RNA, 22 nt, Human
ugagagaaauggaguagacaga

SEQ ID NO: 52102 - RNA, 23 nt, Human
ugaggaaaaaaaagaauauaaga

SEQ ID NO: 52103 - RNA, 19 nt, Human
ugagggcuuuugagagaaa

SEQ ID NO: 52104 - RNA, 22 nt, Human
ugaguaggugugaagaagggac

SEQ ID NO: 52105 - RNA, 25 nt, Human
uggaaaggaaggggcuugagaggga

SEQ ID NO: 52106 - RNA, 18 nt, Human
uggagggagugccucggg

SEQ ID NO: 52107 - RNA, 23 nt, Human
uggaguagacagauagauaaaua

SEQ ID NO: 52108 - RNA, 26 nt, Human
uggcagauucaucagcaccaccaaca

SEQ ID NO: 52109 - RNA, 19 nt, Human
ugggagagagaagucuugg

SEQ ID NO: 52110 - RNA, 18 nt, Human
uuccccgcccccuccugc

SEQ ID NO: 52111 - RNA, 21 nt, Human
uuccccgcccccuccugccug

SEQ ID NO: 52112 - RNA, 20 nt, Human
uugucuucucacuccuuuuc

SEQ ID NO: 52113 - RNA, 18 nt, Human
uuuacugcccuggagcag

SEQ ID NO: 52114 - RNA, 19 nt, Human
uuuguguuuacugcccugg

SEQ ID NO: 52115 - RNA, 23 nt, Human
uuuuauaccucuaacuacccucc

SEQ ID NO: 52116 - RNA, 18 nt, Human
uuuuuuuuuuuuuuucug

SEQ ID NO: 52117 - RNA, 24 nt, Human
uuuuuuuuuuuuuuuuuuucuggg

SEQ ID NO: 52118 - RNA, 24 nt, Human
aagaggggggcaugcugaagagga

SEQ ID NO: 52119 - RNA, 21 nt, Human
aagccuaccaggguauagagg

SEQ ID NO: 52120 - RNA, 21 nt, Human
acucugaguguacacaugggg

SEQ ID NO: 52121 - RNA, 23 nt, Human
agccuggagcggcagcaggacuc

SEQ ID NO: 52122 - RNA, 19 nt, Human
aggagggguggggaugggg

SEQ ID NO: 52123 - RNA, 22 nt, Human
aggcccaggauacagaccagga

SEQ ID NO: 52124 - RNA, 18 nt, Human
aggcccggagcgccgagc

SEQ ID NO: 52125 - RNA, 20 nt, Human
aguguacacauggguguggg

SEQ ID NO: 52126 - RNA, 23 nt, Human
caaagcagcagcuuggccaaggc

SEQ ID NO: 52127 - RNA, 19 nt, Human
caagccccugaguccccug

SEQ ID NO: 52128 - RNA, 19 nt, Human
cacugcaaagcuaaggcaa

SEQ ID NO: 52129 - RNA, 20 nt, Human
cagaacagcucccagaccau

SEQ ID NO: 52130 - RNA, 21 nt, Human
cagcucccagaccaugguccc

SEQ ID NO: 52131 - RNA, 21 nt, Human
cagcuuggccaaggccucugg

SEQ ID NO: 52132 - RNA, 22 nt, Human
cauggguguggggugaagaggg

SEQ ID NO: 52133 - RNA, 20 nt, Human
ccaaaggagagcuacagcac

SEQ ID NO: 52134 - RNA, 26 nt, Human
ccaauccuacacuuggccccucucuu

SEQ ID NO: 52135 - RNA, 21 nt, Human
ccagaacagcucccagaccau

SEQ ID NO: 52136 - RNA, 22 nt, Human
ccaggagggguggggauggggg

SEQ ID NO: 52137 - RNA, 27 nt, Human
cccccugccccagaacagcucccagac

SEQ ID NO: 52138 - RNA, 18 nt, Human
ccgcgccgcgguuguccc

SEQ ID NO: 52139 - RNA, 19 nt, Human
ccuggagcggcagcaggac

SEQ ID NO: 52140 - RNA, 18 nt, Human
cuaaggcaaagaauagag

SEQ ID NO: 52141 - RNA, 21 nt, Human
cugaguguacacaugggugug

SEQ ID NO: 52142 - RNA, 22 nt, Human
cuuggccccucucuuaaguucu

SEQ ID NO: 52143 - RNA, 18 nt, Human
gaccaugguccccaaucc

SEQ ID NO: 52144 - RNA, 24 nt, Human
gagcggcagcaggacucugaguga

SEQ ID NO: 52145 - RNA, 18 nt, Human
gagcugcagggaagggag

SEQ ID NO: 52146 - RNA, 19 nt, Human
gcaaaacauucuuagggcc

SEQ ID NO: 52147 - RNA, 18 nt, Human
gcagcaggacucugagug

SEQ ID NO: 52148 - RNA, 22 nt, Human
gccacaacgccaggcccggagc

SEQ ID NO: 52149 - RNA, 18 nt, Human
gccuaccaggguauagag

SEQ ID NO: 52150 - RNA, 26 nt, Human
gcucccagaccaugguccccaauccu

SEQ ID NO: 52151 - RNA, 20 nt, Human
ggagcggcagcaggacucug

SEQ ID NO: 52152 - RNA, 19 nt, Human
ggagggguggggauggggg

SEQ ID NO: 52153 - RNA, 19 nt, Human
ggccaagccccugaguccc

SEQ ID NO: 52154 - RNA, 21 nt, Human
guccccaauccuacacuuggc

SEQ ID NO: 52155 - RNA, 22 nt, Human
guccugcucagguuccuucugc

SEQ ID NO: 52156 - RNA, 25 nt, Human
gugaagggcagcgacccccaugugc

SEQ ID NO: 52157 - RNA, 21 nt, Human
guguggggugaagaggggggc

SEQ ID NO: 52158 - RNA, 18 nt, Human
uaaggcaaagaauagagc

SEQ ID NO: 52159 - RNA, 18 nt, Human
uacacauggguguggggu

SEQ ID NO: 52160 - RNA, 20 nt, Human
uacuucagguggggguccug

SEQ ID NO: 52161 - RNA, 25 nt, Human
ucaaagcagcagcuuggccaaggcc

SEQ ID NO: 52162 - RNA, 23 nt, Human
uccaugaggcuccaggauggaug

SEQ ID NO: 52163 - RNA, 19 nt, Human
ucccagaccauggucccca

SEQ ID NO: 52164 - RNA, 21 nt, Human
ucccagaccaugguccccaau

SEQ ID NO: 52165 - RNA, 22 nt, Human
uccccaauccuacacuuggccc

SEQ ID NO: 52166 - RNA, 24 nt, Human
ucccccugccccagaacagcuccc

SEQ ID NO: 52167 - RNA, 22 nt, Human
ucucuuaaguucuacuucaggu

SEQ ID NO: 52168 - RNA, 18 nt, Human
ucugccaccuuauccccu

SEQ ID NO: 52169 - RNA, 18 nt, Human
ucuuaaguucuacuucag

SEQ ID NO: 52170 - RNA, 22 nt, Human
ugaggcccaggauacagaccag

SEQ ID NO: 52171 - RNA, 20 nt, Human
ugccccagaacagcucccag

SEQ ID NO: 52172 - RNA, 21 nt, Human
ugccccagaacagcucccaga

SEQ ID NO: 52173 - RNA, 23 nt, Human
ugccccagaacagcucccagacc

SEQ ID NO: 52174 - RNA, 23 nt, Human
ugcggcgccacaacgccaggccc

SEQ ID NO: 52175 - RNA, 18 nt, Human
uggaggggaggacaugaa

SEQ ID NO: 52176 - RNA, 19 nt, Human
uggcaagggcugcggcgcc

SEQ ID NO: 52177 - RNA, 21 nt, Human
ugggagaugccuccccucaau

SEQ ID NO: 52178 - RNA, 23 nt, Human
uggguguggggugaagagggggg

SEQ ID NO: 52179 - RNA, 18 nt, Human
uggugggagaugccuccc

SEQ ID NO: 52180 - RNA, 23 nt, Human
ugucuccaagaucccgcuuucaa

SEQ ID NO: 52181 - RNA, 23 nt, Human
uugcauauucccccugccccaga

SEQ ID NO: 52182 - RNA, 21 nt, Human
uuuuuuuuuuuuuuuuccaga

SEQ ID NO: 52183 - RNA, 22 nt, Human
uuuuuuuuuuuuuuuuuuccag

SEQ ID NO: 52184 - RNA, 18 nt, Human
aacaacacaugaaccaac

SEQ ID NO: 52185 - RNA, 20 nt, Human
aacaacacaugaaccaacga

SEQ ID NO: 52186 - RNA, 22 nt, Human
aauuaaaauaaauaaaauuuca

SEQ ID NO: 52187 - RNA, 25 nt, Human
agaguaaauuuauaggcagaaauaa

SEQ ID NO: 52188 - RNA, 18 nt, Human
aggcaggcgggggcgggu

SEQ ID NO: 52189 - RNA, 18 nt, Human
aggcggcgucggcggcgg

SEQ ID NO: 52190 - RNA, 19 nt, Human
aggcggcgucggcggcggc

SEQ ID NO: 52191 - RNA, 21 nt, Human
aggcggcgucggcggcggcgg

SEQ ID NO: 52192 - RNA, 19 nt, Human
aggcguaggccccgcaccg

SEQ ID NO: 52193 - RNA, 18 nt, Human
aggugguauguuauggca

SEQ ID NO: 52194 - RNA, 21 nt, Human
auugcaacuggaauuucaauc

SEQ ID NO: 52195 - RNA, 19 nt, Human
caccaggauccccgccccg

SEQ ID NO: 52196 - RNA, 19 nt, Human
cauuaguuaugaauugcaa

SEQ ID NO: 52197 - RNA, 20 nt, Human
cccggcuccgcuaggcccga

SEQ ID NO: 52198 - RNA, 26 nt, Human
cccgggcugggacagcugacugaggc

SEQ ID NO: 52199 - RNA, 20 nt, Human
cggcaguggcggcgccgggc

SEQ ID NO: 52200 - RNA, 23 nt, Human
cgugaugugacacaguguugugg

SEQ ID NO: 52201 - RNA, 18 nt, Human
cuccuggcugcggcagug

SEQ ID NO: 52202 - RNA, 19 nt, Human
cuccuggcugcggcagugg

SEQ ID NO: 52203 - RNA, 19 nt, Human
cugcaccuucaccggacgc

SEQ ID NO: 52204 - RNA, 24 nt, Human
cugcaccuucaccggacgcgcauu

SEQ ID NO: 52205 - RNA, 19 nt, Human
cuggcaccaggauccccgc

SEQ ID NO: 52206 - RNA, 18 nt, Human
gcagcgaugcgccucaca

SEQ ID NO: 52207 - RNA, 20 nt, Human
ggaaauauuaaagggccaac

SEQ ID NO: 52208 - RNA, 25 nt, Human
ggcggcgucggcggcggcggcagcg

SEQ ID NO: 52209 - RNA, 27 nt, Human
gucggcggcggcggcagcgaugcgccu

SEQ ID NO: 52210 - RNA, 23 nt, Human
uaggcagaaauaacuaagucuua

SEQ ID NO: 52211 - RNA, 21 nt, Human
ucaaaaacaacaacacaugaa

SEQ ID NO: 52212 - RNA, 19 nt, Human
ucccggcuccgcuaggccc

SEQ ID NO: 52213 - RNA, 18 nt, Human
uccgcuaggcccgaacca

SEQ ID NO: 52214 - RNA, 22 nt, Human
ucuccuggcugcggcaguggcg

SEQ ID NO: 52215 - RNA, 21 nt, Human
ugaaccaacgaggagaaaacu

SEQ ID NO: 52216 - RNA, 25 nt, Human
ugacugaggcaggcgggggcggguu

SEQ ID NO: 52217 - RNA, 20 nt, Human
ugaggcaggcgggggcgggu

SEQ ID NO: 52218 - RNA, 24 nt, Human
ugccaagggcgaggggcuccggga

SEQ ID NO: 52219 - RNA, 18 nt, Human
uggcugcggcaguggcgg

SEQ ID NO: 52220 - RNA, 24 nt, Human
ugguauguuauggcaguuuuccuu

SEQ ID NO: 52221 - RNA, 20 nt, Human
uucaaucuuaucauagcuca

SEQ ID NO: 52222 - RNA, 23 nt, Human
uuuggauuaucaaaaacaacaac

SEQ ID NO: 52223 - RNA, 19 nt, Human
caccagucucuuugggugg

SEQ ID NO: 52224 - RNA, 19 nt, Human
cacuggaacaggaggccag

SEQ ID NO: 52225 - RNA, 22 nt, Human
ccccuggaagcacuggaacagg

SEQ ID NO: 52226 - RNA, 22 nt, Human
gucagcuucugaacguggaucc

SEQ ID NO: 52227 - RNA, 19 nt, Human
uugccugcagagucagcuu

SEQ ID NO: 52228 - RNA, 24 nt, Human
acaucaauuucauccuuuaagacc

SEQ ID NO: 52229 - RNA, 18 nt, Human
aggaccagugagaauggc

SEQ ID NO: 52230 - RNA, 21 nt, Human
caagaaggcgaugaugagcac

SEQ ID NO: 52231 - RNA, 22 nt, Human
caagaaggcgaugaugagcacc

SEQ ID NO: 52232 - RNA, 20 nt, Human
caauguagacaacaggcacc

SEQ ID NO: 52233 - RNA, 18 nt, Human
cagcagaaaagagccauc

SEQ ID NO: 52234 - RNA, 19 nt, Human
cagcagaaaagagccauca

SEQ ID NO: 52235 - RNA, 19 nt, Human
cagcaggcccucuucugau

SEQ ID NO: 52236 - RNA, 22 nt, Human
cagugccuggaggaccagugag

SEQ ID NO: 52237 - RNA, 20 nt, Human
cauccuuuaagaccuuggca

SEQ ID NO: 52238 - RNA, 22 nt, Human
ccaaugccagcaggcccucuuc

SEQ ID NO: 52239 - RNA, 25 nt, Human
cccacaccaacgaacaucuccaaaa

SEQ ID NO: 52240 - RNA, 26 nt, Human
cccacaccaacgaacaucuccaaaaa

SEQ ID NO: 52241 - RNA, 21 nt, Human
cccuuugggauuuuugcuccu

SEQ ID NO: 52242 - RNA, 23 nt, Human
cgaacaucuccaaaaacucagau

SEQ ID NO: 52243 - RNA, 18 nt, Human
cuccuaggucuugauacu

SEQ ID NO: 52244 - RNA, 23 nt, Human
gaggaccagugagaauggcaccc

SEQ ID NO: 52245 - RNA, 19 nt, Human
gcccacaccaacgaacauc

SEQ ID NO: 52246 - RNA, 22 nt, Human
uagcagcgucuucccagugccu

SEQ ID NO: 52247 - RNA, 21 nt, Human
uagcuagcagcgucuucccag

SEQ ID NO: 52248 - RNA, 23 nt, Human
ucagcagaaaagagccaucacuu

SEQ ID NO: 52249 - RNA, 22 nt, Human
uccacuaacggugaugaagggg

SEQ ID NO: 52250 - RNA, 19 nt, Human
uccaugaucucuagcuugg

SEQ ID NO: 52251 - RNA, 25 nt, Human
uccaugaucucuagcuuggccuccu

SEQ ID NO: 52252 - RNA, 21 nt, Human
ucuccaaaaacucagauccac

SEQ ID NO: 52253 - RNA, 19 nt, Human
ugccagcaggcccucuucu

SEQ ID NO: 52254 - RNA, 28 nt, Human
uguagagcaagaaggcgaugaugagcac

SEQ ID NO: 52255 - RNA, 20 nt, Human
uuagcuagcagcgucuuccc

SEQ ID NO: 52256 - RNA, 18 nt, Human
uucaagaaauucacaaaa

SEQ ID NO: 52257 - RNA, 22 nt, Human
uugauaagcagcaauuauaucu

SEQ ID NO: 52258 - RNA, 22 nt, Human
uuucaagaaauucacaaauucc

SEQ ID NO: 52259 - RNA, 21 nt, Human
aacaacaauaguuauacuaag

SEQ ID NO: 52260 - RNA, 21 nt, Human
auacaacaacaauaguuauac

SEQ ID NO: 52261 - RNA, 19 nt, Human
caaaauguuguguuuauug

SEQ ID NO: 52262 - RNA, 23 nt, Human
caggaaaugcgauucaucaccac

SEQ ID NO: 52263 - RNA, 24 nt, Human
caggugacaguuacagaaaaaucc

SEQ ID NO: 52264 - RNA, 22 nt, Human
ccacauuuacaaaagaaagaaa

SEQ ID NO: 52265 - RNA, 25 nt, Human
ccccuggaucaauuugcuuuagucc

SEQ ID NO: 52266 - RNA, 20 nt, Human
cuaauaaauaucaauacaac

SEQ ID NO: 52267 - RNA, 22 nt, Human
cuacaguguuucccccuggauc

SEQ ID NO: 52268 - RNA, 23 nt, Human
gacucuuuuugugagcaccaaua

SEQ ID NO: 52269 - RNA, 23 nt, Human
uacuaauaaauaucaauacaaca

SEQ ID NO: 52270 - RNA, 24 nt, Human
uaggaagccuucccuuuggugcuu

SEQ ID NO: 52271 - RNA, 23 nt, Human
ucuuuacauaucuccagcagcug

SEQ ID NO: 52272 - RNA, 21 nt, Human
ugacaguuacagaaaaauccu

SEQ ID NO: 52273 - RNA, 19 nt, Human
uucaaaaauaaagaguagc

SEQ ID NO: 52274 - RNA, 27 nt, Human
acucguuuugucuucucuuccccugaa

SEQ ID NO: 52275 - RNA, 19 nt, Human
aucucacauaaaagucuuu

SEQ ID NO: 52276 - RNA, 18 nt, Human
cuucucuuccccugaagu

SEQ ID NO: 52277 - RNA, 24 nt, Human
cuuuaucauuucauuaauucacaa

SEQ ID NO: 52278 - RNA, 20 nt, Human
uggcagugguggaagcacaa

SEQ ID NO: 52279 - RNA, 24 nt, Human
uuaaaauuaaagagaaaaguucac

SEQ ID NO: 52280 - RNA, 23 nt, Human
aaacaaaccaagcuaaacaaccc

SEQ ID NO: 52281 - RNA, 20 nt, Human
aaaccaagcuaaacaaccca

SEQ ID NO: 52282 - RNA, 25 nt, Human
aaagugccaauucaacauaaauuua

SEQ ID NO: 52283 - RNA, 20 nt, Human
aaaucugccuuuugaaacca

SEQ ID NO: 52284 - RNA, 18 nt, Human
aacaaaccaagcuaaaca

SEQ ID NO: 52285 - RNA, 19 nt, Human
aacccauuucuugacuucu

SEQ ID NO: 52286 - RNA, 20 nt, Human
aagaggaaaaaagcaaagaa

SEQ ID NO: 52287 - RNA, 22 nt, Human
aagaggaaaaaagcaaagaaaa

SEQ ID NO: 52288 - RNA, 24 nt, Human
acaacccauuucuugacuucuaau

SEQ ID NO: 52289 - RNA, 18 nt, Human
acauauucaucuucagau

SEQ ID NO: 52290 - RNA, 21 nt, Human
agaggaaaaaagcaaagaaaa

SEQ ID NO: 52291 - RNA, 20 nt, Human
agcgaucgccgaacaauugu

SEQ ID NO: 52292 - RNA, 21 nt, Human
aucacugugacauaaugaaau

SEQ ID NO: 52293 - RNA, 18 nt, Human
aucauuuuuaaaagaaac

SEQ ID NO: 52294 - RNA, 23 nt, Human
caauaaucagugcuaagacaugc

SEQ ID NO: 52295 - RNA, 18 nt, Human
cagaauguugggagaaga

SEQ ID NO: 52296 - RNA, 18 nt, Human
cagcgcgagaaaaguccc

SEQ ID NO: 52297 - RNA, 19 nt, Human
caugcugagacucugcaug

SEQ ID NO: 52298 - RNA, 19 nt, Human
cauguucuaucaucuuccu

SEQ ID NO: 52299 - RNA, 22 nt, Human
cgagaaaagucccggcagccag

SEQ ID NO: 52300 - RNA, 18 nt, Human
cugaccaccgaagagacc

SEQ ID NO: 52301 - RNA, 24 nt, Human
cugaccaccgaagagaccagcgcu

SEQ ID NO: 52302 - RNA, 23 nt, Human
cuuccuuccucaaguuuuuaggg

SEQ ID NO: 52303 - RNA, 23 nt, Human
cuuucacacacugagagcuccau

SEQ ID NO: 52304 - RNA, 23 nt, Human
gaaauaacagaauguugggagaa

SEQ ID NO: 52305 - RNA, 23 nt, Human
gagaccagcgcgagaaaaguccc

SEQ ID NO: 52306 - RNA, 24 nt, Human
gaggaaaaaagcaaagaaaaucaa

SEQ ID NO: 52307 - RNA, 19 nt, Human
gaggaacacuagaugauga

SEQ ID NO: 52308 - RNA, 22 nt, Human
ggaaaaaagcaaagaaaaucaa

SEQ ID NO: 52309 - RNA, 18 nt, Human
uaaaaauagauaauacaa

SEQ ID NO: 52310 - RNA, 21 nt, Human
uaaaaccaauaaucagugcua

SEQ ID NO: 52311 - RNA, 21 nt, Human
uaaaucucaaaguagcaauuu

SEQ ID NO: 52312 - RNA, 22 nt, Human
uaagaggaaaaaagcaaagaaa

SEQ ID NO: 52313 - RNA, 22 nt, Human
uaauauaucacuguggaaauaa

SEQ ID NO: 52314 - RNA, 20 nt, Human
uauacaaaauacagccacau

SEQ ID NO: 52315 - RNA, 18 nt, Human
uaugaugauuccuuuugg

SEQ ID NO: 52316 - RNA, 24 nt, Human
uauuuuacaaaaagacuuuagaac

SEQ ID NO: 52317 - RNA, 21 nt, Human
uauuuucauuaaauuguuuca

SEQ ID NO: 52318 - RNA, 18 nt, Human
ucaaguuccccaaaucau

SEQ ID NO: 52319 - RNA, 23 nt, Human
ucgccgaacaauuguuuuuauua

SEQ ID NO: 52320 - RNA, 18 nt, Human
ugaaggaaaaaugcugcu

SEQ ID NO: 52321 - RNA, 18 nt, Human
ugggagaagauaaaucug

SEQ ID NO: 52322 - RNA, 19 nt, Human
ugggagaagauaaaucugc

SEQ ID NO: 52323 - RNA, 20 nt, Human
uguacaaaacaaagaguauc

SEQ ID NO: 52324 - RNA, 23 nt, Human
uguucuaucaucuuccuuccuca

SEQ ID NO: 52325 - RNA, 23 nt, Human
uucaaaaguaucagaaauaacag

SEQ ID NO: 52326 - RNA, 22 nt, Human
uucuguagaguugucauacaga

SEQ ID NO: 52327 - RNA, 24 nt, Human
uuuagaacuuucacacacugagag

SEQ ID NO: 52328 - RNA, 26 nt, Human
augacaaaaagcgacaagagggaccc

SEQ ID NO: 52329 - RNA, 18 nt, Human
cagccuggcaggcuccug

SEQ ID NO: 52330 - RNA, 22 nt, Human
cagccuggcaggcuccugggcu

SEQ ID NO: 52331 - RNA, 20 nt, Human
cagcguccugggugcguccu

SEQ ID NO: 52332 - RNA, 23 nt, Human
caggcuccugggcucagcguccu

SEQ ID NO: 52333 - RNA, 20 nt, Human
cagucccacacaccuggccg

SEQ ID NO: 52334 - RNA, 18 nt, Human
cgacaagaagaggacacc

SEQ ID NO: 52335 - RNA, 23 nt, Human
cguccugggugcguccuggaagc

SEQ ID NO: 52336 - RNA, 23 nt, Human
gacaagaagaggacaccgucugg

SEQ ID NO: 52337 - RNA, 21 nt, Human
ggcuccugggcucagcguccu

SEQ ID NO: 52338 - RNA, 18 nt, Human
guccugggugcguccugg

SEQ ID NO: 52339 - RNA, 20 nt, Human
uaaugggauuccuuauauga

SEQ ID NO: 52340 - RNA, 22 nt, Human
uaugacaaaaagcgacaagaag

SEQ ID NO: 52341 - RNA, 24 nt, Human
uaugacaaaaagcgacaagaagag

SEQ ID NO: 52342 - RNA, 24 nt, Human
ugacaaaaagcgacaagaagagga

SEQ ID NO: 52343 - RNA, 21 nt, Human
uggcaggcuccugggcucagc

SEQ ID NO: 52344 - RNA, 21 nt, Human
ugggugcguccuggaagcucu

SEQ ID NO: 52345 - RNA, 21 nt, Human
aaagggagcugauggauggga

SEQ ID NO: 52346 - RNA, 23 nt, Human
agaaaagggagcugauggauggg

SEQ ID NO: 52347 - RNA, 21 nt, Human
agaguuggucugaggccagaa

SEQ ID NO: 52348 - RNA, 21 nt, Human
aggccagaacaguucaaggga

SEQ ID NO: 52349 - RNA, 20 nt, Human
agggagcugauggaugggau

SEQ ID NO: 52350 - RNA, 26 nt, Human
agggagcugauggaugggaucugucu

SEQ ID NO: 52351 - RNA, 24 nt, Human
aggugggguuauacaggagagaga

SEQ ID NO: 52352 - RNA, 19 nt, Human
caagggaaaaagaaaaggg

SEQ ID NO: 52353 - RNA, 20 nt, Human
gggagcugauggaugggauc

SEQ ID NO: 52354 - RNA, 20 nt, Human
ugguuguagaagaaagcuug

SEQ ID NO: 52355 - RNA, 19 nt, Human
ugucagguguuuaaucauc

SEQ ID NO: 52356 - RNA, 20 nt, Human
uucaagggaaaaagaaaagg

SEQ ID NO: 52357 - RNA, 27 nt, Human
uucaagggaaaaagaaaagggagcuuc

SEQ ID NO: 52358 - RNA, 19 nt, Human
uuuugagaugugucaggug

SEQ ID NO: 52359 - RNA, 18 nt, Human
uuuuuuuuuuuuuuuuug

SEQ ID NO: 52360 - RNA, 22 nt, Human
aaaaaauuaaaaaccuagacca

SEQ ID NO: 52361 - RNA, 21 nt, Human
aaacagaaggggaagggcugg

SEQ ID NO: 52362 - RNA, 25 nt, Human
aaacuacauaaaccuuugauaaacu

SEQ ID NO: 52363 - RNA, 23 nt, Human
aaacuuuaaaauauaccacgcag

SEQ ID NO: 52364 - RNA, 21 nt, Human
aaaugcuguauuacagauucu

SEQ ID NO: 52365 - RNA, 22 nt, Human
aacaaggaaggaacugaagaga

SEQ ID NO: 52366 - RNA, 20 nt, Human
aacauagugagacccaguuu

SEQ ID NO: 52367 - RNA, 21 nt, Human
aacaucauagagcugucugcu

SEQ ID NO: 52368 - RNA, 22 nt, Human
aaccugggcaacauagugagac

SEQ ID NO: 52369 - RNA, 22 nt, Human
aaccuguaaacuaacuaaaaaa

SEQ ID NO: 52370 - RNA, 18 nt, Human
aacuacauaaaccuuuga

SEQ ID NO: 52371 - RNA, 22 nt, Human
aagcaauacacuuaggaaagcc

SEQ ID NO: 52372 - RNA, 19 nt, Human
aaggaaggaacugaagaga

SEQ ID NO: 52373 - RNA, 19 nt, Human
aaguaugaagcauucuacc

SEQ ID NO: 52374 - RNA, 19 nt, Human
aauauuauauagcaaugaa

SEQ ID NO: 52375 - RNA, 24 nt, Human
aauuucacauuuuagcaaguauag

SEQ ID NO: 52376 - RNA, 19 nt, Human
acaaauagaagaugacaug

SEQ ID NO: 52377 - RNA, 21 nt, Human
acaauauccuaaaaauuuacc

SEQ ID NO: 52378 - RNA, 21 nt, Human
acauuaaaaaaaaucaaugcu

SEQ ID NO: 52379 - RNA, 20 nt, Human
accacagcauacuaaacugg

SEQ ID NO: 52380 - RNA, 22 nt, Human
accacagcauacuaaacuggua

SEQ ID NO: 52381 - RNA, 23 nt, Human
accacagcauacuaaacugguaa

SEQ ID NO: 52382 - RNA, 19 nt, Human
acuagacacaguaguucaa

SEQ ID NO: 52383 - RNA, 23 nt, Human
acucaaguaugaagcauucuacc

SEQ ID NO: 52384 - RNA, 23 nt, Human
acugaagauuauauauaccacaa

SEQ ID NO: 52385 - RNA, 21 nt, Human
acuuccagugauuuuauugaa

SEQ ID NO: 52386 - RNA, 22 nt, Human
acuuucagaggccaaagaggga

SEQ ID NO: 52387 - RNA, 22 nt, Human
acuuuguauuccaauuuagcug

SEQ ID NO: 52388 - RNA, 22 nt, Human
agaaaacaguaaaaaacaguaa

SEQ ID NO: 52389 - RNA, 19 nt, Human
agaaaagcaauacacuuag

SEQ ID NO: 52390 - RNA, 18 nt, Human
agaauucuugccacuacu

SEQ ID NO: 52391 - RNA, 22 nt, Human
agagggaggguugcuugagucc

SEQ ID NO: 52392 - RNA, 23 nt, Human
agccucgcacagaagccgcagcc

SEQ ID NO: 52393 - RNA, 18 nt, Human
aggaaggaacugaagaga

SEQ ID NO: 52394 - RNA, 23 nt, Human
aggggaagggcuggcugcccagc

SEQ ID NO: 52395 - RNA, 24 nt, Human
aggguugcuugaguccaggaguuc

SEQ ID NO: 52396 - RNA, 23 nt, Human
auagcaaugaaagaauucuugcc

SEQ ID NO: 52397 - RNA, 18 nt, Human
aucaauaugaccagucuc

SEQ ID NO: 52398 - RNA, 20 nt, Human
augcuuguaaucccaguacu

SEQ ID NO: 52399 - RNA, 22 nt, Human
augcuuugcauguuuccucaca

SEQ ID NO: 52400 - RNA, 23 nt, Human
caauaccuuauccagcaucacuc

SEQ ID NO: 52401 - RNA, 18 nt, Human
caauaucaaccugggcaa

SEQ ID NO: 52402 - RNA, 22 nt, Human
caaugaaagagaaugaaucuua

SEQ ID NO: 52403 - RNA, 24 nt, Human
cacaacgaauaagaccgaaauaaa

SEQ ID NO: 52404 - RNA, 22 nt, Human
cacaauauccuaaaaauuuacc

SEQ ID NO: 52405 - RNA, 19 nt, Human
cacaauucacauguuacaa

SEQ ID NO: 52406 - RNA, 18 nt, Human
cacagucgaaugaguuac

SEQ ID NO: 52407 - RNA, 19 nt, Human
cacagucgaaugaguuacc

SEQ ID NO: 52408 - RNA, 19 nt, Human
cacagucgaaugaguuacc

SEQ ID NO: 52409 - RNA, 19 nt, Human
cacagucgaaugaguuacc

SEQ ID NO: 52410 - RNA, 20 nt, Human
cacccgguacccaaccuggc

SEQ ID NO: 52411 - RNA, 20 nt, Human
cacgagcuuucaagcauggg

SEQ ID NO: 52412 - RNA, 23 nt, Human
cacuucugcuuacaagagauuag

SEQ ID NO: 52413 - RNA, 23 nt, Human
cagaaguaaaauucgaaucuguu

SEQ ID NO: 52414 - RNA, 18 nt, Human
cagcccaaggagggccgg

SEQ ID NO: 52415 - RNA, 18 nt, Human
cagcgccgaggcagcugg

SEQ ID NO: 52416 - RNA, 19 nt, Human
cauaagaauuaaaagaacu

SEQ ID NO: 52417 - RNA, 19 nt, Human
cauaagaauuaaaagaacu

SEQ ID NO: 52418 - RNA, 19 nt, Human
cauaagaauuaaaagaacu

SEQ ID NO: 52419 - RNA, 19 nt, Human
cauaagaauuaaaagaacu

SEQ ID NO: 52420 - RNA, 24 nt, Human
cauagugagacccaguuucuuguu

SEQ ID NO: 52421 - RNA, 24 nt, Human
cauucccagccccaagccacaggg

SEQ ID NO: 52422 - RNA, 21 nt, Human
ccaaauucgggucgccagcca

SEQ ID NO: 52423 - RNA, 19 nt, Human
ccacagcguauucaguaug

SEQ ID NO: 52424 - RNA, 21 nt, Human
ccacuacuuucuuccaacuga

SEQ ID NO: 52425 - RNA, 19 nt, Human
cccagccccaagccacagg

SEQ ID NO: 52426 - RNA, 25 nt, Human
ccccaaauggcuacauuaaaaaaau

SEQ ID NO: 52427 - RNA, 19 nt, Human
ccccaagccacagggcucu

SEQ ID NO: 52428 - RNA, 20 nt, Human
ccccaagccacagggcucug

SEQ ID NO: 52429 - RNA, 22 nt, Human
ccccuggaaacguacauuccua

SEQ ID NO: 52430 - RNA, 23 nt, Human
ccgugcgcgcacucgccccaggu

SEQ ID NO: 52431 - RNA, 18 nt, Human
cgaccggggcagcgccga

SEQ ID NO: 52432 - RNA, 25 nt, Human
cggggagaaacagaaggggaagggc

SEQ ID NO: 52433 - RNA, 20 nt, Human
cuaaaaaaaugcuacuuuga

SEQ ID NO: 52434 - RNA, 19 nt, Human
cuacggucggggggagggg

SEQ ID NO: 52435 - RNA, 22 nt, Human
cuacuaugaucuagcaauagau

SEQ ID NO: 52436 - RNA, 18 nt, Human
cuacugaauucauaucca

SEQ ID NO: 52437 - RNA, 21 nt, Human
cuacugaauucauauccauau

SEQ ID NO: 52438 - RNA, 22 nt, Human
cuagcagagcaaugaaagagaa

SEQ ID NO: 52439 - RNA, 23 nt, Human
cuagugcaacacaauauccuaaa

SEQ ID NO: 52440 - RNA, 22 nt, Human
cuauuucuaaagcaaggucagc

SEQ ID NO: 52441 - RNA, 22 nt, Human
cucaaagauaacaggugggcaa

SEQ ID NO: 52442 - RNA, 22 nt, Human
cuccacagucgaaugaguuacc

SEQ ID NO: 52443 - RNA, 22 nt, Human
cuccacagucgaaugaguuacc

SEQ ID NO: 52444 - RNA, 22 nt, Human
cuccacagucgaaugaguuacc

SEQ ID NO: 52445 - RNA, 22 nt, Human
cuccacagucgaaugaguuacc

SEQ ID NO: 52446 - RNA, 22 nt, Human
cugaagauuauauauaccacaa

SEQ ID NO: 52447 - RNA, 22 nt, Human
cugaauauuauauagcaaugaa

SEQ ID NO: 52448 - RNA, 28 nt, Human
cuggugcuacggucggggggaggggacg

SEQ ID NO: 52449 - RNA, 19 nt, Human
cuuacuagagauaacccca

SEQ ID NO: 52450 - RNA, 24 nt, Human
cuuucauuaaucuuccucauuaga

SEQ ID NO: 52451 - RNA, 20 nt, Human
gaaaaaccaaggcauagucc

SEQ ID NO: 52452 - RNA, 24 nt, Human
gaaauaaaaaugcuguauuacaga

SEQ ID NO: 52453 - RNA, 18 nt, Human
gaagcauucuaccgaaac

SEQ ID NO: 52454 - RNA, 21 nt, Human
gaaggggaagggcuggcugcc

SEQ ID NO: 52455 - RNA, 20 nt, Human
gagaaacagaaggggaaggg

SEQ ID NO: 52456 - RNA, 20 nt, Human
gagaagcaggcagagucuca

SEQ ID NO: 52457 - RNA, 23 nt, Human
gcaaucuccccauucccaaauuc

SEQ ID NO: 52458 - RNA, 20 nt, Human
gcaggacccgcgacucuggu

SEQ ID NO: 52459 - RNA, 22 nt, Human
gccgggcgccgugaagggcaaa

SEQ ID NO: 52460 - RNA, 21 nt, Human
gccgugcgcgcacucgccccu

SEQ ID NO: 52461 - RNA, 22 nt, Human
gccucuggaauagcugccguag

SEQ ID NO: 52462 - RNA, 19 nt, Human
gcuuguaaucccaguacuu

SEQ ID NO: 52463 - RNA, 20 nt, Human
ggaagggcuggcugcccagc

SEQ ID NO: 52464 - RNA, 19 nt, Human
ggagaugagaacagaggga

SEQ ID NO: 52465 - RNA, 24 nt, Human
ggcuuaugcuuguaaucccaguac

SEQ ID NO: 52466 - RNA, 20 nt, Human
gggagaaacagaaggggaag

SEQ ID NO: 52467 - RNA, 22 nt, Human
gggaguuauacgugcggcuucu

SEQ ID NO: 52468 - RNA, 27 nt, Human
ggggagaaacagaaggggaagggcugg

SEQ ID NO: 52469 - RNA, 24 nt, Human
ggggcagcgccgaggcagcugggu

SEQ ID NO: 52470 - RNA, 23 nt, Human
ggguugcuugaguccaggaguuc

SEQ ID NO: 52471 - RNA, 23 nt, Human
gguggcuuaugcuuguaauccca

SEQ ID NO: 52472 - RNA, 24 nt, Human
gguggcuuaugcuuguaaucccag

SEQ ID NO: 52473 - RNA, 24 nt, Human
gguugcuugaguccaggaguucaa

SEQ ID NO: 52474 - RNA, 21 nt, Human
gucucuuucuccuuccccugg

SEQ ID NO: 52475 - RNA, 21 nt, Human
uaacaggugggcaaucucccc

SEQ ID NO: 52476 - RNA, 20 nt, Human
uaagaaaacaguaaaaaaca

SEQ ID NO: 52477 - RNA, 19 nt, Human
uaaguaaaucauauaaaau

SEQ ID NO: 52478 - RNA, 20 nt, Human
uaaguaaaucauauaaaaua

SEQ ID NO: 52479 - RNA, 23 nt, Human
uacaauuaaaaaauuaaaaaccu

SEQ ID NO: 52480 - RNA, 24 nt, Human
uacauaugaugaccuugcauccua

SEQ ID NO: 52481 - RNA, 21 nt, Human
uacauuaaaaaaauugugaac

SEQ ID NO: 52482 - RNA, 21 nt, Human
uaccacauugaaaaacagaug

SEQ ID NO: 52483 - RNA, 23 nt, Human
uaccauagaggaaauaauguuua

SEQ ID NO: 52484 - RNA, 23 nt, Human
uacuagagauaaccccaaauggc

SEQ ID NO: 52485 - RNA, 25 nt, Human
uagcagagcaaugaaagagaaugaa

SEQ ID NO: 52486 - RNA, 18 nt, Human
uaggaaagccugaaguca

SEQ ID NO: 52487 - RNA, 18 nt, Human
uaggaaagccugaaguca

SEQ ID NO: 52488 - RNA, 18 nt, Human
uagugaaaaaccaaggca

SEQ ID NO: 52489 - RNA, 21 nt, Human
uauauagcaaugaaagaauuc

SEQ ID NO: 52490 - RNA, 20 nt, Human
uaugcuuguaaucccaguac

SEQ ID NO: 52491 - RNA, 25 nt, Human
uauucacauagcaacuugggaugug

SEQ ID NO: 52492 - RNA, 21 nt, Human
ucaagucugaagagggucuuu

SEQ ID NO: 52493 - RNA, 26 nt, Human
ucacauagcaacuugggaugugcaaa

SEQ ID NO: 52494 - RNA, 20 nt, Human
ucagaggccaaagagggagg

SEQ ID NO: 52495 - RNA, 20 nt, Human
ucagaggccaaagagggagg

SEQ ID NO: 52496 - RNA, 23 nt, Human
uccaaacuauggauuucuaggca

SEQ ID NO: 52497 - RNA, 23 nt, Human
ucccagccccaagccacagggcu

SEQ ID NO: 52498 - RNA, 24 nt, Human
ucccagccccaagccacagggcuc

SEQ ID NO: 52499 - RNA, 19 nt, Human
uccuaccucccugaauauc

SEQ ID NO: 52500 - RNA, 19 nt, Human
ucgcacagaagccgcagcc

SEQ ID NO: 52501 - RNA, 21 nt, Human
ucucuuucuccuuccccugga

SEQ ID NO: 52502 - RNA, 19 nt, Human
ugaaauacaauaccuuauc

SEQ ID NO: 52503 - RNA, 19 nt, Human
ugaagagggucuuuuccag

SEQ ID NO: 52504 - RNA, 18 nt, Human
ugaaugcauaaugauuua

SEQ ID NO: 52505 - RNA, 20 nt, Human
ugacuuuaagauuuuuaagg

SEQ ID NO: 52506 - RNA, 21 nt, Human
ugagaagcaggcagagucuca

SEQ ID NO: 52507 - RNA, 22 nt, Human
ugagaagcaggcagagucucaa

SEQ ID NO: 52508 - RNA, 20 nt, Human
ugagcacaacgaauaagacc

SEQ ID NO: 52509 - RNA, 20 nt, Human
ugcauguuuccucacauaag

SEQ ID NO: 52510 - RNA, 23 nt, Human
ugcccagaaguuuuaguuugcug

SEQ ID NO: 52511 - RNA, 22 nt, Human
uggcuuaugcuuguaaucccag

SEQ ID NO: 52512 - RNA, 24 nt, Human
uggcuuaugcuuguaaucccagua

SEQ ID NO: 52513 - RNA, 23 nt, Human
ugugacuuuaagauuuuuaaggc

SEQ ID NO: 52514 - RNA, 21 nt, Human
ugugcauauagcauuuacaua

SEQ ID NO: 52515 - RNA, 23 nt, Human
ugugcauauagcauuuacauaug

SEQ ID NO: 52516 - RNA, 24 nt, Human
ugugcauauagcauuuacauaugg

SEQ ID NO: 52517 - RNA, 18 nt, Human
uguuuuggcacuacuuug

SEQ ID NO: 52518 - RNA, 19 nt, Human
uguuuuuaggaaauaaauu

SEQ ID NO: 52519 - RNA, 25 nt, Human
uuaaacuuuaaaauauaccacgcag

SEQ ID NO: 52520 - RNA, 19 nt, Human
uuaccacauugaaaaacag

SEQ ID NO: 52521 - RNA, 20 nt, Human
uuaguuuuggaaaccagaaa

SEQ ID NO: 52522 - RNA, 23 nt, Human
uuauuuuccaaacuauggauuuc

SEQ ID NO: 52523 - RNA, 24 nt, Human
uucauuucuguacaaauagaagau

SEQ ID NO: 52524 - RNA, 19 nt, Human
uuccagugauuuuauugaa

SEQ ID NO: 52525 - RNA, 22 nt, Human
uugaagaagagcaggcagauaa

SEQ ID NO: 52526 - RNA, 24 nt, Human
uuggaaaccagaaaacuaagcuag

SEQ ID NO: 52527 - RNA, 18 nt, Human
uuuaagauaucuacugaa

SEQ ID NO: 52528 - RNA, 21 nt, Human
uuuaagauaucuacugaauuc

SEQ ID NO: 52529 - RNA, 26 nt, Human
uuuauuuuccaaacuauggauuucua

SEQ ID NO: 52530 - RNA, 19 nt, Human
uuuccaguuucuccauuuc

SEQ ID NO: 52531 - RNA, 23 nt, Human
aagaaaaacagaucuagagacaa

SEQ ID NO: 52532 - RNA, 23 nt, Human
aagcccccuucaccuacacgcag

SEQ ID NO: 52533 - RNA, 18 nt, Human
ccacauaaaacuguacag

SEQ ID NO: 52534 - RNA, 19 nt, Human
cccuucaccuacacgcagc

SEQ ID NO: 52535 - RNA, 18 nt, Human
ccugcaugaauuguuccc

SEQ ID NO: 52536 - RNA, 20 nt, Human
ggaagcccccuucaccuaca

SEQ ID NO: 52537 - RNA, 21 nt, Human
uaagaaaaacagaucuagaga

SEQ ID NO: 52538 - RNA, 19 nt, Human
uccccacauaaaacuguac

SEQ ID NO: 52539 - RNA, 22 nt, Human
ucuagagacaauccaguaggcu

SEQ ID NO: 52540 - RNA, 27 nt, Human
ucucuuaguacugccauuauuauugac

SEQ ID NO: 52541 - RNA, 18 nt, Human
ucuuuaacaaguguaagg

SEQ ID NO: 52542 - RNA, 22 nt, Human
uguaaaaaguccaguuucucag

SEQ ID NO: 52543 - RNA, 19 nt, Human
uguacaguuagugacugaa

SEQ ID NO: 52544 - RNA, 21 nt, Human
uuagugacugaauuguauacu

SEQ ID NO: 52545 - RNA, 19 nt, Human
uuaguguuuaagaaaaaca

SEQ ID NO: 52546 - RNA, 18 nt, Human
uuuuuuuuuuuuuuuuug

SEQ ID NO: 52547 - RNA, 20 nt, Human
uuuuuuuuuuuuuuuuuggu

SEQ ID NO: 52548 - RNA, 20 nt, Human
aaaaaacagcaacggaguac

SEQ ID NO: 52549 - RNA, 27 nt, Human
aaaaacagcaacggaguaccgguaccc

SEQ ID NO: 52550 - RNA, 18 nt, Human
accccacagagucuucca

SEQ ID NO: 52551 - RNA, 20 nt, Human
acccuggagcccagcugcac

SEQ ID NO: 52552 - RNA, 27 nt, Human
acuuccaagaguguguuuauaaaaaaa

SEQ ID NO: 52553 - RNA, 21 nt, Human
agccgggaggaguccccucug

SEQ ID NO: 52554 - RNA, 19 nt, Human
aggcggcugagcagagggc

SEQ ID NO: 52555 - RNA, 18 nt, Human
cagcaggagcagcaggcc

SEQ ID NO: 52556 - RNA, 21 nt, Human
cagcgggccacagccgcaagc

SEQ ID NO: 52557 - RNA, 19 nt, Human
cagcugagcccccugcagg

SEQ ID NO: 52558 - RNA, 20 nt, Human
caggccagcaggagcagcag

SEQ ID NO: 52559 - RNA, 21 nt, Human
caggggccugugucugagacc

SEQ ID NO: 52560 - RNA, 21 nt, Human
caggggccugugucugaggcc

SEQ ID NO: 52561 - RNA, 21 nt, Human
cagggugcgugagucugggac

SEQ ID NO: 52562 - RNA, 18 nt, Human
ccaccugcccuccccagg

SEQ ID NO: 52563 - RNA, 20 nt, Human
ccaggccagcaggagcagca

SEQ ID NO: 52564 - RNA, 20 nt, Human
ccaggcggcugagcagaggg

SEQ ID NO: 52565 - RNA, 22 nt, Human
ccagugacagaaggggcuuccu

SEQ ID NO: 52566 - RNA, 21 nt, Human
cccaccagcgggccacagccg

SEQ ID NO: 52567 - RNA, 23 nt, Human
cccaccagcgggccacagccgca

SEQ ID NO: 52568 - RNA, 19 nt, Human
cccaggucaugcccugccu

SEQ ID NO: 52569 - RNA, 19 nt, Human
ccccacagagucuuccagg

SEQ ID NO: 52570 - RNA, 18 nt, Human
cccggcccggcgcccgac

SEQ ID NO: 52571 - RNA, 18 nt, Human
cccuccaggccccuccuc

SEQ ID NO: 52572 - RNA, 24 nt, Human
cccucugcccauccuccagccauc

SEQ ID NO: 52573 - RNA, 20 nt, Human
cccuggagcccagcugcacc

SEQ ID NO: 52574 - RNA, 21 nt, Human
cccuggagcccagcugcaccc

SEQ ID NO: 52575 - RNA, 22 nt, Human
ccggcgcccgacggcgccgcca

SEQ ID NO: 52576 - RNA, 18 nt, Human
cggcccggcgcccgacgg

SEQ ID NO: 52577 - RNA, 18 nt, Human
cggcuuccaccugcccuc

SEQ ID NO: 52578 - RNA, 19 nt, Human
cgggaggaguccccucugc

SEQ ID NO: 52579 - RNA, 21 nt, Human
cggggaggguccagcugagcc

SEQ ID NO: 52580 - RNA, 20 nt, Human
cuccugggccaucgggggcc

SEQ ID NO: 52581 - RNA, 23 nt, Human
cugcaggggacaccaggggccug

SEQ ID NO: 52582 - RNA, 19 nt, Human
cugcccuccccaggucaug

SEQ ID NO: 52583 - RNA, 19 nt, Human
cugcuccugggccaucggg

SEQ ID NO: 52584 - RNA, 23 nt, Human
cuuccaggccagcaggagcagca

SEQ ID NO: 52585 - RNA, 20 nt, Human
cuugugggcuggacccugga

SEQ ID NO: 52586 - RNA, 20 nt, Human
gaugcagcuugugggcugga

SEQ ID NO: 52587 - RNA, 21 nt, Human
gccagugacagaaggggcuuc

SEQ ID NO: 52588 - RNA, 27 nt, Human
gcccuccccaggucaugcccugccggu

SEQ ID NO: 52589 - RNA, 22 nt, Human
gcccuggaggccccuccucucc

SEQ ID NO: 52590 - RNA, 23 nt, Human
gcccuggaggccccuccucuccc

SEQ ID NO: 52591 - RNA, 24 nt, Human
gcuccugggccaucgggggcccca

SEQ ID NO: 52592 - RNA, 20 nt, Human
ggaguacagugcugacccca

SEQ ID NO: 52593 - RNA, 21 nt, Human
ggaguccccucugcccauccu

SEQ ID NO: 52594 - RNA, 21 nt, Human
ggccagcaggagcagcaggcc

SEQ ID NO: 52595 - RNA, 20 nt, Human
ggcugagugagagcuggggg

SEQ ID NO: 52596 - RNA, 23 nt, Human
ggcugagugagagcugggggagc

SEQ ID NO: 52597 - RNA, 18 nt, Human
gggaggaguccccucugc

SEQ ID NO: 52598 - RNA, 20 nt, Human
ggggaggguccagcugagcc

SEQ ID NO: 52599 - RNA, 18 nt, Human
gugggcuggacccuggag

SEQ ID NO: 52600 - RNA, 21 nt, Human
uaaaaaaacagcaacggagua

SEQ ID NO: 52601 - RNA, 21 nt, Human
uacagugcugaccccacagag

SEQ ID NO: 52602 - RNA, 19 nt, Human
uccaagaguguguuuauaa

SEQ ID NO: 52603 - RNA, 20 nt, Human
ucccagagacccugaugcag

SEQ ID NO: 52604 - RNA, 20 nt, Human
uccccaggucaugcccugcc

SEQ ID NO: 52605 - RNA, 23 nt, Human
uccccaggucaugcccugccgug

SEQ ID NO: 52606 - RNA, 19 nt, Human
ucccggcucccuguggccc

SEQ ID NO: 52607 - RNA, 21 nt, Human
uccugggccaucgggggccuu

SEQ ID NO: 52608 - RNA, 21 nt, Human
ucugaggccagugacagaagg

SEQ ID NO: 52609 - RNA, 20 nt, Human
ucugcuccugggccaucggg

SEQ ID NO: 52610 - RNA, 20 nt, Human
ugagagcugggggagccgga

SEQ ID NO: 52611 - RNA, 19 nt, Human
ugagucugggacuccuggc

SEQ ID NO: 52612 - RNA, 20 nt, Human
ugcaggggacaccaggggcc

SEQ ID NO: 52613 - RNA, 24 nt, Human
ugcccucgagcccggggagggucc

SEQ ID NO: 52614 - RNA, 18 nt, Human
uggcccagggugcgugag

SEQ ID NO: 52615 - RNA, 25 nt, Human
uggcccuccaggccccuccucuccc

SEQ ID NO: 52616 - RNA, 21 nt, Human
uggcccuggaggccccuccuc

SEQ ID NO: 52617 - RNA, 19 nt, Human
uggcucagcccaccagcgg

SEQ ID NO: 52618 - RNA, 21 nt, Human
ugggucccaggcggcugagca

SEQ ID NO: 52619 - RNA, 21 nt, Human
ugguauuuggaagccgggagg

SEQ ID NO: 52620 - RNA, 24 nt, Human
uggugggucccaggcggcugagca

SEQ ID NO: 52621 - RNA, 21 nt, Human
gaaaacuuaaaaaaaaaauug

SEQ ID NO: 52622 - RNA, 21 nt, Human
guauaaccacaguugaaaacu

SEQ ID NO: 52623 - RNA, 18 nt, Human
aaacagaacacccccaaa

SEQ ID NO: 52624 - RNA, 21 nt, Human
aaccacugugaaagaccaagu

SEQ ID NO: 52625 - RNA, 22 nt, Human
aagcaacagauacugcaaagca

SEQ ID NO: 52626 - RNA, 21 nt, Human
aagcacauggcuugauacuuc

SEQ ID NO: 52627 - RNA, 19 nt, Human
acaaggucaauucccagga

SEQ ID NO: 52628 - RNA, 19 nt, Human
acacaauucuaauuucugu

SEQ ID NO: 52629 - RNA, 18 nt, Human
acacuugaaaccaaauuu

SEQ ID NO: 52630 - RNA, 20 nt, Human
acagaacacccccaaaacau

SEQ ID NO: 52631 - RNA, 23 nt, Human
acccuaguaaccucugaucucca

SEQ ID NO: 52632 - RNA, 18 nt, Human
acccugaugccacagccu

SEQ ID NO: 52633 - RNA, 21 nt, Human
acuaguuuugguuuugucuug

SEQ ID NO: 52634 - RNA, 20 nt, Human
acuugccagaggcuuucccu

SEQ ID NO: 52635 - RNA, 18 nt, Human
aggaggggcugggcagua

SEQ ID NO: 52636 - RNA, 23 nt, Human
aggggccaaagaaaucaggaggg

SEQ ID NO: 52637 - RNA, 23 nt, Human
aguuccuggccagaguugacucu

SEQ ID NO: 52638 - RNA, 20 nt, Human
caaaaaagguuuuauccaaa

SEQ ID NO: 52639 - RNA, 28 nt, Human
caaaaaagguuuuauccaaaaaaguuaa

SEQ ID NO: 52640 - RNA, 23 nt, Human
caacacgucaccacccuuugcuc

SEQ ID NO: 52641 - RNA, 21 nt, Human
caagacaagcaacagauacug

SEQ ID NO: 52642 - RNA, 22 nt, Human
caagacaagcaacagauacugc

SEQ ID NO: 52643 - RNA, 23 nt, Human
cacagccuuucacguuuccuaaa

SEQ ID NO: 52644 - RNA, 18 nt, Human
caccauaguccaggggcc

SEQ ID NO: 52645 - RNA, 21 nt, Human
cagaaugcuccccuacccuga

SEQ ID NO: 52646 - RNA, 23 nt, Human
cagacaaaucgauuacaagguca

SEQ ID NO: 52647 - RNA, 24 nt, Human
cagcaccauaguccaggggccaaa

SEQ ID NO: 52648 - RNA, 24 nt, Human
ccucugaucuccaucugccucauc

SEQ ID NO: 52649 - RNA, 21 nt, Human
cucuggauuuccucacccacc

SEQ ID NO: 52650 - RNA, 20 nt, Human
cugacagacagaagggcuuu

SEQ ID NO: 52651 - RNA, 25 nt, Human
cugccuugugugagucggcggcuag

SEQ ID NO: 52652 - RNA, 23 nt, Human
cuggauuuccucacccaccugcc

SEQ ID NO: 52653 - RNA, 20 nt, Human
cuugccagaggcuuucccug

SEQ ID NO: 52654 - RNA, 20 nt, Human
gaaagcuacuugccagaggc

SEQ ID NO: 52655 - RNA, 26 nt, Human
gagaaaacagaacacccccaaaacau

SEQ ID NO: 52656 - RNA, 24 nt, Human
gcagaaugcuccccuacccugaug

SEQ ID NO: 52657 - RNA, 19 nt, Human
gcuugauacuucuguugau

SEQ ID NO: 52658 - RNA, 18 nt, Human
ggagaaaacagaacaccc

SEQ ID NO: 52659 - RNA, 24 nt, Human
ggagaaaacagaacacccccaaaa

SEQ ID NO: 52660 - RNA, 25 nt, Human
uaaacccuaguaaccucugaucucc

SEQ ID NO: 52661 - RNA, 23 nt, Human
uaaccucugaucuccaucugccu

SEQ ID NO: 52662 - RNA, 22 nt, Human
uacagcaccauaguccaggggc

SEQ ID NO: 52663 - RNA, 20 nt, Human
uaccuuagaguuccuggcca

SEQ ID NO: 52664 - RNA, 24 nt, Human
ucaaaaaagguuuuauccaaaaaa

SEQ ID NO: 52665 - RNA, 19 nt, Human
ucaggguguguucaggagu

SEQ ID NO: 52666 - RNA, 19 nt, Human
uccuaaacccuaguaaccu

SEQ ID NO: 52667 - RNA, 24 nt, Human
ucucaaggccugacagacagaagg

SEQ ID NO: 52668 - RNA, 22 nt, Human
ucuucaggguguguucaggagu

SEQ ID NO: 52669 - RNA, 24 nt, Human
ugacagacagaagggcuuggagau

SEQ ID NO: 52670 - RNA, 23 nt, Human
ugccagaggcuuucccugagagc

SEQ ID NO: 52671 - RNA, 18 nt, Human
ugguaaacgaaccacugu

SEQ ID NO: 52672 - RNA, 20 nt, Human
uuaaucaagacaagcaacag

SEQ ID NO: 52673 - RNA, 21 nt, Human
uuccuggccagaguugacucu

SEQ ID NO: 52674 - RNA, 24 nt, Human
uugucuugucccuuccuugagcag

SEQ ID NO: 52675 - RNA, 22 nt, Human
uuuuuuuuuuuuuuuuucuguu

SEQ ID NO: 52676 - RNA, 26 nt, Human
uuuuuuuuuuuuuuuuuuuucugggg

SEQ ID NO: 52677 - RNA, 19 nt, Human
aaaaagcaacaaguuuaca

SEQ ID NO: 52678 - RNA, 22 nt, Human
aaaaagcaacaaguuuacaaaa

SEQ ID NO: 52679 - RNA, 23 nt, Human
aaaaagcaacaaguuuacaaaaa

SEQ ID NO: 52680 - RNA, 22 nt, Human
aaaugggggcuuggaaaggccc

SEQ ID NO: 52681 - RNA, 18 nt, Human
acaccguggggcaggcgc

SEQ ID NO: 52682 - RNA, 19 nt, Human
acacucaggcaagaaaauc

SEQ ID NO: 52683 - RNA, 18 nt, Human
accacaaggagaggcagc

SEQ ID NO: 52684 - RNA, 20 nt, Human
accacaaggagaggcagcag

SEQ ID NO: 52685 - RNA, 18 nt, Human
acgccgagcccuccacgc

SEQ ID NO: 52686 - RNA, 22 nt, Human
agcacacacaggaaggagcagc

SEQ ID NO: 52687 - RNA, 19 nt, Human
agcacgggagcaacgcaga

SEQ ID NO: 52688 - RNA, 22 nt, Human
agccauggccaggcccagauac

SEQ ID NO: 52689 - RNA, 19 nt, Human
agcuccucucgauagcccc

SEQ ID NO: 52690 - RNA, 23 nt, Human
aggcagggcccagagcacacaca

SEQ ID NO: 52691 - RNA, 20 nt, Human
aggccgaggcagggcccaga

SEQ ID NO: 52692 - RNA, 21 nt, Human
agggccagcugagggucagga

SEQ ID NO: 52693 - RNA, 24 nt, Human
aucaaaaagcaacaaguuuacaaa

SEQ ID NO: 52694 - RNA, 18 nt, Human
auggccaggcccagauac

SEQ ID NO: 52695 - RNA, 22 nt, Human
auggggguggggaagggacggg

SEQ ID NO: 52696 - RNA, 19 nt, Human
caacacucaggcaagaaaa

SEQ ID NO: 52697 - RNA, 21 nt, Human
cacacaggaaggagcagcuca

SEQ ID NO: 52698 - RNA, 20 nt, Human
cacagcgauugacacagaaa

SEQ ID NO: 52699 - RNA, 20 nt, Human
cacagguaugggggugcagg

SEQ ID NO: 52700 - RNA, 26 nt, Human
caccacguucgucuucuccucgcgcc

SEQ ID NO: 52701 - RNA, 19 nt, Human
caccguggggcaggcgcag

SEQ ID NO: 52702 - RNA, 20 nt, Human
cacgggagcaacgcagagcu

SEQ ID NO: 52703 - RNA, 19 nt, Human
cacguucgucuucuccucg

SEQ ID NO: 52704 - RNA, 23 nt, Human
cagaggucaaccccaucccacag

SEQ ID NO: 52705 - RNA, 18 nt, Human
cagcagccuggggcuggc

SEQ ID NO: 52706 - RNA, 21 nt, Human
cagcgauugacacagaaacau

SEQ ID NO: 52707 - RNA, 19 nt, Human
cagcucaaaugggggcuug

SEQ ID NO: 52708 - RNA, 18 nt, Human
caggagccggggcugcuu

SEQ ID NO: 52709 - RNA, 23 nt, Human
cagugagcuccucucgauagccc

SEQ ID NO: 52710 - RNA, 19 nt, Human
caguuuaaggcauuucugg

SEQ ID NO: 52711 - RNA, 19 nt, Human
cauggccaggcccagauac

SEQ ID NO: 52712 - RNA, 19 nt, Human
cauggccaggcccagauac

SEQ ID NO: 52713 - RNA, 23 nt, Human
ccaccuuguugccgccguccagc

SEQ ID NO: 52714 - RNA, 18 nt, Human
ccagcaggcucucccggg

SEQ ID NO: 52715 - RNA, 21 nt, Human
cccacagugagcuccucucga

SEQ ID NO: 52716 - RNA, 25 nt, Human
cccaccacuccaggggucaaauaaa

SEQ ID NO: 52717 - RNA, 21 nt, Human
cccgccugacggagcgagggu

SEQ ID NO: 52718 - RNA, 18 nt, Human
cccuggucuggccucugc

SEQ ID NO: 52719 - RNA, 20 nt, Human
ccuccacgcugccaccucgc

SEQ ID NO: 52720 - RNA, 25 nt, Human
ccuccacgcugccaccucgccuguc

SEQ ID NO: 52721 - RNA, 19 nt, Human
ccuggggcuggcgcaggca

SEQ ID NO: 52722 - RNA, 18 nt, Human
cucagcagccccuuccuc

SEQ ID NO: 52723 - RNA, 26 nt, Human
cucaggcaagaaaaucauaucaaaaa

SEQ ID NO: 52724 - RNA, 25 nt, Human
cuccaccgucccggugagcaccacg

SEQ ID NO: 52725 - RNA, 21 nt, Human
cugccaccucugcaccugccc

SEQ ID NO: 52726 - RNA, 22 nt, Human
cugccaccucugcaccugcccc

SEQ ID NO: 52727 - RNA, 24 nt, Human
cugccccuugaccuuggucagaca

SEQ ID NO: 52728 - RNA, 20 nt, Human
cugcuccucagcagccuggg

SEQ ID NO: 52729 - RNA, 18 nt, Human
cuggccacagguaugggg

SEQ ID NO: 52730 - RNA, 21 nt, Human
gaaaauaauuacagcgggcgc

SEQ ID NO: 52731 - RNA, 20 nt, Human
gaacacagccauggccaggc

SEQ ID NO: 52732 - RNA, 21 nt, Human
gagaugggaaagaugagaccc

SEQ ID NO: 52733 - RNA, 23 nt, Human
gcagaggucaaccccaucccaca

SEQ ID NO: 52734 - RNA, 18 nt, Human
gcaggcgcagugcaaggc

SEQ ID NO: 52735 - RNA, 21 nt, Human
gcccuguggggucacccggag

SEQ ID NO: 52736 - RNA, 18 nt, Human
gcgcagugcaaggcgggg

SEQ ID NO: 52737 - RNA, 18 nt, Human
gcgggcgcggggcucugg

SEQ ID NO: 52738 - RNA, 22 nt, Human
gcuggccacagguaugggggug

SEQ ID NO: 52739 - RNA, 21 nt, Human
ggaggacugggcuggggcugg

SEQ ID NO: 52740 - RNA, 18 nt, Human
ggcagggccagcugaggg

SEQ ID NO: 52741 - RNA, 22 nt, Human
ggccccaucagaccucagcagc

SEQ ID NO: 52742 - RNA, 21 nt, Human
ggccgaggcagggcccagagc

SEQ ID NO: 52743 - RNA, 22 nt, Human
ggccucugcuccucagcagccu

SEQ ID NO: 52744 - RNA, 18 nt, Human
ggcuggggcugggggugg

SEQ ID NO: 52745 - RNA, 21 nt, Human
gggauggggguggggaaggga

SEQ ID NO: 52746 - RNA, 24 nt, Human
gggcaugucccgccggcuccgggc

SEQ ID NO: 52747 - RNA, 19 nt, Human
gggcccagagcacacacag

SEQ ID NO: 52748 - RNA, 19 nt, Human
gggcuggggguggggaugg

SEQ ID NO: 52749 - RNA, 19 nt, Human
ggggaugggaugggggugg

SEQ ID NO: 52750 - RNA, 20 nt, Human
gggguggggaugggaugggg

SEQ ID NO: 52751 - RNA, 22 nt, Human
guaacacggcacccagccccac

SEQ ID NO: 52752 - RNA, 24 nt, Human
uaccgccagacccgaaccuugcag

SEQ ID NO: 52753 - RNA, 26 nt, Human
ucacagaugagggggucuccaaagcc

SEQ ID NO: 52754 - RNA, 18 nt, Human
ucagcagccuggggcugg

SEQ ID NO: 52755 - RNA, 24 nt, Human
ucccgggccaccaggucuuugccc

SEQ ID NO: 52756 - RNA, 25 nt, Human
ucccgggccaccaggucuuugcccu

SEQ ID NO: 52757 - RNA, 20 nt, Human
uccucgcgccgcuccagcgc

SEQ ID NO: 52758 - RNA, 18 nt, Human
uccugaggcugccaucca

SEQ ID NO: 52759 - RNA, 26 nt, Human
uccugcuccuaggaggacugggcugg

SEQ ID NO: 52760 - RNA, 18 nt, Human
uccugguguccccagugg

SEQ ID NO: 52761 - RNA, 18 nt, Human
ucucccgggccaccaggu

SEQ ID NO: 52762 - RNA, 22 nt, Human
ucugcaccugccccuugaccuu

SEQ ID NO: 52763 - RNA, 21 nt, Human
ucugcuccucagcagccuggg

SEQ ID NO: 52764 - RNA, 23 nt, Human
ucugcuccucagcagccuggggc

SEQ ID NO: 52765 - RNA, 21 nt, Human
ugacacagaaacauacuagag

SEQ ID NO: 52766 - RNA, 18 nt, Human
ugaggcaggggugugugu

SEQ ID NO: 52767 - RNA, 21 nt, Human
ugcaaggcgggggcucagcac

SEQ ID NO: 52768 - RNA, 27 nt, Human
ugcaaggcgggggcucagcaccuugag

SEQ ID NO: 52769 - RNA, 21 nt, Human
ugcagcacggcugccuggacg

SEQ ID NO: 52770 - RNA, 19 nt, Human
ugccuggacggaagggagg

SEQ ID NO: 52771 - RNA, 20 nt, Human
ugccuggacggaagggaggc

SEQ ID NO: 52772 - RNA, 18 nt, Human
uggacggaagggaggccg

SEQ ID NO: 52773 - RNA, 19 nt, Human
uggcagagggauacgguca

SEQ ID NO: 52774 - RNA, 27 nt, Human
uggcagagggauacggucauguccagg

SEQ ID NO: 52775 - RNA, 18 nt, Human
uggcugggcagggccagc

SEQ ID NO: 52776 - RNA, 22 nt, Human
uggcugggcagggccagcugag

SEQ ID NO: 52777 - RNA, 23 nt, Human
uggcugggcagggccagcugagg

SEQ ID NO: 52778 - RNA, 18 nt, Human
ugggauggggguggggaa

SEQ ID NO: 52779 - RNA, 21 nt, Human
ugggauggggguggggaaggg

SEQ ID NO: 52780 - RNA, 21 nt, Human
ugggcagggccagcugagggu

SEQ ID NO: 52781 - RNA, 24 nt, Human
ugggcuggggcuggggguggggau

SEQ ID NO: 52782 - RNA, 22 nt, Human
uggggcuggggguggggauggg

SEQ ID NO: 52783 - RNA, 18 nt, Human
uggggguggggaugggau

SEQ ID NO: 52784 - RNA, 21 nt, Human
ugggguguggcagagggauac

SEQ ID NO: 52785 - RNA, 21 nt, Human
uggucuggccucugcuccuca

SEQ ID NO: 52786 - RNA, 20 nt, Human
ugucacagaugagggggucu

SEQ ID NO: 52787 - RNA, 25 nt, Human
uucaaguaccgccagacccgaaccu

SEQ ID NO: 52788 - RNA, 27 nt, Human
uuggaaaggcccugugggaagcgccgc

SEQ ID NO: 52789 - RNA, 20 nt, Human
uuucuggcuucggagccauc

SEQ ID NO: 52790 - RNA, 23 nt, Human
aaauuugggagcaagagagggug

SEQ ID NO: 52791 - RNA, 23 nt, Human
aaggacccuuccuggaggguggg

SEQ ID NO: 52792 - RNA, 18 nt, Human
agagggugcccagggucc

SEQ ID NO: 52793 - RNA, 20 nt, Human
caggagccgauuaaaauuug

SEQ ID NO: 52794 - RNA, 22 nt, Human
caggccgugaaggacccuuccu

SEQ ID NO: 52795 - RNA, 19 nt, Human
cccgacccugacguuggcc

SEQ ID NO: 52796 - RNA, 25 nt, Human
cccuacccuagccccgacccugacc

SEQ ID NO: 52797 - RNA, 25 nt, Human
cccuagccccgacccugacguuggc

SEQ ID NO: 52798 - RNA, 23 nt, Human
cccuuggcuuauauggcagggcc

SEQ ID NO: 52799 - RNA, 21 nt, Human
ccuccgggauucuugccuaga

SEQ ID NO: 52800 - RNA, 19 nt, Human
ccuuccuggaggguggggg

SEQ ID NO: 52801 - RNA, 31 nt, Human
ccuugccccuacccuagccccgacccugacc

SEQ ID NO: 52802 - RNA, 24 nt, Human
gcaagagagggugcccagggucca

SEQ ID NO: 52803 - RNA, 21 nt, Human
ggagccgauuaaaauuuggga

SEQ ID NO: 52804 - RNA, 23 nt, Human
ggagggugggggcacaguucagg

SEQ ID NO: 52805 - RNA, 22 nt, Human
gggggcacaguucaggcccuca

SEQ ID NO: 52806 - RNA, 18 nt, Human
guccacaaauuuccacag

SEQ ID NO: 52807 - RNA, 21 nt, Human
guucccggccaccccgugccc

SEQ ID NO: 52808 - RNA, 20 nt, Human
uauggcagggccuaaugaag

SEQ ID NO: 52809 - RNA, 23 nt, Human
ucccggccaccccgugcccuugg

SEQ ID NO: 52810 - RNA, 18 nt, Human
ucccugaaccugagccuu

SEQ ID NO: 52811 - RNA, 20 nt, Human
ugacugaucccugcagccaa

SEQ ID NO: 52812 - RNA, 23 nt, Human
ugcccaggguccacaaauuucca

SEQ ID NO: 52813 - RNA, 23 nt, Human
ugccccuacccuagccccgaccc

SEQ ID NO: 52814 - RNA, 20 nt, Human
ugggagcaagagagggugcc

SEQ ID NO: 52815 - RNA, 18 nt, Human
ugggggcacaguucaggc

SEQ ID NO: 52816 - RNA, 19 nt, Human
uuccacaggacagggaccu

SEQ ID NO: 52817 - RNA, 23 nt, Human
uuccuggagggugggggcacagu

SEQ ID NO: 52818 - RNA, 19 nt, Human
uuccuugccccuacccuag

SEQ ID NO: 52819 - RNA, 23 nt, Human
uugccuagagaguucccggccac

SEQ ID NO: 52820 - RNA, 22 nt, Human
uuuuuuuuuuuuuuuuuguugg

SEQ ID NO: 52821 - RNA, 21 nt, Human
uuuuuuuuuuuuuuuuuuguu

SEQ ID NO: 52822 - RNA, 24 nt, Human
uuuuuuuuuuuuuuuuuuguuggu

SEQ ID NO: 52823 - RNA, 24 nt, Human
uuuuuuuuuuuuuuuuuuuguugg

SEQ ID NO: 52824 - RNA, 18 nt, Human
acaaaccgaaggcaaugc

SEQ ID NO: 52825 - RNA, 18 nt, Human
aggugggagacugggggu

SEQ ID NO: 52826 - RNA, 21 nt, Human
ccagaacaacggcagcuucuu

SEQ ID NO: 52827 - RNA, 22 nt, Human
ccgcugcaggcuucuacugcuc

SEQ ID NO: 52828 - RNA, 24 nt, Human
cgguuggaauucuuuuuggaacag

SEQ ID NO: 52829 - RNA, 24 nt, Human
cuucugcuguaguacccagaacaa

SEQ ID NO: 52830 - RNA, 22 nt, Human
gaggugcauuugugccgcugca

SEQ ID NO: 52831 - RNA, 20 nt, Human
gccaggggcagaggccuugg

SEQ ID NO: 52832 - RNA, 25 nt, Human
gccuccccacccccauucucuaaaa

SEQ ID NO: 52833 - RNA, 23 nt, Human
ggaaaaaacuaagguauuacaga

SEQ ID NO: 52834 - RNA, 23 nt, Human
ggaggugcauuugugccgcugca

SEQ ID NO: 52835 - RNA, 21 nt, Human
uauuacagacacuacacggag

SEQ ID NO: 52836 - RNA, 22 nt, Human
ucaagacacuaaauacaaaccg

SEQ ID NO: 52837 - RNA, 22 nt, Human
uccaugcagcacacuuagacca

SEQ ID NO: 52838 - RNA, 22 nt, Human
uccgcauucaaacagaaauuca

SEQ ID NO: 52839 - RNA, 19 nt, Human
ugaaaagggaacacuuuuu

SEQ ID NO: 52840 - RNA, 26 nt, Human
ugccaggcacuguguucuggggcccu

SEQ ID NO: 52841 - RNA, 25 nt, Human
ugcugcuggccuuugccucaaaggc

SEQ ID NO: 52842 - RNA, 22 nt, Human
uggaaaaaacuaagguauuaca

SEQ ID NO: 52843 - RNA, 20 nt, Human
uuccagcucaaagucgacuc

SEQ ID NO: 52844 - RNA, 18 nt, Human
uucugcuguaguacccag

SEQ ID NO: 52845 - RNA, 20 nt, Human
uucuugccuccccaccccca

SEQ ID NO: 52846 - RNA, 20 nt, Human
aaacaaacacaucuauagaa

SEQ ID NO: 52847 - RNA, 22 nt, Human
aacccaauaguuaacaugauuc

SEQ ID NO: 52848 - RNA, 24 nt, Human
aauaucuacccacuucuaaacaaa

SEQ ID NO: 52849 - RNA, 24 nt, Human
caaugcuacauaaagugcauugaa

SEQ ID NO: 52850 - RNA, 21 nt, Human
caggauggggcgcuggaggcg

SEQ ID NO: 52851 - RNA, 19 nt, Human
ccacuucuaaacaaacaca

SEQ ID NO: 52852 - RNA, 23 nt, Human
ccacuucuaaacaaacacaucua

SEQ ID NO: 52853 - RNA, 24 nt, Human
ccugcacuacuucagucacaaccc

SEQ ID NO: 52854 - RNA, 18 nt, Human
cuucuaaacaaacacauc

SEQ ID NO: 52855 - RNA, 21 nt, Human
ggcgcuggaggcggcggaacc

SEQ ID NO: 52856 - RNA, 20 nt, Human
guuuuuuuuuuuuaaaggua

SEQ ID NO: 52857 - RNA, 22 nt, Human
uaaagugcauugaauaucgaaa

SEQ ID NO: 52858 - RNA, 23 nt, Human
uaaagugcauugaauaucgaaaa

SEQ ID NO: 52859 - RNA, 19 nt, Human
uaacaagagauggcagcgg

SEQ ID NO: 52860 - RNA, 22 nt, Human
uacccacuucuaaacaaacaca

SEQ ID NO: 52861 - RNA, 24 nt, Human
uacucagguuuuuuuuuuuuaaaa

SEQ ID NO: 52862 - RNA, 18 nt, Human
ucauucaaugcuacauaa

SEQ ID NO: 52863 - RNA, 23 nt, Human
ucucucaagcuuccugggaaaua

SEQ ID NO: 52864 - RNA, 22 nt, Human
ucuguauaaacucauuucucuc

SEQ ID NO: 52865 - RNA, 21 nt, Human
ugcacuacuucagucacaacc

SEQ ID NO: 52866 - RNA, 22 nt, Human
ugcacuacuucagucacaaccc

SEQ ID NO: 52867 - RNA, 19 nt, Human
uggaggcggcggaaccugu

SEQ ID NO: 52868 - RNA, 21 nt, Human
ugguaaauguagaauguaaug

SEQ ID NO: 52869 - RNA, 20 nt, Human
ugguuucaaggcaaacccug

SEQ ID NO: 52870 - RNA, 21 nt, Human
uguagaauguaaugguuucaa

SEQ ID NO: 52871 - RNA, 23 nt, Human
uucaaugcuacauaaagugcauu

SEQ ID NO: 52872 - RNA, 21 nt, Human
uugaauaucgaaaauaaaaca

SEQ ID NO: 52873 - RNA, 23 nt, Human
uuucauuuauucuuugcaguuaa

SEQ ID NO: 52874 - RNA, 24 nt, Human
uuugguaaauguagaauguaaugg

SEQ ID NO: 52875 - RNA, 22 nt, Human
aaaaaauaacaggacaaaagca

SEQ ID NO: 52876 - RNA, 18 nt, Human
aaauacaccuggugccga

SEQ ID NO: 52877 - RNA, 22 nt, Human
aacaaucuggaacucucaucuc

SEQ ID NO: 52878 - RNA, 18 nt, Human
aaugcucauuugguagug

SEQ ID NO: 52879 - RNA, 23 nt, Human
acacuauaucaaauacaccuggu

SEQ ID NO: 52880 - RNA, 20 nt, Human
agcuaggugggcaguggugc

SEQ ID NO: 52881 - RNA, 19 nt, Human
agcuguggagccuuuggac

SEQ ID NO: 52882 - RNA, 19 nt, Human
agcuguggagccuuuggac

SEQ ID NO: 52883 - RNA, 23 nt, Human
aggaaagaaaagcuuuuguucag

SEQ ID NO: 52884 - RNA, 21 nt, Human
aggaaggcauacuuuaugaua

SEQ ID NO: 52885 - RNA, 21 nt, Human
aggacaaaagcaggcuaggga

SEQ ID NO: 52886 - RNA, 23 nt, Human
aggagcagguccccagaugaaca

SEQ ID NO: 52887 - RNA, 18 nt, Human
aggccaggacagcuaggu

SEQ ID NO: 52888 - RNA, 19 nt, Human
auaaaaaauaacaggacaa

SEQ ID NO: 52889 - RNA, 18 nt, Human
auauacauauauauauau

SEQ ID NO: 52890 - RNA, 18 nt, Human
auauacauauauauauau

SEQ ID NO: 52891 - RNA, 19 nt, Human
auauagauauacauauaua

SEQ ID NO: 52892 - RNA, 19 nt, Human
auauagauauacauauaua

SEQ ID NO: 52893 - RNA, 20 nt, Human
aucaaauacacccgcgcccc

SEQ ID NO: 52894 - RNA, 26 nt, Human
caccgaaugugguacagccacacucu

SEQ ID NO: 52895 - RNA, 26 nt, Human
cacuauaucaaauacacccgcgcccc

SEQ ID NO: 52896 - RNA, 21 nt, Human
cacuauaucaaauacaccucc

SEQ ID NO: 52897 - RNA, 21 nt, Human
cacuauaucaaauacaccucc

SEQ ID NO: 52898 - RNA, 22 nt, Human
cacucgcuggguccgcuccagc

SEQ ID NO: 52899 - RNA, 22 nt, Human
cacucugaggugaaggucagca

SEQ ID NO: 52900 - RNA, 22 nt, Human
caggaaggcauacuuuaugaua

SEQ ID NO: 52901 - RNA, 21 nt, Human
cagguccccagaugaacaugg

SEQ ID NO: 52902 - RNA, 19 nt, Human
ccccagaugaacauggcug

SEQ ID NO: 52903 - RNA, 22 nt, Human
ccgcccgccgccucggcguccc

SEQ ID NO: 52904 - RNA, 21 nt, Human
ccgccucggcgucccggcugu

SEQ ID NO: 52905 - RNA, 18 nt, Human
ccgcgccccgggcgcugc

SEQ ID NO: 52906 - RNA, 18 nt, Human
ccgcggcccggcagagcu

SEQ ID NO: 52907 - RNA, 19 nt, Human
cgccgcggcccggcagagc

SEQ ID NO: 52908 - RNA, 20 nt, Human
cgcuggaaucauuggcgagg

SEQ ID NO: 52909 - RNA, 18 nt, Human
cucgcuggguccgcucca

SEQ ID NO: 52910 - RNA, 26 nt, Human
cucuugcuccuucuuucagggccgcc

SEQ ID NO: 52911 - RNA, 19 nt, Human
cugccugggguccuggcug

SEQ ID NO: 52912 - RNA, 19 nt, Human
cugcugccugggguccugg

SEQ ID NO: 52913 - RNA, 22 nt, Human
cuugcaauggcaugcccuccuc

SEQ ID NO: 52914 - RNA, 19 nt, Human
gaagugcugcagaggaaug

SEQ ID NO: 52915 - RNA, 18 nt, Human
gaaucauuggcgaggagg

SEQ ID NO: 52916 - RNA, 23 nt, Human
gagcagguccccagaugaacaug

SEQ ID NO: 52917 - RNA, 21 nt, Human
gagcugcuagcggcgcgccgg

SEQ ID NO: 52918 - RNA, 21 nt, Human
gaguuauucagauaaaaaccc

SEQ ID NO: 52919 - RNA, 18 nt, Human
gcacgaaaacuuuacugc

SEQ ID NO: 52920 - RNA, 23 nt, Human
gcagagcugcuagcggcgcgccg

SEQ ID NO: 52921 - RNA, 27 nt, Human
gcccucacucgcuggguccgcuccagc

SEQ ID NO: 52922 - RNA, 18 nt, Human
gccgcggcccggcagagc

SEQ ID NO: 52923 - RNA, 18 nt, Human
gcggcgcgccgguccaga

SEQ ID NO: 52924 - RNA, 23 nt, Human
ggaauguucucuugcuccuucuu

SEQ ID NO: 52925 - RNA, 18 nt, Human
ggacaaaagcaggcuagg

SEQ ID NO: 52926 - RNA, 19 nt, Human
ggacaaaagcaggcuaggg

SEQ ID NO: 52927 - RNA, 22 nt, Human
ggcagagcugcuagcggcgcgc

SEQ ID NO: 52928 - RNA, 20 nt, Human
ggcgaggaggcagcuccgaa

SEQ ID NO: 52929 - RNA, 19 nt, Human
gggcacaggccaggacagc

SEQ ID NO: 52930 - RNA, 22 nt, Human
guccugucacucgcugcugccu

SEQ ID NO: 52931 - RNA, 22 nt, Human
uaaaaaauaacaggacaaaagc

SEQ ID NO: 52932 - RNA, 23 nt, Human
uaaaauuucucaaaucaacacau

SEQ ID NO: 52933 - RNA, 21 nt, Human
uaacaggacaaaagcaggcua

SEQ ID NO: 52934 - RNA, 22 nt, Human
uacaccgaaugugguacagcca

SEQ ID NO: 52935 - RNA, 22 nt, Human
uacagccacacucugaggugaa

SEQ ID NO: 52936 - RNA, 19 nt, Human
uacauauauauauaugugu

SEQ ID NO: 52937 - RNA, 22 nt, Human
uaccacaaacuauauacacuuc

SEQ ID NO: 52938 - RNA, 25 nt, Human
uagauauacauauauauauaugugu

SEQ ID NO: 52939 - RNA, 18 nt, Human
uauacauauauauauaug

SEQ ID NO: 52940 - RNA, 19 nt, Human
uauacauauauauauaugu

SEQ ID NO: 52941 - RNA, 20 nt, Human
uauacauauauauauaugug

SEQ ID NO: 52942 - RNA, 23 nt, Human
uauauauauguguagaauauaua

SEQ ID NO: 52943 - RNA, 22 nt, Human
uauaucaaauacacccgcgccc

SEQ ID NO: 52944 - RNA, 25 nt, Human
uauaucaaauacaccuccucugagc

SEQ ID NO: 52945 - RNA, 25 nt, Human
uauaucaaauacaccuccucugagc

SEQ ID NO: 52946 - RNA, 22 nt, Human
uauaucaaauacaccuggugcc

SEQ ID NO: 52947 - RNA, 24 nt, Human
ucccgcccgccgccucggcguccc

SEQ ID NO: 52948 - RNA, 19 nt, Human
uccugucacucgcugcugc

SEQ ID NO: 52949 - RNA, 20 nt, Human
ucgcuggguccgcuccagcc

SEQ ID NO: 52950 - RNA, 22 nt, Human
ucgcuggguccgcuccagccgc

SEQ ID NO: 52951 - RNA, 26 nt, Human
ucucuugcaauggcaugcccuccucu

SEQ ID NO: 52952 - RNA, 23 nt, Human
ucucuugcuccuucuuucacaaa

SEQ ID NO: 52953 - RNA, 27 nt, Human
ucucuugcuccuucuuucagggccgcc

SEQ ID NO: 52954 - RNA, 20 nt, Human
ugacuugugauucauuuucu

SEQ ID NO: 52955 - RNA, 20 nt, Human
ugacuugugauucauuuucu

SEQ ID NO: 52956 - RNA, 21 nt, Human
ugaggugaaggucagcauugg

SEQ ID NO: 52957 - RNA, 24 nt, Human
ugauauauaaucuuuuuaccacaa

SEQ ID NO: 52958 - RNA, 23 nt, Human
ugcugggcacacagauccuauug

SEQ ID NO: 52959 - RNA, 20 nt, Human
uggaaucauuggcgaggagg

SEQ ID NO: 52960 - RNA, 18 nt, Human
uggcugagcauucucuug

SEQ ID NO: 52961 - RNA, 18 nt, Human
ugggguccuggcugucag

SEQ ID NO: 52962 - RNA, 20 nt, Human
ugggguccuggcugucaggg

SEQ ID NO: 52963 - RNA, 24 nt, Human
ugggucgaauuuguugcaaacacu

SEQ ID NO: 52964 - RNA, 24 nt, Human
ugggucgaauuuguugcaaacacu

SEQ ID NO: 52965 - RNA, 24 nt, Human
ugggucgaauuuguugcaaacacu

SEQ ID NO: 52966 - RNA, 24 nt, Human
ugggucgaauuuguugcaaacacu

SEQ ID NO: 52967 - RNA, 24 nt, Human
ugggucgaauuuguugcaaacacu

SEQ ID NO: 52968 - RNA, 22 nt, Human
uguacaaaaugugcaguaccag

SEQ ID NO: 52969 - RNA, 23 nt, Human
uguacaaaaugugcaguaccagg

SEQ ID NO: 52970 - RNA, 19 nt, Human
ugucaaauaucaaacccgc

SEQ ID NO: 52971 - RNA, 21 nt, Human
ugucuuguugcaaaaggaaag

SEQ ID NO: 52972 - RNA, 22 nt, Human
uuaaaguaaauauaacuuugcc

SEQ ID NO: 52973 - RNA, 22 nt, Human
uucagauaaaaacccagccauu

SEQ ID NO: 52974 - RNA, 22 nt, Human
uucucaaaucaacacauucauc

SEQ ID NO: 52975 - RNA, 20 nt, Human
uuuuggcaguguaaaccuau

SEQ ID NO: 52976 - RNA, 24 nt, Human
acugcagcucauuuggaaggcacu

SEQ ID NO: 52977 - RNA, 19 nt, Human
agggaaaagggcugccugg

SEQ ID NO: 52978 - RNA, 23 nt, Human
cacccaaccugccgcucgggaac

SEQ ID NO: 52979 - RNA, 18 nt, Human
caguggcuuuccuguccu

SEQ ID NO: 52980 - RNA, 26 nt, Human
ccaaagccuggaauauuucccagcag

SEQ ID NO: 52981 - RNA, 19 nt, Human
ccacuggagggaaaagggc

SEQ ID NO: 52982 - RNA, 19 nt, Human
cccaaccugccgcucggga

SEQ ID NO: 52983 - RNA, 22 nt, Human
ccucccgggcugggucaguggc

SEQ ID NO: 52984 - RNA, 24 nt, Human
ccuggggcugcacuggccuuggcc

SEQ ID NO: 52985 - RNA, 22 nt, Human
cucccgggcugggucaguggcu

SEQ ID NO: 52986 - RNA, 21 nt, Human
cugccugguucugccucccgg

SEQ ID NO: 52987 - RNA, 22 nt, Human
cugccugguucugccucccggg

SEQ ID NO: 52988 - RNA, 18 nt, Human
cuggggcugcacuggccu

SEQ ID NO: 52989 - RNA, 23 nt, Human
gaggugagaggugaggauuggug

SEQ ID NO: 52990 - RNA, 20 nt, Human
gaggugccacuggagggaaa

SEQ ID NO: 52991 - RNA, 20 nt, Human
gcaugggacaggugugugcc

SEQ ID NO: 52992 - RNA, 18 nt, Human
gccuggggccagggaggc

SEQ ID NO: 52993 - RNA, 18 nt, Human
gccugguucugccucccg

SEQ ID NO: 52994 - RNA, 18 nt, Human
gcugcacuggccuuggcc

SEQ ID NO: 52995 - RNA, 22 nt, Human
ggaaaagggcugccuggggcca

SEQ ID NO: 52996 - RNA, 19 nt, Human
ggaggaccuugcagggucu

SEQ ID NO: 52997 - RNA, 19 nt, Human
ggccuggggacugcagcuc

SEQ ID NO: 52998 - RNA, 19 nt, Human
ggccuuggccaaagccugg

SEQ ID NO: 52999 - RNA, 20 nt, Human
ucaguggcuuuccugucccc

SEQ ID NO: 53000 - RNA, 24 nt, Human
ucccgggaggcucauggccugggg

SEQ ID NO: 53001 - RNA, 21 nt, Human
uccgcacccaaccugccgcuc

SEQ ID NO: 53002 - RNA, 21 nt, Human
ugcacuggccuuggccaaagc

SEQ ID NO: 53003 - RNA, 19 nt, Human
uggggccagggaggcugcc

SEQ ID NO: 53004 - RNA, 19 nt, Human
uuccuguccccaggccugg

SEQ ID NO: 53005 - RNA, 22 nt, Human
uuccuguccccaggccuggagg

SEQ ID NO: 53006 - RNA, 18 nt, Human
aagaggguacucuguucc

SEQ ID NO: 53007 - RNA, 20 nt, Human
aaggaaggacugacuuagug

SEQ ID NO: 53008 - RNA, 23 nt, Human
acccaggguugugaaaggaaccc

SEQ ID NO: 53009 - RNA, 20 nt, Human
accccuguaaaacagggacu

SEQ ID NO: 53010 - RNA, 19 nt, Human
aggaaaauucaaacaacag

SEQ ID NO: 53011 - RNA, 19 nt, Human
aggcaccaagauuuuuauu

SEQ ID NO: 53012 - RNA, 18 nt, Human
agggacuaaaaguacuaa

SEQ ID NO: 53013 - RNA, 19 nt, Human
agggacuaaaaguacuaac

SEQ ID NO: 53014 - RNA, 18 nt, Human
agggaggagagguggggc

SEQ ID NO: 53015 - RNA, 21 nt, Human
caagcacacagguauaagucc

SEQ ID NO: 53016 - RNA, 20 nt, Human
caaggacagcagcuggaggg

SEQ ID NO: 53017 - RNA, 19 nt, Human
cacugagcucaugguuccc

SEQ ID NO: 53018 - RNA, 19 nt, Human
cacuggaccuguaaaccaa

SEQ ID NO: 53019 - RNA, 20 nt, Human
ccagcacuaagccaggcucu

SEQ ID NO: 53020 - RNA, 23 nt, Human
ccagucacaaaguuggugccauu

SEQ ID NO: 53021 - RNA, 19 nt, Human
cuaaaaguacuaaccucau

SEQ ID NO: 53022 - RNA, 18 nt, Human
cucaugguucccuguggc

SEQ ID NO: 53023 - RNA, 21 nt, Human
cucuguucuuucucaguugcc

SEQ ID NO: 53024 - RNA, 26 nt, Human
cugcagcagaggccaaaaacuaagug

SEQ ID NO: 53025 - RNA, 18 nt, Human
cugucacuucucuguucu

SEQ ID NO: 53026 - RNA, 20 nt, Human
gcccagcacuaagccaggcu

SEQ ID NO: 53027 - RNA, 22 nt, Human
gccccucucaaccccuagcugu

SEQ ID NO: 53028 - RNA, 21 nt, Human
ggacacugacaaaccagucac

SEQ ID NO: 53029 - RNA, 21 nt, Human
ggaggagagguggggccuggg

SEQ ID NO: 53030 - RNA, 20 nt, Human
ggagggugaaacgcagaccu

SEQ ID NO: 53031 - RNA, 20 nt, Human
gggcgaagggggcugggccu

SEQ ID NO: 53032 - RNA, 19 nt, Human
gugaucagccccagagagu

SEQ ID NO: 53033 - RNA, 23 nt, Human
guggcagauuucacgaaaucugc

SEQ ID NO: 53034 - RNA, 24 nt, Human
uaaccccuguaaaacagggacuaa

SEQ ID NO: 53035 - RNA, 22 nt, Human
uaagccaggcucucaggaaaau

SEQ ID NO: 53036 - RNA, 19 nt, Human
uaaguccacagaccaggug

SEQ ID NO: 53037 - RNA, 23 nt, Human
uaaugagguuuaagagaaggccc

SEQ ID NO: 53038 - RNA, 23 nt, Human
uagcugucacuucucuguucuuu

SEQ ID NO: 53039 - RNA, 20 nt, Human
uagggaggagagguggggcc

SEQ ID NO: 53040 - RNA, 23 nt, Human
ucagccccagagagucgaugggg

SEQ ID NO: 53041 - RNA, 21 nt, Human
uccacagaccaggugaaggcc

SEQ ID NO: 53042 - RNA, 21 nt, Human
ucccuguggcugggaccucca

SEQ ID NO: 53043 - RNA, 21 nt, Human
ucucuguucuuucucaguugc

SEQ ID NO: 53044 - RNA, 19 nt, Human
ucugguuauaaaguggugg

SEQ ID NO: 53045 - RNA, 23 nt, Human
ugaccggggcuugaagaggguac

SEQ ID NO: 53046 - RNA, 20 nt, Human
ugagcuguuccaagaccacu

SEQ ID NO: 53047 - RNA, 18 nt, Human
ugagguuuaagagaaggc

SEQ ID NO: 53048 - RNA, 24 nt, Human
uggaacaguaugacggcugcagca

SEQ ID NO: 53049 - RNA, 19 nt, Human
uggaccuguaaaccaagca

SEQ ID NO: 53050 - RNA, 18 nt, Human
uggagggugaaacgcaga

SEQ ID NO: 53051 - RNA, 23 nt, Human
uguaaaacagggacuaaaaguac

SEQ ID NO: 53052 - RNA, 24 nt, Human
ugugacuccacuacuggcuuccag

SEQ ID NO: 53053 - RNA, 19 nt, Human
uguuuuucuggccccucuc

SEQ ID NO: 53054 - RNA, 22 nt, Human
uuaacagucuauucuaaccccu

SEQ ID NO: 53055 - RNA, 24 nt, Human
uuggugccauuagcucuuagggag

SEQ ID NO: 53056 - RNA, 23 nt, Human
uuuucuggccccucucaaccccu

SEQ ID NO: 53057 - RNA, 23 nt, Human
aaaaaaccuaaaguuugaaggua

SEQ ID NO: 53058 - RNA, 18 nt, Human
aaaaagccuauuuuccac

SEQ ID NO: 53059 - RNA, 23 nt, Human
aagauugugccacugcacuccag

SEQ ID NO: 53060 - RNA, 21 nt, Human
aaguuugaagguaaacgaacu

SEQ ID NO: 53061 - RNA, 24 nt, Human
aaucacuugaacccaggagguaga

SEQ ID NO: 53062 - RNA, 19 nt, Human
acccuuucuaucuugacug

SEQ ID NO: 53063 - RNA, 22 nt, Human
acgcaggcuuccgcagcccgcg

SEQ ID NO: 53064 - RNA, 21 nt, Human
acuaauuuaauccaaaaacca

SEQ ID NO: 53065 - RNA, 28 nt, Human
acucucucucaaaaaaaaaaaaaaaaaa

SEQ ID NO: 53066 - RNA, 24 nt, Human
acugcacuccaguuugggcggcag

SEQ ID NO: 53067 - RNA, 26 nt, Human
acugcacuccaguuugggcggcagag

SEQ ID NO: 53068 - RNA, 24 nt, Human
acugccucccgccgccgcgcgcac

SEQ ID NO: 53069 - RNA, 18 nt, Human
agaaaaaaaugugaggca

SEQ ID NO: 53070 - RNA, 21 nt, Human
agaauccaguagcucaaaacu

SEQ ID NO: 53071 - RNA, 22 nt, Human
agagguugcagugagccaagau

SEQ ID NO: 53072 - RNA, 24 nt, Human
agagguugcagugagccaagauug

SEQ ID NO: 53073 - RNA, 21 nt, Human
agccaagauugugccacugca

SEQ ID NO: 53074 - RNA, 20 nt, Human
agcccgcgccaguacaggug

SEQ ID NO: 53075 - RNA, 18 nt, Human
agccucccgaguagcuag

SEQ ID NO: 53076 - RNA, 22 nt, Human
aggagccugggccgucuauuua

SEQ ID NO: 53077 - RNA, 18 nt, Human
aggcaagagaaucacuug

SEQ ID NO: 53078 - RNA, 24 nt, Human
aggcaagagaaucacuugaaccca

SEQ ID NO: 53079 - RNA, 24 nt, Human
aggcugaggcaagagaaucacuug

SEQ ID NO: 53080 - RNA, 25 nt, Human
aggcuggagugcaguggggcgaucu

SEQ ID NO: 53081 - RNA, 24 nt, Human
agguagagguugcagugagccaag

SEQ ID NO: 53082 - RNA, 22 nt, Human
agugcaguggggcgaucuuggc

SEQ ID NO: 53083 - RNA, 25 nt, Human
agugcaguggggcgaucuuggcccu

SEQ ID NO: 53084 - RNA, 24 nt, Human
aguuuuguauauuuuguggugccc

SEQ ID NO: 53085 - RNA, 19 nt, Human
auaaaguauguaaagcccc

SEQ ID NO: 53086 - RNA, 18 nt, Human
augaagaucaguauauca

SEQ ID NO: 53087 - RNA, 20 nt, Human
augcccgcaaucccagcaac

SEQ ID NO: 53088 - RNA, 23 nt, Human
auguuaggacaguaaaguuggua

SEQ ID NO: 53089 - RNA, 19 nt, Human
auuauaucuauacaaugca

SEQ ID NO: 53090 - RNA, 18 nt, Human
auucuccugccucagccu

SEQ ID NO: 53091 - RNA, 24 nt, Human
auugugccacugcacuccaguuug

SEQ ID NO: 53092 - RNA, 21 nt, Human
caacucgggaggcugaggcaa

SEQ ID NO: 53093 - RNA, 19 nt, Human
cacgguggcgccgcgcccc

SEQ ID NO: 53094 - RNA, 23 nt, Human
cacucauuacaauacuuugcacc

SEQ ID NO: 53095 - RNA, 23 nt, Human
cacuccaguuugggcggcagagu

SEQ ID NO: 53096 - RNA, 19 nt, Human
cacugcacuccaguuuggg

SEQ ID NO: 53097 - RNA, 20 nt, Human
cacugcacuccaguuugggc

SEQ ID NO: 53098 - RNA, 22 nt, Human
cacugcacuccaguuugggcgg

SEQ ID NO: 53099 - RNA, 24 nt, Human
cacugcacuccaguuugggcggca

SEQ ID NO: 53100 - RNA, 23 nt, Human
cagaguaagacucucucucaaaa

SEQ ID NO: 53101 - RNA, 22 nt, Human
caggcuauucuccugccucagc

SEQ ID NO: 53102 - RNA, 22 nt, Human
caucauggagauaucaauaaag

SEQ ID NO: 53103 - RNA, 21 nt, Human
caugcccgcaaucccagcaac

SEQ ID NO: 53104 - RNA, 20 nt, Human
ccacugcacuccaguuuggg

SEQ ID NO: 53105 - RNA, 21 nt, Human
ccacugcacuccaguuugggc

SEQ ID NO: 53106 - RNA, 22 nt, Human
ccacugcacuccaguuugggcg

SEQ ID NO: 53107 - RNA, 22 nt, Human
ccacugcacuccaguuugggcg

SEQ ID NO: 53108 - RNA, 23 nt, Human
ccacugcacuccaguuugggcgg

SEQ ID NO: 53109 - RNA, 24 nt, Human
ccacugcacuccaguuugggcggc

SEQ ID NO: 53110 - RNA, 22 nt, Human
ccaggagguagagguugcagug

SEQ ID NO: 53111 - RNA, 21 nt, Human
ccaguaacauguggaagagag

SEQ ID NO: 53112 - RNA, 18 nt, Human
ccaugcccgcaaucccag

SEQ ID NO: 53113 - RNA, 18 nt, Human
ccccagccacugccuccc

SEQ ID NO: 53114 - RNA, 19 nt, Human
ccccagccacugccucccg

SEQ ID NO: 53115 - RNA, 24 nt, Human
cccgaguagcuaggacuacaggcu

SEQ ID NO: 53116 - RNA, 19 nt, Human
cccgggcacuggcggccgg

SEQ ID NO: 53117 - RNA, 23 nt, Human
cccugcaaccuccgauucccagg

SEQ ID NO: 53118 - RNA, 19 nt, Human
cccuguucugagcuggcgg

SEQ ID NO: 53119 - RNA, 18 nt, Human
ccgcgagcaaggcggcgc

SEQ ID NO: 53120 - RNA, 23 nt, Human
ccgcgccucaacgccucggcuca

SEQ ID NO: 53121 - RNA, 23 nt, Human
ccgguguaggcugggaccacugc

SEQ ID NO: 53122 - RNA, 19 nt, Human
ccgugaccgucgccgcggc

SEQ ID NO: 53123 - RNA, 20 nt, Human
ccucccgccgccgcgcgcac

SEQ ID NO: 53124 - RNA, 23 nt, Human
ccugccucagccucccgaguagc

SEQ ID NO: 53125 - RNA, 20 nt, Human
ccugggccuggcgcagugag

SEQ ID NO: 53126 - RNA, 21 nt, Human
cgaaauuuauaaagucaacac

SEQ ID NO: 53127 - RNA, 20 nt, Human
cgccccgugaccgucgccgc

SEQ ID NO: 53128 - RNA, 20 nt, Human
cggagacccgcgagcaaggc

SEQ ID NO: 53129 - RNA, 24 nt, Human
cggcagaguaagacucucucucaa

SEQ ID NO: 53130 - RNA, 18 nt, Human
cggcugcucccagcuucc

SEQ ID NO: 53131 - RNA, 22 nt, Human
cuaaacaauuuauccaguaaca

SEQ ID NO: 53132 - RNA, 25 nt, Human
cucaaaaaaaaaaaaaaaaaaagaa

SEQ ID NO: 53133 - RNA, 19 nt, Human
cucaacgccucggcucacg

SEQ ID NO: 53134 - RNA, 24 nt, Human
cucagagauauuuuguccgaagcc

SEQ ID NO: 53135 - RNA, 22 nt, Human
cucauuacaauacuuugcacca

SEQ ID NO: 53136 - RNA, 23 nt, Human
cucauuacaauacuuugcaccaa

SEQ ID NO: 53137 - RNA, 24 nt, Human
cucccgaguagcuaggacuacagg

SEQ ID NO: 53138 - RNA, 20 nt, Human
cucccgccgccgcgcgcacc

SEQ ID NO: 53139 - RNA, 18 nt, Human
cucucucaaaaaaaaaaa

SEQ ID NO: 53140 - RNA, 23 nt, Human
cugccucagccucccgaguagcu

SEQ ID NO: 53141 - RNA, 21 nt, Human
cugcucccgggacuucccaaa

SEQ ID NO: 53142 - RNA, 23 nt, Human
gagaaucacuugaacccaggagg

SEQ ID NO: 53143 - RNA, 20 nt, Human
gaggcggcccgggcggagga

SEQ ID NO: 53144 - RNA, 21 nt, Human
gagguagagguugcagugagc

SEQ ID NO: 53145 - RNA, 26 nt, Human
gaguagcuaggacuacaggcucacgc

SEQ ID NO: 53146 - RNA, 22 nt, Human
gcaaccuccgauucccagguuc

SEQ ID NO: 53147 - RNA, 22 nt, Human
gcaagagaaucacuugaaccca

SEQ ID NO: 53148 - RNA, 22 nt, Human
gcacccuuucuaucuugacugu

SEQ ID NO: 53149 - RNA, 23 nt, Human
gcacuccaguuugggcggcagag

SEQ ID NO: 53150 - RNA, 23 nt, Human
gccaccaugcccgcaaucccagg

SEQ ID NO: 53151 - RNA, 22 nt, Human
gccacugcacuccaguuugggc

SEQ ID NO: 53152 - RNA, 24 nt, Human
gccacugcacuccaguuugggcgg

SEQ ID NO: 53153 - RNA, 22 nt, Human
gcccgcaggugaggcggcccgg

SEQ ID NO: 53154 - RNA, 19 nt, Human
gcgccgcgccucaacgccu

SEQ ID NO: 53155 - RNA, 23 nt, Human
ggacaguaaaguugguaggguga

SEQ ID NO: 53156 - RNA, 22 nt, Human
ggacuacaggcucacgccacca

SEQ ID NO: 53157 - RNA, 20 nt, Human
ggcggccggguccccggaac

SEQ ID NO: 53158 - RNA, 19 nt, Human
gggaggcugaggcaagaga

SEQ ID NO: 53159 - RNA, 23 nt, Human
gggaggcugaggcaagagaauca

SEQ ID NO: 53160 - RNA, 27 nt, Human
gggccaccagucccggcugcucccagg

SEQ ID NO: 53161 - RNA, 21 nt, Human
gggcggaggaggagccugggc

SEQ ID NO: 53162 - RNA, 19 nt, Human
ggggcgaucuuggcccugc

SEQ ID NO: 53163 - RNA, 18 nt, Human
gguauggacuuuuuaaaa

SEQ ID NO: 53164 - RNA, 21 nt, Human
ggugcuuugcuuaauuaaaaa

SEQ ID NO: 53165 - RNA, 21 nt, Human
gugauuuuauuauucuuagau

SEQ ID NO: 53166 - RNA, 19 nt, Human
gugcuuugcuuaauuaaaa

SEQ ID NO: 53167 - RNA, 22 nt, Human
uaaaaagccuauuuuccacuaa

SEQ ID NO: 53168 - RNA, 20 nt, Human
uaaacucccuuuucuaaaag

SEQ ID NO: 53169 - RNA, 24 nt, Human
uaaagguaaagagugguauauuua

SEQ ID NO: 53170 - RNA, 21 nt, Human
uaacaugauaggaaaaacuag

SEQ ID NO: 53171 - RNA, 18 nt, Human
uaacuguauaacugauug

SEQ ID NO: 53172 - RNA, 21 nt, Human
uaagaauccaguagcucaaaa

SEQ ID NO: 53173 - RNA, 23 nt, Human
uaauaagaauccaguagcucaaa

SEQ ID NO: 53174 - RNA, 19 nt, Human
uaauaccaacuuuaagcag

SEQ ID NO: 53175 - RNA, 24 nt, Human
uacaaugcaccauucaauucacuc

SEQ ID NO: 53176 - RNA, 19 nt, Human
uacacagaacucagagaua

SEQ ID NO: 53177 - RNA, 22 nt, Human
uaccucaccacuccguggcagc

SEQ ID NO: 53178 - RNA, 19 nt, Human
uagaauccuggccuggguc

SEQ ID NO: 53179 - RNA, 24 nt, Human
uaggacuacaggcucacgccacca

SEQ ID NO: 53180 - RNA, 20 nt, Human
uauauaaaauauacauccua

SEQ ID NO: 53181 - RNA, 19 nt, Human
uauguaaagccccaacaaa

SEQ ID NO: 53182 - RNA, 25 nt, Human
ucaaaaaaaaaaaaaaaaaaagaau

SEQ ID NO: 53183 - RNA, 20 nt, Human
ucaaauaugagaaaaacaca

SEQ ID NO: 53184 - RNA, 23 nt, Human
uccacuguucuaagaagcgaaau

SEQ ID NO: 53185 - RNA, 18 nt, Human
uccaguuugggcggcaga

SEQ ID NO: 53186 - RNA, 19 nt, Human
ucccagguucaggcuauuc

SEQ ID NO: 53187 - RNA, 21 nt, Human
ucccagguucaggcuauucuc

SEQ ID NO: 53188 - RNA, 24 nt, Human
ucccagguucaggcuauucuccug

SEQ ID NO: 53189 - RNA, 24 nt, Human
ucccgaguagcuaggacuacaggc

SEQ ID NO: 53190 - RNA, 19 nt, Human
ucccugauaaaguuuugua

SEQ ID NO: 53191 - RNA, 25 nt, Human
ucgggaggcugaggcaagagaauca

SEQ ID NO: 53192 - RNA, 22 nt, Human
ucuagaccucuggucuaaaucc

SEQ ID NO: 53193 - RNA, 21 nt, Human
ucuauugccaggcuggagugc

SEQ ID NO: 53194 - RNA, 23 nt, Human
ucuauugccaggcuggagugcag

SEQ ID NO: 53195 - RNA, 24 nt, Human
ucuccugccucagccucccgagua

SEQ ID NO: 53196 - RNA, 23 nt, Human
ucucucucaaaaaaaaaaaaaaa

SEQ ID NO: 53197 - RNA, 21 nt, Human
ucugagcuggcgguccggggc

SEQ ID NO: 53198 - RNA, 25 nt, Human
ugaaaauacacagaacucagagaua

SEQ ID NO: 53199 - RNA, 23 nt, Human
ugaaaugggugcuuugcuuaauu

SEQ ID NO: 53200 - RNA, 22 nt, Human
ugagauaaaagcagagguuaac

SEQ ID NO: 53201 - RNA, 22 nt, Human
ugagccaagauugugccacugc

SEQ ID NO: 53202 - RNA, 18 nt, Human
ugagcugccugggccugg

SEQ ID NO: 53203 - RNA, 18 nt, Human
ugaggcaagagaaucacu

SEQ ID NO: 53204 - RNA, 20 nt, Human
ugaggcaagagaaucacuug

SEQ ID NO: 53205 - RNA, 24 nt, Human
ugaggcaagagaaucacuugaacc

SEQ ID NO: 53206 - RNA, 25 nt, Human
ugaggcaagagaaucacuugaaccc

SEQ ID NO: 53207 - RNA, 24 nt, Human
ugccacugcacuccaguuugggcg

SEQ ID NO: 53208 - RNA, 21 nt, Human
ugccaggcuggagugcagugg

SEQ ID NO: 53209 - RNA, 19 nt, Human
ugccccuguucugagcugg

SEQ ID NO: 53210 - RNA, 24 nt, Human
ugccucagccucccgaguagcuag

SEQ ID NO: 53211 - RNA, 18 nt, Human
ugccugggccuggcgcag

SEQ ID NO: 53212 - RNA, 23 nt, Human
ugccugggccuggcgcagugagg

SEQ ID NO: 53213 - RNA, 23 nt, Human
uggagugcaguggggcgaucuug

SEQ ID NO: 53214 - RNA, 24 nt, Human
uggagugcaguggggcgaucuugg

SEQ ID NO: 53215 - RNA, 24 nt, Human
uggauucauuacuugauuucuuag

SEQ ID NO: 53216 - RNA, 28 nt, Human
uggcagcacccuuucuaucuugacuggu

SEQ ID NO: 53217 - RNA, 20 nt, Human
ugggcggcagaguaagacuc

SEQ ID NO: 53218 - RNA, 19 nt, Human
uggggcgaucuuggcccug

SEQ ID NO: 53219 - RNA, 22 nt, Human
ugguaaugaagaucaguauauc

SEQ ID NO: 53220 - RNA, 19 nt, Human
uggucuaaauccuuagaua

SEQ ID NO: 53221 - RNA, 22 nt, Human
ugugccacugcacuccaguuug

SEQ ID NO: 53222 - RNA, 19 nt, Human
uuaaaauaugccugaauua

SEQ ID NO: 53223 - RNA, 22 nt, Human
uuaauuuaaaaaagaaaaagaa

SEQ ID NO: 53224 - RNA, 21 nt, Human
uucaggcuauucuccugccuc

SEQ ID NO: 53225 - RNA, 22 nt, Human
uugcagugagccaagauugugc

SEQ ID NO: 53226 - RNA, 20 nt, Human
uuguauuuggggaacuaaua

SEQ ID NO: 53227 - RNA, 23 nt, Human
uuuaaagacaauuuauacacauu

SEQ ID NO: 53228 - RNA, 20 nt, Human
uuuaaauguaaaaauagagu

SEQ ID NO: 53229 - RNA, 24 nt, Human
uuuuccauaauccuucacaaacua

SEQ ID NO: 53230 - RNA, 19 nt, Human
aaccagaggcagagaacac

SEQ ID NO: 53231 - RNA, 21 nt, Human
aaccagaggcagagaacacaa

SEQ ID NO: 53232 - RNA, 18 nt, Human
aaccuccucaucucugcc

SEQ ID NO: 53233 - RNA, 21 nt, Human
aaggccccccacccaugccca

SEQ ID NO: 53234 - RNA, 24 nt, Human
acaguuccaaugguuuuuguaagg

SEQ ID NO: 53235 - RNA, 20 nt, Human
acccacucugcuucuguccu

SEQ ID NO: 53236 - RNA, 18 nt, Human
aggcaggcgugcaggugg

SEQ ID NO: 53237 - RNA, 20 nt, Human
caaggccccccacccaugcc

SEQ ID NO: 53238 - RNA, 21 nt, Human
cacucugcuucuguccuguga

SEQ ID NO: 53239 - RNA, 24 nt, Human
cacuugcguggccagcagacaagg

SEQ ID NO: 53240 - RNA, 19 nt, Human
cagcagacaaggcccccca

SEQ ID NO: 53241 - RNA, 27 nt, Human
cagcagacaaggccccccacccaugcc

SEQ ID NO: 53242 - RNA, 18 nt, Human
cauuaacaggcacauaua

SEQ ID NO: 53243 - RNA, 21 nt, Human
ccaaaccuccucaucucugcc

SEQ ID NO: 53244 - RNA, 19 nt, Human
ccaaugguuuuuguaaggu

SEQ ID NO: 53245 - RNA, 19 nt, Human
ccccccacccaugcccagg

SEQ ID NO: 53246 - RNA, 18 nt, Human
gagaggcccuggcaggca

SEQ ID NO: 53247 - RNA, 20 nt, Human
gcaggcgugcaggugguugg

SEQ ID NO: 53248 - RNA, 18 nt, Human
gccagcagacaaggcccc

SEQ ID NO: 53249 - RNA, 19 nt, Human
uccaaugguuuuuguaagg

SEQ ID NO: 53250 - RNA, 20 nt, Human
uccaaugguuuuuguaaggu

SEQ ID NO: 53251 - RNA, 18 nt, Human
ucugugccaaaccuccuc

SEQ ID NO: 53252 - RNA, 25 nt, Human
ugacaaguugucaaccuaaugccuu

SEQ ID NO: 53253 - RNA, 20 nt, Human
ugccccagagaggcccuggc

SEQ ID NO: 53254 - RNA, 21 nt, Human
uggcaggcaggcgugcaggug

SEQ ID NO: 53255 - RNA, 21 nt, Human
ugucaaacauaaccaccaccc

SEQ ID NO: 53256 - RNA, 21 nt, Human
uucauuaacaggcacauauaa

SEQ ID NO: 53257 - RNA, 19 nt, Human
uugucaaccuaaugccuuc

SEQ ID NO: 53258 - RNA, 20 nt, Human
aaaaacagagaagacuugaa

SEQ ID NO: 53259 - RNA, 18 nt, Human
aaacucuaagaaagugag

SEQ ID NO: 53260 - RNA, 24 nt, Human
aaagugcugggauuacaggcguga

SEQ ID NO: 53261 - RNA, 22 nt, Human
aacaugcuucugcugauuaaaa

SEQ ID NO: 53262 - RNA, 20 nt, Human
aagaauaaaaacagagaaga

SEQ ID NO: 53263 - RNA, 21 nt, Human
aagagacccacgagagccaau

SEQ ID NO: 53264 - RNA, 22 nt, Human
aagagacccacgagagccaaua

SEQ ID NO: 53265 - RNA, 22 nt, Human
aaguagcugggauuacaggugc

SEQ ID NO: 53266 - RNA, 19 nt, Human
aagugcugggauuacaggc

SEQ ID NO: 53267 - RNA, 19 nt, Human
aagugcugggauuacaggc

SEQ ID NO: 53268 - RNA, 26 nt, Human
aagugcugggauuacaggcgugagcc

SEQ ID NO: 53269 - RNA, 18 nt, Human
acacacauacaaaaugua

SEQ ID NO: 53270 - RNA, 24 nt, Human
acacacauacaaaauguagcaaac

SEQ ID NO: 53271 - RNA, 18 nt, Human
accacgccuggcuaauuu

SEQ ID NO: 53272 - RNA, 18 nt, Human
accuccauccccacccau

SEQ ID NO: 53273 - RNA, 18 nt, Human
acgggguuuugccauguu

SEQ ID NO: 53274 - RNA, 23 nt, Human
acgggguuuugccauguuggcca

SEQ ID NO: 53275 - RNA, 24 nt, Human
acgggguuuugccauguuggccag

SEQ ID NO: 53276 - RNA, 21 nt, Human
acugcaaccuccaccuccugg

SEQ ID NO: 53277 - RNA, 21 nt, Human
acugcaaccuccaccuccugg

SEQ ID NO: 53278 - RNA, 22 nt, Human
acugcaaccuccaccuccuggg

SEQ ID NO: 53279 - RNA, 24 nt, Human
acugcaaccuccaccuccuggguu

SEQ ID NO: 53280 - RNA, 26 nt, Human
acugcaauguuacaauuacauacguu

SEQ ID NO: 53281 - RNA, 21 nt, Human
agaaagugagaguugaagaau

SEQ ID NO: 53282 - RNA, 18 nt, Human
agacaggaucuuguuaug

SEQ ID NO: 53283 - RNA, 18 nt, Human
agagacccacgagagcca

SEQ ID NO: 53284 - RNA, 21 nt, Human
agcacaauuuccuugcaaugc

SEQ ID NO: 53285 - RNA, 20 nt, Human
aggaugcucccagguccugc

SEQ ID NO: 53286 - RNA, 19 nt, Human
agggauaugguuauucuga

SEQ ID NO: 53287 - RNA, 22 nt, Human
agggaucccuuauuggcuccuu

SEQ ID NO: 53288 - RNA, 24 nt, Human
aggggacaauguugcauucaaaac

SEQ ID NO: 53289 - RNA, 24 nt, Human
aggugauccgcccggcucggccuc

SEQ ID NO: 53290 - RNA, 18 nt, Human
agugcugggauuacaggc

SEQ ID NO: 53291 - RNA, 20 nt, Human
agugguguccagagugucuu

SEQ ID NO: 53292 - RNA, 22 nt, Human
aguugugcauucaaguuuuccu

SEQ ID NO: 53293 - RNA, 19 nt, Human
auguugcccaggcuggccu

SEQ ID NO: 53294 - RNA, 19 nt, Human
auuacaggugccugcuacc

SEQ ID NO: 53295 - RNA, 18 nt, Human
auuuaucauuuauuuaac

SEQ ID NO: 53296 - RNA, 24 nt, Human
caaagugcugggauuacaggcgug

SEQ ID NO: 53297 - RNA, 21 nt, Human
caaauagacaccaaaagagac

SEQ ID NO: 53298 - RNA, 23 nt, Human
caaccuccaccuccuggguucaa

SEQ ID NO: 53299 - RNA, 23 nt, Human
caaccucccaagcagcuagaacu

SEQ ID NO: 53300 - RNA, 22 nt, Human
caagcgauucuccugccucagc

SEQ ID NO: 53301 - RNA, 27 nt, Human
caagcgauucuccugccucagccuccc

SEQ ID NO: 53302 - RNA, 27 nt, Human
caagggaaaagaauagaaaaaucuauc

SEQ ID NO: 53303 - RNA, 21 nt, Human
caauaagauuaaaauaagaca

SEQ ID NO: 53304 - RNA, 18 nt, Human
cagacgggguuuugccau

SEQ ID NO: 53305 - RNA, 21 nt, Human
cagagugucuucuugccuccc

SEQ ID NO: 53306 - RNA, 24 nt, Human
caggaucuuguuauguugcccagg

SEQ ID NO: 53307 - RNA, 23 nt, Human
caggugauccgcccggcucggcc

SEQ ID NO: 53308 - RNA, 19 nt, Human
cauaaaaacaugcuucugc

SEQ ID NO: 53309 - RNA, 24 nt, Human
cauguuggccaggcuggucucaaa

SEQ ID NO: 53310 - RNA, 22 nt, Human
ccaaagugcugggauuacaggc

SEQ ID NO: 53311 - RNA, 22 nt, Human
ccaaagugcugggauuacaggc

SEQ ID NO: 53312 - RNA, 24 nt, Human
ccaaagugcugggauuacaggcgu

SEQ ID NO: 53313 - RNA, 22 nt, Human
ccaagcagcuagaacuaugagc

SEQ ID NO: 53314 - RNA, 21 nt, Human
ccaaguagcugggauuacagg

SEQ ID NO: 53315 - RNA, 23 nt, Human
ccaauagauuuuccucuccccaa

SEQ ID NO: 53316 - RNA, 24 nt, Human
ccaccuccuggguucaagcgauuc

SEQ ID NO: 53317 - RNA, 19 nt, Human
ccauguuggccaggcuggu

SEQ ID NO: 53318 - RNA, 22 nt, Human
cccaaguagcugggauuacagg

SEQ ID NO: 53319 - RNA, 23 nt, Human
cccaaguagcugggauuacaggu

SEQ ID NO: 53320 - RNA, 24 nt, Human
cccaaguagcugggauuacaggug

SEQ ID NO: 53321 - RNA, 20 nt, Human
cccggcccucucucuuucuu

SEQ ID NO: 53322 - RNA, 24 nt, Human
cccggcccucucucuuucuuuuuu

SEQ ID NO: 53323 - RNA, 24 nt, Human
cccuggccagaccuguguuccuuc

SEQ ID NO: 53324 - RNA, 19 nt, Human
ccuccaccuccuggguuca

SEQ ID NO: 53325 - RNA, 20 nt, Human
ccucccuccucaaccuccca

SEQ ID NO: 53326 - RNA, 23 nt, Human
ccucccuccucaaccucccaagc

SEQ ID NO: 53327 - RNA, 22 nt, Human
ccucccugcaagucucaggcca

SEQ ID NO: 53328 - RNA, 24 nt, Human
ccuccuggguucaagcgauucucc

SEQ ID NO: 53329 - RNA, 18 nt, Human
ccugaccacaggugaucc

SEQ ID NO: 53330 - RNA, 23 nt, Human
ccugccucagccucccaaguagc

SEQ ID NO: 53331 - RNA, 23 nt, Human
ccuggguucaagcgauucuccug

SEQ ID NO: 53332 - RNA, 22 nt, Human
cgugagccaccacgcccggccc

SEQ ID NO: 53333 - RNA, 24 nt, Human
cucagccucccaaguagcugggau

SEQ ID NO: 53334 - RNA, 26 nt, Human
cucccugcaagucucaggccagaaaa

SEQ ID NO: 53335 - RNA, 24 nt, Human
cuccucaaccucccaagcagcuag

SEQ ID NO: 53336 - RNA, 21 nt, Human
cuccuggguucaagcgauucu

SEQ ID NO: 53337 - RNA, 19 nt, Human
cucucauuaggagguccua

SEQ ID NO: 53338 - RNA, 21 nt, Human
cucuugucgcccaggcuggag

SEQ ID NO: 53339 - RNA, 18 nt, Human
cugcaaccuccaccuccu

SEQ ID NO: 53340 - RNA, 23 nt, Human
cugcaaccuccaccuccuggguu

SEQ ID NO: 53341 - RNA, 23 nt, Human
cugccucagccucccaaguagcu

SEQ ID NO: 53342 - RNA, 24 nt, Human
cugcucucauccuaccuaaaaguc

SEQ ID NO: 53343 - RNA, 24 nt, Human
cuugcucuugucgcccaggcugga

SEQ ID NO: 53344 - RNA, 24 nt, Human
cuugucgcccaggcuggagugcaa

SEQ ID NO: 53345 - RNA, 21 nt, Human
cuuucucucucucucucuuuu

SEQ ID NO: 53346 - RNA, 21 nt, Human
cuuuuuuuuuuuuuuuuuuuu

SEQ ID NO: 53347 - RNA, 23 nt, Human
gaaaucauguuaauaaaaaauca

SEQ ID NO: 53348 - RNA, 18 nt, Human
gaccacaggugauccgcc

SEQ ID NO: 53349 - RNA, 18 nt, Human
gaccuguguuccuucucu

SEQ ID NO: 53350 - RNA, 19 nt, Human
gacgggguuuugccauguu

SEQ ID NO: 53351 - RNA, 22 nt, Human
gagagacaggaucuuguuaugu

SEQ ID NO: 53352 - RNA, 24 nt, Human
gaguacagacgggguuuugccaug

SEQ ID NO: 53353 - RNA, 18 nt, Human
gauuacaggcgugagcca

SEQ ID NO: 53354 - RNA, 21 nt, Human
gauuacaggcgugagccacca

SEQ ID NO: 53355 - RNA, 22 nt, Human
gauuacaggcgugagccaccac

SEQ ID NO: 53356 - RNA, 21 nt, Human
gauucuccugccucagccucc

SEQ ID NO: 53357 - RNA, 22 nt, Human
gcaaccuccaccuccuggguuc

SEQ ID NO: 53358 - RNA, 20 nt, Human
gccauguuggccaggcuggu

SEQ ID NO: 53359 - RNA, 19 nt, Human
gcccaggcuggagugcaac

SEQ ID NO: 53360 - RNA, 22 nt, Human
gcccucucucuuucuuuuuuuu

SEQ ID NO: 53361 - RNA, 24 nt, Human
gcgauucuccugccucagccuccc

SEQ ID NO: 53362 - RNA, 21 nt, Human
gcucuugucgcccaggcugga

SEQ ID NO: 53363 - RNA, 19 nt, Human
gcuggagugcaacggcacg

SEQ ID NO: 53364 - RNA, 18 nt, Human
ggacaaauagacaccaaa

SEQ ID NO: 53365 - RNA, 21 nt, Human
ggacaaauagacaccaaaaga

SEQ ID NO: 53366 - RNA, 18 nt, Human
ggagaagcaucacacaca

SEQ ID NO: 53367 - RNA, 19 nt, Human
ggauuacaggcgugagcca

SEQ ID NO: 53368 - RNA, 23 nt, Human
ggcacgaucucagcuuacugcaa

SEQ ID NO: 53369 - RNA, 23 nt, Human
gggguuuugccauguuggccagg

SEQ ID NO: 53370 - RNA, 22 nt, Human
ggguuuugccauguuggccagg

SEQ ID NO: 53371 - RNA, 19 nt, Human
gguaauaacggcacaggga

SEQ ID NO: 53372 - RNA, 23 nt, Human
guacagacgggguuuugccaugu

SEQ ID NO: 53373 - RNA, 18 nt, Human
guagcugggauuacaggu

SEQ ID NO: 53374 - RNA, 26 nt, Human
guucaagccauccucccuccucaacc

SEQ ID NO: 53375 - RNA, 21 nt, Human
guucucuuucucucuccgggc

SEQ ID NO: 53376 - RNA, 22 nt, Human
guugcuagguaauaacggcaca

SEQ ID NO: 53377 - RNA, 20 nt, Human
guuuggggucacaaucaccc

SEQ ID NO: 53378 - RNA, 21 nt, Human
uaaagcacaauuuccuugcaa

SEQ ID NO: 53379 - RNA, 20 nt, Human
uaaaguagcuugaaggugac

SEQ ID NO: 53380 - RNA, 22 nt, Human
uacaaaauguagcaaaccuuga

SEQ ID NO: 53381 - RNA, 22 nt, Human
uacagacgggguuuugccaugu

SEQ ID NO: 53382 - RNA, 23 nt, Human
uacaggcgugagccaccacgccc

SEQ ID NO: 53383 - RNA, 20 nt, Human
uaccuaaaagucauagaaaa

SEQ ID NO: 53384 - RNA, 25 nt, Human
uacuaaaaaucaagagaaauggcuu

SEQ ID NO: 53385 - RNA, 21 nt, Human
uacugcaaccuccaccuccug

SEQ ID NO: 53386 - RNA, 23 nt, Human
uacugcaaccuccaccuccuggg

SEQ ID NO: 53387 - RNA, 19 nt, Human
uauaucagaaaaggaaauc

SEQ ID NO: 53388 - RNA, 18 nt, Human
uaucagaaaaggaaaucc

SEQ ID NO: 53389 - RNA, 20 nt, Human
uauguugcccaggcuggccu

SEQ ID NO: 53390 - RNA, 23 nt, Human
uauguugcccaggcuggccuuga

SEQ ID NO: 53391 - RNA, 24 nt, Human
uauguugcccaggcuggccuugaa

SEQ ID NO: 53392 - RNA, 23 nt, Human
ucaaacuccugaccacaggugau

SEQ ID NO: 53393 - RNA, 25 nt, Human
ucaagccauccucccuccucaaccu

SEQ ID NO: 53394 - RNA, 19 nt, Human
ucaagcgauucuccugccu

SEQ ID NO: 53395 - RNA, 18 nt, Human
ucacccagauacucucau

SEQ ID NO: 53396 - RNA, 20 nt, Human
ucagccucccaaguagcugg

SEQ ID NO: 53397 - RNA, 21 nt, Human
uccauccccacccauaacaau

SEQ ID NO: 53398 - RNA, 24 nt, Human
ucccaaagugcugggauuacaggc

SEQ ID NO: 53399 - RNA, 23 nt, Human
ucccaaguagcugggauuacagg

SEQ ID NO: 53400 - RNA, 24 nt, Human
ucccaaguagcugggauuacaggu

SEQ ID NO: 53401 - RNA, 21 nt, Human
uccccauccuucucucccaaa

SEQ ID NO: 53402 - RNA, 21 nt, Human
uccuggguucaagcgauucuc

SEQ ID NO: 53403 - RNA, 24 nt, Human
uccuggguucaagcgauucuccug

SEQ ID NO: 53404 - RNA, 18 nt, Human
ucgcccaggcuggagugc

SEQ ID NO: 53405 - RNA, 18 nt, Human
ucggccucccaaagugcu

SEQ ID NO: 53406 - RNA, 22 nt, Human
ucuauaccuccauccccaccca

SEQ ID NO: 53407 - RNA, 18 nt, Human
ucuaucacuaacaccacu

SEQ ID NO: 53408 - RNA, 26 nt, Human
ucuccugccucagccucccaaguagc

SEQ ID NO: 53409 - RNA, 24 nt, Human
ucucuuucucucucucucucuuuu

SEQ ID NO: 53410 - RNA, 24 nt, Human
ucuugcucuugucgcccaggcugg

SEQ ID NO: 53411 - RNA, 25 nt, Human
ucuugcucuugucgcccaggcugga

SEQ ID NO: 53412 - RNA, 19 nt, Human
ucuuguuauguugcccagg

SEQ ID NO: 53413 - RNA, 23 nt, Human
ucuuguuauguugcccaggcugg

SEQ ID NO: 53414 - RNA, 19 nt, Human
ucuuucucucucucucucc

SEQ ID NO: 53415 - RNA, 25 nt, Human
ugaccacaggugauccgcccggcuc

SEQ ID NO: 53416 - RNA, 21 nt, Human
ugaccugauuggcauuucuga

SEQ ID NO: 53417 - RNA, 18 nt, Human
ugagacagagucuugcuc

SEQ ID NO: 53418 - RNA, 23 nt, Human
ugagagacaggaucuuguuaugu

SEQ ID NO: 53419 - RNA, 26 nt, Human
ugagaugaagagacccacgagagcca

SEQ ID NO: 53420 - RNA, 25 nt, Human
ugagccagaagcaaauuugcuguca

SEQ ID NO: 53421 - RNA, 24 nt, Human
ugaguacagacgggguuuugccau

SEQ ID NO: 53422 - RNA, 24 nt, Human
ugauggaagaguuuguguuacuug

SEQ ID NO: 53423 - RNA, 24 nt, Human
ugccauguuggccaggcuggucuc

SEQ ID NO: 53424 - RNA, 27 nt, Human
ugccauguuggccaggcuggucucaaa

SEQ ID NO: 53425 - RNA, 24 nt, Human
ugccucagccucccaaguagcugg

SEQ ID NO: 53426 - RNA, 24 nt, Human
ugcucuugucgcccaggcuggagu

SEQ ID NO: 53427 - RNA, 24 nt, Human
ugcugggauuacaggcgugagcca

SEQ ID NO: 53428 - RNA, 23 nt, Human
ugcuuccccauccuucucuccca

SEQ ID NO: 53429 - RNA, 20 nt, Human
uggagugcaacggcacgauc

SEQ ID NO: 53430 - RNA, 20 nt, Human
uggaucugcucaucuucauu

SEQ ID NO: 53431 - RNA, 24 nt, Human
uggccaggcuggucucaaacuccu

SEQ ID NO: 53432 - RNA, 24 nt, Human
uggccugauggaagaguuuguguu

SEQ ID NO: 53433 - RNA, 18 nt, Human
ugggauuacaggcgugag

SEQ ID NO: 53434 - RNA, 19 nt, Human
ugggauuacaggcgugagc

SEQ ID NO: 53435 - RNA, 22 nt, Human
ugggauuacaggcgugagccac

SEQ ID NO: 53436 - RNA, 23 nt, Human
ugggauuacaggcgugagccacc

SEQ ID NO: 53437 - RNA, 24 nt, Human
ugggauuacaggcgugagccacca

SEQ ID NO: 53438 - RNA, 22 nt, Human
ugggauuacaggugccugcuac

SEQ ID NO: 53439 - RNA, 24 nt, Human
ugggauuacaggugccugcuacca

SEQ ID NO: 53440 - RNA, 23 nt, Human
uggguucaagcgauucuccugcc

SEQ ID NO: 53441 - RNA, 24 nt, Human
uggguucaagcgauucuccugccu

SEQ ID NO: 53442 - RNA, 20 nt, Human
ugucgcccaggcuggagugc

SEQ ID NO: 53443 - RNA, 22 nt, Human
uguuauguugcccaggcuggcc

SEQ ID NO: 53444 - RNA, 22 nt, Human
uguucacaguccuccugcccau

SEQ ID NO: 53445 - RNA, 24 nt, Human
uuacugcaaccuccaccuccuggg

SEQ ID NO: 53446 - RNA, 25 nt, Human
uuacugcaaccuccaccuccugggu

SEQ ID NO: 53447 - RNA, 21 nt, Human
uucaagcgauucuccugccuc

SEQ ID NO: 53448 - RNA, 23 nt, Human
uucaagcgauucuccugccucag

SEQ ID NO: 53449 - RNA, 24 nt, Human
uucaagcgauucuccugccucagc

SEQ ID NO: 53450 - RNA, 23 nt, Human
uucaauauaucagaaaaggaaau

SEQ ID NO: 53451 - RNA, 22 nt, Human
uucacagcuuccaaaauuauuu

SEQ ID NO: 53452 - RNA, 21 nt, Human
uugagagacaggaucuuguua

SEQ ID NO: 53453 - RNA, 20 nt, Human
uugauccucucaccaugcuu

SEQ ID NO: 53454 - RNA, 24 nt, Human
uugccauguuggccaggcuggucu

SEQ ID NO: 53455 - RNA, 21 nt, Human
uuugauccucucaccaugcuu

SEQ ID NO: 53456 - RNA, 22 nt, Human
uuuguacaaacauaaaaacaug

SEQ ID NO: 53457 - RNA, 23 nt, Human
uuuugccauguuggccaggcugg

SEQ ID NO: 53458 - RNA, 20 nt, Human
uuuuuuuuucugagacagag

SEQ ID NO: 53459 - RNA, 24 nt, Human
uuuuuuuuuucugagacagagucu

SEQ ID NO: 53460 - RNA, 21 nt, Human
uuuuuuuuuugagagacaggg

SEQ ID NO: 53461 - RNA, 18 nt, Human
uuuuuuuuuuuuuuucug

SEQ ID NO: 53462 - RNA, 18 nt, Human
uuuuuuuuuuuuuuuuug

SEQ ID NO: 53463 - RNA, 26 nt, Human
aaaaaacaaaauuuggcugggcuugg

SEQ ID NO: 53464 - RNA, 19 nt, Human
aaaaggccuaaaaucagag

SEQ ID NO: 53465 - RNA, 20 nt, Human
aacgugaugaaaccccaucu

SEQ ID NO: 53466 - RNA, 21 nt, Human
aacgugaugaaaccccaucuc

SEQ ID NO: 53467 - RNA, 18 nt, Human
aagaaauaagguggcugg

SEQ ID NO: 53468 - RNA, 19 nt, Human
aagcauggcugcagaacac

SEQ ID NO: 53469 - RNA, 22 nt, Human
aagcugcuaauuaggcaaccug

SEQ ID NO: 53470 - RNA, 21 nt, Human
aaguguuuaaggccaagaacc

SEQ ID NO: 53471 - RNA, 19 nt, Human
aauugcuugagcccagagg

SEQ ID NO: 53472 - RNA, 22 nt, Human
aauuuguuccaguucucuccug

SEQ ID NO: 53473 - RNA, 18 nt, Human
acacugcagggaaggcag

SEQ ID NO: 53474 - RNA, 20 nt, Human
accagcaacaucccuaaagg

SEQ ID NO: 53475 - RNA, 26 nt, Human
accccaucucuacaaaaaaaaaacaa

SEQ ID NO: 53476 - RNA, 22 nt, Human
acccugaagcauggcugcagaa

SEQ ID NO: 53477 - RNA, 18 nt, Human
acugcacuccagccugag

SEQ ID NO: 53478 - RNA, 19 nt, Human
agaaaguguuuaaggccaa

SEQ ID NO: 53479 - RNA, 24 nt, Human
agaggcugcagugagccgugauug

SEQ ID NO: 53480 - RNA, 18 nt, Human
agcacuuuuguucaaagc

SEQ ID NO: 53481 - RNA, 18 nt, Human
agcagcuauaagaaaggc

SEQ ID NO: 53482 - RNA, 20 nt, Human
agcaugauuuaagguugaau

SEQ ID NO: 53483 - RNA, 21 nt, Human
agcauuuuagaauuagaaaca

SEQ ID NO: 53484 - RNA, 21 nt, Human
agcauuuugggaggccgaggc

SEQ ID NO: 53485 - RNA, 20 nt, Human
agcccagagguucgagauca

SEQ ID NO: 53486 - RNA, 27 nt, Human
agcccagagguucgagaucagccuggg

SEQ ID NO: 53487 - RNA, 23 nt, Human
agccugagauccugucucaaaaa

SEQ ID NO: 53488 - RNA, 22 nt, Human
agccugggcaacgugaugaaac

SEQ ID NO: 53489 - RNA, 24 nt, Human
agccugggcaacgugaugaaaccc

SEQ ID NO: 53490 - RNA, 22 nt, Human
agcuaccaaaaaugaaaggcaa

SEQ ID NO: 53491 - RNA, 24 nt, Human
agcuacuugggaggcugagguggg

SEQ ID NO: 53492 - RNA, 24 nt, Human
agcuauaagaaaggcauuaaacaa

SEQ ID NO: 53493 - RNA, 23 nt, Human
aggaaaauaguauuuuguuuaga

SEQ ID NO: 53494 - RNA, 19 nt, Human
aggaagaauauauucaagg

SEQ ID NO: 53495 - RNA, 21 nt, Human
aggcaagaaaugaaaggagga

SEQ ID NO: 53496 - RNA, 19 nt, Human
aggccgaggcgagugaauu

SEQ ID NO: 53497 - RNA, 24 nt, Human
aggcugaggugggaggaucaccug

SEQ ID NO: 53498 - RNA, 19 nt, Human
agguagaggcugcagugag

SEQ ID NO: 53499 - RNA, 21 nt, Human
agguagaggcugcagugagcc

SEQ ID NO: 53500 - RNA, 20 nt, Human
aggugggaggaucaccugag

SEQ ID NO: 53501 - RNA, 24 nt, Human
aggugggaggaucaccugagccug

SEQ ID NO: 53502 - RNA, 23 nt, Human
agugaugaggacaaaaagaggaa

SEQ ID NO: 53503 - RNA, 24 nt, Human
aguggcucaggccuguaaucccag

SEQ ID NO: 53504 - RNA, 18 nt, Human
auaacucaaauccuacua

SEQ ID NO: 53505 - RNA, 24 nt, Human
augggcuggugucuugucaguugg

SEQ ID NO: 53506 - RNA, 24 nt, Human
auugugccacugcacuccagccug

SEQ ID NO: 53507 - RNA, 23 nt, Human
auuugacuccggucaaaucaaga

SEQ ID NO: 53508 - RNA, 19 nt, Human
caagacagauauguuggau

SEQ ID NO: 53509 - RNA, 23 nt, Human
caagaccugaggcuguccaccaa

SEQ ID NO: 53510 - RNA, 24 nt, Human
caccaacagcuauacccugaagca

SEQ ID NO: 53511 - RNA, 20 nt, Human
caccccucacacccaggaaa

SEQ ID NO: 53512 - RNA, 18 nt, Human
cacugcacuccagccuga

SEQ ID NO: 53513 - RNA, 19 nt, Human
cacugcacuccagccugag

SEQ ID NO: 53514 - RNA, 19 nt, Human
cacugcacuccagccugag

SEQ ID NO: 53515 - RNA, 20 nt, Human
cacugcacuccagccugaga

SEQ ID NO: 53516 - RNA, 21 nt, Human
cagcaccuggugaagcguccu

SEQ ID NO: 53517 - RNA, 23 nt, Human
cagcauuuugggaggccgaggcg

SEQ ID NO: 53518 - RNA, 24 nt, Human
cagccugagauccugucucaaaaa

SEQ ID NO: 53519 - RNA, 21 nt, Human
cagcuacuugggaggcugagg

SEQ ID NO: 53520 - RNA, 24 nt, Human
cagcuacuugggaggcugaggugg

SEQ ID NO: 53521 - RNA, 24 nt, Human
cagguggauaggaggacaagaaau

SEQ ID NO: 53522 - RNA, 23 nt, Human
caucagcauuguccuuuuuaaga

SEQ ID NO: 53523 - RNA, 21 nt, Human
ccaacagcuauacccugaagc

SEQ ID NO: 53524 - RNA, 20 nt, Human
ccacugcacuccagccugag

SEQ ID NO: 53525 - RNA, 20 nt, Human
ccacugcacuccagccugag

SEQ ID NO: 53526 - RNA, 21 nt, Human
ccacugcacuccagccugaga

SEQ ID NO: 53527 - RNA, 22 nt, Human
ccacugcacuccagccugagau

SEQ ID NO: 53528 - RNA, 18 nt, Human
ccagaaaguguuuaaggc

SEQ ID NO: 53529 - RNA, 23 nt, Human
ccagcaacaucccuaaaggucuc

SEQ ID NO: 53530 - RNA, 18 nt, Human
ccagcaccuggugaagcg

SEQ ID NO: 53531 - RNA, 20 nt, Human
ccagccugagauccugucuc

SEQ ID NO: 53532 - RNA, 24 nt, Human
ccaugcaggccauguguggaugca

SEQ ID NO: 53533 - RNA, 21 nt, Human
cccaucucuacaaaaaaaaaa

SEQ ID NO: 53534 - RNA, 18 nt, Human
ccccagggagccuucuuc

SEQ ID NO: 53535 - RNA, 26 nt, Human
cccccaagaccugaggcuguccaccu

SEQ ID NO: 53536 - RNA, 18 nt, Human
ccuauagucccagcuacu

SEQ ID NO: 53537 - RNA, 21 nt, Human
ccuauagucccagcuacuugg

SEQ ID NO: 53538 - RNA, 22 nt, Human
ccucacacccaggaaagccucc

SEQ ID NO: 53539 - RNA, 23 nt, Human
ccucccgcgggccgcuccugggu

SEQ ID NO: 53540 - RNA, 25 nt, Human
ccuccuguucguggccagcaccugg

SEQ ID NO: 53541 - RNA, 22 nt, Human
ccugagccuggggagguagagg

SEQ ID NO: 53542 - RNA, 24 nt, Human
ccugggcaacgugaugaaacccca

SEQ ID NO: 53543 - RNA, 20 nt, Human
ccugggugggcgacccuggc

SEQ ID NO: 53544 - RNA, 20 nt, Human
ccuguaaucccagcauuuug

SEQ ID NO: 53545 - RNA, 18 nt, Human
cgacccuggcgcaccccu

SEQ ID NO: 53546 - RNA, 18 nt, Human
cgcaccccucacacccag

SEQ ID NO: 53547 - RNA, 21 nt, Human
cgcaccccucacacccaggaa

SEQ ID NO: 53548 - RNA, 25 nt, Human
cggcucguccacuugugcccccuca

SEQ ID NO: 53549 - RNA, 21 nt, Human
cuaccaaaaaugaaaggcaag

SEQ ID NO: 53550 - RNA, 24 nt, Human
cucaggccuguaaucccagcauuu

SEQ ID NO: 53551 - RNA, 22 nt, Human
cugcagugagccgugauugugc

SEQ ID NO: 53552 - RNA, 24 nt, Human
cugcgcccucggccggaggcucac

SEQ ID NO: 53553 - RNA, 24 nt, Human
cuuucacaccucguuuaguggcua

SEQ ID NO: 53554 - RNA, 19 nt, Human
gagcaccaguauugaguga

SEQ ID NO: 53555 - RNA, 21 nt, Human
gagcccagagguucgagauca

SEQ ID NO: 53556 - RNA, 24 nt, Human
gaggcgagugaauugcuugagccc

SEQ ID NO: 53557 - RNA, 26 nt, Human
gaucagcauuuuagaauuagaaacac

SEQ ID NO: 53558 - RNA, 22 nt, Human
gaugcagguggauaggaggaca

SEQ ID NO: 53559 - RNA, 21 nt, Human
gauugugccacugcacuccag

SEQ ID NO: 53560 - RNA, 21 nt, Human
gcagggaaggcagccccaugc

SEQ ID NO: 53561 - RNA, 20 nt, Human
gccaagaaccaaaauuacag

SEQ ID NO: 53562 - RNA, 22 nt, Human
gcccagagguucgagaucagcc

SEQ ID NO: 53563 - RNA, 23 nt, Human
gcgagugaauugcuugagcccag

SEQ ID NO: 53564 - RNA, 23 nt, Human
gcgcugcgcccucggccggaggc

SEQ ID NO: 53565 - RNA, 21 nt, Human
gcugggcuuggugaugugugc

SEQ ID NO: 53566 - RNA, 22 nt, Human
gcugggcuuggugaugugugcc

SEQ ID NO: 53567 - RNA, 18 nt, Human
gcuggucauccucuugag

SEQ ID NO: 53568 - RNA, 20 nt, Human
ggcaagaaaugaaaggagga

SEQ ID NO: 53569 - RNA, 24 nt, Human
ggccuguaaucccagcauuuuggg

SEQ ID NO: 53570 - RNA, 23 nt, Human
ggcgcaguggcucaggccuguaa

SEQ ID NO: 53571 - RNA, 20 nt, Human
ggcguugcggggccccaggg

SEQ ID NO: 53572 - RNA, 19 nt, Human
ggcugggcgcaguggcuca

SEQ ID NO: 53573 - RNA, 18 nt, Human
gucaguuguuaagcaguu

SEQ ID NO: 53574 - RNA, 18 nt, Human
gugaugaaaccccaucuc

SEQ ID NO: 53575 - RNA, 20 nt, Human
gugugccuauagucccagcu

SEQ ID NO: 53576 - RNA, 21 nt, Human
uaaaacaagacaaacuauucc

SEQ ID NO: 53577 - RNA, 22 nt, Human
uaaaauguacacagucuugaaa

SEQ ID NO: 53578 - RNA, 19 nt, Human
uaaacaguucucuaccuuu

SEQ ID NO: 53579 - RNA, 21 nt, Human
uaaacaguucucuaccuuuca

SEQ ID NO: 53580 - RNA, 20 nt, Human
uaaaggaaaauaguauuuug

SEQ ID NO: 53581 - RNA, 19 nt, Human
uaaauuaggucauaauagu

SEQ ID NO: 53582 - RNA, 22 nt, Human
uaagcagcuaccaaaaaugaaa

SEQ ID NO: 53583 - RNA, 24 nt, Human
uacaaaaaaaaaacaaaauuuggc

SEQ ID NO: 53584 - RNA, 19 nt, Human
uaccaaaaaugaaaggcaa

SEQ ID NO: 53585 - RNA, 21 nt, Human
uaccaaaaaugaaaggcaaga

SEQ ID NO: 53586 - RNA, 20 nt, Human
uacccugaagcauggcugca

SEQ ID NO: 53587 - RNA, 24 nt, Human
uauacccugaagcauggcugcaga

SEQ ID NO: 53588 - RNA, 24 nt, Human
uaucuuuggaaauaauuuaaaaug

SEQ ID NO: 53589 - RNA, 21 nt, Human
uauuccagugaccauaauugc

SEQ ID NO: 53590 - RNA, 24 nt, Human
ucaaaaaauaauaacucaaauccu

SEQ ID NO: 53591 - RNA, 22 nt, Human
ucaaaucaagacuugaccagca

SEQ ID NO: 53592 - RNA, 19 nt, Human
ucaaauccuggcugggcgc

SEQ ID NO: 53593 - RNA, 23 nt, Human
ucaccgcaaucuuccgcucuggg

SEQ ID NO: 53594 - RNA, 20 nt, Human
ucaccugagccuggggaggu

SEQ ID NO: 53595 - RNA, 22 nt, Human
ucacuaucuuuggaaauaauuu

SEQ ID NO: 53596 - RNA, 21 nt, Human
ucaggccuguaaucccagcau

SEQ ID NO: 53597 - RNA, 23 nt, Human
uccaccaacagcuauacccugaa

SEQ ID NO: 53598 - RNA, 21 nt, Human
ucccccggacugcgggcgggc

SEQ ID NO: 53599 - RNA, 21 nt, Human
ucuuccaucagcauuguccuu

SEQ ID NO: 53600 - RNA, 25 nt, Human
ucuugaaaucuugauauaacauuuu

SEQ ID NO: 53601 - RNA, 19 nt, Human
ugaacuaaaggaaaauagu

SEQ ID NO: 53602 - RNA, 24 nt, Human
ugaauugcuugagcccagagguuc

SEQ ID NO: 53603 - RNA, 23 nt, Human
ugagcccagagguucgagaucag

SEQ ID NO: 53604 - RNA, 22 nt, Human
ugagccgugauugugccacugc

SEQ ID NO: 53605 - RNA, 19 nt, Human
ugagccuggggagguagag

SEQ ID NO: 53606 - RNA, 25 nt, Human
ugagccuggggagguagaggcugca

SEQ ID NO: 53607 - RNA, 21 nt, Human
ugaggauuccaagauugcuug

SEQ ID NO: 53608 - RNA, 19 nt, Human
ugaggugggaggaucaccu

SEQ ID NO: 53609 - RNA, 20 nt, Human
ugaggugggaggaucaccug

SEQ ID NO: 53610 - RNA, 21 nt, Human
ugaggugggaggaucaccuga

SEQ ID NO: 53611 - RNA, 23 nt, Human
ugaggugggaggaucaccugagc

SEQ ID NO: 53612 - RNA, 24 nt, Human
ugaggugggaggaucaccugagcc

SEQ ID NO: 53613 - RNA, 19 nt, Human
ugaguaaguucucugaguc

SEQ ID NO: 53614 - RNA, 21 nt, Human
ugagugaugaggacaaaaaga

SEQ ID NO: 53615 - RNA, 21 nt, Human
ugaugaggacaaaaagaggaa

SEQ ID NO: 53616 - RNA, 18 nt, Human
ugaugugugccuauaguc

SEQ ID NO: 53617 - RNA, 18 nt, Human
ugcagggaaggcagcccc

SEQ ID NO: 53618 - RNA, 22 nt, Human
ugcagugagccgugauugugcc

SEQ ID NO: 53619 - RNA, 18 nt, Human
ugcccccaagaccugagg

SEQ ID NO: 53620 - RNA, 24 nt, Human
ugccuauagucccagcuacuuggg

SEQ ID NO: 53621 - RNA, 19 nt, Human
ugcggggccccagggagcc

SEQ ID NO: 53622 - RNA, 22 nt, Human
uggcucaggccuguaaucccag

SEQ ID NO: 53623 - RNA, 24 nt, Human
uggcucaggccuguaaucccagca

SEQ ID NO: 53624 - RNA, 19 nt, Human
uggcuggaaggaccuccag

SEQ ID NO: 53625 - RNA, 22 nt, Human
ugggaggccgaggcgagugaau

SEQ ID NO: 53626 - RNA, 24 nt, Human
ugggaggccgaggcgagugaauug

SEQ ID NO: 53627 - RNA, 19 nt, Human
ugggaggcugaggugggag

SEQ ID NO: 53628 - RNA, 24 nt, Human
ugggaggcugaggugggaggauca

SEQ ID NO: 53629 - RNA, 20 nt, Human
ugggcuggugucuugucagu

SEQ ID NO: 53630 - RNA, 24 nt, Human
ugguaugcacaaaaggccuaaaau

SEQ ID NO: 53631 - RNA, 24 nt, Human
uggugaugugugccuauaguccca

SEQ ID NO: 53632 - RNA, 24 nt, Human
uguagaaugucuuaccccaccaua

SEQ ID NO: 53633 - RNA, 20 nt, Human
uguucaaagcuagaacccac

SEQ ID NO: 53634 - RNA, 20 nt, Human
uucuucggcacacacacugg

SEQ ID NO: 53635 - RNA, 24 nt, Human
uugcuggucauccucuugagccuu

SEQ ID NO: 53636 - RNA, 21 nt, Human
uugcuugagcccagagguucg

SEQ ID NO: 53637 - RNA, 19 nt, Human
uuggcugggcuuggugaug

SEQ ID NO: 53638 - RNA, 24 nt, Human
uuggcugggcuuggugaugugugc

SEQ ID NO: 53639 - RNA, 18 nt, Human
uugggaggccgaggcgag

SEQ ID NO: 53640 - RNA, 24 nt, Human
uugggaggccgaggcgagugaauu

SEQ ID NO: 53641 - RNA, 25 nt, Human
uugggaggcugaggugggaggauca

SEQ ID NO: 53642 - RNA, 23 nt, Human
uugugccacugcacuccagccug

SEQ ID NO: 53643 - RNA, 23 nt, Human
uuuaagcagcuaccaaaaaugaa

SEQ ID NO: 53644 - RNA, 22 nt, Human
uuuguucaaagcuagaacccac

SEQ ID NO: 53645 - RNA, 21 nt, Human
aaacagauguuuauugugauc

SEQ ID NO: 53646 - RNA, 24 nt, Human
agcaaaccgggucugccaccuucu

SEQ ID NO: 53647 - RNA, 22 nt, Human
augcccaaauaaccuaggugac

SEQ ID NO: 53648 - RNA, 24 nt, Human
cagccuccugaucccuggggcgau

SEQ ID NO: 53649 - RNA, 21 nt, Human
caugcccaaauaaccuaggug

SEQ ID NO: 53650 - RNA, 18 nt, Human
ccagcaauuauucuaucc

SEQ ID NO: 53651 - RNA, 21 nt, Human
ccaggcccaguguggguagga

SEQ ID NO: 53652 - RNA, 19 nt, Human
ccaguguggguaggaguga

SEQ ID NO: 53653 - RNA, 24 nt, Human
gaagaggcuguaucacauauucuu

SEQ ID NO: 53654 - RNA, 20 nt, Human
gaauugguccuuuuuacuuu

SEQ ID NO: 53655 - RNA, 19 nt, Human
gaucagcaaaccgggucug

SEQ ID NO: 53656 - RNA, 22 nt, Human
ucagccuccugaucccuggggc

SEQ ID NO: 53657 - RNA, 20 nt, Human
uucaaagcuacaaagacucu

SEQ ID NO: 53658 - RNA, 21 nt, Human
aaaaaucaccgagaugacccc

SEQ ID NO: 53659 - RNA, 24 nt, Human
aacuaccagaagaauuaaaaacag

SEQ ID NO: 53660 - RNA, 18 nt, Human
aagugacaccacgauccu

SEQ ID NO: 53661 - RNA, 21 nt, Human
aagugacaccacgauccuggu

SEQ ID NO: 53662 - RNA, 19 nt, Human
aaguuacaaaaaucaccga

SEQ ID NO: 53663 - RNA, 22 nt, Human
aaugagagggguagaggagaaa

SEQ ID NO: 53664 - RNA, 24 nt, Human
accgagaugacccccaaauguaac

SEQ ID NO: 53665 - RNA, 19 nt, Human
acuaaagucagugggauuc

SEQ ID NO: 53666 - RNA, 22 nt, Human
agaacccucucaggcuaagcuc

SEQ ID NO: 53667 - RNA, 20 nt, Human
aggccacuugcucccugccu

SEQ ID NO: 53668 - RNA, 24 nt, Human
caaaaaucaccgagaugaccccca

SEQ ID NO: 53669 - RNA, 19 nt, Human
cacggaaggaaugagaggg

SEQ ID NO: 53670 - RNA, 20 nt, Human
cacuugcucccugccugggu

SEQ ID NO: 53671 - RNA, 20 nt, Human
cagaagugaccaggccacuu

SEQ ID NO: 53672 - RNA, 22 nt, Human
caucaagacccacuaaagucag

SEQ ID NO: 53673 - RNA, 22 nt, Human
ccacuugcucccugccugggug

SEQ ID NO: 53674 - RNA, 24 nt, Human
ccacuugcucccugccuggguggc

SEQ ID NO: 53675 - RNA, 20 nt, Human
cccacuaaagucagugggau

SEQ ID NO: 53676 - RNA, 20 nt, Human
gagagcucuaaguguccugc

SEQ ID NO: 53677 - RNA, 18 nt, Human
ggccacuugcucccugcc

SEQ ID NO: 53678 - RNA, 19 nt, Human
ggccacuugcucccugccu

SEQ ID NO: 53679 - RNA, 19 nt, Human
ggccacuugcucccugccu

SEQ ID NO: 53680 - RNA, 19 nt, Human
gggauuguuuuuuuuuuuu

SEQ ID NO: 53681 - RNA, 30 nt, Human
uacaaaaaucaccgagaugacccccaaauu

SEQ ID NO: 53682 - RNA, 21 nt, Human
uagagaaaacuaccagaagaa

SEQ ID NO: 53683 - RNA, 23 nt, Human
uagagagcucuaaguguccugcg

SEQ ID NO: 53684 - RNA, 24 nt, Human
ucaaucgaaccagaagugaccagg

SEQ ID NO: 53685 - RNA, 18 nt, Human
ucaccgagaugaccccca

SEQ ID NO: 53686 - RNA, 23 nt, Human
ucaccgagaugacccccaaaugu

SEQ ID NO: 53687 - RNA, 21 nt, Human
uccaaaauggggagacaggga

SEQ ID NO: 53688 - RNA, 25 nt, Human
ucgaaccagaagugaccaggccacu

SEQ ID NO: 53689 - RNA, 21 nt, Human
ucucaggcuaagcuccagugu

SEQ ID NO: 53690 - RNA, 19 nt, Human
ugccuggguggcugugggc

SEQ ID NO: 53691 - RNA, 22 nt, Human
ugccuggguggcugugggccuc

SEQ ID NO: 53692 - RNA, 20 nt, Human
uggcacggaaggaaugagag

SEQ ID NO: 53693 - RNA, 23 nt, Human
ugggauuguuuuuuuuuuuuuuu

SEQ ID NO: 53694 - RNA, 22 nt, Human
ugggguaaaaucuagaaacuga

SEQ ID NO: 53695 - RNA, 24 nt, Human
uggguggcugugggccucaggggg

SEQ ID NO: 53696 - RNA, 26 nt, Human
uguuuuuuuuuuuuuuuuuaccaugg

SEQ ID NO: 53697 - RNA, 24 nt, Human
uuaaaaacagggucaauuaaaacc

SEQ ID NO: 53698 - RNA, 18 nt, Human
uugcucccugccugggug

SEQ ID NO: 53699 - RNA, 25 nt, Human
uuuuuuuuuuuuuuuuuaccauggg

SEQ ID NO: 53700 - RNA, 20 nt, Human
aaccaugcuggggacgaaag

SEQ ID NO: 53701 - RNA, 21 nt, Human
acaugauggcuggugucccca

SEQ ID NO: 53702 - RNA, 19 nt, Human
acuggagugcaguggcgca

SEQ ID NO: 53703 - RNA, 21 nt, Human
agaugugaaugccacugaacu

SEQ ID NO: 53704 - RNA, 21 nt, Human
agugcaguggcgcaaucucag

SEQ ID NO: 53705 - RNA, 23 nt, Human
caaccuccaccucccgaguucaa

SEQ ID NO: 53706 - RNA, 28 nt, Human
caagugauucucaugccucaggcuccca

SEQ ID NO: 53707 - RNA, 21 nt, Human
cacccaccaccacacccagcu

SEQ ID NO: 53708 - RNA, 21 nt, Human
cacugcaaccuccaccucccg

SEQ ID NO: 53709 - RNA, 22 nt, Human
cagccccucgcuuggccucggg

SEQ ID NO: 53710 - RNA, 20 nt, Human
cagcggguacagccuggacc

SEQ ID NO: 53711 - RNA, 19 nt, Human
cagcugagagcagcgggua

SEQ ID NO: 53712 - RNA, 21 nt, Human
caggcacccaccaccacaccc

SEQ ID NO: 53713 - RNA, 23 nt, Human
caggcacccaccaccacacccag

SEQ ID NO: 53714 - RNA, 18 nt, Human
caguggauccuugaccuu

SEQ ID NO: 53715 - RNA, 24 nt, Human
ccaccucccgaguucaagugauuc

SEQ ID NO: 53716 - RNA, 21 nt, Human
ccacgggcccagcugagagca

SEQ ID NO: 53717 - RNA, 23 nt, Human
ccauguagcugggauuacaggca

SEQ ID NO: 53718 - RNA, 21 nt, Human
cccaccaccacacccagcuaa

SEQ ID NO: 53719 - RNA, 19 nt, Human
cccauguagcugggauuac

SEQ ID NO: 53720 - RNA, 18 nt, Human
ccccagaaacacagagcu

SEQ ID NO: 53721 - RNA, 23 nt, Human
cccgaguucaagugauucucaug

SEQ ID NO: 53722 - RNA, 23 nt, Human
ccucacagggcaguggggccagg

SEQ ID NO: 53723 - RNA, 21 nt, Human
ccuccuggcuauagcaggggc

SEQ ID NO: 53724 - RNA, 18 nt, Human
cggggcuggggcggacgc

SEQ ID NO: 53725 - RNA, 24 nt, Human
cucacugcaaccuccaccucccga

SEQ ID NO: 53726 - RNA, 19 nt, Human
cucccgaguucaagugauu

SEQ ID NO: 53727 - RNA, 23 nt, Human
cugcaaccuccaccucccgaguu

SEQ ID NO: 53728 - RNA, 24 nt, Human
cugcaaccuccaccucccgaguuc

SEQ ID NO: 53729 - RNA, 20 nt, Human
cuguggggccuccgcgccgg

SEQ ID NO: 53730 - RNA, 19 nt, Human
gaaugccacugaacugaaa

SEQ ID NO: 53731 - RNA, 19 nt, Human
gacacuggcagccccucgc

SEQ ID NO: 53732 - RNA, 23 nt, Human
gaccagacuggagugcaguggcg

SEQ ID NO: 53733 - RNA, 22 nt, Human
gcaaccuccaccucccgaguuc

SEQ ID NO: 53734 - RNA, 24 nt, Human
gcccggcccacccacgggcccagc

SEQ ID NO: 53735 - RNA, 21 nt, Human
gcggggcuguggggccuccgc

SEQ ID NO: 53736 - RNA, 18 nt, Human
ggacccggggcuggggcg

SEQ ID NO: 53737 - RNA, 19 nt, Human
ggacccggggcuggggcgg

SEQ ID NO: 53738 - RNA, 20 nt, Human
ggcccagcugagagcagcgg

SEQ ID NO: 53739 - RNA, 21 nt, Human
ggcuggggcggacgcgguggg

SEQ ID NO: 53740 - RNA, 22 nt, Human
gggcuggggcggacgcgguggg

SEQ ID NO: 53741 - RNA, 23 nt, Human
gggcuggggcggacgcggugggu

SEQ ID NO: 53742 - RNA, 22 nt, Human
gggcuguggggccuccgcgccg

SEQ ID NO: 53743 - RNA, 22 nt, Human
ggggcuggggcggacgcggugg

SEQ ID NO: 53744 - RNA, 18 nt, Human
guagcugggauuacaggc

SEQ ID NO: 53745 - RNA, 21 nt, Human
guggggcaggguuuaauuucc

SEQ ID NO: 53746 - RNA, 21 nt, Human
uaauuuuuauauuuuuaguag

SEQ ID NO: 53747 - RNA, 22 nt, Human
uaauuuuuauauuuuuaguagg

SEQ ID NO: 53748 - RNA, 24 nt, Human
ucaccaggcaaggagaggcucccg

SEQ ID NO: 53749 - RNA, 18 nt, Human
ucacugcaaccuccaccu

SEQ ID NO: 53750 - RNA, 19 nt, Human
ucacugcaaccuccaccuc

SEQ ID NO: 53751 - RNA, 22 nt, Human
ucacugcaaccuccaccucccg

SEQ ID NO: 53752 - RNA, 27 nt, Human
ucacugcaaccuccaccucccgaguuc

SEQ ID NO: 53753 - RNA, 24 nt, Human
ucccauguagcugggauuacaggc

SEQ ID NO: 53754 - RNA, 21 nt, Human
uccccagaaacacagagcugu

SEQ ID NO: 53755 - RNA, 21 nt, Human
ucccgaguucaagugauucuc

SEQ ID NO: 53756 - RNA, 24 nt, Human
ucccgaguucaagugauucucaug

SEQ ID NO: 53757 - RNA, 20 nt, Human
uccucacagggcaguggggc

SEQ ID NO: 53758 - RNA, 26 nt, Human
uccuugaccuccuggcuauagcaggg

SEQ ID NO: 53759 - RNA, 25 nt, Human
ucucacucuugccgaccagacugga

SEQ ID NO: 53760 - RNA, 22 nt, Human
ugcaguggcgcaaucucagcuc

SEQ ID NO: 53761 - RNA, 23 nt, Human
ugcaguggcgcaaucucagcuca

SEQ ID NO: 53762 - RNA, 21 nt, Human
ugccucaggcucccauguagc

SEQ ID NO: 53763 - RNA, 24 nt, Human
ugccucaggcucccauguagcugg

SEQ ID NO: 53764 - RNA, 18 nt, Human
uggagugcaguggcgcaa

SEQ ID NO: 53765 - RNA, 23 nt, Human
uggagugcaguggcgcaaucuca

SEQ ID NO: 53766 - RNA, 24 nt, Human
uggagugcaguggcgcaaucucag

SEQ ID NO: 53767 - RNA, 24 nt, Human
uggcgcaaucucagcucacugcaa

SEQ ID NO: 53768 - RNA, 19 nt, Human
ugggauuacaggcacccac

SEQ ID NO: 53769 - RNA, 21 nt, Human
ugggauuacaggcacccacca

SEQ ID NO: 53770 - RNA, 24 nt, Human
ugggauuacaggcacccaccacca

SEQ ID NO: 53771 - RNA, 18 nt, Human
uggggcaggguuuaauuu

SEQ ID NO: 53772 - RNA, 22 nt, Human
uggggccaggcccagggagguc

SEQ ID NO: 53773 - RNA, 18 nt, Human
uggggccuccgcgccggc

SEQ ID NO: 53774 - RNA, 18 nt, Human
ugguuuuuuuguuuuguu

SEQ ID NO: 53775 - RNA, 19 nt, Human
uguagcugggauuacaggc

SEQ ID NO: 53776 - RNA, 24 nt, Human
uguagcugggauuacaggcaccca

SEQ ID NO: 53777 - RNA, 22 nt, Human
uguccuucucagcacucucuca

SEQ ID NO: 53778 - RNA, 23 nt, Human
uucaagugauucucaugccucag

SEQ ID NO: 53779 - RNA, 21 nt, Human
uucucaugccucaggcuccca

SEQ ID NO: 53780 - RNA, 21 nt, Human
uucucaugccucaggcuccca

SEQ ID NO: 53781 - RNA, 25 nt, Human
uucucaugccucaggcucccaugua

SEQ ID NO: 53782 - RNA, 24 nt, Human
aaagugcugggauuacaggcauga

SEQ ID NO: 53783 - RNA, 19 nt, Human
aacugcccaggaagcccca

SEQ ID NO: 53784 - RNA, 23 nt, Human
aagaggcucucuuggcuuaaagg

SEQ ID NO: 53785 - RNA, 20 nt, Human
aagggguuuugccauguugg

SEQ ID NO: 53786 - RNA, 19 nt, Human
aagugcugggauuacaggc

SEQ ID NO: 53787 - RNA, 21 nt, Human
aagugcugggauuacaggcau

SEQ ID NO: 53788 - RNA, 26 nt, Human
aagugcugggauuacaggcaugagcc

SEQ ID NO: 53789 - RNA, 19 nt, Human
aauggcucccccuacaugc

SEQ ID NO: 53790 - RNA, 20 nt, Human
acaugacugacuccccaccc

SEQ ID NO: 53791 - RNA, 19 nt, Human
acccaggcuggagugcagu

SEQ ID NO: 53792 - RNA, 18 nt, Human
acgggguggggcggggcu

SEQ ID NO: 53793 - RNA, 23 nt, Human
acugacuccccacccacccaugc

SEQ ID NO: 53794 - RNA, 22 nt, Human
agaauuggaaacggcucacaga

SEQ ID NO: 53795 - RNA, 18 nt, Human
agagaaaaagcaguaaaa

SEQ ID NO: 53796 - RNA, 23 nt, Human
agagcgaugggggucagggccaa

SEQ ID NO: 53797 - RNA, 20 nt, Human
agauucaccuuuuauaacuu

SEQ ID NO: 53798 - RNA, 26 nt, Human
agccaccucauugggccucccccucc

SEQ ID NO: 53799 - RNA, 23 nt, Human
agccccacuugccauaacagccc

SEQ ID NO: 53800 - RNA, 18 nt, Human
agcuagaggagggguggc

SEQ ID NO: 53801 - RNA, 18 nt, Human
aggaaacuuuaaauaacc

SEQ ID NO: 53802 - RNA, 26 nt, Human
aggaggaacggaggguugaggggccg

SEQ ID NO: 53803 - RNA, 24 nt, Human
aggagggguggcuggcaaagggag

SEQ ID NO: 53804 - RNA, 22 nt, Human
aggcaggcauggaacauaugcu

SEQ ID NO: 53805 - RNA, 22 nt, Human
aggcgcugcgcucaggccagga

SEQ ID NO: 53806 - RNA, 25 nt, Human
aggcuggagugcaguggcgcaaucu

SEQ ID NO: 53807 - RNA, 20 nt, Human
aggggcuggggacuugcggc

SEQ ID NO: 53808 - RNA, 22 nt, Human
aguaaauaagggguuuugccau

SEQ ID NO: 53809 - RNA, 18 nt, Human
aguagcugggaauacagg

SEQ ID NO: 53810 - RNA, 23 nt, Human
agugcaguggcgcaaucuuggcu

SEQ ID NO: 53811 - RNA, 24 nt, Human
agugcaguggcgcaaucuuggcuc

SEQ ID NO: 53812 - RNA, 18 nt, Human
agugcugggauuacaggc

SEQ ID NO: 53813 - RNA, 23 nt, Human
augaaaaaccagccccacuugcc

SEQ ID NO: 53814 - RNA, 24 nt, Human
augaaucaacuccaacuggaagcu

SEQ ID NO: 53815 - RNA, 23 nt, Human
augcuguucuggucuccagcccu

SEQ ID NO: 53816 - RNA, 28 nt, Human
auuucuuuuuuuuuuuuuuuuuuuuuga

SEQ ID NO: 53817 - RNA, 24 nt, Human
caaagugcugggauuacaggcaug

SEQ ID NO: 53818 - RNA, 23 nt, Human
caacugcccaggaagccccacuc

SEQ ID NO: 53819 - RNA, 27 nt, Human
caacugcccaggaagccccacucagac

SEQ ID NO: 53820 - RNA, 20 nt, Human
caacuggaagcagagaaaaa

SEQ ID NO: 53821 - RNA, 24 nt, Human
cacccaggcuggagugcaguggcg

SEQ ID NO: 53822 - RNA, 22 nt, Human
cacgccauucuccugccucagc

SEQ ID NO: 53823 - RNA, 25 nt, Human
cacucccggguucacgccauucucc

SEQ ID NO: 53824 - RNA, 22 nt, Human
cagaggagcccaggcugggacc

SEQ ID NO: 53825 - RNA, 18 nt, Human
cagagggugggcuguguc

SEQ ID NO: 53826 - RNA, 20 nt, Human
cagcagggcaggguggaggc

SEQ ID NO: 53827 - RNA, 21 nt, Human
caggcugggaccgguucugcc

SEQ ID NO: 53828 - RNA, 18 nt, Human
cagggcaggguggaggcg

SEQ ID NO: 53829 - RNA, 22 nt, Human
caggugauccuccugccucagc

SEQ ID NO: 53830 - RNA, 20 nt, Human
cauccggggccccgcacgcu

SEQ ID NO: 53831 - RNA, 23 nt, Human
cauccugaccuugaggugggggu

SEQ ID NO: 53832 - RNA, 19 nt, Human
caugccaccaugcccggcu

SEQ ID NO: 53833 - RNA, 24 nt, Human
cauguuggccaggcugcucucgaa

SEQ ID NO: 53834 - RNA, 23 nt, Human
ccaaagugcugggauuacaggca

SEQ ID NO: 53835 - RNA, 24 nt, Human
ccaaagugcugggauuacaggcau

SEQ ID NO: 53836 - RNA, 19 nt, Human
ccacucccggguucacgcc

SEQ ID NO: 53837 - RNA, 18 nt, Human
ccacugggccagcuggcg

SEQ ID NO: 53838 - RNA, 22 nt, Human
ccauguuggccaggcugcucuc

SEQ ID NO: 53839 - RNA, 24 nt, Human
cccaaagugcugggauuacaggca

SEQ ID NO: 53840 - RNA, 19 nt, Human
cccaggggauucuggggug

SEQ ID NO: 53841 - RNA, 22 nt, Human
ccccaacugcccaggaagcccc

SEQ ID NO: 53842 - RNA, 24 nt, Human
ccccaacugcccaggaagccccac

SEQ ID NO: 53843 - RNA, 18 nt, Human
ccccacccacccaugcca

SEQ ID NO: 53844 - RNA, 19 nt, Human
ccccgcacgcuucgggcca

SEQ ID NO: 53845 - RNA, 21 nt, Human
ccccgcacgcuucgggccaug

SEQ ID NO: 53846 - RNA, 18 nt, Human
ccccgccacucagcgccg

SEQ ID NO: 53847 - RNA, 22 nt, Human
ccccucggagcaggggccccgc

SEQ ID NO: 53848 - RNA, 18 nt, Human
cccugugcgaggaagggc

SEQ ID NO: 53849 - RNA, 20 nt, Human
cccugugcgaggaagggccc

SEQ ID NO: 53850 - RNA, 19 nt, Human
ccucaggccaggcaugccc

SEQ ID NO: 53851 - RNA, 19 nt, Human
ccucccaccagagcuagag

SEQ ID NO: 53852 - RNA, 24 nt, Human
ccuccugccucagcuucccaaagu

SEQ ID NO: 53853 - RNA, 24 nt, Human
ccucuaaucaggacgggguggggc

SEQ ID NO: 53854 - RNA, 18 nt, Human
ccugaccucaggugaucc

SEQ ID NO: 53855 - RNA, 21 nt, Human
ccugaccucaggugauccucc

SEQ ID NO: 53856 - RNA, 23 nt, Human
ccugaccucaggugauccuccug

SEQ ID NO: 53857 - RNA, 19 nt, Human
ccugccgaggucccgggag

SEQ ID NO: 53858 - RNA, 20 nt, Human
ccuugucuucugcuacuccg

SEQ ID NO: 53859 - RNA, 22 nt, Human
cgcugcgcucaggccaggagga

SEQ ID NO: 53860 - RNA, 23 nt, Human
cgggguggggcggggcucugagc

SEQ ID NO: 53861 - RNA, 24 nt, Human
cuacuccgcugaacuccuguuuau

SEQ ID NO: 53862 - RNA, 19 nt, Human
cucacagagggugggcugu

SEQ ID NO: 53863 - RNA, 25 nt, Human
cucaccccugaccaugacuccccca

SEQ ID NO: 53864 - RNA, 21 nt, Human
cucagcuguccaugaaaacag

SEQ ID NO: 53865 - RNA, 18 nt, Human
cucaggugauccuccugc

SEQ ID NO: 53866 - RNA, 21 nt, Human
cucccggguucacgccauucu

SEQ ID NO: 53867 - RNA, 24 nt, Human
cugccgaggucccgggagccgugu

SEQ ID NO: 53868 - RNA, 23 nt, Human
cugccucagccucaugaguagcu

SEQ ID NO: 53869 - RNA, 23 nt, Human
cugccucagcuucccaaagugcu

SEQ ID NO: 53870 - RNA, 18 nt, Human
cugucacccaggcuggag

SEQ ID NO: 53871 - RNA, 18 nt, Human
cuugccauaacagcccca

SEQ ID NO: 53872 - RNA, 20 nt, Human
gaagccaauucacuacccac

SEQ ID NO: 53873 - RNA, 24 nt, Human
gaauacaggcacaugccaccaugc

SEQ ID NO: 53874 - RNA, 23 nt, Human
gaaucaacuccaacuggaagcag

SEQ ID NO: 53875 - RNA, 22 nt, Human
gaccucaggugauccuccugcc

SEQ ID NO: 53876 - RNA, 24 nt, Human
gaccucaggugauccuccugccuc

SEQ ID NO: 53877 - RNA, 18 nt, Human
gaggucccgggagccgug

SEQ ID NO: 53878 - RNA, 20 nt, Human
gaguagcugggaauacaggc

SEQ ID NO: 53879 - RNA, 19 nt, Human
gagucuguuuuagaauugg

SEQ ID NO: 53880 - RNA, 20 nt, Human
gagucuguuuuagaauuggg

SEQ ID NO: 53881 - RNA, 18 nt, Human
gauuacaggcaugagcca

SEQ ID NO: 53882 - RNA, 20 nt, Human
gauuacaggcaugagccacc

SEQ ID NO: 53883 - RNA, 23 nt, Human
gauuacaggcaugagccaccuca

SEQ ID NO: 53884 - RNA, 24 nt, Human
gccauguuggccaggcugcucucg

SEQ ID NO: 53885 - RNA, 23 nt, Human
gcccaggcugggaccgguucugc

SEQ ID NO: 53886 - RNA, 20 nt, Human
gccccaacugcccaggaagc

SEQ ID NO: 53887 - RNA, 26 nt, Human
gccccacuugccauaacagccccaac

SEQ ID NO: 53888 - RNA, 24 nt, Human
gccucagcuucccaaagugcuggg

SEQ ID NO: 53889 - RNA, 20 nt, Human
gccucaugaguagcugggaa

SEQ ID NO: 53890 - RNA, 24 nt, Human
gcgcaggaaggguucuccccaggg

SEQ ID NO: 53891 - RNA, 19 nt, Human
gcucugagcuggggaagcg

SEQ ID NO: 53892 - RNA, 25 nt, Human
gcucugucacccaggcuggagugca

SEQ ID NO: 53893 - RNA, 19 nt, Human
gcuggagugcaguggcgca

SEQ ID NO: 53894 - RNA, 20 nt, Human
ggaauacaggcacaugccac

SEQ ID NO: 53895 - RNA, 18 nt, Human
ggacgggguggggcgggg

SEQ ID NO: 53896 - RNA, 19 nt, Human
ggagcccaggcugggaccg

SEQ ID NO: 53897 - RNA, 19 nt, Human
ggauuacaggcaugagcca

SEQ ID NO: 53898 - RNA, 23 nt, Human
ggcaaagggaggcugaggaggaa

SEQ ID NO: 53899 - RNA, 19 nt, Human
ggcggggcucugagcuggg

SEQ ID NO: 53900 - RNA, 22 nt, Human
ggcuggggacuugcggccaggu

SEQ ID NO: 53901 - RNA, 23 nt, Human
gggaggcugaggaggaacggagg

SEQ ID NO: 53902 - RNA, 25 nt, Human
gggcaggcgggguccacaagaggcu

SEQ ID NO: 53903 - RNA, 21 nt, Human
gggccaaggcacagagcaaga

SEQ ID NO: 53904 - RNA, 18 nt, Human
gggcggggcucugagcug

SEQ ID NO: 53905 - RNA, 21 nt, Human
gggcggggcucugagcugggg

SEQ ID NO: 53906 - RNA, 19 nt, Human
ggggcggggcucugagcug

SEQ ID NO: 53907 - RNA, 21 nt, Human
gggggacauugagucuguuuu

SEQ ID NO: 53908 - RNA, 22 nt, Human
gggggugagggggacauugagu

SEQ ID NO: 53909 - RNA, 22 nt, Human
gggguuuugccauguuggccag

SEQ ID NO: 53910 - RNA, 23 nt, Human
gggguuuugccauguuggccagg

SEQ ID NO: 53911 - RNA, 22 nt, Human
ggguggcuggcaaagggaggcu

SEQ ID NO: 53912 - RNA, 22 nt, Human
ggguuuugccauguuggccagg

SEQ ID NO: 53913 - RNA, 23 nt, Human
guaaauaagggguuuugccaugu

SEQ ID NO: 53914 - RNA, 24 nt, Human
guccucaggccaggcaugcccugu

SEQ ID NO: 53915 - RNA, 24 nt, Human
gucuugcucugucacccaggcugg

SEQ ID NO: 53916 - RNA, 24 nt, Human
gugauccuccugccucagcuuccc

SEQ ID NO: 53917 - RNA, 18 nt, Human
gugcucucuggggagggg

SEQ ID NO: 53918 - RNA, 18 nt, Human
gugggcgccggggccagu

SEQ ID NO: 53919 - RNA, 21 nt, Human
uaaaggaaacuuuaaauaacc

SEQ ID NO: 53920 - RNA, 23 nt, Human
uaaccaauggaaaugaaaaacca

SEQ ID NO: 53921 - RNA, 19 nt, Human
uaaguuuuuguauuuuuag

SEQ ID NO: 53922 - RNA, 23 nt, Human
uacaggcacaugccaccaugccc

SEQ ID NO: 53923 - RNA, 20 nt, Human
uacaggcaugagccaccuca

SEQ ID NO: 53924 - RNA, 19 nt, Human
uacaugccuugucuucugc

SEQ ID NO: 53925 - RNA, 24 nt, Human
uaguaaauaagggguuuugccaug

SEQ ID NO: 53926 - RNA, 22 nt, Human
ucacccaggcuggagugcagug

SEQ ID NO: 53927 - RNA, 18 nt, Human
ucaggccaggcaugcccu

SEQ ID NO: 53928 - RNA, 24 nt, Human
ucaugaguagcugggaauacaggc

SEQ ID NO: 53929 - RNA, 23 nt, Human
ucauugcaagcuccacucccggg

SEQ ID NO: 53930 - RNA, 24 nt, Human
ucccaaagugcugggauuacaggc

SEQ ID NO: 53931 - RNA, 21 nt, Human
ucccggguucacgccauucuc

SEQ ID NO: 53932 - RNA, 24 nt, Human
ucccggguucacgccauucuccug

SEQ ID NO: 53933 - RNA, 24 nt, Human
ucuccugccucagccucaugagua

SEQ ID NO: 53934 - RNA, 23 nt, Human
ucucgaacuccugaccucaggug

SEQ ID NO: 53935 - RNA, 23 nt, Human
ucucuggggaggggugcgggugg

SEQ ID NO: 53936 - RNA, 24 nt, Human
ucugucacccaggcuggagugcag

SEQ ID NO: 53937 - RNA, 21 nt, Human
ucugugcucagcagggcaggg

SEQ ID NO: 53938 - RNA, 23 nt, Human
ucuugcucugucacccaggcugg

SEQ ID NO: 53939 - RNA, 24 nt, Human
ucuugcucugucacccaggcugga

SEQ ID NO: 53940 - RNA, 18 nt, Human
ucuuuuuuuuuuuuuuuu

SEQ ID NO: 53941 - RNA, 28 nt, Human
ugaaaacaggauaagcggcuuccucccu

SEQ ID NO: 53942 - RNA, 18 nt, Human
ugaccucaggugauccuc

SEQ ID NO: 53943 - RNA, 20 nt, Human
ugaccucaggugauccuccu

SEQ ID NO: 53944 - RNA, 24 nt, Human
ugaccucaggugauccuccugccu

SEQ ID NO: 53945 - RNA, 22 nt, Human
ugagacggagucuugcucuguc

SEQ ID NO: 53946 - RNA, 19 nt, Human
ugagaugcccuuuucagac

SEQ ID NO: 53947 - RNA, 22 nt, Human
ugagaugcccuuuucagacccu

SEQ ID NO: 53948 - RNA, 24 nt, Human
ugaggggcuggggacuugcggcca

SEQ ID NO: 53949 - RNA, 21 nt, Human
ugaggugggggugagggggac

SEQ ID NO: 53950 - RNA, 21 nt, Human
ugaugaggucaaaaaaugaaa

SEQ ID NO: 53951 - RNA, 22 nt, Human
ugcaguggcgcaaucuuggcuc

SEQ ID NO: 53952 - RNA, 23 nt, Human
ugcaguggcgcaaucuuggcuca

SEQ ID NO: 53953 - RNA, 27 nt, Human
ugccauguuggccaggcugcucucgaa

SEQ ID NO: 53954 - RNA, 25 nt, Human
ugcccggcuaaguuuuuguauuuuu

SEQ ID NO: 53955 - RNA, 24 nt, Human
ugccucagccucaugaguagcugg

SEQ ID NO: 53956 - RNA, 24 nt, Human
ugccucagcuucccaaagugcugg

SEQ ID NO: 53957 - RNA, 23 nt, Human
ugcgaggaagggccccgggccuc

SEQ ID NO: 53958 - RNA, 21 nt, Human
ugcucucgaacuccugaccuc

SEQ ID NO: 53959 - RNA, 20 nt, Human
ugcucucuggggaggggugc

SEQ ID NO: 53960 - RNA, 24 nt, Human
ugcucugucacccaggcuggagug

SEQ ID NO: 53961 - RNA, 23 nt, Human
uggagugcaguggcgcaaucuug

SEQ ID NO: 53962 - RNA, 24 nt, Human
uggagugcaguggcgcaaucuugg

SEQ ID NO: 53963 - RNA, 18 nt, Human
uggcaaagggaggcugag

SEQ ID NO: 53964 - RNA, 24 nt, Human
uggccaggcugcucucgaacuccu

SEQ ID NO: 53965 - RNA, 20 nt, Human
uggcgcaaucuuggcucauu

SEQ ID NO: 53966 - RNA, 24 nt, Human
uggcucccccuacaugccuugucu

SEQ ID NO: 53967 - RNA, 22 nt, Human
ugggaauacaggcacaugccac

SEQ ID NO: 53968 - RNA, 24 nt, Human
ugggaauacaggcacaugccacca

SEQ ID NO: 53969 - RNA, 25 nt, Human
ugggaauacaggcacaugccaccau

SEQ ID NO: 53970 - RNA, 18 nt, Human
ugggauuacaggcaugag

SEQ ID NO: 53971 - RNA, 21 nt, Human
ugggauuacaggcaugagcca

SEQ ID NO: 53972 - RNA, 22 nt, Human
ugggauuacaggcaugagccac

SEQ ID NO: 53973 - RNA, 23 nt, Human
ugggauuacaggcaugagccacc

SEQ ID NO: 53974 - RNA, 23 nt, Human
ugggauuacaggcaugagccacc

SEQ ID NO: 53975 - RNA, 23 nt, Human
ugggauuacaggcaugagccacc

SEQ ID NO: 53976 - RNA, 24 nt, Human
ugggauuacaggcaugagccaccu

SEQ ID NO: 53977 - RNA, 25 nt, Human
ugggauuacaggcaugagccaccuc

SEQ ID NO: 53978 - RNA, 21 nt, Human
ugggccgccccaacugcccag

SEQ ID NO: 53979 - RNA, 22 nt, Human
ugggccucccccauucaauuuc

SEQ ID NO: 53980 - RNA, 21 nt, Human
uggggcggggcucugagcugg

SEQ ID NO: 53981 - RNA, 21 nt, Human
ugucacccaggcuggagugca

SEQ ID NO: 53982 - RNA, 21 nt, Human
uguucuggucuccagcccuca

SEQ ID NO: 53983 - RNA, 22 nt, Human
uuaaagggcacgcagcuugggc

SEQ ID NO: 53984 - RNA, 24 nt, Human
uuaguaaauaagggguuuugccau

SEQ ID NO: 53985 - RNA, 25 nt, Human
uuaguaaauaagggguuuugccaug

SEQ ID NO: 53986 - RNA, 24 nt, Human
uugcucugucacccaggcuggagu

SEQ ID NO: 53987 - RNA, 21 nt, Human
uuggcucauugcaagcuccac

SEQ ID NO: 53988 - RNA, 20 nt, Human
uuuaaauaaccaauggaaau

SEQ ID NO: 53989 - RNA, 21 nt, Human
uuuuuaguaaauaagggguuu

SEQ ID NO: 53990 - RNA, 24 nt, Human
uuuuuuuuuuuugagacggagucu

SEQ ID NO: 53991 - RNA, 22 nt, Human
uuuuuuuuuuuuuugagacgga

SEQ ID NO: 53992 - RNA, 18 nt, Human
uuuuuuuuuuuuuuuuug

SEQ ID NO: 53993 - RNA, 21 nt, Human
aaaaugccacaacaggggaua

SEQ ID NO: 53994 - RNA, 21 nt, Human
aagagucccuucacacagugc

SEQ ID NO: 53995 - RNA, 20 nt, Human
aagcugccuugucucugggc

SEQ ID NO: 53996 - RNA, 19 nt, Human
aaguauuccucugagcccc

SEQ ID NO: 53997 - RNA, 24 nt, Human
acacacacacacaacacacauaca

SEQ ID NO: 53998 - RNA, 31 nt, Human
acacacacacacacaacacacauacacacag

SEQ ID NO: 53999 - RNA, 26 nt, Human
acacacacacacacacaacacacaua

SEQ ID NO: 54000 - RNA, 31 nt, Human
acacacacacacacacaacacacauacacag

SEQ ID NO: 54001 - RNA, 24 nt, Human
acccugaccacccuuccccucugc

SEQ ID NO: 54002 - RNA, 25 nt, Human
acuugcucauuuauuuaaaagaguc

SEQ ID NO: 54003 - RNA, 18 nt, Human
agaguagcacacacgcca

SEQ ID NO: 54004 - RNA, 18 nt, Human
aggaagcagauaucuuuc

SEQ ID NO: 54005 - RNA, 18 nt, Human
aggcaccucauugaaaau

SEQ ID NO: 54006 - RNA, 24 nt, Human
agugcuaucuccacuagaccaagc

SEQ ID NO: 54007 - RNA, 19 nt, Human
aucuccacuagaccaagcu

SEQ ID NO: 54008 - RNA, 25 nt, Human
augcacacacacacacacacaacac

SEQ ID NO: 54009 - RNA, 21 nt, Human
auuucauucccuucccccucc

SEQ ID NO: 54010 - RNA, 18 nt, Human
caaagcucccuguuccaa

SEQ ID NO: 54011 - RNA, 25 nt, Human
cacaacacacauacacacagaugag

SEQ ID NO: 54012 - RNA, 27 nt, Human
cacacaacacacauacacacagauggu

SEQ ID NO: 54013 - RNA, 20 nt, Human
cacacacacacaacacacau

SEQ ID NO: 54014 - RNA, 25 nt, Human
cacacacacacacaacacacauaca

SEQ ID NO: 54015 - RNA, 25 nt, Human
cacccuuccccucugccaccacugg

SEQ ID NO: 54016 - RNA, 18 nt, Human
cacccuuccccucugccc

SEQ ID NO: 54017 - RNA, 21 nt, Human
cagcugaggaaacaggagcac

SEQ ID NO: 54018 - RNA, 23 nt, Human
ccaagcugccuugucucugggcu

SEQ ID NO: 54019 - RNA, 20 nt, Human
ccagguacugagcaaaaacc

SEQ ID NO: 54020 - RNA, 18 nt, Human
cccccuccccuugauucc

SEQ ID NO: 54021 - RNA, 20 nt, Human
ccccucugcccagcaccuag

SEQ ID NO: 54022 - RNA, 20 nt, Human
ccccugaacuccaagcacag

SEQ ID NO: 54023 - RNA, 20 nt, Human
cccucaccagcccucccuca

SEQ ID NO: 54024 - RNA, 21 nt, Human
cccuuuccauuucauucccuu

SEQ ID NO: 54025 - RNA, 20 nt, Human
ccucacccugaccacccuuc

SEQ ID NO: 54026 - RNA, 24 nt, Human
ccucacccugaccacccuuccccu

SEQ ID NO: 54027 - RNA, 21 nt, Human
ccucccuuuccauuucauucc

SEQ ID NO: 54028 - RNA, 26 nt, Human
cgaugcacacacacacacacacaaca

SEQ ID NO: 54029 - RNA, 27 nt, Human
cgaugcacacacacacacacacaacac

SEQ ID NO: 54030 - RNA, 21 nt, Human
cgccaaagauacaucaagcaa

SEQ ID NO: 54031 - RNA, 22 nt, Human
cgccgaagucucucacugccac

SEQ ID NO: 54032 - RNA, 20 nt, Human
cucccucaccauccucaccc

SEQ ID NO: 54033 - RNA, 27 nt, Human
cuccuaccacacagcugccagcgacaa

SEQ ID NO: 54034 - RNA, 19 nt, Human
gaaauuccuucuuggaccc

SEQ ID NO: 54035 - RNA, 19 nt, Human
gcaagacgauaggauugug

SEQ ID NO: 54036 - RNA, 26 nt, Human
gcacacacacacacacacaacacaca

SEQ ID NO: 54037 - RNA, 18 nt, Human
gccauuaaggccaagaag

SEQ ID NO: 54038 - RNA, 19 nt, Human
gccucacagggauggaaag

SEQ ID NO: 54039 - RNA, 23 nt, Human
gcgaugcacacacacacacacac

SEQ ID NO: 54040 - RNA, 18 nt, Human
gcucauuuauuuaaaaga

SEQ ID NO: 54041 - RNA, 21 nt, Human
ggaaagaaauuccuucuugga

SEQ ID NO: 54042 - RNA, 18 nt, Human
gucucgccuggccuucug

SEQ ID NO: 54043 - RNA, 25 nt, Human
uaaaagaaacugccacacuacaaua

SEQ ID NO: 54044 - RNA, 23 nt, Human
uaaaagagucccuucacacagug

SEQ ID NO: 54045 - RNA, 22 nt, Human
uaccacacagcugccagcgaca

SEQ ID NO: 54046 - RNA, 21 nt, Human
uagcacacacgccaaagauac

SEQ ID NO: 54047 - RNA, 23 nt, Human
uagccuaguaaauuagugguaag

SEQ ID NO: 54048 - RNA, 22 nt, Human
uaucuaaaaaaaaugccacaac

SEQ ID NO: 54049 - RNA, 22 nt, Human
ucacaggauuugagaauggaaa

SEQ ID NO: 54050 - RNA, 21 nt, Human
ucacccugaccacccuucccc

SEQ ID NO: 54051 - RNA, 18 nt, Human
ucauaugcacauacuugg

SEQ ID NO: 54052 - RNA, 24 nt, Human
uccaagcacagugcuaucuccacu

SEQ ID NO: 54053 - RNA, 25 nt, Human
uccaagcuauagacagacaggacaa

SEQ ID NO: 54054 - RNA, 19 nt, Human
uccaaguauuccucugagc

SEQ ID NO: 54055 - RNA, 20 nt, Human
uccagaguaaaugaaaaccc

SEQ ID NO: 54056 - RNA, 22 nt, Human
ucccucaccauccucacccuga

SEQ ID NO: 54057 - RNA, 20 nt, Human
ucccuguuccaagcuauaga

SEQ ID NO: 54058 - RNA, 23 nt, Human
uccgccgaagucucucacugcca

SEQ ID NO: 54059 - RNA, 19 nt, Human
uccuaccacacagcugcca

SEQ ID NO: 54060 - RNA, 19 nt, Human
uccuagguccccugaacuc

SEQ ID NO: 54061 - RNA, 19 nt, Human
uccucacccugaccacccu

SEQ ID NO: 54062 - RNA, 19 nt, Human
ucucuuucaaauguggaga

SEQ ID NO: 54063 - RNA, 27 nt, Human
ucugcccagcaccuaagagcagggauc

SEQ ID NO: 54064 - RNA, 23 nt, Human
ucuuucaaauguggagaugguuu

SEQ ID NO: 54065 - RNA, 19 nt, Human
ucuuuggaugacauagcuu

SEQ ID NO: 54066 - RNA, 22 nt, Human
ugaaaauaauacaucacagugc

SEQ ID NO: 54067 - RNA, 23 nt, Human
ugaaaguagguagccuaguaaau

SEQ ID NO: 54068 - RNA, 24 nt, Human
ugaacuccaagcacagugcuaucu

SEQ ID NO: 54069 - RNA, 19 nt, Human
ugagauaaaagcugagguc

SEQ ID NO: 54070 - RNA, 21 nt, Human
ugagccccucaccagcccucc

SEQ ID NO: 54071 - RNA, 20 nt, Human
ugcacacacacacacacaca

SEQ ID NO: 54072 - RNA, 23 nt, Human
ugccuugucucugggcucaagag

SEQ ID NO: 54073 - RNA, 27 nt, Human
ugcgaugcacacacacacacacacagu

SEQ ID NO: 54074 - RNA, 22 nt, Human
uggaaaggacaaucuuuggaug

SEQ ID NO: 54075 - RNA, 19 nt, Human
uggaccuccuaccacacag

SEQ ID NO: 54076 - RNA, 18 nt, Human
uggcaugugcuggguagc

SEQ ID NO: 54077 - RNA, 21 nt, Human
ugggauuuguccuaggucccc

SEQ ID NO: 54078 - RNA, 23 nt, Human
ugggguucugagauaaaagcuga

SEQ ID NO: 54079 - RNA, 22 nt, Human
uuacacuuuaaaaacucucacc

SEQ ID NO: 54080 - RNA, 22 nt, Human
aaaaaaaaaagaaaaaaaaaag

SEQ ID NO: 54081 - RNA, 21 nt, Human
aaaagaaaaaaaaaagccaaa

SEQ ID NO: 54082 - RNA, 19 nt, Human
aaaagccuaagagugaaaa

SEQ ID NO: 54083 - RNA, 21 nt, Human
aaacaaccacuaugaguaagu

SEQ ID NO: 54084 - RNA, 24 nt, Human
aaacagauguccaaaaaaaaaaga

SEQ ID NO: 54085 - RNA, 19 nt, Human
aacagcugucaaaaaccaa

SEQ ID NO: 54086 - RNA, 18 nt, Human
aaccccuccccucagccc

SEQ ID NO: 54087 - RNA, 19 nt, Human
aaccccuccccucagccca

SEQ ID NO: 54088 - RNA, 26 nt, Human
acagauguccaaaaaaaaaagaaaaa

SEQ ID NO: 54089 - RNA, 21 nt, Human
acagccuuuguggggaugggg

SEQ ID NO: 54090 - RNA, 19 nt, Human
accacaucuuccugguucu

SEQ ID NO: 54091 - RNA, 18 nt, Human
accagcuggagcugaagu

SEQ ID NO: 54092 - RNA, 20 nt, Human
agaaaaggaguuauuccuac

SEQ ID NO: 54093 - RNA, 19 nt, Human
agacaaccccuccccucag

SEQ ID NO: 54094 - RNA, 23 nt, Human
agaugcugcaagcuaccucagcu

SEQ ID NO: 54095 - RNA, 18 nt, Human
agccuuuguggggauggg

SEQ ID NO: 54096 - RNA, 19 nt, Human
agcugucaaaaaccagcug

SEQ ID NO: 54097 - RNA, 24 nt, Human
agcugucaaaaaccagcuggagcu

SEQ ID NO: 54098 - RNA, 23 nt, Human
augucaaaaauauuaccacagca

SEQ ID NO: 54099 - RNA, 25 nt, Human
auguccaaaaaaaaaagaaaaaaaa

SEQ ID NO: 54100 - RNA, 28 nt, Human
caaaaaaaaaagaaaaaaaaaagccaaa

SEQ ID NO: 54101 - RNA, 27 nt, Human
caaaaauauuaccacagcaacagcugu

SEQ ID NO: 54102 - RNA, 23 nt, Human
cacccuccgcucucacugggacu

SEQ ID NO: 54103 - RNA, 18 nt, Human
cagccccgaccgcggccc

SEQ ID NO: 54104 - RNA, 23 nt, Human
cagucacucaagaccagagaaac

SEQ ID NO: 54105 - RNA, 25 nt, Human
ccaauacuacacacacuauugaaug

SEQ ID NO: 54106 - RNA, 24 nt, Human
cccaggaugucugaaaaggagaga

SEQ ID NO: 54107 - RNA, 18 nt, Human
cccccuaccucuggcacc

SEQ ID NO: 54108 - RNA, 22 nt, Human
cccccuaccucuggcacccucc

SEQ ID NO: 54109 - RNA, 19 nt, Human
ccccggaggaagccccggg

SEQ ID NO: 54110 - RNA, 22 nt, Human
ccccggaggaagccccgggaac

SEQ ID NO: 54111 - RNA, 24 nt, Human
cccgaccgcggccccggaggaagc

SEQ ID NO: 54112 - RNA, 23 nt, Human
cggaaaaaaaugaacuguggaca

SEQ ID NO: 54113 - RNA, 19 nt, Human
cuacucauuuguuuuccua

SEQ ID NO: 54114 - RNA, 21 nt, Human
cucaagaccagagaaacaacc

SEQ ID NO: 54115 - RNA, 20 nt, Human
gaaaagaugcugcaagcuac

SEQ ID NO: 54116 - RNA, 29 nt, Human
gaacucuuucuacucauuuguuuuccuau

SEQ ID NO: 54117 - RNA, 19 nt, Human
gccccgaccgcggccccgg

SEQ ID NO: 54118 - RNA, 21 nt, Human
gccgccccuacagggggaagg

SEQ ID NO: 54119 - RNA, 20 nt, Human
gccugggacaaagccugggc

SEQ ID NO: 54120 - RNA, 19 nt, Human
ggaaaaaaaugaacugugg

SEQ ID NO: 54121 - RNA, 19 nt, Human
uaaaagaaaggaacagugu

SEQ ID NO: 54122 - RNA, 18 nt, Human
uaagacaaccccuccccu

SEQ ID NO: 54123 - RNA, 19 nt, Human
uaagacaaccccuccccuc

SEQ ID NO: 54124 - RNA, 19 nt, Human
uaagacaaccccuccccuc

SEQ ID NO: 54125 - RNA, 23 nt, Human
uaauaagauucucuucauagcuc

SEQ ID NO: 54126 - RNA, 19 nt, Human
uaccaggagggcacacacc

SEQ ID NO: 54127 - RNA, 26 nt, Human
uagaaaagaugcugcaagcuaccuca

SEQ ID NO: 54128 - RNA, 21 nt, Human
ucaaaaaccagcuggagcuga

SEQ ID NO: 54129 - RNA, 20 nt, Human
ucaauccauaaagucagacc

SEQ ID NO: 54130 - RNA, 21 nt, Human
uccaaaaaaaaaagaaaaaaa

SEQ ID NO: 54131 - RNA, 22 nt, Human
uccuggugcugugguucaacag

SEQ ID NO: 54132 - RNA, 21 nt, Human
ucuggcacccuccgcucucac

SEQ ID NO: 54133 - RNA, 22 nt, Human
ugaaaacagauguccaaaaaaa

SEQ ID NO: 54134 - RNA, 18 nt, Human
ugaaaggcagaggagggc

SEQ ID NO: 54135 - RNA, 22 nt, Human
ugaacuguggacacagucacuc

SEQ ID NO: 54136 - RNA, 23 nt, Human
ugaccacaucuuccugguucuuc

SEQ ID NO: 54137 - RNA, 20 nt, Human
ugagagggauaaaagcaaua

SEQ ID NO: 54138 - RNA, 21 nt, Human
uggacacagucacucaagacc

SEQ ID NO: 54139 - RNA, 19 nt, Human
ugguucaacagccuuugug

SEQ ID NO: 54140 - RNA, 18 nt, Human
ugucaaaaaccagcugga

SEQ ID NO: 54141 - RNA, 18 nt, Human
ugucaaaaaccagcugga

SEQ ID NO: 54142 - RNA, 18 nt, Human
uguggggauggggagaac

SEQ ID NO: 54143 - RNA, 19 nt, Human
uucaacuagaaaagaugcu

SEQ ID NO: 54144 - RNA, 23 nt, Human
uucacaauaaaagaaaggaacag

SEQ ID NO: 54145 - RNA, 19 nt, Human
uuccugguucuuccauugg

SEQ ID NO: 54146 - RNA, 25 nt, Human
uuuuuuucacaauaaaagaaaggaa

SEQ ID NO: 54147 - RNA, 25 nt, Human
aaacccucucaagcaagcaacauac

SEQ ID NO: 54148 - RNA, 25 nt, Human
aaacccucucaagcaagcaacauac

SEQ ID NO: 54149 - RNA, 23 nt, Human
aacagcuauccacggaauccaug

SEQ ID NO: 54150 - RNA, 24 nt, Human
aacucacauagcgccccugcuugc

SEQ ID NO: 54151 - RNA, 23 nt, Human
aagagcagaagcugcacugcaga

SEQ ID NO: 54152 - RNA, 23 nt, Human
aagagcagaagcugcacugcaga

SEQ ID NO: 54153 - RNA, 20 nt, Human
aagcaacauacaucccuggc

SEQ ID NO: 54154 - RNA, 20 nt, Human
aagcaacauacaucccuggc

SEQ ID NO: 54155 - RNA, 20 nt, Human
aaguucccagaucacagucu

SEQ ID NO: 54156 - RNA, 24 nt, Human
acacauauuuacagaguuugcaca

SEQ ID NO: 54157 - RNA, 24 nt, Human
acacauauuuacagaguuugcaca

SEQ ID NO: 54158 - RNA, 19 nt, Human
acaccacuucaucuccaac

SEQ ID NO: 54159 - RNA, 19 nt, Human
acaccuugcuggguagugc

SEQ ID NO: 54160 - RNA, 18 nt, Human
acaguugcaauuuaaaaa

SEQ ID NO: 54161 - RNA, 18 nt, Human
acaguugcaauuuaaaaa

SEQ ID NO: 54162 - RNA, 20 nt, Human
accucgaucucccagaugau

SEQ ID NO: 54163 - RNA, 23 nt, Human
agaaaggacuuucuggagaggac

SEQ ID NO: 54164 - RNA, 23 nt, Human
agaaaggacuuucuggagaggac

SEQ ID NO: 54165 - RNA, 19 nt, Human
agaaggaagaagaggggaa

SEQ ID NO: 54166 - RNA, 19 nt, Human
agaaggaagaagaggggaa

SEQ ID NO: 54167 - RNA, 21 nt, Human
agaggggaauggaacaggggg

SEQ ID NO: 54168 - RNA, 21 nt, Human
agaggggaauggaacaggggg

SEQ ID NO: 54169 - RNA, 19 nt, Human
aggaagaagaggggaaugg

SEQ ID NO: 54170 - RNA, 19 nt, Human
aggaagaagaggggaaugg

SEQ ID NO: 54171 - RNA, 28 nt, Human
aggaagaagaggggaauggaacaggggg

SEQ ID NO: 54172 - RNA, 28 nt, Human
aggaagaagaggggaauggaacaggggg

SEQ ID NO: 54173 - RNA, 21 nt, Human
aggaggcaaccacuugggcuc

SEQ ID NO: 54174 - RNA, 20 nt, Human
aggaugucaucggcagagaa

SEQ ID NO: 54175 - RNA, 20 nt, Human
aggcagugccagugaaggca

SEQ ID NO: 54176 - RNA, 18 nt, Human
aggcugcgcagcgcgugg

SEQ ID NO: 54177 - RNA, 21 nt, Human
agggaccgguuuaucaacacc

SEQ ID NO: 54178 - RNA, 18 nt, Human
aggggcccuggccagagg

SEQ ID NO: 54179 - RNA, 18 nt, Human
aggggcccuggccagagg

SEQ ID NO: 54180 - RNA, 19 nt, Human
agugaaggcaaugggggag

SEQ ID NO: 54181 - RNA, 23 nt, Human
auagcgccccugcuugccaauua

SEQ ID NO: 54182 - RNA, 21 nt, Human
auaggacuacaguauggauaa

SEQ ID NO: 54183 - RNA, 21 nt, Human
auaggacuacaguauggauaa

SEQ ID NO: 54184 - RNA, 21 nt, Human
aucggggugcgggaugcggag

SEQ ID NO: 54185 - RNA, 18 nt, Human
auugaccugguugaccac

SEQ ID NO: 54186 - RNA, 19 nt, Human
caaaaaaagacucucagga

SEQ ID NO: 54187 - RNA, 19 nt, Human
caaaaaaagacucucagga

SEQ ID NO: 54188 - RNA, 22 nt, Human
caaaaaaagacucucaggaagc

SEQ ID NO: 54189 - RNA, 22 nt, Human
caaaaaaagacucucaggaagc

SEQ ID NO: 54190 - RNA, 18 nt, Human
caacagugcaaaaaaaga

SEQ ID NO: 54191 - RNA, 25 nt, Human
cacacuguccagaaggacuucugcu

SEQ ID NO: 54192 - RNA, 21 nt, Human
caccaggccccguccgcaccg

SEQ ID NO: 54193 - RNA, 19 nt, Human
caccagggaccgguuuauc

SEQ ID NO: 54194 - RNA, 25 nt, Human
cacgaacaggugcccggcauugacc

SEQ ID NO: 54195 - RNA, 18 nt, Human
cacuggggugggcaaggu

SEQ ID NO: 54196 - RNA, 18 nt, Human
caggggcggcacagauga

SEQ ID NO: 54197 - RNA, 23 nt, Human
caguuggacuguaacuugucacc

SEQ ID NO: 54198 - RNA, 33 nt, Human
ccaagagcagaagcugcacugcagaguuuacua

SEQ ID NO: 54199 - RNA, 22 nt, Human
ccacacuccacagcugaaucag

SEQ ID NO: 54200 - RNA, 21 nt, Human
ccacuggggugggcaaggugg

SEQ ID NO: 54201 - RNA, 25 nt, Human
cccgcagcgccgcgcuuccgcagcu

SEQ ID NO: 54202 - RNA, 22 nt, Human
ccgccggcccccggcugugccc

SEQ ID NO: 54203 - RNA, 18 nt, Human
ccggcccgcagcgccgcg

SEQ ID NO: 54204 - RNA, 18 nt, Human
ccuggccugucugccagu

SEQ ID NO: 54205 - RNA, 18 nt, Human
ccuggccugucugccagu

SEQ ID NO: 54206 - RNA, 21 nt, Human
ccuuuggcuuugcgaagagaa

SEQ ID NO: 54207 - RNA, 23 nt, Human
cgaagagaacccauaguuccauc

SEQ ID NO: 54208 - RNA, 23 nt, Human
cgaagagaacccauaguuccauc

SEQ ID NO: 54209 - RNA, 19 nt, Human
cucccccacgugcuagccc

SEQ ID NO: 54210 - RNA, 23 nt, Human
cuucaucuccaaccacacuccac

SEQ ID NO: 54211 - RNA, 24 nt, Human
gaaacccucucaagcaagcaacau

SEQ ID NO: 54212 - RNA, 24 nt, Human
gaaacccucucaagcaagcaacau

SEQ ID NO: 54213 - RNA, 26 nt, Human
gaaacccucucaagcaagcaacauac

SEQ ID NO: 54214 - RNA, 26 nt, Human
gaaacccucucaagcaagcaacauac

SEQ ID NO: 54215 - RNA, 22 nt, Human
gaagaagaggggaauggaacag

SEQ ID NO: 54216 - RNA, 22 nt, Human
gaagaagaggggaauggaacag

SEQ ID NO: 54217 - RNA, 20 nt, Human
gaguuacuuuuuuuuuuuuu

SEQ ID NO: 54218 - RNA, 18 nt, Human
gcaaaaaguucccagauc

SEQ ID NO: 54219 - RNA, 18 nt, Human
gcaaaaaguucccagauc

SEQ ID NO: 54220 - RNA, 22 nt, Human
gcacgucuacuuucacccucuu

SEQ ID NO: 54221 - RNA, 23 nt, Human
gcagcucccccacgugcuagccc

SEQ ID NO: 54222 - RNA, 22 nt, Human
gccaccaggccccguccgcacc

SEQ ID NO: 54223 - RNA, 23 nt, Human
gccccgcggcccggcccgcagcg

SEQ ID NO: 54224 - RNA, 26 nt, Human
gccugggcauuuuggaagccgggccc

SEQ ID NO: 54225 - RNA, 27 nt, Human
ggaagaagaggggaauggaacaggggg

SEQ ID NO: 54226 - RNA, 27 nt, Human
ggaagaagaggggaauggaacaggggg

SEQ ID NO: 54227 - RNA, 23 nt, Human
ggaaggagauagaaggaagaaga

SEQ ID NO: 54228 - RNA, 23 nt, Human
ggaaggagauagaaggaagaaga

SEQ ID NO: 54229 - RNA, 23 nt, Human
ggaggcuugaaguaauuacaccu

SEQ ID NO: 54230 - RNA, 25 nt, Human
ggcaagguggggauuccaggcugag

SEQ ID NO: 54231 - RNA, 19 nt, Human
ggcaaugggggagcguaga

SEQ ID NO: 54232 - RNA, 24 nt, Human
gggaaggagauagaaggaagaaga

SEQ ID NO: 54233 - RNA, 24 nt, Human
gggaaggagauagaaggaagaaga

SEQ ID NO: 54234 - RNA, 21 nt, Human
gggcaagguggggauuccagg

SEQ ID NO: 54235 - RNA, 25 nt, Human
ggguuggagccugccugggcauuuu

SEQ ID NO: 54236 - RNA, 22 nt, Human
ggucgaggcugcgcagcgcgug

SEQ ID NO: 54237 - RNA, 19 nt, Human
guucagcucuuugaacuuc

SEQ ID NO: 54238 - RNA, 24 nt, Human
uacaaccaggcuuggcaggauacc

SEQ ID NO: 54239 - RNA, 24 nt, Human
uacaaccaggcuuggcaggauacc

SEQ ID NO: 54240 - RNA, 18 nt, Human
uaccaguuccccucccca

SEQ ID NO: 54241 - RNA, 18 nt, Human
uaccaguuccccucccca

SEQ ID NO: 54242 - RNA, 20 nt, Human
uaccauacagucaccugucc

SEQ ID NO: 54243 - RNA, 20 nt, Human
uaccauacagucaccugucc

SEQ ID NO: 54244 - RNA, 20 nt, Human
uacuuuuuuuuuuuuuuaaa

SEQ ID NO: 54245 - RNA, 20 nt, Human
uacuuuuuuuuuuuuuuaaa

SEQ ID NO: 54246 - RNA, 19 nt, Human
uagaaggaagaagagggga

SEQ ID NO: 54247 - RNA, 19 nt, Human
uagaaggaagaagagggga

SEQ ID NO: 54248 - RNA, 27 nt, Human
uagagaccuaaaugaaguuuauaaaaa

SEQ ID NO: 54249 - RNA, 27 nt, Human
uagagaccuaaaugaaguuuauaaaaa

SEQ ID NO: 54250 - RNA, 24 nt, Human
uauccuuuggcuuugcgaagagaa

SEQ ID NO: 54251 - RNA, 24 nt, Human
uauccuuuggcuuugcgaagagaa

SEQ ID NO: 54252 - RNA, 21 nt, Human
ucaaaggcuuguguaguagcu

SEQ ID NO: 54253 - RNA, 22 nt, Human
ucaacaccacuucaucuccaac

SEQ ID NO: 54254 - RNA, 21 nt, Human
ucaagcaagcaacauacaucc

SEQ ID NO: 54255 - RNA, 21 nt, Human
ucaagcaagcaacauacaucc

SEQ ID NO: 54256 - RNA, 24 nt, Human
ucacagucucuaccauacagucac

SEQ ID NO: 54257 - RNA, 24 nt, Human
ucacagucucuaccauacagucac

SEQ ID NO: 54258 - RNA, 18 nt, Human
ucagaccugauuugccgg

SEQ ID NO: 54259 - RNA, 22 nt, Human
ucagcgcuuugucuacaugaug

SEQ ID NO: 54260 - RNA, 21 nt, Human
uccacagcugaaucagaggaa

SEQ ID NO: 54261 - RNA, 25 nt, Human
uccaugcuguuccugucagaaccug

SEQ ID NO: 54262 - RNA, 18 nt, Human
uccgcaccaggggcggca

SEQ ID NO: 54263 - RNA, 21 nt, Human
uccgcgcgccgccgccggccc

SEQ ID NO: 54264 - RNA, 18 nt, Human
uccuuuuuuuuuuuuuuu

SEQ ID NO: 54265 - RNA, 18 nt, Human
uccuuuuuuuuuuuuuuu

SEQ ID NO: 54266 - RNA, 19 nt, Human
ucuaccuacaggugacaug

SEQ ID NO: 54267 - RNA, 19 nt, Human
ucuaccuacaggugacaug

SEQ ID NO: 54268 - RNA, 19 nt, Human
ucugaacugucuacgcugg

SEQ ID NO: 54269 - RNA, 18 nt, Human
ugaccuccacggugaugc

SEQ ID NO: 54270 - RNA, 21 nt, Human
ugaccugguugaccacaauga

SEQ ID NO: 54271 - RNA, 26 nt, Human
ugagccaggaugucaucggcagagaa

SEQ ID NO: 54272 - RNA, 22 nt, Human
ugaguuacuuuuuuuuuuuuuu

SEQ ID NO: 54273 - RNA, 24 nt, Human
ugcacaaauagaaaaugguuacaa

SEQ ID NO: 54274 - RNA, 24 nt, Human
ugcacaaauagaaaaugguuacaa

SEQ ID NO: 54275 - RNA, 19 nt, Human
ugccugggcauuuuggaag

SEQ ID NO: 54276 - RNA, 23 nt, Human
ugcgaagagaacccauaguucca

SEQ ID NO: 54277 - RNA, 23 nt, Human
ugcgaagagaacccauaguucca

SEQ ID NO: 54278 - RNA, 18 nt, Human
ugcggaguccgcgcgccg

SEQ ID NO: 54279 - RNA, 22 nt, Human
ugcuucagaaaacucacauagc

SEQ ID NO: 54280 - RNA, 18 nt, Human
uggccagaggggccaaga

SEQ ID NO: 54281 - RNA, 18 nt, Human
uggccagaggggccaaga

SEQ ID NO: 54282 - RNA, 20 nt, Human
uggcggcaucugcuuccggu

SEQ ID NO: 54283 - RNA, 18 nt, Human
uguggcagaucuggacgc

SEQ ID NO: 54284 - RNA, 18 nt, Human
uguguuuagagaccuaaa

SEQ ID NO: 54285 - RNA, 18 nt, Human
uguguuuagagaccuaaa

SEQ ID NO: 54286 - RNA, 19 nt, Human
uguguuuagagaccuaaau

SEQ ID NO: 54287 - RNA, 23 nt, Human
uuaauucaaugaguuacuuuuuu

SEQ ID NO: 54288 - RNA, 23 nt, Human
uuaauucaaugaguuacuuuuuu

SEQ ID NO: 54289 - RNA, 18 nt, Human
uuggagccugccugggca

SEQ ID NO: 54290 - RNA, 19 nt, Human
uuuguuauuccgauguuca

SEQ ID NO: 54291 - RNA, 19 nt, Human
uuuguuauuccgauguuca

SEQ ID NO: 54292 - RNA, 20 nt, Human
uuuuuuuuuuuuaaacagau

SEQ ID NO: 54293 - RNA, 20 nt, Human
uuuuuuuuuuuuaaacagau

SEQ ID NO: 54294 - RNA, 21 nt, Human
aaaaaaacaaccccuucucau

SEQ ID NO: 54295 - RNA, 22 nt, Human
aaaaagaccaccaaaacaacca

SEQ ID NO: 54296 - RNA, 20 nt, Human
aaaacaaccaaagcagauga

SEQ ID NO: 54297 - RNA, 24 nt, Human
aaaacaaccaaagcagaugaaaca

SEQ ID NO: 54298 - RNA, 18 nt, Human
aaacaucagaacaucaaa

SEQ ID NO: 54299 - RNA, 21 nt, Human
aaaccaagacaggccauuaga

SEQ ID NO: 54300 - RNA, 23 nt, Human
aaacucccucccagggccugccu

SEQ ID NO: 54301 - RNA, 19 nt, Human
aaacuggaaggaaaaggua

SEQ ID NO: 54302 - RNA, 23 nt, Human
aaagcaaagccgagcagcaggca

SEQ ID NO: 54303 - RNA, 21 nt, Human
aaaguaugcacaaccaaaggc

SEQ ID NO: 54304 - RNA, 22 nt, Human
aaaucccaucagcaccaaccuc

SEQ ID NO: 54305 - RNA, 21 nt, Human
aacagugcuggcugccacuuc

SEQ ID NO: 54306 - RNA, 21 nt, Human
aacccucuccauuuucuaaga

SEQ ID NO: 54307 - RNA, 20 nt, Human
aacucugugccaggcacguu

SEQ ID NO: 54308 - RNA, 19 nt, Human
aagaagaaaacacagucaa

SEQ ID NO: 54309 - RNA, 21 nt, Human
aagaagaaaacacagucaaua

SEQ ID NO: 54310 - RNA, 20 nt, Human
aagaccaccaaaacaaccaa

SEQ ID NO: 54311 - RNA, 23 nt, Human
aagauaaauaaaauacgaagcca

SEQ ID NO: 54312 - RNA, 23 nt, Human
aagaugaaaacacggugggaaaa

SEQ ID NO: 54313 - RNA, 23 nt, Human
aagaugaaaacacggugggaaaa

SEQ ID NO: 54314 - RNA, 22 nt, Human
aagcaaagccgagcagcaggca

SEQ ID NO: 54315 - RNA, 18 nt, Human
aagcacaaaauuuuccag

SEQ ID NO: 54316 - RNA, 20 nt, Human
aauaagaagagccaagagaa

SEQ ID NO: 54317 - RNA, 21 nt, Human
aauuagccagucagcacacuu

SEQ ID NO: 54318 - RNA, 19 nt, Human
acaaagguauguaagcaca

SEQ ID NO: 54319 - RNA, 20 nt, Human
acaaaucauggccgaagcag

SEQ ID NO: 54320 - RNA, 19 nt, Human
acaaggagaagaaugcagg

SEQ ID NO: 54321 - RNA, 19 nt, Human
acaagggucugaagcuggu

SEQ ID NO: 54322 - RNA, 18 nt, Human
acacacugaaaaaaaucu

SEQ ID NO: 54323 - RNA, 19 nt, Human
acaggagaccacaggcuaa

SEQ ID NO: 54324 - RNA, 22 nt, Human
acauaauuacaaaugaauauac

SEQ ID NO: 54325 - RNA, 20 nt, Human
accaagcccaaacucccugc

SEQ ID NO: 54326 - RNA, 22 nt, Human
accacccuccugcggaucccca

SEQ ID NO: 54327 - RNA, 24 nt, Human
accuaacgacaacgacugagauga

SEQ ID NO: 54328 - RNA, 24 nt, Human
accuccccucccacaucaagaaac

SEQ ID NO: 54329 - RNA, 24 nt, Human
acgugcucuaacuucagcauccac

SEQ ID NO: 54330 - RNA, 20 nt, Human
acuucaaaagacacagagug

SEQ ID NO: 54331 - RNA, 19 nt, Human
acuuccaaggggggaagag

SEQ ID NO: 54332 - RNA, 18 nt, Human
acuuggauacacucuuuc

SEQ ID NO: 54333 - RNA, 18 nt, Human
acuuugugcucacgacua

SEQ ID NO: 54334 - RNA, 24 nt, Human
agaaaaagagcccuagaaacaaaa

SEQ ID NO: 54335 - RNA, 23 nt, Human
agaaagaaagauaaauaaaauac

SEQ ID NO: 54336 - RNA, 18 nt, Human
agaagaaugcagguucag

SEQ ID NO: 54337 - RNA, 18 nt, Human
agaaugaggcgggguggg

SEQ ID NO: 54338 - RNA, 21 nt, Human
agagcacguacgcaaguaaau

SEQ ID NO: 54339 - RNA, 20 nt, Human
agcaaaggggcgacucugaa

SEQ ID NO: 54340 - RNA, 21 nt, Human
agcacacaaauguccauagag

SEQ ID NO: 54341 - RNA, 23 nt, Human
agcagguuuuggccuuuggucug

SEQ ID NO: 54342 - RNA, 23 nt, Human
aggaaaguucaaaaccaagccca

SEQ ID NO: 54343 - RNA, 18 nt, Human
aggcaaagguaggucaga

SEQ ID NO: 54344 - RNA, 23 nt, Human
aggcacacagaucuccagcagcc

SEQ ID NO: 54345 - RNA, 19 nt, Human
aggcagccaucuguaucug

SEQ ID NO: 54346 - RNA, 19 nt, Human
aggcagccaucuguaucug

SEQ ID NO: 54347 - RNA, 20 nt, Human
aggggcacccggccuacauu

SEQ ID NO: 54348 - RNA, 22 nt, Human
aggucagcgcggagcccgagca

SEQ ID NO: 54349 - RNA, 18 nt, Human
aggucucaaaacuuugug

SEQ ID NO: 54350 - RNA, 18 nt, Human
aguacugggugaacugcu

SEQ ID NO: 54351 - RNA, 19 nt, Human
agucaauaaaguuuaugcc

SEQ ID NO: 54352 - RNA, 18 nt, Human
aguugggugguuugaggg

SEQ ID NO: 54353 - RNA, 23 nt, Human
auacuaaaauccuugggaagacc

SEQ ID NO: 54354 - RNA, 24 nt, Human
auagaaaccaagacaggccauuag

SEQ ID NO: 54355 - RNA, 22 nt, Human
auagaaagcacuucuguggaca

SEQ ID NO: 54356 - RNA, 19 nt, Human
auggacccccucccuuuaa

SEQ ID NO: 54357 - RNA, 22 nt, Human
auggccgaagcagagucugggc

SEQ ID NO: 54358 - RNA, 22 nt, Human
caaaaaaacaaccccuucucau

SEQ ID NO: 54359 - RNA, 25 nt, Human
caaaaccaagcccaaacucccugcc

SEQ ID NO: 54360 - RNA, 19 nt, Human
caaaagcacaggcagccac

SEQ ID NO: 54361 - RNA, 21 nt, Human
caaaagcacaggcagccacca

SEQ ID NO: 54362 - RNA, 24 nt, Human
caaacccggagaacaggggcaccc

SEQ ID NO: 54363 - RNA, 22 nt, Human
caaccaaagcagaugaaacauc

SEQ ID NO: 54364 - RNA, 23 nt, Human
caacuccaaugcaaauacuaaaa

SEQ ID NO: 54365 - RNA, 22 nt, Human
caagccccggguagaucucagg

SEQ ID NO: 54366 - RNA, 24 nt, Human
caagccccggguagaucucaggaa

SEQ ID NO: 54367 - RNA, 18 nt, Human
caagugaacaaagaugaa

SEQ ID NO: 54368 - RNA, 18 nt, Human
caagugaacaaagaugaa

SEQ ID NO: 54369 - RNA, 21 nt, Human
cacaaaucauggccgaagcag

SEQ ID NO: 54370 - RNA, 22 nt, Human
cacaaaucauggccgaagcaga

SEQ ID NO: 54371 - RNA, 23 nt, Human
cacagaucaaguccaaaacaucu

SEQ ID NO: 54372 - RNA, 18 nt, Human
caccuccccucccacauc

SEQ ID NO: 54373 - RNA, 21 nt, Human
caccuccccucccacaucaag

SEQ ID NO: 54374 - RNA, 19 nt, Human
cacgccuuuaacccuuagu

SEQ ID NO: 54375 - RNA, 24 nt, Human
cacucgaauaagaagagccaagag

SEQ ID NO: 54376 - RNA, 19 nt, Human
cagaagccccuccggacug

SEQ ID NO: 54377 - RNA, 20 nt, Human
cagcaaaguuugauguagug

SEQ ID NO: 54378 - RNA, 20 nt, Human
cagcaucuggguuuuaaccc

SEQ ID NO: 54379 - RNA, 21 nt, Human
cagcaucuggguuuuaacccg

SEQ ID NO: 54380 - RNA, 19 nt, Human
cagcccaaccugagagucc

SEQ ID NO: 54381 - RNA, 22 nt, Human
cagcuguccuagcuucagagca

SEQ ID NO: 54382 - RNA, 22 nt, Human
cagcuguccuagcuucagagca

SEQ ID NO: 54383 - RNA, 22 nt, Human
caggacugucuuucuaaacucc

SEQ ID NO: 54384 - RNA, 19 nt, Human
caguccgagucaccccaaa

SEQ ID NO: 54385 - RNA, 19 nt, Human
cauaagaagggcgcuuuca

SEQ ID NO: 54386 - RNA, 26 nt, Human
caucaagaaacaacgccaaaggucuc

SEQ ID NO: 54387 - RNA, 24 nt, Human
caucaagccuucucucacugguuu

SEQ ID NO: 54388 - RNA, 22 nt, Human
cauugccucaggaacacagcca

SEQ ID NO: 54389 - RNA, 22 nt, Human
ccaaaaaaacaaccccuucuca

SEQ ID NO: 54390 - RNA, 19 nt, Human
ccaaaacaaccaaagcaga

SEQ ID NO: 54391 - RNA, 20 nt, Human
ccaaaacgcagagggugcac

SEQ ID NO: 54392 - RNA, 19 nt, Human
ccaaccagaaccugaccaa

SEQ ID NO: 54393 - RNA, 19 nt, Human
ccaagcccaaacucccugc

SEQ ID NO: 54394 - RNA, 27 nt, Human
ccagaacagacagccaagccccgggua

SEQ ID NO: 54395 - RNA, 20 nt, Human
ccagcccaaccugagagucc

SEQ ID NO: 54396 - RNA, 20 nt, Human
ccaggcacugcccuugugcu

SEQ ID NO: 54397 - RNA, 20 nt, Human
ccauagguggcugcgcaccu

SEQ ID NO: 54398 - RNA, 18 nt, Human
ccaucuaaaacuagguug

SEQ ID NO: 54399 - RNA, 20 nt, Human
cccaaaaaaacaaccccuuc

SEQ ID NO: 54400 - RNA, 24 nt, Human
cccaaaaaaacaaccccuucucau

SEQ ID NO: 54401 - RNA, 25 nt, Human
cccaaaacuuaagcacaguuucagg

SEQ ID NO: 54402 - RNA, 19 nt, Human
cccaaacucccugcccucu

SEQ ID NO: 54403 - RNA, 24 nt, Human
cccacaucaagaaacaacgccaaa

SEQ ID NO: 54404 - RNA, 23 nt, Human
cccacgccuccccugcgcauccc

SEQ ID NO: 54405 - RNA, 23 nt, Human
ccccagauagcucucacgggggu

SEQ ID NO: 54406 - RNA, 30 nt, Human
cccccaaaacuuaagcacaguuucaggcag

SEQ ID NO: 54407 - RNA, 19 nt, Human
ccccgcgggccgagcuggg

SEQ ID NO: 54408 - RNA, 19 nt, Human
cccggggcucccccgcggg

SEQ ID NO: 54409 - RNA, 21 nt, Human
ccgagucaccccaaaaaaaca

SEQ ID NO: 54410 - RNA, 24 nt, Human
ccucaagugaacaaagaugaaaac

SEQ ID NO: 54411 - RNA, 24 nt, Human
ccucaagugaacaaagaugaaaac

SEQ ID NO: 54412 - RNA, 19 nt, Human
ccucacagccacccucuuu

SEQ ID NO: 54413 - RNA, 21 nt, Human
ccucacccagcaagggccaga

SEQ ID NO: 54414 - RNA, 23 nt, Human
ccucacccagcaagggccagaca

SEQ ID NO: 54415 - RNA, 22 nt, Human
ccucaggaacacagccaggagg

SEQ ID NO: 54416 - RNA, 20 nt, Human
ccucccagggccugccuggc

SEQ ID NO: 54417 - RNA, 26 nt, Human
ccucccuuuaaaauuucaucugggaa

SEQ ID NO: 54418 - RNA, 20 nt, Human
ccuccugcaaaucccaggag

SEQ ID NO: 54419 - RNA, 19 nt, Human
ccugaaacaccgagaucga

SEQ ID NO: 54420 - RNA, 18 nt, Human
ccugaaccacaggcagac

SEQ ID NO: 54421 - RNA, 22 nt, Human
ccugagaguccugggcagucac

SEQ ID NO: 54422 - RNA, 23 nt, Human
ccugaguagggccagcccaaccu

SEQ ID NO: 54423 - RNA, 22 nt, Human
ccugcaaaucccaggaggggaa

SEQ ID NO: 54424 - RNA, 24 nt, Human
ccuggccagcaggcaguagauucc

SEQ ID NO: 54425 - RNA, 25 nt, Human
ccuggccagcaggcaguagauucca

SEQ ID NO: 54426 - RNA, 19 nt, Human
ccuguacuuacgaggccau

SEQ ID NO: 54427 - RNA, 18 nt, Human
ccuguacuuacgaggccu

SEQ ID NO: 54428 - RNA, 21 nt, Human
ccuuccgggccagcuccucuc

SEQ ID NO: 54429 - RNA, 21 nt, Human
ccuuccgggccagcuccucuc

SEQ ID NO: 54430 - RNA, 21 nt, Human
ccuuugauuaaagaaugaggc

SEQ ID NO: 54431 - RNA, 23 nt, Human
cgacuaauacugaggccucagga

SEQ ID NO: 54432 - RNA, 18 nt, Human
cgcaaguaaaucccauca

SEQ ID NO: 54433 - RNA, 22 nt, Human
cgcaccuagacgguccugcuga

SEQ ID NO: 54434 - RNA, 21 nt, Human
cgcccaggaggacuggacgcu

SEQ ID NO: 54435 - RNA, 18 nt, Human
cgccucggucgccgccgc

SEQ ID NO: 54436 - RNA, 18 nt, Human
cgccucggucgccgccgc

SEQ ID NO: 54437 - RNA, 27 nt, Human
cgccugugcucugccgagacugccgug

SEQ ID NO: 54438 - RNA, 20 nt, Human
cgccuuccgggccagcuccu

SEQ ID NO: 54439 - RNA, 20 nt, Human
cgccuuccgggccagcuccu

SEQ ID NO: 54440 - RNA, 25 nt, Human
cgcggugaagcgccugugcucugcc

SEQ ID NO: 54441 - RNA, 19 nt, Human
cuagagcacugucaaggcc

SEQ ID NO: 54442 - RNA, 19 nt, Human
cucaaaagccccaugcuuc

SEQ ID NO: 54443 - RNA, 22 nt, Human
cucaaaagccccaugcuuccga

SEQ ID NO: 54444 - RNA, 19 nt, Human
cucagccagcuguccuagc

SEQ ID NO: 54445 - RNA, 19 nt, Human
cucagccagcuguccuagc

SEQ ID NO: 54446 - RNA, 21 nt, Human
cucaggaacacagccaggagg

SEQ ID NO: 54447 - RNA, 19 nt, Human
cuccagcagccgcugcccc

SEQ ID NO: 54448 - RNA, 22 nt, Human
cuccccucccacaucaagaaac

SEQ ID NO: 54449 - RNA, 22 nt, Human
cucgccucggucgccgccgcuu

SEQ ID NO: 54450 - RNA, 20 nt, Human
cugccuggcuguccucuggg

SEQ ID NO: 54451 - RNA, 18 nt, Human
cuggaaaucugggggcuc

SEQ ID NO: 54452 - RNA, 19 nt, Human
cuguccucugggcacagcu

SEQ ID NO: 54453 - RNA, 18 nt, Human
cuuccgggccagcuccuc

SEQ ID NO: 54454 - RNA, 18 nt, Human
cuuccgggccagcuccuc

SEQ ID NO: 54455 - RNA, 21 nt, Human
cuucgccugaacccacuucuc

SEQ ID NO: 54456 - RNA, 21 nt, Human
cuucgccugaacccacuucuc

SEQ ID NO: 54457 - RNA, 18 nt, Human
cuuggaguuguacaaaua

SEQ ID NO: 54458 - RNA, 23 nt, Human
cuugguaaggauucuucccccca

SEQ ID NO: 54459 - RNA, 19 nt, Human
gaacagacagccaagcccc

SEQ ID NO: 54460 - RNA, 22 nt, Human
gaacagacagccaagccccggg

SEQ ID NO: 54461 - RNA, 21 nt, Human
gaaccacaggcagacucacca

SEQ ID NO: 54462 - RNA, 23 nt, Human
gaagccccuccggacugcagcac

SEQ ID NO: 54463 - RNA, 21 nt, Human
gaauaguauuacccugagaca

SEQ ID NO: 54464 - RNA, 18 nt, Human
gacaauaggcggccgccc

SEQ ID NO: 54465 - RNA, 18 nt, Human
gacccaggacacgugcgg

SEQ ID NO: 54466 - RNA, 24 nt, Human
gagaagacauccuuugauuaaaga

SEQ ID NO: 54467 - RNA, 20 nt, Human
gagaguccugggcagucaca

SEQ ID NO: 54468 - RNA, 23 nt, Human
gagcaaaagcacaggcagccacc

SEQ ID NO: 54469 - RNA, 18 nt, Human
gagcagugggcguccagu

SEQ ID NO: 54470 - RNA, 18 nt, Human
gaguaggccucuucacuu

SEQ ID NO: 54471 - RNA, 20 nt, Human
gagucaccccaaaaaaacaa

SEQ ID NO: 54472 - RNA, 18 nt, Human
gauccccacgccuccccu

SEQ ID NO: 54473 - RNA, 24 nt, Human
gcaaagccgagcagcaggcagcca

SEQ ID NO: 54474 - RNA, 24 nt, Human
gcaaagccgagcagcaggcagcca

SEQ ID NO: 54475 - RNA, 22 nt, Human
gcaacuagagcacugucaaggc

SEQ ID NO: 54476 - RNA, 18 nt, Human
gcacgcggggacagcagg

SEQ ID NO: 54477 - RNA, 20 nt, Human
gcaggaacugcuacacaugg

SEQ ID NO: 54478 - RNA, 20 nt, Human
gcaggaacugcuacacaugg

SEQ ID NO: 54479 - RNA, 21 nt, Human
gcaggaacugcuacacauggc

SEQ ID NO: 54480 - RNA, 21 nt, Human
gcaggaacugcuacacauggc

SEQ ID NO: 54481 - RNA, 22 nt, Human
gcaugcacuaacaccuccccuc

SEQ ID NO: 54482 - RNA, 21 nt, Human
gccaccaucccagguaaaucc

SEQ ID NO: 54483 - RNA, 28 nt, Human
gccccaauuccauccacaggguuauuuc

SEQ ID NO: 54484 - RNA, 19 nt, Human
gccuccuuccccacccgac

SEQ ID NO: 54485 - RNA, 19 nt, Human
gccuggccugggugcgagg

SEQ ID NO: 54486 - RNA, 19 nt, Human
gccuggccugggugcgagg

SEQ ID NO: 54487 - RNA, 22 nt, Human
gcggcucccggggcucccccgc

SEQ ID NO: 54488 - RNA, 24 nt, Human
gcggugaagcgccugugcucugcc

SEQ ID NO: 54489 - RNA, 19 nt, Human
gcuacauugaaaggaaagu

SEQ ID NO: 54490 - RNA, 20 nt, Human
gcucgccucggucgccgccg

SEQ ID NO: 54491 - RNA, 19 nt, Human
gcugcacugcagacuguau

SEQ ID NO: 54492 - RNA, 22 nt, Human
ggaaaagcaaaagcaaagccga

SEQ ID NO: 54493 - RNA, 22 nt, Human
ggaaaagcaaaagcaaagccga

SEQ ID NO: 54494 - RNA, 19 nt, Human
ggaacaaaucccccugagg

SEQ ID NO: 54495 - RNA, 19 nt, Human
ggacccccucccuuuaaaa

SEQ ID NO: 54496 - RNA, 18 nt, Human
ggaccuggggccgcccag

SEQ ID NO: 54497 - RNA, 23 nt, Human
ggaccuggggccgcccaggagga

SEQ ID NO: 54498 - RNA, 23 nt, Human
ggagaacaggggcacccggccua

SEQ ID NO: 54499 - RNA, 23 nt, Human
ggagaagaaugcagguucaguac

SEQ ID NO: 54500 - RNA, 21 nt, Human
ggaggccguggccccuucuga

SEQ ID NO: 54501 - RNA, 21 nt, Human
ggcaggaacugcuacacaugg

SEQ ID NO: 54502 - RNA, 21 nt, Human
ggcaggaacugcuacacaugg

SEQ ID NO: 54503 - RNA, 18 nt, Human
ggcucccggggcuccccc

SEQ ID NO: 54504 - RNA, 18 nt, Human
gggaaaccagucucugag

SEQ ID NO: 54505 - RNA, 25 nt, Human
gggacagcaggagaggugggcuggc

SEQ ID NO: 54506 - RNA, 21 nt, Human
ggggaagagagaugacaaagg

SEQ ID NO: 54507 - RNA, 22 nt, Human
gguaaggauucuuccccccaga

SEQ ID NO: 54508 - RNA, 21 nt, Human
guccccauguacguacacaga

SEQ ID NO: 54509 - RNA, 23 nt, Human
gucgccgccgcuuuagccgcucc

SEQ ID NO: 54510 - RNA, 20 nt, Human
gugcuaaguugaccagacgc

SEQ ID NO: 54511 - RNA, 23 nt, Human
gugcuggcugccacuucacucgg

SEQ ID NO: 54512 - RNA, 22 nt, Human
guggacagcaacuucuggauca

SEQ ID NO: 54513 - RNA, 18 nt, Human
gugggcuggccaggauca

SEQ ID NO: 54514 - RNA, 21 nt, Human
guuugaaguuguuacuuuugu

SEQ ID NO: 54515 - RNA, 24 nt, Human
uaaaaaagaccaccaaaacaacca

SEQ ID NO: 54516 - RNA, 24 nt, Human
uaaaaacuggaaggaaaagguaag

SEQ ID NO: 54517 - RNA, 23 nt, Human
uaaaucagaaagugauuaaagua

SEQ ID NO: 54518 - RNA, 22 nt, Human
uaaaucccaucagcaccaaccu

SEQ ID NO: 54519 - RNA, 18 nt, Human
uaaauccccaggacagga

SEQ ID NO: 54520 - RNA, 19 nt, Human
uaacaaauacgggagaaaa

SEQ ID NO: 54521 - RNA, 23 nt, Human
uaacaccuccccucccacaucaa

SEQ ID NO: 54522 - RNA, 22 nt, Human
uaacauaagaagggcgcuuuca

SEQ ID NO: 54523 - RNA, 27 nt, Human
uaacgacaacgacugagaugacuggaa

SEQ ID NO: 54524 - RNA, 20 nt, Human
uaagcacaguucuugguaag

SEQ ID NO: 54525 - RNA, 24 nt, Human
uaaguaacuuuacaauuauuauca

SEQ ID NO: 54526 - RNA, 24 nt, Human
uacaaauuagccagucagcacacu

SEQ ID NO: 54527 - RNA, 20 nt, Human
uacccugagacacagaaggg

SEQ ID NO: 54528 - RNA, 24 nt, Human
uagaaaccaagacaggccauuaga

SEQ ID NO: 54529 - RNA, 24 nt, Human
uagagcauuugcaaacaagcaaug

SEQ ID NO: 54530 - RNA, 24 nt, Human
uagaugaguacuuggaaagaugcc

SEQ ID NO: 54531 - RNA, 22 nt, Human
uaggaacuccaucuuuccccca

SEQ ID NO: 54532 - RNA, 21 nt, Human
uaggcucccacauuccaagga

SEQ ID NO: 54533 - RNA, 28 nt, Human
uauaugcagacagguccccauguacgua

SEQ ID NO: 54534 - RNA, 27 nt, Human
uaucccaaccacccuccugcggauccc

SEQ ID NO: 54535 - RNA, 20 nt, Human
uaugcagacagguccccaug

SEQ ID NO: 54536 - RNA, 19 nt, Human
uauuacccugagacacaga

SEQ ID NO: 54537 - RNA, 19 nt, Human
ucaaacaagggagaagaca

SEQ ID NO: 54538 - RNA, 20 nt, Human
ucaacccuugcaugcacuaa

SEQ ID NO: 54539 - RNA, 19 nt, Human
ucacaaccacgccuuccgg

SEQ ID NO: 54540 - RNA, 19 nt, Human
ucacaaccacgccuuccgg

SEQ ID NO: 54541 - RNA, 21 nt, Human
ucacaaccacgccuuccgggc

SEQ ID NO: 54542 - RNA, 21 nt, Human
ucacaaccacgccuuccgggc

SEQ ID NO: 54543 - RNA, 21 nt, Human
ucaccccaaaaaaacaacccc

SEQ ID NO: 54544 - RNA, 20 nt, Human
ucagaaagugauuaaaguau

SEQ ID NO: 54545 - RNA, 21 nt, Human
ucagccagcuguccuagcuuc

SEQ ID NO: 54546 - RNA, 21 nt, Human
ucagccagcuguccuagcuuc

SEQ ID NO: 54547 - RNA, 19 nt, Human
ucaggaggcagcugccuca

SEQ ID NO: 54548 - RNA, 21 nt, Human
ucaggccggggaagguguggg

SEQ ID NO: 54549 - RNA, 25 nt, Human
ucauucucaaacaagggagaagaca

SEQ ID NO: 54550 - RNA, 19 nt, Human
uccauagagcauuugcaaa

SEQ ID NO: 54551 - RNA, 20 nt, Human
uccauagguggcugcgcacc

SEQ ID NO: 54552 - RNA, 25 nt, Human
uccaucuuucccccaaaacuuaagc

SEQ ID NO: 54553 - RNA, 19 nt, Human
ucccacaucaagaaacaac

SEQ ID NO: 54554 - RNA, 21 nt, Human
ucccagggccugccuggcugu

SEQ ID NO: 54555 - RNA, 19 nt, Human
uccccaggacaggaacaaa

SEQ ID NO: 54556 - RNA, 23 nt, Human
ucccccgcgggccgagcugggac

SEQ ID NO: 54557 - RNA, 19 nt, Human
ucccccugaggacaacuuc

SEQ ID NO: 54558 - RNA, 20 nt, Human
ucccggggcucccccgcggg

SEQ ID NO: 54559 - RNA, 21 nt, Human
ucccuaaaaugaaaugagaaa

SEQ ID NO: 54560 - RNA, 22 nt, Human
ucccuuccucccccccgccucc

SEQ ID NO: 54561 - RNA, 24 nt, Human
uccgagucaccccaaaaaaacaac

SEQ ID NO: 54562 - RNA, 23 nt, Human
uccgguguaucccaaccacccuc

SEQ ID NO: 54563 - RNA, 26 nt, Human
uccuugggaagaccuggcuacagaaa

SEQ ID NO: 54564 - RNA, 23 nt, Human
ucuaagaagaaaacacagucaau

SEQ ID NO: 54565 - RNA, 20 nt, Human
ucuaggcucccacauuccaa

SEQ ID NO: 54566 - RNA, 22 nt, Human
ucuccauuauaaaauaguugca

SEQ ID NO: 54567 - RNA, 19 nt, Human
ucuguaucugcuuccaggg

SEQ ID NO: 54568 - RNA, 19 nt, Human
ucuguaucugcuuccaggg

SEQ ID NO: 54569 - RNA, 22 nt, Human
ucugugccaggcacguuacuag

SEQ ID NO: 54570 - RNA, 22 nt, Human
ucuguggacagcaacuucugga

SEQ ID NO: 54571 - RNA, 23 nt, Human
ucuucuuugucucugaggaugga

SEQ ID NO: 54572 - RNA, 21 nt, Human
ugaaaacacggugggaaaagc

SEQ ID NO: 54573 - RNA, 21 nt, Human
ugaaaacacggugggaaaagc

SEQ ID NO: 54574 - RNA, 19 nt, Human
ugaaaaugaagccaaccga

SEQ ID NO: 54575 - RNA, 19 nt, Human
ugaaaggaaaguucaaaac

SEQ ID NO: 54576 - RNA, 20 nt, Human
ugaaaguggcaguuugcaug

SEQ ID NO: 54577 - RNA, 23 nt, Human
ugaaauagaaagcacuucugugg

SEQ ID NO: 54578 - RNA, 23 nt, Human
ugaaauagcauuaacuaggauaa

SEQ ID NO: 54579 - RNA, 22 nt, Human
ugaagcugguaacuagaaagaa

SEQ ID NO: 54580 - RNA, 21 nt, Human
ugaauuaugcaacuccuccuc

SEQ ID NO: 54581 - RNA, 22 nt, Human
ugacagaaaaaggcaaagguag

SEQ ID NO: 54582 - RNA, 23 nt, Human
ugacuaucacuaacagguaauau

SEQ ID NO: 54583 - RNA, 26 nt, Human
ugagaaauacaugcaaaaaggguuuc

SEQ ID NO: 54584 - RNA, 19 nt, Human
ugagagcagagguauccgg

SEQ ID NO: 54585 - RNA, 22 nt, Human
ugagagcagagguauccggugu

SEQ ID NO: 54586 - RNA, 18 nt, Human
ugagaugacuggaauuga

SEQ ID NO: 54587 - RNA, 18 nt, Human
ugagcaaaggggcgacuc

SEQ ID NO: 54588 - RNA, 23 nt, Human
ugaguggucagugacaaucaaaa

SEQ ID NO: 54589 - RNA, 19 nt, Human
ugaugacaaaaugagauac

SEQ ID NO: 54590 - RNA, 26 nt, Human
ugcaacuccuccuccucaucacucga

SEQ ID NO: 54591 - RNA, 22 nt, Human
ugcacuaacaccuccccuccca

SEQ ID NO: 54592 - RNA, 24 nt, Human
ugcacuaacaccuccccucccaca

SEQ ID NO: 54593 - RNA, 22 nt, Human
ugcacugcagacuguauuccug

SEQ ID NO: 54594 - RNA, 23 nt, Human
ugcacuggcaggaacugcuacac

SEQ ID NO: 54595 - RNA, 18 nt, Human
ugcauugccucaggaaca

SEQ ID NO: 54596 - RNA, 20 nt, Human
ugccccaauuccauccacag

SEQ ID NO: 54597 - RNA, 20 nt, Human
ugcccucuucuuugucucug

SEQ ID NO: 54598 - RNA, 19 nt, Human
ugcuaaguugaccagacgc

SEQ ID NO: 54599 - RNA, 21 nt, Human
uggaaaucugggggcucugga

SEQ ID NO: 54600 - RNA, 24 nt, Human
uggacccccucccuuuaaaauuuc

SEQ ID NO: 54601 - RNA, 23 nt, Human
uggaugaaguugggugguuugag

SEQ ID NO: 54602 - RNA, 22 nt, Human
uggcaaaauucgagaaaacaca

SEQ ID NO: 54603 - RNA, 23 nt, Human
uggcagcauuaaaacacuuuuca

SEQ ID NO: 54604 - RNA, 20 nt, Human
uggcaggggacacagccagu

SEQ ID NO: 54605 - RNA, 21 nt, Human
uggcaggggacacagccagug

SEQ ID NO: 54606 - RNA, 18 nt, Human
uggcaguggugugcccuc

SEQ ID NO: 54607 - RNA, 22 nt, Human
uggccucuaagguuauaguccc

SEQ ID NO: 54608 - RNA, 19 nt, Human
ugggaaaagcaaaagcaaa

SEQ ID NO: 54609 - RNA, 19 nt, Human
ugggaaaagcaaaagcaaa

SEQ ID NO: 54610 - RNA, 20 nt, Human
ugggagaggcacgacggggg

SEQ ID NO: 54611 - RNA, 22 nt, Human
ugguaagcgguucuguugcugc

SEQ ID NO: 54612 - RNA, 20 nt, Human
ugguaugugcccgggauggg

SEQ ID NO: 54613 - RNA, 18 nt, Human
ugguauuguggaagguac

SEQ ID NO: 54614 - RNA, 22 nt, Human
ugucaucccuaaaaugaaauga

SEQ ID NO: 54615 - RNA, 18 nt, Human
uguccaggaccuggggcc

SEQ ID NO: 54616 - RNA, 21 nt, Human
ugucugggagaggcacgacgg

SEQ ID NO: 54617 - RNA, 22 nt, Human
ugucuuucuaaacucccuccca

SEQ ID NO: 54618 - RNA, 24 nt, Human
uguggcgacgugcucuaacuucag

SEQ ID NO: 54619 - RNA, 23 nt, Human
uuagauccagcaacuagagcacu

SEQ ID NO: 54620 - RNA, 20 nt, Human
uuccaaaaaaaccuugguag

SEQ ID NO: 54621 - RNA, 20 nt, Human
uuccaaggcucugguuaacu

SEQ ID NO: 54622 - RNA, 19 nt, Human
uuccagggccucccuucug

SEQ ID NO: 54623 - RNA, 22 nt, Human
uuccugcagaagccccuccgga

SEQ ID NO: 54624 - RNA, 20 nt, Human
uucuccaugacagaaaaagg

SEQ ID NO: 54625 - RNA, 23 nt, Human
uugaaaguggcaguuugcauguu

SEQ ID NO: 54626 - RNA, 24 nt, Human
uuucuaggcucccacauuccaagg

SEQ ID NO: 54627 - RNA, 19 nt, Human
uuugaguggggucugggca

SEQ ID NO: 54628 - RNA, 18 nt, Human
uuuggucuguuucugaag

SEQ ID NO: 54629 - RNA, 19 nt, Human
uuuuaaacuuguccaacca

SEQ ID NO: 54630 - RNA, 24 nt, Human
uuuuuuuuuuuuuuuuuucucagg

SEQ ID NO: 54631 - RNA, 20 nt, Human
aaaaaaagaaaaacaaagaa

SEQ ID NO: 54632 - RNA, 18 nt, Human
aaaaacacacgcuguagu

SEQ ID NO: 54633 - RNA, 20 nt, Human
aaaaagaaauucucacucca

SEQ ID NO: 54634 - RNA, 19 nt, Human
aaaaugcccccaccaucuu

SEQ ID NO: 54635 - RNA, 27 nt, Human
aaaaugcccccaccaucuugaaccagu

SEQ ID NO: 54636 - RNA, 20 nt, Human
aaagaaaaacaaagaaaaaa

SEQ ID NO: 54637 - RNA, 21 nt, Human
aacacaaaaucaaaauuggca

SEQ ID NO: 54638 - RNA, 24 nt, Human
aagagcacagagaaaaucuggcuc

SEQ ID NO: 54639 - RNA, 18 nt, Human
aaggaaacugaugggcac

SEQ ID NO: 54640 - RNA, 27 nt, Human
aaucacucuaaaaccaaagcaggauaa

SEQ ID NO: 54641 - RNA, 25 nt, Human
acacacacacacacauccacacaca

SEQ ID NO: 54642 - RNA, 21 nt, Human
acagcuuugugacugugggag

SEQ ID NO: 54643 - RNA, 24 nt, Human
acgcuguagucacccaaggaaacu

SEQ ID NO: 54644 - RNA, 22 nt, Human
acucuggaauuuuaauacacac

SEQ ID NO: 54645 - RNA, 18 nt, Human
acuuaggcuacuuuuuuu

SEQ ID NO: 54646 - RNA, 22 nt, Human
agaaugcaauacuuccagaaag

SEQ ID NO: 54647 - RNA, 19 nt, Human
agguaaagacgauccuccu

SEQ ID NO: 54648 - RNA, 20 nt, Human
aguaguuaaucagcucugga

SEQ ID NO: 54649 - RNA, 19 nt, Human
agucaccaaaaaaguccuu

SEQ ID NO: 54650 - RNA, 20 nt, Human
aucauccugaaacacacugg

SEQ ID NO: 54651 - RNA, 20 nt, Human
augagucagagaaaacauga

SEQ ID NO: 54652 - RNA, 24 nt, Human
augguuccauuuuuuacuuugugc

SEQ ID NO: 54653 - RNA, 22 nt, Human
auguguguguguauauauaugu

SEQ ID NO: 54654 - RNA, 23 nt, Human
auuugugaauaaauguccccccc

SEQ ID NO: 54655 - RNA, 24 nt, Human
caagugacaggugggaaacuggug

SEQ ID NO: 54656 - RNA, 30 nt, Human
cacacacacacacacauccacacacacccu

SEQ ID NO: 54657 - RNA, 26 nt, Human
cacacacauccacacacaccccaucu

SEQ ID NO: 54658 - RNA, 21 nt, Human
cacacauccacacacacccca

SEQ ID NO: 54659 - RNA, 23 nt, Human
cacacgcuguagucacccaagga

SEQ ID NO: 54660 - RNA, 24 nt, Human
cacagugaaaacagcuuugugacu

SEQ ID NO: 54661 - RNA, 19 nt, Human
cacaguuuuaaaacaaagg

SEQ ID NO: 54662 - RNA, 22 nt, Human
caccauuguccuucaucgccca

SEQ ID NO: 54663 - RNA, 26 nt, Human
caccauuguccuucaucgcccagaga

SEQ ID NO: 54664 - RNA, 18 nt, Human
cacuuuauauauauauau

SEQ ID NO: 54665 - RNA, 20 nt, Human
cagaguucgccuuuuuuuuc

SEQ ID NO: 54666 - RNA, 22 nt, Human
cagcaaaaauaguaucucuuac

SEQ ID NO: 54667 - RNA, 21 nt, Human
caggcaggggaaagaggaaag

SEQ ID NO: 54668 - RNA, 21 nt, Human
cagggacggcuggggauccgc

SEQ ID NO: 54669 - RNA, 18 nt, Human
cauccacacacaccccau

SEQ ID NO: 54670 - RNA, 21 nt, Human
cauuguauauugcagcuucug

SEQ ID NO: 54671 - RNA, 20 nt, Human
cccagagccuagcacggugc

SEQ ID NO: 54672 - RNA, 21 nt, Human
cccauagaacuauccuacucu

SEQ ID NO: 54673 - RNA, 19 nt, Human
ccccaaaaaaagaaaaaca

SEQ ID NO: 54674 - RNA, 26 nt, Human
cccccaaaaaaagaaaaacaaagaaa

SEQ ID NO: 54675 - RNA, 19 nt, Human
cccccaaagucaacacuag

SEQ ID NO: 54676 - RNA, 22 nt, Human
ccccccaaagucaacacuaguc

SEQ ID NO: 54677 - RNA, 19 nt, Human
cccucccuuuuucucucuc

SEQ ID NO: 54678 - RNA, 23 nt, Human
ccuauaaacacggcagaaugcaa

SEQ ID NO: 54679 - RNA, 21 nt, Human
ccucccccaaaaaaagaaaaa

SEQ ID NO: 54680 - RNA, 21 nt, Human
ccuccuuccugaguccuccca

SEQ ID NO: 54681 - RNA, 20 nt, Human
ccucuguucuuaucccugug

SEQ ID NO: 54682 - RNA, 18 nt, Human
ccuucccucccuuuuucu

SEQ ID NO: 54683 - RNA, 19 nt, Human
ccuuucucuuuugauuccu

SEQ ID NO: 54684 - RNA, 18 nt, Human
cuagaacccgggagaacg

SEQ ID NO: 54685 - RNA, 19 nt, Human
cucacaaucacucuaaaac

SEQ ID NO: 54686 - RNA, 19 nt, Human
cucacaaucacucuaaaac

SEQ ID NO: 54687 - RNA, 23 nt, Human
cuccaaggcagaguucgccuuuu

SEQ ID NO: 54688 - RNA, 19 nt, Human
cuccaugccaaccucccuc

SEQ ID NO: 54689 - RNA, 21 nt, Human
cucccuuuuucucucucuacc

SEQ ID NO: 54690 - RNA, 22 nt, Human
cuccugaagccagcaaacagcu

SEQ ID NO: 54691 - RNA, 21 nt, Human
cugugcgcacggcgggcucgc

SEQ ID NO: 54692 - RNA, 23 nt, Human
cuuccccuuucucagccuccuca

SEQ ID NO: 54693 - RNA, 18 nt, Human
cuuccuggguugaaggaa

SEQ ID NO: 54694 - RNA, 23 nt, Human
cuucuaaucuaacacggaucuca

SEQ ID NO: 54695 - RNA, 21 nt, Human
cuugcaacagggaucuuacuu

SEQ ID NO: 54696 - RNA, 29 nt, Human
cuuguuacacuuuauauauauauaugugu

SEQ ID NO: 54697 - RNA, 24 nt, Human
cuuucuccuucccucccuuuuuuu

SEQ ID NO: 54698 - RNA, 21 nt, Human
gaaacgccauucauuuuaugg

SEQ ID NO: 54699 - RNA, 18 nt, Human
gaacccgggagaacgccc

SEQ ID NO: 54700 - RNA, 21 nt, Human
gaagauagacagcaguaaucc

SEQ ID NO: 54701 - RNA, 19 nt, Human
gaauaaauaggagacuuuc

SEQ ID NO: 54702 - RNA, 19 nt, Human
gaaugacuuuccuccaggg

SEQ ID NO: 54703 - RNA, 23 nt, Human
gacaggugggaaacuggugcagg

SEQ ID NO: 54704 - RNA, 25 nt, Human
gagaacgcccagggacggcugggga

SEQ ID NO: 54705 - RNA, 25 nt, Human
gagaauucauucaaaauauucagga

SEQ ID NO: 54706 - RNA, 21 nt, Human
gaguauaauuuccaaacacag

SEQ ID NO: 54707 - RNA, 22 nt, Human
gaguuaaugcaacacccucuga

SEQ ID NO: 54708 - RNA, 21 nt, Human
gaucccagagccuagcacggu

SEQ ID NO: 54709 - RNA, 22 nt, Human
gauuguguuugugacaugaaga

SEQ ID NO: 54710 - RNA, 19 nt, Human
gcaccagccugggcccuac

SEQ ID NO: 54711 - RNA, 19 nt, Human
gccacugugccuggggcug

SEQ ID NO: 54712 - RNA, 19 nt, Human
gccacugugccuggggcug

SEQ ID NO: 54713 - RNA, 22 nt, Human
gcccagagaggcuggucucagu

SEQ ID NO: 54714 - RNA, 24 nt, Human
ggagcauggcccaagaacccccag

SEQ ID NO: 54715 - RNA, 23 nt, Human
gggaaagaggaaagaaaaaacac

SEQ ID NO: 54716 - RNA, 21 nt, Human
guaaagagcaacacaaaauca

SEQ ID NO: 54717 - RNA, 18 nt, Human
gucugaguuaauuauugc

SEQ ID NO: 54718 - RNA, 21 nt, Human
gucugauggggggacuuccuu

SEQ ID NO: 54719 - RNA, 18 nt, Human
guggcccaagguuucuug

SEQ ID NO: 54720 - RNA, 26 nt, Human
guguacacacacacacacacacaucc

SEQ ID NO: 54721 - RNA, 22 nt, Human
gugucauccaaguaaaacacag

SEQ ID NO: 54722 - RNA, 24 nt, Human
guguguauauauauguggacauug

SEQ ID NO: 54723 - RNA, 23 nt, Human
guuccauuuuuuacuuugugccu

SEQ ID NO: 54724 - RNA, 21 nt, Human
guuuccuucaaaacagaacaa

SEQ ID NO: 54725 - RNA, 19 nt, Human
uaaaaacucaacacacauu

SEQ ID NO: 54726 - RNA, 23 nt, Human
uaaaaaugcccccaccaucuuga

SEQ ID NO: 54727 - RNA, 22 nt, Human
uaaaacacagcacggccuccug

SEQ ID NO: 54728 - RNA, 25 nt, Human
uaaaacacagcacggccuccugcca

SEQ ID NO: 54729 - RNA, 22 nt, Human
uaaaagaagcaaaggaaaugug

SEQ ID NO: 54730 - RNA, 20 nt, Human
uaacaagcuugugugcuauu

SEQ ID NO: 54731 - RNA, 23 nt, Human
uaacauacacaggaaaaccagau

SEQ ID NO: 54732 - RNA, 30 nt, Human
uaacaucauccauuugguuuguuuuucucc

SEQ ID NO: 54733 - RNA, 19 nt, Human
uaagagauguaggggccac

SEQ ID NO: 54734 - RNA, 23 nt, Human
uaauacacacacacacacacccu

SEQ ID NO: 54735 - RNA, 20 nt, Human
uacacacacacacacacaca

SEQ ID NO: 54736 - RNA, 25 nt, Human
uacacuuuauauauauauaugugug

SEQ ID NO: 54737 - RNA, 21 nt, Human
uaccuccuuauuuuauuccca

SEQ ID NO: 54738 - RNA, 22 nt, Human
uagacagcaguaauccggaagg

SEQ ID NO: 54739 - RNA, 27 nt, Human
uauaauacaaaauaguuauaaacaccu

SEQ ID NO: 54740 - RNA, 19 nt, Human
uauauauauauaugugugu

SEQ ID NO: 54741 - RNA, 26 nt, Human
uaucauccugaaacacacugguugcu

SEQ ID NO: 54742 - RNA, 21 nt, Human
uaugaagaggcaaguaaacug

SEQ ID NO: 54743 - RNA, 23 nt, Human
uauguguguguguauauauaugu

SEQ ID NO: 54744 - RNA, 20 nt, Human
uauucaggagacucaaccau

SEQ ID NO: 54745 - RNA, 23 nt, Human
ucaaauuacaaaaccgcucaaaa

SEQ ID NO: 54746 - RNA, 24 nt, Human
ucaacuuaauauuacaaauacugc

SEQ ID NO: 54747 - RNA, 19 nt, Human
ucaggacuucuaaucuaac

SEQ ID NO: 54748 - RNA, 19 nt, Human
ucagugaauauuauaagca

SEQ ID NO: 54749 - RNA, 18 nt, Human
ucauaacugccucuucug

SEQ ID NO: 54750 - RNA, 20 nt, Human
uccaagccugcacuuauuuc

SEQ ID NO: 54751 - RNA, 25 nt, Human
uccacacacggagcauggcccaaga

SEQ ID NO: 54752 - RNA, 23 nt, Human
uccacuccugaagccagcaaaca

SEQ ID NO: 54753 - RNA, 22 nt, Human
uccauuugggaucccagagccu

SEQ ID NO: 54754 - RNA, 20 nt, Human
ucccagagccuagcacggug

SEQ ID NO: 54755 - RNA, 22 nt, Human
ucccagagccuagcacggugcu

SEQ ID NO: 54756 - RNA, 21 nt, Human
uccccuccucccccaaaaaaa

SEQ ID NO: 54757 - RNA, 18 nt, Human
uccuggguguccagaguc

SEQ ID NO: 54758 - RNA, 22 nt, Human
ucgcuggguucucagcccaggc

SEQ ID NO: 54759 - RNA, 25 nt, Human
ucuaaaaaugcccccaccaucuuga

SEQ ID NO: 54760 - RNA, 23 nt, Human
ucuacauaaggauugcugaguuu

SEQ ID NO: 54761 - RNA, 23 nt, Human
ucucauuugugaauaaauguccc

SEQ ID NO: 54762 - RNA, 28 nt, Human
ucucuaaguggcccuaccaccauugucc

SEQ ID NO: 54763 - RNA, 19 nt, Human
ucugauugauccaaaagga

SEQ ID NO: 54764 - RNA, 26 nt, Human
ucuuucuccuucccucccuuuuucuc

SEQ ID NO: 54765 - RNA, 24 nt, Human
ugaauaaauguccccccccaaagu

SEQ ID NO: 54766 - RNA, 18 nt, Human
ugacaggugggaaacugg

SEQ ID NO: 54767 - RNA, 21 nt, Human
ugcaagugacaggugggaaac

SEQ ID NO: 54768 - RNA, 18 nt, Human
ugcaaugcugcugccucc

SEQ ID NO: 54769 - RNA, 18 nt, Human
ugccacugacagacccug

SEQ ID NO: 54770 - RNA, 20 nt, Human
ugccgcucuaaaaaugcccc

SEQ ID NO: 54771 - RNA, 20 nt, Human
ugccuggggcugugcaaugc

SEQ ID NO: 54772 - RNA, 19 nt, Human
ugcuauuugggcugccauc

SEQ ID NO: 54773 - RNA, 22 nt, Human
uggcccaagaacccccagcucu

SEQ ID NO: 54774 - RNA, 23 nt, Human
ugggauugagucaccaaaaaagu

SEQ ID NO: 54775 - RNA, 18 nt, Human
ugggcaacccauagaacu

SEQ ID NO: 54776 - RNA, 23 nt, Human
uguaaaguaugagaauaaauagg

SEQ ID NO: 54777 - RNA, 24 nt, Human
uguccccccccaaagucaacacua

SEQ ID NO: 54778 - RNA, 18 nt, Human
ugugcuauuugggcugcc

SEQ ID NO: 54779 - RNA, 21 nt, Human
uguguauauauauguggacau

SEQ ID NO: 54780 - RNA, 20 nt, Human
uguguguguguauauauaug

SEQ ID NO: 54781 - RNA, 26 nt, Human
uguguguguguauauauauguggacc

SEQ ID NO: 54782 - RNA, 23 nt, Human
uguuacacuuuauauauauauau

SEQ ID NO: 54783 - RNA, 29 nt, Human
uguuacacuuuauauauauauaugugugu

SEQ ID NO: 54784 - RNA, 18 nt, Human
uguugagaauucauucaa

SEQ ID NO: 54785 - RNA, 21 nt, Human
uuaacaucuacauacaaauuu

SEQ ID NO: 54786 - RNA, 20 nt, Human
uucaucugccucuaaagcca

SEQ ID NO: 54787 - RNA, 24 nt, Human
uuccccuuucucagccuccucaug

SEQ ID NO: 54788 - RNA, 21 nt, Human
uugcuagaacccgggagaacg

SEQ ID NO: 54789 - RNA, 24 nt, Human
uuguaagaggugggguuaacaagc

SEQ ID NO: 54790 - RNA, 26 nt, Human
uuguaagaggugggguuaacaagcuu

SEQ ID NO: 54791 - RNA, 28 nt, Human
uuguaagaggugggguuaacaagcuugu

SEQ ID NO: 54792 - RNA, 22 nt, Human
uugugugcuauuuggggguggg

SEQ ID NO: 54793 - RNA, 22 nt, Human
uuuaauuauuugucuucagaga

SEQ ID NO: 54794 - RNA, 25 nt, Human
uuucuugcaacagggaucuuacuug

SEQ ID NO: 54795 - RNA, 18 nt, Human
uuuggggguggggcugag

SEQ ID NO: 54796 - RNA, 20 nt, Human
uuugugacaugaagaacuau

SEQ ID NO: 54797 - RNA, 20 nt, Human
uuuuggauccauuguagauu

SEQ ID NO: 54798 - RNA, 19 nt, Human
aacgugacacccagaaggg

SEQ ID NO: 54799 - RNA, 18 nt, Human
aacucuccaugcccuccu

SEQ ID NO: 54800 - RNA, 21 nt, Human
aagaugaagaggagucaagga

SEQ ID NO: 54801 - RNA, 21 nt, Human
ccuacagccuugacugccagc

SEQ ID NO: 54802 - RNA, 18 nt, Human
cucuuccagucugccuca

SEQ ID NO: 54803 - RNA, 18 nt, Human
cugaaaacgugacaccca

SEQ ID NO: 54804 - RNA, 19 nt, Human
cugauggugggggugcucu

SEQ ID NO: 54805 - RNA, 18 nt, Human
cugcucaaguguauuggg

SEQ ID NO: 54806 - RNA, 21 nt, Human
cuucaacucuccaugcccucc

SEQ ID NO: 54807 - RNA, 24 nt, Human
gcuuuuuucuucaacucuccaugc

SEQ ID NO: 54808 - RNA, 24 nt, Human
ggagaugugccccuuuagauggaa

SEQ ID NO: 54809 - RNA, 22 nt, Human
guuuguugacaccucuuacauu

SEQ ID NO: 54810 - RNA, 21 nt, Human
ucaacucuccaugcccuccua

SEQ ID NO: 54811 - RNA, 19 nt, Human
ucuuuuagauguuuggcug

SEQ ID NO: 54812 - RNA, 21 nt, Human
uggcugaaaacgugacaccca

SEQ ID NO: 54813 - RNA, 23 nt, Human
uggcugaaaacgugacacccaga

SEQ ID NO: 54814 - RNA, 18 nt, Human
uggcugggauggaaugcu

SEQ ID NO: 54815 - RNA, 22 nt, Human
ugugaugacucuuccagucugc

SEQ ID NO: 54816 - RNA, 20 nt, Human
uucuucaacucuccaugccc

SEQ ID NO: 54817 - RNA, 19 nt, Human
uuucccaguuuguugacac

SEQ ID NO: 54818 - RNA, 22 nt, Human
uuuucuucaacucuccaugccc

SEQ ID NO: 54819 - RNA, 20 nt, Human
uuuuuuauuuuauuucccag

SEQ ID NO: 54820 - RNA, 24 nt, Human
uuuuuuuuuuuuuuuauuauuuuu

SEQ ID NO: 54821 - RNA, 24 nt, Human
ccaauggcuuuauuaacucccucu

SEQ ID NO: 54822 - RNA, 18 nt, Human
gaggccaagaagcugugg

SEQ ID NO: 54823 - RNA, 18 nt, Human
uagcugcagagcuggaag

SEQ ID NO: 54824 - RNA, 25 nt, Human
caaacuggaagagacuucuacucua

SEQ ID NO: 54825 - RNA, 22 nt, Human
caaagagaagucuugcugaaag

SEQ ID NO: 54826 - RNA, 20 nt, Human
caaagcaaacuggaagagac

SEQ ID NO: 54827 - RNA, 18 nt, Human
caagcuagacacgcccuc

SEQ ID NO: 54828 - RNA, 22 nt, Human
cacagguauaggucacuugggg

SEQ ID NO: 54829 - RNA, 18 nt, Human
cagggcucuugagaucca

SEQ ID NO: 54830 - RNA, 18 nt, Human
cagguauaggucacuugg

SEQ ID NO: 54831 - RNA, 21 nt, Human
caucaagcuagacacgcccuc

SEQ ID NO: 54832 - RNA, 21 nt, Human
ccccagacccccgcccaguac

SEQ ID NO: 54833 - RNA, 18 nt, Human
cgagcaggcaaccacagc

SEQ ID NO: 54834 - RNA, 21 nt, Human
cuagacacgcccucgcuggcc

SEQ ID NO: 54835 - RNA, 23 nt, Human
cucuacagguugcugucccacug

SEQ ID NO: 54836 - RNA, 23 nt, Human
cugcugagugacacaggccauac

SEQ ID NO: 54837 - RNA, 21 nt, Human
cugguagauuuugcuucucuu

SEQ ID NO: 54838 - RNA, 21 nt, Human
gcaaagagaagucuugcugaa

SEQ ID NO: 54839 - RNA, 21 nt, Human
gccacucuacagguugcuguc

SEQ ID NO: 54840 - RNA, 27 nt, Human
ucaaaacucaaccguuaguggcacuau

SEQ ID NO: 54841 - RNA, 18 nt, Human
uccccagacccccgccca

SEQ ID NO: 54842 - RNA, 18 nt, Human
ugcaaggaaaaaaaugag

SEQ ID NO: 54843 - RNA, 21 nt, Human
ugcugcgcuccccagaccccc

SEQ ID NO: 54844 - RNA, 21 nt, Human
uuggucagaaaaggguauuca

SEQ ID NO: 54845 - RNA, 23 nt, Human
aagcaggagagauuuaaccagag

SEQ ID NO: 54846 - RNA, 27 nt, Human
aagcaggagagauuuaaccagaggcga

SEQ ID NO: 54847 - RNA, 20 nt, Human
agaccucaugcaaugcccuc

SEQ ID NO: 54848 - RNA, 21 nt, Human
caaugggcuuugcuguagcuu

SEQ ID NO: 54849 - RNA, 24 nt, Human
caccagcauagagccauccucugu

SEQ ID NO: 54850 - RNA, 22 nt, Human
cagaccucaugcaaugcccucc

SEQ ID NO: 54851 - RNA, 21 nt, Human
gcuguagcuugcugaaaucac

SEQ ID NO: 54852 - RNA, 22 nt, Human
ugaaaaaacaaaauuauugucu

SEQ ID NO: 54853 - RNA, 18 nt, Human
ugcugaaaucaccaagca

SEQ ID NO: 54854 - RNA, 22 nt, Human
uuucuggccaaugggcuuugcu

SEQ ID NO: 54855 - RNA, 18 nt, Human
accggcauagagacgucc

SEQ ID NO: 54856 - RNA, 25 nt, Human
acucagcuguaguugacugaaguca

SEQ ID NO: 54857 - RNA, 18 nt, Human
caccggcauagagacguc

SEQ ID NO: 54858 - RNA, 19 nt, Human
ucacuugucugacuagcaa

SEQ ID NO: 54859 - RNA, 23 nt, Human
uuuauugucuuucuggccuaugg

SEQ ID NO: 54860 - RNA, 23 nt, Human
agcuagcugaaguugccaagcag

SEQ ID NO: 54861 - RNA, 19 nt, Human
caccagcauagagacaucc

SEQ ID NO: 54862 - RNA, 18 nt, Human
cagaggccguguguccag

SEQ ID NO: 54863 - RNA, 19 nt, Human
cugcaucaccauccacacc

SEQ ID NO: 54864 - RNA, 21 nt, Human
uagaugucgugcaacacccuc

SEQ ID NO: 54865 - RNA, 22 nt, Human
ucugcaucaccauccacaccac

SEQ ID NO: 54866 - RNA, 18 nt, Human
ugccaagcaggaggggag

SEQ ID NO: 54867 - RNA, 21 nt, Human
aaccuugcuccucugucccac

SEQ ID NO: 54868 - RNA, 24 nt, Human
aagcgucgaaaaggucaagugcua

SEQ ID NO: 54869 - RNA, 24 nt, Human
acacaugggcaggaccugcccggc

SEQ ID NO: 54870 - RNA, 20 nt, Human
acagagugaggggacacaug

SEQ ID NO: 54871 - RNA, 20 nt, Human
acccccaaaaugcauuugaa

SEQ ID NO: 54872 - RNA, 22 nt, Human
agcggaaagguuaagcgucgaa

SEQ ID NO: 54873 - RNA, 21 nt, Human
agcuggccuggccacagccuc

SEQ ID NO: 54874 - RNA, 23 nt, Human
aggcccagggccccagagagaug

SEQ ID NO: 54875 - RNA, 21 nt, Human
agggcugaggccacacccgga

SEQ ID NO: 54876 - RNA, 22 nt, Human
cacagcacaaaaacgucuuucc

SEQ ID NO: 54877 - RNA, 21 nt, Human
caccagguugaacugaggccc

SEQ ID NO: 54878 - RNA, 19 nt, Human
cacccgagaaauaaaaacc

SEQ ID NO: 54879 - RNA, 20 nt, Human
cacgcgcuccucucaggcug

SEQ ID NO: 54880 - RNA, 22 nt, Human
cagcccagggcggcuggcugac

SEQ ID NO: 54881 - RNA, 21 nt, Human
cagccccuuugacuucuuuga

SEQ ID NO: 54882 - RNA, 19 nt, Human
cagccuccgaugacguccu

SEQ ID NO: 54883 - RNA, 21 nt, Human
cagccuccgaugacguccuca

SEQ ID NO: 54884 - RNA, 26 nt, Human
cagcguggcuucucucaaaugcaccc

SEQ ID NO: 54885 - RNA, 24 nt, Human
cauagugagguugcaucuggugcc

SEQ ID NO: 54886 - RNA, 23 nt, Human
caucccuggucccaucccagggg

SEQ ID NO: 54887 - RNA, 20 nt, Human
ccaaugccacauugcgcaua

SEQ ID NO: 54888 - RNA, 24 nt, Human
ccaccagguugaacugaggcccag

SEQ ID NO: 54889 - RNA, 23 nt, Human
ccacccccacagggagucaggga

SEQ ID NO: 54890 - RNA, 21 nt, Human
ccacuggguaaacccuggccc

SEQ ID NO: 54891 - RNA, 23 nt, Human
ccacuggguaaacccuggcccau

SEQ ID NO: 54892 - RNA, 18 nt, Human
cccaaaaugcauuugaac

SEQ ID NO: 54893 - RNA, 19 nt, Human
ccccaaugccacauugcgc

SEQ ID NO: 54894 - RNA, 25 nt, Human
cccccaaaaugcauuugaacaacau

SEQ ID NO: 54895 - RNA, 22 nt, Human
cccccaucccuggucccauccc

SEQ ID NO: 54896 - RNA, 18 nt, Human
ccccgagcccagcuggcc

SEQ ID NO: 54897 - RNA, 18 nt, Human
cccuaagccccuggugac

SEQ ID NO: 54898 - RNA, 19 nt, Human
ccucucaggcuggcgcucc

SEQ ID NO: 54899 - RNA, 20 nt, Human
ccuggcccaucccccauccc

SEQ ID NO: 54900 - RNA, 21 nt, Human
cggcagcggcagcgucuggcc

SEQ ID NO: 54901 - RNA, 24 nt, Human
cggcagcgucuggccaggaggcgu

SEQ ID NO: 54902 - RNA, 19 nt, Human
cuccggugggacagucacc

SEQ ID NO: 54903 - RNA, 21 nt, Human
cugagggggaggcuccggugg

SEQ ID NO: 54904 - RNA, 19 nt, Human
cugccuccuccaggcagcc

SEQ ID NO: 54905 - RNA, 23 nt, Human
cugcugugugccugccaccccuc

SEQ ID NO: 54906 - RNA, 21 nt, Human
gacagagugaggggacacaug

SEQ ID NO: 54907 - RNA, 21 nt, Human
gacaggcugccuccuccaggc

SEQ ID NO: 54908 - RNA, 19 nt, Human
gaggggacacaugggcagg

SEQ ID NO: 54909 - RNA, 22 nt, Human
gcagcgucuggccaggaggcgu

SEQ ID NO: 54910 - RNA, 21 nt, Human
gccccuggugacagauggccc

SEQ ID NO: 54911 - RNA, 18 nt, Human
gcguggaggggcccaggg

SEQ ID NO: 54912 - RNA, 23 nt, Human
gcuggccuggccacagccucuga

SEQ ID NO: 54913 - RNA, 18 nt, Human
gcuggcugacagagugag

SEQ ID NO: 54914 - RNA, 18 nt, Human
ggacacaugggcaggacc

SEQ ID NO: 54915 - RNA, 18 nt, Human
ggcaggaccugcccggcc

SEQ ID NO: 54916 - RNA, 24 nt, Human
ggcaggaccugcccggccccccaa

SEQ ID NO: 54917 - RNA, 24 nt, Human
ggccuggggcgacagcggaaaggu

SEQ ID NO: 54918 - RNA, 18 nt, Human
gguaaacccuggcccauc

SEQ ID NO: 54919 - RNA, 22 nt, Human
gguaaacccuggcccauccccc

SEQ ID NO: 54920 - RNA, 19 nt, Human
guaaaaaaacgccguggug

SEQ ID NO: 54921 - RNA, 23 nt, Human
uaaaaaaacgccguggugcagcg

SEQ ID NO: 54922 - RNA, 24 nt, Human
uacacaauaacaaauuuaaaccuu

SEQ ID NO: 54923 - RNA, 19 nt, Human
uaccauagugagguugcau

SEQ ID NO: 54924 - RNA, 19 nt, Human
ucacaaagauuaaaaaccu

SEQ ID NO: 54925 - RNA, 23 nt, Human
ucccacuggguaaacccuggccc

SEQ ID NO: 54926 - RNA, 22 nt, Human
ucccuggucccaucccaggggc

SEQ ID NO: 54927 - RNA, 18 nt, Human
ucucaggcuggcgcuccc

SEQ ID NO: 54928 - RNA, 24 nt, Human
ucucucaaaugcacccgagaaaua

SEQ ID NO: 54929 - RNA, 19 nt, Human
ugaacugaggcccagggcc

SEQ ID NO: 54930 - RNA, 19 nt, Human
ugacagacagcccagggcg

SEQ ID NO: 54931 - RNA, 22 nt, Human
ugacagagugaggggacacaug

SEQ ID NO: 54932 - RNA, 21 nt, Human
ugacagauggcccugugcccu

SEQ ID NO: 54933 - RNA, 22 nt, Human
ugacaggcugccuccuccaggc

SEQ ID NO: 54934 - RNA, 19 nt, Human
ugaggcccagggccccaga

SEQ ID NO: 54935 - RNA, 23 nt, Human
ugcccgaggcucccgcgacgcuc

SEQ ID NO: 54936 - RNA, 23 nt, Human
ugccuccuccaggcagccccuuu

SEQ ID NO: 54937 - RNA, 23 nt, Human
ugcugugugccugccacccccag

SEQ ID NO: 54938 - RNA, 26 nt, Human
ugcugugugccugccacccccaggag

SEQ ID NO: 54939 - RNA, 18 nt, Human
uggcacgaggccgccucu

SEQ ID NO: 54940 - RNA, 23 nt, Human
uggcacgaggccgccucuccauc

SEQ ID NO: 54941 - RNA, 21 nt, Human
uggccaggaggcguggagggg

SEQ ID NO: 54942 - RNA, 24 nt, Human
uggccuggccacagccucugaugc

SEQ ID NO: 54943 - RNA, 19 nt, Human
uggggcgacagcggaaagg

SEQ ID NO: 54944 - RNA, 21 nt, Human
uggugacagacagcccagggc

SEQ ID NO: 54945 - RNA, 23 nt, Human
ugucacaaagauuaaaaaccccc

SEQ ID NO: 54946 - RNA, 19 nt, Human
uucccuaagccccugguga

SEQ ID NO: 54947 - RNA, 24 nt, Human
uuguucugagggcugaggccacac

SEQ ID NO: 54948 - RNA, 21 nt, Human
aaaaccacccagcggugaugg

SEQ ID NO: 54949 - RNA, 18 nt, Human
agggcacagucugucacc

SEQ ID NO: 54950 - RNA, 18 nt, Human
caccggcagccgcccagc

SEQ ID NO: 54951 - RNA, 22 nt, Human
cagcucagggcagcaggacaug

SEQ ID NO: 54952 - RNA, 23 nt, Human
caucgccacgcugcgcugguucc

SEQ ID NO: 54953 - RNA, 20 nt, Human
ccuuguguuucccggcagcg

SEQ ID NO: 54954 - RNA, 21 nt, Human
cggcagccgcccagccucucc

SEQ ID NO: 54955 - RNA, 20 nt, Human
cucuacccccgcccaucgcc

SEQ ID NO: 54956 - RNA, 21 nt, Human
gugcguccucugcgugggcag

SEQ ID NO: 54957 - RNA, 20 nt, Human
uaaaaaaccacccagcggug

SEQ ID NO: 54958 - RNA, 23 nt, Human
uagcucgggacagcucagggcag

SEQ ID NO: 54959 - RNA, 22 nt, Human
ucaccggcagccgcccagccuc

SEQ ID NO: 54960 - RNA, 19 nt, Human
ucaccuagcucgggacagc

SEQ ID NO: 54961 - RNA, 21 nt, Human
ucccggcagcggcaacggcgc

SEQ ID NO: 54962 - RNA, 22 nt, Human
ucccggcagcggcaacggcgcc

SEQ ID NO: 54963 - RNA, 23 nt, Human
acaguucuaaaagcagcauuuac

SEQ ID NO: 54964 - RNA, 23 nt, Human
gcacaggggcaucaguugguugg

SEQ ID NO: 54965 - RNA, 21 nt, Human
gggcacaggggcaucaguugg

SEQ ID NO: 54966 - RNA, 22 nt, Human
guucuugggccuggcacugucc

SEQ ID NO: 54967 - RNA, 24 nt, Human
ucacuugucugaggccccgggaac

SEQ ID NO: 54968 - RNA, 22 nt, Human
ugggcacaggggcaucaguugg

SEQ ID NO: 54969 - RNA, 19 nt, Human
uucuugggccuggcacugu

SEQ ID NO: 54970 - RNA, 18 nt, Human
aaagacaacucugaagac

SEQ ID NO: 54971 - RNA, 19 nt, Human
acucugaagaccaucugga

SEQ ID NO: 54972 - RNA, 18 nt, Human
aggaaguaugcuggcucc

SEQ ID NO: 54973 - RNA, 20 nt, Human
aggaggcgggcacucaaguc

SEQ ID NO: 54974 - RNA, 18 nt, Human
aggcggcggcgaaggagg

SEQ ID NO: 54975 - RNA, 21 nt, Human
aggcgggcacucaagucgaga

SEQ ID NO: 54976 - RNA, 22 nt, Human
cccuaaacccgaggaagggguc

SEQ ID NO: 54977 - RNA, 22 nt, Human
cgaaggaggcgggcacucaagu

SEQ ID NO: 54978 - RNA, 19 nt, Human
cuccugguccccacauccc

SEQ ID NO: 54979 - RNA, 23 nt, Human
gcggcggcgaaggaggcgggcac

SEQ ID NO: 54980 - RNA, 25 nt, Human
ggaagaacugggcauaacugcgcug

SEQ ID NO: 54981 - RNA, 19 nt, Human
gggguccagcagggucccg

SEQ ID NO: 54982 - RNA, 20 nt, Human
gucguguccccacagcggga

SEQ ID NO: 54983 - RNA, 23 nt, Human
uccugguccccacauccccuaaa

SEQ ID NO: 54984 - RNA, 23 nt, Human
uccuguggaaagaaucuaggugg

SEQ ID NO: 54985 - RNA, 19 nt, Human
uggagaagaagccacucau

SEQ ID NO: 54986 - RNA, 28 nt, Human
uucacauauaaagacaacucugaagacc

SEQ ID NO: 54987 - RNA, 25 nt, Human
uuuuuuuuuuuuuuuuauuuccagg

SEQ ID NO: 54988 - RNA, 21 nt, Human
uuuuuuuuuuuuuuuuuauuu

SEQ ID NO: 54989 - RNA, 20 nt, Human
aacuuagaagaguauuagug

SEQ ID NO: 54990 - RNA, 22 nt, Human
aagcacagagaaaagaggcaaa

SEQ ID NO: 54991 - RNA, 25 nt, Human
acacuggaacuuccacaaccggagg

SEQ ID NO: 54992 - RNA, 20 nt, Human
acuuagaagaguauuaguga

SEQ ID NO: 54993 - RNA, 19 nt, Human
agacaggguguuggcuuua

SEQ ID NO: 54994 - RNA, 23 nt, Human
caacacaucuuugaaaaauaaca

SEQ ID NO: 54995 - RNA, 22 nt, Human
cacagaaacuagaaauccucua

SEQ ID NO: 54996 - RNA, 25 nt, Human
cagaauuuucaggauagcaacacau

SEQ ID NO: 54997 - RNA, 25 nt, Human
ccacagaaacuagaaauccucuacc

SEQ ID NO: 54998 - RNA, 24 nt, Human
ccacagaaccuacagaauuuucag

SEQ ID NO: 54999 - RNA, 23 nt, Human
cuagaaauccucuaccgaagugg

SEQ ID NO: 55000 - RNA, 18 nt, Human
gaaaaagaaaacagauga

SEQ ID NO: 55001 - RNA, 24 nt, Human
guuggcuuuacaccaacgaaaaag

SEQ ID NO: 55002 - RNA, 24 nt, Human
uaccacucuauuagauucuuucca

SEQ ID NO: 55003 - RNA, 19 nt, Human
uccucuaccgaaguggaau

SEQ ID NO: 55004 - RNA, 21 nt, Human
ugaagcacagagaaaagaggc

SEQ ID NO: 55005 - RNA, 18 nt, Human
ugccaaaggcgugugggg

SEQ ID NO: 55006 - RNA, 18 nt, Human
uggaacuuccacagaacc

SEQ ID NO: 55007 - RNA, 18 nt, Human
ugggguugacagaagaga

SEQ ID NO: 55008 - RNA, 22 nt, Human
uuacaccaacgaaaaagaaaac

SEQ ID NO: 55009 - RNA, 21 nt, Human
uugaaaaauaacagugcugua

SEQ ID NO: 55010 - RNA, 19 nt, Human
uugaagcacagagaaaaga

SEQ ID NO: 55011 - RNA, 24 nt, Human
uuggcuuuacaccaacgaaaaaga

SEQ ID NO: 55012 - RNA, 22 nt, Human
aaaaagaaauccucagugcaga

SEQ ID NO: 55013 - RNA, 24 nt, Human
aagcugccaccuuuggguuuuagg

SEQ ID NO: 55014 - RNA, 23 nt, Human
agauaauucucugaaaaccugug

SEQ ID NO: 55015 - RNA, 26 nt, Human
auagcaaucagaaucagaaauguacc

SEQ ID NO: 55016 - RNA, 20 nt, Human
aucauggcugccaaaacuug

SEQ ID NO: 55017 - RNA, 19 nt, Human
augagaaaguuuggggcau

SEQ ID NO: 55018 - RNA, 21 nt, Human
caaaaagaaauccucagugca

SEQ ID NO: 55019 - RNA, 20 nt, Human
caacuaggacaguuucucuc

SEQ ID NO: 55020 - RNA, 23 nt, Human
caacucccagaacaaagcuuaca

SEQ ID NO: 55021 - RNA, 21 nt, Human
cccucccuugugauaaaaauc

SEQ ID NO: 55022 - RNA, 20 nt, Human
ccucccuugugauaaaaauu

SEQ ID NO: 55023 - RNA, 23 nt, Human
cggaaaaaaaauugaaccaaaca

SEQ ID NO: 55024 - RNA, 20 nt, Human
cuugaaccaugaauugcugu

SEQ ID NO: 55025 - RNA, 19 nt, Human
gugugucuauaugcaucug

SEQ ID NO: 55026 - RNA, 19 nt, Human
uaacagcaacucccagaac

SEQ ID NO: 55027 - RNA, 22 nt, Human
uagcaaucagaaucagaaaugu

SEQ ID NO: 55028 - RNA, 19 nt, Human
uauguaugugugucuauau

SEQ ID NO: 55029 - RNA, 18 nt, Human
uaugugugucuauaugca

SEQ ID NO: 55030 - RNA, 25 nt, Human
uaugugugucuauaugcaucuguga

SEQ ID NO: 55031 - RNA, 23 nt, Human
ucucugaaaaccugugacagcuu

SEQ ID NO: 55032 - RNA, 23 nt, Human
ucucuggacaacuaggacaguuu

SEQ ID NO: 55033 - RNA, 23 nt, Human
ucuuggugggccacugacggagu

SEQ ID NO: 55034 - RNA, 27 nt, Human
ugaaauaaaaacauuacauuauacauc

SEQ ID NO: 55035 - RNA, 25 nt, Human
ugaaccaaacacaacauaugaccua

SEQ ID NO: 55036 - RNA, 18 nt, Human
ugacucucggccuccccu

SEQ ID NO: 55037 - RNA, 23 nt, Human
ugaguguccccaaucuucacaag

SEQ ID NO: 55038 - RNA, 22 nt, Human
ugggaguaccauuauguaugug

SEQ ID NO: 55039 - RNA, 20 nt, Human
ugguagaaugaacugcuuaa

SEQ ID NO: 55040 - RNA, 24 nt, Human
aagcagacaugacauccuaggaaa

SEQ ID NO: 55041 - RNA, 21 nt, Human
acaaagcuagagagaucauac

SEQ ID NO: 55042 - RNA, 25 nt, Human
acaaaggaaaaucacauaacuauga

SEQ ID NO: 55043 - RNA, 27 nt, Human
acuucaagagucacuaagggaaagaag

SEQ ID NO: 55044 - RNA, 19 nt, Human
aggcaaauaauucuuucag

SEQ ID NO: 55045 - RNA, 24 nt, Human
auaggacuugggggucacauuuca

SEQ ID NO: 55046 - RNA, 24 nt, Human
caagagucacuaagggaaagaagc

SEQ ID NO: 55047 - RNA, 19 nt, Human
cagaagaagcuacauguca

SEQ ID NO: 55048 - RNA, 20 nt, Human
cggcuccuggaacacagccu

SEQ ID NO: 55049 - RNA, 22 nt, Human
cuugggggucacauuucagaag

SEQ ID NO: 55050 - RNA, 22 nt, Human
ggaaagaagcuaaaugcaacug

SEQ ID NO: 55051 - RNA, 21 nt, Human
gucacauuucagaaggcaaau

SEQ ID NO: 55052 - RNA, 23 nt, Human
uaaaaaaaucaagaaaagaaaaa

SEQ ID NO: 55053 - RNA, 19 nt, Human
uaaguacuucaagagucac

SEQ ID NO: 55054 - RNA, 21 nt, Human
uacaaaggaaaaucacauaac

SEQ ID NO: 55055 - RNA, 23 nt, Human
uauugaagagcuucucuccacuc

SEQ ID NO: 55056 - RNA, 22 nt, Human
ucagaagaagcuacaugucaag

SEQ ID NO: 55057 - RNA, 22 nt, Human
ugacaagcagacaugacauccu

SEQ ID NO: 55058 - RNA, 18 nt, Human
uuagcuauugaagagcuu

SEQ ID NO: 55059 - RNA, 22 nt, Human
uuagcuauugaagagcuucucu

SEQ ID NO: 55060 - RNA, 20 nt, Human
uucaugcaagguuguuuuua

SEQ ID NO: 55061 - RNA, 20 nt, Human
cgggccgggugucccuagcc

SEQ ID NO: 55062 - RNA, 22 nt, Human
aaaaaaccuuacugugaauccu

SEQ ID NO: 55063 - RNA, 23 nt, Human
aaaaaccaaaaaaccuuacugug

SEQ ID NO: 55064 - RNA, 25 nt, Human
aaaacaagaaaacaaaaaacaaaaa

SEQ ID NO: 55065 - RNA, 20 nt, Human
aaacaaaaaacaaaaaccaa

SEQ ID NO: 55066 - RNA, 22 nt, Human
aaacaaaaaacaaaaaccaaaa

SEQ ID NO: 55067 - RNA, 23 nt, Human
aaacaaaaaacaaaaaccaaaaa

SEQ ID NO: 55068 - RNA, 23 nt, Human
aaaccacaccacagggguaaacc

SEQ ID NO: 55069 - RNA, 20 nt, Human
aaagauacaauaacucuacc

SEQ ID NO: 55070 - RNA, 23 nt, Human
aaauaggacuuaaaaauaacaag

SEQ ID NO: 55071 - RNA, 23 nt, Human
aagaaaaauucacaaccugccag

SEQ ID NO: 55072 - RNA, 21 nt, Human
aagaaaacaaaaaacaaaaac

SEQ ID NO: 55073 - RNA, 23 nt, Human
aagaggaaaagaaaaauucacaa

SEQ ID NO: 55074 - RNA, 19 nt, Human
aagcacuacuuucccaauu

SEQ ID NO: 55075 - RNA, 24 nt, Human
aagccaaaugugguaauuuauauc

SEQ ID NO: 55076 - RNA, 22 nt, Human
aagccuccagaagaaugugucc

SEQ ID NO: 55077 - RNA, 18 nt, Human
aagggaaacacagaaaug

SEQ ID NO: 55078 - RNA, 23 nt, Human
aauaaacaggagagugagaggaa

SEQ ID NO: 55079 - RNA, 21 nt, Human
acaaaaaccaaaaaaccuuac

SEQ ID NO: 55080 - RNA, 23 nt, Human
acaagaaaacaaaaaacaaaaac

SEQ ID NO: 55081 - RNA, 22 nt, Human
acagcaaucauucaacuccagu

SEQ ID NO: 55082 - RNA, 19 nt, Human
acccugaggagaccgcugg

SEQ ID NO: 55083 - RNA, 23 nt, Human
accucggaaagaggcguggcuug

SEQ ID NO: 55084 - RNA, 24 nt, Human
agaaaacaaaaaacaaaaaccaaa

SEQ ID NO: 55085 - RNA, 18 nt, Human
agaagauuggaucuuuag

SEQ ID NO: 55086 - RNA, 19 nt, Human
agcaaagguaaccucaaca

SEQ ID NO: 55087 - RNA, 20 nt, Human
aggaaaagaaaaauucacaa

SEQ ID NO: 55088 - RNA, 25 nt, Human
aggaaaagaaaaauucacaaccugc

SEQ ID NO: 55089 - RNA, 19 nt, Human
aggaacccucuaacguauc

SEQ ID NO: 55090 - RNA, 20 nt, Human
aggaagacuacacagacuua

SEQ ID NO: 55091 - RNA, 19 nt, Human
aggcauccccagucuggug

SEQ ID NO: 55092 - RNA, 21 nt, Human
agugaaauacucaggccacuu

SEQ ID NO: 55093 - RNA, 18 nt, Human
aguuaguaaccauaaaag

SEQ ID NO: 55094 - RNA, 23 nt, Human
auggccaacagcucccuccccag

SEQ ID NO: 55095 - RNA, 18 nt, Human
auucugucauauuccaaa

SEQ ID NO: 55096 - RNA, 25 nt, Human
caaaaaccaaaaaaccuuacuguga

SEQ ID NO: 55097 - RNA, 20 nt, Human
caaagacccuggcgcccuuc

SEQ ID NO: 55098 - RNA, 21 nt, Human
caacugcuggacacuucaaau

SEQ ID NO: 55099 - RNA, 24 nt, Human
caagaaaacaaaaaacaaaaacca

SEQ ID NO: 55100 - RNA, 19 nt, Human
cacacacugguucuguuac

SEQ ID NO: 55101 - RNA, 18 nt, Human
caccacagggguaaaccu

SEQ ID NO: 55102 - RNA, 30 nt, Human
caccuucaccucggaaagaggcguggcuuu

SEQ ID NO: 55103 - RNA, 24 nt, Human
ccaaaaaaccuuacugugaauccu

SEQ ID NO: 55104 - RNA, 18 nt, Human
ccaaggaauggucccacc

SEQ ID NO: 55105 - RNA, 19 nt, Human
cccaaggaauggucccacc

SEQ ID NO: 55106 - RNA, 18 nt, Human
cccgggaaggucagaaau

SEQ ID NO: 55107 - RNA, 23 nt, Human
cuaggauuugcuaugcuguugug

SEQ ID NO: 55108 - RNA, 24 nt, Human
cucauuuuauuauugcccucccca

SEQ ID NO: 55109 - RNA, 23 nt, Human
cuccuccgcgcucccuggcccga

SEQ ID NO: 55110 - RNA, 21 nt, Human
cuuacugugaauccuuuccca

SEQ ID NO: 55111 - RNA, 24 nt, Human
cuuuccaguuguguacgcuuuacu

SEQ ID NO: 55112 - RNA, 19 nt, Human
gaacccucuaacguaucac

SEQ ID NO: 55113 - RNA, 23 nt, Human
gaacuggagaaaaggaagacuac

SEQ ID NO: 55114 - RNA, 18 nt, Human
gacugcgauuucacagac

SEQ ID NO: 55115 - RNA, 21 nt, Human
gcccugcuugcagaacacaca

SEQ ID NO: 55116 - RNA, 19 nt, Human
gccuauagauuuuuaaacc

SEQ ID NO: 55117 - RNA, 23 nt, Human
gguaacagaacuggagaaaagga

SEQ ID NO: 55118 - RNA, 18 nt, Human
guuuuugaagcuauaugg

SEQ ID NO: 55119 - RNA, 22 nt, Human
guuuuuguuuuugaagcuauau

SEQ ID NO: 55120 - RNA, 26 nt, Human
uaaaaacaagaaaacaaaaaacaaaa

SEQ ID NO: 55121 - RNA, 23 nt, Human
uaaaauacugaaaauucagugua

SEQ ID NO: 55122 - RNA, 21 nt, Human
uaaaccacaccacagggguaa

SEQ ID NO: 55123 - RNA, 21 nt, Human
uaacagaacuggagaaaagga

SEQ ID NO: 55124 - RNA, 18 nt, Human
uaaccucaacaauauuuu

SEQ ID NO: 55125 - RNA, 22 nt, Human
uaaccucaacaauauuuucugc

SEQ ID NO: 55126 - RNA, 23 nt, Human
uaaccucaacaauauuuucugcu

SEQ ID NO: 55127 - RNA, 20 nt, Human
uaauuugcaaacuuaagcac

SEQ ID NO: 55128 - RNA, 26 nt, Human
uacacagacuuaucauaagcuguuag

SEQ ID NO: 55129 - RNA, 21 nt, Human
uacuugagauaaaauacugaa

SEQ ID NO: 55130 - RNA, 18 nt, Human
uauuacagcagucuuucc

SEQ ID NO: 55131 - RNA, 22 nt, Human
ucaaauauccaauuuuauuuua

SEQ ID NO: 55132 - RNA, 19 nt, Human
uccacccugaggagaccgc

SEQ ID NO: 55133 - RNA, 22 nt, Human
uccgcgcucccuggcccgaggc

SEQ ID NO: 55134 - RNA, 21 nt, Human
uccuccgcgcucccuggcccg

SEQ ID NO: 55135 - RNA, 22 nt, Human
ucucacugucuccaggaucugg

SEQ ID NO: 55136 - RNA, 20 nt, Human
ucucugggcuauugauucuu

SEQ ID NO: 55137 - RNA, 19 nt, Human
ucuguaagcagguccaccc

SEQ ID NO: 55138 - RNA, 19 nt, Human
ugaaaccuaacacuauaua

SEQ ID NO: 55139 - RNA, 19 nt, Human
ugaauuacagcucugauuu

SEQ ID NO: 55140 - RNA, 19 nt, Human
ugacaagggugauaggccc

SEQ ID NO: 55141 - RNA, 19 nt, Human
ugacuaagcucucugggcu

SEQ ID NO: 55142 - RNA, 19 nt, Human
ugaggaaggagccccgccu

SEQ ID NO: 55143 - RNA, 22 nt, Human
ugcacaucaucauuuggauucc

SEQ ID NO: 55144 - RNA, 25 nt, Human
ugcucuguaagcagguccacccuga

SEQ ID NO: 55145 - RNA, 19 nt, Human
uggcuugcucuguaagcag

SEQ ID NO: 55146 - RNA, 20 nt, Human
uggugcaagagcccugcuug

SEQ ID NO: 55147 - RNA, 19 nt, Human
ugucauauuccaaaggcag

SEQ ID NO: 55148 - RNA, 25 nt, Human
ugucauauuccaaaggcaguauugg

SEQ ID NO: 55149 - RNA, 26 nt, Human
uuacaacuauaaaaagauacaauaac

SEQ ID NO: 55150 - RNA, 24 nt, Human
uuacagcagucuuuccaguugugu

SEQ ID NO: 55151 - RNA, 23 nt, Human
uuagcagcaaagguaaccucaac

SEQ ID NO: 55152 - RNA, 19 nt, Human
uuccacgguaugcacuaac

SEQ ID NO: 55153 - RNA, 21 nt, Human
uucccaaagaggaaaagaaaa

SEQ ID NO: 55154 - RNA, 18 nt, Human
uuucccacauucuuacug

SEQ ID NO: 55155 - RNA, 20 nt, Human
uuucuaaauacaguauauua

SEQ ID NO: 55156 - RNA, 20 nt, Human
uuugcaaacuuaagcacuac

SEQ ID NO: 55157 - RNA, 18 nt, Human
aaaacagccagcaacugg

SEQ ID NO: 55158 - RNA, 20 nt, Human
aaaauggugaaaccucaucu

SEQ ID NO: 55159 - RNA, 20 nt, Human
aaaccccuaacacuuuccaa

SEQ ID NO: 55160 - RNA, 22 nt, Human
aacaauuacuccucuauccccu

SEQ ID NO: 55161 - RNA, 20 nt, Human
aagcaacucaugggccacca

SEQ ID NO: 55162 - RNA, 18 nt, Human
aagccaaugaagaguggg

SEQ ID NO: 55163 - RNA, 21 nt, Human
aaggaaaagcaccucugguuu

SEQ ID NO: 55164 - RNA, 18 nt, Human
aaucgcuugaaucuggga

SEQ ID NO: 55165 - RNA, 24 nt, Human
aaucgcuugaaucugggaggcgga

SEQ ID NO: 55166 - RNA, 18 nt, Human
aauggaaucauacagucu

SEQ ID NO: 55167 - RNA, 20 nt, Human
acaccacugcacuccagccu

SEQ ID NO: 55168 - RNA, 24 nt, Human
acaccacugcacuccagccugggc

SEQ ID NO: 55169 - RNA, 24 nt, Human
acagagugagacuccgugucaaaa

SEQ ID NO: 55170 - RNA, 18 nt, Human
accaaaucaugcaaccau

SEQ ID NO: 55171 - RNA, 22 nt, Human
accacugcacuccagccugggc

SEQ ID NO: 55172 - RNA, 24 nt, Human
accacugcacuccagccugggcga

SEQ ID NO: 55173 - RNA, 24 nt, Human
accucaucucuacuaaaaauacaa

SEQ ID NO: 55174 - RNA, 24 nt, Human
accugaggucaggaguucaagauc

SEQ ID NO: 55175 - RNA, 24 nt, Human
acuccagccugggcgacagaguga

SEQ ID NO: 55176 - RNA, 18 nt, Human
acuccuucccacaaauua

SEQ ID NO: 55177 - RNA, 24 nt, Human
acugcacuccagccugggcgacag

SEQ ID NO: 55178 - RNA, 26 nt, Human
acugcacuccagccugggcgacagag

SEQ ID NO: 55179 - RNA, 22 nt, Human
agaaucgcuugaaucugggagg

SEQ ID NO: 55180 - RNA, 22 nt, Human
agacaaggaaaagcaccucugg

SEQ ID NO: 55181 - RNA, 20 nt, Human
agacaggagaaucgcuugaa

SEQ ID NO: 55182 - RNA, 24 nt, Human
agacaggagaaucgcuugaaucug

SEQ ID NO: 55183 - RNA, 21 nt, Human
agcaacuaaaacagccagcaa

SEQ ID NO: 55184 - RNA, 24 nt, Human
agcacuuugggaggcugaggcggg

SEQ ID NO: 55185 - RNA, 23 nt, Human
agccuggccaaaauggugaaacc

SEQ ID NO: 55186 - RNA, 24 nt, Human
agccugggcgacagagugagacuc

SEQ ID NO: 55187 - RNA, 19 nt, Human
aggcggagguugcagugag

SEQ ID NO: 55188 - RNA, 21 nt, Human
aggcggagguugcagugagac

SEQ ID NO: 55189 - RNA, 24 nt, Human
aggcggagguugcagugagacgag

SEQ ID NO: 55190 - RNA, 22 nt, Human
aggcggguggaucaccugaggu

SEQ ID NO: 55191 - RNA, 26 nt, Human
aggcggguggaucaccugaggucagg

SEQ ID NO: 55192 - RNA, 24 nt, Human
aggcugagacaggagaaucgcuug

SEQ ID NO: 55193 - RNA, 21 nt, Human
aggcugaggcggguggaucac

SEQ ID NO: 55194 - RNA, 24 nt, Human
aggcugaggcggguggaucaccug

SEQ ID NO: 55195 - RNA, 22 nt, Human
aggugguuguggaauugcugga

SEQ ID NO: 55196 - RNA, 23 nt, Human
aguugagucgauccacuaaacca

SEQ ID NO: 55197 - RNA, 24 nt, Human
aucacaccacugcacuccagccug

SEQ ID NO: 55198 - RNA, 20 nt, Human
aucaguagcaaaaugaaggg

SEQ ID NO: 55199 - RNA, 21 nt, Human
auggaagcaacucaugggcca

SEQ ID NO: 55200 - RNA, 23 nt, Human
auggcauguaccuauaaucccag

SEQ ID NO: 55201 - RNA, 21 nt, Human
auggucggguguuguggcucc

SEQ ID NO: 55202 - RNA, 21 nt, Human
caaaaacaaaucccaugccca

SEQ ID NO: 55203 - RNA, 25 nt, Human
caaaaccccuaacacuuuccaagcu

SEQ ID NO: 55204 - RNA, 23 nt, Human
caagcgcacccaugggaaagucc

SEQ ID NO: 55205 - RNA, 20 nt, Human
caaggaauauuccauggaaa

SEQ ID NO: 55206 - RNA, 21 nt, Human
cacaccacugcacuccagccu

SEQ ID NO: 55207 - RNA, 23 nt, Human
caccugaggucaggaguucaaga

SEQ ID NO: 55208 - RNA, 23 nt, Human
caccuguaaucccagcacuuugg

SEQ ID NO: 55209 - RNA, 24 nt, Human
caccuguaaucccagcacuuuggg

SEQ ID NO: 55210 - RNA, 22 nt, Human
cacuccagccugggcgacagag

SEQ ID NO: 55211 - RNA, 22 nt, Human
cacuccagccugggcgacagag

SEQ ID NO: 55212 - RNA, 24 nt, Human
cacuccagccugggcgacagagug

SEQ ID NO: 55213 - RNA, 19 nt, Human
cacugcacuccagccuggg

SEQ ID NO: 55214 - RNA, 20 nt, Human
cacugcacuccagccugggc

SEQ ID NO: 55215 - RNA, 22 nt, Human
cacugcacuccagccugggcga

SEQ ID NO: 55216 - RNA, 23 nt, Human
cacugcacuccagccugggcgac

SEQ ID NO: 55217 - RNA, 24 nt, Human
cacugcacuccagccugggcgaca

SEQ ID NO: 55218 - RNA, 24 nt, Human
cagcacuuugggaggcugaggcgg

SEQ ID NO: 55219 - RNA, 22 nt, Human
cagcucuguccacauggccgcc

SEQ ID NO: 55220 - RNA, 18 nt, Human
cagugagacgagaucaca

SEQ ID NO: 55221 - RNA, 23 nt, Human
cauggucggguguuguggcuccc

SEQ ID NO: 55222 - RNA, 21 nt, Human
ccaagggggcugugguugggg

SEQ ID NO: 55223 - RNA, 20 nt, Human
ccacugcacuccagccuggg

SEQ ID NO: 55224 - RNA, 21 nt, Human
ccacugcacuccagccugggc

SEQ ID NO: 55225 - RNA, 21 nt, Human
ccacugcacuccagccugggc

SEQ ID NO: 55226 - RNA, 23 nt, Human
ccacugcacuccagccugggcga

SEQ ID NO: 55227 - RNA, 24 nt, Human
ccacugcacuccagccugggcgac

SEQ ID NO: 55228 - RNA, 22 nt, Human
ccagaacauuuucaaaaccucc

SEQ ID NO: 55229 - RNA, 24 nt, Human
cccaccuguaaucccagcacuuug

SEQ ID NO: 55230 - RNA, 21 nt, Human
ccuauaaucccagcuacucag

SEQ ID NO: 55231 - RNA, 18 nt, Human
ccuccagagacuccuaag

SEQ ID NO: 55232 - RNA, 24 nt, Human
ccuggccaaaauggugaaaccuca

SEQ ID NO: 55233 - RNA, 22 nt, Human
ccugggcgacagagugagacuc

SEQ ID NO: 55234 - RNA, 24 nt, Human
cggguggaucaccugaggucagga

SEQ ID NO: 55235 - RNA, 22 nt, Human
cgugucaaaaaaaaaaaaaaaa

SEQ ID NO: 55236 - RNA, 24 nt, Human
cuaguucaaaaccccuaacacuuu

SEQ ID NO: 55237 - RNA, 24 nt, Human
cucccaccuguaaucccagcacuu

SEQ ID NO: 55238 - RNA, 24 nt, Human
cuccgugucaaaaaaaaaaaaaaa

SEQ ID NO: 55239 - RNA, 22 nt, Human
cucugagccugguccccaucuc

SEQ ID NO: 55240 - RNA, 20 nt, Human
cugcagcaggcucgggcucc

SEQ ID NO: 55241 - RNA, 20 nt, Human
cugcagcaggcucgggcucc

SEQ ID NO: 55242 - RNA, 18 nt, Human
cuggcacacagacaagga

SEQ ID NO: 55243 - RNA, 23 nt, Human
cuggccaaaauggugaaaccuca

SEQ ID NO: 55244 - RNA, 21 nt, Human
cuucccacaaauuaaggaaaa

SEQ ID NO: 55245 - RNA, 19 nt, Human
cuugaaucugggaggcgga

SEQ ID NO: 55246 - RNA, 24 nt, Human
gacagagugagacuccgugucaaa

SEQ ID NO: 55247 - RNA, 19 nt, Human
gacugugacugggccuccc

SEQ ID NO: 55248 - RNA, 23 nt, Human
gagaucacaccacugcacuccag

SEQ ID NO: 55249 - RNA, 23 nt, Human
gaggcggguggaucaccugaggu

SEQ ID NO: 55250 - RNA, 21 nt, Human
gaucaccugaggucaggaguu

SEQ ID NO: 55251 - RNA, 23 nt, Human
gaucaccugaggucaggaguuca

SEQ ID NO: 55252 - RNA, 24 nt, Human
gaucaccugaggucaggaguucaa

SEQ ID NO: 55253 - RNA, 19 nt, Human
gaucacgcuuggguucugg

SEQ ID NO: 55254 - RNA, 24 nt, Human
gauggcauguaccuauaaucccag

SEQ ID NO: 55255 - RNA, 24 nt, Human
gcacacagacaaggaaaagcaccu

SEQ ID NO: 55256 - RNA, 24 nt, Human
gcacuccagccugggcgacagagu

SEQ ID NO: 55257 - RNA, 20 nt, Human
gccaccaagggggcuguggu

SEQ ID NO: 55258 - RNA, 20 nt, Human
gccaggugugauggcaugua

SEQ ID NO: 55259 - RNA, 23 nt, Human
ggagguugcagugagacgagauc

SEQ ID NO: 55260 - RNA, 24 nt, Human
ggagguugcagugagacgagauca

SEQ ID NO: 55261 - RNA, 20 nt, Human
ggccaaaauggugaaaccuc

SEQ ID NO: 55262 - RNA, 18 nt, Human
gggaggcggagguugcag

SEQ ID NO: 55263 - RNA, 24 nt, Human
ggguguuguggcucccaccuguaa

SEQ ID NO: 55264 - RNA, 25 nt, Human
ggguucacugaugucacagcaugug

SEQ ID NO: 55265 - RNA, 21 nt, Human
gguggaucaccugaggucagg

SEQ ID NO: 55266 - RNA, 22 nt, Human
gugacugggccucccugacagc

SEQ ID NO: 55267 - RNA, 22 nt, Human
guggcucccaccuguaauccca

SEQ ID NO: 55268 - RNA, 21 nt, Human
uaaaaauacaaaaauuagcca

SEQ ID NO: 55269 - RNA, 20 nt, Human
uaaaacagccagcaacuggc

SEQ ID NO: 55270 - RNA, 21 nt, Human
uaaauggaaucauacagucug

SEQ ID NO: 55271 - RNA, 21 nt, Human
uaagcauauucuuugccuacu

SEQ ID NO: 55272 - RNA, 19 nt, Human
uacaucucucuggcuuguu

SEQ ID NO: 55273 - RNA, 18 nt, Human
uaccauaauuaaacaauu

SEQ ID NO: 55274 - RNA, 24 nt, Human
uaccuauaaucccagcuacucagg

SEQ ID NO: 55275 - RNA, 21 nt, Human
uacuucauuccuuuuuauggc

SEQ ID NO: 55276 - RNA, 22 nt, Human
uagcaaaaugaagggcaagcaa

SEQ ID NO: 55277 - RNA, 23 nt, Human
ucaaaaaaaaaaaaaaaaagaaa

SEQ ID NO: 55278 - RNA, 25 nt, Human
ucaaaaaaaaaaaaaaaaagaaaaa

SEQ ID NO: 55279 - RNA, 24 nt, Human
ucaaaaccccuaacacuuuccaag

SEQ ID NO: 55280 - RNA, 23 nt, Human
ucacaccacugcacuccagccug

SEQ ID NO: 55281 - RNA, 31 nt, Human
ucacaccacugcacuccagccugggcgacaa

SEQ ID NO: 55282 - RNA, 23 nt, Human
ucaccugaggucaggaguucaag

SEQ ID NO: 55283 - RNA, 18 nt, Human
ucagccuggccaaaaugg

SEQ ID NO: 55284 - RNA, 24 nt, Human
ucaguagcaaaaugaagggcaagg

SEQ ID NO: 55285 - RNA, 19 nt, Human
uccaaggaauauuccaugg

SEQ ID NO: 55286 - RNA, 23 nt, Human
uccagccugggcgacagagugag

SEQ ID NO: 55287 - RNA, 24 nt, Human
uccagccugggcgacagagugaga

SEQ ID NO: 55288 - RNA, 22 nt, Human
ucccaaaaacaaaucccaugcc

SEQ ID NO: 55289 - RNA, 31 nt, Human
ucccaaaaacaaaucccaugcccacuaacaa

SEQ ID NO: 55290 - RNA, 21 nt, Human
uccccuggcaaccacuaaucu

SEQ ID NO: 55291 - RNA, 23 nt, Human
uccgugucaaaaaaaaaaaaaaa

SEQ ID NO: 55292 - RNA, 28 nt, Human
uccgugucaaaaaaaaaaaaaaaaagaa

SEQ ID NO: 55293 - RNA, 24 nt, Human
ucgcuugaaucugggaggcggagg

SEQ ID NO: 55294 - RNA, 23 nt, Human
ucucuacuaaaaauacaaaaauu

SEQ ID NO: 55295 - RNA, 26 nt, Human
ucucucuggcuuguuucacugagaag

SEQ ID NO: 55296 - RNA, 22 nt, Human
ucucuggcuuguuucacugaga

SEQ ID NO: 55297 - RNA, 23 nt, Human
ucuguagccuuguacaucucucu

SEQ ID NO: 55298 - RNA, 19 nt, Human
ugaaaccucaucucuacua

SEQ ID NO: 55299 - RNA, 20 nt, Human
ugagacaggagaaucgcuug

SEQ ID NO: 55300 - RNA, 24 nt, Human
ugagacaggagaaucgcuugaauc

SEQ ID NO: 55301 - RNA, 20 nt, Human
ugaggcggguggaucaccug

SEQ ID NO: 55302 - RNA, 22 nt, Human
ugaggcggguggaucaccugag

SEQ ID NO: 55303 - RNA, 24 nt, Human
ugaggcggguggaucaccugaggu

SEQ ID NO: 55304 - RNA, 26 nt, Human
ugaggcggguggaucaccugagguca

SEQ ID NO: 55305 - RNA, 19 nt, Human
ugagucgauccacuaaacc

SEQ ID NO: 55306 - RNA, 21 nt, Human
ugagucgauccacuaaaccau

SEQ ID NO: 55307 - RNA, 19 nt, Human
uggaagcaacucaugggcc

SEQ ID NO: 55308 - RNA, 20 nt, Human
uggaaucauacagucuguag

SEQ ID NO: 55309 - RNA, 24 nt, Human
uggaucaccugaggucaggaguuc

SEQ ID NO: 55310 - RNA, 26 nt, Human
uggaucaccugaggucaggaguucaa

SEQ ID NO: 55311 - RNA, 21 nt, Human
uggcaaccacuaaucuauguu

SEQ ID NO: 55312 - RNA, 24 nt, Human
uggcucccaccuguaaucccagca

SEQ ID NO: 55313 - RNA, 22 nt, Human
ugggaaaguccuuggaucagca

SEQ ID NO: 55314 - RNA, 23 nt, Human
ugggaaaguccuuggaucagcag

SEQ ID NO: 55315 - RNA, 20 nt, Human
ugggaggcggagguugcagu

SEQ ID NO: 55316 - RNA, 29 nt, Human
ugggaggcggagguugcagugacaacggu

SEQ ID NO: 55317 - RNA, 20 nt, Human
ugggaggcugaggcgggugg

SEQ ID NO: 55318 - RNA, 23 nt, Human
ugggaggcugaggcggguggauc

SEQ ID NO: 55319 - RNA, 24 nt, Human
ugggaggcugaggcggguggauca

SEQ ID NO: 55320 - RNA, 19 nt, Human
uguaccuauaaucccagcu

SEQ ID NO: 55321 - RNA, 20 nt, Human
ugucaaaaaaaaaaaaaaaa

SEQ ID NO: 55322 - RNA, 24 nt, Human
uguggcucccaccuguaaucccag

SEQ ID NO: 55323 - RNA, 19 nt, Human
ugugggguuucuucuaaga

SEQ ID NO: 55324 - RNA, 19 nt, Human
uguucuuggcuuuaaaaca

SEQ ID NO: 55325 - RNA, 21 nt, Human
uucaaaaccucccaaaaacaa

SEQ ID NO: 55326 - RNA, 24 nt, Human
uugaaucugggaggcggagguugc

SEQ ID NO: 55327 - RNA, 20 nt, Human
uugcagugagacgagaucac

SEQ ID NO: 55328 - RNA, 25 nt, Human
uugggaggcugaggcggguggauca

SEQ ID NO: 55329 - RNA, 20 nt, Human
uuucauauaaauggaaucau

SEQ ID NO: 55330 - RNA, 24 nt, Human
uuuucaggguucacugaugucaca

SEQ ID NO: 55331 - RNA, 24 nt, Human
uuuuuuuuuuuuuuuugcucacag

SEQ ID NO: 55332 - RNA, 20 nt, Human
uuuuuuuuuuuuuuuuugcu

SEQ ID NO: 55333 - RNA, 26 nt, Human
uuuuuuuuuuuuuuuuuuuuuugggg

SEQ ID NO: 55334 - RNA, 23 nt, Human
aacaauagcuuuuucuuccccua

SEQ ID NO: 55335 - RNA, 23 nt, Human
aagcguuucagagagaggauaac

SEQ ID NO: 55336 - RNA, 26 nt, Human
acaaagcaggguguagcaguugccuu

SEQ ID NO: 55337 - RNA, 20 nt, Human
acccaagagauuuuguagga

SEQ ID NO: 55338 - RNA, 24 nt, Human
agauauucagcacgcaaggaucau

SEQ ID NO: 55339 - RNA, 19 nt, Human
caacccaccauguuuauca

SEQ ID NO: 55340 - RNA, 26 nt, Human
caauagcuuuuucuuccccuauaaac

SEQ ID NO: 55341 - RNA, 24 nt, Human
caauggcugagggaggaagcuugc

SEQ ID NO: 55342 - RNA, 24 nt, Human
cuuuucagauauucagcacgcaag

SEQ ID NO: 55343 - RNA, 20 nt, Human
uagcccagaauacaaagcag

SEQ ID NO: 55344 - RNA, 20 nt, Human
uaggaagcguuucagagaga

SEQ ID NO: 55345 - RNA, 26 nt, Human
uauaauuguaaacaauagcuuuuucu

SEQ ID NO: 55346 - RNA, 21 nt, Human
ucaauggcugagggaggaagc

SEQ ID NO: 55347 - RNA, 18 nt, Human
ucagagagaggauaacac

SEQ ID NO: 55348 - RNA, 20 nt, Human
ucuagaacuuucuugacccu

SEQ ID NO: 55349 - RNA, 21 nt, Human
ugaaagcuagcaguauuguug

SEQ ID NO: 55350 - RNA, 24 nt, Human
uguaaacaauagcuuuuucuuccc

SEQ ID NO: 55351 - RNA, 19 nt, Human
uuaauggugauauaauugu

SEQ ID NO: 55352 - RNA, 21 nt, Human
uuagcccagaauacaaagcag

SEQ ID NO: 55353 - RNA, 20 nt, Human
uugcugaucuugcugaacuu

SEQ ID NO: 55354 - RNA, 20 nt, Human
agcagaggaguggggcuggg

SEQ ID NO: 55355 - RNA, 20 nt, Human
agccagugagggugguccgc

SEQ ID NO: 55356 - RNA, 22 nt, Human
aggaguggggcugggcuggggc

SEQ ID NO: 55357 - RNA, 19 nt, Human
agggguggagacuuggaau

SEQ ID NO: 55358 - RNA, 21 nt, Human
cacaguauggccaggccaggc

SEQ ID NO: 55359 - RNA, 20 nt, Human
caggagagccagugagggug

SEQ ID NO: 55360 - RNA, 21 nt, Human
ccaggccaggcggagcaaccc

SEQ ID NO: 55361 - RNA, 23 nt, Human
ccuuugacacagccucucccggu

SEQ ID NO: 55362 - RNA, 25 nt, Human
gcuggggcugcaggagcgauucucc

SEQ ID NO: 55363 - RNA, 21 nt, Human
ggaguggggcugggcuggggc

SEQ ID NO: 55364 - RNA, 19 nt, Human
ggccaggcggagcaacccc

SEQ ID NO: 55365 - RNA, 21 nt, Human
ggcugggcuggggcugcagga

SEQ ID NO: 55366 - RNA, 19 nt, Human
ggggcugggcuggggcugc

SEQ ID NO: 55367 - RNA, 18 nt, Human
ucagcagaggaguggggc

SEQ ID NO: 55368 - RNA, 24 nt, Human
ucagcaggucagcagaggaguggg

SEQ ID NO: 55369 - RNA, 21 nt, Human
ucccagggccaggagagccag

SEQ ID NO: 55370 - RNA, 18 nt, Human
uggaauggugaggccugg

SEQ ID NO: 55371 - RNA, 20 nt, Human
ugggacacaguauggccagg

SEQ ID NO: 55372 - RNA, 25 nt, Human
ugggaguggggugugcacaggucag

SEQ ID NO: 55373 - RNA, 18 nt, Human
uggggcugggcuggggcu

SEQ ID NO: 55374 - RNA, 23 nt, Human
ugugggaguggggugugcacagg

SEQ ID NO: 55375 - RNA, 22 nt, Human
uugcugaguuagaaaauuguau

SEQ ID NO: 55376 - RNA, 21 nt, Human
uuuuuuuuuuuuugcugaguu

SEQ ID NO: 55377 - RNA, 22 nt, Human
uuuuuuuuuuuuuuuugcugag

SEQ ID NO: 55378 - RNA, 18 nt, Human
uuuuuuuuuuuuuuuuug

SEQ ID NO: 55379 - RNA, 20 nt, Human
uuuuuuuuuuuuuuuuugcu

SEQ ID NO: 55380 - RNA, 24 nt, Human
aaagugcugggauuacaggcauga

SEQ ID NO: 55381 - RNA, 18 nt, Human
aacacuucauacuaugau

SEQ ID NO: 55382 - RNA, 23 nt, Human
aagaggaauaauucaguagaggc

SEQ ID NO: 55383 - RNA, 25 nt, Human
aagcaauccucccaccucggccucc

SEQ ID NO: 55384 - RNA, 22 nt, Human
aagcagauguguauuaguagac

SEQ ID NO: 55385 - RNA, 25 nt, Human
aagccaauaauuuaaacauacucaa

SEQ ID NO: 55386 - RNA, 24 nt, Human
aagcugaagugcaguggugcaauc

SEQ ID NO: 55387 - RNA, 19 nt, Human
aagugcugggauuacaggc

SEQ ID NO: 55388 - RNA, 21 nt, Human
aagugcugggauuacaggcau

SEQ ID NO: 55389 - RNA, 26 nt, Human
aagugcugggauuacaggcaugagcc

SEQ ID NO: 55390 - RNA, 22 nt, Human
aaucacagccugcugcagccuu

SEQ ID NO: 55391 - RNA, 21 nt, Human
acacaggcucaugccaccaca

SEQ ID NO: 55392 - RNA, 24 nt, Human
acagauuuguccuugaagaccuac

SEQ ID NO: 55393 - RNA, 20 nt, Human
accaggggccuacuccugga

SEQ ID NO: 55394 - RNA, 24 nt, Human
aggaaaugguucccucacuuuaag

SEQ ID NO: 55395 - RNA, 23 nt, Human
aggcgccgggggaggacugagcu

SEQ ID NO: 55396 - RNA, 20 nt, Human
agggggcggcgggguguagg

SEQ ID NO: 55397 - RNA, 18 nt, Human
agugaugguggcagcaga

SEQ ID NO: 55398 - RNA, 25 nt, Human
agugcaguggugcaaucacagccug

SEQ ID NO: 55399 - RNA, 18 nt, Human
agugcugggauuacaggc

SEQ ID NO: 55400 - RNA, 21 nt, Human
aucacauucucucauugagug

SEQ ID NO: 55401 - RNA, 20 nt, Human
auccuccugcuucagccucc

SEQ ID NO: 55402 - RNA, 24 nt, Human
aucuaagguauuuuaugauuacuc

SEQ ID NO: 55403 - RNA, 19 nt, Human
aucucucuauaguuucaaa

SEQ ID NO: 55404 - RNA, 24 nt, Human
augaccaaccgcaguggcuuacuc

SEQ ID NO: 55405 - RNA, 24 nt, Human
caaagugcugggauuacaggcaug

SEQ ID NO: 55406 - RNA, 25 nt, Human
caaaguuccaagauuuagauaagca

SEQ ID NO: 55407 - RNA, 24 nt, Human
caacacaagaaugacaggugaugc

SEQ ID NO: 55408 - RNA, 19 nt, Human
caagaagaucuaaucucac

SEQ ID NO: 55409 - RNA, 27 nt, Human
caagcaauccucccaccucggccuccc

SEQ ID NO: 55410 - RNA, 28 nt, Human
caagcaauccucccaccucggccuccca

SEQ ID NO: 55411 - RNA, 24 nt, Human
cacagaguguuugcauauuuucuu

SEQ ID NO: 55412 - RNA, 22 nt, Human
cacagccugcugcagccuuggc

SEQ ID NO: 55413 - RNA, 23 nt, Human
cacagccugcugcagccuuggcc

SEQ ID NO: 55414 - RNA, 20 nt, Human
cacaggcucaugccaccaca

SEQ ID NO: 55415 - RNA, 24 nt, Human
caccucggccucccaaagugcugg

SEQ ID NO: 55416 - RNA, 19 nt, Human
cacgcggcccccgcccucu

SEQ ID NO: 55417 - RNA, 21 nt, Human
cacuguguuguccaggcuggu

SEQ ID NO: 55418 - RNA, 24 nt, Human
cacuguguuguccaggcuggucuc

SEQ ID NO: 55419 - RNA, 23 nt, Human
cagccuccuaagcagcugggaac

SEQ ID NO: 55420 - RNA, 24 nt, Human
cagggucuugcucuguugcccaag

SEQ ID NO: 55421 - RNA, 20 nt, Human
cagguaaugcugcauuccac

SEQ ID NO: 55422 - RNA, 24 nt, Human
caugccaccacaucuagcuaauuu

SEQ ID NO: 55423 - RNA, 23 nt, Human
ccaaagugcugggauuacaggca

SEQ ID NO: 55424 - RNA, 24 nt, Human
ccaaagugcugggauuacaggcau

SEQ ID NO: 55425 - RNA, 24 nt, Human
ccacgcccgcugagucccacugcc

SEQ ID NO: 55426 - RNA, 23 nt, Human
ccacgggccagggggcggcgggg

SEQ ID NO: 55427 - RNA, 22 nt, Human
ccaggccucuuugucugugaga

SEQ ID NO: 55428 - RNA, 24 nt, Human
cccaaagugcugggauuacaggca

SEQ ID NO: 55429 - RNA, 21 nt, Human
cccccgcccucuccccggcuc

SEQ ID NO: 55430 - RNA, 20 nt, Human
cccgcccucuccccggcucu

SEQ ID NO: 55431 - RNA, 24 nt, Human
cccgcccucuccccggcucuggca

SEQ ID NO: 55432 - RNA, 21 nt, Human
cccuccgccucccuccggggg

SEQ ID NO: 55433 - RNA, 20 nt, Human
cccuucaguaugaccaaccg

SEQ ID NO: 55434 - RNA, 19 nt, Human
ccgcugagucccacugcca

SEQ ID NO: 55435 - RNA, 24 nt, Human
ccuaagcagcugggaacacaggcu

SEQ ID NO: 55436 - RNA, 23 nt, Human
ccuccacgcccgcugagucccac

SEQ ID NO: 55437 - RNA, 26 nt, Human
ccucccaccucggccucccaaagugc

SEQ ID NO: 55438 - RNA, 23 nt, Human
ccuccugcuucagccuccuaagc

SEQ ID NO: 55439 - RNA, 23 nt, Human
ccugcagucaggagcuccaaggc

SEQ ID NO: 55440 - RNA, 20 nt, Human
ccuggacucaagcaauccuc

SEQ ID NO: 55441 - RNA, 20 nt, Human
cgcccagggcucgcucgcuc

SEQ ID NO: 55442 - RNA, 21 nt, Human
cgcuggggagugggaggcggg

SEQ ID NO: 55443 - RNA, 19 nt, Human
cggaggcgccgggggagga

SEQ ID NO: 55444 - RNA, 20 nt, Human
cggcccacgugacagccgcu

SEQ ID NO: 55445 - RNA, 24 nt, Human
cuacagaaauaagaaacuuacaga

SEQ ID NO: 55446 - RNA, 24 nt, Human
cucaagcaauccucccaccucggc

SEQ ID NO: 55447 - RNA, 23 nt, Human
cucaccccuauuggccugggcgg

SEQ ID NO: 55448 - RNA, 25 nt, Human
cucccuuacaaccccgcaguuugua

SEQ ID NO: 55449 - RNA, 20 nt, Human
cucgacccaaagccucaccc

SEQ ID NO: 55450 - RNA, 28 nt, Human
cucgcccagggcucgcucggccuaaugg

SEQ ID NO: 55451 - RNA, 23 nt, Human
cucuguugcccaagcugaagugc

SEQ ID NO: 55452 - RNA, 23 nt, Human
cugcuucagccuccuaagcagcu

SEQ ID NO: 55453 - RNA, 22 nt, Human
cuugaagaccuacuaaccugca

SEQ ID NO: 55454 - RNA, 19 nt, Human
gaccauccaccaucugucu

SEQ ID NO: 55455 - RNA, 23 nt, Human
gaccuccacgcccgcugaguccc

SEQ ID NO: 55456 - RNA, 20 nt, Human
gagacagggucuugcucugu

SEQ ID NO: 55457 - RNA, 20 nt, Human
gagcagugcgggagccgagc

SEQ ID NO: 55458 - RNA, 19 nt, Human
gaggcgccgggggaggacu

SEQ ID NO: 55459 - RNA, 26 nt, Human
gaugauaaagaaugaaugaggaagaa

SEQ ID NO: 55460 - RNA, 18 nt, Human
gauuacaggcaugagcca

SEQ ID NO: 55461 - RNA, 21 nt, Human
gauuacaggcaugagccacca

SEQ ID NO: 55462 - RNA, 22 nt, Human
gauuacaggcaugagccaccac

SEQ ID NO: 55463 - RNA, 21 nt, Human
gcaggugcaggccucgccucc

SEQ ID NO: 55464 - RNA, 24 nt, Human
gcccacgugacagccgcuguucac

SEQ ID NO: 55465 - RNA, 23 nt, Human
gcccagggcucgcucgcucagcc

SEQ ID NO: 55466 - RNA, 22 nt, Human
gcugcagccuuggccucgcagg

SEQ ID NO: 55467 - RNA, 24 nt, Human
ggacagagucccugcagucaggag

SEQ ID NO: 55468 - RNA, 22 nt, Human
ggagacagggucuugcucuguu

SEQ ID NO: 55469 - RNA, 22 nt, Human
ggaguaaccccucccuucccca

SEQ ID NO: 55470 - RNA, 19 nt, Human
ggauuacaggcaugagcca

SEQ ID NO: 55471 - RNA, 22 nt, Human
ggccacgggccagggggcggcg

SEQ ID NO: 55472 - RNA, 20 nt, Human
gggagugggaggcgggaagc

SEQ ID NO: 55473 - RNA, 19 nt, Human
ggggagugggaggcgggaa

SEQ ID NO: 55474 - RNA, 24 nt, Human
ggucucacuguguuguccaggcug

SEQ ID NO: 55475 - RNA, 19 nt, Human
guggugcaaucacagccug

SEQ ID NO: 55476 - RNA, 20 nt, Human
uaaccccucccuuccccacc

SEQ ID NO: 55477 - RNA, 23 nt, Human
uaagauguagaauucuauaacuc

SEQ ID NO: 55478 - RNA, 24 nt, Human
uaauagaacaaauuauucaacaaa

SEQ ID NO: 55479 - RNA, 23 nt, Human
uacaggcaugagccaccacgccc

SEQ ID NO: 55480 - RNA, 19 nt, Human
uacccuauuagggaauguu

SEQ ID NO: 55481 - RNA, 21 nt, Human
uacuccuggaggucaaguccu

SEQ ID NO: 55482 - RNA, 20 nt, Human
uaggguauaucugagguucc

SEQ ID NO: 55483 - RNA, 18 nt, Human
uaucugagguuccauacc

SEQ ID NO: 55484 - RNA, 25 nt, Human
ucaaucaauccuccugcuucagccu

SEQ ID NO: 55485 - RNA, 20 nt, Human
ucagccuccuaagcagcugg

SEQ ID NO: 55486 - RNA, 19 nt, Human
ucagccuugcccacucagc

SEQ ID NO: 55487 - RNA, 19 nt, Human
ucauugagugagcugaguc

SEQ ID NO: 55488 - RNA, 21 nt, Human
uccaccgucaacccacagcca

SEQ ID NO: 55489 - RNA, 23 nt, Human
uccaccgucaacccacagccaca

SEQ ID NO: 55490 - RNA, 24 nt, Human
ucccaaagugcugggauuacaggc

SEQ ID NO: 55491 - RNA, 23 nt, Human
uccccggcucuggcagcgggcug

SEQ ID NO: 55492 - RNA, 25 nt, Human
uccccggcucuggcagcgggcuggg

SEQ ID NO: 55493 - RNA, 19 nt, Human
uccuaauaucccaggccuc

SEQ ID NO: 55494 - RNA, 18 nt, Human
ucggccucccaaagugcu

SEQ ID NO: 55495 - RNA, 19 nt, Human
ucuauaacuccaacacaac

SEQ ID NO: 55496 - RNA, 21 nt, Human
ucucaccucucuggacuacag

SEQ ID NO: 55497 - RNA, 19 nt, Human
ucucacuguguuguccagg

SEQ ID NO: 55498 - RNA, 23 nt, Human
ucucacuguguuguccaggcugg

SEQ ID NO: 55499 - RNA, 24 nt, Human
ucucacuguguuguccaggcuggu

SEQ ID NO: 55500 - RNA, 26 nt, Human
ucuccaccgucaacccacagccacaa

SEQ ID NO: 55501 - RNA, 23 nt, Human
ucugagacucccuuacaacccuu

SEQ ID NO: 55502 - RNA, 18 nt, Human
ucuugcucuguugcccaa

SEQ ID NO: 55503 - RNA, 19 nt, Human
ucuugcucuguugcccaag

SEQ ID NO: 55504 - RNA, 23 nt, Human
ucuugcucuguugcccaagcuga

SEQ ID NO: 55505 - RNA, 24 nt, Human
ucuugcucuguugcccaagcugaa

SEQ ID NO: 55506 - RNA, 21 nt, Human
ugaaaccucacagggaaccaa

SEQ ID NO: 55507 - RNA, 19 nt, Human
ugaagaccuacuaaccugc

SEQ ID NO: 55508 - RNA, 19 nt, Human
ugaagugcaguggugcaau

SEQ ID NO: 55509 - RNA, 24 nt, Human
ugaaugaggaagaaugaagaccac

SEQ ID NO: 55510 - RNA, 20 nt, Human
ugagcagugccauuaacugg

SEQ ID NO: 55511 - RNA, 19 nt, Human
ugaggaagaaugaagacca

SEQ ID NO: 55512 - RNA, 24 nt, Human
ugaggaagaaugaagaccacuggu

SEQ ID NO: 55513 - RNA, 23 nt, Human
ugagucccacugccagucggagg

SEQ ID NO: 55514 - RNA, 18 nt, Human
ugagugagcugagucuuu

SEQ ID NO: 55515 - RNA, 24 nt, Human
ugauagagaugaggucucacugug

SEQ ID NO: 55516 - RNA, 21 nt, Human
ugcccaagcugaagugcagug

SEQ ID NO: 55517 - RNA, 20 nt, Human
ugccugcccugcucugucca

SEQ ID NO: 55518 - RNA, 24 nt, Human
ugcucuguugcccaagcugaagug

SEQ ID NO: 55519 - RNA, 24 nt, Human
ugcuucagccuccuaagcagcugg

SEQ ID NO: 55520 - RNA, 21 nt, Human
uggagugaaggauucagugag

SEQ ID NO: 55521 - RNA, 26 nt, Human
uggccugggcggcccacgugacagcc

SEQ ID NO: 55522 - RNA, 24 nt, Human
ugggaacacaggcucaugccacca

SEQ ID NO: 55523 - RNA, 20 nt, Human
ugggaggcgggaagcaugca

SEQ ID NO: 55524 - RNA, 20 nt, Human
ugggauguaggggguggagu

SEQ ID NO: 55525 - RNA, 18 nt, Human
ugggauuacaggcaugag

SEQ ID NO: 55526 - RNA, 19 nt, Human
ugggauuacaggcaugagc

SEQ ID NO: 55527 - RNA, 22 nt, Human
ugggauuacaggcaugagccac

SEQ ID NO: 55528 - RNA, 23 nt, Human
ugggauuacaggcaugagccacc

SEQ ID NO: 55529 - RNA, 24 nt, Human
ugggauuacaggcaugagccacca

SEQ ID NO: 55530 - RNA, 24 nt, Human
ugggauuacaggcaugagccacca

SEQ ID NO: 55531 - RNA, 18 nt, Human
uggggagugggaggcggg

SEQ ID NO: 55532 - RNA, 21 nt, Human
uguagggauggagggaaggug

SEQ ID NO: 55533 - RNA, 18 nt, Human
uguccagaccauccacca

SEQ ID NO: 55534 - RNA, 24 nt, Human
uguccaggcuggucucaaauuccu

SEQ ID NO: 55535 - RNA, 23 nt, Human
uguguuguccaggcuggucucaa

SEQ ID NO: 55536 - RNA, 24 nt, Human
uguguuguccaggcuggucucaaa

SEQ ID NO: 55537 - RNA, 21 nt, Human
uucaaaaagugaaauuuuacu

SEQ ID NO: 55538 - RNA, 25 nt, Human
uuccuggacucaagcaauccuccca

SEQ ID NO: 55539 - RNA, 21 nt, Human
uucuauaacuccaacacaaga

SEQ ID NO: 55540 - RNA, 21 nt, Human
uucuuguccagaccauccacc

SEQ ID NO: 55541 - RNA, 24 nt, Human
aaagugcugggauuacagguguga

SEQ ID NO: 55542 - RNA, 24 nt, Human
aagcauccggcuuguuaggaaauu

SEQ ID NO: 55543 - RNA, 24 nt, Human
aagcugcccuuccuccuggcuguc

SEQ ID NO: 55544 - RNA, 20 nt, Human
aaggagaacuugccauggua

SEQ ID NO: 55545 - RNA, 18 nt, Human
aagugcugggauuacagg

SEQ ID NO: 55546 - RNA, 19 nt, Human
aagugcugggauuacaggu

SEQ ID NO: 55547 - RNA, 26 nt, Human
aagugcugggauuacaggugugagcc

SEQ ID NO: 55548 - RNA, 18 nt, Human
acgaugggcaggaugggc

SEQ ID NO: 55549 - RNA, 24 nt, Human
acgcaaucucagcucacggcaacc

SEQ ID NO: 55550 - RNA, 21 nt, Human
acgccaggcuaauuuuuguau

SEQ ID NO: 55551 - RNA, 18 nt, Human
acgggguuucgccauguu

SEQ ID NO: 55552 - RNA, 19 nt, Human
acgggguuucgccauguua

SEQ ID NO: 55553 - RNA, 20 nt, Human
acgggguuucgccauguuag

SEQ ID NO: 55554 - RNA, 24 nt, Human
acgggguuucgccauguuagccag

SEQ ID NO: 55555 - RNA, 21 nt, Human
agacaggagacgaaacucagg

SEQ ID NO: 55556 - RNA, 25 nt, Human
agacaggagacgaaacucaggucca

SEQ ID NO: 55557 - RNA, 21 nt, Human
agacgaaacucagguccaccc

SEQ ID NO: 55558 - RNA, 20 nt, Human
agcagccucucauuguccaa

SEQ ID NO: 55559 - RNA, 18 nt, Human
agccuccugaguagcugg

SEQ ID NO: 55560 - RNA, 18 nt, Human
agccuuggccuccauggc

SEQ ID NO: 55561 - RNA, 22 nt, Human
aggcaggcuggccagggucaug

SEQ ID NO: 55562 - RNA, 25 nt, Human
aggcaggcuggccagggucggaccc

SEQ ID NO: 55563 - RNA, 23 nt, Human
aggcgcgauggugggagaaggug

SEQ ID NO: 55564 - RNA, 22 nt, Human
aggcguacagggccaggggcuu

SEQ ID NO: 55565 - RNA, 18 nt, Human
aggcugaggcagggagag

SEQ ID NO: 55566 - RNA, 19 nt, Human
agggaggaggcugaggcag

SEQ ID NO: 55567 - RNA, 24 nt, Human
aggugauccgccugccucggccuc

SEQ ID NO: 55568 - RNA, 22 nt, Human
aguagagacgggguuucgccau

SEQ ID NO: 55569 - RNA, 21 nt, Human
aguagcugggauuacaggcau

SEQ ID NO: 55570 - RNA, 18 nt, Human
agugugcagcugcagccu

SEQ ID NO: 55571 - RNA, 18 nt, Human
aucgcauaaccacagccc

SEQ ID NO: 55572 - RNA, 23 nt, Human
augcgccaccacgccaggcuaau

SEQ ID NO: 55573 - RNA, 24 nt, Human
auuuuuguauuuuuaguagagacg

SEQ ID NO: 55574 - RNA, 24 nt, Human
caaagugcugggauuacaggugug

SEQ ID NO: 55575 - RNA, 23 nt, Human
caaccuccaccucccggguucaa

SEQ ID NO: 55576 - RNA, 22 nt, Human
caagcgauucuccugccuuagc

SEQ ID NO: 55577 - RNA, 24 nt, Human
caccacgccaggcuaauuuuugua

SEQ ID NO: 55578 - RNA, 23 nt, Human
cacccacuccuccaaaaggcaac

SEQ ID NO: 55579 - RNA, 24 nt, Human
caccucggcucucaugguugggag

SEQ ID NO: 55580 - RNA, 19 nt, Human
cagcuuguucaaaaguggg

SEQ ID NO: 55581 - RNA, 22 nt, Human
caggugauccgccugccucggc

SEQ ID NO: 55582 - RNA, 20 nt, Human
cagugacgcaaucucagcuc

SEQ ID NO: 55583 - RNA, 24 nt, Human
caugcgccaccacgccaggcuaau

SEQ ID NO: 55584 - RNA, 23 nt, Human
cauguuagccaggcugaucuuga

SEQ ID NO: 55585 - RNA, 24 nt, Human
cauguuagccaggcugaucuugaa

SEQ ID NO: 55586 - RNA, 21 nt, Human
ccaaagugcugggauuacagg

SEQ ID NO: 55587 - RNA, 21 nt, Human
ccaaagugcugggauuacagg

SEQ ID NO: 55588 - RNA, 24 nt, Human
ccaaagugcugggauuacaggugu

SEQ ID NO: 55589 - RNA, 18 nt, Human
ccaaauguagguuucuca

SEQ ID NO: 55590 - RNA, 24 nt, Human
ccaccucccggguucaagcgauuc

SEQ ID NO: 55591 - RNA, 18 nt, Human
ccagccgcaggcgacagc

SEQ ID NO: 55592 - RNA, 22 nt, Human
ccagccgcaggcgacagcuguc

SEQ ID NO: 55593 - RNA, 22 nt, Human
ccaggccccgucuccaccagcc

SEQ ID NO: 55594 - RNA, 21 nt, Human
ccaggggcuucucccgccggu

SEQ ID NO: 55595 - RNA, 21 nt, Human
ccauguuagccaggcugaucu

SEQ ID NO: 55596 - RNA, 23 nt, Human
cccacagaagcccccgcugcugg

SEQ ID NO: 55597 - RNA, 22 nt, Human
cccacuggcacccacuccucca

SEQ ID NO: 55598 - RNA, 24 nt, Human
cccacuggcacccacuccuccaaa

SEQ ID NO: 55599 - RNA, 22 nt, Human
cccgcaggccgcaggagcagcc

SEQ ID NO: 55600 - RNA, 19 nt, Human
cccgggagcccaggccccg

SEQ ID NO: 55601 - RNA, 23 nt, Human
cccggguucaagcgauucuccug

SEQ ID NO: 55602 - RNA, 20 nt, Human
cccuuccuccuggcuguccc

SEQ ID NO: 55603 - RNA, 24 nt, Human
ccucccggguucaagcgauucucc

SEQ ID NO: 55604 - RNA, 24 nt, Human
ccuccuucugucacccaggccgga

SEQ ID NO: 55605 - RNA, 23 nt, Human
ccugaguagcugggauuacaggc

SEQ ID NO: 55606 - RNA, 24 nt, Human
ccugaguagcugggauuacaggca

SEQ ID NO: 55607 - RNA, 18 nt, Human
ccugagucagaugccagg

SEQ ID NO: 55608 - RNA, 19 nt, Human
ccugagucagaugccaggg

SEQ ID NO: 55609 - RNA, 21 nt, Human
ccugauuucaggugauccgcc

SEQ ID NO: 55610 - RNA, 23 nt, Human
ccugccuuagccuccugaguagc

SEQ ID NO: 55611 - RNA, 24 nt, Human
ccugccuuagccuccugaguagcu

SEQ ID NO: 55612 - RNA, 21 nt, Human
ccuggcugucccgcucugccu

SEQ ID NO: 55613 - RNA, 24 nt, Human
cgccauguuagccaggcugaucuu

SEQ ID NO: 55614 - RNA, 27 nt, Human
cgccauguuagccaggcugaucuugaa

SEQ ID NO: 55615 - RNA, 18 nt, Human
cggcaaccuccaccuccc

SEQ ID NO: 55616 - RNA, 24 nt, Human
cgggguuucgccauguuagccagg

SEQ ID NO: 55617 - RNA, 22 nt, Human
cucacggcaaccuccaccuccc

SEQ ID NO: 55618 - RNA, 24 nt, Human
cucacggcaaccuccaccucccgg

SEQ ID NO: 55619 - RNA, 27 nt, Human
cucagcaaucccucaaucccucaaucc

SEQ ID NO: 55620 - RNA, 22 nt, Human
cucagguccaccccugucccuc

SEQ ID NO: 55621 - RNA, 19 nt, Human
cucauuguccaaauguagg

SEQ ID NO: 55622 - RNA, 21 nt, Human
cuccucuggcaugggcuggag

SEQ ID NO: 55623 - RNA, 19 nt, Human
cucugccaagcugcccuuc

SEQ ID NO: 55624 - RNA, 22 nt, Human
cugaggcucugccaagcugccc

SEQ ID NO: 55625 - RNA, 23 nt, Human
cugaguagcugggauuacaggca

SEQ ID NO: 55626 - RNA, 24 nt, Human
cugaguagcugggauuacaggcau

SEQ ID NO: 55627 - RNA, 21 nt, Human
cugcccuuccuccuggcuguc

SEQ ID NO: 55628 - RNA, 23 nt, Human
cugccucggccucccaaagugcu

SEQ ID NO: 55629 - RNA, 18 nt, Human
cuggagcuccagcucagc

SEQ ID NO: 55630 - RNA, 24 nt, Human
cuuagccuccugaguagcugggau

SEQ ID NO: 55631 - RNA, 18 nt, Human
gaaacucagguccacccc

SEQ ID NO: 55632 - RNA, 24 nt, Human
gagacgggguuucgccauguuagc

SEQ ID NO: 55633 - RNA, 18 nt, Human
gagcagcauggggaagag

SEQ ID NO: 55634 - RNA, 24 nt, Human
gagcagcauggggaagaguaugac

SEQ ID NO: 55635 - RNA, 22 nt, Human
gaguagcugggauuacaggcau

SEQ ID NO: 55636 - RNA, 24 nt, Human
gaguagcugggauuacaggcaugc

SEQ ID NO: 55637 - RNA, 18 nt, Human
gauuacaggcaugcgcca

SEQ ID NO: 55638 - RNA, 18 nt, Human
gauuacaggugugagccg

SEQ ID NO: 55639 - RNA, 23 nt, Human
gauuacaggugugagccgccuca

SEQ ID NO: 55640 - RNA, 24 nt, Human
gauuacaggugugagccgccucac

SEQ ID NO: 55641 - RNA, 24 nt, Human
gauuucaggugauccgccugccuc

SEQ ID NO: 55642 - RNA, 22 nt, Human
gcaaccuccaccucccggguuc

SEQ ID NO: 55643 - RNA, 21 nt, Human
gcccaggaggaugagcagcau

SEQ ID NO: 55644 - RNA, 22 nt, Human
gcccuggagccuuggcaauccu

SEQ ID NO: 55645 - RNA, 22 nt, Human
gccugggccuggggaagggcuc

SEQ ID NO: 55646 - RNA, 23 nt, Human
gcucugccugguggcccugcugu

SEQ ID NO: 55647 - RNA, 22 nt, Human
ggaagaggagguggcccgcagg

SEQ ID NO: 55648 - RNA, 20 nt, Human
ggagaacuugccaugguacc

SEQ ID NO: 55649 - RNA, 19 nt, Human
ggagccaaggaagaggagg

SEQ ID NO: 55650 - RNA, 22 nt, Human
ggagcggcugagggaggaggcu

SEQ ID NO: 55651 - RNA, 25 nt, Human
ggaggaggcugaggcagggagaggg

SEQ ID NO: 55652 - RNA, 26 nt, Human
ggagguuuuuuuuuuuuuuuuuuuua

SEQ ID NO: 55653 - RNA, 19 nt, Human
ggauuacaggcaugcgcca

SEQ ID NO: 55654 - RNA, 21 nt, Human
ggccaguuucagaaucaucag

SEQ ID NO: 55655 - RNA, 20 nt, Human
ggcugaucuugaacuccuga

SEQ ID NO: 55656 - RNA, 21 nt, Human
gggaagaaggcuuuauucagg

SEQ ID NO: 55657 - RNA, 19 nt, Human
gggaagacccaggagggag

SEQ ID NO: 55658 - RNA, 20 nt, Human
gggaggcggccccgcuccgu

SEQ ID NO: 55659 - RNA, 20 nt, Human
gggcccaggaggaugagcag

SEQ ID NO: 55660 - RNA, 18 nt, Human
gggccuggggaagggcuc

SEQ ID NO: 55661 - RNA, 20 nt, Human
gggcucagagcagugugcag

SEQ ID NO: 55662 - RNA, 23 nt, Human
gggguuucgccauguuagccagg

SEQ ID NO: 55663 - RNA, 23 nt, Human
guagagacgggguuucgccaugu

SEQ ID NO: 55664 - RNA, 20 nt, Human
guagcugggauuacaggcau

SEQ ID NO: 55665 - RNA, 23 nt, Human
gucaugugcaugaagccgucguu

SEQ ID NO: 55666 - RNA, 21 nt, Human
gugguuggugcgggggcaggg

SEQ ID NO: 55667 - RNA, 22 nt, Human
gugguuggugcgggggcagggg

SEQ ID NO: 55668 - RNA, 22 nt, Human
uaaggcagagccuccuucuguc

SEQ ID NO: 55669 - RNA, 24 nt, Human
uaauuuuuguauuuuuaguagaga

SEQ ID NO: 55670 - RNA, 18 nt, Human
uacagggccaggggcuuc

SEQ ID NO: 55671 - RNA, 22 nt, Human
uaccggcccaucccacuggcac

SEQ ID NO: 55672 - RNA, 22 nt, Human
uagagacgggguuucgccaugu

SEQ ID NO: 55673 - RNA, 24 nt, Human
uagccaggcugaucuugaacuccu

SEQ ID NO: 55674 - RNA, 20 nt, Human
uagccuccugaguagcuggg

SEQ ID NO: 55675 - RNA, 24 nt, Human
uaguagagacgggguuucgccaug

SEQ ID NO: 55676 - RNA, 21 nt, Human
uaucgcauaaccacagcccca

SEQ ID NO: 55677 - RNA, 19 nt, Human
ucaaaagugggacuuggga

SEQ ID NO: 55678 - RNA, 19 nt, Human
ucaaugguuaauucucuca

SEQ ID NO: 55679 - RNA, 24 nt, Human
ucacggcaaccuccaccucccggg

SEQ ID NO: 55680 - RNA, 18 nt, Human
ucagagcagugugcagcu

SEQ ID NO: 55681 - RNA, 24 nt, Human
ucagagcagugugcagcugcagcc

SEQ ID NO: 55682 - RNA, 22 nt, Human
ucagcacccgcuugaccaccug

SEQ ID NO: 55683 - RNA, 21 nt, Human
ucaggugauccgccugccucg

SEQ ID NO: 55684 - RNA, 21 nt, Human
uccaaauguagguuucucaag

SEQ ID NO: 55685 - RNA, 21 nt, Human
uccacugaacaaauggaaaaa

SEQ ID NO: 55686 - RNA, 23 nt, Human
uccauccccgggcugcgcaggag

SEQ ID NO: 55687 - RNA, 23 nt, Human
ucccaaagugcugggauuacagg

SEQ ID NO: 55688 - RNA, 21 nt, Human
ucccacagaagcccccgcugc

SEQ ID NO: 55689 - RNA, 21 nt, Human
ucccacuggcacccacuccuc

SEQ ID NO: 55690 - RNA, 21 nt, Human
ucccggguucaagcgauucuc

SEQ ID NO: 55691 - RNA, 24 nt, Human
ucccggguucaagcgauucuccug

SEQ ID NO: 55692 - RNA, 21 nt, Human
uccgugccaccccacugagaa

SEQ ID NO: 55693 - RNA, 18 nt, Human
uccucuggcaugggcugg

SEQ ID NO: 55694 - RNA, 24 nt, Human
uccugaguagcugggauuacaggc

SEQ ID NO: 55695 - RNA, 20 nt, Human
uccuucugucacccaggccg

SEQ ID NO: 55696 - RNA, 19 nt, Human
ucgaaggagaacuugccau

SEQ ID NO: 55697 - RNA, 18 nt, Human
ucggccucccaaagugcu

SEQ ID NO: 55698 - RNA, 24 nt, Human
ucuccugccuuagccuccugagua

SEQ ID NO: 55699 - RNA, 23 nt, Human
ucuugaacuccugauuucaggug

SEQ ID NO: 55700 - RNA, 19 nt, Human
ugacgcaaucucagcucac

SEQ ID NO: 55701 - RNA, 19 nt, Human
ugagaaggguugucaggca

SEQ ID NO: 55702 - RNA, 21 nt, Human
ugaggauaaagaguuacaagc

SEQ ID NO: 55703 - RNA, 23 nt, Human
ugaggcagggagagggaagaccc

SEQ ID NO: 55704 - RNA, 19 nt, Human
ugaguggauggggcccagg

SEQ ID NO: 55705 - RNA, 21 nt, Human
ugaguggauggggcccaggag

SEQ ID NO: 55706 - RNA, 18 nt, Human
ugauuucaggugauccgc

SEQ ID NO: 55707 - RNA, 24 nt, Human
ugauuucaggugauccgccugccu

SEQ ID NO: 55708 - RNA, 23 nt, Human
ugcagcugcagccuuggccucca

SEQ ID NO: 55709 - RNA, 19 nt, Human
ugccaugguaccggcccau

SEQ ID NO: 55710 - RNA, 21 nt, Human
ugccucggccucccaaagugc

SEQ ID NO: 55711 - RNA, 24 nt, Human
ugccucggccucccaaagugcugg

SEQ ID NO: 55712 - RNA, 24 nt, Human
ugccuuagccuccugaguagcugg

SEQ ID NO: 55713 - RNA, 18 nt, Human
ugcugggauuacaggugu

SEQ ID NO: 55714 - RNA, 18 nt, Human
ugcuggucugggucagca

SEQ ID NO: 55715 - RNA, 20 nt, Human
uggagagaagagggaggcgg

SEQ ID NO: 55716 - RNA, 24 nt, Human
uggagccuuggcaauccuuuuccu

SEQ ID NO: 55717 - RNA, 20 nt, Human
uggaugcagugauuccaugg

SEQ ID NO: 55718 - RNA, 20 nt, Human
uggauggggcccaggaggau

SEQ ID NO: 55719 - RNA, 20 nt, Human
uggcaauccuuuuccuccuc

SEQ ID NO: 55720 - RNA, 18 nt, Human
uggcaugggcuggaggga

SEQ ID NO: 55721 - RNA, 21 nt, Human
uggccagggucaugugcauga

SEQ ID NO: 55722 - RNA, 19 nt, Human
ugggagcggcugagggagg

SEQ ID NO: 55723 - RNA, 18 nt, Human
ugggauuacaggcaugcg

SEQ ID NO: 55724 - RNA, 21 nt, Human
ugggauuacaggcaugcgcca

SEQ ID NO: 55725 - RNA, 22 nt, Human
ugggauuacaggcaugcgccac

SEQ ID NO: 55726 - RNA, 24 nt, Human
ugggauuacaggcaugcgccacca

SEQ ID NO: 55727 - RNA, 18 nt, Human
ugggauuacaggugugag

SEQ ID NO: 55728 - RNA, 19 nt, Human
ugggauuacaggugugagc

SEQ ID NO: 55729 - RNA, 21 nt, Human
ugggauuacaggugugagccg

SEQ ID NO: 55730 - RNA, 21 nt, Human
ugggauuacaggugugagccg

SEQ ID NO: 55731 - RNA, 22 nt, Human
ugggauuacaggugugagccgc

SEQ ID NO: 55732 - RNA, 23 nt, Human
ugggauuacaggugugagccgcc

SEQ ID NO: 55733 - RNA, 23 nt, Human
ugggauuacaggugugagccgcc

SEQ ID NO: 55734 - RNA, 25 nt, Human
ugggauuacaggugugagccgccuc

SEQ ID NO: 55735 - RNA, 18 nt, Human
ugguuggugcgggggcag

SEQ ID NO: 55736 - RNA, 21 nt, Human
uguauuuuuaguagagacggg

SEQ ID NO: 55737 - RNA, 18 nt, Human
ugucaggcaggaaacccu

SEQ ID NO: 55738 - RNA, 24 nt, Human
ugugcagcugcagccuuggccucc

SEQ ID NO: 55739 - RNA, 18 nt, Human
uuaguagagacgggguuu

SEQ ID NO: 55740 - RNA, 22 nt, Human
uuaguagagacgggguuucgcc

SEQ ID NO: 55741 - RNA, 24 nt, Human
uuaguagagacgggguuucgccau

SEQ ID NO: 55742 - RNA, 20 nt, Human
uucaagcgauucuccugccu

SEQ ID NO: 55743 - RNA, 24 nt, Human
uucaagcgauucuccugccuuagc

SEQ ID NO: 55744 - RNA, 23 nt, Human
uucagaaucaucagcuuguucaa

SEQ ID NO: 55745 - RNA, 21 nt, Human
uucaggugauccgccugccuc

SEQ ID NO: 55746 - RNA, 19 nt, Human
uucccaugccucccaccuc

SEQ ID NO: 55747 - RNA, 23 nt, Human
uuguauuuuuaguagagacgggg

SEQ ID NO: 55748 - RNA, 21 nt, Human
uuucgccauguuagccaggcu

SEQ ID NO: 55749 - RNA, 23 nt, Human
uuuuuaguagagacgggguuucg

SEQ ID NO: 55750 - RNA, 24 nt, Human
uuuuuaguagagacgggguuucgc

SEQ ID NO: 55751 - RNA, 20 nt, Human
uuuuuguauuuuuaguagag

SEQ ID NO: 55752 - RNA, 26 nt, Human
uuuuuuuuuuaaggcagagccuccuu

SEQ ID NO: 55753 - RNA, 23 nt, Human
uuuuuuuuuuuuaaggcagagcc

SEQ ID NO: 55754 - RNA, 23 nt, Human
uuuuuuuuuuuuuuuuuuuaagg

SEQ ID NO: 55755 - RNA, 20 nt, Human
aaccugaggcugggggagcc

SEQ ID NO: 55756 - RNA, 21 nt, Human
aaguggcccaggcccuggagc

SEQ ID NO: 55757 - RNA, 18 nt, Human
acagucuuugaggacgug

SEQ ID NO: 55758 - RNA, 20 nt, Human
acagucuuugaggacgugcu

SEQ ID NO: 55759 - RNA, 21 nt, Human
accagagggguggugcagaga

SEQ ID NO: 55760 - RNA, 23 nt, Human
agcaacuuucacauaaggaaacu

SEQ ID NO: 55761 - RNA, 23 nt, Human
aggcagggcacuguauuuuccag

SEQ ID NO: 55762 - RNA, 22 nt, Human
aggcccuggagcugcgcagccc

SEQ ID NO: 55763 - RNA, 21 nt, Human
agggcuggaauuggggagggu

SEQ ID NO: 55764 - RNA, 23 nt, Human
agggugcggugugaaccagaggg

SEQ ID NO: 55765 - RNA, 21 nt, Human
aguggauggagcugcuguggg

SEQ ID NO: 55766 - RNA, 24 nt, Human
aguugaaggccucacgcagccgcc

SEQ ID NO: 55767 - RNA, 20 nt, Human
augagcucagauaugucugc

SEQ ID NO: 55768 - RNA, 21 nt, Human
augccccuaagaaggcagggc

SEQ ID NO: 55769 - RNA, 19 nt, Human
caggaugcagucaugugac

SEQ ID NO: 55770 - RNA, 21 nt, Human
caggcauacacagagggccac

SEQ ID NO: 55771 - RNA, 23 nt, Human
cagggcacuguauuuuccagggu

SEQ ID NO: 55772 - RNA, 23 nt, Human
ccaacccugaccgagagggcaaa

SEQ ID NO: 55773 - RNA, 18 nt, Human
cccaguggauggagcugc

SEQ ID NO: 55774 - RNA, 18 nt, Human
cccaguggauggagcugc

SEQ ID NO: 55775 - RNA, 20 nt, Human
ccccaggccucagcccugcu

SEQ ID NO: 55776 - RNA, 18 nt, Human
cccccaggucccacuaac

SEQ ID NO: 55777 - RNA, 19 nt, Human
cccccccgacuccauuuua

SEQ ID NO: 55778 - RNA, 20 nt, Human
cccugugacugggccuggcc

SEQ ID NO: 55779 - RNA, 20 nt, Human
ccuacccccaggccucagcc

SEQ ID NO: 55780 - RNA, 18 nt, Human
ccugcggucuggaggaac

SEQ ID NO: 55781 - RNA, 23 nt, Human
ccuggagcugcgcagcccggaac

SEQ ID NO: 55782 - RNA, 18 nt, Human
ccuggagggcuccacgcu

SEQ ID NO: 55783 - RNA, 23 nt, Human
cuccuacccccaggccucagccc

SEQ ID NO: 55784 - RNA, 18 nt, Human
cugggccagcacgucgcg

SEQ ID NO: 55785 - RNA, 21 nt, Human
cuggugcaguugggauggggc

SEQ ID NO: 55786 - RNA, 20 nt, Human
cugugugacccguuggaggc

SEQ ID NO: 55787 - RNA, 22 nt, Human
gaacaaugugaguugggagcau

SEQ ID NO: 55788 - RNA, 22 nt, Human
gacagaaguccauguaagcagc

SEQ ID NO: 55789 - RNA, 19 nt, Human
gagguggaagugcgcgugu

SEQ ID NO: 55790 - RNA, 22 nt, Human
gcccugugucuggucuuacaug

SEQ ID NO: 55791 - RNA, 18 nt, Human
ggagcugcugugggugag

SEQ ID NO: 55792 - RNA, 21 nt, Human
ggaugugagaggaucccuggg

SEQ ID NO: 55793 - RNA, 21 nt, Human
ggccugaagguucuugagagc

SEQ ID NO: 55794 - RNA, 22 nt, Human
ggggaggguggggugagugagg

SEQ ID NO: 55795 - RNA, 24 nt, Human
ggguccuucgcugcaccuccacuc

SEQ ID NO: 55796 - RNA, 20 nt, Human
gggugcggugugaaccagag

SEQ ID NO: 55797 - RNA, 19 nt, Human
guggagugaugcaaacccc

SEQ ID NO: 55798 - RNA, 24 nt, Human
uaagucacaagcugaucgcaggag

SEQ ID NO: 55799 - RNA, 21 nt, Human
uacacagagggccacagccaa

SEQ ID NO: 55800 - RNA, 25 nt, Human
uacaugcaggcgugucuuggugaua

SEQ ID NO: 55801 - RNA, 24 nt, Human
uacccccaggccucagcccugcuc

SEQ ID NO: 55802 - RNA, 18 nt, Human
uacgggcaugugugugug

SEQ ID NO: 55803 - RNA, 18 nt, Human
uagaagcaagaccuugcu

SEQ ID NO: 55804 - RNA, 19 nt, Human
uaugcagguccugggccag

SEQ ID NO: 55805 - RNA, 28 nt, Human
ucaugugacagcuccagcaaccugaggc

SEQ ID NO: 55806 - RNA, 19 nt, Human
ucccaguggauggagcugc

SEQ ID NO: 55807 - RNA, 21 nt, Human
ucccaguggauggagcugcug

SEQ ID NO: 55808 - RNA, 19 nt, Human
ucccccagauagaagcaag

SEQ ID NO: 55809 - RNA, 22 nt, Human
ucugcggccucucggccucucu

SEQ ID NO: 55810 - RNA, 22 nt, Human
ucuggcaaaggaugagcucaga

SEQ ID NO: 55811 - RNA, 18 nt, Human
ugacacugccccugugac

SEQ ID NO: 55812 - RNA, 19 nt, Human
ugaccgagagggcaaaggg

SEQ ID NO: 55813 - RNA, 21 nt, Human
ugaccgagagggcaaagggcu

SEQ ID NO: 55814 - RNA, 23 nt, Human
ugacugggccuggccaacccuga

SEQ ID NO: 55815 - RNA, 23 nt, Human
ugaggacaccuggcauguucugc

SEQ ID NO: 55816 - RNA, 21 nt, Human
ugccuagaggggagagcaaag

SEQ ID NO: 55817 - RNA, 20 nt, Human
ugcuccuacccccaggccuc

SEQ ID NO: 55818 - RNA, 25 nt, Human
ugcucugcugacugcgauccuccca

SEQ ID NO: 55819 - RNA, 23 nt, Human
ugcugugggugagugcagggugc

SEQ ID NO: 55820 - RNA, 23 nt, Human
uggcaaaggaugagcucagauau

SEQ ID NO: 55821 - RNA, 18 nt, Human
uggcauaagugacuccau

SEQ ID NO: 55822 - RNA, 23 nt, Human
ugggaugugagaggaucccuggg

SEQ ID NO: 55823 - RNA, 24 nt, Human
ugggcucugccccuggguccuucg

SEQ ID NO: 55824 - RNA, 23 nt, Human
uggggaggguggggugagugagg

SEQ ID NO: 55825 - RNA, 18 nt, Human
ugguagguaagcaucugc

SEQ ID NO: 55826 - RNA, 20 nt, Human
ugucuuggugauaaauccug

SEQ ID NO: 55827 - RNA, 18 nt, Human
ugugagaggaucccuggg

SEQ ID NO: 55828 - RNA, 21 nt, Human
uguuacgggcaugugugugug

SEQ ID NO: 55829 - RNA, 21 nt, Human
uuaaaggacagaaguccaugu

SEQ ID NO: 55830 - RNA, 23 nt, Human
uucagggcugaugccccuaagaa

SEQ ID NO: 55831 - RNA, 24 nt, Human
uuccagggugacacugccccugug

SEQ ID NO: 55832 - RNA, 24 nt, Human
uucgcugcaccuccacucccuuuc

SEQ ID NO: 55833 - RNA, 22 nt, Human
uucucugugugacccguuggag

SEQ ID NO: 55834 - RNA, 21 nt, Human
uugcagcccuggcaggcagga

SEQ ID NO: 55835 - RNA, 23 nt, Human
uugggauggggcagagguggaag

SEQ ID NO: 55836 - RNA, 24 nt, Human
uugggauggggcagagguggaagu

SEQ ID NO: 55837 - RNA, 19 nt, Human
uuuucugguggagacggcc

SEQ ID NO: 55838 - RNA, 27 nt, Human
aaaaauaaagggagauuaccgguaccc

SEQ ID NO: 55839 - RNA, 20 nt, Human
aaucccaucgaucugaucug

SEQ ID NO: 55840 - RNA, 19 nt, Human
ccgcaccccgcgccucuac

SEQ ID NO: 55841 - RNA, 21 nt, Human
cuccgcaccccgcgccucuac

SEQ ID NO: 55842 - RNA, 20 nt, Human
gagucagucuuaaacaaacu

SEQ ID NO: 55843 - RNA, 18 nt, Human
ucccuagcuccgcacccc

SEQ ID NO: 55844 - RNA, 21 nt, Human
ugacaaaugaagcuggucaaa

SEQ ID NO: 55845 - RNA, 22 nt, Human
aaggcggcaggccugcugcaaa

SEQ ID NO: 55846 - RNA, 20 nt, Human
aggaaucucuugauuuaauc

SEQ ID NO: 55847 - RNA, 19 nt, Human
aggcggcaggccugcugca

SEQ ID NO: 55848 - RNA, 19 nt, Human
caaaaacagcugcuggaac

SEQ ID NO: 55849 - RNA, 22 nt, Human
cagucauaauaaugcauuuauu

SEQ ID NO: 55850 - RNA, 21 nt, Human
ccaaaaacagcugcuggaaca

SEQ ID NO: 55851 - RNA, 18 nt, Human
ggcaggccugcugcaaag

SEQ ID NO: 55852 - RNA, 22 nt, Human
uccaaaaacagcugcuggaaca

SEQ ID NO: 55853 - RNA, 23 nt, Human
ugcuggaacaccucaaauuaagg

SEQ ID NO: 55854 - RNA, 21 nt, Human
uggaacaccucaaauuaaggg

SEQ ID NO: 55855 - RNA, 23 nt, Human
uucuuugucuucuccaaaaacag

SEQ ID NO: 55856 - RNA, 24 nt, Human
aaacacuaugaaaacauaaccugg

SEQ ID NO: 55857 - RNA, 18 nt, Human
aaagacguccacagcccc

SEQ ID NO: 55858 - RNA, 24 nt, Human
aaagugcugggauuauaggcauga

SEQ ID NO: 55859 - RNA, 24 nt, Human
aaauuauggcuauuuauuuuuggu

SEQ ID NO: 55860 - RNA, 25 nt, Human
aagcgauccucccaccucagccucc

SEQ ID NO: 55861 - RNA, 19 nt, Human
aaguagcuggggcuauagg

SEQ ID NO: 55862 - RNA, 24 nt, Human
aagugauccacccaccuuggccuc

SEQ ID NO: 55863 - RNA, 19 nt, Human
aagugcugggauuauaggc

SEQ ID NO: 55864 - RNA, 21 nt, Human
aagugcugggauuauaggcau

SEQ ID NO: 55865 - RNA, 23 nt, Human
aaugcaguggaaugaucauggcu

SEQ ID NO: 55866 - RNA, 24 nt, Human
acauagccuuccccuaacaaauuc

SEQ ID NO: 55867 - RNA, 21 nt, Human
acuguaucccccaggcugaaa

SEQ ID NO: 55868 - RNA, 18 nt, Human
agacaaggucucacugua

SEQ ID NO: 55869 - RNA, 21 nt, Human
agacaguaucucuucacuagu

SEQ ID NO: 55870 - RNA, 22 nt, Human
agaguucaaugaagaugaugaa

SEQ ID NO: 55871 - RNA, 24 nt, Human
aggcugaaaugcaguggaaugauc

SEQ ID NO: 55872 - RNA, 19 nt, Human
agugauccacccaccuugg

SEQ ID NO: 55873 - RNA, 22 nt, Human
auaagucuuuuuuuccgagucc

SEQ ID NO: 55874 - RNA, 21 nt, Human
augaaagaaacacuaugaaaa

SEQ ID NO: 55875 - RNA, 23 nt, Human
augaaagaaacacuaugaaaaca

SEQ ID NO: 55876 - RNA, 24 nt, Human
caaagugcugggauuauaggcaug

SEQ ID NO: 55877 - RNA, 18 nt, Human
caaccgccugggcucaag

SEQ ID NO: 55878 - RNA, 27 nt, Human
caagcgauccucccaccucagccuccc

SEQ ID NO: 55879 - RNA, 27 nt, Human
caagcgauccucccaccucagccuccc

SEQ ID NO: 55880 - RNA, 23 nt, Human
caagugauccacccaccuuggcc

SEQ ID NO: 55881 - RNA, 24 nt, Human
caccauguugccuaggcugaucuc

SEQ ID NO: 55882 - RNA, 27 nt, Human
caccauguugccuaggcugaucucgaa

SEQ ID NO: 55883 - RNA, 22 nt, Human
cacccaccuuggccucccaaag

SEQ ID NO: 55884 - RNA, 23 nt, Human
cacccaccuuggccucccaaagu

SEQ ID NO: 55885 - RNA, 24 nt, Human
caccucagccucccaaguagcugg

SEQ ID NO: 55886 - RNA, 22 nt, Human
cacuaugaaaacauaaccuggg

SEQ ID NO: 55887 - RNA, 19 nt, Human
cagcccccuuauguaauga

SEQ ID NO: 55888 - RNA, 24 nt, Human
cagccucaaccgccugggcucaag

SEQ ID NO: 55889 - RNA, 24 nt, Human
caggauuucaccauguugccuagg

SEQ ID NO: 55890 - RNA, 21 nt, Human
caguggaaugaucauggcuca

SEQ ID NO: 55891 - RNA, 18 nt, Human
cauagcuggaauucaugc

SEQ ID NO: 55892 - RNA, 19 nt, Human
cauguugccuaggcugauc

SEQ ID NO: 55893 - RNA, 21 nt, Human
cauguugccuaggcugaucuc

SEQ ID NO: 55894 - RNA, 24 nt, Human
cauguugccuaggcugaucucgaa

SEQ ID NO: 55895 - RNA, 24 nt, Human
ccaaagugcugggauuauaggcau

SEQ ID NO: 55896 - RNA, 18 nt, Human
ccacaccaagcuaauuuu

SEQ ID NO: 55897 - RNA, 23 nt, Human
ccacauagccuuccccuaacaaa

SEQ ID NO: 55898 - RNA, 23 nt, Human
ccauaaucucuccaaagauggca

SEQ ID NO: 55899 - RNA, 24 nt, Human
cccaaguagcuggggcuauaggca

SEQ ID NO: 55900 - RNA, 23 nt, Human
cccaccucagccucccaaguagc

SEQ ID NO: 55901 - RNA, 23 nt, Human
ccucccaccucagccucccaagu

SEQ ID NO: 55902 - RNA, 26 nt, Human
ccucccaccucagccucccaaguagc

SEQ ID NO: 55903 - RNA, 24 nt, Human
ccugaacucaagugauccacccac

SEQ ID NO: 55904 - RNA, 20 nt, Human
ccugggcucaagcgauccuc

SEQ ID NO: 55905 - RNA, 21 nt, Human
ccugggcucaagcgauccucc

SEQ ID NO: 55906 - RNA, 20 nt, Human
cuauaggcagagggcaccac

SEQ ID NO: 55907 - RNA, 24 nt, Human
cucaagcgauccucccaccucagc

SEQ ID NO: 55908 - RNA, 24 nt, Human
cucaagugauccacccaccuuggc

SEQ ID NO: 55909 - RNA, 18 nt, Human
cucacugcagccucaacc

SEQ ID NO: 55910 - RNA, 24 nt, Human
cucagccucccaaguagcuggggc

SEQ ID NO: 55911 - RNA, 23 nt, Human
cugcagccucaaccgccugggcu

SEQ ID NO: 55912 - RNA, 22 nt, Human
cuggggcuauaggcagagggca

SEQ ID NO: 55913 - RNA, 20 nt, Human
cuuaccacauagccuucccc

SEQ ID NO: 55914 - RNA, 27 nt, Human
cuucuuguuccaaguuuccuccaaaag

SEQ ID NO: 55915 - RNA, 19 nt, Human
gaaagaaacacuaugaaaa

SEQ ID NO: 55916 - RNA, 24 nt, Human
gaacucaagugauccacccaccuu

SEQ ID NO: 55917 - RNA, 19 nt, Human
gaucauggcucacugcagc

SEQ ID NO: 55918 - RNA, 19 nt, Human
gauuauaggcaugaggcac

SEQ ID NO: 55919 - RNA, 21 nt, Human
gauuauaggcaugaggcacug

SEQ ID NO: 55920 - RNA, 24 nt, Human
gccugggcucaagcgauccuccca

SEQ ID NO: 55921 - RNA, 18 nt, Human
ggagccugacaacuggca

SEQ ID NO: 55922 - RNA, 23 nt, Human
ggagccugacaacuggcaucauu

SEQ ID NO: 55923 - RNA, 19 nt, Human
ggcugaaaugcaguggaau

SEQ ID NO: 55924 - RNA, 21 nt, Human
gguaaagacaggauuucacca

SEQ ID NO: 55925 - RNA, 22 nt, Human
guaaagacaggauuucaccaug

SEQ ID NO: 55926 - RNA, 22 nt, Human
guagagcuuaccacauagccuu

SEQ ID NO: 55927 - RNA, 24 nt, Human
gugauccacccaccuuggccuccc

SEQ ID NO: 55928 - RNA, 22 nt, Human
uaaagacaggauuucaccaugu

SEQ ID NO: 55929 - RNA, 24 nt, Human
uaacaaauuccaaagacguccaca

SEQ ID NO: 55930 - RNA, 22 nt, Human
uagcuggggcuauaggcagagg

SEQ ID NO: 55931 - RNA, 24 nt, Human
ucacugcagccucaaccgccuggg

SEQ ID NO: 55932 - RNA, 20 nt, Human
ucagccucccaaguagcugg

SEQ ID NO: 55933 - RNA, 23 nt, Human
ucagccucccaaguagcuggggc

SEQ ID NO: 55934 - RNA, 19 nt, Human
uccaaagauggcaaauuau

SEQ ID NO: 55935 - RNA, 20 nt, Human
uccaaguuuccuccaaaagu

SEQ ID NO: 55936 - RNA, 18 nt, Human
uccacauugaaaauagac

SEQ ID NO: 55937 - RNA, 24 nt, Human
ucccaaagugcugggauuauaggc

SEQ ID NO: 55938 - RNA, 24 nt, Human
ucccaaguagcuggggcuauaggc

SEQ ID NO: 55939 - RNA, 21 nt, Human
ucccccaggcugaaaugcagu

SEQ ID NO: 55940 - RNA, 24 nt, Human
ucucacuguaucccccaggcugaa

SEQ ID NO: 55941 - RNA, 21 nt, Human
ucucgaacuccugaacucaag

SEQ ID NO: 55942 - RNA, 21 nt, Human
ugaaagaaacacuaugaaaac

SEQ ID NO: 55943 - RNA, 24 nt, Human
ugaaagaaacacuaugaaaacaua

SEQ ID NO: 55944 - RNA, 19 nt, Human
ugaaaugcaguggaaugau

SEQ ID NO: 55945 - RNA, 24 nt, Human
ugauccacccaccuuggccuccca

SEQ ID NO: 55946 - RNA, 26 nt, Human
ugcagccaggcauuggccauaguggc

SEQ ID NO: 55947 - RNA, 24 nt, Human
ugccuaggcugaucucgaacuccu

SEQ ID NO: 55948 - RNA, 22 nt, Human
ugccugcagccaggcauuggcc

SEQ ID NO: 55949 - RNA, 18 nt, Human
ugggaggagccugacaac

SEQ ID NO: 55950 - RNA, 23 nt, Human
ugggaggagccugacaacuggca

SEQ ID NO: 55951 - RNA, 19 nt, Human
ugggauuauaggcaugagg

SEQ ID NO: 55952 - RNA, 21 nt, Human
ugggauuauaggcaugaggca

SEQ ID NO: 55953 - RNA, 22 nt, Human
ugggauuauaggcaugaggcac

SEQ ID NO: 55954 - RNA, 22 nt, Human
ugggauuauaggcaugaggcac

SEQ ID NO: 55955 - RNA, 22 nt, Human
ugggauuauaggcaugaggcac

SEQ ID NO: 55956 - RNA, 24 nt, Human
ugggauuauaggcaugaggcacug

SEQ ID NO: 55957 - RNA, 24 nt, Human
ugguaaagacaggauuucaccaug

SEQ ID NO: 55958 - RNA, 18 nt, Human
uuggccucccaaagugcu

SEQ ID NO: 55959 - RNA, 24 nt, Human
uugguaaagacaggauuucaccau

SEQ ID NO: 55960 - RNA, 21 nt, Human
uuucaccauguugccuaggcu

SEQ ID NO: 55961 - RNA, 21 nt, Human
uuuuccgaguccacauugaaa

SEQ ID NO: 55962 - RNA, 24 nt, Human
uuuuuaaaauuuaccaaaugaaau

SEQ ID NO: 55963 - RNA, 19 nt, Human
uuuuugguuuugcagcauu

SEQ ID NO: 55964 - RNA, 19 nt, Human
uuuuuuuuuuaaagacaag

SEQ ID NO: 55965 - RNA, 22 nt, Human
aagagaaauaaaucuuuggcca

SEQ ID NO: 55966 - RNA, 19 nt, Human
aagccagccuggagccccg

SEQ ID NO: 55967 - RNA, 23 nt, Human
agagaaauaaaucuuuggccagg

SEQ ID NO: 55968 - RNA, 18 nt, Human
aggcaccccugcguaccc

SEQ ID NO: 55969 - RNA, 24 nt, Human
agggggcagggccuggaguuguug

SEQ ID NO: 55970 - RNA, 20 nt, Human
cagacgacaccacacaccac

SEQ ID NO: 55971 - RNA, 20 nt, Human
cagccugggaacaccuccgc

SEQ ID NO: 55972 - RNA, 20 nt, Human
cagggccuggaguuguuggg

SEQ ID NO: 55973 - RNA, 25 nt, Human
ccccgaggaggcggccuccucuucu

SEQ ID NO: 55974 - RNA, 19 nt, Human
ccgaggaggcggccuccuc

SEQ ID NO: 55975 - RNA, 22 nt, Human
cuggaguuguugggggcagccu

SEQ ID NO: 55976 - RNA, 18 nt, Human
cugguaguagcaaguucc

SEQ ID NO: 55977 - RNA, 18 nt, Human
gagcgcgggcaagccagc

SEQ ID NO: 55978 - RNA, 23 nt, Human
ggagaguccguggacggagugug

SEQ ID NO: 55979 - RNA, 21 nt, Human
ggcagggccuggaguuguugg

SEQ ID NO: 55980 - RNA, 25 nt, Human
gggcagggccuggaguuguuggggg

SEQ ID NO: 55981 - RNA, 19 nt, Human
ggggcagccugggaacacc

SEQ ID NO: 55982 - RNA, 18 nt, Human
uaaaucuuuggccaggga

SEQ ID NO: 55983 - RNA, 19 nt, Human
uaaaucuuuggccagggac

SEQ ID NO: 55984 - RNA, 18 nt, Human
ucuucaagagugggaggg

SEQ ID NO: 55985 - RNA, 22 nt, Human
ugaggcaccccugcguacccuc

SEQ ID NO: 55986 - RNA, 20 nt, Human
ugccggaaagggugauggac

SEQ ID NO: 55987 - RNA, 18 nt, Human
ugggagggggcagggccu

SEQ ID NO: 55988 - RNA, 19 nt, Human
ugggagggggcagggccug

SEQ ID NO: 55989 - RNA, 24 nt, Human
uucacagacgacaccacacaccac

SEQ ID NO: 55990 - RNA, 22 nt, Human
agaguccuccuagauaucaaaa

SEQ ID NO: 55991 - RNA, 18 nt, Human
agauaucaaaagcugugg

SEQ ID NO: 55992 - RNA, 23 nt, Human
agaucuuugguagcacacaauuu

SEQ ID NO: 55993 - RNA, 20 nt, Human
agcuaucuccuucccaaccu

SEQ ID NO: 55994 - RNA, 19 nt, Human
cuacuagaagcacuggagc

SEQ ID NO: 55995 - RNA, 24 nt, Human
gaagaguccuccuagauaucaaaa

SEQ ID NO: 55996 - RNA, 18 nt, Human
ggauuggaggaaaaguug

SEQ ID NO: 55997 - RNA, 18 nt, Human
gggagagaagaguccucc

SEQ ID NO: 55998 - RNA, 23 nt, Human
ggugacagguaguuugggagaga

SEQ ID NO: 55999 - RNA, 21 nt, Human
ucagcaguuguucuuuggaug

SEQ ID NO: 56000 - RNA, 18 nt, Human
uccaggauuggaggaaaa

SEQ ID NO: 56001 - RNA, 19 nt, Human
ugcagcuaucuccuuccca

SEQ ID NO: 56002 - RNA, 23 nt, Human
uggagcuaggcuggcgggcauug

SEQ ID NO: 56003 - RNA, 21 nt, Human
ugguugcagcuaucuccuucc

SEQ ID NO: 56004 - RNA, 22 nt, Human
uugcucccuuucagcccuccua

SEQ ID NO: 56005 - RNA, 19 nt, Human
uugguagcacacaauuuuu

SEQ ID NO: 56006 - RNA, 21 nt, Human
uugguugcagcuaucuccuuc

SEQ ID NO: 56007 - RNA, 21 nt, Human
uuucuuggguggguauucugg

SEQ ID NO: 56008 - RNA, 24 nt, Human
accauuuauuugcuguaugguaug

SEQ ID NO: 56009 - RNA, 22 nt, Human
agcaaugagagaggggaaggga

SEQ ID NO: 56010 - RNA, 21 nt, Human
aggaagacaaguuggugccag

SEQ ID NO: 56011 - RNA, 18 nt, Human
aggcaagaaggagagccc

SEQ ID NO: 56012 - RNA, 22 nt, Human
aggcaagaaggagagcccaggg

SEQ ID NO: 56013 - RNA, 24 nt, Human
agggggagacccagccauccuguu

SEQ ID NO: 56014 - RNA, 24 nt, Human
aguuggugccaggugaaggcaucu

SEQ ID NO: 56015 - RNA, 18 nt, Human
cagccgcagccacaagca

SEQ ID NO: 56016 - RNA, 20 nt, Human
ccaggugaaggcaucucugc

SEQ ID NO: 56017 - RNA, 22 nt, Human
ccauccuguucugacuucuagc

SEQ ID NO: 56018 - RNA, 21 nt, Human
ccgcagccacaagcacagcuc

SEQ ID NO: 56019 - RNA, 23 nt, Human
cuggaagagguagggggagaccc

SEQ ID NO: 56020 - RNA, 22 nt, Human
gacagggcaggcaagaaggaga

SEQ ID NO: 56021 - RNA, 18 nt, Human
gagacagggcaggcaaga

SEQ ID NO: 56022 - RNA, 23 nt, Human
ggagacagggcaggcaagaagga

SEQ ID NO: 56023 - RNA, 25 nt, Human
uagggggagacccagccauccuguu

SEQ ID NO: 56024 - RNA, 21 nt, Human
ucugcauagcuauuuggcccu

SEQ ID NO: 56025 - RNA, 23 nt, Human
ucugcauagcuauuuggcccugg

SEQ ID NO: 56026 - RNA, 19 nt, Human
ugacuucuagcaauuucuu

SEQ ID NO: 56027 - RNA, 20 nt, Human
ugagagaggggaagggaagu

SEQ ID NO: 56028 - RNA, 22 nt, Human
ugccaggugaaggcaucucugc

SEQ ID NO: 56029 - RNA, 19 nt, Human
uggccaugacuacaagcaa

SEQ ID NO: 56030 - RNA, 18 nt, Human
ugggaaaauugugggagc

SEQ ID NO: 56031 - RNA, 21 nt, Human
ugggaaaauugugggagcugg

SEQ ID NO: 56032 - RNA, 24 nt, Human
ugggagcuggaagagguaggggga

SEQ ID NO: 56033 - RNA, 24 nt, Human
ugggugcagauggcugggccaagg

SEQ ID NO: 56034 - RNA, 24 nt, Human
ugguauguacucaaggcaugaguc

SEQ ID NO: 56035 - RNA, 18 nt, Human
uugugggagcuggaagag

SEQ ID NO: 56036 - RNA, 24 nt, Human
uuuuuuuuuuuuuuuuuuuguuuu

SEQ ID NO: 56037 - RNA, 27 nt, Human
uuuuuuuuuuuuuuuuuuuuuuugggg

SEQ ID NO: 56038 - RNA, 22 nt, Human
aaaacaggcucgcucuggccca

SEQ ID NO: 56039 - RNA, 27 nt, Human
aaacacaacuuuauugaugaaacacaa

SEQ ID NO: 56040 - RNA, 27 nt, Human
aaccucguccuccuucccccaggccac

SEQ ID NO: 56041 - RNA, 20 nt, Human
aacugcaaauaucucaauau

SEQ ID NO: 56042 - RNA, 19 nt, Human
acaggcccucucgcccucu

SEQ ID NO: 56043 - RNA, 22 nt, Human
accaacugcaaauaucucaaua

SEQ ID NO: 56044 - RNA, 21 nt, Human
accucguccuccuucccccag

SEQ ID NO: 56045 - RNA, 18 nt, Human
agucuuagaauaacaaau

SEQ ID NO: 56046 - RNA, 25 nt, Human
agugcaaccggaccaaacgaagacu

SEQ ID NO: 56047 - RNA, 21 nt, Human
caaacgaagacuaggauuaga

SEQ ID NO: 56048 - RNA, 23 nt, Human
caaccggaccaaacgaagacuag

SEQ ID NO: 56049 - RNA, 20 nt, Human
caacuuuauugaugaaacac

SEQ ID NO: 56050 - RNA, 20 nt, Human
cacaggcccucucgcccucu

SEQ ID NO: 56051 - RNA, 23 nt, Human
cagaaccucguccuccuuccccc

SEQ ID NO: 56052 - RNA, 29 nt, Human
ccaaaauagcagcugaaaagaucucuuua

SEQ ID NO: 56053 - RNA, 19 nt, Human
cccaagaucugcagggauu

SEQ ID NO: 56054 - RNA, 23 nt, Human
ccccaggccacaggcccucucgc

SEQ ID NO: 56055 - RNA, 22 nt, Human
cgcucuggcccagagaagcgcg

SEQ ID NO: 56056 - RNA, 23 nt, Human
cucguccuccuucccccaggcca

SEQ ID NO: 56057 - RNA, 18 nt, Human
cugcugggauccaggcag

SEQ ID NO: 56058 - RNA, 21 nt, Human
cuuccugcuccaaggguugga

SEQ ID NO: 56059 - RNA, 21 nt, Human
gaaaaacaaagaauuuacaaa

SEQ ID NO: 56060 - RNA, 18 nt, Human
gaccaaacgaagacuagg

SEQ ID NO: 56061 - RNA, 22 nt, Human
gaggcagcucgacuugguucuu

SEQ ID NO: 56062 - RNA, 18 nt, Human
gcugggauccaggcagaa

SEQ ID NO: 56063 - RNA, 20 nt, Human
ggccccaagaucugcaggga

SEQ ID NO: 56064 - RNA, 20 nt, Human
guuggacuggccuccggccc

SEQ ID NO: 56065 - RNA, 19 nt, Human
guuucuuccugcuccaagg

SEQ ID NO: 56066 - RNA, 19 nt, Human
uaacccgagcacaaaacag

SEQ ID NO: 56067 - RNA, 19 nt, Human
uagaauaacaaauauaaac

SEQ ID NO: 56068 - RNA, 20 nt, Human
ucauccuaaacccaaccauu

SEQ ID NO: 56069 - RNA, 19 nt, Human
uccaaaauagcagcugaaa

SEQ ID NO: 56070 - RNA, 19 nt, Human
uccaaggguuggacuggcc

SEQ ID NO: 56071 - RNA, 19 nt, Human
ucccccaggccacaggccc

SEQ ID NO: 56072 - RNA, 21 nt, Human
uccggccccaagaucugcagg

SEQ ID NO: 56073 - RNA, 25 nt, Human
ugaaaaacaaagaauuuacaaauca

SEQ ID NO: 56074 - RNA, 20 nt, Human
ugcagggauuccaggcagac

SEQ ID NO: 56075 - RNA, 24 nt, Human
ugcaugauguauaaccaauucauu

SEQ ID NO: 56076 - RNA, 24 nt, Human
ugcuuaaaacacaacuuuauugau

SEQ ID NO: 56077 - RNA, 20 nt, Human
uggccuccggccccaagauc

SEQ ID NO: 56078 - RNA, 25 nt, Human
ugggacaaaucucuuaacccgagca

SEQ ID NO: 56079 - RNA, 21 nt, Human
uguauaaccaauucauuguca

SEQ ID NO: 56080 - RNA, 19 nt, Human
uucccaaauggcacagcgu

SEQ ID NO: 56081 - RNA, 23 nt, Human
aaaaggaagacagacccuccaaa

SEQ ID NO: 56082 - RNA, 20 nt, Human
aagcuggugacugucacaga

SEQ ID NO: 56083 - RNA, 19 nt, Human
acaaguucugcugaggcuu

SEQ ID NO: 56084 - RNA, 19 nt, Human
acagagcccaaaaggaaga

SEQ ID NO: 56085 - RNA, 24 nt, Human
acagagcccaaaaggaagacagac

SEQ ID NO: 56086 - RNA, 18 nt, Human
acagauaacaucacucug

SEQ ID NO: 56087 - RNA, 21 nt, Human
aggaagacagacccuccaaag

SEQ ID NO: 56088 - RNA, 18 nt, Human
aggccauucauaauggac

SEQ ID NO: 56089 - RNA, 23 nt, Human
agucuuugguggauaaauucaag

SEQ ID NO: 56090 - RNA, 23 nt, Human
auccuaaggacagacugaagagc

SEQ ID NO: 56091 - RNA, 24 nt, Human
auuuucuccuccuccuccucgccu

SEQ ID NO: 56092 - RNA, 22 nt, Human
cacagagcccaaaaggaagaca

SEQ ID NO: 56093 - RNA, 21 nt, Human
cagacugaagagcagaaauau

SEQ ID NO: 56094 - RNA, 21 nt, Human
ccacuguagcugcaguugcac

SEQ ID NO: 56095 - RNA, 19 nt, Human
cccaaaaggaagacagacc

SEQ ID NO: 56096 - RNA, 24 nt, Human
gaaagcccgaauuccuuuuccagg

SEQ ID NO: 56097 - RNA, 19 nt, Human
gagcccaaaaggaagacag

SEQ ID NO: 56098 - RNA, 19 nt, Human
gcacggcagcgagcugcgc

SEQ ID NO: 56099 - RNA, 21 nt, Human
ggacugaaaagacggggggug

SEQ ID NO: 56100 - RNA, 19 nt, Human
ggcugugugggccggaggu

SEQ ID NO: 56101 - RNA, 22 nt, Human
gggugaggcucuucaguuuagg

SEQ ID NO: 56102 - RNA, 21 nt, Human
ucaaaacaaauaauagaacag

SEQ ID NO: 56103 - RNA, 27 nt, Human
ucaaaacaaauaauagaacaguaggcc

SEQ ID NO: 56104 - RNA, 22 nt, Human
ucaagagcaguuugcuuuuuuc

SEQ ID NO: 56105 - RNA, 19 nt, Human
uccaagcagcacgauuaaa

SEQ ID NO: 56106 - RNA, 22 nt, Human
uccacacugcaaaaucaugaaa

SEQ ID NO: 56107 - RNA, 19 nt, Human
uccacuguagcugcaguug

SEQ ID NO: 56108 - RNA, 20 nt, Human
uccuccuccucgccuggguu

SEQ ID NO: 56109 - RNA, 19 nt, Human
ucuccuccuccuccucgcc

SEQ ID NO: 56110 - RNA, 24 nt, Human
ugaaauuucuucaagucuuuugac

SEQ ID NO: 56111 - RNA, 27 nt, Human
ugaggcucuucaguuuaggaggucccc

SEQ ID NO: 56112 - RNA, 21 nt, Human
ugaggcucuucaguuuaggcu

SEQ ID NO: 56113 - RNA, 20 nt, Human
uggaacuggauugcuuaagg

SEQ ID NO: 56114 - RNA, 22 nt, Human
uggugacugucacagauaacau

SEQ ID NO: 56115 - RNA, 21 nt, Human
uuagagcuucauccuaaggac

SEQ ID NO: 56116 - RNA, 26 nt, Human
uuuccacuguagcugcaguugcacag

SEQ ID NO: 56117 - RNA, 19 nt, Human
uuuuuuuuuuuuuuuuuaa

SEQ ID NO: 56118 - RNA, 27 nt, Human
aaaaagcaacaaacauguuuucagaac

SEQ ID NO: 56119 - RNA, 21 nt, Human
aagcaguucgccccuucuucu

SEQ ID NO: 56120 - RNA, 19 nt, Human
aauagcagggaccaaggaa

SEQ ID NO: 56121 - RNA, 20 nt, Human
aaugaaaaugacagaaggga

SEQ ID NO: 56122 - RNA, 21 nt, Human
acucaguuaaauaucagcauu

SEQ ID NO: 56123 - RNA, 24 nt, Human
acucccaacaaucuuuccaaucuc

SEQ ID NO: 56124 - RNA, 22 nt, Human
agaagggagcuuacucaugaug

SEQ ID NO: 56125 - RNA, 19 nt, Human
agaggcuuggacccacugc

SEQ ID NO: 56126 - RNA, 20 nt, Human
agcaguucgccccuucuucu

SEQ ID NO: 56127 - RNA, 23 nt, Human
agcugauuguggggguugaccuc

SEQ ID NO: 56128 - RNA, 18 nt, Human
aggaauagaguagucacu

SEQ ID NO: 56129 - RNA, 23 nt, Human
aggccggcccgcccucagggcag

SEQ ID NO: 56130 - RNA, 20 nt, Human
agggagcuuacucaugaugg

SEQ ID NO: 56131 - RNA, 21 nt, Human
agggauucgggacaauuuccu

SEQ ID NO: 56132 - RNA, 23 nt, Human
caacaaucuuuccaaucucuacu

SEQ ID NO: 56133 - RNA, 25 nt, Human
caaccuacagaaagacuggccaccc

SEQ ID NO: 56134 - RNA, 22 nt, Human
caagacaagcaguucgccccuu

SEQ ID NO: 56135 - RNA, 20 nt, Human
cacugucacuuaugcagaag

SEQ ID NO: 56136 - RNA, 20 nt, Human
cagggcaguggggagcuggu

SEQ ID NO: 56137 - RNA, 21 nt, Human
ccaacucaguuaaauaucagc

SEQ ID NO: 56138 - RNA, 23 nt, Human
ccacucccaacaaucuuuccaau

SEQ ID NO: 56139 - RNA, 26 nt, Human
ccacucccaacaaucuuuccaaucuc

SEQ ID NO: 56140 - RNA, 20 nt, Human
ccagcauuaacauacaauuu

SEQ ID NO: 56141 - RNA, 21 nt, Human
ccauauaaacaagguggagaa

SEQ ID NO: 56142 - RNA, 22 nt, Human
cccaacaaucuuuccaaucucu

SEQ ID NO: 56143 - RNA, 18 nt, Human
ccuuccucuucuuuugcc

SEQ ID NO: 56144 - RNA, 22 nt, Human
ccuucuccucuuccuuuuuccc

SEQ ID NO: 56145 - RNA, 20 nt, Human
cgagauaaaaagcaacaaac

SEQ ID NO: 56146 - RNA, 22 nt, Human
cgcuucaagcggagccaccugc

SEQ ID NO: 56147 - RNA, 24 nt, Human
cuccgccgcaggccggcccgcccu

SEQ ID NO: 56148 - RNA, 18 nt, Human
cuccucuuccuuuuuccc

SEQ ID NO: 56149 - RNA, 20 nt, Human
cuggccacccgggagaggcu

SEQ ID NO: 56150 - RNA, 20 nt, Human
cugggcucaagccuguggag

SEQ ID NO: 56151 - RNA, 23 nt, Human
cuucagccacuucaaggccacaa

SEQ ID NO: 56152 - RNA, 22 nt, Human
cuuccagcauuaacauacaauu

SEQ ID NO: 56153 - RNA, 22 nt, Human
cuuccuuuuucccuccgccgca

SEQ ID NO: 56154 - RNA, 22 nt, Human
cuucuccucuuccuuuuucccu

SEQ ID NO: 56155 - RNA, 22 nt, Human
gaaacuuccucccucgcuucaa

SEQ ID NO: 56156 - RNA, 24 nt, Human
gaaaggauuccuuuaccauauaaa

SEQ ID NO: 56157 - RNA, 24 nt, Human
gccccuucuucuuuucccuagugg

SEQ ID NO: 56158 - RNA, 19 nt, Human
ggcaguggggagcugguac

SEQ ID NO: 56159 - RNA, 22 nt, Human
ggcugggggaggaaggcugugg

SEQ ID NO: 56160 - RNA, 25 nt, Human
uaugcagaagaaauagcaaaauauu

SEQ ID NO: 56161 - RNA, 26 nt, Human
uaugcagaagaaauagcaaaauauuu

SEQ ID NO: 56162 - RNA, 21 nt, Human
uccaucuuaaaccuaaagacc

SEQ ID NO: 56163 - RNA, 19 nt, Human
ucccaacaaucuuuccaau

SEQ ID NO: 56164 - RNA, 25 nt, Human
ucccaacaaucuuuccaaucucuac

SEQ ID NO: 56165 - RNA, 18 nt, Human
uccccgacaauagcaggg

SEQ ID NO: 56166 - RNA, 19 nt, Human
uccuuccucuucuuuugcc

SEQ ID NO: 56167 - RNA, 21 nt, Human
ucuucuuuugccuggcguugu

SEQ ID NO: 56168 - RNA, 18 nt, Human
ugccuggcguugugccgc

SEQ ID NO: 56169 - RNA, 20 nt, Human
uggccacccgggagaggcuu

SEQ ID NO: 56170 - RNA, 22 nt, Human
ugggcucaagccuguggagggu

SEQ ID NO: 56171 - RNA, 21 nt, Human
uugugccgcaaccuacagaaa

SEQ ID NO: 56172 - RNA, 25 nt, Human
uuuauccaucuuaaaccuaaagacc

SEQ ID NO: 56173 - RNA, 23 nt, Human
uuuuuuuuuucccuuccagcauu

SEQ ID NO: 56174 - RNA, 22 nt, Human
uuuuuuuuuuuuuuuuucccuu

SEQ ID NO: 56175 - RNA, 22 nt, Human
aaaaccuuucagcacuguucac

SEQ ID NO: 56176 - RNA, 21 nt, Human
aacaaugacuuuucaccauuu

SEQ ID NO: 56177 - RNA, 23 nt, Human
agggaggggaagaaaacacagca

SEQ ID NO: 56178 - RNA, 21 nt, Human
caaaaaguucacaaaaccuuu

SEQ ID NO: 56179 - RNA, 22 nt, Human
caacaaugacuuuucaccauuu

SEQ ID NO: 56180 - RNA, 23 nt, Human
cacauuuguuuaggaaacaauuu

SEQ ID NO: 56181 - RNA, 22 nt, Human
cacuucuuuucuuguucagaga

SEQ ID NO: 56182 - RNA, 22 nt, Human
caguuugagagaauuuuaauga

SEQ ID NO: 56183 - RNA, 21 nt, Human
cauuuccuuuccugugguucc

SEQ ID NO: 56184 - RNA, 18 nt, Human
ccgcccgccggccgcugc

SEQ ID NO: 56185 - RNA, 21 nt, Human
ccgccgcccgccggccgcugc

SEQ ID NO: 56186 - RNA, 23 nt, Human
ccgccgcccgccggccgcugcuc

SEQ ID NO: 56187 - RNA, 20 nt, Human
ccgccggccgcugcucgugc

SEQ ID NO: 56188 - RNA, 22 nt, Human
gauucuucgcaauuagcaguuu

SEQ ID NO: 56189 - RNA, 22 nt, Human
ggaaacaauuuguuuaggaaua

SEQ ID NO: 56190 - RNA, 20 nt, Human
gggaagaaaacacagcacca

SEQ ID NO: 56191 - RNA, 27 nt, Human
uagcaaaaaguucacaaaaccuuucag

SEQ ID NO: 56192 - RNA, 22 nt, Human
uauacauagcaaaaaguucaca

SEQ ID NO: 56193 - RNA, 21 nt, Human
uccugugguuccaugguucuc

SEQ ID NO: 56194 - RNA, 19 nt, Human
uguagaaguauccccgccg

SEQ ID NO: 56195 - RNA, 20 nt, Human
uuccaugguucucaaaaugg

SEQ ID NO: 56196 - RNA, 20 nt, Human
uuccaugguucucaaaaugg

SEQ ID NO: 56197 - RNA, 21 nt, Human
uuccaugguucucaaaauggu

SEQ ID NO: 56198 - RNA, 21 nt, Human
uuuuguguagacaacaaugac

SEQ ID NO: 56199 - RNA, 18 nt, Human
uuuuuuuuuuuuuuuuug

SEQ ID NO: 56200 - RNA, 20 nt, Human
uuuuuuuuuuuuuuuuuggu

SEQ ID NO: 56201 - RNA, 19 nt, Human
aaaaaccuuaugcaaccac

SEQ ID NO: 56202 - RNA, 21 nt, Human
aaaauagguuggcacaaaaca

SEQ ID NO: 56203 - RNA, 18 nt, Human
aaacagaccuggaagcuc

SEQ ID NO: 56204 - RNA, 18 nt, Human
aagaggcucugaacaguc

SEQ ID NO: 56205 - RNA, 19 nt, Human
aauacagcuuuuuuggugg

SEQ ID NO: 56206 - RNA, 22 nt, Human
aaucuugccgcccccuccucac

SEQ ID NO: 56207 - RNA, 27 nt, Human
acaaaacaaaacgugacauuuggucuc

SEQ ID NO: 56208 - RNA, 23 nt, Human
acaacaaacaugcauaaaaaccu

SEQ ID NO: 56209 - RNA, 20 nt, Human
acacugcucuccgggcccag

SEQ ID NO: 56210 - RNA, 23 nt, Human
acagaccuggaagcucaggggcg

SEQ ID NO: 56211 - RNA, 22 nt, Human
acugucugccugcugaacuucu

SEQ ID NO: 56212 - RNA, 21 nt, Human
acuucugggcgugaaucccag

SEQ ID NO: 56213 - RNA, 19 nt, Human
agccucacccuucgcucuc

SEQ ID NO: 56214 - RNA, 22 nt, Human
agcgcccgcggcuuuggguggc

SEQ ID NO: 56215 - RNA, 24 nt, Human
aggccguuuacacugcucuccggg

SEQ ID NO: 56216 - RNA, 22 nt, Human
aucuugccgcccccuccucacc

SEQ ID NO: 56217 - RNA, 21 nt, Human
augaaacagaccuggaagcuc

SEQ ID NO: 56218 - RNA, 18 nt, Human
caagcacacugggcucac

SEQ ID NO: 56219 - RNA, 22 nt, Human
caaucucugcaacuuuuaaggc

SEQ ID NO: 56220 - RNA, 20 nt, Human
cacccuucgcucuccccgag

SEQ ID NO: 56221 - RNA, 21 nt, Human
cacucaagcacacugggcuca

SEQ ID NO: 56222 - RNA, 21 nt, Human
cagagggcggccggaaagcac

SEQ ID NO: 56223 - RNA, 19 nt, Human
cagcccccgcgcugcgcaa

SEQ ID NO: 56224 - RNA, 23 nt, Human
cagccuccaaucucugcaacuuu

SEQ ID NO: 56225 - RNA, 23 nt, Human
cagcggcuccuuccaccugaucu

SEQ ID NO: 56226 - RNA, 24 nt, Human
cauaaaaaccuuaugcaaccacau

SEQ ID NO: 56227 - RNA, 26 nt, Human
ccagcggcuccuuccaccugaucucc

SEQ ID NO: 56228 - RNA, 25 nt, Human
ccagcugcuaccaccgcugccgccc

SEQ ID NO: 56229 - RNA, 19 nt, Human
cccagcggcuccuuccacc

SEQ ID NO: 56230 - RNA, 22 nt, Human
cccccaacugcacggaggcgag

SEQ ID NO: 56231 - RNA, 18 nt, Human
ccggcgccucggcuccuc

SEQ ID NO: 56232 - RNA, 18 nt, Human
ccgggcccagccucaccc

SEQ ID NO: 56233 - RNA, 21 nt, Human
ccucacccuucgcucuccccg

SEQ ID NO: 56234 - RNA, 24 nt, Human
ccuccaagcucuucugcccggucu

SEQ ID NO: 56235 - RNA, 22 nt, Human
ccugccccccgcagucggagcu

SEQ ID NO: 56236 - RNA, 20 nt, Human
ccuugagccucccgcucucc

SEQ ID NO: 56237 - RNA, 22 nt, Human
cgaaagaauaggaugaacccau

SEQ ID NO: 56238 - RNA, 21 nt, Human
cgaguccagagacacucaagc

SEQ ID NO: 56239 - RNA, 20 nt, Human
cgcccgaaaucuugccgccc

SEQ ID NO: 56240 - RNA, 21 nt, Human
cggagcuggggucuguccccu

SEQ ID NO: 56241 - RNA, 19 nt, Human
cgucuguagcucgcugcgc

SEQ ID NO: 56242 - RNA, 21 nt, Human
cucaagcuaucucuccgcugc

SEQ ID NO: 56243 - RNA, 21 nt, Human
cucacccaucaucagcgcccg

SEQ ID NO: 56244 - RNA, 22 nt, Human
cucacccaucaucagcgcccgc

SEQ ID NO: 56245 - RNA, 18 nt, Human
cugcccggucugggcggg

SEQ ID NO: 56246 - RNA, 19 nt, Human
cugcgggaaggcuucggac

SEQ ID NO: 56247 - RNA, 22 nt, Human
gaacggcggcucccagcugcug

SEQ ID NO: 56248 - RNA, 21 nt, Human
gaacuucugggcgugaauccc

SEQ ID NO: 56249 - RNA, 23 nt, Human
gggcggccggaaagcaccucggu

SEQ ID NO: 56250 - RNA, 22 nt, Human
gguacuucaaaauagguuggca

SEQ ID NO: 56251 - RNA, 20 nt, Human
ggucugggcgggaaccgagg

SEQ ID NO: 56252 - RNA, 18 nt, Human
gguggccgaccagagggc

SEQ ID NO: 56253 - RNA, 24 nt, Human
gugguacuucaaaauagguuggca

SEQ ID NO: 56254 - RNA, 21 nt, Human
uaaaaaccuuaugcaaccaca

SEQ ID NO: 56255 - RNA, 23 nt, Human
uaaaugaaacagaccuggaagcu

SEQ ID NO: 56256 - RNA, 23 nt, Human
uacaacaaacaugcauaaaaacc

SEQ ID NO: 56257 - RNA, 24 nt, Human
uacacugcucuccgggcccagccu

SEQ ID NO: 56258 - RNA, 26 nt, Human
uacacugcucuccgggcccagccuca

SEQ ID NO: 56259 - RNA, 20 nt, Human
ucacuggcugggaccuugag

SEQ ID NO: 56260 - RNA, 22 nt, Human
ucagcgcccgcggcuuugggug

SEQ ID NO: 56261 - RNA, 22 nt, Human
ucucaccggcgccucggcuccu

SEQ ID NO: 56262 - RNA, 21 nt, Human
ucucggggcagccuccaaucu

SEQ ID NO: 56263 - RNA, 19 nt, Human
ucucucuccuccacggucu

SEQ ID NO: 56264 - RNA, 21 nt, Human
ucucugcaacuuuuaaggcug

SEQ ID NO: 56265 - RNA, 22 nt, Human
ucugccugcugaacuucugggc

SEQ ID NO: 56266 - RNA, 21 nt, Human
ucugggcgugaaucccagccc

SEQ ID NO: 56267 - RNA, 21 nt, Human
ucuucugcccggucugggcgg

SEQ ID NO: 56268 - RNA, 23 nt, Human
ugaacaguccuugguacccagcg

SEQ ID NO: 56269 - RNA, 21 nt, Human
uucagggcaggggcgcccgaa

SEQ ID NO: 56270 - RNA, 19 nt, Human
uugccgcccccuccucacc

SEQ ID NO: 56271 - RNA, 18 nt, Human
uuugcagcguccuugcuc

SEQ ID NO: 56272 - RNA, 23 nt, Human
uuuggcuccuccaagcucuucug

SEQ ID NO: 56273 - RNA, 24 nt, Human
uuuuggcuccuccaagcucuucug

SEQ ID NO: 56274 - RNA, 21 nt, Human
aaccagacucacaaaaguaag

SEQ ID NO: 56275 - RNA, 21 nt, Human
agaggaggaggaggagggggg

SEQ ID NO: 56276 - RNA, 21 nt, Human
aggaggaggagggggggaggg

SEQ ID NO: 56277 - RNA, 21 nt, Human
aggaggagggggggagggagg

SEQ ID NO: 56278 - RNA, 19 nt, Human
aggagggggggagggaggg

SEQ ID NO: 56279 - RNA, 22 nt, Human
aggagggggggagggaggggaa

SEQ ID NO: 56280 - RNA, 26 nt, Human
aguauaaaaacacauacaaaaaggga

SEQ ID NO: 56281 - RNA, 21 nt, Human
caccacuuuguuccagacucu

SEQ ID NO: 56282 - RNA, 19 nt, Human
cacuuuguuccagacucuu

SEQ ID NO: 56283 - RNA, 22 nt, Human
cagaggaggaggaggagggggg

SEQ ID NO: 56284 - RNA, 24 nt, Human
cccagcuuaggcgcagugccgccc

SEQ ID NO: 56285 - RNA, 25 nt, Human
cggcagaggaggaggaggagggggg

SEQ ID NO: 56286 - RNA, 23 nt, Human
gaggaggaggagggggggaggga

SEQ ID NO: 56287 - RNA, 22 nt, Human
ggaggaggaggagggggggagg

SEQ ID NO: 56288 - RNA, 23 nt, Human
ggaggaggaggagggggggaggg

SEQ ID NO: 56289 - RNA, 22 nt, Human
ggagggaggggaaggggagagc

SEQ ID NO: 56290 - RNA, 18 nt, Human
ggagggggggagggaggg

SEQ ID NO: 56291 - RNA, 23 nt, Human
ggagggggggagggaggggaagg

SEQ ID NO: 56292 - RNA, 22 nt, Human
ggcagaggaggaggaggagggg

SEQ ID NO: 56293 - RNA, 25 nt, Human
gggcggcagaggaggaggaggaggg

SEQ ID NO: 56294 - RNA, 20 nt, Human
gggggagggaggggaagggg

SEQ ID NO: 56295 - RNA, 22 nt, Human
uacacauggacaaagaauaagc

SEQ ID NO: 56296 - RNA, 20 nt, Human
uucucuagguucauaaaaua

SEQ ID NO: 56297 - RNA, 23 nt, Human
aaaaaggaucuagucuuugcaga

SEQ ID NO: 56298 - RNA, 18 nt, Human
aagauagaaaugucaguc

SEQ ID NO: 56299 - RNA, 24 nt, Human
acauagucacacucauuuccaugu

SEQ ID NO: 56300 - RNA, 19 nt, Human
acuaugcggucugcaaagc

SEQ ID NO: 56301 - RNA, 23 nt, Human
cagcagcuuaggcgaggggagcc

SEQ ID NO: 56302 - RNA, 22 nt, Human
ccauguugucuguggcugccuu

SEQ ID NO: 56303 - RNA, 24 nt, Human
cccccagcagcuuaggcgagggga

SEQ ID NO: 56304 - RNA, 21 nt, Human
ggagagcugaguaguugagac

SEQ ID NO: 56305 - RNA, 19 nt, Human
ggggguuuaacugggggag

SEQ ID NO: 56306 - RNA, 24 nt, Human
guugucuguggcugccuucaugcu

SEQ ID NO: 56307 - RNA, 21 nt, Human
uacugcuccccugggcuagug

SEQ ID NO: 56308 - RNA, 22 nt, Human
uaggggguuuaacugggggagg

SEQ ID NO: 56309 - RNA, 23 nt, Human
ugaaauucaagauagaaauguca

SEQ ID NO: 56310 - RNA, 20 nt, Human
ugcugcagcaggagagcuga

SEQ ID NO: 56311 - RNA, 23 nt, Human
uggcugccuucaugcugcagcag

SEQ ID NO: 56312 - RNA, 24 nt, Human
ugucuguggcugccuucaugcugc

SEQ ID NO: 56313 - RNA, 22 nt, Human
uuccauguugucuguggcugcc

SEQ ID NO: 56314 - RNA, 18 nt, Human
agcccagcugguggugag

SEQ ID NO: 56315 - RNA, 21 nt, Human
aggcaggcaagagaagccagg

SEQ ID NO: 56316 - RNA, 24 nt, Human
caagaggggcacucagucccagac

SEQ ID NO: 56317 - RNA, 22 nt, Human
caaggcaggcaagagaagccag

SEQ ID NO: 56318 - RNA, 25 nt, Human
cacacgaaggcccaaggcaggcaag

SEQ ID NO: 56319 - RNA, 18 nt, Human
caccguggagggccacac

SEQ ID NO: 56320 - RNA, 23 nt, Human
ccagacaccguggagggccacac

SEQ ID NO: 56321 - RNA, 19 nt, Human
ccugccagccaaauucugg

SEQ ID NO: 56322 - RNA, 21 nt, Human
cugcucuucaggaggcaagag

SEQ ID NO: 56323 - RNA, 22 nt, Human
gaaggcccaaggcaggcaagag

SEQ ID NO: 56324 - RNA, 20 nt, Human
gaggggcacucagucccaga

SEQ ID NO: 56325 - RNA, 20 nt, Human
ggcccaaggcaggcaagaga

SEQ ID NO: 56326 - RNA, 21 nt, Human
ggcccagcggagcccagcugg

SEQ ID NO: 56327 - RNA, 19 nt, Human
guagggcacagaaugggga

SEQ ID NO: 56328 - RNA, 19 nt, Human
ucuggaaaagcugcugccc

SEQ ID NO: 56329 - RNA, 22 nt, Human
ucuggaaaagcugcugcccuug

SEQ ID NO: 56330 - RNA, 18 nt, Human
ugacuaggccugccagcc

SEQ ID NO: 56331 - RNA, 18 nt, Human
ugcccuugguggccgggg

SEQ ID NO: 56332 - RNA, 18 nt, Human
uggggugacuaggccugc

SEQ ID NO: 56333 - RNA, 22 nt, Human
uggugagguggcgagguggggu

SEQ ID NO: 56334 - RNA, 18 nt, Human
ugguggccggggugggug

SEQ ID NO: 56335 - RNA, 23 nt, Human
ugguggccggggugggugccggg

SEQ ID NO: 56336 - RNA, 20 nt, Human
ugguguuuuggucucugagg

SEQ ID NO: 56337 - RNA, 20 nt, Human
uugcuuguuuguuuuguuuu

SEQ ID NO: 56338 - RNA, 20 nt, Human
uuuugcuuguuuguuuuguu

SEQ ID NO: 56339 - RNA, 22 nt, Human
aaaggaggaaggaaggaaagag

SEQ ID NO: 56340 - RNA, 21 nt, Human
aacaacaacaaaaaaaucaua

SEQ ID NO: 56341 - RNA, 20 nt, Human
aacauagugaggccccgucu

SEQ ID NO: 56342 - RNA, 21 nt, Human
aacauagugaggccccgucuc

SEQ ID NO: 56343 - RNA, 19 nt, Human
aaccacgaaggggucagcu

SEQ ID NO: 56344 - RNA, 19 nt, Human
aaugaagaaagaggaagag

SEQ ID NO: 56345 - RNA, 19 nt, Human
accacugcacuccagccug

SEQ ID NO: 56346 - RNA, 18 nt, Human
acugcacuccagccuggg

SEQ ID NO: 56347 - RNA, 19 nt, Human
acugggugcagagaccaug

SEQ ID NO: 56348 - RNA, 25 nt, Human
acuuuuuauuauuguuaaacucaau

SEQ ID NO: 56349 - RNA, 23 nt, Human
agaggaaggaagauaggaaagga

SEQ ID NO: 56350 - RNA, 18 nt, Human
agccguggugauggcacc

SEQ ID NO: 56351 - RNA, 20 nt, Human
agccuaggcaacauagugag

SEQ ID NO: 56352 - RNA, 24 nt, Human
agccugggugucaaagugagacuc

SEQ ID NO: 56353 - RNA, 24 nt, Human
agccuguagucccagcuacucagg

SEQ ID NO: 56354 - RNA, 20 nt, Human
agcguaaaacaacuuuuuau

SEQ ID NO: 56355 - RNA, 24 nt, Human
agcuacucaggaggcugagguggg

SEQ ID NO: 56356 - RNA, 23 nt, Human
agcugggcaugauggcaugagcc

SEQ ID NO: 56357 - RNA, 24 nt, Human
aggaaggaagauaggaaaggagga

SEQ ID NO: 56358 - RNA, 18 nt, Human
aggaaggaaggaaagagg

SEQ ID NO: 56359 - RNA, 19 nt, Human
aggaaggaaggaaagagga

SEQ ID NO: 56360 - RNA, 24 nt, Human
aggcugaggugggaggaucauuug

SEQ ID NO: 56361 - RNA, 24 nt, Human
aggugccccucuagggaggguggg

SEQ ID NO: 56362 - RNA, 24 nt, Human
auccuauuuccagccuaggcaaca

SEQ ID NO: 56363 - RNA, 20 nt, Human
caccacugcacuccagccug

SEQ ID NO: 56364 - RNA, 26 nt, Human
caccacugcacuccagccuggguguc

SEQ ID NO: 56365 - RNA, 22 nt, Human
cacuccagccugggugucaaag

SEQ ID NO: 56366 - RNA, 22 nt, Human
cacuccagccugggugucaaag

SEQ ID NO: 56367 - RNA, 24 nt, Human
cacuccagccugggugucaaagug

SEQ ID NO: 56368 - RNA, 18 nt, Human
cacugcacuccagccugg

SEQ ID NO: 56369 - RNA, 19 nt, Human
cacugcacuccagccuggg

SEQ ID NO: 56370 - RNA, 21 nt, Human
cacugcacuccagccugggug

SEQ ID NO: 56371 - RNA, 21 nt, Human
cacugcacuccagccugggug

SEQ ID NO: 56372 - RNA, 23 nt, Human
cacugcacuccagccuggguguc

SEQ ID NO: 56373 - RNA, 23 nt, Human
cacugcacuccagccuggguguc

SEQ ID NO: 56374 - RNA, 21 nt, Human
cagcuacucaggaggcugagg

SEQ ID NO: 56375 - RNA, 24 nt, Human
cagcuacucaggaggcugaggugg

SEQ ID NO: 56376 - RNA, 20 nt, Human
ccacugcacuccagccuggg

SEQ ID NO: 56377 - RNA, 20 nt, Human
ccacugcacuccagccuggg

SEQ ID NO: 56378 - RNA, 20 nt, Human
ccacugcacuccagccuggg

SEQ ID NO: 56379 - RNA, 20 nt, Human
ccacugcacuccagccuggg

SEQ ID NO: 56380 - RNA, 21 nt, Human
ccacugcacuccagccugggu

SEQ ID NO: 56381 - RNA, 21 nt, Human
ccacugcacuccagccugggu

SEQ ID NO: 56382 - RNA, 22 nt, Human
ccacugcacuccagccugggug

SEQ ID NO: 56383 - RNA, 23 nt, Human
ccacugcacuccagccugggugu

SEQ ID NO: 56384 - RNA, 19 nt, Human
cccgucuccacgaaaauaa

SEQ ID NO: 56385 - RNA, 21 nt, Human
ccuauuuccagccuaggcaac

SEQ ID NO: 56386 - RNA, 22 nt, Human
ccugggugucaaagugagacuc

SEQ ID NO: 56387 - RNA, 19 nt, Human
ccuguagucccagcuacuc

SEQ ID NO: 56388 - RNA, 21 nt, Human
ccuguagucccagcuacucag

SEQ ID NO: 56389 - RNA, 22 nt, Human
ccuguagucccagcuacucagg

SEQ ID NO: 56390 - RNA, 18 nt, Human
gaaagaggaagagagaga

SEQ ID NO: 56391 - RNA, 24 nt, Human
gaagauaggaaaggaggaaggaag

SEQ ID NO: 56392 - RNA, 21 nt, Human
gaaggaaggaaagaggaguaa

SEQ ID NO: 56393 - RNA, 25 nt, Human
gacucugucuuaacaacaacaaaaa

SEQ ID NO: 56394 - RNA, 24 nt, Human
gagaggaaggaagauaggaaagga

SEQ ID NO: 56395 - RNA, 24 nt, Human
gaucauuugagcccaggacgcuga

SEQ ID NO: 56396 - RNA, 24 nt, Human
gcccaggacgcugaggcugcagug

SEQ ID NO: 56397 - RNA, 19 nt, Human
gcugaaauaaccaaagggu

SEQ ID NO: 56398 - RNA, 19 nt, Human
ggaaaggaggaaggaagga

SEQ ID NO: 56399 - RNA, 24 nt, Human
ggaagagggugggacuugggaggg

SEQ ID NO: 56400 - RNA, 21 nt, Human
gggaagagggugggacuuggg

SEQ ID NO: 56401 - RNA, 21 nt, Human
gggcagggcuauaaccacgaa

SEQ ID NO: 56402 - RNA, 20 nt, Human
gggcugaaauaaccaaaggg

SEQ ID NO: 56403 - RNA, 21 nt, Human
gggugggacuugggagggcag

SEQ ID NO: 56404 - RNA, 24 nt, Human
ggugauggcaccacugcacuccag

SEQ ID NO: 56405 - RNA, 19 nt, Human
ggugggacuugggagggca

SEQ ID NO: 56406 - RNA, 23 nt, Human
ggugggacuugggagggcagggc

SEQ ID NO: 56407 - RNA, 20 nt, Human
gucagcuuguggcuugggug

SEQ ID NO: 56408 - RNA, 22 nt, Human
gugccccucuagggaggguggg

SEQ ID NO: 56409 - RNA, 22 nt, Human
gugucaaagugagacucugucu

SEQ ID NO: 56410 - RNA, 24 nt, Human
gugucaaagugagacucugucuua

SEQ ID NO: 56411 - RNA, 20 nt, Human
uaaaacaacuuuuuauuauu

SEQ ID NO: 56412 - RNA, 19 nt, Human
uaaaagguguggaguaaua

SEQ ID NO: 56413 - RNA, 22 nt, Human
uaauauguauuauaucccccua

SEQ ID NO: 56414 - RNA, 18 nt, Human
uagcguaaaacaacuuuu

SEQ ID NO: 56415 - RNA, 23 nt, Human
uccagccugggugucaaagugag

SEQ ID NO: 56416 - RNA, 24 nt, Human
uccagccugggugucaaagugaga

SEQ ID NO: 56417 - RNA, 21 nt, Human
uccuaguucuuuuccaucuuu

SEQ ID NO: 56418 - RNA, 18 nt, Human
ucuagucuugaaaugauu

SEQ ID NO: 56419 - RNA, 22 nt, Human
ugaaugaagaaagaggaagaga

SEQ ID NO: 56420 - RNA, 23 nt, Human
ugagccuguagucccagcuacuc

SEQ ID NO: 56421 - RNA, 20 nt, Human
ugaggugggaggaucauuug

SEQ ID NO: 56422 - RNA, 23 nt, Human
ugaggugggaggaucauuugagc

SEQ ID NO: 56423 - RNA, 24 nt, Human
ugaggugggaggaucauuugagcc

SEQ ID NO: 56424 - RNA, 24 nt, Human
ugauggcaugagccuguaguccca

SEQ ID NO: 56425 - RNA, 20 nt, Human
uggcaccacugcacuccagc

SEQ ID NO: 56426 - RNA, 19 nt, Human
ugggacaugggaagagggu

SEQ ID NO: 56427 - RNA, 20 nt, Human
ugggacuugggagggcaggg

SEQ ID NO: 56428 - RNA, 18 nt, Human
ugucaaagugagacucug

SEQ ID NO: 56429 - RNA, 21 nt, Human
uguuaaacucaauuuggguuc

SEQ ID NO: 56430 - RNA, 18 nt, Human
uuagcugggcaugauggc

SEQ ID NO: 56431 - RNA, 23 nt, Human
uuauauaauuguggcuauuugcc

SEQ ID NO: 56432 - RNA, 19 nt, Human
aaaugcugagcugggugug

SEQ ID NO: 56433 - RNA, 24 nt, Human
aagaauaaauggaaagguacuggc

SEQ ID NO: 56434 - RNA, 24 nt, Human
aggcaggcuggaguccaucuggcu

SEQ ID NO: 56435 - RNA, 23 nt, Human
cagaaaauaaucaucccaugucu

SEQ ID NO: 56436 - RNA, 20 nt, Human
cagccugccaggcaggcugg

SEQ ID NO: 56437 - RNA, 19 nt, Human
cagcgagcgccgggagccu

SEQ ID NO: 56438 - RNA, 21 nt, Human
cagcgagcgccgggagccucg

SEQ ID NO: 56439 - RNA, 27 nt, Human
caugucuccaacaagaauagacaucua

SEQ ID NO: 56440 - RNA, 19 nt, Human
cgggccgcgggagcagcga

SEQ ID NO: 56441 - RNA, 21 nt, Human
cuccaacaagaauagacaucu

SEQ ID NO: 56442 - RNA, 21 nt, Human
cugaagaucaaagaauaaaug

SEQ ID NO: 56443 - RNA, 20 nt, Human
cuggggcagcuggccuuccc

SEQ ID NO: 56444 - RNA, 20 nt, Human
gaaaugcugagcugggugug

SEQ ID NO: 56445 - RNA, 23 nt, Human
gcuggaguccaucuggcuggggc

SEQ ID NO: 56446 - RNA, 20 nt, Human
ggacaggacgcugugcaguc

SEQ ID NO: 56447 - RNA, 19 nt, Human
ggguaccuacuaugugcaa

SEQ ID NO: 56448 - RNA, 22 nt, Human
gguguggaaaugcugagcuggg

SEQ ID NO: 56449 - RNA, 19 nt, Human
gugauuugcuguugcugcu

SEQ ID NO: 56450 - RNA, 21 nt, Human
ucaguggucgugauuugcugu

SEQ ID NO: 56451 - RNA, 21 nt, Human
uccaacaagaauagacaucua

SEQ ID NO: 56452 - RNA, 22 nt, Human
ucccugaagaucaaagaauaaa

SEQ ID NO: 56453 - RNA, 19 nt, Human
uggaaagguacuggccucg

SEQ ID NO: 56454 - RNA, 24 nt, Human
ugguguggaaaugcugagcugggg

SEQ ID NO: 56455 - RNA, 23 nt, Human
uguggacaggacgcugugcaguc

SEQ ID NO: 56456 - RNA, 22 nt, Human
uugcuguugcugcuuggugugg

SEQ ID NO: 56457 - RNA, 21 nt, Human
aaacaaacaaaaugcauggga

SEQ ID NO: 56458 - RNA, 27 nt, Human
aaacaaacaaaaugcaugggaauagca

SEQ ID NO: 56459 - RNA, 23 nt, Human
aaacacaaaccuggucacaaaac

SEQ ID NO: 56460 - RNA, 24 nt, Human
aaacacaaaccuggucacaaaaca

SEQ ID NO: 56461 - RNA, 23 nt, Human
aacaccaaccccauauucagcag

SEQ ID NO: 56462 - RNA, 20 nt, Human
aaccccauauucagcagaga

SEQ ID NO: 56463 - RNA, 26 nt, Human
aagaaaacacaaaccuggucacaaaa

SEQ ID NO: 56464 - RNA, 18 nt, Human
agaacaccaaccccauau

SEQ ID NO: 56465 - RNA, 21 nt, Human
agagaggacugcucugccucc

SEQ ID NO: 56466 - RNA, 25 nt, Human
agagcugaauuaugaugacuuguag

SEQ ID NO: 56467 - RNA, 19 nt, Human
agugaagaaacaaacaaaa

SEQ ID NO: 56468 - RNA, 18 nt, Human
auagcaaauuuggggcca

SEQ ID NO: 56469 - RNA, 21 nt, Human
caaacaaaaugcaugggaaua

SEQ ID NO: 56470 - RNA, 21 nt, Human
caaccccauauucagcagaga

SEQ ID NO: 56471 - RNA, 22 nt, Human
cagaaugcucucaagagcugaa

SEQ ID NO: 56472 - RNA, 24 nt, Human
ccaauagauuuacagccaucuaaa

SEQ ID NO: 56473 - RNA, 21 nt, Human
ccuccagcugcacaaccugcc

SEQ ID NO: 56474 - RNA, 26 nt, Human
gagaacaccaaccccauauucagcag

SEQ ID NO: 56475 - RNA, 22 nt, Human
ggaaaagcaagguuaacucaag

SEQ ID NO: 56476 - RNA, 21 nt, Human
guuugcuucaggcuccccaga

SEQ ID NO: 56477 - RNA, 19 nt, Human
uauuuuaagaaaacacaaa

SEQ ID NO: 56478 - RNA, 22 nt, Human
ucugcauuuuauuuuaagaaaa

SEQ ID NO: 56479 - RNA, 21 nt, Human
ugaagaaacaaacaaaaugca

SEQ ID NO: 56480 - RNA, 19 nt, Human
ugacaugacaucauuuugu

SEQ ID NO: 56481 - RNA, 23 nt, Human
ugcaugggaauagcaaauuuggg

SEQ ID NO: 56482 - RNA, 18 nt, Human
ugcuucaggcuccccaga

SEQ ID NO: 56483 - RNA, 18 nt, Human
ugggaauagcaaauuugg

SEQ ID NO: 56484 - RNA, 25 nt, Human
aaacaauaggauaaaggucuaaagc

SEQ ID NO: 56485 - RNA, 20 nt, Human
acaauugcaaaaucaacuug

SEQ ID NO: 56486 - RNA, 24 nt, Human
agauuauguuagaauacaagauug

SEQ ID NO: 56487 - RNA, 22 nt, Human
aggauaaaggucuaaagccuug

SEQ ID NO: 56488 - RNA, 23 nt, Human
auaucauuauugcuagccccaaa

SEQ ID NO: 56489 - RNA, 24 nt, Human
caauaggauaaaggucuaaagccu

SEQ ID NO: 56490 - RNA, 20 nt, Human
cauagcaggcauuugccucc

SEQ ID NO: 56491 - RNA, 22 nt, Human
ccccgcgcagggcagccacucc

SEQ ID NO: 56492 - RNA, 19 nt, Human
ccucaauaaacaauaggau

SEQ ID NO: 56493 - RNA, 24 nt, Human
cgcgugggugggugcgugcgugcg

SEQ ID NO: 56494 - RNA, 23 nt, Human
cuagccccaaaaagaguugcaaa

SEQ ID NO: 56495 - RNA, 21 nt, Human
gcacaauccuucugcccaaag

SEQ ID NO: 56496 - RNA, 23 nt, Human
gcacaauccuucugcccaaagcc

SEQ ID NO: 56497 - RNA, 22 nt, Human
ggaguugacaaucugcacaauc

SEQ ID NO: 56498 - RNA, 20 nt, Human
guaauaguuaaaacacauac

SEQ ID NO: 56499 - RNA, 19 nt, Human
uaaaacacauacagacaac

SEQ ID NO: 56500 - RNA, 18 nt, Human
uaaaggucuaaagccuug

SEQ ID NO: 56501 - RNA, 21 nt, Human
uacauguaaauuguggaguau

SEQ ID NO: 56502 - RNA, 21 nt, Human
uauugcuagccccaaaaagag

SEQ ID NO: 56503 - RNA, 24 nt, Human
ucacauagcaggcauuugccuccc

SEQ ID NO: 56504 - RNA, 22 nt, Human
uccccgcgcagggcagccacuc

SEQ ID NO: 56505 - RNA, 23 nt, Human
ucccuaacaugcacuguaauagu

SEQ ID NO: 56506 - RNA, 25 nt, Human
uccucaauaaacaauaggauaaagg

SEQ ID NO: 56507 - RNA, 21 nt, Human
ugaguguccccgcgcagggca

SEQ ID NO: 56508 - RNA, 21 nt, Human
ugcacaauccuucugcccaaa

SEQ ID NO: 56509 - RNA, 24 nt, Human
aagcgcuccuuggaucuggugacc

SEQ ID NO: 56510 - RNA, 19 nt, Human
accuugaggaggcagggga

SEQ ID NO: 56511 - RNA, 19 nt, Human
aggagggaggcgaaguggg

SEQ ID NO: 56512 - RNA, 19 nt, Human
aggagggaggcgaaguggg

SEQ ID NO: 56513 - RNA, 19 nt, Human
aggauagaggcaggguggg

SEQ ID NO: 56514 - RNA, 24 nt, Human
aggcagccgcauggcacaaaucug

SEQ ID NO: 56515 - RNA, 20 nt, Human
aggcaggguggggguugggu

SEQ ID NO: 56516 - RNA, 22 nt, Human
aggcaggguggggguugggugg

SEQ ID NO: 56517 - RNA, 18 nt, Human
agggaggcgaagugggga

SEQ ID NO: 56518 - RNA, 24 nt, Human
cagagcuccucaagcgcuccuugg

SEQ ID NO: 56519 - RNA, 23 nt, Human
cagcaggagggaggcgaaguggg

SEQ ID NO: 56520 - RNA, 23 nt, Human
cagcucccagggcgcccugggcu

SEQ ID NO: 56521 - RNA, 19 nt, Human
caggguggggguugggugg

SEQ ID NO: 56522 - RNA, 19 nt, Human
caggguggggguugggugg

SEQ ID NO: 56523 - RNA, 21 nt, Human
ccagaugucccgggagggccc

SEQ ID NO: 56524 - RNA, 19 nt, Human
ccccugggaauccccgauc

SEQ ID NO: 56525 - RNA, 19 nt, Human
cccugaaggggaugcggag

SEQ ID NO: 56526 - RNA, 20 nt, Human
cccuguacccagagcuccuc

SEQ ID NO: 56527 - RNA, 18 nt, Human
ccugaaggggaugcggag

SEQ ID NO: 56528 - RNA, 21 nt, Human
ccugauccacccaaguccuug

SEQ ID NO: 56529 - RNA, 22 nt, Human
ccugcucccugaaggggaugcg

SEQ ID NO: 56530 - RNA, 24 nt, Human
ccugcucccugaaggggaugcgga

SEQ ID NO: 56531 - RNA, 20 nt, Human
cggcucaggacggggaacag

SEQ ID NO: 56532 - RNA, 21 nt, Human
cgguggggcacgcggucuggg

SEQ ID NO: 56533 - RNA, 24 nt, Human
cucaggacggggaacagggcagga

SEQ ID NO: 56534 - RNA, 23 nt, Human
gagaccuugaggaggcaggggag

SEQ ID NO: 56535 - RNA, 23 nt, Human
gagaccuugaggaggcaggggag

SEQ ID NO: 56536 - RNA, 21 nt, Human
gaggaggcaggggagucuucc

SEQ ID NO: 56537 - RNA, 19 nt, Human
gaggcaggggagucuuccu

SEQ ID NO: 56538 - RNA, 18 nt, Human
gcgcccugggcuccugcu

SEQ ID NO: 56539 - RNA, 22 nt, Human
ggcaggaagcaucugaguggcu

SEQ ID NO: 56540 - RNA, 22 nt, Human
gggaauccccgauccaguagcc

SEQ ID NO: 56541 - RNA, 20 nt, Human
gggagggcccaugggcucug

SEQ ID NO: 56542 - RNA, 24 nt, Human
gggcagcaggagggaggcgaagug

SEQ ID NO: 56543 - RNA, 25 nt, Human
ggggaacagggcaggacgcccggag

SEQ ID NO: 56544 - RNA, 18 nt, Human
ggggagacagcagaggac

SEQ ID NO: 56545 - RNA, 18 nt, Human
ggggagcaggauaacucc

SEQ ID NO: 56546 - RNA, 24 nt, Human
gggggcagcaggagggaggcgaag

SEQ ID NO: 56547 - RNA, 20 nt, Human
ggguggggguugggugguuu

SEQ ID NO: 56548 - RNA, 20 nt, Human
gguccaggccugcuuggucu

SEQ ID NO: 56549 - RNA, 23 nt, Human
gguggguugcaggguugccggaa

SEQ ID NO: 56550 - RNA, 19 nt, Human
gucccaggcucagcuccca

SEQ ID NO: 56551 - RNA, 20 nt, Human
gucuccuaggagaauggaga

SEQ ID NO: 56552 - RNA, 25 nt, Human
uagaggcaggguggggguugggugg

SEQ ID NO: 56553 - RNA, 25 nt, Human
uagccuccuuggguggguugcaggg

SEQ ID NO: 56554 - RNA, 20 nt, Human
ucccagggcgcccugggcuc

SEQ ID NO: 56555 - RNA, 23 nt, Human
ucccagggcgcccugggcuccug

SEQ ID NO: 56556 - RNA, 21 nt, Human
uccccgauccaguagccuccu

SEQ ID NO: 56557 - RNA, 19 nt, Human
uccuaggagaauggagacc

SEQ ID NO: 56558 - RNA, 20 nt, Human
uccuggaagucccaggcuca

SEQ ID NO: 56559 - RNA, 21 nt, Human
uccuugggucuaccaggugcc

SEQ ID NO: 56560 - RNA, 23 nt, Human
uccuugggucuaccaggugcugc

SEQ ID NO: 56561 - RNA, 18 nt, Human
uccuuggguggguugcag

SEQ ID NO: 56562 - RNA, 18 nt, Human
ucugaguggcugugacuu

SEQ ID NO: 56563 - RNA, 22 nt, Human
ucugcagucucugggguuggga

SEQ ID NO: 56564 - RNA, 18 nt, Human
ugaggggagguccuggaa

SEQ ID NO: 56565 - RNA, 21 nt, Human
ugcccagcauccagauguccc

SEQ ID NO: 56566 - RNA, 20 nt, Human
ugcggagggaagaagggccc

SEQ ID NO: 56567 - RNA, 18 nt, Human
ugcuuugucuccuaggag

SEQ ID NO: 56568 - RNA, 20 nt, Human
ugcuuugucuccuaggagaa

SEQ ID NO: 56569 - RNA, 18 nt, Human
uggaaugauccuaguggg

SEQ ID NO: 56570 - RNA, 19 nt, Human
uggaaugggcacugggggg

SEQ ID NO: 56571 - RNA, 19 nt, Human
uggagaccuugaggaggca

SEQ ID NO: 56572 - RNA, 21 nt, Human
ugggcucuggguugcugcccu

SEQ ID NO: 56573 - RNA, 22 nt, Human
ugggggacgucucuggguccag

SEQ ID NO: 56574 - RNA, 22 nt, Human
uggggugcaggcagccgcaugg

SEQ ID NO: 56575 - RNA, 20 nt, Human
uggugaccuggaaugggcac

SEQ ID NO: 56576 - RNA, 18 nt, Human
ugguuuuggucccuuuau

SEQ ID NO: 56577 - RNA, 20 nt, Human
uuggucccuuuauugucugg

SEQ ID NO: 56578 - RNA, 19 nt, Human
accaaaaagagaaaaaaaa

SEQ ID NO: 56579 - RNA, 19 nt, Human
agagaggagcuggcgugug

SEQ ID NO: 56580 - RNA, 26 nt, Human
agagcccaggagugugagcccugcca

SEQ ID NO: 56581 - RNA, 19 nt, Human
agcccugccagguggcucu

SEQ ID NO: 56582 - RNA, 19 nt, Human
agcgcaacgcggcccgggc

SEQ ID NO: 56583 - RNA, 23 nt, Human
aggcuuugagaaugucugcaguc

SEQ ID NO: 56584 - RNA, 19 nt, Human
agggagcaaaggcuggagg

SEQ ID NO: 56585 - RNA, 21 nt, Human
aggugggcggcagacuuuggu

SEQ ID NO: 56586 - RNA, 22 nt, Human
auccacaauguuccacggaggc

SEQ ID NO: 56587 - RNA, 20 nt, Human
caaagggcagcggggaggga

SEQ ID NO: 56588 - RNA, 24 nt, Human
caccaccaaaaagagaaaaaaaaa

SEQ ID NO: 56589 - RNA, 21 nt, Human
cagagcccaggagugugagcc

SEQ ID NO: 56590 - RNA, 20 nt, Human
cagcggggagggagcaaagg

SEQ ID NO: 56591 - RNA, 23 nt, Human
ccaccaccaaaaagagaaaaaaa

SEQ ID NO: 56592 - RNA, 20 nt, Human
ccagguggcucuucccggcc

SEQ ID NO: 56593 - RNA, 21 nt, Human
ccccaagaccugcuuuauccc

SEQ ID NO: 56594 - RNA, 23 nt, Human
ccccaagaccugcuuuaucccug

SEQ ID NO: 56595 - RNA, 20 nt, Human
ccccugaaggagggcucgcc

SEQ ID NO: 56596 - RNA, 26 nt, Human
ccccugaaggagggcucgccugggga

SEQ ID NO: 56597 - RNA, 23 nt, Human
ccccuugaggggggggcugccgu

SEQ ID NO: 56598 - RNA, 22 nt, Human
cccugccagguggcucuucccg

SEQ ID NO: 56599 - RNA, 21 nt, Human
cccuuuuaaccaccaccaaaa

SEQ ID NO: 56600 - RNA, 24 nt, Human
ccucggaaauauuuggaaaguuuu

SEQ ID NO: 56601 - RNA, 21 nt, Human
ccugcccaagagaaaucuacc

SEQ ID NO: 56602 - RNA, 24 nt, Human
ccuggguccccuuucuugcaguug

SEQ ID NO: 56603 - RNA, 18 nt, Human
cggccugggcacgcuggg

SEQ ID NO: 56604 - RNA, 23 nt, Human
cgggcuugugggugcccgggccc

SEQ ID NO: 56605 - RNA, 22 nt, Human
cguucgcuagaaaaauaagagg

SEQ ID NO: 56606 - RNA, 22 nt, Human
cugcccaagagaaaucuacccu

SEQ ID NO: 56607 - RNA, 20 nt, Human
gagcgcaacgcggcccgggc

SEQ ID NO: 56608 - RNA, 23 nt, Human
gaggagcuggcguguguguucag

SEQ ID NO: 56609 - RNA, 19 nt, Human
gaggggggggcugccgugu

SEQ ID NO: 56610 - RNA, 19 nt, Human
gagguaaggagaugggagu

SEQ ID NO: 56611 - RNA, 23 nt, Human
gagucgcuucagagaggagcugg

SEQ ID NO: 56612 - RNA, 22 nt, Human
gcagagcacuggcgaggguccg

SEQ ID NO: 56613 - RNA, 18 nt, Human
gcagcggggagggagcaa

SEQ ID NO: 56614 - RNA, 19 nt, Human
gcagucuguacucucugcc

SEQ ID NO: 56615 - RNA, 20 nt, Human
gcucgccuggggacagggac

SEQ ID NO: 56616 - RNA, 23 nt, Human
ggagcaaaggcuggaggccagaa

SEQ ID NO: 56617 - RNA, 23 nt, Human
ggagcuggcguguguguucagag

SEQ ID NO: 56618 - RNA, 22 nt, Human
ggaggcccccaccucccugccc

SEQ ID NO: 56619 - RNA, 22 nt, Human
ggcugccgugugggaaguuggc

SEQ ID NO: 56620 - RNA, 25 nt, Human
ggcuggaggccagaaguggguuugg

SEQ ID NO: 56621 - RNA, 27 nt, Human
gggcagcggggagggagcaaaggcugg

SEQ ID NO: 56622 - RNA, 22 nt, Human
gggcuugugggugcccgggccc

SEQ ID NO: 56623 - RNA, 21 nt, Human
gggugcccgggcccugggccc

SEQ ID NO: 56624 - RNA, 23 nt, Human
gguaaggagaugggagugggagg

SEQ ID NO: 56625 - RNA, 23 nt, Human
gguaaggagaugggagugggagg

SEQ ID NO: 56626 - RNA, 24 nt, Human
gguaaggagaugggagugggaggg

SEQ ID NO: 56627 - RNA, 24 nt, Human
ggucaggagaugagacugggaggg

SEQ ID NO: 56628 - RNA, 20 nt, Human
ggugcccgggcccugggccc

SEQ ID NO: 56629 - RNA, 24 nt, Human
gguuccagagguaaggagauggga

SEQ ID NO: 56630 - RNA, 22 nt, Human
guccaggcacaagcgcguggga

SEQ ID NO: 56631 - RNA, 22 nt, Human
gugggugggagggggugggcug

SEQ ID NO: 56632 - RNA, 19 nt, Human
guucgcuagaaaaauaaga

SEQ ID NO: 56633 - RNA, 20 nt, Human
uaaccaccaccaaaaagaga

SEQ ID NO: 56634 - RNA, 27 nt, Human
uaaccaccaccaaaaagagaaaaaaaa

SEQ ID NO: 56635 - RNA, 23 nt, Human
uagaaaaauaagaggcuuugaga

SEQ ID NO: 56636 - RNA, 18 nt, Human
uaggauggccacccaggc

SEQ ID NO: 56637 - RNA, 18 nt, Human
uagggccugggggguucc

SEQ ID NO: 56638 - RNA, 20 nt, Human
uccacggaggcuucagggcc

SEQ ID NO: 56639 - RNA, 19 nt, Human
ucccuuuuaaccaccacca

SEQ ID NO: 56640 - RNA, 18 nt, Human
ucugcagucuguacucuc

SEQ ID NO: 56641 - RNA, 23 nt, Human
ucugcagucuguacucucugccu

SEQ ID NO: 56642 - RNA, 25 nt, Human
ucuguacucucugccugcccaagag

SEQ ID NO: 56643 - RNA, 24 nt, Human
ugaggggggggcugccguguggga

SEQ ID NO: 56644 - RNA, 19 nt, Human
ugcaguugcagaggcugag

SEQ ID NO: 56645 - RNA, 22 nt, Human
uggcgaggguccguccaggcac

SEQ ID NO: 56646 - RNA, 20 nt, Human
ugggacccugguggucuugg

SEQ ID NO: 56647 - RNA, 23 nt, Human
ugggagggggugggcuggcagug

SEQ ID NO: 56648 - RNA, 22 nt, Human
ugggagggucagauccacaaug

SEQ ID NO: 56649 - RNA, 20 nt, Human
ugggagggucaggagaugag

SEQ ID NO: 56650 - RNA, 19 nt, Human
ugggugcccgggcccuggg

SEQ ID NO: 56651 - RNA, 19 nt, Human
ugggugggagggggugggc

SEQ ID NO: 56652 - RNA, 18 nt, Human
uuccagaggggagcgagg

SEQ ID NO: 56653 - RNA, 19 nt, Human
uugagaaugucugcagucu

SEQ ID NO: 56654 - RNA, 24 nt, Human
uuggaaaguuuuauuuaaauguuu

SEQ ID NO: 56655 - RNA, 18 nt, Human
aaagugcugggauuacaa

SEQ ID NO: 56656 - RNA, 18 nt, Human
aagggguuucaccguguu

SEQ ID NO: 56657 - RNA, 20 nt, Human
aagggguuucaccguguuag

SEQ ID NO: 56658 - RNA, 21 nt, Human
aagugcugggauuacaaacac

SEQ ID NO: 56659 - RNA, 22 nt, Human
aagugcugggauuacaaacacu

SEQ ID NO: 56660 - RNA, 23 nt, Human
acgacaggagguggggagcagga

SEQ ID NO: 56661 - RNA, 18 nt, Human
acugcaaucuccgccgcc

SEQ ID NO: 56662 - RNA, 18 nt, Human
agccgaaggcugugucaa

SEQ ID NO: 56663 - RNA, 24 nt, Human
agcgauuauccugcuucagccucc

SEQ ID NO: 56664 - RNA, 18 nt, Human
aggcagagggcccccugg

SEQ ID NO: 56665 - RNA, 23 nt, Human
aggcagagggcccccuggggggg

SEQ ID NO: 56666 - RNA, 18 nt, Human
aggcagccacagggcaca

SEQ ID NO: 56667 - RNA, 20 nt, Human
aggcagccacagggcacaac

SEQ ID NO: 56668 - RNA, 23 nt, Human
aggcaggacgacaggaggugggg

SEQ ID NO: 56669 - RNA, 19 nt, Human
agggcagcaggacaguggc

SEQ ID NO: 56670 - RNA, 24 nt, Human
agggguuucaccguguuagccagg

SEQ ID NO: 56671 - RNA, 21 nt, Human
aggugguggcuggauggccug

SEQ ID NO: 56672 - RNA, 23 nt, Human
agugcaguggcaugaccucggcu

SEQ ID NO: 56673 - RNA, 24 nt, Human
agugcaguggcaugaccucggcuc

SEQ ID NO: 56674 - RNA, 21 nt, Human
auggggaagcaggagccccag

SEQ ID NO: 56675 - RNA, 21 nt, Human
caaaaucccccuggugauccc

SEQ ID NO: 56676 - RNA, 22 nt, Human
caaagugcugggauuacaaaca

SEQ ID NO: 56677 - RNA, 23 nt, Human
caaagugcugggauuacaaacac

SEQ ID NO: 56678 - RNA, 20 nt, Human
caaggggcagguuugguguc

SEQ ID NO: 56679 - RNA, 24 nt, Human
caagucccacaggugauucaagga

SEQ ID NO: 56680 - RNA, 18 nt, Human
caccguguuagccaggau

SEQ ID NO: 56681 - RNA, 24 nt, Human
caccguguuagccaggauggucuc

SEQ ID NO: 56682 - RNA, 24 nt, Human
caccucggccucccaaagugcugg

SEQ ID NO: 56683 - RNA, 20 nt, Human
cagcaggacaguggcgaggc

SEQ ID NO: 56684 - RNA, 20 nt, Human
cagccuccuggguagcuggg

SEQ ID NO: 56685 - RNA, 20 nt, Human
caggacaguggcgaggcagg

SEQ ID NO: 56686 - RNA, 22 nt, Human
caggauggucuccaucuccuga

SEQ ID NO: 56687 - RNA, 21 nt, Human
caguggcaugaccucggcuca

SEQ ID NO: 56688 - RNA, 19 nt, Human
ccaaagugcugggauuaca

SEQ ID NO: 56689 - RNA, 18 nt, Human
ccacugggcuguaggugg

SEQ ID NO: 56690 - RNA, 20 nt, Human
cccaggcugcagugcagugg

SEQ ID NO: 56691 - RNA, 22 nt, Human
ccccaccccaggagccuccuug

SEQ ID NO: 56692 - RNA, 22 nt, Human
cccccuggggggguacaggggu

SEQ ID NO: 56693 - RNA, 23 nt, Human
cccccuggggggguacaggggug

SEQ ID NO: 56694 - RNA, 21 nt, Human
ccccuggggggguacaggggu

SEQ ID NO: 56695 - RNA, 23 nt, Human
ccccuggggggguacaggggugu

SEQ ID NO: 56696 - RNA, 20 nt, Human
cccggguucaagcgauuauc

SEQ ID NO: 56697 - RNA, 23 nt, Human
cccggguucaagcgauuauccuc

SEQ ID NO: 56698 - RNA, 23 nt, Human
cccggguucaagcgauuauccug

SEQ ID NO: 56699 - RNA, 19 nt, Human
cccuggggggguacagggg

SEQ ID NO: 56700 - RNA, 23 nt, Human
ccgccgcccggguucaagcgauu

SEQ ID NO: 56701 - RNA, 24 nt, Human
ccuccuggguagcugggacuacag

SEQ ID NO: 56702 - RNA, 19 nt, Human
ccuccuuggccagcagggu

SEQ ID NO: 56703 - RNA, 24 nt, Human
ccugcacccagggcuucccaggag

SEQ ID NO: 56704 - RNA, 24 nt, Human
ccugcuucagccuccuggguagcu

SEQ ID NO: 56705 - RNA, 20 nt, Human
ccugggguugggguagggag

SEQ ID NO: 56706 - RNA, 23 nt, Human
ccuggguagcugggacuacaggc

SEQ ID NO: 56707 - RNA, 23 nt, Human
ccuggguagcugggacuacaggc

SEQ ID NO: 56708 - RNA, 23 nt, Human
cgacaggagguggggagcaggag

SEQ ID NO: 56709 - RNA, 23 nt, Human
cgcccggguucaagcgauuaucc

SEQ ID NO: 56710 - RNA, 19 nt, Human
cggggaugacgacucgggc

SEQ ID NO: 56711 - RNA, 22 nt, Human
cuccugaccucgugauccgccc

SEQ ID NO: 56712 - RNA, 20 nt, Human
cucugucgcccaggcugcag

SEQ ID NO: 56713 - RNA, 22 nt, Human
cugagcccccuccuuuccuggg

SEQ ID NO: 56714 - RNA, 22 nt, Human
cuuccuuuuauuauugcuuugu

SEQ ID NO: 56715 - RNA, 22 nt, Human
gaccucgugauccgcccaccuc

SEQ ID NO: 56716 - RNA, 22 nt, Human
gaccucgugauccgcccaccuc

SEQ ID NO: 56717 - RNA, 24 nt, Human
gaccucgugauccgcccaccucgg

SEQ ID NO: 56718 - RNA, 18 nt, Human
gacuacaggcgcauagau

SEQ ID NO: 56719 - RNA, 21 nt, Human
gagcagccaaggggcagguuu

SEQ ID NO: 56720 - RNA, 23 nt, Human
gaggcccuggggaggcaggggag

SEQ ID NO: 56721 - RNA, 20 nt, Human
gcacaaccugcagucccugg

SEQ ID NO: 56722 - RNA, 22 nt, Human
gcacccagggcuucccaggagc

SEQ ID NO: 56723 - RNA, 18 nt, Human
gcaggggagucuuccuuc

SEQ ID NO: 56724 - RNA, 19 nt, Human
gcaguggcaugaccucggc

SEQ ID NO: 56725 - RNA, 24 nt, Human
gcccaggcugcagugcaguggcau

SEQ ID NO: 56726 - RNA, 24 nt, Human
gcccggguucaagcgauuauccug

SEQ ID NO: 56727 - RNA, 25 nt, Human
gcccuggggaggcaggggagucuuc

SEQ ID NO: 56728 - RNA, 24 nt, Human
gcgauuauccugcuucagccuccu

SEQ ID NO: 56729 - RNA, 21 nt, Human
gcucugucgcccaggcugcag

SEQ ID NO: 56730 - RNA, 18 nt, Human
ggaagcaggagccccagg

SEQ ID NO: 56731 - RNA, 18 nt, Human
ggcagcaggacaguggcg

SEQ ID NO: 56732 - RNA, 21 nt, Human
ggcgcggggucugggugcuuc

SEQ ID NO: 56733 - RNA, 20 nt, Human
ggcuguaggugguggcugga

SEQ ID NO: 56734 - RNA, 18 nt, Human
gggagggaccuuuggcuc

SEQ ID NO: 56735 - RNA, 18 nt, Human
ggggagcaggagaacucc

SEQ ID NO: 56736 - RNA, 18 nt, Human
gggguuucaccguguuag

SEQ ID NO: 56737 - RNA, 23 nt, Human
gggguuucaccguguuagccagg

SEQ ID NO: 56738 - RNA, 23 nt, Human
gggugcuucuuuuccccaggaag

SEQ ID NO: 56739 - RNA, 20 nt, Human
ggucuccaucuccugaccuc

SEQ ID NO: 56740 - RNA, 21 nt, Human
guauggaacgucugagaaguu

SEQ ID NO: 56741 - RNA, 24 nt, Human
gugauccgcccaccucggccuccc

SEQ ID NO: 56742 - RNA, 19 nt, Human
uaagggguuucaccguguu

SEQ ID NO: 56743 - RNA, 24 nt, Human
uacaggcgcauagauaagggguuu

SEQ ID NO: 56744 - RNA, 18 nt, Human
uagauaagggguuucacc

SEQ ID NO: 56745 - RNA, 20 nt, Human
uagauaagggguuucaccgu

SEQ ID NO: 56746 - RNA, 24 nt, Human
uagccaggauggucuccaucuccu

SEQ ID NO: 56747 - RNA, 26 nt, Human
uaguggggggcagccgaaggcugugu

SEQ ID NO: 56748 - RNA, 24 nt, Human
ucaccguguuagccaggauggucu

SEQ ID NO: 56749 - RNA, 18 nt, Human
ucacugcaaucuccgccg

SEQ ID NO: 56750 - RNA, 23 nt, Human
ucacugcaaucuccgccgcccgg

SEQ ID NO: 56751 - RNA, 24 nt, Human
ucacugcaaucuccgccgcccggg

SEQ ID NO: 56752 - RNA, 23 nt, Human
ucagccuccuggguagcugggac

SEQ ID NO: 56753 - RNA, 18 nt, Human
ucaguugggugcugaaau

SEQ ID NO: 56754 - RNA, 18 nt, Human
ucccaaagugcugggauu

SEQ ID NO: 56755 - RNA, 24 nt, Human
ucccaaagugcugggauuacaaac

SEQ ID NO: 56756 - RNA, 22 nt, Human
uccccaccccaggagccuccuu

SEQ ID NO: 56757 - RNA, 19 nt, Human
uccccaggaagggagccug

SEQ ID NO: 56758 - RNA, 21 nt, Human
uccccaggaagggagccugcc

SEQ ID NO: 56759 - RNA, 19 nt, Human
uccgggauggggaagcagg

SEQ ID NO: 56760 - RNA, 24 nt, Human
uccuggguagcugggacuacaggc

SEQ ID NO: 56761 - RNA, 18 nt, Human
uccuuggccagcagggug

SEQ ID NO: 56762 - RNA, 20 nt, Human
uccuuggccagcaggguggc

SEQ ID NO: 56763 - RNA, 24 nt, Human
ucgcccaggcugcagugcaguggc

SEQ ID NO: 56764 - RNA, 21 nt, Human
ucggaucucaguugggugcug

SEQ ID NO: 56765 - RNA, 18 nt, Human
ucggccucccaaagugcu

SEQ ID NO: 56766 - RNA, 19 nt, Human
ucuaugcccaguguccaga

SEQ ID NO: 56767 - RNA, 22 nt, Human
ucuccaggcguccugaagaucc

SEQ ID NO: 56768 - RNA, 20 nt, Human
ucucccaggagagcagaggc

SEQ ID NO: 56769 - RNA, 18 nt, Human
ucucgcucugucgcccag

SEQ ID NO: 56770 - RNA, 19 nt, Human
ucucgcucugucgcccagg

SEQ ID NO: 56771 - RNA, 22 nt, Human
ucucgcucugucgcccaggcug

SEQ ID NO: 56772 - RNA, 26 nt, Human
ucucgcucugucgcccaggcugcagu

SEQ ID NO: 56773 - RNA, 27 nt, Human
ucucgcucugucgcccaggcugcagug

SEQ ID NO: 56774 - RNA, 24 nt, Human
ucugucgcccaggcugcagugcag

SEQ ID NO: 56775 - RNA, 20 nt, Human
ugaggcagaaucucgcucug

SEQ ID NO: 56776 - RNA, 22 nt, Human
ugaggcagaaucucgcucuguc

SEQ ID NO: 56777 - RNA, 19 nt, Human
ugaggcagagggcccccug

SEQ ID NO: 56778 - RNA, 24 nt, Human
ugauccgcccaccucggccuccca

SEQ ID NO: 56779 - RNA, 24 nt, Human
ugcagugcaguggcaugaccucgg

SEQ ID NO: 56780 - RNA, 18 nt, Human
ugcugggauuacaaacac

SEQ ID NO: 56781 - RNA, 24 nt, Human
ugcuucagccuccuggguagcugg

SEQ ID NO: 56782 - RNA, 20 nt, Human
ugcuuugucucccaggagag

SEQ ID NO: 56783 - RNA, 18 nt, Human
ugggacuacaggcgcaua

SEQ ID NO: 56784 - RNA, 21 nt, Human
uggggaggcaggggagucuuc

SEQ ID NO: 56785 - RNA, 21 nt, Human
uggggggguacaggggugugg

SEQ ID NO: 56786 - RNA, 23 nt, Human
ugggguagggaguccgagagcag

SEQ ID NO: 56787 - RNA, 24 nt, Human
uggggugcaggcagccacagggca

SEQ ID NO: 56788 - RNA, 19 nt, Human
ugggugcugaaauuggcau

SEQ ID NO: 56789 - RNA, 24 nt, Human
uguccugcacccagggcuucccag

SEQ ID NO: 56790 - RNA, 23 nt, Human
uucaagcgauuauccugcuucag

SEQ ID NO: 56791 - RNA, 24 nt, Human
uucagccuccuggguagcugggac

SEQ ID NO: 56792 - RNA, 18 nt, Human
uuggugucaugggcucag

SEQ ID NO: 56793 - RNA, 19 nt, Human
uuucaccguguuagccagg

SEQ ID NO: 56794 - RNA, 23 nt, Human
aagaauggaggcccagggaggga

SEQ ID NO: 56795 - RNA, 26 nt, Human
accuuagggggcgucgaacaucugag

SEQ ID NO: 56796 - RNA, 21 nt, Human
agguggagguccggcaggacg

SEQ ID NO: 56797 - RNA, 20 nt, Human
augcccagcacccagauggc

SEQ ID NO: 56798 - RNA, 21 nt, Human
auggggaagcaggagccccag

SEQ ID NO: 56799 - RNA, 24 nt, Human
caagagcaagauaaagcaaagggc

SEQ ID NO: 56800 - RNA, 20 nt, Human
caaggcguccugaugcaccc

SEQ ID NO: 56801 - RNA, 22 nt, Human
cagagcuucccaggugcuccuc

SEQ ID NO: 56802 - RNA, 22 nt, Human
cagcagccuccuuggcugggag

SEQ ID NO: 56803 - RNA, 20 nt, Human
cagccuccuuggcugggagg

SEQ ID NO: 56804 - RNA, 25 nt, Human
cagcugccaggcacaaauccccagu

SEQ ID NO: 56805 - RNA, 23 nt, Human
caggcacaaauccccagucccug

SEQ ID NO: 56806 - RNA, 24 nt, Human
ccacagcagccuccuuggcuggga

SEQ ID NO: 56807 - RNA, 19 nt, Human
ccagaagaauggaggccca

SEQ ID NO: 56808 - RNA, 19 nt, Human
ccagaagaauggaggccca

SEQ ID NO: 56809 - RNA, 23 nt, Human
ccaugacugaagcuaaaaaaggc

SEQ ID NO: 56810 - RNA, 21 nt, Human
ccccaccacagcagccuccuu

SEQ ID NO: 56811 - RNA, 22 nt, Human
ccccaccacagcagccuccuug

SEQ ID NO: 56812 - RNA, 19 nt, Human
ccccuaggaggggcacagg

SEQ ID NO: 56813 - RNA, 21 nt, Human
ccccuaggaggggcacagggg

SEQ ID NO: 56814 - RNA, 22 nt, Human
ccccuaggaggggcacaggggu

SEQ ID NO: 56815 - RNA, 20 nt, Human
cccuaggaggggcacagggg

SEQ ID NO: 56816 - RNA, 19 nt, Human
ccucaggugcugccaugac

SEQ ID NO: 56817 - RNA, 23 nt, Human
cgggaggggaagguuccauggca

SEQ ID NO: 56818 - RNA, 18 nt, Human
cuuccuugcugagaaauc

SEQ ID NO: 56819 - RNA, 22 nt, Human
cuuccuuuuauuauugcuuugu

SEQ ID NO: 56820 - RNA, 22 nt, Human
gcgcaggggguccuagguaugg

SEQ ID NO: 56821 - RNA, 18 nt, Human
ggaacucaggugggugcu

SEQ ID NO: 56822 - RNA, 18 nt, Human
ggaagcaggagccccagg

SEQ ID NO: 56823 - RNA, 21 nt, Human
ggauccccaccacagcagccu

SEQ ID NO: 56824 - RNA, 24 nt, Human
ggcgucgaacaucugaguggcugu

SEQ ID NO: 56825 - RNA, 22 nt, Human
gggcguggugucaagggcucgg

SEQ ID NO: 56826 - RNA, 24 nt, Human
gggggugacagcuccagguggagg

SEQ ID NO: 56827 - RNA, 21 nt, Human
ggugacagcuccagguggagg

SEQ ID NO: 56828 - RNA, 22 nt, Human
gguggguugcaggguggcagga

SEQ ID NO: 56829 - RNA, 19 nt, Human
gucuggaagcagucggaga

SEQ ID NO: 56830 - RNA, 21 nt, Human
guggagggacagcagaggacu

SEQ ID NO: 56831 - RNA, 27 nt, Human
uaaugagucuuccuugcugagaaaucc

SEQ ID NO: 56832 - RNA, 22 nt, Human
uagcccaguggagggacagcag

SEQ ID NO: 56833 - RNA, 24 nt, Human
uauccugcacccagagcuucccag

SEQ ID NO: 56834 - RNA, 19 nt, Human
uccaugcccagcacccaga

SEQ ID NO: 56835 - RNA, 19 nt, Human
uccccagucccuggaguug

SEQ ID NO: 56836 - RNA, 21 nt, Human
uccccggggagagagccugcc

SEQ ID NO: 56837 - RNA, 19 nt, Human
uccgggauggggaagcagg

SEQ ID NO: 56838 - RNA, 18 nt, Human
uccucggaacucaggugg

SEQ ID NO: 56839 - RNA, 23 nt, Human
ucgaacaucugaguggcugugac

SEQ ID NO: 56840 - RNA, 18 nt, Human
ucucugacucaugggccc

SEQ ID NO: 56841 - RNA, 21 nt, Human
ucucugacucaugggccccua

SEQ ID NO: 56842 - RNA, 18 nt, Human
ucugaguggcugugacuu

SEQ ID NO: 56843 - RNA, 19 nt, Human
ugaaaugcaggcagcugcc

SEQ ID NO: 56844 - RNA, 21 nt, Human
ugacugaagcuaaaaaaggcg

SEQ ID NO: 56845 - RNA, 19 nt, Human
ugcuggaauggaccuuagg

SEQ ID NO: 56846 - RNA, 24 nt, Human
uggagguggggagcaggggaacuc

SEQ ID NO: 56847 - RNA, 19 nt, Human
uggcaggaagccacgcuuc

SEQ ID NO: 56848 - RNA, 24 nt, Human
uggcugggaggguggguugcaggg

SEQ ID NO: 56849 - RNA, 22 nt, Human
aaaaguaauuaacaucuucuca

SEQ ID NO: 56850 - RNA, 20 nt, Human
aaaaguuccuuucuccccuc

SEQ ID NO: 56851 - RNA, 18 nt, Human
aaacacagccugcaugca

SEQ ID NO: 56852 - RNA, 22 nt, Human
aaacagcuuagaaaaaguuaaa

SEQ ID NO: 56853 - RNA, 25 nt, Human
aaaccaaaaacaaaauuccuauguu

SEQ ID NO: 56854 - RNA, 20 nt, Human
aaaguagagcaaaaaccaug

SEQ ID NO: 56855 - RNA, 19 nt, Human
aaaguuccuuucuccccuc

SEQ ID NO: 56856 - RNA, 21 nt, Human
aagaaaccaaaaacaaaauuc

SEQ ID NO: 56857 - RNA, 22 nt, Human
aaguagagcaaaaaccaugauc

SEQ ID NO: 56858 - RNA, 18 nt, Human
aaguuccuuucuccccuc

SEQ ID NO: 56859 - RNA, 18 nt, Human
aaguuccuuucuccccuc

SEQ ID NO: 56860 - RNA, 21 nt, Human
acacagccugcaugcaaaacu

SEQ ID NO: 56861 - RNA, 24 nt, Human
acagaaagucuaucaagaccugaa

SEQ ID NO: 56862 - RNA, 24 nt, Human
agaaagucuaucaagaccugaagc

SEQ ID NO: 56863 - RNA, 24 nt, Human
agaaccucucccaucaagaaacag

SEQ ID NO: 56864 - RNA, 21 nt, Human
agaccugaagcuccaccggca

SEQ ID NO: 56865 - RNA, 24 nt, Human
agagcaccuauguuauucaaaaca

SEQ ID NO: 56866 - RNA, 24 nt, Human
agcaccuauguuauucaaaacagc

SEQ ID NO: 56867 - RNA, 19 nt, Human
agccaacauuccaaaacag

SEQ ID NO: 56868 - RNA, 22 nt, Human
aggaagacuccagaugguguua

SEQ ID NO: 56869 - RNA, 24 nt, Human
aggccaagaacuggucuaaucuga

SEQ ID NO: 56870 - RNA, 22 nt, Human
aguccuuuuuucugggcucagg

SEQ ID NO: 56871 - RNA, 21 nt, Human
agugugaaguauagggaagaa

SEQ ID NO: 56872 - RNA, 24 nt, Human
agugugaaguauagggaagaacaa

SEQ ID NO: 56873 - RNA, 19 nt, Human
aucaacuucuuuaauauaa

SEQ ID NO: 56874 - RNA, 20 nt, Human
auccucuucuuuuuucaaau

SEQ ID NO: 56875 - RNA, 19 nt, Human
auccugaguucagugugaa

SEQ ID NO: 56876 - RNA, 24 nt, Human
auuucccaguuguuaguccugcuc

SEQ ID NO: 56877 - RNA, 25 nt, Human
caagaaacagcuuagaaaaaguuaa

SEQ ID NO: 56878 - RNA, 19 nt, Human
cacaauacuuuugagaugg

SEQ ID NO: 56879 - RNA, 18 nt, Human
cacaggccuuggaauaca

SEQ ID NO: 56880 - RNA, 20 nt, Human
caccggcagcaccgcgcucc

SEQ ID NO: 56881 - RNA, 18 nt, Human
cacuacaggaagacucca

SEQ ID NO: 56882 - RNA, 22 nt, Human
cacuccaucaccaaaucauucc

SEQ ID NO: 56883 - RNA, 23 nt, Human
cacuccaucaccaaaucauuccu

SEQ ID NO: 56884 - RNA, 19 nt, Human
cacucuguaugcucaccac

SEQ ID NO: 56885 - RNA, 20 nt, Human
caggaagacuccagauggug

SEQ ID NO: 56886 - RNA, 24 nt, Human
cagguggauucaggcaaaccagaa

SEQ ID NO: 56887 - RNA, 25 nt, Human
ccucaggcugccauucacaggccuu

SEQ ID NO: 56888 - RNA, 19 nt, Human
ccuuuuuucugggcucagg

SEQ ID NO: 56889 - RNA, 22 nt, Human
cgaaaacacagccugcaugcaa

SEQ ID NO: 56890 - RNA, 19 nt, Human
cuacuggaagcuuuucuua

SEQ ID NO: 56891 - RNA, 18 nt, Human
cucgaaaacacagccugc

SEQ ID NO: 56892 - RNA, 26 nt, Human
cugaagcuccaccggcagcaccgcgc

SEQ ID NO: 56893 - RNA, 23 nt, Human
cuuggaauacagcguuugcacau

SEQ ID NO: 56894 - RNA, 24 nt, Human
cuuggaauacagcguuugcacaug

SEQ ID NO: 56895 - RNA, 19 nt, Human
cuuguuuccuuuuucuucc

SEQ ID NO: 56896 - RNA, 18 nt, Human
gaacaacaccaggcuggg

SEQ ID NO: 56897 - RNA, 18 nt, Human
gcaaaacuuccucaggcu

SEQ ID NO: 56898 - RNA, 19 nt, Human
gcaaaacuuccucaggcug

SEQ ID NO: 56899 - RNA, 20 nt, Human
gcagaguguggccacuauag

SEQ ID NO: 56900 - RNA, 20 nt, Human
ggagaugagaugaggaagag

SEQ ID NO: 56901 - RNA, 25 nt, Human
ggcagcaccgcgcuccgcauccggc

SEQ ID NO: 56902 - RNA, 24 nt, Human
guagagcaaaaaccaugauccuuu

SEQ ID NO: 56903 - RNA, 19 nt, Human
gucagugggaacacuccau

SEQ ID NO: 56904 - RNA, 22 nt, Human
guuccuuucuccccucccuugg

SEQ ID NO: 56905 - RNA, 18 nt, Human
uagcaugauaaagaaacc

SEQ ID NO: 56906 - RNA, 23 nt, Human
uaggaagggauauccucuucuuu

SEQ ID NO: 56907 - RNA, 21 nt, Human
uaguuuugcacagaaccucuc

SEQ ID NO: 56908 - RNA, 20 nt, Human
uauaaaccaacaacuuacaa

SEQ ID NO: 56909 - RNA, 26 nt, Human
uccacauuuuggggacagaauguggu

SEQ ID NO: 56910 - RNA, 24 nt, Human
uccaccggcagcaccgcgcuccgc

SEQ ID NO: 56911 - RNA, 25 nt, Human
uccaccggcagcaccgcgcuccgca

SEQ ID NO: 56912 - RNA, 24 nt, Human
ucccauccugaguucagugugaag

SEQ ID NO: 56913 - RNA, 19 nt, Human
uccuuuuucuucccauccu

SEQ ID NO: 56914 - RNA, 19 nt, Human
ucuacuggaagcuuuucuu

SEQ ID NO: 56915 - RNA, 22 nt, Human
ucuaucaagaccugaagcucca

SEQ ID NO: 56916 - RNA, 25 nt, Human
ucuccccucccuuggcaaagagacc

SEQ ID NO: 56917 - RNA, 19 nt, Human
ucuguaguagauaauccag

SEQ ID NO: 56918 - RNA, 21 nt, Human
ucuguaguagauaauccaguu

SEQ ID NO: 56919 - RNA, 23 nt, Human
ucuguaguagauaauccaguuuu

SEQ ID NO: 56920 - RNA, 24 nt, Human
ucuguaugcucaccacgguguagg

SEQ ID NO: 56921 - RNA, 20 nt, Human
ugcacauggacaaaugaggu

SEQ ID NO: 56922 - RNA, 22 nt, Human
ugccacaauacuuuugagaugg

SEQ ID NO: 56923 - RNA, 19 nt, Human
ugcucaccacgguguagga

SEQ ID NO: 56924 - RNA, 19 nt, Human
uggaaaaagccaaagcuug

SEQ ID NO: 56925 - RNA, 21 nt, Human
uggaagggacucaggaaggca

SEQ ID NO: 56926 - RNA, 24 nt, Human
uggauucaggcaaaccagaaauuc

SEQ ID NO: 56927 - RNA, 22 nt, Human
ugguauuuuuggaacuuaucau

SEQ ID NO: 56928 - RNA, 24 nt, Human
uucaaaaauauccaucaacuucuu

SEQ ID NO: 56929 - RNA, 25 nt, Human
uucaaaaauauccaucaacuucuuu

SEQ ID NO: 56930 - RNA, 18 nt, Human
uucucagucacuuaacac

SEQ ID NO: 56931 - RNA, 23 nt, Human
uuuaaaaguuccuuucuccccuc

SEQ ID NO: 56932 - RNA, 20 nt, Human
uuugcacagaaccucuccca

SEQ ID NO: 56933 - RNA, 19 nt, Human
uuuuuugcuuauuucccag

SEQ ID NO: 56934 - RNA, 19 nt, Human
aauuucugcccccuuggag

SEQ ID NO: 56935 - RNA, 22 nt, Human
accaacauccaauaucauuucc

SEQ ID NO: 56936 - RNA, 23 nt, Human
acccuguaacguguucccugcug

SEQ ID NO: 56937 - RNA, 19 nt, Human
acugcauggcaugcuggga

SEQ ID NO: 56938 - RNA, 24 nt, Human
agagaugacaauggacuuggacaa

SEQ ID NO: 56939 - RNA, 24 nt, Human
agccagugugccucagucuaugcu

SEQ ID NO: 56940 - RNA, 22 nt, Human
agcgacugggaauggaaaaaga

SEQ ID NO: 56941 - RNA, 21 nt, Human
agugcaggcacauggcaggag

SEQ ID NO: 56942 - RNA, 22 nt, Human
caccuuguucuaagagaaaaga

SEQ ID NO: 56943 - RNA, 25 nt, Human
cagccccaccuuguucuaagagggg

SEQ ID NO: 56944 - RNA, 18 nt, Human
cccccuuggaggggaaga

SEQ ID NO: 56945 - RNA, 19 nt, Human
ccccuuggaggggaagaug

SEQ ID NO: 56946 - RNA, 18 nt, Human
ccucccauuuuccugggu

SEQ ID NO: 56947 - RNA, 21 nt, Human
ccucccauuuuccuggguucc

SEQ ID NO: 56948 - RNA, 24 nt, Human
ccuccgugguguccaggcgggggu

SEQ ID NO: 56949 - RNA, 23 nt, Human
ccuuggccuuuacacccuccuua

SEQ ID NO: 56950 - RNA, 21 nt, Human
cgacugggaauggaaaaagag

SEQ ID NO: 56951 - RNA, 18 nt, Human
cucgcagccuccagaacc

SEQ ID NO: 56952 - RNA, 22 nt, Human
cugacuccaccccaucauggga

SEQ ID NO: 56953 - RNA, 19 nt, Human
cuuggaggggaagaugacu

SEQ ID NO: 56954 - RNA, 21 nt, Human
gaguucaggugaggggacuca

SEQ ID NO: 56955 - RNA, 18 nt, Human
ggaagcagggcagugucu

SEQ ID NO: 56956 - RNA, 18 nt, Human
ggacuuggacaaagucug

SEQ ID NO: 56957 - RNA, 20 nt, Human
ggcuggagcugaggagccag

SEQ ID NO: 56958 - RNA, 19 nt, Human
ggcugggagcgacugggaa

SEQ ID NO: 56959 - RNA, 18 nt, Human
gggcagugucucccugcc

SEQ ID NO: 56960 - RNA, 21 nt, Human
gggcugacuccaccccaucau

SEQ ID NO: 56961 - RNA, 23 nt, Human
ggguggcuggagcugaggagcca

SEQ ID NO: 56962 - RNA, 19 nt, Human
gugcgcccccugcuggugg

SEQ ID NO: 56963 - RNA, 22 nt, Human
uaccaacauccaauaucauuuc

SEQ ID NO: 56964 - RNA, 18 nt, Human
uagcucugggcugguccc

SEQ ID NO: 56965 - RNA, 19 nt, Human
uccaccccaucaugggaga

SEQ ID NO: 56966 - RNA, 24 nt, Human
ucccugcugggggcugacagugcc

SEQ ID NO: 56967 - RNA, 18 nt, Human
uccgugguguccaggcgg

SEQ ID NO: 56968 - RNA, 24 nt, Human
ucuccuaggcagccccaccuuguu

SEQ ID NO: 56969 - RNA, 28 nt, Human
ucuggggcuuggaggcagaggugcuucc

SEQ ID NO: 56970 - RNA, 18 nt, Human
ucuguagaaaucuguuuu

SEQ ID NO: 56971 - RNA, 18 nt, Human
ugacugcauggcaugcug

SEQ ID NO: 56972 - RNA, 18 nt, Human
ugaggggacucaguuugu

SEQ ID NO: 56973 - RNA, 18 nt, Human
ugcgcccccugcuggugg

SEQ ID NO: 56974 - RNA, 22 nt, Human
ugcucucgcagccuccagaacc

SEQ ID NO: 56975 - RNA, 24 nt, Human
uggaaaaagaggugggcagcucau

SEQ ID NO: 56976 - RNA, 25 nt, Human
uggaagaagauuccaaauauguggu

SEQ ID NO: 56977 - RNA, 24 nt, Human
uggacaaagucuggaggaagcagg

SEQ ID NO: 56978 - RNA, 18 nt, Human
uggcaggagugagggugg

SEQ ID NO: 56979 - RNA, 24 nt, Human
uggcaggagugaggguggcuggag

SEQ ID NO: 56980 - RNA, 19 nt, Human
uggcaugcugggagugcag

SEQ ID NO: 56981 - RNA, 21 nt, Human
uggcuggagcugaggagccag

SEQ ID NO: 56982 - RNA, 19 nt, Human
ugggagugcaggcacaugg

SEQ ID NO: 56983 - RNA, 19 nt, Human
uggggcuuggaggcagagg

SEQ ID NO: 56984 - RNA, 18 nt, Human
ugguaggaagaguccugg

SEQ ID NO: 56985 - RNA, 24 nt, Human
ugguggggaggggaagcagggcug

SEQ ID NO: 56986 - RNA, 18 nt, Human
uuccuggguucccugaac

SEQ ID NO: 56987 - RNA, 18 nt, Human
uucgaagccccuucuccu

SEQ ID NO: 56988 - RNA, 25 nt, Human
uuuccuggguucccugaacgaugag

SEQ ID NO: 56989 - RNA, 18 nt, Human
uuugugguaggaagaguc

SEQ ID NO: 56990 - RNA, 19 nt, Human
aggaaagucgagugggagg

SEQ ID NO: 56991 - RNA, 20 nt, Human
aggccccuggcccaggccag

SEQ ID NO: 56992 - RNA, 18 nt, Human
agugccagggaggggccg

SEQ ID NO: 56993 - RNA, 20 nt, Human
cagcaguccacggggccuca

SEQ ID NO: 56994 - RNA, 20 nt, Human
caggccccuggcccaggcca

SEQ ID NO: 56995 - RNA, 19 nt, Human
caggccccuggcccagggg

SEQ ID NO: 56996 - RNA, 20 nt, Human
ccccucccucccagcagucc

SEQ ID NO: 56997 - RNA, 20 nt, Human
ccccucccucccagcagucc

SEQ ID NO: 56998 - RNA, 23 nt, Human
ccuggcuugcgcaggcggcgggc

SEQ ID NO: 56999 - RNA, 27 nt, Human
ccuguggccgggagcaggggucagggc

SEQ ID NO: 57000 - RNA, 21 nt, Human
cgcaggcggcgggcggggacg

SEQ ID NO: 57001 - RNA, 24 nt, Human
cugcugcccccucccucccagcag

SEQ ID NO: 57002 - RNA, 20 nt, Human
gaaaacaugggcguggccca

SEQ ID NO: 57003 - RNA, 22 nt, Human
gaaaacaugggcguggcccaug

SEQ ID NO: 57004 - RNA, 23 nt, Human
gcccccucccucccagcagucca

SEQ ID NO: 57005 - RNA, 23 nt, Human
gccccuggcccaggccagguucc

SEQ ID NO: 57006 - RNA, 19 nt, Human
gccucagugccagggaggg

SEQ ID NO: 57007 - RNA, 22 nt, Human
ggccgggagcaggggucagggc

SEQ ID NO: 57008 - RNA, 23 nt, Human
uccacggggccucagacuugggg

SEQ ID NO: 57009 - RNA, 22 nt, Human
ugagggucaggccccuggccca

SEQ ID NO: 57010 - RNA, 23 nt, Human
ugcccccucccucccagcagucc

SEQ ID NO: 57011 - RNA, 22 nt, Human
ugccuguggccgggagcagggg

SEQ ID NO: 57012 - RNA, 22 nt, Human
uggaaaacaugggcguggccca

SEQ ID NO: 57013 - RNA, 18 nt, Human
uuggcugggaguuugggg

SEQ ID NO: 57014 - RNA, 23 nt, Human
uuggggaggcgaggaggcugugg

SEQ ID NO: 57015 - RNA, 22 nt, Human
uuggggcggcugaaagugcuga

SEQ ID NO: 57016 - RNA, 28 nt, Human
uuggggcggcugaaagugcugaggguca

SEQ ID NO: 57017 - RNA, 23 nt, Human
aacugacugucccucuggacucu

SEQ ID NO: 57018 - RNA, 21 nt, Human
aacugagcagcccuuagcccc

SEQ ID NO: 57019 - RNA, 24 nt, Human
aaggaaagcugacagcccagagac

SEQ ID NO: 57020 - RNA, 18 nt, Human
aauuuguggcauuuccuc

SEQ ID NO: 57021 - RNA, 20 nt, Human
acuuuuaucaccauacaauu

SEQ ID NO: 57022 - RNA, 22 nt, Human
agacaaaaggccuggaugcaac

SEQ ID NO: 57023 - RNA, 25 nt, Human
agacaaaaggccuggaugcaaccaa

SEQ ID NO: 57024 - RNA, 22 nt, Human
agcccagagacccacggggaaa

SEQ ID NO: 57025 - RNA, 21 nt, Human
agcugacagcccagagaccca

SEQ ID NO: 57026 - RNA, 18 nt, Human
auaucaagcaaacuggaa

SEQ ID NO: 57027 - RNA, 19 nt, Human
auucacuugagccguggga

SEQ ID NO: 57028 - RNA, 20 nt, Human
caaauucacuugagccgugg

SEQ ID NO: 57029 - RNA, 23 nt, Human
cagccugaggagaaaucaaacac

SEQ ID NO: 57030 - RNA, 21 nt, Human
cauacaauuuguggcauuucc

SEQ ID NO: 57031 - RNA, 19 nt, Human
cauggagaaaggaaagcug

SEQ ID NO: 57032 - RNA, 26 nt, Human
cauuuucuacauuguagaaucaagag

SEQ ID NO: 57033 - RNA, 19 nt, Human
cccacggggaaacaggccc

SEQ ID NO: 57034 - RNA, 18 nt, Human
ccccagcccagcagccug

SEQ ID NO: 57035 - RNA, 19 nt, Human
cccuaaaacugacuguccc

SEQ ID NO: 57036 - RNA, 18 nt, Human
ccucuggacucuacguag

SEQ ID NO: 57037 - RNA, 19 nt, Human
ccugcaagaagcccuccca

SEQ ID NO: 57038 - RNA, 22 nt, Human
cugagcagcccuuagccccagc

SEQ ID NO: 57039 - RNA, 18 nt, Human
gaagcccucccaaucccc

SEQ ID NO: 57040 - RNA, 22 nt, Human
gaagcccucccaauccccggcg

SEQ ID NO: 57041 - RNA, 23 nt, Human
gaguuacuggauacaggcaaccc

SEQ ID NO: 57042 - RNA, 22 nt, Human
gcccuuagccccagcccagcag

SEQ ID NO: 57043 - RNA, 23 nt, Human
guaauacuguuccuccauguuuc

SEQ ID NO: 57044 - RNA, 22 nt, Human
guagaaucaagaguguaaauaa

SEQ ID NO: 57045 - RNA, 24 nt, Human
uaacuaccauaauuuaguauaagu

SEQ ID NO: 57046 - RNA, 20 nt, Human
uaucaagcaaacuggaaggc

SEQ ID NO: 57047 - RNA, 21 nt, Human
uaucaagcaaacuggaaggca

SEQ ID NO: 57048 - RNA, 25 nt, Human
ucaaaauauaagucaagaaucuuaa

SEQ ID NO: 57049 - RNA, 19 nt, Human
ucaguugaaggcauucuga

SEQ ID NO: 57050 - RNA, 21 nt, Human
ucaguugaaggcauucugauu

SEQ ID NO: 57051 - RNA, 22 nt, Human
uccaugcauacaauguuaugug

SEQ ID NO: 57052 - RNA, 21 nt, Human
ucuugauuagagugguaggac

SEQ ID NO: 57053 - RNA, 24 nt, Human
ugagcagcccuuagccccagccca

SEQ ID NO: 57054 - RNA, 19 nt, Human
ugaggagaaaucaaacaca

SEQ ID NO: 57055 - RNA, 23 nt, Human
ugaggagaaaucaaacacaugga

SEQ ID NO: 57056 - RNA, 24 nt, Human
ugaggagaaaucaaacacauggaa

SEQ ID NO: 57057 - RNA, 18 nt, Human
uguguguuggguauaaga

SEQ ID NO: 57058 - RNA, 22 nt, Human
uuagagggagaucaugaacacc

SEQ ID NO: 57059 - RNA, 24 nt, Human
uucaagaauauaucauuccuuuuu

SEQ ID NO: 57060 - RNA, 22 nt, Human
uucacgugacuuuuaucaccau

SEQ ID NO: 57061 - RNA, 22 nt, Human
uuuccaugcauacaauguuaug

SEQ ID NO: 57062 - RNA, 23 nt, Human
caacagaagggccaccgccuccc

SEQ ID NO: 57063 - RNA, 28 nt, Human
cacaggaccccgggacagagggcucuuc

SEQ ID NO: 57064 - RNA, 20 nt, Human
caggcucggucuagcaacag

SEQ ID NO: 57065 - RNA, 18 nt, Human
ccgggacagacacuggcc

SEQ ID NO: 57066 - RNA, 23 nt, Human
ccugcaacagggcagcugugaac

SEQ ID NO: 57067 - RNA, 23 nt, Human
cuaugggcuccucugccuuggua

SEQ ID NO: 57068 - RNA, 18 nt, Human
ugccacaggaccccggga

SEQ ID NO: 57069 - RNA, 18 nt, Human
ugccuugguauaucccac

SEQ ID NO: 57070 - RNA, 23 nt, Human
uggacccagguugcuuggcgcug

SEQ ID NO: 57071 - RNA, 22 nt, Human
uggcgcugccugccacaggacc

SEQ ID NO: 57072 - RNA, 28 nt, Human
uuuaguuuuuauuuggacccagguucua

SEQ ID NO: 57073 - RNA, 25 nt, Human
aaaacaaaaacaaaaccaaaccaga

SEQ ID NO: 57074 - RNA, 22 nt, Human
aaaacaaaacaaaaacaaaacc

SEQ ID NO: 57075 - RNA, 24 nt, Human
aaaaccaaaacaaaacaaaaacaa

SEQ ID NO: 57076 - RNA, 22 nt, Human
aaaaccaaaccagaccucaagu

SEQ ID NO: 57077 - RNA, 23 nt, Human
aaacaaaaacaaaaccaaaccag

SEQ ID NO: 57078 - RNA, 29 nt, Human
aaacaaaaacaaaaccaaaccagaccuca

SEQ ID NO: 57079 - RNA, 23 nt, Human
aaacaaaacaaaaacaaaaccaa

SEQ ID NO: 57080 - RNA, 20 nt, Human
aaacaaaacaaaaccaaaac

SEQ ID NO: 57081 - RNA, 22 nt, Human
aaacaaaacaaaaccaaaacaa

SEQ ID NO: 57082 - RNA, 20 nt, Human
aaacaaaaccaaaacaaaac

SEQ ID NO: 57083 - RNA, 23 nt, Human
aaacaaaaccaaaacaaaacaaa

SEQ ID NO: 57084 - RNA, 28 nt, Human
aaacaaaaccaaaacaaaacaaaaacaa

SEQ ID NO: 57085 - RNA, 18 nt, Human
aaacacagaagagagcau

SEQ ID NO: 57086 - RNA, 19 nt, Human
aaacaucacugcaucaauc

SEQ ID NO: 57087 - RNA, 24 nt, Human
aaaccaaaacaaaacaaaaacaaa

SEQ ID NO: 57088 - RNA, 25 nt, Human
aaaccaaaacaaaacaaaaacaaaa

SEQ ID NO: 57089 - RNA, 19 nt, Human
aaaggacuauaaaugcagg

SEQ ID NO: 57090 - RNA, 21 nt, Human
aacaaaacaaaaccaaaacaa

SEQ ID NO: 57091 - RNA, 21 nt, Human
aacaagguccaccuuaagcau

SEQ ID NO: 57092 - RNA, 24 nt, Human
aauucaaaaugauuacacuaucau

SEQ ID NO: 57093 - RNA, 22 nt, Human
acaaaacaaaaacaaaaccaaa

SEQ ID NO: 57094 - RNA, 23 nt, Human
acaaaacaaaaacaaaaccaaac

SEQ ID NO: 57095 - RNA, 23 nt, Human
acaaaaccaaaacaaaacaaaaa

SEQ ID NO: 57096 - RNA, 21 nt, Human
acagaagagagcauucaugca

SEQ ID NO: 57097 - RNA, 19 nt, Human
acauguguucucuuuuugc

SEQ ID NO: 57098 - RNA, 20 nt, Human
accaaaacaaaacaaaaaca

SEQ ID NO: 57099 - RNA, 24 nt, Human
accaaaacaaaacaaaaacaaaac

SEQ ID NO: 57100 - RNA, 25 nt, Human
accaaauugaguugcuuucacaagu

SEQ ID NO: 57101 - RNA, 18 nt, Human
acuaaaguucagguuccu

SEQ ID NO: 57102 - RNA, 21 nt, Human
acugauuuaaguccaacacca

SEQ ID NO: 57103 - RNA, 18 nt, Human
agaaaguggagguaacug

SEQ ID NO: 57104 - RNA, 24 nt, Human
agauaucuaacuccuugauauaau

SEQ ID NO: 57105 - RNA, 18 nt, Human
agucacgagauggaaaag

SEQ ID NO: 57106 - RNA, 21 nt, Human
aguggaaagggcugcuaaagg

SEQ ID NO: 57107 - RNA, 19 nt, Human
aucacagucacagaacuuu

SEQ ID NO: 57108 - RNA, 19 nt, Human
augaguaacuggaaucauu

SEQ ID NO: 57109 - RNA, 23 nt, Human
caaaaacaaaaccaaaccagacc

SEQ ID NO: 57110 - RNA, 26 nt, Human
caaaacaaaaacaaaaccaaaccaga

SEQ ID NO: 57111 - RNA, 24 nt, Human
caaaacaaaaacaaaaccaaaccc

SEQ ID NO: 57112 - RNA, 25 nt, Human
caaaacaaaaccaaaacaaaacaaa

SEQ ID NO: 57113 - RNA, 23 nt, Human
caaaacagagcuccucaaaauau

SEQ ID NO: 57114 - RNA, 23 nt, Human
caaaaccaaaacaaaacaaaaac

SEQ ID NO: 57115 - RNA, 23 nt, Human
caaaaccaaaccagaccucaagu

SEQ ID NO: 57116 - RNA, 21 nt, Human
caaaauauuaggugcugugcu

SEQ ID NO: 57117 - RNA, 19 nt, Human
caaaccagaccucaaguca

SEQ ID NO: 57118 - RNA, 21 nt, Human
caaccacagaaaaucaacuaa

SEQ ID NO: 57119 - RNA, 24 nt, Human
caaccacuugauuucaaaccaagu

SEQ ID NO: 57120 - RNA, 20 nt, Human
caagcugacuugauuuacug

SEQ ID NO: 57121 - RNA, 23 nt, Human
caaucucaaucuacaacucuggu

SEQ ID NO: 57122 - RNA, 19 nt, Human
cacagaacagccaguacac

SEQ ID NO: 57123 - RNA, 18 nt, Human
cacagaagagagcauuca

SEQ ID NO: 57124 - RNA, 20 nt, Human
cacaguggugguuauggaaa

SEQ ID NO: 57125 - RNA, 21 nt, Human
caccaaaacuuuuccuuccua

SEQ ID NO: 57126 - RNA, 22 nt, Human
cagccaguacacccaaucucaa

SEQ ID NO: 57127 - RNA, 26 nt, Human
cagucacagaacuuuaagucacgaga

SEQ ID NO: 57128 - RNA, 23 nt, Human
cauacaauucaaaaugauuacac

SEQ ID NO: 57129 - RNA, 18 nt, Human
caucaaguuaguaaaggg

SEQ ID NO: 57130 - RNA, 20 nt, Human
caucacagucacagaacuuu

SEQ ID NO: 57131 - RNA, 19 nt, Human
cauccaccaccuucuacau

SEQ ID NO: 57132 - RNA, 19 nt, Human
cauuagaagcucaauuuca

SEQ ID NO: 57133 - RNA, 25 nt, Human
ccaaaacaaaacaaaaacaaaacca

SEQ ID NO: 57134 - RNA, 23 nt, Human
ccaaaccagaccucaagucaaca

SEQ ID NO: 57135 - RNA, 21 nt, Human
ccaacaccuaaugaggacgaa

SEQ ID NO: 57136 - RNA, 19 nt, Human
cccacaguguuaacagggu

SEQ ID NO: 57137 - RNA, 21 nt, Human
cccagggaccaucuccccccu

SEQ ID NO: 57138 - RNA, 23 nt, Human
cccguuagagagaguagagcgag

SEQ ID NO: 57139 - RNA, 26 nt, Human
ccgccgcugccgccgccgcugcgauu

SEQ ID NO: 57140 - RNA, 18 nt, Human
cgcugccgccgccgcugc

SEQ ID NO: 57141 - RNA, 23 nt, Human
cgcugcgauuguuccagcugugu

SEQ ID NO: 57142 - RNA, 24 nt, Human
cggaacacucacaugcaucacagu

SEQ ID NO: 57143 - RNA, 24 nt, Human
cuagcgaacaaccaacaaccacag

SEQ ID NO: 57144 - RNA, 28 nt, Human
cuagcgaacaaccaacaaccacagaaaa

SEQ ID NO: 57145 - RNA, 19 nt, Human
cuucucccgccgcugccgc

SEQ ID NO: 57146 - RNA, 24 nt, Human
gaaaaacaucacugcaucaaucca

SEQ ID NO: 57147 - RNA, 23 nt, Human
gaacaaccaacaaccacagaaaa

SEQ ID NO: 57148 - RNA, 20 nt, Human
gaagaaaaacuuuaauugcu

SEQ ID NO: 57149 - RNA, 21 nt, Human
gacaccagggagagggaagaa

SEQ ID NO: 57150 - RNA, 22 nt, Human
gcacugcccccagcaucgacau

SEQ ID NO: 57151 - RNA, 21 nt, Human
ggaaacaaaacaaaaccaaaa

SEQ ID NO: 57152 - RNA, 21 nt, Human
uaagucacgagauggaaaaga

SEQ ID NO: 57153 - RNA, 20 nt, Human
uacaaggaacgaaaaacauc

SEQ ID NO: 57154 - RNA, 22 nt, Human
uacaauucaaaaugauuacacu

SEQ ID NO: 57155 - RNA, 25 nt, Human
uacguaaagguaccaacucuugaaa

SEQ ID NO: 57156 - RNA, 19 nt, Human
uagaaacaccaaaaaaagg

SEQ ID NO: 57157 - RNA, 19 nt, Human
uagaaacaccaaaaaaagg

SEQ ID NO: 57158 - RNA, 23 nt, Human
uagaaacaccaaaaaaagguuuu

SEQ ID NO: 57159 - RNA, 19 nt, Human
uagaaaguggagguaacug

SEQ ID NO: 57160 - RNA, 19 nt, Human
uagaaaguggagguaacug

SEQ ID NO: 57161 - RNA, 23 nt, Human
uagaaaguggagguaacuggaug

SEQ ID NO: 57162 - RNA, 19 nt, Human
uagcgaacaaccaacaacc

SEQ ID NO: 57163 - RNA, 19 nt, Human
uagucauuucccauugagu

SEQ ID NO: 57164 - RNA, 21 nt, Human
uauauaaacccacaguguuaa

SEQ ID NO: 57165 - RNA, 23 nt, Human
uauuuauaauguuauucucuuua

SEQ ID NO: 57166 - RNA, 20 nt, Human
uccaagcugacuugauuuac

SEQ ID NO: 57167 - RNA, 21 nt, Human
uccacagaacagccaguacac

SEQ ID NO: 57168 - RNA, 21 nt, Human
ucuacaacucuggucucccug

SEQ ID NO: 57169 - RNA, 22 nt, Human
ucuucucccgccgcugccgcua

SEQ ID NO: 57170 - RNA, 23 nt, Human
ugaauccagaagcaaaauuaugc

SEQ ID NO: 57171 - RNA, 18 nt, Human
ugagacuagcgaacaacc

SEQ ID NO: 57172 - RNA, 18 nt, Human
ugagcgaaaguugaacgu

SEQ ID NO: 57173 - RNA, 23 nt, Human
ugaggccaacaccuaaugaggac

SEQ ID NO: 57174 - RNA, 22 nt, Human
ugaguugcuuucacaaguguug

SEQ ID NO: 57175 - RNA, 18 nt, Human
uggaaagggcugcuaaag

SEQ ID NO: 57176 - RNA, 19 nt, Human
uggcaccaaaacuuuuccu

SEQ ID NO: 57177 - RNA, 21 nt, Human
uggcagagaauaccuaaacac

SEQ ID NO: 57178 - RNA, 19 nt, Human
ugggaaacaaaacaaaacc

SEQ ID NO: 57179 - RNA, 20 nt, Human
ugggacagucauucauuuca

SEQ ID NO: 57180 - RNA, 20 nt, Human
uguauguuuuccacagaaca

SEQ ID NO: 57181 - RNA, 24 nt, Human
uuaauucuauugggaaacaaaaca

SEQ ID NO: 57182 - RNA, 21 nt, Human
uucaaauaaaagucaaacagu

SEQ ID NO: 57183 - RNA, 22 nt, Human
uucacagcaagaguggcagaga

SEQ ID NO: 57184 - RNA, 24 nt, Human
uucuacauguguucucuuuuugcg

SEQ ID NO: 57185 - RNA, 20 nt, Human
uucucaguuccuuaaaaucc

SEQ ID NO: 57186 - RNA, 21 nt, Human
uucucccgccgcugccgccgc

SEQ ID NO: 57187 - RNA, 19 nt, Human
cugcuaaugguacuuuuuu

SEQ ID NO: 57188 - RNA, 20 nt, Human
ucacuccugaaagcaucuga

SEQ ID NO: 57189 - RNA, 19 nt, Human
ucauuccccucucaucuuc

SEQ ID NO: 57190 - RNA, 22 nt, Human
ugcaaguuucuguuugaaacuc

SEQ ID NO: 57191 - RNA, 20 nt, Human
uuaguuacagaauuugcuaa

SEQ ID NO: 57192 - RNA, 20 nt, Human
uaagugauuguaagcaaaaa

SEQ ID NO: 57193 - RNA, 23 nt, Human
ugauuuuuaaaacauuuuauugu

SEQ ID NO: 57194 - RNA, 23 nt, Human
ugguacauuuuuaguuacagaau

SEQ ID NO: 57195 - RNA, 20 nt, Human
uuaguuacagaauuugcuaa

SEQ ID NO: 57196 - RNA, 22 nt, Human
uugugugcuugugucaucccuc

SEQ ID NO: 57197 - RNA, 26 nt, Human
aaaaaaaaaaaaaguaauccaauggg

SEQ ID NO: 57198 - RNA, 26 nt, Human
aaaaaaaaaaaaaguaauccaauggg

SEQ ID NO: 57199 - RNA, 19 nt, Human
aaacaaauagcuaugcucu

SEQ ID NO: 57200 - RNA, 19 nt, Human
aaacaaauagcuaugcucu

SEQ ID NO: 57201 - RNA, 19 nt, Human
aaagcccuucaagguuuac

SEQ ID NO: 57202 - RNA, 19 nt, Human
aaagcccuucaagguuuac

SEQ ID NO: 57203 - RNA, 21 nt, Human
aaaggacuaccacaaaacaaa

SEQ ID NO: 57204 - RNA, 20 nt, Human
aaauagcuaugcucucagca

SEQ ID NO: 57205 - RNA, 25 nt, Human
aaaucacagaaauuuacuaacagca

SEQ ID NO: 57206 - RNA, 25 nt, Human
aaaucacagaaauuuacuaacagca

SEQ ID NO: 57207 - RNA, 26 nt, Human
aacaccagaagagaucauaccuacag

SEQ ID NO: 57208 - RNA, 26 nt, Human
aacaccagaagagaucauaccuacag

SEQ ID NO: 57209 - RNA, 18 nt, Human
aaccaaagcuugcugccu

SEQ ID NO: 57210 - RNA, 27 nt, Human
aacugagcgugucagcuggagguccug

SEQ ID NO: 57211 - RNA, 21 nt, Human
aagagauuugggaccugggcc

SEQ ID NO: 57212 - RNA, 21 nt, Human
aagagauuugggaccugggcc

SEQ ID NO: 57213 - RNA, 18 nt, Human
aagcugccugcugcaggc

SEQ ID NO: 57214 - RNA, 18 nt, Human
aagcugccugcugcaggc

SEQ ID NO: 57215 - RNA, 22 nt, Human
aagucagucccagauguagugg

SEQ ID NO: 57216 - RNA, 22 nt, Human
aagucagucccagauguagugg

SEQ ID NO: 57217 - RNA, 21 nt, Human
acaaaacaaagcuuucaaaga

SEQ ID NO: 57218 - RNA, 21 nt, Human
acaaaacaaagcuuucaaaga

SEQ ID NO: 57219 - RNA, 21 nt, Human
acacugugcgccucccccaca

SEQ ID NO: 57220 - RNA, 21 nt, Human
acacugugcgccucccccaca

SEQ ID NO: 57221 - RNA, 18 nt, Human
accucuggcccccaggcu

SEQ ID NO: 57222 - RNA, 21 nt, Human
acuaacagcauuucaagguaa

SEQ ID NO: 57223 - RNA, 21 nt, Human
acuaacagcauuucaagguaa

SEQ ID NO: 57224 - RNA, 23 nt, Human
acuuccuccugaucgucccccac

SEQ ID NO: 57225 - RNA, 23 nt, Human
acuuccuccugaucgucccccac

SEQ ID NO: 57226 - RNA, 24 nt, Human
agacgggacaaggaaaugcugaga

SEQ ID NO: 57227 - RNA, 24 nt, Human
agacgggacaaggaaaugcugaga

SEQ ID NO: 57228 - RNA, 20 nt, Human
agaggggaggggacccaugg

SEQ ID NO: 57229 - RNA, 22 nt, Human
aggcaggaguagaagcugccug

SEQ ID NO: 57230 - RNA, 22 nt, Human
aggcaggaguagaagcugccug

SEQ ID NO: 57231 - RNA, 21 nt, Human
aggcgaggacugagguccagu

SEQ ID NO: 57232 - RNA, 22 nt, Human
aggcuuuagcacugccuaauuu

SEQ ID NO: 57233 - RNA, 23 nt, Human
aguuugcuuuuuauuauuauuau

SEQ ID NO: 57234 - RNA, 23 nt, Human
aguuugcuuuuuauuauuauuau

SEQ ID NO: 57235 - RNA, 19 nt, Human
aucugaccgcuguguagga

SEQ ID NO: 57236 - RNA, 21 nt, Human
auggaaccuggggaaacaucu

SEQ ID NO: 57237 - RNA, 23 nt, Human
auggaaccuggggaaacaucucu

SEQ ID NO: 57238 - RNA, 23 nt, Human
caaaaggacuaccacaaaacaaa

SEQ ID NO: 57239 - RNA, 20 nt, Human
caaagaguaaaaaaaaaaaa

SEQ ID NO: 57240 - RNA, 30 nt, Human
caaagcuugcugccuaaccacuccccaggg

SEQ ID NO: 57241 - RNA, 30 nt, Human; identical to SEQ ID NO: 57240

SEQ ID NO: 57242 - RNA, 22 nt, Human
caaauagcuaugcucucagcaa

SEQ ID NO: 57243 - RNA, 21 nt, Human
caacaccagaagagaucauac

SEQ ID NO: 57244 - RNA, 22 nt, Human
cacaaaacaaagcuuucaaaga

SEQ ID NO: 57245 - RNA, 22 nt, Human
cacaaaacaaagcuuucaaaga

SEQ ID NO: 57246 - RNA, 21 nt, Human
cacacucaugagaugcaggag

SEQ ID NO: 57247 - RNA, 21 nt, Human
cacacucaugagaugcaggag

SEQ ID NO: 57248 - RNA, 20 nt, Human
cacccuauagcccuggacuu

SEQ ID NO: 57249 - RNA, 23 nt, Human
caccucacugggcuccacuucca

SEQ ID NO: 57250 - RNA, 19 nt, Human
caccucgccgaaguccagc

SEQ ID NO: 57251 - RNA, 21 nt, Human
caccugcauuugugggacgua

SEQ ID NO: 57252 - RNA, 21 nt, Human
caccugcauuugugggacgua

SEQ ID NO: 57253 - RNA, 24 nt, Human
caggaggcagcugaggaaggcaag

SEQ ID NO: 57254 - RNA, 24 nt, Human
caggaggcagcugaggaaggcaag

SEQ ID NO: 57255 - RNA, 24 nt, Human
cauaaaccaaagcuugcugccuaa

SEQ ID NO: 57256 - RNA, 24 nt, Human
cauaaaccaaagcuugcugccuaa

SEQ ID NO: 57257 - RNA, 22 nt, Human
caucuucagaacuuuuguucaa

SEQ ID NO: 57258 - RNA, 20 nt, Human
caucuugcaaggcccacaua

SEQ ID NO: 57259 - RNA, 20 nt, Human
caucuugcaaggcccacaua

SEQ ID NO: 57260 - RNA, 23 nt, Human
caucuuguucaaggaccaaaccc

SEQ ID NO: 57261 - RNA, 23 nt, Human
caucuuguucaaggaccaaaccc

SEQ ID NO: 57262 - RNA, 18 nt, Human
ccaagaugcccugcuggc

SEQ ID NO: 57263 - RNA, 21 nt, Human
ccaggauaaaagauacaaaag

SEQ ID NO: 57264 - RNA, 21 nt, Human
ccaggauaaaagauacaaaag

SEQ ID NO: 57265 - RNA, 24 nt, Human
ccaggcuucccugcgcugcggccg

SEQ ID NO: 57266 - RNA, 22 nt, Human
ccauggggcacacucaugagau

SEQ ID NO: 57267 - RNA, 22 nt, Human
ccauggggcacacucaugagau

SEQ ID NO: 57268 - RNA, 22 nt, Human
cccaccccaagcaguccaguca

SEQ ID NO: 57269 - RNA, 22 nt, Human
cccaccccaagcaguccaguca

SEQ ID NO: 57270 - RNA, 20 nt, Human
ccccaagcaguccagucaac

SEQ ID NO: 57271 - RNA, 20 nt, Human
ccccaagcaguccagucaac

SEQ ID NO: 57272 - RNA, 22 nt, Human
cccugcgcugcggccgggccuc

SEQ ID NO: 57273 - RNA, 26 nt, Human
ccuaaaaauuuaccuaucaccuuuuu

SEQ ID NO: 57274 - RNA, 26 nt, Human
ccuaaaaauuuaccuaucaccuuuuu

SEQ ID NO: 57275 - RNA, 19 nt, Human
ccucccccacacucuuccc

SEQ ID NO: 57276 - RNA, 19 nt, Human
ccucccccacacucuuccc

SEQ ID NO: 57277 - RNA, 20 nt, Human
ccucccccacacucuuccca

SEQ ID NO: 57278 - RNA, 20 nt, Human
ccucccccacacucuuccca

SEQ ID NO: 57279 - RNA, 23 nt, Human
ccucccccacacucuucccacug

SEQ ID NO: 57280 - RNA, 23 nt, Human
cgaaguccagcgucuccuccagg

SEQ ID NO: 57281 - RNA, 26 nt, Human
cgaagucuuccaccucacugggcucc

SEQ ID NO: 57282 - RNA, 24 nt, Human
cgaccucuggcccccaggcuuccc

SEQ ID NO: 57283 - RNA, 19 nt, Human
cgacgugggggcgggcuca

SEQ ID NO: 57284 - RNA, 19 nt, Human
cgacgugggggcgggcuca

SEQ ID NO: 57285 - RNA, 18 nt, Human
cgcuguguaggaaaaggu

SEQ ID NO: 57286 - RNA, 21 nt, Human
cggcagcggcgaccucuggcc

SEQ ID NO: 57287 - RNA, 18 nt, Human
cuaauuuacuucaccaau

SEQ ID NO: 57288 - RNA, 18 nt, Human
cuaauuuacuucaccaau

SEQ ID NO: 57289 - RNA, 23 nt, Human
cuacaugcuuccacaacaacgac

SEQ ID NO: 57290 - RNA, 23 nt, Human
cuacaugcuuccacaacaacgac

SEQ ID NO: 57291 - RNA, 20 nt, Human
cucacugggcuccacuucca

SEQ ID NO: 57292 - RNA, 18 nt, Human
cucaucagcagacuugga

SEQ ID NO: 57293 - RNA, 19 nt, Human
cugcaccagcaugcgcugu

SEQ ID NO: 57294 - RNA, 27 nt, Human
cugcaggcaggcgacugcucacuuccu

SEQ ID NO: 57295 - RNA, 27 nt, Human
cugcaggcaggcgacugcucacuuccu

SEQ ID NO: 57296 - RNA, 21 nt, Human
cugcugcaggcaggcgacugc

SEQ ID NO: 57297 - RNA, 21 nt, Human
cugcugcaggcaggcgacugc

SEQ ID NO: 57298 - RNA, 20 nt, Human
cuggagguccugcaguaccg

SEQ ID NO: 57299 - RNA, 19 nt, Human
cuggcccccaggcuucccu

SEQ ID NO: 57300 - RNA, 18 nt, Human
cuucccaaaaggacuacc

SEQ ID NO: 57301 - RNA, 18 nt, Human
cuucccaaaaggacuacc

SEQ ID NO: 57302 - RNA, 19 nt, Human
gaagagauuugggaccugg

SEQ ID NO: 57303 - RNA, 19 nt, Human
gaagagauuugggaccugg

SEQ ID NO: 57304 - RNA, 20 nt, Human
gaagucuuccaccucacugg

SEQ ID NO: 57305 - RNA, 19 nt, Human
gaccucuggcccccaggcu

SEQ ID NO: 57306 - RNA, 23 nt, Human
gaccucuggcccccaggcuuccc

SEQ ID NO: 57307 - RNA, 22 nt, Human
gaguuugcuuuuuauuauuauu

SEQ ID NO: 57308 - RNA, 22 nt, Human
gaguuugcuuuuuauuauuauu

SEQ ID NO: 57309 - RNA, 20 nt, Human
gaugguauggaaccugggga

SEQ ID NO: 57310 - RNA, 18 nt, Human
gcagaauugggacaggcc

SEQ ID NO: 57311 - RNA, 18 nt, Human
gcagaauugggacaggcc

SEQ ID NO: 57312 - RNA, 19 nt, Human
gccaagaauguugguggug

SEQ ID NO: 57313 - RNA, 22 nt, Human
gcggcagcggcgaccucuggcc

SEQ ID NO: 57314 - RNA, 24 nt, Human
gcucacacugugcgccucccccac

SEQ ID NO: 57315 - RNA, 24 nt, Human
gcucacacugugcgccucccccac

SEQ ID NO: 57316 - RNA, 23 nt, Human
gcucucugaggccgcaucaucuu

SEQ ID NO: 57317 - RNA, 19 nt, Human
gcugcaggcaggcgacugc

SEQ ID NO: 57318 - RNA, 19 nt, Human
gcugcaggcaggcgacugc

SEQ ID NO: 57319 - RNA, 23 nt, Human
ggagguccugcaguaccagaugg

SEQ ID NO: 57320 - RNA, 19 nt, Human
guccaguggcacacgcucg

SEQ ID NO: 57321 - RNA, 25 nt, Human
uaaagcccuucaagguuuacucucc

SEQ ID NO: 57322 - RNA, 25 nt, Human
uaaagcccuucaagguuuacucucc

SEQ ID NO: 57323 - RNA, 21 nt, Human
uaaauuuaucagcuguccaaa

SEQ ID NO: 57324 - RNA, 21 nt, Human
uaaauuuaucagcuguccaaa

SEQ ID NO: 57325 - RNA, 19 nt, Human
uagcccuggacuuuccccu

SEQ ID NO: 57326 - RNA, 19 nt, Human
uagcccuggacuuuccccu

SEQ ID NO: 57327 - RNA, 24 nt, Human
uaggaaaagguacuugaauccguc

SEQ ID NO: 57328 - RNA, 24 nt, Human
uaugcaugaggcaggaguagaagc

SEQ ID NO: 57329 - RNA, 27 nt, Human
ucaaagaguaaaaaaaaaaaaaaaaaa

SEQ ID NO: 57330 - RNA, 27 nt, Human
ucaaagaguaaaaaaaaaaaaaaaaaa

SEQ ID NO: 57331 - RNA, 22 nt, Human
ucaacaccagaagagaucauac

SEQ ID NO: 57332 - RNA, 21 nt, Human
ucaaggaccaaacccacaggc

SEQ ID NO: 57333 - RNA, 26 nt, Human
ucagcaaaacaaauuaaaaaaaaaaa

SEQ ID NO: 57334 - RNA, 20 nt, Human
uccaagaugcccugcuggcu

SEQ ID NO: 57335 - RNA, 25 nt, Human
ucccugcgcugcggccgggccucug

SEQ ID NO: 57336 - RNA, 20 nt, Human
ucucucaucagcagacuugg

SEQ ID NO: 57337 - RNA, 19 nt, Human
ucugaagccuccguuccgc

SEQ ID NO: 57338 - RNA, 22 nt, Human
ugacuucaugguucaaauccuu

SEQ ID NO: 57339 - RNA, 22 nt, Human
ugacuucaugguucaaauccuu

SEQ ID NO: 57340 - RNA, 19 nt, Human
ugagaggggaggggaccca

SEQ ID NO: 57341 - RNA, 19 nt, Human
ugagaggggaggggaccca

SEQ ID NO: 57342 - RNA, 23 nt, Human
ugagaugcaggagcaccagaguu

SEQ ID NO: 57343 - RNA, 23 nt, Human
ugagaugcaggagcaccagaguu

SEQ ID NO: 57344 - RNA, 24 nt, Human
ugaggaaggcaagggagcgcuagg

SEQ ID NO: 57345 - RNA, 24 nt, Human
ugaggcaggaguagaagcugccug

SEQ ID NO: 57346 - RNA, 24 nt, Human
ugaggcaggaguagaagcugccug

SEQ ID NO: 57347 - RNA, 18 nt, Human
ugcaaggcccacaucuug

SEQ ID NO: 57348 - RNA, 18 nt, Human
ugcaaggcccacaucuug

SEQ ID NO: 57349 - RNA, 24 nt, Human
ugcggccgggccucugcggcggcc

SEQ ID NO: 57350 - RNA, 21 nt, Human
ugcugcaggcaggcgacugcu

SEQ ID NO: 57351 - RNA, 21 nt, Human
ugcugcaggcaggcgacugcu

SEQ ID NO: 57352 - RNA, 25 nt, Human
uggcucaggggugcaugagcccgug

SEQ ID NO: 57353 - RNA, 25 nt, Human
uggcucaggggugcaugagcccgug

SEQ ID NO: 57354 - RNA, 18 nt, Human
ugggaccugggcccucuc

SEQ ID NO: 57355 - RNA, 18 nt, Human
ugggaccugggcccucuc

SEQ ID NO: 57356 - RNA, 18 nt, Human
uguccaaacacuauaaga

SEQ ID NO: 57357 - RNA, 18 nt, Human
uguccaaacacuauaaga

SEQ ID NO: 57358 - RNA, 22 nt, Human
uucaaggaccaaacccacaggc

SEQ ID NO: 57359 - RNA, 19 nt, Human
uucuaaggggaagagaaau

SEQ ID NO: 57360 - RNA, 19 nt, Human
uucuaaggggaagagaaau

SEQ ID NO: 57361 - RNA, 25 nt, Human
uucuucccaaaaggacuaccacaaa

SEQ ID NO: 57362 - RNA, 25 nt, Human
uucuucccaaaaggacuaccacaaa

SEQ ID NO: 57363 - RNA, 25 nt, Human
uugaauccguccuucuaaaauauug

SEQ ID NO: 57364 - RNA, 21 nt, Human
uugcauugagcugggaguugc

SEQ ID NO: 57365 - RNA, 24 nt, Human
uuuacuaacagcauuucaagguaa

SEQ ID NO: 57366 - RNA, 24 nt, Human
uuuacuaacagcauuucaagguaa

SEQ ID NO: 57367 - RNA, 18 nt, Human
uuugccaauaauuguaga

SEQ ID NO: 57368 - RNA, 18 nt, Human
uuugccaauaauuguaga

SEQ ID NO: 57369 - RNA, 23 nt, Human
agagcccuuucugucccuggcag

SEQ ID NO: 57370 - RNA, 21 nt, Human
aggugggguguuugugcagga

SEQ ID NO: 57371 - RNA, 21 nt, Human
caggacagaccccuaucuccu

SEQ ID NO: 57372 - RNA, 21 nt, Human
cagugcccggcgcccccacuc

SEQ ID NO: 57373 - RNA, 24 nt, Human
cccagugauagagcugggguaccc

SEQ ID NO: 57374 - RNA, 19 nt, Human
ccccuaucuccucugccgc

SEQ ID NO: 57375 - RNA, 21 nt, Human
ccggcgcccccacuccaggca

SEQ ID NO: 57376 - RNA, 24 nt, Human
ccucggggcaggaguccgcgcggc

SEQ ID NO: 57377 - RNA, 26 nt, Human
cgcccccacuccaggcagaguggccu

SEQ ID NO: 57378 - RNA, 22 nt, Human
cggacccucggggcaggagucc

SEQ ID NO: 57379 - RNA, 18 nt, Human
cggcgcccccacuccagg

SEQ ID NO: 57380 - RNA, 21 nt, Human
cucaaagagcccuuucugucc

SEQ ID NO: 57381 - RNA, 19 nt, Human
gaccccuaucuccucugcc

SEQ ID NO: 57382 - RNA, 24 nt, Human
gagcuggggcgcguccggacccuc

SEQ ID NO: 57383 - RNA, 18 nt, Human
gggaaggggcgcgagcug

SEQ ID NO: 57384 - RNA, 20 nt, Human
ggugcugccaggggcugggc

SEQ ID NO: 57385 - RNA, 18 nt, Human
guccgaauaaauauggga

SEQ ID NO: 57386 - RNA, 21 nt, Human
guccggacccucggggcagga

SEQ ID NO: 57387 - RNA, 22 nt, Human
gugggugcugccaggggcuggg

SEQ ID NO: 57388 - RNA, 19 nt, Human
uaucuccucugccgcgacc

SEQ ID NO: 57389 - RNA, 23 nt, Human
uccaggcagaguggccuucucaa

SEQ ID NO: 57390 - RNA, 24 nt, Human
uccaggcagaguggccuucucaaa

SEQ ID NO: 57391 - RNA, 25 nt, Human
ugccgcgaccuugggggaccggcgc

SEQ ID NO: 57392 - RNA, 19 nt, Human
ugggaaggggcgcgagcug

SEQ ID NO: 57393 - RNA, 24 nt, Human
ugggguccgaauaaauaugggaag

SEQ ID NO: 57394 - RNA, 19 nt, Human
ugggugcugccaggggcug

SEQ ID NO: 57395 - RNA, 18 nt, Human
uugggggacagugcccgg

SEQ ID NO: 57396 - RNA, 22 nt, Human
ccagcacagcugccccuggcca

SEQ ID NO: 57397 - RNA, 20 nt, Human
cccuggccaaaucuuucuuc

SEQ ID NO: 57398 - RNA, 21 nt, Human
gaggauggcagcagcagaagg

SEQ ID NO: 57399 - RNA, 24 nt, Human
gcagcagaaggagaagagcauaag

SEQ ID NO: 57400 - RNA, 20 nt, Human
uggcagcagcagaaggagau

SEQ ID NO: 57401 - RNA, 21 nt, Human
uggccaaaucuuucuucagau

SEQ ID NO: 57402 - RNA, 22 nt, Human
uuuauguuggcauguacauuga

SEQ ID NO: 57403 - RNA, 21 nt, Human
acaguaaaagagauagcuaga

SEQ ID NO: 57404 - RNA, 18 nt, Human
acgcagcguuuccgaccc

SEQ ID NO: 57405 - RNA, 19 nt, Human
acgcggcugccccgcgcgc

SEQ ID NO: 57406 - RNA, 24 nt, Human
agcuagaccaagaagguguagggu

SEQ ID NO: 57407 - RNA, 24 nt, Human
agcuggcggcgggggcgagcacgc

SEQ ID NO: 57408 - RNA, 20 nt, Human
ccacgcagcguuuccgaccc

SEQ ID NO: 57409 - RNA, 19 nt, Human
cccggccccgucugccuag

SEQ ID NO: 57410 - RNA, 18 nt, Human
ccugggaagaggucugca

SEQ ID NO: 57411 - RNA, 19 nt, Human
cgcgcgcgcgccgcucccg

SEQ ID NO: 57412 - RNA, 22 nt, Human
gaccaagaagguguagggucuc

SEQ ID NO: 57413 - RNA, 22 nt, Human
gagcuggcggcgggggcgagca

SEQ ID NO: 57414 - RNA, 26 nt, Human
gagcuggcggcgggggcgagcacgcu

SEQ ID NO: 57415 - RNA, 20 nt, Human
gcgccagaggcuggcggggc

SEQ ID NO: 57416 - RNA, 22 nt, Human
ggaagaggucugcagagaggcc

SEQ ID NO: 57417 - RNA, 26 nt, Human
ucccggccccgucugccuagccacgc

SEQ ID NO: 57418 - RNA, 23 nt, Human
uccugggaagaggucugcagaga

SEQ ID NO: 57419 - RNA, 19 nt, Human
ugaggcgagcuggcggcgg

SEQ ID NO: 57420 - RNA, 21 nt, Human
ugcagagaggcccagugacug

SEQ ID NO: 57421 - RNA, 21 nt, Human
uggcggcgggggcgagcacgc

SEQ ID NO: 57422 - RNA, 27 nt, Human
aaacaccuuuacugaguaaggccaccc

SEQ ID NO: 57423 - RNA, 18 nt, Human
accccucccauguccccc

SEQ ID NO: 57424 - RNA, 22 nt, Human
acuggggccagaggggguggag

SEQ ID NO: 57425 - RNA, 23 nt, Human
agaccccucccaugucccccagu

SEQ ID NO: 57426 - RNA, 24 nt, Human
agaggggguggagagccccaaggu

SEQ ID NO: 57427 - RNA, 18 nt, Human
agcagcuugguaccagga

SEQ ID NO: 57428 - RNA, 22 nt, Human
agccaggcugacagcaggugca

SEQ ID NO: 57429 - RNA, 18 nt, Human
agcuagaccccucccaug

SEQ ID NO: 57430 - RNA, 21 nt, Human
agcuccucacccuccccucac

SEQ ID NO: 57431 - RNA, 21 nt, Human
aggaaggggagguuugggggc

SEQ ID NO: 57432 - RNA, 24 nt, Human
aggaaggggagguuugggggcugg

SEQ ID NO: 57433 - RNA, 20 nt, Human
aggcugggcuccuaguccuc

SEQ ID NO: 57434 - RNA, 25 nt, Human
agggggaaaggaaggggagguuugg

SEQ ID NO: 57435 - RNA, 18 nt, Human
aucugccuucgcacccag

SEQ ID NO: 57436 - RNA, 21 nt, Human
caacuucgcagaucccagccu

SEQ ID NO: 57437 - RNA, 23 nt, Human
caccaggcacggccuuuggcucc

SEQ ID NO: 57438 - RNA, 19 nt, Human
caccccuugccucucuccc

SEQ ID NO: 57439 - RNA, 24 nt, Human
cacggccuuuggcuccguccaccc

SEQ ID NO: 57440 - RNA, 21 nt, Human
cagcuccucacccuccccuca

SEQ ID NO: 57441 - RNA, 23 nt, Human
cagcuccucacccuccccucacc

SEQ ID NO: 57442 - RNA, 21 nt, Human
caggaaacaccuuuacugagu

SEQ ID NO: 57443 - RNA, 21 nt, Human
ccaccaggcacggccuuuggc

SEQ ID NO: 57444 - RNA, 27 nt, Human
ccagcaguggccagcuagaccccuccc

SEQ ID NO: 57445 - RNA, 19 nt, Human
ccagcgcugccuccagcag

SEQ ID NO: 57446 - RNA, 24 nt, Human
ccagcuagaccccucccauguccc

SEQ ID NO: 57447 - RNA, 19 nt, Human
cccagccucuggccgccca

SEQ ID NO: 57448 - RNA, 19 nt, Human
ccccucaccggaaggcggg

SEQ ID NO: 57449 - RNA, 19 nt, Human
ccccucccuccagcuccuc

SEQ ID NO: 57450 - RNA, 21 nt, Human
cccgccccucccuccagcucc

SEQ ID NO: 57451 - RNA, 24 nt, Human
cccgccccucccuccagcuccuca

SEQ ID NO: 57452 - RNA, 25 nt, Human
cccuccagcuccucacccuccccuc

SEQ ID NO: 57453 - RNA, 20 nt, Human
ccgccccucccuccagcucc

SEQ ID NO: 57454 - RNA, 21 nt, Human
ccucacccuccccucaccgga

SEQ ID NO: 57455 - RNA, 22 nt, Human
ccuugccucucucccgccccuc

SEQ ID NO: 57456 - RNA, 18 nt, Human
cggaaggcgggggaagcc

SEQ ID NO: 57457 - RNA, 21 nt, Human
cggaggagggggaaaggaagg

SEQ ID NO: 57458 - RNA, 18 nt, Human
cguccgccccaccaggca

SEQ ID NO: 57459 - RNA, 22 nt, Human
cucccgccccucccuccagcuc

SEQ ID NO: 57460 - RNA, 22 nt, Human
cucucucccgccccucccucca

SEQ ID NO: 57461 - RNA, 19 nt, Human
cugaguaaggccacccugu

SEQ ID NO: 57462 - RNA, 20 nt, Human
cuuggcccccggaggagggg

SEQ ID NO: 57463 - RNA, 21 nt, Human
gaaggggagguuugggggcug

SEQ ID NO: 57464 - RNA, 19 nt, Human
gcaaggcugggcuccuagu

SEQ ID NO: 57465 - RNA, 22 nt, Human
ggaaaggaaggggagguuuggg

SEQ ID NO: 57466 - RNA, 23 nt, Human
ggaaggggagguuugggggcugg

SEQ ID NO: 57467 - RNA, 19 nt, Human
ggagagccccaaggucgac

SEQ ID NO: 57468 - RNA, 21 nt, Human
ggccgguggcggcauagccag

SEQ ID NO: 57469 - RNA, 21 nt, Human
ggcgggggaagccccacuccu

SEQ ID NO: 57470 - RNA, 19 nt, Human
gggcggggccgguggcggc

SEQ ID NO: 57471 - RNA, 23 nt, Human
ggggaaaggaaggggagguuugg

SEQ ID NO: 57472 - RNA, 19 nt, Human
uaccaggagggaugcccac

SEQ ID NO: 57473 - RNA, 20 nt, Human
ucacccuccccucaccggaa

SEQ ID NO: 57474 - RNA, 19 nt, Human
uccagcuccucacccuccc

SEQ ID NO: 57475 - RNA, 23 nt, Human
ucccuccagcuccucacccuccc

SEQ ID NO: 57476 - RNA, 23 nt, Human
ucccuccagcuccucacccuccc

SEQ ID NO: 57477 - RNA, 19 nt, Human
ucgcacccagcagcuuggu

SEQ ID NO: 57478 - RNA, 19 nt, Human
ucucccgccccucccucca

SEQ ID NO: 57479 - RNA, 19 nt, Human
ugccuucgcacccagcagc

SEQ ID NO: 57480 - RNA, 23 nt, Human
uggggccagaggggguggagagc

SEQ ID NO: 57481 - RNA, 27 nt, Human
uuggcccccggaggagggggaaaggaa

SEQ ID NO: 57482 - RNA, 18 nt, Human
aguagaaaagaagagaga

SEQ ID NO: 57483 - RNA, 18 nt, Human
cugacugacacuauaaaa

SEQ ID NO: 57484 - RNA, 20 nt, Human
ggugacugacugacacuaua

SEQ ID NO: 57485 - RNA, 20 nt, Human
uccuugauucuaggauagca

SEQ ID NO: 57486 - RNA, 22 nt, Human
aaaagacaggauuuggaauaag

SEQ ID NO: 57487 - RNA, 24 nt, Human
aaaauccuggccccaacaguucag

SEQ ID NO: 57488 - RNA, 21 nt, Human
aaaccaagacucagaauagga

SEQ ID NO: 57489 - RNA, 26 nt, Human
aacacacacacacacacacacaacua

SEQ ID NO: 57490 - RNA, 19 nt, Human
aacaguucaggcacuggca

SEQ ID NO: 57491 - RNA, 21 nt, Human
aagaaaccaagacucagaaua

SEQ ID NO: 57492 - RNA, 23 nt, Human
aagugcucagcucccagaucccc

SEQ ID NO: 57493 - RNA, 22 nt, Human
aaguuaaaaugcaugucaaaug

SEQ ID NO: 57494 - RNA, 18 nt, Human
acacacacacaacuaaca

SEQ ID NO: 57495 - RNA, 24 nt, Human
acacacacacacacacacaacuaa

SEQ ID NO: 57496 - RNA, 22 nt, Human
acagugauuaaaaacacacaca

SEQ ID NO: 57497 - RNA, 19 nt, Human
acucacucccuucccuccc

SEQ ID NO: 57498 - RNA, 21 nt, Human
acucacucccuucccuccccc

SEQ ID NO: 57499 - RNA, 25 nt, Human
acucacucccuucccucccccaccc

SEQ ID NO: 57500 - RNA, 21 nt, Human
acuuauuagcugugugcccuu

SEQ ID NO: 57501 - RNA, 18 nt, Human
agacaagugcucagcucc

SEQ ID NO: 57502 - RNA, 18 nt, Human
agagcggagcggggcugc

SEQ ID NO: 57503 - RNA, 22 nt, Human
agcauauuagagccaaaaggaa

SEQ ID NO: 57504 - RNA, 24 nt, Human
agccccugagcaucacucacuccc

SEQ ID NO: 57505 - RNA, 21 nt, Human
aggcacuaguaacacagauaa

SEQ ID NO: 57506 - RNA, 19 nt, Human
agggacggccgcagggcug

SEQ ID NO: 57507 - RNA, 22 nt, Human
agucaccaucuuguuacucaga

SEQ ID NO: 57508 - RNA, 21 nt, Human
aguuaaauuucacuuaucugg

SEQ ID NO: 57509 - RNA, 20 nt, Human
auccccggccaggagggccc

SEQ ID NO: 57510 - RNA, 23 nt, Human
caagaaggaagucuuccaucuua

SEQ ID NO: 57511 - RNA, 20 nt, Human
cacacacacacacacacaca

SEQ ID NO: 57512 - RNA, 24 nt, Human
caccaucuuguuacucagaaauac

SEQ ID NO: 57513 - RNA, 18 nt, Human
cacucccuucccuccccc

SEQ ID NO: 57514 - RNA, 24 nt, Human
cacuuaucuggccuaacucuuaau

SEQ ID NO: 57515 - RNA, 19 nt, Human
cagaacacccugaaagcca

SEQ ID NO: 57516 - RNA, 21 nt, Human
cagauaaagaguacacugaua

SEQ ID NO: 57517 - RNA, 24 nt, Human
cagccccaguguaaaacugaugaa

SEQ ID NO: 57518 - RNA, 22 nt, Human
cagcccccgucggugcccuacc

SEQ ID NO: 57519 - RNA, 23 nt, Human
caguucaggcacuggcaguuuca

SEQ ID NO: 57520 - RNA, 19 nt, Human
ccccaacaguucaggcacu

SEQ ID NO: 57521 - RNA, 18 nt, Human
ccccaaggagaagucacc

SEQ ID NO: 57522 - RNA, 23 nt, Human
ccccggccaggagggccccgcgg

SEQ ID NO: 57523 - RNA, 19 nt, Human
ccccugagcaucacucacu

SEQ ID NO: 57524 - RNA, 19 nt, Human
ccccuuuaugaaauggagc

SEQ ID NO: 57525 - RNA, 18 nt, Human
cccgcagcaggcgcgggg

SEQ ID NO: 57526 - RNA, 23 nt, Human
cccgggccgcggcgccaacggga

SEQ ID NO: 57527 - RNA, 19 nt, Human
cccgguuacagugauuaaa

SEQ ID NO: 57528 - RNA, 18 nt, Human
cccucccccacccuaaag

SEQ ID NO: 57529 - RNA, 24 nt, Human
cccugagcaucacucacucccuuc

SEQ ID NO: 57530 - RNA, 20 nt, Human
ccggccaggccccgccccgc

SEQ ID NO: 57531 - RNA, 23 nt, Human
ccggccgaaagggacggccgcag

SEQ ID NO: 57532 - RNA, 24 nt, Human
ccuacaguuguagcauauuagagc

SEQ ID NO: 57533 - RNA, 18 nt, Human
cgcagcgcugcggauccc

SEQ ID NO: 57534 - RNA, 21 nt, Human
cgcccgggccgcggcgccaac

SEQ ID NO: 57535 - RNA, 22 nt, Human
cuaguaacacagauaaagagua

SEQ ID NO: 57536 - RNA, 19 nt, Human
cucacucccuucccucccc

SEQ ID NO: 57537 - RNA, 20 nt, Human
gaacaaguauagacaagugc

SEQ ID NO: 57538 - RNA, 21 nt, Human
gaauaguggggaaaagacagg

SEQ ID NO: 57539 - RNA, 18 nt, Human
gagcggagcagagagagc

SEQ ID NO: 57540 - RNA, 24 nt, Human
gcagcaggcgcgggggccgggcgu

SEQ ID NO: 57541 - RNA, 19 nt, Human
gcauccucuucacagagga

SEQ ID NO: 57542 - RNA, 19 nt, Human
gccccugagcaucacucac

SEQ ID NO: 57543 - RNA, 19 nt, Human
gcccuaccugggcgcggag

SEQ ID NO: 57544 - RNA, 21 nt, Human
gcggagcagagagagccgaga

SEQ ID NO: 57545 - RNA, 23 nt, Human
gcggggcugcuggcacugaggcc

SEQ ID NO: 57546 - RNA, 18 nt, Human
ggacgcgcugggcagagc

SEQ ID NO: 57547 - RNA, 21 nt, Human
ggcgccaacgggaaacuugag

SEQ ID NO: 57548 - RNA, 22 nt, Human
gggccgcggcgccaacgggaaa

SEQ ID NO: 57549 - RNA, 22 nt, Human
ggugaagaaaccaagacucaga

SEQ ID NO: 57550 - RNA, 21 nt, Human
guccuaguucggaaucuugac

SEQ ID NO: 57551 - RNA, 25 nt, Human
uaaaaacacacacacacacacacac

SEQ ID NO: 57552 - RNA, 26 nt, Human
uaaagugagcagugcaaccaaaauca

SEQ ID NO: 57553 - RNA, 27 nt, Human
uaaagugagcagugcaaccaaaaucac

SEQ ID NO: 57554 - RNA, 19 nt, Human
uaccaggcacuaguaacac

SEQ ID NO: 57555 - RNA, 24 nt, Human
uaggaguggcuguuuucaugagua

SEQ ID NO: 57556 - RNA, 19 nt, Human
uauagacaagugcucagcu

SEQ ID NO: 57557 - RNA, 24 nt, Human
uaugaaauggagcuuugaaauuga

SEQ ID NO: 57558 - RNA, 20 nt, Human
uauuagccacagcagacuug

SEQ ID NO: 57559 - RNA, 19 nt, Human
uauucaugaggagauucac

SEQ ID NO: 57560 - RNA, 24 nt, Human
ucaagaaggaagucuuccaucuua

SEQ ID NO: 57561 - RNA, 20 nt, Human
ucacagaggaaaguccuagu

SEQ ID NO: 57562 - RNA, 18 nt, Human
uccaucuuaacuccuuca

SEQ ID NO: 57563 - RNA, 18 nt, Human
uccugugcuuuuugaagu

SEQ ID NO: 57564 - RNA, 19 nt, Human
ucguucaaaugaaaauauu

SEQ ID NO: 57565 - RNA, 23 nt, Human
ucuuccaucuuaacuccuucaaa

SEQ ID NO: 57566 - RNA, 22 nt, Human
ugaaagccacucaucuagucca

SEQ ID NO: 57567 - RNA, 25 nt, Human
ugaaaugaacaacuaccaauuagcc

SEQ ID NO: 57568 - RNA, 25 nt, Human
ugaaauugaaccaaaaaguuaaaau

SEQ ID NO: 57569 - RNA, 19 nt, Human
ugaagaaaccaagacucag

SEQ ID NO: 57570 - RNA, 20 nt, Human
ugagcaucacucacucccuu

SEQ ID NO: 57571 - RNA, 21 nt, Human
ugaguacauuuggcuuccaac

SEQ ID NO: 57572 - RNA, 31 nt, Human
ugauuaaaaacacacacacacacacacacag

SEQ ID NO: 57573 - RNA, 19 nt, Human
ugggcagagcggagcgggg

SEQ ID NO: 57574 - RNA, 20 nt, Human
uuaaaaacacacacacacac

SEQ ID NO: 57575 - RNA, 21 nt, Human
uuaaagugagcagugcaaccc

SEQ ID NO: 57576 - RNA, 21 nt, Human
uuaggaacaaguauagacaag

SEQ ID NO: 57577 - RNA, 19 nt, Human
uucaagagaaauacuugga

SEQ ID NO: 57578 - RNA, 21 nt, Human
uucaagagaaauacuuggaaa

SEQ ID NO: 57579 - RNA, 23 nt, Human
uucacagaacacccugaaagcca

SEQ ID NO: 57580 - RNA, 19 nt, Human
uucaugaggagauucacag

SEQ ID NO: 57581 - RNA, 22 nt, Human
uuuaagaaauucacuaaaaaca

SEQ ID NO: 57582 - RNA, 18 nt, Human
aaagcacaaacaaaccug

SEQ ID NO: 57583 - RNA, 24 nt, Human
acaagagucuccacagcuuggaca

SEQ ID NO: 57584 - RNA, 20 nt, Human
acaauggaaaggaaagaagc

SEQ ID NO: 57585 - RNA, 19 nt, Human
acacauagauccaggaguc

SEQ ID NO: 57586 - RNA, 23 nt, Human
agaugaauaugccccaucuuucu

SEQ ID NO: 57587 - RNA, 20 nt, Human
agcuacaauggaaaggaaag

SEQ ID NO: 57588 - RNA, 19 nt, Human
agcugcccaucccaacuag

SEQ ID NO: 57589 - RNA, 19 nt, Human
aggcagaagagaagacugc

SEQ ID NO: 57590 - RNA, 26 nt, Human
agguuuaaaaaccccguaacugagcu

SEQ ID NO: 57591 - RNA, 28 nt, Human
aguugcauaaauagaaagagguggaaau

SEQ ID NO: 57592 - RNA, 25 nt, Human
auguagccuucugcauacacauaga

SEQ ID NO: 57593 - RNA, 19 nt, Human
cacgugcucacaccugggc

SEQ ID NO: 57594 - RNA, 20 nt, Human
cacgugcucacaccugggca

SEQ ID NO: 57595 - RNA, 21 nt, Human
cacucaauacgauacaccuga

SEQ ID NO: 57596 - RNA, 23 nt, Human
cauaguaaaccugaaagggagcg

SEQ ID NO: 57597 - RNA, 21 nt, Human
cauccugaaaacugcacagua

SEQ ID NO: 57598 - RNA, 22 nt, Human
ccaacuagccuaccuccagcca

SEQ ID NO: 57599 - RNA, 28 nt, Human
ccaucccaacuagccuaccuccagccac

SEQ ID NO: 57600 - RNA, 19 nt, Human
ccggggagcugcgaagagc

SEQ ID NO: 57601 - RNA, 19 nt, Human
ccugaaaacugcacaguac

SEQ ID NO: 57602 - RNA, 21 nt, Human
cuagccuaccuccagccacag

SEQ ID NO: 57603 - RNA, 20 nt, Human
cucauccugaaaacugcaca

SEQ ID NO: 57604 - RNA, 25 nt, Human
gaagcaacuauguauauguagccuu

SEQ ID NO: 57605 - RNA, 18 nt, Human
gacucuuuugccaauggg

SEQ ID NO: 57606 - RNA, 18 nt, Human
gagcgcgcagcggggcug

SEQ ID NO: 57607 - RNA, 21 nt, Human
gagcgcgcagcggggcuggcg

SEQ ID NO: 57608 - RNA, 20 nt, Human
gauacaucuucccaagguuu

SEQ ID NO: 57609 - RNA, 22 nt, Human
gaucaaguacaagagucuccac

SEQ ID NO: 57610 - RNA, 21 nt, Human
ggacaaagcacaaacaaaccu

SEQ ID NO: 57611 - RNA, 20 nt, Human
ggcggcggcgcggaggagcg

SEQ ID NO: 57612 - RNA, 22 nt, Human
gugaagaugaguugcauaaaua

SEQ ID NO: 57613 - RNA, 24 nt, Human
uaacugagcuccuucuugcaguac

SEQ ID NO: 57614 - RNA, 25 nt, Human
uaacugagcuccuucuugcaguacu

SEQ ID NO: 57615 - RNA, 22 nt, Human
uaauuguuacagaugauuugug

SEQ ID NO: 57616 - RNA, 18 nt, Human
uacaauggaaaggaaaga

SEQ ID NO: 57617 - RNA, 19 nt, Human
uacaauggaaaggaaagaa

SEQ ID NO: 57618 - RNA, 21 nt, Human
uacaauggaaaggaaagaagc

SEQ ID NO: 57619 - RNA, 24 nt, Human
uacaauggaaaggaaagaagcaac

SEQ ID NO: 57620 - RNA, 21 nt, Human
uacagcauacaccaucuauuu

SEQ ID NO: 57621 - RNA, 22 nt, Human
uagaggagcuguuuuuauagug

SEQ ID NO: 57622 - RNA, 25 nt, Human
uauguagccuucugcauacacauag

SEQ ID NO: 57623 - RNA, 24 nt, Human
uauguauauguagccuucugcaua

SEQ ID NO: 57624 - RNA, 22 nt, Human
uccauugauacaucuucccaag

SEQ ID NO: 57625 - RNA, 22 nt, Human
ucccaacuagccuaccuccagc

SEQ ID NO: 57626 - RNA, 25 nt, Human
ucccaacuagccuaccuccagccac

SEQ ID NO: 57627 - RNA, 21 nt, Human
ucucugagggugccucagugu

SEQ ID NO: 57628 - RNA, 24 nt, Human
ucugcauacacauagauccaggag

SEQ ID NO: 57629 - RNA, 19 nt, Human
ucuggagaaagcuacuuua

SEQ ID NO: 57630 - RNA, 21 nt, Human
ucuuuuggggguagaugaaua

SEQ ID NO: 57631 - RNA, 18 nt, Human
ugacucuuuugccaaugg

SEQ ID NO: 57632 - RNA, 21 nt, Human
ugagaacuuuugcagcaguuu

SEQ ID NO: 57633 - RNA, 24 nt, Human
ugagaggcaaagagcuacaaugga

SEQ ID NO: 57634 - RNA, 22 nt, Human
ugagugaggauuuuuuccuuaa

SEQ ID NO: 57635 - RNA, 21 nt, Human
ugccagacagaauaagagcaa

SEQ ID NO: 57636 - RNA, 27 nt, Human
ugccccaucuuucuacccaaucucaua

SEQ ID NO: 57637 - RNA, 21 nt, Human
uggaaugacacagcacugaaa

SEQ ID NO: 57638 - RNA, 22 nt, Human
uggcggcggcgcggaggagcgg

SEQ ID NO: 57639 - RNA, 19 nt, Human
ugucuggcaucagucugua

SEQ ID NO: 57640 - RNA, 18 nt, Human
uguguccauauauauaua

SEQ ID NO: 57641 - RNA, 18 nt, Human
uguuauugacaacauggg

SEQ ID NO: 57642 - RNA, 21 nt, Human
uuuuuuuuuuuuaggguaauc

SEQ ID NO: 57643 - RNA, 22 nt, Human
uuuuuuuuuuuuuuuuuuaggg

SEQ ID NO: 57644 - RNA, 18 nt, Human
aggaagcccacccugccc

SEQ ID NO: 57645 - RNA, 18 nt, Human
aggccucugcucggacag

SEQ ID NO: 57646 - RNA, 21 nt, Human
agguggggggaauagguggug

SEQ ID NO: 57647 - RNA, 24 nt, Human
agugggaucauggacugaaacaag

SEQ ID NO: 57648 - RNA, 21 nt, Human
caaagcuucucauuacccucc

SEQ ID NO: 57649 - RNA, 21 nt, Human
caccacacugccaggcacgcc

SEQ ID NO: 57650 - RNA, 23 nt, Human
cagcccuacugugagucagcaau

SEQ ID NO: 57651 - RNA, 20 nt, Human
cagcuucuugacuaaccccu

SEQ ID NO: 57652 - RNA, 21 nt, Human
cagugaguucugccucagcuu

SEQ ID NO: 57653 - RNA, 21 nt, Human
ccaggguaaggcaagucuggg

SEQ ID NO: 57654 - RNA, 25 nt, Human
ccaggguaaggcaagucugggagga

SEQ ID NO: 57655 - RNA, 21 nt, Human
ccuccagcaggcaagaguagg

SEQ ID NO: 57656 - RNA, 24 nt, Human
ccuccagcaggcaagaguagguca

SEQ ID NO: 57657 - RNA, 21 nt, Human
cuaaccccuuguaggggcaaa

SEQ ID NO: 57658 - RNA, 18 nt, Human
cugcaacgagugcagacg

SEQ ID NO: 57659 - RNA, 19 nt, Human
cugcccacccccagugagu

SEQ ID NO: 57660 - RNA, 19 nt, Human
cugcccuacagcagcccug

SEQ ID NO: 57661 - RNA, 19 nt, Human
gaacucagaauagguggug

SEQ ID NO: 57662 - RNA, 20 nt, Human
gaagggacagccccacccug

SEQ ID NO: 57663 - RNA, 21 nt, Human
ggaaagcaaacuggagggggu

SEQ ID NO: 57664 - RNA, 25 nt, Human
ggaguccauuaaugcauaccagggg

SEQ ID NO: 57665 - RNA, 18 nt, Human
gggcagccccaagggcaa

SEQ ID NO: 57666 - RNA, 22 nt, Human
ggguaaggcaagucugggagga

SEQ ID NO: 57667 - RNA, 21 nt, Human
guccauuaaugcauaccaggg

SEQ ID NO: 57668 - RNA, 20 nt, Human
uaaugcauaccaggggcaaa

SEQ ID NO: 57669 - RNA, 26 nt, Human
ucaaccagacaauuagaaucagccuc

SEQ ID NO: 57670 - RNA, 21 nt, Human
ucagaagcaggguccugaagg

SEQ ID NO: 57671 - RNA, 19 nt, Human
ucagcccaggguaaggcaa

SEQ ID NO: 57672 - RNA, 23 nt, Human
uccaccuuaacugcccaccccca

SEQ ID NO: 57673 - RNA, 24 nt, Human
ucccucagccauccccaaguuuac

SEQ ID NO: 57674 - RNA, 23 nt, Human
ucugggaggaagcccacccugcc

SEQ ID NO: 57675 - RNA, 24 nt, Human
ugaaggaagcuggaauggcaugag

SEQ ID NO: 57676 - RNA, 22 nt, Human
ugacuugcaguaaggacaauuu

SEQ ID NO: 57677 - RNA, 23 nt, Human
ugagucagcaaucauuccugacu

SEQ ID NO: 57678 - RNA, 24 nt, Human
ugcaguaaggacaauuugcauuua

SEQ ID NO: 57679 - RNA, 22 nt, Human
ugcccacccccagugaguucug

SEQ ID NO: 57680 - RNA, 20 nt, Human
uggaauggcaugaguuaggu

SEQ ID NO: 57681 - RNA, 18 nt, Human
uggcagagugggagagau

SEQ ID NO: 57682 - RNA, 20 nt, Human
uggcagagugggagagaugg

SEQ ID NO: 57683 - RNA, 21 nt, Human
ugggaggaagcccacccugcc

SEQ ID NO: 57684 - RNA, 23 nt, Human
uuagguggggggaauagguggug

SEQ ID NO: 57685 - RNA, 20 nt, Human
uuugaaguugucaguguccu

SEQ ID NO: 57686 - RNA, 23 nt, Human
uuccagaaacuauuuauauuccu

SEQ ID NO: 57687 - RNA, 20 nt, Human
uuugaaguugucaguguccu

SEQ ID NO: 57688 - RNA, 24 nt, Human
uuuuuuuuuuuuuuguuuugagga

SEQ ID NO: 57689 - RNA, 24 nt, Human
uuuuuuuuuuuuuuuuuuuguuuu

SEQ ID NO: 57690 - RNA, 27 nt, Human
uuuuuuuuuuuuuuuuuuuuuuugggg

SEQ ID NO: 57691 - RNA, 26 nt, Human
aaaaaccuaaaacaucauaaaagccc

SEQ ID NO: 57692 - RNA, 18 nt, Human
aaagaucacuugaagucu

SEQ ID NO: 57693 - RNA, 21 nt, Human
aaccuaaaacaucauaaaagc

SEQ ID NO: 57694 - RNA, 24 nt, Human
agaucacuugaagucuaguugucc

SEQ ID NO: 57695 - RNA, 23 nt, Human
agcuaauaguaguugagugaugu

SEQ ID NO: 57696 - RNA, 18 nt, Human
agugaugugccaggaaaa

SEQ ID NO: 57697 - RNA, 18 nt, Human
cacaucgccagauucaac

SEQ ID NO: 57698 - RNA, 22 nt, Human
caucgccagauucaaccaaagu

SEQ ID NO: 57699 - RNA, 19 nt, Human
ccagguggucaauuucuuc

SEQ ID NO: 57700 - RNA, 23 nt, Human
cccuccauauccauggguuccac

SEQ ID NO: 57701 - RNA, 21 nt, Human
ccuaaaacaucauaaaagccc

SEQ ID NO: 57702 - RNA, 18 nt, Human
cuuccucucaaaguuaga

SEQ ID NO: 57703 - RNA, 21 nt, Human
uccauauccauggguuccaca

SEQ ID NO: 57704 - RNA, 18 nt, Human
ugacucgccagcuaauag

SEQ ID NO: 57705 - RNA, 18 nt, Human
ugccaggaaaaaacaugg

SEQ ID NO: 57706 - RNA, 22 nt, Human
ugucccuagucauuccaacaac

SEQ ID NO: 57707 - RNA, 23 nt, Human
uuccagaaacuauuuauauuccu

SEQ ID NO: 57708 - RNA, 20 nt, Human
uuugaaguugucaguguccu

SEQ ID NO: 57709 - RNA, 19 nt, Human
uuuuuuuuuuuuuugagga

SEQ ID NO: 57710 - RNA, 21 nt, Human
uuuuuuuuuuuuuuuuugagg

SEQ ID NO: 57711 - RNA, 27 nt, Human
uuuuuuuuuuuuuuuuuuuuuuugggg

SEQ ID NO: 57712 - RNA, 18 nt, Human
agcagcccagcagggaug

SEQ ID NO: 57713 - RNA, 21 nt, Human
cggcccgagacuaagucucgg

SEQ ID NO: 57714 - RNA, 18 nt, Human
cucgggcccgcggcgcgc

SEQ ID NO: 57715 - RNA, 24 nt, Human
ugucacaaauacaucauuuauagg

SEQ ID NO: 57716 - RNA, 21 nt, Human
uuuauugacaagauagggugu

SEQ ID NO: 57717 - RNA, 24 nt, Human
uuuuuuuuuuuaaucagaaugcug

SEQ ID NO: 57718 - RNA, 24 nt, Human
uuuuuuuuuuuuuuuuuuaaucag

SEQ ID NO: 57719 - RNA, 20 nt, Human
aaacagaaaacaaaaggucc

SEQ ID NO: 57720 - RNA, 21 nt, Human
aaacagaaaacaaaaggucca

SEQ ID NO: 57721 - RNA, 23 nt, Human
aaacagaaaacaaaagguccagg

SEQ ID NO: 57722 - RNA, 25 nt, Human
agagccagcacuugaccaggggccc

SEQ ID NO: 57723 - RNA, 24 nt, Human
agccagcacuugaccaggggcccg

SEQ ID NO: 57724 - RNA, 18 nt, Human
aggcaaggacagcagagc

SEQ ID NO: 57725 - RNA, 20 nt, Human
auggaaggcaaggacagcag

SEQ ID NO: 57726 - RNA, 22 nt, Human
cagaggggaaauggaaggcaag

SEQ ID NO: 57727 - RNA, 18 nt, Human
caggagcuuugcucucug

SEQ ID NO: 57728 - RNA, 21 nt, Human
caggcuccugcggagggcaaa

SEQ ID NO: 57729 - RNA, 18 nt, Human
cccaagaacagcaucacc

SEQ ID NO: 57730 - RNA, 21 nt, Human
cucuuccaacacaggcuccug

SEQ ID NO: 57731 - RNA, 21 nt, Human
ggaaggcaaggacagcagagc

SEQ ID NO: 57732 - RNA, 24 nt, Human
guagacccaagaacagcaucacca

SEQ ID NO: 57733 - RNA, 24 nt, Human
uccugcggagggcaaaaggaggug

SEQ ID NO: 57734 - RNA, 23 nt, Human
ucuuccaacacaggcuccugcgg

SEQ ID NO: 57735 - RNA, 21 nt, Human
ugcagaggggaaauggaaggc

SEQ ID NO: 57736 - RNA, 19 nt, Human
uuaaacauguugucaaaca

SEQ ID NO: 57737 - RNA, 23 nt, Human
uuccaacacaggcuccugcggag

SEQ ID NO: 57738 - RNA, 22 nt, Human
aaaauggaauuuucauuugaag

SEQ ID NO: 57739 - RNA, 19 nt, Human
aacaaaacaguaaauauca

SEQ ID NO: 57740 - RNA, 22 nt, Human
aacacaaaaggacaaaauacuc

SEQ ID NO: 57741 - RNA, 24 nt, Human
aaccacaugaauuuuaaagacaaa

SEQ ID NO: 57742 - RNA, 19 nt, Human
aacccucuaaaucaugccu

SEQ ID NO: 57743 - RNA, 19 nt, Human
aagaaagcguuugaagaag

SEQ ID NO: 57744 - RNA, 21 nt, Human
aagagauuauuuaagccaaug

SEQ ID NO: 57745 - RNA, 21 nt, Human
aagauggguaagcagaaauca

SEQ ID NO: 57746 - RNA, 23 nt, Human
aagcuggaagcaggcagccuuuc

SEQ ID NO: 57747 - RNA, 18 nt, Human
aagggaauggacugaagg

SEQ ID NO: 57748 - RNA, 21 nt, Human
aaugcuguucuaaauuuuuau

SEQ ID NO: 57749 - RNA, 20 nt, Human
acagaacaacaguaugcuug

SEQ ID NO: 57750 - RNA, 22 nt, Human
accccaaaaauucacuuaaaau

SEQ ID NO: 57751 - RNA, 20 nt, Human
accuuggugacuucacauaa

SEQ ID NO: 57752 - RNA, 18 nt, Human
acuacaguucauuauggc

SEQ ID NO: 57753 - RNA, 19 nt, Human
acuagccauuuguuagcuu

SEQ ID NO: 57754 - RNA, 25 nt, Human
acucuugugaacucaaacggcucca

SEQ ID NO: 57755 - RNA, 21 nt, Human
acugcaugauaaccacagaac

SEQ ID NO: 57756 - RNA, 23 nt, Human
acugguauaauacaucuuuucca

SEQ ID NO: 57757 - RNA, 21 nt, Human
agauauaaacaugcuauguac

SEQ ID NO: 57758 - RNA, 24 nt, Human
agcuucucauugaaaaaggauaau

SEQ ID NO: 57759 - RNA, 19 nt, Human
agcuuuguucuaaaauuuu

SEQ ID NO: 57760 - RNA, 21 nt, Human
aggaaugcaugagugugcccc

SEQ ID NO: 57761 - RNA, 20 nt, Human
agucaaccuacgaaaacuga

SEQ ID NO: 57762 - RNA, 19 nt, Human
auacuccaaaauauugcuu

SEQ ID NO: 57763 - RNA, 19 nt, Human
aucaugccucaucuucucu

SEQ ID NO: 57764 - RNA, 19 nt, Human
caaaaggacaaaauacuca

SEQ ID NO: 57765 - RNA, 23 nt, Human
caaaauaagguccaguaguaguu

SEQ ID NO: 57766 - RNA, 22 nt, Human
caaauaucacuuguaaggcaaa

SEQ ID NO: 57767 - RNA, 23 nt, Human
caccccaaaaauucacuuaaaau

SEQ ID NO: 57768 - RNA, 24 nt, Human
caccccaaaaauucacuuaaaaua

SEQ ID NO: 57769 - RNA, 20 nt, Human
cacuuauugcuggaagggag

SEQ ID NO: 57770 - RNA, 21 nt, Human
cagauucacggucaagaaccu

SEQ ID NO: 57771 - RNA, 23 nt, Human
caguaaauaucaugcuuucuuuu

SEQ ID NO: 57772 - RNA, 27 nt, Human
cauuucucaaacccagacaacaaaaca

SEQ ID NO: 57773 - RNA, 23 nt, Human
ccacagaacaacaguaugcuuga

SEQ ID NO: 57774 - RNA, 20 nt, Human
ccagaguacuugcuuuuacu

SEQ ID NO: 57775 - RNA, 18 nt, Human
cccgacagucaguggagu

SEQ ID NO: 57776 - RNA, 19 nt, Human
ccuaucugcugcagaucug

SEQ ID NO: 57777 - RNA, 26 nt, Human
ccucaaagaaagcguuugaagaagaa

SEQ ID NO: 57778 - RNA, 20 nt, Human
cucaaacccagacaacaaaa

SEQ ID NO: 57779 - RNA, 21 nt, Human
cucaaagaaagcguuugaaga

SEQ ID NO: 57780 - RNA, 19 nt, Human
cucccagaccucagugagu

SEQ ID NO: 57781 - RNA, 22 nt, Human
cugaaaacuguaucaaaaauca

SEQ ID NO: 57782 - RNA, 24 nt, Human
cugcguguacauauucuagacccu

SEQ ID NO: 57783 - RNA, 24 nt, Human
cugcuaugaagaagccaccaagaa

SEQ ID NO: 57784 - RNA, 21 nt, Human
cuuuuccaaaggauuauggca

SEQ ID NO: 57785 - RNA, 26 nt, Human
cuuuuuagauuuaccaagaaaacccu

SEQ ID NO: 57786 - RNA, 22 nt, Human
gaaaaaggauaauuggaaacau

SEQ ID NO: 57787 - RNA, 23 nt, Human
gaacacaaaaggacaaaauacuc

SEQ ID NO: 57788 - RNA, 25 nt, Human
gaucauuugaaaaaugcuaauucaa

SEQ ID NO: 57789 - RNA, 19 nt, Human
gauuuauuguuuccucucu

SEQ ID NO: 57790 - RNA, 23 nt, Human
gcuaugaagaagccaccaagaau

SEQ ID NO: 57791 - RNA, 18 nt, Human
gcuuuguucuaaaauuuu

SEQ ID NO: 57792 - RNA, 20 nt, Human
ggaaauaguauucuuuaucc

SEQ ID NO: 57793 - RNA, 18 nt, Human
guccauguacuacaguuc

SEQ ID NO: 57794 - RNA, 20 nt, Human
uaaaauacauuaucccauag

SEQ ID NO: 57795 - RNA, 22 nt, Human
uaaccaacucagaggacaaugc

SEQ ID NO: 57796 - RNA, 20 nt, Human
uaaggcaaaaagggguagaa

SEQ ID NO: 57797 - RNA, 23 nt, Human
uaaggcaaaaagggguagaauac

SEQ ID NO: 57798 - RNA, 27 nt, Human
uaauaggucuagacaaaaaaaaaagaa

SEQ ID NO: 57799 - RNA, 24 nt, Human
uaaugcaguaacuucaagcacccc

SEQ ID NO: 57800 - RNA, 20 nt, Human
uaauuggaaacaauauuuca

SEQ ID NO: 57801 - RNA, 18 nt, Human
uacauguauguauacaca

SEQ ID NO: 57802 - RNA, 24 nt, Human
uacuguaaaaugaacugcuccaga

SEQ ID NO: 57803 - RNA, 18 nt, Human
uacuugcuuuuacuucaa

SEQ ID NO: 57804 - RNA, 21 nt, Human
uaggucuagacaaaaaaaaaa

SEQ ID NO: 57805 - RNA, 24 nt, Human
uauaacaccuuuucacugguauaa

SEQ ID NO: 57806 - RNA, 20 nt, Human
uauguauacacaugcaagua

SEQ ID NO: 57807 - RNA, 20 nt, Human
uauuccagauuaauuagcua

SEQ ID NO: 57808 - RNA, 20 nt, Human
uauuguccauguacuacagu

SEQ ID NO: 57809 - RNA, 22 nt, Human
uauuguccauguacuacaguuc

SEQ ID NO: 57810 - RNA, 24 nt, Human
ucaaagauagucaaccuacgaaaa

SEQ ID NO: 57811 - RNA, 19 nt, Human
ucaguggaguuuucuauag

SEQ ID NO: 57812 - RNA, 25 nt, Human
ucaucaaaaaaaguagaaccagaaa

SEQ ID NO: 57813 - RNA, 19 nt, Human
ucaucccauagugacucau

SEQ ID NO: 57814 - RNA, 18 nt, Human
uccaagccaagcuggaag

SEQ ID NO: 57815 - RNA, 21 nt, Human
ucgaauaccuaauuauccuau

SEQ ID NO: 57816 - RNA, 23 nt, Human
ucguuaaaacuugagauauuuau

SEQ ID NO: 57817 - RNA, 21 nt, Human
ucuauagucgagccacgugag

SEQ ID NO: 57818 - RNA, 23 nt, Human
ucucaaacccagacaacaaaaca

SEQ ID NO: 57819 - RNA, 22 nt, Human
ucuccggauuucuuuguugcuu

SEQ ID NO: 57820 - RNA, 18 nt, Human
ucugaccucuaaaacuag
